United States Patent 7,888,497 (BIOINFORMATICALLY DETECTABLE GROUP OF NOVEL REGULATORY OLIGONUCLEOTIDES AND USES THEREOF) - sequence listing, part 72

SEQ ID NO: 3033921 - DNA, 20 bp, Homo sapiens
cctaatcaagagtctctcca

SEQ ID NO: 3033922 - DNA, 21 bp, Homo sapiens
cctaatcaagagtctctccag

SEQ ID NO: 3033923 - DNA, 14 bp, Homo sapiens
cctaatccaggcag

SEQ ID NO: 3033924 - DNA, 18 bp, Homo sapiens
cctaatccaggcagatcc

SEQ ID NO: 3033925 - DNA, 19 bp, Homo sapiens
cctaatccaggcagatcca

SEQ ID NO: 3033926 - DNA, 15 bp, Homo sapiens
cctaatgctctgaaa

SEQ ID NO: 3033927 - DNA, 16 bp, Homo sapiens
cctaattcatctttta

SEQ ID NO: 3033928 - DNA, 19 bp, Homo sapiens
cctaattcatcttttaatc

SEQ ID NO: 3033929 - DNA, 15 bp, Homo sapiens
cctaattcttcatag

SEQ ID NO: 3033930 - DNA, 16 bp, Homo sapiens
cctaattgtcacatca

SEQ ID NO: 3033931 - DNA, 14 bp, Homo sapiens
cctacaatatttta

SEQ ID NO: 3033932 - DNA, 18 bp, Homo sapiens
cctacaatattttattct

SEQ ID NO: 3033933 - DNA, 21 bp, Homo sapiens
cctacactgatgcaaggatta

SEQ ID NO: 3033934 - DNA, 20 bp, Homo sapiens
cctacagctttgatccctga

SEQ ID NO: 3033935 - DNA, 21 bp, Homo sapiens
cctacagctttgatccctgac

SEQ ID NO: 3033936 - DNA, 18 bp, Homo sapiens
cctaccacctccccagcc

SEQ ID NO: 3033937 - DNA, 19 bp, Homo sapiens
cctaccacttttctgctgt

SEQ ID NO: 3033938 - DNA, 14 bp, Homo sapiens
cctgatcaatgaca

SEQ ID NO: 3033939 - DNA, 17 bp, Homo sapiens
cctgatcaatgacagag

SEQ ID NO: 3033940 - DNA, 18 bp, Homo sapiens
cctgatcagaccacggct

SEQ ID NO: 3033941 - DNA, 17 bp, Homo sapiens
cctgatcccagacctgt

SEQ ID NO: 3033942 - DNA, 13 bp, Homo sapiens
cctgatcctggag

SEQ ID NO: 3033943 - DNA, 15 bp, Homo sapiens
cctgatcctggaggc

SEQ ID NO: 3033944 - DNA, 18 bp, Homo sapiens
cctgatcctggaggccca

SEQ ID NO: 3033945 - DNA, 17 bp, Homo sapiens
cctgatgagactccact

SEQ ID NO: 3033946 - DNA, 13 bp, Homo sapiens
cctgatgctgaca

SEQ ID NO: 3033947 - DNA, 21 bp, Homo sapiens
cctgatgctgacattcacctg

SEQ ID NO: 3033948 - DNA, 12 bp, Homo sapiens
cctgatggagag

SEQ ID NO: 3033949 - DNA, 17 bp, Homo sapiens
cctgatgtcagctgctg

SEQ ID NO: 3033950 - DNA, 18 bp, Homo sapiens
cctgattgtgccagtgca

SEQ ID NO: 3033951 - DNA, 20 bp, Homo sapiens
cctgatttaggagaagccag

SEQ ID NO: 3033952 - DNA, 21 bp, Homo sapiens
cctgatttaggagaagccagg

SEQ ID NO: 3033953 - DNA, 22 bp, Homo sapiens
cctgatttaggagaagccagga

SEQ ID NO: 3033954 - DNA, 15 bp, Homo sapiens
cctgatttcttcagg

SEQ ID NO: 3033955 - DNA, 14 bp, Homo sapiens
cctgcaaaaaatac

SEQ ID NO: 3033956 - DNA, 19 bp, Homo sapiens
cctgcaaacgctgcctgcc

SEQ ID NO: 3033957 - DNA, 22 bp, Homo sapiens
cctgcaaacgctgcctgcccgt

SEQ ID NO: 3033958 - DNA, 17 bp, Homo sapiens
cctgcaagccttctaaa

SEQ ID NO: 3033959 - DNA, 13 bp, Homo sapiens
cctgcaatcccag

SEQ ID NO: 3033960 - DNA, 20 bp, Homo sapiens
cctgcacagattcccaggcc

SEQ ID NO: 3033961 - DNA, 22 bp, Homo sapiens
cctgcacagattcccaggccag

SEQ ID NO: 3033962 - DNA, 23 bp, Homo sapiens
cctgcacagattcccaggccagg

SEQ ID NO: 3033963 - DNA, 19 bp, Homo sapiens
cctgcaccgaccccgggcc

SEQ ID NO: 3033964 - DNA, 20 bp, Homo sapiens
cctgcaccgacccgaggccc

SEQ ID NO: 3033965 - DNA, 19 bp, Homo sapiens
cctgcacctccccccactg

SEQ ID NO: 3033966 - DNA, 12 bp, Homo sapiens
cctgcacctggt

SEQ ID NO: 3033967 - DNA, 17 bp, Homo sapiens
cctgcactccctcctgg

SEQ ID NO: 3033968 - DNA, 20 bp, Homo sapiens
cctgcactccctcctggagc

SEQ ID NO: 3033969 - DNA, 14 bp, Homo sapiens
cctgcactccctgg

SEQ ID NO: 3033970 - DNA, 14 bp, Homo sapiens
cctgcactgtgccc

SEQ ID NO: 3033971 - DNA, 18 bp, Homo sapiens
cctgcactgtgccccgcg

SEQ ID NO: 3033972 - DNA, 15 bp, Homo sapiens
cctgcacttcatatc

SEQ ID NO: 3033973 - DNA, 21 bp, Homo sapiens
cctgcagacgtctggccctgg

SEQ ID NO: 3033974 - DNA, 14 bp, Homo sapiens
cctgcagagctgcg

SEQ ID NO: 3033975 - DNA, 17 bp, Homo sapiens
cctgcagagctgcgggc

SEQ ID NO: 3033976 - DNA, 22 bp, Homo sapiens
cctgcagcactttttccttctg

SEQ ID NO: 3033977 - DNA, 16 bp, Homo sapiens
cctgcagctagtccta

SEQ ID NO: 3033978 - DNA, 16 bp, Homo sapiens
cctgcaggacctgcct

SEQ ID NO: 3033979 - DNA, 17 bp, Homo sapiens
cctgcaggacctgcctg

SEQ ID NO: 3033980 - DNA, 18 bp, Homo sapiens
cctgcaggacctgcctgt

SEQ ID NO: 3033981 - DNA, 17 bp, Homo sapiens
cctgcaggagcagggcg

SEQ ID NO: 3033982 - DNA, 20 bp, Homo sapiens
cctgcaggagcagggcggct

SEQ ID NO: 3033983 - DNA, 22 bp, Homo sapiens
cctgcaggagcagggcggctgc

SEQ ID NO: 3033984 - DNA, 19 bp, Homo sapiens
cctgcaggctgcaggaggg

SEQ ID NO: 3033985 - DNA, 20 bp, Homo sapiens
cctgcagggccatggctcag

SEQ ID NO: 3033986 - DNA, 15 bp, Homo sapiens
cctgcagtcatcttg

SEQ ID NO: 3033987 - DNA, 15 bp, Homo sapiens
cctgcagtgccagct

SEQ ID NO: 3033988 - DNA, 22 bp, Homo sapiens
cctgcagtgccagctccctcgt

SEQ ID NO: 3033989 - DNA, 21 bp, Homo sapiens
cctgcatatctctagtccctg

SEQ ID NO: 3033990 - DNA, 13 bp, Homo sapiens
cctgcatctaagc

SEQ ID NO: 3033991 - DNA, 16 bp, Homo sapiens
cctgcatctaagccca

SEQ ID NO: 3033992 - DNA, 23 bp, Homo sapiens
cctgcatgtaaacacgcctgcaa

SEQ ID NO: 3033993 - DNA, 12 bp, Homo sapiens
cctgcatgtgta

SEQ ID NO: 3033994 - DNA, 13 bp, Homo sapiens
cctgcatgtgtat

SEQ ID NO: 3033995 - DNA, 14 bp, Homo sapiens
cctgcatgtgtata

SEQ ID NO: 3033996 - DNA, 18 bp, Homo sapiens
cctgccaatgattccaga

SEQ ID NO: 3033997 - DNA, 13 bp, Homo sapiens
cctgccaccagca

SEQ ID NO: 3033998 - DNA, 23 bp, Homo sapiens
cctgccaccgactgcccagccac

SEQ ID NO: 3033999 - DNA, 14 bp, Homo sapiens
cctgccactcaccc

SEQ ID NO: 3034000 - DNA, 18 bp, Homo sapiens
cctgccactcacccttcc

SEQ ID NO: 3034001 - DNA, 14 bp, Homo sapiens
cctgccagaccccc

SEQ ID NO: 3034002 - DNA, 13 bp, Homo sapiens
cctgccagccggt

SEQ ID NO: 3034003 - DNA, 14 bp, Homo sapiens
cctgccagctgcac

SEQ ID NO: 3034004 - DNA, 18 bp, Homo sapiens
cctgccagctgcactgat

SEQ ID NO: 3034005 - DNA, 13 bp, Homo sapiens
cctgccagggcag

SEQ ID NO: 3034006 - DNA, 14 bp, Homo sapiens
cctgccagtgcctt

SEQ ID NO: 3034007 - DNA, 17 bp, Homo sapiens
cctgccagtgccttacc

SEQ ID NO: 3034008 - DNA, 22 bp, Homo sapiens
cctgccatccccctctcacgcc

SEQ ID NO: 3034009 - DNA, 16 bp, Homo sapiens
cctgccatgcaagaac

SEQ ID NO: 3034010 - DNA, 13 bp, Homo sapiens
cctgcccacctgc

SEQ ID NO: 3034011 - DNA, 14 bp, Homo sapiens
cctgcccacctgcc

SEQ ID NO: 3034012 - DNA, 16 bp, Homo sapiens
cctgcccacctgcctg

SEQ ID NO: 3034013 - DNA, 14 bp, Homo sapiens
cctgcccacctgtc

SEQ ID NO: 3034014 - DNA, 16 bp, Homo sapiens
cctgcccagcctcaat

SEQ ID NO: 3034015 - DNA, 12 bp, Homo sapiens
cctgcccaggag

SEQ ID NO: 3034016 - DNA, 22 bp, Homo sapiens
cctgcccaggagagccagccct

SEQ ID NO: 3034017 - DNA, 21 bp, Homo sapiens
cctgcccattctgccctgtgg

SEQ ID NO: 3034018 - DNA, 16 bp, Homo sapiens
cctgcccccaatccat

SEQ ID NO: 3034019 - DNA, 17 bp, Homo sapiens
cctgccccgcaggcctg

SEQ ID NO: 3034020 - DNA, 18 bp, Homo sapiens
cctgccccggagctggag

SEQ ID NO: 3034021 - DNA, 12 bp, Homo sapiens
cctgcccctccc

SEQ ID NO: 3034022 - DNA, 18 bp, Homo sapiens
cctgcccgcaccctggcc

SEQ ID NO: 3034023 - DNA, 15 bp, Homo sapiens
cctgcccgtaaacac

SEQ ID NO: 3034024 - DNA, 20 bp, Homo sapiens
cctgcccgtaaacacgcctg

SEQ ID NO: 3034025 - DNA, 21 bp, Homo sapiens
cctgcccgtaaacacgcctgc

SEQ ID NO: 3034026 - DNA, 23 bp, Homo sapiens
cctgcccgtaaacacgcctgcaa

SEQ ID NO: 3034027 - DNA, 14 bp, Homo sapiens
cctgcccgttcttg

SEQ ID NO: 3034028 - DNA, 13 bp, Homo sapiens
cctgccctcccct

SEQ ID NO: 3034029 - DNA, 19 bp, Homo sapiens
cctgccctccctcagccgt

SEQ ID NO: 3034030 - DNA, 14 bp, Homo sapiens
cctgccctgcccaa

SEQ ID NO: 3034031 - DNA, 17 bp, Homo sapiens
cctgccctgcccaagtg

SEQ ID NO: 3034032 - DNA, 12 bp, Homo sapiens
cctgccctgcta

SEQ ID NO: 3034033 - DNA, 13 bp, Homo sapiens
cctgccctgctcc

SEQ ID NO: 3034034 - DNA, 14 bp, Homo sapiens
cctgccgagagtcc

SEQ ID NO: 3034035 - DNA, 23 bp, Homo sapiens
cctgccgagagtccatcagcctc

SEQ ID NO: 3034036 - DNA, 14 bp, Homo sapiens
cctgccgcctcaat

SEQ ID NO: 3034037 - DNA, 22 bp, Homo sapiens
cctgccggtaaacacgcctgca

SEQ ID NO: 3034038 - DNA, 18 bp, Homo sapiens
cctgcctagctcttgggc

SEQ ID NO: 3034039 - DNA, 23 bp, Homo sapiens
cctgcctagctcttgggcctgac

SEQ ID NO: 3034040 - DNA, 17 bp, Homo sapiens
cctgcctcacatctccc

SEQ ID NO: 3034041 - DNA, 19 bp, Homo sapiens
cctgcctcacatctccctt

SEQ ID NO: 3034042 - DNA, 13 bp, Homo sapiens
cctgcctcagcct

SEQ ID NO: 3034043 - DNA, 14 bp, Homo sapiens
cctgcctcagcctc

SEQ ID NO: 3034044 - DNA, 14 bp, Homo sapiens
cctgcctcagcctt

SEQ ID NO: 3034045 - DNA, 13 bp, Homo sapiens
cctgcctcagtgg

SEQ ID NO: 3034046 - DNA, 17 bp, Homo sapiens
cctgcctccagctgtca

SEQ ID NO: 3034047 - DNA, 14 bp, Homo sapiens
cctgcctcctggct

SEQ ID NO: 3034048 - DNA, 15 bp, Homo sapiens
cctgcctcctggctc

SEQ ID NO: 3034049 - DNA, 20 bp, Homo sapiens
cctgcctcgagggccgcctg

SEQ ID NO: 3034050 - DNA, 19 bp, Homo sapiens
cctgcctcgcccccacttt

SEQ ID NO: 3034051 - DNA, 23 bp, Homo sapiens
cctgcctcgcccccacttttcta

SEQ ID NO: 3034052 - DNA, 21 bp, Homo sapiens
cctgcctctgtgtagccgccc

SEQ ID NO: 3034053 - DNA, 14 bp, Homo sapiens
cctgcctgccaccc

SEQ ID NO: 3034054 - DNA, 12 bp, Homo sapiens
cctgcctgctgt

SEQ ID NO: 3034055 - DNA, 13 bp, Homo sapiens
cctgcctgctgtg

SEQ ID NO: 3034056 - DNA, 14 bp, Homo sapiens
cctgcctgctgtgg

SEQ ID NO: 3034057 - DNA, 19 bp, Homo sapiens
cctgcctggaccagcctct

SEQ ID NO: 3034058 - DNA, 15 bp, Homo sapiens
cctgcctggccggcc

SEQ ID NO: 3034059 - DNA, 23 bp, Homo sapiens
cctgcctggccggccagccagcc

SEQ ID NO: 3034060 - DNA, 13 bp, Homo sapiens
cctgccttcagag

SEQ ID NO: 3034061 - DNA, 22 bp, Homo sapiens
cctgccttcctcctgggccctc

SEQ ID NO: 3034062 - DNA, 18 bp, Homo sapiens
cctgcctttgggagcagg

SEQ ID NO: 3034063 - DNA, 19 bp, Homo sapiens
cctgccttttctagtttta

SEQ ID NO: 3034064 - DNA, 14 bp, Homo sapiens
cctgcgaccctggg

SEQ ID NO: 3034065 - DNA, 16 bp, Homo sapiens
cctgcgaccctggggg

SEQ ID NO: 3034066 - DNA, 21 bp, Homo sapiens
cctgcgaccctgggggcacag

SEQ ID NO: 3034067 - DNA, 21 bp, Homo sapiens
cctgcgcctccatccatctgt

SEQ ID NO: 3034068 - DNA, 23 bp, Homo sapiens
cctgcgctttgaacgtgccagca

SEQ ID NO: 3034069 - DNA, 24 bp, Homo sapiens
cctgcgctttgaacgtgccagcag

SEQ ID NO: 3034070 - DNA, 14 bp, Homo sapiens
cctgcggcctccac

SEQ ID NO: 3034071 - DNA, 22 bp, Homo sapiens
ccttgtgttccttctgtgaaga

SEQ ID NO: 3034072 - DNA, 21 bp, Homo sapiens
ccttgttatttctcagacttt

SEQ ID NO: 3034073 - DNA, 16 bp, Homo sapiens
ccttgtttgttttatt

SEQ ID NO: 3034074 - DNA, 19 bp, Homo sapiens
ccttgttttgaaactagaa

SEQ ID NO: 3034075 - DNA, 22 bp, Homo sapiens
ccttgttttgaaactagaaatc

SEQ ID NO: 3034076 - DNA, 12 bp, Homo sapiens
cctttaaatact

SEQ ID NO: 3034077 - DNA, 19 bp, Homo sapiens
cctttaagatatccatctt

SEQ ID NO: 3034078 - DNA, 19 bp, Homo sapiens
cctttaagcctgcattctt

SEQ ID NO: 3034079 - DNA, 14 bp, Homo sapiens
cctttacggacacc

SEQ ID NO: 3034080 - DNA, 14 bp, Homo sapiens
cctttactcctggc

SEQ ID NO: 3034081 - DNA, 17 bp, Homo sapiens
cctttactgaccctggg

SEQ ID NO: 3034082 - DNA, 20 bp, Homo sapiens
cctttactgaccctggggct

SEQ ID NO: 3034083 - DNA, 15 bp, Homo sapiens
cctttatactgtgaa

SEQ ID NO: 3034084 - DNA, 21 bp, Homo sapiens
cctttatcaagagactcctga

SEQ ID NO: 3034085 - DNA, 16 bp, Homo sapiens
cctttatcacctcatt

SEQ ID NO: 3034086 - DNA, 21 bp, Homo sapiens
cctttatccctgcttatctga

SEQ ID NO: 3034087 - DNA, 15 bp, Homo sapiens
cctttatctcagcca

SEQ ID NO: 3034088 - DNA, 12 bp, Homo sapiens
cctttcaaagct

SEQ ID NO: 3034089 - DNA, 15 bp, Homo sapiens
cctttcaaatttaga

SEQ ID NO: 3034090 - DNA, 23 bp, Homo sapiens
cctttcacacatctgggtgccct

SEQ ID NO: 3034091 - DNA, 17 bp, Homo sapiens
cctttcaccccagggcc

SEQ ID NO: 3034092 - DNA, 13 bp, Homo sapiens
cctttcagccaca

SEQ ID NO: 3034093 - DNA, 15 bp, Homo sapiens
cctttcagcccacgt

SEQ ID NO: 3034094 - DNA, 13 bp, Homo sapiens
cctttccaaagag

SEQ ID NO: 3034095 - DNA, 13 bp, Homo sapiens
cctttccatctgt

SEQ ID NO: 3034096 - DNA, 16 bp, Homo sapiens
cctttccatctgtcca

SEQ ID NO: 3034097 - DNA, 14 bp, Homo sapiens
cctttccccagcct

SEQ ID NO: 3034098 - DNA, 22 bp, Homo sapiens
cctttccccagcctctcctcct

SEQ ID NO: 3034099 - DNA, 16 bp, Homo sapiens
cctttccccttccttt

SEQ ID NO: 3034100 - DNA, 20 bp, Homo sapiens
cctttcctatcacctcgaga

SEQ ID NO: 3034101 - DNA, 14 bp, Homo sapiens
cctttcctgtgtga

SEQ ID NO: 3034102 - DNA, 14 bp, Homo sapiens
cctttctagagcac

SEQ ID NO: 3034103 - DNA, 14 bp, Homo sapiens
cctttctcctttgt

SEQ ID NO: 3034104 - DNA, 12 bp, Homo sapiens
cctttctgcccc

SEQ ID NO: 3034105 - DNA, 22 bp, Homo sapiens
cctttctgccccccagggctag

SEQ ID NO: 3034106 - DNA, 12 bp, Homo sapiens
cctttgcccaca

SEQ ID NO: 3034107 - DNA, 19 bp, Homo sapiens
cctttgcccacacacactc

SEQ ID NO: 3034108 - DNA, 18 bp, Homo sapiens
cctttggaacaagacagc

SEQ ID NO: 3034109 - DNA, 15 bp, Homo sapiens
cctttggagatgctg

SEQ ID NO: 3034110 - DNA, 20 bp, Homo sapiens
cctttggagatgctgagggt

SEQ ID NO: 3034111 - DNA, 14 bp, Homo sapiens
cctttgggccctgc

SEQ ID NO: 3034112 - DNA, 16 bp, Homo sapiens
cctttgggccctgcat

SEQ ID NO: 3034113 - DNA, 17 bp, Homo sapiens
cctttgggccctgcatg

SEQ ID NO: 3034114 - DNA, 19 bp, Homo sapiens
cctttgggtcctgggcagg

SEQ ID NO: 3034115 - DNA, 15 bp, Homo sapiens
cctttggtatttcac

SEQ ID NO: 3034116 - DNA, 17 bp, Homo sapiens
cctttggtcctgtcccc

SEQ ID NO: 3034117 - DNA, 14 bp, Homo sapiens
cctttggttctggc

SEQ ID NO: 3034118 - DNA, 12 bp, Homo sapiens
cctttgtatatt

SEQ ID NO: 3034119 - DNA, 20 bp, Homo sapiens
cctttgtcttttttttcatc

SEQ ID NO: 3034120 - DNA, 18 bp, Homo sapiens
ccttttacattctgtgtg

SEQ ID NO: 3034121 - DNA, 15 bp, Homo sapiens
ccttttcactacacc

SEQ ID NO: 3034122 - DNA, 12 bp, Homo sapiens
ccttttccatgc

SEQ ID NO: 3034123 - DNA, 20 bp, Homo sapiens
ccttttctttaagttttatt

SEQ ID NO: 3034124 - DNA, 23 bp, Homo sapiens
ccttttgacagctggtccctgcc

SEQ ID NO: 3034125 - DNA, 23 bp, Homo sapiens
ccttttgataaaatgttcctttt

SEQ ID NO: 3034126 - DNA, 19 bp, Homo sapiens
ccttttgcagaagagggtg

SEQ ID NO: 3034127 - DNA, 12 bp, Homo sapiens
ccttttgccaat

SEQ ID NO: 3034128 - DNA, 12 bp, Homo sapiens
ccttttgtaaag

SEQ ID NO: 3034129 - DNA, 19 bp, Homo sapiens
ccttttgtagaatgaacca

SEQ ID NO: 3034130 - DNA, 18 bp, Homo sapiens
ccttttgttttgaagctg

SEQ ID NO: 3034131 - DNA, 17 bp, Homo sapiens
cctttttaaaacacatg

SEQ ID NO: 3034132 - DNA, 11 bp, Homo sapiens
cctttttaagg

SEQ ID NO: 3034133 - DNA, 23 bp, Homo sapiens
cctttttgagtaattttctgatg

SEQ ID NO: 3034134 - DNA, 22 bp, Homo sapiens
ccttttttaaaaaaatttttgc

SEQ ID NO: 3034135 - DNA, 17 bp, Homo sapiens
ccttttttatcatttct

SEQ ID NO: 3034136 - DNA, 12 bp, Homo sapiens
ccttttttcaaa

SEQ ID NO: 3034137 - DNA, 20 bp, Homo sapiens
ccttttttctcttctgtcca

SEQ ID NO: 3034138 - DNA, 23 bp, Homo sapiens
ccttttttgataaagtttctcag

SEQ ID NO: 3034139 - DNA, 23 bp, Homo sapiens
ccttttttgttttttcaaaatag

SEQ ID NO: 3034140 - DNA, 19 bp, Homo sapiens
cctttttttaaattttctc

SEQ ID NO: 3034141 - DNA, 13 bp, Homo sapiens
cgaaacagcgctg

SEQ ID NO: 3034142 - DNA, 18 bp, Homo sapiens
cgaaagctctagaatctg

SEQ ID NO: 3034143 - DNA, 16 bp, Homo sapiens
cgaaagtgtcatcaat

SEQ ID NO: 3034144 - DNA, 17 bp, Homo sapiens
cgaaattccaaggccca

SEQ ID NO: 3034145 - DNA, 14 bp, Homo sapiens
cgaacatcttcata

SEQ ID NO: 3034146 - DNA, 16 bp, Homo sapiens
cgaacatcttcatata

SEQ ID NO: 3034147 - DNA, 20 bp, Homo sapiens
cgaacatcttcatataaact

SEQ ID NO: 3034148 - DNA, 16 bp, Homo sapiens
cgaacccacctgctga

SEQ ID NO: 3034149 - DNA, 23 bp, Homo sapiens
cgaacccacctgctgagagaccc

SEQ ID NO: 3034150 - DNA, 17 bp, Homo sapiens
cgaacccctagaaagga

SEQ ID NO: 3034151 - DNA, 21 bp, Homo sapiens
cgaacccctagaaaggagaga

SEQ ID NO: 3034152 - DNA, 19 bp, Homo sapiens
cgaactccaggctgggctg

SEQ ID NO: 3034153 - DNA, 15 bp, Homo sapiens
cgaactgtgctccca

SEQ ID NO: 3034154 - DNA, 17 bp, Homo sapiens
cgaactgtgctcccacg

SEQ ID NO: 3034155 - DNA, 20 bp, Homo sapiens
cgaactgtgctcccacgggg

SEQ ID NO: 3034156 - DNA, 15 bp, Homo sapiens
cgaagaagagccaca

SEQ ID NO: 3034157 - DNA, 14 bp, Homo sapiens
cgaagaagatgctc

SEQ ID NO: 3034158 - DNA, 14 bp, Homo sapiens
cgaagagcaggcca

SEQ ID NO: 3034159 - DNA, 22 bp, Homo sapiens
cgaagcaatcagcaaacacaat

SEQ ID NO: 3034160 - DNA, 16 bp, Homo sapiens
cgaagcgttgtcctca

SEQ ID NO: 3034161 - DNA, 22 bp, Homo sapiens
cgaagctgctgtgactgtgtcc

SEQ ID NO: 3034162 - DNA, 14 bp, Homo sapiens
cgaagggcccccac

SEQ ID NO: 3034163 - DNA, 15 bp, Homo sapiens
cgaagtcctatggaa

SEQ ID NO: 3034164 - DNA, 16 bp, Homo sapiens
cgaagtcctatggaaa

SEQ ID NO: 3034165 - DNA, 13 bp, Homo sapiens
cgaagtgttgcat

SEQ ID NO: 3034166 - DNA, 20 bp, Homo sapiens
cgaatgcatattcaacacac

SEQ ID NO: 3034167 - DNA, 17 bp, Homo sapiens
cgaatgcccctgttcat

SEQ ID NO: 3034168 - DNA, 16 bp, Homo sapiens
cgaattttaaaagatg

SEQ ID NO: 3034169 - DNA, 16 bp, Homo sapiens
cgacaccactcctgcc

SEQ ID NO: 3034170 - DNA, 19 bp, Homo sapiens
cgacaccactcctgccagc

SEQ ID NO: 3034171 - DNA, 23 bp, Homo sapiens
cgacaccactcctgccagcccgg

SEQ ID NO: 3034172 - DNA, 13 bp, Homo sapiens
cgacactcagggc

SEQ ID NO: 3034173 - DNA, 17 bp, Homo sapiens
cgacactcagggcagct

SEQ ID NO: 3034174 - DNA, 14 bp, Homo sapiens
cgacactgttctcc

SEQ ID NO: 3034175 - DNA, 22 bp, Homo sapiens
cgacagagggaagaaaagagct

SEQ ID NO: 3034176 - DNA, 15 bp, Homo sapiens
cgacagcggccttga

SEQ ID NO: 3034177 - DNA, 20 bp, Homo sapiens
cgacatcccagtagtgtttg

SEQ ID NO: 3034178 - DNA, 16 bp, Homo sapiens
cgaccacaccagcctc

SEQ ID NO: 3034179 - DNA, 16 bp, Homo sapiens
cgaccagaggagcctt

SEQ ID NO: 3034180 - DNA, 13 bp, Homo sapiens
cgacccccaaggg

SEQ ID NO: 3034181 - DNA, 19 bp, Homo sapiens
cgaccccccgtgggctccc

SEQ ID NO: 3034182 - DNA, 17 bp, Homo sapiens
cgacccccgcagaggca

SEQ ID NO: 3034183 - DNA, 17 bp, Homo sapiens
cgacccctgcctcgagg

SEQ ID NO: 3034184 - DNA, 14 bp, Homo sapiens
cgacccgaggccca

SEQ ID NO: 3034185 - DNA, 15 bp, Homo sapiens
cgacccgaggcccag

SEQ ID NO: 3034186 - DNA, 12 bp, Homo sapiens
cgaccctggggg

SEQ ID NO: 3034187 - DNA, 14 bp, Homo sapiens
cgactaatttcaaa

SEQ ID NO: 3034188 - DNA, 14 bp, Homo sapiens
cgactgcctgtctc

SEQ ID NO: 3034189 - DNA, 13 bp, Homo sapiens
cgagaccagcctg

SEQ ID NO: 3034190 - DNA, 17 bp, Homo sapiens
cgagacccaagggcaga

SEQ ID NO: 3034191 - DNA, 21 bp, Homo sapiens
cgagaccccatcttccagcca

SEQ ID NO: 3034192 - DNA, 20 bp, Homo sapiens
cgagaccccggcttcctttc

SEQ ID NO: 3034193 - DNA, 23 bp, Homo sapiens
cgagagctggccaaagagccttt

SEQ ID NO: 3034194 - DNA, 22 bp, Homo sapiens
cgagatagggtggcacatctgt

SEQ ID NO: 3034195 - DNA, 23 bp, Homo sapiens
cgagattgctggaaaccaagtca

SEQ ID NO: 3034196 - DNA, 15 bp, Homo sapiens
cgagcagacacactg

SEQ ID NO: 3034197 - DNA, 22 bp, Homo sapiens
cgagcatgcggagccagcaggc

SEQ ID NO: 3034198 - DNA, 13 bp, Homo sapiens
cgagccacaggaa

SEQ ID NO: 3034199 - DNA, 15 bp, Homo sapiens
cgagcccctcggctc

SEQ ID NO: 3034200 - DNA, 16 bp, Homo sapiens
cgagcccctcggctct

SEQ ID NO: 3034201 - DNA, 13 bp, Homo sapiens
cgagcctggctcc

SEQ ID NO: 3034202 - DNA, 22 bp, Homo sapiens
cgagctctcaaatccctctcca

SEQ ID NO: 3034203 - DNA, 18 bp, Homo sapiens
cgaggaaaaacaacaaat

SEQ ID NO: 3034204 - DNA, 22 bp, Homo sapiens
ctaaaatgtgatgttctaaggc

SEQ ID NO: 3034205 - DNA, 23 bp, Homo sapiens
ctaaaatgtgatgttctaaggct

SEQ ID NO: 3034206 - DNA, 19 bp, Homo sapiens
ctaaacaatgctgatttgg

SEQ ID NO: 3034207 - DNA, 16 bp, Homo sapiens
ctaaacactgcgcttt

SEQ ID NO: 3034208 - DNA, 17 bp, Homo sapiens
ctaaacctcagttatta

SEQ ID NO: 3034209 - DNA, 14 bp, Homo sapiens
ctaaacctgtgcct

SEQ ID NO: 3034210 - DNA, 19 bp, Homo sapiens
ctaaacctgtgcctccctc

SEQ ID NO: 3034211 - DNA, 22 bp, Homo sapiens
ctaaaccttcatcattttgtga

SEQ ID NO: 3034212 - DNA, 17 bp, Homo sapiens
ctaaacggattccaaag

SEQ ID NO: 3034213 - DNA, 20 bp, Homo sapiens
ctaaacggttcagtttcttc

SEQ ID NO: 3034214 - DNA, 18 bp, Homo sapiens
ctaaacgtaagcactgtt

SEQ ID NO: 3034215 - DNA, 19 bp, Homo sapiens
ctaaacgtaagcactgttt

SEQ ID NO: 3034216 - DNA, 15 bp, Homo sapiens
ctaaactacattata

SEQ ID NO: 3034217 - DNA, 14 bp, Homo sapiens
ctaaactcatttat

SEQ ID NO: 3034218 - DNA, 15 bp, Homo sapiens
ctaaactcatttata

SEQ ID NO: 3034219 - DNA, 17 bp, Homo sapiens
ctaaactcatttataaa

SEQ ID NO: 3034220 - DNA, 21 bp, Homo sapiens
ctaaagagttattcaaatgaa

SEQ ID NO: 3034221 - DNA, 18 bp, Homo sapiens
ctaaagagtttattttaa

SEQ ID NO: 3034222 - DNA, 19 bp, Homo sapiens
ctaaagagtttattttaag

SEQ ID NO: 3034223 - DNA, 15 bp, Homo sapiens
ctaaagatcttctgt

SEQ ID NO: 3034224 - DNA, 19 bp, Homo sapiens
ctaaagatggagtttctaa

SEQ ID NO: 3034225 - DNA, 17 bp, Homo sapiens
ctaaagattctatagtt

SEQ ID NO: 3034226 - DNA, 14 bp, Homo sapiens
ctaaagcaataatc

SEQ ID NO: 3034227 - DNA, 18 bp, Homo sapiens
ctaaagccaaccagcctt

SEQ ID NO: 3034228 - DNA, 12 bp, Homo sapiens
ctaaagccttaa

SEQ ID NO: 3034229 - DNA, 18 bp, Homo sapiens
ctaaaggatggaaaaata

SEQ ID NO: 3034230 - DNA, 19 bp, Homo sapiens
ctaaaggatggaaaaataa

SEQ ID NO: 3034231 - DNA, 23 bp, Homo sapiens
ctaaaggtggccacaaattcttt

SEQ ID NO: 3034232 - DNA, 14 bp, Homo sapiens
ctaaagtgctggga

SEQ ID NO: 3034233 - DNA, 10 bp, Homo sapiens
ctaaagttat

SEQ ID NO: 3034234 - DNA, 13 bp, Homo sapiens
ctaaagttctaag

SEQ ID NO: 3034235 - DNA, 18 bp, Homo sapiens
ctaaataaaagttttaca

SEQ ID NO: 3034236 - DNA, 22 bp, Homo sapiens
ctaaataaaagttttacaaagg

SEQ ID NO: 3034237 - DNA, 20 bp, Homo sapiens
ctaaataaaatttgttgcat

SEQ ID NO: 3034238 - DNA, 18 bp, Homo sapiens
ctaaataagtcaccattg

SEQ ID NO: 3034239 - DNA, 17 bp, Homo sapiens
ctaaatacttgctccat

SEQ ID NO: 3034240 - DNA, 15 bp, Homo sapiens
ctaaatagatacttt

SEQ ID NO: 3034241 - DNA, 15 bp, Homo sapiens
ctaaatatgaatgaa

SEQ ID NO: 3034242 - DNA, 21 bp, Homo sapiens
ctaaatattggtttgttattc

SEQ ID NO: 3034243 - DNA, 20 bp, Homo sapiens
ctaaatattttcaagaaaag

SEQ ID NO: 3034244 - DNA, 21 bp, Homo sapiens
ctaaatcaccagagaccaaac

SEQ ID NO: 3034245 - DNA, 12 bp, Homo sapiens
ctaaatgcccag

SEQ ID NO: 3034246 - DNA, 18 bp, Homo sapiens
ctaaatgcccagttcact

SEQ ID NO: 3034247 - DNA, 15 bp, Homo sapiens
ctaaatgtaacagtc

SEQ ID NO: 3034248 - DNA, 19 bp, Homo sapiens
ctaaatgtaacagtctgat

SEQ ID NO: 3034249 - DNA, 19 bp, Homo sapiens
ctaaatgtgtaataatgta

SEQ ID NO: 3034250 - DNA, 23 bp, Homo sapiens
ctaaatgtgtaataatgtaacat

SEQ ID NO: 3034251 - DNA, 13 bp, Homo sapiens
ctaaattgaataa

SEQ ID NO: 3034252 - DNA, 14 bp, Homo sapiens
ctaaattgaataat

SEQ ID NO: 3034253 - DNA, 19 bp, Homo sapiens
ctaaattgatcattcataa

SEQ ID NO: 3034254 - DNA, 15 bp, Homo sapiens
ctaaatttcttccta

SEQ ID NO: 3034255 - DNA, 16 bp, Homo sapiens
ctaaattttctgaaac

SEQ ID NO: 3034256 - DNA, 13 bp, Homo sapiens
ctaacaatgacat

SEQ ID NO: 3034257 - DNA, 15 bp, Homo sapiens
ctaacaccagacaga

SEQ ID NO: 3034258 - DNA, 23 bp, Homo sapiens
ctaacacggtgctcattttttct

SEQ ID NO: 3034259 - DNA, 16 bp, Homo sapiens
ctaacacttaccccat

SEQ ID NO: 3034260 - DNA, 23 bp, Homo sapiens
ctaacacttaccccatggctgca

SEQ ID NO: 3034261 - DNA, 18 bp, Homo sapiens
ctaacagtaccagtgtaa

SEQ ID NO: 3034262 - DNA, 17 bp, Homo sapiens
ctaacatgccctgttca

SEQ ID NO: 3034263 - DNA, 21 bp, Homo sapiens
ctaacatttttgataaagcct

SEQ ID NO: 3034264 - DNA, 21 bp, Homo sapiens
ctaaccaaggctgtgtttaga

SEQ ID NO: 3034265 - DNA, 13 bp, Homo sapiens
ctaacccctttcc

SEQ ID NO: 3034266 - DNA, 16 bp, Homo sapiens
ctaacccctttcctgc

SEQ ID NO: 3034267 - DNA, 23 bp, Homo sapiens
ctaaccctatactgtagtattct

SEQ ID NO: 3034268 - DNA, 19 bp, Homo sapiens
ctaacccttcaaccccctc

SEQ ID NO: 3034269 - DNA, 22 bp, Homo sapiens
ctaacctcaagtgatcctccca

SEQ ID NO: 3034270 - DNA, 12 bp, Homo sapiens
ctaacctgccga

SEQ ID NO: 3034271 - DNA, 14 bp, Homo sapiens
ctaacctgtgtctg

SEQ ID NO: 3034272 - DNA, 15 bp, Homo sapiens
ctaactagacaccaa

SEQ ID NO: 3034273 - DNA, 14 bp, Homo sapiens
ctaactccctcctc

SEQ ID NO: 3034274 - DNA, 15 bp, Homo sapiens
ctaactccctcctca

SEQ ID NO: 3034275 - DNA, 16 bp, Homo sapiens
ctaactccgagagcag

SEQ ID NO: 3034276 - DNA, 17 bp, Homo sapiens
ctaactgtaaatcatgt

SEQ ID NO: 3034277 - DNA, 18 bp, Homo sapiens
ctaactgtaaatcatgtt

SEQ ID NO: 3034278 - DNA, 16 bp, Homo sapiens
ctaagaaacttaaatt

SEQ ID NO: 3034279 - DNA, 16 bp, Homo sapiens
ctaagaacctggaact

SEQ ID NO: 3034280 - DNA, 18 bp, Homo sapiens
ctaagaatttcactgtct

SEQ ID NO: 3034281 - DNA, 23 bp, Homo sapiens
ctaagacatagtctctacctata

SEQ ID NO: 3034282 - DNA, 19 bp, Homo sapiens
ctaagactaatgctttctg

SEQ ID NO: 3034283 - DNA, 21 bp, Homo sapiens
ctaagactaatgctttctgtg

SEQ ID NO: 3034284 - DNA, 16 bp, Homo sapiens
ctaagactcaaatgtt

SEQ ID NO: 3034285 - DNA, 21 bp, Homo sapiens
ctaagactcaaatgttctaag

SEQ ID NO: 3034286 - DNA, 22 bp, Homo sapiens
ctaagactcaaatgttctaagt

SEQ ID NO: 3034287 - DNA, 17 bp, Homo sapiens
ctaagacttactctaag

SEQ ID NO: 3034288 - DNA, 19 bp, Homo sapiens
ctaagacttactctaagat

SEQ ID NO: 3034289 - DNA, 20 bp, Homo sapiens
ctaagacttcagtcctggtc

SEQ ID NO: 3034290 - DNA, 18 bp, Homo sapiens
ctaagagattctgatttg

SEQ ID NO: 3034291 - DNA, 18 bp, Homo sapiens
ctaagagctagcgctgcc

SEQ ID NO: 3034292 - DNA, 20 bp, Homo sapiens
ctaagaggttgctaatgcct

SEQ ID NO: 3034293 - DNA, 20 bp, Homo sapiens
ctaagatcttagattctctg

SEQ ID NO: 3034294 - DNA, 19 bp, Homo sapiens
ctaagatgacattgctaag

SEQ ID NO: 3034295 - DNA, 19 bp, Homo sapiens
ctaagatgtgatattctaa

SEQ ID NO: 3034296 - DNA, 23 bp, Homo sapiens
ctaagatgtgatattctaagact

SEQ ID NO: 3034297 - DNA, 12 bp, Homo sapiens
ctaagattctaa

SEQ ID NO: 3034298 - DNA, 13 bp, Homo sapiens
ctaagattctaaa

SEQ ID NO: 3034299 - DNA, 18 bp, Homo sapiens
ctaagattctaaaggtcc

SEQ ID NO: 3034300 - DNA, 22 bp, Homo sapiens
ctaagattctagatcagatgct

SEQ ID NO: 3034301 - DNA, 11 bp, Homo sapiens
ctaagattctg

SEQ ID NO: 3034302 - DNA, 12 bp, Homo sapiens
ctaagattctga

SEQ ID NO: 3034303 - DNA, 14 bp, Homo sapiens
ctaagcagaggagg

SEQ ID NO: 3034304 - DNA, 20 bp, Homo sapiens
ctaagcagaggaggggccgc

SEQ ID NO: 3034305 - DNA, 14 bp, Homo sapiens
ctaagcagccagga

SEQ ID NO: 3034306 - DNA, 15 bp, Homo sapiens
ctaagcatgtagcca

SEQ ID NO: 3034307 - DNA, 17 bp, Homo sapiens
ctaagccaagctgtgtt

SEQ ID NO: 3034308 - DNA, 11 bp, Homo sapiens
ctaagcctgtg

SEQ ID NO: 3034309 - DNA, 13 bp, Homo sapiens
ctaagctccagcc

SEQ ID NO: 3034310 - DNA, 14 bp, Homo sapiens
ctaagctccagccc

SEQ ID NO: 3034311 - DNA, 18 bp, Homo sapiens
ctaaggaagctaaaagca

SEQ ID NO: 3034312 - DNA, 20 bp, Homo sapiens
ctaaggaagtatcagcacta

SEQ ID NO: 3034313 - DNA, 19 bp, Homo sapiens
ctaaggacctgaaattcca

SEQ ID NO: 3034314 - DNA, 22 bp, Homo sapiens
ctaaggacctgaaattccaaag

SEQ ID NO: 3034315 - DNA, 23 bp, Homo sapiens
ctaaggagcgctagtgccttgcc

SEQ ID NO: 3034316 - DNA, 20 bp, Homo sapiens
ctaaggaggggaaaaaaatg

SEQ ID NO: 3034317 - DNA, 22 bp, Homo sapiens
ctaaggaggggaaaaaaatgtt

SEQ ID NO: 3034318 - DNA, 18 bp, Homo sapiens
ctaaggataatgaaataa

SEQ ID NO: 3034319 - DNA, 13 bp, Homo sapiens
ctaaggcctactt

SEQ ID NO: 3034320 - DNA, 14 bp, Homo sapiens
ctaaggcctaggat

SEQ ID NO: 3034321 - DNA, 20 bp, Homo sapiens
ctaaggcctaggattctaaa

SEQ ID NO: 3034322 - DNA, 20 bp, Homo sapiens
ctaaggctctgagagtctag

SEQ ID NO: 3034323 - DNA, 12 bp, Homo sapiens
ctaagggcagcc

SEQ ID NO: 3034324 - DNA, 12 bp, Homo sapiens
ctaaggggcccg

SEQ ID NO: 3034325 - DNA, 22 bp, Homo sapiens
ctaaggggcccggccagccatg

SEQ ID NO: 3034326 - DNA, 21 bp, Homo sapiens
ctaaggtccggtgttctaaga

SEQ ID NO: 3034327 - DNA, 14 bp, Homo sapiens
ctaaggtgactttc

SEQ ID NO: 3034328 - DNA, 19 bp, Homo sapiens
ctaaggtgactttctgaaa

SEQ ID NO: 3034329 - DNA, 12 bp, Homo sapiens
ctaaggttctaa

SEQ ID NO: 3034330 - DNA, 20 bp, Homo sapiens
ctaagtagctgggtttacag

SEQ ID NO: 3034331 - DNA, 16 bp, Homo sapiens
ctaagtcgcgagccag

SEQ ID NO: 3034332 - DNA, 15 bp, Homo sapiens
ctaagttaatttaaa

SEQ ID NO: 3034333 - DNA, 16 bp, Homo sapiens
ctaagttattttatga

SEQ ID NO: 3034334 - DNA, 23 bp, Homo sapiens
ctaagttattttatgacatgaaa

SEQ ID NO: 3034335 - DNA, 19 bp, Homo sapiens
ctaagtttcagttgatttt

SEQ ID NO: 3034336 - DNA, 20 bp, Homo sapiens
ctatattgatttaaaagtgt

SEQ ID NO: 3034337 - DNA, 14 bp, Homo sapiens
ctatattgcccagg

SEQ ID NO: 3034338 - DNA, 22 bp, Homo sapiens
ctatattgcccaggctggtctt

SEQ ID NO: 3034339 - DNA, 15 bp, Homo sapiens
ctatcaacaataaaa

SEQ ID NO: 3034340 - DNA, 19 bp, Homo sapiens
ctatcaagaggctgagaca

SEQ ID NO: 3034341 - DNA, 16 bp, Homo sapiens
ctatcacctatttcca

SEQ ID NO: 3034342 - DNA, 13 bp, Homo sapiens
ctatcactgacac

SEQ ID NO: 3034343 - DNA, 12 bp, Homo sapiens
ctatcaggcaga

SEQ ID NO: 3034344 - DNA, 19 bp, Homo sapiens
ctatcaggcagaagaatct

SEQ ID NO: 3034345 - DNA, 14 bp, Homo sapiens
ctatcattaaagtt

SEQ ID NO: 3034346 - DNA, 15 bp, Homo sapiens
ctatcattaaagttc

SEQ ID NO: 3034347 - DNA, 18 bp, Homo sapiens
ctatcattccctagaaca

SEQ ID NO: 3034348 - DNA, 20 bp, Homo sapiens
ctatcattgcttcctcctcc

SEQ ID NO: 3034349 - DNA, 20 bp, Homo sapiens
ctatcatttccgttttgcct

SEQ ID NO: 3034350 - DNA, 15 bp, Homo sapiens
ctatccaaaggaatc

SEQ ID NO: 3034351 - DNA, 15 bp, Homo sapiens
ctatccacactgtca

SEQ ID NO: 3034352 - DNA, 13 bp, Homo sapiens
ctatccacccagc

SEQ ID NO: 3034353 - DNA, 11 bp, Homo sapiens
ctatcctggcc

SEQ ID NO: 3034354 - DNA, 19 bp, Homo sapiens
ctatcgttattataaatgt

SEQ ID NO: 3034355 - DNA, 15 bp, Homo sapiens
ctatctactaagttt

SEQ ID NO: 3034356 - DNA, 14 bp, Homo sapiens
ctatctagatggat

SEQ ID NO: 3034357 - DNA, 15 bp, Homo sapiens
ctatctatcctgaat

SEQ ID NO: 3034358 - DNA, 14 bp, Homo sapiens
ctatctcagagata

SEQ ID NO: 3034359 - DNA, 15 bp, Homo sapiens
ctatctcagccatag

SEQ ID NO: 3034360 - DNA, 15 bp, Homo sapiens
ctatctcctagggct

SEQ ID NO: 3034361 - DNA, 22 bp, Homo sapiens
ctatctgcaatgtttttgtgta

SEQ ID NO: 3034362 - DNA, 14 bp, Homo sapiens
ctatcttaattttg

SEQ ID NO: 3034363 - DNA, 23 bp, Homo sapiens
ctatcttaattttggttgtattc

SEQ ID NO: 3034364 - DNA, 18 bp, Homo sapiens
ctatcttgctctgtaatc

SEQ ID NO: 3034365 - DNA, 18 bp, Homo sapiens
ctatgaaacctttttcct

SEQ ID NO: 3034366 - DNA, 21 bp, Homo sapiens
ctatgacctcgccctccacaa

SEQ ID NO: 3034367 - DNA, 16 bp, Homo sapiens
ctatgagtctagatgt

SEQ ID NO: 3034368 - DNA, 17 bp, Homo sapiens
ctatgagtctagatgtt

SEQ ID NO: 3034369 - DNA, 17 bp, Homo sapiens
ctatgataagattgaaa

SEQ ID NO: 3034370 - DNA, 21 bp, Homo sapiens
ctatgatgtttcttttgcaat

SEQ ID NO: 3034371 - DNA, 18 bp, Homo sapiens
ctatgcaaaatgtctgtt

SEQ ID NO: 3034372 - DNA, 18 bp, Homo sapiens
ctatgcacatatggactc

SEQ ID NO: 3034373 - DNA, 18 bp, Homo sapiens
ctatgcagaggcctgggg

SEQ ID NO: 3034374 - DNA, 19 bp, Homo sapiens
ctatgcatggtgccccagg

SEQ ID NO: 3034375 - DNA, 23 bp, Homo sapiens
ctatgcatggtgccccaggacca

SEQ ID NO: 3034376 - DNA, 21 bp, Homo sapiens
ctatgcccctagtaactgctg

SEQ ID NO: 3034377 - DNA, 22 bp, Homo sapiens
ctatgcccctagtaactgctgt

SEQ ID NO: 3034378 - DNA, 23 bp, Homo sapiens
ctatgcccctagtaactgctgtc

SEQ ID NO: 3034379 - DNA, 15 bp, Homo sapiens
ctatgccgtcttctg

SEQ ID NO: 3034380 - DNA, 14 bp, Homo sapiens
ctatgcctgtgtct

SEQ ID NO: 3034381 - DNA, 19 bp, Homo sapiens
ctatgctgcttttatatct

SEQ ID NO: 3034382 - DNA, 11 bp, Homo sapiens
ctatgctttga

SEQ ID NO: 3034383 - DNA, 18 bp, Homo sapiens
ctatggaatgtcagtgtt

SEQ ID NO: 3034384 - DNA, 14 bp, Homo sapiens
ctatggacaactta

SEQ ID NO: 3034385 - DNA, 17 bp, Homo sapiens
ctatggacaacttattt

SEQ ID NO: 3034386 - DNA, 14 bp, Homo sapiens
ctatggcagaaaaa

SEQ ID NO: 3034387 - DNA, 23 bp, Homo sapiens
ctatgggagagtgtcaaccagac

SEQ ID NO: 3034388 - DNA, 19 bp, Homo sapiens
ctatggtttgccattattt

SEQ ID NO: 3034389 - DNA, 11 bp, Homo sapiens
ctatggttttt

SEQ ID NO: 3034390 - DNA, 15 bp, Homo sapiens
ctatgtaactgcatt

SEQ ID NO: 3034391 - DNA, 19 bp, Homo sapiens
ctatgtaatgcttatgtgt

SEQ ID NO: 3034392 - DNA, 19 bp, Homo sapiens
ctatgtaggaaaaaaatag

SEQ ID NO: 3034393 - DNA, 14 bp, Homo sapiens
ctatgtctcaggag

SEQ ID NO: 3034394 - DNA, 11 bp, Homo sapiens
ctatgtgattt

SEQ ID NO: 3034395 - DNA, 19 bp, Homo sapiens
ctatgtgattttaactctg

SEQ ID NO: 3034396 - DNA, 21 bp, Homo sapiens
ctatgtgattttaactctgtc

SEQ ID NO: 3034397 - DNA, 17 bp, Homo sapiens
ctatgtgtgttgtttcc

SEQ ID NO: 3034398 - DNA, 19 bp, Homo sapiens
ctatgtgtttggtttataa

SEQ ID NO: 3034399 - DNA, 18 bp, Homo sapiens
ctatgttgcatgataaac

SEQ ID NO: 3034400 - DNA, 16 bp, Homo sapiens
ctatgtttctcagact

SEQ ID NO: 3034401 - DNA, 16 bp, Homo sapiens
ctatgttttaaaataa

SEQ ID NO: 3034402 - DNA, 20 bp, Homo sapiens
ctatgtttttgttcaaagcc

SEQ ID NO: 3034403 - DNA, 22 bp, Homo sapiens
ctatgtttttgttcaaagccag

SEQ ID NO: 3034404 - DNA, 20 bp, Homo sapiens
ctattaaagtgctaaggttc

SEQ ID NO: 3034405 - DNA, 23 bp, Homo sapiens
ctattaaagtgctaaggttctaa

SEQ ID NO: 3034406 - DNA, 22 bp, Homo sapiens
ctattaaagtggagaagcacac

SEQ ID NO: 3034407 - DNA, 15 bp, Homo sapiens
ctattaatagaacac

SEQ ID NO: 3034408 - DNA, 19 bp, Homo sapiens
ctattaatcacctctctgt

SEQ ID NO: 3034409 - DNA, 18 bp, Homo sapiens
ctattatactttatcaaa

SEQ ID NO: 3034410 - DNA, 18 bp, Homo sapiens
ctattatgttgttagaga

SEQ ID NO: 3034411 - DNA, 11 bp, Homo sapiens
ctattcacaac

SEQ ID NO: 3034412 - DNA, 23 bp, Homo sapiens
ctattcagaatcaaaccttttta

SEQ ID NO: 3034413 - DNA, 13 bp, Homo sapiens
ctattccatgttt

SEQ ID NO: 3034414 - DNA, 16 bp, Homo sapiens
ctattcccactttcat

SEQ ID NO: 3034415 - DNA, 17 bp, Homo sapiens
ctattcctgtaatgaaa

SEQ ID NO: 3034416 - DNA, 21 bp, Homo sapiens
ctattctctccaaaaatgcac

SEQ ID NO: 3034417 - DNA, 16 bp, Homo sapiens
ctattgacttcaatga

SEQ ID NO: 3034418 - DNA, 20 bp, Homo sapiens
ctattgcagcaattaaaaat

SEQ ID NO: 3034419 - DNA, 19 bp, Homo sapiens
ctattgccaggaatgtttc

SEQ ID NO: 3034420 - DNA, 13 bp, Homo sapiens
ctattggatttgt

SEQ ID NO: 3034421 - DNA, 22 bp, Homo sapiens
ctattggatttgtccaaacagg

SEQ ID NO: 3034422 - DNA, 15 bp, Homo sapiens
ctattgtaaatttgg

SEQ ID NO: 3034423 - DNA, 15 bp, Homo sapiens
ctattgtacgctaga

SEQ ID NO: 3034424 - DNA, 16 bp, Homo sapiens
ctattgtttagatatt

SEQ ID NO: 3034425 - DNA, 23 bp, Homo sapiens
ctatttaaaatgctcaatttcag

SEQ ID NO: 3034426 - DNA, 18 bp, Homo sapiens
ctatttaattaggaaaaa

SEQ ID NO: 3034427 - DNA, 18 bp, Homo sapiens
ctatttacttctaatctt

SEQ ID NO: 3034428 - DNA, 22 bp, Homo sapiens
ctatttcaggccctcagctgtc

SEQ ID NO: 3034429 - DNA, 14 bp, Homo sapiens
ctatttcagtactt

SEQ ID NO: 3034430 - DNA, 14 bp, Homo sapiens
ctatttcctttgcg

SEQ ID NO: 3034431 - DNA, 22 bp, Homo sapiens
ctatttcctttgcgcaaacttt

SEQ ID NO: 3034432 - DNA, 13 bp, Homo sapiens
ctatttcggcctt

SEQ ID NO: 3034433 - DNA, 21 bp, Homo sapiens
ctatttctatgtatgtgccaa

SEQ ID NO: 3034434 - DNA, 13 bp, Homo sapiens
ctatttctctgtg

SEQ ID NO: 3034435 - DNA, 14 bp, Homo sapiens
ctatttgaacaagt

SEQ ID NO: 3034436 - DNA, 16 bp, Homo sapiens
ctatttgacccccaca

SEQ ID NO: 3034437 - DNA, 15 bp, Homo sapiens
ctatttgtgactttt

SEQ ID NO: 3034438 - DNA, 17 bp, Homo sapiens
ctattttggattgtata

SEQ ID NO: 3034439 - DNA, 23 bp, Homo sapiens
ctatttttaaataatttcctaca

SEQ ID NO: 3034440 - DNA, 13 bp, Homo sapiens
ctatttttatcat

SEQ ID NO: 3034441 - DNA, 15 bp, Homo sapiens
ctatttttatcatga

SEQ ID NO: 3034442 - DNA, 23 bp, Homo sapiens
ctatttttatgatgacaatcaaa

SEQ ID NO: 3034443 - DNA, 16 bp, Homo sapiens
ctatttttctttccaa

SEQ ID NO: 3034444 - DNA, 13 bp, Homo sapiens
ctatttttgtgaa

SEQ ID NO: 3034445 - DNA, 15 bp, Homo sapiens
ctatttttgtgaaga

SEQ ID NO: 3034446 - DNA, 23 bp, Homo sapiens
ctcaaaaaaaaaatttttttcct

SEQ ID NO: 3034447 - DNA, 13 bp, Homo sapiens
ctcaaaaagcaga

SEQ ID NO: 3034448 - DNA, 17 bp, Homo sapiens
ctcaaaaagcagaagga

SEQ ID NO: 3034449 - DNA, 21 bp, Homo sapiens
ctcaaaactgtactgtcttta

SEQ ID NO: 3034450 - DNA, 21 bp, Homo sapiens
ctcaaactcctgacctcaggt

SEQ ID NO: 3034451 - DNA, 16 bp, Homo sapiens
ctcaaacttctggctc

SEQ ID NO: 3034452 - DNA, 16 bp, Homo sapiens
ctcaaagatgtaatgt

SEQ ID NO: 3034453 - DNA, 15 bp, Homo sapiens
ctcaaatctgaggga

SEQ ID NO: 3034454 - DNA, 22 bp, Homo sapiens
ctcaaatgctcagaccagctct

SEQ ID NO: 3034455 - DNA, 20 bp, Homo sapiens
ctcaaatggggccagatcca

SEQ ID NO: 3034456 - DNA, 15 bp, Homo sapiens
ctcaaatgttctaag

SEQ ID NO: 3034457 - DNA, 17 bp, Homo sapiens
ctcaaatgttttctgca

SEQ ID NO: 3034458 - DNA, 15 bp, Homo sapiens
ctcaacaacatcttt

SEQ ID NO: 3034459 - DNA, 24 bp, Homo sapiens
ctcaacagagaggaccaacatcca

SEQ ID NO: 3034460 - DNA, 15 bp, Homo sapiens
ctcaacatgagtcaa

SEQ ID NO: 3034461 - DNA, 20 bp, Homo sapiens
ctcaaccaaattaaaaattt

SEQ ID NO: 3034462 - DNA, 12 bp, Homo sapiens
ctcaacctcttc

SEQ ID NO: 3034463 - DNA, 18 bp, Homo sapiens
ctcaacctcttctggctc

SEQ ID NO: 3034464 - DNA, 15 bp, Homo sapiens
ctcaacgtattgttt

SEQ ID NO: 3034465 - DNA, 16 bp, Homo sapiens
ctcaacgtattgtttc

SEQ ID NO: 3034466 - DNA, 20 bp, Homo sapiens
ctcaactccaccctctgcga

SEQ ID NO: 3034467 - DNA, 21 bp, Homo sapiens
ctcaagaaataaaaggaagcc

SEQ ID NO: 3034468 - DNA, 18 bp, Homo sapiens
ctcataaacatttgagtt

SEQ ID NO: 3034469 - DNA, 16 bp, Homo sapiens
ctcataaattaatgat

SEQ ID NO: 3034470 - DNA, 13 bp, Homo sapiens
ctcataatgtgaa

SEQ ID NO: 3034471 - DNA, 20 bp, Homo sapiens
ctcataatgtgaaatatgat

SEQ ID NO: 3034472 - DNA, 14 bp, Homo sapiens
ctcataatgtgaag

SEQ ID NO: 3034473 - DNA, 22 bp, Homo sapiens
ctcatagtgaacacagcagacc

SEQ ID NO: 3034474 - DNA, 16 bp, Homo sapiens
ctcatatcactgaagg

SEQ ID NO: 3034475 - DNA, 14 bp, Homo sapiens
ctcatcacacacat

SEQ ID NO: 3034476 - DNA, 15 bp, Homo sapiens
ctcatcacacacatg

SEQ ID NO: 3034477 - DNA, 15 bp, Homo sapiens
ctcatcactgtggct

SEQ ID NO: 3034478 - DNA, 19 bp, Homo sapiens
ctcatcaggagttccagtg

SEQ ID NO: 3034479 - DNA, 15 bp, Homo sapiens
ctcatcattctctgt

SEQ ID NO: 3034480 - DNA, 18 bp, Homo sapiens
ctcatcattctctgtctc

SEQ ID NO: 3034481 - DNA, 19 bp, Homo sapiens
ctcatccatcatcatgtgt

SEQ ID NO: 3034482 - DNA, 12 bp, Homo sapiens
ctcatccatcca

SEQ ID NO: 3034483 - DNA, 22 bp, Homo sapiens
ctcatcccgagcacctccacat

SEQ ID NO: 3034484 - DNA, 13 bp, Homo sapiens
ctcatcctccagt

SEQ ID NO: 3034485 - DNA, 12 bp, Homo sapiens
ctcatcctcctc

SEQ ID NO: 3034486 - DNA, 13 bp, Homo sapiens
ctcatcctcctcc

SEQ ID NO: 3034487 - DNA, 14 bp, Homo sapiens
ctcatcctgcttct

SEQ ID NO: 3034488 - DNA, 15 bp, Homo sapiens
ctcatcctgcttctc

SEQ ID NO: 3034489 - DNA, 15 bp, Homo sapiens
ctcatctgagccagc

SEQ ID NO: 3034490 - DNA, 17 bp, Homo sapiens
ctcatctgcctggaaag

SEQ ID NO: 3034491 - DNA, 15 bp, Homo sapiens
ctcatctgtgcctgt

SEQ ID NO: 3034492 - DNA, 22 bp, Homo sapiens
ctcatctgtgcctgtctgtcca

SEQ ID NO: 3034493 - DNA, 13 bp, Homo sapiens
ctcatcttactgt

SEQ ID NO: 3034494 - DNA, 21 bp, Homo sapiens
ctcatcttcaaagtttttact

SEQ ID NO: 3034495 - DNA, 16 bp, Homo sapiens
ctcatctttcttccaa

SEQ ID NO: 3034496 - DNA, 23 bp, Homo sapiens
ctcatgatccacccacctcagcc

SEQ ID NO: 3034497 - DNA, 17 bp, Homo sapiens
ctcatgcccctggctgg

SEQ ID NO: 3034498 - DNA, 16 bp, Homo sapiens
ctcatgccccttgggg

SEQ ID NO: 3034499 - DNA, 13 bp, Homo sapiens
ctcatgcctctga

SEQ ID NO: 3034500 - DNA, 15 bp, Homo sapiens
ctcatgcctctgagc

SEQ ID NO: 3034501 - DNA, 20 bp, Homo sapiens
ctcatgcctctgagcttcta

SEQ ID NO: 3034502 - DNA, 12 bp, Homo sapiens
ctcatgctctga

SEQ ID NO: 3034503 - DNA, 15 bp, Homo sapiens
ctcatgctctgatta

SEQ ID NO: 3034504 - DNA, 17 bp, Homo sapiens
ctcatggcaggattcta

SEQ ID NO: 3034505 - DNA, 17 bp, Homo sapiens
ctcatgtccctatttat

SEQ ID NO: 3034506 - DNA, 14 bp, Homo sapiens
ctcatgtgactctt

SEQ ID NO: 3034507 - DNA, 18 bp, Homo sapiens
ctcatgtgactctttcca

SEQ ID NO: 3034508 - DNA, 9 bp, Homo sapiens
ctcatgtgt

SEQ ID NO: 3034509 - DNA, 13 bp, Homo sapiens
ctcatgtgtgtgg

SEQ ID NO: 3034510 - DNA, 21 bp, Homo sapiens
ctcatgttttccattgtttga

SEQ ID NO: 3034511 - DNA, 21 bp, Homo sapiens
ctcattaaatggtgatttctt

SEQ ID NO: 3034512 - DNA, 15 bp, Homo sapiens
ctcattcaaaagttg

SEQ ID NO: 3034513 - DNA, 19 bp, Homo sapiens
ctcattcaaaagttgaaat

SEQ ID NO: 3034514 - DNA, 22 bp, Homo sapiens
ctcattcaggaaaactgacaga

SEQ ID NO: 3034515 - DNA, 21 bp, Homo sapiens
ctcattcattttatattgaaa

SEQ ID NO: 3034516 - DNA, 22 bp, Homo sapiens
ctcattcattttatattgaaaa

SEQ ID NO: 3034517 - DNA, 18 bp, Homo sapiens
ctcattccacactgttga

SEQ ID NO: 3034518 - DNA, 17 bp, Homo sapiens
ctcattccactgttggt

SEQ ID NO: 3034519 - DNA, 12 bp, Homo sapiens
ctcattccccag

SEQ ID NO: 3034520 - DNA, 18 bp, Homo sapiens
ctcattccctccccagaa

SEQ ID NO: 3034521 - DNA, 11 bp, Homo sapiens
ctcattctgaa

SEQ ID NO: 3034522 - DNA, 17 bp, Homo sapiens
ctcattctgaaggagcc

SEQ ID NO: 3034523 - DNA, 18 bp, Homo sapiens
ctcattgctgagcctctg

SEQ ID NO: 3034524 - DNA, 20 bp, Homo sapiens
ctcattgctgagcctctgct

SEQ ID NO: 3034525 - DNA, 21 bp, Homo sapiens
ctcattgctgcccgtttgtac

SEQ ID NO: 3034526 - DNA, 20 bp, Homo sapiens
ctcattgcttggaattcagc

SEQ ID NO: 3034527 - DNA, 18 bp, Homo sapiens
ctcattggacccttccat

SEQ ID NO: 3034528 - DNA, 15 bp, Homo sapiens
ctcatttagaaacaa

SEQ ID NO: 3034529 - DNA, 20 bp, Homo sapiens
ctcatttgcttttgtcacta

SEQ ID NO: 3034530 - DNA, 22 bp, Homo sapiens
ctcatttggtttgattttccct

SEQ ID NO: 3034531 - DNA, 22 bp, Homo sapiens
ctccaaaggaagtctaggagct

SEQ ID NO: 3034532 - DNA, 21 bp, Homo sapiens
ctccaaagtaatgtagcatga

SEQ ID NO: 3034533 - DNA, 15 bp, Homo sapiens
ctccaacaccaagca

SEQ ID NO: 3034534 - DNA, 14 bp, Homo sapiens
ctccaacctaacct

SEQ ID NO: 3034535 - DNA, 15 bp, Homo sapiens
ctccaacctaacctg

SEQ ID NO: 3034536 - DNA, 20 bp, Homo sapiens
ctccaacctaacctgtgtct

SEQ ID NO: 3034537 - DNA, 22 bp, Homo sapiens
ctccaacctaacctgtgtctgc

SEQ ID NO: 3034538 - DNA, 13 bp, Homo sapiens
ctccaacctctcg

SEQ ID NO: 3034539 - DNA, 14 bp, Homo sapiens
ctccaacctctcgg

SEQ ID NO: 3034540 - DNA, 15 bp, Homo sapiens
ctccaacctgaaggt

SEQ ID NO: 3034541 - DNA, 21 bp, Homo sapiens
ctccaagaatggaagcctgaa

SEQ ID NO: 3034542 - DNA, 23 bp, Homo sapiens
ctccaagcccagttcagcttggg

SEQ ID NO: 3034543 - DNA, 22 bp, Homo sapiens
ctccaagccccctggcagctgc

SEQ ID NO: 3034544 - DNA, 11 bp, Homo sapiens
ctccaagctgt

SEQ ID NO: 3034545 - DNA, 14 bp, Homo sapiens
ctccaagctgttaa

SEQ ID NO: 3034546 - DNA, 12 bp, Homo sapiens
ctccaatcctcc

SEQ ID NO: 3034547 - DNA, 13 bp, Homo sapiens
ctccaatcctccc

SEQ ID NO: 3034548 - DNA, 11 bp, Homo sapiens
ctccaatgtcg

SEQ ID NO: 3034549 - DNA, 21 bp, Homo sapiens
ctccacaaagcaaaggcagtc

SEQ ID NO: 3034550 - DNA, 22 bp, Homo sapiens
ctccacactgaccaagtgctgg

SEQ ID NO: 3034551 - DNA, 13 bp, Homo sapiens
ctccaccaaccca

SEQ ID NO: 3034552 - DNA, 22 bp, Homo sapiens
ctccaccaaccccgcggcccag

SEQ ID NO: 3034553 - DNA, 19 bp, Homo sapiens
ctccaccaccgcccgtctg

SEQ ID NO: 3034554 - DNA, 22 bp, Homo sapiens
ctccaccaccgcccgtctgtgt

SEQ ID NO: 3034555 - DNA, 20 bp, Homo sapiens
ctccacccaaaccccttccc

SEQ ID NO: 3034556 - DNA, 18 bp, Homo sapiens
ctccacccccaccactct

SEQ ID NO: 3034557 - DNA, 22 bp, Homo sapiens
ctccacccgttcccactgccct

SEQ ID NO: 3034558 - DNA, 14 bp, Homo sapiens
ctccaccgctgcct

SEQ ID NO: 3034559 - DNA, 13 bp, Homo sapiens
ctccacctcagcc

SEQ ID NO: 3034560 - DNA, 16 bp, Homo sapiens
ctccacctcagccttg

SEQ ID NO: 3034561 - DNA, 14 bp, Homo sapiens
ctccaccttcccac

SEQ ID NO: 3034562 - DNA, 17 bp, Homo sapiens
ctccacgccactgcctc

SEQ ID NO: 3034563 - DNA, 15 bp, Homo sapiens
ctccacgttctgctc

SEQ ID NO: 3034564 - DNA, 17 bp, Homo sapiens
ctccacgttctgctcat

SEQ ID NO: 3034565 - DNA, 18 bp, Homo sapiens
ctccacgttctgctcatc

SEQ ID NO: 3034566 - DNA, 20 bp, Homo sapiens
ctccacgttctgctcatcat

SEQ ID NO: 3034567 - DNA, 13 bp, Homo sapiens
ctccactcctctc

SEQ ID NO: 3034568 - DNA, 15 bp, Homo sapiens
ctccactcctctcaa

SEQ ID NO: 3034569 - DNA, 19 bp, Homo sapiens
ctccacttctggtcccctg

SEQ ID NO: 3034570 - DNA, 20 bp, Homo sapiens
ctccacttctggtcccctgt

SEQ ID NO: 3034571 - DNA, 13 bp, Homo sapiens
ctccagaagaaaa

SEQ ID NO: 3034572 - DNA, 16 bp, Homo sapiens
ctccagaagcactggg

SEQ ID NO: 3034573 - DNA, 20 bp, Homo sapiens
ctccagaagcactgggatca

SEQ ID NO: 3034574 - DNA, 12 bp, Homo sapiens
ctccagaagcct

SEQ ID NO: 3034575 - DNA, 18 bp, Homo sapiens
ctccagaatgtgctgcct

SEQ ID NO: 3034576 - DNA, 21 bp, Homo sapiens
ctccagaattacccttcctca

SEQ ID NO: 3034577 - DNA, 23 bp, Homo sapiens
ctccagaattacccttcctcatc

SEQ ID NO: 3034578 - DNA, 12 bp, Homo sapiens
ctccagacctga

SEQ ID NO: 3034579 - DNA, 18 bp, Homo sapiens
ctccagagacaggaaaga

SEQ ID NO: 3034580 - DNA, 20 bp, Homo sapiens
ctccagagacaggaaagaat

SEQ ID NO: 3034581 - DNA, 13 bp, Homo sapiens
ctccagagggcac

SEQ ID NO: 3034582 - DNA, 20 bp, Homo sapiens
ctccagaggggctcaggtca

SEQ ID NO: 3034583 - DNA, 20 bp, Homo sapiens
ctccagagtggggatgacat

SEQ ID NO: 3034584 - DNA, 23 bp, Homo sapiens
ctccagatatgaacagggcccag

SEQ ID NO: 3034585 - DNA, 16 bp, Homo sapiens
ctccagatgcagggca

SEQ ID NO: 3034586 - DNA, 18 bp, Homo sapiens
ctccagatgcagggcagt

SEQ ID NO: 3034587 - DNA, 22 bp, Homo sapiens
ctccagcaagcaaacagggtgg

SEQ ID NO: 3034588 - DNA, 16 bp, Homo sapiens
ctccagcacaaacaca

SEQ ID NO: 3034589 - DNA, 18 bp, Homo sapiens
ctccagcattctcagcca

SEQ ID NO: 3034590 - DNA, 20 bp, Homo sapiens
ctccagcattctcagccaca

SEQ ID NO: 3034591 - DNA, 22 bp, Homo sapiens
ctccagcattctcagccacaac

SEQ ID NO: 3034592 - DNA, 23 bp, Homo sapiens
ctccagccatcaagagactgagt

SEQ ID NO: 3034593 - DNA, 17 bp, Homo sapiens
ctccagcccctttccaa

SEQ ID NO: 3034594 - DNA, 21 bp, Homo sapiens
ctccagcccgagtggtctcct

SEQ ID NO: 3034595 - DNA, 21 bp, Homo sapiens
ctccagccctgcccaccctcc

SEQ ID NO: 3034596 - DNA, 20 bp, Homo sapiens
ctccagcctcacagatgctg

SEQ ID NO: 3034597 - DNA, 17 bp, Homo sapiens
ctccagcgatggtgctg

SEQ ID NO: 3034598 - DNA, 23 bp, Homo sapiens
ctccagcgatggtgctgcccagg

SEQ ID NO: 3034599 - DNA, 23 bp, Homo sapiens
ctccagcggttgccttttttatc

SEQ ID NO: 3034600 - DNA, 23 bp, Homo sapiens
ctcgacgtttacaagccccccct

SEQ ID NO: 3034601 - DNA, 22 bp, Homo sapiens
ctcgactgagctttagacagca

SEQ ID NO: 3034602 - DNA, 20 bp, Homo sapiens
ctcgaggactgtatttgtga

SEQ ID NO: 3034603 - DNA, 13 bp, Homo sapiens
ctcgagggccgcc

SEQ ID NO: 3034604 - DNA, 13 bp, Homo sapiens
ctcgaggtgcctt

SEQ ID NO: 3034605 - DNA, 15 bp, Homo sapiens
ctcgaggtgccttct

SEQ ID NO: 3034606 - DNA, 20 bp, Homo sapiens
ctcgagtactgtgggcaatt

SEQ ID NO: 3034607 - DNA, 15 bp, Homo sapiens
ctcgatgcctttgct

SEQ ID NO: 3034608 - DNA, 16 bp, Homo sapiens
ctcgatgctgctggcc

SEQ ID NO: 3034609 - DNA, 17 bp, Homo sapiens
ctcgcacctgtgctgga

SEQ ID NO: 3034610 - DNA, 20 bp, Homo sapiens
ctcgcacttgcagaggagcc

SEQ ID NO: 3034611 - DNA, 15 bp, Homo sapiens
ctcgcaggaccaagg

SEQ ID NO: 3034612 - DNA, 16 bp, Homo sapiens
ctcgcatcattgcaga

SEQ ID NO: 3034613 - DNA, 15 bp, Homo sapiens
ctcgcatccagacag

SEQ ID NO: 3034614 - DNA, 19 bp, Homo sapiens
ctcgccatttcctcacgtg

SEQ ID NO: 3034615 - DNA, 15 bp, Homo sapiens
ctcgcccatcagtgc

SEQ ID NO: 3034616 - DNA, 21 bp, Homo sapiens
ctcgcccatcagtgccagccc

SEQ ID NO: 3034617 - DNA, 19 bp, Homo sapiens
ctcgcccccacttttctag

SEQ ID NO: 3034618 - DNA, 13 bp, Homo sapiens
ctcgccctgggtc

SEQ ID NO: 3034619 - DNA, 15 bp, Homo sapiens
ctcgccctgggtcta

SEQ ID NO: 3034620 - DNA, 13 bp, Homo sapiens
ctcgccctgtttg

SEQ ID NO: 3034621 - DNA, 17 bp, Homo sapiens
ctcgcctcagcctgatc

SEQ ID NO: 3034622 - DNA, 16 bp, Homo sapiens
ctcgcctgccctcctc

SEQ ID NO: 3034623 - DNA, 18 bp, Homo sapiens
ctcgcctgccctcctctc

SEQ ID NO: 3034624 - DNA, 19 bp, Homo sapiens
ctcgcctgccctcctctcc

SEQ ID NO: 3034625 - DNA, 14 bp, Homo sapiens
ctcgcctggaaaca

SEQ ID NO: 3034626 - DNA, 18 bp, Homo sapiens
ctcgcctggaaacagagg

SEQ ID NO: 3034627 - DNA, 15 bp, Homo sapiens
ctcgccttcctgcag

SEQ ID NO: 3034628 - DNA, 16 bp, Homo sapiens
ctcgccttcctgcagt

SEQ ID NO: 3034629 - DNA, 18 bp, Homo sapiens
ctcgctccctcccaggac

SEQ ID NO: 3034630 - DNA, 19 bp, Homo sapiens
ctcgctgccagctctgtat

SEQ ID NO: 3034631 - DNA, 19 bp, Homo sapiens
ctcgctggactctcagtct

SEQ ID NO: 3034632 - DNA, 18 bp, Homo sapiens
ctcgctgtcctttctaga

SEQ ID NO: 3034633 - DNA, 22 bp, Homo sapiens
ctcgcttggacggctgggcaca

SEQ ID NO: 3034634 - DNA, 16 bp, Homo sapiens
ctcggagctggcccag

SEQ ID NO: 3034635 - DNA, 15 bp, Homo sapiens
ctcggaggctcctcc

SEQ ID NO: 3034636 - DNA, 16 bp, Homo sapiens
ctcggaggctcctccc

SEQ ID NO: 3034637 - DNA, 21 bp, Homo sapiens
ctcggatgaccatactcagac

SEQ ID NO: 3034638 - DNA, 18 bp, Homo sapiens
ctcggcagaactctctgt

SEQ ID NO: 3034639 - DNA, 19 bp, Homo sapiens
ctcggcagaactctctgtc

SEQ ID NO: 3034640 - DNA, 20 bp, Homo sapiens
ctcggcagaactctctgtct

SEQ ID NO: 3034641 - DNA, 16 bp, Homo sapiens
ctcggcaggaaggagc

SEQ ID NO: 3034642 - DNA, 15 bp, Homo sapiens
ctcggcccagggccg

SEQ ID NO: 3034643 - DNA, 15 bp, Homo sapiens
ctcggcccatctgtc

SEQ ID NO: 3034644 - DNA, 16 bp, Homo sapiens
ctcggcccatctgtcc

SEQ ID NO: 3034645 - DNA, 15 bp, Homo sapiens
ctcggccccatcgcc

SEQ ID NO: 3034646 - DNA, 22 bp, Homo sapiens
ctcggccccatcgccccaccgc

SEQ ID NO: 3034647 - DNA, 15 bp, Homo sapiens
ctcggcccctcccac

SEQ ID NO: 3034648 - DNA, 17 bp, Homo sapiens
ctcggccgcagcggcgt

SEQ ID NO: 3034649 - DNA, 18 bp, Homo sapiens
ctcggcctcccaaagtgc

SEQ ID NO: 3034650 - DNA, 22 bp, Homo sapiens
ctcggctcagtgcaacctctgc

SEQ ID NO: 3034651 - DNA, 23 bp, Homo sapiens
ctcggctcagtgcaacctctgct

SEQ ID NO: 3034652 - DNA, 21 bp, Homo sapiens
ctcggcttggatcctgggctg

SEQ ID NO: 3034653 - DNA, 18 bp, Homo sapiens
ctcggcttttctcagctg

SEQ ID NO: 3034654 - DNA, 14 bp, Homo sapiens
ctcgggggcctgtg

SEQ ID NO: 3034655 - DNA, 16 bp, Homo sapiens
ctcgggggcctgtggt

SEQ ID NO: 3034656 - DNA, 14 bp, Homo sapiens
ctcggggtgggggt

SEQ ID NO: 3034657 - DNA, 16 bp, Homo sapiens
ctcgggtgggggagcc

SEQ ID NO: 3034658 - DNA, 15 bp, Homo sapiens
ctcggttgaaacctg

SEQ ID NO: 3034659 - DNA, 23 bp, Homo sapiens
ctcggtttcccatttgttgctgc

SEQ ID NO: 3034660 - DNA, 22 bp, Homo sapiens
ctcggtttgccaaaattcattt

SEQ ID NO: 3034661 - DNA, 18 bp, Homo sapiens
ctcgtcaatccatcagca

SEQ ID NO: 3034662 - DNA, 16 bp, Homo sapiens
ctcgtcaggctgccag

SEQ ID NO: 3034663 - DNA, 14 bp, Homo sapiens
ctcgtcctccccct

SEQ ID NO: 3034664 - DNA, 16 bp, Homo sapiens
ctcgtcctccccctgc

SEQ ID NO: 3034665 - DNA, 19 bp, Homo sapiens
ctcgtctcttgtgactcag

SEQ ID NO: 3034666 - DNA, 12 bp, Homo sapiens
ctcgtgccagca

SEQ ID NO: 3034667 - DNA, 14 bp, Homo sapiens
ctcgtgccagcagc

SEQ ID NO: 3034668 - DNA, 19 bp, Homo sapiens
ctcgtgccagcagcctcgc

SEQ ID NO: 3034669 - DNA, 20 bp, Homo sapiens
ctcgtgccagcagcctcgca

SEQ ID NO: 3034670 - DNA, 21 bp, Homo sapiens
ctcgtgccagcagcctcgcac

SEQ ID NO: 3034671 - DNA, 22 bp, Homo sapiens
ctcgtgccagcagcctcgcaca

SEQ ID NO: 3034672 - DNA, 19 bp, Homo sapiens
ctcgttacttcagcccatg

SEQ ID NO: 3034673 - DNA, 19 bp, Homo sapiens
ctcgttccggtccccacag

SEQ ID NO: 3034674 - DNA, 19 bp, Homo sapiens
ctcgttgcagtctgtattt

SEQ ID NO: 3034675 - DNA, 20 bp, Homo sapiens
ctcgttgccctaattcatct

SEQ ID NO: 3034676 - DNA, 19 bp, Homo sapiens
ctcgttgcctctgattttc

SEQ ID NO: 3034677 - DNA, 12 bp, Homo sapiens
ctcgtttgatag

SEQ ID NO: 3034678 - DNA, 19 bp, Homo sapiens
ctctaaaacagattgcttt

SEQ ID NO: 3034679 - DNA, 17 bp, Homo sapiens
ctctaaagccaagcact

SEQ ID NO: 3034680 - DNA, 19 bp, Homo sapiens
ctctaaagccaagcacttt

SEQ ID NO: 3034681 - DNA, 14 bp, Homo sapiens
ctctaactccctcc

SEQ ID NO: 3034682 - DNA, 16 bp, Homo sapiens
ctctaactccctcctc

SEQ ID NO: 3034683 - DNA, 21 bp, Homo sapiens
ctctaactccctcctcacact

SEQ ID NO: 3034684 - DNA, 19 bp, Homo sapiens
ctctaagatcttagattct

SEQ ID NO: 3034685 - DNA, 22 bp, Homo sapiens
ctctaagatcttagattctctg

SEQ ID NO: 3034686 - DNA, 20 bp, Homo sapiens
ctctaagcagccaggaggga

SEQ ID NO: 3034687 - DNA, 15 bp, Homo sapiens
ctctaatatcagcaa

SEQ ID NO: 3034688 - DNA, 18 bp, Homo sapiens
ctctaattctattaaagt

SEQ ID NO: 3034689 - DNA, 19 bp, Homo sapiens
ctctacatggactcagaga

SEQ ID NO: 3034690 - DNA, 12 bp, Homo sapiens
ctctacatttaa

SEQ ID NO: 3034691 - DNA, 22 bp, Homo sapiens
ctctaccagtgcaggctggcca

SEQ ID NO: 3034692 - DNA, 14 bp, Homo sapiens
ctctacccagggcc

SEQ ID NO: 3034693 - DNA, 16 bp, Homo sapiens
ctctacctctctcctc

SEQ ID NO: 3034694 - DNA, 12 bp, Homo sapiens
ctctacctgaca

SEQ ID NO: 3034695 - DNA, 20 bp, Homo sapiens
ctctacgtttaggcacccct

SEQ ID NO: 3034696 - DNA, 19 bp, Homo sapiens
ctctactaaaaataccaaa

SEQ ID NO: 3034697 - DNA, 21 bp, Homo sapiens
ctctactaacaatcagctcct

SEQ ID NO: 3034698 - DNA, 13 bp, Homo sapiens
ctctacttcagga

SEQ ID NO: 3034699 - DNA, 15 bp, Homo sapiens
ctctactttgattct

SEQ ID NO: 3034700 - DNA, 12 bp, Homo sapiens
ctctagaatctg

SEQ ID NO: 3034701 - DNA, 16 bp, Homo sapiens
ctctagagtccaaggt

SEQ ID NO: 3034702 - DNA, 16 bp, Homo sapiens
ctctagcaaggctcat

SEQ ID NO: 3034703 - DNA, 20 bp, Homo sapiens
ctctagctgggggtgggcca

SEQ ID NO: 3034704 - DNA, 16 bp, Homo sapiens
ctctaggctctgcctt

SEQ ID NO: 3034705 - DNA, 21 bp, Homo sapiens
ctctagggcagggtgggagcc

SEQ ID NO: 3034706 - DNA, 18 bp, Homo sapiens
ctctagtagttaaaaaaa

SEQ ID NO: 3034707 - DNA, 13 bp, Homo sapiens
ctctagtccctgt

SEQ ID NO: 3034708 - DNA, 16 bp, Homo sapiens
ctctagtgccttctaa

SEQ ID NO: 3034709 - DNA, 16 bp, Homo sapiens
ctctataactttttct

SEQ ID NO: 3034710 - DNA, 21 bp, Homo sapiens
ctctatactgccctgagttgg

SEQ ID NO: 3034711 - DNA, 15 bp, Homo sapiens
ctctatcattaaagt

SEQ ID NO: 3034712 - DNA, 16 bp, Homo sapiens
ctctatcattaaagtt

SEQ ID NO: 3034713 - DNA, 18 bp, Homo sapiens
ctctatcattaaagttct

SEQ ID NO: 3034714 - DNA, 16 bp, Homo sapiens
ctctatcttgctctgt

SEQ ID NO: 3034715 - DNA, 13 bp, Homo sapiens
ctctatgagtcta

SEQ ID NO: 3034716 - DNA, 13 bp, Homo sapiens
ctctattgtaatt

SEQ ID NO: 3034717 - DNA, 16 bp, Homo sapiens
ctctatttatgtttgc

SEQ ID NO: 3034718 - DNA, 19 bp, Homo sapiens
ctctcaaacggcaacattc

SEQ ID NO: 3034719 - DNA, 12 bp, Homo sapiens
ctctcactttgg

SEQ ID NO: 3034720 - DNA, 13 bp, Homo sapiens
ctctcagccccat

SEQ ID NO: 3034721 - DNA, 18 bp, Homo sapiens
ctctcagccccatcgccc

SEQ ID NO: 3034722 - DNA, 13 bp, Homo sapiens
ctctcaggagcca

SEQ ID NO: 3034723 - DNA, 14 bp, Homo sapiens
ctctcaggagccat

SEQ ID NO: 3034724 - DNA, 13 bp, Homo sapiens
ctctcaggatcca

SEQ ID NO: 3034725 - DNA, 21 bp, Homo sapiens
ctctcaggctgtcccaagctc

SEQ ID NO: 3034726 - DNA, 18 bp, Homo sapiens
ctctcagtactttggagg

SEQ ID NO: 3034727 - DNA, 19 bp, Homo sapiens
ctctcagtactttggaggc

SEQ ID NO: 3034728 - DNA, 16 bp, Homo sapiens
ctctcagtctctgagc

SEQ ID NO: 3034729 - DNA, 18 bp, Homo sapiens
ctctcagtgccttctctc

SEQ ID NO: 3034730 - DNA, 20 bp, Homo sapiens
ctctcagtgccttctctcag

SEQ ID NO: 3034731 - DNA, 13 bp, Homo sapiens
ctctcagtgtttt

SEQ ID NO: 3034732 - DNA, 22 bp, Homo sapiens
ctctcagtgttttggactccat

SEQ ID NO: 3034733 - DNA, 15 bp, Homo sapiens
ctgaagcccagacct

SEQ ID NO: 3034734 - DNA, 21 bp, Homo sapiens
ctgaagccctcccaggtgtta

SEQ ID NO: 3034735 - DNA, 19 bp, Homo sapiens
ctgaagcctttcttttgga

SEQ ID NO: 3034736 - DNA, 16 bp, Homo sapiens
ctgaagcgaacatctt

SEQ ID NO: 3034737 - DNA, 23 bp, Homo sapiens
ctgaagcgaacatcttcatataa

SEQ ID NO: 3034738 - DNA, 14 bp, Homo sapiens
ctgaagcggtcaga

SEQ ID NO: 3034739 - DNA, 17 bp, Homo sapiens
ctgaagcggtcagactg

SEQ ID NO: 3034740 - DNA, 18 bp, Homo sapiens
ctgaagcggtcagactgg

SEQ ID NO: 3034741 - DNA, 20 bp, Homo sapiens
ctgaagctgacgaacttcca

SEQ ID NO: 3034742 - DNA, 12 bp, Homo sapiens
ctgaagctgctg

SEQ ID NO: 3034743 - DNA, 22 bp, Homo sapiens
ctgaagctgctgcagccctgcc

SEQ ID NO: 3034744 - DNA, 14 bp, Homo sapiens
ctgaagctgctgga

SEQ ID NO: 3034745 - DNA, 18 bp, Homo sapiens
ctgaagcttatgtttctt

SEQ ID NO: 3034746 - DNA, 13 bp, Homo sapiens
ctgaaggagcccc

SEQ ID NO: 3034747 - DNA, 14 bp, Homo sapiens
ctgaaggctttgtg

SEQ ID NO: 3034748 - DNA, 17 bp, Homo sapiens
ctgaaggtcccctggca

SEQ ID NO: 3034749 - DNA, 16 bp, Homo sapiens
ctgaagtcttgcattg

SEQ ID NO: 3034750 - DNA, 19 bp, Homo sapiens
ctgaagtcttgcattgaat

SEQ ID NO: 3034751 - DNA, 21 bp, Homo sapiens
ctgaagtcttgcattgaattt

SEQ ID NO: 3034752 - DNA, 14 bp, Homo sapiens
ctgaagttcaccat

SEQ ID NO: 3034753 - DNA, 11 bp, Homo sapiens
ctgaagttttt

SEQ ID NO: 3034754 - DNA, 18 bp, Homo sapiens
ctgaagtttttgaaatac

SEQ ID NO: 3034755 - DNA, 12 bp, Homo sapiens
ctgaataaacca

SEQ ID NO: 3034756 - DNA, 17 bp, Homo sapiens
ctgaataaaccaagaca

SEQ ID NO: 3034757 - DNA, 14 bp, Homo sapiens
ctgaataaagggaa

SEQ ID NO: 3034758 - DNA, 19 bp, Homo sapiens
ctgaatacttgaagtagga

SEQ ID NO: 3034759 - DNA, 14 bp, Homo sapiens
ctgaatattaagaa

SEQ ID NO: 3034760 - DNA, 20 bp, Homo sapiens
ctgaatattaagaaacaatt

SEQ ID NO: 3034761 - DNA, 18 bp, Homo sapiens
ctgaatattttttgaggc

SEQ ID NO: 3034762 - DNA, 18 bp, Homo sapiens
ctgaatcaggaaactcaa

SEQ ID NO: 3034763 - DNA, 17 bp, Homo sapiens
ctgaatgaaaataactg

SEQ ID NO: 3034764 - DNA, 18 bp, Homo sapiens
ctgaatgaaaataactga

SEQ ID NO: 3034765 - DNA, 22 bp, Homo sapiens
ctgaatgaaaataactgaacca

SEQ ID NO: 3034766 - DNA, 19 bp, Homo sapiens
ctgaatgagacttaatttt

SEQ ID NO: 3034767 - DNA, 16 bp, Homo sapiens
ctgaatgatcctgtct

SEQ ID NO: 3034768 - DNA, 18 bp, Homo sapiens
ctgaatgatcctgtctct

SEQ ID NO: 3034769 - DNA, 15 bp, Homo sapiens
ctgaatggctttgtc

SEQ ID NO: 3034770 - DNA, 19 bp, Homo sapiens
ctgaatggctttgtcttga

SEQ ID NO: 3034771 - DNA, 21 bp, Homo sapiens
ctgaatggctttgtcttgaaa

SEQ ID NO: 3034772 - DNA, 15 bp, Homo sapiens
ctgaatgtcattatt

SEQ ID NO: 3034773 - DNA, 19 bp, Homo sapiens
ctgaatgttgggactgcta

SEQ ID NO: 3034774 - DNA, 15 bp, Homo sapiens
ctgaatgtttgtgtc

SEQ ID NO: 3034775 - DNA, 18 bp, Homo sapiens
ctgaatgtttgtgtctgt

SEQ ID NO: 3034776 - DNA, 20 bp, Homo sapiens
ctgaatgtttgtgtctgtgg

SEQ ID NO: 3034777 - DNA, 23 bp, Homo sapiens
ctgaattgacatgaccctctgtc

SEQ ID NO: 3034778 - DNA, 14 bp, Homo sapiens
ctgaatttcaaaca

SEQ ID NO: 3034779 - DNA, 13 bp, Homo sapiens
ctgaatttcttct

SEQ ID NO: 3034780 - DNA, 15 bp, Homo sapiens
ctgaatttctttgat

SEQ ID NO: 3034781 - DNA, 18 bp, Homo sapiens
ctgaatttctttgattta

SEQ ID NO: 3034782 - DNA, 13 bp, Homo sapiens
ctgaatttgcaaa

SEQ ID NO: 3034783 - DNA, 15 bp, Homo sapiens
ctgaatttgcaaagt

SEQ ID NO: 3034784 - DNA, 19 bp, Homo sapiens
ctgaatttgcaaagtactg

SEQ ID NO: 3034785 - DNA, 16 bp, Homo sapiens
ctgaatttgccctggg

SEQ ID NO: 3034786 - DNA, 18 bp, Homo sapiens
ctgaatttgccctgggaa

SEQ ID NO: 3034787 - DNA, 20 bp, Homo sapiens
ctgaatttgtatatgactgc

SEQ ID NO: 3034788 - DNA, 15 bp, Homo sapiens
ctgacaacgtctctt

SEQ ID NO: 3034789 - DNA, 22 bp, Homo sapiens
ctgacaatggtgttatttgaaa

SEQ ID NO: 3034790 - DNA, 16 bp, Homo sapiens
ctgacaatgtattttg

SEQ ID NO: 3034791 - DNA, 16 bp, Homo sapiens
ctgacacatcagcatg

SEQ ID NO: 3034792 - DNA, 19 bp, Homo sapiens
ctgacacatcagcatgttt

SEQ ID NO: 3034793 - DNA, 14 bp, Homo sapiens
ctgacactcccacc

SEQ ID NO: 3034794 - DNA, 16 bp, Homo sapiens
ctgacacttcaaggtg

SEQ ID NO: 3034795 - DNA, 17 bp, Homo sapiens
ctgacagcagcctgtga

SEQ ID NO: 3034796 - DNA, 19 bp, Homo sapiens
ctgacagctgtccctgccc

SEQ ID NO: 3034797 - DNA, 15 bp, Homo sapiens
ctgacaggcagcctg

SEQ ID NO: 3034798 - DNA, 23 bp, Homo sapiens
ctgacaggcagcctggacataga

SEQ ID NO: 3034799 - DNA, 21 bp, Homo sapiens
ctgacagggacatgccctgtg

SEQ ID NO: 3034800 - DNA, 22 bp, Homo sapiens
ctgacagggacatgccctgtgt

SEQ ID NO: 3034801 - DNA, 16 bp, Homo sapiens
ctgacagtttttctgt

SEQ ID NO: 3034802 - DNA, 16 bp, Homo sapiens
ctgacattcacctgcc

SEQ ID NO: 3034803 - DNA, 23 bp, Homo sapiens
ctgacattcacctgccccaactc

SEQ ID NO: 3034804 - DNA, 19 bp, Homo sapiens
ctgacattctcaggaagcc

SEQ ID NO: 3034805 - DNA, 15 bp, Homo sapiens
ctgacattctgattc

SEQ ID NO: 3034806 - DNA, 20 bp, Homo sapiens
ctgacattgctccaagatgt

SEQ ID NO: 3034807 - DNA, 16 bp, Homo sapiens
ctgaccaacatggaga

SEQ ID NO: 3034808 - DNA, 14 bp, Homo sapiens
ctgaccacagcaca

SEQ ID NO: 3034809 - DNA, 14 bp, Homo sapiens
ctgaccagcagcgc

SEQ ID NO: 3034810 - DNA, 21 bp, Homo sapiens
ctgaccagcagcgcctttccc

SEQ ID NO: 3034811 - DNA, 15 bp, Homo sapiens
ctgaccatctgtgac

SEQ ID NO: 3034812 - DNA, 21 bp, Homo sapiens
ctgaccattttggatgtcatt

SEQ ID NO: 3034813 - DNA, 15 bp, Homo sapiens
ctgacccacagcctc

SEQ ID NO: 3034814 - DNA, 21 bp, Homo sapiens
ctgacccacagcctccaagtc

SEQ ID NO: 3034815 - DNA, 19 bp, Homo sapiens
ctgacccaccaaggtctca

SEQ ID NO: 3034816 - DNA, 12 bp, Homo sapiens
ctgacccagtcc

SEQ ID NO: 3034817 - DNA, 14 bp, Homo sapiens
ctgacccagtccct

SEQ ID NO: 3034818 - DNA, 15 bp, Homo sapiens
ctgacccagtccctg

SEQ ID NO: 3034819 - DNA, 12 bp, Homo sapiens
ctgacccagtgc

SEQ ID NO: 3034820 - DNA, 23 bp, Homo sapiens
ctgacccagtgcccccactgacc

SEQ ID NO: 3034821 - DNA, 19 bp, Homo sapiens
ctgaccccccccattagaa

SEQ ID NO: 3034822 - DNA, 23 bp, Homo sapiens
ctgaccccccccattagaatgtg

SEQ ID NO: 3034823 - DNA, 21 bp, Homo sapiens
ctgacccggattggccctgcc

SEQ ID NO: 3034824 - DNA, 14 bp, Homo sapiens
ctgaccctgggcct

SEQ ID NO: 3034825 - DNA, 19 bp, Homo sapiens
ctgaccctggggctggctt

SEQ ID NO: 3034826 - DNA, 12 bp, Homo sapiens
ctgaccctgtat

SEQ ID NO: 3034827 - DNA, 13 bp, Homo sapiens
ctgaccctgtata

SEQ ID NO: 3034828 - DNA, 20 bp, Homo sapiens
ctgaccctgtatatagccca

SEQ ID NO: 3034829 - DNA, 19 bp, Homo sapiens
ctgaccgctgcccaggtgg

SEQ ID NO: 3034830 - DNA, 18 bp, Homo sapiens
ctgaccgtgtacatagcc

SEQ ID NO: 3034831 - DNA, 15 bp, Homo sapiens
ctgacctcacctggt

SEQ ID NO: 3034832 - DNA, 18 bp, Homo sapiens
ctgacctcacctggtcct

SEQ ID NO: 3034833 - DNA, 20 bp, Homo sapiens
ctgacctcacctggtcctcc

SEQ ID NO: 3034834 - DNA, 21 bp, Homo sapiens
ctgacctcacctggtcctccg

SEQ ID NO: 3034835 - DNA, 13 bp, Homo sapiens
ctgacctccacag

SEQ ID NO: 3034836 - DNA, 16 bp, Homo sapiens
ctgacctccacagctt

SEQ ID NO: 3034837 - DNA, 18 bp, Homo sapiens
ctgacctccagtcctgct

SEQ ID NO: 3034838 - DNA, 21 bp, Homo sapiens
ctgacctccagtcctgctggc

SEQ ID NO: 3034839 - DNA, 20 bp, Homo sapiens
ctgacctgcgggtcctcagc

SEQ ID NO: 3034840 - DNA, 18 bp, Homo sapiens
ctgacctggtccacaggg

SEQ ID NO: 3034841 - DNA, 21 bp, Homo sapiens
ctgacctggtccacagggcac

SEQ ID NO: 3034842 - DNA, 12 bp, Homo sapiens
ctgacctgtcca

SEQ ID NO: 3034843 - DNA, 21 bp, Homo sapiens
ctgacgaacttccatggccct

SEQ ID NO: 3034844 - DNA, 15 bp, Homo sapiens
ctgacgccaataata

SEQ ID NO: 3034845 - DNA, 15 bp, Homo sapiens
ctgactaaaatgttt

SEQ ID NO: 3034846 - DNA, 12 bp, Homo sapiens
ctgactcagggc

SEQ ID NO: 3034847 - DNA, 16 bp, Homo sapiens
ctgactcattctgaag

SEQ ID NO: 3034848 - DNA, 16 bp, Homo sapiens
ctgactctctgagctg

SEQ ID NO: 3034849 - DNA, 20 bp, Homo sapiens
ctgactctctgagctgggga

SEQ ID NO: 3034850 - DNA, 21 bp, Homo sapiens
ctgactctctgagctggggag

SEQ ID NO: 3034851 - DNA, 18 bp, Homo sapiens
ctgactgcccagcatttg

SEQ ID NO: 3034852 - DNA, 14 bp, Homo sapiens
ctgactgggctggg

SEQ ID NO: 3034853 - DNA, 16 bp, Homo sapiens
ctgactgggctgggtt

SEQ ID NO: 3034854 - DNA, 23 bp, Homo sapiens
ctgactgggctgggtttgctgtc

SEQ ID NO: 3034855 - DNA, 20 bp, Homo sapiens
ctgactgtctcccgggacta

SEQ ID NO: 3034856 - DNA, 14 bp, Homo sapiens
ctgacttaggtttc

SEQ ID NO: 3034857 - DNA, 17 bp, Homo sapiens
ctgacttcatctcccac

SEQ ID NO: 3034858 - DNA, 14 bp, Homo sapiens
ctgacttgagtgtt

SEQ ID NO: 3034859 - DNA, 15 bp, Homo sapiens
ctgacttgagtgttc

SEQ ID NO: 3034860 - DNA, 22 bp, Homo sapiens
ctgacttgagtgttccttttta

SEQ ID NO: 3034861 - DNA, 13 bp, Homo sapiens
ctgacttgcttta

SEQ ID NO: 3034862 - DNA, 20 bp, Homo sapiens
ctgacttggatcccaaagca

SEQ ID NO: 3034863 - DNA, 21 bp, Homo sapiens
ctgacttggatcccaaagcaa

SEQ ID NO: 3034864 - DNA, 15 bp, Homo sapiens
ctgactttttgtttc

SEQ ID NO: 3034865 - DNA, 24 bp, Homo sapiens
ctgcttgtactaagccaggaggct

SEQ ID NO: 3034866 - DNA, 14 bp, Homo sapiens
ctgcttgtgcctcc

SEQ ID NO: 3034867 - DNA, 13 bp, Homo sapiens
ctgctttctcccc

SEQ ID NO: 3034868 - DNA, 12 bp, Homo sapiens
ctgctttctctt

SEQ ID NO: 3034869 - DNA, 19 bp, Homo sapiens
ctgctttctgatgttgcct

SEQ ID NO: 3034870 - DNA, 17 bp, Homo sapiens
ctgctttctgttcatct

SEQ ID NO: 3034871 - DNA, 18 bp, Homo sapiens
ctgctttctgttcatctc

SEQ ID NO: 3034872 - DNA, 23 bp, Homo sapiens
ctgctttgacgggccaggccctg

SEQ ID NO: 3034873 - DNA, 22 bp, Homo sapiens
ctgctttgcctcgaaagtgtca

SEQ ID NO: 3034874 - DNA, 13 bp, Homo sapiens
ctgcttttatatc

SEQ ID NO: 3034875 - DNA, 22 bp, Homo sapiens
ctgcttttatgtagtttaggct

SEQ ID NO: 3034876 - DNA, 23 bp, Homo sapiens
ctgcttttccttggggcaggcag

SEQ ID NO: 3034877 - DNA, 20 bp, Homo sapiens
ctgcttttgcccatataaaa

SEQ ID NO: 3034878 - DNA, 15 bp, Homo sapiens
ctgcttttggcctgg

SEQ ID NO: 3034879 - DNA, 12 bp, Homo sapiens
ctggaaaaatga

SEQ ID NO: 3034880 - DNA, 23 bp, Homo sapiens
ctggaaaatctgtaaaaaagaaa

SEQ ID NO: 3034881 - DNA, 21 bp, Homo sapiens
ctggaaacagaggtaaaaaaa

SEQ ID NO: 3034882 - DNA, 14 bp, Homo sapiens
ctggaaaccaagtc

SEQ ID NO: 3034883 - DNA, 22 bp, Homo sapiens
ctggaaaccaagtcaggccagg

SEQ ID NO: 3034884 - DNA, 23 bp, Homo sapiens
ctggaaaccaagtcaggccaggt

SEQ ID NO: 3034885 - DNA, 23 bp, Homo sapiens
ctggaaaggaaagatgatgctca

SEQ ID NO: 3034886 - DNA, 15 bp, Homo sapiens
ctggaaatctggatt

SEQ ID NO: 3034887 - DNA, 20 bp, Homo sapiens
ctggaaatctggattttcag

SEQ ID NO: 3034888 - DNA, 21 bp, Homo sapiens
ctggaaatgtaaaattgaaaa

SEQ ID NO: 3034889 - DNA, 13 bp, Homo sapiens
ctggaacccagac

SEQ ID NO: 3034890 - DNA, 16 bp, Homo sapiens
ctggaacccagactca

SEQ ID NO: 3034891 - DNA, 16 bp, Homo sapiens
ctggaacctcagcctg

SEQ ID NO: 3034892 - DNA, 22 bp, Homo sapiens
ctggaacctcagcctggccaga

SEQ ID NO: 3034893 - DNA, 15 bp, Homo sapiens
ctggaacctgcaaaa

SEQ ID NO: 3034894 - DNA, 18 bp, Homo sapiens
ctggaacctgcaaaaaat

SEQ ID NO: 3034895 - DNA, 21 bp, Homo sapiens
ctggaacctgcaaaaaatact

SEQ ID NO: 3034896 - DNA, 14 bp, Homo sapiens
ctggaagaaccact

SEQ ID NO: 3034897 - DNA, 11 bp, Homo sapiens
ctggaagaagc

SEQ ID NO: 3034898 - DNA, 15 bp, Homo sapiens
ctggaagaagcagcg

SEQ ID NO: 3034899 - DNA, 14 bp, Homo sapiens
ctggaagcagagca

SEQ ID NO: 3034900 - DNA, 15 bp, Homo sapiens
ctggaagcagagcaa

SEQ ID NO: 3034901 - DNA, 16 bp, Homo sapiens
ctggaagcagagcaaa

SEQ ID NO: 3034902 - DNA, 18 bp, Homo sapiens
ctggaagcagagcaaaat

SEQ ID NO: 3034903 - DNA, 17 bp, Homo sapiens
ctggaagctaatttgca

SEQ ID NO: 3034904 - DNA, 18 bp, Homo sapiens
ctggaagctaatttgcat

SEQ ID NO: 3034905 - DNA, 20 bp, Homo sapiens
ctggaagctggagggtgcta

SEQ ID NO: 3034906 - DNA, 16 bp, Homo sapiens
ctggaagctgtgtcct

SEQ ID NO: 3034907 - DNA, 14 bp, Homo sapiens
ctggaagctttgtc

SEQ ID NO: 3034908 - DNA, 15 bp, Homo sapiens
ctggaagctttgtcc

SEQ ID NO: 3034909 - DNA, 21 bp, Homo sapiens
ctggaagctttgtcccctgct

SEQ ID NO: 3034910 - DNA, 22 bp, Homo sapiens
ctggaagctttgtcccctgctt

SEQ ID NO: 3034911 - DNA, 15 bp, Homo sapiens
ctggaaggagcacat

SEQ ID NO: 3034912 - DNA, 19 bp, Homo sapiens
ctggaaggggcccgtggga

SEQ ID NO: 3034913 - DNA, 23 bp, Homo sapiens
ctggaagtcatctcattccactg

SEQ ID NO: 3034914 - DNA, 19 bp, Homo sapiens
ctggaatctggagaccagg

SEQ ID NO: 3034915 - DNA, 24 bp, Homo sapiens
ctggaatctggagaccagggagcc

SEQ ID NO: 3034916 - DNA, 13 bp, Homo sapiens
ctggaatgaggga

SEQ ID NO: 3034917 - DNA, 14 bp, Homo sapiens
ctggaatgagggag

SEQ ID NO: 3034918 - DNA, 20 bp, Homo sapiens
ctggaattagcttggggcca

SEQ ID NO: 3034919 - DNA, 23 bp, Homo sapiens
ctggaattcctaacttttcaatg

SEQ ID NO: 3034920 - DNA, 19 bp, Homo sapiens
ctggaatttacctcccctt

SEQ ID NO: 3034921 - DNA, 17 bp, Homo sapiens
ctggacacttctttata

SEQ ID NO: 3034922 - DNA, 17 bp, Homo sapiens
ctggacagatggacgca

SEQ ID NO: 3034923 - DNA, 21 bp, Homo sapiens
ctggacagatggacgcaggcc

SEQ ID NO: 3034924 - DNA, 13 bp, Homo sapiens
ctggacagcccca

SEQ ID NO: 3034925 - DNA, 15 bp, Homo sapiens
ctggacagccccacc

SEQ ID NO: 3034926 - DNA, 17 bp, Homo sapiens
ctggacatagagaggga

SEQ ID NO: 3034927 - DNA, 18 bp, Homo sapiens
ctggaccagcctctccac

SEQ ID NO: 3034928 - DNA, 14 bp, Homo sapiens
ctggaccaggtcct

SEQ ID NO: 3034929 - DNA, 21 bp, Homo sapiens
ctggaccagtggtctcacatg

SEQ ID NO: 3034930 - DNA, 15 bp, Homo sapiens
ctggaccccctgccc

SEQ ID NO: 3034931 - DNA, 19 bp, Homo sapiens
ctggaccccctgcccgcca

SEQ ID NO: 3034932 - DNA, 20 bp, Homo sapiens
ctggacctagggtggcctga

SEQ ID NO: 3034933 - DNA, 13 bp, Homo sapiens
ctggacctctctt

SEQ ID NO: 3034934 - DNA, 15 bp, Homo sapiens
ctggacctgtatatt

SEQ ID NO: 3034935 - DNA, 16 bp, Homo sapiens
ctggacctgtatattt

SEQ ID NO: 3034936 - DNA, 14 bp, Homo sapiens
ctggaccttgacag

SEQ ID NO: 3034937 - DNA, 19 bp, Homo sapiens
ctggaccttgacagagcag

SEQ ID NO: 3034938 - DNA, 20 bp, Homo sapiens
ctggacgaagagcaggccag

SEQ ID NO: 3034939 - DNA, 22 bp, Homo sapiens
ctggacggggtcggacggggca

SEQ ID NO: 3034940 - DNA, 22 bp, Homo sapiens
ctggactagggcctcggaggct

SEQ ID NO: 3034941 - DNA, 15 bp, Homo sapiens
ctggactccggccct

SEQ ID NO: 3034942 - DNA, 20 bp, Homo sapiens
ctggactcctgccaccagca

SEQ ID NO: 3034943 - DNA, 14 bp, Homo sapiens
ctggactctcagtc

SEQ ID NO: 3034944 - DNA, 21 bp, Homo sapiens
ctggactctcagtctctgagc

SEQ ID NO: 3034945 - DNA, 13 bp, Homo sapiens
ctggacttggagg

SEQ ID NO: 3034946 - DNA, 20 bp, Homo sapiens
ctggagacagaaccagcaga

SEQ ID NO: 3034947 - DNA, 17 bp, Homo sapiens
ctggagaccagggagcc

SEQ ID NO: 3034948 - DNA, 17 bp, Homo sapiens
ctggagactaaccccac

SEQ ID NO: 3034949 - DNA, 19 bp, Homo sapiens
ctggagagcgaggaggcgc

SEQ ID NO: 3034950 - DNA, 21 bp, Homo sapiens
ctggagagcgaggaggcgcgg

SEQ ID NO: 3034951 - DNA, 23 bp, Homo sapiens
ctggagatattataagggagagc

SEQ ID NO: 3034952 - DNA, 13 bp, Homo sapiens
ctggagcaccagg

SEQ ID NO: 3034953 - DNA, 18 bp, Homo sapiens
ctggagcagaaagtgcct

SEQ ID NO: 3034954 - DNA, 16 bp, Homo sapiens
ctggagcatggacagt

SEQ ID NO: 3034955 - DNA, 17 bp, Homo sapiens
ctggagcatggacagtg

SEQ ID NO: 3034956 - DNA, 14 bp, Homo sapiens
ctggagccacaggc

SEQ ID NO: 3034957 - DNA, 15 bp, Homo sapiens
ctggagccacaggca

SEQ ID NO: 3034958 - DNA, 21 bp, Homo sapiens
ctggagccatgggcacaaagg

SEQ ID NO: 3034959 - DNA, 13 bp, Homo sapiens
ctggagcccaggg

SEQ ID NO: 3034960 - DNA, 20 bp, Homo sapiens
ctggagcccgcactgtccca

SEQ ID NO: 3034961 - DNA, 15 bp, Homo sapiens
ctggagctgggaggt

SEQ ID NO: 3034962 - DNA, 22 bp, Homo sapiens
ctggaggatcccctccaagcct

SEQ ID NO: 3034963 - DNA, 13 bp, Homo sapiens
ctggaggcagggc

SEQ ID NO: 3034964 - DNA, 19 bp, Homo sapiens
ctggaggcagggccttgcc

SEQ ID NO: 3034965 - DNA, 20 bp, Homo sapiens
ctggaggcagggccttgccc

SEQ ID NO: 3034966 - DNA, 14 bp, Homo sapiens
ctggaggcccaggc

SEQ ID NO: 3034967 - DNA, 19 bp, Homo sapiens
ctggaggcccaggctggga

SEQ ID NO: 3034968 - DNA, 14 bp, Homo sapiens
ctggaggcccagtt

SEQ ID NO: 3034969 - DNA, 21 bp, Homo sapiens
ctggagggcgcccagcagcct

SEQ ID NO: 3034970 - DNA, 22 bp, Homo sapiens
ctggagggcgcccagcagcctg

SEQ ID NO: 3034971 - DNA, 18 bp, Homo sapiens
ctggagggggagcaccag

SEQ ID NO: 3034972 - DNA, 21 bp, Homo sapiens
ctggaggggtcatccttgccc

SEQ ID NO: 3034973 - DNA, 17 bp, Homo sapiens
ctggaggtctgaaaaga

SEQ ID NO: 3034974 - DNA, 22 bp, Homo sapiens
ctggaggttgataactttgctt

SEQ ID NO: 3034975 - DNA, 19 bp, Homo sapiens
ctggagtatttggaagcaa

SEQ ID NO: 3034976 - DNA, 16 bp, Homo sapiens
ctggagtgagcactca

SEQ ID NO: 3034977 - DNA, 22 bp, Homo sapiens
ctggagtgtgtcagagcccagg

SEQ ID NO: 3034978 - DNA, 15 bp, Homo sapiens
ctggagttgatctgg

SEQ ID NO: 3034979 - DNA, 15 bp, Homo sapiens
ctggagttgcattga

SEQ ID NO: 3034980 - DNA, 13 bp, Homo sapiens
ctggagtttcatg

SEQ ID NO: 3034981 - DNA, 22 bp, Homo sapiens
ctggagtttcatgtacaagatg

SEQ ID NO: 3034982 - DNA, 14 bp, Homo sapiens
ctggagtttgggat

SEQ ID NO: 3034983 - DNA, 20 bp, Homo sapiens
ctggataaaaaagaaaacat

SEQ ID NO: 3034984 - DNA, 20 bp, Homo sapiens
ctggataagtgaccacagaa

SEQ ID NO: 3034985 - DNA, 20 bp, Homo sapiens
ctggatacagtataaaaata

SEQ ID NO: 3034986 - DNA, 17 bp, Homo sapiens
ctggatagccttgaaaa

SEQ ID NO: 3034987 - DNA, 19 bp, Homo sapiens
ctggatagccttgaaaaca

SEQ ID NO: 3034988 - DNA, 20 bp, Homo sapiens
ctggatagccttgaaaacaa

SEQ ID NO: 3034989 - DNA, 23 bp, Homo sapiens
ctggatagccttgaaaacaaaca

SEQ ID NO: 3034990 - DNA, 19 bp, Homo sapiens
ctggatcccatcaaagaac

SEQ ID NO: 3034991 - DNA, 17 bp, Homo sapiens
ctggatccttcccaagg

SEQ ID NO: 3034992 - DNA, 22 bp, Homo sapiens
ctggatccttcccaaggtacag

SEQ ID NO: 3034993 - DNA, 23 bp, Homo sapiens
ctggatccttcccaaggtacagc

SEQ ID NO: 3034994 - DNA, 20 bp, Homo sapiens
ctggatctgggaccctttcc

SEQ ID NO: 3034995 - DNA, 21 bp, Homo sapiens
ctggatctgggaccctttcct

SEQ ID NO: 3034996 - DNA, 15 bp, Homo sapiens
ctgtcatctgtgcac

SEQ ID NO: 3034997 - DNA, 21 bp, Homo sapiens
ctgtcatctgtgcactgccca

SEQ ID NO: 3034998 - DNA, 14 bp, Homo sapiens
ctgtcatgcttcat

SEQ ID NO: 3034999 - DNA, 22 bp, Homo sapiens
ctgtcattcccctcttttgtct

SEQ ID NO: 3035000 - DNA, 14 bp, Homo sapiens
ctgtcatttacaca

SEQ ID NO: 3035001 - DNA, 23 bp, Homo sapiens
ctgtcattttggcatctgcaaag

SEQ ID NO: 3035002 - DNA, 16 bp, Homo sapiens
ctgtccaacatggtga

SEQ ID NO: 3035003 - DNA, 16 bp, Homo sapiens
ctgtccaacctaaccc

SEQ ID NO: 3035004 - DNA, 20 bp, Homo sapiens
ctgtccaacctaaccccttt

SEQ ID NO: 3035005 - DNA, 19 bp, Homo sapiens
ctgtccacttgtgggtcct

SEQ ID NO: 3035006 - DNA, 23 bp, Homo sapiens
ctgtccacttgtgggtcctgggg

SEQ ID NO: 3035007 - DNA, 14 bp, Homo sapiens
ctgtccagccccca

SEQ ID NO: 3035008 - DNA, 18 bp, Homo sapiens
ctgtccagcccccagtgc

SEQ ID NO: 3035009 - DNA, 17 bp, Homo sapiens
ctgtccagctccaacct

SEQ ID NO: 3035010 - DNA, 18 bp, Homo sapiens
ctgtccagctccaacctg

SEQ ID NO: 3035011 - DNA, 21 bp, Homo sapiens
ctgtccagctccaacctgcaa

SEQ ID NO: 3035012 - DNA, 16 bp, Homo sapiens
ctgtccaggcactgag

SEQ ID NO: 3035013 - DNA, 20 bp, Homo sapiens
ctgtccaggtgagtgtgagg

SEQ ID NO: 3035014 - DNA, 20 bp, Homo sapiens
ctgtccatcctcctctccat

SEQ ID NO: 3035015 - DNA, 21 bp, Homo sapiens
ctgtccatcctcctctccatg

SEQ ID NO: 3035016 - DNA, 17 bp, Homo sapiens
ctgtccatctgcccgcc

SEQ ID NO: 3035017 - DNA, 23 bp, Homo sapiens
ctgtccatctgcccgcctgccca

SEQ ID NO: 3035018 - DNA, 14 bp, Homo sapiens
ctgtcccaagctcc

SEQ ID NO: 3035019 - DNA, 18 bp, Homo sapiens
ctgtcccaggactcaccc

SEQ ID NO: 3035020 - DNA, 16 bp, Homo sapiens
ctgtccccaggcctgg

SEQ ID NO: 3035021 - DNA, 19 bp, Homo sapiens
ctgtccccaggcctggctc

SEQ ID NO: 3035022 - DNA, 17 bp, Homo sapiens
ctgtccccgccttccct

SEQ ID NO: 3035023 - DNA, 19 bp, Homo sapiens
ctgtccccgccttccctca

SEQ ID NO: 3035024 - DNA, 13 bp, Homo sapiens
ctgtcccctcaca

SEQ ID NO: 3035025 - DNA, 19 bp, Homo sapiens
ctgtcccctcacagactct

SEQ ID NO: 3035026 - DNA, 13 bp, Homo sapiens
ctgtcccctcagc

SEQ ID NO: 3035027 - DNA, 19 bp, Homo sapiens
ctgtcccctgcgaggagaa

SEQ ID NO: 3035028 - DNA, 14 bp, Homo sapiens
ctgtcccctggagt

SEQ ID NO: 3035029 - DNA, 12 bp, Homo sapiens
ctgtcccctggg

SEQ ID NO: 3035030 - DNA, 14 bp, Homo sapiens
ctgtcccctggggc

SEQ ID NO: 3035031 - DNA, 18 bp, Homo sapiens
ctgtcccctggggctggt

SEQ ID NO: 3035032 - DNA, 13 bp, Homo sapiens
ctgtccctcctgg

SEQ ID NO: 3035033 - DNA, 15 bp, Homo sapiens
ctgtccctcctggtg

SEQ ID NO: 3035034 - DNA, 16 bp, Homo sapiens
ctgtccctctcagtgc

SEQ ID NO: 3035035 - DNA, 17 bp, Homo sapiens
ctgtccctctcagtgcc

SEQ ID NO: 3035036 - DNA, 18 bp, Homo sapiens
ctgtccctctcagtgcct

SEQ ID NO: 3035037 - DNA, 15 bp, Homo sapiens
ctgtccctgcccttc

SEQ ID NO: 3035038 - DNA, 16 bp, Homo sapiens
ctgtccctgcccttct

SEQ ID NO: 3035039 - DNA, 21 bp, Homo sapiens
ctgtccggaatgccacccaca

SEQ ID NO: 3035040 - DNA, 15 bp, Homo sapiens
ctgtccgtccagagc

SEQ ID NO: 3035041 - DNA, 18 bp, Homo sapiens
ctgtcctcacgccccctg

SEQ ID NO: 3035042 - DNA, 21 bp, Homo sapiens
ctgtcctcagccttgccagag

SEQ ID NO: 3035043 - DNA, 15 bp, Homo sapiens
ctgtcctcaggtggc

SEQ ID NO: 3035044 - DNA, 17 bp, Homo sapiens
ctgtcctcaggtggcca

SEQ ID NO: 3035045 - DNA, 23 bp, Homo sapiens
ctgtcctcctcggatcaccgaga

SEQ ID NO: 3035046 - DNA, 15 bp, Homo sapiens
ctgtcctcttctgca

SEQ ID NO: 3035047 - DNA, 13 bp, Homo sapiens
ctgtcctgggcct

SEQ ID NO: 3035048 - DNA, 14 bp, Homo sapiens
ctgtcctgggcctg

SEQ ID NO: 3035049 - DNA, 12 bp, Homo sapiens
ctgtcctggtgg

SEQ ID NO: 3035050 - DNA, 19 bp, Homo sapiens
ctgtcctggtggctgggcc

SEQ ID NO: 3035051 - DNA, 21 bp, Homo sapiens
ctgtcctggtggctgggccca

SEQ ID NO: 3035052 - DNA, 20 bp, Homo sapiens
ctgtcctgtgaggtttccca

SEQ ID NO: 3035053 - DNA, 21 bp, Homo sapiens
ctgtcctgttaggccaactgc

SEQ ID NO: 3035054 - DNA, 17 bp, Homo sapiens
ctgtccttacccatctg

SEQ ID NO: 3035055 - DNA, 17 bp, Homo sapiens
ctgtccttactcagagc

SEQ ID NO: 3035056 - DNA, 18 bp, Homo sapiens
ctgtccttactcagagct

SEQ ID NO: 3035057 - DNA, 21 bp, Homo sapiens
ctgtccttactcagagctgcg

SEQ ID NO: 3035058 - DNA, 24 bp, Homo sapiens
ctgtccttactcagagctgcgggc

SEQ ID NO: 3035059 - DNA, 17 bp, Homo sapiens
ctgtccttggcaacttt

SEQ ID NO: 3035060 - DNA, 17 bp, Homo sapiens
ctgtcgattagactgga

SEQ ID NO: 3035061 - DNA, 19 bp, Homo sapiens
ctgtcgattagactggaca

SEQ ID NO: 3035062 - DNA, 13 bp, Homo sapiens
ctgtcggaggaaa

SEQ ID NO: 3035063 - DNA, 15 bp, Homo sapiens
ctgtcggaggaaaga

SEQ ID NO: 3035064 - DNA, 18 bp, Homo sapiens
ctgtcgggggccactgtg

SEQ ID NO: 3035065 - DNA, 17 bp, Homo sapiens
ctgtcggtggctgcctt

SEQ ID NO: 3035066 - DNA, 15 bp, Homo sapiens
ctgtctaacctgtga

SEQ ID NO: 3035067 - DNA, 23 bp, Homo sapiens
ctgtctaagcagttttgtaaatg

SEQ ID NO: 3035068 - DNA, 17 bp, Homo sapiens
ctgtctactttctcttg

SEQ ID NO: 3035069 - DNA, 15 bp, Homo sapiens
ctgtctagactggcc

SEQ ID NO: 3035070 - DNA, 16 bp, Homo sapiens
ctgtctagagagggag

SEQ ID NO: 3035071 - DNA, 18 bp, Homo sapiens
ctgtctagagagggaggc

SEQ ID NO: 3035072 - DNA, 12 bp, Homo sapiens
ctgtctagagta

SEQ ID NO: 3035073 - DNA, 15 bp, Homo sapiens
ctgtctagcatgcca

SEQ ID NO: 3035074 - DNA, 15 bp, Homo sapiens
ctgtctagccttagt

SEQ ID NO: 3035075 - DNA, 16 bp, Homo sapiens
ctgtctcaatagctcc

SEQ ID NO: 3035076 - DNA, 16 bp, Homo sapiens
ctgtctcatccatcat

SEQ ID NO: 3035077 - DNA, 20 bp, Homo sapiens
ctgtctcatccatcatcatg

SEQ ID NO: 3035078 - DNA, 17 bp, Homo sapiens
ctgtctcccctaccagg

SEQ ID NO: 3035079 - DNA, 17 bp, Homo sapiens
ctgtctcgccagaagac

SEQ ID NO: 3035080 - DNA, 11 bp, Homo sapiens
ctgtctctccc

SEQ ID NO: 3035081 - DNA, 11 bp, Homo sapiens
ctgtctctctc

SEQ ID NO: 3035082 - DNA, 19 bp, Homo sapiens
ctgtctctcttgtcacatg

SEQ ID NO: 3035083 - DNA, 12 bp, Homo sapiens
ctgtctctgtgg

SEQ ID NO: 3035084 - DNA, 14 bp, Homo sapiens
ctgtctgaacaaaa

SEQ ID NO: 3035085 - DNA, 15 bp, Homo sapiens
ctgtctgcagccttg

SEQ ID NO: 3035086 - DNA, 19 bp, Homo sapiens
ctgtctggatccttcccaa

SEQ ID NO: 3035087 - DNA, 14 bp, Homo sapiens
ctgtctgtacctaa

SEQ ID NO: 3035088 - DNA, 16 bp, Homo sapiens
ctgtctgtcatctgct

SEQ ID NO: 3035089 - DNA, 15 bp, Homo sapiens
ctgtctgtccaaccc

SEQ ID NO: 3035090 - DNA, 18 bp, Homo sapiens
ctgtctgtccaacccctc

SEQ ID NO: 3035091 - DNA, 23 bp, Homo sapiens
ctgtctgtccaacccctccccca

SEQ ID NO: 3035092 - DNA, 13 bp, Homo sapiens
ctgtctgtctctc

SEQ ID NO: 3035093 - DNA, 14 bp, Homo sapiens
ctgtctgtctctcc

SEQ ID NO: 3035094 - DNA, 17 bp, Homo sapiens
ctgtcttcacctgattc

SEQ ID NO: 3035095 - DNA, 20 bp, Homo sapiens
ctgtcttcaggctctgccca

SEQ ID NO: 3035096 - DNA, 14 bp, Homo sapiens
ctgtcttctctcca

SEQ ID NO: 3035097 - DNA, 13 bp, Homo sapiens
ctgtcttctggac

SEQ ID NO: 3035098 - DNA, 14 bp, Homo sapiens
ctgtcttctggact

SEQ ID NO: 3035099 - DNA, 19 bp, Homo sapiens
ctgtcttctgtatataaat

SEQ ID NO: 3035100 - DNA, 14 bp, Homo sapiens
ctgtcttgctcctg

SEQ ID NO: 3035101 - DNA, 18 bp, Homo sapiens
ctgtcttgctcctgggga

SEQ ID NO: 3035102 - DNA, 16 bp, Homo sapiens
ctgtctttgcagggca

SEQ ID NO: 3035103 - DNA, 17 bp, Homo sapiens
ctgtctttgcagggcac

SEQ ID NO: 3035104 - DNA, 22 bp, Homo sapiens
ctgtctttgcggggcctgtctc

SEQ ID NO: 3035105 - DNA, 18 bp, Homo sapiens
ctgtctttgtggactgtg

SEQ ID NO: 3035106 - DNA, 13 bp, Homo sapiens
ctgtctttttcct

SEQ ID NO: 3035107 - DNA, 21 bp, Homo sapiens
ctgtgaaaaaaccgttcaaat

SEQ ID NO: 3035108 - DNA, 19 bp, Homo sapiens
ctgtgaaccaacccccatc

SEQ ID NO: 3035109 - DNA, 11 bp, Homo sapiens
ctgtgaagaag

SEQ ID NO: 3035110 - DNA, 14 bp, Homo sapiens
ctgtgaagatctca

SEQ ID NO: 3035111 - DNA, 20 bp, Homo sapiens
ctgtgaagatctcactctgc

SEQ ID NO: 3035112 - DNA, 21 bp, Homo sapiens
ctgtgaagatctcactctgcc

SEQ ID NO: 3035113 - DNA, 23 bp, Homo sapiens
ctgtgaagcattcgagacagaac

SEQ ID NO: 3035114 - DNA, 17 bp, Homo sapiens
ctgtgaagccctttgcc

SEQ ID NO: 3035115 - DNA, 16 bp, Homo sapiens
ctgtgaataaaaagaa

SEQ ID NO: 3035116 - DNA, 21 bp, Homo sapiens
ctgtgaatcctggcaagaaag

SEQ ID NO: 3035117 - DNA, 16 bp, Homo sapiens
ctgtgaatgcttctga

SEQ ID NO: 3035118 - DNA, 21 bp, Homo sapiens
ctgtgacacactacaccacac

SEQ ID NO: 3035119 - DNA, 19 bp, Homo sapiens
ctgtgacattgctggtcat

SEQ ID NO: 3035120 - DNA, 23 bp, Homo sapiens
ctgtgaccagtctgacccttaca

SEQ ID NO: 3035121 - DNA, 16 bp, Homo sapiens
ctgtgacccccagctc

SEQ ID NO: 3035122 - DNA, 15 bp, Homo sapiens
ctgtgaccctctcac

SEQ ID NO: 3035123 - DNA, 13 bp, Homo sapiens
ctgtgaccttggg

SEQ ID NO: 3035124 - DNA, 20 bp, Homo sapiens
ctgtgaccttgggaccaaag

SEQ ID NO: 3035125 - DNA, 15 bp, Homo sapiens
ctgtgactataaagc

SEQ ID NO: 3035126 - DNA, 19 bp, Homo sapiens
ctgtgactataaagctgtt

SEQ ID NO: 3035127 - DNA, 19 bp, Homo sapiens
ctgtgactctgggcaggga

SEQ ID NO: 3035128 - DNA, 15 bp, Homo sapiens
ctgtgagacagtggg

SEQ ID NO: 3035129 - DNA, 19 bp, Homo sapiens
cttatccttcatcttttaa

SEQ ID NO: 3035130 - DNA, 14 bp, Homo sapiens
cttatctccaagac

SEQ ID NO: 3035131 - DNA, 15 bp, Homo sapiens
cttatctccctgctt

SEQ ID NO: 3035132 - DNA, 20 bp, Homo sapiens
cttatctgagctgagccagg

SEQ ID NO: 3035133 - DNA, 21 bp, Homo sapiens
cttatctgagctgagccaggc

SEQ ID NO: 3035134 - DNA, 12 bp, Homo sapiens
cttatgaatgtt

SEQ ID NO: 3035135 - DNA, 15 bp, Homo sapiens
cttatgaatgtttcc

SEQ ID NO: 3035136 - DNA, 17 bp, Homo sapiens
cttatgaatgtttccgg

SEQ ID NO: 3035137 - DNA, 14 bp, Homo sapiens
cttatggaacaggg

SEQ ID NO: 3035138 - DNA, 20 bp, Homo sapiens
cttatggaattgatttgcat

SEQ ID NO: 3035139 - DNA, 23 bp, Homo sapiens
cttatggaattgatttgcattga

SEQ ID NO: 3035140 - DNA, 19 bp, Homo sapiens
cttatgtttcttattctct

SEQ ID NO: 3035141 - DNA, 22 bp, Homo sapiens
cttattaagttcgaacatgttt

SEQ ID NO: 3035142 - DNA, 16 bp, Homo sapiens
cttattacataactga

SEQ ID NO: 3035143 - DNA, 17 bp, Homo sapiens
cttattacataactgat

SEQ ID NO: 3035144 - DNA, 14 bp, Homo sapiens
cttattacatttaa

SEQ ID NO: 3035145 - DNA, 20 bp, Homo sapiens
cttattagagtgtctttcca

SEQ ID NO: 3035146 - DNA, 15 bp, Homo sapiens
cttattcaaagatga

SEQ ID NO: 3035147 - DNA, 12 bp, Homo sapiens
cttattcacttt

SEQ ID NO: 3035148 - DNA, 13 bp, Homo sapiens
cttattcactttt

SEQ ID NO: 3035149 - DNA, 20 bp, Homo sapiens
cttattccacagatatcttt

SEQ ID NO: 3035150 - DNA, 18 bp, Homo sapiens
cttattctctgtttgctt

SEQ ID NO: 3035151 - DNA, 13 bp, Homo sapiens
cttattcttttat

SEQ ID NO: 3035152 - DNA, 19 bp, Homo sapiens
cttattgcctgggcagtgc

SEQ ID NO: 3035153 - DNA, 19 bp, Homo sapiens
cttattgtgtgcgctgcct

SEQ ID NO: 3035154 - DNA, 21 bp, Homo sapiens
cttatttaaaaatatttcaga

SEQ ID NO: 3035155 - DNA, 18 bp, Homo sapiens
cttatttagaaaaaaggg

SEQ ID NO: 3035156 - DNA, 12 bp, Homo sapiens
cttcaaaacatt

SEQ ID NO: 3035157 - DNA, 15 bp, Homo sapiens
cttcaaaagtaatgc

SEQ ID NO: 3035158 - DNA, 16 bp, Homo sapiens
cttcaaaagtattttc

SEQ ID NO: 3035159 - DNA, 22 bp, Homo sapiens
cttcaaaatgttatcttctcaa

SEQ ID NO: 3035160 - DNA, 16 bp, Homo sapiens
cttcaaatgcctgact

SEQ ID NO: 3035161 - DNA, 13 bp, Homo sapiens
cttcaaattaaag

SEQ ID NO: 3035162 - DNA, 24 bp, Homo sapiens
cttcaacagaccccctctagaaat

SEQ ID NO: 3035163 - DNA, 15 bp, Homo sapiens
cttcaacatttacat

SEQ ID NO: 3035164 - DNA, 16 bp, Homo sapiens
cttcaacgtttcttca

SEQ ID NO: 3035165 - DNA, 19 bp, Homo sapiens
cttcaacgtttcttcactt

SEQ ID NO: 3035166 - DNA, 22 bp, Homo sapiens
cttcaacgtttcttcacttttg

SEQ ID NO: 3035167 - DNA, 22 bp, Homo sapiens
cttcaagaatcagaagaaaggc

SEQ ID NO: 3035168 - DNA, 21 bp, Homo sapiens
cttcaagcatcctcagaagcc

SEQ ID NO: 3035169 - DNA, 14 bp, Homo sapiens
cttcaaggcttcag

SEQ ID NO: 3035170 - DNA, 15 bp, Homo sapiens
cttcaaggcttcagt

SEQ ID NO: 3035171 - DNA, 17 bp, Homo sapiens
cttcaaggcttcagtct

SEQ ID NO: 3035172 - DNA, 15 bp, Homo sapiens
cttcaaggtgacaga

SEQ ID NO: 3035173 - DNA, 23 bp, Homo sapiens
cttcaaggtgacagaaggaccag

SEQ ID NO: 3035174 - DNA, 18 bp, Homo sapiens
cttcaagtgagtggcatg

SEQ ID NO: 3035175 - DNA, 16 bp, Homo sapiens
cttcaataattgtcca

SEQ ID NO: 3035176 - DNA, 15 bp, Homo sapiens
cttcaatctcgttta

SEQ ID NO: 3035177 - DNA, 15 bp, Homo sapiens
cttcacactgcaaga

SEQ ID NO: 3035178 - DNA, 20 bp, Homo sapiens
cttcacagtgacactggacc

SEQ ID NO: 3035179 - DNA, 21 bp, Homo sapiens
cttcacagtgacactggacca

SEQ ID NO: 3035180 - DNA, 22 bp, Homo sapiens
cttcaccagaggaatcactctt

SEQ ID NO: 3035181 - DNA, 18 bp, Homo sapiens
cttcaccatggatcctgg

SEQ ID NO: 3035182 - DNA, 15 bp, Homo sapiens
cttcacccaggccta

SEQ ID NO: 3035183 - DNA, 20 bp, Homo sapiens
cttcacctgattcaactaaa

SEQ ID NO: 3035184 - DNA, 19 bp, Homo sapiens
cttcactgcaattttgtgt

SEQ ID NO: 3035185 - DNA, 15 bp, Homo sapiens
cttcactgctacatg

SEQ ID NO: 3035186 - DNA, 16 bp, Homo sapiens
cttcactggcgccttc

SEQ ID NO: 3035187 - DNA, 17 bp, Homo sapiens
cttcactggcgccttct

SEQ ID NO: 3035188 - DNA, 15 bp, Homo sapiens
cttcactgtaaaata

SEQ ID NO: 3035189 - DNA, 17 bp, Homo sapiens
cttcactgtcctccaag

SEQ ID NO: 3035190 - DNA, 14 bp, Homo sapiens
cttcacttcctcca

SEQ ID NO: 3035191 - DNA, 16 bp, Homo sapiens
cttcagaacagaggca

SEQ ID NO: 3035192 - DNA, 23 bp, Homo sapiens
cttcagaggccctcgctgccagc

SEQ ID NO: 3035193 - DNA, 23 bp, Homo sapiens
cttcagagtttgtcatatactgc

SEQ ID NO: 3035194 - DNA, 17 bp, Homo sapiens
cttcagatcagtgcttg

SEQ ID NO: 3035195 - DNA, 18 bp, Homo sapiens
cttcagatgtggagccag

SEQ ID NO: 3035196 - DNA, 20 bp, Homo sapiens
cttcagatgtggagccaggc

SEQ ID NO: 3035197 - DNA, 21 bp, Homo sapiens
cttcagatgtggagccaggcg

SEQ ID NO: 3035198 - DNA, 14 bp, Homo sapiens
cttcagcaagagag

SEQ ID NO: 3035199 - DNA, 15 bp, Homo sapiens
cttcagcagcagctc

SEQ ID NO: 3035200 - DNA, 20 bp, Homo sapiens
cttcagcagcagctcacacc

SEQ ID NO: 3035201 - DNA, 17 bp, Homo sapiens
cttcagccacctctctt

SEQ ID NO: 3035202 - DNA, 23 bp, Homo sapiens
cttcagcctagtggcttgtcctc

SEQ ID NO: 3035203 - DNA, 20 bp, Homo sapiens
cttcagcctccccaccttct

SEQ ID NO: 3035204 - DNA, 20 bp, Homo sapiens
cttcagctcacgcttcacag

SEQ ID NO: 3035205 - DNA, 11 bp, Homo sapiens
cttcagctcca

SEQ ID NO: 3035206 - DNA, 15 bp, Homo sapiens
cttcagctccagccc

SEQ ID NO: 3035207 - DNA, 16 bp, Homo sapiens
cttcagctccagcccc

SEQ ID NO: 3035208 - DNA, 19 bp, Homo sapiens
cttcagctccagccccttt

SEQ ID NO: 3035209 - DNA, 11 bp, Homo sapiens
cttcagctggt

SEQ ID NO: 3035210 - DNA, 21 bp, Homo sapiens
cttcaggaacctcgagtactg

SEQ ID NO: 3035211 - DNA, 21 bp, Homo sapiens
cttcaggagtttcatgttgga

SEQ ID NO: 3035212 - DNA, 18 bp, Homo sapiens
cttcaggcaattctcctg

SEQ ID NO: 3035213 - DNA, 13 bp, Homo sapiens
cttcagggcctgg

SEQ ID NO: 3035214 - DNA, 17 bp, Homo sapiens
cttcaggggcacttcat

SEQ ID NO: 3035215 - DNA, 18 bp, Homo sapiens
cttcagggtgatgccagg

SEQ ID NO: 3035216 - DNA, 14 bp, Homo sapiens
cttcaggtgtgact

SEQ ID NO: 3035217 - DNA, 14 bp, Homo sapiens
cttcagtccctgag

SEQ ID NO: 3035218 - DNA, 15 bp, Homo sapiens
cttcagtgcccacca

SEQ ID NO: 3035219 - DNA, 17 bp, Homo sapiens
cttcagtgcccaccaac

SEQ ID NO: 3035220 - DNA, 19 bp, Homo sapiens
cttcagtggaacacaaatg

SEQ ID NO: 3035221 - DNA, 16 bp, Homo sapiens
cttcagtgtaatgtga

SEQ ID NO: 3035222 - DNA, 21 bp, Homo sapiens
cttcataccgcctcgtgccag

SEQ ID NO: 3035223 - DNA, 23 bp, Homo sapiens
cttcataccgcctcgtgccagca

SEQ ID NO: 3035224 - DNA, 23 bp, Homo sapiens
cttcatagggacctttaaaaagc

SEQ ID NO: 3035225 - DNA, 13 bp, Homo sapiens
cttcatataaact

SEQ ID NO: 3035226 - DNA, 15 bp, Homo sapiens
cttcatatctctccc

SEQ ID NO: 3035227 - DNA, 22 bp, Homo sapiens
cttcatattaatataagtttct

SEQ ID NO: 3035228 - DNA, 17 bp, Homo sapiens
cttcatcattccctctc

SEQ ID NO: 3035229 - DNA, 14 bp, Homo sapiens
cttcatctccctgc

SEQ ID NO: 3035230 - DNA, 17 bp, Homo sapiens
cttcatctccctgccat

SEQ ID NO: 3035231 - DNA, 20 bp, Homo sapiens
cttcatctccctgccatccc

SEQ ID NO: 3035232 - DNA, 14 bp, Homo sapiens
cttcatctggctgc

SEQ ID NO: 3035233 - DNA, 22 bp, Homo sapiens
cttcatgcaggtgaaacccagt

SEQ ID NO: 3035234 - DNA, 19 bp, Homo sapiens
cttcatgcctgatgaaagc

SEQ ID NO: 3035235 - DNA, 23 bp, Homo sapiens
cttcatggatgggggaactcaga

SEQ ID NO: 3035236 - DNA, 21 bp, Homo sapiens
cttcatggcagaaggcaaacc

SEQ ID NO: 3035237 - DNA, 17 bp, Homo sapiens
cttcatgggcccacagg

SEQ ID NO: 3035238 - DNA, 14 bp, Homo sapiens
cttcatttcatcct

SEQ ID NO: 3035239 - DNA, 14 bp, Homo sapiens
cttcattttcagag

SEQ ID NO: 3035240 - DNA, 16 bp, Homo sapiens
cttcattttcagagtg

SEQ ID NO: 3035241 - DNA, 17 bp, Homo sapiens
cttcattttcagagtga

SEQ ID NO: 3035242 - DNA, 22 bp, Homo sapiens
cttccaaagactccctccatag

SEQ ID NO: 3035243 - DNA, 18 bp, Homo sapiens
cttccaagaccatttgta

SEQ ID NO: 3035244 - DNA, 20 bp, Homo sapiens
cttccaaggagcagagaggt

SEQ ID NO: 3035245 - DNA, 20 bp, Homo sapiens
cttccacatttttgcacaga

SEQ ID NO: 3035246 - DNA, 22 bp, Homo sapiens
cttccaccagagcaggggctgc

SEQ ID NO: 3035247 - DNA, 23 bp, Homo sapiens
cttccacctcacctctttgttct

SEQ ID NO: 3035248 - DNA, 14 bp, Homo sapiens
cttccactgagggc

SEQ ID NO: 3035249 - DNA, 14 bp, Homo sapiens
cttccacttctcca

SEQ ID NO: 3035250 - DNA, 20 bp, Homo sapiens
cttccacttctccaagaatg

SEQ ID NO: 3035251 - DNA, 18 bp, Homo sapiens
cttccagagctctgaccc

SEQ ID NO: 3035252 - DNA, 16 bp, Homo sapiens
cttccagcaaaatcca

SEQ ID NO: 3035253 - DNA, 19 bp, Homo sapiens
cttccagcaaaatccaaac

SEQ ID NO: 3035254 - DNA, 20 bp, Homo sapiens
cttccagcaaaatccaaact

SEQ ID NO: 3035255 - DNA, 21 bp, Homo sapiens
cttccaggagccaccttgcca

SEQ ID NO: 3035256 - DNA, 17 bp, Homo sapiens
cttccaggatggtgtta

SEQ ID NO: 3035257 - DNA, 22 bp, Homo sapiens
cttccagggacgaagaagagcc

SEQ ID NO: 3035258 - DNA, 19 bp, Homo sapiens
cttccaggtgcccagctat

SEQ ID NO: 3035259 - DNA, 19 bp, Homo sapiens
cttccaggtgttactgtaa

SEQ ID NO: 3035260 - DNA, 16 bp, Homo sapiens
cttgtttaaaaaaaga

SEQ ID NO: 3035261 - DNA, 18 bp, Homo sapiens
cttgtttaaaaaaagaaa

SEQ ID NO: 3035262 - DNA, 20 bp, Homo sapiens
cttgtttccttagcttggta

SEQ ID NO: 3035263 - DNA, 14 bp, Homo sapiens
cttgtttctcaact

SEQ ID NO: 3035264 - DNA, 16 bp, Homo sapiens
cttgtttctttctgaa

SEQ ID NO: 3035265 - DNA, 14 bp, Homo sapiens
cttgtttcttttca

SEQ ID NO: 3035266 - DNA, 20 bp, Homo sapiens
cttgtttgattttagctgca

SEQ ID NO: 3035267 - DNA, 23 bp, Homo sapiens
cttgtttgattttagctgcagaa

SEQ ID NO: 3035268 - DNA, 20 bp, Homo sapiens
cttgtttgctcacctggggt

SEQ ID NO: 3035269 - DNA, 13 bp, Homo sapiens
cttgtttgtcagc

SEQ ID NO: 3035270 - DNA, 19 bp, Homo sapiens
cttgtttgtcagcatctga

SEQ ID NO: 3035271 - DNA, 21 bp, Homo sapiens
cttgtttgtcagcatctgacc

SEQ ID NO: 3035272 - DNA, 22 bp, Homo sapiens
cttgtttgtcagcatctgacca

SEQ ID NO: 3035273 - DNA, 21 bp, Homo sapiens
cttgttttaagcaaatgcatt

SEQ ID NO: 3035274 - DNA, 15 bp, Homo sapiens
cttgttttaatttta

SEQ ID NO: 3035275 - DNA, 15 bp, Homo sapiens
cttgttttattttgg

SEQ ID NO: 3035276 - DNA, 11 bp, Homo sapiens
cttgttttcca

SEQ ID NO: 3035277 - DNA, 13 bp, Homo sapiens
ctttaaaaaagaa

SEQ ID NO: 3035278 - DNA, 23 bp, Homo sapiens
ctttaaaaaagaaaagtgcatat

SEQ ID NO: 3035279 - DNA, 23 bp, Homo sapiens
ctttaaaaaagaaattatcttta

SEQ ID NO: 3035280 - DNA, 15 bp, Homo sapiens
ctttaaaaagaaaaa

SEQ ID NO: 3035281 - DNA, 18 bp, Homo sapiens
ctttaaaagatgctttta

SEQ ID NO: 3035282 - DNA, 19 bp, Homo sapiens
ctttaaaatgtaaagccat

SEQ ID NO: 3035283 - DNA, 17 bp, Homo sapiens
ctttaaaattacaacta

SEQ ID NO: 3035284 - DNA, 20 bp, Homo sapiens
ctttaaaattacaactaagt

SEQ ID NO: 3035285 - DNA, 13 bp, Homo sapiens
ctttaaagccagt

SEQ ID NO: 3035286 - DNA, 13 bp, Homo sapiens
ctttaaattaaaa

SEQ ID NO: 3035287 - DNA, 18 bp, Homo sapiens
ctttaaccgtttttcaag

SEQ ID NO: 3035288 - DNA, 20 bp, Homo sapiens
ctttaaccgtttttcaagaa

SEQ ID NO: 3035289 - DNA, 21 bp, Homo sapiens
ctttaaccgtttttcaagaaa

SEQ ID NO: 3035290 - DNA, 16 bp, Homo sapiens
ctttaacctgaacctt

SEQ ID NO: 3035291 - DNA, 18 bp, Homo sapiens
ctttaactcgttgcagtc

SEQ ID NO: 3035292 - DNA, 17 bp, Homo sapiens
ctttaactctgcggata

SEQ ID NO: 3035293 - DNA, 20 bp, Homo sapiens
ctttaagaaccttattttga

SEQ ID NO: 3035294 - DNA, 14 bp, Homo sapiens
ctttaagaatgaac

SEQ ID NO: 3035295 - DNA, 23 bp, Homo sapiens
ctttaagacatactccttccatc

SEQ ID NO: 3035296 - DNA, 17 bp, Homo sapiens
ctttaagatatccatct

SEQ ID NO: 3035297 - DNA, 18 bp, Homo sapiens
ctttaatatttccaatgt

SEQ ID NO: 3035298 - DNA, 15 bp, Homo sapiens
ctttaatcaatgtga

SEQ ID NO: 3035299 - DNA, 18 bp, Homo sapiens
ctttacagctgtttacag

SEQ ID NO: 3035300 - DNA, 16 bp, Homo sapiens
ctttacaggatcatgt

SEQ ID NO: 3035301 - DNA, 17 bp, Homo sapiens
ctttacaggatcatgta

SEQ ID NO: 3035302 - DNA, 23 bp, Homo sapiens
ctttacaggatcatgtaaatgct

SEQ ID NO: 3035303 - DNA, 18 bp, Homo sapiens
ctttaccaaacagcaaac

SEQ ID NO: 3035304 - DNA, 23 bp, Homo sapiens
ctttaccaaaggtttttaaagta

SEQ ID NO: 3035305 - DNA, 16 bp, Homo sapiens
ctttacccttgagccc

SEQ ID NO: 3035306 - DNA, 18 bp, Homo sapiens
ctttactaagatgacatt

SEQ ID NO: 3035307 - DNA, 19 bp, Homo sapiens
ctttactcctcacacttac

SEQ ID NO: 3035308 - DNA, 15 bp, Homo sapiens
ctttactcctggctc

SEQ ID NO: 3035309 - DNA, 23 bp, Homo sapiens
ctttactgcctgaataaagagcc

SEQ ID NO: 3035310 - DNA, 23 bp, Homo sapiens
ctttactgggttggaagaaatat

SEQ ID NO: 3035311 - DNA, 14 bp, Homo sapiens
ctttactgtttgtt

SEQ ID NO: 3035312 - DNA, 22 bp, Homo sapiens
ctttagaatgagagtgtgaaat

SEQ ID NO: 3035313 - DNA, 15 bp, Homo sapiens
ctttagagaactgaa

SEQ ID NO: 3035314 - DNA, 20 bp, Homo sapiens
ctttagagaactgaaaagag

SEQ ID NO: 3035315 - DNA, 17 bp, Homo sapiens
ctttagagcaacagtaa

SEQ ID NO: 3035316 - DNA, 19 bp, Homo sapiens
ctttagtacctgaaaagta

SEQ ID NO: 3035317 - DNA, 18 bp, Homo sapiens
ctttagtgattgctttta

SEQ ID NO: 3035318 - DNA, 13 bp, Homo sapiens
ctttagtgtattt

SEQ ID NO: 3035319 - DNA, 22 bp, Homo sapiens
ctttagttgaattccaagtgta

SEQ ID NO: 3035320 - DNA, 13 bp, Homo sapiens
ctttatactctct

SEQ ID NO: 3035321 - DNA, 15 bp, Homo sapiens
ctttatactctcttc

SEQ ID NO: 3035322 - DNA, 15 bp, Homo sapiens
ctttatagttgtaga

SEQ ID NO: 3035323 - DNA, 13 bp, Homo sapiens
ctttatataaggt

SEQ ID NO: 3035324 - DNA, 20 bp, Homo sapiens
ctttatataaggtcatagat

SEQ ID NO: 3035325 - DNA, 17 bp, Homo sapiens
ctttatcacctcattct

SEQ ID NO: 3035326 - DNA, 20 bp, Homo sapiens
ctttatcacctcattctgaa

SEQ ID NO: 3035327 - DNA, 19 bp, Homo sapiens
ctttatcacctggcttgtt

SEQ ID NO: 3035328 - DNA, 20 bp, Homo sapiens
ctttatcacctggcttgttt

SEQ ID NO: 3035329 - DNA, 22 bp, Homo sapiens
ctttatcacctggcttgtttat

SEQ ID NO: 3035330 - DNA, 21 bp, Homo sapiens
ctttatctaatacctctgtgt

SEQ ID NO: 3035331 - DNA, 22 bp, Homo sapiens
ctttatgagctaaaaatatgca

SEQ ID NO: 3035332 - DNA, 20 bp, Homo sapiens
ctttatgataatagattctc

SEQ ID NO: 3035333 - DNA, 13 bp, Homo sapiens
ctttatgcttgca

SEQ ID NO: 3035334 - DNA, 16 bp, Homo sapiens
ctttatggtaaagatg

SEQ ID NO: 3035335 - DNA, 18 bp, Homo sapiens
ctttatgtggaaaacaga

SEQ ID NO: 3035336 - DNA, 12 bp, Homo sapiens
ctttatgtgtaa

SEQ ID NO: 3035337 - DNA, 14 bp, Homo sapiens
ctttattaaaaact

SEQ ID NO: 3035338 - DNA, 20 bp, Homo sapiens
ctttattaccccctccttca

SEQ ID NO: 3035339 - DNA, 20 bp, Homo sapiens
ctttattccagaatgctgta

SEQ ID NO: 3035340 - DNA, 13 bp, Homo sapiens
ctttattcttttc

SEQ ID NO: 3035341 - DNA, 14 bp, Homo sapiens
ctttattgcaatgc

SEQ ID NO: 3035342 - DNA, 11 bp, Homo sapiens
ctttatttctg

SEQ ID NO: 3035343 - DNA, 21 bp, Homo sapiens
ctttattttctataatttaaa

SEQ ID NO: 3035344 - DNA, 22 bp, Homo sapiens
ctttcaaagacaatcactgaaa

SEQ ID NO: 3035345 - DNA, 11 bp, Homo sapiens
ctttcaaattt

SEQ ID NO: 3035346 - DNA, 13 bp, Homo sapiens
ctttcaagaatga

SEQ ID NO: 3035347 - DNA, 14 bp, Homo sapiens
ctttcacacatctg

SEQ ID NO: 3035348 - DNA, 18 bp, Homo sapiens
ctttcagacttgccatgt

SEQ ID NO: 3035349 - DNA, 17 bp, Homo sapiens
ctttcagcgcccccagg

SEQ ID NO: 3035350 - DNA, 20 bp, Homo sapiens
ctttcagcgcccccaggcct

SEQ ID NO: 3035351 - DNA, 22 bp, Homo sapiens
ctttcagcgcccccaggcctgc

SEQ ID NO: 3035352 - DNA, 13 bp, Homo sapiens
ctttcagggcagc

SEQ ID NO: 3035353 - DNA, 17 bp, Homo sapiens
ctttcagggcagcccct

SEQ ID NO: 3035354 - DNA, 15 bp, Homo sapiens
ctttcagtacttttt

SEQ ID NO: 3035355 - DNA, 21 bp, Homo sapiens
ctttcagtacttttttaaata

SEQ ID NO: 3035356 - DNA, 23 bp, Homo sapiens
ctttcagtattaaactctccttt

SEQ ID NO: 3035357 - DNA, 18 bp, Homo sapiens
ctttcataatctttgctt

SEQ ID NO: 3035358 - DNA, 15 bp, Homo sapiens
ctttcatagagaggc

SEQ ID NO: 3035359 - DNA, 16 bp, Homo sapiens
ctttcatagagaggcc

SEQ ID NO: 3035360 - DNA, 19 bp, Homo sapiens
ctttcatagagaggcctgc

SEQ ID NO: 3035361 - DNA, 20 bp, Homo sapiens
ctttcatcaatgggattttc

SEQ ID NO: 3035362 - DNA, 23 bp, Homo sapiens
ctttcatcaatgggattttctag

SEQ ID NO: 3035363 - DNA, 15 bp, Homo sapiens
ctttcatccaactct

SEQ ID NO: 3035364 - DNA, 15 bp, Homo sapiens
ctttcatcctgtgtc

SEQ ID NO: 3035365 - DNA, 16 bp, Homo sapiens
ctttcatcctgtgtcc

SEQ ID NO: 3035366 - DNA, 22 bp, Homo sapiens
ctttcatgagtttttcccagct

SEQ ID NO: 3035367 - DNA, 22 bp, Homo sapiens
ctttcatgtgtgccaaggctga

SEQ ID NO: 3035368 - DNA, 17 bp, Homo sapiens
ctttcatttgaaagtgg

SEQ ID NO: 3035369 - DNA, 17 bp, Homo sapiens
ctttccaaaatttttca

SEQ ID NO: 3035370 - DNA, 18 bp, Homo sapiens
ctttccaaaatttttcaa

SEQ ID NO: 3035371 - DNA, 11 bp, Homo sapiens
ctttccaaaga

SEQ ID NO: 3035372 - DNA, 17 bp, Homo sapiens
ctttccaaatccaggag

SEQ ID NO: 3035373 - DNA, 15 bp, Homo sapiens
ctttccaaggcttct

SEQ ID NO: 3035374 - DNA, 15 bp, Homo sapiens
ctttccactcccact

SEQ ID NO: 3035375 - DNA, 16 bp, Homo sapiens
ctttccacttctctgg

SEQ ID NO: 3035376 - DNA, 23 bp, Homo sapiens
ctttccactttgttggcccttcc

SEQ ID NO: 3035377 - DNA, 21 bp, Homo sapiens
ctttccaggcttccctgactt

SEQ ID NO: 3035378 - DNA, 22 bp, Homo sapiens
ctttccagttccctttgcttgt

SEQ ID NO: 3035379 - DNA, 16 bp, Homo sapiens
ctttccatctgtccac

SEQ ID NO: 3035380 - DNA, 17 bp, Homo sapiens
ctttccatctgtccaca

SEQ ID NO: 3035381 - DNA, 23 bp, Homo sapiens
ctttccatctgtccacatcccca

SEQ ID NO: 3035382 - DNA, 18 bp, Homo sapiens
ctttccattggatctcat

SEQ ID NO: 3035383 - DNA, 16 bp, Homo sapiens
ctttcccaactctagc

SEQ ID NO: 3035384 - DNA, 13 bp, Homo sapiens
ctttccccagcct

SEQ ID NO: 3035385 - DNA, 19 bp, Homo sapiens
ctttccccattcctaccca

SEQ ID NO: 3035386 - DNA, 22 bp, Homo sapiens
ctttccctcctaaagctgaatc

SEQ ID NO: 3035387 - DNA, 22 bp, Homo sapiens
ctttccgtcaacgttgtactgt

SEQ ID NO: 3035388 - DNA, 16 bp, Homo sapiens
ctttcctaaggctgca

SEQ ID NO: 3035389 - DNA, 20 bp, Homo sapiens
ctttcctaaggctgcaaggt

SEQ ID NO: 3035390 - DNA, 16 bp, Homo sapiens
ctttcctactttctat

SEQ ID NO: 3035391 - DNA, 16 bp, Homo sapiens
gaccctgagctgacca

SEQ ID NO: 3035392 - DNA, 15 bp, Homo sapiens
gaccctgggcctgga

SEQ ID NO: 3035393 - DNA, 16 bp, Homo sapiens
gaccctgggcctggag

SEQ ID NO: 3035394 - DNA, 18 bp, Homo sapiens
gaccctgggggcacagga

SEQ ID NO: 3035395 - DNA, 11 bp, Homo sapiens
gaccctgtata

SEQ ID NO: 3035396 - DNA, 19 bp, Homo sapiens
gaccctgtatatagcccag

SEQ ID NO: 3035397 - DNA, 15 bp, Homo sapiens
gaccctgtgcaggag

SEQ ID NO: 3035398 - DNA, 17 bp, Homo sapiens
gacccttacagcctctg

SEQ ID NO: 3035399 - DNA, 18 bp, Homo sapiens
gaccgcccttttccccta

SEQ ID NO: 3035400 - DNA, 17 bp, Homo sapiens
gaccgcctcctgctctg

SEQ ID NO: 3035401 - DNA, 23 bp, Homo sapiens
gaccgggcactcccgggatgggt

SEQ ID NO: 3035402 - DNA, 21 bp, Homo sapiens
gaccgtgccattgtactccag

SEQ ID NO: 3035403 - DNA, 20 bp, Homo sapiens
gacctagaaatgtagcagca

SEQ ID NO: 3035404 - DNA, 22 bp, Homo sapiens
gacctatgtacttaatccttta

SEQ ID NO: 3035405 - DNA, 14 bp, Homo sapiens
gacctcagcctgca

SEQ ID NO: 3035406 - DNA, 18 bp, Homo sapiens
gacctcagggctatgtgg

SEQ ID NO: 3035407 - DNA, 15 bp, Homo sapiens
gacctccagtcctgc

SEQ ID NO: 3035408 - DNA, 20 bp, Homo sapiens
gacctccagtcctgctggcc

SEQ ID NO: 3035409 - DNA, 18 bp, Homo sapiens
gacctccgtgcccaggcc

SEQ ID NO: 3035410 - DNA, 22 bp, Homo sapiens
gacctcctgacaacgtctcttc

SEQ ID NO: 3035411 - DNA, 18 bp, Homo sapiens
gacctcggatgaccatac

SEQ ID NO: 3035412 - DNA, 13 bp, Homo sapiens
gacctcgtcctcc

SEQ ID NO: 3035413 - DNA, 16 bp, Homo sapiens
gacctcgtcctccccc

SEQ ID NO: 3035414 - DNA, 17 bp, Homo sapiens
gacctcgtcctccccct

SEQ ID NO: 3035415 - DNA, 22 bp, Homo sapiens
gacctcgtcctccccctgccag

SEQ ID NO: 3035416 - DNA, 19 bp, Homo sapiens
gacctctccatcttcagct

SEQ ID NO: 3035417 - DNA, 12 bp, Homo sapiens
gacctctcccag

SEQ ID NO: 3035418 - DNA, 17 bp, Homo sapiens
gacctctctcagcccca

SEQ ID NO: 3035419 - DNA, 22 bp, Homo sapiens
gacctctctcagccccatcgcc

SEQ ID NO: 3035420 - DNA, 15 bp, Homo sapiens
gacctgaaattccaa

SEQ ID NO: 3035421 - DNA, 23 bp, Homo sapiens
gacctgaaattccaaagtctcta

SEQ ID NO: 3035422 - DNA, 13 bp, Homo sapiens
gacctgaagttca

SEQ ID NO: 3035423 - DNA, 22 bp, Homo sapiens
gacctgaagttcaccattaaaa

SEQ ID NO: 3035424 - DNA, 21 bp, Homo sapiens
gacctgatcctggaggcccag

SEQ ID NO: 3035425 - DNA, 13 bp, Homo sapiens
gacctgatggaga

SEQ ID NO: 3035426 - DNA, 15 bp, Homo sapiens
gacctgatttattga

SEQ ID NO: 3035427 - DNA, 20 bp, Homo sapiens
gacctgatttattgaaattt

SEQ ID NO: 3035428 - DNA, 19 bp, Homo sapiens
gacctggactagggcctcg

SEQ ID NO: 3035429 - DNA, 11 bp, Homo sapiens
gacctggcagt

SEQ ID NO: 3035430 - DNA, 12 bp, Homo sapiens
gacctggcttgg

SEQ ID NO: 3035431 - DNA, 17 bp, Homo sapiens
gacctggtccacagggc

SEQ ID NO: 3035432 - DNA, 19 bp, Homo sapiens
gacctggtccacagggcac

SEQ ID NO: 3035433 - DNA, 14 bp, Homo sapiens
gacctggtgctcta

SEQ ID NO: 3035434 - DNA, 18 bp, Homo sapiens
gacctggttaaacaaacc

SEQ ID NO: 3035435 - DNA, 21 bp, Homo sapiens
gacctgtatatttgtaaagct

SEQ ID NO: 3035436 - DNA, 11 bp, Homo sapiens
gacctgtccag

SEQ ID NO: 3035437 - DNA, 15 bp, Homo sapiens
gacctgtgagcccag

SEQ ID NO: 3035438 - DNA, 16 bp, Homo sapiens
gacctgtgagcccagc

SEQ ID NO: 3035439 - DNA, 19 bp, Homo sapiens
gaccttaaatgctactgaa

SEQ ID NO: 3035440 - DNA, 22 bp, Homo sapiens
gaccttaatttaactttccagt

SEQ ID NO: 3035441 - DNA, 13 bp, Homo sapiens
gaccttaggcctt

SEQ ID NO: 3035442 - DNA, 16 bp, Homo sapiens
gaccttaggccttcct

SEQ ID NO: 3035443 - DNA, 20 bp, Homo sapiens
gaccttagtgtttctgtgca

SEQ ID NO: 3035444 - DNA, 18 bp, Homo sapiens
gaccttcagagccagccg

SEQ ID NO: 3035445 - DNA, 18 bp, Homo sapiens
gaccttccaagagcctga

SEQ ID NO: 3035446 - DNA, 19 bp, Homo sapiens
gaccttcgggctgtgcccg

SEQ ID NO: 3035447 - DNA, 17 bp, Homo sapiens
gaccttctgagaggggc

SEQ ID NO: 3035448 - DNA, 19 bp, Homo sapiens
gaccttctgatcttggaaa

SEQ ID NO: 3035449 - DNA, 16 bp, Homo sapiens
gacctttgcccacaca

SEQ ID NO: 3035450 - DNA, 14 bp, Homo sapiens
gacgaacttccatg

SEQ ID NO: 3035451 - DNA, 21 bp, Homo sapiens
gacgaacttccatggccctca

SEQ ID NO: 3035452 - DNA, 18 bp, Homo sapiens
gacgaagaagagccacag

SEQ ID NO: 3035453 - DNA, 15 bp, Homo sapiens
gacgaagagcaggcc

SEQ ID NO: 3035454 - DNA, 22 bp, Homo sapiens
gacgaatgcatattcaacacac

SEQ ID NO: 3035455 - DNA, 14 bp, Homo sapiens
gacgcaggcccctc

SEQ ID NO: 3035456 - DNA, 13 bp, Homo sapiens
gacgcaggccctg

SEQ ID NO: 3035457 - DNA, 17 bp, Homo sapiens
gacgcaggccctgtcca

SEQ ID NO: 3035458 - DNA, 15 bp, Homo sapiens
gacgccaataataaa

SEQ ID NO: 3035459 - DNA, 22 bp, Homo sapiens
gacgcccccgcccgcacagctc

SEQ ID NO: 3035460 - DNA, 12 bp, Homo sapiens
gacgcctggggg

SEQ ID NO: 3035461 - DNA, 21 bp, Homo sapiens
gacgcctgggggtgccaggac

SEQ ID NO: 3035462 - DNA, 16 bp, Homo sapiens
gacgcgaggggaaagg

SEQ ID NO: 3035463 - DNA, 14 bp, Homo sapiens
gacgctcttttcta

SEQ ID NO: 3035464 - DNA, 18 bp, Homo sapiens
gacgctgtgctggttctg

SEQ ID NO: 3035465 - DNA, 18 bp, Homo sapiens
gacggctccactaggact

SEQ ID NO: 3035466 - DNA, 13 bp, Homo sapiens
gacggctgggcac

SEQ ID NO: 3035467 - DNA, 20 bp, Homo sapiens
gacggctgtgacgcagccgg

SEQ ID NO: 3035468 - DNA, 16 bp, Homo sapiens
gacggctgtgggacca

SEQ ID NO: 3035469 - DNA, 11 bp, Homo sapiens
gacgggacaga

SEQ ID NO: 3035470 - DNA, 13 bp, Homo sapiens
gacgggccaggcc

SEQ ID NO: 3035471 - DNA, 16 bp, Homo sapiens
gacgggccaggccctg

SEQ ID NO: 3035472 - DNA, 20 bp, Homo sapiens
gacggggtcggacggggcag

SEQ ID NO: 3035473 - DNA, 17 bp, Homo sapiens
gacggggtttctccatg

SEQ ID NO: 3035474 - DNA, 16 bp, Homo sapiens
gacggtgcagtctggg

SEQ ID NO: 3035475 - DNA, 13 bp, Homo sapiens
gacggtgtcttgt

SEQ ID NO: 3035476 - DNA, 22 bp, Homo sapiens
gacggtttccagggaggggccg

SEQ ID NO: 3035477 - DNA, 18 bp, Homo sapiens
gacgtcccttttttctct

SEQ ID NO: 3035478 - DNA, 15 bp, Homo sapiens
gacgtgactcagagc

SEQ ID NO: 3035479 - DNA, 12 bp, Homo sapiens
gacgtggctcag

SEQ ID NO: 3035480 - DNA, 15 bp, Homo sapiens
gacgtggctcagcca

SEQ ID NO: 3035481 - DNA, 16 bp, Homo sapiens
gacgtggctcagccag

SEQ ID NO: 3035482 - DNA, 13 bp, Homo sapiens
gacgtgggccctg

SEQ ID NO: 3035483 - DNA, 19 bp, Homo sapiens
gacgtgggccctgcaggct

SEQ ID NO: 3035484 - DNA, 13 bp, Homo sapiens
gacgtgggctggg

SEQ ID NO: 3035485 - DNA, 20 bp, Homo sapiens
gacgtgttacccactgccat

SEQ ID NO: 3035486 - DNA, 18 bp, Homo sapiens
gacgtttacaagcccccc

SEQ ID NO: 3035487 - DNA, 12 bp, Homo sapiens
gacgtttctcat

SEQ ID NO: 3035488 - DNA, 18 bp, Homo sapiens
gactaaaatgtttcattt

SEQ ID NO: 3035489 - DNA, 18 bp, Homo sapiens
gactaaccccaccacacc

SEQ ID NO: 3035490 - DNA, 17 bp, Homo sapiens
gactaaccctgtggttg

SEQ ID NO: 3035491 - DNA, 21 bp, Homo sapiens
gactaactagacaccaaagtt

SEQ ID NO: 3035492 - DNA, 19 bp, Homo sapiens
gactaagccaagctgtgtt

SEQ ID NO: 3035493 - DNA, 14 bp, Homo sapiens
gactaatggcatga

SEQ ID NO: 3035494 - DNA, 20 bp, Homo sapiens
gactaatggcatgagaaata

SEQ ID NO: 3035495 - DNA, 15 bp, Homo sapiens
gactaattgtataac

SEQ ID NO: 3035496 - DNA, 20 bp, Homo sapiens
gactaattgtataacaggtt

SEQ ID NO: 3035497 - DNA, 13 bp, Homo sapiens
gactaatttcaaa

SEQ ID NO: 3035498 - DNA, 17 bp, Homo sapiens
gactacattttgctctg

SEQ ID NO: 3035499 - DNA, 22 bp, Homo sapiens
gactacctactggtgtaatctc

SEQ ID NO: 3035500 - DNA, 14 bp, Homo sapiens
gactacctgggacc

SEQ ID NO: 3035501 - DNA, 18 bp, Homo sapiens
gactacttgggagcaccg

SEQ ID NO: 3035502 - DNA, 20 bp, Homo sapiens
gactacttgggagcaccgcc

SEQ ID NO: 3035503 - DNA, 12 bp, Homo sapiens
gactagaattct

SEQ ID NO: 3035504 - DNA, 17 bp, Homo sapiens
gactagagggacctctc

SEQ ID NO: 3035505 - DNA, 19 bp, Homo sapiens
gactagagggacctctccc

SEQ ID NO: 3035506 - DNA, 20 bp, Homo sapiens
gactagagggacctctccca

SEQ ID NO: 3035507 - DNA, 14 bp, Homo sapiens
gactagatgatgga

SEQ ID NO: 3035508 - DNA, 14 bp, Homo sapiens
gactataaagctgt

SEQ ID NO: 3035509 - DNA, 19 bp, Homo sapiens
gactatatttgggcctgct

SEQ ID NO: 3035510 - DNA, 15 bp, Homo sapiens
gactatggaatgtca

SEQ ID NO: 3035511 - DNA, 22 bp, Homo sapiens
gactattaggtgcaatttcaag

SEQ ID NO: 3035512 - DNA, 15 bp, Homo sapiens
gactattatgttgtt

SEQ ID NO: 3035513 - DNA, 17 bp, Homo sapiens
gactattccttttctgt

SEQ ID NO: 3035514 - DNA, 19 bp, Homo sapiens
gactatttgacccccacaa

SEQ ID NO: 3035515 - DNA, 18 bp, Homo sapiens
gactcaaagtttcagaga

SEQ ID NO: 3035516 - DNA, 22 bp, Homo sapiens
gactcaaatgctcagaccagct

SEQ ID NO: 3035517 - DNA, 15 bp, Homo sapiens
gactcaaatgttcta

SEQ ID NO: 3035518 - DNA, 18 bp, Homo sapiens
gactcaaatgttctaagt

SEQ ID NO: 3035519 - DNA, 18 bp, Homo sapiens
gactcacaacctgaacct

SEQ ID NO: 3035520 - DNA, 19 bp, Homo sapiens
gactcacaacctgaaccta

SEQ ID NO: 3035521 - DNA, 14 bp, Homo sapiens
gactcacctctgcc

SEQ ID NO: 3035522 - DNA, 14 bp, Homo sapiens
gactcactggcagc

SEQ ID NO: 3035523 - DNA, 23 bp, Homo sapiens
gactcacttgatgtttcctggaa

SEQ ID NO: 3035524 - DNA, 13 bp, Homo sapiens
gagagggtctgga

SEQ ID NO: 3035525 - DNA, 21 bp, Homo sapiens
gagaggtggccaccgggggtg

SEQ ID NO: 3035526 - DNA, 20 bp, Homo sapiens
gagaggttaaagcaaaccag

SEQ ID NO: 3035527 - DNA, 18 bp, Homo sapiens
gagagtagccgagagcct

SEQ ID NO: 3035528 - DNA, 20 bp, Homo sapiens
gagagtagccgagagcctgc

SEQ ID NO: 3035529 - DNA, 22 bp, Homo sapiens
gagagtagccgagagcctgctc

SEQ ID NO: 3035530 - DNA, 13 bp, Homo sapiens
gagagtctagatt

SEQ ID NO: 3035531 - DNA, 16 bp, Homo sapiens
gagagtctagattctc

SEQ ID NO: 3035532 - DNA, 15 bp, Homo sapiens
gagagtgagtgcctt

SEQ ID NO: 3035533 - DNA, 23 bp, Homo sapiens
gagagtgtcaaccagacagaggg

SEQ ID NO: 3035534 - DNA, 21 bp, Homo sapiens
gagagtgtcttcacggcagga

SEQ ID NO: 3035535 - DNA, 20 bp, Homo sapiens
gagagtgtgaaatagacatt

SEQ ID NO: 3035536 - DNA, 11 bp, Homo sapiens
gagagtgtgac

SEQ ID NO: 3035537 - DNA, 17 bp, Homo sapiens
gagagttttgtcttgaa

SEQ ID NO: 3035538 - DNA, 19 bp, Homo sapiens
gagataaaccaataaatcc

SEQ ID NO: 3035539 - DNA, 20 bp, Homo sapiens
gagataaaccaataaatcca

SEQ ID NO: 3035540 - DNA, 16 bp, Homo sapiens
gagataatacattccg

SEQ ID NO: 3035541 - DNA, 15 bp, Homo sapiens
gagatactattttca

SEQ ID NO: 3035542 - DNA, 15 bp, Homo sapiens
gagatagcattgtga

SEQ ID NO: 3035543 - DNA, 20 bp, Homo sapiens
gagatagcattgtgaactga

SEQ ID NO: 3035544 - DNA, 23 bp, Homo sapiens
gagatagcattgtgaactgacag

SEQ ID NO: 3035545 - DNA, 14 bp, Homo sapiens
gagatagcctgtgg

SEQ ID NO: 3035546 - DNA, 16 bp, Homo sapiens
gagatagcctgtggcc

SEQ ID NO: 3035547 - DNA, 20 bp, Homo sapiens
gagatagcctgtggccctgt

SEQ ID NO: 3035548 - DNA, 21 bp, Homo sapiens
gagatagcctgtggccctgtc

SEQ ID NO: 3035549 - DNA, 14 bp, Homo sapiens
gagatattataagg

SEQ ID NO: 3035550 - DNA, 22 bp, Homo sapiens
gagatatttatggggggagaac

SEQ ID NO: 3035551 - DNA, 22 bp, Homo sapiens
gagatcacgccattgtactcca

SEQ ID NO: 3035552 - DNA, 19 bp, Homo sapiens
gagatcccaacactgccag

SEQ ID NO: 3035553 - DNA, 15 bp, Homo sapiens
gagatcgtgccactg

SEQ ID NO: 3035554 - DNA, 18 bp, Homo sapiens
gagatctgaacccagctg

SEQ ID NO: 3035555 - DNA, 23 bp, Homo sapiens
gagatctgcacagtcagaaggac

SEQ ID NO: 3035556 - DNA, 21 bp, Homo sapiens
gagatgacccctaccccctca

SEQ ID NO: 3035557 - DNA, 20 bp, Homo sapiens
gagatgatgaaaatatttaa

SEQ ID NO: 3035558 - DNA, 13 bp, Homo sapiens
gagatgatttgta

SEQ ID NO: 3035559 - DNA, 20 bp, Homo sapiens
gagatgcctccaccgctgcc

SEQ ID NO: 3035560 - DNA, 22 bp, Homo sapiens
gagatgcctccaccgctgccta

SEQ ID NO: 3035561 - DNA, 14 bp, Homo sapiens
gagatgcttggagc

SEQ ID NO: 3035562 - DNA, 16 bp, Homo sapiens
gagatggagtttctct

SEQ ID NO: 3035563 - DNA, 16 bp, Homo sapiens
gagatgggggtgtatt

SEQ ID NO: 3035564 - DNA, 15 bp, Homo sapiens
gagatgtttgccaaa

SEQ ID NO: 3035565 - DNA, 12 bp, Homo sapiens
gagattgaactt

SEQ ID NO: 3035566 - DNA, 22 bp, Homo sapiens
gagattgtagtatttagtatat

SEQ ID NO: 3035567 - DNA, 19 bp, Homo sapiens
gagcaaaaatgtaaaaaac

SEQ ID NO: 3035568 - DNA, 21 bp, Homo sapiens
gagcaaaaatgtaaaaaacaa

SEQ ID NO: 3035569 - DNA, 20 bp, Homo sapiens
gagcaaaactccgtctcaaa

SEQ ID NO: 3035570 - DNA, 15 bp, Homo sapiens
gagcaacctactgtc

SEQ ID NO: 3035571 - DNA, 18 bp, Homo sapiens
gagcaacctactgtctaa

SEQ ID NO: 3035572 - DNA, 12 bp, Homo sapiens
gagcaagcctag

SEQ ID NO: 3035573 - DNA, 20 bp, Homo sapiens
gagcaagggttccctcaaga

SEQ ID NO: 3035574 - DNA, 20 bp, Homo sapiens
gagcaaggtttcgtggcagc

SEQ ID NO: 3035575 - DNA, 18 bp, Homo sapiens
gagcaagttccttctggt

SEQ ID NO: 3035576 - DNA, 14 bp, Homo sapiens
gagcaagttgcagt

SEQ ID NO: 3035577 - DNA, 18 bp, Homo sapiens
gagcaatcacaggaaaat

SEQ ID NO: 3035578 - DNA, 13 bp, Homo sapiens
gagcacaatctgt

SEQ ID NO: 3035579 - DNA, 15 bp, Homo sapiens
gagcacacccagccc

SEQ ID NO: 3035580 - DNA, 16 bp, Homo sapiens
gagcacagcctcactc

SEQ ID NO: 3035581 - DNA, 17 bp, Homo sapiens
gagcaccacggccagaa

SEQ ID NO: 3035582 - DNA, 13 bp, Homo sapiens
gagcaccagggga

SEQ ID NO: 3035583 - DNA, 14 bp, Homo sapiens
gagcacctccacat

SEQ ID NO: 3035584 - DNA, 19 bp, Homo sapiens
gagcacctccacatcctcc

SEQ ID NO: 3035585 - DNA, 23 bp, Homo sapiens
gagcacctgccagaggatgctct

SEQ ID NO: 3035586 - DNA, 13 bp, Homo sapiens
gagcacctggacc

SEQ ID NO: 3035587 - DNA, 22 bp, Homo sapiens
gagcacctggaccccctgcccg

SEQ ID NO: 3035588 - DNA, 15 bp, Homo sapiens
gagcacgcctgccat

SEQ ID NO: 3035589 - DNA, 17 bp, Homo sapiens
gagcacgcctgccatct

SEQ ID NO: 3035590 - DNA, 22 bp, Homo sapiens
gagcacgcctgccatcttctcc

SEQ ID NO: 3035591 - DNA, 17 bp, Homo sapiens
gagcactcctgattttt

SEQ ID NO: 3035592 - DNA, 22 bp, Homo sapiens
gagcactggagtggctcgccag

SEQ ID NO: 3035593 - DNA, 14 bp, Homo sapiens
gagcactgtgttca

SEQ ID NO: 3035594 - DNA, 20 bp, Homo sapiens
gagcactgtgttcacacttt

SEQ ID NO: 3035595 - DNA, 14 bp, Homo sapiens
gagcagacaggaca

SEQ ID NO: 3035596 - DNA, 14 bp, Homo sapiens
gagcagaggtctcc

SEQ ID NO: 3035597 - DNA, 18 bp, Homo sapiens
gagcagcttcggtgtgca

SEQ ID NO: 3035598 - DNA, 16 bp, Homo sapiens
gagcaggccagcccgg

SEQ ID NO: 3035599 - DNA, 18 bp, Homo sapiens
gagcaggcggtgggcacc

SEQ ID NO: 3035600 - DNA, 14 bp, Homo sapiens
gagcagggcggctg

SEQ ID NO: 3035601 - DNA, 16 bp, Homo sapiens
gagcagggcggctgcc

SEQ ID NO: 3035602 - DNA, 17 bp, Homo sapiens
gagcagggcggctgccg

SEQ ID NO: 3035603 - DNA, 15 bp, Homo sapiens
gagcaggggctgctg

SEQ ID NO: 3035604 - DNA, 20 bp, Homo sapiens
gagcaggggctgctgggggc

SEQ ID NO: 3035605 - DNA, 23 bp, Homo sapiens
gagcagtaactgtccctgctttc

SEQ ID NO: 3035606 - DNA, 15 bp, Homo sapiens
gagcagtccctgctt

SEQ ID NO: 3035607 - DNA, 16 bp, Homo sapiens
gagcagtccctgctta

SEQ ID NO: 3035608 - DNA, 14 bp, Homo sapiens
gagcagtgggcagg

SEQ ID NO: 3035609 - DNA, 17 bp, Homo sapiens
gagcagtgggcaggtgg

SEQ ID NO: 3035610 - DNA, 18 bp, Homo sapiens
gagcagtgggcaggtggc

SEQ ID NO: 3035611 - DNA, 21 bp, Homo sapiens
gagcatacatcttaaatcttt

SEQ ID NO: 3035612 - DNA, 22 bp, Homo sapiens
gagcatagtccaaaaagctcct

SEQ ID NO: 3035613 - DNA, 13 bp, Homo sapiens
gagcatcacagaa

SEQ ID NO: 3035614 - DNA, 17 bp, Homo sapiens
gagcatcactagtgaca

SEQ ID NO: 3035615 - DNA, 17 bp, Homo sapiens
gagcatctcaaatgttt

SEQ ID NO: 3035616 - DNA, 21 bp, Homo sapiens
gagcatctcaaatgttttctg

SEQ ID NO: 3035617 - DNA, 23 bp, Homo sapiens
gagcatctccagcattctcagcc

SEQ ID NO: 3035618 - DNA, 18 bp, Homo sapiens
gagcatgcggagccagca

SEQ ID NO: 3035619 - DNA, 20 bp, Homo sapiens
gagcatgcggagccagcagg

SEQ ID NO: 3035620 - DNA, 16 bp, Homo sapiens
gagcattaaaataact

SEQ ID NO: 3035621 - DNA, 20 bp, Homo sapiens
gagcattcaggcagcactga

SEQ ID NO: 3035622 - DNA, 21 bp, Homo sapiens
gagcatttatgtagacattgt

SEQ ID NO: 3035623 - DNA, 15 bp, Homo sapiens
gagccaaagccagag

SEQ ID NO: 3035624 - DNA, 20 bp, Homo sapiens
gagccaaaggcatccaggcc

SEQ ID NO: 3035625 - DNA, 22 bp, Homo sapiens
gagccacaggcaggggtgagag

SEQ ID NO: 3035626 - DNA, 23 bp, Homo sapiens
gagccaccacacctggctaattt

SEQ ID NO: 3035627 - DNA, 18 bp, Homo sapiens
gagccaccgcgcccagcc

SEQ ID NO: 3035628 - DNA, 15 bp, Homo sapiens
gagccagagaagtga

SEQ ID NO: 3035629 - DNA, 15 bp, Homo sapiens
gagccagccctccct

SEQ ID NO: 3035630 - DNA, 11 bp, Homo sapiens
gagccagggta

SEQ ID NO: 3035631 - DNA, 13 bp, Homo sapiens
gagccagggtaga

SEQ ID NO: 3035632 - DNA, 17 bp, Homo sapiens
gagccagggtagagcaa

SEQ ID NO: 3035633 - DNA, 19 bp, Homo sapiens
gagccagttgtcctatgga

SEQ ID NO: 3035634 - DNA, 23 bp, Homo sapiens
gagccagttgtcctatggacaac

SEQ ID NO: 3035635 - DNA, 23 bp, Homo sapiens
gagccatataagtttgaaggaaa

SEQ ID NO: 3035636 - DNA, 18 bp, Homo sapiens
gagccatggaaggtgcca

SEQ ID NO: 3035637 - DNA, 17 bp, Homo sapiens
gagccatgggcacaaag

SEQ ID NO: 3035638 - DNA, 18 bp, Homo sapiens
gagccatgggcacaaagg

SEQ ID NO: 3035639 - DNA, 11 bp, Homo sapiens
gagcccaccca

SEQ ID NO: 3035640 - DNA, 11 bp, Homo sapiens
gagcccactgt

SEQ ID NO: 3035641 - DNA, 22 bp, Homo sapiens
gagcccagattgtgccactgct

SEQ ID NO: 3035642 - DNA, 15 bp, Homo sapiens
gagcccagccctccc

SEQ ID NO: 3035643 - DNA, 14 bp, Homo sapiens
gagcccagctccaa

SEQ ID NO: 3035644 - DNA, 12 bp, Homo sapiens
gagcccagctct

SEQ ID NO: 3035645 - DNA, 22 bp, Homo sapiens
gagcccaggggagaatgcagcc

SEQ ID NO: 3035646 - DNA, 14 bp, Homo sapiens
gagcccattgtgga

SEQ ID NO: 3035647 - DNA, 12 bp, Homo sapiens
gagccccatctg

SEQ ID NO: 3035648 - DNA, 13 bp, Homo sapiens
gagccccatcttc

SEQ ID NO: 3035649 - DNA, 19 bp, Homo sapiens
gagccccatcttcacccag

SEQ ID NO: 3035650 - DNA, 20 bp, Homo sapiens
gagccccatcttcacccagg

SEQ ID NO: 3035651 - DNA, 18 bp, Homo sapiens
gagccccattcctgggaa

SEQ ID NO: 3035652 - DNA, 21 bp, Homo sapiens
gagcccctcagacagccccct

SEQ ID NO: 3035653 - DNA, 17 bp, Homo sapiens
gagccccttctgctcag

SEQ ID NO: 3035654 - DNA, 20 bp, Homo sapiens
gagccccttctgctcagctc

SEQ ID NO: 3035655 - DNA, 14 bp, Homo sapiens
gagcccgcactgtc

SEQ ID NO: 3035656 - DNA, 19 bp, Homo sapiens
gagttaaaatgtttactgt

SEQ ID NO: 3035657 - DNA, 21 bp, Homo sapiens
gagttaaaatgtttactgtaa

SEQ ID NO: 3035658 - DNA, 23 bp, Homo sapiens
gagttaaaatgtttactgtaaat

SEQ ID NO: 3035659 - DNA, 14 bp, Homo sapiens
gagttaagacctgg

SEQ ID NO: 3035660 - DNA, 17 bp, Homo sapiens
gagttaggctattcaca

SEQ ID NO: 3035661 - DNA, 16 bp, Homo sapiens
gagttattcaaatgaa

SEQ ID NO: 3035662 - DNA, 15 bp, Homo sapiens
gagttcaactacatg

SEQ ID NO: 3035663 - DNA, 18 bp, Homo sapiens
gagttcaagaccagcctg

SEQ ID NO: 3035664 - DNA, 21 bp, Homo sapiens
gagttcaggtagctgcccctg

SEQ ID NO: 3035665 - DNA, 19 bp, Homo sapiens
gagttccagttcctctttg

SEQ ID NO: 3035666 - DNA, 23 bp, Homo sapiens
gagttcgtgaagagggaagccag

SEQ ID NO: 3035667 - DNA, 20 bp, Homo sapiens
gagttctcactatgtttctc

SEQ ID NO: 3035668 - DNA, 21 bp, Homo sapiens
gagttctcactatgtttctca

SEQ ID NO: 3035669 - DNA, 22 bp, Homo sapiens
gagttctttgcaagcttattta

SEQ ID NO: 3035670 - DNA, 21 bp, Homo sapiens
gagttgaaaatcttataattt

SEQ ID NO: 3035671 - DNA, 14 bp, Homo sapiens
gagttgatctggaa

SEQ ID NO: 3035672 - DNA, 21 bp, Homo sapiens
gagttgatctggaacccagac

SEQ ID NO: 3035673 - DNA, 20 bp, Homo sapiens
gagttgcaccattctttctt

SEQ ID NO: 3035674 - DNA, 20 bp, Homo sapiens
gagttggcgttgtgggcagg

SEQ ID NO: 3035675 - DNA, 16 bp, Homo sapiens
gagttggggaaggcaa

SEQ ID NO: 3035676 - DNA, 14 bp, Homo sapiens
gagttgtcactgct

SEQ ID NO: 3035677 - DNA, 16 bp, Homo sapiens
gagttgttgtgtacag

SEQ ID NO: 3035678 - DNA, 15 bp, Homo sapiens
gagtttagggtgggg

SEQ ID NO: 3035679 - DNA, 19 bp, Homo sapiens
gagtttatacagtgtacat

SEQ ID NO: 3035680 - DNA, 21 bp, Homo sapiens
gagtttatacagtgtacatgt

SEQ ID NO: 3035681 - DNA, 22 bp, Homo sapiens
gagtttatttttttgatggcta

SEQ ID NO: 3035682 - DNA, 13 bp, Homo sapiens
gagtttcagctgg

SEQ ID NO: 3035683 - DNA, 16 bp, Homo sapiens
gagtttcagctggaaa

SEQ ID NO: 3035684 - DNA, 17 bp, Homo sapiens
gagtttcagctggaaac

SEQ ID NO: 3035685 - DNA, 12 bp, Homo sapiens
gagtttctaagg

SEQ ID NO: 3035686 - DNA, 17 bp, Homo sapiens
gagtttgagaccaggct

SEQ ID NO: 3035687 - DNA, 14 bp, Homo sapiens
gagtttgctgtttt

SEQ ID NO: 3035688 - DNA, 20 bp, Homo sapiens
gagtttggttaatcagtgtt

SEQ ID NO: 3035689 - DNA, 23 bp, Homo sapiens
gagttttcttatatatatattga

SEQ ID NO: 3035690 - DNA, 21 bp, Homo sapiens
gagttttctttctttctgttt

SEQ ID NO: 3035691 - DNA, 19 bp, Homo sapiens
gagttttgttttaaaatta

SEQ ID NO: 3035692 - DNA, 18 bp, Homo sapiens
gagtttttatggggctga

SEQ ID NO: 3035693 - DNA, 20 bp, Homo sapiens
gagtttttattttgtctctg

SEQ ID NO: 3035694 - DNA, 19 bp, Homo sapiens
gataaaaaagaaaacattc

SEQ ID NO: 3035695 - DNA, 17 bp, Homo sapiens
gataaaaaggaaggaga

SEQ ID NO: 3035696 - DNA, 21 bp, Homo sapiens
gataaaagaaaaacctgtgat

SEQ ID NO: 3035697 - DNA, 17 bp, Homo sapiens
gataaaatactaaacta

SEQ ID NO: 3035698 - DNA, 15 bp, Homo sapiens
gataaaatgttcctt

SEQ ID NO: 3035699 - DNA, 13 bp, Homo sapiens
gataaacattcat

SEQ ID NO: 3035700 - DNA, 22 bp, Homo sapiens
gataaactgagcctcacttgcc

SEQ ID NO: 3035701 - DNA, 14 bp, Homo sapiens
gataaataaaagat

SEQ ID NO: 3035702 - DNA, 18 bp, Homo sapiens
gataaataatcggcccac

SEQ ID NO: 3035703 - DNA, 21 bp, Homo sapiens
gataaataatgtagttttgtt

SEQ ID NO: 3035704 - DNA, 18 bp, Homo sapiens
gataaatcagtggttatt

SEQ ID NO: 3035705 - DNA, 13 bp, Homo sapiens
gataacaaagata

SEQ ID NO: 3035706 - DNA, 17 bp, Homo sapiens
gataacaaagatatctt

SEQ ID NO: 3035707 - DNA, 17 bp, Homo sapiens
gataacatttgtgtgtt

SEQ ID NO: 3035708 - DNA, 18 bp, Homo sapiens
gataacttgctttcttct

SEQ ID NO: 3035709 - DNA, 22 bp, Homo sapiens
gataagagtagaaactgcaggg

SEQ ID NO: 3035710 - DNA, 14 bp, Homo sapiens
gataagatggtttc

SEQ ID NO: 3035711 - DNA, 16 bp, Homo sapiens
gataagcacattaaag

SEQ ID NO: 3035712 - DNA, 13 bp, Homo sapiens
gataaggaagaaa

SEQ ID NO: 3035713 - DNA, 15 bp, Homo sapiens
gataaggaagaaaca

SEQ ID NO: 3035714 - DNA, 19 bp, Homo sapiens
gataagtgttcttcagtgt

SEQ ID NO: 3035715 - DNA, 21 bp, Homo sapiens
gataagtgttcttcagtgtaa

SEQ ID NO: 3035716 - DNA, 13 bp, Homo sapiens
gataataaaaatt

SEQ ID NO: 3035717 - DNA, 11 bp, Homo sapiens
gataataataa

SEQ ID NO: 3035718 - DNA, 15 bp, Homo sapiens
gataatcttttacat

SEQ ID NO: 3035719 - DNA, 20 bp, Homo sapiens
gataatgaaataatcagtga

SEQ ID NO: 3035720 - DNA, 23 bp, Homo sapiens
gataatgaaataatcagtgactg

SEQ ID NO: 3035721 - DNA, 12 bp, Homo sapiens
gataatttcagg

SEQ ID NO: 3035722 - DNA, 16 bp, Homo sapiens
gatacaagattagaag

SEQ ID NO: 3035723 - DNA, 21 bp, Homo sapiens
gatacacccaaagtatcagga

SEQ ID NO: 3035724 - DNA, 14 bp, Homo sapiens
gatacagtcattat

SEQ ID NO: 3035725 - DNA, 17 bp, Homo sapiens
gatacagtgttttttag

SEQ ID NO: 3035726 - DNA, 21 bp, Homo sapiens
gataccacttttcattgcaaa

SEQ ID NO: 3035727 - DNA, 15 bp, Homo sapiens
gataccagcgaggag

SEQ ID NO: 3035728 - DNA, 15 bp, Homo sapiens
gataccagctcaggg

SEQ ID NO: 3035729 - DNA, 16 bp, Homo sapiens
gataccagctcagggg

SEQ ID NO: 3035730 - DNA, 13 bp, Homo sapiens
gataccagctgga

SEQ ID NO: 3035731 - DNA, 16 bp, Homo sapiens
gataccatatgaatga

SEQ ID NO: 3035732 - DNA, 14 bp, Homo sapiens
gatacctaaaacat

SEQ ID NO: 3035733 - DNA, 11 bp, Homo sapiens
gataccttcaa

SEQ ID NO: 3035734 - DNA, 16 bp, Homo sapiens
gataccttgaaaaagt

SEQ ID NO: 3035735 - DNA, 13 bp, Homo sapiens
gatactattttca

SEQ ID NO: 3035736 - DNA, 14 bp, Homo sapiens
gatactcatttctt

SEQ ID NO: 3035737 - DNA, 20 bp, Homo sapiens
gatactgcatgtttgctgtt

SEQ ID NO: 3035738 - DNA, 22 bp, Homo sapiens
gatactgtgagcttacattgaa

SEQ ID NO: 3035739 - DNA, 13 bp, Homo sapiens
gatagaactgtac

SEQ ID NO: 3035740 - DNA, 15 bp, Homo sapiens
gatagaactgtactg

SEQ ID NO: 3035741 - DNA, 15 bp, Homo sapiens
gatagagcctttgat

SEQ ID NO: 3035742 - DNA, 18 bp, Homo sapiens
gatagatgactttgcaga

SEQ ID NO: 3035743 - DNA, 21 bp, Homo sapiens
gatagatgctggcccagggcc

SEQ ID NO: 3035744 - DNA, 13 bp, Homo sapiens
gatagatgtttga

SEQ ID NO: 3035745 - DNA, 20 bp, Homo sapiens
gatagattgtatctcttaaa

SEQ ID NO: 3035746 - DNA, 20 bp, Homo sapiens
gatagccttgaaaacaaaca

SEQ ID NO: 3035747 - DNA, 16 bp, Homo sapiens
gatagctaactgtaaa

SEQ ID NO: 3035748 - DNA, 19 bp, Homo sapiens
gatagctaactgtaaatca

SEQ ID NO: 3035749 - DNA, 19 bp, Homo sapiens
gataggaaaaatgagtaat

SEQ ID NO: 3035750 - DNA, 21 bp, Homo sapiens
gataggactccatttctttct

SEQ ID NO: 3035751 - DNA, 14 bp, Homo sapiens
gataggagggggcg

SEQ ID NO: 3035752 - DNA, 17 bp, Homo sapiens
gatagtactaagcattt

SEQ ID NO: 3035753 - DNA, 16 bp, Homo sapiens
gatagtctgggtcaga

SEQ ID NO: 3035754 - DNA, 13 bp, Homo sapiens
gatagtgagattt

SEQ ID NO: 3035755 - DNA, 17 bp, Homo sapiens
gatagtgcttcttgtaa

SEQ ID NO: 3035756 - DNA, 23 bp, Homo sapiens
gatagtggggagacttcttggct

SEQ ID NO: 3035757 - DNA, 16 bp, Homo sapiens
gatataaattaattgt

SEQ ID NO: 3035758 - DNA, 21 bp, Homo sapiens
gatataaattaattgtgcctg

SEQ ID NO: 3035759 - DNA, 16 bp, Homo sapiens
gatatatctttatact

SEQ ID NO: 3035760 - DNA, 22 bp, Homo sapiens
gatatatgtattaataaataga

SEQ ID NO: 3035761 - DNA, 12 bp, Homo sapiens
gatatcaaaatt

SEQ ID NO: 3035762 - DNA, 14 bp, Homo sapiens
gatatcaaaattct

SEQ ID NO: 3035763 - DNA, 15 bp, Homo sapiens
gatatccatcttttt

SEQ ID NO: 3035764 - DNA, 21 bp, Homo sapiens
gatatgagttgttttcagact

SEQ ID NO: 3035765 - DNA, 14 bp, Homo sapiens
gatatgatttaaaa

SEQ ID NO: 3035766 - DNA, 20 bp, Homo sapiens
gatatgatttaaaacatgta

SEQ ID NO: 3035767 - DNA, 14 bp, Homo sapiens
gatatgcttagtaa

SEQ ID NO: 3035768 - DNA, 23 bp, Homo sapiens
gatatgttttatttcattggtta

SEQ ID NO: 3035769 - DNA, 18 bp, Homo sapiens
gatattataagggagagc

SEQ ID NO: 3035770 - DNA, 17 bp, Homo sapiens
gatattcagaattatga

SEQ ID NO: 3035771 - DNA, 19 bp, Homo sapiens
gatattcttctcttgcttt

SEQ ID NO: 3035772 - DNA, 19 bp, Homo sapiens
gatattgtcctaagtgtca

SEQ ID NO: 3035773 - DNA, 20 bp, Homo sapiens
gatattgtgaacatttgtga

SEQ ID NO: 3035774 - DNA, 20 bp, Homo sapiens
gatatttaaaagacaaacac

SEQ ID NO: 3035775 - DNA, 11 bp, Homo sapiens
gatatttcatg

SEQ ID NO: 3035776 - DNA, 21 bp, Homo sapiens
gatatttctacaaggtgttca

SEQ ID NO: 3035777 - DNA, 23 bp, Homo sapiens
gatatttctatttcctggaatgg

SEQ ID NO: 3035778 - DNA, 22 bp, Homo sapiens
gatatttctctagtagttaaaa

SEQ ID NO: 3035779 - DNA, 14 bp, Homo sapiens
gatattttgaaatg

SEQ ID NO: 3035780 - DNA, 16 bp, Homo sapiens
gatattttgaaatgaa

SEQ ID NO: 3035781 - DNA, 14 bp, Homo sapiens
gatatttttattca

SEQ ID NO: 3035782 - DNA, 20 bp, Homo sapiens
gatcaagcatgaaaggcttt

SEQ ID NO: 3035783 - DNA, 13 bp, Homo sapiens
gatcaaggcctta

SEQ ID NO: 3035784 - DNA, 22 bp, Homo sapiens
gatcaaggccttattggaaagc

SEQ ID NO: 3035785 - DNA, 15 bp, Homo sapiens
gatcaaggtgaaata

SEQ ID NO: 3035786 - DNA, 16 bp, Homo sapiens
gatcaattatagtttc

SEQ ID NO: 3035787 - DNA, 19 bp, Homo sapiens
gatcaattatagtttctga

SEQ ID NO: 3035788 - DNA, 15 bp, Homo sapiens
gatttttagaattaa

SEQ ID NO: 3035789 - DNA, 19 bp, Homo sapiens
gatttttattaactgcttt

SEQ ID NO: 3035790 - DNA, 23 bp, Homo sapiens
gatttttctggaggttgataact

SEQ ID NO: 3035791 - DNA, 21 bp, Homo sapiens
gatttttgttttccactgtgc

SEQ ID NO: 3035792 - DNA, 21 bp, Homo sapiens
gattttttcagacttgtcaag

SEQ ID NO: 3035793 - DNA, 19 bp, Homo sapiens
gatttttttataaacagtt

SEQ ID NO: 3035794 - DNA, 18 bp, Homo sapiens
gatttttttgttcttgtt

SEQ ID NO: 3035795 - DNA, 13 bp, Homo sapiens
gcaaaaaaagaaa

SEQ ID NO: 3035796 - DNA, 12 bp, Homo sapiens
gcaaaaaaatta

SEQ ID NO: 3035797 - DNA, 21 bp, Homo sapiens
gcaaaaaaattaaaatggatg

SEQ ID NO: 3035798 - DNA, 11 bp, Homo sapiens
gcaaaaaatac

SEQ ID NO: 3035799 - DNA, 12 bp, Homo sapiens
gcaaaaaatact

SEQ ID NO: 3035800 - DNA, 18 bp, Homo sapiens
gcaaaaaatactttttct

SEQ ID NO: 3035801 - DNA, 20 bp, Homo sapiens
gcaaaaaatactttttctaa

SEQ ID NO: 3035802 - DNA, 17 bp, Homo sapiens
gcaaaaaggactggaaa

SEQ ID NO: 3035803 - DNA, 15 bp, Homo sapiens
gcaaaaataatttat

SEQ ID NO: 3035804 - DNA, 16 bp, Homo sapiens
gcaaaaataatttatt

SEQ ID NO: 3035805 - DNA, 17 bp, Homo sapiens
gcaaaaataatttattt

SEQ ID NO: 3035806 - DNA, 21 bp, Homo sapiens
gcaaaaataatttattttgct

SEQ ID NO: 3035807 - DNA, 22 bp, Homo sapiens
gcaaaaataatttattttgctc

SEQ ID NO: 3035808 - DNA, 12 bp, Homo sapiens
gcaaaaatgcta

SEQ ID NO: 3035809 - DNA, 14 bp, Homo sapiens
gcaaaaatgctaat

SEQ ID NO: 3035810 - DNA, 23 bp, Homo sapiens
gcaaaactaaatacttgctccat

SEQ ID NO: 3035811 - DNA, 14 bp, Homo sapiens
gcaaaagaaagcaa

SEQ ID NO: 3035812 - DNA, 19 bp, Homo sapiens
gcaaaatcaagcaagcctc

SEQ ID NO: 3035813 - DNA, 18 bp, Homo sapiens
gcaaaatccaaactgctg

SEQ ID NO: 3035814 - DNA, 16 bp, Homo sapiens
gcaaaatgtcttgtgt

SEQ ID NO: 3035815 - DNA, 19 bp, Homo sapiens
gcaaaatgtcttgtgtatt

SEQ ID NO: 3035816 - DNA, 17 bp, Homo sapiens
gcaaacacaagaaatca

SEQ ID NO: 3035817 - DNA, 18 bp, Homo sapiens
gcaaacagggtggcccag

SEQ ID NO: 3035818 - DNA, 18 bp, Homo sapiens
gcaaaccaacctttctga

SEQ ID NO: 3035819 - DNA, 23 bp, Homo sapiens
gcaaaccaacctttctgacatca

SEQ ID NO: 3035820 - DNA, 16 bp, Homo sapiens
gcaaaccaagagattg

SEQ ID NO: 3035821 - DNA, 18 bp, Homo sapiens
gcaaaccaagagattgct

SEQ ID NO: 3035822 - DNA, 20 bp, Homo sapiens
gcaaaccaagagattgctaa

SEQ ID NO: 3035823 - DNA, 22 bp, Homo sapiens
gcaaaccaagagattgctaatt

SEQ ID NO: 3035824 - DNA, 21 bp, Homo sapiens
gcaaacctagccggaaggccg

SEQ ID NO: 3035825 - DNA, 15 bp, Homo sapiens
gcaaacgctgcctgc

SEQ ID NO: 3035826 - DNA, 14 bp, Homo sapiens
gcaaactctgctgt

SEQ ID NO: 3035827 - DNA, 23 bp, Homo sapiens
gcaaactttgtatgtcatttcct

SEQ ID NO: 3035828 - DNA, 15 bp, Homo sapiens
gcaaagaagcttcat

SEQ ID NO: 3035829 - DNA, 19 bp, Homo sapiens
gcaaagatatatattcacc

SEQ ID NO: 3035830 - DNA, 21 bp, Homo sapiens
gcaaagcgcccacccaggtcc

SEQ ID NO: 3035831 - DNA, 12 bp, Homo sapiens
gcaaaggagaca

SEQ ID NO: 3035832 - DNA, 20 bp, Homo sapiens
gcaaagggcatgggtcggga

SEQ ID NO: 3035833 - DNA, 22 bp, Homo sapiens
gcaaagggtccagaaggagaca

SEQ ID NO: 3035834 - DNA, 16 bp, Homo sapiens
gcaaagggtgggtttg

SEQ ID NO: 3035835 - DNA, 11 bp, Homo sapiens
gcaaagtactg

SEQ ID NO: 3035836 - DNA, 15 bp, Homo sapiens
gcaaagtattgtaaa

SEQ ID NO: 3035837 - DNA, 21 bp, Homo sapiens
gcaaagtattgtaaattatat

SEQ ID NO: 3035838 - DNA, 16 bp, Homo sapiens
gcaaagtcacttctcc

SEQ ID NO: 3035839 - DNA, 20 bp, Homo sapiens
gcaaagtcacttctccatca

SEQ ID NO: 3035840 - DNA, 14 bp, Homo sapiens
gcaaagtgttttgt

SEQ ID NO: 3035841 - DNA, 12 bp, Homo sapiens
gcaaataaaagt

SEQ ID NO: 3035842 - DNA, 22 bp, Homo sapiens
gcaaatcagaaacttgtgaagt

SEQ ID NO: 3035843 - DNA, 15 bp, Homo sapiens
gcaaatcctatgtga

SEQ ID NO: 3035844 - DNA, 17 bp, Homo sapiens
gcaaatcctatgtgatt

SEQ ID NO: 3035845 - DNA, 22 bp, Homo sapiens
gcaaatccttgtgggaaaagaa

SEQ ID NO: 3035846 - DNA, 21 bp, Homo sapiens
gcaaatgccaactgttggaat

SEQ ID NO: 3035847 - DNA, 15 bp, Homo sapiens
gcaaattagaaacac

SEQ ID NO: 3035848 - DNA, 17 bp, Homo sapiens
gcaaattatttttaaaa

SEQ ID NO: 3035849 - DNA, 17 bp, Homo sapiens
gcaaattccagatttgt

SEQ ID NO: 3035850 - DNA, 12 bp, Homo sapiens
gcaaattctttt

SEQ ID NO: 3035851 - DNA, 20 bp, Homo sapiens
gcaaattcttttgaattgtt

SEQ ID NO: 3035852 - DNA, 22 bp, Homo sapiens
gcaacaagaccaccacttcgaa

SEQ ID NO: 3035853 - DNA, 13 bp, Homo sapiens
gcaacacaacatt

SEQ ID NO: 3035854 - DNA, 18 bp, Homo sapiens
gcaacacagcctgggccc

SEQ ID NO: 3035855 - DNA, 17 bp, Homo sapiens
gcaacagagagaaaaag

SEQ ID NO: 3035856 - DNA, 12 bp, Homo sapiens
gcaacagatctg

SEQ ID NO: 3035857 - DNA, 18 bp, Homo sapiens
gcaacagatctggaacct

SEQ ID NO: 3035858 - DNA, 17 bp, Homo sapiens
gcaacatccaaaatagt

SEQ ID NO: 3035859 - DNA, 18 bp, Homo sapiens
gcaacatctagcaaatgt

SEQ ID NO: 3035860 - DNA, 15 bp, Homo sapiens
gcaacatggattcca

SEQ ID NO: 3035861 - DNA, 21 bp, Homo sapiens
gcaacatggattccaaagcat

SEQ ID NO: 3035862 - DNA, 14 bp, Homo sapiens
gcaacattccaaga

SEQ ID NO: 3035863 - DNA, 12 bp, Homo sapiens
gcaaccaaaagg

SEQ ID NO: 3035864 - DNA, 18 bp, Homo sapiens
gcaaccaaaagggaaaaa

SEQ ID NO: 3035865 - DNA, 19 bp, Homo sapiens
gcaaccaaaagggaaaaaa

SEQ ID NO: 3035866 - DNA, 13 bp, Homo sapiens
gcaaccagaagtt

SEQ ID NO: 3035867 - DNA, 13 bp, Homo sapiens
gcaacctctgcct

SEQ ID NO: 3035868 - DNA, 23 bp, Homo sapiens
gcaacctcttggcctgatcagac

SEQ ID NO: 3035869 - DNA, 22 bp, Homo sapiens
gcaacggtctcctgactggtgc

SEQ ID NO: 3035870 - DNA, 18 bp, Homo sapiens
gcaactctggctccaggc

SEQ ID NO: 3035871 - DNA, 12 bp, Homo sapiens
gcaacttgaaga

SEQ ID NO: 3035872 - DNA, 13 bp, Homo sapiens
gcaacttgaagaa

SEQ ID NO: 3035873 - DNA, 14 bp, Homo sapiens
gcaacttgaagaaa

SEQ ID NO: 3035874 - DNA, 17 bp, Homo sapiens
gcaagaaaaaaaaatgc

SEQ ID NO: 3035875 - DNA, 14 bp, Homo sapiens
gcaagagagaacct

SEQ ID NO: 3035876 - DNA, 22 bp, Homo sapiens
gcaagagccttggtgtccacct

SEQ ID NO: 3035877 - DNA, 14 bp, Homo sapiens
gcaagagggaaggt

SEQ ID NO: 3035878 - DNA, 18 bp, Homo sapiens
gcaagattctgaaacatt

SEQ ID NO: 3035879 - DNA, 19 bp, Homo sapiens
gcaagattggaaagacagg

SEQ ID NO: 3035880 - DNA, 20 bp, Homo sapiens
gcaagattggaaagacagga

SEQ ID NO: 3035881 - DNA, 22 bp, Homo sapiens
gcaagcaaacagggtggcccag

SEQ ID NO: 3035882 - DNA, 12 bp, Homo sapiens
gcaagcagaact

SEQ ID NO: 3035883 - DNA, 12 bp, Homo sapiens
gcaagcagagga

SEQ ID NO: 3035884 - DNA, 16 bp, Homo sapiens
gcaagcagaggaccag

SEQ ID NO: 3035885 - DNA, 21 bp, Homo sapiens
gcaagcagaggaccagggcct

SEQ ID NO: 3035886 - DNA, 15 bp, Homo sapiens
gcaagcatgcttgtg

SEQ ID NO: 3035887 - DNA, 11 bp, Homo sapiens
gcaagccaacc

SEQ ID NO: 3035888 - DNA, 19 bp, Homo sapiens
gcaagcctgtaatcccagc

SEQ ID NO: 3035889 - DNA, 22 bp, Homo sapiens
gcaagccttctaaatgagtcac

SEQ ID NO: 3035890 - DNA, 11 bp, Homo sapiens
gcaagctgtgt

SEQ ID NO: 3035891 - DNA, 12 bp, Homo sapiens
gcaagctgtgtt

SEQ ID NO: 3035892 - DNA, 16 bp, Homo sapiens
gcaagctgtgttactt

SEQ ID NO: 3035893 - DNA, 17 bp, Homo sapiens
gcaagctgtgttacttg

SEQ ID NO: 3035894 - DNA, 19 bp, Homo sapiens
gcaagctgtgttacttgaa

SEQ ID NO: 3035895 - DNA, 23 bp, Homo sapiens
gcaagctgtgttacttgaagtaa

SEQ ID NO: 3035896 - DNA, 16 bp, Homo sapiens
gcaagcttatttagca

SEQ ID NO: 3035897 - DNA, 21 bp, Homo sapiens
gcaagcttatttagcacattt

SEQ ID NO: 3035898 - DNA, 9 bp, Homo sapiens
gcaaggaaa

SEQ ID NO: 3035899 - DNA, 16 bp, Homo sapiens
gcaaggaaaaacaggt

SEQ ID NO: 3035900 - DNA, 19 bp, Homo sapiens
gcaaggagtttaaatgaga

SEQ ID NO: 3035901 - DNA, 16 bp, Homo sapiens
gcaaggattacagaaa

SEQ ID NO: 3035902 - DNA, 17 bp, Homo sapiens
gcaaggattacagaaac

SEQ ID NO: 3035903 - DNA, 14 bp, Homo sapiens
gcaagggcccagag

SEQ ID NO: 3035904 - DNA, 13 bp, Homo sapiens
gcaagggcctgga

SEQ ID NO: 3035905 - DNA, 16 bp, Homo sapiens
gcaagggggaaggctg

SEQ ID NO: 3035906 - DNA, 16 bp, Homo sapiens
gcaagggttccctcaa

SEQ ID NO: 3035907 - DNA, 18 bp, Homo sapiens
gcaagggttccctcaaga

SEQ ID NO: 3035908 - DNA, 14 bp, Homo sapiens
gcaaggttccacag

SEQ ID NO: 3035909 - DNA, 23 bp, Homo sapiens
gcaaggttccacagagtaagaca

SEQ ID NO: 3035910 - DNA, 22 bp, Homo sapiens
gcaaggtttaggctggtggccc

SEQ ID NO: 3035911 - DNA, 23 bp, Homo sapiens
gcaaggtttaggctggtggccca

SEQ ID NO: 3035912 - DNA, 18 bp, Homo sapiens
gcaagtcacactgcattg

SEQ ID NO: 3035913 - DNA, 14 bp, Homo sapiens
gcaagtcatgtaaa

SEQ ID NO: 3035914 - DNA, 21 bp, Homo sapiens
gcaagtctttaggtctttgta

SEQ ID NO: 3035915 - DNA, 19 bp, Homo sapiens
gcaagtgagaggggaggga

SEQ ID NO: 3035916 - DNA, 21 bp, Homo sapiens
gcaagtgagaggggagggagg

SEQ ID NO: 3035917 - DNA, 20 bp, Homo sapiens
gcaagtgctgtttgggcagg

SEQ ID NO: 3035918 - DNA, 15 bp, Homo sapiens
gcaagtggatgggaa

SEQ ID NO: 3035919 - DNA, 21 bp, Homo sapiens
gcaagtggatgggaatttgtc

SEQ ID NO: 3035920 - DNA, 19 bp, Homo sapiens
gcaagtgtctggagcggct

SEQ ID NO: 3035921 - DNA, 20 bp, Homo sapiens
gcaggcggccagggcggcca

SEQ ID NO: 3035922 - DNA, 20 bp, Homo sapiens
gcaggcggggggggcgcctg

SEQ ID NO: 3035923 - DNA, 23 bp, Homo sapiens
gcaggcggggggggcgcctggag

SEQ ID NO: 3035924 - DNA, 16 bp, Homo sapiens
gcaggcggtgggcacc

SEQ ID NO: 3035925 - DNA, 16 bp, Homo sapiens
gcaggcgtgactcagc

SEQ ID NO: 3035926 - DNA, 22 bp, Homo sapiens
gcaggcgtgactcagcagcctg

SEQ ID NO: 3035927 - DNA, 16 bp, Homo sapiens
gcaggcgtgtggcagc

SEQ ID NO: 3035928 - DNA, 22 bp, Homo sapiens
gcaggcgtgtggcagccacacg

SEQ ID NO: 3035929 - DNA, 23 bp, Homo sapiens
gcaggctcccagggacacctggg

SEQ ID NO: 3035930 - DNA, 16 bp, Homo sapiens
gcaggctcccctgagg

SEQ ID NO: 3035931 - DNA, 20 bp, Homo sapiens
gcaggctgcaggagggcact

SEQ ID NO: 3035932 - DNA, 20 bp, Homo sapiens
gcaggctggccagccgctct

SEQ ID NO: 3035933 - DNA, 22 bp, Homo sapiens
gcaggcttaataaaaatgacag

SEQ ID NO: 3035934 - DNA, 22 bp, Homo sapiens
gcagggacccggggtctcctgg

SEQ ID NO: 3035935 - DNA, 13 bp, Homo sapiens
gcagggatgccct

SEQ ID NO: 3035936 - DNA, 21 bp, Homo sapiens
gcagggatgccctggaggtgg

SEQ ID NO: 3035937 - DNA, 23 bp, Homo sapiens
gcagggccactcaacagagagga

SEQ ID NO: 3035938 - DNA, 21 bp, Homo sapiens
gcagggccccaggcattgcca

SEQ ID NO: 3035939 - DNA, 15 bp, Homo sapiens
gcagggccgccaggg

SEQ ID NO: 3035940 - DNA, 23 bp, Homo sapiens
gcagggccgctcgatgcctttgc

SEQ ID NO: 3035941 - DNA, 17 bp, Homo sapiens
gcagggcctagctgcta

SEQ ID NO: 3035942 - DNA, 20 bp, Homo sapiens
gcagggcctagctgctacaa

SEQ ID NO: 3035943 - DNA, 21 bp, Homo sapiens
gcagggccttgcccagagatg

SEQ ID NO: 3035944 - DNA, 17 bp, Homo sapiens
gcagggcgggcagaggg

SEQ ID NO: 3035945 - DNA, 11 bp, Homo sapiens
gcagggctggt

SEQ ID NO: 3035946 - DNA, 14 bp, Homo sapiens
gcagggctggtttg

SEQ ID NO: 3035947 - DNA, 12 bp, Homo sapiens
gcaggggactgg

SEQ ID NO: 3035948 - DNA, 14 bp, Homo sapiens
gcaggggagccagg

SEQ ID NO: 3035949 - DNA, 15 bp, Homo sapiens
gcaggggctgctggg

SEQ ID NO: 3035950 - DNA, 16 bp, Homo sapiens
gcagggggactgcttg

SEQ ID NO: 3035951 - DNA, 22 bp, Homo sapiens
gcaggggttgagagctttctgc

SEQ ID NO: 3035952 - DNA, 21 bp, Homo sapiens
gcagggtctgtttggactgca

SEQ ID NO: 3035953 - DNA, 16 bp, Homo sapiens
gcagggtcttttcatc

SEQ ID NO: 3035954 - DNA, 23 bp, Homo sapiens
gcagggtcttttcatctgggaaa

SEQ ID NO: 3035955 - DNA, 22 bp, Homo sapiens
gcagggtgcagtatcatgccct

SEQ ID NO: 3035956 - DNA, 20 bp, Homo sapiens
gcagggtggtggtattctgt

SEQ ID NO: 3035957 - DNA, 22 bp, Homo sapiens
gcagggtggtggtattctgtca

SEQ ID NO: 3035958 - DNA, 15 bp, Homo sapiens
gcagggtttgagcac

SEQ ID NO: 3035959 - DNA, 14 bp, Homo sapiens
gcaggtaccactga

SEQ ID NO: 3035960 - DNA, 16 bp, Homo sapiens
gcaggtgaaacccagt

SEQ ID NO: 3035961 - DNA, 20 bp, Homo sapiens
gcaggtgaaacccagtcact

SEQ ID NO: 3035962 - DNA, 17 bp, Homo sapiens
gcaggtggccgcccctg

SEQ ID NO: 3035963 - DNA, 18 bp, Homo sapiens
gcaggtggccgcccctga

SEQ ID NO: 3035964 - DNA, 22 bp, Homo sapiens
gcaggtggccgcccctgaggct

SEQ ID NO: 3035965 - DNA, 18 bp, Homo sapiens
gcaggtggcctctgctgg

SEQ ID NO: 3035966 - DNA, 19 bp, Homo sapiens
gcaggtggcctctgctggt

SEQ ID NO: 3035967 - DNA, 21 bp, Homo sapiens
gcaggtggcctctgctggtct

SEQ ID NO: 3035968 - DNA, 13 bp, Homo sapiens
gcaggttcccaag

SEQ ID NO: 3035969 - DNA, 15 bp, Homo sapiens
gcaggttcccaagct

SEQ ID NO: 3035970 - DNA, 16 bp, Homo sapiens
gcaggttcccaagctc

SEQ ID NO: 3035971 - DNA, 21 bp, Homo sapiens
gcaggttggcaaacgggcttg

SEQ ID NO: 3035972 - DNA, 15 bp, Homo sapiens
gcaggtttgaccagg

SEQ ID NO: 3035973 - DNA, 17 bp, Homo sapiens
gcaggtttgaccaggaa

SEQ ID NO: 3035974 - DNA, 19 bp, Homo sapiens
gcaggtttgaccaggaaag

SEQ ID NO: 3035975 - DNA, 15 bp, Homo sapiens
gcagtagattttctt

SEQ ID NO: 3035976 - DNA, 12 bp, Homo sapiens
gcagtatatttc

SEQ ID NO: 3035977 - DNA, 17 bp, Homo sapiens
gcagtatggtacatttt

SEQ ID NO: 3035978 - DNA, 15 bp, Homo sapiens
gcagtccagagcttt

SEQ ID NO: 3035979 - DNA, 23 bp, Homo sapiens
gcagtccttttactacagctatg

SEQ ID NO: 3035980 - DNA, 17 bp, Homo sapiens
gcagtcgcttgccaaag

SEQ ID NO: 3035981 - DNA, 15 bp, Homo sapiens
gcagtcggcatgcca

SEQ ID NO: 3035982 - DNA, 16 bp, Homo sapiens
gcagtcggcatgccag

SEQ ID NO: 3035983 - DNA, 20 bp, Homo sapiens
gcagtcggcatgccaggacc

SEQ ID NO: 3035984 - DNA, 13 bp, Homo sapiens
gcagtctctgcct

SEQ ID NO: 3035985 - DNA, 14 bp, Homo sapiens
gcagtgaagtgttc

SEQ ID NO: 3035986 - DNA, 14 bp, Homo sapiens
gcagtgagctgaga

SEQ ID NO: 3035987 - DNA, 15 bp, Homo sapiens
gcagtgagctgagat

SEQ ID NO: 3035988 - DNA, 21 bp, Homo sapiens
gcagtgatgctggatgctcct

SEQ ID NO: 3035989 - DNA, 13 bp, Homo sapiens
gcagtgcacattt

SEQ ID NO: 3035990 - DNA, 13 bp, Homo sapiens
gcagtgccagcca

SEQ ID NO: 3035991 - DNA, 22 bp, Homo sapiens
gcagtgctgagggaccgagccc

SEQ ID NO: 3035992 - DNA, 22 bp, Homo sapiens
gcagtggccacgttcagggagg

SEQ ID NO: 3035993 - DNA, 23 bp, Homo sapiens
gcagtggccacgttcagggaggg

SEQ ID NO: 3035994 - DNA, 12 bp, Homo sapiens
gcagtgggcagg

SEQ ID NO: 3035995 - DNA, 17 bp, Homo sapiens
gcagtgggcaggtggcc

SEQ ID NO: 3035996 - DNA, 16 bp, Homo sapiens
gcagtgggcctggcca

SEQ ID NO: 3035997 - DNA, 17 bp, Homo sapiens
gcagtgggcctggccag

SEQ ID NO: 3035998 - DNA, 14 bp, Homo sapiens
gcagtggtgcgatc

SEQ ID NO: 3035999 - DNA, 21 bp, Homo sapiens
gcagtgtccagaagcggcctg

SEQ ID NO: 3036000 - DNA, 16 bp, Homo sapiens
gcagtgtcttaaggag

SEQ ID NO: 3036001 - DNA, 21 bp, Homo sapiens
gcagtgtcttaaggagactgg

SEQ ID NO: 3036002 - DNA, 19 bp, Homo sapiens
gcagtgtgaggccagggca

SEQ ID NO: 3036003 - DNA, 21 bp, Homo sapiens
gcagtgtgcactaaggggccc

SEQ ID NO: 3036004 - DNA, 22 bp, Homo sapiens
gcagtgtgtccatcatattaaa

SEQ ID NO: 3036005 - DNA, 18 bp, Homo sapiens
gcagttacatgcatactt

SEQ ID NO: 3036006 - DNA, 23 bp, Homo sapiens
gcagttactccctacactgatgc

SEQ ID NO: 3036007 - DNA, 15 bp, Homo sapiens
gcagttccatcaggt

SEQ ID NO: 3036008 - DNA, 16 bp, Homo sapiens
gcagttctagtttgca

SEQ ID NO: 3036009 - DNA, 14 bp, Homo sapiens
gcagttgaggtggg

SEQ ID NO: 3036010 - DNA, 15 bp, Homo sapiens
gcagtttatcattca

SEQ ID NO: 3036011 - DNA, 13 bp, Homo sapiens
gcagtttgaaatt

SEQ ID NO: 3036012 - DNA, 21 bp, Homo sapiens
gcagttttgacatcagccagc

SEQ ID NO: 3036013 - DNA, 16 bp, Homo sapiens
gcagttttgtaaatgt

SEQ ID NO: 3036014 - DNA, 22 bp, Homo sapiens
gcataaatctgaagtggttcag

SEQ ID NO: 3036015 - DNA, 14 bp, Homo sapiens
gcataaatgggaac

SEQ ID NO: 3036016 - DNA, 13 bp, Homo sapiens
gcataaatttaat

SEQ ID NO: 3036017 - DNA, 16 bp, Homo sapiens
gcataacaattcctct

SEQ ID NO: 3036018 - DNA, 17 bp, Homo sapiens
gcataacaattcctcta

SEQ ID NO: 3036019 - DNA, 12 bp, Homo sapiens
gcataagaaaaa

SEQ ID NO: 3036020 - DNA, 16 bp, Homo sapiens
gcataagaccaatctc

SEQ ID NO: 3036021 - DNA, 21 bp, Homo sapiens
gcataattccgaaacaaaact

SEQ ID NO: 3036022 - DNA, 21 bp, Homo sapiens
gcataatttgtttaaaattct

SEQ ID NO: 3036023 - DNA, 22 bp, Homo sapiens
gcataatttgtttaaaattctc

SEQ ID NO: 3036024 - DNA, 11 bp, Homo sapiens
gcatacacaca

SEQ ID NO: 3036025 - DNA, 14 bp, Homo sapiens
gcatacacacacac

SEQ ID NO: 3036026 - DNA, 19 bp, Homo sapiens
gcatacctttcacagcttt

SEQ ID NO: 3036027 - DNA, 21 bp, Homo sapiens
gcatactccgtgaggctgctg

SEQ ID NO: 3036028 - DNA, 13 bp, Homo sapiens
gcatacttcaaaa

SEQ ID NO: 3036029 - DNA, 17 bp, Homo sapiens
gcatacttcaaaagtat

SEQ ID NO: 3036030 - DNA, 18 bp, Homo sapiens
gcatacttcaaaagtatt

SEQ ID NO: 3036031 - DNA, 21 bp, Homo sapiens
gcatacttcaaaagtattttc

SEQ ID NO: 3036032 - DNA, 14 bp, Homo sapiens
gcatactttgtaaa

SEQ ID NO: 3036033 - DNA, 15 bp, Homo sapiens
gcatacttttaatca

SEQ ID NO: 3036034 - DNA, 18 bp, Homo sapiens
gcatacttttaatcaagt

SEQ ID NO: 3036035 - DNA, 18 bp, Homo sapiens
gcatagcgtcctgccctg

SEQ ID NO: 3036036 - DNA, 19 bp, Homo sapiens
gcatagcgtcctgccctgc

SEQ ID NO: 3036037 - DNA, 15 bp, Homo sapiens
gcataggtatgctta

SEQ ID NO: 3036038 - DNA, 20 bp, Homo sapiens
gcatatcatgctttgaaaaa

SEQ ID NO: 3036039 - DNA, 22 bp, Homo sapiens
gcatatctctagtccctgtgtt

SEQ ID NO: 3036040 - DNA, 20 bp, Homo sapiens
gcatatgttgaatacttttt

SEQ ID NO: 3036041 - DNA, 18 bp, Homo sapiens
gcatattcaacacactgc

SEQ ID NO: 3036042 - DNA, 18 bp, Homo sapiens
gcatattgtacacttttt

SEQ ID NO: 3036043 - DNA, 23 bp, Homo sapiens
gcatatttatccaaaatgtgtat

SEQ ID NO: 3036044 - DNA, 14 bp, Homo sapiens
gcatcaaaagacaa

SEQ ID NO: 3036045 - DNA, 16 bp, Homo sapiens
gcatcaaaagacaatt

SEQ ID NO: 3036046 - DNA, 17 bp, Homo sapiens
gcatcaaaagacaattc

SEQ ID NO: 3036047 - DNA, 22 bp, Homo sapiens
gcatcaaaagacaattctttat

SEQ ID NO: 3036048 - DNA, 14 bp, Homo sapiens
gcatcaaacatgaa

SEQ ID NO: 3036049 - DNA, 16 bp, Homo sapiens
gcatcaaacatgaaaa

SEQ ID NO: 3036050 - DNA, 22 bp, Homo sapiens
gcatcaaacatgaaaacattga

SEQ ID NO: 3036051 - DNA, 22 bp, Homo sapiens
gcatcaaggggtcacttacaga

SEQ ID NO: 3036052 - DNA, 21 bp, Homo sapiens
gccaggcccccaccacacatc

SEQ ID NO: 3036053 - DNA, 15 bp, Homo sapiens
gccaggccctggagg

SEQ ID NO: 3036054 - DNA, 23 bp, Homo sapiens
gccaggccctggagggcagagac

SEQ ID NO: 3036055 - DNA, 19 bp, Homo sapiens
gccaggccggcgagccctg

SEQ ID NO: 3036056 - DNA, 21 bp, Homo sapiens
gccaggccgggcctgtacagt

SEQ ID NO: 3036057 - DNA, 13 bp, Homo sapiens
gccaggcctcgca

SEQ ID NO: 3036058 - DNA, 14 bp, Homo sapiens
gccaggcctcgcct

SEQ ID NO: 3036059 - DNA, 17 bp, Homo sapiens
gccaggcctcgcctgcc

SEQ ID NO: 3036060 - DNA, 19 bp, Homo sapiens
gccaggcctcgcctgccct

SEQ ID NO: 3036061 - DNA, 21 bp, Homo sapiens
gccaggcctcttggcagtcac

SEQ ID NO: 3036062 - DNA, 12 bp, Homo sapiens
gccaggcgctgc

SEQ ID NO: 3036063 - DNA, 17 bp, Homo sapiens
gccaggcgctgcagggc

SEQ ID NO: 3036064 - DNA, 16 bp, Homo sapiens
gccaggctgaccacag

SEQ ID NO: 3036065 - DNA, 22 bp, Homo sapiens
gccaggctgaccacagcacagc

SEQ ID NO: 3036066 - DNA, 15 bp, Homo sapiens
gccaggctgatctcg

SEQ ID NO: 3036067 - DNA, 14 bp, Homo sapiens
gccaggctgcctgg

SEQ ID NO: 3036068 - DNA, 14 bp, Homo sapiens
gccaggctgcggtg

SEQ ID NO: 3036069 - DNA, 21 bp, Homo sapiens
gccaggctgggccgcaagggc

SEQ ID NO: 3036070 - DNA, 17 bp, Homo sapiens
gccaggctggtccgagc

SEQ ID NO: 3036071 - DNA, 13 bp, Homo sapiens
gccaggcttgcct

SEQ ID NO: 3036072 - DNA, 16 bp, Homo sapiens
gccaggcttgcctggg

SEQ ID NO: 3036073 - DNA, 19 bp, Homo sapiens
gccaggcttgcctgggctg

SEQ ID NO: 3036074 - DNA, 17 bp, Homo sapiens
gccaggcttggatggaa

SEQ ID NO: 3036075 - DNA, 15 bp, Homo sapiens
gccagggagaagctc

SEQ ID NO: 3036076 - DNA, 15 bp, Homo sapiens
gccagggagacctgg

SEQ ID NO: 3036077 - DNA, 21 bp, Homo sapiens
gccagggagacctggacacag

SEQ ID NO: 3036078 - DNA, 15 bp, Homo sapiens
gccagggaggcagag

SEQ ID NO: 3036079 - DNA, 20 bp, Homo sapiens
gccagggaggcagagcggga

SEQ ID NO: 3036080 - DNA, 15 bp, Homo sapiens
gccagggcagagtga

SEQ ID NO: 3036081 - DNA, 16 bp, Homo sapiens
gccagggcagagtgag

SEQ ID NO: 3036082 - DNA, 14 bp, Homo sapiens
gccagggcagggcc

SEQ ID NO: 3036083 - DNA, 19 bp, Homo sapiens
gccagggcagggccccagg

SEQ ID NO: 3036084 - DNA, 20 bp, Homo sapiens
gccagggccacgctccagct

SEQ ID NO: 3036085 - DNA, 17 bp, Homo sapiens
gccagggcccaggccat

SEQ ID NO: 3036086 - DNA, 22 bp, Homo sapiens
gccagggctcctgtggcagctg

SEQ ID NO: 3036087 - DNA, 16 bp, Homo sapiens
gccagggctctggggg

SEQ ID NO: 3036088 - DNA, 17 bp, Homo sapiens
gccagggctgggtcaca

SEQ ID NO: 3036089 - DNA, 18 bp, Homo sapiens
gccagggctgggtcacag

SEQ ID NO: 3036090 - DNA, 10 bp, Homo sapiens
gccagggctt

SEQ ID NO: 3036091 - DNA, 19 bp, Homo sapiens
gccaggggggtgaggagct

SEQ ID NO: 3036092 - DNA, 21 bp, Homo sapiens
gccaggtaatgtgaataaatt

SEQ ID NO: 3036093 - DNA, 18 bp, Homo sapiens
gccaggtccccctgcagc

SEQ ID NO: 3036094 - DNA, 19 bp, Homo sapiens
gccaggtccccctgcagct

SEQ ID NO: 3036095 - DNA, 14 bp, Homo sapiens
gccaggtgcggcct

SEQ ID NO: 3036096 - DNA, 15 bp, Homo sapiens
gccaggtgcggcctg

SEQ ID NO: 3036097 - DNA, 17 bp, Homo sapiens
gccaggtgcggcctggg

SEQ ID NO: 3036098 - DNA, 22 bp, Homo sapiens
gccaggtgcggcctggggggaa

SEQ ID NO: 3036099 - DNA, 16 bp, Homo sapiens
gccaggtgggcggaca

SEQ ID NO: 3036100 - DNA, 22 bp, Homo sapiens
gccagtatctatatatgtgtat

SEQ ID NO: 3036101 - DNA, 12 bp, Homo sapiens
gccagtcctggt

SEQ ID NO: 3036102 - DNA, 18 bp, Homo sapiens
gccagtcgggagagccag

SEQ ID NO: 3036103 - DNA, 20 bp, Homo sapiens
gccagtcgggagagccaggc

SEQ ID NO: 3036104 - DNA, 22 bp, Homo sapiens
gccagtctcactgtgggaaggc

SEQ ID NO: 3036105 - DNA, 14 bp, Homo sapiens
gccagtcttcctct

SEQ ID NO: 3036106 - DNA, 20 bp, Homo sapiens
gccagtcttgacgagtgtga

SEQ ID NO: 3036107 - DNA, 20 bp, Homo sapiens
gccagtgccttacctcctgc

SEQ ID NO: 3036108 - DNA, 22 bp, Homo sapiens
gccagtgccttacctcctgccc

SEQ ID NO: 3036109 - DNA, 12 bp, Homo sapiens
gccagtgtttct

SEQ ID NO: 3036110 - DNA, 15 bp, Homo sapiens
gccagtgtttctgaa

SEQ ID NO: 3036111 - DNA, 15 bp, Homo sapiens
gccagttttctgttc

SEQ ID NO: 3036112 - DNA, 21 bp, Homo sapiens
gccataacagattatgtatta

SEQ ID NO: 3036113 - DNA, 18 bp, Homo sapiens
gccatacattaaggagca

SEQ ID NO: 3036114 - DNA, 14 bp, Homo sapiens
gccataggccaagg

SEQ ID NO: 3036115 - DNA, 15 bp, Homo sapiens
gccataggccaaggt

SEQ ID NO: 3036116 - DNA, 16 bp, Homo sapiens
gccatagtcacatggc

SEQ ID NO: 3036117 - DNA, 19 bp, Homo sapiens
gccatataagtttgaagga

SEQ ID NO: 3036118 - DNA, 22 bp, Homo sapiens
gccatataagtttgaaggaaac

SEQ ID NO: 3036119 - DNA, 16 bp, Homo sapiens
gccatatgaaaaggct

SEQ ID NO: 3036120 - DNA, 20 bp, Homo sapiens
gccatatggacactgtgaca

SEQ ID NO: 3036121 - DNA, 19 bp, Homo sapiens
gccatcaaaatgcttttta

SEQ ID NO: 3036122 - DNA, 15 bp, Homo sapiens
gccatcaagcacttc

SEQ ID NO: 3036123 - DNA, 19 bp, Homo sapiens
gccatcaagcacttcccag

SEQ ID NO: 3036124 - DNA, 15 bp, Homo sapiens
gccatcactcagccc

SEQ ID NO: 3036125 - DNA, 21 bp, Homo sapiens
gccatcactcagcccctaccc

SEQ ID NO: 3036126 - DNA, 22 bp, Homo sapiens
gccatcactcagcccctacccc

SEQ ID NO: 3036127 - DNA, 18 bp, Homo sapiens
gccatcattgctgtctgc

SEQ ID NO: 3036128 - DNA, 19 bp, Homo sapiens
gccatcattgctgtctgca

SEQ ID NO: 3036129 - DNA, 15 bp, Homo sapiens
gccatccacatttta

SEQ ID NO: 3036130 - DNA, 16 bp, Homo sapiens
gccatccccagggggc

SEQ ID NO: 3036131 - DNA, 19 bp, Homo sapiens
gccatccccctctcacgcc

SEQ ID NO: 3036132 - DNA, 23 bp, Homo sapiens
gccatccgcagactgcttggcca

SEQ ID NO: 3036133 - DNA, 18 bp, Homo sapiens
gccatctaatgcttgttt

SEQ ID NO: 3036134 - DNA, 12 bp, Homo sapiens
gccatctcaggt

SEQ ID NO: 3036135 - DNA, 16 bp, Homo sapiens
gccatctgcgcagggt

SEQ ID NO: 3036136 - DNA, 21 bp, Homo sapiens
gccatctgcgtgacaataaaa

SEQ ID NO: 3036137 - DNA, 16 bp, Homo sapiens
gccatcttggcagggt

SEQ ID NO: 3036138 - DNA, 16 bp, Homo sapiens
gccatcttggtaaatt

SEQ ID NO: 3036139 - DNA, 18 bp, Homo sapiens
gccatgatgcctctgtct

SEQ ID NO: 3036140 - DNA, 21 bp, Homo sapiens
gccatgatggcaacagatctg

SEQ ID NO: 3036141 - DNA, 19 bp, Homo sapiens
gccatgatttcccactgca

SEQ ID NO: 3036142 - DNA, 23 bp, Homo sapiens
gccatgatttcccactgcactcc

SEQ ID NO: 3036143 - DNA, 22 bp, Homo sapiens
gccatgcaccaggactggctgt

SEQ ID NO: 3036144 - DNA, 14 bp, Homo sapiens
gccatgctgtccct

SEQ ID NO: 3036145 - DNA, 15 bp, Homo sapiens
gccatgctgtccctg

SEQ ID NO: 3036146 - DNA, 17 bp, Homo sapiens
gccatgctgtccctgca

SEQ ID NO: 3036147 - DNA, 18 bp, Homo sapiens
gccatgctgtccctgcac

SEQ ID NO: 3036148 - DNA, 20 bp, Homo sapiens
gccatggagtgagacccagg

SEQ ID NO: 3036149 - DNA, 21 bp, Homo sapiens
gccatggagtgagacccagga

SEQ ID NO: 3036150 - DNA, 19 bp, Homo sapiens
gccatggatttccactgct

SEQ ID NO: 3036151 - DNA, 12 bp, Homo sapiens
gccatggcctct

SEQ ID NO: 3036152 - DNA, 23 bp, Homo sapiens
gccatggctcagggtggtctctt

SEQ ID NO: 3036153 - DNA, 18 bp, Homo sapiens
gccatggctttcatcctg

SEQ ID NO: 3036154 - DNA, 19 bp, Homo sapiens
gccatggctttcatcctgt

SEQ ID NO: 3036155 - DNA, 17 bp, Homo sapiens
gccatgtacagacagag

SEQ ID NO: 3036156 - DNA, 16 bp, Homo sapiens
gccatgtctgtgctgt

SEQ ID NO: 3036157 - DNA, 14 bp, Homo sapiens
gccatgtgactctg

SEQ ID NO: 3036158 - DNA, 15 bp, Homo sapiens
gccatgtggcctgcc

SEQ ID NO: 3036159 - DNA, 20 bp, Homo sapiens
gccatgttccacttggaaat

SEQ ID NO: 3036160 - DNA, 16 bp, Homo sapiens
gccatgtttttgccaa

SEQ ID NO: 3036161 - DNA, 17 bp, Homo sapiens
gccatgtttttgccaaa

SEQ ID NO: 3036162 - DNA, 18 bp, Homo sapiens
gccattacccagctaaat

SEQ ID NO: 3036163 - DNA, 14 bp, Homo sapiens
gccattacccagtg

SEQ ID NO: 3036164 - DNA, 15 bp, Homo sapiens
gccattctccccctc

SEQ ID NO: 3036165 - DNA, 20 bp, Homo sapiens
gccattctcctgcctcagcc

SEQ ID NO: 3036166 - DNA, 23 bp, Homo sapiens
gccattctcctgcctcagccttc

SEQ ID NO: 3036167 - DNA, 12 bp, Homo sapiens
gccattctttcc

SEQ ID NO: 3036168 - DNA, 15 bp, Homo sapiens
gccattgtactccag

SEQ ID NO: 3036169 - DNA, 22 bp, Homo sapiens
gccattgtcttcggaaaccttg

SEQ ID NO: 3036170 - DNA, 16 bp, Homo sapiens
gccatttatttattga

SEQ ID NO: 3036171 - DNA, 20 bp, Homo sapiens
gccatttcctcacgtgcagg

SEQ ID NO: 3036172 - DNA, 22 bp, Homo sapiens
gccattttaaggaaaactacct

SEQ ID NO: 3036173 - DNA, 13 bp, Homo sapiens
gccattttggaaa

SEQ ID NO: 3036174 - DNA, 17 bp, Homo sapiens
gccattttgtaaactaa

SEQ ID NO: 3036175 - DNA, 15 bp, Homo sapiens
gcccaaaccttgggc

SEQ ID NO: 3036176 - DNA, 18 bp, Homo sapiens
gcccaaagcttgtaaata

SEQ ID NO: 3036177 - DNA, 15 bp, Homo sapiens
gcccaaatggctctg

SEQ ID NO: 3036178 - DNA, 19 bp, Homo sapiens
gcccaaatttaatttgcaa

SEQ ID NO: 3036179 - DNA, 23 bp, Homo sapiens
gcccaacagacaccatcttttgt

SEQ ID NO: 3036180 - DNA, 14 bp, Homo sapiens
gcccaacagcactt

SEQ ID NO: 3036181 - DNA, 13 bp, Homo sapiens
gcccaagagcccg

SEQ ID NO: 3036182 - DNA, 14 bp, Homo sapiens
gcccaaggctcccg

SEQ ID NO: 3036183 - DNA, 15 bp, Homo sapiens
gcccaagggatctgg

SEQ ID NO: 3036184 - DNA, 23 bp, Homo sapiens
gccggaggccttggggtgggggc

SEQ ID NO: 3036185 - DNA, 18 bp, Homo sapiens
gccggatgaaacttctca

SEQ ID NO: 3036186 - DNA, 20 bp, Homo sapiens
gccggatgaaacttctcagt

SEQ ID NO: 3036187 - DNA, 16 bp, Homo sapiens
gccggcatccttgcct

SEQ ID NO: 3036188 - DNA, 12 bp, Homo sapiens
gccggccagcca

SEQ ID NO: 3036189 - DNA, 15 bp, Homo sapiens
gccggccagccagcc

SEQ ID NO: 3036190 - DNA, 17 bp, Homo sapiens
gccggccagccagccac

SEQ ID NO: 3036191 - DNA, 18 bp, Homo sapiens
gccggccctgcccctccc

SEQ ID NO: 3036192 - DNA, 19 bp, Homo sapiens
gccggctggcctggaggct

SEQ ID NO: 3036193 - DNA, 16 bp, Homo sapiens
gccggctgtgctcaga

SEQ ID NO: 3036194 - DNA, 15 bp, Homo sapiens
gccgggaccctcagg

SEQ ID NO: 3036195 - DNA, 17 bp, Homo sapiens
gccgggagaagccacct

SEQ ID NO: 3036196 - DNA, 14 bp, Homo sapiens
gccgggagaggatg

SEQ ID NO: 3036197 - DNA, 20 bp, Homo sapiens
gccgggcacagtggctcacg

SEQ ID NO: 3036198 - DNA, 12 bp, Homo sapiens
gccgggcaggcg

SEQ ID NO: 3036199 - DNA, 22 bp, Homo sapiens
gccgggcaggcgtgactcagca

SEQ ID NO: 3036200 - DNA, 15 bp, Homo sapiens
gccgggcatgatggt

SEQ ID NO: 3036201 - DNA, 14 bp, Homo sapiens
gccgggcctgtaca

SEQ ID NO: 3036202 - DNA, 16 bp, Homo sapiens
gccgggctagagcctt

SEQ ID NO: 3036203 - DNA, 13 bp, Homo sapiens
gccggggaggggg

SEQ ID NO: 3036204 - DNA, 15 bp, Homo sapiens
gccggggagggggca

SEQ ID NO: 3036205 - DNA, 16 bp, Homo sapiens
gccggggagggggcac

SEQ ID NO: 3036206 - DNA, 18 bp, Homo sapiens
gccggggagggggcacgg

SEQ ID NO: 3036207 - DNA, 23 bp, Homo sapiens
gccggggagggggcacggcaggc

SEQ ID NO: 3036208 - DNA, 17 bp, Homo sapiens
gccggggtcctgggagg

SEQ ID NO: 3036209 - DNA, 23 bp, Homo sapiens
gccggggtcctgggaggctgcag

SEQ ID NO: 3036210 - DNA, 21 bp, Homo sapiens
gccgggtgtggcacgcacctg

SEQ ID NO: 3036211 - DNA, 22 bp, Homo sapiens
gccgtacctgcaagtatccaga

SEQ ID NO: 3036212 - DNA, 20 bp, Homo sapiens
gccgtcaaggaaagggcagt

SEQ ID NO: 3036213 - DNA, 19 bp, Homo sapiens
gccgtcagccatcagccat

SEQ ID NO: 3036214 - DNA, 20 bp, Homo sapiens
gccgtgctcgccccagcagg

SEQ ID NO: 3036215 - DNA, 12 bp, Homo sapiens
gccgtggctcca

SEQ ID NO: 3036216 - DNA, 13 bp, Homo sapiens
gccgtggctccag

SEQ ID NO: 3036217 - DNA, 15 bp, Homo sapiens
gccgtggctccagaa

SEQ ID NO: 3036218 - DNA, 18 bp, Homo sapiens
gccgtggcttgggctggt

SEQ ID NO: 3036219 - DNA, 15 bp, Homo sapiens
gccgttactctccaa

SEQ ID NO: 3036220 - DNA, 20 bp, Homo sapiens
gccgttactctccaacctgg

SEQ ID NO: 3036221 - DNA, 17 bp, Homo sapiens
gcctaaatttattaaat

SEQ ID NO: 3036222 - DNA, 16 bp, Homo sapiens
gcctaagtggctgctg

SEQ ID NO: 3036223 - DNA, 17 bp, Homo sapiens
gcctaagtggctgctga

SEQ ID NO: 3036224 - DNA, 23 bp, Homo sapiens
gcctaattacgataaggaagaaa

SEQ ID NO: 3036225 - DNA, 14 bp, Homo sapiens
gcctaattgtcaca

SEQ ID NO: 3036226 - DNA, 18 bp, Homo sapiens
gcctaattgtcacatcaa

SEQ ID NO: 3036227 - DNA, 19 bp, Homo sapiens
gcctaccgggttctcctga

SEQ ID NO: 3036228 - DNA, 17 bp, Homo sapiens
gcctaccttgtgaggga

SEQ ID NO: 3036229 - DNA, 12 bp, Homo sapiens
gcctactcacga

SEQ ID NO: 3036230 - DNA, 17 bp, Homo sapiens
gcctactgagtagcttt

SEQ ID NO: 3036231 - DNA, 19 bp, Homo sapiens
gcctactgagtagctttca

SEQ ID NO: 3036232 - DNA, 17 bp, Homo sapiens
gcctagaagctggtggc

SEQ ID NO: 3036233 - DNA, 16 bp, Homo sapiens
gcctagaatctttatt

SEQ ID NO: 3036234 - DNA, 15 bp, Homo sapiens
gcctagctgctacaa

SEQ ID NO: 3036235 - DNA, 16 bp, Homo sapiens
gcctagctgctacaaa

SEQ ID NO: 3036236 - DNA, 17 bp, Homo sapiens
gcctagctgctacaaag

SEQ ID NO: 3036237 - DNA, 19 bp, Homo sapiens
gcctagctgctacaaagaa

SEQ ID NO: 3036238 - DNA, 22 bp, Homo sapiens
gcctagctgctacaaagaagac

SEQ ID NO: 3036239 - DNA, 14 bp, Homo sapiens
gcctaggattctaa

SEQ ID NO: 3036240 - DNA, 13 bp, Homo sapiens
gcctaggatttca

SEQ ID NO: 3036241 - DNA, 23 bp, Homo sapiens
gcctagtgaaggcttctctctgt

SEQ ID NO: 3036242 - DNA, 23 bp, Homo sapiens
gcctagtggggtctccctctcct

SEQ ID NO: 3036243 - DNA, 14 bp, Homo sapiens
gcctataaatttac

SEQ ID NO: 3036244 - DNA, 14 bp, Homo sapiens
gcctataacttttt

SEQ ID NO: 3036245 - DNA, 20 bp, Homo sapiens
gcctataatcccagctactg

SEQ ID NO: 3036246 - DNA, 14 bp, Homo sapiens
gcctatcctggcca

SEQ ID NO: 3036247 - DNA, 23 bp, Homo sapiens
gcctatgcacatatggactctgc

SEQ ID NO: 3036248 - DNA, 14 bp, Homo sapiens
gcctcaacctcctg

SEQ ID NO: 3036249 - DNA, 22 bp, Homo sapiens
gcctcaactccaccctctgcga

SEQ ID NO: 3036250 - DNA, 18 bp, Homo sapiens
gcctcaagccatcttccc

SEQ ID NO: 3036251 - DNA, 20 bp, Homo sapiens
gcctcaagttccagtgcaga

SEQ ID NO: 3036252 - DNA, 21 bp, Homo sapiens
gcctcaatgtggttgcaaggc

SEQ ID NO: 3036253 - DNA, 14 bp, Homo sapiens
gcctcacagatgct

SEQ ID NO: 3036254 - DNA, 14 bp, Homo sapiens
gcctcacatctccc

SEQ ID NO: 3036255 - DNA, 19 bp, Homo sapiens
gcctcacccacccctgcac

SEQ ID NO: 3036256 - DNA, 20 bp, Homo sapiens
gcctcacccacccctgcaca

SEQ ID NO: 3036257 - DNA, 14 bp, Homo sapiens
gcctcactggctca

SEQ ID NO: 3036258 - DNA, 20 bp, Homo sapiens
gcctcactggctcatgcccc

SEQ ID NO: 3036259 - DNA, 22 bp, Homo sapiens
gcctcagaagaaaacaaagttc

SEQ ID NO: 3036260 - DNA, 20 bp, Homo sapiens
gcctcagactgcacccagga

SEQ ID NO: 3036261 - DNA, 15 bp, Homo sapiens
gcctcagccagagaa

SEQ ID NO: 3036262 - DNA, 13 bp, Homo sapiens
gcctcaggcactc

SEQ ID NO: 3036263 - DNA, 16 bp, Homo sapiens
gcctcagggccaggaa

SEQ ID NO: 3036264 - DNA, 17 bp, Homo sapiens
gcctcagggccaggaag

SEQ ID NO: 3036265 - DNA, 19 bp, Homo sapiens
gcctcagggccaggaagga

SEQ ID NO: 3036266 - DNA, 22 bp, Homo sapiens
gcctcagggccaggaaggacag

SEQ ID NO: 3036267 - DNA, 19 bp, Homo sapiens
gcctcagggtctaaggagc

SEQ ID NO: 3036268 - DNA, 19 bp, Homo sapiens
gcctcagtggctctgggta

SEQ ID NO: 3036269 - DNA, 13 bp, Homo sapiens
gcctcataaatta

SEQ ID NO: 3036270 - DNA, 13 bp, Homo sapiens
gcctcatcctcct

SEQ ID NO: 3036271 - DNA, 18 bp, Homo sapiens
gcctcatcctcctcctca

SEQ ID NO: 3036272 - DNA, 22 bp, Homo sapiens
gcctcatctataacatgcattt

SEQ ID NO: 3036273 - DNA, 13 bp, Homo sapiens
gcctcatgttctg

SEQ ID NO: 3036274 - DNA, 14 bp, Homo sapiens
gcctcatgttctgt

SEQ ID NO: 3036275 - DNA, 16 bp, Homo sapiens
gcctccaagtcaggtg

SEQ ID NO: 3036276 - DNA, 15 bp, Homo sapiens
gcctccacccacagt

SEQ ID NO: 3036277 - DNA, 21 bp, Homo sapiens
gcctccacccacagtggagag

SEQ ID NO: 3036278 - DNA, 22 bp, Homo sapiens
gcctccacccacagtggagagg

SEQ ID NO: 3036279 - DNA, 17 bp, Homo sapiens
gcctccagaactcactg

SEQ ID NO: 3036280 - DNA, 18 bp, Homo sapiens
gcctccagctgccccggg

SEQ ID NO: 3036281 - DNA, 19 bp, Homo sapiens
gcctccaggaaccacacca

SEQ ID NO: 3036282 - DNA, 18 bp, Homo sapiens
gcctccagttgtagcagg

SEQ ID NO: 3036283 - DNA, 13 bp, Homo sapiens
gcctcccactggg

SEQ ID NO: 3036284 - DNA, 17 bp, Homo sapiens
gcctcccagagtgctgg

SEQ ID NO: 3036285 - DNA, 22 bp, Homo sapiens
gcctcccatccagggcccccat

SEQ ID NO: 3036286 - DNA, 14 bp, Homo sapiens
gcctccccaatcca

SEQ ID NO: 3036287 - DNA, 21 bp, Homo sapiens
gcctcccctctccttcctgtg

SEQ ID NO: 3036288 - DNA, 20 bp, Homo sapiens
gcctcccctgaggatcccct

SEQ ID NO: 3036289 - DNA, 21 bp, Homo sapiens
gcctcccctgaggatcccctg

SEQ ID NO: 3036290 - DNA, 22 bp, Homo sapiens
gcctcccctgaggatcccctgt

SEQ ID NO: 3036291 - DNA, 15 bp, Homo sapiens
gcctcccctgccagg

SEQ ID NO: 3036292 - DNA, 17 bp, Homo sapiens
gcctcccctgccagggc

SEQ ID NO: 3036293 - DNA, 16 bp, Homo sapiens
gcctcccgaggagggg

SEQ ID NO: 3036294 - DNA, 22 bp, Homo sapiens
gcctcccgggaagcatcctccc

SEQ ID NO: 3036295 - DNA, 23 bp, Homo sapiens
gcctcccgggaagcatcctcccc

SEQ ID NO: 3036296 - DNA, 14 bp, Homo sapiens
gcctccctcaaccc

SEQ ID NO: 3036297 - DNA, 20 bp, Homo sapiens
gcctccctctcttccgggag

SEQ ID NO: 3036298 - DNA, 21 bp, Homo sapiens
gcctccctgaaacactgcttc

SEQ ID NO: 3036299 - DNA, 13 bp, Homo sapiens
gcctccctgaagc

SEQ ID NO: 3036300 - DNA, 16 bp, Homo sapiens
gcctccctgcctcagc

SEQ ID NO: 3036301 - DNA, 18 bp, Homo sapiens
gcctcccttcccagtggg

SEQ ID NO: 3036302 - DNA, 21 bp, Homo sapiens
gcctcccttgagtaggccctg

SEQ ID NO: 3036303 - DNA, 22 bp, Homo sapiens
gcctcccttgagtaggccctgc

SEQ ID NO: 3036304 - DNA, 17 bp, Homo sapiens
gcctccgatgcctggcc

SEQ ID NO: 3036305 - DNA, 21 bp, Homo sapiens
gcctccgatgcctggcctgcc

SEQ ID NO: 3036306 - DNA, 22 bp, Homo sapiens
gcctccgcacctgaccgctgcc

SEQ ID NO: 3036307 - DNA, 17 bp, Homo sapiens
gcctccgcttatcctgc

SEQ ID NO: 3036308 - DNA, 14 bp, Homo sapiens
gcctccggaagctg

SEQ ID NO: 3036309 - DNA, 14 bp, Homo sapiens
gcctcctcagcttt

SEQ ID NO: 3036310 - DNA, 17 bp, Homo sapiens
gcctcctccctggctgc

SEQ ID NO: 3036311 - DNA, 19 bp, Homo sapiens
gcctcctccctggctgcag

SEQ ID NO: 3036312 - DNA, 18 bp, Homo sapiens
gcctcctctctccctgcc

SEQ ID NO: 3036313 - DNA, 19 bp, Homo sapiens
gcctcctctctccctgcct

SEQ ID NO: 3036314 - DNA, 21 bp, Homo sapiens
gcctcctctctccctgcctca

SEQ ID NO: 3036315 - DNA, 15 bp, Homo sapiens
gcctcctggcccagg

SEQ ID NO: 3036316 - DNA, 14 bp, Homo sapiens
gctccctcccagga

SEQ ID NO: 3036317 - DNA, 20 bp, Homo sapiens
gctccctcccatcctccagc

SEQ ID NO: 3036318 - DNA, 23 bp, Homo sapiens
gctccctcgtcttcagctgcatt

SEQ ID NO: 3036319 - DNA, 12 bp, Homo sapiens
gctccctctctc

SEQ ID NO: 3036320 - DNA, 15 bp, Homo sapiens
gctccctctctcctg

SEQ ID NO: 3036321 - DNA, 20 bp, Homo sapiens
gctccctctctcctggactg

SEQ ID NO: 3036322 - DNA, 22 bp, Homo sapiens
gctccctctctcctggactggt

SEQ ID NO: 3036323 - DNA, 15 bp, Homo sapiens
gctccgaaattccaa

SEQ ID NO: 3036324 - DNA, 16 bp, Homo sapiens
gctccgacctctctca

SEQ ID NO: 3036325 - DNA, 22 bp, Homo sapiens
gctccgacctctctcagcccca

SEQ ID NO: 3036326 - DNA, 17 bp, Homo sapiens
gctccgctgcctggaac

SEQ ID NO: 3036327 - DNA, 12 bp, Homo sapiens
gctccgtctctg

SEQ ID NO: 3036328 - DNA, 13 bp, Homo sapiens
gctccgtctctgt

SEQ ID NO: 3036329 - DNA, 17 bp, Homo sapiens
gctccgtctctgtcctc

SEQ ID NO: 3036330 - DNA, 21 bp, Homo sapiens
gctccgtggactgcagtcggc

SEQ ID NO: 3036331 - DNA, 15 bp, Homo sapiens
gctcctagagggagg

SEQ ID NO: 3036332 - DNA, 15 bp, Homo sapiens
gctcctcactgtggt

SEQ ID NO: 3036333 - DNA, 15 bp, Homo sapiens
gctcctccagggcca

SEQ ID NO: 3036334 - DNA, 23 bp, Homo sapiens
gctcctccagggccacgtgccag

SEQ ID NO: 3036335 - DNA, 20 bp, Homo sapiens
gctcctccagggtgtgtgct

SEQ ID NO: 3036336 - DNA, 16 bp, Homo sapiens
gctcctcccctgccgc

SEQ ID NO: 3036337 - DNA, 17 bp, Homo sapiens
gctcctcccctgccgcc

SEQ ID NO: 3036338 - DNA, 19 bp, Homo sapiens
gctcctcccctgccgcctc

SEQ ID NO: 3036339 - DNA, 12 bp, Homo sapiens
gctcctccctct

SEQ ID NO: 3036340 - DNA, 14 bp, Homo sapiens
gctcctccctctgc

SEQ ID NO: 3036341 - DNA, 15 bp, Homo sapiens
gctcctccctctgcc

SEQ ID NO: 3036342 - DNA, 16 bp, Homo sapiens
gctcctccctctgcct

SEQ ID NO: 3036343 - DNA, 14 bp, Homo sapiens
gctcctcctccctg

SEQ ID NO: 3036344 - DNA, 13 bp, Homo sapiens
gctcctcctcctg

SEQ ID NO: 3036345 - DNA, 17 bp, Homo sapiens
gctcctcctcctgggct

SEQ ID NO: 3036346 - DNA, 12 bp, Homo sapiens
gctcctctcagt

SEQ ID NO: 3036347 - DNA, 12 bp, Homo sapiens
gctcctctgctt

SEQ ID NO: 3036348 - DNA, 23 bp, Homo sapiens
gctcctctttcccctcctttgtc

SEQ ID NO: 3036349 - DNA, 13 bp, Homo sapiens
gctcctgcccagc

SEQ ID NO: 3036350 - DNA, 17 bp, Homo sapiens
gctcctgcccagccacc

SEQ ID NO: 3036351 - DNA, 14 bp, Homo sapiens
gctcctggggagaa

SEQ ID NO: 3036352 - DNA, 14 bp, Homo sapiens
gctcctgtggcagc

SEQ ID NO: 3036353 - DNA, 18 bp, Homo sapiens
gctcctgtggcagctgcc

SEQ ID NO: 3036354 - DNA, 17 bp, Homo sapiens
gctccttaaggctcttt

SEQ ID NO: 3036355 - DNA, 21 bp, Homo sapiens
gctccttaaggctcttttgta

SEQ ID NO: 3036356 - DNA, 13 bp, Homo sapiens
gctccttagctgc

SEQ ID NO: 3036357 - DNA, 15 bp, Homo sapiens
gctccttagctgcca

SEQ ID NO: 3036358 - DNA, 18 bp, Homo sapiens
gctccttagctgccaagc

SEQ ID NO: 3036359 - DNA, 23 bp, Homo sapiens
gctccttcctggagactgcccag

SEQ ID NO: 3036360 - DNA, 13 bp, Homo sapiens
gctccttgggagg

SEQ ID NO: 3036361 - DNA, 17 bp, Homo sapiens
gctccttgggccctttg

SEQ ID NO: 3036362 - DNA, 14 bp, Homo sapiens
gctccttttctgtg

SEQ ID NO: 3036363 - DNA, 24 bp, Homo sapiens
gctccttttctgtgaagccctttg

SEQ ID NO: 3036364 - DNA, 15 bp, Homo sapiens
gctcgaagactgtga

SEQ ID NO: 3036365 - DNA, 18 bp, Homo sapiens
gctcgatgcctttgctgt

SEQ ID NO: 3036366 - DNA, 15 bp, Homo sapiens
gctcgcccaggaagg

SEQ ID NO: 3036367 - DNA, 23 bp, Homo sapiens
gctcgcccatacccgtgacagtg

SEQ ID NO: 3036368 - DNA, 15 bp, Homo sapiens
gctcggaggaagccc

SEQ ID NO: 3036369 - DNA, 14 bp, Homo sapiens
gctcggcccagcac

SEQ ID NO: 3036370 - DNA, 23 bp, Homo sapiens
gctcggcccagcaccccctctcc

SEQ ID NO: 3036371 - DNA, 21 bp, Homo sapiens
gctcggttaagtacccgaggc

SEQ ID NO: 3036372 - DNA, 18 bp, Homo sapiens
gctcgttacttcagccca

SEQ ID NO: 3036373 - DNA, 22 bp, Homo sapiens
gctcgttccggtccccacagac

SEQ ID NO: 3036374 - DNA, 15 bp, Homo sapiens
gctctaaaacataga

SEQ ID NO: 3036375 - DNA, 15 bp, Homo sapiens
gctctaagcagccag

SEQ ID NO: 3036376 - DNA, 15 bp, Homo sapiens
gctctaagtctcaac

SEQ ID NO: 3036377 - DNA, 15 bp, Homo sapiens
gctctacacaacatg

SEQ ID NO: 3036378 - DNA, 20 bp, Homo sapiens
gctctacacaacatgtatgt

SEQ ID NO: 3036379 - DNA, 15 bp, Homo sapiens
gctctacccagggcc

SEQ ID NO: 3036380 - DNA, 20 bp, Homo sapiens
gctctaccctgtgctaagca

SEQ ID NO: 3036381 - DNA, 17 bp, Homo sapiens
gctctagtcctttataa

SEQ ID NO: 3036382 - DNA, 18 bp, Homo sapiens
gctctagtcctttataag

SEQ ID NO: 3036383 - DNA, 15 bp, Homo sapiens
gctctagtgccttct

SEQ ID NO: 3036384 - DNA, 16 bp, Homo sapiens
gctctatctgcaatgt

SEQ ID NO: 3036385 - DNA, 19 bp, Homo sapiens
gctctatcttgctctgtaa

SEQ ID NO: 3036386 - DNA, 14 bp, Homo sapiens
gctctatgagtcta

SEQ ID NO: 3036387 - DNA, 21 bp, Homo sapiens
gctctatgagtctagatgttt

SEQ ID NO: 3036388 - DNA, 21 bp, Homo sapiens
gctctattatataaactttat

SEQ ID NO: 3036389 - DNA, 13 bp, Homo sapiens
gctctatttactt

SEQ ID NO: 3036390 - DNA, 14 bp, Homo sapiens
gctctcaaatgtga

SEQ ID NO: 3036391 - DNA, 13 bp, Homo sapiens
gctctccacctca

SEQ ID NO: 3036392 - DNA, 21 bp, Homo sapiens
gctctccacctcagccttgga

SEQ ID NO: 3036393 - DNA, 13 bp, Homo sapiens
gctctccaggcca

SEQ ID NO: 3036394 - DNA, 22 bp, Homo sapiens
gctctccctaccttgcctcctt

SEQ ID NO: 3036395 - DNA, 14 bp, Homo sapiens
gctctccctctggc

SEQ ID NO: 3036396 - DNA, 15 bp, Homo sapiens
gctctccctctggcc

SEQ ID NO: 3036397 - DNA, 17 bp, Homo sapiens
gctctccctctggccct

SEQ ID NO: 3036398 - DNA, 19 bp, Homo sapiens
gctctccctctggccctgc

SEQ ID NO: 3036399 - DNA, 23 bp, Homo sapiens
gctctccctctggccctgccttc

SEQ ID NO: 3036400 - DNA, 14 bp, Homo sapiens
gctctcctgacttt

SEQ ID NO: 3036401 - DNA, 19 bp, Homo sapiens
gctctcgggtgggggagcc

SEQ ID NO: 3036402 - DNA, 13 bp, Homo sapiens
gctctctgcagcc

SEQ ID NO: 3036403 - DNA, 14 bp, Homo sapiens
gctctctgcagcca

SEQ ID NO: 3036404 - DNA, 18 bp, Homo sapiens
gctctctgtgtctgagag

SEQ ID NO: 3036405 - DNA, 21 bp, Homo sapiens
gctctcttgtgacgtgcactg

SEQ ID NO: 3036406 - DNA, 17 bp, Homo sapiens
gctctgacccacagcct

SEQ ID NO: 3036407 - DNA, 15 bp, Homo sapiens
gctctgaggcctcac

SEQ ID NO: 3036408 - DNA, 16 bp, Homo sapiens
gctctgcccacctctc

SEQ ID NO: 3036409 - DNA, 18 bp, Homo sapiens
gctctgcccacctctctt

SEQ ID NO: 3036410 - DNA, 20 bp, Homo sapiens
gctctgccgccgcccgctgg

SEQ ID NO: 3036411 - DNA, 21 bp, Homo sapiens
gctctgccgccgcccgctggg

SEQ ID NO: 3036412 - DNA, 16 bp, Homo sapiens
gctctgccgtctctgg

SEQ ID NO: 3036413 - DNA, 19 bp, Homo sapiens
gctctgcctctaactccct

SEQ ID NO: 3036414 - DNA, 22 bp, Homo sapiens
gctctgcctctaactccctcct

SEQ ID NO: 3036415 - DNA, 18 bp, Homo sapiens
gctctgcgccaggcagag

SEQ ID NO: 3036416 - DNA, 13 bp, Homo sapiens
gctctggacagat

SEQ ID NO: 3036417 - DNA, 16 bp, Homo sapiens
gctctggacagcccca

SEQ ID NO: 3036418 - DNA, 16 bp, Homo sapiens
gctctggacgtgaaat

SEQ ID NO: 3036419 - DNA, 11 bp, Homo sapiens
gctctggctct

SEQ ID NO: 3036420 - DNA, 21 bp, Homo sapiens
gctctggggggcaacctggag

SEQ ID NO: 3036421 - DNA, 20 bp, Homo sapiens
gctctgggtacctgcaagca

SEQ ID NO: 3036422 - DNA, 16 bp, Homo sapiens
gctctggtccaggccc

SEQ ID NO: 3036423 - DNA, 19 bp, Homo sapiens
gctctgtaatctcgtttca

SEQ ID NO: 3036424 - DNA, 18 bp, Homo sapiens
gctctgtatcaggaccca

SEQ ID NO: 3036425 - DNA, 18 bp, Homo sapiens
gctctgtcaccctggcca

SEQ ID NO: 3036426 - DNA, 13 bp, Homo sapiens
gctctgtctactt

SEQ ID NO: 3036427 - DNA, 23 bp, Homo sapiens
gctctgtgaaatcagaagtgcaa

SEQ ID NO: 3036428 - DNA, 15 bp, Homo sapiens
gctctgtgggtctct

SEQ ID NO: 3036429 - DNA, 23 bp, Homo sapiens
gctctgttacccagggtggagtg

SEQ ID NO: 3036430 - DNA, 19 bp, Homo sapiens
gctctgttatcagctgggc

SEQ ID NO: 3036431 - DNA, 21 bp, Homo sapiens
gctctgttatcagctgggcag

SEQ ID NO: 3036432 - DNA, 22 bp, Homo sapiens
gctctgttatcagctgggcagt

SEQ ID NO: 3036433 - DNA, 16 bp, Homo sapiens
gctcttacttccccca

SEQ ID NO: 3036434 - DNA, 20 bp, Homo sapiens
gctcttacttcccccaccct

SEQ ID NO: 3036435 - DNA, 13 bp, Homo sapiens
gctcttcacttcc

SEQ ID NO: 3036436 - DNA, 17 bp, Homo sapiens
gctcttcacttcctcca

SEQ ID NO: 3036437 - DNA, 17 bp, Homo sapiens
gctcttctccttggagg

SEQ ID NO: 3036438 - DNA, 13 bp, Homo sapiens
gctcttctgggca

SEQ ID NO: 3036439 - DNA, 22 bp, Homo sapiens
gctcttctgggcagagcctgtc

SEQ ID NO: 3036440 - DNA, 12 bp, Homo sapiens
gctcttcttaaa

SEQ ID NO: 3036441 - DNA, 15 bp, Homo sapiens
gctcttcttgaaaaa

SEQ ID NO: 3036442 - DNA, 18 bp, Homo sapiens
gctcttgaccttgtagag

SEQ ID NO: 3036443 - DNA, 13 bp, Homo sapiens
gctcttgggcctg

SEQ ID NO: 3036444 - DNA, 21 bp, Homo sapiens
gctcttgggcctgacctccag

SEQ ID NO: 3036445 - DNA, 12 bp, Homo sapiens
gctcttgtttct

SEQ ID NO: 3036446 - DNA, 14 bp, Homo sapiens
gctctttcccagga

SEQ ID NO: 3036447 - DNA, 15 bp, Homo sapiens
gctctttcccaggac

SEQ ID NO: 3036448 - DNA, 16 bp, Homo sapiens
gctctttcccaggacg

SEQ ID NO: 3036449 - DNA, 16 bp, Homo sapiens
gcttctcctttggcat

SEQ ID NO: 3036450 - DNA, 17 bp, Homo sapiens
gcttctcggccagcccg

SEQ ID NO: 3036451 - DNA, 20 bp, Homo sapiens
gcttctcggggtccagtgca

SEQ ID NO: 3036452 - DNA, 14 bp, Homo sapiens
gcttctcttttcct

SEQ ID NO: 3036453 - DNA, 20 bp, Homo sapiens
gcttctcttttcctcgcaga

SEQ ID NO: 3036454 - DNA, 14 bp, Homo sapiens
gcttctggccagga

SEQ ID NO: 3036455 - DNA, 12 bp, Homo sapiens
gcttctggggtc

SEQ ID NO: 3036456 - DNA, 19 bp, Homo sapiens
gcttctggtgaccttccaa

SEQ ID NO: 3036457 - DNA, 15 bp, Homo sapiens
gcttcttcagctgac

SEQ ID NO: 3036458 - DNA, 15 bp, Homo sapiens
gcttcttccaggtgc

SEQ ID NO: 3036459 - DNA, 19 bp, Homo sapiens
gcttcttccaggtgcccag

SEQ ID NO: 3036460 - DNA, 12 bp, Homo sapiens
gcttcttgtgaa

SEQ ID NO: 3036461 - DNA, 20 bp, Homo sapiens
gcttcttgtgaaggccatga

SEQ ID NO: 3036462 - DNA, 21 bp, Homo sapiens
gcttgaacctgggaagtggag

SEQ ID NO: 3036463 - DNA, 13 bp, Homo sapiens
gcttgaatttgca

SEQ ID NO: 3036464 - DNA, 15 bp, Homo sapiens
gcttgacaacatctg

SEQ ID NO: 3036465 - DNA, 15 bp, Homo sapiens
gcttgacacctttga

SEQ ID NO: 3036466 - DNA, 23 bp, Homo sapiens
gcttgagacaaatcctttctgcc

SEQ ID NO: 3036467 - DNA, 19 bp, Homo sapiens
gcttgagttaggaatgaga

SEQ ID NO: 3036468 - DNA, 17 bp, Homo sapiens
gcttgagttctgcactc

SEQ ID NO: 3036469 - DNA, 19 bp, Homo sapiens
gcttgagttctgcactcca

SEQ ID NO: 3036470 - DNA, 19 bp, Homo sapiens
gcttgagtttggggaatgc

SEQ ID NO: 3036471 - DNA, 20 bp, Homo sapiens
gcttgatagaaatgccaagc

SEQ ID NO: 3036472 - DNA, 14 bp, Homo sapiens
gcttgcagccagga

SEQ ID NO: 3036473 - DNA, 22 bp, Homo sapiens
gcttgcctgcagggccatggct

SEQ ID NO: 3036474 - DNA, 13 bp, Homo sapiens
gcttgcctgggct

SEQ ID NO: 3036475 - DNA, 11 bp, Homo sapiens
gcttggagcaa

SEQ ID NO: 3036476 - DNA, 16 bp, Homo sapiens
gcttggagcagagggg

SEQ ID NO: 3036477 - DNA, 15 bp, Homo sapiens
gcttggatcctgggc

SEQ ID NO: 3036478 - DNA, 16 bp, Homo sapiens
gcttggcccgcggcct

SEQ ID NO: 3036479 - DNA, 19 bp, Homo sapiens
gcttggcccgcggcctgca

SEQ ID NO: 3036480 - DNA, 16 bp, Homo sapiens
gcttggcctatctcct

SEQ ID NO: 3036481 - DNA, 17 bp, Homo sapiens
gcttgggcagcatcccc

SEQ ID NO: 3036482 - DNA, 23 bp, Homo sapiens
gcttgggggtttttgaagtcttt

SEQ ID NO: 3036483 - DNA, 20 bp, Homo sapiens
gcttgggtggagaagccatt

SEQ ID NO: 3036484 - DNA, 16 bp, Homo sapiens
gcttggtgctggttta

SEQ ID NO: 3036485 - DNA, 22 bp, Homo sapiens
gcttgtaactccaccaacccat

SEQ ID NO: 3036486 - DNA, 21 bp, Homo sapiens
gcttgtacatttttaaattct

SEQ ID NO: 3036487 - DNA, 17 bp, Homo sapiens
gcttgtactaagccagg

SEQ ID NO: 3036488 - DNA, 18 bp, Homo sapiens
gcttgtactaagccagga

SEQ ID NO: 3036489 - DNA, 22 bp, Homo sapiens
gcttgtcccctcctcactccct

SEQ ID NO: 3036490 - DNA, 18 bp, Homo sapiens
gcttgtgaaaatgtgttc

SEQ ID NO: 3036491 - DNA, 12 bp, Homo sapiens
gcttgtgaggaa

SEQ ID NO: 3036492 - DNA, 17 bp, Homo sapiens
gcttgtgcctcccttcc

SEQ ID NO: 3036493 - DNA, 21 bp, Homo sapiens
gcttgtgcctcccttcccagt

SEQ ID NO: 3036494 - DNA, 19 bp, Homo sapiens
gcttgtgtatccattatca

SEQ ID NO: 3036495 - DNA, 22 bp, Homo sapiens
gcttgtgtatccattatcatgt

SEQ ID NO: 3036496 - DNA, 23 bp, Homo sapiens
gcttgttgtcaagtataaagtca

SEQ ID NO: 3036497 - DNA, 16 bp, Homo sapiens
gcttgttttattttgg

SEQ ID NO: 3036498 - DNA, 19 bp, Homo sapiens
gctttaaccgtttttcaag

SEQ ID NO: 3036499 - DNA, 17 bp, Homo sapiens
gctttacaggatcatgt

SEQ ID NO: 3036500 - DNA, 18 bp, Homo sapiens
gctttacgctcatcacct

SEQ ID NO: 3036501 - DNA, 11 bp, Homo sapiens
gctttagagct

SEQ ID NO: 3036502 - DNA, 23 bp, Homo sapiens
gctttataccccatttgatttcg

SEQ ID NO: 3036503 - DNA, 19 bp, Homo sapiens
gctttatgaagtttgagtt

SEQ ID NO: 3036504 - DNA, 19 bp, Homo sapiens
gctttatttatagaaatga

SEQ ID NO: 3036505 - DNA, 19 bp, Homo sapiens
gctttatttttctttaaag

SEQ ID NO: 3036506 - DNA, 21 bp, Homo sapiens
gctttcaattccgtagccagc

SEQ ID NO: 3036507 - DNA, 17 bp, Homo sapiens
gctttcagcgcccccag

SEQ ID NO: 3036508 - DNA, 18 bp, Homo sapiens
gctttcagggaggccctg

SEQ ID NO: 3036509 - DNA, 21 bp, Homo sapiens
gctttcagggcagcccctgca

SEQ ID NO: 3036510 - DNA, 18 bp, Homo sapiens
gctttcatgattagcaag

SEQ ID NO: 3036511 - DNA, 21 bp, Homo sapiens
gctttcccacttcccaccctg

SEQ ID NO: 3036512 - DNA, 20 bp, Homo sapiens
gctttcccccaggcgcctgc

SEQ ID NO: 3036513 - DNA, 22 bp, Homo sapiens
gctttcccccaggcgcctgcgc

SEQ ID NO: 3036514 - DNA, 15 bp, Homo sapiens
gctttcctaaatcag

SEQ ID NO: 3036515 - DNA, 17 bp, Homo sapiens
gctttccttttttaaaa

SEQ ID NO: 3036516 - DNA, 16 bp, Homo sapiens
gctttcgaactgctag

SEQ ID NO: 3036517 - DNA, 16 bp, Homo sapiens
gctttcggggagggcg

SEQ ID NO: 3036518 - DNA, 13 bp, Homo sapiens
gctttcgtccaca

SEQ ID NO: 3036519 - DNA, 20 bp, Homo sapiens
gctttctattacccctcatt

SEQ ID NO: 3036520 - DNA, 13 bp, Homo sapiens
gctttctgaaatt

SEQ ID NO: 3036521 - DNA, 22 bp, Homo sapiens
gctttctggtataaagctctca

SEQ ID NO: 3036522 - DNA, 22 bp, Homo sapiens
gctttctttggtaggtaaatct

SEQ ID NO: 3036523 - DNA, 11 bp, Homo sapiens
gctttgaaaaa

SEQ ID NO: 3036524 - DNA, 18 bp, Homo sapiens
gctttgaaaaaaagtttc

SEQ ID NO: 3036525 - DNA, 20 bp, Homo sapiens
gctttgaacgtgccagcagc

SEQ ID NO: 3036526 - DNA, 18 bp, Homo sapiens
gctttgacgggccaggcc

SEQ ID NO: 3036527 - DNA, 15 bp, Homo sapiens
gctttgagcaactaa

SEQ ID NO: 3036528 - DNA, 19 bp, Homo sapiens
gctttgaggtggaagaggg

SEQ ID NO: 3036529 - DNA, 15 bp, Homo sapiens
gctttgatccctgac

SEQ ID NO: 3036530 - DNA, 21 bp, Homo sapiens
gctttgattagttttcttgtt

SEQ ID NO: 3036531 - DNA, 15 bp, Homo sapiens
gctttgattcatagt

SEQ ID NO: 3036532 - DNA, 19 bp, Homo sapiens
gctttgctgctgaaggctc

SEQ ID NO: 3036533 - DNA, 21 bp, Homo sapiens
gctttgcttatggtaataaaa

SEQ ID NO: 3036534 - DNA, 18 bp, Homo sapiens
gctttgctttctgctcag

SEQ ID NO: 3036535 - DNA, 14 bp, Homo sapiens
gctttgctttgtct

SEQ ID NO: 3036536 - DNA, 16 bp, Homo sapiens
gctttggaatagatgg

SEQ ID NO: 3036537 - DNA, 17 bp, Homo sapiens
gctttggacccaaggaa

SEQ ID NO: 3036538 - DNA, 18 bp, Homo sapiens
gctttggacccaaggaaa

SEQ ID NO: 3036539 - DNA, 18 bp, Homo sapiens
gctttggcagtgttttgg

SEQ ID NO: 3036540 - DNA, 16 bp, Homo sapiens
gctttggcccaatgcc

SEQ ID NO: 3036541 - DNA, 13 bp, Homo sapiens
gctttggcttctt

SEQ ID NO: 3036542 - DNA, 17 bp, Homo sapiens
gctttggtgagaacctg

SEQ ID NO: 3036543 - DNA, 16 bp, Homo sapiens
gctttgtaggtgtctc

SEQ ID NO: 3036544 - DNA, 21 bp, Homo sapiens
gctttgtcccctgcttcagat

SEQ ID NO: 3036545 - DNA, 19 bp, Homo sapiens
gctttgtgtgaaggcagag

SEQ ID NO: 3036546 - DNA, 22 bp, Homo sapiens
gctttgttcttgtcatcagtaa

SEQ ID NO: 3036547 - DNA, 16 bp, Homo sapiens
gctttgttttccctgg

SEQ ID NO: 3036548 - DNA, 14 bp, Homo sapiens
gctttgttttgcac

SEQ ID NO: 3036549 - DNA, 13 bp, Homo sapiens
gcttttagtaaaa

SEQ ID NO: 3036550 - DNA, 18 bp, Homo sapiens
gcttttagtaaaaacatt

SEQ ID NO: 3036551 - DNA, 16 bp, Homo sapiens
gcttttatatctgtat

SEQ ID NO: 3036552 - DNA, 18 bp, Homo sapiens
gcttttatgtttgtacac

SEQ ID NO: 3036553 - DNA, 20 bp, Homo sapiens
gcttttattttttcttttgt

SEQ ID NO: 3036554 - DNA, 14 bp, Homo sapiens
gcttttcagccaat

SEQ ID NO: 3036555 - DNA, 20 bp, Homo sapiens
gcttttcctggacagctaga

SEQ ID NO: 3036556 - DNA, 23 bp, Homo sapiens
gcttttcgaactgtgctcccacg

SEQ ID NO: 3036557 - DNA, 12 bp, Homo sapiens
gcttttctgttt

SEQ ID NO: 3036558 - DNA, 14 bp, Homo sapiens
gcttttggcctgga

SEQ ID NO: 3036559 - DNA, 20 bp, Homo sapiens
gcttttgtctaattaaaaca

SEQ ID NO: 3036560 - DNA, 18 bp, Homo sapiens
gcttttttttttcttttg

SEQ ID NO: 3036561 - DNA, 23 bp, Homo sapiens
gcttttttttttcttttgttttg

SEQ ID NO: 3036562 - DNA, 21 bp, Homo sapiens
ggaaaaaaaaaaaaagaaatt

SEQ ID NO: 3036563 - DNA, 17 bp, Homo sapiens
ggaaaaaaaaaaaagag

SEQ ID NO: 3036564 - DNA, 21 bp, Homo sapiens
ggaaaaaaacataaaaagcag

SEQ ID NO: 3036565 - DNA, 19 bp, Homo sapiens
ggaaaaaaatcgtccaggg

SEQ ID NO: 3036566 - DNA, 12 bp, Homo sapiens
ggaaaaaaatgt

SEQ ID NO: 3036567 - DNA, 13 bp, Homo sapiens
ggaaaaaaatgtt

SEQ ID NO: 3036568 - DNA, 19 bp, Homo sapiens
ggaaaaagaaagaaacact

SEQ ID NO: 3036569 - DNA, 19 bp, Homo sapiens
ggaaaaagacgatgtttat

SEQ ID NO: 3036570 - DNA, 22 bp, Homo sapiens
ggaaaaagccatatcatgctaa

SEQ ID NO: 3036571 - DNA, 18 bp, Homo sapiens
ggaaaaataaaagaaaat

SEQ ID NO: 3036572 - DNA, 16 bp, Homo sapiens
ggaaaaattcttggtt

SEQ ID NO: 3036573 - DNA, 22 bp, Homo sapiens
ggaaaaccagactacttgggag

SEQ ID NO: 3036574 - DNA, 22 bp, Homo sapiens
ggaaaactacctgtatttaaaa

SEQ ID NO: 3036575 - DNA, 13 bp, Homo sapiens
ggaaaagaaatca

SEQ ID NO: 3036576 - DNA, 15 bp, Homo sapiens
ggaaaagcacaagaa

SEQ ID NO: 3036577 - DNA, 18 bp, Homo sapiens
ggaaaagcagctctcccc

SEQ ID NO: 3036578 - DNA, 19 bp, Homo sapiens
ggaaaataggcaggaagcc

SEQ ID NO: 3036579 - DNA, 17 bp, Homo sapiens
ggaaaatatttcctgac

SEQ ID NO: 3036580 - DNA, 19 bp, Homo sapiens
ggaaaatctgtaaaaaaga

SEQ ID NO: 3036581 - DNA, 14 bp, Homo sapiens
ggagcggaaagcag

SEQ ID NO: 3036582 - DNA, 15 bp, Homo sapiens
ggagcggaaagcagc

SEQ ID NO: 3036583 - DNA, 13 bp, Homo sapiens
ggagcgggcaggg

SEQ ID NO: 3036584 - DNA, 13 bp, Homo sapiens
ggagcgttctaaa

SEQ ID NO: 3036585 - DNA, 20 bp, Homo sapiens
ggagcgtttgctgtgccagg

SEQ ID NO: 3036586 - DNA, 15 bp, Homo sapiens
ggagctagccagagg

SEQ ID NO: 3036587 - DNA, 17 bp, Homo sapiens
ggagctcatgtgtccct

SEQ ID NO: 3036588 - DNA, 16 bp, Homo sapiens
ggagctctgcgccagg

SEQ ID NO: 3036589 - DNA, 20 bp, Homo sapiens
ggagctctgcgccaggcaga

SEQ ID NO: 3036590 - DNA, 21 bp, Homo sapiens
ggagctctgtgggtctctgga

SEQ ID NO: 3036591 - DNA, 17 bp, Homo sapiens
ggagctcttctgtgccc

SEQ ID NO: 3036592 - DNA, 18 bp, Homo sapiens
ggagctcttctgtgccct

SEQ ID NO: 3036593 - DNA, 16 bp, Homo sapiens
ggagctcttgggtcag

SEQ ID NO: 3036594 - DNA, 16 bp, Homo sapiens
ggagctgaaaaggatc

SEQ ID NO: 3036595 - DNA, 13 bp, Homo sapiens
ggagctgagggag

SEQ ID NO: 3036596 - DNA, 15 bp, Homo sapiens
ggagctgcccctctc

SEQ ID NO: 3036597 - DNA, 21 bp, Homo sapiens
ggagctgccttggctcagaca

SEQ ID NO: 3036598 - DNA, 18 bp, Homo sapiens
ggagctgctatagcctgg

SEQ ID NO: 3036599 - DNA, 13 bp, Homo sapiens
ggagctggcccag

SEQ ID NO: 3036600 - DNA, 16 bp, Homo sapiens
ggagctggccccgccg

SEQ ID NO: 3036601 - DNA, 21 bp, Homo sapiens
ggagctgggacacttaacaga

SEQ ID NO: 3036602 - DNA, 16 bp, Homo sapiens
ggagctgggaggtctc

SEQ ID NO: 3036603 - DNA, 18 bp, Homo sapiens
ggagctggtgacagcctt

SEQ ID NO: 3036604 - DNA, 19 bp, Homo sapiens
ggagctgtcaccaaggaaa

SEQ ID NO: 3036605 - DNA, 19 bp, Homo sapiens
ggagcttcctgtcctccca

SEQ ID NO: 3036606 - DNA, 15 bp, Homo sapiens
ggagcttctggggtc

SEQ ID NO: 3036607 - DNA, 14 bp, Homo sapiens
ggagctttctgtat

SEQ ID NO: 3036608 - DNA, 18 bp, Homo sapiens
ggagctttcttgtttctt

SEQ ID NO: 3036609 - DNA, 15 bp, Homo sapiens
ggaggaaagggcctg

SEQ ID NO: 3036610 - DNA, 18 bp, Homo sapiens
ggaggaagagagagactg

SEQ ID NO: 3036611 - DNA, 21 bp, Homo sapiens
ggaggaatgtgtgccttgttc

SEQ ID NO: 3036612 - DNA, 23 bp, Homo sapiens
ggaggacaagaccctctcaggct

SEQ ID NO: 3036613 - DNA, 20 bp, Homo sapiens
ggaggaccagggcagggcca

SEQ ID NO: 3036614 - DNA, 17 bp, Homo sapiens
ggaggaccttaaatgct

SEQ ID NO: 3036615 - DNA, 15 bp, Homo sapiens
ggaggagcacagttt

SEQ ID NO: 3036616 - DNA, 21 bp, Homo sapiens
ggaggagctgcctcttctctt

SEQ ID NO: 3036617 - DNA, 20 bp, Homo sapiens
ggaggatcctgagctgctgt

SEQ ID NO: 3036618 - DNA, 20 bp, Homo sapiens
ggaggcaaagctggctcacc

SEQ ID NO: 3036619 - DNA, 21 bp, Homo sapiens
ggaggcagagcgggagggagt

SEQ ID NO: 3036620 - DNA, 14 bp, Homo sapiens
ggaggcaggcatgg

SEQ ID NO: 3036621 - DNA, 19 bp, Homo sapiens
ggaggcagggccttgccca

SEQ ID NO: 3036622 - DNA, 19 bp, Homo sapiens
ggaggccaaggtgggcgga

SEQ ID NO: 3036623 - DNA, 11 bp, Homo sapiens
ggaggccaggc

SEQ ID NO: 3036624 - DNA, 14 bp, Homo sapiens
ggaggccaggccgg

SEQ ID NO: 3036625 - DNA, 14 bp, Homo sapiens
ggaggccaggcgag

SEQ ID NO: 3036626 - DNA, 17 bp, Homo sapiens
ggaggccagtgagccac

SEQ ID NO: 3036627 - DNA, 14 bp, Homo sapiens
ggaggccccagggg

SEQ ID NO: 3036628 - DNA, 20 bp, Homo sapiens
ggaggccccggcgcccgcac

SEQ ID NO: 3036629 - DNA, 15 bp, Homo sapiens
ggaggccctgtgccc

SEQ ID NO: 3036630 - DNA, 19 bp, Homo sapiens
ggaggcctgcgaccctggg

SEQ ID NO: 3036631 - DNA, 20 bp, Homo sapiens
ggaggcctgcgaccctgggg

SEQ ID NO: 3036632 - DNA, 19 bp, Homo sapiens
ggaggccttggggtggggg

SEQ ID NO: 3036633 - DNA, 20 bp, Homo sapiens
ggaggccttggggtgggggc

SEQ ID NO: 3036634 - DNA, 16 bp, Homo sapiens
ggaggcgctcctccct

SEQ ID NO: 3036635 - DNA, 20 bp, Homo sapiens
ggaggcggatgttgaagtga

SEQ ID NO: 3036636 - DNA, 13 bp, Homo sapiens
ggaggcggcagct

SEQ ID NO: 3036637 - DNA, 23 bp, Homo sapiens
ggaggcggcagctcttctgggca

SEQ ID NO: 3036638 - DNA, 21 bp, Homo sapiens
ggaggctcacccccttctcca

SEQ ID NO: 3036639 - DNA, 16 bp, Homo sapiens
ggaggctccagagggc

SEQ ID NO: 3036640 - DNA, 14 bp, Homo sapiens
ggaggctcctccct

SEQ ID NO: 3036641 - DNA, 15 bp, Homo sapiens
ggaggctcctccctc

SEQ ID NO: 3036642 - DNA, 21 bp, Homo sapiens
ggaggctcctgttagctcctc

SEQ ID NO: 3036643 - DNA, 13 bp, Homo sapiens
ggaggctgcactg

SEQ ID NO: 3036644 - DNA, 19 bp, Homo sapiens
ggaggctgcactggagcca

SEQ ID NO: 3036645 - DNA, 12 bp, Homo sapiens
ggaggctgcagc

SEQ ID NO: 3036646 - DNA, 17 bp, Homo sapiens
ggaggctgcagccaggc

SEQ ID NO: 3036647 - DNA, 20 bp, Homo sapiens
ggaggctgcagccaggcctc

SEQ ID NO: 3036648 - DNA, 21 bp, Homo sapiens
ggagggaaactgtgaatgctt

SEQ ID NO: 3036649 - DNA, 17 bp, Homo sapiens
ggagggactgctgaccc

SEQ ID NO: 3036650 - DNA, 20 bp, Homo sapiens
ggagggactgctgacccacc

SEQ ID NO: 3036651 - DNA, 14 bp, Homo sapiens
ggagggagaaagga

SEQ ID NO: 3036652 - DNA, 12 bp, Homo sapiens
ggagggagctga

SEQ ID NO: 3036653 - DNA, 19 bp, Homo sapiens
ggagggagctgaggcctcc

SEQ ID NO: 3036654 - DNA, 21 bp, Homo sapiens
ggagggagctgaggcctccct

SEQ ID NO: 3036655 - DNA, 20 bp, Homo sapiens
ggagggatgaagggcgagtg

SEQ ID NO: 3036656 - DNA, 19 bp, Homo sapiens
ggagggcactggagctggg

SEQ ID NO: 3036657 - DNA, 11 bp, Homo sapiens
ggagggcagag

SEQ ID NO: 3036658 - DNA, 12 bp, Homo sapiens
ggagggcagaga

SEQ ID NO: 3036659 - DNA, 15 bp, Homo sapiens
ggagggcagcagggc

SEQ ID NO: 3036660 - DNA, 16 bp, Homo sapiens
ggagggcagcagggct

SEQ ID NO: 3036661 - DNA, 14 bp, Homo sapiens
ggagggcaggcatc

SEQ ID NO: 3036662 - DNA, 23 bp, Homo sapiens
ggagggccacatgggaggctcac

SEQ ID NO: 3036663 - DNA, 19 bp, Homo sapiens
ggagggcgcccagcagcct

SEQ ID NO: 3036664 - DNA, 21 bp, Homo sapiens
ggagggcgcccagcagcctgc

SEQ ID NO: 3036665 - DNA, 15 bp, Homo sapiens
ggaggggaaggggcc

SEQ ID NO: 3036666 - DNA, 21 bp, Homo sapiens
ggaggggcccggtggcggcag

SEQ ID NO: 3036667 - DNA, 18 bp, Homo sapiens
ggaggggccggctggcct

SEQ ID NO: 3036668 - DNA, 18 bp, Homo sapiens
ggagggggcacggcaggc

SEQ ID NO: 3036669 - DNA, 21 bp, Homo sapiens
ggagggggtacctcatgagga

SEQ ID NO: 3036670 - DNA, 18 bp, Homo sapiens
ggaggtaaaggatgaggg

SEQ ID NO: 3036671 - DNA, 21 bp, Homo sapiens
ggaggtagctttgaggtggaa

SEQ ID NO: 3036672 - DNA, 16 bp, Homo sapiens
ggaggtgggaggccag

SEQ ID NO: 3036673 - DNA, 18 bp, Homo sapiens
ggaggtgggaggccaggc

SEQ ID NO: 3036674 - DNA, 19 bp, Homo sapiens
ggaggtgggaggccaggcg

SEQ ID NO: 3036675 - DNA, 13 bp, Homo sapiens
ggaggtgttcact

SEQ ID NO: 3036676 - DNA, 19 bp, Homo sapiens
ggaggttaaggctgaggaa

SEQ ID NO: 3036677 - DNA, 21 bp, Homo sapiens
ggaggttgcagtgagctgaga

SEQ ID NO: 3036678 - DNA, 17 bp, Homo sapiens
ggaggttgcattgagct

SEQ ID NO: 3036679 - DNA, 21 bp, Homo sapiens
ggagtaatagtaaacacaggg

SEQ ID NO: 3036680 - DNA, 18 bp, Homo sapiens
ggagtaatctgtgtacaa

SEQ ID NO: 3036681 - DNA, 15 bp, Homo sapiens
ggagtcaatttgcct

SEQ ID NO: 3036682 - DNA, 15 bp, Homo sapiens
ggagtcagccaggag

SEQ ID NO: 3036683 - DNA, 18 bp, Homo sapiens
ggagtcagccaggagctg

SEQ ID NO: 3036684 - DNA, 17 bp, Homo sapiens
ggagtcatctcaaccat

SEQ ID NO: 3036685 - DNA, 21 bp, Homo sapiens
ggagtcatttgagtctcttaa

SEQ ID NO: 3036686 - DNA, 13 bp, Homo sapiens
ggagtcccagagc

SEQ ID NO: 3036687 - DNA, 21 bp, Homo sapiens
ggagtcccaggggcagccaca

SEQ ID NO: 3036688 - DNA, 22 bp, Homo sapiens
ggagtcccaggggcagccacac

SEQ ID NO: 3036689 - DNA, 14 bp, Homo sapiens
ggagtctcaggagg

SEQ ID NO: 3036690 - DNA, 20 bp, Homo sapiens
ggagtctcaggaggaggctg

SEQ ID NO: 3036691 - DNA, 14 bp, Homo sapiens
ggagtctgaagcag

SEQ ID NO: 3036692 - DNA, 16 bp, Homo sapiens
ggagtgcagagaaaga

SEQ ID NO: 3036693 - DNA, 14 bp, Homo sapiens
ggagtgctgcttgt

SEQ ID NO: 3036694 - DNA, 14 bp, Homo sapiens
ggagtgctgtgctg

SEQ ID NO: 3036695 - DNA, 18 bp, Homo sapiens
ggagtggctcgccaggcc

SEQ ID NO: 3036696 - DNA, 16 bp, Homo sapiens
ggagtggggtagagga

SEQ ID NO: 3036697 - DNA, 20 bp, Homo sapiens
ggagtggggtagaggaagac

SEQ ID NO: 3036698 - DNA, 20 bp, Homo sapiens
ggagtgtcctcttccctctc

SEQ ID NO: 3036699 - DNA, 19 bp, Homo sapiens
ggagtgtgtcagagcccag

SEQ ID NO: 3036700 - DNA, 12 bp, Homo sapiens
ggagtgtttgac

SEQ ID NO: 3036701 - DNA, 21 bp, Homo sapiens
ggagttcctgctccgtggact

SEQ ID NO: 3036702 - DNA, 22 bp, Homo sapiens
ggagttcctgctccgtggactg

SEQ ID NO: 3036703 - DNA, 22 bp, Homo sapiens
ggagttctaacaaaacaagttg

SEQ ID NO: 3036704 - DNA, 20 bp, Homo sapiens
ggagttgggggcaggtcagg

SEQ ID NO: 3036705 - DNA, 14 bp, Homo sapiens
ggagtttctaaggt

SEQ ID NO: 3036706 - DNA, 15 bp, Homo sapiens
ggagtttgtgtgtct

SEQ ID NO: 3036707 - DNA, 13 bp, Homo sapiens
ggataacaaagat

SEQ ID NO: 3036708 - DNA, 18 bp, Homo sapiens
ggataacaaagatatctt

SEQ ID NO: 3036709 - DNA, 20 bp, Homo sapiens
ggataacaaagatatctttt

SEQ ID NO: 3036710 - DNA, 10 bp, Homo sapiens
ggataataaa

SEQ ID NO: 3036711 - DNA, 21 bp, Homo sapiens
ggataccagatagctcaatac

SEQ ID NO: 3036712 - DNA, 15 bp, Homo sapiens
ggataccagctcagg

SEQ ID NO: 3036713 - DNA, 13 bp, Homo sapiens
ggcagagggctgg

SEQ ID NO: 3036714 - DNA, 20 bp, Homo sapiens
ggcagagggctggaggccca

SEQ ID NO: 3036715 - DNA, 21 bp, Homo sapiens
ggcagagttctataatgtaaa

SEQ ID NO: 3036716 - DNA, 21 bp, Homo sapiens
ggcagagtttgtgtgttgtct

SEQ ID NO: 3036717 - DNA, 16 bp, Homo sapiens
ggcagataactgctgt

SEQ ID NO: 3036718 - DNA, 16 bp, Homo sapiens
ggcagatccaggacta

SEQ ID NO: 3036719 - DNA, 21 bp, Homo sapiens
ggcagatggcagggctgagga

SEQ ID NO: 3036720 - DNA, 16 bp, Homo sapiens
ggcagatgtggggctg

SEQ ID NO: 3036721 - DNA, 19 bp, Homo sapiens
ggcagatttgtggggacct

SEQ ID NO: 3036722 - DNA, 13 bp, Homo sapiens
ggcagcactggga

SEQ ID NO: 3036723 - DNA, 19 bp, Homo sapiens
ggcagcactgggaagctgg

SEQ ID NO: 3036724 - DNA, 19 bp, Homo sapiens
ggcagcagcatcccagcct

SEQ ID NO: 3036725 - DNA, 19 bp, Homo sapiens
ggcagcaggcatggcttcc

SEQ ID NO: 3036726 - DNA, 22 bp, Homo sapiens
ggcagcagtgtgaggccagggc

SEQ ID NO: 3036727 - DNA, 15 bp, Homo sapiens
ggcagcagttgaggt

SEQ ID NO: 3036728 - DNA, 17 bp, Homo sapiens
ggcagcatccccttgaa

SEQ ID NO: 3036729 - DNA, 17 bp, Homo sapiens
ggcagccacacgcaggc

SEQ ID NO: 3036730 - DNA, 22 bp, Homo sapiens
ggcagccacacgcaggcggcca

SEQ ID NO: 3036731 - DNA, 13 bp, Homo sapiens
ggcagccaggctg

SEQ ID NO: 3036732 - DNA, 16 bp, Homo sapiens
ggcagccaggctgggc

SEQ ID NO: 3036733 - DNA, 14 bp, Homo sapiens
ggcagccccagcac

SEQ ID NO: 3036734 - DNA, 23 bp, Homo sapiens
ggcagccccagcaccaccaggtc

SEQ ID NO: 3036735 - DNA, 14 bp, Homo sapiens
ggcagcccctgcag

SEQ ID NO: 3036736 - DNA, 16 bp, Homo sapiens
ggcagccctccatggt

SEQ ID NO: 3036737 - DNA, 13 bp, Homo sapiens
ggcagccctcctt

SEQ ID NO: 3036738 - DNA, 21 bp, Homo sapiens
ggcagctcttctgggcagagc

SEQ ID NO: 3036739 - DNA, 12 bp, Homo sapiens
ggcagctgccac

SEQ ID NO: 3036740 - DNA, 19 bp, Homo sapiens
ggcagctgcccctggcacc

SEQ ID NO: 3036741 - DNA, 14 bp, Homo sapiens
ggcagctgcctggc

SEQ ID NO: 3036742 - DNA, 15 bp, Homo sapiens
ggcagctgcctggcc

SEQ ID NO: 3036743 - DNA, 20 bp, Homo sapiens
ggcagctgcctggccatgct

SEQ ID NO: 3036744 - DNA, 15 bp, Homo sapiens
ggcagctgggcccac

SEQ ID NO: 3036745 - DNA, 18 bp, Homo sapiens
ggcagctgggcccacagc

SEQ ID NO: 3036746 - DNA, 22 bp, Homo sapiens
ggcagctgggcccacagccccc

SEQ ID NO: 3036747 - DNA, 15 bp, Homo sapiens
ggcaggaaggagcgg

SEQ ID NO: 3036748 - DNA, 19 bp, Homo sapiens
ggcaggacaacgaggaagc

SEQ ID NO: 3036749 - DNA, 20 bp, Homo sapiens
ggcaggacaacgaggaagcc

SEQ ID NO: 3036750 - DNA, 23 bp, Homo sapiens
ggcaggaccttcgggctgtgccc

SEQ ID NO: 3036751 - DNA, 23 bp, Homo sapiens
ggcaggagtcaccatgcaagggt

SEQ ID NO: 3036752 - DNA, 15 bp, Homo sapiens
ggcaggatgacttta

SEQ ID NO: 3036753 - DNA, 15 bp, Homo sapiens
ggcaggcatggccct

SEQ ID NO: 3036754 - DNA, 17 bp, Homo sapiens
ggcaggcatggccctgg

SEQ ID NO: 3036755 - DNA, 14 bp, Homo sapiens
ggcaggcctttcct

SEQ ID NO: 3036756 - DNA, 23 bp, Homo sapiens
ggcaggcggggggggcgcctgga

SEQ ID NO: 3036757 - DNA, 22 bp, Homo sapiens
ggcaggcgtgactcagcagcct

SEQ ID NO: 3036758 - DNA, 23 bp, Homo sapiens
ggcaggcgtgactcagcagcctg

SEQ ID NO: 3036759 - DNA, 20 bp, Homo sapiens
ggcaggcgtgtggcagccac

SEQ ID NO: 3036760 - DNA, 22 bp, Homo sapiens
ggcaggctgtctggccaggcct

SEQ ID NO: 3036761 - DNA, 22 bp, Homo sapiens
ggcagggagcggccggccagcc

SEQ ID NO: 3036762 - DNA, 17 bp, Homo sapiens
ggcagggagctgggccc

SEQ ID NO: 3036763 - DNA, 13 bp, Homo sapiens
ggcagggccaggc

SEQ ID NO: 3036764 - DNA, 17 bp, Homo sapiens
ggcagggccagggggtg

SEQ ID NO: 3036765 - DNA, 19 bp, Homo sapiens
ggcagggccttgcccagag

SEQ ID NO: 3036766 - DNA, 21 bp, Homo sapiens
ggcagggccttgcccagagat

SEQ ID NO: 3036767 - DNA, 21 bp, Homo sapiens
ggcagggcgggcagagggctg

SEQ ID NO: 3036768 - DNA, 22 bp, Homo sapiens
ggcagggcgggcagagggctgg

SEQ ID NO: 3036769 - DNA, 23 bp, Homo sapiens
ggcagggcgggcagagggctgga

SEQ ID NO: 3036770 - DNA, 14 bp, Homo sapiens
ggcagggctgagga

SEQ ID NO: 3036771 - DNA, 16 bp, Homo sapiens
ggcaggggcaggaggg

SEQ ID NO: 3036772 - DNA, 12 bp, Homo sapiens
ggcaggggcgga

SEQ ID NO: 3036773 - DNA, 19 bp, Homo sapiens
ggcagggggtgaaggcagg

SEQ ID NO: 3036774 - DNA, 21 bp, Homo sapiens
ggcagggggtgaaggcaggag

SEQ ID NO: 3036775 - DNA, 14 bp, Homo sapiens
ggcaggggtgagag

SEQ ID NO: 3036776 - DNA, 22 bp, Homo sapiens
ggcaggggtgagagcacccact

SEQ ID NO: 3036777 - DNA, 16 bp, Homo sapiens
ggcagggtctctgctc

SEQ ID NO: 3036778 - DNA, 19 bp, Homo sapiens
ggcagggtctctgctccag

SEQ ID NO: 3036779 - DNA, 21 bp, Homo sapiens
ggcagggtctctgctccagca

SEQ ID NO: 3036780 - DNA, 16 bp, Homo sapiens
ggcagggtgggatgga

SEQ ID NO: 3036781 - DNA, 15 bp, Homo sapiens
ggcaggtcactgtca

SEQ ID NO: 3036782 - DNA, 17 bp, Homo sapiens
ggcaggtcaggaccagg

SEQ ID NO: 3036783 - DNA, 17 bp, Homo sapiens
ggcaggtggcctctgct

SEQ ID NO: 3036784 - DNA, 16 bp, Homo sapiens
ggcaggtgggagctga

SEQ ID NO: 3036785 - DNA, 23 bp, Homo sapiens
ggcagtagctgtggtgaggtggg

SEQ ID NO: 3036786 - DNA, 14 bp, Homo sapiens
ggcagtattttctg

SEQ ID NO: 3036787 - DNA, 13 bp, Homo sapiens
ggcagtccagagc

SEQ ID NO: 3036788 - DNA, 16 bp, Homo sapiens
ggcagtcccgggagaa

SEQ ID NO: 3036789 - DNA, 20 bp, Homo sapiens
ggcagtcgctgcagggagca

SEQ ID NO: 3036790 - DNA, 16 bp, Homo sapiens
ggcagtgagggagggc

SEQ ID NO: 3036791 - DNA, 18 bp, Homo sapiens
ggcagtgtcttaaggaga

SEQ ID NO: 3036792 - DNA, 11 bp, Homo sapiens
ggcagttacat

SEQ ID NO: 3036793 - DNA, 23 bp, Homo sapiens
ggcagttttgacatcagccagct

SEQ ID NO: 3036794 - DNA, 14 bp, Homo sapiens
ggcatatacagtga

SEQ ID NO: 3036795 - DNA, 18 bp, Homo sapiens
ggcatcaccttaggcagg

SEQ ID NO: 3036796 - DNA, 23 bp, Homo sapiens
ggcatcatgcatcttactgaagg

SEQ ID NO: 3036797 - DNA, 13 bp, Homo sapiens
ggcatcatgcatg

SEQ ID NO: 3036798 - DNA, 22 bp, Homo sapiens
ggcatccagagtccctgcctgg

SEQ ID NO: 3036799 - DNA, 21 bp, Homo sapiens
ggcatccaggccagggctcct

SEQ ID NO: 3036800 - DNA, 14 bp, Homo sapiens
ggcatccagggctg

SEQ ID NO: 3036801 - DNA, 14 bp, Homo sapiens
ggcatccttgcctg

SEQ ID NO: 3036802 - DNA, 20 bp, Homo sapiens
ggcatccttgcctgtctaaa

SEQ ID NO: 3036803 - DNA, 21 bp, Homo sapiens
ggcatccttgcctgtctaaag

SEQ ID NO: 3036804 - DNA, 22 bp, Homo sapiens
ggcatccttgcctgtctaaagc

SEQ ID NO: 3036805 - DNA, 22 bp, Homo sapiens
ggcatctaattcttatttttaa

SEQ ID NO: 3036806 - DNA, 20 bp, Homo sapiens
ggcatctctgagtgtctctg

SEQ ID NO: 3036807 - DNA, 14 bp, Homo sapiens
ggcatctgcaaagg

SEQ ID NO: 3036808 - DNA, 13 bp, Homo sapiens
ggcatctgtgtgc

SEQ ID NO: 3036809 - DNA, 13 bp, Homo sapiens
ggcatgacccagt

SEQ ID NO: 3036810 - DNA, 19 bp, Homo sapiens
ggcatgacccagtgaagat

SEQ ID NO: 3036811 - DNA, 21 bp, Homo sapiens
ggcatgagactcagtgcagat

SEQ ID NO: 3036812 - DNA, 17 bp, Homo sapiens
ggcatgcacacggctgg

SEQ ID NO: 3036813 - DNA, 19 bp, Homo sapiens
ggcatgcacacggctggtc

SEQ ID NO: 3036814 - DNA, 14 bp, Homo sapiens
ggcatgcacctgca

SEQ ID NO: 3036815 - DNA, 18 bp, Homo sapiens
ggcatgcacgggcatgca

SEQ ID NO: 3036816 - DNA, 23 bp, Homo sapiens
ggcatgccaggacccgccagccc

SEQ ID NO: 3036817 - DNA, 16 bp, Homo sapiens
ggcatggccctgggcg

SEQ ID NO: 3036818 - DNA, 13 bp, Homo sapiens
ggcatggctccct

SEQ ID NO: 3036819 - DNA, 17 bp, Homo sapiens
ggcatggctggtgcctg

SEQ ID NO: 3036820 - DNA, 19 bp, Homo sapiens
ggcatgggtcgggagaggg

SEQ ID NO: 3036821 - DNA, 20 bp, Homo sapiens
ggcatgggtcgggagagggg

SEQ ID NO: 3036822 - DNA, 21 bp, Homo sapiens
ggcatggtggcgcaagcctgt

SEQ ID NO: 3036823 - DNA, 20 bp, Homo sapiens
ggcatgtattagccagtcat

SEQ ID NO: 3036824 - DNA, 23 bp, Homo sapiens
ggcatgtcctttccatctgtcca

SEQ ID NO: 3036825 - DNA, 13 bp, Homo sapiens
ggcatgtctgcct

SEQ ID NO: 3036826 - DNA, 14 bp, Homo sapiens
ggcatgtgggcttc

SEQ ID NO: 3036827 - DNA, 12 bp, Homo sapiens
ggcattccacag

SEQ ID NO: 3036828 - DNA, 17 bp, Homo sapiens
ggcattctacacctgga

SEQ ID NO: 3036829 - DNA, 16 bp, Homo sapiens
ggcattgatggggaag

SEQ ID NO: 3036830 - DNA, 23 bp, Homo sapiens
ggcattgatggggaaggaggctg

SEQ ID NO: 3036831 - DNA, 13 bp, Homo sapiens
ggcattgctttcc

SEQ ID NO: 3036832 - DNA, 13 bp, Homo sapiens
ggcatttcacaaa

SEQ ID NO: 3036833 - DNA, 11 bp, Homo sapiens
ggcatttccta

SEQ ID NO: 3036834 - DNA, 17 bp, Homo sapiens
ggcattttgaatgtgat

SEQ ID NO: 3036835 - DNA, 20 bp, Homo sapiens
ggcatttttgcaggctggct

SEQ ID NO: 3036836 - DNA, 12 bp, Homo sapiens
ggccaaacctct

SEQ ID NO: 3036837 - DNA, 14 bp, Homo sapiens
ggccaacaaagaac

SEQ ID NO: 3036838 - DNA, 13 bp, Homo sapiens
ggccaacatggta

SEQ ID NO: 3036839 - DNA, 20 bp, Homo sapiens
ggccaacccttctcctcttg

SEQ ID NO: 3036840 - DNA, 13 bp, Homo sapiens
ggccaagagaagg

SEQ ID NO: 3036841 - DNA, 16 bp, Homo sapiens
ggccaaggagggtgag

SEQ ID NO: 3036842 - DNA, 16 bp, Homo sapiens
ggccacatcaaagagg

SEQ ID NO: 3036843 - DNA, 17 bp, Homo sapiens
ggccaccacccaacctg

SEQ ID NO: 3036844 - DNA, 14 bp, Homo sapiens
ggccacctcaccct

SEQ ID NO: 3036845 - DNA, 20 bp, Homo sapiens
ggctcctccctctgcctcat

SEQ ID NO: 3036846 - DNA, 23 bp, Homo sapiens
ggctcctccctctgcctcatcct

SEQ ID NO: 3036847 - DNA, 13 bp, Homo sapiens
ggctcggcccagc

SEQ ID NO: 3036848 - DNA, 14 bp, Homo sapiens
ggctcggcccagca

SEQ ID NO: 3036849 - DNA, 15 bp, Homo sapiens
ggctcggcccagcac

SEQ ID NO: 3036850 - DNA, 23 bp, Homo sapiens
ggctctaaacctcaggccacatc

SEQ ID NO: 3036851 - DNA, 11 bp, Homo sapiens
ggctctagatc

SEQ ID NO: 3036852 - DNA, 22 bp, Homo sapiens
ggctctattggatttgtccaaa

SEQ ID NO: 3036853 - DNA, 23 bp, Homo sapiens
ggctctcatgttttcaactgcca

SEQ ID NO: 3036854 - DNA, 14 bp, Homo sapiens
ggctctccacctca

SEQ ID NO: 3036855 - DNA, 17 bp, Homo sapiens
ggctctccacctcagcc

SEQ ID NO: 3036856 - DNA, 18 bp, Homo sapiens
ggctctccacctcagcct

SEQ ID NO: 3036857 - DNA, 17 bp, Homo sapiens
ggctctcgggtggggga

SEQ ID NO: 3036858 - DNA, 12 bp, Homo sapiens
ggctctctgagt

SEQ ID NO: 3036859 - DNA, 23 bp, Homo sapiens
ggctctgaagcaaggcggtggac

SEQ ID NO: 3036860 - DNA, 15 bp, Homo sapiens
ggctctgagagtcta

SEQ ID NO: 3036861 - DNA, 22 bp, Homo sapiens
ggctctgagagtctagattctc

SEQ ID NO: 3036862 - DNA, 19 bp, Homo sapiens
ggctctgctggccggagca

SEQ ID NO: 3036863 - DNA, 14 bp, Homo sapiens
ggctctgggggcag

SEQ ID NO: 3036864 - DNA, 14 bp, Homo sapiens
ggctctgtgccttg

SEQ ID NO: 3036865 - DNA, 19 bp, Homo sapiens
ggctctgttatcagctggg

SEQ ID NO: 3036866 - DNA, 13 bp, Homo sapiens
ggctctgttcctc

SEQ ID NO: 3036867 - DNA, 20 bp, Homo sapiens
ggctctgttcctcaatggcc

SEQ ID NO: 3036868 - DNA, 20 bp, Homo sapiens
ggctcttctccttggaggac

SEQ ID NO: 3036869 - DNA, 15 bp, Homo sapiens
ggctcttctgagcag

SEQ ID NO: 3036870 - DNA, 18 bp, Homo sapiens
ggctcttgaactgagctt

SEQ ID NO: 3036871 - DNA, 15 bp, Homo sapiens
ggctgaacagtgctc

SEQ ID NO: 3036872 - DNA, 20 bp, Homo sapiens
ggctgaacagtgctctgcct

SEQ ID NO: 3036873 - DNA, 17 bp, Homo sapiens
ggctgaacggggagaaa

SEQ ID NO: 3036874 - DNA, 13 bp, Homo sapiens
ggctgaccacagc

SEQ ID NO: 3036875 - DNA, 16 bp, Homo sapiens
ggctgaccacagcaca

SEQ ID NO: 3036876 - DNA, 22 bp, Homo sapiens
ggctgacggtgcagtctgggtg

SEQ ID NO: 3036877 - DNA, 15 bp, Homo sapiens
ggctgagccaaagcc

SEQ ID NO: 3036878 - DNA, 13 bp, Homo sapiens
ggctgagctgggg

SEQ ID NO: 3036879 - DNA, 18 bp, Homo sapiens
ggctgaggatgggctctg

SEQ ID NO: 3036880 - DNA, 14 bp, Homo sapiens
ggctgaggcagaag

SEQ ID NO: 3036881 - DNA, 18 bp, Homo sapiens
ggctgaggctggcacagg

SEQ ID NO: 3036882 - DNA, 15 bp, Homo sapiens
ggctgagggcatctc

SEQ ID NO: 3036883 - DNA, 16 bp, Homo sapiens
ggctgagggtgccctt

SEQ ID NO: 3036884 - DNA, 16 bp, Homo sapiens
ggctgagtctccaggg

SEQ ID NO: 3036885 - DNA, 20 bp, Homo sapiens
ggctgatggattccaaacca

SEQ ID NO: 3036886 - DNA, 21 bp, Homo sapiens
ggctgatggattccaaaccag

SEQ ID NO: 3036887 - DNA, 14 bp, Homo sapiens
ggctgatttctagg

SEQ ID NO: 3036888 - DNA, 17 bp, Homo sapiens
ggctgcacgctcccctc

SEQ ID NO: 3036889 - DNA, 18 bp, Homo sapiens
ggctgcactggagccaca

SEQ ID NO: 3036890 - DNA, 20 bp, Homo sapiens
ggctgcactggagccacagg

SEQ ID NO: 3036891 - DNA, 19 bp, Homo sapiens
ggctgcagagtctgcccca

SEQ ID NO: 3036892 - DNA, 17 bp, Homo sapiens
ggctgcagccaggcctc

SEQ ID NO: 3036893 - DNA, 18 bp, Homo sapiens
ggctgcagccaggcctcg

SEQ ID NO: 3036894 - DNA, 20 bp, Homo sapiens
ggctgcagccaggcctcgcc

SEQ ID NO: 3036895 - DNA, 13 bp, Homo sapiens
ggctgcaggtgct

SEQ ID NO: 3036896 - DNA, 14 bp, Homo sapiens
ggctgcaggtgctg

SEQ ID NO: 3036897 - DNA, 23 bp, Homo sapiens
ggctgccccaggccggagcccag

SEQ ID NO: 3036898 - DNA, 20 bp, Homo sapiens
ggctgccgactcccccaacc

SEQ ID NO: 3036899 - DNA, 19 bp, Homo sapiens
ggctgccgagacagaccct

SEQ ID NO: 3036900 - DNA, 22 bp, Homo sapiens
ggctgccgagacagaccctctg

SEQ ID NO: 3036901 - DNA, 19 bp, Homo sapiens
ggctgcctttgatcacagg

SEQ ID NO: 3036902 - DNA, 20 bp, Homo sapiens
ggctgcctttgatcacagga

SEQ ID NO: 3036903 - DNA, 12 bp, Homo sapiens
ggctgcctttgt

SEQ ID NO: 3036904 - DNA, 23 bp, Homo sapiens
ggctgcctttgtggtgggcgctg

SEQ ID NO: 3036905 - DNA, 16 bp, Homo sapiens
ggctgcggtgggcagc

SEQ ID NO: 3036906 - DNA, 15 bp, Homo sapiens
ggctgctcctccagg

SEQ ID NO: 3036907 - DNA, 15 bp, Homo sapiens
ggctgctcgcccagg

SEQ ID NO: 3036908 - DNA, 19 bp, Homo sapiens
ggctgctcgcccaggaagg

SEQ ID NO: 3036909 - DNA, 22 bp, Homo sapiens
ggctgctcgcccaggaaggcct

SEQ ID NO: 3036910 - DNA, 12 bp, Homo sapiens
ggctgctgccac

SEQ ID NO: 3036911 - DNA, 14 bp, Homo sapiens
ggctgctgccatcc

SEQ ID NO: 3036912 - DNA, 11 bp, Homo sapiens
ggctgctggga

SEQ ID NO: 3036913 - DNA, 23 bp, Homo sapiens
ggctgctgggggctccccttgcc

SEQ ID NO: 3036914 - DNA, 15 bp, Homo sapiens
ggctgctgtgtggac

SEQ ID NO: 3036915 - DNA, 18 bp, Homo sapiens
ggctgcttctacggccat

SEQ ID NO: 3036916 - DNA, 14 bp, Homo sapiens
ggctgcttgcagcc

SEQ ID NO: 3036917 - DNA, 20 bp, Homo sapiens
ggctggagaatgtggagaac

SEQ ID NO: 3036918 - DNA, 19 bp, Homo sapiens
ggctggaggcagggccttg

SEQ ID NO: 3036919 - DNA, 20 bp, Homo sapiens
ggctggagtacagtggtgcc

SEQ ID NO: 3036920 - DNA, 20 bp, Homo sapiens
ggctggagtgcagtggtgca

SEQ ID NO: 3036921 - DNA, 20 bp, Homo sapiens
ggctggagtgcagtggtgtg

SEQ ID NO: 3036922 - DNA, 15 bp, Homo sapiens
ggctggcacaggaca

SEQ ID NO: 3036923 - DNA, 22 bp, Homo sapiens
ggctggcatgatccaagcaaga

SEQ ID NO: 3036924 - DNA, 13 bp, Homo sapiens
ggctggccagccg

SEQ ID NO: 3036925 - DNA, 16 bp, Homo sapiens
ggctggccagccgctc

SEQ ID NO: 3036926 - DNA, 18 bp, Homo sapiens
ggctggccctgtgcagac

SEQ ID NO: 3036927 - DNA, 20 bp, Homo sapiens
ggctggcctggaggctcagc

SEQ ID NO: 3036928 - DNA, 20 bp, Homo sapiens
ggctggcggctactcagcag

SEQ ID NO: 3036929 - DNA, 20 bp, Homo sapiens
ggctggctctgtggaggggc

SEQ ID NO: 3036930 - DNA, 10 bp, Homo sapiens
ggctggctgg

SEQ ID NO: 3036931 - DNA, 19 bp, Homo sapiens
ggctgggacgtggctcagc

SEQ ID NO: 3036932 - DNA, 23 bp, Homo sapiens
ggctgggacgtggctcagccagc

SEQ ID NO: 3036933 - DNA, 13 bp, Homo sapiens
ggctgggaggagg

SEQ ID NO: 3036934 - DNA, 14 bp, Homo sapiens
ggctgggcctcctt

SEQ ID NO: 3036935 - DNA, 11 bp, Homo sapiens
ggctgggctga

SEQ ID NO: 3036936 - DNA, 14 bp, Homo sapiens
ggctgggctgagcc

SEQ ID NO: 3036937 - DNA, 21 bp, Homo sapiens
ggctgggggagggactgctga

SEQ ID NO: 3036938 - DNA, 20 bp, Homo sapiens
ggctggggtggcctgtgtgg

SEQ ID NO: 3036939 - DNA, 18 bp, Homo sapiens
ggctgggtcacaggaagg

SEQ ID NO: 3036940 - DNA, 18 bp, Homo sapiens
ggctgggtccttgggcct

SEQ ID NO: 3036941 - DNA, 14 bp, Homo sapiens
ggctgggtggcccc

SEQ ID NO: 3036942 - DNA, 16 bp, Homo sapiens
ggctggtattctctct

SEQ ID NO: 3036943 - DNA, 13 bp, Homo sapiens
ggctggtcactct

SEQ ID NO: 3036944 - DNA, 15 bp, Homo sapiens
ggctggtcactctgc

SEQ ID NO: 3036945 - DNA, 17 bp, Homo sapiens
ggctggtcactctgccc

SEQ ID NO: 3036946 - DNA, 17 bp, Homo sapiens
ggctggtgcctgagccc

SEQ ID NO: 3036947 - DNA, 19 bp, Homo sapiens
ggctggtggattgggcaga

SEQ ID NO: 3036948 - DNA, 14 bp, Homo sapiens
ggctggtttgttct

SEQ ID NO: 3036949 - DNA, 13 bp, Homo sapiens
ggctgtcccaagc

SEQ ID NO: 3036950 - DNA, 14 bp, Homo sapiens
ggctgtcccaagct

SEQ ID NO: 3036951 - DNA, 19 bp, Homo sapiens
ggctgtcccaagctcccaa

SEQ ID NO: 3036952 - DNA, 22 bp, Homo sapiens
ggctgtctttgcagggcacaga

SEQ ID NO: 3036953 - DNA, 19 bp, Homo sapiens
ggctgtgaatgccaaagcc

SEQ ID NO: 3036954 - DNA, 18 bp, Homo sapiens
ggctgtgactctgggcag

SEQ ID NO: 3036955 - DNA, 19 bp, Homo sapiens
ggctgtgactctgggcagg

SEQ ID NO: 3036956 - DNA, 14 bp, Homo sapiens
ggctgtgctcagag

SEQ ID NO: 3036957 - DNA, 21 bp, Homo sapiens
ggctgtggagacaatgtctgc

SEQ ID NO: 3036958 - DNA, 23 bp, Homo sapiens
ggctgtggcatccagagtccctg

SEQ ID NO: 3036959 - DNA, 15 bp, Homo sapiens
ggctgtgggaccagg

SEQ ID NO: 3036960 - DNA, 13 bp, Homo sapiens
ggctgttgcatgg

SEQ ID NO: 3036961 - DNA, 19 bp, Homo sapiens
ggcttaagaaatctagtat

SEQ ID NO: 3036962 - DNA, 13 bp, Homo sapiens
ggcttaataaaaa

SEQ ID NO: 3036963 - DNA, 14 bp, Homo sapiens
ggcttaataaaaat

SEQ ID NO: 3036964 - DNA, 14 bp, Homo sapiens
ggcttaatcatttt

SEQ ID NO: 3036965 - DNA, 22 bp, Homo sapiens
ggcttacaggggggtcggaagc

SEQ ID NO: 3036966 - DNA, 16 bp, Homo sapiens
ggcttatttagaaaaa

SEQ ID NO: 3036967 - DNA, 11 bp, Homo sapiens
ggcttcagcct

SEQ ID NO: 3036968 - DNA, 21 bp, Homo sapiens
ggcttcagcctagtggcttgt

SEQ ID NO: 3036969 - DNA, 24 bp, Homo sapiens
ggcttcagcctagtggcttgtcct

SEQ ID NO: 3036970 - DNA, 20 bp, Homo sapiens
ggcttcagctccagcccctt

SEQ ID NO: 3036971 - DNA, 16 bp, Homo sapiens
ggcttcaggtccaggc

SEQ ID NO: 3036972 - DNA, 18 bp, Homo sapiens
ggcttcagtctcatattt

SEQ ID NO: 3036973 - DNA, 12 bp, Homo sapiens
ggcttcatacac

SEQ ID NO: 3036974 - DNA, 22 bp, Homo sapiens
ggcttcctcttccgggcagaaa

SEQ ID NO: 3036975 - DNA, 22 bp, Homo sapiens
ggcttctgcgtccaccaggcct

SEQ ID NO: 3036976 - DNA, 15 bp, Homo sapiens
ggcttgaatttgcat

SEQ ID NO: 3036977 - DNA, 22 bp, Homo sapiens
gggggctccccttgcccttcct

SEQ ID NO: 3036978 - DNA, 12 bp, Homo sapiens
ggggggctgcct

SEQ ID NO: 3036979 - DNA, 19 bp, Homo sapiens
gggggtcggaagcctgtcc

SEQ ID NO: 3036980 - DNA, 21 bp, Homo sapiens
ggggtaaagggcgcaaagggc

SEQ ID NO: 3036981 - DNA, 23 bp, Homo sapiens
ggggtagaggaagacgagacagg

SEQ ID NO: 3036982 - DNA, 19 bp, Homo sapiens
ggggtagctagaggaacca

SEQ ID NO: 3036983 - DNA, 16 bp, Homo sapiens
ggggtcaagctgagct

SEQ ID NO: 3036984 - DNA, 18 bp, Homo sapiens
ggggtcaagctgagctgg

SEQ ID NO: 3036985 - DNA, 15 bp, Homo sapiens
ggggtcatccttgcc

SEQ ID NO: 3036986 - DNA, 16 bp, Homo sapiens
ggggtcatccttgccc

SEQ ID NO: 3036987 - DNA, 21 bp, Homo sapiens
ggggtcatgccctcctctccc

SEQ ID NO: 3036988 - DNA, 16 bp, Homo sapiens
ggggtccctagcagcc

SEQ ID NO: 3036989 - DNA, 18 bp, Homo sapiens
ggggtcctgccggagagg

SEQ ID NO: 3036990 - DNA, 11 bp, Homo sapiens
ggggtcctggc

SEQ ID NO: 3036991 - DNA, 13 bp, Homo sapiens
ggggtcctggcca

SEQ ID NO: 3036992 - DNA, 14 bp, Homo sapiens
ggggtcctggccat

SEQ ID NO: 3036993 - DNA, 23 bp, Homo sapiens
ggggtcctgggaggctgcagcca

SEQ ID NO: 3036994 - DNA, 19 bp, Homo sapiens
ggggtctccctctcctgcc

SEQ ID NO: 3036995 - DNA, 20 bp, Homo sapiens
ggggtctccctctcctgcct

SEQ ID NO: 3036996 - DNA, 22 bp, Homo sapiens
ggggtctccctctcctgcctac

SEQ ID NO: 3036997 - DNA, 16 bp, Homo sapiens
ggggtctcctggacct

SEQ ID NO: 3036998 - DNA, 14 bp, Homo sapiens
ggggtgaggagctg

SEQ ID NO: 3036999 - DNA, 15 bp, Homo sapiens
ggggtgaggagctgg

SEQ ID NO: 3037000 - DNA, 16 bp, Homo sapiens
ggggtggagtcccaga

SEQ ID NO: 3037001 - DNA, 17 bp, Homo sapiens
ggggtggagtcccagag

SEQ ID NO: 3037002 - DNA, 13 bp, Homo sapiens
ggggtggcctgtg

SEQ ID NO: 3037003 - DNA, 15 bp, Homo sapiens
ggggtggcctgtgtg

SEQ ID NO: 3037004 - DNA, 19 bp, Homo sapiens
ggggtggcgcgcctgcctt

SEQ ID NO: 3037005 - DNA, 13 bp, Homo sapiens
ggggtgggcagca

SEQ ID NO: 3037006 - DNA, 12 bp, Homo sapiens
ggggtggggtgg

SEQ ID NO: 3037007 - DNA, 18 bp, Homo sapiens
ggggtgtccgagaggctg

SEQ ID NO: 3037008 - DNA, 15 bp, Homo sapiens
ggggttgtgttgtca

SEQ ID NO: 3037009 - DNA, 23 bp, Homo sapiens
gggtaaagggcgcaaagggcatg

SEQ ID NO: 3037010 - DNA, 20 bp, Homo sapiens
gggtaagggatttcttaggg

SEQ ID NO: 3037011 - DNA, 22 bp, Homo sapiens
gggtagaggaagacgagacagg

SEQ ID NO: 3037012 - DNA, 14 bp, Homo sapiens
gggtaggccccaca

SEQ ID NO: 3037013 - DNA, 17 bp, Homo sapiens
gggtcaagctgagctgg

SEQ ID NO: 3037014 - DNA, 23 bp, Homo sapiens
gggtcaagctgagctggcttcgg

SEQ ID NO: 3037015 - DNA, 15 bp, Homo sapiens
gggtcaccctgtgac

SEQ ID NO: 3037016 - DNA, 18 bp, Homo sapiens
gggtcagaaacaggaccg

SEQ ID NO: 3037017 - DNA, 21 bp, Homo sapiens
gggtcatgccctcctctccca

SEQ ID NO: 3037018 - DNA, 19 bp, Homo sapiens
gggtcatttttaactactg

SEQ ID NO: 3037019 - DNA, 13 bp, Homo sapiens
gggtccagaagga

SEQ ID NO: 3037020 - DNA, 17 bp, Homo sapiens
gggtccagaaggagaca

SEQ ID NO: 3037021 - DNA, 16 bp, Homo sapiens
gggtccagggagcagg

SEQ ID NO: 3037022 - DNA, 17 bp, Homo sapiens
gggtccagggagcaggc

SEQ ID NO: 3037023 - DNA, 13 bp, Homo sapiens
gggtccccagggc

SEQ ID NO: 3037024 - DNA, 15 bp, Homo sapiens
gggtcccctgccacc

SEQ ID NO: 3037025 - DNA, 15 bp, Homo sapiens
gggtccgcatccctg

SEQ ID NO: 3037026 - DNA, 13 bp, Homo sapiens
gggtcctcggccc

SEQ ID NO: 3037027 - DNA, 10 bp, Homo sapiens
gggtcctggg

SEQ ID NO: 3037028 - DNA, 11 bp, Homo sapiens
gggtcctggga

SEQ ID NO: 3037029 - DNA, 15 bp, Homo sapiens
gggtcctgggggcag

SEQ ID NO: 3037030 - DNA, 18 bp, Homo sapiens
gggtcggaagcctgtcct

SEQ ID NO: 3037031 - DNA, 18 bp, Homo sapiens
gggtcgggagaggggacg

SEQ ID NO: 3037032 - DNA, 21 bp, Homo sapiens
gggtctaaggagcgctagtgc

SEQ ID NO: 3037033 - DNA, 23 bp, Homo sapiens
gggtctaaggagcgctagtgcct

SEQ ID NO: 3037034 - DNA, 23 bp, Homo sapiens
gggtctaccaatacaaaatgtat

SEQ ID NO: 3037035 - DNA, 17 bp, Homo sapiens
gggtctattccagctca

SEQ ID NO: 3037036 - DNA, 17 bp, Homo sapiens
gggtctcaggtccagct

SEQ ID NO: 3037037 - DNA, 18 bp, Homo sapiens
gggtctccctctcctgcc

SEQ ID NO: 3037038 - DNA, 19 bp, Homo sapiens
gggtctccctctcctgcct

SEQ ID NO: 3037039 - DNA, 14 bp, Homo sapiens
gggtcttagctctt

SEQ ID NO: 3037040 - DNA, 21 bp, Homo sapiens
gggtcttttcatctgggaaag

SEQ ID NO: 3037041 - DNA, 21 bp, Homo sapiens
gggtctttttctcttctgttc

SEQ ID NO: 3037042 - DNA, 15 bp, Homo sapiens
gggtgaggagctggg

SEQ ID NO: 3037043 - DNA, 15 bp, Homo sapiens
gggtgatttctagaa

SEQ ID NO: 3037044 - DNA, 23 bp, Homo sapiens
gggtgcagtatcatgccctgtgc

SEQ ID NO: 3037045 - DNA, 17 bp, Homo sapiens
gggtgccaagtcctagc

SEQ ID NO: 3037046 - DNA, 12 bp, Homo sapiens
gggtgccctgaa

SEQ ID NO: 3037047 - DNA, 21 bp, Homo sapiens
gggtgctgccccatgaagcca

SEQ ID NO: 3037048 - DNA, 15 bp, Homo sapiens
gggtggagaagccat

SEQ ID NO: 3037049 - DNA, 16 bp, Homo sapiens
gggtggagaagccatt

SEQ ID NO: 3037050 - DNA, 22 bp, Homo sapiens
gggtggagctgagaagaggagg

SEQ ID NO: 3037051 - DNA, 11 bp, Homo sapiens
gggtggcctgt

SEQ ID NO: 3037052 - DNA, 18 bp, Homo sapiens
gggtggcgcgcctgcctt

SEQ ID NO: 3037053 - DNA, 16 bp, Homo sapiens
gggtggctagtcagag

SEQ ID NO: 3037054 - DNA, 18 bp, Homo sapiens
gggtggctagtcagagag

SEQ ID NO: 3037055 - DNA, 15 bp, Homo sapiens
gggtggctggagtga

SEQ ID NO: 3037056 - DNA, 15 bp, Homo sapiens
gggtgggaaggggct

SEQ ID NO: 3037057 - DNA, 17 bp, Homo sapiens
gggtgggatggaggaga

SEQ ID NO: 3037058 - DNA, 12 bp, Homo sapiens
gggtgggcagca

SEQ ID NO: 3037059 - DNA, 18 bp, Homo sapiens
gggtggggagagacgggc

SEQ ID NO: 3037060 - DNA, 14 bp, Homo sapiens
gggtggggaggggc

SEQ ID NO: 3037061 - DNA, 14 bp, Homo sapiens
gggtggggctgctc

SEQ ID NO: 3037062 - DNA, 17 bp, Homo sapiens
gggtgtccgagaggctg

SEQ ID NO: 3037063 - DNA, 21 bp, Homo sapiens
gggtgtcctgcaccggggcct

SEQ ID NO: 3037064 - DNA, 15 bp, Homo sapiens
gggtgttaatttatg

SEQ ID NO: 3037065 - DNA, 17 bp, Homo sapiens
gggttaaatcaaagata

SEQ ID NO: 3037066 - DNA, 18 bp, Homo sapiens
gggttatgtatcagaaga

SEQ ID NO: 3037067 - DNA, 16 bp, Homo sapiens
gggttcagcctcctgt

SEQ ID NO: 3037068 - DNA, 19 bp, Homo sapiens
gggttctcagtgccggagg

SEQ ID NO: 3037069 - DNA, 19 bp, Homo sapiens
gggttgattaaggcagtac

SEQ ID NO: 3037070 - DNA, 17 bp, Homo sapiens
gggttggagaaggaggt

SEQ ID NO: 3037071 - DNA, 17 bp, Homo sapiens
gggtttacaacaaacac

SEQ ID NO: 3037072 - DNA, 20 bp, Homo sapiens
gggtttcctgcatggacagt

SEQ ID NO: 3037073 - DNA, 13 bp, Homo sapiens
gggtttctctccc

SEQ ID NO: 3037074 - DNA, 23 bp, Homo sapiens
gggtttggcccaagactgggctg

SEQ ID NO: 3037075 - DNA, 15 bp, Homo sapiens
gggtttggcccctgg

SEQ ID NO: 3037076 - DNA, 13 bp, Homo sapiens
gggttttaatgta

SEQ ID NO: 3037077 - DNA, 13 bp, Homo sapiens
ggtaaaatgccat

SEQ ID NO: 3037078 - DNA, 16 bp, Homo sapiens
ggtaaatctagagttt

SEQ ID NO: 3037079 - DNA, 13 bp, Homo sapiens
ggtaaatgccaca

SEQ ID NO: 3037080 - DNA, 19 bp, Homo sapiens
ggtaacatttatagaagaa

SEQ ID NO: 3037081 - DNA, 15 bp, Homo sapiens
ggtaactaagaagtg

SEQ ID NO: 3037082 - DNA, 20 bp, Homo sapiens
ggtaagctagagagaaaaag

SEQ ID NO: 3037083 - DNA, 16 bp, Homo sapiens
ggtaatatatatattt

SEQ ID NO: 3037084 - DNA, 20 bp, Homo sapiens
ggtaattatgttttgtgatt

SEQ ID NO: 3037085 - DNA, 13 bp, Homo sapiens
ggtaattgtacaa

SEQ ID NO: 3037086 - DNA, 19 bp, Homo sapiens
ggtacaaaaataaatttat

SEQ ID NO: 3037087 - DNA, 17 bp, Homo sapiens
ggtacagttgcaggagc

SEQ ID NO: 3037088 - DNA, 19 bp, Homo sapiens
ggtacagttgcaggagcgt

SEQ ID NO: 3037089 - DNA, 12 bp, Homo sapiens
ggtacagtttgg

SEQ ID NO: 3037090 - DNA, 23 bp, Homo sapiens
ggtacatttttcaactttgaata

SEQ ID NO: 3037091 - DNA, 22 bp, Homo sapiens
ggtaccagatgcagctcaagag

SEQ ID NO: 3037092 - DNA, 23 bp, Homo sapiens
ggtaccaggcacatggctggggg

SEQ ID NO: 3037093 - DNA, 11 bp, Homo sapiens
ggtaccctggg

SEQ ID NO: 3037094 - DNA, 14 bp, Homo sapiens
ggtacctcatgagg

SEQ ID NO: 3037095 - DNA, 17 bp, Homo sapiens
ggtacctgcaagcagaa

SEQ ID NO: 3037096 - DNA, 19 bp, Homo sapiens
ggtacttcttgaaggtgct

SEQ ID NO: 3037097 - DNA, 19 bp, Homo sapiens
ggtagaaaactccagggtc

SEQ ID NO: 3037098 - DNA, 12 bp, Homo sapiens
ggtagaagccac

SEQ ID NO: 3037099 - DNA, 18 bp, Homo sapiens
ggtagaagccacccttcc

SEQ ID NO: 3037100 - DNA, 22 bp, Homo sapiens
ggtagaagccacccttccctgc

SEQ ID NO: 3037101 - DNA, 23 bp, Homo sapiens
ggtagaagccacccttccctgcc

SEQ ID NO: 3037102 - DNA, 19 bp, Homo sapiens
ggtagaatgtaaagcttgt

SEQ ID NO: 3037103 - DNA, 23 bp, Homo sapiens
ggtagagcaaaggagacaaagca

SEQ ID NO: 3037104 - DNA, 12 bp, Homo sapiens
ggtagagtttat

SEQ ID NO: 3037105 - DNA, 17 bp, Homo sapiens
ggtagccatcaagcact

SEQ ID NO: 3037106 - DNA, 22 bp, Homo sapiens
ggtagccatcaagcacttccca

SEQ ID NO: 3037107 - DNA, 15 bp, Homo sapiens
ggtagctagaggaac

SEQ ID NO: 3037108 - DNA, 13 bp, Homo sapiens
ggtagctccagcg

SEQ ID NO: 3037109 - DNA, 17 bp, Homo sapiens
ggtagctttgaggtgga

SEQ ID NO: 3037110 - DNA, 22 bp, Homo sapiens
gtaagaagtttcttaaacattg

SEQ ID NO: 3037111 - DNA, 14 bp, Homo sapiens
gtaagacatttcct

SEQ ID NO: 3037112 - DNA, 16 bp, Homo sapiens
gtaagaccttggtagg

SEQ ID NO: 3037113 - DNA, 19 bp, Homo sapiens
gtaagatggttttcaaatc

SEQ ID NO: 3037114 - DNA, 23 bp, Homo sapiens
gtaagattatagattctaaagat

SEQ ID NO: 3037115 - DNA, 12 bp, Homo sapiens
gtaagctgtgtg

SEQ ID NO: 3037116 - DNA, 20 bp, Homo sapiens
gtaagcttagattttctgta

SEQ ID NO: 3037117 - DNA, 15 bp, Homo sapiens
gtaagggatttctta

SEQ ID NO: 3037118 - DNA, 16 bp, Homo sapiens
gtaagggatttcttag

SEQ ID NO: 3037119 - DNA, 22 bp, Homo sapiens
gtaaggtcttacattgcctgac

SEQ ID NO: 3037120 - DNA, 14 bp, Homo sapiens
gtaaggtctttgta

SEQ ID NO: 3037121 - DNA, 12 bp, Homo sapiens
gtaaggtgcctt

SEQ ID NO: 3037122 - DNA, 17 bp, Homo sapiens
gtaagtctcaactctgt

SEQ ID NO: 3037123 - DNA, 14 bp, Homo sapiens
gtaagtgggcccac

SEQ ID NO: 3037124 - DNA, 16 bp, Homo sapiens
gtaagtgggcccaccc

SEQ ID NO: 3037125 - DNA, 18 bp, Homo sapiens
gtaagttaataagcaaaa

SEQ ID NO: 3037126 - DNA, 21 bp, Homo sapiens
gtaagtttaaaggatgttggt

SEQ ID NO: 3037127 - DNA, 17 bp, Homo sapiens
gtaatacagcttgtgag

SEQ ID NO: 3037128 - DNA, 22 bp, Homo sapiens
gtaatactttcggagaaattct

SEQ ID NO: 3037129 - DNA, 11 bp, Homo sapiens
gtaatatatat

SEQ ID NO: 3037130 - DNA, 12 bp, Homo sapiens
gtaatatgaaat

SEQ ID NO: 3037131 - DNA, 19 bp, Homo sapiens
gtaatattctctgatgttt

SEQ ID NO: 3037132 - DNA, 19 bp, Homo sapiens
gtaatatttcttcaagtga

SEQ ID NO: 3037133 - DNA, 13 bp, Homo sapiens
gtaatcaataaac

SEQ ID NO: 3037134 - DNA, 18 bp, Homo sapiens
gtaatcaataaacgattt

SEQ ID NO: 3037135 - DNA, 15 bp, Homo sapiens
gtaatcccagcactt

SEQ ID NO: 3037136 - DNA, 16 bp, Homo sapiens
gtaatcccagcacttt

SEQ ID NO: 3037137 - DNA, 12 bp, Homo sapiens
gtaatcccagct

SEQ ID NO: 3037138 - DNA, 18 bp, Homo sapiens
gtaatctcgtttcaaaaa

SEQ ID NO: 3037139 - DNA, 20 bp, Homo sapiens
gtaatctcgtttcaaaaaca

SEQ ID NO: 3037140 - DNA, 20 bp, Homo sapiens
gtaatctgtgtacaaagaaa

SEQ ID NO: 3037141 - DNA, 17 bp, Homo sapiens
gtaatcttgggtttcta

SEQ ID NO: 3037142 - DNA, 17 bp, Homo sapiens
gtaatgtagttctttgt

SEQ ID NO: 3037143 - DNA, 19 bp, Homo sapiens
gtaatgtcaccaccttccc

SEQ ID NO: 3037144 - DNA, 14 bp, Homo sapiens
gtaatgtcttcagt

SEQ ID NO: 3037145 - DNA, 14 bp, Homo sapiens
gtaatgtgaataaa

SEQ ID NO: 3037146 - DNA, 16 bp, Homo sapiens
gtaattaataaacgaa

SEQ ID NO: 3037147 - DNA, 23 bp, Homo sapiens
gtaattagtaacatgtgttaagt

SEQ ID NO: 3037148 - DNA, 15 bp, Homo sapiens
gtaattgacatgtgc

SEQ ID NO: 3037149 - DNA, 16 bp, Homo sapiens
gtaattgtacaatact

SEQ ID NO: 3037150 - DNA, 22 bp, Homo sapiens
gtaatttaaaacttttgtttaa

SEQ ID NO: 3037151 - DNA, 17 bp, Homo sapiens
gtaatttagattgtaaa

SEQ ID NO: 3037152 - DNA, 13 bp, Homo sapiens
gtaatttcagttc

SEQ ID NO: 3037153 - DNA, 16 bp, Homo sapiens
gtacaaaatggtccta

SEQ ID NO: 3037154 - DNA, 16 bp, Homo sapiens
gtacaagctcttgttt

SEQ ID NO: 3037155 - DNA, 20 bp, Homo sapiens
gtacaagctcttgtttctgt

SEQ ID NO: 3037156 - DNA, 14 bp, Homo sapiens
gtacaagttgcttt

SEQ ID NO: 3037157 - DNA, 17 bp, Homo sapiens
gtacaagttgctttgtt

SEQ ID NO: 3037158 - DNA, 11 bp, Homo sapiens
gtacaataaaa

SEQ ID NO: 3037159 - DNA, 14 bp, Homo sapiens
gtacaattcattgt

SEQ ID NO: 3037160 - DNA, 17 bp, Homo sapiens
gtacacgtgtcctgtag

SEQ ID NO: 3037161 - DNA, 16 bp, Homo sapiens
gtacagacttgttgtg

SEQ ID NO: 3037162 - DNA, 14 bp, Homo sapiens
gtacagaggggaca

SEQ ID NO: 3037163 - DNA, 12 bp, Homo sapiens
gtacaggcagca

SEQ ID NO: 3037164 - DNA, 15 bp, Homo sapiens
gtacaggcagcacag

SEQ ID NO: 3037165 - DNA, 22 bp, Homo sapiens
gtacagtctcaattttgtattt

SEQ ID NO: 3037166 - DNA, 13 bp, Homo sapiens
gtacagtctgtct

SEQ ID NO: 3037167 - DNA, 17 bp, Homo sapiens
gtacagtctgtcttctg

SEQ ID NO: 3037168 - DNA, 20 bp, Homo sapiens
gtacagtctgtcttctgtat

SEQ ID NO: 3037169 - DNA, 21 bp, Homo sapiens
gtacagtctgtcttctgtata

SEQ ID NO: 3037170 - DNA, 15 bp, Homo sapiens
gtacagttcataaat

SEQ ID NO: 3037171 - DNA, 16 bp, Homo sapiens
gtacagttgcaggagc

SEQ ID NO: 3037172 - DNA, 15 bp, Homo sapiens
gtacagttttgtgga

SEQ ID NO: 3037173 - DNA, 14 bp, Homo sapiens
gtacataagttaaa

SEQ ID NO: 3037174 - DNA, 21 bp, Homo sapiens
gtacataagttaaatgattga

SEQ ID NO: 3037175 - DNA, 23 bp, Homo sapiens
gtacataatacacttgccctgct

SEQ ID NO: 3037176 - DNA, 20 bp, Homo sapiens
gtacataattgattaaaatc

SEQ ID NO: 3037177 - DNA, 17 bp, Homo sapiens
gtacatagtaaagtatt

SEQ ID NO: 3037178 - DNA, 18 bp, Homo sapiens
gtacatagtaaagtattt

SEQ ID NO: 3037179 - DNA, 20 bp, Homo sapiens
gtacatcccatgtaacagaa

SEQ ID NO: 3037180 - DNA, 22 bp, Homo sapiens
gtacatcccatgtaacagaaag

SEQ ID NO: 3037181 - DNA, 18 bp, Homo sapiens
gtacatctattttggatt

SEQ ID NO: 3037182 - DNA, 19 bp, Homo sapiens
gtacatgggactgattctg

SEQ ID NO: 3037183 - DNA, 16 bp, Homo sapiens
gtacatgtacatagta

SEQ ID NO: 3037184 - DNA, 18 bp, Homo sapiens
gtacatttcaccatggcc

SEQ ID NO: 3037185 - DNA, 21 bp, Homo sapiens
gtacatttctataaatagatg

SEQ ID NO: 3037186 - DNA, 19 bp, Homo sapiens
gtacattttggatttcttt

SEQ ID NO: 3037187 - DNA, 15 bp, Homo sapiens
gtacattttgtaaca

SEQ ID NO: 3037188 - DNA, 10 bp, Homo sapiens
gtacattttt

SEQ ID NO: 3037189 - DNA, 16 bp, Homo sapiens
gtaccaagccaccgca

SEQ ID NO: 3037190 - DNA, 18 bp, Homo sapiens
gtaccacaccctgcctgc

SEQ ID NO: 3037191 - DNA, 20 bp, Homo sapiens
gtaccacaccctgcctgctg

SEQ ID NO: 3037192 - DNA, 21 bp, Homo sapiens
gtaccacaccctgcctgctgt

SEQ ID NO: 3037193 - DNA, 23 bp, Homo sapiens
gtaccacaccctgcctgctgtgg

SEQ ID NO: 3037194 - DNA, 21 bp, Homo sapiens
gtaccaggcacatggctgggg

SEQ ID NO: 3037195 - DNA, 22 bp, Homo sapiens
gtaccaggcacatggctggggg

SEQ ID NO: 3037196 - DNA, 15 bp, Homo sapiens
gtaccagtgaatttt

SEQ ID NO: 3037197 - DNA, 16 bp, Homo sapiens
gtaccagtgaattttt

SEQ ID NO: 3037198 - DNA, 17 bp, Homo sapiens
gtacccctaaaatccca

SEQ ID NO: 3037199 - DNA, 13 bp, Homo sapiens
gtaccctgggtgt

SEQ ID NO: 3037200 - DNA, 13 bp, Homo sapiens
gtaccctttaaga

SEQ ID NO: 3037201 - DNA, 22 bp, Homo sapiens
gtacctatattgatttaaaagt

SEQ ID NO: 3037202 - DNA, 16 bp, Homo sapiens
gtacctattaaaagtt

SEQ ID NO: 3037203 - DNA, 15 bp, Homo sapiens
gtacctcagcattta

SEQ ID NO: 3037204 - DNA, 19 bp, Homo sapiens
gtacctcctctcagtgttt

SEQ ID NO: 3037205 - DNA, 12 bp, Homo sapiens
gtacctgaaaag

SEQ ID NO: 3037206 - DNA, 18 bp, Homo sapiens
gtacctgaaaagtaactt

SEQ ID NO: 3037207 - DNA, 16 bp, Homo sapiens
gtacctgcaagcagaa

SEQ ID NO: 3037208 - DNA, 17 bp, Homo sapiens
gtacctgcccccaatcc

SEQ ID NO: 3037209 - DNA, 11 bp, Homo sapiens
gtaccttgctt

SEQ ID NO: 3037210 - DNA, 23 bp, Homo sapiens
gtaccttgcttcttactgataat

SEQ ID NO: 3037211 - DNA, 19 bp, Homo sapiens
gtaccttttaacacctgat

SEQ ID NO: 3037212 - DNA, 15 bp, Homo sapiens
gtaccttttaatatg

SEQ ID NO: 3037213 - DNA, 12 bp, Homo sapiens
gtacgcacagac

SEQ ID NO: 3037214 - DNA, 15 bp, Homo sapiens
gtacgtagccacagg

SEQ ID NO: 3037215 - DNA, 13 bp, Homo sapiens
gtacgtcccagcg

SEQ ID NO: 3037216 - DNA, 15 bp, Homo sapiens
gtacgtcccagcggc

SEQ ID NO: 3037217 - DNA, 22 bp, Homo sapiens
gtacgtcccagcggcctcaggg

SEQ ID NO: 3037218 - DNA, 16 bp, Homo sapiens
gtactaagccaggagg

SEQ ID NO: 3037219 - DNA, 16 bp, Homo sapiens
gtactagttacacatc

SEQ ID NO: 3037220 - DNA, 14 bp, Homo sapiens
gtactcacttttca

SEQ ID NO: 3037221 - DNA, 16 bp, Homo sapiens
gtactccagcctgggt

SEQ ID NO: 3037222 - DNA, 20 bp, Homo sapiens
gtactccctctcaggatcca

SEQ ID NO: 3037223 - DNA, 18 bp, Homo sapiens
gtactgaaataatgatct

SEQ ID NO: 3037224 - DNA, 15 bp, Homo sapiens
gtactgaaggtgtgt

SEQ ID NO: 3037225 - DNA, 13 bp, Homo sapiens
gtactggtccctt

SEQ ID NO: 3037226 - DNA, 20 bp, Homo sapiens
gtactgttaagaataataaa

SEQ ID NO: 3037227 - DNA, 19 bp, Homo sapiens
gtactgtttaatgttctgt

SEQ ID NO: 3037228 - DNA, 14 bp, Homo sapiens
gtacttcagcaaga

SEQ ID NO: 3037229 - DNA, 18 bp, Homo sapiens
gtacttcagcaagagaga

SEQ ID NO: 3037230 - DNA, 19 bp, Homo sapiens
gtacttcagcaagagagaa

SEQ ID NO: 3037231 - DNA, 21 bp, Homo sapiens
gtacttcagcaagagagaacc

SEQ ID NO: 3037232 - DNA, 22 bp, Homo sapiens
gtacttgactacctactggtgt

SEQ ID NO: 3037233 - DNA, 23 bp, Homo sapiens
gtacttgccagaagttgtggatt

SEQ ID NO: 3037234 - DNA, 22 bp, Homo sapiens
gtacttgccttattagagtgtc

SEQ ID NO: 3037235 - DNA, 16 bp, Homo sapiens
gtacttggagggctca

SEQ ID NO: 3037236 - DNA, 15 bp, Homo sapiens
gtacttggtccaact

SEQ ID NO: 3037237 - DNA, 21 bp, Homo sapiens
gtacttggtccaactgcaact

SEQ ID NO: 3037238 - DNA, 21 bp, Homo sapiens
gtacttggttgggtcagattt

SEQ ID NO: 3037239 - DNA, 22 bp, Homo sapiens
gtacttggttgggtcagattta

SEQ ID NO: 3037240 - DNA, 11 bp, Homo sapiens
gtacttgtcaa

SEQ ID NO: 3037241 - DNA, 17 bp, Homo sapiens
gtactttgtttttccat

SEQ ID NO: 3037242 - DNA, 23 bp, Homo sapiens
gtacttttattttacacagaaac

SEQ ID NO: 3037243 - DNA, 23 bp, Homo sapiens
gtcccaaggtgaaatgaagcaac

SEQ ID NO: 3037244 - DNA, 19 bp, Homo sapiens
gtcccaccttggagcattt

SEQ ID NO: 3037245 - DNA, 16 bp, Homo sapiens
gtcccactcaagccaa

SEQ ID NO: 3037246 - DNA, 14 bp, Homo sapiens
gtcccacttctcat

SEQ ID NO: 3037247 - DNA, 10 bp, Homo sapiens
gtcccagagc

SEQ ID NO: 3037248 - DNA, 19 bp, Homo sapiens
gtcccagcggcctcagggt

SEQ ID NO: 3037249 - DNA, 18 bp, Homo sapiens
gtcccaggaagcagggag

SEQ ID NO: 3037250 - DNA, 16 bp, Homo sapiens
gtcccaggcagggaga

SEQ ID NO: 3037251 - DNA, 15 bp, Homo sapiens
gtcccaggggcagcc

SEQ ID NO: 3037252 - DNA, 19 bp, Homo sapiens
gtcccaggggcagccacac

SEQ ID NO: 3037253 - DNA, 12 bp, Homo sapiens
gtcccagtgaac

SEQ ID NO: 3037254 - DNA, 22 bp, Homo sapiens
gtccccaaatccgaacctcctc

SEQ ID NO: 3037255 - DNA, 15 bp, Homo sapiens
gtccccaacatggat

SEQ ID NO: 3037256 - DNA, 20 bp, Homo sapiens
gtccccacagactgccccag

SEQ ID NO: 3037257 - DNA, 18 bp, Homo sapiens
gtccccagactctgccta

SEQ ID NO: 3037258 - DNA, 12 bp, Homo sapiens
gtccccaggcct

SEQ ID NO: 3037259 - DNA, 17 bp, Homo sapiens
gtccccaggcctggctc

SEQ ID NO: 3037260 - DNA, 18 bp, Homo sapiens
gtccccaggcctggctcc

SEQ ID NO: 3037261 - DNA, 21 bp, Homo sapiens
gtcccccaaagggcctcctca

SEQ ID NO: 3037262 - DNA, 18 bp, Homo sapiens
gtccccccccaggccctc

SEQ ID NO: 3037263 - DNA, 13 bp, Homo sapiens
gtccccctgcagc

SEQ ID NO: 3037264 - DNA, 15 bp, Homo sapiens
gtccccctgcagcta

SEQ ID NO: 3037265 - DNA, 15 bp, Homo sapiens
gtccccggggcccag

SEQ ID NO: 3037266 - DNA, 21 bp, Homo sapiens
gtcccctcacagactcttcca

SEQ ID NO: 3037267 - DNA, 23 bp, Homo sapiens
gtcccctcacagactcttccacc

SEQ ID NO: 3037268 - DNA, 12 bp, Homo sapiens
gtcccctcagcg

SEQ ID NO: 3037269 - DNA, 22 bp, Homo sapiens
gtcccctcccagagctggtgga

SEQ ID NO: 3037270 - DNA, 18 bp, Homo sapiens
gtcccctgacctgtccag

SEQ ID NO: 3037271 - DNA, 23 bp, Homo sapiens
gtcccctggagtgtgtcagagcc

SEQ ID NO: 3037272 - DNA, 12 bp, Homo sapiens
gtcccctggcag

SEQ ID NO: 3037273 - DNA, 13 bp, Homo sapiens
gtcccctggcagt

SEQ ID NO: 3037274 - DNA, 17 bp, Homo sapiens
gtcccctggggctggtg

SEQ ID NO: 3037275 - DNA, 23 bp, Homo sapiens
gtcccctgtggtgatgtgcctgt

SEQ ID NO: 3037276 - DNA, 15 bp, Homo sapiens
gtccccttcccaggg

SEQ ID NO: 3037277 - DNA, 15 bp, Homo sapiens
gtcccggggccagca

SEQ ID NO: 3037278 - DNA, 23 bp, Homo sapiens
gtccctccgggacctggtgctgc

SEQ ID NO: 3037279 - DNA, 21 bp, Homo sapiens
gtccctcctggtgtcacccca

SEQ ID NO: 3037280 - DNA, 23 bp, Homo sapiens
gtccctcgtctcttgtgactcag

SEQ ID NO: 3037281 - DNA, 18 bp, Homo sapiens
gtccctctcagtgccttc

SEQ ID NO: 3037282 - DNA, 11 bp, Homo sapiens
gtccctctgcc

SEQ ID NO: 3037283 - DNA, 14 bp, Homo sapiens
gtccctctgcccca

SEQ ID NO: 3037284 - DNA, 13 bp, Homo sapiens
gtccctgcctgga

SEQ ID NO: 3037285 - DNA, 14 bp, Homo sapiens
gtccctgcctggac

SEQ ID NO: 3037286 - DNA, 21 bp, Homo sapiens
gtccctgcctggaccagcctc

SEQ ID NO: 3037287 - DNA, 22 bp, Homo sapiens
gtccctgctgctgccagggctt

SEQ ID NO: 3037288 - DNA, 16 bp, Homo sapiens
gtccctggcgctgtgc

SEQ ID NO: 3037289 - DNA, 11 bp, Homo sapiens
gtccctggggc

SEQ ID NO: 3037290 - DNA, 21 bp, Homo sapiens
gtccctggggcactcccccag

SEQ ID NO: 3037291 - DNA, 19 bp, Homo sapiens
gtccctgggggaagccctg

SEQ ID NO: 3037292 - DNA, 13 bp, Homo sapiens
gtccctggtcctt

SEQ ID NO: 3037293 - DNA, 12 bp, Homo sapiens
gtcccttcctgc

SEQ ID NO: 3037294 - DNA, 19 bp, Homo sapiens
gtcccttgagacctcagcc

SEQ ID NO: 3037295 - DNA, 22 bp, Homo sapiens
gtcccttgcttgcctgcagggc

SEQ ID NO: 3037296 - DNA, 17 bp, Homo sapiens
gtcccttgtttccagct

SEQ ID NO: 3037297 - DNA, 13 bp, Homo sapiens
gtccgatgctgga

SEQ ID NO: 3037298 - DNA, 17 bp, Homo sapiens
gtccgcataagaaaaag

SEQ ID NO: 3037299 - DNA, 20 bp, Homo sapiens
gtccgcatccctgcttctgg

SEQ ID NO: 3037300 - DNA, 14 bp, Homo sapiens
gtccgcggcctgca

SEQ ID NO: 3037301 - DNA, 18 bp, Homo sapiens
gtccgcggcctgcaccga

SEQ ID NO: 3037302 - DNA, 24 bp, Homo sapiens
gtccggtgtccttttcactacacc

SEQ ID NO: 3037303 - DNA, 19 bp, Homo sapiens
gtccgtgctgacagctgct

SEQ ID NO: 3037304 - DNA, 22 bp, Homo sapiens
gtccgtgctgacagctgctcct

SEQ ID NO: 3037305 - DNA, 17 bp, Homo sapiens
gtccgtgggttgctaac

SEQ ID NO: 3037306 - DNA, 12 bp, Homo sapiens
gtcctaggagta

SEQ ID NO: 3037307 - DNA, 16 bp, Homo sapiens
gtcctagtcgggcagg

SEQ ID NO: 3037308 - DNA, 18 bp, Homo sapiens
gtcctagtctcctttgaa

SEQ ID NO: 3037309 - DNA, 18 bp, Homo sapiens
gtcctatccaaaggaatc

SEQ ID NO: 3037310 - DNA, 20 bp, Homo sapiens
gtcctatccaaaggaatcag

SEQ ID NO: 3037311 - DNA, 16 bp, Homo sapiens
gtcctatgaatgcttt

SEQ ID NO: 3037312 - DNA, 20 bp, Homo sapiens
gtcctatgaatgctttgcat

SEQ ID NO: 3037313 - DNA, 13 bp, Homo sapiens
gtcctatggaaac

SEQ ID NO: 3037314 - DNA, 17 bp, Homo sapiens
gtcctatggacaactta

SEQ ID NO: 3037315 - DNA, 20 bp, Homo sapiens
gtcctatggacaacttattt

SEQ ID NO: 3037316 - DNA, 15 bp, Homo sapiens
gtcctatttttgtga

SEQ ID NO: 3037317 - DNA, 14 bp, Homo sapiens
gtcctcaaagaagt

SEQ ID NO: 3037318 - DNA, 19 bp, Homo sapiens
gtcctcacctggttgaccc

SEQ ID NO: 3037319 - DNA, 20 bp, Homo sapiens
gtcctcacgccccctgtgac

SEQ ID NO: 3037320 - DNA, 13 bp, Homo sapiens
gtcctcagctgct

SEQ ID NO: 3037321 - DNA, 17 bp, Homo sapiens
gtcctcagctgctccca

SEQ ID NO: 3037322 - DNA, 17 bp, Homo sapiens
gtcctcaggtggccatg

SEQ ID NO: 3037323 - DNA, 23 bp, Homo sapiens
gtcctcaggtggccatgcctcag

SEQ ID NO: 3037324 - DNA, 15 bp, Homo sapiens
gtcctcatttctcca

SEQ ID NO: 3037325 - DNA, 17 bp, Homo sapiens
gtcctcatttctccaga

SEQ ID NO: 3037326 - DNA, 22 bp, Homo sapiens
gtcctccaacaccaagcacagc

SEQ ID NO: 3037327 - DNA, 22 bp, Homo sapiens
gtcctccctccctcccttcctt

SEQ ID NO: 3037328 - DNA, 14 bp, Homo sapiens
gtcctccgcctact

SEQ ID NO: 3037329 - DNA, 20 bp, Homo sapiens
gtcctccgcctactgtccct

SEQ ID NO: 3037330 - DNA, 18 bp, Homo sapiens
gtcctcctctacctctct

SEQ ID NO: 3037331 - DNA, 20 bp, Homo sapiens
gtcctcctctacctctctcc

SEQ ID NO: 3037332 - DNA, 12 bp, Homo sapiens
gtcctcctctgt

SEQ ID NO: 3037333 - DNA, 13 bp, Homo sapiens
gtcctcctctgtg

SEQ ID NO: 3037334 - DNA, 23 bp, Homo sapiens
gtcctcgaattttatctgtggag

SEQ ID NO: 3037335 - DNA, 12 bp, Homo sapiens
gtcctcggagct

SEQ ID NO: 3037336 - DNA, 20 bp, Homo sapiens
gtcctcggcccatctgtcca

SEQ ID NO: 3037337 - DNA, 13 bp, Homo sapiens
gtcctctgaatga

SEQ ID NO: 3037338 - DNA, 15 bp, Homo sapiens
gtcctctttcaaagg

SEQ ID NO: 3037339 - DNA, 20 bp, Homo sapiens
gtcctgcacagattcccagg

SEQ ID NO: 3037340 - DNA, 15 bp, Homo sapiens
gtcctgcaccggggc

SEQ ID NO: 3037341 - DNA, 14 bp, Homo sapiens
gtcctgccctgccc

SEQ ID NO: 3037342 - DNA, 11 bp, Homo sapiens
gtcctgctggc

SEQ ID NO: 3037343 - DNA, 14 bp, Homo sapiens
gtcctgctggcctg

SEQ ID NO: 3037344 - DNA, 18 bp, Homo sapiens
gtcctgctggcctgctct

SEQ ID NO: 3037345 - DNA, 20 bp, Homo sapiens
gtcctggacaccgggccagt

SEQ ID NO: 3037346 - DNA, 15 bp, Homo sapiens
gtcctggccatccca

SEQ ID NO: 3037347 - DNA, 18 bp, Homo sapiens
gtcctggccatcccacaa

SEQ ID NO: 3037348 - DNA, 16 bp, Homo sapiens
gtcctggctgcactct

SEQ ID NO: 3037349 - DNA, 15 bp, Homo sapiens
gtcctggcttcaggc

SEQ ID NO: 3037350 - DNA, 19 bp, Homo sapiens
gtcctgggaggatcctgag

SEQ ID NO: 3037351 - DNA, 17 bp, Homo sapiens
gtcctgggaggctgcag

SEQ ID NO: 3037352 - DNA, 21 bp, Homo sapiens
gtcctgggaggctgcagccag

SEQ ID NO: 3037353 - DNA, 15 bp, Homo sapiens
gtcctgggcaggtgg

SEQ ID NO: 3037354 - DNA, 17 bp, Homo sapiens
gtcctgggcctgcagaa

SEQ ID NO: 3037355 - DNA, 14 bp, Homo sapiens
gtcctgggggcagg

SEQ ID NO: 3037356 - DNA, 12 bp, Homo sapiens
gtcctggtggct

SEQ ID NO: 3037357 - DNA, 19 bp, Homo sapiens
gtcctggtggctgggccca

SEQ ID NO: 3037358 - DNA, 23 bp, Homo sapiens
gtcctgtagttgcgtggactctg

SEQ ID NO: 3037359 - DNA, 18 bp, Homo sapiens
gtcctgtatgtctgtcat

SEQ ID NO: 3037360 - DNA, 19 bp, Homo sapiens
gtcctgtgaggtttcccaa

SEQ ID NO: 3037361 - DNA, 22 bp, Homo sapiens
gtcctgttaggccaactgcctc

SEQ ID NO: 3037362 - DNA, 19 bp, Homo sapiens
gtccttaaaaatcacactg

SEQ ID NO: 3037363 - DNA, 22 bp, Homo sapiens
gtccttaaaaatcacactgtaa

SEQ ID NO: 3037364 - DNA, 14 bp, Homo sapiens
gtccttaaaatgtg

SEQ ID NO: 3037365 - DNA, 15 bp, Homo sapiens
gtccttactcagagc

SEQ ID NO: 3037366 - DNA, 17 bp, Homo sapiens
gtccttactcagagctg

SEQ ID NO: 3037367 - DNA, 13 bp, Homo sapiens
gtccttcaaaggc

SEQ ID NO: 3037368 - DNA, 14 bp, Homo sapiens
gtccttccacctcg

SEQ ID NO: 3037369 - DNA, 17 bp, Homo sapiens
gtccttcctgtgccctg

SEQ ID NO: 3037370 - DNA, 14 bp, Homo sapiens
gtccttcttcctca

SEQ ID NO: 3037371 - DNA, 15 bp, Homo sapiens
gtccttgcacctgca

SEQ ID NO: 3037372 - DNA, 16 bp, Homo sapiens
gtccttgcacctgcat

SEQ ID NO: 3037373 - DNA, 14 bp, Homo sapiens
gtccttgggcctgg

SEQ ID NO: 3037374 - DNA, 13 bp, Homo sapiens
gtcctttatgtgg

SEQ ID NO: 3037375 - DNA, 16 bp, Homo sapiens
gtcctttatgtggaaa

SEQ ID NO: 3037376 - DNA, 19 bp, Homo sapiens
gtgcactgtgaatcctggc

SEQ ID NO: 3037377 - DNA, 14 bp, Homo sapiens
gtgcactttgtaaa

SEQ ID NO: 3037378 - DNA, 15 bp, Homo sapiens
gtgcactttgtaaat

SEQ ID NO: 3037379 - DNA, 14 bp, Homo sapiens
gtgcagaacacctg

SEQ ID NO: 3037380 - DNA, 16 bp, Homo sapiens
gtgcagaacacctggc

SEQ ID NO: 3037381 - DNA, 17 bp, Homo sapiens
gtgcagaacacctggcc

SEQ ID NO: 3037382 - DNA, 13 bp, Homo sapiens
gtgcagaatgtaa

SEQ ID NO: 3037383 - DNA, 23 bp, Homo sapiens
gtgcagaggaagtggaaggcatc

SEQ ID NO: 3037384 - DNA, 22 bp, Homo sapiens
gtgcagatcatccgtctgtgtg

SEQ ID NO: 3037385 - DNA, 12 bp, Homo sapiens
gtgcagccagag

SEQ ID NO: 3037386 - DNA, 14 bp, Homo sapiens
gtgcagccagaggc

SEQ ID NO: 3037387 - DNA, 17 bp, Homo sapiens
gtgcagccgctgagcga

SEQ ID NO: 3037388 - DNA, 16 bp, Homo sapiens
gtgcaggacagctctt

SEQ ID NO: 3037389 - DNA, 17 bp, Homo sapiens
gtgcaggacagctcttg

SEQ ID NO: 3037390 - DNA, 15 bp, Homo sapiens
gtgcaggctggccag

SEQ ID NO: 3037391 - DNA, 20 bp, Homo sapiens
gtgcaggctggccagccgct

SEQ ID NO: 3037392 - DNA, 21 bp, Homo sapiens
gtgcaggggatggggtggggg

SEQ ID NO: 3037393 - DNA, 14 bp, Homo sapiens
gtgcagtctgggtg

SEQ ID NO: 3037394 - DNA, 19 bp, Homo sapiens
gtgcagttctagtttgcat

SEQ ID NO: 3037395 - DNA, 20 bp, Homo sapiens
gtgcagttctagtttgcatt

SEQ ID NO: 3037396 - DNA, 19 bp, Homo sapiens
gtgcatactggcattggcc

SEQ ID NO: 3037397 - DNA, 14 bp, Homo sapiens
gtgcatagcgtcct

SEQ ID NO: 3037398 - DNA, 15 bp, Homo sapiens
gtgcatccccacgac

SEQ ID NO: 3037399 - DNA, 23 bp, Homo sapiens
gtgcatccccacgacccctgcct

SEQ ID NO: 3037400 - DNA, 22 bp, Homo sapiens
gtgcatctgcaggcaccgggct

SEQ ID NO: 3037401 - DNA, 20 bp, Homo sapiens
gtgcatgacgtttaaggcca

SEQ ID NO: 3037402 - DNA, 22 bp, Homo sapiens
gtgcatggaactaaaatgttat

SEQ ID NO: 3037403 - DNA, 23 bp, Homo sapiens
gtgcatgtatgtcttggacactg

SEQ ID NO: 3037404 - DNA, 21 bp, Homo sapiens
gtgcattttctaagtgggaca

SEQ ID NO: 3037405 - DNA, 22 bp, Homo sapiens
gtgcattttctaagtgggacat

SEQ ID NO: 3037406 - DNA, 14 bp, Homo sapiens
gtgccaaagaaagt

SEQ ID NO: 3037407 - DNA, 17 bp, Homo sapiens
gtgccaaatagccccag

SEQ ID NO: 3037408 - DNA, 14 bp, Homo sapiens
gtgccaaccccacc

SEQ ID NO: 3037409 - DNA, 18 bp, Homo sapiens
gtgccaaccccacccagc

SEQ ID NO: 3037410 - DNA, 21 bp, Homo sapiens
gtgccaaccccacccagctcc

SEQ ID NO: 3037411 - DNA, 16 bp, Homo sapiens
gtgccaagtcctagct

SEQ ID NO: 3037412 - DNA, 18 bp, Homo sapiens
gtgccacaacgcctggct

SEQ ID NO: 3037413 - DNA, 19 bp, Homo sapiens
gtgccacccccagccctgg

SEQ ID NO: 3037414 - DNA, 14 bp, Homo sapiens
gtgccagaaggaag

SEQ ID NO: 3037415 - DNA, 13 bp, Homo sapiens
gtgccagcagcct

SEQ ID NO: 3037416 - DNA, 21 bp, Homo sapiens
gtgccagcagcctcgcacagg

SEQ ID NO: 3037417 - DNA, 12 bp, Homo sapiens
gtgccagcccct

SEQ ID NO: 3037418 - DNA, 19 bp, Homo sapiens
gtgccagcccctgctggct

SEQ ID NO: 3037419 - DNA, 21 bp, Homo sapiens
gtgccagcccctgctggctgg

SEQ ID NO: 3037420 - DNA, 20 bp, Homo sapiens
gtgccagcccggaggggact

SEQ ID NO: 3037421 - DNA, 19 bp, Homo sapiens
gtgccatggatttccactg

SEQ ID NO: 3037422 - DNA, 20 bp, Homo sapiens
gtgccatggatttccactgc

SEQ ID NO: 3037423 - DNA, 21 bp, Homo sapiens
gtgccattgtactccagcctg

SEQ ID NO: 3037424 - DNA, 23 bp, Homo sapiens
gtgcccaccaacatcccattgcc

SEQ ID NO: 3037425 - DNA, 15 bp, Homo sapiens
gtgccccagactgag

SEQ ID NO: 3037426 - DNA, 21 bp, Homo sapiens
gtgccccagactgagctctcc

SEQ ID NO: 3037427 - DNA, 22 bp, Homo sapiens
gtgccccagactgagctctcca

SEQ ID NO: 3037428 - DNA, 20 bp, Homo sapiens
gtgcccccagacagctgctc

SEQ ID NO: 3037429 - DNA, 21 bp, Homo sapiens
gtgcccccttcaagcctgtgc

SEQ ID NO: 3037430 - DNA, 14 bp, Homo sapiens
gtgcccttgatttt

SEQ ID NO: 3037431 - DNA, 16 bp, Homo sapiens
gtgcccttggaggcca

SEQ ID NO: 3037432 - DNA, 14 bp, Homo sapiens
gtgcctcattgctt

SEQ ID NO: 3037433 - DNA, 23 bp, Homo sapiens
gtgcctccagaggggctcaggtc

SEQ ID NO: 3037434 - DNA, 11 bp, Homo sapiens
gtgcctccctc

SEQ ID NO: 3037435 - DNA, 18 bp, Homo sapiens
gtgcctcccttcccagtg

SEQ ID NO: 3037436 - DNA, 22 bp, Homo sapiens
gtgcctcccttcccagtgggct

SEQ ID NO: 3037437 - DNA, 14 bp, Homo sapiens
gtgcctctgtccta

SEQ ID NO: 3037438 - DNA, 12 bp, Homo sapiens
gtgcctgagccc

SEQ ID NO: 3037439 - DNA, 18 bp, Homo sapiens
gtgcctgagcccctcaga

SEQ ID NO: 3037440 - DNA, 16 bp, Homo sapiens
gtgcctgggcccctcc

SEQ ID NO: 3037441 - DNA, 11 bp, Homo sapiens
gtgcctggggt

SEQ ID NO: 3037442 - DNA, 17 bp, Homo sapiens
gtgcctgggtggggctg

SEQ ID NO: 3037443 - DNA, 20 bp, Homo sapiens
gtgcctgggtggggctgctc

SEQ ID NO: 3037444 - DNA, 15 bp, Homo sapiens
gtgcctgtctgtcca

SEQ ID NO: 3037445 - DNA, 16 bp, Homo sapiens
gtgcctgtgaggcagg

SEQ ID NO: 3037446 - DNA, 15 bp, Homo sapiens
gtgccttacctcctg

SEQ ID NO: 3037447 - DNA, 19 bp, Homo sapiens
gtgccttcttattctcact

SEQ ID NO: 3037448 - DNA, 20 bp, Homo sapiens
gtgccttcttcagggcctgg

SEQ ID NO: 3037449 - DNA, 21 bp, Homo sapiens
gtgccttcttcagggcctggt

SEQ ID NO: 3037450 - DNA, 12 bp, Homo sapiens
gtgccttgccca

SEQ ID NO: 3037451 - DNA, 19 bp, Homo sapiens
gtgccttgtcacgccagac

SEQ ID NO: 3037452 - DNA, 13 bp, Homo sapiens
gtgcctttcaaat

SEQ ID NO: 3037453 - DNA, 18 bp, Homo sapiens
gtgcctttccctcctaaa

SEQ ID NO: 3037454 - DNA, 14 bp, Homo sapiens
gtgcctttcctatc

SEQ ID NO: 3037455 - DNA, 21 bp, Homo sapiens
gtgccttttgcagaagagggt

SEQ ID NO: 3037456 - DNA, 19 bp, Homo sapiens
gtgcgctcgttccggtccc

SEQ ID NO: 3037457 - DNA, 14 bp, Homo sapiens
gtgcgctgcctggc

SEQ ID NO: 3037458 - DNA, 17 bp, Homo sapiens
gtgcgctgcctggccag

SEQ ID NO: 3037459 - DNA, 15 bp, Homo sapiens
gtgcgtccacgagct

SEQ ID NO: 3037460 - DNA, 18 bp, Homo sapiens
gtgcgtggaagtgttcct

SEQ ID NO: 3037461 - DNA, 19 bp, Homo sapiens
gtgcgtggaagtgttcctg

SEQ ID NO: 3037462 - DNA, 16 bp, Homo sapiens
gtgcgtggtccgtgtg

SEQ ID NO: 3037463 - DNA, 15 bp, Homo sapiens
gtgctaaggttctaa

SEQ ID NO: 3037464 - DNA, 16 bp, Homo sapiens
gtgctaaggttctaag

SEQ ID NO: 3037465 - DNA, 23 bp, Homo sapiens
gtgctaatattttatttgaaaaa

SEQ ID NO: 3037466 - DNA, 15 bp, Homo sapiens
gtgctacagaaagca

SEQ ID NO: 3037467 - DNA, 16 bp, Homo sapiens
gtgctacagagaaaat

SEQ ID NO: 3037468 - DNA, 17 bp, Homo sapiens
gtgctacgtgtgaaatc

SEQ ID NO: 3037469 - DNA, 20 bp, Homo sapiens
gtgctacgtgtgaaatctgt

SEQ ID NO: 3037470 - DNA, 22 bp, Homo sapiens
gtgctacgtgtgaaatctgtct

SEQ ID NO: 3037471 - DNA, 16 bp, Homo sapiens
gtgctactgattgttt

SEQ ID NO: 3037472 - DNA, 17 bp, Homo sapiens
gtgctagtcactggcag

SEQ ID NO: 3037473 - DNA, 14 bp, Homo sapiens
gtgctatggtgctc

SEQ ID NO: 3037474 - DNA, 13 bp, Homo sapiens
gtgctatttcagc

SEQ ID NO: 3037475 - DNA, 17 bp, Homo sapiens
gtgctcaagcagcaaaa

SEQ ID NO: 3037476 - DNA, 17 bp, Homo sapiens
gtgctcagttgtagaat

SEQ ID NO: 3037477 - DNA, 14 bp, Homo sapiens
gtgctcatgtgtgt

SEQ ID NO: 3037478 - DNA, 23 bp, Homo sapiens
gtgctccatctccgcctccacac

SEQ ID NO: 3037479 - DNA, 13 bp, Homo sapiens
gtgctccctctgt

SEQ ID NO: 3037480 - DNA, 19 bp, Homo sapiens
gtgctccctctgtcatcct

SEQ ID NO: 3037481 - DNA, 18 bp, Homo sapiens
gtgctcctgcccagccac

SEQ ID NO: 3037482 - DNA, 14 bp, Homo sapiens
gtgctcgggaaggg

SEQ ID NO: 3037483 - DNA, 13 bp, Homo sapiens
gtgctctgaccct

SEQ ID NO: 3037484 - DNA, 19 bp, Homo sapiens
gtgctctgaggcctcacta

SEQ ID NO: 3037485 - DNA, 13 bp, Homo sapiens
gtgctctgcctct

SEQ ID NO: 3037486 - DNA, 15 bp, Homo sapiens
gtgctctttcctgcc

SEQ ID NO: 3037487 - DNA, 23 bp, Homo sapiens
gtgctgaacacacaccagtttac

SEQ ID NO: 3037488 - DNA, 19 bp, Homo sapiens
gtgctgaatgttgggactg

SEQ ID NO: 3037489 - DNA, 15 bp, Homo sapiens
gtgctgacggccagg

SEQ ID NO: 3037490 - DNA, 14 bp, Homo sapiens
gtgctgagtagatg

SEQ ID NO: 3037491 - DNA, 15 bp, Homo sapiens
gtgctgatgtagtga

SEQ ID NO: 3037492 - DNA, 11 bp, Homo sapiens
gtgctgccctg

SEQ ID NO: 3037493 - DNA, 16 bp, Homo sapiens
gtgctgccctgaagaa

SEQ ID NO: 3037494 - DNA, 11 bp, Homo sapiens
gtgctgcctct

SEQ ID NO: 3037495 - DNA, 19 bp, Homo sapiens
gtgctgcctctacctgaca

SEQ ID NO: 3037496 - DNA, 15 bp, Homo sapiens
gtgctggcccaccca

SEQ ID NO: 3037497 - DNA, 16 bp, Homo sapiens
gtgctggcccagcatg

SEQ ID NO: 3037498 - DNA, 14 bp, Homo sapiens
gtgctggccttggt

SEQ ID NO: 3037499 - DNA, 20 bp, Homo sapiens
gtgctggccttggtatgtgc

SEQ ID NO: 3037500 - DNA, 18 bp, Homo sapiens
gtgctggcgacactcagg

SEQ ID NO: 3037501 - DNA, 23 bp, Homo sapiens
gtgctggcgacactcagggcagc

SEQ ID NO: 3037502 - DNA, 20 bp, Homo sapiens
gtgctgggtgagctcttcca

SEQ ID NO: 3037503 - DNA, 17 bp, Homo sapiens
gtgctggtagctgaggg

SEQ ID NO: 3037504 - DNA, 12 bp, Homo sapiens
gtgctgtaattt

SEQ ID NO: 3037505 - DNA, 18 bp, Homo sapiens
gtgctgtcctcaggtggc

SEQ ID NO: 3037506 - DNA, 16 bp, Homo sapiens
gtgcttatggtaccag

SEQ ID NO: 3037507 - DNA, 20 bp, Homo sapiens
gtgcttctagttctgccagg

SEQ ID NO: 3037508 - DNA, 22 bp, Homo sapiens
gtgcttctagttctgccaggag

SEQ ID NO: 3037509 - DNA, 19 bp, Homo sapiens
gtgtccgcataagaaaaag

SEQ ID NO: 3037510 - DNA, 14 bp, Homo sapiens
gtgtcctaggagta

SEQ ID NO: 3037511 - DNA, 12 bp, Homo sapiens
gtgtcctccctc

SEQ ID NO: 3037512 - DNA, 13 bp, Homo sapiens
gtgtcctccctcc

SEQ ID NO: 3037513 - DNA, 21 bp, Homo sapiens
gtgtcctgcaccggggcctgg

SEQ ID NO: 3037514 - DNA, 12 bp, Homo sapiens
gtgtcctggctg

SEQ ID NO: 3037515 - DNA, 21 bp, Homo sapiens
gtgtcctgtagttgcgtggac

SEQ ID NO: 3037516 - DNA, 14 bp, Homo sapiens
gtgtccttcttcct

SEQ ID NO: 3037517 - DNA, 15 bp, Homo sapiens
gtgtccttcttcctc

SEQ ID NO: 3037518 - DNA, 18 bp, Homo sapiens
gtgtccttgcacctgcat

SEQ ID NO: 3037519 - DNA, 14 bp, Homo sapiens
gtgtctaagattct

SEQ ID NO: 3037520 - DNA, 15 bp, Homo sapiens
gtgtctcgctgcatc

SEQ ID NO: 3037521 - DNA, 15 bp, Homo sapiens
gtgtctctatgtgaa

SEQ ID NO: 3037522 - DNA, 14 bp, Homo sapiens
gtgtctctgcctgg

SEQ ID NO: 3037523 - DNA, 15 bp, Homo sapiens
gtgtctctgcctgga

SEQ ID NO: 3037524 - DNA, 23 bp, Homo sapiens
gtgtctctgcctggagcaggggt

SEQ ID NO: 3037525 - DNA, 20 bp, Homo sapiens
gtgtctctggaacccaggac

SEQ ID NO: 3037526 - DNA, 11 bp, Homo sapiens
gtgtctggaag

SEQ ID NO: 3037527 - DNA, 17 bp, Homo sapiens
gtgtctggcacagcctg

SEQ ID NO: 3037528 - DNA, 12 bp, Homo sapiens
gtgtctggcctg

SEQ ID NO: 3037529 - DNA, 16 bp, Homo sapiens
gtgtctggcctgaggt

SEQ ID NO: 3037530 - DNA, 16 bp, Homo sapiens
gtgtctgttttgagct

SEQ ID NO: 3037531 - DNA, 23 bp, Homo sapiens
gtgtcttaaactaggtgttctaa

SEQ ID NO: 3037532 - DNA, 20 bp, Homo sapiens
gtgtcttacaaggcaggcct

SEQ ID NO: 3037533 - DNA, 21 bp, Homo sapiens
gtgtctttgtgattttgagta

SEQ ID NO: 3037534 - DNA, 14 bp, Homo sapiens
gtgtcttttgacat

SEQ ID NO: 3037535 - DNA, 15 bp, Homo sapiens
gtgtcttttgacatt

SEQ ID NO: 3037536 - DNA, 17 bp, Homo sapiens
gtgtgaaatctgtcttt

SEQ ID NO: 3037537 - DNA, 18 bp, Homo sapiens
gtgtgaaatctgtctttg

SEQ ID NO: 3037538 - DNA, 18 bp, Homo sapiens
gtgtgaaggtcctgctat

SEQ ID NO: 3037539 - DNA, 11 bp, Homo sapiens
gtgtgaagtta

SEQ ID NO: 3037540 - DNA, 13 bp, Homo sapiens
gtgtgaagttaga

SEQ ID NO: 3037541 - DNA, 21 bp, Homo sapiens
gtgtgaagttagaattccttc

SEQ ID NO: 3037542 - DNA, 13 bp, Homo sapiens
gtgtgaatgaaca

SEQ ID NO: 3037543 - DNA, 15 bp, Homo sapiens
gtgtgacccctcctg

SEQ ID NO: 3037544 - DNA, 18 bp, Homo sapiens
gtgtgacccctcctgggg

SEQ ID NO: 3037545 - DNA, 18 bp, Homo sapiens
gtgtgagaccaggggacc

SEQ ID NO: 3037546 - DNA, 22 bp, Homo sapiens
gtgtgagaccaggggaccagag

SEQ ID NO: 3037547 - DNA, 13 bp, Homo sapiens
gtgtgagggcagc

SEQ ID NO: 3037548 - DNA, 19 bp, Homo sapiens
gtgtgatcccagctcactg

SEQ ID NO: 3037549 - DNA, 21 bp, Homo sapiens
gtgtgattgggaataaatatg

SEQ ID NO: 3037550 - DNA, 16 bp, Homo sapiens
gtgtgcaccagggttg

SEQ ID NO: 3037551 - DNA, 22 bp, Homo sapiens
gtgtgcagatcatccgtctgtg

SEQ ID NO: 3037552 - DNA, 19 bp, Homo sapiens
gtgtgcatagcgtcctgcc

SEQ ID NO: 3037553 - DNA, 22 bp, Homo sapiens
gtgtgcatagcgtcctgccctg

SEQ ID NO: 3037554 - DNA, 16 bp, Homo sapiens
gtgtgcatattgtaca

SEQ ID NO: 3037555 - DNA, 18 bp, Homo sapiens
gtgtgcatctgtgtgtgt

SEQ ID NO: 3037556 - DNA, 20 bp, Homo sapiens
gtgtgcatggaagttggggc

SEQ ID NO: 3037557 - DNA, 19 bp, Homo sapiens
gtgtgcctgactgcccagc

SEQ ID NO: 3037558 - DNA, 22 bp, Homo sapiens
gtgtgcctgtctgttacactgg

SEQ ID NO: 3037559 - DNA, 17 bp, Homo sapiens
gtgtgcgctgcctggcc

SEQ ID NO: 3037560 - DNA, 16 bp, Homo sapiens
gtgtgcgtgtttgcac

SEQ ID NO: 3037561 - DNA, 12 bp, Homo sapiens
gtgtgctacaga

SEQ ID NO: 3037562 - DNA, 17 bp, Homo sapiens
gtgtggagagagaggct

SEQ ID NO: 3037563 - DNA, 13 bp, Homo sapiens
gtgtggcagcagg

SEQ ID NO: 3037564 - DNA, 13 bp, Homo sapiens
gtgtggcatttgg

SEQ ID NO: 3037565 - DNA, 15 bp, Homo sapiens
gtgtggccacttctg

SEQ ID NO: 3037566 - DNA, 19 bp, Homo sapiens
gtgtggccacttctgtcca

SEQ ID NO: 3037567 - DNA, 20 bp, Homo sapiens
gtgtggccatcactcagccc

SEQ ID NO: 3037568 - DNA, 16 bp, Homo sapiens
gtgtgggaagggagag

SEQ ID NO: 3037569 - DNA, 21 bp, Homo sapiens
gtgtgggccgtggcttgggct

SEQ ID NO: 3037570 - DNA, 14 bp, Homo sapiens
gtgtggtggcctgt

SEQ ID NO: 3037571 - DNA, 16 bp, Homo sapiens
gtgtgtaattgttcct

SEQ ID NO: 3037572 - DNA, 16 bp, Homo sapiens
gtgtgtaccacaccct

SEQ ID NO: 3037573 - DNA, 17 bp, Homo sapiens
gtgtgtaccacaccctg

SEQ ID NO: 3037574 - DNA, 19 bp, Homo sapiens
gtgtgtagacaaatatttg

SEQ ID NO: 3037575 - DNA, 12 bp, Homo sapiens
gtgtgtatatat

SEQ ID NO: 3037576 - DNA, 12 bp, Homo sapiens
gtgtgtcagagc

SEQ ID NO: 3037577 - DNA, 13 bp, Homo sapiens
gtgtgtcagagcc

SEQ ID NO: 3037578 - DNA, 17 bp, Homo sapiens
gtgtgtcagagcccagg

SEQ ID NO: 3037579 - DNA, 20 bp, Homo sapiens
gtgtgtcagagcccagggga

SEQ ID NO: 3037580 - DNA, 18 bp, Homo sapiens
gtgtgtcaggccctctgc

SEQ ID NO: 3037581 - DNA, 19 bp, Homo sapiens
gtgtgtcaggccctctgcc

SEQ ID NO: 3037582 - DNA, 22 bp, Homo sapiens
gtgtgtcaggccctctgcctgc

SEQ ID NO: 3037583 - DNA, 18 bp, Homo sapiens
gtgtgtcccaggcaggga

SEQ ID NO: 3037584 - DNA, 20 bp, Homo sapiens
gtgtgtgaaacctacagcat

SEQ ID NO: 3037585 - DNA, 22 bp, Homo sapiens
gtgtgtgacccctcctggggcc

SEQ ID NO: 3037586 - DNA, 13 bp, Homo sapiens
gtgtgtgatggga

SEQ ID NO: 3037587 - DNA, 19 bp, Homo sapiens
gtgtgtgcagagtccattt

SEQ ID NO: 3037588 - DNA, 12 bp, Homo sapiens
gtgtgtgtgtga

SEQ ID NO: 3037589 - DNA, 23 bp, Homo sapiens
gtgtgttatttccccagccacag

SEQ ID NO: 3037590 - DNA, 16 bp, Homo sapiens
gtgtgttctcacagtg

SEQ ID NO: 3037591 - DNA, 16 bp, Homo sapiens
gtgtgtttagaagcct

SEQ ID NO: 3037592 - DNA, 13 bp, Homo sapiens
gtgtgtttcccta

SEQ ID NO: 3037593 - DNA, 13 bp, Homo sapiens
gtgtgttttcaat

SEQ ID NO: 3037594 - DNA, 21 bp, Homo sapiens
gtgtgttttgagagtatatta

SEQ ID NO: 3037595 - DNA, 21 bp, Homo sapiens
gtgttaaatgtgatgaatact

SEQ ID NO: 3037596 - DNA, 16 bp, Homo sapiens
gtgttaataataactt

SEQ ID NO: 3037597 - DNA, 16 bp, Homo sapiens
gtgttactgcagttga

SEQ ID NO: 3037598 - DNA, 21 bp, Homo sapiens
gtgttactgcagttgaaaggg

SEQ ID NO: 3037599 - DNA, 15 bp, Homo sapiens
gtgttactgtaattc

SEQ ID NO: 3037600 - DNA, 13 bp, Homo sapiens
gtgttacttgaag

SEQ ID NO: 3037601 - DNA, 17 bp, Homo sapiens
gtgttacttgaagtaac

SEQ ID NO: 3037602 - DNA, 16 bp, Homo sapiens
gtgttagggaagggcc

SEQ ID NO: 3037603 - DNA, 14 bp, Homo sapiens
gtgttatgtatttc

SEQ ID NO: 3037604 - DNA, 20 bp, Homo sapiens
gtgttatttccccagccaca

SEQ ID NO: 3037605 - DNA, 22 bp, Homo sapiens
gtgttatttccccagccacagg

SEQ ID NO: 3037606 - DNA, 16 bp, Homo sapiens
gtgttcaccagagaaa

SEQ ID NO: 3037607 - DNA, 22 bp, Homo sapiens
gtgttcagttccagcttttgta

SEQ ID NO: 3037608 - DNA, 18 bp, Homo sapiens
gtgttccccaagcgcctg

SEQ ID NO: 3037609 - DNA, 22 bp, Homo sapiens
gtgttccccaagcgcctggctg

SEQ ID NO: 3037610 - DNA, 23 bp, Homo sapiens
gtgttccccttccactgagggca

SEQ ID NO: 3037611 - DNA, 15 bp, Homo sapiens
gtgttcctgtctcaa

SEQ ID NO: 3037612 - DNA, 13 bp, Homo sapiens
gtgttccttctgt

SEQ ID NO: 3037613 - DNA, 20 bp, Homo sapiens
gtgttccttctgtgaagaag

SEQ ID NO: 3037614 - DNA, 14 bp, Homo sapiens
gtgttctaaaatga

SEQ ID NO: 3037615 - DNA, 19 bp, Homo sapiens
gtgttctaacttatttata

SEQ ID NO: 3037616 - DNA, 22 bp, Homo sapiens
gtgttctaagatgtgatattct

SEQ ID NO: 3037617 - DNA, 18 bp, Homo sapiens
gtgttctcacagtgacac

SEQ ID NO: 3037618 - DNA, 21 bp, Homo sapiens
gtgttctcacagtgacaccat

SEQ ID NO: 3037619 - DNA, 20 bp, Homo sapiens
gtgttctccactaatactgg

SEQ ID NO: 3037620 - DNA, 18 bp, Homo sapiens
gtgttctctttaatgctg

SEQ ID NO: 3037621 - DNA, 17 bp, Homo sapiens
gtgttcttcgtatatac

SEQ ID NO: 3037622 - DNA, 21 bp, Homo sapiens
gtgttgaaaatgtatttcctg

SEQ ID NO: 3037623 - DNA, 17 bp, Homo sapiens
gtgttgacgtaagctct

SEQ ID NO: 3037624 - DNA, 23 bp, Homo sapiens
gtgttgcccctcctccgcatgcc

SEQ ID NO: 3037625 - DNA, 18 bp, Homo sapiens
gtgttggtttacagggta

SEQ ID NO: 3037626 - DNA, 22 bp, Homo sapiens
gtgttggttttgactggatatt

SEQ ID NO: 3037627 - DNA, 17 bp, Homo sapiens
gtgttgttgctctagga

SEQ ID NO: 3037628 - DNA, 13 bp, Homo sapiens
gtgttgtttccat

SEQ ID NO: 3037629 - DNA, 14 bp, Homo sapiens
gtgttgtttccata

SEQ ID NO: 3037630 - DNA, 13 bp, Homo sapiens
gtgtttataaaat

SEQ ID NO: 3037631 - DNA, 14 bp, Homo sapiens
gtgtttataaaata

SEQ ID NO: 3037632 - DNA, 22 bp, Homo sapiens
gtgtttataaaatataaacaaa

SEQ ID NO: 3037633 - DNA, 21 bp, Homo sapiens
gtgtttccctagactctgtaa

SEQ ID NO: 3037634 - DNA, 18 bp, Homo sapiens
gtgtttctgtaagaaacc

SEQ ID NO: 3037635 - DNA, 13 bp, Homo sapiens
gtgtttctgtgca

SEQ ID NO: 3037636 - DNA, 22 bp, Homo sapiens
gtgtttgcacgttatggtgttt

SEQ ID NO: 3037637 - DNA, 10 bp, Homo sapiens
gtgtttgctt

SEQ ID NO: 3037638 - DNA, 11 bp, Homo sapiens
gtgtttgcttg

SEQ ID NO: 3037639 - DNA, 16 bp, Homo sapiens
gtgttttagatggttt

SEQ ID NO: 3037640 - DNA, 20 bp, Homo sapiens
gtgttttcatcatttcagcc

SEQ ID NO: 3037641 - DNA, 12 bp, Homo sapiens
gtgttttgctgt

SEQ ID NO: 3037642 - DNA, 20 bp, Homo sapiens
gtttatcattcaagtgtaaa

SEQ ID NO: 3037643 - DNA, 15 bp, Homo sapiens
gtttatgatatttct

SEQ ID NO: 3037644 - DNA, 17 bp, Homo sapiens
gtttatgatatttcttg

SEQ ID NO: 3037645 - DNA, 21 bp, Homo sapiens
gtttatgatatttcttgcttt

SEQ ID NO: 3037646 - DNA, 16 bp, Homo sapiens
gtttatgtaacatagt

SEQ ID NO: 3037647 - DNA, 17 bp, Homo sapiens
gtttatgtaacatagtc

SEQ ID NO: 3037648 - DNA, 15 bp, Homo sapiens
gtttatgttcttata

SEQ ID NO: 3037649 - DNA, 20 bp, Homo sapiens
gtttattcttctagagttca

SEQ ID NO: 3037650 - DNA, 13 bp, Homo sapiens
gtttattgccatt

SEQ ID NO: 3037651 - DNA, 12 bp, Homo sapiens
gtttatttcatt

SEQ ID NO: 3037652 - DNA, 22 bp, Homo sapiens
gtttatttttttgatggctaag

SEQ ID NO: 3037653 - DNA, 15 bp, Homo sapiens
gtttcaaaataaaaa

SEQ ID NO: 3037654 - DNA, 20 bp, Homo sapiens
gtttcaaagatgctgtgagt

SEQ ID NO: 3037655 - DNA, 19 bp, Homo sapiens
gtttcaaggcactctagat

SEQ ID NO: 3037656 - DNA, 21 bp, Homo sapiens
gtttcacaggtcaataaactt

SEQ ID NO: 3037657 - DNA, 14 bp, Homo sapiens
gtttcagctgcagt

SEQ ID NO: 3037658 - DNA, 16 bp, Homo sapiens
gtttcagctttcttca

SEQ ID NO: 3037659 - DNA, 17 bp, Homo sapiens
gtttcatgtaaagaaaa

SEQ ID NO: 3037660 - DNA, 20 bp, Homo sapiens
gtttcattgcgaatcttttt

SEQ ID NO: 3037661 - DNA, 14 bp, Homo sapiens
gtttccagggaggg

SEQ ID NO: 3037662 - DNA, 21 bp, Homo sapiens
gtttcccccaacatataaaat

SEQ ID NO: 3037663 - DNA, 14 bp, Homo sapiens
gtttcccccactcc

SEQ ID NO: 3037664 - DNA, 12 bp, Homo sapiens
gtttcctctgga

SEQ ID NO: 3037665 - DNA, 20 bp, Homo sapiens
gtttcctgcccagcctgggg

SEQ ID NO: 3037666 - DNA, 15 bp, Homo sapiens
gtttcctggaagcag

SEQ ID NO: 3037667 - DNA, 21 bp, Homo sapiens
gtttcctgtgcccatcatctc

SEQ ID NO: 3037668 - DNA, 17 bp, Homo sapiens
gtttccttattccacag

SEQ ID NO: 3037669 - DNA, 16 bp, Homo sapiens
gtttccttgcctgctt

SEQ ID NO: 3037670 - DNA, 17 bp, Homo sapiens
gtttcgaagtcattaaa

SEQ ID NO: 3037671 - DNA, 16 bp, Homo sapiens
gtttcgcagcctgagt

SEQ ID NO: 3037672 - DNA, 18 bp, Homo sapiens
gtttcgcagcctgagtcc

SEQ ID NO: 3037673 - DNA, 20 bp, Homo sapiens
gtttcgtgaagtatactgta

SEQ ID NO: 3037674 - DNA, 16 bp, Homo sapiens
gtttcgtttctgtata

SEQ ID NO: 3037675 - DNA, 14 bp, Homo sapiens
gtttctaagattct

SEQ ID NO: 3037676 - DNA, 15 bp, Homo sapiens
gtttctaagattcta

SEQ ID NO: 3037677 - DNA, 16 bp, Homo sapiens
gtttctaagattctaa

SEQ ID NO: 3037678 - DNA, 20 bp, Homo sapiens
gtttctaagattctaaaggt

SEQ ID NO: 3037679 - DNA, 21 bp, Homo sapiens
gtttctaagattctaaaggtc

SEQ ID NO: 3037680 - DNA, 18 bp, Homo sapiens
gtttctaaggactttttc

SEQ ID NO: 3037681 - DNA, 22 bp, Homo sapiens
gtttctaaggtccggtgttcta

SEQ ID NO: 3037682 - DNA, 17 bp, Homo sapiens
gtttctatttagacact

SEQ ID NO: 3037683 - DNA, 18 bp, Homo sapiens
gtttctcagactggtctc

SEQ ID NO: 3037684 - DNA, 14 bp, Homo sapiens
gtttctcagatcct

SEQ ID NO: 3037685 - DNA, 18 bp, Homo sapiens
gtttctcctgagctagga

SEQ ID NO: 3037686 - DNA, 23 bp, Homo sapiens
gtttctctgccgctacctccctc

SEQ ID NO: 3037687 - DNA, 20 bp, Homo sapiens
gtttctgaaagtattcacat

SEQ ID NO: 3037688 - DNA, 23 bp, Homo sapiens
gtttctgaaagtattcacatcat

SEQ ID NO: 3037689 - DNA, 21 bp, Homo sapiens
gtttctgaatgtttgtgtctg

SEQ ID NO: 3037690 - DNA, 22 bp, Homo sapiens
gtttctgaatgtttgtgtctgt

SEQ ID NO: 3037691 - DNA, 22 bp, Homo sapiens
gtttctgaggctttatgataat

SEQ ID NO: 3037692 - DNA, 17 bp, Homo sapiens
gtttctgggtctacaag

SEQ ID NO: 3037693 - DNA, 14 bp, Homo sapiens
gtttctggtgtctg

SEQ ID NO: 3037694 - DNA, 12 bp, Homo sapiens
gtttctgtatat

SEQ ID NO: 3037695 - DNA, 21 bp, Homo sapiens
gtttctgtatatgattctctg

SEQ ID NO: 3037696 - DNA, 16 bp, Homo sapiens
gtttctgtcaagcata

SEQ ID NO: 3037697 - DNA, 13 bp, Homo sapiens
gtttctgttctgc

SEQ ID NO: 3037698 - DNA, 14 bp, Homo sapiens
gtttctgttctgtg

SEQ ID NO: 3037699 - DNA, 18 bp, Homo sapiens
gtttctgttctgtggaaa

SEQ ID NO: 3037700 - DNA, 14 bp, Homo sapiens
gtttcttacaaata

SEQ ID NO: 3037701 - DNA, 21 bp, Homo sapiens
gtttcttacaaataaagtttg

SEQ ID NO: 3037702 - DNA, 13 bp, Homo sapiens
gtttcttattcaa

SEQ ID NO: 3037703 - DNA, 14 bp, Homo sapiens
gtttcttattctct

SEQ ID NO: 3037704 - DNA, 18 bp, Homo sapiens
gtttcttattctctgttt

SEQ ID NO: 3037705 - DNA, 14 bp, Homo sapiens
gtttcttcactttt

SEQ ID NO: 3037706 - DNA, 14 bp, Homo sapiens
gtttcttgcttctg

SEQ ID NO: 3037707 - DNA, 22 bp, Homo sapiens
gtttcttttttctttcttcctt

SEQ ID NO: 3037708 - DNA, 15 bp, Homo sapiens
gtttgaaacaaagaa

SEQ ID NO: 3037709 - DNA, 19 bp, Homo sapiens
gtttgaaattctgaatttg

SEQ ID NO: 3037710 - DNA, 19 bp, Homo sapiens
gtttgaagaaccgcatttt

SEQ ID NO: 3037711 - DNA, 18 bp, Homo sapiens
gtttgactagatgatgga

SEQ ID NO: 3037712 - DNA, 14 bp, Homo sapiens
gtttgacttgtata

SEQ ID NO: 3037713 - DNA, 23 bp, Homo sapiens
gtttgaggctgcaatgagccatg

SEQ ID NO: 3037714 - DNA, 16 bp, Homo sapiens
gtttgattttcatatc

SEQ ID NO: 3037715 - DNA, 14 bp, Homo sapiens
gtttgatttttatt

SEQ ID NO: 3037716 - DNA, 11 bp, Homo sapiens
gtttgcacaga

SEQ ID NO: 3037717 - DNA, 22 bp, Homo sapiens
gtttgcacgttatggtgtttct

SEQ ID NO: 3037718 - DNA, 17 bp, Homo sapiens
gtttgcactatctttca

SEQ ID NO: 3037719 - DNA, 22 bp, Homo sapiens
gtttgcagaaaagcacctgccg

SEQ ID NO: 3037720 - DNA, 12 bp, Homo sapiens
gtttgcattcct

SEQ ID NO: 3037721 - DNA, 16 bp, Homo sapiens
gtttgctatcttaatt

SEQ ID NO: 3037722 - DNA, 13 bp, Homo sapiens
gtttgctgtgcca

SEQ ID NO: 3037723 - DNA, 16 bp, Homo sapiens
gtttgctgtgccagga

SEQ ID NO: 3037724 - DNA, 11 bp, Homo sapiens
gtttgctttct

SEQ ID NO: 3037725 - DNA, 21 bp, Homo sapiens
gtttgctttctgatcaaggcc

SEQ ID NO: 3037726 - DNA, 14 bp, Homo sapiens
gtttgcttttgaac

SEQ ID NO: 3037727 - DNA, 14 bp, Homo sapiens
gtttggcccctgga

SEQ ID NO: 3037728 - DNA, 13 bp, Homo sapiens
gtttggctttcag

SEQ ID NO: 3037729 - DNA, 22 bp, Homo sapiens
gtttgggacccctggtggttca

SEQ ID NO: 3037730 - DNA, 20 bp, Homo sapiens
gtttgggtcttttatacatg

SEQ ID NO: 3037731 - DNA, 14 bp, Homo sapiens
gtttggtataaatt

SEQ ID NO: 3037732 - DNA, 17 bp, Homo sapiens
gtttggtgtttttacag

SEQ ID NO: 3037733 - DNA, 14 bp, Homo sapiens
gtttgtatgatgta

SEQ ID NO: 3037734 - DNA, 13 bp, Homo sapiens
gtttgtatgtgtg

SEQ ID NO: 3037735 - DNA, 13 bp, Homo sapiens
gtttgtcagcatc

SEQ ID NO: 3037736 - DNA, 19 bp, Homo sapiens
gtttgtcagcatctgacca

SEQ ID NO: 3037737 - DNA, 17 bp, Homo sapiens
gtttgtcctttaactat

SEQ ID NO: 3037738 - DNA, 22 bp, Homo sapiens
gtttgtgagccttgctgccaag

SEQ ID NO: 3037739 - DNA, 23 bp, Homo sapiens
gtttgtgagccttgctgccaagt

SEQ ID NO: 3037740 - DNA, 23 bp, Homo sapiens
gtttgtgattcttccagatgtga

SEQ ID NO: 3037741 - DNA, 13 bp, Homo sapiens
gtttgtgcagaat

SEQ ID NO: 3037742 - DNA, 22 bp, Homo sapiens
gtttgtgtatttacgctttgat

SEQ ID NO: 3037743 - DNA, 21 bp, Homo sapiens
gtttgtgtgttgtcttgaaag

SEQ ID NO: 3037744 - DNA, 19 bp, Homo sapiens
gtttgttaaaaataaatcc

SEQ ID NO: 3037745 - DNA, 13 bp, Homo sapiens
gtttgttggtcac

SEQ ID NO: 3037746 - DNA, 18 bp, Homo sapiens
gtttgtttattagatgaa

SEQ ID NO: 3037747 - DNA, 19 bp, Homo sapiens
gtttgtttattagatgaat

SEQ ID NO: 3037748 - DNA, 13 bp, Homo sapiens
gtttgtttcctgt

SEQ ID NO: 3037749 - DNA, 14 bp, Homo sapiens
gtttgtttttgctt

SEQ ID NO: 3037750 - DNA, 17 bp, Homo sapiens
gtttgtttttgctttct

SEQ ID NO: 3037751 - DNA, 23 bp, Homo sapiens
gtttgtttttgtttggtataaat

SEQ ID NO: 3037752 - DNA, 21 bp, Homo sapiens
gttttaaaaaggaactgcagc

SEQ ID NO: 3037753 - DNA, 18 bp, Homo sapiens
gttttaaaactggacctg

SEQ ID NO: 3037754 - DNA, 21 bp, Homo sapiens
gttttaaaataagttaaaggc

SEQ ID NO: 3037755 - DNA, 12 bp, Homo sapiens
gttttaaaatta

SEQ ID NO: 3037756 - DNA, 14 bp, Homo sapiens
gttttaaaattaaa

SEQ ID NO: 3037757 - DNA, 14 bp, Homo sapiens
gttttaaatgtaca

SEQ ID NO: 3037758 - DNA, 20 bp, Homo sapiens
gttttaaattgcatttctat

SEQ ID NO: 3037759 - DNA, 21 bp, Homo sapiens
gttttaaattgcatttctatg

SEQ ID NO: 3037760 - DNA, 14 bp, Homo sapiens
gttttaacaaaaac

SEQ ID NO: 3037761 - DNA, 16 bp, Homo sapiens
gttttaacttatttat

SEQ ID NO: 3037762 - DNA, 17 bp, Homo sapiens
gttttaacttatttata

SEQ ID NO: 3037763 - DNA, 23 bp, Homo sapiens
gttttaacttatttatatgaagc

SEQ ID NO: 3037764 - DNA, 14 bp, Homo sapiens
gttttaattccatg

SEQ ID NO: 3037765 - DNA, 18 bp, Homo sapiens
gttttacgcaaggaagga

SEQ ID NO: 3037766 - DNA, 17 bp, Homo sapiens
gttttacttacaaaaat

SEQ ID NO: 3037767 - DNA, 18 bp, Homo sapiens
gttttagacaaatactca

SEQ ID NO: 3037768 - DNA, 19 bp, Homo sapiens
gttttagattattttatct

SEQ ID NO: 3037769 - DNA, 20 bp, Homo sapiens
gttttagccattgttggctt

SEQ ID NO: 3037770 - DNA, 17 bp, Homo sapiens
gttttaggttctaaagt

SEQ ID NO: 3037771 - DNA, 14 bp, Homo sapiens
gttttataaaatag

SEQ ID NO: 3037772 - DNA, 21 bp, Homo sapiens
gttttatgagaaagccttctt

SEQ ID NO: 3037773 - DNA, 19 bp, Homo sapiens
gttttatgagatggatcac

SEQ ID NO: 3037774 - DNA, 21 bp, Homo sapiens
taaattatgggaatcaagatt

SEQ ID NO: 3037775 - DNA, 22 bp, Homo sapiens
taaattattatcttcttaacag

SEQ ID NO: 3037776 - DNA, 14 bp, Homo sapiens
taaattcctctttg

SEQ ID NO: 3037777 - DNA, 19 bp, Homo sapiens
taaattcctctttgctttg

SEQ ID NO: 3037778 - DNA, 20 bp, Homo sapiens
taaattcctctttgctttgc

SEQ ID NO: 3037779 - DNA, 19 bp, Homo sapiens
taaattcgctgtgagtgag

SEQ ID NO: 3037780 - DNA, 16 bp, Homo sapiens
taaattctcaaagttt

SEQ ID NO: 3037781 - DNA, 17 bp, Homo sapiens
taaattctctctaacat

SEQ ID NO: 3037782 - DNA, 12 bp, Homo sapiens
taaattgaataa

SEQ ID NO: 3037783 - DNA, 14 bp, Homo sapiens
taaattgcatttct

SEQ ID NO: 3037784 - DNA, 23 bp, Homo sapiens
taaattgtccgtgttcatacatt

SEQ ID NO: 3037785 - DNA, 19 bp, Homo sapiens
taaattgttataacttcat

SEQ ID NO: 3037786 - DNA, 18 bp, Homo sapiens
taaatttatgacctgctg

SEQ ID NO: 3037787 - DNA, 12 bp, Homo sapiens
taaatttattaa

SEQ ID NO: 3037788 - DNA, 16 bp, Homo sapiens
taaatttattaaataa

SEQ ID NO: 3037789 - DNA, 21 bp, Homo sapiens
taaatttccatatccttctgg

SEQ ID NO: 3037790 - DNA, 16 bp, Homo sapiens
taaatttgaactccat

SEQ ID NO: 3037791 - DNA, 14 bp, Homo sapiens
taaatttgcatgaa

SEQ ID NO: 3037792 - DNA, 22 bp, Homo sapiens
taaatttgcatgaaagcacaag

SEQ ID NO: 3037793 - DNA, 21 bp, Homo sapiens
taaatttgttgtcatgtgtat

SEQ ID NO: 3037794 - DNA, 14 bp, Homo sapiens
taacaaaaaaagaa

SEQ ID NO: 3037795 - DNA, 21 bp, Homo sapiens
taacaaatggagctttctgta

SEQ ID NO: 3037796 - DNA, 22 bp, Homo sapiens
taacaacctttcccatttcgtg

SEQ ID NO: 3037797 - DNA, 13 bp, Homo sapiens
taacaagaagatg

SEQ ID NO: 3037798 - DNA, 16 bp, Homo sapiens
taacaagaagatgaat

SEQ ID NO: 3037799 - DNA, 18 bp, Homo sapiens
taacaagaagatgaatgg

SEQ ID NO: 3037800 - DNA, 14 bp, Homo sapiens
taacaatgtatttt

SEQ ID NO: 3037801 - DNA, 20 bp, Homo sapiens
taacaattaggcagactctt

SEQ ID NO: 3037802 - DNA, 19 bp, Homo sapiens
taacacagtacctaagact

SEQ ID NO: 3037803 - DNA, 18 bp, Homo sapiens
taacacattgttatttct

SEQ ID NO: 3037804 - DNA, 17 bp, Homo sapiens
taacacattttgtataa

SEQ ID NO: 3037805 - DNA, 19 bp, Homo sapiens
taacacctgattaactgag

SEQ ID NO: 3037806 - DNA, 22 bp, Homo sapiens
taacacttcttacgcaatgctt

SEQ ID NO: 3037807 - DNA, 11 bp, Homo sapiens
taacagaaagg

SEQ ID NO: 3037808 - DNA, 21 bp, Homo sapiens
taacagaaagggcaacaataa

SEQ ID NO: 3037809 - DNA, 14 bp, Homo sapiens
taacagagtagttt

SEQ ID NO: 3037810 - DNA, 21 bp, Homo sapiens
taacagagtagttttggtttt

SEQ ID NO: 3037811 - DNA, 15 bp, Homo sapiens
taacagcaagagatg

SEQ ID NO: 3037812 - DNA, 23 bp, Homo sapiens
taacagcgtgtcaactttcattt

SEQ ID NO: 3037813 - DNA, 16 bp, Homo sapiens
taacaggttattttag

SEQ ID NO: 3037814 - DNA, 17 bp, Homo sapiens
taacataataaattaaa

SEQ ID NO: 3037815 - DNA, 17 bp, Homo sapiens
taacatatctaaagtca

SEQ ID NO: 3037816 - DNA, 20 bp, Homo sapiens
taacatcattttgttttcca

SEQ ID NO: 3037817 - DNA, 16 bp, Homo sapiens
taacatcttcaacatg

SEQ ID NO: 3037818 - DNA, 11 bp, Homo sapiens
taacatgaaat

SEQ ID NO: 3037819 - DNA, 14 bp, Homo sapiens
taacatgaaatgat

SEQ ID NO: 3037820 - DNA, 19 bp, Homo sapiens
taacatgagtatcatcaga

SEQ ID NO: 3037821 - DNA, 19 bp, Homo sapiens
taacatgtggaagaaaaca

SEQ ID NO: 3037822 - DNA, 21 bp, Homo sapiens
taacatgtttctctataaagt

SEQ ID NO: 3037823 - DNA, 16 bp, Homo sapiens
taacattcccactgcc

SEQ ID NO: 3037824 - DNA, 16 bp, Homo sapiens
taacattctacttgct

SEQ ID NO: 3037825 - DNA, 17 bp, Homo sapiens
taacatttatagaagaa

SEQ ID NO: 3037826 - DNA, 19 bp, Homo sapiens
taacatttatagaagaaat

SEQ ID NO: 3037827 - DNA, 20 bp, Homo sapiens
taacatttatctaaaagaat

SEQ ID NO: 3037828 - DNA, 18 bp, Homo sapiens
taaccaaagagtctctgg

SEQ ID NO: 3037829 - DNA, 19 bp, Homo sapiens
taaccacaaagcacagttt

SEQ ID NO: 3037830 - DNA, 23 bp, Homo sapiens
taaccacaaagcacagtttgaac

SEQ ID NO: 3037831 - DNA, 19 bp, Homo sapiens
taaccacattttaggatct

SEQ ID NO: 3037832 - DNA, 17 bp, Homo sapiens
taaccacctctctgtct

SEQ ID NO: 3037833 - DNA, 17 bp, Homo sapiens
taaccactgcaagtcct

SEQ ID NO: 3037834 - DNA, 18 bp, Homo sapiens
taaccactgcaagtcctt

SEQ ID NO: 3037835 - DNA, 17 bp, Homo sapiens
taaccaggctgggctca

SEQ ID NO: 3037836 - DNA, 17 bp, Homo sapiens
taaccatcactggttgc

SEQ ID NO: 3037837 - DNA, 16 bp, Homo sapiens
taaccatttgttaact

SEQ ID NO: 3037838 - DNA, 10 bp, Homo sapiens
taaccatttt

SEQ ID NO: 3037839 - DNA, 12 bp, Homo sapiens
taacccctttcc

SEQ ID NO: 3037840 - DNA, 13 bp, Homo sapiens
taacccctttcct

SEQ ID NO: 3037841 - DNA, 17 bp, Homo sapiens
taaccgatgctttacca

SEQ ID NO: 3037842 - DNA, 13 bp, Homo sapiens
taaccgtttttca

SEQ ID NO: 3037843 - DNA, 16 bp, Homo sapiens
taaccgtttttcaaga

SEQ ID NO: 3037844 - DNA, 18 bp, Homo sapiens
taaccgtttttcaagaaa

SEQ ID NO: 3037845 - DNA, 18 bp, Homo sapiens
taacctcagagtatcttt

SEQ ID NO: 3037846 - DNA, 18 bp, Homo sapiens
taacctcatcttcttcac

SEQ ID NO: 3037847 - DNA, 14 bp, Homo sapiens
taacctgtgtctgc

SEQ ID NO: 3037848 - DNA, 19 bp, Homo sapiens
taaccttactaattatact

SEQ ID NO: 3037849 - DNA, 14 bp, Homo sapiens
taacctttaaaaat

SEQ ID NO: 3037850 - DNA, 22 bp, Homo sapiens
taacggtctgttctgtttcaag

SEQ ID NO: 3037851 - DNA, 19 bp, Homo sapiens
taacgtatgtatttcattg

SEQ ID NO: 3037852 - DNA, 17 bp, Homo sapiens
taacgtgatgtgccact

SEQ ID NO: 3037853 - DNA, 18 bp, Homo sapiens
taacgttgatgtaatgaa

SEQ ID NO: 3037854 - DNA, 19 bp, Homo sapiens
taacgttgatgtaatgaaa

SEQ ID NO: 3037855 - DNA, 19 bp, Homo sapiens
taactaaccacattttagg

SEQ ID NO: 3037856 - DNA, 16 bp, Homo sapiens
taactaatgaattgaa

SEQ ID NO: 3037857 - DNA, 18 bp, Homo sapiens
taactaatgaattgaaat

SEQ ID NO: 3037858 - DNA, 20 bp, Homo sapiens
taactactgtagaactgatt

SEQ ID NO: 3037859 - DNA, 13 bp, Homo sapiens
taactactgtatt

SEQ ID NO: 3037860 - DNA, 20 bp, Homo sapiens
taactagacaccaaagttct

SEQ ID NO: 3037861 - DNA, 22 bp, Homo sapiens
taactagacaccaaagttctaa

SEQ ID NO: 3037862 - DNA, 16 bp, Homo sapiens
taactataacaaaaaa

SEQ ID NO: 3037863 - DNA, 15 bp, Homo sapiens
taactatcaggcaga

SEQ ID NO: 3037864 - DNA, 18 bp, Homo sapiens
taactatcttctttggac

SEQ ID NO: 3037865 - DNA, 18 bp, Homo sapiens
taactcactatggttttt

SEQ ID NO: 3037866 - DNA, 16 bp, Homo sapiens
taactccaccaaccca

SEQ ID NO: 3037867 - DNA, 22 bp, Homo sapiens
taactccaccaacccatcagaa

SEQ ID NO: 3037868 - DNA, 13 bp, Homo sapiens
taactcccactcc

SEQ ID NO: 3037869 - DNA, 23 bp, Homo sapiens
taactcccctgtttcaatcactg

SEQ ID NO: 3037870 - DNA, 15 bp, Homo sapiens
taactccctcctcac

SEQ ID NO: 3037871 - DNA, 18 bp, Homo sapiens
taactctgtaaaagtgtc

SEQ ID NO: 3037872 - DNA, 11 bp, Homo sapiens
taactctgtct

SEQ ID NO: 3037873 - DNA, 15 bp, Homo sapiens
taactctgtcttcac

SEQ ID NO: 3037874 - DNA, 15 bp, Homo sapiens
taactgaaccaaatt

SEQ ID NO: 3037875 - DNA, 21 bp, Homo sapiens
taactgaagaaagagaagtca

SEQ ID NO: 3037876 - DNA, 18 bp, Homo sapiens
taactgacttaacaactg

SEQ ID NO: 3037877 - DNA, 17 bp, Homo sapiens
taactgcattgagaact

SEQ ID NO: 3037878 - DNA, 21 bp, Homo sapiens
taactgccctctgaaataatg

SEQ ID NO: 3037879 - DNA, 18 bp, Homo sapiens
taactgctacttgctctg

SEQ ID NO: 3037880 - DNA, 17 bp, Homo sapiens
taactgctcttttacta

SEQ ID NO: 3037881 - DNA, 14 bp, Homo sapiens
taactgctgatttt

SEQ ID NO: 3037882 - DNA, 19 bp, Homo sapiens
taactggaacaaattattt

SEQ ID NO: 3037883 - DNA, 22 bp, Homo sapiens
taactggtgcactttgtaaatt

SEQ ID NO: 3037884 - DNA, 12 bp, Homo sapiens
taactgtatctt

SEQ ID NO: 3037885 - DNA, 17 bp, Homo sapiens
taactgtgaataataaa

SEQ ID NO: 3037886 - DNA, 23 bp, Homo sapiens
taactgttgcacttttgaatgtc

SEQ ID NO: 3037887 - DNA, 21 bp, Homo sapiens
taactgttgctcgaagactgt

SEQ ID NO: 3037888 - DNA, 13 bp, Homo sapiens
taacttaaaattg

SEQ ID NO: 3037889 - DNA, 12 bp, Homo sapiens
taacttaaagat

SEQ ID NO: 3037890 - DNA, 22 bp, Homo sapiens
taacttattgcctgggcagtgc

SEQ ID NO: 3037891 - DNA, 17 bp, Homo sapiens
taacttatttatatgaa

SEQ ID NO: 3037892 - DNA, 14 bp, Homo sapiens
taacttcatagaaa

SEQ ID NO: 3037893 - DNA, 14 bp, Homo sapiens
taacttcatattaa

SEQ ID NO: 3037894 - DNA, 23 bp, Homo sapiens
taacttcatattaatataagttt

SEQ ID NO: 3037895 - DNA, 18 bp, Homo sapiens
taacttctatattttaat

SEQ ID NO: 3037896 - DNA, 22 bp, Homo sapiens
taacttctatattttaatagaa

SEQ ID NO: 3037897 - DNA, 23 bp, Homo sapiens
taacttctatattttaatagaaa

SEQ ID NO: 3037898 - DNA, 17 bp, Homo sapiens
taacttcttatggaatt

SEQ ID NO: 3037899 - DNA, 19 bp, Homo sapiens
taacttcttatggaattga

SEQ ID NO: 3037900 - DNA, 23 bp, Homo sapiens
taacttcttatggaattgatttg

SEQ ID NO: 3037901 - DNA, 22 bp, Homo sapiens
taacttgaacctatgaagcaat

SEQ ID NO: 3037902 - DNA, 22 bp, Homo sapiens
taacttgagagtagatggtttg

SEQ ID NO: 3037903 - DNA, 18 bp, Homo sapiens
taacttgctttcttcttt

SEQ ID NO: 3037904 - DNA, 14 bp, Homo sapiens
taactttatgaagt

SEQ ID NO: 3037905 - DNA, 18 bp, Homo sapiens
taactttatgtgtaaata

SEQ ID NO: 3037906 - DNA, 12 bp, Homo sapiens
tacaacctgctt

SEQ ID NO: 3037907 - DNA, 15 bp, Homo sapiens
tacaacggaggcctg

SEQ ID NO: 3037908 - DNA, 23 bp, Homo sapiens
tacaactgcctcgaaacacagaa

SEQ ID NO: 3037909 - DNA, 13 bp, Homo sapiens
tacaagattagaa

SEQ ID NO: 3037910 - DNA, 21 bp, Homo sapiens
tacaagctacagttgtccaga

SEQ ID NO: 3037911 - DNA, 13 bp, Homo sapiens
tacaagctcttgt

SEQ ID NO: 3037912 - DNA, 21 bp, Homo sapiens
tacaagctcttgtttctgttt

SEQ ID NO: 3037913 - DNA, 23 bp, Homo sapiens
tacaagctcttgtttctgtttag

SEQ ID NO: 3037914 - DNA, 21 bp, Homo sapiens
tacaaggcaggcctttcctac

SEQ ID NO: 3037915 - DNA, 17 bp, Homo sapiens
tacaagtgaacaaaata

SEQ ID NO: 3037916 - DNA, 17 bp, Homo sapiens
tacaagttctttttaaa

SEQ ID NO: 3037917 - DNA, 14 bp, Homo sapiens
tacaagttgctttg

SEQ ID NO: 3037918 - DNA, 15 bp, Homo sapiens
tacaagttgctttgt

SEQ ID NO: 3037919 - DNA, 17 bp, Homo sapiens
tacaagttgctttgtta

SEQ ID NO: 3037920 - DNA, 15 bp, Homo sapiens
tacaagtttataagc

SEQ ID NO: 3037921 - DNA, 17 bp, Homo sapiens
tacaagtttatatatat

SEQ ID NO: 3037922 - DNA, 21 bp, Homo sapiens
tacaataaaactaaatgtgta

SEQ ID NO: 3037923 - DNA, 22 bp, Homo sapiens
tacaataaaactaaatgtgtac

SEQ ID NO: 3037924 - DNA, 13 bp, Homo sapiens
tacaataaagtct

SEQ ID NO: 3037925 - DNA, 12 bp, Homo sapiens
tacaataatgga

SEQ ID NO: 3037926 - DNA, 16 bp, Homo sapiens
tacaataatggaaaaa

SEQ ID NO: 3037927 - DNA, 14 bp, Homo sapiens
tacaatacatctga

SEQ ID NO: 3037928 - DNA, 20 bp, Homo sapiens
tacaatcaaaggaaaatagt

SEQ ID NO: 3037929 - DNA, 17 bp, Homo sapiens
tacaatcagtgtgaatg

SEQ ID NO: 3037930 - DNA, 14 bp, Homo sapiens
tacaatgggaaaag

SEQ ID NO: 3037931 - DNA, 20 bp, Homo sapiens
tacaatgggaaaagagtctc

SEQ ID NO: 3037932 - DNA, 17 bp, Homo sapiens
tacaatgtatttattta

SEQ ID NO: 3037933 - DNA, 20 bp, Homo sapiens
tacaatgtatttatttaaaa

SEQ ID NO: 3037934 - DNA, 17 bp, Homo sapiens
tacaatgtgtatcaaaa

SEQ ID NO: 3037935 - DNA, 18 bp, Homo sapiens
tacaattaaaaaaaaaga

SEQ ID NO: 3037936 - DNA, 18 bp, Homo sapiens
tacaattatttttacagt

SEQ ID NO: 3037937 - DNA, 14 bp, Homo sapiens
tacaattcattgtt

SEQ ID NO: 3037938 - DNA, 20 bp, Homo sapiens
tacaatttttttaattttgt

SEQ ID NO: 3037939 - DNA, 16 bp, Homo sapiens
tacacaacacctaaaa

SEQ ID NO: 3037940 - DNA, 18 bp, Homo sapiens
tacacaactagttttgtt

SEQ ID NO: 3037941 - DNA, 18 bp, Homo sapiens
tacacaaggagctttctt

SEQ ID NO: 3037942 - DNA, 20 bp, Homo sapiens
tacacaaggagctttcttgt

SEQ ID NO: 3037943 - DNA, 18 bp, Homo sapiens
tacacacacacacacaca

SEQ ID NO: 3037944 - DNA, 19 bp, Homo sapiens
tacacacacacacacagcc

SEQ ID NO: 3037945 - DNA, 20 bp, Homo sapiens
tacacacacacacacagcca

SEQ ID NO: 3037946 - DNA, 22 bp, Homo sapiens
tacacacacacacacagccaca

SEQ ID NO: 3037947 - DNA, 23 bp, Homo sapiens
tacacacacacacacagccacac

SEQ ID NO: 3037948 - DNA, 13 bp, Homo sapiens
tacacagaaacac

SEQ ID NO: 3037949 - DNA, 18 bp, Homo sapiens
tacacagagcaggactgc

SEQ ID NO: 3037950 - DNA, 19 bp, Homo sapiens
tacacagtaagtcatttaa

SEQ ID NO: 3037951 - DNA, 16 bp, Homo sapiens
tacacagtctgcaaga

SEQ ID NO: 3037952 - DNA, 17 bp, Homo sapiens
tacacagtctgcaagat

SEQ ID NO: 3037953 - DNA, 23 bp, Homo sapiens
tacacatagcatgtaatggtatc

SEQ ID NO: 3037954 - DNA, 19 bp, Homo sapiens
tacacatctctgtcagtgt

SEQ ID NO: 3037955 - DNA, 14 bp, Homo sapiens
tacacatttcacat

SEQ ID NO: 3037956 - DNA, 15 bp, Homo sapiens
tacacatttcacatt

SEQ ID NO: 3037957 - DNA, 17 bp, Homo sapiens
tacaccacacacaacag

SEQ ID NO: 3037958 - DNA, 19 bp, Homo sapiens
tacaccacacacaacagcc

SEQ ID NO: 3037959 - DNA, 21 bp, Homo sapiens
tacaccacacacaacagccaa

SEQ ID NO: 3037960 - DNA, 19 bp, Homo sapiens
tacaccagagataatatga

SEQ ID NO: 3037961 - DNA, 21 bp, Homo sapiens
tacacctggaccatttgattg

SEQ ID NO: 3037962 - DNA, 19 bp, Homo sapiens
tacaccttgcttttttact

SEQ ID NO: 3037963 - DNA, 19 bp, Homo sapiens
tacacctttctcctttgta

SEQ ID NO: 3037964 - DNA, 20 bp, Homo sapiens
tacacctttctcctttgtac

SEQ ID NO: 3037965 - DNA, 16 bp, Homo sapiens
tacactcattgaaatg

SEQ ID NO: 3037966 - DNA, 19 bp, Homo sapiens
tacactcattgaaatgtaa

SEQ ID NO: 3037967 - DNA, 12 bp, Homo sapiens
tacactcttata

SEQ ID NO: 3037968 - DNA, 19 bp, Homo sapiens
tacactggaggagagaaga

SEQ ID NO: 3037969 - DNA, 21 bp, Homo sapiens
tacactggaggagagaagaat

SEQ ID NO: 3037970 - DNA, 15 bp, Homo sapiens
tacactgtaccatat

SEQ ID NO: 3037971 - DNA, 18 bp, Homo sapiens
tacactgtgtctctatgt

SEQ ID NO: 3037972 - DNA, 21 bp, Homo sapiens
tacacttggggagatttgcca

SEQ ID NO: 3037973 - DNA, 21 bp, Homo sapiens
tacagaaaccaggtaagccct

SEQ ID NO: 3037974 - DNA, 19 bp, Homo sapiens
tacagaactctttcaaaac

SEQ ID NO: 3037975 - DNA, 15 bp, Homo sapiens
tacagaattactgta

SEQ ID NO: 3037976 - DNA, 13 bp, Homo sapiens
tacagaattttat

SEQ ID NO: 3037977 - DNA, 18 bp, Homo sapiens
tacagacagacatacata

SEQ ID NO: 3037978 - DNA, 14 bp, Homo sapiens
tacagacatattta

SEQ ID NO: 3037979 - DNA, 15 bp, Homo sapiens
tacagacatatttaa

SEQ ID NO: 3037980 - DNA, 15 bp, Homo sapiens
tacagacgtctcaag

SEQ ID NO: 3037981 - DNA, 15 bp, Homo sapiens
tacagagaaaatcaa

SEQ ID NO: 3037982 - DNA, 20 bp, Homo sapiens
tacagagaaaatcaaagcag

SEQ ID NO: 3037983 - DNA, 16 bp, Homo sapiens
tacagagattgtagta

SEQ ID NO: 3037984 - DNA, 15 bp, Homo sapiens
tacagagcttccctg

SEQ ID NO: 3037985 - DNA, 12 bp, Homo sapiens
tacagaggagaa

SEQ ID NO: 3037986 - DNA, 14 bp, Homo sapiens
tacagatactgtga

SEQ ID NO: 3037987 - DNA, 15 bp, Homo sapiens
tacagatactgtgag

SEQ ID NO: 3037988 - DNA, 19 bp, Homo sapiens
tacagatattctaagtcgt

SEQ ID NO: 3037989 - DNA, 22 bp, Homo sapiens
tacagatgaatgtatttatttg

SEQ ID NO: 3037990 - DNA, 13 bp, Homo sapiens
tacagcagcaaga

SEQ ID NO: 3037991 - DNA, 15 bp, Homo sapiens
tacagcagcaagaaa

SEQ ID NO: 3037992 - DNA, 17 bp, Homo sapiens
tacagcagtagacattt

SEQ ID NO: 3037993 - DNA, 19 bp, Homo sapiens
tacagcagtagacatttta

SEQ ID NO: 3037994 - DNA, 12 bp, Homo sapiens
tacagcccagag

SEQ ID NO: 3037995 - DNA, 16 bp, Homo sapiens
tacagctgtatataaa

SEQ ID NO: 3037996 - DNA, 14 bp, Homo sapiens
tacaggatcatgta

SEQ ID NO: 3037997 - DNA, 16 bp, Homo sapiens
tacagggagctgggac

SEQ ID NO: 3037998 - DNA, 17 bp, Homo sapiens
tacaggggttctggaaa

SEQ ID NO: 3037999 - DNA, 18 bp, Homo sapiens
tacagggtagcaggtacc

SEQ ID NO: 3038000 - DNA, 23 bp, Homo sapiens
tacaggtgggatatgctagaaaa

SEQ ID NO: 3038001 - DNA, 22 bp, Homo sapiens
tacaggtgtgagcatagtgaga

SEQ ID NO: 3038002 - DNA, 13 bp, Homo sapiens
tacaggttacaac

SEQ ID NO: 3038003 - DNA, 17 bp, Homo sapiens
tacaggttacaacagat

SEQ ID NO: 3038004 - DNA, 21 bp, Homo sapiens
tacaggttactaccctcaccc

SEQ ID NO: 3038005 - DNA, 13 bp, Homo sapiens
tacagtaggagcc

SEQ ID NO: 3038006 - DNA, 14 bp, Homo sapiens
tacagtaggagccc

SEQ ID NO: 3038007 - DNA, 15 bp, Homo sapiens
tacagtaggagccca

SEQ ID NO: 3038008 - DNA, 20 bp, Homo sapiens
tacagtaggagcccagctct

SEQ ID NO: 3038009 - DNA, 14 bp, Homo sapiens
tacagtatttttca

SEQ ID NO: 3038010 - DNA, 18 bp, Homo sapiens
tacagtatttttcagata

SEQ ID NO: 3038011 - DNA, 23 bp, Homo sapiens
tacagtatttttcagatataaat

SEQ ID NO: 3038012 - DNA, 15 bp, Homo sapiens
tacagtctcaatttt

SEQ ID NO: 3038013 - DNA, 18 bp, Homo sapiens
tacagtctcaattttgta

SEQ ID NO: 3038014 - DNA, 22 bp, Homo sapiens
tacagtctgtcttctgtatata

SEQ ID NO: 3038015 - DNA, 22 bp, Homo sapiens
tacagtcttccatttgcaaggg

SEQ ID NO: 3038016 - DNA, 18 bp, Homo sapiens
tacagtgtacatgtacat

SEQ ID NO: 3038017 - DNA, 14 bp, Homo sapiens
tacagtgtttttta

SEQ ID NO: 3038018 - DNA, 18 bp, Homo sapiens
tacagttagggttttgca

SEQ ID NO: 3038019 - DNA, 16 bp, Homo sapiens
tacagttatcctgcaa

SEQ ID NO: 3038020 - DNA, 23 bp, Homo sapiens
tacagttcggtgagctacaaatg

SEQ ID NO: 3038021 - DNA, 18 bp, Homo sapiens
tacagtttataaagccaa

SEQ ID NO: 3038022 - DNA, 22 bp, Homo sapiens
tacagtttataaagccaagaat

SEQ ID NO: 3038023 - DNA, 23 bp, Homo sapiens
tacataaatagtagaaaaatcag

SEQ ID NO: 3038024 - DNA, 22 bp, Homo sapiens
tacataactgatctatttatta

SEQ ID NO: 3038025 - DNA, 22 bp, Homo sapiens
tacataagcggcgtaagtttaa

SEQ ID NO: 3038026 - DNA, 17 bp, Homo sapiens
tacataagttaaatgat

SEQ ID NO: 3038027 - DNA, 22 bp, Homo sapiens
tacataatacacttgccctgct

SEQ ID NO: 3038028 - DNA, 19 bp, Homo sapiens
tacataatgggccactgaa

SEQ ID NO: 3038029 - DNA, 23 bp, Homo sapiens
tacataatgggccactgaaatct

SEQ ID NO: 3038030 - DNA, 17 bp, Homo sapiens
tacataattcactctga

SEQ ID NO: 3038031 - DNA, 20 bp, Homo sapiens
tacatacaccagcattcctt

SEQ ID NO: 3038032 - DNA, 13 bp, Homo sapiens
tacatagtaaagt

SEQ ID NO: 3038033 - DNA, 14 bp, Homo sapiens
tacatagtaaagta

SEQ ID NO: 3038034 - DNA, 15 bp, Homo sapiens
tacatagtaaagtat

SEQ ID NO: 3038035 - DNA, 17 bp, Homo sapiens
tacatagtaaagtattt

SEQ ID NO: 3038036 - DNA, 11 bp, Homo sapiens
tacatatatat

SEQ ID NO: 3038037 - DNA, 18 bp, Homo sapiens
tacatatatatatataac

SEQ ID NO: 3038038 - DNA, 13 bp, Homo sapiens
tagaattgatttc

SEQ ID NO: 3038039 - DNA, 15 bp, Homo sapiens
tagaattgcattgac

SEQ ID NO: 3038040 - DNA, 13 bp, Homo sapiens
tagaattggaaat

SEQ ID NO: 3038041 - DNA, 14 bp, Homo sapiens
tagacaagccagaa

SEQ ID NO: 3038042 - DNA, 19 bp, Homo sapiens
tagacaagccagaacttga

SEQ ID NO: 3038043 - DNA, 19 bp, Homo sapiens
tagacacatatgaggggga

SEQ ID NO: 3038044 - DNA, 14 bp, Homo sapiens
tagacaccaaagtt

SEQ ID NO: 3038045 - DNA, 21 bp, Homo sapiens
tagacaccaaagttctaataa

SEQ ID NO: 3038046 - DNA, 18 bp, Homo sapiens
tagacagtctcactttgt

SEQ ID NO: 3038047 - DNA, 17 bp, Homo sapiens
tagacatggaggttcta

SEQ ID NO: 3038048 - DNA, 15 bp, Homo sapiens
tagacattgaggacc

SEQ ID NO: 3038049 - DNA, 13 bp, Homo sapiens
tagacattgtaaa

SEQ ID NO: 3038050 - DNA, 19 bp, Homo sapiens
tagacatttgtaaatgtaa

SEQ ID NO: 3038051 - DNA, 21 bp, Homo sapiens
tagacattttaacaagaagat

SEQ ID NO: 3038052 - DNA, 19 bp, Homo sapiens
tagaccctctttcttgttt

SEQ ID NO: 3038053 - DNA, 19 bp, Homo sapiens
tagactatggaatgtcagt

SEQ ID NO: 3038054 - DNA, 21 bp, Homo sapiens
tagactatggaatgtcagtgt

SEQ ID NO: 3038055 - DNA, 22 bp, Homo sapiens
tagactattccttttctgtata

SEQ ID NO: 3038056 - DNA, 18 bp, Homo sapiens
tagactcatcttactgta

SEQ ID NO: 3038057 - DNA, 21 bp, Homo sapiens
tagactcatcttactgtacct

SEQ ID NO: 3038058 - DNA, 20 bp, Homo sapiens
tagactctgtaaccacctct

SEQ ID NO: 3038059 - DNA, 16 bp, Homo sapiens
tagactgaagatttat

SEQ ID NO: 3038060 - DNA, 19 bp, Homo sapiens
tagactggaacttgaactg

SEQ ID NO: 3038061 - DNA, 16 bp, Homo sapiens
tagactggacagcttg

SEQ ID NO: 3038062 - DNA, 13 bp, Homo sapiens
tagactggcctag

SEQ ID NO: 3038063 - DNA, 18 bp, Homo sapiens
tagacttggagaatactg

SEQ ID NO: 3038064 - DNA, 20 bp, Homo sapiens
tagacttggagaatactgcc

SEQ ID NO: 3038065 - DNA, 23 bp, Homo sapiens
tagacttggagaatactgccaaa

SEQ ID NO: 3038066 - DNA, 16 bp, Homo sapiens
tagactttaggctttc

SEQ ID NO: 3038067 - DNA, 22 bp, Homo sapiens
tagagaacaaagtaaaagtagt

SEQ ID NO: 3038068 - DNA, 13 bp, Homo sapiens
tagagaactgaaa

SEQ ID NO: 3038069 - DNA, 22 bp, Homo sapiens
tagagaactgaaaagagagcag

SEQ ID NO: 3038070 - DNA, 16 bp, Homo sapiens
tagagaactgtggccg

SEQ ID NO: 3038071 - DNA, 17 bp, Homo sapiens
tagagaaggaaagcttt

SEQ ID NO: 3038072 - DNA, 16 bp, Homo sapiens
tagagaagtaagcaga

SEQ ID NO: 3038073 - DNA, 23 bp, Homo sapiens
tagagaagtaagcagagttcttt

SEQ ID NO: 3038074 - DNA, 14 bp, Homo sapiens
tagagactggaaca

SEQ ID NO: 3038075 - DNA, 18 bp, Homo sapiens
tagagactggaacactag

SEQ ID NO: 3038076 - DNA, 13 bp, Homo sapiens
tagagaggaaaag

SEQ ID NO: 3038077 - DNA, 12 bp, Homo sapiens
tagagaggcctg

SEQ ID NO: 3038078 - DNA, 21 bp, Homo sapiens
tagagagttgttgtgtacaga

SEQ ID NO: 3038079 - DNA, 19 bp, Homo sapiens
tagagatatttaaaagaca

SEQ ID NO: 3038080 - DNA, 13 bp, Homo sapiens
tagagatgtgcaa

SEQ ID NO: 3038081 - DNA, 17 bp, Homo sapiens
tagagattacctcctga

SEQ ID NO: 3038082 - DNA, 21 bp, Homo sapiens
tagagattacctcctgagaaa

SEQ ID NO: 3038083 - DNA, 14 bp, Homo sapiens
tagagcactgccac

SEQ ID NO: 3038084 - DNA, 15 bp, Homo sapiens
tagagcagacaggcc

SEQ ID NO: 3038085 - DNA, 17 bp, Homo sapiens
tagagcatgctgcctga

SEQ ID NO: 3038086 - DNA, 18 bp, Homo sapiens
tagagccagccttggttg

SEQ ID NO: 3038087 - DNA, 14 bp, Homo sapiens
tagagcctgaggga

SEQ ID NO: 3038088 - DNA, 13 bp, Homo sapiens
tagagctgccact

SEQ ID NO: 3038089 - DNA, 14 bp, Homo sapiens
tagagctgccactg

SEQ ID NO: 3038090 - DNA, 17 bp, Homo sapiens
tagagctgccactgggc

SEQ ID NO: 3038091 - DNA, 22 bp, Homo sapiens
tagagctgttcaacatcactga

SEQ ID NO: 3038092 - DNA, 19 bp, Homo sapiens
tagagcttctgtattttca

SEQ ID NO: 3038093 - DNA, 20 bp, Homo sapiens
tagagcttgcagtgaagtgt

SEQ ID NO: 3038094 - DNA, 11 bp, Homo sapiens
tagaggaagac

SEQ ID NO: 3038095 - DNA, 20 bp, Homo sapiens
tagaggcagggctgcattgg

SEQ ID NO: 3038096 - DNA, 19 bp, Homo sapiens
tagagggacctctcccagg

SEQ ID NO: 3038097 - DNA, 22 bp, Homo sapiens
tagagggacggccaagaatgta

SEQ ID NO: 3038098 - DNA, 13 bp, Homo sapiens
tagagggaggggc

SEQ ID NO: 3038099 - DNA, 14 bp, Homo sapiens
tagagggaggggcc

SEQ ID NO: 3038100 - DNA, 17 bp, Homo sapiens
tagaggtgagttttaaa

SEQ ID NO: 3038101 - DNA, 13 bp, Homo sapiens
tagagtaagaaat

SEQ ID NO: 3038102 - DNA, 21 bp, Homo sapiens
tagagtaagaaatttcaggtt

SEQ ID NO: 3038103 - DNA, 18 bp, Homo sapiens
tagagttcttttggatca

SEQ ID NO: 3038104 - DNA, 15 bp, Homo sapiens
tagagtttatacagt

SEQ ID NO: 3038105 - DNA, 17 bp, Homo sapiens
tagagtttgctattaga

SEQ ID NO: 3038106 - DNA, 12 bp, Homo sapiens
tagataaaggaa

SEQ ID NO: 3038107 - DNA, 17 bp, Homo sapiens
tagataactgctctttt

SEQ ID NO: 3038108 - DNA, 21 bp, Homo sapiens
tagataactgctcttttacta

SEQ ID NO: 3038109 - DNA, 20 bp, Homo sapiens
tagataattaaatagtgaga

SEQ ID NO: 3038110 - DNA, 12 bp, Homo sapiens
tagatacttttg

SEQ ID NO: 3038111 - DNA, 13 bp, Homo sapiens
tagatacttttga

SEQ ID NO: 3038112 - DNA, 16 bp, Homo sapiens
tagatacttttgataa

SEQ ID NO: 3038113 - DNA, 22 bp, Homo sapiens
tagatacttttgataatagata

SEQ ID NO: 3038114 - DNA, 22 bp, Homo sapiens
tagataggtcagtgcaaatact

SEQ ID NO: 3038115 - DNA, 14 bp, Homo sapiens
tagatattaaaatt

SEQ ID NO: 3038116 - DNA, 14 bp, Homo sapiens
tagatcagatgctc

SEQ ID NO: 3038117 - DNA, 23 bp, Homo sapiens
tagatcagatgctccaagattct

SEQ ID NO: 3038118 - DNA, 16 bp, Homo sapiens
tagatctggtgtccag

SEQ ID NO: 3038119 - DNA, 21 bp, Homo sapiens
tagatgacataaaatttacat

SEQ ID NO: 3038120 - DNA, 20 bp, Homo sapiens
tagatgactttgcagatgga

SEQ ID NO: 3038121 - DNA, 15 bp, Homo sapiens
tagatgatcaacata

SEQ ID NO: 3038122 - DNA, 23 bp, Homo sapiens
tagatgattaaataagattctaa

SEQ ID NO: 3038123 - DNA, 12 bp, Homo sapiens
tagatgcagaaa

SEQ ID NO: 3038124 - DNA, 19 bp, Homo sapiens
tagatgcagaaaaagaaaa

SEQ ID NO: 3038125 - DNA, 20 bp, Homo sapiens
tagatgcagaaaaagaaaaa

SEQ ID NO: 3038126 - DNA, 17 bp, Homo sapiens
tagatgcgcagccccat

SEQ ID NO: 3038127 - DNA, 19 bp, Homo sapiens
tagatgcgcagccccatct

SEQ ID NO: 3038128 - DNA, 22 bp, Homo sapiens
tagatgctggcccagggcccag

SEQ ID NO: 3038129 - DNA, 23 bp, Homo sapiens
tagatggacagtttgtttcctgt

SEQ ID NO: 3038130 - DNA, 22 bp, Homo sapiens
tagatgggaatgaagcttgtgt

SEQ ID NO: 3038131 - DNA, 23 bp, Homo sapiens
tagatgggaatgaagcttgtgta

SEQ ID NO: 3038132 - DNA, 13 bp, Homo sapiens
tagatgtgattta

SEQ ID NO: 3038133 - DNA, 21 bp, Homo sapiens
tagatgtgatttaatagtgtt

SEQ ID NO: 3038134 - DNA, 19 bp, Homo sapiens
tagatgtttatatcaaatg

SEQ ID NO: 3038135 - DNA, 20 bp, Homo sapiens
tagatgttttaacttattta

SEQ ID NO: 3038136 - DNA, 20 bp, Homo sapiens
tagattaaaatatcctttca

SEQ ID NO: 3038137 - DNA, 17 bp, Homo sapiens
tagattcaaaggttcta

SEQ ID NO: 3038138 - DNA, 20 bp, Homo sapiens
tagattccattggtccaaga

SEQ ID NO: 3038139 - DNA, 21 bp, Homo sapiens
tagattctctgtgtctaagat

SEQ ID NO: 3038140 - DNA, 23 bp, Homo sapiens
tagattctctgtgtctaagattc

SEQ ID NO: 3038141 - DNA, 21 bp, Homo sapiens
tagattttctggttctaacat

SEQ ID NO: 3038142 - DNA, 14 bp, Homo sapiens
tagattttctttaa

SEQ ID NO: 3038143 - DNA, 16 bp, Homo sapiens
tagattttctttaaaa

SEQ ID NO: 3038144 - DNA, 21 bp, Homo sapiens
tagattttttaaaaaaaatgt

SEQ ID NO: 3038145 - DNA, 18 bp, Homo sapiens
tagcaaaaaaaacccatg

SEQ ID NO: 3038146 - DNA, 18 bp, Homo sapiens
tagcaaaaacatgtatgt

SEQ ID NO: 3038147 - DNA, 21 bp, Homo sapiens
tagcaaaattcttaagtatgt

SEQ ID NO: 3038148 - DNA, 16 bp, Homo sapiens
tagcaaagatatatat

SEQ ID NO: 3038149 - DNA, 23 bp, Homo sapiens
tagcaaataatttcctggtgtga

SEQ ID NO: 3038150 - DNA, 15 bp, Homo sapiens
tagcaagacagctct

SEQ ID NO: 3038151 - DNA, 18 bp, Homo sapiens
tagcaagttacagtgatg

SEQ ID NO: 3038152 - DNA, 17 bp, Homo sapiens
tagcaatgtgattttgt

SEQ ID NO: 3038153 - DNA, 21 bp, Homo sapiens
tagcaattcatgggctgtgtg

SEQ ID NO: 3038154 - DNA, 15 bp, Homo sapiens
tagcacatgcttcaa

SEQ ID NO: 3038155 - DNA, 17 bp, Homo sapiens
tagcagaagaaaggaac

SEQ ID NO: 3038156 - DNA, 21 bp, Homo sapiens
tagcagatggtttccacattt

SEQ ID NO: 3038157 - DNA, 12 bp, Homo sapiens
tagcagcaaata

SEQ ID NO: 3038158 - DNA, 19 bp, Homo sapiens
tagcagcaccgttctgtgc

SEQ ID NO: 3038159 - DNA, 20 bp, Homo sapiens
tagcagcaccgttctgtgca

SEQ ID NO: 3038160 - DNA, 12 bp, Homo sapiens
tagcagcccagc

SEQ ID NO: 3038161 - DNA, 14 bp, Homo sapiens
tagcagcccagcat

SEQ ID NO: 3038162 - DNA, 14 bp, Homo sapiens
tagcagctgctact

SEQ ID NO: 3038163 - DNA, 15 bp, Homo sapiens
tagcaggaaatgtag

SEQ ID NO: 3038164 - DNA, 22 bp, Homo sapiens
tagcaggactgaattgtcccca

SEQ ID NO: 3038165 - DNA, 17 bp, Homo sapiens
tagcaggccccctagga

SEQ ID NO: 3038166 - DNA, 21 bp, Homo sapiens
tagcaggttgggtttttatga

SEQ ID NO: 3038167 - DNA, 13 bp, Homo sapiens
tagcagtcatcat

SEQ ID NO: 3038168 - DNA, 13 bp, Homo sapiens
tagcataaattta

SEQ ID NO: 3038169 - DNA, 15 bp, Homo sapiens
tagcatctgtacaaa

SEQ ID NO: 3038170 - DNA, 22 bp, Homo sapiens
tatagttattaagttctttaaa

SEQ ID NO: 3038171 - DNA, 13 bp, Homo sapiens
tatagttctagac

SEQ ID NO: 3038172 - DNA, 15 bp, Homo sapiens
tatagttctagacat

SEQ ID NO: 3038173 - DNA, 22 bp, Homo sapiens
tatagtttctgaggctttatga

SEQ ID NO: 3038174 - DNA, 19 bp, Homo sapiens
tatataaaaatatatgttg

SEQ ID NO: 3038175 - DNA, 14 bp, Homo sapiens
tatataagaaagac

SEQ ID NO: 3038176 - DNA, 17 bp, Homo sapiens
tatataagaaagacatc

SEQ ID NO: 3038177 - DNA, 19 bp, Homo sapiens
tatatacaacctgcttggg

SEQ ID NO: 3038178 - DNA, 16 bp, Homo sapiens
tatatacaataatgga

SEQ ID NO: 3038179 - DNA, 13 bp, Homo sapiens
tatatacacacaa

SEQ ID NO: 3038180 - DNA, 15 bp, Homo sapiens
tatatacacacatgt

SEQ ID NO: 3038181 - DNA, 17 bp, Homo sapiens
tatatacagtaacttta

SEQ ID NO: 3038182 - DNA, 14 bp, Homo sapiens
tatatacttttaaa

SEQ ID NO: 3038183 - DNA, 14 bp, Homo sapiens
tatatagaaacact

SEQ ID NO: 3038184 - DNA, 13 bp, Homo sapiens
tatatagcaaaga

SEQ ID NO: 3038185 - DNA, 19 bp, Homo sapiens
tatatagcaaagatatata

SEQ ID NO: 3038186 - DNA, 20 bp, Homo sapiens
tatatagcaaagatatatat

SEQ ID NO: 3038187 - DNA, 21 bp, Homo sapiens
tatatagcaaagatatatatt

SEQ ID NO: 3038188 - DNA, 14 bp, Homo sapiens
tatatagcttgaaa

SEQ ID NO: 3038189 - DNA, 17 bp, Homo sapiens
tatatagtatttaattg

SEQ ID NO: 3038190 - DNA, 16 bp, Homo sapiens
tatatataacatatat

SEQ ID NO: 3038191 - DNA, 14 bp, Homo sapiens
tatatatactggaa

SEQ ID NO: 3038192 - DNA, 15 bp, Homo sapiens
tatatatatacacac

SEQ ID NO: 3038193 - DNA, 14 bp, Homo sapiens
tatatatatataac

SEQ ID NO: 3038194 - DNA, 15 bp, Homo sapiens
tatatatatatgtac

SEQ ID NO: 3038195 - DNA, 17 bp, Homo sapiens
tatatatgtacagttat

SEQ ID NO: 3038196 - DNA, 18 bp, Homo sapiens
tatatatgtataaataaa

SEQ ID NO: 3038197 - DNA, 14 bp, Homo sapiens
tatatatgtgtatg

SEQ ID NO: 3038198 - DNA, 12 bp, Homo sapiens
tatatattcacc

SEQ ID NO: 3038199 - DNA, 15 bp, Homo sapiens
tatatattcaccaat

SEQ ID NO: 3038200 - DNA, 19 bp, Homo sapiens
tatatattcaccaatgttg

SEQ ID NO: 3038201 - DNA, 20 bp, Homo sapiens
tatatattcttataaaaatg

SEQ ID NO: 3038202 - DNA, 12 bp, Homo sapiens
tatatattgtct

SEQ ID NO: 3038203 - DNA, 18 bp, Homo sapiens
tatatattgtctgtaaaa

SEQ ID NO: 3038204 - DNA, 15 bp, Homo sapiens
tatatcaaagtattt

SEQ ID NO: 3038205 - DNA, 14 bp, Homo sapiens
tatatcaaatgagc

SEQ ID NO: 3038206 - DNA, 17 bp, Homo sapiens
tatatcatgaagccttg

SEQ ID NO: 3038207 - DNA, 21 bp, Homo sapiens
tatatccttttcttctatgta

SEQ ID NO: 3038208 - DNA, 13 bp, Homo sapiens
tatatctaaattg

SEQ ID NO: 3038209 - DNA, 16 bp, Homo sapiens
tatatctatatgtact

SEQ ID NO: 3038210 - DNA, 17 bp, Homo sapiens
tatatctatatgtactt

SEQ ID NO: 3038211 - DNA, 14 bp, Homo sapiens
tatatctctatttg

SEQ ID NO: 3038212 - DNA, 11 bp, Homo sapiens
tatatctgtat

SEQ ID NO: 3038213 - DNA, 15 bp, Homo sapiens
tatatgaaatatttt

SEQ ID NO: 3038214 - DNA, 16 bp, Homo sapiens
tatatgaagcaagctg

SEQ ID NO: 3038215 - DNA, 19 bp, Homo sapiens
tatatgaagcaagctgtgt

SEQ ID NO: 3038216 - DNA, 21 bp, Homo sapiens
tatatgaagcaagctgtgtta

SEQ ID NO: 3038217 - DNA, 22 bp, Homo sapiens
tatatgaagcaagctgtgttac

SEQ ID NO: 3038218 - DNA, 24 bp, Homo sapiens
tatatgaagcaagctgtgttactt

SEQ ID NO: 3038219 - DNA, 18 bp, Homo sapiens
tatatgattaaagaaaat

SEQ ID NO: 3038220 - DNA, 14 bp, Homo sapiens
tatatgatttatat

SEQ ID NO: 3038221 - DNA, 19 bp, Homo sapiens
tatatgcccattcttttca

SEQ ID NO: 3038222 - DNA, 14 bp, Homo sapiens
tatatgctactttt

SEQ ID NO: 3038223 - DNA, 17 bp, Homo sapiens
tatatggaagaggaaaa

SEQ ID NO: 3038224 - DNA, 12 bp, Homo sapiens
tatatgtatttt

SEQ ID NO: 3038225 - DNA, 14 bp, Homo sapiens
tatatgtgtatgta

SEQ ID NO: 3038226 - DNA, 18 bp, Homo sapiens
tatatgtgtttttcacat

SEQ ID NO: 3038227 - DNA, 20 bp, Homo sapiens
tatatgttgaatgttaacag

SEQ ID NO: 3038228 - DNA, 23 bp, Homo sapiens
tatatgttgaatgttaacaggta

SEQ ID NO: 3038229 - DNA, 11 bp, Homo sapiens
tatattacaag

SEQ ID NO: 3038230 - DNA, 18 bp, Homo sapiens
tatattacccaatggaaa

SEQ ID NO: 3038231 - DNA, 13 bp, Homo sapiens
tatattatatata

SEQ ID NO: 3038232 - DNA, 14 bp, Homo sapiens
tatattatcatgca

SEQ ID NO: 3038233 - DNA, 20 bp, Homo sapiens
tatattattccgtattacat

SEQ ID NO: 3038234 - DNA, 22 bp, Homo sapiens
tatattatttctaggaagaatt

SEQ ID NO: 3038235 - DNA, 14 bp, Homo sapiens
tatattcttccttg

SEQ ID NO: 3038236 - DNA, 13 bp, Homo sapiens
tatattgatttaa

SEQ ID NO: 3038237 - DNA, 18 bp, Homo sapiens
tatattgttagtggactt

SEQ ID NO: 3038238 - DNA, 13 bp, Homo sapiens
tatatttaacatg

SEQ ID NO: 3038239 - DNA, 20 bp, Homo sapiens
tatatttaagcaacatcttt

SEQ ID NO: 3038240 - DNA, 12 bp, Homo sapiens
tatatttacaaa

SEQ ID NO: 3038241 - DNA, 14 bp, Homo sapiens
tatatttacaaatg

SEQ ID NO: 3038242 - DNA, 13 bp, Homo sapiens
tatatttctcata

SEQ ID NO: 3038243 - DNA, 17 bp, Homo sapiens
tatatttgaaaaaatta

SEQ ID NO: 3038244 - DNA, 14 bp, Homo sapiens
tatatttgagttgt

SEQ ID NO: 3038245 - DNA, 21 bp, Homo sapiens
tatatttgagttgtgattgaa

SEQ ID NO: 3038246 - DNA, 16 bp, Homo sapiens
tatatttgtgtattta

SEQ ID NO: 3038247 - DNA, 15 bp, Homo sapiens
tatattttaatagaa

SEQ ID NO: 3038248 - DNA, 15 bp, Homo sapiens
tatattttatactgc

SEQ ID NO: 3038249 - DNA, 16 bp, Homo sapiens
tatatttttgtgaatt

SEQ ID NO: 3038250 - DNA, 15 bp, Homo sapiens
tatattttttgtctg

SEQ ID NO: 3038251 - DNA, 23 bp, Homo sapiens
tatcaaaactctatcaaatgtga

SEQ ID NO: 3038252 - DNA, 23 bp, Homo sapiens
tatcaaaagtgatcagcaatgaa

SEQ ID NO: 3038253 - DNA, 22 bp, Homo sapiens
tatcaaaattgcctttttctct

SEQ ID NO: 3038254 - DNA, 18 bp, Homo sapiens
tatcaaagaataagaaaa

SEQ ID NO: 3038255 - DNA, 18 bp, Homo sapiens
tatcaaatattagatgtg

SEQ ID NO: 3038256 - DNA, 17 bp, Homo sapiens
tatcaaccccagacact

SEQ ID NO: 3038257 - DNA, 21 bp, Homo sapiens
tatcaaccccagacactggtt

SEQ ID NO: 3038258 - DNA, 14 bp, Homo sapiens
tatcaacttcctaa

SEQ ID NO: 3038259 - DNA, 19 bp, Homo sapiens
tatcaacttcctaaatatt

SEQ ID NO: 3038260 - DNA, 14 bp, Homo sapiens
tatcaagacatagc

SEQ ID NO: 3038261 - DNA, 21 bp, Homo sapiens
tatcaaggagatatatcagtg

SEQ ID NO: 3038262 - DNA, 15 bp, Homo sapiens
tatcaagtactacat

SEQ ID NO: 3038263 - DNA, 21 bp, Homo sapiens
tatcaagtgttctaaaatgaa

SEQ ID NO: 3038264 - DNA, 14 bp, Homo sapiens
tatcaataaagcac

SEQ ID NO: 3038265 - DNA, 16 bp, Homo sapiens
tatcaataaagcacta

SEQ ID NO: 3038266 - DNA, 22 bp, Homo sapiens
tatcaatacagtttataaagcc

SEQ ID NO: 3038267 - DNA, 19 bp, Homo sapiens
tatcacctcattctgaacc

SEQ ID NO: 3038268 - DNA, 18 bp, Homo sapiens
tatcacctcgagaagtaa

SEQ ID NO: 3038269 - DNA, 13 bp, Homo sapiens
tatcagacctctt

SEQ ID NO: 3038270 - DNA, 18 bp, Homo sapiens
tatcagacgtgctccctc

SEQ ID NO: 3038271 - DNA, 23 bp, Homo sapiens
tatcagacgtgctccctcccatc

SEQ ID NO: 3038272 - DNA, 14 bp, Homo sapiens
tatcagcttcagaa

SEQ ID NO: 3038273 - DNA, 20 bp, Homo sapiens
tatcaggacccagaggaagg

SEQ ID NO: 3038274 - DNA, 21 bp, Homo sapiens
tatcaggacccagaggaaggg

SEQ ID NO: 3038275 - DNA, 15 bp, Homo sapiens
tatcagtaatgctaa

SEQ ID NO: 3038276 - DNA, 23 bp, Homo sapiens
tatcagtaatgctaaatgtgtaa

SEQ ID NO: 3038277 - DNA, 15 bp, Homo sapiens
tatcagttactcagc

SEQ ID NO: 3038278 - DNA, 18 bp, Homo sapiens
tatcagttactcagccct

SEQ ID NO: 3038279 - DNA, 14 bp, Homo sapiens
tatcatattattat

SEQ ID NO: 3038280 - DNA, 16 bp, Homo sapiens
tatcatattattatcc

SEQ ID NO: 3038281 - DNA, 18 bp, Homo sapiens
tatcatcagatagcatct

SEQ ID NO: 3038282 - DNA, 20 bp, Homo sapiens
tatcatctgtggactgacct

SEQ ID NO: 3038283 - DNA, 16 bp, Homo sapiens
tatcatgaagccttgc

SEQ ID NO: 3038284 - DNA, 18 bp, Homo sapiens
tatcatgaagccttgctg

SEQ ID NO: 3038285 - DNA, 15 bp, Homo sapiens
tatcatgcaaatgct

SEQ ID NO: 3038286 - DNA, 16 bp, Homo sapiens
tatcatgcaaatgctg

SEQ ID NO: 3038287 - DNA, 20 bp, Homo sapiens
tatcatgctaaaattctata

SEQ ID NO: 3038288 - DNA, 22 bp, Homo sapiens
tatcatgctaaaattctataga

SEQ ID NO: 3038289 - DNA, 15 bp, Homo sapiens
tatcatgtaaatgta

SEQ ID NO: 3038290 - DNA, 13 bp, Homo sapiens
tatcatgtatctc

SEQ ID NO: 3038291 - DNA, 13 bp, Homo sapiens
tatcatgtgtaat

SEQ ID NO: 3038292 - DNA, 17 bp, Homo sapiens
tatcatgtgtaatcaat

SEQ ID NO: 3038293 - DNA, 19 bp, Homo sapiens
tatcatgtgtaatcaataa

SEQ ID NO: 3038294 - DNA, 13 bp, Homo sapiens
tatcattaaagtt

SEQ ID NO: 3038295 - DNA, 14 bp, Homo sapiens
tatcattaaagttc

SEQ ID NO: 3038296 - DNA, 14 bp, Homo sapiens
tatcattcaagtgt

SEQ ID NO: 3038297 - DNA, 19 bp, Homo sapiens
tatccaacacaactatcaa

SEQ ID NO: 3038298 - DNA, 16 bp, Homo sapiens
tatccacactgtcaaa

SEQ ID NO: 3038299 - DNA, 18 bp, Homo sapiens
tatccacactgtcaaaca

SEQ ID NO: 3038300 - DNA, 15 bp, Homo sapiens
tatccacccagccca

SEQ ID NO: 3038301 - DNA, 12 bp, Homo sapiens
tatccagaggaa

SEQ ID NO: 3038302 - DNA, 15 bp, Homo sapiens
tatccaggtcaacag

SEQ ID NO: 3038303 - DNA, 20 bp, Homo sapiens
tatccaggtcaacagaatga

SEQ ID NO: 3038304 - DNA, 13 bp, Homo sapiens
tattattttccaa

SEQ ID NO: 3038305 - DNA, 20 bp, Homo sapiens
tattcaaactacctatattc

SEQ ID NO: 3038306 - DNA, 14 bp, Homo sapiens
tattcacatcattt

SEQ ID NO: 3038307 - DNA, 16 bp, Homo sapiens
tattcagaatctttgt

SEQ ID NO: 3038308 - DNA, 15 bp, Homo sapiens
tattcagaattatga

SEQ ID NO: 3038309 - DNA, 13 bp, Homo sapiens
tattcagacagat

SEQ ID NO: 3038310 - DNA, 16 bp, Homo sapiens
tattcaggcactgaga

SEQ ID NO: 3038311 - DNA, 15 bp, Homo sapiens
tattcagtgtcactg

SEQ ID NO: 3038312 - DNA, 16 bp, Homo sapiens
tattccagaatgctgt

SEQ ID NO: 3038313 - DNA, 23 bp, Homo sapiens
tattccagctcattcattttata

SEQ ID NO: 3038314 - DNA, 14 bp, Homo sapiens
tattcctgtatgtt

SEQ ID NO: 3038315 - DNA, 13 bp, Homo sapiens
tattcctttaaag

SEQ ID NO: 3038316 - DNA, 13 bp, Homo sapiens
tattctaagactt

SEQ ID NO: 3038317 - DNA, 21 bp, Homo sapiens
tattctaataaatcaatgtga

SEQ ID NO: 3038318 - DNA, 15 bp, Homo sapiens
tattctcactccacc

SEQ ID NO: 3038319 - DNA, 13 bp, Homo sapiens
tattctctctatg

SEQ ID NO: 3038320 - DNA, 19 bp, Homo sapiens
tattctctgagctgtgcag

SEQ ID NO: 3038321 - DNA, 12 bp, Homo sapiens
tattctctgttt

SEQ ID NO: 3038322 - DNA, 17 bp, Homo sapiens
tattctctgtttgcttt

SEQ ID NO: 3038323 - DNA, 20 bp, Homo sapiens
tattctctgtttgcttttga

SEQ ID NO: 3038324 - DNA, 22 bp, Homo sapiens
tattctctgtttgcttttgaac

SEQ ID NO: 3038325 - DNA, 17 bp, Homo sapiens
tattctgagaaaacaag

SEQ ID NO: 3038326 - DNA, 18 bp, Homo sapiens
tattctgataatgtattg

SEQ ID NO: 3038327 - DNA, 15 bp, Homo sapiens
tattctgattggtct

SEQ ID NO: 3038328 - DNA, 16 bp, Homo sapiens
tattctgtacattttt

SEQ ID NO: 3038329 - DNA, 18 bp, Homo sapiens
tattctgtacattttttc

SEQ ID NO: 3038330 - DNA, 9 bp, Homo sapiens
tattctgtc

SEQ ID NO: 3038331 - DNA, 15 bp, Homo sapiens
tattctgtcatttac

SEQ ID NO: 3038332 - DNA, 11 bp, Homo sapiens
tattctgttcc

SEQ ID NO: 3038333 - DNA, 14 bp, Homo sapiens
tattcttctagagt

SEQ ID NO: 3038334 - DNA, 18 bp, Homo sapiens
tattcttctagagttcag

SEQ ID NO: 3038335 - DNA, 18 bp, Homo sapiens
tattcttgaaagaagaat

SEQ ID NO: 3038336 - DNA, 13 bp, Homo sapiens
tattcttggtttt

SEQ ID NO: 3038337 - DNA, 10 bp, Homo sapiens
tattctttga

SEQ ID NO: 3038338 - DNA, 14 bp, Homo sapiens
tattcttttcaatt

SEQ ID NO: 3038339 - DNA, 14 bp, Homo sapiens
tattgaaaaaaata

SEQ ID NO: 3038340 - DNA, 18 bp, Homo sapiens
tattgaaagaattatcct

SEQ ID NO: 3038341 - DNA, 13 bp, Homo sapiens
tattgaacttttt

SEQ ID NO: 3038342 - DNA, 17 bp, Homo sapiens
tattgaatacttacatt

SEQ ID NO: 3038343 - DNA, 20 bp, Homo sapiens
tattgaatataatatatttg

SEQ ID NO: 3038344 - DNA, 18 bp, Homo sapiens
tattgacacagaaaatgt

SEQ ID NO: 3038345 - DNA, 23 bp, Homo sapiens
tattgacacagaaaatgttgaga

SEQ ID NO: 3038346 - DNA, 23 bp, Homo sapiens
tattgattatagcaatgtgattt

SEQ ID NO: 3038347 - DNA, 23 bp, Homo sapiens
tattgcaaaggttccaactgtat

SEQ ID NO: 3038348 - DNA, 11 bp, Homo sapiens
tattgcaatgc

SEQ ID NO: 3038349 - DNA, 13 bp, Homo sapiens
tattgcaatgcag

SEQ ID NO: 3038350 - DNA, 16 bp, Homo sapiens
tattgcaggagacatt

SEQ ID NO: 3038351 - DNA, 17 bp, Homo sapiens
tattgcaggagacattt

SEQ ID NO: 3038352 - DNA, 18 bp, Homo sapiens
tattgcaggagacatttt

SEQ ID NO: 3038353 - DNA, 20 bp, Homo sapiens
tattgcaggagacattttca

SEQ ID NO: 3038354 - DNA, 13 bp, Homo sapiens
tattgcagtttat

SEQ ID NO: 3038355 - DNA, 19 bp, Homo sapiens
tattgcagtttatcattca

SEQ ID NO: 3038356 - DNA, 19 bp, Homo sapiens
tattgccaggaatgtttca

SEQ ID NO: 3038357 - DNA, 15 bp, Homo sapiens
tattgcctctacttt

SEQ ID NO: 3038358 - DNA, 17 bp, Homo sapiens
tattgccttctcaccag

SEQ ID NO: 3038359 - DNA, 21 bp, Homo sapiens
tattgccttctcaccagctgc

SEQ ID NO: 3038360 - DNA, 18 bp, Homo sapiens
tattgctccattttcttg

SEQ ID NO: 3038361 - DNA, 20 bp, Homo sapiens
tattgctctatatgtaatat

SEQ ID NO: 3038362 - DNA, 22 bp, Homo sapiens
tattggaaatgtgaataagtaa

SEQ ID NO: 3038363 - DNA, 19 bp, Homo sapiens
tattggaggatttggtcag

SEQ ID NO: 3038364 - DNA, 16 bp, Homo sapiens
tattggatcagtgaaa

SEQ ID NO: 3038365 - DNA, 20 bp, Homo sapiens
tattggatttgtccaaacag

SEQ ID NO: 3038366 - DNA, 23 bp, Homo sapiens
tattgggacgtagagcacagcct

SEQ ID NO: 3038367 - DNA, 15 bp, Homo sapiens
tattgggtttggtca

SEQ ID NO: 3038368 - DNA, 10 bp, Homo sapiens
tattgtaaat

SEQ ID NO: 3038369 - DNA, 22 bp, Homo sapiens
tattgtaattttgttcctgttt

SEQ ID NO: 3038370 - DNA, 17 bp, Homo sapiens
tattgtaccttttaaca

SEQ ID NO: 3038371 - DNA, 15 bp, Homo sapiens
tattgtattgctgct

SEQ ID NO: 3038372 - DNA, 12 bp, Homo sapiens
tattgtattttg

SEQ ID NO: 3038373 - DNA, 21 bp, Homo sapiens
tattgtcatggggatcaattt

SEQ ID NO: 3038374 - DNA, 15 bp, Homo sapiens
tattgtccattgtcc

SEQ ID NO: 3038375 - DNA, 17 bp, Homo sapiens
tattgtcctaagtgtca

SEQ ID NO: 3038376 - DNA, 18 bp, Homo sapiens
tattgtggataacaaaga

SEQ ID NO: 3038377 - DNA, 18 bp, Homo sapiens
tattgtgtgcgctgcctg

SEQ ID NO: 3038378 - DNA, 19 bp, Homo sapiens
tattgttaattatgtacaa

SEQ ID NO: 3038379 - DNA, 15 bp, Homo sapiens
tattgttagtggact

SEQ ID NO: 3038380 - DNA, 17 bp, Homo sapiens
tattgtttctttatcac

SEQ ID NO: 3038381 - DNA, 17 bp, Homo sapiens
tatttaaaaatatttca

SEQ ID NO: 3038382 - DNA, 21 bp, Homo sapiens
tatttaaaaatatttcagata

SEQ ID NO: 3038383 - DNA, 12 bp, Homo sapiens
tatttaaaaatg

SEQ ID NO: 3038384 - DNA, 18 bp, Homo sapiens
tatttaaaaatgtcttgc

SEQ ID NO: 3038385 - DNA, 21 bp, Homo sapiens
tatttaaacctttttcttgat

SEQ ID NO: 3038386 - DNA, 24 bp, Homo sapiens
tatttaaactctgttgcaagtgca

SEQ ID NO: 3038387 - DNA, 12 bp, Homo sapiens
tatttaaagaaa

SEQ ID NO: 3038388 - DNA, 18 bp, Homo sapiens
tatttaaattacaatttt

SEQ ID NO: 3038389 - DNA, 14 bp, Homo sapiens
tatttaactcttaa

SEQ ID NO: 3038390 - DNA, 15 bp, Homo sapiens
tatttaactggtgca

SEQ ID NO: 3038391 - DNA, 12 bp, Homo sapiens
tatttaactttt

SEQ ID NO: 3038392 - DNA, 14 bp, Homo sapiens
tatttaagaagaat

SEQ ID NO: 3038393 - DNA, 21 bp, Homo sapiens
tatttaagcaacatcttttta

SEQ ID NO: 3038394 - DNA, 16 bp, Homo sapiens
tatttaaggaatcaaa

SEQ ID NO: 3038395 - DNA, 20 bp, Homo sapiens
tatttaaggaatcaaatctt

SEQ ID NO: 3038396 - DNA, 22 bp, Homo sapiens
tatttaatgacacaccttggat

SEQ ID NO: 3038397 - DNA, 17 bp, Homo sapiens
tatttaatgttttaaat

SEQ ID NO: 3038398 - DNA, 18 bp, Homo sapiens
tatttaatgttttaaatg

SEQ ID NO: 3038399 - DNA, 21 bp, Homo sapiens
tatttaatgttttaaatgtac

SEQ ID NO: 3038400 - DNA, 18 bp, Homo sapiens
tatttaattgtttcaaaa

SEQ ID NO: 3038401 - DNA, 17 bp, Homo sapiens
tatttacaatgtgtatc

SEQ ID NO: 3038402 - DNA, 10 bp, Homo sapiens
tatttacatt

SEQ ID NO: 3038403 - DNA, 18 bp, Homo sapiens
tatttacttctaatctta

SEQ ID NO: 3038404 - DNA, 17 bp, Homo sapiens
tatttacttgaaagatg

SEQ ID NO: 3038405 - DNA, 22 bp, Homo sapiens
tatttagacactacaacatatg

SEQ ID NO: 3038406 - DNA, 21 bp, Homo sapiens
tatttagactcatcttactgt

SEQ ID NO: 3038407 - DNA, 19 bp, Homo sapiens
tatttagcataaatttaat

SEQ ID NO: 3038408 - DNA, 19 bp, Homo sapiens
tatttagcttgggaaaggt

SEQ ID NO: 3038409 - DNA, 16 bp, Homo sapiens
tatttagtatatgaaa

SEQ ID NO: 3038410 - DNA, 13 bp, Homo sapiens
tatttagtgatat

SEQ ID NO: 3038411 - DNA, 13 bp, Homo sapiens
tatttatatgaag

SEQ ID NO: 3038412 - DNA, 15 bp, Homo sapiens
tatttatatgtactg

SEQ ID NO: 3038413 - DNA, 21 bp, Homo sapiens
tatttatctgattaagttgtc

SEQ ID NO: 3038414 - DNA, 17 bp, Homo sapiens
tatttatgatttcaaca

SEQ ID NO: 3038415 - DNA, 13 bp, Homo sapiens
tatttatgtttgc

SEQ ID NO: 3038416 - DNA, 13 bp, Homo sapiens
tatttattggatg

SEQ ID NO: 3038417 - DNA, 22 bp, Homo sapiens
tatttattggatgatacagtgt

SEQ ID NO: 3038418 - DNA, 13 bp, Homo sapiens
tatttatttatgt

SEQ ID NO: 3038419 - DNA, 18 bp, Homo sapiens
tatttcaagggttgcttc

SEQ ID NO: 3038420 - DNA, 14 bp, Homo sapiens
tatttcacagagca

SEQ ID NO: 3038421 - DNA, 23 bp, Homo sapiens
tatttcactgaatttcaaacatt

SEQ ID NO: 3038422 - DNA, 13 bp, Homo sapiens
tatttcagatgta

SEQ ID NO: 3038423 - DNA, 19 bp, Homo sapiens
tatttcagatgtaatgttt

SEQ ID NO: 3038424 - DNA, 21 bp, Homo sapiens
tatttcagatgtaatgttttc

SEQ ID NO: 3038425 - DNA, 15 bp, Homo sapiens
tatttcagcaacaac

SEQ ID NO: 3038426 - DNA, 15 bp, Homo sapiens
tatttcagccaatct

SEQ ID NO: 3038427 - DNA, 21 bp, Homo sapiens
tatttcagtacttcagcaaga

SEQ ID NO: 3038428 - DNA, 23 bp, Homo sapiens
tatttccagaaggatttcttgta

SEQ ID NO: 3038429 - DNA, 18 bp, Homo sapiens
tatttccattcaacaaga

SEQ ID NO: 3038430 - DNA, 18 bp, Homo sapiens
tatttcctgaaataaatg

SEQ ID NO: 3038431 - DNA, 15 bp, Homo sapiens
tatttcctgacttga

SEQ ID NO: 3038432 - DNA, 18 bp, Homo sapiens
tatttcctggatgtttgg

SEQ ID NO: 3038433 - DNA, 19 bp, Homo sapiens
tatttctatatagacttgg

SEQ ID NO: 3038434 - DNA, 18 bp, Homo sapiens
tatttctatttcctggaa

SEQ ID NO: 3038435 - DNA, 13 bp, Homo sapiens
tatttctctgtga

SEQ ID NO: 3038436 - DNA, 18 bp, Homo sapiens
tatttctgagcaaagcat

SEQ ID NO: 3038437 - DNA, 16 bp, Homo sapiens
tcacctaaccctctgt

SEQ ID NO: 3038438 - DNA, 20 bp, Homo sapiens
tcacctaaccctctgtcacc

SEQ ID NO: 3038439 - DNA, 17 bp, Homo sapiens
tcacctaagagattctg

SEQ ID NO: 3038440 - DNA, 23 bp, Homo sapiens
tcacctccccatcatccacgcca

SEQ ID NO: 3038441 - DNA, 13 bp, Homo sapiens
tcacctctgcctc

SEQ ID NO: 3038442 - DNA, 14 bp, Homo sapiens
tcacctgaacccca

SEQ ID NO: 3038443 - DNA, 18 bp, Homo sapiens
tcacctgaaccccagagg

SEQ ID NO: 3038444 - DNA, 23 bp, Homo sapiens
tcacctgaggtcaggagttcaag

SEQ ID NO: 3038445 - DNA, 12 bp, Homo sapiens
tcacctgattca

SEQ ID NO: 3038446 - DNA, 19 bp, Homo sapiens
tcacctgattcaactaaaa

SEQ ID NO: 3038447 - DNA, 14 bp, Homo sapiens
tcacctgcctgtta

SEQ ID NO: 3038448 - DNA, 21 bp, Homo sapiens
tcacctgctggggtcctttgt

SEQ ID NO: 3038449 - DNA, 23 bp, Homo sapiens
tcacctggcttgtttattttgtg

SEQ ID NO: 3038450 - DNA, 15 bp, Homo sapiens
tcacctggttgaccc

SEQ ID NO: 3038451 - DNA, 14 bp, Homo sapiens
tcacctgttgctta

SEQ ID NO: 3038452 - DNA, 20 bp, Homo sapiens
tcaccttaggcagggaagtg

SEQ ID NO: 3038453 - DNA, 22 bp, Homo sapiens
tcaccttcgtttactatgcctg

SEQ ID NO: 3038454 - DNA, 18 bp, Homo sapiens
tcaccttggcaccagaca

SEQ ID NO: 3038455 - DNA, 19 bp, Homo sapiens
tcaccttggcaccagacac

SEQ ID NO: 3038456 - DNA, 17 bp, Homo sapiens
tcaccttgtgtggcgca

SEQ ID NO: 3038457 - DNA, 18 bp, Homo sapiens
tcacctttctccactggg

SEQ ID NO: 3038458 - DNA, 16 bp, Homo sapiens
tcacgcacctcccatc

SEQ ID NO: 3038459 - DNA, 17 bp, Homo sapiens
tcacgcacctcccatcc

SEQ ID NO: 3038460 - DNA, 18 bp, Homo sapiens
tcacgccagacttcccac

SEQ ID NO: 3038461 - DNA, 23 bp, Homo sapiens
tcacgccattctcctgcctcagc

SEQ ID NO: 3038462 - DNA, 20 bp, Homo sapiens
tcacgccattgtactccagc

SEQ ID NO: 3038463 - DNA, 22 bp, Homo sapiens
tcacgccgggagaagccacctt

SEQ ID NO: 3038464 - DNA, 20 bp, Homo sapiens
tcacgcctgtaatcccagca

SEQ ID NO: 3038465 - DNA, 21 bp, Homo sapiens
tcacgcctgtaatcccagcag

SEQ ID NO: 3038466 - DNA, 14 bp, Homo sapiens
tcacgccttggcct

SEQ ID NO: 3038467 - DNA, 14 bp, Homo sapiens
tcacgcttcacagt

SEQ ID NO: 3038468 - DNA, 15 bp, Homo sapiens
tcacgcttcacagtg

SEQ ID NO: 3038469 - DNA, 13 bp, Homo sapiens
tcacggagacagc

SEQ ID NO: 3038470 - DNA, 17 bp, Homo sapiens
tcacgggactatttcca

SEQ ID NO: 3038471 - DNA, 17 bp, Homo sapiens
tcacgggcggtcctgca

SEQ ID NO: 3038472 - DNA, 14 bp, Homo sapiens
tcacgtgcaggaca

SEQ ID NO: 3038473 - DNA, 17 bp, Homo sapiens
tcacgtgcgctgggcac

SEQ ID NO: 3038474 - DNA, 23 bp, Homo sapiens
tcacgtgcgctgggcacttccct

SEQ ID NO: 3038475 - DNA, 16 bp, Homo sapiens
tcacgtgtactggctc

SEQ ID NO: 3038476 - DNA, 17 bp, Homo sapiens
tcacgtgtactggctcc

SEQ ID NO: 3038477 - DNA, 17 bp, Homo sapiens
tcacgtttcttccccaa

SEQ ID NO: 3038478 - DNA, 23 bp, Homo sapiens
tcactacctgccatgcatacatg

SEQ ID NO: 3038479 - DNA, 17 bp, Homo sapiens
tcactactcgagcccac

SEQ ID NO: 3038480 - DNA, 22 bp, Homo sapiens
tcactagagtgctctgaccctg

SEQ ID NO: 3038481 - DNA, 17 bp, Homo sapiens
tcactattcaaggatga

SEQ ID NO: 3038482 - DNA, 13 bp, Homo sapiens
tcactcacatagc

SEQ ID NO: 3038483 - DNA, 14 bp, Homo sapiens
tcactcagccccta

SEQ ID NO: 3038484 - DNA, 16 bp, Homo sapiens
tcactcagcccctacc

SEQ ID NO: 3038485 - DNA, 14 bp, Homo sapiens
tcactcaggctgga

SEQ ID NO: 3038486 - DNA, 17 bp, Homo sapiens
tcactcattgctgagcc

SEQ ID NO: 3038487 - DNA, 19 bp, Homo sapiens
tcactcattgctgagcctc

SEQ ID NO: 3038488 - DNA, 20 bp, Homo sapiens
tcactcattgctgagcctct

SEQ ID NO: 3038489 - DNA, 13 bp, Homo sapiens
tcactccaccacc

SEQ ID NO: 3038490 - DNA, 16 bp, Homo sapiens
tcactccaccacccaa

SEQ ID NO: 3038491 - DNA, 12 bp, Homo sapiens
tcactccctagg

SEQ ID NO: 3038492 - DNA, 14 bp, Homo sapiens
tcactcctggaggc

SEQ ID NO: 3038493 - DNA, 21 bp, Homo sapiens
tcactctaattggtcattcct

SEQ ID NO: 3038494 - DNA, 13 bp, Homo sapiens
tcactctgccctc

SEQ ID NO: 3038495 - DNA, 14 bp, Homo sapiens
tcactctgccctct

SEQ ID NO: 3038496 - DNA, 18 bp, Homo sapiens
tcactctgccctctgctg

SEQ ID NO: 3038497 - DNA, 13 bp, Homo sapiens
tcactcttcctca

SEQ ID NO: 3038498 - DNA, 13 bp, Homo sapiens
tcactcttggagc

SEQ ID NO: 3038499 - DNA, 17 bp, Homo sapiens
tcactcttggagcctgc

SEQ ID NO: 3038500 - DNA, 18 bp, Homo sapiens
tcactcttggagcctgca

SEQ ID NO: 3038501 - DNA, 15 bp, Homo sapiens
tcactctttctccct

SEQ ID NO: 3038502 - DNA, 12 bp, Homo sapiens
tcactctttttt

SEQ ID NO: 3038503 - DNA, 20 bp, Homo sapiens
tcactgaaaacatctggaag

SEQ ID NO: 3038504 - DNA, 12 bp, Homo sapiens
tcactgaaacaa

SEQ ID NO: 3038505 - DNA, 19 bp, Homo sapiens
tcactgaaacaaaaattgt

SEQ ID NO: 3038506 - DNA, 15 bp, Homo sapiens
tcactgaagcccaga

SEQ ID NO: 3038507 - DNA, 16 bp, Homo sapiens
tcactgacacatcagc

SEQ ID NO: 3038508 - DNA, 22 bp, Homo sapiens
tcactgacacatcagcatgttt

SEQ ID NO: 3038509 - DNA, 22 bp, Homo sapiens
tcactgagcatcactagtgaca

SEQ ID NO: 3038510 - DNA, 23 bp, Homo sapiens
tcactgaggcctgagacccagga

SEQ ID NO: 3038511 - DNA, 23 bp, Homo sapiens
tcactgagttttccatggcagga

SEQ ID NO: 3038512 - DNA, 18 bp, Homo sapiens
tcactgatgggaaaactg

SEQ ID NO: 3038513 - DNA, 18 bp, Homo sapiens
tcactgcaacctctgcct

SEQ ID NO: 3038514 - DNA, 17 bp, Homo sapiens
tcactgcaacttctgcc

SEQ ID NO: 3038515 - DNA, 18 bp, Homo sapiens
tcactgcaacttctgcct

SEQ ID NO: 3038516 - DNA, 16 bp, Homo sapiens
tcactgcattttgttt

SEQ ID NO: 3038517 - DNA, 23 bp, Homo sapiens
tcactgcattttgtttgaaactt

SEQ ID NO: 3038518 - DNA, 13 bp, Homo sapiens
tcactgccatata

SEQ ID NO: 3038519 - DNA, 18 bp, Homo sapiens
tcactgccatcaaactgt

SEQ ID NO: 3038520 - DNA, 16 bp, Homo sapiens
tcactgccgacatccc

SEQ ID NO: 3038521 - DNA, 11 bp, Homo sapiens
tcactgctgct

SEQ ID NO: 3038522 - DNA, 13 bp, Homo sapiens
tcactgctgctac

SEQ ID NO: 3038523 - DNA, 22 bp, Homo sapiens
tcactgctgctactgcccctct

SEQ ID NO: 3038524 - DNA, 12 bp, Homo sapiens
tcactgctgctc

SEQ ID NO: 3038525 - DNA, 15 bp, Homo sapiens
tcactgctgctcctc

SEQ ID NO: 3038526 - DNA, 20 bp, Homo sapiens
tcactggaaaggaaagatga

SEQ ID NO: 3038527 - DNA, 18 bp, Homo sapiens
tcactggagcaccaggca

SEQ ID NO: 3038528 - DNA, 15 bp, Homo sapiens
tcactggcagcctgc

SEQ ID NO: 3038529 - DNA, 15 bp, Homo sapiens
tcactggcgccttct

SEQ ID NO: 3038530 - DNA, 17 bp, Homo sapiens
tcactggcgccttctcg

SEQ ID NO: 3038531 - DNA, 16 bp, Homo sapiens
tcactggttttactta

SEQ ID NO: 3038532 - DNA, 11 bp, Homo sapiens
tcactgtcact

SEQ ID NO: 3038533 - DNA, 15 bp, Homo sapiens
tcactgtcactgccg

SEQ ID NO: 3038534 - DNA, 17 bp, Homo sapiens
tcactgtccctcctggt

SEQ ID NO: 3038535 - DNA, 13 bp, Homo sapiens
tcactgtctttta

SEQ ID NO: 3038536 - DNA, 22 bp, Homo sapiens
tcactgtcttttaaaaaacaaa

SEQ ID NO: 3038537 - DNA, 16 bp, Homo sapiens
tcactgtgagctccca

SEQ ID NO: 3038538 - DNA, 12 bp, Homo sapiens
tcactgtgctcc

SEQ ID NO: 3038539 - DNA, 21 bp, Homo sapiens
tcactgtgggaaggccagctg

SEQ ID NO: 3038540 - DNA, 22 bp, Homo sapiens
tcactgtggtaaatgccacaca

SEQ ID NO: 3038541 - DNA, 17 bp, Homo sapiens
tcactgtgtcacccagg

SEQ ID NO: 3038542 - DNA, 22 bp, Homo sapiens
tcactgttgcagtggcctggcc

SEQ ID NO: 3038543 - DNA, 20 bp, Homo sapiens
tcactgttggggagaagaaa

SEQ ID NO: 3038544 - DNA, 14 bp, Homo sapiens
tcactgtttttaga

SEQ ID NO: 3038545 - DNA, 21 bp, Homo sapiens
tcactgtttttagacaccttc

SEQ ID NO: 3038546 - DNA, 19 bp, Homo sapiens
tcacttcccgagcgctggt

SEQ ID NO: 3038547 - DNA, 19 bp, Homo sapiens
tcacttcctccagaagcct

SEQ ID NO: 3038548 - DNA, 15 bp, Homo sapiens
tcacttcctgtttta

SEQ ID NO: 3038549 - DNA, 15 bp, Homo sapiens
tcacttcgaaattct

SEQ ID NO: 3038550 - DNA, 20 bp, Homo sapiens
tcacttcgaaattctgagtt

SEQ ID NO: 3038551 - DNA, 18 bp, Homo sapiens
tcacttcggccagagctg

SEQ ID NO: 3038552 - DNA, 20 bp, Homo sapiens
tcacttctagggtatgggaa

SEQ ID NO: 3038553 - DNA, 18 bp, Homo sapiens
tcacttctttgcagagcc

SEQ ID NO: 3038554 - DNA, 23 bp, Homo sapiens
tcacttgaaagattttattgtat

SEQ ID NO: 3038555 - DNA, 18 bp, Homo sapiens
tcacttgatgtttcctgg

SEQ ID NO: 3038556 - DNA, 15 bp, Homo sapiens
tcacttgattcataa

SEQ ID NO: 3038557 - DNA, 16 bp, Homo sapiens
tcacttgattcataaa

SEQ ID NO: 3038558 - DNA, 13 bp, Homo sapiens
tcacttgcatgtc

SEQ ID NO: 3038559 - DNA, 15 bp, Homo sapiens
tcacttgctctttga

SEQ ID NO: 3038560 - DNA, 21 bp, Homo sapiens
tcacttggtctgccaggcccc

SEQ ID NO: 3038561 - DNA, 13 bp, Homo sapiens
tcactttaaacct

SEQ ID NO: 3038562 - DNA, 21 bp, Homo sapiens
tcacttttaatgaacaaatgg

SEQ ID NO: 3038563 - DNA, 13 bp, Homo sapiens
tcacttttcactt

SEQ ID NO: 3038564 - DNA, 15 bp, Homo sapiens
tcacttttcacttgt

SEQ ID NO: 3038565 - DNA, 13 bp, Homo sapiens
tcacttttgcaag

SEQ ID NO: 3038566 - DNA, 15 bp, Homo sapiens
tcactttttttttcc

SEQ ID NO: 3038567 - DNA, 21 bp, Homo sapiens
tcactttttttttccaaaaaa

SEQ ID NO: 3038568 - DNA, 17 bp, Homo sapiens
tcagaaaaaaataaatg

SEQ ID NO: 3038569 - DNA, 17 bp, Homo sapiens
tcagaaaaatggagcaa

SEQ ID NO: 3038570 - DNA, 16 bp, Homo sapiens
tcatctctgcctttga

SEQ ID NO: 3038571 - DNA, 19 bp, Homo sapiens
tcatctctttgtcctgaat

SEQ ID NO: 3038572 - DNA, 20 bp, Homo sapiens
tcatctctttgtcctgaatg

SEQ ID NO: 3038573 - DNA, 13 bp, Homo sapiens
tcatctgaagggg

SEQ ID NO: 3038574 - DNA, 22 bp, Homo sapiens
tcatctgaatttgccctgggaa

SEQ ID NO: 3038575 - DNA, 12 bp, Homo sapiens
tcatctggctgc

SEQ ID NO: 3038576 - DNA, 16 bp, Homo sapiens
tcatctggggacctgg

SEQ ID NO: 3038577 - DNA, 18 bp, Homo sapiens
tcatctggggacctggtt

SEQ ID NO: 3038578 - DNA, 12 bp, Homo sapiens
tcatctgtgcac

SEQ ID NO: 3038579 - DNA, 17 bp, Homo sapiens
tcatctgtgcctgtctg

SEQ ID NO: 3038580 - DNA, 18 bp, Homo sapiens
tcatctgtgcctgtctgt

SEQ ID NO: 3038581 - DNA, 19 bp, Homo sapiens
tcatcttcaccagaggaat

SEQ ID NO: 3038582 - DNA, 11 bp, Homo sapiens
tcatcttccct

SEQ ID NO: 3038583 - DNA, 21 bp, Homo sapiens
tcatcttccctgcccctgtgc

SEQ ID NO: 3038584 - DNA, 13 bp, Homo sapiens
tcatcttctctgg

SEQ ID NO: 3038585 - DNA, 19 bp, Homo sapiens
tcatcttgaccaagcagga

SEQ ID NO: 3038586 - DNA, 22 bp, Homo sapiens
tcatcttgaccaagcaggaagc

SEQ ID NO: 3038587 - DNA, 23 bp, Homo sapiens
tcatcttgaccaagcaggaagct

SEQ ID NO: 3038588 - DNA, 22 bp, Homo sapiens
tcatcttgatgtctatgataga

SEQ ID NO: 3038589 - DNA, 20 bp, Homo sapiens
tcatctttatcctaaaaatc

SEQ ID NO: 3038590 - DNA, 23 bp, Homo sapiens
tcatcttttaatcatgagcctgt

SEQ ID NO: 3038591 - DNA, 20 bp, Homo sapiens
tcatgaactggcttgtacat

SEQ ID NO: 3038592 - DNA, 15 bp, Homo sapiens
tcatgaacttcgcat

SEQ ID NO: 3038593 - DNA, 18 bp, Homo sapiens
tcatgaacttcgcatcaa

SEQ ID NO: 3038594 - DNA, 22 bp, Homo sapiens
tcatgaacttcgcatcaaaaga

SEQ ID NO: 3038595 - DNA, 14 bp, Homo sapiens
tcatgaagccttgc

SEQ ID NO: 3038596 - DNA, 11 bp, Homo sapiens
tcatgaagtga

SEQ ID NO: 3038597 - DNA, 21 bp, Homo sapiens
tcatgaattcatactctgttg

SEQ ID NO: 3038598 - DNA, 19 bp, Homo sapiens
tcatgaattcccttttaat

SEQ ID NO: 3038599 - DNA, 22 bp, Homo sapiens
tcatgaatttattgcacattgt

SEQ ID NO: 3038600 - DNA, 23 bp, Homo sapiens
tcatgaatttattgcacattgtt

SEQ ID NO: 3038601 - DNA, 18 bp, Homo sapiens
tcatgacaagatgggaca

SEQ ID NO: 3038602 - DNA, 22 bp, Homo sapiens
tcatgacaagatgggacagcaa

SEQ ID NO: 3038603 - DNA, 15 bp, Homo sapiens
tcatgagcctgttta

SEQ ID NO: 3038604 - DNA, 18 bp, Homo sapiens
tcatgagcctgtttattg

SEQ ID NO: 3038605 - DNA, 20 bp, Homo sapiens
tcatgagcctgtttattgcc

SEQ ID NO: 3038606 - DNA, 21 bp, Homo sapiens
tcatgagcctgtttattgcca

SEQ ID NO: 3038607 - DNA, 19 bp, Homo sapiens
tcatgaggaccagggtgga

SEQ ID NO: 3038608 - DNA, 23 bp, Homo sapiens
tcatgatccacccacctcagcct

SEQ ID NO: 3038609 - DNA, 19 bp, Homo sapiens
tcatgatctccctgccgcc

SEQ ID NO: 3038610 - DNA, 20 bp, Homo sapiens
tcatgcaaatgctgtattct

SEQ ID NO: 3038611 - DNA, 13 bp, Homo sapiens
tcatgccctcctc

SEQ ID NO: 3038612 - DNA, 15 bp, Homo sapiens
tcatgccctgtgcaa

SEQ ID NO: 3038613 - DNA, 13 bp, Homo sapiens
tcatgcctctgag

SEQ ID NO: 3038614 - DNA, 21 bp, Homo sapiens
tcatgcctgatgaaagctttg

SEQ ID NO: 3038615 - DNA, 15 bp, Homo sapiens
tcatgctaaaattct

SEQ ID NO: 3038616 - DNA, 18 bp, Homo sapiens
tcatgctacccagccatt

SEQ ID NO: 3038617 - DNA, 22 bp, Homo sapiens
tcatgctggaacctgcaaaaaa

SEQ ID NO: 3038618 - DNA, 13 bp, Homo sapiens
tcatggacattca

SEQ ID NO: 3038619 - DNA, 23 bp, Homo sapiens
tcatggatgggggaactcagatc

SEQ ID NO: 3038620 - DNA, 14 bp, Homo sapiens
tcatggatttggtt

SEQ ID NO: 3038621 - DNA, 18 bp, Homo sapiens
tcatggccacactgtgac

SEQ ID NO: 3038622 - DNA, 21 bp, Homo sapiens
tcatggccacactgtgacaca

SEQ ID NO: 3038623 - DNA, 22 bp, Homo sapiens
tcatgggaacgcagcctccagt

SEQ ID NO: 3038624 - DNA, 13 bp, Homo sapiens
tcatgtaaactgt

SEQ ID NO: 3038625 - DNA, 16 bp, Homo sapiens
tcatgtaaactgtgca

SEQ ID NO: 3038626 - DNA, 13 bp, Homo sapiens
tcatgtaaatgct

SEQ ID NO: 3038627 - DNA, 19 bp, Homo sapiens
tcatgtacatttggaacta

SEQ ID NO: 3038628 - DNA, 13 bp, Homo sapiens
tcatgtacttttt

SEQ ID NO: 3038629 - DNA, 17 bp, Homo sapiens
tcatgtagtatcaaata

SEQ ID NO: 3038630 - DNA, 13 bp, Homo sapiens
tcatgtcatttct

SEQ ID NO: 3038631 - DNA, 16 bp, Homo sapiens
tcatgtcatttctcat

SEQ ID NO: 3038632 - DNA, 14 bp, Homo sapiens
tcatgtctttccac

SEQ ID NO: 3038633 - DNA, 18 bp, Homo sapiens
tcatgtctttccacttct

SEQ ID NO: 3038634 - DNA, 15 bp, Homo sapiens
tcatgtgaaatgttt

SEQ ID NO: 3038635 - DNA, 18 bp, Homo sapiens
tcatgtggaatataaaga

SEQ ID NO: 3038636 - DNA, 18 bp, Homo sapiens
tcatgtgtaatcaataaa

SEQ ID NO: 3038637 - DNA, 19 bp, Homo sapiens
tcatgtgtaatcaataaac

SEQ ID NO: 3038638 - DNA, 21 bp, Homo sapiens
tcatgtgtaatcaataaacga

SEQ ID NO: 3038639 - DNA, 13 bp, Homo sapiens
tcatgtgtatgag

SEQ ID NO: 3038640 - DNA, 16 bp, Homo sapiens
tcatgtgtgtccacga

SEQ ID NO: 3038641 - DNA, 17 bp, Homo sapiens
tcatgttgaccaggctg

SEQ ID NO: 3038642 - DNA, 20 bp, Homo sapiens
tcatgttgaccaggctggtc

SEQ ID NO: 3038643 - DNA, 15 bp, Homo sapiens
tcatgtttataacta

SEQ ID NO: 3038644 - DNA, 22 bp, Homo sapiens
tcatgttttaaaagtttgtcct

SEQ ID NO: 3038645 - DNA, 23 bp, Homo sapiens
tcatgttttaaaagtttgtcctt

SEQ ID NO: 3038646 - DNA, 13 bp, Homo sapiens
tcatgttttaaca

SEQ ID NO: 3038647 - DNA, 15 bp, Homo sapiens
tcatgttttaacaaa

SEQ ID NO: 3038648 - DNA, 16 bp, Homo sapiens
tcatgttttttctgca

SEQ ID NO: 3038649 - DNA, 23 bp, Homo sapiens
tcatgttttttctgcaatgactg

SEQ ID NO: 3038650 - DNA, 18 bp, Homo sapiens
tcattaaaaacatagaaa

SEQ ID NO: 3038651 - DNA, 14 bp, Homo sapiens
tcattaaagttcta

SEQ ID NO: 3038652 - DNA, 21 bp, Homo sapiens
tcattaaatattctgtacatt

SEQ ID NO: 3038653 - DNA, 23 bp, Homo sapiens
tcattaaatggtgatttcttgct

SEQ ID NO: 3038654 - DNA, 13 bp, Homo sapiens
tcattaaatgttt

SEQ ID NO: 3038655 - DNA, 13 bp, Homo sapiens
tcattaatgacac

SEQ ID NO: 3038656 - DNA, 15 bp, Homo sapiens
tcattaatgacactt

SEQ ID NO: 3038657 - DNA, 19 bp, Homo sapiens
tcattaatgacacttgtcc

SEQ ID NO: 3038658 - DNA, 21 bp, Homo sapiens
tcattaatgacacttgtcccc

SEQ ID NO: 3038659 - DNA, 13 bp, Homo sapiens
tcattaattctat

SEQ ID NO: 3038660 - DNA, 14 bp, Homo sapiens
tcattaattctata

SEQ ID NO: 3038661 - DNA, 12 bp, Homo sapiens
tcattactaacc

SEQ ID NO: 3038662 - DNA, 12 bp, Homo sapiens
tcattactataa

SEQ ID NO: 3038663 - DNA, 16 bp, Homo sapiens
tcattatcaaaagtga

SEQ ID NO: 3038664 - DNA, 17 bp, Homo sapiens
tcattatcaaaagtgat

SEQ ID NO: 3038665 - DNA, 19 bp, Homo sapiens
tcattcagcagcaaatttt

SEQ ID NO: 3038666 - DNA, 21 bp, Homo sapiens
tcattcagcagcaaattttca

SEQ ID NO: 3038667 - DNA, 23 bp, Homo sapiens
tcattcagcagcaaattttcagc

SEQ ID NO: 3038668 - DNA, 12 bp, Homo sapiens
tcattcaggaaa

SEQ ID NO: 3038669 - DNA, 22 bp, Homo sapiens
tcattcattttatattgaaaaa

SEQ ID NO: 3038670 - DNA, 14 bp, Homo sapiens
tcattcattttgtg

SEQ ID NO: 3038671 - DNA, 16 bp, Homo sapiens
tcattccacactgttg

SEQ ID NO: 3038672 - DNA, 11 bp, Homo sapiens
tcattccacag

SEQ ID NO: 3038673 - DNA, 20 bp, Homo sapiens
tcattccacaggacgaatgc

SEQ ID NO: 3038674 - DNA, 18 bp, Homo sapiens
tcattccctctcatctca

SEQ ID NO: 3038675 - DNA, 17 bp, Homo sapiens
tcattcctaatgcatta

SEQ ID NO: 3038676 - DNA, 14 bp, Homo sapiens
tcattctctgtctc

SEQ ID NO: 3038677 - DNA, 18 bp, Homo sapiens
tcattctgaaggagcccc

SEQ ID NO: 3038678 - DNA, 14 bp, Homo sapiens
tcattgagagtttt

SEQ ID NO: 3038679 - DNA, 18 bp, Homo sapiens
tcattgagagttttgtct

SEQ ID NO: 3038680 - DNA, 19 bp, Homo sapiens
tcattgagagttttgtctt

SEQ ID NO: 3038681 - DNA, 18 bp, Homo sapiens
tcattgatttcctgtgtc

SEQ ID NO: 3038682 - DNA, 19 bp, Homo sapiens
tcattgatttcctgtgtca

SEQ ID NO: 3038683 - DNA, 21 bp, Homo sapiens
tcattgcacctatctcagcca

SEQ ID NO: 3038684 - DNA, 20 bp, Homo sapiens
tcattgccctcaggaaagtt

SEQ ID NO: 3038685 - DNA, 18 bp, Homo sapiens
tcattggaaacactgcct

SEQ ID NO: 3038686 - DNA, 24 bp, Homo sapiens
tcattgtaacactgtttattgaaa

SEQ ID NO: 3038687 - DNA, 20 bp, Homo sapiens
tcattgttggagtgtaaacc

SEQ ID NO: 3038688 - DNA, 15 bp, Homo sapiens
tcattgttttgcaaa

SEQ ID NO: 3038689 - DNA, 12 bp, Homo sapiens
tcatttacacac

SEQ ID NO: 3038690 - DNA, 15 bp, Homo sapiens
tcatttactcaccat

SEQ ID NO: 3038691 - DNA, 21 bp, Homo sapiens
tcatttactcaccatatttga

SEQ ID NO: 3038692 - DNA, 23 bp, Homo sapiens
tcatttactcaccatatttgaat

SEQ ID NO: 3038693 - DNA, 20 bp, Homo sapiens
tcatttactgatcatctgct

SEQ ID NO: 3038694 - DNA, 19 bp, Homo sapiens
tcatttagattgaaaactt

SEQ ID NO: 3038695 - DNA, 22 bp, Homo sapiens
tcatttataaagctaaaataac

SEQ ID NO: 3038696 - DNA, 19 bp, Homo sapiens
tcatttatatcgctggcca

SEQ ID NO: 3038697 - DNA, 18 bp, Homo sapiens
tcatttattgtttatgta

SEQ ID NO: 3038698 - DNA, 22 bp, Homo sapiens
tcatttattgtttatgtaaatg

SEQ ID NO: 3038699 - DNA, 19 bp, Homo sapiens
tcatttatttttagccatt

SEQ ID NO: 3038700 - DNA, 13 bp, Homo sapiens
tcatttcagccaa

SEQ ID NO: 3038701 - DNA, 15 bp, Homo sapiens
tcatttcagccaaag

SEQ ID NO: 3038702 - DNA, 13 bp, Homo sapiens
tccccggggccca

SEQ ID NO: 3038703 - DNA, 15 bp, Homo sapiens
tccccgtctcattcc

SEQ ID NO: 3038704 - DNA, 20 bp, Homo sapiens
tcccctaagcagaccactga

SEQ ID NO: 3038705 - DNA, 20 bp, Homo sapiens
tcccctaccaggctgtaaat

SEQ ID NO: 3038706 - DNA, 17 bp, Homo sapiens
tcccctactctgcccct

SEQ ID NO: 3038707 - DNA, 16 bp, Homo sapiens
tcccctatccacccag

SEQ ID NO: 3038708 - DNA, 18 bp, Homo sapiens
tcccctatccacccagcc

SEQ ID NO: 3038709 - DNA, 21 bp, Homo sapiens
tcccctatggaatttataatt

SEQ ID NO: 3038710 - DNA, 17 bp, Homo sapiens
tcccctcacagactctt

SEQ ID NO: 3038711 - DNA, 22 bp, Homo sapiens
tcccctcacagactcttccacc

SEQ ID NO: 3038712 - DNA, 14 bp, Homo sapiens
tcccctcagagccc

SEQ ID NO: 3038713 - DNA, 22 bp, Homo sapiens
tcccctcattgcatttattgca

SEQ ID NO: 3038714 - DNA, 12 bp, Homo sapiens
tcccctccccat

SEQ ID NO: 3038715 - DNA, 14 bp, Homo sapiens
tcccctccccatct

SEQ ID NO: 3038716 - DNA, 19 bp, Homo sapiens
tcccctccccatctgtgtt

SEQ ID NO: 3038717 - DNA, 22 bp, Homo sapiens
tcccctccccatctgtgttcta

SEQ ID NO: 3038718 - DNA, 21 bp, Homo sapiens
tcccctcccccacccctgctg

SEQ ID NO: 3038719 - DNA, 15 bp, Homo sapiens
tcccctcctttgtct

SEQ ID NO: 3038720 - DNA, 19 bp, Homo sapiens
tcccctcgcccatcagtgc

SEQ ID NO: 3038721 - DNA, 21 bp, Homo sapiens
tcccctctgaaagttgtacat

SEQ ID NO: 3038722 - DNA, 22 bp, Homo sapiens
tcccctgccaccgactgcccag

SEQ ID NO: 3038723 - DNA, 20 bp, Homo sapiens
tcccctgccagggcagggcc

SEQ ID NO: 3038724 - DNA, 13 bp, Homo sapiens
tcccctgccgcct

SEQ ID NO: 3038725 - DNA, 19 bp, Homo sapiens
tcccctgccgcctcccggg

SEQ ID NO: 3038726 - DNA, 11 bp, Homo sapiens
tcccctggcag

SEQ ID NO: 3038727 - DNA, 15 bp, Homo sapiens
tcccctggcagtgct

SEQ ID NO: 3038728 - DNA, 13 bp, Homo sapiens
tcccctggggctg

SEQ ID NO: 3038729 - DNA, 14 bp, Homo sapiens
tcccctggggctgg

SEQ ID NO: 3038730 - DNA, 19 bp, Homo sapiens
tcccctgtcccctggggct

SEQ ID NO: 3038731 - DNA, 21 bp, Homo sapiens
tcccctgtcccctggggctgg

SEQ ID NO: 3038732 - DNA, 19 bp, Homo sapiens
tccccttaattaggatgca

SEQ ID NO: 3038733 - DNA, 17 bp, Homo sapiens
tccccttccactgaggg

SEQ ID NO: 3038734 - DNA, 13 bp, Homo sapiens
tccccttctctgt

SEQ ID NO: 3038735 - DNA, 15 bp, Homo sapiens
tccccttcttgtgtc

SEQ ID NO: 3038736 - DNA, 18 bp, Homo sapiens
tccccttgaactcttcac

SEQ ID NO: 3038737 - DNA, 20 bp, Homo sapiens
tccccttgtctgaactggag

SEQ ID NO: 3038738 - DNA, 19 bp, Homo sapiens
tccccttttctatgttgct

SEQ ID NO: 3038739 - DNA, 22 bp, Homo sapiens
tcccgagcttagattctgtatg

SEQ ID NO: 3038740 - DNA, 15 bp, Homo sapiens
tcccgaggaggggcc

SEQ ID NO: 3038741 - DNA, 18 bp, Homo sapiens
tcccgcctcagcctctca

SEQ ID NO: 3038742 - DNA, 16 bp, Homo sapiens
tcccgggaagcatcct

SEQ ID NO: 3038743 - DNA, 20 bp, Homo sapiens
tcccgggaagcatcctcccc

SEQ ID NO: 3038744 - DNA, 15 bp, Homo sapiens
tcccgggacgcagca

SEQ ID NO: 3038745 - DNA, 22 bp, Homo sapiens
tcccgggttcacgccattctcc

SEQ ID NO: 3038746 - DNA, 15 bp, Homo sapiens
tcccgtctcgcctgc

SEQ ID NO: 3038747 - DNA, 16 bp, Homo sapiens
tcccgtggatgctctt

SEQ ID NO: 3038748 - DNA, 17 bp, Homo sapiens
tcccgttttccccatga

SEQ ID NO: 3038749 - DNA, 18 bp, Homo sapiens
tccctaaaaacacagaca

SEQ ID NO: 3038750 - DNA, 14 bp, Homo sapiens
tccctaaatttgca

SEQ ID NO: 3038751 - DNA, 13 bp, Homo sapiens
tccctacactgat

SEQ ID NO: 3038752 - DNA, 16 bp, Homo sapiens
tccctacactgatgca

SEQ ID NO: 3038753 - DNA, 18 bp, Homo sapiens
tccctaccacctccccag

SEQ ID NO: 3038754 - DNA, 19 bp, Homo sapiens
tccctacctaagaatttca

SEQ ID NO: 3038755 - DNA, 16 bp, Homo sapiens
tccctaccttgcctcc

SEQ ID NO: 3038756 - DNA, 13 bp, Homo sapiens
tccctagacttta

SEQ ID NO: 3038757 - DNA, 11 bp, Homo sapiens
tccctagccca

SEQ ID NO: 3038758 - DNA, 13 bp, Homo sapiens
tccctaggcccaa

SEQ ID NO: 3038759 - DNA, 16 bp, Homo sapiens
tccctagtaaaaatac

SEQ ID NO: 3038760 - DNA, 17 bp, Homo sapiens
tccctagttagcatcca

SEQ ID NO: 3038761 - DNA, 22 bp, Homo sapiens
tccctagttagcatccaggctg

SEQ ID NO: 3038762 - DNA, 15 bp, Homo sapiens
tccctatactgcttg

SEQ ID NO: 3038763 - DNA, 22 bp, Homo sapiens
tccctatatgcacccctggaac

SEQ ID NO: 3038764 - DNA, 15 bp, Homo sapiens
tccctatgaaagatt

SEQ ID NO: 3038765 - DNA, 13 bp, Homo sapiens
tccctatgtattt

SEQ ID NO: 3038766 - DNA, 18 bp, Homo sapiens
tccctatgtatttgcagt

SEQ ID NO: 3038767 - DNA, 14 bp, Homo sapiens
tccctccactcctc

SEQ ID NO: 3038768 - DNA, 23 bp, Homo sapiens
tccctcccacactcgccatctcc

SEQ ID NO: 3038769 - DNA, 14 bp, Homo sapiens
tccctcccatcctc

SEQ ID NO: 3038770 - DNA, 15 bp, Homo sapiens
tccctccccacccaa

SEQ ID NO: 3038771 - DNA, 14 bp, Homo sapiens
tccctcccccccat

SEQ ID NO: 3038772 - DNA, 14 bp, Homo sapiens
tccctccctctgcc

SEQ ID NO: 3038773 - DNA, 15 bp, Homo sapiens
tccctccgactccag

SEQ ID NO: 3038774 - DNA, 19 bp, Homo sapiens
tccctccggcttgacctgt

SEQ ID NO: 3038775 - DNA, 13 bp, Homo sapiens
tccctcctcacac

SEQ ID NO: 3038776 - DNA, 17 bp, Homo sapiens
tccctcgtcttcagctg

SEQ ID NO: 3038777 - DNA, 22 bp, Homo sapiens
tccctctactaaggctttccta

SEQ ID NO: 3038778 - DNA, 15 bp, Homo sapiens
tccctctactgggag

SEQ ID NO: 3038779 - DNA, 18 bp, Homo sapiens
tccctctaggctctgcct

SEQ ID NO: 3038780 - DNA, 13 bp, Homo sapiens
tccctctatttat

SEQ ID NO: 3038781 - DNA, 16 bp, Homo sapiens
tccctctcaggatcca

SEQ ID NO: 3038782 - DNA, 15 bp, Homo sapiens
tccctctcagtgcct

SEQ ID NO: 3038783 - DNA, 17 bp, Homo sapiens
tccctctcagtgccttc

SEQ ID NO: 3038784 - DNA, 18 bp, Homo sapiens
tccctctcagtgccttct

SEQ ID NO: 3038785 - DNA, 22 bp, Homo sapiens
tccctctcagtgccttctctca

SEQ ID NO: 3038786 - DNA, 14 bp, Homo sapiens
tccctctcctgcct

SEQ ID NO: 3038787 - DNA, 15 bp, Homo sapiens
tccctctcctgccta

SEQ ID NO: 3038788 - DNA, 17 bp, Homo sapiens
tccctctctcctggact

SEQ ID NO: 3038789 - DNA, 22 bp, Homo sapiens
tccctctcttccgggagctggt

SEQ ID NO: 3038790 - DNA, 13 bp, Homo sapiens
tccctctgccggc

SEQ ID NO: 3038791 - DNA, 15 bp, Homo sapiens
tccctctgcctcatc

SEQ ID NO: 3038792 - DNA, 14 bp, Homo sapiens
tccctcttctgccc

SEQ ID NO: 3038793 - DNA, 16 bp, Homo sapiens
tccctcttgacattca

SEQ ID NO: 3038794 - DNA, 16 bp, Homo sapiens
tccctcttgtgctcag

SEQ ID NO: 3038795 - DNA, 15 bp, Homo sapiens
tccctctttctagcc

SEQ ID NO: 3038796 - DNA, 16 bp, Homo sapiens
tccctctttctagcct

SEQ ID NO: 3038797 - DNA, 18 bp, Homo sapiens
tccctgaaaacccagaga

SEQ ID NO: 3038798 - DNA, 19 bp, Homo sapiens
tccctgaaacactgcttct

SEQ ID NO: 3038799 - DNA, 16 bp, Homo sapiens
tccctgaagtcttgca

SEQ ID NO: 3038800 - DNA, 16 bp, Homo sapiens
tccctgaccctgtata

SEQ ID NO: 3038801 - DNA, 14 bp, Homo sapiens
tccctgacttgctt

SEQ ID NO: 3038802 - DNA, 15 bp, Homo sapiens
tccctgacttgcttt

SEQ ID NO: 3038803 - DNA, 20 bp, Homo sapiens
tccctgagcagtctacttct

SEQ ID NO: 3038804 - DNA, 15 bp, Homo sapiens
tccctgagtcaccag

SEQ ID NO: 3038805 - DNA, 17 bp, Homo sapiens
tccctgagtcaccagga

SEQ ID NO: 3038806 - DNA, 19 bp, Homo sapiens
tccctgcactccctcctgg

SEQ ID NO: 3038807 - DNA, 15 bp, Homo sapiens
tccctgcactgtgcc

SEQ ID NO: 3038808 - DNA, 21 bp, Homo sapiens
tccctgcatctgaccagcagc

SEQ ID NO: 3038809 - DNA, 15 bp, Homo sapiens
tccctgccatccccc

SEQ ID NO: 3038810 - DNA, 21 bp, Homo sapiens
tccctgcccctgtgcctctgt

SEQ ID NO: 3038811 - DNA, 17 bp, Homo sapiens
tccctgcctcacatctc

SEQ ID NO: 3038812 - DNA, 19 bp, Homo sapiens
tccctgcctcacatctccc

SEQ ID NO: 3038813 - DNA, 22 bp, Homo sapiens
tccctgcctcagtggctctggg

SEQ ID NO: 3038814 - DNA, 19 bp, Homo sapiens
tccctgcctccacccacag

SEQ ID NO: 3038815 - DNA, 20 bp, Homo sapiens
tccctgcctccacccacagt

SEQ ID NO: 3038816 - DNA, 12 bp, Homo sapiens
tccctgccttca

SEQ ID NO: 3038817 - DNA, 19 bp, Homo sapiens
tccctgccttcactgtgct

SEQ ID NO: 3038818 - DNA, 14 bp, Homo sapiens
tccctgctggggtc

SEQ ID NO: 3038819 - DNA, 12 bp, Homo sapiens
tccctgcttatc

SEQ ID NO: 3038820 - DNA, 21 bp, Homo sapiens
tccctgcttatgatgggctcc

SEQ ID NO: 3038821 - DNA, 14 bp, Homo sapiens
tccctgcttctggc

SEQ ID NO: 3038822 - DNA, 21 bp, Homo sapiens
tccctggcaagactgtcttac

SEQ ID NO: 3038823 - DNA, 11 bp, Homo sapiens
tccctggcttg

SEQ ID NO: 3038824 - DNA, 19 bp, Homo sapiens
tccctggcttgtaactcca

SEQ ID NO: 3038825 - DNA, 22 bp, Homo sapiens
tccctggcttgtaactccacca

SEQ ID NO: 3038826 - DNA, 17 bp, Homo sapiens
tccctgggagcaagttg

SEQ ID NO: 3038827 - DNA, 13 bp, Homo sapiens
tccctgggcctca

SEQ ID NO: 3038828 - DNA, 13 bp, Homo sapiens
tccctggggcact

SEQ ID NO: 3038829 - DNA, 14 bp, Homo sapiens
tccctggggcactc

SEQ ID NO: 3038830 - DNA, 22 bp, Homo sapiens
tccctggggcactcccccagga

SEQ ID NO: 3038831 - DNA, 18 bp, Homo sapiens
tccctgggggaagccctg

SEQ ID NO: 3038832 - DNA, 21 bp, Homo sapiens
tccctgggggaagccctggat

SEQ ID NO: 3038833 - DNA, 11 bp, Homo sapiens
tccctggtcct

SEQ ID NO: 3038834 - DNA, 17 bp, Homo sapiens
tccctggtccttcactg

SEQ ID NO: 3038835 - DNA, 16 bp, Homo sapiens
tcctatggacaactta

SEQ ID NO: 3038836 - DNA, 18 bp, Homo sapiens
tcctatggacaacttatt

SEQ ID NO: 3038837 - DNA, 19 bp, Homo sapiens
tcctatggacaacttattt

SEQ ID NO: 3038838 - DNA, 21 bp, Homo sapiens
tcctatggacaacttatttaa

SEQ ID NO: 3038839 - DNA, 19 bp, Homo sapiens
tcctatgtttttgttcaaa

SEQ ID NO: 3038840 - DNA, 16 bp, Homo sapiens
tcctattacttttcat

SEQ ID NO: 3038841 - DNA, 17 bp, Homo sapiens
tcctattcaaattccta

SEQ ID NO: 3038842 - DNA, 16 bp, Homo sapiens
tcctatttcagtactt

SEQ ID NO: 3038843 - DNA, 21 bp, Homo sapiens
tcctatttcagtacttcagca

SEQ ID NO: 3038844 - DNA, 19 bp, Homo sapiens
tcctatttctggaatggaa

SEQ ID NO: 3038845 - DNA, 14 bp, Homo sapiens
tcctatttttgtga

SEQ ID NO: 3038846 - DNA, 16 bp, Homo sapiens
tcctcaagaagaaagt

SEQ ID NO: 3038847 - DNA, 20 bp, Homo sapiens
tcctcaagaagaaagtgttc

SEQ ID NO: 3038848 - DNA, 13 bp, Homo sapiens
tcctcaatccagc

SEQ ID NO: 3038849 - DNA, 15 bp, Homo sapiens
tcctcacataaaaaa

SEQ ID NO: 3038850 - DNA, 22 bp, Homo sapiens
tcctcacgtgcaggacagctct

SEQ ID NO: 3038851 - DNA, 13 bp, Homo sapiens
tcctcagatgctc

SEQ ID NO: 3038852 - DNA, 14 bp, Homo sapiens
tcctcagctttgct

SEQ ID NO: 3038853 - DNA, 18 bp, Homo sapiens
tcctcagctttgcttcat

SEQ ID NO: 3038854 - DNA, 15 bp, Homo sapiens
tcctcaggcacacag

SEQ ID NO: 3038855 - DNA, 18 bp, Homo sapiens
tcctcagggacagagaca

SEQ ID NO: 3038856 - DNA, 22 bp, Homo sapiens
tcctcagggacagagacacctg

SEQ ID NO: 3038857 - DNA, 12 bp, Homo sapiens
tcctcagggcag

SEQ ID NO: 3038858 - DNA, 13 bp, Homo sapiens
tcctcaggtggcc

SEQ ID NO: 3038859 - DNA, 22 bp, Homo sapiens
tcctcaggtggccatgcctcag

SEQ ID NO: 3038860 - DNA, 19 bp, Homo sapiens
tcctcagtgcatttgtgct

SEQ ID NO: 3038861 - DNA, 17 bp, Homo sapiens
tcctcatcctcagatgc

SEQ ID NO: 3038862 - DNA, 16 bp, Homo sapiens
tcctcatcctgcttct

SEQ ID NO: 3038863 - DNA, 17 bp, Homo sapiens
tcctcatcctgcttctc

SEQ ID NO: 3038864 - DNA, 18 bp, Homo sapiens
tcctcatctgcctggaaa

SEQ ID NO: 3038865 - DNA, 20 bp, Homo sapiens
tcctcatctgcctggaaagt

SEQ ID NO: 3038866 - DNA, 21 bp, Homo sapiens
tcctcatctgtgcctgtctgt

SEQ ID NO: 3038867 - DNA, 15 bp, Homo sapiens
tcctcattcagacca

SEQ ID NO: 3038868 - DNA, 23 bp, Homo sapiens
tcctccaaaggaagtctaggagc

SEQ ID NO: 3038869 - DNA, 17 bp, Homo sapiens
tcctccaacaccaagca

SEQ ID NO: 3038870 - DNA, 12 bp, Homo sapiens
tcctccaagcca

SEQ ID NO: 3038871 - DNA, 22 bp, Homo sapiens
tcctccacgttctgctcatcat

SEQ ID NO: 3038872 - DNA, 23 bp, Homo sapiens
tcctccacgttctgctcatcatt

SEQ ID NO: 3038873 - DNA, 13 bp, Homo sapiens
tcctccagaagcc

SEQ ID NO: 3038874 - DNA, 12 bp, Homo sapiens
tcctccagccct

SEQ ID NO: 3038875 - DNA, 19 bp, Homo sapiens
tcctccagggccacgtgcc

SEQ ID NO: 3038876 - DNA, 23 bp, Homo sapiens
tcctccagggccacgtgccaggc

SEQ ID NO: 3038877 - DNA, 15 bp, Homo sapiens
tcctcccagtgcctt

SEQ ID NO: 3038878 - DNA, 14 bp, Homo sapiens
tcctccccaccaga

SEQ ID NO: 3038879 - DNA, 21 bp, Homo sapiens
tcctccccaccagagctgcct

SEQ ID NO: 3038880 - DNA, 14 bp, Homo sapiens
tcctccccaccctc

SEQ ID NO: 3038881 - DNA, 18 bp, Homo sapiens
tcctccccaccctcctgg

SEQ ID NO: 3038882 - DNA, 18 bp, Homo sapiens
tcctcccccggctgggcc

SEQ ID NO: 3038883 - DNA, 19 bp, Homo sapiens
tcctcccccggctgggcct

SEQ ID NO: 3038884 - DNA, 17 bp, Homo sapiens
tcctccccctgccagtg

SEQ ID NO: 3038885 - DNA, 20 bp, Homo sapiens
tcctccccctgccagtgcct

SEQ ID NO: 3038886 - DNA, 18 bp, Homo sapiens
tcctcccctactctgccc

SEQ ID NO: 3038887 - DNA, 15 bp, Homo sapiens
tcctcccctcgccca

SEQ ID NO: 3038888 - DNA, 10 bp, Homo sapiens
tcctcccctg

SEQ ID NO: 3038889 - DNA, 14 bp, Homo sapiens
tcctccctctgcct

SEQ ID NO: 3038890 - DNA, 15 bp, Homo sapiens
tcctccctctgcctc

SEQ ID NO: 3038891 - DNA, 16 bp, Homo sapiens
tcctccctctgcctca

SEQ ID NO: 3038892 - DNA, 19 bp, Homo sapiens
tcctccctctgcctcatcc

SEQ ID NO: 3038893 - DNA, 23 bp, Homo sapiens
tcctccctctgcctcatcctcct

SEQ ID NO: 3038894 - DNA, 17 bp, Homo sapiens
tcctccctggctgcagc

SEQ ID NO: 3038895 - DNA, 13 bp, Homo sapiens
tcctccctgttat

SEQ ID NO: 3038896 - DNA, 10 bp, Homo sapiens
tcctcccttc

SEQ ID NO: 3038897 - DNA, 15 bp, Homo sapiens
tcctcccttctgcta

SEQ ID NO: 3038898 - DNA, 15 bp, Homo sapiens
tcctccgaggccagt

SEQ ID NO: 3038899 - DNA, 14 bp, Homo sapiens
tcctccgcatgcca

SEQ ID NO: 3038900 - DNA, 16 bp, Homo sapiens
tcctcctacctcagcc

SEQ ID NO: 3038901 - DNA, 19 bp, Homo sapiens
tcctcctacctcagcctcc

SEQ ID NO: 3038902 - DNA, 12 bp, Homo sapiens
tcctcctcaggc

SEQ ID NO: 3038903 - DNA, 17 bp, Homo sapiens
tcctcctcattcagacc

SEQ ID NO: 3038904 - DNA, 13 bp, Homo sapiens
tcctcctccacca

SEQ ID NO: 3038905 - DNA, 14 bp, Homo sapiens
tcctcctccaccac

SEQ ID NO: 3038906 - DNA, 12 bp, Homo sapiens
tcctcctccagg

SEQ ID NO: 3038907 - DNA, 13 bp, Homo sapiens
tcctcctccaggg

SEQ ID NO: 3038908 - DNA, 14 bp, Homo sapiens
tcctcctccagggt

SEQ ID NO: 3038909 - DNA, 15 bp, Homo sapiens
tcctcctccagggtg

SEQ ID NO: 3038910 - DNA, 13 bp, Homo sapiens
tcctcctccctcc

SEQ ID NO: 3038911 - DNA, 13 bp, Homo sapiens
tcctcctccctgc

SEQ ID NO: 3038912 - DNA, 13 bp, Homo sapiens
tcctcctcctcat

SEQ ID NO: 3038913 - DNA, 14 bp, Homo sapiens
tcctcctcctgggc

SEQ ID NO: 3038914 - DNA, 19 bp, Homo sapiens
tcctcctctacctctctcc

SEQ ID NO: 3038915 - DNA, 16 bp, Homo sapiens
tcctcctgccagctct

SEQ ID NO: 3038916 - DNA, 21 bp, Homo sapiens
tcctcctgccagctctgtcac

SEQ ID NO: 3038917 - DNA, 16 bp, Homo sapiens
tcctcctgcccacctg

SEQ ID NO: 3038918 - DNA, 14 bp, Homo sapiens
tcctcctgggccct

SEQ ID NO: 3038919 - DNA, 16 bp, Homo sapiens
tcctcctgggccctct

SEQ ID NO: 3038920 - DNA, 22 bp, Homo sapiens
tcctcctgggccctctctgctc

SEQ ID NO: 3038921 - DNA, 21 bp, Homo sapiens
tcctccttaaaacagagaagg

SEQ ID NO: 3038922 - DNA, 19 bp, Homo sapiens
tcctccttgggcagggtct

SEQ ID NO: 3038923 - DNA, 15 bp, Homo sapiens
tcctcctttctctgt

SEQ ID NO: 3038924 - DNA, 14 bp, Homo sapiens
tcctcgcaagctgg

SEQ ID NO: 3038925 - DNA, 15 bp, Homo sapiens
tcctcgcaagctggg

SEQ ID NO: 3038926 - DNA, 15 bp, Homo sapiens
tcctcggacacccag

SEQ ID NO: 3038927 - DNA, 20 bp, Homo sapiens
tcctcggacacccagggtct

SEQ ID NO: 3038928 - DNA, 23 bp, Homo sapiens
tcctcggtttcccatttgttgct

SEQ ID NO: 3038929 - DNA, 15 bp, Homo sapiens
tcctctacctctctc

SEQ ID NO: 3038930 - DNA, 19 bp, Homo sapiens
tcctctactaacaatcagc

SEQ ID NO: 3038931 - DNA, 15 bp, Homo sapiens
tcctctatttcttta

SEQ ID NO: 3038932 - DNA, 17 bp, Homo sapiens
tcctctcacctcagcct

SEQ ID NO: 3038933 - DNA, 12 bp, Homo sapiens
tcctctcagctt

SEQ ID NO: 3038934 - DNA, 13 bp, Homo sapiens
tcctctcagcttc

SEQ ID NO: 3038935 - DNA, 19 bp, Homo sapiens
tcctctcccattgtccctc

SEQ ID NO: 3038936 - DNA, 17 bp, Homo sapiens
tcctctccccagcccag

SEQ ID NO: 3038937 - DNA, 13 bp, Homo sapiens
tcctctctcccac

SEQ ID NO: 3038938 - DNA, 20 bp, Homo sapiens
tcctctctcccaccctaagg

SEQ ID NO: 3038939 - DNA, 16 bp, Homo sapiens
tcctctctccctgcct

SEQ ID NO: 3038940 - DNA, 17 bp, Homo sapiens
tcctctctccctgcctc

SEQ ID NO: 3038941 - DNA, 10 bp, Homo sapiens
tcctctctct

SEQ ID NO: 3038942 - DNA, 19 bp, Homo sapiens
tcctctctctccctctttc

SEQ ID NO: 3038943 - DNA, 21 bp, Homo sapiens
tcctctctctccctctttcta

SEQ ID NO: 3038944 - DNA, 13 bp, Homo sapiens
tcctctctctctc

SEQ ID NO: 3038945 - DNA, 13 bp, Homo sapiens
tcctctctctgtg

SEQ ID NO: 3038946 - DNA, 12 bp, Homo sapiens
tcctctctgtct

SEQ ID NO: 3038947 - DNA, 16 bp, Homo sapiens
tcctctctgtctgtct

SEQ ID NO: 3038948 - DNA, 17 bp, Homo sapiens
tcctctctgtctgtctc

SEQ ID NO: 3038949 - DNA, 14 bp, Homo sapiens
tcctctgaaacagc

SEQ ID NO: 3038950 - DNA, 16 bp, Homo sapiens
tcctctgaaacagctg

SEQ ID NO: 3038951 - DNA, 17 bp, Homo sapiens
tcctctgactcagggct

SEQ ID NO: 3038952 - DNA, 18 bp, Homo sapiens
tcctctgactcagggctc

SEQ ID NO: 3038953 - DNA, 14 bp, Homo sapiens
tcctctgccacctc

SEQ ID NO: 3038954 - DNA, 15 bp, Homo sapiens
tcctctgccacctcc

SEQ ID NO: 3038955 - DNA, 22 bp, Homo sapiens
tcctctgccacctcccctatcc

SEQ ID NO: 3038956 - DNA, 12 bp, Homo sapiens
tcctctgcctcc

SEQ ID NO: 3038957 - DNA, 23 bp, Homo sapiens
tcctctggctggctaactggaag

SEQ ID NO: 3038958 - DNA, 23 bp, Homo sapiens
tcctctggcttccctctctgaaa

SEQ ID NO: 3038959 - DNA, 21 bp, Homo sapiens
tcctctgtcagtcacagccac

SEQ ID NO: 3038960 - DNA, 12 bp, Homo sapiens
tcctctgtgaag

SEQ ID NO: 3038961 - DNA, 17 bp, Homo sapiens
tcctcttagcctctgga

SEQ ID NO: 3038962 - DNA, 18 bp, Homo sapiens
tcctcttccctctctgca

SEQ ID NO: 3038963 - DNA, 18 bp, Homo sapiens
tcctcttgtaaataaagc

SEQ ID NO: 3038964 - DNA, 19 bp, Homo sapiens
tcctcttgtaaataaagcc

SEQ ID NO: 3038965 - DNA, 21 bp, Homo sapiens
tcctcttgtaaataaagccct

SEQ ID NO: 3038966 - DNA, 16 bp, Homo sapiens
tcctctttgctttgct

SEQ ID NO: 3038967 - DNA, 20 bp, Homo sapiens
tcctctttgctttgctttct

SEQ ID NO: 3038968 - DNA, 22 bp, Homo sapiens
tcctgaaagttggggcccagtc

SEQ ID NO: 3038969 - DNA, 14 bp, Homo sapiens
tctaaatgcccagt

SEQ ID NO: 3038970 - DNA, 23 bp, Homo sapiens
tctaaatgggaaagtattctgta

SEQ ID NO: 3038971 - DNA, 14 bp, Homo sapiens
tctaaattgaataa

SEQ ID NO: 3038972 - DNA, 15 bp, Homo sapiens
tctaaattgaataat

SEQ ID NO: 3038973 - DNA, 17 bp, Homo sapiens
tctaaattgaataatgg

SEQ ID NO: 3038974 - DNA, 15 bp, Homo sapiens
tctaaattgatcatt

SEQ ID NO: 3038975 - DNA, 24 bp, Homo sapiens
tctaacatatgatactgatgccat

SEQ ID NO: 3038976 - DNA, 21 bp, Homo sapiens
tctaaccaaagagtctctggc

SEQ ID NO: 3038977 - DNA, 20 bp, Homo sapiens
tctaaccaaggctgtgttta

SEQ ID NO: 3038978 - DNA, 13 bp, Homo sapiens
tctaacctcatct

SEQ ID NO: 3038979 - DNA, 18 bp, Homo sapiens
tctaacctcatcttcttc

SEQ ID NO: 3038980 - DNA, 17 bp, Homo sapiens
tctaacggtctgttctg

SEQ ID NO: 3038981 - DNA, 22 bp, Homo sapiens
tctaacggtctgttctgtttca

SEQ ID NO: 3038982 - DNA, 15 bp, Homo sapiens
tctaactcagaaaca

SEQ ID NO: 3038983 - DNA, 22 bp, Homo sapiens
tctaactccctcctcacactcc

SEQ ID NO: 3038984 - DNA, 21 bp, Homo sapiens
tctaacttaagaaataaatca

SEQ ID NO: 3038985 - DNA, 19 bp, Homo sapiens
tctaagactcaaatgttct

SEQ ID NO: 3038986 - DNA, 20 bp, Homo sapiens
tctaagagaacaatgtgcta

SEQ ID NO: 3038987 - DNA, 21 bp, Homo sapiens
tctaagatcttagattctctg

SEQ ID NO: 3038988 - DNA, 13 bp, Homo sapiens
tctaagatgtgat

SEQ ID NO: 3038989 - DNA, 14 bp, Homo sapiens
tctaagattctaaa

SEQ ID NO: 3038990 - DNA, 17 bp, Homo sapiens
tctaagattctaaaggt

SEQ ID NO: 3038991 - DNA, 17 bp, Homo sapiens
tctaagattctaatgat

SEQ ID NO: 3038992 - DNA, 13 bp, Homo sapiens
tctaagattctag

SEQ ID NO: 3038993 - DNA, 15 bp, Homo sapiens
tctaagattctagat

SEQ ID NO: 3038994 - DNA, 12 bp, Homo sapiens
tctaagattctg

SEQ ID NO: 3038995 - DNA, 19 bp, Homo sapiens
tctaagattctgattttag

SEQ ID NO: 3038996 - DNA, 19 bp, Homo sapiens
tctaagcagttttgtaaat

SEQ ID NO: 3038997 - DNA, 14 bp, Homo sapiens
tctaagcctgaagg

SEQ ID NO: 3038998 - DNA, 15 bp, Homo sapiens
tctaagcctgaaggg

SEQ ID NO: 3038999 - DNA, 17 bp, Homo sapiens
tctaaggacctgaaatt

SEQ ID NO: 3039000 - DNA, 21 bp, Homo sapiens
tctaaggacctgaaattccaa

SEQ ID NO: 3039001 - DNA, 17 bp, Homo sapiens
tctaaggactttttctt

SEQ ID NO: 3039002 - DNA, 19 bp, Homo sapiens
tctaaggagcgctagtgcc

SEQ ID NO: 3039003 - DNA, 20 bp, Homo sapiens
tctaaggagcgctagtgcct

SEQ ID NO: 3039004 - DNA, 23 bp, Homo sapiens
tctaaggagcgctagtgccttgc

SEQ ID NO: 3039005 - DNA, 19 bp, Homo sapiens
tctaaggcctaggattcta

SEQ ID NO: 3039006 - DNA, 21 bp, Homo sapiens
tctaaggcctaggattctaaa

SEQ ID NO: 3039007 - DNA, 17 bp, Homo sapiens
tctaaggctctgagagt

SEQ ID NO: 3039008 - DNA, 23 bp, Homo sapiens
tctaaggctctgagagtctagat

SEQ ID NO: 3039009 - DNA, 22 bp, Homo sapiens
tctaaggtccggtgttctaaga

SEQ ID NO: 3039010 - DNA, 23 bp, Homo sapiens
tctaaggtccggtgttctaagat

SEQ ID NO: 3039011 - DNA, 23 bp, Homo sapiens
tctaagtcgttgagggaatgaca

SEQ ID NO: 3039012 - DNA, 16 bp, Homo sapiens
tctaagttaatttaaa

SEQ ID NO: 3039013 - DNA, 20 bp, Homo sapiens
tctaagttaatttaaagttg

SEQ ID NO: 3039014 - DNA, 21 bp, Homo sapiens
tctaagttaatttaaagttgt

SEQ ID NO: 3039015 - DNA, 16 bp, Homo sapiens
tctaagttataagact

SEQ ID NO: 3039016 - DNA, 22 bp, Homo sapiens
tctaagttataagactctcaca

SEQ ID NO: 3039017 - DNA, 22 bp, Homo sapiens
tctaagtttctaagattctaaa

SEQ ID NO: 3039018 - DNA, 17 bp, Homo sapiens
tctaataatttctaatg

SEQ ID NO: 3039019 - DNA, 14 bp, Homo sapiens
tctaatatcagcaa

SEQ ID NO: 3039020 - DNA, 15 bp, Homo sapiens
tctaatcataacata

SEQ ID NO: 3039021 - DNA, 23 bp, Homo sapiens
tctaatcttaaatcagaataaat

SEQ ID NO: 3039022 - DNA, 14 bp, Homo sapiens
tctaatgcttgttt

SEQ ID NO: 3039023 - DNA, 15 bp, Homo sapiens
tctaattctctgtgg

SEQ ID NO: 3039024 - DNA, 24 bp, Homo sapiens
tctaattggtcattcctaatgcat

SEQ ID NO: 3039025 - DNA, 15 bp, Homo sapiens
tctaatttattaatc

SEQ ID NO: 3039026 - DNA, 22 bp, Homo sapiens
tctaatttctttagttttctat

SEQ ID NO: 3039027 - DNA, 16 bp, Homo sapiens
tctacaaaaaggtata

SEQ ID NO: 3039028 - DNA, 21 bp, Homo sapiens
tctacaaaaaggtataaataa

SEQ ID NO: 3039029 - DNA, 23 bp, Homo sapiens
tctacaaaaaggtataaataata

SEQ ID NO: 3039030 - DNA, 22 bp, Homo sapiens
tctacaactgttttaaaacttt

SEQ ID NO: 3039031 - DNA, 19 bp, Homo sapiens
tctacaaggactttccaaa

SEQ ID NO: 3039032 - DNA, 23 bp, Homo sapiens
tctacaaggactttccaaatcca

SEQ ID NO: 3039033 - DNA, 14 bp, Homo sapiens
tctacacaacatgt

SEQ ID NO: 3039034 - DNA, 16 bp, Homo sapiens
tctacaccttgctttt

SEQ ID NO: 3039035 - DNA, 16 bp, Homo sapiens
tctacagagcttccct

SEQ ID NO: 3039036 - DNA, 17 bp, Homo sapiens
tctacagagcttccctg

SEQ ID NO: 3039037 - DNA, 19 bp, Homo sapiens
tctacagagcttccctgac

SEQ ID NO: 3039038 - DNA, 11 bp, Homo sapiens
tctacatgaat

SEQ ID NO: 3039039 - DNA, 15 bp, Homo sapiens
tctacattaaatcac

SEQ ID NO: 3039040 - DNA, 15 bp, Homo sapiens
tctacatttaaacaa

SEQ ID NO: 3039041 - DNA, 22 bp, Homo sapiens
tctacatttaaacaagtatttt

SEQ ID NO: 3039042 - DNA, 13 bp, Homo sapiens
tctacatttgttt

SEQ ID NO: 3039043 - DNA, 20 bp, Homo sapiens
tctaccagtgcaggctggcc

SEQ ID NO: 3039044 - DNA, 23 bp, Homo sapiens
tctaccagtgcaggctggccagc

SEQ ID NO: 3039045 - DNA, 13 bp, Homo sapiens
tctacctctctcc

SEQ ID NO: 3039046 - DNA, 13 bp, Homo sapiens
tctacctgttcct

SEQ ID NO: 3039047 - DNA, 16 bp, Homo sapiens
tctacctgttctgtag

SEQ ID NO: 3039048 - DNA, 19 bp, Homo sapiens
tctacctgttctgtagctt

SEQ ID NO: 3039049 - DNA, 15 bp, Homo sapiens
tctacgctctccttt

SEQ ID NO: 3039050 - DNA, 17 bp, Homo sapiens
tctacgctctcctttct

SEQ ID NO: 3039051 - DNA, 21 bp, Homo sapiens
tctactaaaattcaaaaacaa

SEQ ID NO: 3039052 - DNA, 21 bp, Homo sapiens
tctactaagttattttatgac

SEQ ID NO: 3039053 - DNA, 16 bp, Homo sapiens
tctactaagtttcctt

SEQ ID NO: 3039054 - DNA, 16 bp, Homo sapiens
tctactccatggttct

SEQ ID NO: 3039055 - DNA, 20 bp, Homo sapiens
tctactccatggttctcaat

SEQ ID NO: 3039056 - DNA, 23 bp, Homo sapiens
tctactctggaccaaggagcatc

SEQ ID NO: 3039057 - DNA, 17 bp, Homo sapiens
tctactcttaagccatc

SEQ ID NO: 3039058 - DNA, 18 bp, Homo sapiens
tctactcttaagccatct

SEQ ID NO: 3039059 - DNA, 21 bp, Homo sapiens
tctactcttttgaagtgtttt

SEQ ID NO: 3039060 - DNA, 15 bp, Homo sapiens
tctactctttttgtt

SEQ ID NO: 3039061 - DNA, 19 bp, Homo sapiens
tctactgagtccctggcaa

SEQ ID NO: 3039062 - DNA, 19 bp, Homo sapiens
tctactgggagcctaccca

SEQ ID NO: 3039063 - DNA, 12 bp, Homo sapiens
tctacttctgtg

SEQ ID NO: 3039064 - DNA, 19 bp, Homo sapiens
tctacttctgtgtctgtca

SEQ ID NO: 3039065 - DNA, 18 bp, Homo sapiens
tctacttgatatttcctt

SEQ ID NO: 3039066 - DNA, 20 bp, Homo sapiens
tctacttgccagaaccaaat

SEQ ID NO: 3039067 - DNA, 22 bp, Homo sapiens
tctacttgccagaaccaaatta

SEQ ID NO: 3039068 - DNA, 22 bp, Homo sapiens
tctacttgctgtcccttggaac

SEQ ID NO: 3039069 - DNA, 22 bp, Homo sapiens
tctacttgcttattacatttaa

SEQ ID NO: 3039070 - DNA, 12 bp, Homo sapiens
tctactttgaag

SEQ ID NO: 3039071 - DNA, 14 bp, Homo sapiens
tctactttgattct

SEQ ID NO: 3039072 - DNA, 15 bp, Homo sapiens
tctactttgattctg

SEQ ID NO: 3039073 - DNA, 14 bp, Homo sapiens
tctactttgtttat

SEQ ID NO: 3039074 - DNA, 19 bp, Homo sapiens
tctagaatcacagctcaag

SEQ ID NO: 3039075 - DNA, 22 bp, Homo sapiens
tctagaatcacagctcaagcat

SEQ ID NO: 3039076 - DNA, 14 bp, Homo sapiens
tctagaatcctgct

SEQ ID NO: 3039077 - DNA, 19 bp, Homo sapiens
tctagacatggaggttcta

SEQ ID NO: 3039078 - DNA, 13 bp, Homo sapiens
tctagagagggag

SEQ ID NO: 3039079 - DNA, 15 bp, Homo sapiens
tctagagcactgcca

SEQ ID NO: 3039080 - DNA, 14 bp, Homo sapiens
tctagagggagaag

SEQ ID NO: 3039081 - DNA, 17 bp, Homo sapiens
tctagagggagaagact

SEQ ID NO: 3039082 - DNA, 22 bp, Homo sapiens
tctagagggagaagactgtgcg

SEQ ID NO: 3039083 - DNA, 23 bp, Homo sapiens
tctagagtttatacagtgtacat

SEQ ID NO: 3039084 - DNA, 15 bp, Homo sapiens
tctagatctcagcca

SEQ ID NO: 3039085 - DNA, 19 bp, Homo sapiens
tctagatggaccccagcat

SEQ ID NO: 3039086 - DNA, 18 bp, Homo sapiens
tctagatggctcctctca

SEQ ID NO: 3039087 - DNA, 13 bp, Homo sapiens
tctagattcaaag

SEQ ID NO: 3039088 - DNA, 18 bp, Homo sapiens
tctagattcaaaggttct

SEQ ID NO: 3039089 - DNA, 14 bp, Homo sapiens
tctagattctctgg

SEQ ID NO: 3039090 - DNA, 16 bp, Homo sapiens
tctagccgctgccctg

SEQ ID NO: 3039091 - DNA, 16 bp, Homo sapiens
tctagcctgcactttg

SEQ ID NO: 3039092 - DNA, 22 bp, Homo sapiens
tctagcctggggcttgaatttg

SEQ ID NO: 3039093 - DNA, 15 bp, Homo sapiens
tctaggaagaatttt

SEQ ID NO: 3039094 - DNA, 20 bp, Homo sapiens
tctaggaagaattttaaaaa

SEQ ID NO: 3039095 - DNA, 23 bp, Homo sapiens
tctaggaagaattttaaaaatga

SEQ ID NO: 3039096 - DNA, 16 bp, Homo sapiens
tctaggagctgggagg

SEQ ID NO: 3039097 - DNA, 18 bp, Homo sapiens
tctaggagtcaactggct

SEQ ID NO: 3039098 - DNA, 14 bp, Homo sapiens
tctaggatagctaa

SEQ ID NO: 3039099 - DNA, 20 bp, Homo sapiens
tctaggcctcctggcccagg

SEQ ID NO: 3039100 - DNA, 17 bp, Homo sapiens
tctgtcattgtaccctt

SEQ ID NO: 3039101 - DNA, 12 bp, Homo sapiens
tctgtccaaccc

SEQ ID NO: 3039102 - DNA, 13 bp, Homo sapiens
tctgtccaacccc

SEQ ID NO: 3039103 - DNA, 16 bp, Homo sapiens
tctgtccaacccctcc

SEQ ID NO: 3039104 - DNA, 17 bp, Homo sapiens
tctgtccaacccctccc

SEQ ID NO: 3039105 - DNA, 18 bp, Homo sapiens
tctgtccacatccccaga

SEQ ID NO: 3039106 - DNA, 22 bp, Homo sapiens
tctgtccacatccccagagccc

SEQ ID NO: 3039107 - DNA, 23 bp, Homo sapiens
tctgtccacatccccagagccca

SEQ ID NO: 3039108 - DNA, 15 bp, Homo sapiens
tctgtccacttgtgg

SEQ ID NO: 3039109 - DNA, 23 bp, Homo sapiens
tctgtccacttgtgggtcctggg

SEQ ID NO: 3039110 - DNA, 18 bp, Homo sapiens
tctgtccatcagtgcatg

SEQ ID NO: 3039111 - DNA, 20 bp, Homo sapiens
tctgtccatcctcctctcca

SEQ ID NO: 3039112 - DNA, 21 bp, Homo sapiens
tctgtccatcctcctctccat

SEQ ID NO: 3039113 - DNA, 22 bp, Homo sapiens
tctgtccatcctcctctccatg

SEQ ID NO: 3039114 - DNA, 14 bp, Homo sapiens
tctgtccatctgcc

SEQ ID NO: 3039115 - DNA, 14 bp, Homo sapiens
tctgtccccacgag

SEQ ID NO: 3039116 - DNA, 15 bp, Homo sapiens
tctgtccccacgagg

SEQ ID NO: 3039117 - DNA, 15 bp, Homo sapiens
tctgtccctcacagc

SEQ ID NO: 3039118 - DNA, 19 bp, Homo sapiens
tctgtcccttctgtccctc

SEQ ID NO: 3039119 - DNA, 14 bp, Homo sapiens
tctgtcccttgctg

SEQ ID NO: 3039120 - DNA, 16 bp, Homo sapiens
tctgtcccttgctgta

SEQ ID NO: 3039121 - DNA, 20 bp, Homo sapiens
tctgtcctcacgccccctgt

SEQ ID NO: 3039122 - DNA, 13 bp, Homo sapiens
tctgtcctcagcc

SEQ ID NO: 3039123 - DNA, 14 bp, Homo sapiens
tctgtcctctgtag

SEQ ID NO: 3039124 - DNA, 10 bp, Homo sapiens
tctgtcctgt

SEQ ID NO: 3039125 - DNA, 15 bp, Homo sapiens
tctgtctaaagatag

SEQ ID NO: 3039126 - DNA, 14 bp, Homo sapiens
tctgtctactttct

SEQ ID NO: 3039127 - DNA, 15 bp, Homo sapiens
tctgtctactttctc

SEQ ID NO: 3039128 - DNA, 18 bp, Homo sapiens
tctgtctactttctcttg

SEQ ID NO: 3039129 - DNA, 22 bp, Homo sapiens
tctgtctactttctcttgttta

SEQ ID NO: 3039130 - DNA, 15 bp, Homo sapiens
tctgtctagactggc

SEQ ID NO: 3039131 - DNA, 17 bp, Homo sapiens
tctgtctagactggcct

SEQ ID NO: 3039132 - DNA, 18 bp, Homo sapiens
tctgtctagactggccta

SEQ ID NO: 3039133 - DNA, 19 bp, Homo sapiens
tctgtctagcatgccaaca

SEQ ID NO: 3039134 - DNA, 13 bp, Homo sapiens
tctgtctcatcca

SEQ ID NO: 3039135 - DNA, 20 bp, Homo sapiens
tctgtctctccccctctgtc

SEQ ID NO: 3039136 - DNA, 23 bp, Homo sapiens
tctgtctctccccctctgtcttc

SEQ ID NO: 3039137 - DNA, 13 bp, Homo sapiens
tctgtctctgtgg

SEQ ID NO: 3039138 - DNA, 14 bp, Homo sapiens
tctgtctgctcaat

SEQ ID NO: 3039139 - DNA, 16 bp, Homo sapiens
tctgtctgtctctccc

SEQ ID NO: 3039140 - DNA, 17 bp, Homo sapiens
tctgtcttctctatcct

SEQ ID NO: 3039141 - DNA, 15 bp, Homo sapiens
tctgtcttctctcca

SEQ ID NO: 3039142 - DNA, 18 bp, Homo sapiens
tctgtcttctctccactt

SEQ ID NO: 3039143 - DNA, 14 bp, Homo sapiens
tctgtcttctggac

SEQ ID NO: 3039144 - DNA, 13 bp, Homo sapiens
tctgtcttctgta

SEQ ID NO: 3039145 - DNA, 15 bp, Homo sapiens
tctgtctttttcctt

SEQ ID NO: 3039146 - DNA, 19 bp, Homo sapiens
tctgtgaagaagccctgtt

SEQ ID NO: 3039147 - DNA, 16 bp, Homo sapiens
tctgtgaccaatgtct

SEQ ID NO: 3039148 - DNA, 16 bp, Homo sapiens
tctgtgacccacttct

SEQ ID NO: 3039149 - DNA, 16 bp, Homo sapiens
tctgtgacctgcatct

SEQ ID NO: 3039150 - DNA, 19 bp, Homo sapiens
tctgtgactataaagctgt

SEQ ID NO: 3039151 - DNA, 15 bp, Homo sapiens
tctgtgatgctccca

SEQ ID NO: 3039152 - DNA, 17 bp, Homo sapiens
tctgtgcagggctggtt

SEQ ID NO: 3039153 - DNA, 18 bp, Homo sapiens
tctgtgcagggctggttt

SEQ ID NO: 3039154 - DNA, 19 bp, Homo sapiens
tctgtgcagggctggtttg

SEQ ID NO: 3039155 - DNA, 22 bp, Homo sapiens
tctgtgcatggtggcaccagcg

SEQ ID NO: 3039156 - DNA, 12 bp, Homo sapiens
tctgtgcgtgtg

SEQ ID NO: 3039157 - DNA, 15 bp, Homo sapiens
tctgtggaaagtgta

SEQ ID NO: 3039158 - DNA, 18 bp, Homo sapiens
tctgtggacaccactgag

SEQ ID NO: 3039159 - DNA, 19 bp, Homo sapiens
tctgtggactgaccttgta

SEQ ID NO: 3039160 - DNA, 19 bp, Homo sapiens
tctgtggatgccagggccg

SEQ ID NO: 3039161 - DNA, 13 bp, Homo sapiens
tctgtggccgcca

SEQ ID NO: 3039162 - DNA, 21 bp, Homo sapiens
tctgtgtaaccagctcagtgt

SEQ ID NO: 3039163 - DNA, 21 bp, Homo sapiens
tctgtgtcagagcccagccca

SEQ ID NO: 3039164 - DNA, 14 bp, Homo sapiens
tctgtgtctaagat

SEQ ID NO: 3039165 - DNA, 17 bp, Homo sapiens
tctgtgtctaagattct

SEQ ID NO: 3039166 - DNA, 18 bp, Homo sapiens
tctgtgtctaagattcta

SEQ ID NO: 3039167 - DNA, 23 bp, Homo sapiens
tctgtgtctaagattctagatca

SEQ ID NO: 3039168 - DNA, 15 bp, Homo sapiens
tctgtgtctgtcacc

SEQ ID NO: 3039169 - DNA, 22 bp, Homo sapiens
tctgtgtggggttctcagtgcc

SEQ ID NO: 3039170 - DNA, 23 bp, Homo sapiens
tctgtgtggggttctcagtgccg

SEQ ID NO: 3039171 - DNA, 18 bp, Homo sapiens
tctgtgtgtgacccctcc

SEQ ID NO: 3039172 - DNA, 19 bp, Homo sapiens
tctgtgtgtgacccctcct

SEQ ID NO: 3039173 - DNA, 20 bp, Homo sapiens
tctgtgtgtgacccctcctg

SEQ ID NO: 3039174 - DNA, 21 bp, Homo sapiens
tctgtgtgtgacccctcctgg

SEQ ID NO: 3039175 - DNA, 15 bp, Homo sapiens
tctgtgtgtgtgtgc

SEQ ID NO: 3039176 - DNA, 13 bp, Homo sapiens
tctgtgtttataa

SEQ ID NO: 3039177 - DNA, 22 bp, Homo sapiens
tctgttaaccaaataaaacata

SEQ ID NO: 3039178 - DNA, 13 bp, Homo sapiens
tctgttacccagg

SEQ ID NO: 3039179 - DNA, 18 bp, Homo sapiens
tctgttatttagactcat

SEQ ID NO: 3039180 - DNA, 12 bp, Homo sapiens
tctgttcagtgt

SEQ ID NO: 3039181 - DNA, 22 bp, Homo sapiens
tctgttcatctctttgtcctga

SEQ ID NO: 3039182 - DNA, 19 bp, Homo sapiens
tctgttcctcaatggcctt

SEQ ID NO: 3039183 - DNA, 18 bp, Homo sapiens
tctgttcgaagttcattt

SEQ ID NO: 3039184 - DNA, 12 bp, Homo sapiens
tctgttctcaca

SEQ ID NO: 3039185 - DNA, 14 bp, Homo sapiens
tctgttctgtggaa

SEQ ID NO: 3039186 - DNA, 19 bp, Homo sapiens
tctgttctgtggaaagtgt

SEQ ID NO: 3039187 - DNA, 22 bp, Homo sapiens
tctgttctgtggaaagtgtaaa

SEQ ID NO: 3039188 - DNA, 12 bp, Homo sapiens
tctgttgaagtt

SEQ ID NO: 3039189 - DNA, 21 bp, Homo sapiens
tctgttgattactactttaag

SEQ ID NO: 3039190 - DNA, 12 bp, Homo sapiens
tctgttgcccag

SEQ ID NO: 3039191 - DNA, 12 bp, Homo sapiens
tctgttgcctcc

SEQ ID NO: 3039192 - DNA, 19 bp, Homo sapiens
tctgttgcctcctctctcc

SEQ ID NO: 3039193 - DNA, 23 bp, Homo sapiens
tctgttgcctcctctctccctgc

SEQ ID NO: 3039194 - DNA, 15 bp, Homo sapiens
tctgttgctgctcca

SEQ ID NO: 3039195 - DNA, 14 bp, Homo sapiens
tctgttgtgtgtca

SEQ ID NO: 3039196 - DNA, 18 bp, Homo sapiens
tctgttgtgtgtcatgcc

SEQ ID NO: 3039197 - DNA, 14 bp, Homo sapiens
tctgttgtgttcac

SEQ ID NO: 3039198 - DNA, 15 bp, Homo sapiens
tctgttgtttgaaga

SEQ ID NO: 3039199 - DNA, 12 bp, Homo sapiens
tctgtttcaagg

SEQ ID NO: 3039200 - DNA, 23 bp, Homo sapiens
tctgtttcaaggcactctagatt

SEQ ID NO: 3039201 - DNA, 21 bp, Homo sapiens
tctgtttggactgcagaagca

SEQ ID NO: 3039202 - DNA, 24 bp, Homo sapiens
tctgttttagttggaatgactgaa

SEQ ID NO: 3039203 - DNA, 18 bp, Homo sapiens
tctgtttttctaactggg

SEQ ID NO: 3039204 - DNA, 22 bp, Homo sapiens
tcttaaagtattcttctcttcc

SEQ ID NO: 3039205 - DNA, 12 bp, Homo sapiens
tcttaaatatat

SEQ ID NO: 3039206 - DNA, 16 bp, Homo sapiens
tcttaaatcagaataa

SEQ ID NO: 3039207 - DNA, 17 bp, Homo sapiens
tcttaaatcagaataaa

SEQ ID NO: 3039208 - DNA, 23 bp, Homo sapiens
tcttaaatcagaataaattaata

SEQ ID NO: 3039209 - DNA, 15 bp, Homo sapiens
tcttaaatcagttta

SEQ ID NO: 3039210 - DNA, 19 bp, Homo sapiens
tcttaaatctttcttcaaa

SEQ ID NO: 3039211 - DNA, 13 bp, Homo sapiens
tcttaacaaacca

SEQ ID NO: 3039212 - DNA, 13 bp, Homo sapiens
tcttaacactgaa

SEQ ID NO: 3039213 - DNA, 17 bp, Homo sapiens
tcttaacactgaaattg

SEQ ID NO: 3039214 - DNA, 12 bp, Homo sapiens
tcttaagccatc

SEQ ID NO: 3039215 - DNA, 13 bp, Homo sapiens
tcttaagccatct

SEQ ID NO: 3039216 - DNA, 16 bp, Homo sapiens
tcttaagccatcttgg

SEQ ID NO: 3039217 - DNA, 20 bp, Homo sapiens
tcttaagccatcttggtaaa

SEQ ID NO: 3039218 - DNA, 23 bp, Homo sapiens
tcttaatttatttcttaaccttt

SEQ ID NO: 3039219 - DNA, 22 bp, Homo sapiens
tcttaatttggataataaaaat

SEQ ID NO: 3039220 - DNA, 16 bp, Homo sapiens
tcttaatttggatcta

SEQ ID NO: 3039221 - DNA, 17 bp, Homo sapiens
tcttaatttggatctat

SEQ ID NO: 3039222 - DNA, 19 bp, Homo sapiens
tcttacagcacatcacctc

SEQ ID NO: 3039223 - DNA, 14 bp, Homo sapiens
tcttacctttatga

SEQ ID NO: 3039224 - DNA, 13 bp, Homo sapiens
tcttactgaaggt

SEQ ID NO: 3039225 - DNA, 22 bp, Homo sapiens
tcttactgcttaattcaaataa

SEQ ID NO: 3039226 - DNA, 15 bp, Homo sapiens
tcttactttcagttt

SEQ ID NO: 3039227 - DNA, 12 bp, Homo sapiens
tcttactttgtg

SEQ ID NO: 3039228 - DNA, 17 bp, Homo sapiens
tcttagaagtgttgtaa

SEQ ID NO: 3039229 - DNA, 12 bp, Homo sapiens
tcttagatctgg

SEQ ID NO: 3039230 - DNA, 14 bp, Homo sapiens
tcttagcctctgga

SEQ ID NO: 3039231 - DNA, 17 bp, Homo sapiens
tcttagcctctggatct

SEQ ID NO: 3039232 - DNA, 15 bp, Homo sapiens
tcttagctactgtat

SEQ ID NO: 3039233 - DNA, 18 bp, Homo sapiens
tgaagctcacctgttgct

SEQ ID NO: 3039234 - DNA, 19 bp, Homo sapiens
tgaagctcgcatccagaca

SEQ ID NO: 3039235 - DNA, 21 bp, Homo sapiens
tgaagctcgcatccagacagt

SEQ ID NO: 3039236 - DNA, 19 bp, Homo sapiens
tgaagctgctggagcccgc

SEQ ID NO: 3039237 - DNA, 14 bp, Homo sapiens
tgaagcttatgttt

SEQ ID NO: 3039238 - DNA, 12 bp, Homo sapiens
tgaagcttcctt

SEQ ID NO: 3039239 - DNA, 14 bp, Homo sapiens
tgaagcttgtgtat

SEQ ID NO: 3039240 - DNA, 23 bp, Homo sapiens
tgaaggaacagttaccctgcttt

SEQ ID NO: 3039241 - DNA, 16 bp, Homo sapiens
tgaaggaaccaaagcg

SEQ ID NO: 3039242 - DNA, 12 bp, Homo sapiens
tgaaggaccctt

SEQ ID NO: 3039243 - DNA, 23 bp, Homo sapiens
tgaaggagccccattcctgggaa

SEQ ID NO: 3039244 - DNA, 13 bp, Homo sapiens
tgaaggatggtta

SEQ ID NO: 3039245 - DNA, 14 bp, Homo sapiens
tgaaggcaaaattg

SEQ ID NO: 3039246 - DNA, 16 bp, Homo sapiens
tgaaggcaggagttgg

SEQ ID NO: 3039247 - DNA, 21 bp, Homo sapiens
tgaaggcaggagttgggggca

SEQ ID NO: 3039248 - DNA, 11 bp, Homo sapiens
tgaaggctggc

SEQ ID NO: 3039249 - DNA, 16 bp, Homo sapiens
tgaaggctggcatgat

SEQ ID NO: 3039250 - DNA, 20 bp, Homo sapiens
tgaagggacggctgtgggac

SEQ ID NO: 3039251 - DNA, 17 bp, Homo sapiens
tgaagggccagagccag

SEQ ID NO: 3039252 - DNA, 16 bp, Homo sapiens
tgaagggtcatttctc

SEQ ID NO: 3039253 - DNA, 19 bp, Homo sapiens
tgaaggtaactaagaagtg

SEQ ID NO: 3039254 - DNA, 17 bp, Homo sapiens
tgaaggtcccctggcag

SEQ ID NO: 3039255 - DNA, 18 bp, Homo sapiens
tgaaggtcccctggcagt

SEQ ID NO: 3039256 - DNA, 22 bp, Homo sapiens
tgaaggtcccctggcagtgctg

SEQ ID NO: 3039257 - DNA, 21 bp, Homo sapiens
tgaaggtgtgctacagaaaat

SEQ ID NO: 3039258 - DNA, 15 bp, Homo sapiens
tgaagtaaactgcag

SEQ ID NO: 3039259 - DNA, 20 bp, Homo sapiens
tgaagtacagtatattcttg

SEQ ID NO: 3039260 - DNA, 17 bp, Homo sapiens
tgaagtatctaaaagtg

SEQ ID NO: 3039261 - DNA, 16 bp, Homo sapiens
tgaagtatgaagtctg

SEQ ID NO: 3039262 - DNA, 16 bp, Homo sapiens
tgaagtcctggcttca

SEQ ID NO: 3039263 - DNA, 15 bp, Homo sapiens
tgaagtgatggactc

SEQ ID NO: 3039264 - DNA, 21 bp, Homo sapiens
tgaagtgctgctccatgtttc

SEQ ID NO: 3039265 - DNA, 15 bp, Homo sapiens
tgaagttacatgcat

SEQ ID NO: 3039266 - DNA, 22 bp, Homo sapiens
tgaagttacatgcataaaaggg

SEQ ID NO: 3039267 - DNA, 19 bp, Homo sapiens
tgaagttaggttcttaaaa

SEQ ID NO: 3039268 - DNA, 17 bp, Homo sapiens
tgaagtttacaatcaaa

SEQ ID NO: 3039269 - DNA, 13 bp, Homo sapiens
tgaagtttggaga

SEQ ID NO: 3039270 - DNA, 18 bp, Homo sapiens
tgaagtttggagatagat

SEQ ID NO: 3039271 - DNA, 14 bp, Homo sapiens
tgaagttttacatt

SEQ ID NO: 3039272 - DNA, 16 bp, Homo sapiens
tgaagttttacattgt

SEQ ID NO: 3039273 - DNA, 20 bp, Homo sapiens
tgaagtttttgaaatacctt

SEQ ID NO: 3039274 - DNA, 16 bp, Homo sapiens
tgaataaagaatactt

SEQ ID NO: 3039275 - DNA, 22 bp, Homo sapiens
tgaataaagaatacttgaactt

SEQ ID NO: 3039276 - DNA, 20 bp, Homo sapiens
tgaataaagcctgcttttta

SEQ ID NO: 3039277 - DNA, 22 bp, Homo sapiens
tgaataaagggaacatgcagct

SEQ ID NO: 3039278 - DNA, 23 bp, Homo sapiens
tgaataaagggaacatgcagctc

SEQ ID NO: 3039279 - DNA, 12 bp, Homo sapiens
tgaataaatgtc

SEQ ID NO: 3039280 - DNA, 14 bp, Homo sapiens
tgaataaatgtctt

SEQ ID NO: 3039281 - DNA, 21 bp, Homo sapiens
tgaataaattctataggaaca

SEQ ID NO: 3039282 - DNA, 16 bp, Homo sapiens
tgaataataagcagga

SEQ ID NO: 3039283 - DNA, 15 bp, Homo sapiens
tgaataatgagttgt

SEQ ID NO: 3039284 - DNA, 20 bp, Homo sapiens
tgaataatggtaccagataa

SEQ ID NO: 3039285 - DNA, 19 bp, Homo sapiens
tgaataattccatgattaa

SEQ ID NO: 3039286 - DNA, 13 bp, Homo sapiens
tgaataattgcat

SEQ ID NO: 3039287 - DNA, 20 bp, Homo sapiens
tgaatacacatctctgtcag

SEQ ID NO: 3039288 - DNA, 16 bp, Homo sapiens
tgaatacagcagcaag

SEQ ID NO: 3039289 - DNA, 16 bp, Homo sapiens
tgaatactgtattttg

SEQ ID NO: 3039290 - DNA, 14 bp, Homo sapiens
tgaatacttgaagt

SEQ ID NO: 3039291 - DNA, 15 bp, Homo sapiens
tgaatacttgaagta

SEQ ID NO: 3039292 - DNA, 21 bp, Homo sapiens
tgaatagcttgtttctgtcaa

SEQ ID NO: 3039293 - DNA, 21 bp, Homo sapiens
tgaatataatatatttgtgta

SEQ ID NO: 3039294 - DNA, 12 bp, Homo sapiens
tgaatataatga

SEQ ID NO: 3039295 - DNA, 14 bp, Homo sapiens
tgaatatgcctgta

SEQ ID NO: 3039296 - DNA, 21 bp, Homo sapiens
tgaatatgcctgtaattcagt

SEQ ID NO: 3039297 - DNA, 20 bp, Homo sapiens
tgaatatggaagtaaaggca

SEQ ID NO: 3039298 - DNA, 19 bp, Homo sapiens
tgaatatggacagttagca

SEQ ID NO: 3039299 - DNA, 22 bp, Homo sapiens
tgaatatggacagttagcattt

SEQ ID NO: 3039300 - DNA, 16 bp, Homo sapiens
tgaatattttatatta

SEQ ID NO: 3039301 - DNA, 21 bp, Homo sapiens
tgaatattttatattaaaata

SEQ ID NO: 3039302 - DNA, 20 bp, Homo sapiens
tgaatattttatctttcctt

SEQ ID NO: 3039303 - DNA, 14 bp, Homo sapiens
tgaatcactgtttt

SEQ ID NO: 3039304 - DNA, 16 bp, Homo sapiens
tgaatcactgttttta

SEQ ID NO: 3039305 - DNA, 22 bp, Homo sapiens
tgaatcagaccctaccccacca

SEQ ID NO: 3039306 - DNA, 12 bp, Homo sapiens
tgaatcatgtag

SEQ ID NO: 3039307 - DNA, 19 bp, Homo sapiens
tgaatcatgtaggatcttg

SEQ ID NO: 3039308 - DNA, 18 bp, Homo sapiens
tgaatcatgtagtatcaa

SEQ ID NO: 3039309 - DNA, 22 bp, Homo sapiens
tgaatccaaatctgtcctctgt

SEQ ID NO: 3039310 - DNA, 20 bp, Homo sapiens
tgaatccatgggtctggcta

SEQ ID NO: 3039311 - DNA, 20 bp, Homo sapiens
tgaatctacatttgtttgta

SEQ ID NO: 3039312 - DNA, 15 bp, Homo sapiens
tgaatgaaaataact

SEQ ID NO: 3039313 - DNA, 13 bp, Homo sapiens
tgaatgaaacatg

SEQ ID NO: 3039314 - DNA, 22 bp, Homo sapiens
tgaatgaaacccccacacacac

SEQ ID NO: 3039315 - DNA, 15 bp, Homo sapiens
tgaatgaacactctt

SEQ ID NO: 3039316 - DNA, 15 bp, Homo sapiens
tgaatgaaccttctg

SEQ ID NO: 3039317 - DNA, 16 bp, Homo sapiens
tgaatgaaccttctgg

SEQ ID NO: 3039318 - DNA, 14 bp, Homo sapiens
tgaatgaattcttg

SEQ ID NO: 3039319 - DNA, 14 bp, Homo sapiens
tgaatgagacttaa

SEQ ID NO: 3039320 - DNA, 17 bp, Homo sapiens
tgaatgagacttaattt

SEQ ID NO: 3039321 - DNA, 21 bp, Homo sapiens
tgaatgagtctgttgtgtgtc

SEQ ID NO: 3039322 - DNA, 22 bp, Homo sapiens
tgaatgcagcactgctgcctca

SEQ ID NO: 3039323 - DNA, 23 bp, Homo sapiens
tgaatgcagtctgtccaggctcg

SEQ ID NO: 3039324 - DNA, 18 bp, Homo sapiens
tgaatgccagtgtgctga

SEQ ID NO: 3039325 - DNA, 17 bp, Homo sapiens
tgaatgcccccagctgg

SEQ ID NO: 3039326 - DNA, 16 bp, Homo sapiens
tgaatgcttctgattt

SEQ ID NO: 3039327 - DNA, 13 bp, Homo sapiens
tgaatgggatcat

SEQ ID NO: 3039328 - DNA, 18 bp, Homo sapiens
tgaatgggatcatgaaag

SEQ ID NO: 3039329 - DNA, 17 bp, Homo sapiens
tgaatgtatttatttgg

SEQ ID NO: 3039330 - DNA, 19 bp, Homo sapiens
tgaatgtatttatttggga

SEQ ID NO: 3039331 - DNA, 15 bp, Homo sapiens
tgaatgtcttttgaa

SEQ ID NO: 3039332 - DNA, 23 bp, Homo sapiens
tgaatgtgatcatctttgctgaa

SEQ ID NO: 3039333 - DNA, 15 bp, Homo sapiens
tgaatgtgtgagaaa

SEQ ID NO: 3039334 - DNA, 17 bp, Homo sapiens
tgaatgtgtgagaaaaa

SEQ ID NO: 3039335 - DNA, 20 bp, Homo sapiens
tgaatgtttgtgtctgtggt

SEQ ID NO: 3039336 - DNA, 17 bp, Homo sapiens
tgaattcaagaaaggaa

SEQ ID NO: 3039337 - DNA, 17 bp, Homo sapiens
tgaattcagacctggaa

SEQ ID NO: 3039338 - DNA, 16 bp, Homo sapiens
tgaattccaagtgtat

SEQ ID NO: 3039339 - DNA, 15 bp, Homo sapiens
tgaattcccttttaa

SEQ ID NO: 3039340 - DNA, 16 bp, Homo sapiens
tgaattcctagaatta

SEQ ID NO: 3039341 - DNA, 16 bp, Homo sapiens
tgaattcgatgcgtat

SEQ ID NO: 3039342 - DNA, 22 bp, Homo sapiens
tgaattcgatgcgtattctgtg

SEQ ID NO: 3039343 - DNA, 22 bp, Homo sapiens
tgaattcttggttgaggaaaca

SEQ ID NO: 3039344 - DNA, 16 bp, Homo sapiens
tgaattgaaattttat

SEQ ID NO: 3039345 - DNA, 17 bp, Homo sapiens
tgaattggcctgaacag

SEQ ID NO: 3039346 - DNA, 14 bp, Homo sapiens
tgaatttaagcatg

SEQ ID NO: 3039347 - DNA, 17 bp, Homo sapiens
tgaatttctttgattta

SEQ ID NO: 3039348 - DNA, 18 bp, Homo sapiens
tgaatttctttgatttaa

SEQ ID NO: 3039349 - DNA, 22 bp, Homo sapiens
tgaatttctttgatttaactga

SEQ ID NO: 3039350 - DNA, 11 bp, Homo sapiens
tgaatttgcaa

SEQ ID NO: 3039351 - DNA, 12 bp, Homo sapiens
tgaatttgcaaa

SEQ ID NO: 3039352 - DNA, 11 bp, Homo sapiens
tgaatttgcat

SEQ ID NO: 3039353 - DNA, 12 bp, Homo sapiens
tgaatttgcatg

SEQ ID NO: 3039354 - DNA, 14 bp, Homo sapiens
tgaatttgcatgtc

SEQ ID NO: 3039355 - DNA, 15 bp, Homo sapiens
tgaatttgcatgtct

SEQ ID NO: 3039356 - DNA, 17 bp, Homo sapiens
tgaatttgcatgtctaa

SEQ ID NO: 3039357 - DNA, 15 bp, Homo sapiens
tgaatttgtatatga

SEQ ID NO: 3039358 - DNA, 13 bp, Homo sapiens
tgaattttctgtg

SEQ ID NO: 3039359 - DNA, 14 bp, Homo sapiens
tgaattttctgtgt

SEQ ID NO: 3039360 - DNA, 21 bp, Homo sapiens
tgaattttgtttttattttca

SEQ ID NO: 3039361 - DNA, 17 bp, Homo sapiens
tgaatttttgcaataat

SEQ ID NO: 3039362 - DNA, 22 bp, Homo sapiens
tgaatttttgcaataatgcagt

SEQ ID NO: 3039363 - DNA, 21 bp, Homo sapiens
tgaatttttttcatcttctct

SEQ ID NO: 3039364 - DNA, 21 bp, Homo sapiens
tgacaaaaaatgttttaaaga

SEQ ID NO: 3039365 - DNA, 22 bp, Homo sapiens
tgagtgtgagggcagcactggg

SEQ ID NO: 3039366 - DNA, 15 bp, Homo sapiens
tgagtgtgctgctgt

SEQ ID NO: 3039367 - DNA, 22 bp, Homo sapiens
tgagtgtgggagtgcagagaaa

SEQ ID NO: 3039368 - DNA, 17 bp, Homo sapiens
tgagtgttcctttttaa

SEQ ID NO: 3039369 - DNA, 15 bp, Homo sapiens
tgagtgtttctatga

SEQ ID NO: 3039370 - DNA, 14 bp, Homo sapiens
tgagtgtttggggg

SEQ ID NO: 3039371 - DNA, 19 bp, Homo sapiens
tgagtgttttatgagaaag

SEQ ID NO: 3039372 - DNA, 23 bp, Homo sapiens
tgagttacaggggattttattaa

SEQ ID NO: 3039373 - DNA, 18 bp, Homo sapiens
tgagttacattaaaataa

SEQ ID NO: 3039374 - DNA, 16 bp, Homo sapiens
tgagttatctaagaat

SEQ ID NO: 3039375 - DNA, 15 bp, Homo sapiens
tgagttcaggtagct

SEQ ID NO: 3039376 - DNA, 16 bp, Homo sapiens
tgagttcaggtagctg

SEQ ID NO: 3039377 - DNA, 19 bp, Homo sapiens
tgagttcctggaatggcac

SEQ ID NO: 3039378 - DNA, 20 bp, Homo sapiens
tgagttctcactatgtttct

SEQ ID NO: 3039379 - DNA, 22 bp, Homo sapiens
tgagttctcactatgtttctca

SEQ ID NO: 3039380 - DNA, 17 bp, Homo sapiens
tgagttggggtctggca

SEQ ID NO: 3039381 - DNA, 21 bp, Homo sapiens
tgagttggggtctggcagcct

SEQ ID NO: 3039382 - DNA, 16 bp, Homo sapiens
tgagtttaaaaatcaa

SEQ ID NO: 3039383 - DNA, 18 bp, Homo sapiens
tgagtttaaaaatcaact

SEQ ID NO: 3039384 - DNA, 16 bp, Homo sapiens
tgagtttcagctggaa

SEQ ID NO: 3039385 - DNA, 18 bp, Homo sapiens
tgagtttcagctggaaac

SEQ ID NO: 3039386 - DNA, 22 bp, Homo sapiens
tgagtttcagctggaaacttct

SEQ ID NO: 3039387 - DNA, 16 bp, Homo sapiens
tgagtttgacatttaa

SEQ ID NO: 3039388 - DNA, 15 bp, Homo sapiens
tgagttttaaagaag

SEQ ID NO: 3039389 - DNA, 13 bp, Homo sapiens
tgagttttccatg

SEQ ID NO: 3039390 - DNA, 23 bp, Homo sapiens
tgagttttcttatatatatattg

SEQ ID NO: 3039391 - DNA, 19 bp, Homo sapiens
tgagtttttatggggctga

SEQ ID NO: 3039392 - DNA, 16 bp, Homo sapiens
tgataaaaatgatatt

SEQ ID NO: 3039393 - DNA, 17 bp, Homo sapiens
tgataaaatgttccttt

SEQ ID NO: 3039394 - DNA, 20 bp, Homo sapiens
tgataaagcctcaaggtttt

SEQ ID NO: 3039395 - DNA, 14 bp, Homo sapiens
tgataaagttgaga

SEQ ID NO: 3039396 - DNA, 13 bp, Homo sapiens
tgataaagtttct

SEQ ID NO: 3039397 - DNA, 18 bp, Homo sapiens
tgataaagtttctcagat

SEQ ID NO: 3039398 - DNA, 13 bp, Homo sapiens
tgataagacatga

SEQ ID NO: 3039399 - DNA, 17 bp, Homo sapiens
tgataagagaatcaaca

SEQ ID NO: 3039400 - DNA, 18 bp, Homo sapiens
tgataagagaatcaacat

SEQ ID NO: 3039401 - DNA, 14 bp, Homo sapiens
tgataagatggttt

SEQ ID NO: 3039402 - DNA, 15 bp, Homo sapiens
tgataagattgaaat

SEQ ID NO: 3039403 - DNA, 13 bp, Homo sapiens
tgataagcacatt

SEQ ID NO: 3039404 - DNA, 19 bp, Homo sapiens
tgataaggacatgatgctt

SEQ ID NO: 3039405 - DNA, 14 bp, Homo sapiens
tgataataatgctt

SEQ ID NO: 3039406 - DNA, 14 bp, Homo sapiens
tgataatagattct

SEQ ID NO: 3039407 - DNA, 21 bp, Homo sapiens
tgataatttcagggaaattaa

SEQ ID NO: 3039408 - DNA, 20 bp, Homo sapiens
tgatacagtcaacaagcctg

SEQ ID NO: 3039409 - DNA, 15 bp, Homo sapiens
tgatacagtgttttt

SEQ ID NO: 3039410 - DNA, 16 bp, Homo sapiens
tgatacatccaaagca

SEQ ID NO: 3039411 - DNA, 18 bp, Homo sapiens
tgataccatatgaatgaa

SEQ ID NO: 3039412 - DNA, 19 bp, Homo sapiens
tgataccatatgaatgaaa

SEQ ID NO: 3039413 - DNA, 18 bp, Homo sapiens
tgataccttcatttaata

SEQ ID NO: 3039414 - DNA, 15 bp, Homo sapiens
tgatagaactgtact

SEQ ID NO: 3039415 - DNA, 22 bp, Homo sapiens
tgatagaactgtactgttttct

SEQ ID NO: 3039416 - DNA, 15 bp, Homo sapiens
tgatagatgtttgac

SEQ ID NO: 3039417 - DNA, 15 bp, Homo sapiens
tgataggagggggcg

SEQ ID NO: 3039418 - DNA, 14 bp, Homo sapiens
tgatagtgcttctt

SEQ ID NO: 3039419 - DNA, 17 bp, Homo sapiens
tgatagtgcttcttgta

SEQ ID NO: 3039420 - DNA, 16 bp, Homo sapiens
tgatagttactgttgt

SEQ ID NO: 3039421 - DNA, 20 bp, Homo sapiens
tgatagttactgttgtgacc

SEQ ID NO: 3039422 - DNA, 22 bp, Homo sapiens
tgatagttttctagatgacata

SEQ ID NO: 3039423 - DNA, 11 bp, Homo sapiens
tgatatagaat

SEQ ID NO: 3039424 - DNA, 14 bp, Homo sapiens
tgatatagaattag

SEQ ID NO: 3039425 - DNA, 12 bp, Homo sapiens
tgatattcagaa

SEQ ID NO: 3039426 - DNA, 14 bp, Homo sapiens
tgatattcagaatt

SEQ ID NO: 3039427 - DNA, 22 bp, Homo sapiens
tgatattcagaattatgatgga

SEQ ID NO: 3039428 - DNA, 17 bp, Homo sapiens
tgatattgaccatgtga

SEQ ID NO: 3039429 - DNA, 18 bp, Homo sapiens
tgatattgaccatgtgat

SEQ ID NO: 3039430 - DNA, 17 bp, Homo sapiens
tgatattgtgaacattt

SEQ ID NO: 3039431 - DNA, 21 bp, Homo sapiens
tgatattgtgaacatttgtga

SEQ ID NO: 3039432 - DNA, 14 bp, Homo sapiens
tgatatttctctag

SEQ ID NO: 3039433 - DNA, 21 bp, Homo sapiens
tgatatttgacagacatcctt

SEQ ID NO: 3039434 - DNA, 19 bp, Homo sapiens
tgatcaacataatggacca

SEQ ID NO: 3039435 - DNA, 18 bp, Homo sapiens
tgatcaatgacagagcct

SEQ ID NO: 3039436 - DNA, 17 bp, Homo sapiens
tgatcacccccctgctt

SEQ ID NO: 3039437 - DNA, 15 bp, Homo sapiens
tgatcagacagcttg

SEQ ID NO: 3039438 - DNA, 21 bp, Homo sapiens
tgatcagctttcaaagcattt

SEQ ID NO: 3039439 - DNA, 16 bp, Homo sapiens
tgatcaggcttcctgg

SEQ ID NO: 3039440 - DNA, 18 bp, Homo sapiens
tgatcagtgttgttgctc

SEQ ID NO: 3039441 - DNA, 18 bp, Homo sapiens
tgatcatcgccagaggtg

SEQ ID NO: 3039442 - DNA, 20 bp, Homo sapiens
tgatcatcgccagaggtgct

SEQ ID NO: 3039443 - DNA, 14 bp, Homo sapiens
tgatcatctttgct

SEQ ID NO: 3039444 - DNA, 15 bp, Homo sapiens
tgatccacccacctc

SEQ ID NO: 3039445 - DNA, 20 bp, Homo sapiens
tgatccacccacctcagcct

SEQ ID NO: 3039446 - DNA, 20 bp, Homo sapiens
tgatccacccgccttcagcc

SEQ ID NO: 3039447 - DNA, 21 bp, Homo sapiens
tgatccacccgccttcagcct

SEQ ID NO: 3039448 - DNA, 16 bp, Homo sapiens
tgatccagctgtgtgt

SEQ ID NO: 3039449 - DNA, 19 bp, Homo sapiens
tgatccgcctacctcagcc

SEQ ID NO: 3039450 - DNA, 14 bp, Homo sapiens
tgatcctcacgcct

SEQ ID NO: 3039451 - DNA, 19 bp, Homo sapiens
tgatcctcacgccttggcc

SEQ ID NO: 3039452 - DNA, 11 bp, Homo sapiens
tgatcctcagt

SEQ ID NO: 3039453 - DNA, 12 bp, Homo sapiens
tgatcctcccac

SEQ ID NO: 3039454 - DNA, 11 bp, Homo sapiens
tgatcctgcca

SEQ ID NO: 3039455 - DNA, 21 bp, Homo sapiens
tgatcgatgattcaggtgcag

SEQ ID NO: 3039456 - DNA, 15 bp, Homo sapiens
tgatcgccttattta

SEQ ID NO: 3039457 - DNA, 15 bp, Homo sapiens
tgatcgcctttccca

SEQ ID NO: 3039458 - DNA, 13 bp, Homo sapiens
tgatcgctgtatt

SEQ ID NO: 3039459 - DNA, 20 bp, Homo sapiens
tgatcggccagttttcggaa

SEQ ID NO: 3039460 - DNA, 21 bp, Homo sapiens
tgatcggccagttttcggaaa

SEQ ID NO: 3039461 - DNA, 16 bp, Homo sapiens
tgatcgtgacgctgaa

SEQ ID NO: 3039462 - DNA, 20 bp, Homo sapiens
tgatcgtgacgctgaataaa

SEQ ID NO: 3039463 - DNA, 15 bp, Homo sapiens
tgatctacatgagga

SEQ ID NO: 3039464 - DNA, 14 bp, Homo sapiens
tgatctacccgtgc

SEQ ID NO: 3039465 - DNA, 16 bp, Homo sapiens
tgatctcctgacctca

SEQ ID NO: 3039466 - DNA, 15 bp, Homo sapiens
tgatctgaacatctg

SEQ ID NO: 3039467 - DNA, 18 bp, Homo sapiens
tgatcttaaagatcgtgt

SEQ ID NO: 3039468 - DNA, 16 bp, Homo sapiens
tgatcttatttttcta

SEQ ID NO: 3039469 - DNA, 19 bp, Homo sapiens
tgatcttatttttctaaac

SEQ ID NO: 3039470 - DNA, 13 bp, Homo sapiens
tgatctttgcaaa

SEQ ID NO: 3039471 - DNA, 18 bp, Homo sapiens
tgatgaaaatatttaaag

SEQ ID NO: 3039472 - DNA, 14 bp, Homo sapiens
tgatgaatactgta

SEQ ID NO: 3039473 - DNA, 13 bp, Homo sapiens
tgatgaatcactg

SEQ ID NO: 3039474 - DNA, 14 bp, Homo sapiens
tgatgaatcactgt

SEQ ID NO: 3039475 - DNA, 14 bp, Homo sapiens
tgatgaatctacat

SEQ ID NO: 3039476 - DNA, 15 bp, Homo sapiens
tgatgactggcattt

SEQ ID NO: 3039477 - DNA, 15 bp, Homo sapiens
tgatgacttgagccc

SEQ ID NO: 3039478 - DNA, 17 bp, Homo sapiens
tgatgagcactcctgat

SEQ ID NO: 3039479 - DNA, 19 bp, Homo sapiens
tgatgagcactcctgattt

SEQ ID NO: 3039480 - DNA, 15 bp, Homo sapiens
tgatgagctcctctt

SEQ ID NO: 3039481 - DNA, 13 bp, Homo sapiens
tgatgaggtattt

SEQ ID NO: 3039482 - DNA, 15 bp, Homo sapiens
tgatgatacaagatt

SEQ ID NO: 3039483 - DNA, 13 bp, Homo sapiens
tgatgatgatgat

SEQ ID NO: 3039484 - DNA, 16 bp, Homo sapiens
tgatgatgatgatgat

SEQ ID NO: 3039485 - DNA, 14 bp, Homo sapiens
tgatgcaaccaaaa

SEQ ID NO: 3039486 - DNA, 18 bp, Homo sapiens
tgatgcaaccaaaaggga

SEQ ID NO: 3039487 - DNA, 18 bp, Homo sapiens
tgatgcaaggattacaga

SEQ ID NO: 3039488 - DNA, 21 bp, Homo sapiens
tgatgcaaggattacagaaac

SEQ ID NO: 3039489 - DNA, 22 bp, Homo sapiens
tgatgcaggatttgttctctgt

SEQ ID NO: 3039490 - DNA, 18 bp, Homo sapiens
tgatgcatgcactgttcc

SEQ ID NO: 3039491 - DNA, 13 bp, Homo sapiens
tgatgcatgtctt

SEQ ID NO: 3039492 - DNA, 18 bp, Homo sapiens
tgatgccataaatacaag

SEQ ID NO: 3039493 - DNA, 15 bp, Homo sapiens
tgatgcgctgggatc

SEQ ID NO: 3039494 - DNA, 20 bp, Homo sapiens
tgatgctacaggatttgaaa

SEQ ID NO: 3039495 - DNA, 23 bp, Homo sapiens
tgatgctacaggatttgaaattg

SEQ ID NO: 3039496 - DNA, 16 bp, Homo sapiens
tgatgctaggttgttt

SEQ ID NO: 3039497 - DNA, 15 bp, Homo sapiens
tgatgctggatgctc

SEQ ID NO: 3039498 - DNA, 14 bp, Homo sapiens
tgccagcagcctcg

SEQ ID NO: 3039499 - DNA, 21 bp, Homo sapiens
tgccagcagcctcgcacaggc

SEQ ID NO: 3039500 - DNA, 20 bp, Homo sapiens
tgccagccaatccctggcca

SEQ ID NO: 3039501 - DNA, 23 bp, Homo sapiens
tgccagcccctgctggctggtgc

SEQ ID NO: 3039502 - DNA, 15 bp, Homo sapiens
tgccagcccggaggg

SEQ ID NO: 3039503 - DNA, 23 bp, Homo sapiens
tgccagctctgtatcaggaccca

SEQ ID NO: 3039504 - DNA, 20 bp, Homo sapiens
tgccagctctgtcaccctgg

SEQ ID NO: 3039505 - DNA, 21 bp, Homo sapiens
tgccagctctgtcaccctggc

SEQ ID NO: 3039506 - DNA, 15 bp, Homo sapiens
tgccagctgcactga

SEQ ID NO: 3039507 - DNA, 18 bp, Homo sapiens
tgccaggaaacaagggaa

SEQ ID NO: 3039508 - DNA, 19 bp, Homo sapiens
tgccaggaaactcttgcta

SEQ ID NO: 3039509 - DNA, 20 bp, Homo sapiens
tgccaggaccagtcaacctg

SEQ ID NO: 3039510 - DNA, 16 bp, Homo sapiens
tgccaggacccgccag

SEQ ID NO: 3039511 - DNA, 19 bp, Homo sapiens
tgccaggacccgccagccc

SEQ ID NO: 3039512 - DNA, 21 bp, Homo sapiens
tgccaggacccgccagccccg

SEQ ID NO: 3039513 - DNA, 23 bp, Homo sapiens
tgccaggacccgccagccccgct

SEQ ID NO: 3039514 - DNA, 19 bp, Homo sapiens
tgccaggcccccaccacac

SEQ ID NO: 3039515 - DNA, 21 bp, Homo sapiens
tgccaggcccccaccacacat

SEQ ID NO: 3039516 - DNA, 16 bp, Homo sapiens
tgccaggcttgcctgg

SEQ ID NO: 3039517 - DNA, 19 bp, Homo sapiens
tgccaggcttgcctgggct

SEQ ID NO: 3039518 - DNA, 17 bp, Homo sapiens
tgccagggatgggcagc

SEQ ID NO: 3039519 - DNA, 12 bp, Homo sapiens
tgccagggcagg

SEQ ID NO: 3039520 - DNA, 15 bp, Homo sapiens
tgccagggcagggcc

SEQ ID NO: 3039521 - DNA, 17 bp, Homo sapiens
tgccagtagtaccttgt

SEQ ID NO: 3039522 - DNA, 23 bp, Homo sapiens
tgccagtctcactgtgggaaggc

SEQ ID NO: 3039523 - DNA, 13 bp, Homo sapiens
tgccagtgcctta

SEQ ID NO: 3039524 - DNA, 15 bp, Homo sapiens
tgccagtgccttacc

SEQ ID NO: 3039525 - DNA, 21 bp, Homo sapiens
tgccagtgccttacctcctgc

SEQ ID NO: 3039526 - DNA, 22 bp, Homo sapiens
tgccagtgccttacctcctgcc

SEQ ID NO: 3039527 - DNA, 13 bp, Homo sapiens
tgccagtgtgctg

SEQ ID NO: 3039528 - DNA, 20 bp, Homo sapiens
tgccataactttatgaagtg

SEQ ID NO: 3039529 - DNA, 21 bp, Homo sapiens
tgccataactttatgaagtgc

SEQ ID NO: 3039530 - DNA, 16 bp, Homo sapiens
tgccataatacaaaag

SEQ ID NO: 3039531 - DNA, 17 bp, Homo sapiens
tgccatactttgtctga

SEQ ID NO: 3039532 - DNA, 18 bp, Homo sapiens
tgccatactttgtctgaa

SEQ ID NO: 3039533 - DNA, 11 bp, Homo sapiens
tgccataggag

SEQ ID NO: 3039534 - DNA, 17 bp, Homo sapiens
tgccatattttcaccat

SEQ ID NO: 3039535 - DNA, 17 bp, Homo sapiens
tgccatcaaactgtaaa

SEQ ID NO: 3039536 - DNA, 15 bp, Homo sapiens
tgccatcatctcctg

SEQ ID NO: 3039537 - DNA, 16 bp, Homo sapiens
tgccatcatctcctgc

SEQ ID NO: 3039538 - DNA, 16 bp, Homo sapiens
tgccatcatgcctgac

SEQ ID NO: 3039539 - DNA, 15 bp, Homo sapiens
tgccatcattgctgt

SEQ ID NO: 3039540 - DNA, 15 bp, Homo sapiens
tgccatccccctctc

SEQ ID NO: 3039541 - DNA, 16 bp, Homo sapiens
tgccatccccctctca

SEQ ID NO: 3039542 - DNA, 14 bp, Homo sapiens
tgccatcgctgtga

SEQ ID NO: 3039543 - DNA, 19 bp, Homo sapiens
tgccatctaatggcttcag

SEQ ID NO: 3039544 - DNA, 18 bp, Homo sapiens
tgccatcttctccccgag

SEQ ID NO: 3039545 - DNA, 16 bp, Homo sapiens
tgccatgatgcctctg

SEQ ID NO: 3039546 - DNA, 17 bp, Homo sapiens
tgccatgatgcctctgt

SEQ ID NO: 3039547 - DNA, 21 bp, Homo sapiens
tgccatgatgcctctgtcttc

SEQ ID NO: 3039548 - DNA, 21 bp, Homo sapiens
tgccatgctatgtgcacagcc

SEQ ID NO: 3039549 - DNA, 19 bp, Homo sapiens
tgccatggcaatggcatgc

SEQ ID NO: 3039550 - DNA, 15 bp, Homo sapiens
tgccatgtagcagac

SEQ ID NO: 3039551 - DNA, 16 bp, Homo sapiens
tgccatgtagcagaca

SEQ ID NO: 3039552 - DNA, 17 bp, Homo sapiens
tgccatgtcaaacaaat

SEQ ID NO: 3039553 - DNA, 18 bp, Homo sapiens
tgccatgtcaaacaaata

SEQ ID NO: 3039554 - DNA, 19 bp, Homo sapiens
tgccatgtgactctggctt

SEQ ID NO: 3039555 - DNA, 21 bp, Homo sapiens
tgccatgttggccaggctggt

SEQ ID NO: 3039556 - DNA, 19 bp, Homo sapiens
tgccatgtttttgccaaaa

SEQ ID NO: 3039557 - DNA, 14 bp, Homo sapiens
tgccattacccagt

SEQ ID NO: 3039558 - DNA, 16 bp, Homo sapiens
tgccattacccagtgc

SEQ ID NO: 3039559 - DNA, 18 bp, Homo sapiens
tgccattatagcgcctgt

SEQ ID NO: 3039560 - DNA, 18 bp, Homo sapiens
tgccattgtactccagcc

SEQ ID NO: 3039561 - DNA, 19 bp, Homo sapiens
tgccattgtactccagcct

SEQ ID NO: 3039562 - DNA, 20 bp, Homo sapiens
tgccattgtactccagcctg

SEQ ID NO: 3039563 - DNA, 14 bp, Homo sapiens
tgccattgtgcaga

SEQ ID NO: 3039564 - DNA, 12 bp, Homo sapiens
tgccatttattt

SEQ ID NO: 3039565 - DNA, 14 bp, Homo sapiens
tgccatttatttat

SEQ ID NO: 3039566 - DNA, 21 bp, Homo sapiens
tgccatttttagtttaaaatc

SEQ ID NO: 3039567 - DNA, 15 bp, Homo sapiens
tgcccaaggatgcct

SEQ ID NO: 3039568 - DNA, 13 bp, Homo sapiens
tgcccaaggccac

SEQ ID NO: 3039569 - DNA, 15 bp, Homo sapiens
tgcccaagtgaccag

SEQ ID NO: 3039570 - DNA, 11 bp, Homo sapiens
tgcccacacac

SEQ ID NO: 3039571 - DNA, 17 bp, Homo sapiens
tgcccacacacactcct

SEQ ID NO: 3039572 - DNA, 21 bp, Homo sapiens
tgcccacacacactccttccc

SEQ ID NO: 3039573 - DNA, 12 bp, Homo sapiens
tgcccacaggcc

SEQ ID NO: 3039574 - DNA, 14 bp, Homo sapiens
tgcccacaggtgcg

SEQ ID NO: 3039575 - DNA, 15 bp, Homo sapiens
tgcccacctgcctgg

SEQ ID NO: 3039576 - DNA, 17 bp, Homo sapiens
tgcccacctgcctggcc

SEQ ID NO: 3039577 - DNA, 19 bp, Homo sapiens
tgcccacctgcctggccgg

SEQ ID NO: 3039578 - DNA, 17 bp, Homo sapiens
tgcccagaatgaggctg

SEQ ID NO: 3039579 - DNA, 16 bp, Homo sapiens
tgcccagagatgcctc

SEQ ID NO: 3039580 - DNA, 15 bp, Homo sapiens
tgcccagccactcca

SEQ ID NO: 3039581 - DNA, 17 bp, Homo sapiens
tgcccagccactccaag

SEQ ID NO: 3039582 - DNA, 19 bp, Homo sapiens
tgcccagccactccaagcc

SEQ ID NO: 3039583 - DNA, 16 bp, Homo sapiens
tgcccagccgggcaca

SEQ ID NO: 3039584 - DNA, 18 bp, Homo sapiens
tgcccagctatacctgtg

SEQ ID NO: 3039585 - DNA, 22 bp, Homo sapiens
tgcccaggagagccagccctcc

SEQ ID NO: 3039586 - DNA, 18 bp, Homo sapiens
tgcccaggctggagtgca

SEQ ID NO: 3039587 - DNA, 17 bp, Homo sapiens
tgcccagggtcagtgta

SEQ ID NO: 3039588 - DNA, 20 bp, Homo sapiens
tgcccagggtcagtgtatct

SEQ ID NO: 3039589 - DNA, 12 bp, Homo sapiens
tgcccatataaa

SEQ ID NO: 3039590 - DNA, 18 bp, Homo sapiens
tgcccatgagcaagccta

SEQ ID NO: 3039591 - DNA, 21 bp, Homo sapiens
tgcccatttcatattctttca

SEQ ID NO: 3039592 - DNA, 16 bp, Homo sapiens
tgccccactctgcctg

SEQ ID NO: 3039593 - DNA, 22 bp, Homo sapiens
tgccccagactgagctctccag

SEQ ID NO: 3039594 - DNA, 23 bp, Homo sapiens
tgccccagactgagctctccagg

SEQ ID NO: 3039595 - DNA, 13 bp, Homo sapiens
tgccccagccaac

SEQ ID NO: 3039596 - DNA, 13 bp, Homo sapiens
tgccccagccaga

SEQ ID NO: 3039597 - DNA, 18 bp, Homo sapiens
tgccccaggaccagctca

SEQ ID NO: 3039598 - DNA, 19 bp, Homo sapiens
tgccccaggaccagctcag

SEQ ID NO: 3039599 - DNA, 20 bp, Homo sapiens
tgccccaggaccagctcagg

SEQ ID NO: 3039600 - DNA, 20 bp, Homo sapiens
tgccccaggccggagcccag

SEQ ID NO: 3039601 - DNA, 20 bp, Homo sapiens
tgccccatcagtgctccctc

SEQ ID NO: 3039602 - DNA, 20 bp, Homo sapiens
tgccccatcctccagcaggg

SEQ ID NO: 3039603 - DNA, 21 bp, Homo sapiens
tgccccatcctccagcaggga

SEQ ID NO: 3039604 - DNA, 18 bp, Homo sapiens
tgccccattcttttgtaa

SEQ ID NO: 3039605 - DNA, 12 bp, Homo sapiens
tgcccccaagtc

SEQ ID NO: 3039606 - DNA, 13 bp, Homo sapiens
tgcccccagctgg

SEQ ID NO: 3039607 - DNA, 12 bp, Homo sapiens
tgccccccaggg

SEQ ID NO: 3039608 - DNA, 18 bp, Homo sapiens
tgcccccgacggctgtga

SEQ ID NO: 3039609 - DNA, 19 bp, Homo sapiens
tgcccccgacggctgtgac

SEQ ID NO: 3039610 - DNA, 19 bp, Homo sapiens
tgccccctcgggggcctgt

SEQ ID NO: 3039611 - DNA, 21 bp, Homo sapiens
tgccccctcgggggcctgtgg

SEQ ID NO: 3039612 - DNA, 15 bp, Homo sapiens
tgccccgcaggcctg

SEQ ID NO: 3039613 - DNA, 22 bp, Homo sapiens
tgccccgcaggcctgccttctc

SEQ ID NO: 3039614 - DNA, 17 bp, Homo sapiens
tgccccggcccctcccc

SEQ ID NO: 3039615 - DNA, 17 bp, Homo sapiens
tgccccgtctctgttcc

SEQ ID NO: 3039616 - DNA, 23 bp, Homo sapiens
tgcccctaagctggctgtacctg

SEQ ID NO: 3039617 - DNA, 20 bp, Homo sapiens
tgcccctagtaactgctgtc

SEQ ID NO: 3039618 - DNA, 12 bp, Homo sapiens
tgcccctcccag

SEQ ID NO: 3039619 - DNA, 21 bp, Homo sapiens
tgcccctcccagaacacactc

SEQ ID NO: 3039620 - DNA, 12 bp, Homo sapiens
tgcccctccccc

SEQ ID NO: 3039621 - DNA, 22 bp, Homo sapiens
tgcccctccctgcctccaccca

SEQ ID NO: 3039622 - DNA, 23 bp, Homo sapiens
tgcccctccctgcctccacccac

SEQ ID NO: 3039623 - DNA, 20 bp, Homo sapiens
tgcccctctccgaaagaaga

SEQ ID NO: 3039624 - DNA, 21 bp, Homo sapiens
tgcccctctctgggcctcaga

SEQ ID NO: 3039625 - DNA, 13 bp, Homo sapiens
tgccccttgccat

SEQ ID NO: 3039626 - DNA, 21 bp, Homo sapiens
tgcccgagtgcggcgtggaga

SEQ ID NO: 3039627 - DNA, 17 bp, Homo sapiens
tgcccgcaccctggcct

SEQ ID NO: 3039628 - DNA, 17 bp, Homo sapiens
tgcccgcagacctctgg

SEQ ID NO: 3039629 - DNA, 12 bp, Homo sapiens
tgcccgcctgcc

SEQ ID NO: 3039630 - DNA, 16 bp, Homo sapiens
tgcttctgatttagca

SEQ ID NO: 3039631 - DNA, 22 bp, Homo sapiens
tgcttctggctttgttcttgtc

SEQ ID NO: 3039632 - DNA, 15 bp, Homo sapiens
tgcttctgtctggtt

SEQ ID NO: 3039633 - DNA, 16 bp, Homo sapiens
tgcttcttagagaggc

SEQ ID NO: 3039634 - DNA, 16 bp, Homo sapiens
tgcttcttgtaatatt

SEQ ID NO: 3039635 - DNA, 21 bp, Homo sapiens
tgcttcttgtaatatttcttc

SEQ ID NO: 3039636 - DNA, 22 bp, Homo sapiens
tgcttctttctactttgtttat

SEQ ID NO: 3039637 - DNA, 19 bp, Homo sapiens
tgcttgagaatattgaagt

SEQ ID NO: 3039638 - DNA, 15 bp, Homo sapiens
tgcttgagctcagga

SEQ ID NO: 3039639 - DNA, 12 bp, Homo sapiens
tgcttgaggaaa

SEQ ID NO: 3039640 - DNA, 13 bp, Homo sapiens
tgcttgaggaaaa

SEQ ID NO: 3039641 - DNA, 16 bp, Homo sapiens
tgcttgaggaaaacaa

SEQ ID NO: 3039642 - DNA, 13 bp, Homo sapiens
tgcttgatagaaa

SEQ ID NO: 3039643 - DNA, 22 bp, Homo sapiens
tgcttgatgggattctggacag

SEQ ID NO: 3039644 - DNA, 15 bp, Homo sapiens
tgcttgcagccagga

SEQ ID NO: 3039645 - DNA, 22 bp, Homo sapiens
tgcttgcagccaggagaaggtc

SEQ ID NO: 3039646 - DNA, 19 bp, Homo sapiens
tgcttgcagtagattttct

SEQ ID NO: 3039647 - DNA, 15 bp, Homo sapiens
tgcttggagcaatca

SEQ ID NO: 3039648 - DNA, 17 bp, Homo sapiens
tgcttggagctgagcaa

SEQ ID NO: 3039649 - DNA, 19 bp, Homo sapiens
tgcttgggggtttttgaag

SEQ ID NO: 3039650 - DNA, 16 bp, Homo sapiens
tgcttgggtggagaag

SEQ ID NO: 3039651 - DNA, 18 bp, Homo sapiens
tgcttgggtggagaagcc

SEQ ID NO: 3039652 - DNA, 19 bp, Homo sapiens
tgcttgggtggagaagcca

SEQ ID NO: 3039653 - DNA, 22 bp, Homo sapiens
tgcttgggtggagaagccattg

SEQ ID NO: 3039654 - DNA, 16 bp, Homo sapiens
tgcttgtactaagcca

SEQ ID NO: 3039655 - DNA, 12 bp, Homo sapiens
tgcttgtgcctc

SEQ ID NO: 3039656 - DNA, 19 bp, Homo sapiens
tgcttgtgctcatgtgtgt

SEQ ID NO: 3039657 - DNA, 20 bp, Homo sapiens
tgcttgtgtaatttatgtga

SEQ ID NO: 3039658 - DNA, 15 bp, Homo sapiens
tgcttgttgtcaagt

SEQ ID NO: 3039659 - DNA, 20 bp, Homo sapiens
tgcttgttgtcaagtataaa

SEQ ID NO: 3039660 - DNA, 14 bp, Homo sapiens
tgcttgtttatgat

SEQ ID NO: 3039661 - DNA, 18 bp, Homo sapiens
tgcttgtttatgatattt

SEQ ID NO: 3039662 - DNA, 20 bp, Homo sapiens
tgcttgtttatgatatttct

SEQ ID NO: 3039663 - DNA, 13 bp, Homo sapiens
tgctttaaattaa

SEQ ID NO: 3039664 - DNA, 17 bp, Homo sapiens
tgctttaaattaaaatt

SEQ ID NO: 3039665 - DNA, 20 bp, Homo sapiens
tgctttacaggatcatgtaa

SEQ ID NO: 3039666 - DNA, 23 bp, Homo sapiens
tgctttacaggatcatgtaaatg

SEQ ID NO: 3039667 - DNA, 17 bp, Homo sapiens
tgctttaccaaacagca

SEQ ID NO: 3039668 - DNA, 22 bp, Homo sapiens
tgctttaccaaacagcaaacca

SEQ ID NO: 3039669 - DNA, 20 bp, Homo sapiens
tgctttataccccatttgat

SEQ ID NO: 3039670 - DNA, 20 bp, Homo sapiens
tgctttccgtggcactgcat

SEQ ID NO: 3039671 - DNA, 12 bp, Homo sapiens
tgctttctcccc

SEQ ID NO: 3039672 - DNA, 14 bp, Homo sapiens
tgctttctctttca

SEQ ID NO: 3039673 - DNA, 16 bp, Homo sapiens
tgctttctctttcagt

SEQ ID NO: 3039674 - DNA, 15 bp, Homo sapiens
tgctttctggtataa

SEQ ID NO: 3039675 - DNA, 19 bp, Homo sapiens
tgctttctggtataaagct

SEQ ID NO: 3039676 - DNA, 15 bp, Homo sapiens
tgctttctgttcatc

SEQ ID NO: 3039677 - DNA, 19 bp, Homo sapiens
tgctttctgttcatctctt

SEQ ID NO: 3039678 - DNA, 16 bp, Homo sapiens
tgctttcttctttcct

SEQ ID NO: 3039679 - DNA, 16 bp, Homo sapiens
tgctttgaaacagaaa

SEQ ID NO: 3039680 - DNA, 22 bp, Homo sapiens
tgctttgacgggccaggccctg

SEQ ID NO: 3039681 - DNA, 13 bp, Homo sapiens
tgctttgatattt

SEQ ID NO: 3039682 - DNA, 17 bp, Homo sapiens
tgctttgatatttcaat

SEQ ID NO: 3039683 - DNA, 15 bp, Homo sapiens
tgctttgcattttga

SEQ ID NO: 3039684 - DNA, 16 bp, Homo sapiens
tgctttgcattttgat

SEQ ID NO: 3039685 - DNA, 19 bp, Homo sapiens
tgctttgcctcgaaagtgt

SEQ ID NO: 3039686 - DNA, 20 bp, Homo sapiens
tgctttgcctcgaaagtgtc

SEQ ID NO: 3039687 - DNA, 22 bp, Homo sapiens
tgctttgcctcgaaagtgtcat

SEQ ID NO: 3039688 - DNA, 18 bp, Homo sapiens
tgctttgctttgtctgga

SEQ ID NO: 3039689 - DNA, 21 bp, Homo sapiens
tgctttggaagatgcagaagc

SEQ ID NO: 3039690 - DNA, 15 bp, Homo sapiens
tgctttgggaagccg

SEQ ID NO: 3039691 - DNA, 11 bp, Homo sapiens
tgctttgtagg

SEQ ID NO: 3039692 - DNA, 21 bp, Homo sapiens
tgctttgtctggaagaaagat

SEQ ID NO: 3039693 - DNA, 15 bp, Homo sapiens
tgctttgtggcttct

SEQ ID NO: 3039694 - DNA, 13 bp, Homo sapiens
tgctttgttgttc

SEQ ID NO: 3039695 - DNA, 18 bp, Homo sapiens
tgcttttagtaaaaacat

SEQ ID NO: 3039696 - DNA, 16 bp, Homo sapiens
tgcttttatagttgta

SEQ ID NO: 3039697 - DNA, 13 bp, Homo sapiens
tgcttttatccac

SEQ ID NO: 3039698 - DNA, 11 bp, Homo sapiens
tgcttttctct

SEQ ID NO: 3039699 - DNA, 18 bp, Homo sapiens
tgcttttctctcagcata

SEQ ID NO: 3039700 - DNA, 18 bp, Homo sapiens
tgcttttgcccatataaa

SEQ ID NO: 3039701 - DNA, 17 bp, Homo sapiens
tgctttttaagtgttaa

SEQ ID NO: 3039702 - DNA, 21 bp, Homo sapiens
tggaaaaaaaaaaaagaggaa

SEQ ID NO: 3039703 - DNA, 16 bp, Homo sapiens
tggaaaaaaaaaagac

SEQ ID NO: 3039704 - DNA, 14 bp, Homo sapiens
tggaaaaaaacata

SEQ ID NO: 3039705 - DNA, 15 bp, Homo sapiens
tggaaaaaaacataa

SEQ ID NO: 3039706 - DNA, 15 bp, Homo sapiens
tggaaaacagggtgc

SEQ ID NO: 3039707 - DNA, 13 bp, Homo sapiens
tggaaaagaaatc

SEQ ID NO: 3039708 - DNA, 15 bp, Homo sapiens
tggaaaagccttctt

SEQ ID NO: 3039709 - DNA, 22 bp, Homo sapiens
tggaaaaggaaaaaaatccact

SEQ ID NO: 3039710 - DNA, 16 bp, Homo sapiens
tggaaaatataatgat

SEQ ID NO: 3039711 - DNA, 22 bp, Homo sapiens
tggaaaatctgtaaaaaagaaa

SEQ ID NO: 3039712 - DNA, 12 bp, Homo sapiens
tggaaaatgtat

SEQ ID NO: 3039713 - DNA, 18 bp, Homo sapiens
tggaaaatgtatattttg

SEQ ID NO: 3039714 - DNA, 19 bp, Homo sapiens
tggaaacagaggtaaaaaa

SEQ ID NO: 3039715 - DNA, 20 bp, Homo sapiens
tggaaacagaggtaaaaaaa

SEQ ID NO: 3039716 - DNA, 22 bp, Homo sapiens
tggaaacagaggtaaaaaaaag

SEQ ID NO: 3039717 - DNA, 23 bp, Homo sapiens
tggaaacagaggtaaaaaaaaga

SEQ ID NO: 3039718 - DNA, 18 bp, Homo sapiens
tggaaacccgagggttga

SEQ ID NO: 3039719 - DNA, 20 bp, Homo sapiens
tggaaacctagccagcttca

SEQ ID NO: 3039720 - DNA, 17 bp, Homo sapiens
tggaaacttctgtaagg

SEQ ID NO: 3039721 - DNA, 12 bp, Homo sapiens
tggaaagacagg

SEQ ID NO: 3039722 - DNA, 19 bp, Homo sapiens
tggaaagaggtgaaaatga

SEQ ID NO: 3039723 - DNA, 23 bp, Homo sapiens
tggaaagataactaggaaatcca

SEQ ID NO: 3039724 - DNA, 19 bp, Homo sapiens
tggaaagcaaggtttcctt

SEQ ID NO: 3039725 - DNA, 16 bp, Homo sapiens
tggaaaggatcacaga

SEQ ID NO: 3039726 - DNA, 17 bp, Homo sapiens
tggaaaggatcacagat

SEQ ID NO: 3039727 - DNA, 17 bp, Homo sapiens
tggaaagggagggagga

SEQ ID NO: 3039728 - DNA, 15 bp, Homo sapiens
tggaaagtcctccta

SEQ ID NO: 3039729 - DNA, 17 bp, Homo sapiens
tggaaagtgattttatt

SEQ ID NO: 3039730 - DNA, 21 bp, Homo sapiens
tggaaagtgtaaagcattcca

SEQ ID NO: 3039731 - DNA, 14 bp, Homo sapiens
tggaaatacacagt

SEQ ID NO: 3039732 - DNA, 20 bp, Homo sapiens
tggaaatactgatggaagca

SEQ ID NO: 3039733 - DNA, 22 bp, Homo sapiens
tggaaatatcagttactcagcc

SEQ ID NO: 3039734 - DNA, 15 bp, Homo sapiens
tggaaatctggattt

SEQ ID NO: 3039735 - DNA, 20 bp, Homo sapiens
tggaaatgctgggctgacgg

SEQ ID NO: 3039736 - DNA, 20 bp, Homo sapiens
tggaacaccagcagcactgg

SEQ ID NO: 3039737 - DNA, 20 bp, Homo sapiens
tggaacactagacaagccag

SEQ ID NO: 3039738 - DNA, 17 bp, Homo sapiens
tggaacagggttggcat

SEQ ID NO: 3039739 - DNA, 13 bp, Homo sapiens
tggaacagtgaaa

SEQ ID NO: 3039740 - DNA, 21 bp, Homo sapiens
tggaacatgcttttactttat

SEQ ID NO: 3039741 - DNA, 13 bp, Homo sapiens
tggaaccaaagtc

SEQ ID NO: 3039742 - DNA, 18 bp, Homo sapiens
tggaaccaaagtctaaac

SEQ ID NO: 3039743 - DNA, 13 bp, Homo sapiens
tggaaccacctgg

SEQ ID NO: 3039744 - DNA, 19 bp, Homo sapiens
tggaaccagcaagtcccag

SEQ ID NO: 3039745 - DNA, 14 bp, Homo sapiens
tggaacccagactc

SEQ ID NO: 3039746 - DNA, 17 bp, Homo sapiens
tggaacccagactcaga

SEQ ID NO: 3039747 - DNA, 19 bp, Homo sapiens
tggaaccgcaggaagctgc

SEQ ID NO: 3039748 - DNA, 20 bp, Homo sapiens
tggaaccgcaggaagctgct

SEQ ID NO: 3039749 - DNA, 17 bp, Homo sapiens
tggaacctcagcctggc

SEQ ID NO: 3039750 - DNA, 23 bp, Homo sapiens
tggaacctcagcctggccagaca

SEQ ID NO: 3039751 - DNA, 19 bp, Homo sapiens
tggaacctgcaaaaaatac

SEQ ID NO: 3039752 - DNA, 20 bp, Homo sapiens
tggaactattccatcaatag

SEQ ID NO: 3039753 - DNA, 18 bp, Homo sapiens
tggaactcgtgtctggca

SEQ ID NO: 3039754 - DNA, 11 bp, Homo sapiens
tggaactcttg

SEQ ID NO: 3039755 - DNA, 12 bp, Homo sapiens
tggaactgtccc

SEQ ID NO: 3039756 - DNA, 22 bp, Homo sapiens
tggaagaaaatggaattactcc

SEQ ID NO: 3039757 - DNA, 12 bp, Homo sapiens
tggaagaagcag

SEQ ID NO: 3039758 - DNA, 14 bp, Homo sapiens
tggaagaagcagcg

SEQ ID NO: 3039759 - DNA, 18 bp, Homo sapiens
tggaagacatatattata

SEQ ID NO: 3039760 - DNA, 21 bp, Homo sapiens
tggaagacatatattatatat

SEQ ID NO: 3039761 - DNA, 23 bp, Homo sapiens
tggaagacatatattatatatag

SEQ ID NO: 3039762 - DNA, 19 bp, Homo sapiens
tgggaaagatggataaact

SEQ ID NO: 3039763 - DNA, 16 bp, Homo sapiens
tgggaaaggagtagaa

SEQ ID NO: 3039764 - DNA, 16 bp, Homo sapiens
tgggaaagtattctgt

SEQ ID NO: 3039765 - DNA, 16 bp, Homo sapiens
tgggaaatgagcaggg

SEQ ID NO: 3039766 - DNA, 21 bp, Homo sapiens
tgggaacagcatggaggcaga

SEQ ID NO: 3039767 - DNA, 14 bp, Homo sapiens
tgggaacgcagcct

SEQ ID NO: 3039768 - DNA, 15 bp, Homo sapiens
tgggaacgcagcctc

SEQ ID NO: 3039769 - DNA, 23 bp, Homo sapiens
tgggaacggctgatgtggactgt

SEQ ID NO: 3039770 - DNA, 16 bp, Homo sapiens
tgggaacgtgactgcc

SEQ ID NO: 3039771 - DNA, 22 bp, Homo sapiens
tgggaagactgttgtgctccat

SEQ ID NO: 3039772 - DNA, 21 bp, Homo sapiens
tgggaagggagagcggggcag

SEQ ID NO: 3039773 - DNA, 17 bp, Homo sapiens
tgggaaggggaggaccc

SEQ ID NO: 3039774 - DNA, 18 bp, Homo sapiens
tgggaagtcgaggctgca

SEQ ID NO: 3039775 - DNA, 15 bp, Homo sapiens
tgggaagtgaagact

SEQ ID NO: 3039776 - DNA, 22 bp, Homo sapiens
tgggaagtggaggttgagtgag

SEQ ID NO: 3039777 - DNA, 13 bp, Homo sapiens
tgggaataaatat

SEQ ID NO: 3039778 - DNA, 14 bp, Homo sapiens
tgggaataaatatg

SEQ ID NO: 3039779 - DNA, 15 bp, Homo sapiens
tgggaatgaagcttg

SEQ ID NO: 3039780 - DNA, 18 bp, Homo sapiens
tgggaatgaagcttgtgt

SEQ ID NO: 3039781 - DNA, 19 bp, Homo sapiens
tgggaatgaagcttgtgta

SEQ ID NO: 3039782 - DNA, 21 bp, Homo sapiens
tgggaatgaagcttgtgtatc

SEQ ID NO: 3039783 - DNA, 21 bp, Homo sapiens
tgggacactgcgggacagagg

SEQ ID NO: 3039784 - DNA, 15 bp, Homo sapiens
tgggaccaggtctgt

SEQ ID NO: 3039785 - DNA, 13 bp, Homo sapiens
tgggaccccaggc

SEQ ID NO: 3039786 - DNA, 13 bp, Homo sapiens
tgggaccctgctt

SEQ ID NO: 3039787 - DNA, 13 bp, Homo sapiens
tgggaccctttcc

SEQ ID NO: 3039788 - DNA, 14 bp, Homo sapiens
tgggaccctttcct

SEQ ID NO: 3039789 - DNA, 17 bp, Homo sapiens
tgggacctgatttattg

SEQ ID NO: 3039790 - DNA, 15 bp, Homo sapiens
tgggacgtggctcag

SEQ ID NO: 3039791 - DNA, 16 bp, Homo sapiens
tgggacgtggctcagc

SEQ ID NO: 3039792 - DNA, 16 bp, Homo sapiens
tgggactgattctgtt

SEQ ID NO: 3039793 - DNA, 22 bp, Homo sapiens
tgggacttcttttcacattctt

SEQ ID NO: 3039794 - DNA, 21 bp, Homo sapiens
tgggagaaaacgccagtgtgt

SEQ ID NO: 3039795 - DNA, 19 bp, Homo sapiens
tgggagaaatctggcttct

SEQ ID NO: 3039796 - DNA, 18 bp, Homo sapiens
tgggagaaattgacagat

SEQ ID NO: 3039797 - DNA, 22 bp, Homo sapiens
tgggagaattcttacatgtttt

SEQ ID NO: 3039798 - DNA, 23 bp, Homo sapiens
tgggagattcaagggacccatga

SEQ ID NO: 3039799 - DNA, 11 bp, Homo sapiens
tgggagcagga

SEQ ID NO: 3039800 - DNA, 14 bp, Homo sapiens
tgggagccgggtct

SEQ ID NO: 3039801 - DNA, 11 bp, Homo sapiens
tgggagcctga

SEQ ID NO: 3039802 - DNA, 17 bp, Homo sapiens
tgggagcctgaggcagg

SEQ ID NO: 3039803 - DNA, 19 bp, Homo sapiens
tgggagccttttgacagct

SEQ ID NO: 3039804 - DNA, 20 bp, Homo sapiens
tgggagctcatgtgtccctg

SEQ ID NO: 3039805 - DNA, 21 bp, Homo sapiens
tgggaggaaagggcctggcca

SEQ ID NO: 3039806 - DNA, 22 bp, Homo sapiens
tgggaggaaagggcctggccag

SEQ ID NO: 3039807 - DNA, 13 bp, Homo sapiens
tgggaggagcaga

SEQ ID NO: 3039808 - DNA, 14 bp, Homo sapiens
tgggaggcacagca

SEQ ID NO: 3039809 - DNA, 11 bp, Homo sapiens
tgggaggcagg

SEQ ID NO: 3039810 - DNA, 19 bp, Homo sapiens
tgggaggccaaggtgggcg

SEQ ID NO: 3039811 - DNA, 20 bp, Homo sapiens
tgggaggccccactggggaa

SEQ ID NO: 3039812 - DNA, 13 bp, Homo sapiens
tgggaggctcacc

SEQ ID NO: 3039813 - DNA, 18 bp, Homo sapiens
tgggaggctgaggcagga

SEQ ID NO: 3039814 - DNA, 18 bp, Homo sapiens
tgggaggctgcagccagg

SEQ ID NO: 3039815 - DNA, 20 bp, Homo sapiens
tgggaggctgcagccaggcc

SEQ ID NO: 3039816 - DNA, 22 bp, Homo sapiens
tgggagggaggctcaggtccct

SEQ ID NO: 3039817 - DNA, 14 bp, Homo sapiens
tgggagggatggcc

SEQ ID NO: 3039818 - DNA, 19 bp, Homo sapiens
tgggagggcagcagggcta

SEQ ID NO: 3039819 - DNA, 24 bp, Homo sapiens
tgggaggggccatgctgtgtgaga

SEQ ID NO: 3039820 - DNA, 20 bp, Homo sapiens
tgggaggtctcgtcccagcc

SEQ ID NO: 3039821 - DNA, 15 bp, Homo sapiens
tgggagtcacacagt

SEQ ID NO: 3039822 - DNA, 22 bp, Homo sapiens
tgggagttgatcgcctttccca

SEQ ID NO: 3039823 - DNA, 13 bp, Homo sapiens
tgggataggaaaa

SEQ ID NO: 3039824 - DNA, 21 bp, Homo sapiens
tgggataggaaaaatgagtaa

SEQ ID NO: 3039825 - DNA, 16 bp, Homo sapiens
tgggatattttgaaat

SEQ ID NO: 3039826 - DNA, 17 bp, Homo sapiens
tgggatattttgaaatg

SEQ ID NO: 3039827 - DNA, 13 bp, Homo sapiens
tgggatcccacag

SEQ ID NO: 3039828 - DNA, 19 bp, Homo sapiens
tgggatcccacagccctag

SEQ ID NO: 3039829 - DNA, 16 bp, Homo sapiens
tgggatggtggagggc

SEQ ID NO: 3039830 - DNA, 21 bp, Homo sapiens
tgggatgtatgaatacagcag

SEQ ID NO: 3039831 - DNA, 21 bp, Homo sapiens
tgggattacaggcatgtgcca

SEQ ID NO: 3039832 - DNA, 21 bp, Homo sapiens
tgggattacagggatgagcca

SEQ ID NO: 3039833 - DNA, 13 bp, Homo sapiens
tgggattagaaac

SEQ ID NO: 3039834 - DNA, 15 bp, Homo sapiens
tgggattagaaacaa

SEQ ID NO: 3039835 - DNA, 19 bp, Homo sapiens
tgggattgagtctgtgcca

SEQ ID NO: 3039836 - DNA, 17 bp, Homo sapiens
tgggatttctatgcagt

SEQ ID NO: 3039837 - DNA, 16 bp, Homo sapiens
tgggcaaaaaactcga

SEQ ID NO: 3039838 - DNA, 16 bp, Homo sapiens
tgggcaatttagaaaa

SEQ ID NO: 3039839 - DNA, 19 bp, Homo sapiens
tgggcacaaagggcccaga

SEQ ID NO: 3039840 - DNA, 21 bp, Homo sapiens
tgggcacacgcctcccactgg

SEQ ID NO: 3039841 - DNA, 14 bp, Homo sapiens
tgggcacccaccct

SEQ ID NO: 3039842 - DNA, 21 bp, Homo sapiens
tgggcacctgcgcacaggtgg

SEQ ID NO: 3039843 - DNA, 20 bp, Homo sapiens
tgggcacttccctgctgcct

SEQ ID NO: 3039844 - DNA, 17 bp, Homo sapiens
tgggcagaatcctgggc

SEQ ID NO: 3039845 - DNA, 13 bp, Homo sapiens
tgggcagagccca

SEQ ID NO: 3039846 - DNA, 17 bp, Homo sapiens
tgggcagcagcatccca

SEQ ID NO: 3039847 - DNA, 21 bp, Homo sapiens
tgggcagcagcatcccagcct

SEQ ID NO: 3039848 - DNA, 18 bp, Homo sapiens
tgggcagccatcttgaat

SEQ ID NO: 3039849 - DNA, 16 bp, Homo sapiens
tgggcagcccaacagc

SEQ ID NO: 3039850 - DNA, 13 bp, Homo sapiens
tgggcagccttgg

SEQ ID NO: 3039851 - DNA, 21 bp, Homo sapiens
tgggcaggagtcaccatgcaa

SEQ ID NO: 3039852 - DNA, 23 bp, Homo sapiens
tgggcagggacccggggtctcct

SEQ ID NO: 3039853 - DNA, 21 bp, Homo sapiens
tgggcagggtctgtttggact

SEQ ID NO: 3039854 - DNA, 20 bp, Homo sapiens
tgggcaggtggccgcccctg

SEQ ID NO: 3039855 - DNA, 18 bp, Homo sapiens
tgggcaggtggcctctgc

SEQ ID NO: 3039856 - DNA, 19 bp, Homo sapiens
tgggcaggtggcctctgct

SEQ ID NO: 3039857 - DNA, 21 bp, Homo sapiens
tgggcaggtggcctctgctgg

SEQ ID NO: 3039858 - DNA, 12 bp, Homo sapiens
tgggcagtgccc

SEQ ID NO: 3039859 - DNA, 14 bp, Homo sapiens
tgggcatgtgggct

SEQ ID NO: 3039860 - DNA, 14 bp, Homo sapiens
tgggcattgctttc

SEQ ID NO: 3039861 - DNA, 14 bp, Homo sapiens
tgggccagcccctc

SEQ ID NO: 3039862 - DNA, 22 bp, Homo sapiens
tgggccagcccctccatctgta

SEQ ID NO: 3039863 - DNA, 17 bp, Homo sapiens
tgggccaggacaggccc

SEQ ID NO: 3039864 - DNA, 18 bp, Homo sapiens
tgggccaggacaggcccg

SEQ ID NO: 3039865 - DNA, 21 bp, Homo sapiens
tgggccatggctttcatcctg

SEQ ID NO: 3039866 - DNA, 19 bp, Homo sapiens
tgggccatgggtcctcggc

SEQ ID NO: 3039867 - DNA, 20 bp, Homo sapiens
tgggcccacagcccccaccc

SEQ ID NO: 3039868 - DNA, 23 bp, Homo sapiens
tgggcccacagcccccaccccag

SEQ ID NO: 3039869 - DNA, 18 bp, Homo sapiens
tgggcccaggcaggtctg

SEQ ID NO: 3039870 - DNA, 23 bp, Homo sapiens
tgggccccaccacctaggccact

SEQ ID NO: 3039871 - DNA, 12 bp, Homo sapiens
tgggccccagct

SEQ ID NO: 3039872 - DNA, 23 bp, Homo sapiens
tgggcccccagagacctttgccc

SEQ ID NO: 3039873 - DNA, 12 bp, Homo sapiens
tgggcccctccc

SEQ ID NO: 3039874 - DNA, 20 bp, Homo sapiens
tgggcccctcccctcagagc

SEQ ID NO: 3039875 - DNA, 13 bp, Homo sapiens
tgggccctttgag

SEQ ID NO: 3039876 - DNA, 22 bp, Homo sapiens
tgggcctcagtgtgcccatctg

SEQ ID NO: 3039877 - DNA, 15 bp, Homo sapiens
tgggcctcggcccct

SEQ ID NO: 3039878 - DNA, 16 bp, Homo sapiens
tgggcctgacctccag

SEQ ID NO: 3039879 - DNA, 21 bp, Homo sapiens
tgggcctgacctccagtcctg

SEQ ID NO: 3039880 - DNA, 14 bp, Homo sapiens
tgggcctgctccag

SEQ ID NO: 3039881 - DNA, 23 bp, Homo sapiens
tgggcctggccagtcttcctctt

SEQ ID NO: 3039882 - DNA, 22 bp, Homo sapiens
tgggcgcggtggctcacgcctg

SEQ ID NO: 3039883 - DNA, 23 bp, Homo sapiens
tgggcgcggtggctcacgcctgt

SEQ ID NO: 3039884 - DNA, 21 bp, Homo sapiens
tgggcgctctccctaccttgc

SEQ ID NO: 3039885 - DNA, 23 bp, Homo sapiens
tgggctaaacccagatggtttcc

SEQ ID NO: 3039886 - DNA, 21 bp, Homo sapiens
tgggctaacatttaggagaag

SEQ ID NO: 3039887 - DNA, 16 bp, Homo sapiens
tgggctactttgtcct

SEQ ID NO: 3039888 - DNA, 22 bp, Homo sapiens
tgggctatattcctgacaaaag

SEQ ID NO: 3039889 - DNA, 23 bp, Homo sapiens
tgggctcagagagtacactgtgt

SEQ ID NO: 3039890 - DNA, 12 bp, Homo sapiens
tgggctccccag

SEQ ID NO: 3039891 - DNA, 15 bp, Homo sapiens
tgggctccctgactg

SEQ ID NO: 3039892 - DNA, 14 bp, Homo sapiens
tgggctctccacct

SEQ ID NO: 3039893 - DNA, 20 bp, Homo sapiens
tgtaaccacctctctgtctt

SEQ ID NO: 3039894 - DNA, 13 bp, Homo sapiens
tgtaacctcgtgt

SEQ ID NO: 3039895 - DNA, 14 bp, Homo sapiens
tgtaaccttgggtg

SEQ ID NO: 3039896 - DNA, 13 bp, Homo sapiens
tgtaactccacca

SEQ ID NO: 3039897 - DNA, 21 bp, Homo sapiens
tgtaactggtagtgttcagta

SEQ ID NO: 3039898 - DNA, 17 bp, Homo sapiens
tgtaacttttaatccct

SEQ ID NO: 3039899 - DNA, 19 bp, Homo sapiens
tgtaagatcgttctctgcc

SEQ ID NO: 3039900 - DNA, 18 bp, Homo sapiens
tgtaagcaacttgcttct

SEQ ID NO: 3039901 - DNA, 22 bp, Homo sapiens
tgtaagcttagattttctgtaa

SEQ ID NO: 3039902 - DNA, 15 bp, Homo sapiens
tgtaaggaactggaa

SEQ ID NO: 3039903 - DNA, 14 bp, Homo sapiens
tgtaaggtctttgt

SEQ ID NO: 3039904 - DNA, 15 bp, Homo sapiens
tgtaaggtctttgta

SEQ ID NO: 3039905 - DNA, 16 bp, Homo sapiens
tgtaaggtctttgtaa

SEQ ID NO: 3039906 - DNA, 18 bp, Homo sapiens
tgtaagtatttaagtgat

SEQ ID NO: 3039907 - DNA, 18 bp, Homo sapiens
tgtaataatgtaacatga

SEQ ID NO: 3039908 - DNA, 22 bp, Homo sapiens
tgtaataatgtaacatgatttc

SEQ ID NO: 3039909 - DNA, 20 bp, Homo sapiens
tgtaatatactgagctgcta

SEQ ID NO: 3039910 - DNA, 13 bp, Homo sapiens
tgtaatcaataaa

SEQ ID NO: 3039911 - DNA, 13 bp, Homo sapiens
tgtaatcccagaa

SEQ ID NO: 3039912 - DNA, 13 bp, Homo sapiens
tgtaatcccagca

SEQ ID NO: 3039913 - DNA, 17 bp, Homo sapiens
tgtaatcccagcacact

SEQ ID NO: 3039914 - DNA, 20 bp, Homo sapiens
tgtaatcccagctactcagg

SEQ ID NO: 3039915 - DNA, 16 bp, Homo sapiens
tgtaatctcaatgcaa

SEQ ID NO: 3039916 - DNA, 18 bp, Homo sapiens
tgtaatctcgtttcaaaa

SEQ ID NO: 3039917 - DNA, 15 bp, Homo sapiens
tgtaatcttgaattg

SEQ ID NO: 3039918 - DNA, 21 bp, Homo sapiens
tgtaatcttgaattgtaactg

SEQ ID NO: 3039919 - DNA, 22 bp, Homo sapiens
tgtaatgcgattttattactgg

SEQ ID NO: 3039920 - DNA, 19 bp, Homo sapiens
tgtaatgtcaccaccttcc

SEQ ID NO: 3039921 - DNA, 23 bp, Homo sapiens
tgtaatgtcaccaccttcccagc

SEQ ID NO: 3039922 - DNA, 13 bp, Homo sapiens
tgtaatgttttct

SEQ ID NO: 3039923 - DNA, 13 bp, Homo sapiens
tgtaattgtgtaa

SEQ ID NO: 3039924 - DNA, 14 bp, Homo sapiens
tgtaattgtgtaaa

SEQ ID NO: 3039925 - DNA, 15 bp, Homo sapiens
tgtaattgttccttt

SEQ ID NO: 3039926 - DNA, 20 bp, Homo sapiens
tgtaatttagttaataaaat

SEQ ID NO: 3039927 - DNA, 16 bp, Homo sapiens
tgtaatttatgtgaaa

SEQ ID NO: 3039928 - DNA, 21 bp, Homo sapiens
tgtaatttctttgcctgttca

SEQ ID NO: 3039929 - DNA, 19 bp, Homo sapiens
tgtaatttgatgaggtatt

SEQ ID NO: 3039930 - DNA, 16 bp, Homo sapiens
tgtacaagatgaagga

SEQ ID NO: 3039931 - DNA, 13 bp, Homo sapiens
tgtacaagttgct

SEQ ID NO: 3039932 - DNA, 18 bp, Homo sapiens
tgtacagaagaaactgaa

SEQ ID NO: 3039933 - DNA, 15 bp, Homo sapiens
tgtacagacagagaa

SEQ ID NO: 3039934 - DNA, 14 bp, Homo sapiens
tgtacagacatatt

SEQ ID NO: 3039935 - DNA, 19 bp, Homo sapiens
tgtacagacatatttaact

SEQ ID NO: 3039936 - DNA, 17 bp, Homo sapiens
tgtacagtctcaatttt

SEQ ID NO: 3039937 - DNA, 22 bp, Homo sapiens
tgtacagtctcaattttgtatt

SEQ ID NO: 3039938 - DNA, 18 bp, Homo sapiens
tgtacagttatctaagtt

SEQ ID NO: 3039939 - DNA, 15 bp, Homo sapiens
tgtacagtttaacag

SEQ ID NO: 3039940 - DNA, 20 bp, Homo sapiens
tgtacatagtaaagtatttt

SEQ ID NO: 3039941 - DNA, 20 bp, Homo sapiens
tgtacatcccatgtaacaga

SEQ ID NO: 3039942 - DNA, 21 bp, Homo sapiens
tgtacatcccatgtaacagaa

SEQ ID NO: 3039943 - DNA, 18 bp, Homo sapiens
tgtacatgacatcaaaat

SEQ ID NO: 3039944 - DNA, 13 bp, Homo sapiens
tgtacatgtacat

SEQ ID NO: 3039945 - DNA, 14 bp, Homo sapiens
tgtacatgtacata

SEQ ID NO: 3039946 - DNA, 17 bp, Homo sapiens
tgtacatgtgtagcctg

SEQ ID NO: 3039947 - DNA, 21 bp, Homo sapiens
tgtacatgtgtagcctgtgca

SEQ ID NO: 3039948 - DNA, 18 bp, Homo sapiens
tgtacatttccaaattca

SEQ ID NO: 3039949 - DNA, 21 bp, Homo sapiens
tgtacatttccaaattcacaa

SEQ ID NO: 3039950 - DNA, 22 bp, Homo sapiens
tgtacatttccaaattcacaag

SEQ ID NO: 3039951 - DNA, 16 bp, Homo sapiens
tgtacatttctataaa

SEQ ID NO: 3039952 - DNA, 18 bp, Homo sapiens
tgtacattttggatttct

SEQ ID NO: 3039953 - DNA, 19 bp, Homo sapiens
tgtacattttggatttctt

SEQ ID NO: 3039954 - DNA, 19 bp, Homo sapiens
tgtacatttttaaattctt

SEQ ID NO: 3039955 - DNA, 17 bp, Homo sapiens
tgtaccacaccctgcct

SEQ ID NO: 3039956 - DNA, 18 bp, Homo sapiens
tgtaccacaccctgcctg

SEQ ID NO: 3039957 - DNA, 20 bp, Homo sapiens
tgtaccacaccctgcctgct

SEQ ID NO: 3039958 - DNA, 21 bp, Homo sapiens
tgtaccagtgaatttttgcaa

SEQ ID NO: 3039959 - DNA, 22 bp, Homo sapiens
tgtaccagtgaatttttgcaat

SEQ ID NO: 3039960 - DNA, 14 bp, Homo sapiens
tgtaccatttgcct

SEQ ID NO: 3039961 - DNA, 22 bp, Homo sapiens
tgtacccttaagtcaccctagc

SEQ ID NO: 3039962 - DNA, 14 bp, Homo sapiens
tgtacctaaagcaa

SEQ ID NO: 3039963 - DNA, 20 bp, Homo sapiens
tgtacctcctctcagtgttt

SEQ ID NO: 3039964 - DNA, 18 bp, Homo sapiens
tgtacctgcccccaatcc

SEQ ID NO: 3039965 - DNA, 15 bp, Homo sapiens
tgtaccttttaacac

SEQ ID NO: 3039966 - DNA, 22 bp, Homo sapiens
tgtaccttttaacacctgatgt

SEQ ID NO: 3039967 - DNA, 17 bp, Homo sapiens
tgtacgtagccacagga

SEQ ID NO: 3039968 - DNA, 18 bp, Homo sapiens
tgtacgtagccacaggag

SEQ ID NO: 3039969 - DNA, 20 bp, Homo sapiens
tgtacgtttgtatgtgtgta

SEQ ID NO: 3039970 - DNA, 16 bp, Homo sapiens
tgtactaagccaggag

SEQ ID NO: 3039971 - DNA, 22 bp, Homo sapiens
tgtactgaataggttccccaat

SEQ ID NO: 3039972 - DNA, 16 bp, Homo sapiens
tgtactggtaattgta

SEQ ID NO: 3039973 - DNA, 19 bp, Homo sapiens
tgtactggtaattgtacaa

SEQ ID NO: 3039974 - DNA, 20 bp, Homo sapiens
tgtactggtaattgtacaat

SEQ ID NO: 3039975 - DNA, 15 bp, Homo sapiens
tgtactgttactggg

SEQ ID NO: 3039976 - DNA, 23 bp, Homo sapiens
tgtacttttattttacacagaaa

SEQ ID NO: 3039977 - DNA, 12 bp, Homo sapiens
tgtacttttcat

SEQ ID NO: 3039978 - DNA, 17 bp, Homo sapiens
tgtacttttcattctct

SEQ ID NO: 3039979 - DNA, 21 bp, Homo sapiens
tgtactttttagtaatttctt

SEQ ID NO: 3039980 - DNA, 16 bp, Homo sapiens
tgtactttttgttcca

SEQ ID NO: 3039981 - DNA, 18 bp, Homo sapiens
tgtactttttgttccaga

SEQ ID NO: 3039982 - DNA, 23 bp, Homo sapiens
tgtagaaaatttgttattttgca

SEQ ID NO: 3039983 - DNA, 16 bp, Homo sapiens
tgtagaaagatacact

SEQ ID NO: 3039984 - DNA, 19 bp, Homo sapiens
tgtagaagaagtgaacact

SEQ ID NO: 3039985 - DNA, 20 bp, Homo sapiens
tgtagaagaagtgaacactt

SEQ ID NO: 3039986 - DNA, 14 bp, Homo sapiens
tgtagaataaatga

SEQ ID NO: 3039987 - DNA, 13 bp, Homo sapiens
tgtagaatgtaat

SEQ ID NO: 3039988 - DNA, 17 bp, Homo sapiens
tgtagaatgtattgtac

SEQ ID NO: 3039989 - DNA, 14 bp, Homo sapiens
tgtagaattgaaaa

SEQ ID NO: 3039990 - DNA, 21 bp, Homo sapiens
tgtagacattatcttttggct

SEQ ID NO: 3039991 - DNA, 17 bp, Homo sapiens
tgtagagaaaaggaggg

SEQ ID NO: 3039992 - DNA, 14 bp, Homo sapiens
tgtagagccagcct

SEQ ID NO: 3039993 - DNA, 17 bp, Homo sapiens
tgtagaggcataaacct

SEQ ID NO: 3039994 - DNA, 20 bp, Homo sapiens
tgtagagtggcgattgaatg

SEQ ID NO: 3039995 - DNA, 17 bp, Homo sapiens
tgtagataatacagttc

SEQ ID NO: 3039996 - DNA, 18 bp, Homo sapiens
tgtagatgcagaaaaaga

SEQ ID NO: 3039997 - DNA, 16 bp, Homo sapiens
tgtagatggaaaaact

SEQ ID NO: 3039998 - DNA, 19 bp, Homo sapiens
tgtagatggaaaaacttgt

SEQ ID NO: 3039999 - DNA, 20 bp, Homo sapiens
tgtagatggcactttagtga

SEQ ID NO: 3040000 - DNA, 22 bp, Homo sapiens
tgtagcaaaattcttaagtatg

SEQ ID NO: 3040001 - DNA, 16 bp, Homo sapiens
tgtagcaggtttcact

SEQ ID NO: 3040002 - DNA, 18 bp, Homo sapiens
tgtagcaggtttcactat

SEQ ID NO: 3040003 - DNA, 16 bp, Homo sapiens
tgtagccacaccagga

SEQ ID NO: 3040004 - DNA, 18 bp, Homo sapiens
tgtagccacaccaggata

SEQ ID NO: 3040005 - DNA, 18 bp, Homo sapiens
tgtagccaggtccccctg

SEQ ID NO: 3040006 - DNA, 20 bp, Homo sapiens
tgtagccaggtccccctgca

SEQ ID NO: 3040007 - DNA, 16 bp, Homo sapiens
tgtagccccagtgaca

SEQ ID NO: 3040008 - DNA, 21 bp, Homo sapiens
tgtagccccagtgacagctag

SEQ ID NO: 3040009 - DNA, 19 bp, Homo sapiens
tgtagccccctggcctctg

SEQ ID NO: 3040010 - DNA, 14 bp, Homo sapiens
tgtagccgccctga

SEQ ID NO: 3040011 - DNA, 15 bp, Homo sapiens
tgtagccgccctgag

SEQ ID NO: 3040012 - DNA, 13 bp, Homo sapiens
tgtagcctgtgca

SEQ ID NO: 3040013 - DNA, 22 bp, Homo sapiens
tgtagcctgtgcatgtatgtct

SEQ ID NO: 3040014 - DNA, 15 bp, Homo sapiens
tgtagctgagctgtg

SEQ ID NO: 3040015 - DNA, 15 bp, Homo sapiens
tgtagcttttcacct

SEQ ID NO: 3040016 - DNA, 16 bp, Homo sapiens
tgtagcttttcacctt

SEQ ID NO: 3040017 - DNA, 16 bp, Homo sapiens
tgtaggaatctgcctt

SEQ ID NO: 3040018 - DNA, 23 bp, Homo sapiens
tgtaggaattcttttggggaagt

SEQ ID NO: 3040019 - DNA, 18 bp, Homo sapiens
tgtaggagaaactcccat

SEQ ID NO: 3040020 - DNA, 11 bp, Homo sapiens
tgtaggagaat

SEQ ID NO: 3040021 - DNA, 20 bp, Homo sapiens
tgtagggaaaaaaatgcttc

SEQ ID NO: 3040022 - DNA, 23 bp, Homo sapiens
tgtaggggagccacatttacata

SEQ ID NO: 3040023 - DNA, 18 bp, Homo sapiens
tgtagggttctgctttta

SEQ ID NO: 3040024 - DNA, 21 bp, Homo sapiens
tgtaggttattttatatttga

SEQ ID NO: 3040025 - DNA, 18 bp, Homo sapiens
tgtctactcagcatttga

SEQ ID NO: 3040026 - DNA, 19 bp, Homo sapiens
tgtctagaatcctgcttta

SEQ ID NO: 3040027 - DNA, 16 bp, Homo sapiens
tgtctagagctcatca

SEQ ID NO: 3040028 - DNA, 14 bp, Homo sapiens
tgtctagagtagct

SEQ ID NO: 3040029 - DNA, 16 bp, Homo sapiens
tgtctattattatgaa

SEQ ID NO: 3040030 - DNA, 16 bp, Homo sapiens
tgtctcaatagctcca

SEQ ID NO: 3040031 - DNA, 14 bp, Homo sapiens
tgtctcatagaact

SEQ ID NO: 3040032 - DNA, 11 bp, Homo sapiens
tgtctcatcca

SEQ ID NO: 3040033 - DNA, 17 bp, Homo sapiens
tgtctcatccatcatca

SEQ ID NO: 3040034 - DNA, 21 bp, Homo sapiens
tgtctcccctaccaggctgta

SEQ ID NO: 3040035 - DNA, 15 bp, Homo sapiens
tgtctcctactctgt

SEQ ID NO: 3040036 - DNA, 22 bp, Homo sapiens
tgtctcctatatatttctatta

SEQ ID NO: 3040037 - DNA, 22 bp, Homo sapiens
tgtctcctttcaccccagggcc

SEQ ID NO: 3040038 - DNA, 17 bp, Homo sapiens
tgtctcgccagaagact

SEQ ID NO: 3040039 - DNA, 23 bp, Homo sapiens
tgtctcgctgcatcacccaggct

SEQ ID NO: 3040040 - DNA, 22 bp, Homo sapiens
tgtctctaaaaagaagccacag

SEQ ID NO: 3040041 - DNA, 12 bp, Homo sapiens
tgtctctacaaa

SEQ ID NO: 3040042 - DNA, 19 bp, Homo sapiens
tgtctctacaaaaaataaa

SEQ ID NO: 3040043 - DNA, 22 bp, Homo sapiens
tgtctctacaaaaaataaaata

SEQ ID NO: 3040044 - DNA, 13 bp, Homo sapiens
tgtctctcagaat

SEQ ID NO: 3040045 - DNA, 17 bp, Homo sapiens
tgtctctccccctctgt

SEQ ID NO: 3040046 - DNA, 20 bp, Homo sapiens
tgtctctccccctctgtctt

SEQ ID NO: 3040047 - DNA, 17 bp, Homo sapiens
tgtctctgacaaagtgt

SEQ ID NO: 3040048 - DNA, 20 bp, Homo sapiens
tgtctctgacaaagtgtgtc

SEQ ID NO: 3040049 - DNA, 18 bp, Homo sapiens
tgtctctgcctggagcag

SEQ ID NO: 3040050 - DNA, 19 bp, Homo sapiens
tgtctctgcctggagcagg

SEQ ID NO: 3040051 - DNA, 20 bp, Homo sapiens
tgtctctgcctggagcaggg

SEQ ID NO: 3040052 - DNA, 11 bp, Homo sapiens
tgtctctgctt

SEQ ID NO: 3040053 - DNA, 13 bp, Homo sapiens
tgtctctgcttcc

SEQ ID NO: 3040054 - DNA, 15 bp, Homo sapiens
tgtctctgcttccat

SEQ ID NO: 3040055 - DNA, 17 bp, Homo sapiens
tgtctctgtggaaaagc

SEQ ID NO: 3040056 - DNA, 14 bp, Homo sapiens
tgtctctttgcaac

SEQ ID NO: 3040057 - DNA, 17 bp, Homo sapiens
tgtctgaactttgggaa

SEQ ID NO: 3040058 - DNA, 18 bp, Homo sapiens
tgtctgagagaccatctc

SEQ ID NO: 3040059 - DNA, 13 bp, Homo sapiens
tgtctgcagcctt

SEQ ID NO: 3040060 - DNA, 15 bp, Homo sapiens
tgtctgcagccttga

SEQ ID NO: 3040061 - DNA, 13 bp, Homo sapiens
tgtctgccagggc

SEQ ID NO: 3040062 - DNA, 22 bp, Homo sapiens
tgtctgcctggagtgctgtgct

SEQ ID NO: 3040063 - DNA, 15 bp, Homo sapiens
tgtctgcgaagtcct

SEQ ID NO: 3040064 - DNA, 13 bp, Homo sapiens
tgtctggagcggc

SEQ ID NO: 3040065 - DNA, 20 bp, Homo sapiens
tgtctggatccttcccaagg

SEQ ID NO: 3040066 - DNA, 14 bp, Homo sapiens
tgtctggctgcaga

SEQ ID NO: 3040067 - DNA, 16 bp, Homo sapiens
tgtctggctgcagagc

SEQ ID NO: 3040068 - DNA, 21 bp, Homo sapiens
tgtctgggtttggcccaagac

SEQ ID NO: 3040069 - DNA, 11 bp, Homo sapiens
tgtctgtaaaa

SEQ ID NO: 3040070 - DNA, 12 bp, Homo sapiens
tgtctgtaaata

SEQ ID NO: 3040071 - DNA, 15 bp, Homo sapiens
tgtctgtactaaaaa

SEQ ID NO: 3040072 - DNA, 21 bp, Homo sapiens
tgtctgtccaacccctccccc

SEQ ID NO: 3040073 - DNA, 22 bp, Homo sapiens
tgtctgtccaacccctccccca

SEQ ID NO: 3040074 - DNA, 14 bp, Homo sapiens
tgtctgtgctgtgt

SEQ ID NO: 3040075 - DNA, 17 bp, Homo sapiens
tgtctgtggatggtcat

SEQ ID NO: 3040076 - DNA, 19 bp, Homo sapiens
tgtctgtgtgattttcata

SEQ ID NO: 3040077 - DNA, 15 bp, Homo sapiens
tgtcttaaggagact

SEQ ID NO: 3040078 - DNA, 17 bp, Homo sapiens
tgtcttacaaggcaggc

SEQ ID NO: 3040079 - DNA, 15 bp, Homo sapiens
tgtcttagctctgga

SEQ ID NO: 3040080 - DNA, 19 bp, Homo sapiens
tgtcttatggattcattta

SEQ ID NO: 3040081 - DNA, 13 bp, Homo sapiens
tgtcttcacctga

SEQ ID NO: 3040082 - DNA, 12 bp, Homo sapiens
tgtcttcatgta

SEQ ID NO: 3040083 - DNA, 15 bp, Homo sapiens
tgtcttcatgtacat

SEQ ID NO: 3040084 - DNA, 13 bp, Homo sapiens
tgtcttccttttc

SEQ ID NO: 3040085 - DNA, 14 bp, Homo sapiens
tgtcttccttttct

SEQ ID NO: 3040086 - DNA, 19 bp, Homo sapiens
tgtcttcggaaaccttggt

SEQ ID NO: 3040087 - DNA, 23 bp, Homo sapiens
tgtcttcggccgagctggtttcc

SEQ ID NO: 3040088 - DNA, 12 bp, Homo sapiens
tgtcttctcctt

SEQ ID NO: 3040089 - DNA, 13 bp, Homo sapiens
tgtcttctgtata

SEQ ID NO: 3040090 - DNA, 17 bp, Homo sapiens
tgtcttctgtatataaa

SEQ ID NO: 3040091 - DNA, 17 bp, Homo sapiens
tgtcttgaatgtctttt

SEQ ID NO: 3040092 - DNA, 20 bp, Homo sapiens
tgtcttgaatgtcttttgaa

SEQ ID NO: 3040093 - DNA, 15 bp, Homo sapiens
tgtcttggacactgt

SEQ ID NO: 3040094 - DNA, 19 bp, Homo sapiens
tgtcttggctttcatgtta

SEQ ID NO: 3040095 - DNA, 16 bp, Homo sapiens
tgtcttggttgccagt

SEQ ID NO: 3040096 - DNA, 15 bp, Homo sapiens
tgtcttgtcaggtgg

SEQ ID NO: 3040097 - DNA, 18 bp, Homo sapiens
tgtcttgtgtatttctct

SEQ ID NO: 3040098 - DNA, 19 bp, Homo sapiens
tgtcttgtgtatttctctg

SEQ ID NO: 3040099 - DNA, 21 bp, Homo sapiens
tgtcttgtgtatttctctgtg

SEQ ID NO: 3040100 - DNA, 23 bp, Homo sapiens
tgtcttgtgtatttctctgtgaa

SEQ ID NO: 3040101 - DNA, 20 bp, Homo sapiens
tgtctttccacttctctggg

SEQ ID NO: 3040102 - DNA, 22 bp, Homo sapiens
tgtctttcctaagacctggggt

SEQ ID NO: 3040103 - DNA, 15 bp, Homo sapiens
tgtctttctttgctg

SEQ ID NO: 3040104 - DNA, 10 bp, Homo sapiens
tgtctttgcg

SEQ ID NO: 3040105 - DNA, 18 bp, Homo sapiens
tgtctttgcggggcctgt

SEQ ID NO: 3040106 - DNA, 20 bp, Homo sapiens
tgtctttgcggggcctgtct

SEQ ID NO: 3040107 - DNA, 21 bp, Homo sapiens
tgtctttgcggggcctgtctc

SEQ ID NO: 3040108 - DNA, 14 bp, Homo sapiens
tgtcttttcccctc

SEQ ID NO: 3040109 - DNA, 17 bp, Homo sapiens
tgtcttttcccctcatt

SEQ ID NO: 3040110 - DNA, 13 bp, Homo sapiens
tgtcttttgaata

SEQ ID NO: 3040111 - DNA, 14 bp, Homo sapiens
tgtcttttgacatt

SEQ ID NO: 3040112 - DNA, 18 bp, Homo sapiens
tgtctttttccttcctga

SEQ ID NO: 3040113 - DNA, 18 bp, Homo sapiens
tgtgaaactctaccctga

SEQ ID NO: 3040114 - DNA, 17 bp, Homo sapiens
tgtgaaatctgtctttg

SEQ ID NO: 3040115 - DNA, 14 bp, Homo sapiens
tgtgaacatttgtg

SEQ ID NO: 3040116 - DNA, 20 bp, Homo sapiens
tgtgaactagggaagctcag

SEQ ID NO: 3040117 - DNA, 21 bp, Homo sapiens
tgtgaactcagccaagcacag

SEQ ID NO: 3040118 - DNA, 16 bp, Homo sapiens
tgtgaactctcccctc

SEQ ID NO: 3040119 - DNA, 14 bp, Homo sapiens
tgtgaactgaaatt

SEQ ID NO: 3040120 - DNA, 20 bp, Homo sapiens
tgtgaagaagccctgttctc

SEQ ID NO: 3040121 - DNA, 17 bp, Homo sapiens
tgtgaagccctttgcct

SEQ ID NO: 3040122 - DNA, 14 bp, Homo sapiens
tgtgaaggccatga

SEQ ID NO: 3040123 - DNA, 20 bp, Homo sapiens
tgtgaaggtaactaagaagt

SEQ ID NO: 3040124 - DNA, 23 bp, Homo sapiens
tgtgaagtccttcacctcactga

SEQ ID NO: 3040125 - DNA, 21 bp, Homo sapiens
tgtgaagttaggttcttaaaa

SEQ ID NO: 3040126 - DNA, 15 bp, Homo sapiens
tgtgaagtttggaga

SEQ ID NO: 3040127 - DNA, 16 bp, Homo sapiens
tgtgaataaaaagaaa

SEQ ID NO: 3040128 - DNA, 14 bp, Homo sapiens
tgtgaatcagaccc

SEQ ID NO: 3040129 - DNA, 14 bp, Homo sapiens
tgtgaatcctggca

SEQ ID NO: 3040130 - DNA, 19 bp, Homo sapiens
tgtgaatttgagtttgctg

SEQ ID NO: 3040131 - DNA, 15 bp, Homo sapiens
tgtgacaatgactaa

SEQ ID NO: 3040132 - DNA, 22 bp, Homo sapiens
tgtgacaatgactaagccaagc

SEQ ID NO: 3040133 - DNA, 15 bp, Homo sapiens
tgtgacaattctgtt

SEQ ID NO: 3040134 - DNA, 16 bp, Homo sapiens
tgtgacacactacacc

SEQ ID NO: 3040135 - DNA, 21 bp, Homo sapiens
tgtgacacactacaccacaca

SEQ ID NO: 3040136 - DNA, 16 bp, Homo sapiens
tgtgacaggaaagatt

SEQ ID NO: 3040137 - DNA, 12 bp, Homo sapiens
tgtgacatgccc

SEQ ID NO: 3040138 - DNA, 12 bp, Homo sapiens
tgtgacatttac

SEQ ID NO: 3040139 - DNA, 22 bp, Homo sapiens
tgtgacatttacaccacacttt

SEQ ID NO: 3040140 - DNA, 18 bp, Homo sapiens
tgtgaccaatacatttgt

SEQ ID NO: 3040141 - DNA, 21 bp, Homo sapiens
tgtgaccaatacatttgtatt

SEQ ID NO: 3040142 - DNA, 15 bp, Homo sapiens
tgtgaccaatgtctt

SEQ ID NO: 3040143 - DNA, 13 bp, Homo sapiens
tgtgaccatgtga

SEQ ID NO: 3040144 - DNA, 14 bp, Homo sapiens
tgtgacccacttct

SEQ ID NO: 3040145 - DNA, 16 bp, Homo sapiens
tgtgacccccagctcc

SEQ ID NO: 3040146 - DNA, 12 bp, Homo sapiens
tgtgacccctcc

SEQ ID NO: 3040147 - DNA, 14 bp, Homo sapiens
tgtgacccctcctg

SEQ ID NO: 3040148 - DNA, 15 bp, Homo sapiens
tgtgacccctcctgg

SEQ ID NO: 3040149 - DNA, 17 bp, Homo sapiens
tgtgacccctcctgggg

SEQ ID NO: 3040150 - DNA, 21 bp, Homo sapiens
tgtgacccctcctggggccag

SEQ ID NO: 3040151 - DNA, 16 bp, Homo sapiens
tgtgacctgaagttca

SEQ ID NO: 3040152 - DNA, 17 bp, Homo sapiens
tgtgaccttaggcccgg

SEQ ID NO: 3040153 - DNA, 17 bp, Homo sapiens
tgtgacgtgcactgtga

SEQ ID NO: 3040154 - DNA, 15 bp, Homo sapiens
tgtgactcagcagag

SEQ ID NO: 3040155 - DNA, 19 bp, Homo sapiens
tgtgactcagcagaggcag

SEQ ID NO: 3040156 - DNA, 20 bp, Homo sapiens
tgtgactctggcttggccta

SEQ ID NO: 3040157 - DNA, 15 bp, Homo sapiens
tgtgactctgggcag

SEQ ID NO: 3040158 - DNA, 12 bp, Homo sapiens
tgtgactcttct

SEQ ID NO: 3040159 - DNA, 15 bp, Homo sapiens
tgttaagtattttca

SEQ ID NO: 3040160 - DNA, 14 bp, Homo sapiens
tgttaatcaattta

SEQ ID NO: 3040161 - DNA, 16 bp, Homo sapiens
tgttaattatgtacaa

SEQ ID NO: 3040162 - DNA, 22 bp, Homo sapiens
tgttacaataaaactaaatgtg

SEQ ID NO: 3040163 - DNA, 20 bp, Homo sapiens
tgttacaatcagtgtgaatg

SEQ ID NO: 3040164 - DNA, 22 bp, Homo sapiens
tgttacacaatggtttttaaat

SEQ ID NO: 3040165 - DNA, 14 bp, Homo sapiens
tgttaccaaataca

SEQ ID NO: 3040166 - DNA, 17 bp, Homo sapiens
tgttaccacagagtttt

SEQ ID NO: 3040167 - DNA, 19 bp, Homo sapiens
tgttaccactggtaacatg

SEQ ID NO: 3040168 - DNA, 21 bp, Homo sapiens
tgttaccactggtaacatgtg

SEQ ID NO: 3040169 - DNA, 15 bp, Homo sapiens
tgttactatctgctt

SEQ ID NO: 3040170 - DNA, 15 bp, Homo sapiens
tgttactgggccctg

SEQ ID NO: 3040171 - DNA, 14 bp, Homo sapiens
tgttactgtaattc

SEQ ID NO: 3040172 - DNA, 14 bp, Homo sapiens
tgttacttgaagta

SEQ ID NO: 3040173 - DNA, 17 bp, Homo sapiens
tgttacttgaagtaact

SEQ ID NO: 3040174 - DNA, 20 bp, Homo sapiens
tgttacttgaagtaactata

SEQ ID NO: 3040175 - DNA, 12 bp, Homo sapiens
tgttactttgaa

SEQ ID NO: 3040176 - DNA, 14 bp, Homo sapiens
tgttactttgaata

SEQ ID NO: 3040177 - DNA, 11 bp, Homo sapiens
tgttagagcac

SEQ ID NO: 3040178 - DNA, 20 bp, Homo sapiens
tgttagttctagctctattt

SEQ ID NO: 3040179 - DNA, 21 bp, Homo sapiens
tgttagtttagtgtgtgtgca

SEQ ID NO: 3040180 - DNA, 21 bp, Homo sapiens
tgttatacatcaatatgtata

SEQ ID NO: 3040181 - DNA, 15 bp, Homo sapiens
tgttatatcatatgt

SEQ ID NO: 3040182 - DNA, 17 bp, Homo sapiens
tgttatatcatatgtat

SEQ ID NO: 3040183 - DNA, 19 bp, Homo sapiens
tgttatcagctgggcagtg

SEQ ID NO: 3040184 - DNA, 23 bp, Homo sapiens
tgttatcagctgggcagtgccag

SEQ ID NO: 3040185 - DNA, 18 bp, Homo sapiens
tgttatcttaacactgaa

SEQ ID NO: 3040186 - DNA, 19 bp, Homo sapiens
tgttatcttatactgtaca

SEQ ID NO: 3040187 - DNA, 16 bp, Homo sapiens
tgttatcttctcaagt

SEQ ID NO: 3040188 - DNA, 15 bp, Homo sapiens
tgttatggcttattg

SEQ ID NO: 3040189 - DNA, 12 bp, Homo sapiens
tgttatgtattt

SEQ ID NO: 3040190 - DNA, 14 bp, Homo sapiens
tgttatgtatttcc

SEQ ID NO: 3040191 - DNA, 19 bp, Homo sapiens
tgttatgtgaatttgagtt

SEQ ID NO: 3040192 - DNA, 22 bp, Homo sapiens
tgttattaaacgtatgcatgtg

SEQ ID NO: 3040193 - DNA, 18 bp, Homo sapiens
tgttattacttgtaaata

SEQ ID NO: 3040194 - DNA, 21 bp, Homo sapiens
tgttattagagattacctcct

SEQ ID NO: 3040195 - DNA, 14 bp, Homo sapiens
tgttattgttttca

SEQ ID NO: 3040196 - DNA, 15 bp, Homo sapiens
tgttatttccccagc

SEQ ID NO: 3040197 - DNA, 19 bp, Homo sapiens
tgttatttccccagccaca

SEQ ID NO: 3040198 - DNA, 17 bp, Homo sapiens
tgttatttctcagactt

SEQ ID NO: 3040199 - DNA, 14 bp, Homo sapiens
tgttattttgcaac

SEQ ID NO: 3040200 - DNA, 20 bp, Homo sapiens
tgttcaaacacaacctactc

SEQ ID NO: 3040201 - DNA, 18 bp, Homo sapiens
tgttcaaattaaaaaagc

SEQ ID NO: 3040202 - DNA, 13 bp, Homo sapiens
tgttcacactcct

SEQ ID NO: 3040203 - DNA, 15 bp, Homo sapiens
tgttcactgaagacg

SEQ ID NO: 3040204 - DNA, 13 bp, Homo sapiens
tgttcacttcgaa

SEQ ID NO: 3040205 - DNA, 22 bp, Homo sapiens
tgttcacttcgaaattctgagt

SEQ ID NO: 3040206 - DNA, 23 bp, Homo sapiens
tgttcacttcgaaattctgagtt

SEQ ID NO: 3040207 - DNA, 18 bp, Homo sapiens
tgttcagttacagaaagt

SEQ ID NO: 3040208 - DNA, 19 bp, Homo sapiens
tgttcatagaatcgttgga

SEQ ID NO: 3040209 - DNA, 20 bp, Homo sapiens
tgttcatagatattggaaga

SEQ ID NO: 3040210 - DNA, 10 bp, Homo sapiens
tgttcatctc

SEQ ID NO: 3040211 - DNA, 15 bp, Homo sapiens
tgttcatctctttgt

SEQ ID NO: 3040212 - DNA, 19 bp, Homo sapiens
tgttcatctctttgtcctg

SEQ ID NO: 3040213 - DNA, 21 bp, Homo sapiens
tgttcatctctttgtcctgaa

SEQ ID NO: 3040214 - DNA, 16 bp, Homo sapiens
tgttcatttctgtctc

SEQ ID NO: 3040215 - DNA, 17 bp, Homo sapiens
tgttcatttctgtctcc

SEQ ID NO: 3040216 - DNA, 16 bp, Homo sapiens
tgttcatttttctctc

SEQ ID NO: 3040217 - DNA, 17 bp, Homo sapiens
tgttccaaatgaatgtt

SEQ ID NO: 3040218 - DNA, 19 bp, Homo sapiens
tgttccaagtctctgtgta

SEQ ID NO: 3040219 - DNA, 15 bp, Homo sapiens
tgttcccaaaacaat

SEQ ID NO: 3040220 - DNA, 16 bp, Homo sapiens
tgttcccacaccccaa

SEQ ID NO: 3040221 - DNA, 16 bp, Homo sapiens
tgttccccaagcgcct

SEQ ID NO: 3040222 - DNA, 13 bp, Homo sapiens
tgttccccagaga

SEQ ID NO: 3040223 - DNA, 15 bp, Homo sapiens
tgttccccctgtgca

SEQ ID NO: 3040224 - DNA, 23 bp, Homo sapiens
tgttccccttccactgagggcag

SEQ ID NO: 3040225 - DNA, 15 bp, Homo sapiens
tgttcctccctccca

SEQ ID NO: 3040226 - DNA, 13 bp, Homo sapiens
tgttcctgctttc

SEQ ID NO: 3040227 - DNA, 14 bp, Homo sapiens
tgttcctgtctcaa

SEQ ID NO: 3040228 - DNA, 19 bp, Homo sapiens
tgttcctgtctcaatagct

SEQ ID NO: 3040229 - DNA, 12 bp, Homo sapiens
tgttcctgtgtt

SEQ ID NO: 3040230 - DNA, 16 bp, Homo sapiens
tgttcctgtgttcttc

SEQ ID NO: 3040231 - DNA, 12 bp, Homo sapiens
tgttcctgttta

SEQ ID NO: 3040232 - DNA, 19 bp, Homo sapiens
tgttccttaagtcagaaca

SEQ ID NO: 3040233 - DNA, 18 bp, Homo sapiens
tgttccttcacatcctgt

SEQ ID NO: 3040234 - DNA, 13 bp, Homo sapiens
tgttccttctgtg

SEQ ID NO: 3040235 - DNA, 19 bp, Homo sapiens
tgttccttctgtgaagaag

SEQ ID NO: 3040236 - DNA, 13 bp, Homo sapiens
tgttccttgcttt

SEQ ID NO: 3040237 - DNA, 20 bp, Homo sapiens
tgttcctttttaaatgtgaa

SEQ ID NO: 3040238 - DNA, 17 bp, Homo sapiens
tgttcggtttttttcct

SEQ ID NO: 3040239 - DNA, 13 bp, Homo sapiens
tgttctaaagctc

SEQ ID NO: 3040240 - DNA, 14 bp, Homo sapiens
tgttctaaagctct

SEQ ID NO: 3040241 - DNA, 19 bp, Homo sapiens
tgttctaaagctctgacat

SEQ ID NO: 3040242 - DNA, 16 bp, Homo sapiens
tgttctaagatgtgat

SEQ ID NO: 3040243 - DNA, 17 bp, Homo sapiens
tgttctaagtttctaag

SEQ ID NO: 3040244 - DNA, 22 bp, Homo sapiens
tgttctaagtttctaagattct

SEQ ID NO: 3040245 - DNA, 14 bp, Homo sapiens
tgttctcattcctg

SEQ ID NO: 3040246 - DNA, 22 bp, Homo sapiens
tgttctcattcctgttctttct

SEQ ID NO: 3040247 - DNA, 14 bp, Homo sapiens
tgttctcctcccca

SEQ ID NO: 3040248 - DNA, 18 bp, Homo sapiens
tgttctcggagtgtgtat

SEQ ID NO: 3040249 - DNA, 15 bp, Homo sapiens
tgttctcgttgccct

SEQ ID NO: 3040250 - DNA, 13 bp, Homo sapiens
tgttctcttctgc

SEQ ID NO: 3040251 - DNA, 16 bp, Homo sapiens
tgttctcttctgcgta

SEQ ID NO: 3040252 - DNA, 20 bp, Homo sapiens
tgttctcttctgcgtaggcg

SEQ ID NO: 3040253 - DNA, 19 bp, Homo sapiens
tgttctgactttttgtttc

SEQ ID NO: 3040254 - DNA, 20 bp, Homo sapiens
tgttctgggtgttgaccact

SEQ ID NO: 3040255 - DNA, 23 bp, Homo sapiens
tgttctgggtgttgaccactcca

SEQ ID NO: 3040256 - DNA, 16 bp, Homo sapiens
tgttctggtatacatt

SEQ ID NO: 3040257 - DNA, 13 bp, Homo sapiens
tgttctgtggaaa

SEQ ID NO: 3040258 - DNA, 19 bp, Homo sapiens
tgttctgtggaaagtgtaa

SEQ ID NO: 3040259 - DNA, 20 bp, Homo sapiens
tgttctgtggaaagtgtaaa

SEQ ID NO: 3040260 - DNA, 21 bp, Homo sapiens
tgttctgtggaaagtgtaaag

SEQ ID NO: 3040261 - DNA, 14 bp, Homo sapiens
tgttcttatagaat

SEQ ID NO: 3040262 - DNA, 20 bp, Homo sapiens
tgttcttgaggtctcttttc

SEQ ID NO: 3040263 - DNA, 16 bp, Homo sapiens
tgttcttgtcatcagt

SEQ ID NO: 3040264 - DNA, 13 bp, Homo sapiens
tgttcttgttgta

SEQ ID NO: 3040265 - DNA, 17 bp, Homo sapiens
tgttcttttgtttcatt

SEQ ID NO: 3040266 - DNA, 17 bp, Homo sapiens
tgttctttttattgaat

SEQ ID NO: 3040267 - DNA, 15 bp, Homo sapiens
tgttgaaaaatatct

SEQ ID NO: 3040268 - DNA, 17 bp, Homo sapiens
tgttgaaagcaaaaatg

SEQ ID NO: 3040269 - DNA, 20 bp, Homo sapiens
tgttgaacaggtgtttttcc

SEQ ID NO: 3040270 - DNA, 15 bp, Homo sapiens
tgttgaatatttagc

SEQ ID NO: 3040271 - DNA, 14 bp, Homo sapiens
tgttgacagcttgg

SEQ ID NO: 3040272 - DNA, 15 bp, Homo sapiens
tgttgacatatttaa

SEQ ID NO: 3040273 - DNA, 19 bp, Homo sapiens
tgttgacatatttaatgtt

SEQ ID NO: 3040274 - DNA, 20 bp, Homo sapiens
tgttgacatatttaatgttt

SEQ ID NO: 3040275 - DNA, 19 bp, Homo sapiens
tgttgaccaggctggtctc

SEQ ID NO: 3040276 - DNA, 14 bp, Homo sapiens
tgttgaccggctgc

SEQ ID NO: 3040277 - DNA, 13 bp, Homo sapiens
tgttgactgctgc

SEQ ID NO: 3040278 - DNA, 22 bp, Homo sapiens
tgttgactttatttctgagcaa

SEQ ID NO: 3040279 - DNA, 14 bp, Homo sapiens
tgttgagcaagcag

SEQ ID NO: 3040280 - DNA, 18 bp, Homo sapiens
tgttgagtctctgaacat

SEQ ID NO: 3040281 - DNA, 15 bp, Homo sapiens
tgttgataattctta

SEQ ID NO: 3040282 - DNA, 18 bp, Homo sapiens
tgttgataatttcaggga

SEQ ID NO: 3040283 - DNA, 19 bp, Homo sapiens
tgttgatccatccagcttg

SEQ ID NO: 3040284 - DNA, 11 bp, Homo sapiens
tgttgattatt

SEQ ID NO: 3040285 - DNA, 16 bp, Homo sapiens
tgttgattattagcca

SEQ ID NO: 3040286 - DNA, 24 bp, Homo sapiens
tgttgattctagatgatcaacata

SEQ ID NO: 3040287 - DNA, 12 bp, Homo sapiens
tgttgattgcta

SEQ ID NO: 3040288 - DNA, 15 bp, Homo sapiens
tgttgattgctaaat

SEQ ID NO: 3040289 - DNA, 17 bp, Homo sapiens
tgttgcaagtactgctg

SEQ ID NO: 3040290 - DNA, 21 bp, Homo sapiens
tgttgcacacccactcagctc

SEQ ID NO: 3040291 - DNA, 23 bp, Homo sapiens
tgttgcacacccactcagctccg

SEQ ID NO: 3040292 - DNA, 22 bp, Homo sapiens
ttaatcaagtacctatattgat

SEQ ID NO: 3040293 - DNA, 15 bp, Homo sapiens
ttaatcaatgtgaca

SEQ ID NO: 3040294 - DNA, 16 bp, Homo sapiens
ttaatcaatgtgacat

SEQ ID NO: 3040295 - DNA, 17 bp, Homo sapiens
ttaatcagctgttgcag

SEQ ID NO: 3040296 - DNA, 13 bp, Homo sapiens
ttaatcatatttg

SEQ ID NO: 3040297 - DNA, 16 bp, Homo sapiens
ttaatcatatttgaaa

SEQ ID NO: 3040298 - DNA, 23 bp, Homo sapiens
ttaatcatatttgaaaaccatat

SEQ ID NO: 3040299 - DNA, 16 bp, Homo sapiens
ttaatcccagcacttt

SEQ ID NO: 3040300 - DNA, 15 bp, Homo sapiens
ttaatcctttaactc

SEQ ID NO: 3040301 - DNA, 14 bp, Homo sapiens
ttaatcgtttttgt

SEQ ID NO: 3040302 - DNA, 18 bp, Homo sapiens
ttaatgaagaaagtggaa

SEQ ID NO: 3040303 - DNA, 23 bp, Homo sapiens
ttaatgacacttgtccccaaatc

SEQ ID NO: 3040304 - DNA, 15 bp, Homo sapiens
ttaatgatctggtgg

SEQ ID NO: 3040305 - DNA, 16 bp, Homo sapiens
ttaatgatctggtggt

SEQ ID NO: 3040306 - DNA, 20 bp, Homo sapiens
ttaatgatgttatcttaaca

SEQ ID NO: 3040307 - DNA, 13 bp, Homo sapiens
ttaatgcactttc

SEQ ID NO: 3040308 - DNA, 23 bp, Homo sapiens
ttaatgcccagccagccacccct

SEQ ID NO: 3040309 - DNA, 15 bp, Homo sapiens
ttaatgctgtctttg

SEQ ID NO: 3040310 - DNA, 16 bp, Homo sapiens
ttaatgctgtctttgt

SEQ ID NO: 3040311 - DNA, 17 bp, Homo sapiens
ttaatgtatttgatgtc

SEQ ID NO: 3040312 - DNA, 22 bp, Homo sapiens
ttaatgtcaattcttgccaaat

SEQ ID NO: 3040313 - DNA, 20 bp, Homo sapiens
ttaatgtgaactctcccctc

SEQ ID NO: 3040314 - DNA, 21 bp, Homo sapiens
ttaatgtgaactctcccctcc

SEQ ID NO: 3040315 - DNA, 18 bp, Homo sapiens
ttaatgtgaagacatttt

SEQ ID NO: 3040316 - DNA, 14 bp, Homo sapiens
ttaatgtgctgtgt

SEQ ID NO: 3040317 - DNA, 19 bp, Homo sapiens
ttaatgtgctgtgtaaagt

SEQ ID NO: 3040318 - DNA, 21 bp, Homo sapiens
ttaatgtgctgtgtaaagtta

SEQ ID NO: 3040319 - DNA, 22 bp, Homo sapiens
ttaatgtgctgtgtaaagttag

SEQ ID NO: 3040320 - DNA, 13 bp, Homo sapiens
ttaatgttctgtg

SEQ ID NO: 3040321 - DNA, 22 bp, Homo sapiens
ttaatgttgattttaatcctgt

SEQ ID NO: 3040322 - DNA, 16 bp, Homo sapiens
ttaatgttttaaatgt

SEQ ID NO: 3040323 - DNA, 18 bp, Homo sapiens
ttaatgttttaaatgtac

SEQ ID NO: 3040324 - DNA, 23 bp, Homo sapiens
ttaatgttttaaatgtacagaca

SEQ ID NO: 3040325 - DNA, 20 bp, Homo sapiens
ttaattaaaaactagtagtt

SEQ ID NO: 3040326 - DNA, 14 bp, Homo sapiens
ttaattaggaaaaa

SEQ ID NO: 3040327 - DNA, 16 bp, Homo sapiens
ttaattatttaaatgt

SEQ ID NO: 3040328 - DNA, 14 bp, Homo sapiens
ttaattcatgtttc

SEQ ID NO: 3040329 - DNA, 15 bp, Homo sapiens
ttaattcatgtttct

SEQ ID NO: 3040330 - DNA, 14 bp, Homo sapiens
ttaattctcttgaa

SEQ ID NO: 3040331 - DNA, 16 bp, Homo sapiens
ttaattgacagtcact

SEQ ID NO: 3040332 - DNA, 13 bp, Homo sapiens
ttaattgctgcaa

SEQ ID NO: 3040333 - DNA, 13 bp, Homo sapiens
ttaattgtgcctg

SEQ ID NO: 3040334 - DNA, 20 bp, Homo sapiens
ttaattgttccttgctttta

SEQ ID NO: 3040335 - DNA, 12 bp, Homo sapiens
ttaattgtttta

SEQ ID NO: 3040336 - DNA, 14 bp, Homo sapiens
ttaatttacaaaaa

SEQ ID NO: 3040337 - DNA, 23 bp, Homo sapiens
ttaatttacaaaaatataaaata

SEQ ID NO: 3040338 - DNA, 18 bp, Homo sapiens
ttaatttagtaaatgtta

SEQ ID NO: 3040339 - DNA, 22 bp, Homo sapiens
ttaattttagagaaactttgag

SEQ ID NO: 3040340 - DNA, 14 bp, Homo sapiens
ttaattttctatgt

SEQ ID NO: 3040341 - DNA, 16 bp, Homo sapiens
ttaattttctatgtgt

SEQ ID NO: 3040342 - DNA, 23 bp, Homo sapiens
ttaattttggttgtattctttga

SEQ ID NO: 3040343 - DNA, 13 bp, Homo sapiens
ttaattttgtatt

SEQ ID NO: 3040344 - DNA, 18 bp, Homo sapiens
ttaattttgtattttcca

SEQ ID NO: 3040345 - DNA, 17 bp, Homo sapiens
ttaatttttaaaagact

SEQ ID NO: 3040346 - DNA, 17 bp, Homo sapiens
ttacaaaactacatgag

SEQ ID NO: 3040347 - DNA, 21 bp, Homo sapiens
ttacaaaatcctggaagattt

SEQ ID NO: 3040348 - DNA, 20 bp, Homo sapiens
ttacaaagaaccatgcagga

SEQ ID NO: 3040349 - DNA, 15 bp, Homo sapiens
ttacaaataaagttt

SEQ ID NO: 3040350 - DNA, 18 bp, Homo sapiens
ttacaaatggggcaaaca

SEQ ID NO: 3040351 - DNA, 14 bp, Homo sapiens
ttacaaattaatat

SEQ ID NO: 3040352 - DNA, 16 bp, Homo sapiens
ttacaaattaatattt

SEQ ID NO: 3040353 - DNA, 13 bp, Homo sapiens
ttacaacaaacac

SEQ ID NO: 3040354 - DNA, 14 bp, Homo sapiens
ttacaacaaacact

SEQ ID NO: 3040355 - DNA, 13 bp, Homo sapiens
ttacaacagattt

SEQ ID NO: 3040356 - DNA, 22 bp, Homo sapiens
ttacaaggcaggcctttcctac

SEQ ID NO: 3040357 - DNA, 17 bp, Homo sapiens
ttacaagtttatatata

SEQ ID NO: 3040358 - DNA, 22 bp, Homo sapiens
ttacaataaaactaaatgtgta

SEQ ID NO: 3040359 - DNA, 12 bp, Homo sapiens
ttacaatcaaag

SEQ ID NO: 3040360 - DNA, 23 bp, Homo sapiens
ttacaatcccacctttcctcaaa

SEQ ID NO: 3040361 - DNA, 15 bp, Homo sapiens
ttacaattgaaatga

SEQ ID NO: 3040362 - DNA, 13 bp, Homo sapiens
ttacaattttatc

SEQ ID NO: 3040363 - DNA, 21 bp, Homo sapiens
ttacaatttttttaattttgt

SEQ ID NO: 3040364 - DNA, 23 bp, Homo sapiens
ttacaatttttttaattttgtat

SEQ ID NO: 3040365 - DNA, 18 bp, Homo sapiens
ttacacaatggtttttaa

SEQ ID NO: 3040366 - DNA, 22 bp, Homo sapiens
ttacactggaggagagaagaat

SEQ ID NO: 3040367 - DNA, 14 bp, Homo sapiens
ttacagaaactgat

SEQ ID NO: 3040368 - DNA, 15 bp, Homo sapiens
ttacagaaactgatg

SEQ ID NO: 3040369 - DNA, 21 bp, Homo sapiens
ttacagaaagtggtgctcagt

SEQ ID NO: 3040370 - DNA, 21 bp, Homo sapiens
ttacagctctgactttacact

SEQ ID NO: 3040371 - DNA, 13 bp, Homo sapiens
ttacagctttgtt

SEQ ID NO: 3040372 - DNA, 20 bp, Homo sapiens
ttacagggatgagccaccgc

SEQ ID NO: 3040373 - DNA, 23 bp, Homo sapiens
ttacaggggagaaggaaatgcag

SEQ ID NO: 3040374 - DNA, 19 bp, Homo sapiens
ttacagtaggagcccagct

SEQ ID NO: 3040375 - DNA, 14 bp, Homo sapiens
ttacagtgcagtgc

SEQ ID NO: 3040376 - DNA, 13 bp, Homo sapiens
ttacagtgttccg

SEQ ID NO: 3040377 - DNA, 17 bp, Homo sapiens
ttacataactgatctat

SEQ ID NO: 3040378 - DNA, 17 bp, Homo sapiens
ttacataagagaaagag

SEQ ID NO: 3040379 - DNA, 21 bp, Homo sapiens
ttacataatctgtacaatgaa

SEQ ID NO: 3040380 - DNA, 15 bp, Homo sapiens
ttacatacagtgata

SEQ ID NO: 3040381 - DNA, 19 bp, Homo sapiens
ttacatactaggtgccttt

SEQ ID NO: 3040382 - DNA, 18 bp, Homo sapiens
ttacatcatttttgtatc

SEQ ID NO: 3040383 - DNA, 20 bp, Homo sapiens
ttacatcatttttgtatcta

SEQ ID NO: 3040384 - DNA, 14 bp, Homo sapiens
ttacatgcatactt

SEQ ID NO: 3040385 - DNA, 15 bp, Homo sapiens
ttacatgcatacttc

SEQ ID NO: 3040386 - DNA, 19 bp, Homo sapiens
ttacatgcatacttcaaaa

SEQ ID NO: 3040387 - DNA, 23 bp, Homo sapiens
ttacatggagaaaaccaaaatga

SEQ ID NO: 3040388 - DNA, 15 bp, Homo sapiens
ttacatgtatgcctg

SEQ ID NO: 3040389 - DNA, 18 bp, Homo sapiens
ttacatgttttctttgct

SEQ ID NO: 3040390 - DNA, 22 bp, Homo sapiens
ttacatgttttctttgctttaa

SEQ ID NO: 3040391 - DNA, 15 bp, Homo sapiens
ttacattaaaaagcc

SEQ ID NO: 3040392 - DNA, 14 bp, Homo sapiens
ttacattagttaag

SEQ ID NO: 3040393 - DNA, 19 bp, Homo sapiens
ttacattgaaaacagatat

SEQ ID NO: 3040394 - DNA, 13 bp, Homo sapiens
ttacatttaaatc

SEQ ID NO: 3040395 - DNA, 17 bp, Homo sapiens
ttaccaaacagcaaacc

SEQ ID NO: 3040396 - DNA, 20 bp, Homo sapiens
ttaccaaacagcaaaccaag

SEQ ID NO: 3040397 - DNA, 19 bp, Homo sapiens
ttaccaaaggtttttaaag

SEQ ID NO: 3040398 - DNA, 16 bp, Homo sapiens
ttaccaaatacacatt

SEQ ID NO: 3040399 - DNA, 18 bp, Homo sapiens
ttaccaaatacacatttc

SEQ ID NO: 3040400 - DNA, 20 bp, Homo sapiens
ttaccaacatgtatctgtct

SEQ ID NO: 3040401 - DNA, 13 bp, Homo sapiens
ttaccaagaagcc

SEQ ID NO: 3040402 - DNA, 13 bp, Homo sapiens
ttaccactggtaa

SEQ ID NO: 3040403 - DNA, 18 bp, Homo sapiens
ttaccactggtaacatgt

SEQ ID NO: 3040404 - DNA, 17 bp, Homo sapiens
ttaccagaagcttccat

SEQ ID NO: 3040405 - DNA, 18 bp, Homo sapiens
ttacccactgccatgcac

SEQ ID NO: 3040406 - DNA, 17 bp, Homo sapiens
ttaccccaaagagaaag

SEQ ID NO: 3040407 - DNA, 12 bp, Homo sapiens
ttacccttagaa

SEQ ID NO: 3040408 - DNA, 14 bp, Homo sapiens
ttacccttcctcat

SEQ ID NO: 3040409 - DNA, 22 bp, Homo sapiens
ttacccttcctcatctgtgcct

SEQ ID NO: 3040410 - DNA, 13 bp, Homo sapiens
ttaccctttagac

SEQ ID NO: 3040411 - DNA, 12 bp, Homo sapiens
ttacctcctgcc

SEQ ID NO: 3040412 - DNA, 19 bp, Homo sapiens
ttacctcctgcccaggaga

SEQ ID NO: 3040413 - DNA, 22 bp, Homo sapiens
ttacctctaaatttccatatcc

SEQ ID NO: 3040414 - DNA, 14 bp, Homo sapiens
ttacctcttacctg

SEQ ID NO: 3040415 - DNA, 12 bp, Homo sapiens
ttacctctttaa

SEQ ID NO: 3040416 - DNA, 20 bp, Homo sapiens
ttacctgaaaacactgtgca

SEQ ID NO: 3040417 - DNA, 22 bp, Homo sapiens
ttacctgaaaacactgtgcaca

SEQ ID NO: 3040418 - DNA, 23 bp, Homo sapiens
ttacctggatataaattaattgt

SEQ ID NO: 3040419 - DNA, 20 bp, Homo sapiens
ttacctgtcttgctcctggg

SEQ ID NO: 3040420 - DNA, 13 bp, Homo sapiens
ttacctgtgaaat

SEQ ID NO: 3040421 - DNA, 17 bp, Homo sapiens
ttacctgtgcaccagtg

SEQ ID NO: 3040422 - DNA, 15 bp, Homo sapiens
ttaccttaagatttt

SEQ ID NO: 3040423 - DNA, 12 bp, Homo sapiens
ttaccttgtttt

SEQ ID NO: 3040424 - DNA, 13 bp, Homo sapiens
ttattttccaaaa

SEQ ID NO: 3040425 - DNA, 17 bp, Homo sapiens
ttattttgtactagtgt

SEQ ID NO: 3040426 - DNA, 18 bp, Homo sapiens
ttatttttaaattttctt

SEQ ID NO: 3040427 - DNA, 14 bp, Homo sapiens
ttatttttctaaac

SEQ ID NO: 3040428 - DNA, 16 bp, Homo sapiens
ttatttttctttaaag

SEQ ID NO: 3040429 - DNA, 21 bp, Homo sapiens
ttattttttggacttcaaagc

SEQ ID NO: 3040430 - DNA, 22 bp, Homo sapiens
ttatttttttaaagtgatttgc

SEQ ID NO: 3040431 - DNA, 16 bp, Homo sapiens
ttcaaaagagtagaaa

SEQ ID NO: 3040432 - DNA, 13 bp, Homo sapiens
ttcaaaagtggag

SEQ ID NO: 3040433 - DNA, 14 bp, Homo sapiens
ttcaaaagttccaa

SEQ ID NO: 3040434 - DNA, 13 bp, Homo sapiens
ttcaaaatattta

SEQ ID NO: 3040435 - DNA, 22 bp, Homo sapiens
ttcaaaatatttaaaaatgtct

SEQ ID NO: 3040436 - DNA, 18 bp, Homo sapiens
ttcaaaattaatagcttt

SEQ ID NO: 3040437 - DNA, 21 bp, Homo sapiens
ttcaaaccttggtatctgttg

SEQ ID NO: 3040438 - DNA, 21 bp, Homo sapiens
ttcaaactggggcctccagaa

SEQ ID NO: 3040439 - DNA, 16 bp, Homo sapiens
ttcaaagatgataatt

SEQ ID NO: 3040440 - DNA, 18 bp, Homo sapiens
ttcaaagatgctgtgagt

SEQ ID NO: 3040441 - DNA, 16 bp, Homo sapiens
ttcaaagcatgaaatg

SEQ ID NO: 3040442 - DNA, 15 bp, Homo sapiens
ttcaaagccctgcct

SEQ ID NO: 3040443 - DNA, 12 bp, Homo sapiens
ttcaaaggttct

SEQ ID NO: 3040444 - DNA, 16 bp, Homo sapiens
ttcaaaggttctaggt

SEQ ID NO: 3040445 - DNA, 23 bp, Homo sapiens
ttcaaatcaatctgtaaaactaa

SEQ ID NO: 3040446 - DNA, 17 bp, Homo sapiens
ttcaaatttactgtctt

SEQ ID NO: 3040447 - DNA, 16 bp, Homo sapiens
ttcaacagtgaagaca

SEQ ID NO: 3040448 - DNA, 18 bp, Homo sapiens
ttcaacagtgaagacaga

SEQ ID NO: 3040449 - DNA, 17 bp, Homo sapiens
ttcaaccacgcaggaag

SEQ ID NO: 3040450 - DNA, 20 bp, Homo sapiens
ttcaaccagatttagctgaa

SEQ ID NO: 3040451 - DNA, 14 bp, Homo sapiens
ttcaaccccaccct

SEQ ID NO: 3040452 - DNA, 20 bp, Homo sapiens
ttcaaccccaccctgtttgg

SEQ ID NO: 3040453 - DNA, 18 bp, Homo sapiens
ttcaactattttattatc

SEQ ID NO: 3040454 - DNA, 18 bp, Homo sapiens
ttcaacttgtgcctggga

SEQ ID NO: 3040455 - DNA, 16 bp, Homo sapiens
ttcaactttgaataaa

SEQ ID NO: 3040456 - DNA, 22 bp, Homo sapiens
ttcaactttgaataaagaatac

SEQ ID NO: 3040457 - DNA, 15 bp, Homo sapiens
ttcaagaaaactgga

SEQ ID NO: 3040458 - DNA, 16 bp, Homo sapiens
ttcaagaaaactggaa

SEQ ID NO: 3040459 - DNA, 13 bp, Homo sapiens
ttcaagaaaggaa

SEQ ID NO: 3040460 - DNA, 15 bp, Homo sapiens
ttcaagaccagcctg

SEQ ID NO: 3040461 - DNA, 16 bp, Homo sapiens
ttcaagagacactgct

SEQ ID NO: 3040462 - DNA, 14 bp, Homo sapiens
ttcaagatccaaat

SEQ ID NO: 3040463 - DNA, 21 bp, Homo sapiens
ttcaagcgattctcctgcctc

SEQ ID NO: 3040464 - DNA, 22 bp, Homo sapiens
ttcaagcgattctcctgcctca

SEQ ID NO: 3040465 - DNA, 16 bp, Homo sapiens
ttcaaggaagaaaacg

SEQ ID NO: 3040466 - DNA, 14 bp, Homo sapiens
ttcaaggcactcta

SEQ ID NO: 3040467 - DNA, 16 bp, Homo sapiens
ttcaaggcactctaga

SEQ ID NO: 3040468 - DNA, 18 bp, Homo sapiens
ttcaaggcactctagatt

SEQ ID NO: 3040469 - DNA, 16 bp, Homo sapiens
ttcaaggccatccttc

SEQ ID NO: 3040470 - DNA, 17 bp, Homo sapiens
ttcaagggacaagtatt

SEQ ID NO: 3040471 - DNA, 24 bp, Homo sapiens
ttcaaggggagccaaaatctcaag

SEQ ID NO: 3040472 - DNA, 14 bp, Homo sapiens
ttcaagggtaatct

SEQ ID NO: 3040473 - DNA, 19 bp, Homo sapiens
ttcaagggttgcttctgag

SEQ ID NO: 3040474 - DNA, 15 bp, Homo sapiens
ttcaaggttctaacc

SEQ ID NO: 3040475 - DNA, 16 bp, Homo sapiens
ttcaatgatagtaaga

SEQ ID NO: 3040476 - DNA, 15 bp, Homo sapiens
ttcaatgttagcctc

SEQ ID NO: 3040477 - DNA, 18 bp, Homo sapiens
ttcaatttgttaacagag

SEQ ID NO: 3040478 - DNA, 21 bp, Homo sapiens
ttcaatttgttaacagagcaa

SEQ ID NO: 3040479 - DNA, 16 bp, Homo sapiens
ttcaatttttctttaa

SEQ ID NO: 3040480 - DNA, 17 bp, Homo sapiens
ttcacaaacttttatac

SEQ ID NO: 3040481 - DNA, 22 bp, Homo sapiens
ttcacacatctgggtgccctga

SEQ ID NO: 3040482 - DNA, 10 bp, Homo sapiens
ttcacactcc

SEQ ID NO: 3040483 - DNA, 21 bp, Homo sapiens
ttcacactgcaagagccttgg

SEQ ID NO: 3040484 - DNA, 16 bp, Homo sapiens
ttcacacttttcagca

SEQ ID NO: 3040485 - DNA, 19 bp, Homo sapiens
ttcacagagcacgcctgcc

SEQ ID NO: 3040486 - DNA, 20 bp, Homo sapiens
ttcacagagcacgcctgcca

SEQ ID NO: 3040487 - DNA, 15 bp, Homo sapiens
ttcacagcagctttg

SEQ ID NO: 3040488 - DNA, 20 bp, Homo sapiens
ttcacagtgacactggacca

SEQ ID NO: 3040489 - DNA, 22 bp, Homo sapiens
ttcacagtgatcgatgattcag

SEQ ID NO: 3040490 - DNA, 18 bp, Homo sapiens
ttcacagtttcttccatt

SEQ ID NO: 3040491 - DNA, 15 bp, Homo sapiens
ttcacatagctgtct

SEQ ID NO: 3040492 - DNA, 15 bp, Homo sapiens
ttcacatctcccatg

SEQ ID NO: 3040493 - DNA, 13 bp, Homo sapiens
ttcacatgccttg

SEQ ID NO: 3040494 - DNA, 20 bp, Homo sapiens
ttcacatgctctaaaaacct

SEQ ID NO: 3040495 - DNA, 19 bp, Homo sapiens
ttcaccagaatggaaagac

SEQ ID NO: 3040496 - DNA, 18 bp, Homo sapiens
ttcaccatgttagccggg

SEQ ID NO: 3040497 - DNA, 18 bp, Homo sapiens
ttcacccaggcctatgtt

SEQ ID NO: 3040498 - DNA, 22 bp, Homo sapiens
ttcaccccagggcctgagcctg

SEQ ID NO: 3040499 - DNA, 22 bp, Homo sapiens
ttcacctcactgaaaacatctg

SEQ ID NO: 3040500 - DNA, 16 bp, Homo sapiens
ttcacctccttcaatt

SEQ ID NO: 3040501 - DNA, 16 bp, Homo sapiens
ttcacctgattcaact

SEQ ID NO: 3040502 - DNA, 20 bp, Homo sapiens
ttcacctttcccactttctt

SEQ ID NO: 3040503 - DNA, 14 bp, Homo sapiens
ttcacctttgtagc

SEQ ID NO: 3040504 - DNA, 20 bp, Homo sapiens
ttcacgaagtgttgcatgga

SEQ ID NO: 3040505 - DNA, 17 bp, Homo sapiens
ttcacgccattctcctg

SEQ ID NO: 3040506 - DNA, 17 bp, Homo sapiens
ttcactattcctatgct

SEQ ID NO: 3040507 - DNA, 13 bp, Homo sapiens
ttcactcttaggc

SEQ ID NO: 3040508 - DNA, 20 bp, Homo sapiens
ttcactcttcaaatgcctga

SEQ ID NO: 3040509 - DNA, 19 bp, Homo sapiens
ttcactcttggagcctgca

SEQ ID NO: 3040510 - DNA, 21 bp, Homo sapiens
ttcactgaatttcaaacattt

SEQ ID NO: 3040511 - DNA, 15 bp, Homo sapiens
ttcactgcaattttg

SEQ ID NO: 3040512 - DNA, 12 bp, Homo sapiens
ttcactgctgct

SEQ ID NO: 3040513 - DNA, 21 bp, Homo sapiens
ttcactgctgctcctctttcc

SEQ ID NO: 3040514 - DNA, 15 bp, Homo sapiens
ttcactggaaaggaa

SEQ ID NO: 3040515 - DNA, 20 bp, Homo sapiens
ttcactggaaaggaaagatg

SEQ ID NO: 3040516 - DNA, 21 bp, Homo sapiens
ttcactggaaaggaaagatga

SEQ ID NO: 3040517 - DNA, 14 bp, Homo sapiens
ttcactggcataaa

SEQ ID NO: 3040518 - DNA, 20 bp, Homo sapiens
ttcactggcataaatctgaa

SEQ ID NO: 3040519 - DNA, 16 bp, Homo sapiens
ttcactgtcttttaaa

SEQ ID NO: 3040520 - DNA, 20 bp, Homo sapiens
ttcactgtgctccaacctga

SEQ ID NO: 3040521 - DNA, 22 bp, Homo sapiens
ttcacttacaagaaaggcctga

SEQ ID NO: 3040522 - DNA, 16 bp, Homo sapiens
ttcacttcctccagaa

SEQ ID NO: 3040523 - DNA, 22 bp, Homo sapiens
ttcacttcctctccacaggagc

SEQ ID NO: 3040524 - DNA, 23 bp, Homo sapiens
ttcacttcctctccacaggagcc

SEQ ID NO: 3040525 - DNA, 13 bp, Homo sapiens
ttcacttctgcat

SEQ ID NO: 3040526 - DNA, 17 bp, Homo sapiens
ttcacttcttttctgat

SEQ ID NO: 3040527 - DNA, 17 bp, Homo sapiens
ttcacttgaaagatttt

SEQ ID NO: 3040528 - DNA, 15 bp, Homo sapiens
ttcacttgtcttgct

SEQ ID NO: 3040529 - DNA, 18 bp, Homo sapiens
ttcacttgtcttgctctt

SEQ ID NO: 3040530 - DNA, 20 bp, Homo sapiens
ttcacttttgacaaaggcaa

SEQ ID NO: 3040531 - DNA, 13 bp, Homo sapiens
ttcagaacagagg

SEQ ID NO: 3040532 - DNA, 17 bp, Homo sapiens
ttcagaacagtgtttga

SEQ ID NO: 3040533 - DNA, 18 bp, Homo sapiens
ttcagaatcaaacctttt

SEQ ID NO: 3040534 - DNA, 16 bp, Homo sapiens
ttcagaatctttgtta

SEQ ID NO: 3040535 - DNA, 17 bp, Homo sapiens
ttcagaatctttgttaa

SEQ ID NO: 3040536 - DNA, 20 bp, Homo sapiens
ttcagacacctgttcacaga

SEQ ID NO: 3040537 - DNA, 22 bp, Homo sapiens
ttcagacacctgttcacagaaa

SEQ ID NO: 3040538 - DNA, 13 bp, Homo sapiens
ttcagaccccagc

SEQ ID NO: 3040539 - DNA, 12 bp, Homo sapiens
ttcagactcaga

SEQ ID NO: 3040540 - DNA, 14 bp, Homo sapiens
ttcagactcagact

SEQ ID NO: 3040541 - DNA, 15 bp, Homo sapiens
ttcagacttgtcaag

SEQ ID NO: 3040542 - DNA, 14 bp, Homo sapiens
ttcagagaaaggca

SEQ ID NO: 3040543 - DNA, 15 bp, Homo sapiens
ttcagagtatctaat

SEQ ID NO: 3040544 - DNA, 14 bp, Homo sapiens
ttcagagttttctg

SEQ ID NO: 3040545 - DNA, 15 bp, Homo sapiens
ttcagatgtaatgtt

SEQ ID NO: 3040546 - DNA, 16 bp, Homo sapiens
ttcagatgtggagcca

SEQ ID NO: 3040547 - DNA, 20 bp, Homo sapiens
ttcagatttaccataatgtt

SEQ ID NO: 3040548 - DNA, 18 bp, Homo sapiens
ttcagcaagagagaacct

SEQ ID NO: 3040549 - DNA, 19 bp, Homo sapiens
ttcagcacactgtgaaaat

SEQ ID NO: 3040550 - DNA, 17 bp, Homo sapiens
ttcagcagcaaattttc

SEQ ID NO: 3040551 - DNA, 20 bp, Homo sapiens
ttcagcagcaaattttcagc

SEQ ID NO: 3040552 - DNA, 23 bp, Homo sapiens
ttcagcatccgcaggtgctggtc

SEQ ID NO: 3040553 - DNA, 15 bp, Homo sapiens
ttcagcccctcctct

SEQ ID NO: 3040554 - DNA, 20 bp, Homo sapiens
ttcagcccctcctctgccac

SEQ ID NO: 3040555 - DNA, 23 bp, Homo sapiens
ttcagcctagtggcttgtcctca

SEQ ID NO: 3040556 - DNA, 12 bp, Homo sapiens
ttctaagtcttt

SEQ ID NO: 3040557 - DNA, 15 bp, Homo sapiens
ttctaagtctttcca

SEQ ID NO: 3040558 - DNA, 13 bp, Homo sapiens
ttctaagtttcta

SEQ ID NO: 3040559 - DNA, 15 bp, Homo sapiens
ttctaataatttcta

SEQ ID NO: 3040560 - DNA, 22 bp, Homo sapiens
ttctaattaaccttactaatta

SEQ ID NO: 3040561 - DNA, 16 bp, Homo sapiens
ttctaattttgtgctc

SEQ ID NO: 3040562 - DNA, 17 bp, Homo sapiens
ttctaattttgtgctct

SEQ ID NO: 3040563 - DNA, 20 bp, Homo sapiens
ttctaattttgtgctctttc

SEQ ID NO: 3040564 - DNA, 17 bp, Homo sapiens
ttctacataattgtgac

SEQ ID NO: 3040565 - DNA, 17 bp, Homo sapiens
ttctacatttcttagac

SEQ ID NO: 3040566 - DNA, 16 bp, Homo sapiens
ttctaccaaggcatat

SEQ ID NO: 3040567 - DNA, 19 bp, Homo sapiens
ttctaccaggcaaattcac

SEQ ID NO: 3040568 - DNA, 22 bp, Homo sapiens
ttctacgcaattgacaaacccg

SEQ ID NO: 3040569 - DNA, 18 bp, Homo sapiens
ttctactgaagttgggaa

SEQ ID NO: 3040570 - DNA, 13 bp, Homo sapiens
ttctagaaaagct

SEQ ID NO: 3040571 - DNA, 19 bp, Homo sapiens
ttctagaaaagcttcctag

SEQ ID NO: 3040572 - DNA, 14 bp, Homo sapiens
ttctagaatggttt

SEQ ID NO: 3040573 - DNA, 22 bp, Homo sapiens
ttctagatgattaaataagatt

SEQ ID NO: 3040574 - DNA, 17 bp, Homo sapiens
ttctagcaccttatcta

SEQ ID NO: 3040575 - DNA, 14 bp, Homo sapiens
ttctaggaagaatt

SEQ ID NO: 3040576 - DNA, 18 bp, Homo sapiens
ttctaggaagaattttaa

SEQ ID NO: 3040577 - DNA, 23 bp, Homo sapiens
ttctaggcactgtagttctaaga

SEQ ID NO: 3040578 - DNA, 20 bp, Homo sapiens
ttctagggctgggaaacact

SEQ ID NO: 3040579 - DNA, 13 bp, Homo sapiens
ttctagtacataa

SEQ ID NO: 3040580 - DNA, 19 bp, Homo sapiens
ttctagtacataattgatt

SEQ ID NO: 3040581 - DNA, 13 bp, Homo sapiens
ttctagttttgtc

SEQ ID NO: 3040582 - DNA, 17 bp, Homo sapiens
ttctagttttttttcta

SEQ ID NO: 3040583 - DNA, 17 bp, Homo sapiens
ttctataaatagatgct

SEQ ID NO: 3040584 - DNA, 13 bp, Homo sapiens
ttctataaggcca

SEQ ID NO: 3040585 - DNA, 14 bp, Homo sapiens
ttctataaggccat

SEQ ID NO: 3040586 - DNA, 13 bp, Homo sapiens
ttctatacaaata

SEQ ID NO: 3040587 - DNA, 21 bp, Homo sapiens
ttctatacaaatataaatctt

SEQ ID NO: 3040588 - DNA, 19 bp, Homo sapiens
ttctatagagatagatatt

SEQ ID NO: 3040589 - DNA, 17 bp, Homo sapiens
ttctatagttctagaca

SEQ ID NO: 3040590 - DNA, 20 bp, Homo sapiens
ttctatatgcgagttagcca

SEQ ID NO: 3040591 - DNA, 16 bp, Homo sapiens
ttctatattttaatag

SEQ ID NO: 3040592 - DNA, 21 bp, Homo sapiens
ttctatcgttattataaatgt

SEQ ID NO: 3040593 - DNA, 15 bp, Homo sapiens
ttctatgctgctttt

SEQ ID NO: 3040594 - DNA, 16 bp, Homo sapiens
ttctatgctgctttta

SEQ ID NO: 3040595 - DNA, 18 bp, Homo sapiens
ttctatgctgcttttata

SEQ ID NO: 3040596 - DNA, 17 bp, Homo sapiens
ttctattacccctcatt

SEQ ID NO: 3040597 - DNA, 12 bp, Homo sapiens
ttctattagttt

SEQ ID NO: 3040598 - DNA, 12 bp, Homo sapiens
ttctattgtaaa

SEQ ID NO: 3040599 - DNA, 12 bp, Homo sapiens
ttctatttagtt

SEQ ID NO: 3040600 - DNA, 23 bp, Homo sapiens
ttctatttagttatttaagaaga

SEQ ID NO: 3040601 - DNA, 17 bp, Homo sapiens
ttctatttctcctccat

SEQ ID NO: 3040602 - DNA, 21 bp, Homo sapiens
ttctatttctctgtgtattta

SEQ ID NO: 3040603 - DNA, 20 bp, Homo sapiens
ttctatttttatcatgaatt

SEQ ID NO: 3040604 - DNA, 21 bp, Homo sapiens
ttctatttttatgatgacaat

SEQ ID NO: 3040605 - DNA, 12 bp, Homo sapiens
ttctcaaagttt

SEQ ID NO: 3040606 - DNA, 13 bp, Homo sapiens
ttctcaaatgtgt

SEQ ID NO: 3040607 - DNA, 14 bp, Homo sapiens
ttctcaaatgtgtg

SEQ ID NO: 3040608 - DNA, 15 bp, Homo sapiens
ttctcaaatgtgtgt

SEQ ID NO: 3040609 - DNA, 22 bp, Homo sapiens
ttctcaagttctaagattctaa

SEQ ID NO: 3040610 - DNA, 11 bp, Homo sapiens
ttctcaatgaa

SEQ ID NO: 3040611 - DNA, 14 bp, Homo sapiens
ttctcaatgaaaaa

SEQ ID NO: 3040612 - DNA, 11 bp, Homo sapiens
ttctcaatgta

SEQ ID NO: 3040613 - DNA, 13 bp, Homo sapiens
ttctcaatttatt

SEQ ID NO: 3040614 - DNA, 13 bp, Homo sapiens
ttctcaccagctg

SEQ ID NO: 3040615 - DNA, 22 bp, Homo sapiens
ttctcaccagctgcaaagtgtt

SEQ ID NO: 3040616 - DNA, 16 bp, Homo sapiens
ttctcactatgtttct

SEQ ID NO: 3040617 - DNA, 19 bp, Homo sapiens
ttctcactccttttggtgt

SEQ ID NO: 3040618 - DNA, 15 bp, Homo sapiens
ttctcagactggtct

SEQ ID NO: 3040619 - DNA, 19 bp, Homo sapiens
ttctcagatccttgtttca

SEQ ID NO: 3040620 - DNA, 18 bp, Homo sapiens
ttctcagcttgcagctgg

SEQ ID NO: 3040621 - DNA, 18 bp, Homo sapiens
ttctcaggaaatggcttt

SEQ ID NO: 3040622 - DNA, 13 bp, Homo sapiens
ttctcaggctggc

SEQ ID NO: 3040623 - DNA, 21 bp, Homo sapiens
ttctcatagcaggaaatgtag

SEQ ID NO: 3040624 - DNA, 16 bp, Homo sapiens
ttctcatcacacacat

SEQ ID NO: 3040625 - DNA, 12 bp, Homo sapiens
ttctcatcttaa

SEQ ID NO: 3040626 - DNA, 17 bp, Homo sapiens
ttctcatcttaaaaata

SEQ ID NO: 3040627 - DNA, 14 bp, Homo sapiens
ttctcatggatttg

SEQ ID NO: 3040628 - DNA, 12 bp, Homo sapiens
ttctcattcctg

SEQ ID NO: 3040629 - DNA, 16 bp, Homo sapiens
ttctcattgctgcccg

SEQ ID NO: 3040630 - DNA, 17 bp, Homo sapiens
ttctcattgctgcccgt

SEQ ID NO: 3040631 - DNA, 23 bp, Homo sapiens
ttctccacccaaaccccttccca

SEQ ID NO: 3040632 - DNA, 12 bp, Homo sapiens
ttctccagaacc

SEQ ID NO: 3040633 - DNA, 14 bp, Homo sapiens
ttctccagtccctg

SEQ ID NO: 3040634 - DNA, 20 bp, Homo sapiens
ttctccataagtggagaaat

SEQ ID NO: 3040635 - DNA, 22 bp, Homo sapiens
ttctccatggccaccttttcag

SEQ ID NO: 3040636 - DNA, 22 bp, Homo sapiens
ttctccccaatgagacttgcct

SEQ ID NO: 3040637 - DNA, 16 bp, Homo sapiens
ttctcctaatgctctg

SEQ ID NO: 3040638 - DNA, 23 bp, Homo sapiens
ttctcctccatgggagaaaatag

SEQ ID NO: 3040639 - DNA, 13 bp, Homo sapiens
ttctcctcttgta

SEQ ID NO: 3040640 - DNA, 17 bp, Homo sapiens
ttctcctctttgaacat

SEQ ID NO: 3040641 - DNA, 18 bp, Homo sapiens
ttctcctctttgaacatg

SEQ ID NO: 3040642 - DNA, 20 bp, Homo sapiens
ttctcctctttgaacatggt

SEQ ID NO: 3040643 - DNA, 18 bp, Homo sapiens
ttctcctgatttgagttt

SEQ ID NO: 3040644 - DNA, 13 bp, Homo sapiens
ttctcctgcctca

SEQ ID NO: 3040645 - DNA, 16 bp, Homo sapiens
ttctcctgcctcagcc

SEQ ID NO: 3040646 - DNA, 18 bp, Homo sapiens
ttctcctgcctcagcctt

SEQ ID NO: 3040647 - DNA, 22 bp, Homo sapiens
ttctcctgcctttgcctccaga

SEQ ID NO: 3040648 - DNA, 13 bp, Homo sapiens
ttctcctgcttgt

SEQ ID NO: 3040649 - DNA, 14 bp, Homo sapiens
ttctcctggatgct

SEQ ID NO: 3040650 - DNA, 18 bp, Homo sapiens
ttctccttggaggacagt

SEQ ID NO: 3040651 - DNA, 16 bp, Homo sapiens
ttctcgcctaggattt

SEQ ID NO: 3040652 - DNA, 19 bp, Homo sapiens
ttctcgctgtcctttctag

SEQ ID NO: 3040653 - DNA, 14 bp, Homo sapiens
ttctcgttgcccta

SEQ ID NO: 3040654 - DNA, 18 bp, Homo sapiens
ttctcgttgccctaattc

SEQ ID NO: 3040655 - DNA, 23 bp, Homo sapiens
ttctcgttgccctaattcatctt

SEQ ID NO: 3040656 - DNA, 14 bp, Homo sapiens
ttctcgttgcctct

SEQ ID NO: 3040657 - DNA, 21 bp, Homo sapiens
ttctcgttgcctctgattttc

SEQ ID NO: 3040658 - DNA, 16 bp, Homo sapiens
ttctctaataagaaaa

SEQ ID NO: 3040659 - DNA, 19 bp, Homo sapiens
ttctctactccatggttct

SEQ ID NO: 3040660 - DNA, 21 bp, Homo sapiens
ttctctactccatggttctca

SEQ ID NO: 3040661 - DNA, 20 bp, Homo sapiens
ttctctactgtctggattaa

SEQ ID NO: 3040662 - DNA, 16 bp, Homo sapiens
ttctctagaagctgtc

SEQ ID NO: 3040663 - DNA, 17 bp, Homo sapiens
ttctctatcctctctct

SEQ ID NO: 3040664 - DNA, 11 bp, Homo sapiens
ttctctattgt

SEQ ID NO: 3040665 - DNA, 13 bp, Homo sapiens
ttctctattgtaa

SEQ ID NO: 3040666 - DNA, 17 bp, Homo sapiens
ttctctattgtaatttt

SEQ ID NO: 3040667 - DNA, 19 bp, Homo sapiens
ttctctattgtaattttgt

SEQ ID NO: 3040668 - DNA, 17 bp, Homo sapiens
ttctctcagctcccagg

SEQ ID NO: 3040669 - DNA, 19 bp, Homo sapiens
ttctctcccaacgctgaag

SEQ ID NO: 3040670 - DNA, 13 bp, Homo sapiens
ttctctctatgca

SEQ ID NO: 3040671 - DNA, 15 bp, Homo sapiens
ttctctctatgcaaa

SEQ ID NO: 3040672 - DNA, 23 bp, Homo sapiens
ttctctctatgcaaaatgtctgt

SEQ ID NO: 3040673 - DNA, 15 bp, Homo sapiens
ttctctcttgttgtc

SEQ ID NO: 3040674 - DNA, 14 bp, Homo sapiens
ttctctgaaaagca

SEQ ID NO: 3040675 - DNA, 16 bp, Homo sapiens
ttctctgagctgtgca

SEQ ID NO: 3040676 - DNA, 19 bp, Homo sapiens
ttctctgcccagccgggca

SEQ ID NO: 3040677 - DNA, 20 bp, Homo sapiens
ttctctggctgtaaggctct

SEQ ID NO: 3040678 - DNA, 12 bp, Homo sapiens
ttctctgtatat

SEQ ID NO: 3040679 - DNA, 18 bp, Homo sapiens
ttctctgtatatttatga

SEQ ID NO: 3040680 - DNA, 13 bp, Homo sapiens
ttctctgtctcat

SEQ ID NO: 3040681 - DNA, 13 bp, Homo sapiens
ttctctgtctctg

SEQ ID NO: 3040682 - DNA, 11 bp, Homo sapiens
ttctctgtgaa

SEQ ID NO: 3040683 - DNA, 17 bp, Homo sapiens
ttctctgtgtctaagat

SEQ ID NO: 3040684 - DNA, 14 bp, Homo sapiens
ttctctgtttgctt

SEQ ID NO: 3040685 - DNA, 18 bp, Homo sapiens
ttctcttccagtttctgt

SEQ ID NO: 3040686 - DNA, 20 bp, Homo sapiens
ttctcttccagtttctgtaa

SEQ ID NO: 3040687 - DNA, 15 bp, Homo sapiens
ttctcttctgtccat

SEQ ID NO: 3040688 - DNA, 17 bp, Homo sapiens
ttctcttgacagtctga

SEQ ID NO: 3040689 - DNA, 11 bp, Homo sapiens
ttctcttggtg

SEQ ID NO: 3040690 - DNA, 15 bp, Homo sapiens
ttgcacagaagtcct

SEQ ID NO: 3040691 - DNA, 18 bp, Homo sapiens
ttgcacagaagtcctgta

SEQ ID NO: 3040692 - DNA, 17 bp, Homo sapiens
ttgcacagtcaaaacga

SEQ ID NO: 3040693 - DNA, 13 bp, Homo sapiens
ttgcacattgttc

SEQ ID NO: 3040694 - DNA, 18 bp, Homo sapiens
ttgcaccattctttcttg

SEQ ID NO: 3040695 - DNA, 17 bp, Homo sapiens
ttgcaccgcctgccctc

SEQ ID NO: 3040696 - DNA, 18 bp, Homo sapiens
ttgcacctatctcagcca

SEQ ID NO: 3040697 - DNA, 21 bp, Homo sapiens
ttgcacgcctcccccctcact

SEQ ID NO: 3040698 - DNA, 15 bp, Homo sapiens
ttgcactatctttca

SEQ ID NO: 3040699 - DNA, 17 bp, Homo sapiens
ttgcactcaagttgttt

SEQ ID NO: 3040700 - DNA, 21 bp, Homo sapiens
ttgcactcaagttgtttaact

SEQ ID NO: 3040701 - DNA, 16 bp, Homo sapiens
ttgcactccagcctgg

SEQ ID NO: 3040702 - DNA, 15 bp, Homo sapiens
ttgcactgaagtttt

SEQ ID NO: 3040703 - DNA, 20 bp, Homo sapiens
ttgcactgaagtttttgaaa

SEQ ID NO: 3040704 - DNA, 13 bp, Homo sapiens
ttgcactgtctgt

SEQ ID NO: 3040705 - DNA, 14 bp, Homo sapiens
ttgcactgtctgta

SEQ ID NO: 3040706 - DNA, 21 bp, Homo sapiens
ttgcagaaaagcacctgccga

SEQ ID NO: 3040707 - DNA, 21 bp, Homo sapiens
ttgcagaactaaactcattta

SEQ ID NO: 3040708 - DNA, 22 bp, Homo sapiens
ttgcaggagcgtgaaggactta

SEQ ID NO: 3040709 - DNA, 12 bp, Homo sapiens
ttgcaggatttt

SEQ ID NO: 3040710 - DNA, 20 bp, Homo sapiens
ttgcaggatttttagagcat

SEQ ID NO: 3040711 - DNA, 20 bp, Homo sapiens
ttgcagtatttttaaatatg

SEQ ID NO: 3040712 - DNA, 17 bp, Homo sapiens
ttgcagtctttccccca

SEQ ID NO: 3040713 - DNA, 11 bp, Homo sapiens
ttgcagtgaag

SEQ ID NO: 3040714 - DNA, 13 bp, Homo sapiens
ttgcagttcttga

SEQ ID NO: 3040715 - DNA, 13 bp, Homo sapiens
ttgcagtttatca

SEQ ID NO: 3040716 - DNA, 20 bp, Homo sapiens
ttgcagtttatcattcaagt

SEQ ID NO: 3040717 - DNA, 19 bp, Homo sapiens
ttgcataaacaatccaaat

SEQ ID NO: 3040718 - DNA, 20 bp, Homo sapiens
ttgcatcaaggggtcactta

SEQ ID NO: 3040719 - DNA, 20 bp, Homo sapiens
ttgcatctcccagataatgt

SEQ ID NO: 3040720 - DNA, 17 bp, Homo sapiens
ttgcatgataaacattc

SEQ ID NO: 3040721 - DNA, 16 bp, Homo sapiens
ttgcatgtgactctga

SEQ ID NO: 3040722 - DNA, 17 bp, Homo sapiens
ttgcatgtgactctgaa

SEQ ID NO: 3040723 - DNA, 13 bp, Homo sapiens
ttgcattaaattc

SEQ ID NO: 3040724 - DNA, 21 bp, Homo sapiens
ttgcattaaattcacaaactt

SEQ ID NO: 3040725 - DNA, 15 bp, Homo sapiens
ttgcattgaacacaa

SEQ ID NO: 3040726 - DNA, 12 bp, Homo sapiens
ttgcatttggaa

SEQ ID NO: 3040727 - DNA, 20 bp, Homo sapiens
ttgcatttgtaccttattga

SEQ ID NO: 3040728 - DNA, 15 bp, Homo sapiens
ttgcattttgatatt

SEQ ID NO: 3040729 - DNA, 13 bp, Homo sapiens
ttgccaaaattca

SEQ ID NO: 3040730 - DNA, 14 bp, Homo sapiens
ttgccaaagcagat

SEQ ID NO: 3040731 - DNA, 19 bp, Homo sapiens
ttgccaaagcagattttcc

SEQ ID NO: 3040732 - DNA, 23 bp, Homo sapiens
ttgccaagggcccaaagaaagag

SEQ ID NO: 3040733 - DNA, 23 bp, Homo sapiens
ttgccaatcttgttttaagcaaa

SEQ ID NO: 3040734 - DNA, 12 bp, Homo sapiens
ttgccagcccca

SEQ ID NO: 3040735 - DNA, 21 bp, Homo sapiens
ttgccagggatgggcagccca

SEQ ID NO: 3040736 - DNA, 19 bp, Homo sapiens
ttgccagtgataagagcag

SEQ ID NO: 3040737 - DNA, 18 bp, Homo sapiens
ttgccatactttgtctga

SEQ ID NO: 3040738 - DNA, 18 bp, Homo sapiens
ttgccatcacactgttgc

SEQ ID NO: 3040739 - DNA, 17 bp, Homo sapiens
ttgccatccattctgga

SEQ ID NO: 3040740 - DNA, 19 bp, Homo sapiens
ttgccattatagcgcctgt

SEQ ID NO: 3040741 - DNA, 18 bp, Homo sapiens
ttgcccacacacactcct

SEQ ID NO: 3040742 - DNA, 15 bp, Homo sapiens
ttgcccacaggtgcg

SEQ ID NO: 3040743 - DNA, 16 bp, Homo sapiens
ttgcccagagatgcct

SEQ ID NO: 3040744 - DNA, 18 bp, Homo sapiens
ttgcccagagatgcctcc

SEQ ID NO: 3040745 - DNA, 13 bp, Homo sapiens
ttgcccatcctcc

SEQ ID NO: 3040746 - DNA, 11 bp, Homo sapiens
ttgccccactc

SEQ ID NO: 3040747 - DNA, 15 bp, Homo sapiens
ttgccccactctgcc

SEQ ID NO: 3040748 - DNA, 20 bp, Homo sapiens
ttgccccactctgcctgcct

SEQ ID NO: 3040749 - DNA, 19 bp, Homo sapiens
ttgcccccgacggctgtga

SEQ ID NO: 3040750 - DNA, 21 bp, Homo sapiens
ttgcccccgtgagccaatccc

SEQ ID NO: 3040751 - DNA, 22 bp, Homo sapiens
ttgccccctgcccgtgtacata

SEQ ID NO: 3040752 - DNA, 15 bp, Homo sapiens
ttgccctgtttcctg

SEQ ID NO: 3040753 - DNA, 16 bp, Homo sapiens
ttgcccttcctgaccc

SEQ ID NO: 3040754 - DNA, 17 bp, Homo sapiens
ttgccgaagtccagctt

SEQ ID NO: 3040755 - DNA, 15 bp, Homo sapiens
ttgcctatcctgctg

SEQ ID NO: 3040756 - DNA, 12 bp, Homo sapiens
ttgcctccaggt

SEQ ID NO: 3040757 - DNA, 15 bp, Homo sapiens
ttgcctcctctctcc

SEQ ID NO: 3040758 - DNA, 16 bp, Homo sapiens
ttgcctcctctctccc

SEQ ID NO: 3040759 - DNA, 12 bp, Homo sapiens
ttgcctctactt

SEQ ID NO: 3040760 - DNA, 21 bp, Homo sapiens
ttgcctgacaattgcaaatca

SEQ ID NO: 3040761 - DNA, 18 bp, Homo sapiens
ttgcctgactaaaatgtt

SEQ ID NO: 3040762 - DNA, 15 bp, Homo sapiens
ttgcctgccctcctg

SEQ ID NO: 3040763 - DNA, 19 bp, Homo sapiens
ttgcctgcctgtgctattt

SEQ ID NO: 3040764 - DNA, 11 bp, Homo sapiens
ttgcctggcct

SEQ ID NO: 3040765 - DNA, 18 bp, Homo sapiens
ttgcctgggcagtgccca

SEQ ID NO: 3040766 - DNA, 20 bp, Homo sapiens
ttgcctgggctgggcagcct

SEQ ID NO: 3040767 - DNA, 17 bp, Homo sapiens
ttgccttattaaagttc

SEQ ID NO: 3040768 - DNA, 13 bp, Homo sapiens
ttgccttcccctt

SEQ ID NO: 3040769 - DNA, 15 bp, Homo sapiens
ttgccttcctaagcc

SEQ ID NO: 3040770 - DNA, 22 bp, Homo sapiens
ttgccttcctaagcctgtggct

SEQ ID NO: 3040771 - DNA, 23 bp, Homo sapiens
ttgccttctcaccagctgcaaag

SEQ ID NO: 3040772 - DNA, 17 bp, Homo sapiens
ttgcctttgaatgttaa

SEQ ID NO: 3040773 - DNA, 19 bp, Homo sapiens
ttgccttttaatttttaat

SEQ ID NO: 3040774 - DNA, 12 bp, Homo sapiens
ttgcctttttct

SEQ ID NO: 3040775 - DNA, 17 bp, Homo sapiens
ttgcggggcctgtctca

SEQ ID NO: 3040776 - DNA, 13 bp, Homo sapiens
ttgctaaacactg

SEQ ID NO: 3040777 - DNA, 17 bp, Homo sapiens
ttgctaaacactgcgct

SEQ ID NO: 3040778 - DNA, 13 bp, Homo sapiens
ttgctaaactgat

SEQ ID NO: 3040779 - DNA, 15 bp, Homo sapiens
ttgctaaatatttct

SEQ ID NO: 3040780 - DNA, 12 bp, Homo sapiens
ttgctaactgaa

SEQ ID NO: 3040781 - DNA, 13 bp, Homo sapiens
ttgctagctagcc

SEQ ID NO: 3040782 - DNA, 17 bp, Homo sapiens
ttgctagctagccagcc

SEQ ID NO: 3040783 - DNA, 18 bp, Homo sapiens
ttgctagctagccagcca

SEQ ID NO: 3040784 - DNA, 19 bp, Homo sapiens
ttgctagctagccagccaa

SEQ ID NO: 3040785 - DNA, 15 bp, Homo sapiens
ttgctataatcatta

SEQ ID NO: 3040786 - DNA, 17 bp, Homo sapiens
ttgctataatcattagt

SEQ ID NO: 3040787 - DNA, 18 bp, Homo sapiens
ttgctataatcattagtt

SEQ ID NO: 3040788 - DNA, 18 bp, Homo sapiens
ttgctatcaacaataaaa

SEQ ID NO: 3040789 - DNA, 18 bp, Homo sapiens
ttgctatcggggaagcca

SEQ ID NO: 3040790 - DNA, 13 bp, Homo sapiens
ttgctatcttaat

SEQ ID NO: 3040791 - DNA, 18 bp, Homo sapiens
ttgctatcttaattttgg

SEQ ID NO: 3040792 - DNA, 14 bp, Homo sapiens
ttgctatgtaaggg

SEQ ID NO: 3040793 - DNA, 14 bp, Homo sapiens
ttgctattagagca

SEQ ID NO: 3040794 - DNA, 18 bp, Homo sapiens
ttgctattgaattgagat

SEQ ID NO: 3040795 - DNA, 18 bp, Homo sapiens
ttgctattgtaaggtctt

SEQ ID NO: 3040796 - DNA, 23 bp, Homo sapiens
ttgctcaaaacacttccagtctg

SEQ ID NO: 3040797 - DNA, 20 bp, Homo sapiens
ttgctccattttcttgtcaa

SEQ ID NO: 3040798 - DNA, 14 bp, Homo sapiens
ttgctcctggggag

SEQ ID NO: 3040799 - DNA, 15 bp, Homo sapiens
ttgctcgaagactgt

SEQ ID NO: 3040800 - DNA, 21 bp, Homo sapiens
ttgctcgaagactgtgacatc

SEQ ID NO: 3040801 - DNA, 21 bp, Homo sapiens
ttgctgcaccaatgcactgag

SEQ ID NO: 3040802 - DNA, 22 bp, Homo sapiens
ttgctgcattcctttttcttca

SEQ ID NO: 3040803 - DNA, 20 bp, Homo sapiens
ttgctgccaagtcctgcctt

SEQ ID NO: 3040804 - DNA, 23 bp, Homo sapiens
ttgctgctataattctatactgt

SEQ ID NO: 3040805 - DNA, 15 bp, Homo sapiens
ttgctgctgctgctc

SEQ ID NO: 3040806 - DNA, 13 bp, Homo sapiens
ttgctgctgtgga

SEQ ID NO: 3040807 - DNA, 23 bp, Homo sapiens
ttgctggaaaccaagtcaggcca

SEQ ID NO: 3040808 - DNA, 15 bp, Homo sapiens
ttgctggcatgtctt

SEQ ID NO: 3040809 - DNA, 16 bp, Homo sapiens
ttgctgtaagatgtct

SEQ ID NO: 3040810 - DNA, 18 bp, Homo sapiens
ttgctgtaagatgtctgt

SEQ ID NO: 3040811 - DNA, 23 bp, Homo sapiens
ttgctgtaccagcccagatgttt

SEQ ID NO: 3040812 - DNA, 12 bp, Homo sapiens
ttgctgtagaga

SEQ ID NO: 3040813 - DNA, 23 bp, Homo sapiens
ttgctgtcacatagtttttcctg

SEQ ID NO: 3040814 - DNA, 18 bp, Homo sapiens
ttgctgtctgcagccttg

SEQ ID NO: 3040815 - DNA, 20 bp, Homo sapiens
ttgctgtcttggggtcccac

SEQ ID NO: 3040816 - DNA, 17 bp, Homo sapiens
ttgctgtgagccttgca

SEQ ID NO: 3040817 - DNA, 19 bp, Homo sapiens
ttgctgtgtgtcccaggca

SEQ ID NO: 3040818 - DNA, 13 bp, Homo sapiens
ttgctgttattat

SEQ ID NO: 3040819 - DNA, 16 bp, Homo sapiens
ttgctgttgaaagcaa

SEQ ID NO: 3040820 - DNA, 17 bp, Homo sapiens
ttgctgttgaaagcaaa

SEQ ID NO: 3040821 - DNA, 21 bp, Homo sapiens
ttgctgttgaaagcaaaaatg

SEQ ID NO: 3040822 - DNA, 20 bp, Homo sapiens
ttgctgttttcctcccttct

SEQ ID NO: 3040823 - DNA, 17 bp, Homo sapiens
tttaaaaaatattttct

SEQ ID NO: 3040824 - DNA, 13 bp, Homo sapiens
tttaaaaagcaaa

SEQ ID NO: 3040825 - DNA, 15 bp, Homo sapiens
tttaaaaagcaaatc

SEQ ID NO: 3040826 - DNA, 17 bp, Homo sapiens
tttaaaaatagaaacat

SEQ ID NO: 3040827 - DNA, 16 bp, Homo sapiens
tttaaaaatatttcag

SEQ ID NO: 3040828 - DNA, 13 bp, Homo sapiens
tttaaaaatcaac

SEQ ID NO: 3040829 - DNA, 15 bp, Homo sapiens
tttaaaaatcaactt

SEQ ID NO: 3040830 - DNA, 23 bp, Homo sapiens
tttaaaaatcaactttttattgc

SEQ ID NO: 3040831 - DNA, 12 bp, Homo sapiens
tttaaaaatgaa

SEQ ID NO: 3040832 - DNA, 11 bp, Homo sapiens
tttaaaaatgt

SEQ ID NO: 3040833 - DNA, 14 bp, Homo sapiens
tttaaaaatgtata

SEQ ID NO: 3040834 - DNA, 16 bp, Homo sapiens
tttaaaacacatgttt

SEQ ID NO: 3040835 - DNA, 16 bp, Homo sapiens
tttaaaacatgtaata

SEQ ID NO: 3040836 - DNA, 15 bp, Homo sapiens
tttaaaacgtgtaaa

SEQ ID NO: 3040837 - DNA, 13 bp, Homo sapiens
tttaaaagaaaaa

SEQ ID NO: 3040838 - DNA, 21 bp, Homo sapiens
tttaaaagaaaaaaaccaaag

SEQ ID NO: 3040839 - DNA, 20 bp, Homo sapiens
tttaaaagataaatattata

SEQ ID NO: 3040840 - DNA, 13 bp, Homo sapiens
tttaaaagatgct

SEQ ID NO: 3040841 - DNA, 22 bp, Homo sapiens
tttaaaagtgtattttattcag

SEQ ID NO: 3040842 - DNA, 18 bp, Homo sapiens
tttaaaagtttgtccttt

SEQ ID NO: 3040843 - DNA, 24 bp, Homo sapiens
tttaaaataaattcctacaactta

SEQ ID NO: 3040844 - DNA, 18 bp, Homo sapiens
tttaaaataaattctctc

SEQ ID NO: 3040845 - DNA, 14 bp, Homo sapiens
tttaaaatatttaa

SEQ ID NO: 3040846 - DNA, 21 bp, Homo sapiens
tttaaaatgctcaatttcagc

SEQ ID NO: 3040847 - DNA, 20 bp, Homo sapiens
tttaaaatggtttgtcctga

SEQ ID NO: 3040848 - DNA, 17 bp, Homo sapiens
tttaaaatgtaaagcca

SEQ ID NO: 3040849 - DNA, 20 bp, Homo sapiens
tttaaaatgtaaagccatgc

SEQ ID NO: 3040850 - DNA, 17 bp, Homo sapiens
tttaaaatgttggtgca

SEQ ID NO: 3040851 - DNA, 15 bp, Homo sapiens
tttaaaattactaac

SEQ ID NO: 3040852 - DNA, 16 bp, Homo sapiens
tttaaaattatatagc

SEQ ID NO: 3040853 - DNA, 17 bp, Homo sapiens
tttaaaattatatagca

SEQ ID NO: 3040854 - DNA, 17 bp, Homo sapiens
tttaaaatttatattgt

SEQ ID NO: 3040855 - DNA, 15 bp, Homo sapiens
tttaaacccatttta

SEQ ID NO: 3040856 - DNA, 19 bp, Homo sapiens
tttaaactaaccttttatc

SEQ ID NO: 3040857 - DNA, 20 bp, Homo sapiens
tttaaactactatttttctt

SEQ ID NO: 3040858 - DNA, 16 bp, Homo sapiens
tttaaactagatgacc

SEQ ID NO: 3040859 - DNA, 21 bp, Homo sapiens
tttaaactagatgacctcatt

SEQ ID NO: 3040860 - DNA, 22 bp, Homo sapiens
tttaaagacaaagacattattt

SEQ ID NO: 3040861 - DNA, 21 bp, Homo sapiens
tttaaagacagggtcttgcta

SEQ ID NO: 3040862 - DNA, 21 bp, Homo sapiens
tttaaagagtctagattcaaa

SEQ ID NO: 3040863 - DNA, 19 bp, Homo sapiens
tttaaaggacaaacagtga

SEQ ID NO: 3040864 - DNA, 21 bp, Homo sapiens
tttaaaggacaaacagtgaat

SEQ ID NO: 3040865 - DNA, 17 bp, Homo sapiens
tttaaaggccctatctg

SEQ ID NO: 3040866 - DNA, 14 bp, Homo sapiens
tttaaatacataaa

SEQ ID NO: 3040867 - DNA, 18 bp, Homo sapiens
tttaaatatatgctaagt

SEQ ID NO: 3040868 - DNA, 21 bp, Homo sapiens
tttaaatatatgctaagtctt

SEQ ID NO: 3040869 - DNA, 15 bp, Homo sapiens
tttaaatattttcta

SEQ ID NO: 3040870 - DNA, 12 bp, Homo sapiens
tttaaatctgtt

SEQ ID NO: 3040871 - DNA, 20 bp, Homo sapiens
tttaaatctgtttttctaac

SEQ ID NO: 3040872 - DNA, 12 bp, Homo sapiens
tttaaatgcttt

SEQ ID NO: 3040873 - DNA, 22 bp, Homo sapiens
tttaaatgcttttaaatctgca

SEQ ID NO: 3040874 - DNA, 13 bp, Homo sapiens
tttaaatgtgaat

SEQ ID NO: 3040875 - DNA, 20 bp, Homo sapiens
tttaaatgtttactatagac

SEQ ID NO: 3040876 - DNA, 21 bp, Homo sapiens
tttaaattattatcttcttaa

SEQ ID NO: 3040877 - DNA, 17 bp, Homo sapiens
tttaaattgcatttcta

SEQ ID NO: 3040878 - DNA, 13 bp, Homo sapiens
tttaaattttctt

SEQ ID NO: 3040879 - DNA, 15 bp, Homo sapiens
tttaacaagaagatg

SEQ ID NO: 3040880 - DNA, 20 bp, Homo sapiens
tttaacaagaagatgaatgg

SEQ ID NO: 3040881 - DNA, 21 bp, Homo sapiens
tttaacaagaagatgaatggc

SEQ ID NO: 3040882 - DNA, 18 bp, Homo sapiens
tttaacacctgatgtgta

SEQ ID NO: 3040883 - DNA, 14 bp, Homo sapiens
tttaacagagtttt

SEQ ID NO: 3040884 - DNA, 21 bp, Homo sapiens
tttaacaggttttcttctaat

SEQ ID NO: 3040885 - DNA, 17 bp, Homo sapiens
tttaaccaaacaattat

SEQ ID NO: 3040886 - DNA, 19 bp, Homo sapiens
tttaaccaaacaattattt

SEQ ID NO: 3040887 - DNA, 19 bp, Homo sapiens
tttaaccaagttgtttatt

SEQ ID NO: 3040888 - DNA, 18 bp, Homo sapiens
tttaaccgtttttcaaga

SEQ ID NO: 3040889 - DNA, 17 bp, Homo sapiens
tttaacctctttaagta

SEQ ID NO: 3040890 - DNA, 14 bp, Homo sapiens
tttaactcatcttt

SEQ ID NO: 3040891 - DNA, 15 bp, Homo sapiens
tttaactcatcttta

SEQ ID NO: 3040892 - DNA, 17 bp, Homo sapiens
tttaactcatctttaga

SEQ ID NO: 3040893 - DNA, 17 bp, Homo sapiens
tttaactctgtcttcac

SEQ ID NO: 3040894 - DNA, 19 bp, Homo sapiens
tttaactcttaactgaaga

SEQ ID NO: 3040895 - DNA, 22 bp, Homo sapiens
tttaactggtgcactttgtaaa

SEQ ID NO: 3040896 - DNA, 23 bp, Homo sapiens
tttaactggtgcactttgtaaat

SEQ ID NO: 3040897 - DNA, 12 bp, Homo sapiens
tttaactgtgat

SEQ ID NO: 3040898 - DNA, 15 bp, Homo sapiens
tttaactgtgcatgt

SEQ ID NO: 3040899 - DNA, 13 bp, Homo sapiens
tttaacttattta

SEQ ID NO: 3040900 - DNA, 17 bp, Homo sapiens
tttaacttatttatatg

SEQ ID NO: 3040901 - DNA, 19 bp, Homo sapiens
tttaagaaaagccctgaga

SEQ ID NO: 3040902 - DNA, 14 bp, Homo sapiens
tttaagaatgaaca

SEQ ID NO: 3040903 - DNA, 17 bp, Homo sapiens
tttaagacgtgtttgtg

SEQ ID NO: 3040904 - DNA, 13 bp, Homo sapiens
tttaagagactca

SEQ ID NO: 3040905 - DNA, 21 bp, Homo sapiens
tttaagatagacttattcttt

SEQ ID NO: 3040906 - DNA, 14 bp, Homo sapiens
tttaagcaaatgca

SEQ ID NO: 3040907 - DNA, 16 bp, Homo sapiens
tttaagcaaatgcatt

SEQ ID NO: 3040908 - DNA, 23 bp, Homo sapiens
tttaagcaaatgcattctatcgt

SEQ ID NO: 3040909 - DNA, 18 bp, Homo sapiens
tttaagcctgcattctta

SEQ ID NO: 3040910 - DNA, 15 bp, Homo sapiens
tttaagctccagctt

SEQ ID NO: 3040911 - DNA, 18 bp, Homo sapiens
tttaaggaatcaaatctt

SEQ ID NO: 3040912 - DNA, 18 bp, Homo sapiens
tttaaggctaaaacttaa

SEQ ID NO: 3040913 - DNA, 22 bp, Homo sapiens
tttaagtgtaactggcagtttt

SEQ ID NO: 3040914 - DNA, 13 bp, Homo sapiens
tttaagtgtgcag

SEQ ID NO: 3040915 - DNA, 14 bp, Homo sapiens
tttaagttgtttgc

SEQ ID NO: 3040916 - DNA, 15 bp, Homo sapiens
tttaagttgtttgca

SEQ ID NO: 3040917 - DNA, 18 bp, Homo sapiens
tttaagttttatttaact

SEQ ID NO: 3040918 - DNA, 23 bp, Homo sapiens
tttaataacatatctaaagtcat

SEQ ID NO: 3040919 - DNA, 12 bp, Homo sapiens
tttaataacttt

SEQ ID NO: 3040920 - DNA, 23 bp, Homo sapiens
tttaataactttgctggaaaatc

SEQ ID NO: 3040921 - DNA, 22 bp, Homo sapiens
tttaatagaaataaattcctaa

SEQ ID NO: 3040922 - DNA, 23 bp, Homo sapiens
tttaatagaaataaattcctaaa

SEQ ID NO: 3040923 - DNA, 15 bp, Homo sapiens
tttaatatttccaat

SEQ ID NO: 3040924 - DNA, 19 bp, Homo sapiens
tttaatatttccaatgtga

SEQ ID NO: 3040925 - DNA, 19 bp, Homo sapiens
tttaatcagttgtttaata

SEQ ID NO: 3040926 - DNA, 19 bp, Homo sapiens
tttaatcatgaaattactt

SEQ ID NO: 3040927 - DNA, 24 bp, Homo sapiens
tttaatcatgaaattacttatcat

SEQ ID NO: 3040928 - DNA, 17 bp, Homo sapiens
tttaatcatgagcctgt

SEQ ID NO: 3040929 - DNA, 16 bp, Homo sapiens
tttaatcccagcactt

SEQ ID NO: 3040930 - DNA, 15 bp, Homo sapiens
tttaatgaacaaatg

SEQ ID NO: 3040931 - DNA, 18 bp, Homo sapiens
tttaatgatttttgtgta

SEQ ID NO: 3040932 - DNA, 19 bp, Homo sapiens
tttaatggacacttttcac

SEQ ID NO: 3040933 - DNA, 15 bp, Homo sapiens
tttaatgtgctgtgt

SEQ ID NO: 3040934 - DNA, 17 bp, Homo sapiens
tttaatgtttaaaacat

SEQ ID NO: 3040935 - DNA, 21 bp, Homo sapiens
tttaatgtttaaaacatcatt

SEQ ID NO: 3040936 - DNA, 15 bp, Homo sapiens
tttaatgtttataca

SEQ ID NO: 3040937 - DNA, 19 bp, Homo sapiens
tttaatgtttatacagagt

SEQ ID NO: 3040938 - DNA, 19 bp, Homo sapiens
tttaatgttttaaatgtac

SEQ ID NO: 3040939 - DNA, 13 bp, Homo sapiens
tttaattatttaa

SEQ ID NO: 3040940 - DNA, 14 bp, Homo sapiens
tttaattatttaaa

SEQ ID NO: 3040941 - DNA, 11 bp, Homo sapiens
tttaattccat

SEQ ID NO: 3040942 - DNA, 13 bp, Homo sapiens
tttaattccatga

SEQ ID NO: 3040943 - DNA, 16 bp, Homo sapiens
tttaatttagtaaatg

SEQ ID NO: 3040944 - DNA, 20 bp, Homo sapiens
tttaatttatgtaacttgaa

SEQ ID NO: 3040945 - DNA, 15 bp, Homo sapiens
tttaattttgtattt

SEQ ID NO: 3040946 - DNA, 17 bp, Homo sapiens
tttaattttttttagta

SEQ ID NO: 3040947 - DNA, 16 bp, Homo sapiens
tttacaaaaatataaa

SEQ ID NO: 3040948 - DNA, 19 bp, Homo sapiens
tttacaaaactacatgaga

SEQ ID NO: 3040949 - DNA, 14 bp, Homo sapiens
tttacaacaaacac

SEQ ID NO: 3040950 - DNA, 15 bp, Homo sapiens
tttacaagccccccc

SEQ ID NO: 3040951 - DNA, 16 bp, Homo sapiens
tttacaattgaaatga

SEQ ID NO: 3040952 - DNA, 15 bp, Homo sapiens
tttacacagaaacac

SEQ ID NO: 3040953 - DNA, 19 bp, Homo sapiens
tttacacagaaacactgcc

SEQ ID NO: 3040954 - DNA, 20 bp, Homo sapiens
tttacacagaaacactgcct

SEQ ID NO: 3040955 - DNA, 14 bp, Homo sapiens
tttacaccacactt

SEQ ID NO: 3040956 - DNA, 14 bp, Homo sapiens
tttggcattgatct

SEQ ID NO: 3040957 - DNA, 19 bp, Homo sapiens
tttggcccaatctctgcca

SEQ ID NO: 3040958 - DNA, 23 bp, Homo sapiens
tttgggaaagatggataaactga

SEQ ID NO: 3040959 - DNA, 23 bp, Homo sapiens
tttgggaccctgctttagagcta

SEQ ID NO: 3040960 - DNA, 19 bp, Homo sapiens
tttggggaggtgttcactg

SEQ ID NO: 3040961 - DNA, 20 bp, Homo sapiens
tttggggtagctagaggaac

SEQ ID NO: 3040962 - DNA, 18 bp, Homo sapiens
tttgggtcttttatacat

SEQ ID NO: 3040963 - DNA, 17 bp, Homo sapiens
tttgggtttttaactca

SEQ ID NO: 3040964 - DNA, 21 bp, Homo sapiens
tttggtaatatatatattttt

SEQ ID NO: 3040965 - DNA, 13 bp, Homo sapiens
tttggtacaaaaa

SEQ ID NO: 3040966 - DNA, 16 bp, Homo sapiens
tttggtacaaaaataa

SEQ ID NO: 3040967 - DNA, 16 bp, Homo sapiens
tttggtagatcttcaa

SEQ ID NO: 3040968 - DNA, 20 bp, Homo sapiens
tttggtaggtaaatctagag

SEQ ID NO: 3040969 - DNA, 23 bp, Homo sapiens
tttggtagtggaaaaaaaaaaga

SEQ ID NO: 3040970 - DNA, 13 bp, Homo sapiens
tttggtccaaaaa

SEQ ID NO: 3040971 - DNA, 14 bp, Homo sapiens
tttggtccaaaaaa

SEQ ID NO: 3040972 - DNA, 14 bp, Homo sapiens
tttggtgagaacct

SEQ ID NO: 3040973 - DNA, 21 bp, Homo sapiens
tttggtgtcaacatgaaacac

SEQ ID NO: 3040974 - DNA, 17 bp, Homo sapiens
tttggttaatcagtgtt

SEQ ID NO: 3040975 - DNA, 17 bp, Homo sapiens
tttggttgtttgctgtt

SEQ ID NO: 3040976 - DNA, 23 bp, Homo sapiens
tttggtttactttcaaaagagta

SEQ ID NO: 3040977 - DNA, 15 bp, Homo sapiens
tttggttttggaaaa

SEQ ID NO: 3040978 - DNA, 14 bp, Homo sapiens
tttgtaaagctatt

SEQ ID NO: 3040979 - DNA, 17 bp, Homo sapiens
tttgtaaagtgtggtcc

SEQ ID NO: 3040980 - DNA, 14 bp, Homo sapiens
tttgtaaataggat

SEQ ID NO: 3040981 - DNA, 12 bp, Homo sapiens
tttgtaaatgta

SEQ ID NO: 3040982 - DNA, 18 bp, Homo sapiens
tttgtaaggtttttgtag

SEQ ID NO: 3040983 - DNA, 14 bp, Homo sapiens
tttgtaatgaattc

SEQ ID NO: 3040984 - DNA, 22 bp, Homo sapiens
tttgtacagtatttttcagata

SEQ ID NO: 3040985 - DNA, 17 bp, Homo sapiens
tttgtaccagtgaattt

SEQ ID NO: 3040986 - DNA, 16 bp, Homo sapiens
tttgtagctttcctgg

SEQ ID NO: 3040987 - DNA, 18 bp, Homo sapiens
tttgtaggttattttata

SEQ ID NO: 3040988 - DNA, 12 bp, Homo sapiens
tttgtagtgagc

SEQ ID NO: 3040989 - DNA, 15 bp, Homo sapiens
tttgtagtgattttt

SEQ ID NO: 3040990 - DNA, 18 bp, Homo sapiens
tttgtagttactcaagca

SEQ ID NO: 3040991 - DNA, 19 bp, Homo sapiens
tttgtagttactcaagcag

SEQ ID NO: 3040992 - DNA, 23 bp, Homo sapiens
tttgtataaatgacaaagtgttg

SEQ ID NO: 3040993 - DNA, 20 bp, Homo sapiens
tttgtataattgtatcgtat

SEQ ID NO: 3040994 - DNA, 17 bp, Homo sapiens
tttgtataccatgatgc

SEQ ID NO: 3040995 - DNA, 18 bp, Homo sapiens
tttgtatattgtatttat

SEQ ID NO: 3040996 - DNA, 19 bp, Homo sapiens
tttgtatctttttgaaaat

SEQ ID NO: 3040997 - DNA, 12 bp, Homo sapiens
tttgtatgaaat

SEQ ID NO: 3040998 - DNA, 13 bp, Homo sapiens
tttgtatgatgta

SEQ ID NO: 3040999 - DNA, 20 bp, Homo sapiens
tttgtatttctcttgtcctt

SEQ ID NO: 3041000 - DNA, 23 bp, Homo sapiens
tttgtattttccaagtgtgcata

SEQ ID NO: 3041001 - DNA, 14 bp, Homo sapiens
tttgtcaaactgta

SEQ ID NO: 3041002 - DNA, 16 bp, Homo sapiens
tttgtcaacattgtga

SEQ ID NO: 3041003 - DNA, 11 bp, Homo sapiens
tttgtcaatga

SEQ ID NO: 3041004 - DNA, 17 bp, Homo sapiens
tttgtcaatgacagttt

SEQ ID NO: 3041005 - DNA, 19 bp, Homo sapiens
tttgtcacagctcttgttt

SEQ ID NO: 3041006 - DNA, 17 bp, Homo sapiens
tttgtcaccagaacaca

SEQ ID NO: 3041007 - DNA, 15 bp, Homo sapiens
tttgtcagcatctga

SEQ ID NO: 3041008 - DNA, 14 bp, Homo sapiens
tttgtcccctgctt

SEQ ID NO: 3041009 - DNA, 19 bp, Homo sapiens
tttgtcctgatgcttttgt

SEQ ID NO: 3041010 - DNA, 16 bp, Homo sapiens
tttgtctaaaacaata

SEQ ID NO: 3041011 - DNA, 19 bp, Homo sapiens
tttgtctaaaacaataaaa

SEQ ID NO: 3041012 - DNA, 13 bp, Homo sapiens
tttgtctcacttt

SEQ ID NO: 3041013 - DNA, 22 bp, Homo sapiens
tttgtctcctactctgtgtaaa

SEQ ID NO: 3041014 - DNA, 14 bp, Homo sapiens
tttgtctctttgca

SEQ ID NO: 3041015 - DNA, 19 bp, Homo sapiens
tttgtcttcagattattaa

SEQ ID NO: 3041016 - DNA, 20 bp, Homo sapiens
tttgtgaactcagccaagca

SEQ ID NO: 3041017 - DNA, 21 bp, Homo sapiens
tttgtgactagaaattcttaa

SEQ ID NO: 3041018 - DNA, 15 bp, Homo sapiens
tttgtgactttttaa

SEQ ID NO: 3041019 - DNA, 22 bp, Homo sapiens
tttgtgagccttgctgccaagt

SEQ ID NO: 3041020 - DNA, 18 bp, Homo sapiens
tttgtgaggtgaatgtct

SEQ ID NO: 3041021 - DNA, 24 bp, Homo sapiens
tttgtgatgaatctacatttgttt

SEQ ID NO: 3041022 - DNA, 14 bp, Homo sapiens
tttgtgattcttcc

SEQ ID NO: 3041023 - DNA, 21 bp, Homo sapiens
tttgtgattcttccagatgtg

SEQ ID NO: 3041024 - DNA, 20 bp, Homo sapiens
tttgtgctatagtatttgat

SEQ ID NO: 3041025 - DNA, 20 bp, Homo sapiens
tttgtgctttgaaaaaaagt

SEQ ID NO: 3041026 - DNA, 11 bp, Homo sapiens
tttgtggccaa

SEQ ID NO: 3041027 - DNA, 18 bp, Homo sapiens
tttgtggccaaggagctg

SEQ ID NO: 3041028 - DNA, 20 bp, Homo sapiens
tttgtggggacctcagcctg

SEQ ID NO: 3041029 - DNA, 21 bp, Homo sapiens
tttgtggtgggcgctggggaa

SEQ ID NO: 3041030 - DNA, 19 bp, Homo sapiens
tttgtgtcaataaagtcat

SEQ ID NO: 3041031 - DNA, 16 bp, Homo sapiens
tttgtgtcactgtaca

SEQ ID NO: 3041032 - DNA, 14 bp, Homo sapiens
tttgtgtgttggca

SEQ ID NO: 3041033 - DNA, 19 bp, Homo sapiens
tttgtgtgttgtcttgaaa

SEQ ID NO: 3041034 - DNA, 20 bp, Homo sapiens
tttgttaattaaatatttct

SEQ ID NO: 3041035 - DNA, 16 bp, Homo sapiens
tttgttacaataaaac

SEQ ID NO: 3041036 - DNA, 19 bp, Homo sapiens
tttgttacaataaaactaa

SEQ ID NO: 3041037 - DNA, 12 bp, Homo sapiens
tttgttactttg

SEQ ID NO: 3041038 - DNA, 19 bp, Homo sapiens
tttgttatgtgtctggaag

SEQ ID NO: 3041039 - DNA, 15 bp, Homo sapiens
tttgttcctgtttat

SEQ ID NO: 3041040 - DNA, 16 bp, Homo sapiens
tttgttcctgtttatt

SEQ ID NO: 3041041 - DNA, 12 bp, Homo sapiens
tttgttctccta

SEQ ID NO: 3041042 - DNA, 13 bp, Homo sapiens
tttgttcttcaga

SEQ ID NO: 3041043 - DNA, 14 bp, Homo sapiens
tttgttctttttat

SEQ ID NO: 3041044 - DNA, 20 bp, Homo sapiens
tttgttggagatgcagcctt

SEQ ID NO: 3041045 - DNA, 12 bp, Homo sapiens
tttgttgttccc

SEQ ID NO: 3041046 - DNA, 18 bp, Homo sapiens
tttgtttaaaattctctt

SEQ ID NO: 3041047 - DNA, 13 bp, Homo sapiens
tttgtttatgtta

SEQ ID NO: 3041048 - DNA, 18 bp, Homo sapiens
tttgtttcaacccaactg

SEQ ID NO: 3041049 - DNA, 12 bp, Homo sapiens
tttgtttcatta

SEQ ID NO: 3041050 - DNA, 12 bp, Homo sapiens
tttgtttcttga

SEQ ID NO: 3041051 - DNA, 13 bp, Homo sapiens
tttgtttgctatc

SEQ ID NO: 3041052 - DNA, 18 bp, Homo sapiens
tttgtttggtataaatta

SEQ ID NO: 3041053 - DNA, 21 bp, Homo sapiens
tttgttttaaaataagttaaa

SEQ ID NO: 3041054 - DNA, 12 bp, Homo sapiens
tttgttttgcac

SEQ ID NO: 3041055 - DNA, 10 bp, Homo sapiens
tttgttttgg

SEQ ID NO: 3041056 - DNA, 21 bp, Homo sapiens
tttgttttgggatttttgtgt

SEQ ID NO: 3041057 - DNA, 18 bp, Homo sapiens
tttgttttggtagatctt

SEQ ID NO: 3041058 - DNA, 15 bp, Homo sapiens
tttgttttgttttgt

SEQ ID NO: 3041059 - DNA, 16 bp, Homo sapiens
tttgtttttattttca

SEQ ID NO: 3041060 - DNA, 18 bp, Homo sapiens
tttgtttttccagttcca

SEQ ID NO: 3041061 - DNA, 13 bp, Homo sapiens
tttgtttttctca

SEQ ID NO: 3041062 - DNA, 20 bp, Homo sapiens
tttgtttttgctttctgaaa

SEQ ID NO: 3041063 - DNA, 19 bp, Homo sapiens
ttttaaaaaacaaaaagta

SEQ ID NO: 3041064 - DNA, 18 bp, Homo sapiens
ttttaaaaaatattttct

SEQ ID NO: 3041065 - DNA, 13 bp, Homo sapiens
ttttaaaaagaaa

SEQ ID NO: 3041066 - DNA, 14 bp, Homo sapiens
ttttaaaaagcaaa

SEQ ID NO: 3041067 - DNA, 14 bp, Homo sapiens
ttttaaaaatgcaa

SEQ ID NO: 3041068 - DNA, 12 bp, Homo sapiens
ttttaaaaatgg

SEQ ID NO: 3041069 - DNA, 13 bp, Homo sapiens
ttttaaaaatggt

SEQ ID NO: 3041070 - DNA, 23 bp, Homo sapiens
ttttaaaaatgtcctgcctttta

SEQ ID NO: 3041071 - DNA, 20 bp, Homo sapiens
ttttaaaacacatgttttta

SEQ ID NO: 3041072 - DNA, 17 bp, Homo sapiens
ttttaaaactggacctg

SEQ ID NO: 3041073 - DNA, 20 bp, Homo sapiens
ttttaaaactggacctgtat

SEQ ID NO: 3041074 - DNA, 21 bp, Homo sapiens
ttttaaaattatatagcaaag

SEQ ID NO: 3041075 - DNA, 18 bp, Homo sapiens
ttttaaaattggcctttt

SEQ ID NO: 3041076 - DNA, 12 bp, Homo sapiens
ttttaaacagtg

SEQ ID NO: 3041077 - DNA, 13 bp, Homo sapiens
ttttaaacagtgt

SEQ ID NO: 3041078 - DNA, 19 bp, Homo sapiens
ttttaaacagtgtttatga

SEQ ID NO: 3041079 - DNA, 23 bp, Homo sapiens
ttttaaacgttaaaagtgtacaa

SEQ ID NO: 3041080 - DNA, 12 bp, Homo sapiens
ttttaaactaga

SEQ ID NO: 3041081 - DNA, 14 bp, Homo sapiens
ttttaaactctttt

SEQ ID NO: 3041082 - DNA, 21 bp, Homo sapiens
ttttaaactctttttgggtcc

SEQ ID NO: 3041083 - DNA, 19 bp, Homo sapiens
ttttaaagtaaatctcttt

SEQ ID NO: 3041084 - DNA, 18 bp, Homo sapiens
ttttaaatatttgttctt

SEQ ID NO: 3041085 - DNA, 15 bp, Homo sapiens
ttttaaatattttct

SEQ ID NO: 3041086 - DNA, 21 bp, Homo sapiens
ttttaaatcgccttgaacaaa

SEQ ID NO: 3041087 - DNA, 14 bp, Homo sapiens
ttttaaatgtacag

SEQ ID NO: 3041088 - DNA, 14 bp, Homo sapiens
ttttaaattttctt

SEQ ID NO: 3041089 - DNA, 19 bp, Homo sapiens
tttttacactgagtttcta

SEQ ID NO: 3041090 - DNA, 20 bp, Homo sapiens
tttttaccaaagtgtctttt

SEQ ID NO: 3041091 - DNA, 18 bp, Homo sapiens
tttttactgtgttttata

SEQ ID NO: 3041092 - DNA, 17 bp, Homo sapiens
tttttagtgttaaagag

SEQ ID NO: 3041093 - DNA, 14 bp, Homo sapiens
tttttatatataca

SEQ ID NO: 3041094 - DNA, 19 bp, Homo sapiens
tttttatctagaacattca

SEQ ID NO: 3041095 - DNA, 23 bp, Homo sapiens
tttttattgaatctatttaagta

SEQ ID NO: 3041096 - DNA, 20 bp, Homo sapiens
tttttatttcttttgtgcag

SEQ ID NO: 3041097 - DNA, 23 bp, Homo sapiens
tttttcaaccccaccctgtttgg

SEQ ID NO: 3041098 - DNA, 15 bp, Homo sapiens
tttttcacacatcgt

SEQ ID NO: 3041099 - DNA, 17 bp, Homo sapiens
tttttcagatataaata

SEQ ID NO: 3041100 - DNA, 21 bp, Homo sapiens
tttttcagatataaatactga

SEQ ID NO: 3041101 - DNA, 23 bp, Homo sapiens
tttttcagcacatgttaccatgt

SEQ ID NO: 3041102 - DNA, 19 bp, Homo sapiens
tttttcagtttaattctgt

SEQ ID NO: 3041103 - DNA, 10 bp, Homo sapiens
tttttcatgt

SEQ ID NO: 3041104 - DNA, 20 bp, Homo sapiens
tttttcatgttttaacaaaa

SEQ ID NO: 3041105 - DNA, 19 bp, Homo sapiens
tttttcattgccaaaaact

SEQ ID NO: 3041106 - DNA, 22 bp, Homo sapiens
tttttcatttattgtttatgta

SEQ ID NO: 3041107 - DNA, 20 bp, Homo sapiens
tttttcatttttttctctct

SEQ ID NO: 3041108 - DNA, 20 bp, Homo sapiens
tttttccttcctctgtaaga

SEQ ID NO: 3041109 - DNA, 14 bp, Homo sapiens
tttttccttcctga

SEQ ID NO: 3041110 - DNA, 14 bp, Homo sapiens
tttttctcttctgt

SEQ ID NO: 3041111 - DNA, 18 bp, Homo sapiens
tttttctcttctgtccat

SEQ ID NO: 3041112 - DNA, 13 bp, Homo sapiens
tttttctgcagaa

SEQ ID NO: 3041113 - DNA, 17 bp, Homo sapiens
tttttctgcttttgaaa

SEQ ID NO: 3041114 - DNA, 14 bp, Homo sapiens
tttttcttgatctt

SEQ ID NO: 3041115 - DNA, 15 bp, Homo sapiens
tttttctttatcaag

SEQ ID NO: 3041116 - DNA, 12 bp, Homo sapiens
tttttctttcac

SEQ ID NO: 3041117 - DNA, 20 bp, Homo sapiens
tttttctttcacaaggtata

SEQ ID NO: 3041118 - DNA, 14 bp, Homo sapiens
tttttctttccaag

SEQ ID NO: 3041119 - DNA, 15 bp, Homo sapiens
tttttgaagctgtat

SEQ ID NO: 3041120 - DNA, 15 bp, Homo sapiens
tttttgataaagcct

SEQ ID NO: 3041121 - DNA, 18 bp, Homo sapiens
tttttgattaacaatgta

SEQ ID NO: 3041122 - DNA, 22 bp, Homo sapiens
tttttgcaccccatgctgttga

SEQ ID NO: 3041123 - DNA, 12 bp, Homo sapiens
tttttgccaaaa

SEQ ID NO: 3041124 - DNA, 16 bp, Homo sapiens
tttttgctataatcat

SEQ ID NO: 3041125 - DNA, 23 bp, Homo sapiens
tttttggaaaagagctgggatcc

SEQ ID NO: 3041126 - DNA, 22 bp, Homo sapiens
tttttggaccaccgttcagtca

SEQ ID NO: 3041127 - DNA, 12 bp, Homo sapiens
tttttggacttc

SEQ ID NO: 3041128 - DNA, 18 bp, Homo sapiens
tttttggacttcaaagca

SEQ ID NO: 3041129 - DNA, 20 bp, Homo sapiens
tttttggagtgttatgtatt

SEQ ID NO: 3041130 - DNA, 13 bp, Homo sapiens
tttttggtacaaa

SEQ ID NO: 3041131 - DNA, 14 bp, Homo sapiens
tttttggtacaaaa

SEQ ID NO: 3041132 - DNA, 16 bp, Homo sapiens
tttttggtagtttctg

SEQ ID NO: 3041133 - DNA, 15 bp, Homo sapiens
tttttggttgtttgc

SEQ ID NO: 3041134 - DNA, 14 bp, Homo sapiens
tttttgtataaatg

SEQ ID NO: 3041135 - DNA, 12 bp, Homo sapiens
tttttgtatttt

SEQ ID NO: 3041136 - DNA, 16 bp, Homo sapiens
tttttgtcaacattgt

SEQ ID NO: 3041137 - DNA, 13 bp, Homo sapiens
tttttgtcttttc

SEQ ID NO: 3041138 - DNA, 12 bp, Homo sapiens
tttttgtgaaga

SEQ ID NO: 3041139 - DNA, 13 bp, Homo sapiens
tttttgtgaagac

SEQ ID NO: 3041140 - DNA, 20 bp, Homo sapiens
tttttgtgagcctctttgta

SEQ ID NO: 3041141 - DNA, 13 bp, Homo sapiens
tttttgttctttt

SEQ ID NO: 3041142 - DNA, 19 bp, Homo sapiens
tttttgttgagtctctgaa

SEQ ID NO: 3041143 - DNA, 11 bp, Homo sapiens
tttttgtttgt

SEQ ID NO: 3041144 - DNA, 18 bp, Homo sapiens
tttttgtttgtttttgct

SEQ ID NO: 3041145 - DNA, 13 bp, Homo sapiens
tttttgtttttta

SEQ ID NO: 3041146 - DNA, 13 bp, Homo sapiens
ttttttaaaaact

SEQ ID NO: 3041147 - DNA, 18 bp, Homo sapiens
ttttttaatttgttttgt

SEQ ID NO: 3041148 - DNA, 12 bp, Homo sapiens
ttttttatttaa

SEQ ID NO: 3041149 - DNA, 12 bp, Homo sapiens
ttttttcatctt

SEQ ID NO: 3041150 - DNA, 13 bp, Homo sapiens
ttttttcatttat

SEQ ID NO: 3041151 - DNA, 18 bp, Homo sapiens
ttttttcctcctttctct

SEQ ID NO: 3041152 - DNA, 13 bp, Homo sapiens
ttttttgaaacac

SEQ ID NO: 3041153 - DNA, 20 bp, Homo sapiens
ttttttgaaacacaatacct

SEQ ID NO: 3041154 - DNA, 16 bp, Homo sapiens
ttttttgaatccaaat

SEQ ID NO: 3041155 - DNA, 15 bp, Homo sapiens
ttttttgatggctaa

SEQ ID NO: 3041156 - DNA, 23 bp, Homo sapiens
ttttttggggatatgcttagtaa

SEQ ID NO: 3041157 - DNA, 12 bp, Homo sapiens
ttttttgtcaac

SEQ ID NO: 3041158 - DNA, 13 bp, Homo sapiens
tttttttaagaca

SEQ ID NO: 3041159 - DNA, 10 bp, Homo sapiens
tttttttggt

SEQ ID NO: 3041160 - DNA, 14 bp, Homo sapiens
ttttttttgtttgt

SEQ ID NO: 3041161 - DNA, 15 bp, Homo sapiens
aaaatcagccagaca

SEQ ID NO: 3041162 - DNA, 22 bp, Homo sapiens
aaaatcatggaatggttataaa

SEQ ID NO: 3041163 - DNA, 11 bp, Homo sapiens
aaaatccaaac

SEQ ID NO: 3041164 - DNA, 14 bp, Homo sapiens
aaaatcctggaaga

SEQ ID NO: 3041165 - DNA, 16 bp, Homo sapiens
aaaatccttacttcca

SEQ ID NO: 3041166 - DNA, 19 bp, Homo sapiens
aaaatccttacttccagca

SEQ ID NO: 3041167 - DNA, 15 bp, Homo sapiens
aaaatctgctaggga

SEQ ID NO: 3041168 - DNA, 15 bp, Homo sapiens
aaaatctgtcataag

SEQ ID NO: 3041169 - DNA, 20 bp, Homo sapiens
aaaatcttatagttctaggc

SEQ ID NO: 3041170 - DNA, 19 bp, Homo sapiens
aaaatcttcagctggtgga

SEQ ID NO: 3041171 - DNA, 18 bp, Homo sapiens
aaaatcttgcagttttgt

SEQ ID NO: 3041172 - DNA, 15 bp, Homo sapiens
aaaatctttctttgg

SEQ ID NO: 3041173 - DNA, 14 bp, Homo sapiens
aaaatgaaagatga

SEQ ID NO: 3041174 - DNA, 18 bp, Homo sapiens
aaaatgaactgtattatt

SEQ ID NO: 3041175 - DNA, 20 bp, Homo sapiens
aaaatgaatagcttgtttct

SEQ ID NO: 3041176 - DNA, 15 bp, Homo sapiens
aaaatgaatcctaca

SEQ ID NO: 3041177 - DNA, 18 bp, Homo sapiens
aaaatgagcatacatctt

SEQ ID NO: 3041178 - DNA, 16 bp, Homo sapiens
aaaatgatgttataca

SEQ ID NO: 3041179 - DNA, 21 bp, Homo sapiens
aaaatgcaatcaatttaaatt

SEQ ID NO: 3041180 - DNA, 15 bp, Homo sapiens
aaaatgccataatac

SEQ ID NO: 3041181 - DNA, 11 bp, Homo sapiens
aaaatgcttct

SEQ ID NO: 3041182 - DNA, 19 bp, Homo sapiens
aaaatgcttctttctactt

SEQ ID NO: 3041183 - DNA, 13 bp, Homo sapiens
aaaatgcttttta

SEQ ID NO: 3041184 - DNA, 19 bp, Homo sapiens
aaaatgctttttatttctg

SEQ ID NO: 3041185 - DNA, 15 bp, Homo sapiens
aaaatggaattactc

SEQ ID NO: 3041186 - DNA, 20 bp, Homo sapiens
aaaatggcagtgatgaattt

SEQ ID NO: 3041187 - DNA, 23 bp, Homo sapiens
aaaatggcatccagggctgccag

SEQ ID NO: 3041188 - DNA, 17 bp, Homo sapiens
aaaatgggaaaaataaa

SEQ ID NO: 3041189 - DNA, 21 bp, Homo sapiens
aaaatgggaaaaataaaagaa

SEQ ID NO: 3041190 - DNA, 15 bp, Homo sapiens
aaaatgggacttctt

SEQ ID NO: 3041191 - DNA, 22 bp, Homo sapiens
aaaatgggacttcttttcacat

SEQ ID NO: 3041192 - DNA, 23 bp, Homo sapiens
aaaatggtcctatttttgtgaag

SEQ ID NO: 3041193 - DNA, 18 bp, Homo sapiens
aaaatggtggcttcagct

SEQ ID NO: 3041194 - DNA, 19 bp, Homo sapiens
aaaatggtggcttcagctc

SEQ ID NO: 3041195 - DNA, 15 bp, Homo sapiens
aaaatgtaaatgaat

SEQ ID NO: 3041196 - DNA, 14 bp, Homo sapiens
aaaatgtatatgca

SEQ ID NO: 3041197 - DNA, 18 bp, Homo sapiens
aaaatgtatattttgatg

SEQ ID NO: 3041198 - DNA, 18 bp, Homo sapiens
aaaatgtatccagaggaa

SEQ ID NO: 3041199 - DNA, 16 bp, Homo sapiens
aaaatgtcctgccttt

SEQ ID NO: 3041200 - DNA, 18 bp, Homo sapiens
aaaatgtcctgcctttta

SEQ ID NO: 3041201 - DNA, 11 bp, Homo sapiens
aaaatgtctgt

SEQ ID NO: 3041202 - DNA, 14 bp, Homo sapiens
aaaatgtcttgtgt

SEQ ID NO: 3041203 - DNA, 12 bp, Homo sapiens
aaaatgtgaaat

SEQ ID NO: 3041204 - DNA, 16 bp, Homo sapiens
aaaatgtgaaattttt

SEQ ID NO: 3041205 - DNA, 15 bp, Homo sapiens
aaaatgtgatgttct

SEQ ID NO: 3041206 - DNA, 21 bp, Homo sapiens
aaaatgtgatgttctaaggct

SEQ ID NO: 3041207 - DNA, 23 bp, Homo sapiens
aaaatgtgcagtaatagcactgc

SEQ ID NO: 3041208 - DNA, 18 bp, Homo sapiens
aaaatgttcccttgacca

SEQ ID NO: 3041209 - DNA, 14 bp, Homo sapiens
aaaatgttgagaat

SEQ ID NO: 3041210 - DNA, 15 bp, Homo sapiens
aaaatgttttttcat

SEQ ID NO: 3041211 - DNA, 13 bp, Homo sapiens
aaaattacaaaga

SEQ ID NO: 3041212 - DNA, 14 bp, Homo sapiens
aaaattacaaagaa

SEQ ID NO: 3041213 - DNA, 18 bp, Homo sapiens
aaaattactaactgccat

SEQ ID NO: 3041214 - DNA, 14 bp, Homo sapiens
aaaattacttttct

SEQ ID NO: 3041215 - DNA, 12 bp, Homo sapiens
aaaattatatag

SEQ ID NO: 3041216 - DNA, 14 bp, Homo sapiens
aaaattatatagca

SEQ ID NO: 3041217 - DNA, 19 bp, Homo sapiens
aaaattatgtttttcagtt

SEQ ID NO: 3041218 - DNA, 14 bp, Homo sapiens
aaaattatttgcat

SEQ ID NO: 3041219 - DNA, 22 bp, Homo sapiens
aaaattcctttgtgtttctatt

SEQ ID NO: 3041220 - DNA, 19 bp, Homo sapiens
aaaattgaacaaagactac

SEQ ID NO: 3041221 - DNA, 14 bp, Homo sapiens
aaaatttacattta

SEQ ID NO: 3041222 - DNA, 19 bp, Homo sapiens
aaaatttgactaattttac

SEQ ID NO: 3041223 - DNA, 20 bp, Homo sapiens
aaaatttggtgcttataaga

SEQ ID NO: 3041224 - DNA, 18 bp, Homo sapiens
aaaatttgttattttgca

SEQ ID NO: 3041225 - DNA, 14 bp, Homo sapiens
aaaatttgttgcat

SEQ ID NO: 3041226 - DNA, 14 bp, Homo sapiens
aaaattttatgaca

SEQ ID NO: 3041227 - DNA, 15 bp, Homo sapiens
aaaattttttttcat

SEQ ID NO: 3041228 - DNA, 17 bp, Homo sapiens
aaaattttttttcatgt

SEQ ID NO: 3041229 - DNA, 18 bp, Homo sapiens
aaaattttttttcatgtt

SEQ ID NO: 3041230 - DNA, 19 bp, Homo sapiens
aaaattttttttcatgttt

SEQ ID NO: 3041231 - DNA, 18 bp, Homo sapiens
aaacaaaaaaactacaaa

SEQ ID NO: 3041232 - DNA, 19 bp, Homo sapiens
aaacaaaaattaaaatcct

SEQ ID NO: 3041233 - DNA, 18 bp, Homo sapiens
aaacaaaatggcttcagt

SEQ ID NO: 3041234 - DNA, 15 bp, Homo sapiens
aaacaaaatttgact

SEQ ID NO: 3041235 - DNA, 17 bp, Homo sapiens
aaacaaaatttgactaa

SEQ ID NO: 3041236 - DNA, 13 bp, Homo sapiens
aaacaaagccaga

SEQ ID NO: 3041237 - DNA, 17 bp, Homo sapiens
aaacaaagcttagcagg

SEQ ID NO: 3041238 - DNA, 22 bp, Homo sapiens
aaacaaagcttagcaggagagg

SEQ ID NO: 3041239 - DNA, 16 bp, Homo sapiens
aaacaaagttctattt

SEQ ID NO: 3041240 - DNA, 22 bp, Homo sapiens
aaacaaataatttgaactttgg

SEQ ID NO: 3041241 - DNA, 16 bp, Homo sapiens
aaacaacaatttctac

SEQ ID NO: 3041242 - DNA, 20 bp, Homo sapiens
aaacaagcactaaacaaaga

SEQ ID NO: 3041243 - DNA, 20 bp, Homo sapiens
aaacaataaagaaagaaata

SEQ ID NO: 3041244 - DNA, 14 bp, Homo sapiens
aaacaatattgttt

SEQ ID NO: 3041245 - DNA, 22 bp, Homo sapiens
aaacaatatttaaccaaagaac

SEQ ID NO: 3041246 - DNA, 15 bp, Homo sapiens
aaacaatttaaaaat

SEQ ID NO: 3041247 - DNA, 14 bp, Homo sapiens
aaacacaaatgcag

SEQ ID NO: 3041248 - DNA, 21 bp, Homo sapiens
aaacacaataagagtctcctt

SEQ ID NO: 3041249 - DNA, 15 bp, Homo sapiens
aaacacactgaggca

SEQ ID NO: 3041250 - DNA, 10 bp, Homo sapiens
aaacacagag

SEQ ID NO: 3041251 - DNA, 15 bp, Homo sapiens
aaacacatacaaaag

SEQ ID NO: 3041252 - DNA, 15 bp, Homo sapiens
aaacacattgttatt

SEQ ID NO: 3041253 - DNA, 23 bp, Homo sapiens
aaacactatttgtgactttttaa

SEQ ID NO: 3041254 - DNA, 15 bp, Homo sapiens
aaacactccttgcat

SEQ ID NO: 3041255 - DNA, 13 bp, Homo sapiens
aaacactgccatc

SEQ ID NO: 3041256 - DNA, 13 bp, Homo sapiens
aaacactttctct

SEQ ID NO: 3041257 - DNA, 14 bp, Homo sapiens
aaacactttctctt

SEQ ID NO: 3041258 - DNA, 21 bp, Homo sapiens
aaacagaataaaagttcctct

SEQ ID NO: 3041259 - DNA, 22 bp, Homo sapiens
aaacagacaaaaacagcctcac

SEQ ID NO: 3041260 - DNA, 16 bp, Homo sapiens
aaacagacaatatgtg

SEQ ID NO: 3041261 - DNA, 22 bp, Homo sapiens
aaacagacaatatgtgagtgcc

SEQ ID NO: 3041262 - DNA, 20 bp, Homo sapiens
aaacagactcgattcatatt

SEQ ID NO: 3041263 - DNA, 17 bp, Homo sapiens
aaacagaggtaaaaaaa

SEQ ID NO: 3041264 - DNA, 18 bp, Homo sapiens
aaacagcaaaccaagaga

SEQ ID NO: 3041265 - DNA, 20 bp, Homo sapiens
aaacagcaaaccaagagatt

SEQ ID NO: 3041266 - DNA, 11 bp, Homo sapiens
aaacagcaggg

SEQ ID NO: 3041267 - DNA, 16 bp, Homo sapiens
aaacagcagggtttga

SEQ ID NO: 3041268 - DNA, 18 bp, Homo sapiens
aaacagcagggtttgagc

SEQ ID NO: 3041269 - DNA, 21 bp, Homo sapiens
aaacagcagggtttgagcaca

SEQ ID NO: 3041270 - DNA, 16 bp, Homo sapiens
aaacagcattgctttc

SEQ ID NO: 3041271 - DNA, 18 bp, Homo sapiens
aaacagcattgctttctg

SEQ ID NO: 3041272 - DNA, 12 bp, Homo sapiens
aaacagctgcct

SEQ ID NO: 3041273 - DNA, 13 bp, Homo sapiens
aaacagctgcctt

SEQ ID NO: 3041274 - DNA, 17 bp, Homo sapiens
aaacagctggacttatt

SEQ ID NO: 3041275 - DNA, 19 bp, Homo sapiens
aaacagctggacttattta

SEQ ID NO: 3041276 - DNA, 23 bp, Homo sapiens
aaacagggtggcccaggtggcta

SEQ ID NO: 3041277 - DNA, 18 bp, Homo sapiens
aaacagtgcctgctgaat

SEQ ID NO: 3041278 - DNA, 21 bp, Homo sapiens
aaacataaaaagcagaatttt

SEQ ID NO: 3041279 - DNA, 14 bp, Homo sapiens
aaacatagaaatgg

SEQ ID NO: 3041280 - DNA, 13 bp, Homo sapiens
aaacatagactga

SEQ ID NO: 3041281 - DNA, 19 bp, Homo sapiens
aaacatagactgaagattt

SEQ ID NO: 3041282 - DNA, 16 bp, Homo sapiens
aaacatagcttgtaac

SEQ ID NO: 3041283 - DNA, 14 bp, Homo sapiens
aaacatatgcacat

SEQ ID NO: 3041284 - DNA, 16 bp, Homo sapiens
aaacatattttacatc

SEQ ID NO: 3041285 - DNA, 16 bp, Homo sapiens
aaacatgaaaacattg

SEQ ID NO: 3041286 - DNA, 16 bp, Homo sapiens
aaacatgaagcataat

SEQ ID NO: 3041287 - DNA, 18 bp, Homo sapiens
aaacatgaagcataattt

SEQ ID NO: 3041288 - DNA, 20 bp, Homo sapiens
aaacatgaagcataatttgt

SEQ ID NO: 3041289 - DNA, 15 bp, Homo sapiens
aaacatgctgtttat

SEQ ID NO: 3041290 - DNA, 21 bp, Homo sapiens
aaacatgtgcaactcttgtat

SEQ ID NO: 3041291 - DNA, 17 bp, Homo sapiens
aaacattattttaattg

SEQ ID NO: 3041292 - DNA, 23 bp, Homo sapiens
aaacattctgatttggaaaaaga

SEQ ID NO: 3041293 - DNA, 20 bp, Homo sapiens
aaacattgaagtaatgaatt

SEQ ID NO: 3041294 - DNA, 13 bp, Homo sapiens
aaacatttgagtt

SEQ ID NO: 3041295 - DNA, 17 bp, Homo sapiens
aaacattttaaatgaaa

SEQ ID NO: 3041296 - DNA, 10 bp, Homo sapiens
aaacattttc

SEQ ID NO: 3041297 - DNA, 17 bp, Homo sapiens
aaaccaaagctttattt

SEQ ID NO: 3041298 - DNA, 17 bp, Homo sapiens
aaaccaacccatgtata

SEQ ID NO: 3041299 - DNA, 16 bp, Homo sapiens
aaaccaagagattgct

SEQ ID NO: 3041300 - DNA, 18 bp, Homo sapiens
aaaccaagagattgctaa

SEQ ID NO: 3041301 - DNA, 19 bp, Homo sapiens
aaaccaagagattgctaat

SEQ ID NO: 3041302 - DNA, 17 bp, Homo sapiens
aaaccaagtcaggccag

SEQ ID NO: 3041303 - DNA, 18 bp, Homo sapiens
aaaccaagtctacttcac

SEQ ID NO: 3041304 - DNA, 22 bp, Homo sapiens
aaaccaagtctacttcactaat

SEQ ID NO: 3041305 - DNA, 22 bp, Homo sapiens
aaaccaattttttgttcttcag

SEQ ID NO: 3041306 - DNA, 21 bp, Homo sapiens
aaaccacagtttcattattct

SEQ ID NO: 3041307 - DNA, 20 bp, Homo sapiens
aaaccactatgcaaagaact

SEQ ID NO: 3041308 - DNA, 17 bp, Homo sapiens
aaaccagagtctgtatt

SEQ ID NO: 3041309 - DNA, 14 bp, Homo sapiens
aaacccaagttttt

SEQ ID NO: 3041310 - DNA, 14 bp, Homo sapiens
aaacccacaagctg

SEQ ID NO: 3041311 - DNA, 17 bp, Homo sapiens
aaacccacaagctgcct

SEQ ID NO: 3041312 - DNA, 21 bp, Homo sapiens
aaacccataggcccacacaca

SEQ ID NO: 3041313 - DNA, 14 bp, Homo sapiens
aaacccatttactt

SEQ ID NO: 3041314 - DNA, 15 bp, Homo sapiens
aaacccccacacaca

SEQ ID NO: 3041315 - DNA, 16 bp, Homo sapiens
aaacccccacacacac

SEQ ID NO: 3041316 - DNA, 19 bp, Homo sapiens
aaacccgaggaagatgctc

SEQ ID NO: 3041317 - DNA, 17 bp, Homo sapiens
aaaccctatctgtgatt

SEQ ID NO: 3041318 - DNA, 18 bp, Homo sapiens
aaaccgctttggcctgag

SEQ ID NO: 3041319 - DNA, 22 bp, Homo sapiens
aaacctctcctcatgttctgct

SEQ ID NO: 3041320 - DNA, 20 bp, Homo sapiens
aaacctcttctgtatttttt

SEQ ID NO: 3041321 - DNA, 18 bp, Homo sapiens
aaacctgggattcaggaa

SEQ ID NO: 3041322 - DNA, 21 bp, Homo sapiens
aaacctgggattcaggaatgt

SEQ ID NO: 3041323 - DNA, 17 bp, Homo sapiens
aaacctgtatctttcta

SEQ ID NO: 3041324 - DNA, 12 bp, Homo sapiens
aaacctgtgcct

SEQ ID NO: 3041325 - DNA, 19 bp, Homo sapiens
aaacctgttgaagattatt

SEQ ID NO: 3041326 - DNA, 20 bp, Homo sapiens
aaacctgtttttttttcatt

SEQ ID NO: 3041327 - DNA, 13 bp, Homo sapiens
aaaccttagtttc

SEQ ID NO: 3041328 - DNA, 14 bp, Homo sapiens
aaaccttgaggaga

SEQ ID NO: 3041329 - DNA, 14 bp, Homo sapiens
aaaccttgtttctt

SEQ ID NO: 3041330 - DNA, 18 bp, Homo sapiens
aaaccttgtttctttctg

SEQ ID NO: 3041331 - DNA, 14 bp, Homo sapiens
aaacctttccattt

SEQ ID NO: 3041332 - DNA, 21 bp, Homo sapiens
aaacctttgcttaccttgttt

SEQ ID NO: 3041333 - DNA, 15 bp, Homo sapiens
aaacgatttaattct

SEQ ID NO: 3041334 - DNA, 18 bp, Homo sapiens
aaacgatttaattctctt

SEQ ID NO: 3041335 - DNA, 13 bp, Homo sapiens
aaacgctacctct

SEQ ID NO: 3041336 - DNA, 16 bp, Homo sapiens
aaacgctgcctgccca

SEQ ID NO: 3041337 - DNA, 17 bp, Homo sapiens
aaacggttcagtttctt

SEQ ID NO: 3041338 - DNA, 16 bp, Homo sapiens
aaacgtatgcatgtga

SEQ ID NO: 3041339 - DNA, 12 bp, Homo sapiens
aaacgtgtcccg

SEQ ID NO: 3041340 - DNA, 20 bp, Homo sapiens
aaactaaagcaatagaaaca

SEQ ID NO: 3041341 - DNA, 16 bp, Homo sapiens
aaactaaatgtgtaca

SEQ ID NO: 3041342 - DNA, 19 bp, Homo sapiens
aaactaaccttttatcaat

SEQ ID NO: 3041343 - DNA, 18 bp, Homo sapiens
aaactaaggccctcttga

SEQ ID NO: 3041344 - DNA, 15 bp, Homo sapiens
aaactaaggtgctaa

SEQ ID NO: 3041345 - DNA, 21 bp, Homo sapiens
aaactaccagtgggcatgtat

SEQ ID NO: 3041346 - DNA, 14 bp, Homo sapiens
aaactactgtgtca

SEQ ID NO: 3041347 - DNA, 17 bp, Homo sapiens
aaactagatgacctcat

SEQ ID NO: 3041348 - DNA, 14 bp, Homo sapiens
aaactagtaaaact

SEQ ID NO: 3041349 - DNA, 18 bp, Homo sapiens
aaactagtagttctcttg

SEQ ID NO: 3041350 - DNA, 14 bp, Homo sapiens
aaactataaataca

SEQ ID NO: 3041351 - DNA, 22 bp, Homo sapiens
aaactattccatgttttaaaat

SEQ ID NO: 3041352 - DNA, 18 bp, Homo sapiens
aaactatttacaatgtgt

SEQ ID NO: 3041353 - DNA, 13 bp, Homo sapiens
aaactatttatct

SEQ ID NO: 3041354 - DNA, 15 bp, Homo sapiens
aaactcaaagaatgt

SEQ ID NO: 3041355 - DNA, 13 bp, Homo sapiens
aaactcagaatat

SEQ ID NO: 3041356 - DNA, 24 bp, Homo sapiens
aaactcatttataaagctaaaata

SEQ ID NO: 3041357 - DNA, 15 bp, Homo sapiens
aaactcccttgtgtt

SEQ ID NO: 3041358 - DNA, 16 bp, Homo sapiens
aaactcccttgtgttc

SEQ ID NO: 3041359 - DNA, 17 bp, Homo sapiens
aaactcccttgtgttcc

SEQ ID NO: 3041360 - DNA, 21 bp, Homo sapiens
aaactcccttgtgttccttct

SEQ ID NO: 3041361 - DNA, 23 bp, Homo sapiens
aaactcctactgcttcctctgaa

SEQ ID NO: 3041362 - DNA, 14 bp, Homo sapiens
aaactcgaaaataa

SEQ ID NO: 3041363 - DNA, 14 bp, Homo sapiens
aaactctctcccag

SEQ ID NO: 3041364 - DNA, 15 bp, Homo sapiens
aaactctctcccagg

SEQ ID NO: 3041365 - DNA, 13 bp, Homo sapiens
aaactctctgaac

SEQ ID NO: 3041366 - DNA, 22 bp, Homo sapiens
aaactctcttcttccattagaa

SEQ ID NO: 3041367 - DNA, 12 bp, Homo sapiens
aaactctgctgt

SEQ ID NO: 3041368 - DNA, 16 bp, Homo sapiens
aaactcttcagttaat

SEQ ID NO: 3041369 - DNA, 11 bp, Homo sapiens
aaactgaagct

SEQ ID NO: 3041370 - DNA, 17 bp, Homo sapiens
aaactgcacaataaaac

SEQ ID NO: 3041371 - DNA, 13 bp, Homo sapiens
aaactgcagtcct

SEQ ID NO: 3041372 - DNA, 14 bp, Homo sapiens
aaactgctgtctct

SEQ ID NO: 3041373 - DNA, 18 bp, Homo sapiens
aaactgcttgagcatcag

SEQ ID NO: 3041374 - DNA, 18 bp, Homo sapiens
aaactggtatgaataatt

SEQ ID NO: 3041375 - DNA, 15 bp, Homo sapiens
aaactgtagaaatga

SEQ ID NO: 3041376 - DNA, 15 bp, Homo sapiens
aaactgtatttaagg

SEQ ID NO: 3041377 - DNA, 17 bp, Homo sapiens
aaactgtgaatgcttct

SEQ ID NO: 3041378 - DNA, 14 bp, Homo sapiens
aaacttagaggaaa

SEQ ID NO: 3041379 - DNA, 14 bp, Homo sapiens
aaacttatgaatgt

SEQ ID NO: 3041380 - DNA, 22 bp, Homo sapiens
aaacttccattctttcttcctc

SEQ ID NO: 3041381 - DNA, 15 bp, Homo sapiens
aaacttgaagcagtc

SEQ ID NO: 3041382 - DNA, 13 bp, Homo sapiens
aaacttgacccag

SEQ ID NO: 3041383 - DNA, 18 bp, Homo sapiens
aaacttgtatctgaagac

SEQ ID NO: 3041384 - DNA, 22 bp, Homo sapiens
aaacttgtatctgaagacctac

SEQ ID NO: 3041385 - DNA, 16 bp, Homo sapiens
aaacttgtcacttgca

SEQ ID NO: 3041386 - DNA, 19 bp, Homo sapiens
aaactttgagtacagatac

SEQ ID NO: 3041387 - DNA, 20 bp, Homo sapiens
aaacttttgtttaaagcatt

SEQ ID NO: 3041388 - DNA, 22 bp, Homo sapiens
aaactttttgaccagtttcttt

SEQ ID NO: 3041389 - DNA, 17 bp, Homo sapiens
aaagaaaaaaaaagaat

SEQ ID NO: 3041390 - DNA, 13 bp, Homo sapiens
aaagaaaaaaacc

SEQ ID NO: 3041391 - DNA, 14 bp, Homo sapiens
aaagaaaaaatatt

SEQ ID NO: 3041392 - DNA, 13 bp, Homo sapiens
aaagaaaaatgca

SEQ ID NO: 3041393 - DNA, 13 bp, Homo sapiens
aaagaaaatctat

SEQ ID NO: 3041394 - DNA, 23 bp, Homo sapiens
aaagaaacccgacagagggaaga

SEQ ID NO: 3041395 - DNA, 12 bp, Homo sapiens
aaagaaagagag

SEQ ID NO: 3041396 - DNA, 17 bp, Homo sapiens
aaagaaagagagaaaat

SEQ ID NO: 3041397 - DNA, 16 bp, Homo sapiens
aaagaaagcatttgta

SEQ ID NO: 3041398 - DNA, 13 bp, Homo sapiens
aaagaaagggaaa

SEQ ID NO: 3041399 - DNA, 21 bp, Homo sapiens
aaagaaagggaaactggctga

SEQ ID NO: 3041400 - DNA, 23 bp, Homo sapiens
aaagaaagttaggttataagaaa

SEQ ID NO: 3041401 - DNA, 14 bp, Homo sapiens
aaagaaataaccac

SEQ ID NO: 3041402 - DNA, 21 bp, Homo sapiens
aaagaaataaccactgcaagt

SEQ ID NO: 3041403 - DNA, 13 bp, Homo sapiens
aaagaaattacag

SEQ ID NO: 3041404 - DNA, 14 bp, Homo sapiens
aaagaaattatctt

SEQ ID NO: 3041405 - DNA, 12 bp, Homo sapiens
aaagaacataaa

SEQ ID NO: 3041406 - DNA, 15 bp, Homo sapiens
aaagaaccttgaaga

SEQ ID NO: 3041407 - DNA, 19 bp, Homo sapiens
aaagaagacaacattaaaa

SEQ ID NO: 3041408 - DNA, 15 bp, Homo sapiens
aaagaagacatgttt

SEQ ID NO: 3041409 - DNA, 16 bp, Homo sapiens
aaagaagatagtgaga

SEQ ID NO: 3041410 - DNA, 20 bp, Homo sapiens
aaagaagtttgggctaacat

SEQ ID NO: 3041411 - DNA, 14 bp, Homo sapiens
aaagaataagaaaa

SEQ ID NO: 3041412 - DNA, 13 bp, Homo sapiens
aaagaatacttga

SEQ ID NO: 3041413 - DNA, 18 bp, Homo sapiens
aaagaatcggcagtattt

SEQ ID NO: 3041414 - DNA, 23 bp, Homo sapiens
aaagaatcggcagtattttctgt

SEQ ID NO: 3041415 - DNA, 14 bp, Homo sapiens
aaagaatgaaagag

SEQ ID NO: 3041416 - DNA, 17 bp, Homo sapiens
aaagaatgttagagcac

SEQ ID NO: 3041417 - DNA, 21 bp, Homo sapiens
aaagaattaaacccacaagct

SEQ ID NO: 3041418 - DNA, 19 bp, Homo sapiens
aaagaattctggtcctgtt

SEQ ID NO: 3041419 - DNA, 17 bp, Homo sapiens
aaagacaaattctgttt

SEQ ID NO: 3041420 - DNA, 19 bp, Homo sapiens
aaagacaaattctgtttct

SEQ ID NO: 3041421 - DNA, 14 bp, Homo sapiens
aaagacaagtgctc

SEQ ID NO: 3041422 - DNA, 14 bp, Homo sapiens
aaagacaatcactg

SEQ ID NO: 3041423 - DNA, 20 bp, Homo sapiens
aaagacaatcactgaaacaa

SEQ ID NO: 3041424 - DNA, 11 bp, Homo sapiens
aaagacaattc

SEQ ID NO: 3041425 - DNA, 13 bp, Homo sapiens
aaagacaattctt

SEQ ID NO: 3041426 - DNA, 16 bp, Homo sapiens
aaagacactgcctggg

SEQ ID NO: 3041427 - DNA, 9 bp, Homo sapiens
aaagacaga

SEQ ID NO: 3041428 - DNA, 22 bp, Homo sapiens
aaagacagtgtatgtagaagca

SEQ ID NO: 3041429 - DNA, 19 bp, Homo sapiens
aaagacattatttctcata

SEQ ID NO: 3041430 - DNA, 16 bp, Homo sapiens
aaagaccaaattttga

SEQ ID NO: 3041431 - DNA, 13 bp, Homo sapiens
aaagagaaaaaaa

SEQ ID NO: 3041432 - DNA, 15 bp, Homo sapiens
aaagagaatgtattt

SEQ ID NO: 3041433 - DNA, 15 bp, Homo sapiens
aaagagagaaaataa

SEQ ID NO: 3041434 - DNA, 16 bp, Homo sapiens
aaagagagaaaataaa

SEQ ID NO: 3041435 - DNA, 17 bp, Homo sapiens
aaagagagaaaataaaa

SEQ ID NO: 3041436 - DNA, 20 bp, Homo sapiens
aaagagagcagagaatataa

SEQ ID NO: 3041437 - DNA, 19 bp, Homo sapiens
aaagagagttaaaagcagc

SEQ ID NO: 3041438 - DNA, 21 bp, Homo sapiens
aaagagatgagacaaacatgc

SEQ ID NO: 3041439 - DNA, 15 bp, Homo sapiens
aaagagcaagtctgg

SEQ ID NO: 3041440 - DNA, 23 bp, Homo sapiens
aaagagccttctgggagttagtg

SEQ ID NO: 3041441 - DNA, 12 bp, Homo sapiens
aaagaggaaaga

SEQ ID NO: 3041442 - DNA, 13 bp, Homo sapiens
aaagagggacaag

SEQ ID NO: 3041443 - DNA, 15 bp, Homo sapiens
aaagaggtgaaaatg

SEQ ID NO: 3041444 - DNA, 16 bp, Homo sapiens
aaagaggtgaaaatga

SEQ ID NO: 3041445 - DNA, 21 bp, Homo sapiens
aaagaggtgaaaatgaagaag

SEQ ID NO: 3041446 - DNA, 15 bp, Homo sapiens
aaagagtctagattc

SEQ ID NO: 3041447 - DNA, 13 bp, Homo sapiens
aaagagtgaaata

SEQ ID NO: 3041448 - DNA, 16 bp, Homo sapiens
aaagagtgaaatattg

SEQ ID NO: 3041449 - DNA, 19 bp, Homo sapiens
aaagagtgaaatattgtaa

SEQ ID NO: 3041450 - DNA, 19 bp, Homo sapiens
aaagagttattcaaatgaa

SEQ ID NO: 3041451 - DNA, 20 bp, Homo sapiens
aaagagttattcaaatgaag

SEQ ID NO: 3041452 - DNA, 14 bp, Homo sapiens
aaagagtttgaaac

SEQ ID NO: 3041453 - DNA, 21 bp, Homo sapiens
aaagataaacctggagatatt

SEQ ID NO: 3041454 - DNA, 14 bp, Homo sapiens
aaagataaatatta

SEQ ID NO: 3041455 - DNA, 22 bp, Homo sapiens
aaagatagagattgtttttaga

SEQ ID NO: 3041456 - DNA, 19 bp, Homo sapiens
aaagatagagtcattgctg

SEQ ID NO: 3041457 - DNA, 18 bp, Homo sapiens
aaagatcatagttgcaaa

SEQ ID NO: 3041458 - DNA, 18 bp, Homo sapiens
aaagatctgtcctcagcc

SEQ ID NO: 3041459 - DNA, 20 bp, Homo sapiens
aaagatctgtcctcagcctt

SEQ ID NO: 3041460 - DNA, 13 bp, Homo sapiens
aaagatctgtttt

SEQ ID NO: 3041461 - DNA, 18 bp, Homo sapiens
aaagatgatcgctgtatt

SEQ ID NO: 3041462 - DNA, 18 bp, Homo sapiens
aaagatgcattttgtgta

SEQ ID NO: 3041463 - DNA, 19 bp, Homo sapiens
aaagatgcttttaacagag

SEQ ID NO: 3041464 - DNA, 14 bp, Homo sapiens
aaagatggataaac

SEQ ID NO: 3041465 - DNA, 15 bp, Homo sapiens
aaagatgggaggaga

SEQ ID NO: 3041466 - DNA, 23 bp, Homo sapiens
aaagatgtaatgtagttctttgt

SEQ ID NO: 3041467 - DNA, 20 bp, Homo sapiens
aaagattattacctttttaa

SEQ ID NO: 3041468 - DNA, 16 bp, Homo sapiens
aaagattatttaaatg

SEQ ID NO: 3041469 - DNA, 19 bp, Homo sapiens
aaagattcatttttaatca

SEQ ID NO: 3041470 - DNA, 12 bp, Homo sapiens
aaagattctata

SEQ ID NO: 3041471 - DNA, 20 bp, Homo sapiens
aaagattctatagttctaga

SEQ ID NO: 3041472 - DNA, 21 bp, Homo sapiens
aaagattctatagttctagac

SEQ ID NO: 3041473 - DNA, 14 bp, Homo sapiens
aaagatttcttgag

SEQ ID NO: 3041474 - DNA, 12 bp, Homo sapiens
aaagattttatt

SEQ ID NO: 3041475 - DNA, 21 bp, Homo sapiens
aaagattttattgtataaaaa

SEQ ID NO: 3041476 - DNA, 16 bp, Homo sapiens
aaagatttttaaaatg

SEQ ID NO: 3041477 - DNA, 14 bp, Homo sapiens
aaagcaaaaatgct

SEQ ID NO: 3041478 - DNA, 13 bp, Homo sapiens
aaagcaaaggcag

SEQ ID NO: 3041479 - DNA, 14 bp, Homo sapiens
aaagcaaggaaact

SEQ ID NO: 3041480 - DNA, 20 bp, Homo sapiens
aaagcaaggaaactatgtaa

SEQ ID NO: 3041481 - DNA, 21 bp, Homo sapiens
aaagcaataaaatttttttgg

SEQ ID NO: 3041482 - DNA, 12 bp, Homo sapiens
aaagcaatagaa

SEQ ID NO: 3041483 - DNA, 16 bp, Homo sapiens
aaagcaatagaaacaa

SEQ ID NO: 3041484 - DNA, 16 bp, Homo sapiens
aaagcacaaaatggat

SEQ ID NO: 3041485 - DNA, 20 bp, Homo sapiens
aaagcacaatttaaaacaat

SEQ ID NO: 3041486 - DNA, 15 bp, Homo sapiens
aaagcacagtttgaa

SEQ ID NO: 3041487 - DNA, 19 bp, Homo sapiens
aaagcacatgccagggaaa

SEQ ID NO: 3041488 - DNA, 13 bp, Homo sapiens
aaagcagaaggag

SEQ ID NO: 3041489 - DNA, 17 bp, Homo sapiens
aaagcagaattttaatg

SEQ ID NO: 3041490 - DNA, 16 bp, Homo sapiens
aaagcagattttccta

SEQ ID NO: 3041491 - DNA, 15 bp, Homo sapiens
aaagcagccacgagg

SEQ ID NO: 3041492 - DNA, 18 bp, Homo sapiens
aaagcagctcaaaggcac

SEQ ID NO: 3041493 - DNA, 18 bp, Homo sapiens
aaagcagctctcccctca

SEQ ID NO: 3041494 - DNA, 21 bp, Homo sapiens
aaagcaggcttgtgctttata

SEQ ID NO: 3041495 - DNA, 23 bp, Homo sapiens
aaagcatggccctgctgcccctc

SEQ ID NO: 3041496 - DNA, 18 bp, Homo sapiens
aaagcatgtctctgcttc

SEQ ID NO: 3041497 - DNA, 21 bp, Homo sapiens
aaagcatgtctctgcttccat

SEQ ID NO: 3041498 - DNA, 15 bp, Homo sapiens
aaagcattatttttt

SEQ ID NO: 3041499 - DNA, 11 bp, Homo sapiens
aaagccaagaa

SEQ ID NO: 3041500 - DNA, 12 bp, Homo sapiens
aaagccaagaat

SEQ ID NO: 3041501 - DNA, 14 bp, Homo sapiens
aaagccaagaattg

SEQ ID NO: 3041502 - DNA, 18 bp, Homo sapiens
aaagccacgttccttact

SEQ ID NO: 3041503 - DNA, 15 bp, Homo sapiens
aaagccactggaagg

SEQ ID NO: 3041504 - DNA, 19 bp, Homo sapiens
aaagccactggaaggagca

SEQ ID NO: 3041505 - DNA, 13 bp, Homo sapiens
aaagccagagtgg

SEQ ID NO: 3041506 - DNA, 12 bp, Homo sapiens
aaagcccacctg

SEQ ID NO: 3041507 - DNA, 14 bp, Homo sapiens
aaagccctgcctct

SEQ ID NO: 3041508 - DNA, 22 bp, Homo sapiens
aaagccctgtcgggctttgtgt

SEQ ID NO: 3041509 - DNA, 16 bp, Homo sapiens
aaagcctcatgtgtga

SEQ ID NO: 3041510 - DNA, 19 bp, Homo sapiens
aaagcctgtcccaggactc

SEQ ID NO: 3041511 - DNA, 13 bp, Homo sapiens
aaagcctgtctct

SEQ ID NO: 3041512 - DNA, 10 bp, Homo sapiens
aaagccttac

SEQ ID NO: 3041513 - DNA, 12 bp, Homo sapiens
aaagccttacag

SEQ ID NO: 3041514 - DNA, 14 bp, Homo sapiens
aaagcgaattttaa

SEQ ID NO: 3041515 - DNA, 19 bp, Homo sapiens
aaagcggacatcagctggt

SEQ ID NO: 3041516 - DNA, 14 bp, Homo sapiens
aaagcgtctttaag

SEQ ID NO: 3041517 - DNA, 20 bp, Homo sapiens
aaagcgtctttaagagactc

SEQ ID NO: 3041518 - DNA, 18 bp, Homo sapiens
aaagctaaagtatctgta

SEQ ID NO: 3041519 - DNA, 15 bp, Homo sapiens
aaagctaaagtttgg

SEQ ID NO: 3041520 - DNA, 14 bp, Homo sapiens
aaagctaagtatag

SEQ ID NO: 3041521 - DNA, 20 bp, Homo sapiens
aaagctagtgtacctcctct

SEQ ID NO: 3041522 - DNA, 18 bp, Homo sapiens
aaagctatttatgggccc

SEQ ID NO: 3041523 - DNA, 20 bp, Homo sapiens
aaagctctcaaatgtgacca

SEQ ID NO: 3041524 - DNA, 15 bp, Homo sapiens
aaagctgacattgcc

SEQ ID NO: 3041525 - DNA, 15 bp, Homo sapiens
aaagctgtgtctctg

SEQ ID NO: 3041526 - DNA, 16 bp, Homo sapiens
aaagctgtgtctctgt

SEQ ID NO: 3041527 - DNA, 17 bp, Homo sapiens
aaagctgtgtctctgta

SEQ ID NO: 3041528 - DNA, 19 bp, Homo sapiens
aaagctgtgtctctgtata

SEQ ID NO: 3041529 - DNA, 18 bp, Homo sapiens
aaagctgttattcttgtt

SEQ ID NO: 3041530 - DNA, 20 bp, Homo sapiens
aaagctgttattcttgttat

SEQ ID NO: 3041531 - DNA, 19 bp, Homo sapiens
aaagctgttctcattcctg

SEQ ID NO: 3041532 - DNA, 15 bp, Homo sapiens
aaagcttagcaggag

SEQ ID NO: 3041533 - DNA, 17 bp, Homo sapiens
aaagcttccatgattct

SEQ ID NO: 3041534 - DNA, 18 bp, Homo sapiens
aaagcttccatgattcta

SEQ ID NO: 3041535 - DNA, 20 bp, Homo sapiens
aaagcttccatgattctatt

SEQ ID NO: 3041536 - DNA, 23 bp, Homo sapiens
aaagcttcctagcttatctccct

SEQ ID NO: 3041537 - DNA, 22 bp, Homo sapiens
aaagcttgaaaagattctgaaa

SEQ ID NO: 3041538 - DNA, 13 bp, Homo sapiens
aaagcttgtaaat

SEQ ID NO: 3041539 - DNA, 14 bp, Homo sapiens
aaaggaaaaaaaga

SEQ ID NO: 3041540 - DNA, 15 bp, Homo sapiens
aaaggaaaaaaagac

SEQ ID NO: 3041541 - DNA, 16 bp, Homo sapiens
aaaggaaaaaaagact

SEQ ID NO: 3041542 - DNA, 14 bp, Homo sapiens
aaaggaaaaataat

SEQ ID NO: 3041543 - DNA, 18 bp, Homo sapiens
aaaggaaaatagtaatgt

SEQ ID NO: 3041544 - DNA, 18 bp, Homo sapiens
aaaggaacaaaaattaca

SEQ ID NO: 3041545 - DNA, 12 bp, Homo sapiens
aaaggaacattt

SEQ ID NO: 3041546 - DNA, 16 bp, Homo sapiens
aaaggaacatttaggg

SEQ ID NO: 3041547 - DNA, 19 bp, Homo sapiens
aaaggaagagctaataaat

SEQ ID NO: 3041548 - DNA, 12 bp, Homo sapiens
aaaggaagccaa

SEQ ID NO: 3041549 - DNA, 15 bp, Homo sapiens
aaaggaagccaaaga

SEQ ID NO: 3041550 - DNA, 23 bp, Homo sapiens
aaaggacagagccagcggctcca

SEQ ID NO: 3041551 - DNA, 19 bp, Homo sapiens
aaaggacagagtatgaaca

SEQ ID NO: 3041552 - DNA, 16 bp, Homo sapiens
aaaggacgtaaaattt

SEQ ID NO: 3041553 - DNA, 15 bp, Homo sapiens
aaaggactctggggt

SEQ ID NO: 3041554 - DNA, 18 bp, Homo sapiens
aaaggactggaaaaatga

SEQ ID NO: 3041555 - DNA, 23 bp, Homo sapiens
aaaggactggaaaaatgaactgt

SEQ ID NO: 3041556 - DNA, 20 bp, Homo sapiens
aaaggagggaaaagcagatg

SEQ ID NO: 3041557 - DNA, 18 bp, Homo sapiens
aaaggatctttgtggcca

SEQ ID NO: 3041558 - DNA, 14 bp, Homo sapiens
aaaggatgagggtt

SEQ ID NO: 3041559 - DNA, 16 bp, Homo sapiens
aaaggatgagggttca

SEQ ID NO: 3041560 - DNA, 19 bp, Homo sapiens
aaaggatgtaaacagtgcc

SEQ ID NO: 3041561 - DNA, 13 bp, Homo sapiens
aaaggatgtgatt

SEQ ID NO: 3041562 - DNA, 16 bp, Homo sapiens
aaaggattaggcaaaa

SEQ ID NO: 3041563 - DNA, 18 bp, Homo sapiens
aaaggattcatgtggaat

SEQ ID NO: 3041564 - DNA, 13 bp, Homo sapiens
aaaggcaaggtcc

SEQ ID NO: 3041565 - DNA, 17 bp, Homo sapiens
aaaggcacctataaaac

SEQ ID NO: 3041566 - DNA, 21 bp, Homo sapiens
aaaggcacctataaaacaggt

SEQ ID NO: 3041567 - DNA, 18 bp, Homo sapiens
aaaggccaaacctctgtt

SEQ ID NO: 3041568 - DNA, 12 bp, Homo sapiens
aaaggccagctg

SEQ ID NO: 3041569 - DNA, 14 bp, Homo sapiens
aaaggccagctggc

SEQ ID NO: 3041570 - DNA, 20 bp, Homo sapiens
aaaggccagctggcagcaga

SEQ ID NO: 3041571 - DNA, 20 bp, Homo sapiens
aaaggcctgtggggagccga

SEQ ID NO: 3041572 - DNA, 15 bp, Homo sapiens
aaaggctgtgctgcc

SEQ ID NO: 3041573 - DNA, 22 bp, Homo sapiens
aaaggctttggcaacagaaaac

SEQ ID NO: 3041574 - DNA, 13 bp, Homo sapiens
aaagggagggagg

SEQ ID NO: 3041575 - DNA, 19 bp, Homo sapiens
aaagggattacccaagcaa

SEQ ID NO: 3041576 - DNA, 18 bp, Homo sapiens
aaagggcacagcatctgt

SEQ ID NO: 3041577 - DNA, 15 bp, Homo sapiens
aaagggcctggccag

SEQ ID NO: 3041578 - DNA, 16 bp, Homo sapiens
aaagggtgtttttctg

SEQ ID NO: 3041579 - DNA, 16 bp, Homo sapiens
aaagggttttaatgta

SEQ ID NO: 3041580 - DNA, 15 bp, Homo sapiens
aaaggtaaaacaaaa

SEQ ID NO: 3041581 - DNA, 13 bp, Homo sapiens
aaaggtataaata

SEQ ID NO: 3041582 - DNA, 19 bp, Homo sapiens
aaaggtccacaggtctaga

SEQ ID NO: 3041583 - DNA, 19 bp, Homo sapiens
aaaggtctaagcaagtgag

SEQ ID NO: 3041584 - DNA, 19 bp, Homo sapiens
aaaggtggattttgtttaa

SEQ ID NO: 3041585 - DNA, 13 bp, Homo sapiens
aaaggtggccaca

SEQ ID NO: 3041586 - DNA, 21 bp, Homo sapiens
aaaggtggccacaaattcttt

SEQ ID NO: 3041587 - DNA, 14 bp, Homo sapiens
aaaggtgttgtccc

SEQ ID NO: 3041588 - DNA, 13 bp, Homo sapiens
aaaggttctaggt

SEQ ID NO: 3041589 - DNA, 17 bp, Homo sapiens
aaaggttgactcaagtt

SEQ ID NO: 3041590 - DNA, 15 bp, Homo sapiens
aaaggtttacagaat

SEQ ID NO: 3041591 - DNA, 17 bp, Homo sapiens
aaagtaaatctcttttt

SEQ ID NO: 3041592 - DNA, 18 bp, Homo sapiens
aaagtaagcatttccagc

SEQ ID NO: 3041593 - DNA, 13 bp, Homo sapiens
aaagtacttgact

SEQ ID NO: 3041594 - DNA, 18 bp, Homo sapiens
aaagtagaagcatgtttg

SEQ ID NO: 3041595 - DNA, 15 bp, Homo sapiens
aaagtagagaacagt

SEQ ID NO: 3041596 - DNA, 18 bp, Homo sapiens
aaagtagcaccaaataaa

SEQ ID NO: 3041597 - DNA, 21 bp, Homo sapiens
aaagtagtaaaaattaaaaaa

SEQ ID NO: 3041598 - DNA, 20 bp, Homo sapiens
aaagtataaattcgctgtga

SEQ ID NO: 3041599 - DNA, 19 bp, Homo sapiens
aaagtatgttgtatatggt

SEQ ID NO: 3041600 - DNA, 15 bp, Homo sapiens
aaagtattattttcc

SEQ ID NO: 3041601 - DNA, 12 bp, Homo sapiens
aaagtattcttc

SEQ ID NO: 3041602 - DNA, 16 bp, Homo sapiens
aaagtattgtaaatta

SEQ ID NO: 3041603 - DNA, 12 bp, Homo sapiens
aaagtattttcc

SEQ ID NO: 3041604 - DNA, 20 bp, Homo sapiens
aaagtcacaatgttctttat

SEQ ID NO: 3041605 - DNA, 14 bp, Homo sapiens
aaagtcacttctcc

SEQ ID NO: 3041606 - DNA, 21 bp, Homo sapiens
aaagtcagctacaaaagttaa

SEQ ID NO: 3041607 - DNA, 18 bp, Homo sapiens
aaagtcagtatcatatta

SEQ ID NO: 3041608 - DNA, 19 bp, Homo sapiens
aaagtccaattttaattta

SEQ ID NO: 3041609 - DNA, 15 bp, Homo sapiens
aaagtcccttcctgc

SEQ ID NO: 3041610 - DNA, 21 bp, Homo sapiens
aaagtcccttcctgcttcctg

SEQ ID NO: 3041611 - DNA, 14 bp, Homo sapiens
aaagtccttttctt

SEQ ID NO: 3041612 - DNA, 22 bp, Homo sapiens
aaagtcctttttttccatcttt

SEQ ID NO: 3041613 - DNA, 22 bp, Homo sapiens
aaagtctctcattctaggcctc

SEQ ID NO: 3041614 - DNA, 14 bp, Homo sapiens
aaagtgacagatgt

SEQ ID NO: 3041615 - DNA, 16 bp, Homo sapiens
aaagtgatcagcaatg

SEQ ID NO: 3041616 - DNA, 20 bp, Homo sapiens
aaagtgatcagcaatgaaga

SEQ ID NO: 3041617 - DNA, 14 bp, Homo sapiens
aaagtgccaaagaa

SEQ ID NO: 3041618 - DNA, 15 bp, Homo sapiens
aaagtgccaaagaaa

SEQ ID NO: 3041619 - DNA, 16 bp, Homo sapiens
aaagtgctaaggttct

SEQ ID NO: 3041620 - DNA, 21 bp, Homo sapiens
aaagtgctaaggttctaaggc

SEQ ID NO: 3041621 - DNA, 13 bp, Homo sapiens
aaagtgcttgtgt

SEQ ID NO: 3041622 - DNA, 15 bp, Homo sapiens
aaagtgcttgtgtaa

SEQ ID NO: 3041623 - DNA, 21 bp, Homo sapiens
aaagtgctttccagaataata

SEQ ID NO: 3041624 - DNA, 16 bp, Homo sapiens
aaagtggaattaaagg

SEQ ID NO: 3041625 - DNA, 23 bp, Homo sapiens
aaagtggtaggtactttttgtga

SEQ ID NO: 3041626 - DNA, 21 bp, Homo sapiens
aaagtggtgctcagttgtaga

SEQ ID NO: 3041627 - DNA, 15 bp, Homo sapiens
aaagtgtaaagcatt

SEQ ID NO: 3041628 - DNA, 18 bp, Homo sapiens
aaagtgtaaagcattcca

SEQ ID NO: 3041629 - DNA, 22 bp, Homo sapiens
aaagtgtaaagcattccaacaa

SEQ ID NO: 3041630 - DNA, 20 bp, Homo sapiens
aaagtgtacctgtaaatgtc

SEQ ID NO: 3041631 - DNA, 14 bp, Homo sapiens
aaagtgtcatcaat

SEQ ID NO: 3041632 - DNA, 18 bp, Homo sapiens
aaagtgtcatcaatttgt

SEQ ID NO: 3041633 - DNA, 20 bp, Homo sapiens
aaagtgtcttttgacatttt

SEQ ID NO: 3041634 - DNA, 17 bp, Homo sapiens
aaagtgttttgtaccag

SEQ ID NO: 3041635 - DNA, 16 bp, Homo sapiens
aaagttaaacattgaa

SEQ ID NO: 3041636 - DNA, 22 bp, Homo sapiens
aaagttaaacattgaagtaatg

SEQ ID NO: 3041637 - DNA, 22 bp, Homo sapiens
aaagttaatgcttaagagggaa

SEQ ID NO: 3041638 - DNA, 23 bp, Homo sapiens
aaagttaggttataagaaacaga

SEQ ID NO: 3041639 - DNA, 13 bp, Homo sapiens
aaagttatatttc

SEQ ID NO: 3041640 - DNA, 13 bp, Homo sapiens
aaagttatttatg

SEQ ID NO: 3041641 - DNA, 22 bp, Homo sapiens
aaagttccaagagtctaaagat

SEQ ID NO: 3041642 - DNA, 13 bp, Homo sapiens
aaagttccagttt

SEQ ID NO: 3041643 - DNA, 16 bp, Homo sapiens
aaagttccagttttgt

SEQ ID NO: 3041644 - DNA, 15 bp, Homo sapiens
aaagttcctctccct

SEQ ID NO: 3041645 - DNA, 16 bp, Homo sapiens
aaagttcctctccctt

SEQ ID NO: 3041646 - DNA, 22 bp, Homo sapiens
aaagttcctctcccttcccttc

SEQ ID NO: 3041647 - DNA, 11 bp, Homo sapiens
aaagttctaag

SEQ ID NO: 3041648 - DNA, 12 bp, Homo sapiens
aaagttctaaga

SEQ ID NO: 3041649 - DNA, 15 bp, Homo sapiens
aaagttctaagattc

SEQ ID NO: 3041650 - DNA, 16 bp, Homo sapiens
aaagttctaagattct

SEQ ID NO: 3041651 - DNA, 21 bp, Homo sapiens
aaagttctaataatttctaat

SEQ ID NO: 3041652 - DNA, 15 bp, Homo sapiens
aaagttctcaatgta

SEQ ID NO: 3041653 - DNA, 14 bp, Homo sapiens
aaagttctgtactc

SEQ ID NO: 3041654 - DNA, 12 bp, Homo sapiens
aaagttgaaatt

SEQ ID NO: 3041655 - DNA, 19 bp, Homo sapiens
aaagttgacacctgagaaa

SEQ ID NO: 3041656 - DNA, 13 bp, Homo sapiens
aaagttgtacatg

SEQ ID NO: 3041657 - DNA, 17 bp, Homo sapiens
aaagttgtacatgaaat

SEQ ID NO: 3041658 - DNA, 17 bp, Homo sapiens
aaagttgttcaactatt

SEQ ID NO: 3041659 - DNA, 18 bp, Homo sapiens
aaagttgttcaactattt

SEQ ID NO: 3041660 - DNA, 19 bp, Homo sapiens
aaagttgttcaactatttt

SEQ ID NO: 3041661 - DNA, 20 bp, Homo sapiens
aaagtttaaaacagaagcct

SEQ ID NO: 3041662 - DNA, 13 bp, Homo sapiens
aaagtttgccaga

SEQ ID NO: 3041663 - DNA, 22 bp, Homo sapiens
aaagtttgccctggatgtcata

SEQ ID NO: 3041664 - DNA, 16 bp, Homo sapiens
aaagtttgcttagaaa

SEQ ID NO: 3041665 - DNA, 17 bp, Homo sapiens
aaagtttgtaaaaatat

SEQ ID NO: 3041666 - DNA, 13 bp, Homo sapiens
aaagttttattat

SEQ ID NO: 3041667 - DNA, 15 bp, Homo sapiens
aaagttttcccttga

SEQ ID NO: 3041668 - DNA, 14 bp, Homo sapiens
aaataaaaagattc

SEQ ID NO: 3041669 - DNA, 15 bp, Homo sapiens
aaataaaacaaaggg

SEQ ID NO: 3041670 - DNA, 19 bp, Homo sapiens
aaataaaactaaggaaccc

SEQ ID NO: 3041671 - DNA, 21 bp, Homo sapiens
aaataaaactaaggaaccctg

SEQ ID NO: 3041672 - DNA, 18 bp, Homo sapiens
aaataaaagatagcaata

SEQ ID NO: 3041673 - DNA, 14 bp, Homo sapiens
aaataaaataaaat

SEQ ID NO: 3041674 - DNA, 15 bp, Homo sapiens
aaataaaatttgttg

SEQ ID NO: 3041675 - DNA, 21 bp, Homo sapiens
aaataaaccttgtttctttct

SEQ ID NO: 3041676 - DNA, 14 bp, Homo sapiens
aaataaactgttgc

SEQ ID NO: 3041677 - DNA, 11 bp, Homo sapiens
aaataaagacc

SEQ ID NO: 3041678 - DNA, 12 bp, Homo sapiens
aaataaagctgt

SEQ ID NO: 3041679 - DNA, 14 bp, Homo sapiens
aaataaataaaagc

SEQ ID NO: 3041680 - DNA, 16 bp, Homo sapiens
aaataaataaaagcct

SEQ ID NO: 3041681 - DNA, 14 bp, Homo sapiens
aaataaatgtttcc

SEQ ID NO: 3041682 - DNA, 16 bp, Homo sapiens
aaataaattacacttt

SEQ ID NO: 3041683 - DNA, 13 bp, Homo sapiens
aaataaattctct

SEQ ID NO: 3041684 - DNA, 16 bp, Homo sapiens
aaataaattctctcct

SEQ ID NO: 3041685 - DNA, 14 bp, Homo sapiens
aaataaatttatat

SEQ ID NO: 3041686 - DNA, 13 bp, Homo sapiens
aaataaattttgt

SEQ ID NO: 3041687 - DNA, 12 bp, Homo sapiens
aaataacaatga

SEQ ID NO: 3041688 - DNA, 19 bp, Homo sapiens
aaataaccaatcctggaca

SEQ ID NO: 3041689 - DNA, 21 bp, Homo sapiens
aaataactatcaggcagaaga

SEQ ID NO: 3041690 - DNA, 15 bp, Homo sapiens
aaataactgaaccaa

SEQ ID NO: 3041691 - DNA, 18 bp, Homo sapiens
aaataactgaaccaaatt

SEQ ID NO: 3041692 - DNA, 21 bp, Homo sapiens
aaataactgaaccaaattgca

SEQ ID NO: 3041693 - DNA, 22 bp, Homo sapiens
aaataactgatctcaagtatat

SEQ ID NO: 3041694 - DNA, 20 bp, Homo sapiens
aaataagaacgaggatttta

SEQ ID NO: 3041695 - DNA, 14 bp, Homo sapiens
aaataagattctaa

SEQ ID NO: 3041696 - DNA, 15 bp, Homo sapiens
aaataagattctaac

SEQ ID NO: 3041697 - DNA, 16 bp, Homo sapiens
aaataagattctaacg

SEQ ID NO: 3041698 - DNA, 15 bp, Homo sapiens
aaataagttaaaggc

SEQ ID NO: 3041699 - DNA, 16 bp, Homo sapiens
aaataataacatatat

SEQ ID NO: 3041700 - DNA, 13 bp, Homo sapiens
aaataataatttt

SEQ ID NO: 3041701 - DNA, 17 bp, Homo sapiens
aaataatactgctgaga

SEQ ID NO: 3041702 - DNA, 17 bp, Homo sapiens
aaataatatacttttac

SEQ ID NO: 3041703 - DNA, 14 bp, Homo sapiens
aaataatcaagatt

SEQ ID NO: 3041704 - DNA, 15 bp, Homo sapiens
aaataatcaagattt

SEQ ID NO: 3041705 - DNA, 15 bp, Homo sapiens
aaataatcggcccac

SEQ ID NO: 3041706 - DNA, 23 bp, Homo sapiens
aaataatgatcttggaatatttg

SEQ ID NO: 3041707 - DNA, 12 bp, Homo sapiens
aaataatgcaaa

SEQ ID NO: 3041708 - DNA, 13 bp, Homo sapiens
aaataatttaagt

SEQ ID NO: 3041709 - DNA, 19 bp, Homo sapiens
aaataatttgaactttgga

SEQ ID NO: 3041710 - DNA, 17 bp, Homo sapiens
aaataattttaaaaatg

SEQ ID NO: 3041711 - DNA, 14 bp, Homo sapiens
aaatacaaatctgt

SEQ ID NO: 3041712 - DNA, 18 bp, Homo sapiens
aaatacacatagcatgta

SEQ ID NO: 3041713 - DNA, 18 bp, Homo sapiens
aaatacacatttcacatt

SEQ ID NO: 3041714 - DNA, 19 bp, Homo sapiens
aaatacatcctttttctgc

SEQ ID NO: 3041715 - DNA, 15 bp, Homo sapiens
aaatacctttgtagt

SEQ ID NO: 3041716 - DNA, 21 bp, Homo sapiens
aaatacctttgtagttactca

SEQ ID NO: 3041717 - DNA, 22 bp, Homo sapiens
aaatacctttgtagttactcaa

SEQ ID NO: 3041718 - DNA, 23 bp, Homo sapiens
aaatacctttgtagttactcaag

SEQ ID NO: 3041719 - DNA, 21 bp, Homo sapiens
aaatactacctataggaaagt

SEQ ID NO: 3041720 - DNA, 17 bp, Homo sapiens
aaatactcatgtgtatg

SEQ ID NO: 3041721 - DNA, 21 bp, Homo sapiens
aaatactcatgtgtatgggca

SEQ ID NO: 3041722 - DNA, 19 bp, Homo sapiens
aaatactgacaatgtattt

SEQ ID NO: 3041723 - DNA, 13 bp, Homo sapiens
aaatactgccaga

SEQ ID NO: 3041724 - DNA, 13 bp, Homo sapiens
aaatactgttggt

SEQ ID NO: 3041725 - DNA, 15 bp, Homo sapiens
aaatacttttcctta

SEQ ID NO: 3041726 - DNA, 18 bp, Homo sapiens
aaatactttttctaatga

SEQ ID NO: 3041727 - DNA, 17 bp, Homo sapiens
aaatagaaaaagtgatg

SEQ ID NO: 3041728 - DNA, 12 bp, Homo sapiens
aaatagaaacat

SEQ ID NO: 3041729 - DNA, 20 bp, Homo sapiens
aaatagacagcctttctgct

SEQ ID NO: 3041730 - DNA, 11 bp, Homo sapiens
aaatagagcaa

SEQ ID NO: 3041731 - DNA, 13 bp, Homo sapiens
aaatagagcaaga

SEQ ID NO: 3041732 - DNA, 15 bp, Homo sapiens
aaatagagcttttaa

SEQ ID NO: 3041733 - DNA, 19 bp, Homo sapiens
aaatagaggctttgagcaa

SEQ ID NO: 3041734 - DNA, 13 bp, Homo sapiens
aaatagatacttt

SEQ ID NO: 3041735 - DNA, 17 bp, Homo sapiens
aaatagatacttttgat

SEQ ID NO: 3041736 - DNA, 18 bp, Homo sapiens
aaatagatgttttaactt

SEQ ID NO: 3041737 - DNA, 21 bp, Homo sapiens
aaatagccgggcatggtggcg

SEQ ID NO: 3041738 - DNA, 13 bp, Homo sapiens
aaataggaaacaa

SEQ ID NO: 3041739 - DNA, 16 bp, Homo sapiens
aaataggaaagacttt

SEQ ID NO: 3041740 - DNA, 17 bp, Homo sapiens
aaataggattgcttcaa

SEQ ID NO: 3041741 - DNA, 14 bp, Homo sapiens
aaataggattttta

SEQ ID NO: 3041742 - DNA, 16 bp, Homo sapiens
aaataggatttttaga

SEQ ID NO: 3041743 - DNA, 22 bp, Homo sapiens
aaatagggtccttgaaacagaa

SEQ ID NO: 3041744 - DNA, 14 bp, Homo sapiens
aaatagttaatata

SEQ ID NO: 3041745 - DNA, 13 bp, Homo sapiens
aaatataaacaaa

SEQ ID NO: 3041746 - DNA, 17 bp, Homo sapiens
aaatataaacacattaa

SEQ ID NO: 3041747 - DNA, 19 bp, Homo sapiens
aaatataaatctgatcacc

SEQ ID NO: 3041748 - DNA, 12 bp, Homo sapiens
aaatatactgta

SEQ ID NO: 3041749 - DNA, 17 bp, Homo sapiens
aaatatactgtaaagaa

SEQ ID NO: 3041750 - DNA, 19 bp, Homo sapiens
aaatatactgtaaagaaag

SEQ ID NO: 3041751 - DNA, 14 bp, Homo sapiens
aaatatacttaaat

SEQ ID NO: 3041752 - DNA, 15 bp, Homo sapiens
aaatatagtcgctga

SEQ ID NO: 3041753 - DNA, 23 bp, Homo sapiens
aaatatagttgtctttctttgct

SEQ ID NO: 3041754 - DNA, 14 bp, Homo sapiens
aaatatatgtattt

SEQ ID NO: 3041755 - DNA, 19 bp, Homo sapiens
aaatatcctttcatcaatg

SEQ ID NO: 3041756 - DNA, 14 bp, Homo sapiens
aaatatgcctctcc

SEQ ID NO: 3041757 - DNA, 17 bp, Homo sapiens
aaatattaaaaaaatgc

SEQ ID NO: 3041758 - DNA, 18 bp, Homo sapiens
aaatattaccctgtaata

SEQ ID NO: 3041759 - DNA, 21 bp, Homo sapiens
aaatattactgatcttacctt

SEQ ID NO: 3041760 - DNA, 13 bp, Homo sapiens
aaatattagatgt

SEQ ID NO: 3041761 - DNA, 21 bp, Homo sapiens
aaatattagatgtgatttaat

SEQ ID NO: 3041762 - DNA, 16 bp, Homo sapiens
aaatattatgagatgc

SEQ ID NO: 3041763 - DNA, 14 bp, Homo sapiens
aaatattctgtaca

SEQ ID NO: 3041764 - DNA, 15 bp, Homo sapiens
aaatattgctgtata

SEQ ID NO: 3041765 - DNA, 14 bp, Homo sapiens
aaatattgtaaatg

SEQ ID NO: 3041766 - DNA, 17 bp, Homo sapiens
aaatattgtcatgttta

SEQ ID NO: 3041767 - DNA, 12 bp, Homo sapiens
aaatattgttaa

SEQ ID NO: 3041768 - DNA, 13 bp, Homo sapiens
aaatatttctgag

SEQ ID NO: 3041769 - DNA, 13 bp, Homo sapiens
aaatattttcaag

SEQ ID NO: 3041770 - DNA, 14 bp, Homo sapiens
aaatattttgaata

SEQ ID NO: 3041771 - DNA, 22 bp, Homo sapiens
aaatattttttatatatacagt

SEQ ID NO: 3041772 - DNA, 14 bp, Homo sapiens
aaatcaaaaacttt

SEQ ID NO: 3041773 - DNA, 15 bp, Homo sapiens
aaatcaaacaacctt

SEQ ID NO: 3041774 - DNA, 18 bp, Homo sapiens
aaatcaaacaaccttcag

SEQ ID NO: 3041775 - DNA, 20 bp, Homo sapiens
aaatcaaactgtagttgttt

SEQ ID NO: 3041776 - DNA, 12 bp, Homo sapiens
aaatcaactttt

SEQ ID NO: 3041777 - DNA, 21 bp, Homo sapiens
aaatcaactttttattgcctt

SEQ ID NO: 3041778 - DNA, 17 bp, Homo sapiens
aaatcaagcaagcctct

SEQ ID NO: 3041779 - DNA, 21 bp, Homo sapiens
aaatcaagcaggttagagaaa

SEQ ID NO: 3041780 - DNA, 13 bp, Homo sapiens
aaatcaataagaa

SEQ ID NO: 3041781 - DNA, 19 bp, Homo sapiens
aaatcaattttttaaacca

SEQ ID NO: 3041782 - DNA, 18 bp, Homo sapiens
aaatcacatccttatcct

SEQ ID NO: 3041783 - DNA, 15 bp, Homo sapiens
aaatcactctgcaat

SEQ ID NO: 3041784 - DNA, 20 bp, Homo sapiens
aaatcagaagtgcaaaggtg

SEQ ID NO: 3041785 - DNA, 17 bp, Homo sapiens
aaatcagaataaattaa

SEQ ID NO: 3041786 - DNA, 17 bp, Homo sapiens
aaatcatggaatggtta

SEQ ID NO: 3041787 - DNA, 17 bp, Homo sapiens
aaatcatgttttttctg

SEQ ID NO: 3041788 - DNA, 13 bp, Homo sapiens
aaatccaaactgc

SEQ ID NO: 3041789 - DNA, 17 bp, Homo sapiens
aaatccaaactgctgtc

SEQ ID NO: 3041790 - DNA, 22 bp, Homo sapiens
aaatccctttcatgtctttcca

SEQ ID NO: 3041791 - DNA, 15 bp, Homo sapiens
aaatccgaacctcct

SEQ ID NO: 3041792 - DNA, 18 bp, Homo sapiens
aaatccgccagtgtttct

SEQ ID NO: 3041793 - DNA, 21 bp, Homo sapiens
aaatcctggaagattttggta

SEQ ID NO: 3041794 - DNA, 15 bp, Homo sapiens
aaatccttcccaagt

SEQ ID NO: 3041795 - DNA, 17 bp, Homo sapiens
aaatcctttctgccccc

SEQ ID NO: 3041796 - DNA, 14 bp, Homo sapiens
aaatcgccataggc

SEQ ID NO: 3041797 - DNA, 15 bp, Homo sapiens
aaatcgccataggcc

SEQ ID NO: 3041798 - DNA, 18 bp, Homo sapiens
aaatcgccataggccaag

SEQ ID NO: 3041799 - DNA, 16 bp, Homo sapiens
aaatcgccttatgaga

SEQ ID NO: 3041800 - DNA, 15 bp, Homo sapiens
aaatcgggaaggatg

SEQ ID NO: 3041801 - DNA, 20 bp, Homo sapiens
aaatcgggaaggatgggaaa

SEQ ID NO: 3041802 - DNA, 20 bp, Homo sapiens
aaatctaaatagatactttt

SEQ ID NO: 3041803 - DNA, 13 bp, Homo sapiens
aaatctagagttt

SEQ ID NO: 3041804 - DNA, 22 bp, Homo sapiens
aaatctagtatttcatgctggg

SEQ ID NO: 3041805 - DNA, 15 bp, Homo sapiens
aaatctcttaaactc

SEQ ID NO: 3041806 - DNA, 16 bp, Homo sapiens
aaatctcttaaactct

SEQ ID NO: 3041807 - DNA, 17 bp, Homo sapiens
aaatctcttaaactctc

SEQ ID NO: 3041808 - DNA, 17 bp, Homo sapiens
aaatctcttctttgctg

SEQ ID NO: 3041809 - DNA, 14 bp, Homo sapiens
aaatctcttgatta

SEQ ID NO: 3041810 - DNA, 13 bp, Homo sapiens
aaatctggaatca

SEQ ID NO: 3041811 - DNA, 21 bp, Homo sapiens
aaatctggcttctggccagga

SEQ ID NO: 3041812 - DNA, 19 bp, Homo sapiens
aaatctgggtatctttcca

SEQ ID NO: 3041813 - DNA, 14 bp, Homo sapiens
aaatctgtaaaaaa

SEQ ID NO: 3041814 - DNA, 13 bp, Homo sapiens
aaatctgtataaa

SEQ ID NO: 3041815 - DNA, 20 bp, Homo sapiens
aaatctgtcaagagtagtta

SEQ ID NO: 3041816 - DNA, 11 bp, Homo sapiens
aaatctgtcta

SEQ ID NO: 3041817 - DNA, 22 bp, Homo sapiens
aaatctgtctagaatcctgctt

SEQ ID NO: 3041818 - DNA, 15 bp, Homo sapiens
aaatctgttctaaca

SEQ ID NO: 3041819 - DNA, 18 bp, Homo sapiens
aaatcttacaaaatcctg

SEQ ID NO: 3041820 - DNA, 23 bp, Homo sapiens
aaatcttacaaaatcctggaaga

SEQ ID NO: 3041821 - DNA, 16 bp, Homo sapiens
aaatcttatagttcta

SEQ ID NO: 3041822 - DNA, 17 bp, Homo sapiens
aaatcttatagttctag

SEQ ID NO: 3041823 - DNA, 15 bp, Homo sapiens
aaatcttcagctggt

SEQ ID NO: 3041824 - DNA, 17 bp, Homo sapiens
aaatcttgtaagtattt

SEQ ID NO: 3041825 - DNA, 17 bp, Homo sapiens
aaatctttctgtaaaca

SEQ ID NO: 3041826 - DNA, 20 bp, Homo sapiens
aaatctttctgtaaacagaa

SEQ ID NO: 3041827 - DNA, 22 bp, Homo sapiens
aaatctttctttggggaaaaat

SEQ ID NO: 3041828 - DNA, 11 bp, Homo sapiens
aaatgaaaaaa

SEQ ID NO: 3041829 - DNA, 17 bp, Homo sapiens
aaatgaaaaagtcagct

SEQ ID NO: 3041830 - DNA, 12 bp, Homo sapiens
aaatgaaaagta

SEQ ID NO: 3041831 - DNA, 12 bp, Homo sapiens
aaatgaaagaaa

SEQ ID NO: 3041832 - DNA, 15 bp, Homo sapiens
aaatgaaagaaaatg

SEQ ID NO: 3041833 - DNA, 20 bp, Homo sapiens
aaatgaaagatgatttgcaa

SEQ ID NO: 3041834 - DNA, 14 bp, Homo sapiens
aaatgaactgattt

SEQ ID NO: 3041835 - DNA, 15 bp, Homo sapiens
aaatgaactgtatta

SEQ ID NO: 3041836 - DNA, 16 bp, Homo sapiens
aaatgaagaaggaagc

SEQ ID NO: 3041837 - DNA, 20 bp, Homo sapiens
aaatgaagtgcaaatttgat

SEQ ID NO: 3041838 - DNA, 15 bp, Homo sapiens
aaatgaatgttgtct

SEQ ID NO: 3041839 - DNA, 15 bp, Homo sapiens
aaatgacaaagtgtt

SEQ ID NO: 3041840 - DNA, 19 bp, Homo sapiens
aaatgacaaagtgttgaaa

SEQ ID NO: 3041841 - DNA, 19 bp, Homo sapiens
aaatgagatttttgttttc

SEQ ID NO: 3041842 - DNA, 13 bp, Homo sapiens
aaatgagccatga

SEQ ID NO: 3041843 - DNA, 18 bp, Homo sapiens
aaatgaggcagttaaata

SEQ ID NO: 3041844 - DNA, 16 bp, Homo sapiens
aaatgagtcactgagc

SEQ ID NO: 3041845 - DNA, 21 bp, Homo sapiens
aaatgagtcaggcaattgatt

SEQ ID NO: 3041846 - DNA, 19 bp, Homo sapiens
aaatgatgatgtggaagaa

SEQ ID NO: 3041847 - DNA, 14 bp, Homo sapiens
aaatgcaagatttt

SEQ ID NO: 3041848 - DNA, 13 bp, Homo sapiens
aaatgcacaattt

SEQ ID NO: 3041849 - DNA, 14 bp, Homo sapiens
aaatgcaccaaata

SEQ ID NO: 3041850 - DNA, 18 bp, Homo sapiens
aaatgcagtatatttctt

SEQ ID NO: 3041851 - DNA, 23 bp, Homo sapiens
aaatgcatccattcctcagggac

SEQ ID NO: 3041852 - DNA, 14 bp, Homo sapiens
aaatgcattcatgt

SEQ ID NO: 3041853 - DNA, 20 bp, Homo sapiens
aaatgcattctatcgttatt

SEQ ID NO: 3041854 - DNA, 22 bp, Homo sapiens
aaatgccaagtgcctgcttagt

SEQ ID NO: 3041855 - DNA, 17 bp, Homo sapiens
aaatgccataatacaaa

SEQ ID NO: 3041856 - DNA, 19 bp, Homo sapiens
aaatgccataatacaaaag

SEQ ID NO: 3041857 - DNA, 20 bp, Homo sapiens
aaatgccataatacaaaagg

SEQ ID NO: 3041858 - DNA, 21 bp, Homo sapiens
aaatgccatttatttattgat

SEQ ID NO: 3041859 - DNA, 16 bp, Homo sapiens
aaatgcccaaggatgc

SEQ ID NO: 3041860 - DNA, 19 bp, Homo sapiens
aaatgcccaaggatgcctt

SEQ ID NO: 3041861 - DNA, 15 bp, Homo sapiens
aaatgcccagttcac

SEQ ID NO: 3041862 - DNA, 21 bp, Homo sapiens
aaatgctaatattaaaagtca

SEQ ID NO: 3041863 - DNA, 23 bp, Homo sapiens
aaatgctaatattaaaagtcaca

SEQ ID NO: 3041864 - DNA, 20 bp, Homo sapiens
aaatgctattatactgttat

SEQ ID NO: 3041865 - DNA, 13 bp, Homo sapiens
aaatgctcttgtc

SEQ ID NO: 3041866 - DNA, 17 bp, Homo sapiens
aaatgctggagaaaaat

SEQ ID NO: 3041867 - DNA, 17 bp, Homo sapiens
aaatgcttctttctact

SEQ ID NO: 3041868 - DNA, 20 bp, Homo sapiens
aaatgctttttatttctgca

SEQ ID NO: 3041869 - DNA, 12 bp, Homo sapiens
aaatggaaaaaa

SEQ ID NO: 3041870 - DNA, 19 bp, Homo sapiens
aaatggaattactccaaaa

SEQ ID NO: 3041871 - DNA, 21 bp, Homo sapiens
aaatggattttagtcaaatat

SEQ ID NO: 3041872 - DNA, 23 bp, Homo sapiens
aaatggattttagtcaaatattt

SEQ ID NO: 3041873 - DNA, 14 bp, Homo sapiens
aaatggcgaacatg

SEQ ID NO: 3041874 - DNA, 16 bp, Homo sapiens
aaatggcgaacatgtg

SEQ ID NO: 3041875 - DNA, 21 bp, Homo sapiens
aaatggcgtctggaagtccaa

SEQ ID NO: 3041876 - DNA, 20 bp, Homo sapiens
aaatggctctgtgaaatcag

SEQ ID NO: 3041877 - DNA, 22 bp, Homo sapiens
aaatgggacttcttttcacatt

SEQ ID NO: 3041878 - DNA, 18 bp, Homo sapiens
aaatgggtcatgacaaga

SEQ ID NO: 3041879 - DNA, 23 bp, Homo sapiens
aaatggtcctatttttgtgaaga

SEQ ID NO: 3041880 - DNA, 17 bp, Homo sapiens
aaatggtggcttcagct

SEQ ID NO: 3041881 - DNA, 18 bp, Homo sapiens
aaatggtggcttcagctc

SEQ ID NO: 3041882 - DNA, 19 bp, Homo sapiens
aaatggtggcttcagctcc

SEQ ID NO: 3041883 - DNA, 17 bp, Homo sapiens
aaatggtttcctctgga

SEQ ID NO: 3041884 - DNA, 12 bp, Homo sapiens
aaatgtaaaaaa

SEQ ID NO: 3041885 - DNA, 18 bp, Homo sapiens
aaatgtaaaaaacaaaaa

SEQ ID NO: 3041886 - DNA, 22 bp, Homo sapiens
aaatgtaaaaaacaaaaacaaa

SEQ ID NO: 3041887 - DNA, 15 bp, Homo sapiens
aaatgtaaacatttt

SEQ ID NO: 3041888 - DNA, 18 bp, Homo sapiens
aaatgtaaactcttcacc

SEQ ID NO: 3041889 - DNA, 14 bp, Homo sapiens
aaatgtaagatcgt

SEQ ID NO: 3041890 - DNA, 20 bp, Homo sapiens
aaatgtaagattatagattc

SEQ ID NO: 3041891 - DNA, 20 bp, Homo sapiens
aaatgtacagacatatttaa

SEQ ID NO: 3041892 - DNA, 22 bp, Homo sapiens
aaatgtacttatattaagaaaa

SEQ ID NO: 3041893 - DNA, 21 bp, Homo sapiens
aaatgtaggcatcatgcatgt

SEQ ID NO: 3041894 - DNA, 13 bp, Homo sapiens
aaatgtattggca

SEQ ID NO: 3041895 - DNA, 21 bp, Homo sapiens
aaatgtattttgaaaacactt

SEQ ID NO: 3041896 - DNA, 22 bp, Homo sapiens
aaatgtattttgaaaacactta

SEQ ID NO: 3041897 - DNA, 18 bp, Homo sapiens
aaatgtcaagaaattctg

SEQ ID NO: 3041898 - DNA, 23 bp, Homo sapiens
aaatgtcaagaaattctgctgtt

SEQ ID NO: 3041899 - DNA, 21 bp, Homo sapiens
aaatgtcctgcaatttaggat

SEQ ID NO: 3041900 - DNA, 14 bp, Homo sapiens
aaatgtctattatt

SEQ ID NO: 3041901 - DNA, 23 bp, Homo sapiens
aaatgtcttgctgttgacatatt

SEQ ID NO: 3041902 - DNA, 12 bp, Homo sapiens
aaatgtcttgtg

SEQ ID NO: 3041903 - DNA, 13 bp, Homo sapiens
aaatgtcttgtgt

SEQ ID NO: 3041904 - DNA, 17 bp, Homo sapiens
aaatgtcttgtgtattt

SEQ ID NO: 3041905 - DNA, 20 bp, Homo sapiens
aaatgtcttttttttaatgt

SEQ ID NO: 3041906 - DNA, 22 bp, Homo sapiens
aaatgtgaagatgcattgtagt

SEQ ID NO: 3041907 - DNA, 15 bp, Homo sapiens
aaatgtgaattttta

SEQ ID NO: 3041908 - DNA, 13 bp, Homo sapiens
aaatgtgatgaat

SEQ ID NO: 3041909 - DNA, 21 bp, Homo sapiens
aaatgtgatgaatactgtatt

SEQ ID NO: 3041910 - DNA, 22 bp, Homo sapiens
aaatgtgatgttctaaggctct

SEQ ID NO: 3041911 - DNA, 15 bp, Homo sapiens
aaatgtggtcctatt

SEQ ID NO: 3041912 - DNA, 22 bp, Homo sapiens
aaatgtggtctgccaatctgta

SEQ ID NO: 3041913 - DNA, 23 bp, Homo sapiens
aaatgtggtctgccaatctgtac

SEQ ID NO: 3041914 - DNA, 22 bp, Homo sapiens
aaatgtggttttcctgaaatca

SEQ ID NO: 3041915 - DNA, 12 bp, Homo sapiens
aaatgtgtacat

SEQ ID NO: 3041916 - DNA, 13 bp, Homo sapiens
aaatgtgtatttt

SEQ ID NO: 3041917 - DNA, 20 bp, Homo sapiens
aaatgtgtctgcaacatgga

SEQ ID NO: 3041918 - DNA, 14 bp, Homo sapiens
aaatgtgtgtcacc

SEQ ID NO: 3041919 - DNA, 22 bp, Homo sapiens
aaatgtgttttgtttattaaat

SEQ ID NO: 3041920 - DNA, 16 bp, Homo sapiens
aaatgttaaaccctta

SEQ ID NO: 3041921 - DNA, 15 bp, Homo sapiens
aaatgttagtttctt

SEQ ID NO: 3041922 - DNA, 16 bp, Homo sapiens
aaatgttagtttcttg

SEQ ID NO: 3041923 - DNA, 17 bp, Homo sapiens
aaatgttagtttcttgg

SEQ ID NO: 3041924 - DNA, 17 bp, Homo sapiens
aaatgttatcttctcaa

SEQ ID NO: 3041925 - DNA, 18 bp, Homo sapiens
aaatgttatcttctcaag

SEQ ID NO: 3041926 - DNA, 23 bp, Homo sapiens
aaatgttatcttctcaagttcta

SEQ ID NO: 3041927 - DNA, 16 bp, Homo sapiens
aaatgttcacttttga

SEQ ID NO: 3041928 - DNA, 20 bp, Homo sapiens
aaatgttgacatacctttta

SEQ ID NO: 3041929 - DNA, 22 bp, Homo sapiens
aaatgttgacataccttttatt

SEQ ID NO: 3041930 - DNA, 19 bp, Homo sapiens
aaatgttgagaatcccaaa

SEQ ID NO: 3041931 - DNA, 18 bp, Homo sapiens
aaatgttgctttaacctg

SEQ ID NO: 3041932 - DNA, 13 bp, Homo sapiens
aaatgttggtgca

SEQ ID NO: 3041933 - DNA, 17 bp, Homo sapiens
aaatgtttaaacatttt

SEQ ID NO: 3041934 - DNA, 19 bp, Homo sapiens
aaatgtttactgtaaattt

SEQ ID NO: 3041935 - DNA, 16 bp, Homo sapiens
aaatgtttcaaatgca

SEQ ID NO: 3041936 - DNA, 15 bp, Homo sapiens
aaatgtttctgtgtc

SEQ ID NO: 3041937 - DNA, 19 bp, Homo sapiens
aaattaaaaaaaaaaaact

SEQ ID NO: 3041938 - DNA, 21 bp, Homo sapiens
aaattaaaaaaaaaaaacttt

SEQ ID NO: 3041939 - DNA, 18 bp, Homo sapiens
aaattaaacgtaaatgtt

SEQ ID NO: 3041940 - DNA, 15 bp, Homo sapiens
aacaatgacatttat

SEQ ID NO: 3041941 - DNA, 12 bp, Homo sapiens
aacaattagagg

SEQ ID NO: 3041942 - DNA, 17 bp, Homo sapiens
aacaattggttgtatat

SEQ ID NO: 3041943 - DNA, 13 bp, Homo sapiens
aacaatttaaaaa

SEQ ID NO: 3041944 - DNA, 14 bp, Homo sapiens
aacaatttaaaaat

SEQ ID NO: 3041945 - DNA, 19 bp, Homo sapiens
aacaatttaaaaatgagtg

SEQ ID NO: 3041946 - DNA, 12 bp, Homo sapiens
aacaattttctt

SEQ ID NO: 3041947 - DNA, 13 bp, Homo sapiens
aacacaaactgta

SEQ ID NO: 3041948 - DNA, 16 bp, Homo sapiens
aacacaaactgtaaat

SEQ ID NO: 3041949 - DNA, 17 bp, Homo sapiens
aacacaaggtcatggcc

SEQ ID NO: 3041950 - DNA, 21 bp, Homo sapiens
aacacaaggtcatggccacac

SEQ ID NO: 3041951 - DNA, 13 bp, Homo sapiens
aacacaataccta

SEQ ID NO: 3041952 - DNA, 11 bp, Homo sapiens
aacacacaaaa

SEQ ID NO: 3041953 - DNA, 13 bp, Homo sapiens
aacacacaaaaag

SEQ ID NO: 3041954 - DNA, 17 bp, Homo sapiens
aacacacagagctcacc

SEQ ID NO: 3041955 - DNA, 14 bp, Homo sapiens
aacacagcctgggc

SEQ ID NO: 3041956 - DNA, 16 bp, Homo sapiens
aacacagcctgggccc

SEQ ID NO: 3041957 - DNA, 18 bp, Homo sapiens
aacacagtacctaagact

SEQ ID NO: 3041958 - DNA, 18 bp, Homo sapiens
aacacagtgtttttgtaa

SEQ ID NO: 3041959 - DNA, 15 bp, Homo sapiens
aacacataaattatg

SEQ ID NO: 3041960 - DNA, 19 bp, Homo sapiens
aacacattaaaagacaaat

SEQ ID NO: 3041961 - DNA, 16 bp, Homo sapiens
aacacattgttatttt

SEQ ID NO: 3041962 - DNA, 21 bp, Homo sapiens
aacacattttgtataattgta

SEQ ID NO: 3041963 - DNA, 20 bp, Homo sapiens
aacaccaccgagctctgtgg

SEQ ID NO: 3041964 - DNA, 17 bp, Homo sapiens
aacaccccgcctgcctc

SEQ ID NO: 3041965 - DNA, 21 bp, Homo sapiens
aacacccctcagttgtgcagc

SEQ ID NO: 3041966 - DNA, 20 bp, Homo sapiens
aacaccgcttctgccttttc

SEQ ID NO: 3041967 - DNA, 15 bp, Homo sapiens
aacacctgatgtgta

SEQ ID NO: 3041968 - DNA, 19 bp, Homo sapiens
aacacctgggcttaagaaa

SEQ ID NO: 3041969 - DNA, 12 bp, Homo sapiens
aacacctttcct

SEQ ID NO: 3041970 - DNA, 19 bp, Homo sapiens
aacacgcacctgcctcagg

SEQ ID NO: 3041971 - DNA, 14 bp, Homo sapiens
aacacgcaggagca

SEQ ID NO: 3041972 - DNA, 18 bp, Homo sapiens
aacactaactatgcatgg

SEQ ID NO: 3041973 - DNA, 18 bp, Homo sapiens
aacactagacaagccaga

SEQ ID NO: 3041974 - DNA, 19 bp, Homo sapiens
aacactagacaagccagaa

SEQ ID NO: 3041975 - DNA, 18 bp, Homo sapiens
aacactatttgtgacttt

SEQ ID NO: 3041976 - DNA, 16 bp, Homo sapiens
aacactcaacaataaa

SEQ ID NO: 3041977 - DNA, 12 bp, Homo sapiens
aacactgaaaaa

SEQ ID NO: 3041978 - DNA, 17 bp, Homo sapiens
aacactgaaaaaatact

SEQ ID NO: 3041979 - DNA, 20 bp, Homo sapiens
aacactgaagtgcttgcaga

SEQ ID NO: 3041980 - DNA, 22 bp, Homo sapiens
aacactgccatcttagtttgga

SEQ ID NO: 3041981 - DNA, 12 bp, Homo sapiens
aacactgccctc

SEQ ID NO: 3041982 - DNA, 23 bp, Homo sapiens
aacactgcctttttatttatatg

SEQ ID NO: 3041983 - DNA, 23 bp, Homo sapiens
aacactgcttctcggccagcccg

SEQ ID NO: 3041984 - DNA, 20 bp, Homo sapiens
aacactgtgcacatctgtgt

SEQ ID NO: 3041985 - DNA, 18 bp, Homo sapiens
aacactgtgggtgtgtga

SEQ ID NO: 3041986 - DNA, 11 bp, Homo sapiens
aacacttccag

SEQ ID NO: 3041987 - DNA, 17 bp, Homo sapiens
aacacttctgtcctgtg

SEQ ID NO: 3041988 - DNA, 13 bp, Homo sapiens
aacacttggtgct

SEQ ID NO: 3041989 - DNA, 18 bp, Homo sapiens
aacactttcctggataaa

SEQ ID NO: 3041990 - DNA, 18 bp, Homo sapiens
aacagaaagtttgtaaaa

SEQ ID NO: 3041991 - DNA, 18 bp, Homo sapiens
aacagaaatgctctgatt

SEQ ID NO: 3041992 - DNA, 14 bp, Homo sapiens
aacagaatgaaaaa

SEQ ID NO: 3041993 - DNA, 15 bp, Homo sapiens
aacagaatgaaaaat

SEQ ID NO: 3041994 - DNA, 13 bp, Homo sapiens
aacagaatggatt

SEQ ID NO: 3041995 - DNA, 21 bp, Homo sapiens
aacagacaatatgtgagtgcc

SEQ ID NO: 3041996 - DNA, 13 bp, Homo sapiens
aacagacacaatt

SEQ ID NO: 3041997 - DNA, 17 bp, Homo sapiens
aacagacacaatttata

SEQ ID NO: 3041998 - DNA, 11 bp, Homo sapiens
aacagacagga

SEQ ID NO: 3041999 - DNA, 15 bp, Homo sapiens
aacagacaggagaaa

SEQ ID NO: 3042000 - DNA, 19 bp, Homo sapiens
aacagaccccctctagaaa

SEQ ID NO: 3042001 - DNA, 19 bp, Homo sapiens
aacagactcgattcatatt

SEQ ID NO: 3042002 - DNA, 13 bp, Homo sapiens
aacagagaaggca

SEQ ID NO: 3042003 - DNA, 19 bp, Homo sapiens
aacagagggaccaaattgc

SEQ ID NO: 3042004 - DNA, 13 bp, Homo sapiens
aacagagttttct

SEQ ID NO: 3042005 - DNA, 21 bp, Homo sapiens
aacagatgcaatgtgctactg

SEQ ID NO: 3042006 - DNA, 17 bp, Homo sapiens
aacagattattttggaa

SEQ ID NO: 3042007 - DNA, 22 bp, Homo sapiens
aacagattattttggaaagttt

SEQ ID NO: 3042008 - DNA, 13 bp, Homo sapiens
aacatgaatcaaa

SEQ ID NO: 3042009 - DNA, 22 bp, Homo sapiens
aacatgacatttaccagcaact

SEQ ID NO: 3042010 - DNA, 13 bp, Homo sapiens
aacatgcagctct

SEQ ID NO: 3042011 - DNA, 11 bp, Homo sapiens
aacatgcagtt

SEQ ID NO: 3042012 - DNA, 13 bp, Homo sapiens
aacatgcagtttg

SEQ ID NO: 3042013 - DNA, 14 bp, Homo sapiens
aacatgccctgttc

SEQ ID NO: 3042014 - DNA, 19 bp, Homo sapiens
aacatgcctgggattggga

SEQ ID NO: 3042015 - DNA, 18 bp, Homo sapiens
aacatgcttttactttat

SEQ ID NO: 3042016 - DNA, 18 bp, Homo sapiens
aacatggattccaaagca

SEQ ID NO: 3042017 - DNA, 20 bp, Homo sapiens
aacatggattccaaagcatt

SEQ ID NO: 3042018 - DNA, 15 bp, Homo sapiens
aacatgggctgtgat

SEQ ID NO: 3042019 - DNA, 12 bp, Homo sapiens
aacatgtaatat

SEQ ID NO: 3042020 - DNA, 18 bp, Homo sapiens
aacatgtaatataaagat

SEQ ID NO: 3042021 - DNA, 19 bp, Homo sapiens
aacatgtatctgtctactt

SEQ ID NO: 3042022 - DNA, 16 bp, Homo sapiens
aacatgtatgtgcatt

SEQ ID NO: 3042023 - DNA, 14 bp, Homo sapiens
aacatgtggaagaa

SEQ ID NO: 3042024 - DNA, 21 bp, Homo sapiens
aacattaaaacaatattgttt

SEQ ID NO: 3042025 - DNA, 23 bp, Homo sapiens
aacattaaaacaatattgtttct

SEQ ID NO: 3042026 - DNA, 18 bp, Homo sapiens
aacattcagatttaccat

SEQ ID NO: 3042027 - DNA, 19 bp, Homo sapiens
aacattcagatttaccata

SEQ ID NO: 3042028 - DNA, 13 bp, Homo sapiens
aacattcaggagc

SEQ ID NO: 3042029 - DNA, 14 bp, Homo sapiens
aacattcaggagct

SEQ ID NO: 3042030 - DNA, 11 bp, Homo sapiens
aacattccaag

SEQ ID NO: 3042031 - DNA, 12 bp, Homo sapiens
aacattccaaga

SEQ ID NO: 3042032 - DNA, 12 bp, Homo sapiens
aacattcccact

SEQ ID NO: 3042033 - DNA, 16 bp, Homo sapiens
aacattctgatttgga

SEQ ID NO: 3042034 - DNA, 17 bp, Homo sapiens
aacattctgatttggaa

SEQ ID NO: 3042035 - DNA, 18 bp, Homo sapiens
aacattgaagtaatgaat

SEQ ID NO: 3042036 - DNA, 19 bp, Homo sapiens
aacattgaagtaatgaatt

SEQ ID NO: 3042037 - DNA, 14 bp, Homo sapiens
aacatttacatgta

SEQ ID NO: 3042038 - DNA, 19 bp, Homo sapiens
aacatttattttatgagaa

SEQ ID NO: 3042039 - DNA, 21 bp, Homo sapiens
aacatttattttatgagaaat

SEQ ID NO: 3042040 - DNA, 23 bp, Homo sapiens
aacatttattttatgagaaatgt

SEQ ID NO: 3042041 - DNA, 20 bp, Homo sapiens
aacatttccaaaagtggcta

SEQ ID NO: 3042042 - DNA, 13 bp, Homo sapiens
aacatttgtgata

SEQ ID NO: 3042043 - DNA, 17 bp, Homo sapiens
aacattttaagttttac

SEQ ID NO: 3042044 - DNA, 15 bp, Homo sapiens
aacattttacccaca

SEQ ID NO: 3042045 - DNA, 12 bp, Homo sapiens
aacattttcaat

SEQ ID NO: 3042046 - DNA, 16 bp, Homo sapiens
aacattttgagaacaa

SEQ ID NO: 3042047 - DNA, 11 bp, Homo sapiens
aacattttgtt

SEQ ID NO: 3042048 - DNA, 22 bp, Homo sapiens
aacattttttaaacaataaact

SEQ ID NO: 3042049 - DNA, 13 bp, Homo sapiens
aaccaaacaatta

SEQ ID NO: 3042050 - DNA, 19 bp, Homo sapiens
aaccaaagagtctctggct

SEQ ID NO: 3042051 - DNA, 13 bp, Homo sapiens
aaccaacccatgt

SEQ ID NO: 3042052 - DNA, 22 bp, Homo sapiens
aaccaacctttctgacatcagc

SEQ ID NO: 3042053 - DNA, 14 bp, Homo sapiens
aaccaagagattgc

SEQ ID NO: 3042054 - DNA, 14 bp, Homo sapiens
aaccaagcctctgg

SEQ ID NO: 3042055 - DNA, 16 bp, Homo sapiens
aaccaagcctctggaa

SEQ ID NO: 3042056 - DNA, 14 bp, Homo sapiens
aaccaaggaaggag

SEQ ID NO: 3042057 - DNA, 19 bp, Homo sapiens
aaccaaggctgtgtttaga

SEQ ID NO: 3042058 - DNA, 15 bp, Homo sapiens
aaccaagtcaggcca

SEQ ID NO: 3042059 - DNA, 13 bp, Homo sapiens
aaccaagttgttt

SEQ ID NO: 3042060 - DNA, 16 bp, Homo sapiens
aaccaagttgtttatt

SEQ ID NO: 3042061 - DNA, 13 bp, Homo sapiens
aaccaatcctgga

SEQ ID NO: 3042062 - DNA, 16 bp, Homo sapiens
aaccaatcgcaaagca

SEQ ID NO: 3042063 - DNA, 16 bp, Homo sapiens
aaccaattcctcatcc

SEQ ID NO: 3042064 - DNA, 21 bp, Homo sapiens
aaccaattttttgttcttcag

SEQ ID NO: 3042065 - DNA, 21 bp, Homo sapiens
aaccacaaacggagcccctga

SEQ ID NO: 3042066 - DNA, 13 bp, Homo sapiens
aaccacaccacat

SEQ ID NO: 3042067 - DNA, 16 bp, Homo sapiens
aaccacattttaggat

SEQ ID NO: 3042068 - DNA, 22 bp, Homo sapiens
aaccaccccggccccctgcccg

SEQ ID NO: 3042069 - DNA, 17 bp, Homo sapiens
aaccacctctctgtctt

SEQ ID NO: 3042070 - DNA, 23 bp, Homo sapiens
aaccacctctctgtctttttcct

SEQ ID NO: 3042071 - DNA, 22 bp, Homo sapiens
aaccacgcaggaagcctactat

SEQ ID NO: 3042072 - DNA, 15 bp, Homo sapiens
aaccactatgcaaag

SEQ ID NO: 3042073 - DNA, 22 bp, Homo sapiens
aaccactggaaagtttatggtt

SEQ ID NO: 3042074 - DNA, 23 bp, Homo sapiens
aaccagactttgaaaaattgttc

SEQ ID NO: 3042075 - DNA, 17 bp, Homo sapiens
aaccagagtctgtattt

SEQ ID NO: 3042076 - DNA, 19 bp, Homo sapiens
aaccagcaagtcccagaca

SEQ ID NO: 3042077 - DNA, 15 bp, Homo sapiens
aaccagctcagtgtt

SEQ ID NO: 3042078 - DNA, 16 bp, Homo sapiens
aaccagctcagtgttt

SEQ ID NO: 3042079 - DNA, 13 bp, Homo sapiens
aaccaggaaaaaa

SEQ ID NO: 3042080 - DNA, 19 bp, Homo sapiens
aaccaggtcagtctgtctc

SEQ ID NO: 3042081 - DNA, 19 bp, Homo sapiens
aaccagttgtggtgtgagt

SEQ ID NO: 3042082 - DNA, 15 bp, Homo sapiens
aaccagttttgctgc

SEQ ID NO: 3042083 - DNA, 20 bp, Homo sapiens
aaccataggactgtggcaaa

SEQ ID NO: 3042084 - DNA, 15 bp, Homo sapiens
aacctgcatttttaa

SEQ ID NO: 3042085 - DNA, 10 bp, Homo sapiens
aacctgccct

SEQ ID NO: 3042086 - DNA, 23 bp, Homo sapiens
aacctgctcccttcgctctgctg

SEQ ID NO: 3042087 - DNA, 22 bp, Homo sapiens
aacctgcttgggtggagaagcc

SEQ ID NO: 3042088 - DNA, 17 bp, Homo sapiens
aacctgggattcaggaa

SEQ ID NO: 3042089 - DNA, 17 bp, Homo sapiens
aacctgggttgcagaca

SEQ ID NO: 3042090 - DNA, 19 bp, Homo sapiens
aacctgggttgcagacagg

SEQ ID NO: 3042091 - DNA, 16 bp, Homo sapiens
aacctgtagatgcaga

SEQ ID NO: 3042092 - DNA, 23 bp, Homo sapiens
aacctgtagatgcagaaaaagaa

SEQ ID NO: 3042093 - DNA, 23 bp, Homo sapiens
aacctgtaggatcttatttggaa

SEQ ID NO: 3042094 - DNA, 22 bp, Homo sapiens
aacctgtataaccctgttacaa

SEQ ID NO: 3042095 - DNA, 20 bp, Homo sapiens
aacctgtccttactcagagc

SEQ ID NO: 3042096 - DNA, 22 bp, Homo sapiens
aacctgtccttactcagagctg

SEQ ID NO: 3042097 - DNA, 22 bp, Homo sapiens
aacctgtgaccagtctgaccct

SEQ ID NO: 3042098 - DNA, 22 bp, Homo sapiens
aacctgtgcccaggccagcttc

SEQ ID NO: 3042099 - DNA, 15 bp, Homo sapiens
aacctgtgtctgcga

SEQ ID NO: 3042100 - DNA, 21 bp, Homo sapiens
aacctgttgatagcaagtgaa

SEQ ID NO: 3042101 - DNA, 23 bp, Homo sapiens
aaccttagatgttctaagtcttt

SEQ ID NO: 3042102 - DNA, 19 bp, Homo sapiens
aaccttattttgataaaat

SEQ ID NO: 3042103 - DNA, 18 bp, Homo sapiens
aaccttggtgtagttgaa

SEQ ID NO: 3042104 - DNA, 21 bp, Homo sapiens
aaccttggtgtagttgaactg

SEQ ID NO: 3042105 - DNA, 22 bp, Homo sapiens
aaccttggtgtagttgaactga

SEQ ID NO: 3042106 - DNA, 17 bp, Homo sapiens
aaccttgttatttctca

SEQ ID NO: 3042107 - DNA, 18 bp, Homo sapiens
aaccttgttatttctcag

SEQ ID NO: 3042108 - DNA, 22 bp, Homo sapiens
aaccttgtttaatagatttggg

SEQ ID NO: 3042109 - DNA, 13 bp, Homo sapiens
aaccttgtttgtt

SEQ ID NO: 3042110 - DNA, 19 bp, Homo sapiens
aacctttaaaaatgtataa

SEQ ID NO: 3042111 - DNA, 15 bp, Homo sapiens
aacctttattctttt

SEQ ID NO: 3042112 - DNA, 11 bp, Homo sapiens
aacctttctga

SEQ ID NO: 3042113 - DNA, 19 bp, Homo sapiens
aacctttgctatgtaaggg

SEQ ID NO: 3042114 - DNA, 20 bp, Homo sapiens
aacctttgcttaccttgttt

SEQ ID NO: 3042115 - DNA, 12 bp, Homo sapiens
aacctttttaaa

SEQ ID NO: 3042116 - DNA, 14 bp, Homo sapiens
aacctttttcttga

SEQ ID NO: 3042117 - DNA, 14 bp, Homo sapiens
aacgaacccctaga

SEQ ID NO: 3042118 - DNA, 19 bp, Homo sapiens
aacgaacccctagaaagga

SEQ ID NO: 3042119 - DNA, 12 bp, Homo sapiens
aacgaggaagcc

SEQ ID NO: 3042120 - DNA, 18 bp, Homo sapiens
aacgatttaattctcttg

SEQ ID NO: 3042121 - DNA, 20 bp, Homo sapiens
aacgatttaattctcttgaa

SEQ ID NO: 3042122 - DNA, 13 bp, Homo sapiens
aacgcagaagagg

SEQ ID NO: 3042123 - DNA, 21 bp, Homo sapiens
aacgcagaagagggggagggg

SEQ ID NO: 3042124 - DNA, 11 bp, Homo sapiens
aacgcagcctc

SEQ ID NO: 3042125 - DNA, 18 bp, Homo sapiens
aacgcctcccctgcccca

SEQ ID NO: 3042126 - DNA, 21 bp, Homo sapiens
aacgcgcagatgtgcagcaga

SEQ ID NO: 3042127 - DNA, 15 bp, Homo sapiens
aacgctacctctctg

SEQ ID NO: 3042128 - DNA, 16 bp, Homo sapiens
aacgctgaagcggtca

SEQ ID NO: 3042129 - DNA, 11 bp, Homo sapiens
aacgctgcctg

SEQ ID NO: 3042130 - DNA, 17 bp, Homo sapiens
aacggaaatgtgtggtc

SEQ ID NO: 3042131 - DNA, 22 bp, Homo sapiens
aacggaggcctgcgaccctggg

SEQ ID NO: 3042132 - DNA, 12 bp, Homo sapiens
aacggggagaaa

SEQ ID NO: 3042133 - DNA, 17 bp, Homo sapiens
aacggtaaatttctgtg

SEQ ID NO: 3042134 - DNA, 14 bp, Homo sapiens
aacggttcagtttc

SEQ ID NO: 3042135 - DNA, 19 bp, Homo sapiens
aacgtatgtgctcttataa

SEQ ID NO: 3042136 - DNA, 17 bp, Homo sapiens
aacgtgatgtgccacta

SEQ ID NO: 3042137 - DNA, 12 bp, Homo sapiens
aacgtgcaactg

SEQ ID NO: 3042138 - DNA, 13 bp, Homo sapiens
aacgtgtcccgag

SEQ ID NO: 3042139 - DNA, 15 bp, Homo sapiens
aacgtgttaattata

SEQ ID NO: 3042140 - DNA, 21 bp, Homo sapiens
aacgtgttaattataaacagc

SEQ ID NO: 3042141 - DNA, 23 bp, Homo sapiens
aacgtgttaattataaacagcag

SEQ ID NO: 3042142 - DNA, 14 bp, Homo sapiens
aacgttaaaagtgt

SEQ ID NO: 3042143 - DNA, 17 bp, Homo sapiens
aacgttgatgtaatgaa

SEQ ID NO: 3042144 - DNA, 20 bp, Homo sapiens
aacgttttttcttcttttaa

SEQ ID NO: 3042145 - DNA, 16 bp, Homo sapiens
aactaaactcatttat

SEQ ID NO: 3042146 - DNA, 14 bp, Homo sapiens
aactaaagttgtac

SEQ ID NO: 3042147 - DNA, 19 bp, Homo sapiens
aactaagaaacttaaattt

SEQ ID NO: 3042148 - DNA, 21 bp, Homo sapiens
aactaaggaaccctggaaact

SEQ ID NO: 3042149 - DNA, 19 bp, Homo sapiens
aactaaggactccaatgtc

SEQ ID NO: 3042150 - DNA, 20 bp, Homo sapiens
aactaattgactttagaaag

SEQ ID NO: 3042151 - DNA, 20 bp, Homo sapiens
aactaatttggtttttactc

SEQ ID NO: 3042152 - DNA, 13 bp, Homo sapiens
aactacatgagaa

SEQ ID NO: 3042153 - DNA, 22 bp, Homo sapiens
aactaccagtgggcatgtatta

SEQ ID NO: 3042154 - DNA, 21 bp, Homo sapiens
aactacccaaaacaagcctgg

SEQ ID NO: 3042155 - DNA, 18 bp, Homo sapiens
aactacctatattccttg

SEQ ID NO: 3042156 - DNA, 15 bp, Homo sapiens
aactacctgtattta

SEQ ID NO: 3042157 - DNA, 23 bp, Homo sapiens
aactaccttgctagctagccagc

SEQ ID NO: 3042158 - DNA, 17 bp, Homo sapiens
aactactgtagaactga

SEQ ID NO: 3042159 - DNA, 15 bp, Homo sapiens
aactagaatttgatt

SEQ ID NO: 3042160 - DNA, 16 bp, Homo sapiens
aactagaatttgatta

SEQ ID NO: 3042161 - DNA, 18 bp, Homo sapiens
aactagatgacctcatta

SEQ ID NO: 3042162 - DNA, 13 bp, Homo sapiens
aactagcccctgg

SEQ ID NO: 3042163 - DNA, 16 bp, Homo sapiens
aactagcccctggggt

SEQ ID NO: 3042164 - DNA, 17 bp, Homo sapiens
aactagggttttggcct

SEQ ID NO: 3042165 - DNA, 18 bp, Homo sapiens
aactagggttttggcctg

SEQ ID NO: 3042166 - DNA, 21 bp, Homo sapiens
aactctctgtcttctctccac

SEQ ID NO: 3042167 - DNA, 15 bp, Homo sapiens
aactctcttcttcca

SEQ ID NO: 3042168 - DNA, 18 bp, Homo sapiens
aactctgtaaaagtgtct

SEQ ID NO: 3042169 - DNA, 20 bp, Homo sapiens
aactctgtcttcacctgatt

SEQ ID NO: 3042170 - DNA, 22 bp, Homo sapiens
aactctgttgcaagtgcaataa

SEQ ID NO: 3042171 - DNA, 14 bp, Homo sapiens
aactcttaactgaa

SEQ ID NO: 3042172 - DNA, 19 bp, Homo sapiens
aactcttagaagtgttgta

SEQ ID NO: 3042173 - DNA, 20 bp, Homo sapiens
aactcttagaagtgttgtaa

SEQ ID NO: 3042174 - DNA, 21 bp, Homo sapiens
aactcttctttgctgcattcc

SEQ ID NO: 3042175 - DNA, 14 bp, Homo sapiens
aactcttgtattgc

SEQ ID NO: 3042176 - DNA, 14 bp, Homo sapiens
aactgaaaagagag

SEQ ID NO: 3042177 - DNA, 19 bp, Homo sapiens
aactgaaaagagagcagag

SEQ ID NO: 3042178 - DNA, 18 bp, Homo sapiens
aactgaaattaaaactat

SEQ ID NO: 3042179 - DNA, 17 bp, Homo sapiens
aactgaaccaaattgca

SEQ ID NO: 3042180 - DNA, 15 bp, Homo sapiens
aactgaactttgaag

SEQ ID NO: 3042181 - DNA, 20 bp, Homo sapiens
aactgaactttgaagacccg

SEQ ID NO: 3042182 - DNA, 17 bp, Homo sapiens
aactgaagaaagagaag

SEQ ID NO: 3042183 - DNA, 20 bp, Homo sapiens
aactgaatcaggaaactcaa

SEQ ID NO: 3042184 - DNA, 23 bp, Homo sapiens
aactgaatgaaacccccacacac

SEQ ID NO: 3042185 - DNA, 20 bp, Homo sapiens
aactgacatgattagcagaa

SEQ ID NO: 3042186 - DNA, 20 bp, Homo sapiens
aactgaggagcggactcact

SEQ ID NO: 3042187 - DNA, 15 bp, Homo sapiens
aactgatagttactg

SEQ ID NO: 3042188 - DNA, 13 bp, Homo sapiens
aactgatctattt

SEQ ID NO: 3042189 - DNA, 17 bp, Homo sapiens
aactgattagtattcag

SEQ ID NO: 3042190 - DNA, 20 bp, Homo sapiens
aactgattagtattcaggca

SEQ ID NO: 3042191 - DNA, 17 bp, Homo sapiens
aactgattcacatctca

SEQ ID NO: 3042192 - DNA, 22 bp, Homo sapiens
aactgattttacaaattaatat

SEQ ID NO: 3042193 - DNA, 23 bp, Homo sapiens
aactgcacaataaaaccaagcct

SEQ ID NO: 3042194 - DNA, 10 bp, Homo sapiens
aactgcagca

SEQ ID NO: 3042195 - DNA, 19 bp, Homo sapiens
aactgcagtcatcaacaat

SEQ ID NO: 3042196 - DNA, 14 bp, Homo sapiens
aactgcattgagaa

SEQ ID NO: 3042197 - DNA, 23 bp, Homo sapiens
aactgctgcctgatttgttggga

SEQ ID NO: 3042198 - DNA, 19 bp, Homo sapiens
aactgctggaaatctcaaa

SEQ ID NO: 3042199 - DNA, 16 bp, Homo sapiens
aactgctggggctggt

SEQ ID NO: 3042200 - DNA, 23 bp, Homo sapiens
aactgctgtctcttaaatctctt

SEQ ID NO: 3042201 - DNA, 18 bp, Homo sapiens
aactgcttgcccagggtg

SEQ ID NO: 3042202 - DNA, 16 bp, Homo sapiens
aactggagaaatgatt

SEQ ID NO: 3042203 - DNA, 13 bp, Homo sapiens
aactggctggcca

SEQ ID NO: 3042204 - DNA, 17 bp, Homo sapiens
aactggctggccagtct

SEQ ID NO: 3042205 - DNA, 18 bp, Homo sapiens
aactggggggaccaaata

SEQ ID NO: 3042206 - DNA, 22 bp, Homo sapiens
aactggggggaccaaatagcca

SEQ ID NO: 3042207 - DNA, 20 bp, Homo sapiens
aactggtgcactttgtaaat

SEQ ID NO: 3042208 - DNA, 11 bp, Homo sapiens
aactgtaaatc

SEQ ID NO: 3042209 - DNA, 13 bp, Homo sapiens
aactgtactgtct

SEQ ID NO: 3042210 - DNA, 20 bp, Homo sapiens
aactgtagatgatgtatttt

SEQ ID NO: 3042211 - DNA, 15 bp, Homo sapiens
aactgtattattgca

SEQ ID NO: 3042212 - DNA, 13 bp, Homo sapiens
aactgtcccagct

SEQ ID NO: 3042213 - DNA, 17 bp, Homo sapiens
aactgtcccagctacca

SEQ ID NO: 3042214 - DNA, 17 bp, Homo sapiens
aactgtcggaggaaaga

SEQ ID NO: 3042215 - DNA, 23 bp, Homo sapiens
aactgtctcgatgcaatgaacac

SEQ ID NO: 3042216 - DNA, 17 bp, Homo sapiens
aactgtgaatgcttctg

SEQ ID NO: 3042217 - DNA, 20 bp, Homo sapiens
aactgtgaatgcttctgatt

SEQ ID NO: 3042218 - DNA, 23 bp, Homo sapiens
aactgtggttaatccaatcaatt

SEQ ID NO: 3042219 - DNA, 18 bp, Homo sapiens
aactgtgtctctgaattc

SEQ ID NO: 3042220 - DNA, 18 bp, Homo sapiens
aactgttcccacctgctg

SEQ ID NO: 3042221 - DNA, 22 bp, Homo sapiens
aactgttgcacttttgaatgtc

SEQ ID NO: 3042222 - DNA, 17 bp, Homo sapiens
aactgttgtagaaattc

SEQ ID NO: 3042223 - DNA, 15 bp, Homo sapiens
aacttaaagtgaatt

SEQ ID NO: 3042224 - DNA, 15 bp, Homo sapiens
aacttagaggaaaat

SEQ ID NO: 3042225 - DNA, 12 bp, Homo sapiens
aacttatgaatg

SEQ ID NO: 3042226 - DNA, 15 bp, Homo sapiens
aacttatgaatgttt

SEQ ID NO: 3042227 - DNA, 14 bp, Homo sapiens
aacttattctgtag

SEQ ID NO: 3042228 - DNA, 23 bp, Homo sapiens
aacttattgcctagcctataaat

SEQ ID NO: 3042229 - DNA, 17 bp, Homo sapiens
aacttatttaaaaatat

SEQ ID NO: 3042230 - DNA, 14 bp, Homo sapiens
aacttatttatatg

SEQ ID NO: 3042231 - DNA, 14 bp, Homo sapiens
aacttcaacattta

SEQ ID NO: 3042232 - DNA, 19 bp, Homo sapiens
aacttcagcattgtaatta

SEQ ID NO: 3042233 - DNA, 23 bp, Homo sapiens
aacttcagcattgtaattatgta

SEQ ID NO: 3042234 - DNA, 21 bp, Homo sapiens
aacttccattctttcttcctc

SEQ ID NO: 3042235 - DNA, 17 bp, Homo sapiens
aacttccccatcttcta

SEQ ID NO: 3042236 - DNA, 18 bp, Homo sapiens
aacttcctgtgcctttcc

SEQ ID NO: 3042237 - DNA, 19 bp, Homo sapiens
aacttcgcatcaaaagaca

SEQ ID NO: 3042238 - DNA, 23 bp, Homo sapiens
aacttcgcatcaaaagacaattc

SEQ ID NO: 3042239 - DNA, 18 bp, Homo sapiens
aacttctatattttaata

SEQ ID NO: 3042240 - DNA, 17 bp, Homo sapiens
aacttctgtaaggggca

SEQ ID NO: 3042241 - DNA, 18 bp, Homo sapiens
aacttctgtaaggggcag

SEQ ID NO: 3042242 - DNA, 15 bp, Homo sapiens
aacttcttatggaat

SEQ ID NO: 3042243 - DNA, 19 bp, Homo sapiens
aacttcttatggaattgat

SEQ ID NO: 3042244 - DNA, 12 bp, Homo sapiens
aacttgaaaaat

SEQ ID NO: 3042245 - DNA, 15 bp, Homo sapiens
aacttgaaaaatact

SEQ ID NO: 3042246 - DNA, 14 bp, Homo sapiens
aacttgaactgatt

SEQ ID NO: 3042247 - DNA, 14 bp, Homo sapiens
aacttgaagaaacg

SEQ ID NO: 3042248 - DNA, 14 bp, Homo sapiens
aacttgaagcagtc

SEQ ID NO: 3042249 - DNA, 13 bp, Homo sapiens
aacttgaataata

SEQ ID NO: 3042250 - DNA, 15 bp, Homo sapiens
aacttgaccctgagc

SEQ ID NO: 3042251 - DNA, 18 bp, Homo sapiens
aacttgaccctgagctga

SEQ ID NO: 3042252 - DNA, 23 bp, Homo sapiens
aacttgagcctgtgaccttggga

SEQ ID NO: 3042253 - DNA, 18 bp, Homo sapiens
aacttgcttatcaacttc

SEQ ID NO: 3042254 - DNA, 15 bp, Homo sapiens
aacttgctttcttct

SEQ ID NO: 3042255 - DNA, 17 bp, Homo sapiens
aacttggaaaaagaaag

SEQ ID NO: 3042256 - DNA, 22 bp, Homo sapiens
aacttggaaaaagaaagaaaca

SEQ ID NO: 3042257 - DNA, 19 bp, Homo sapiens
acggctgtgacgcagccgg

SEQ ID NO: 3042258 - DNA, 21 bp, Homo sapiens
acggctgtgacgcagccggag

SEQ ID NO: 3042259 - DNA, 23 bp, Homo sapiens
acgggacatcacagggtgggcct

SEQ ID NO: 3042260 - DNA, 18 bp, Homo sapiens
acgggcaagtgagagggg

SEQ ID NO: 3042261 - DNA, 23 bp, Homo sapiens
acgggcaagtgagaggggaggga

SEQ ID NO: 3042262 - DNA, 22 bp, Homo sapiens
acgggccaggccctggagggca

SEQ ID NO: 3042263 - DNA, 21 bp, Homo sapiens
acggggtcggacggggcaggc

SEQ ID NO: 3042264 - DNA, 20 bp, Homo sapiens
acggggtttcatcatgttga

SEQ ID NO: 3042265 - DNA, 13 bp, Homo sapiens
acggtcagtttgg

SEQ ID NO: 3042266 - DNA, 16 bp, Homo sapiens
acggttcaatggtaga

SEQ ID NO: 3042267 - DNA, 21 bp, Homo sapiens
acggttcagtttcttctgcgc

SEQ ID NO: 3042268 - DNA, 14 bp, Homo sapiens
acggtttccaggga

SEQ ID NO: 3042269 - DNA, 15 bp, Homo sapiens
acggtttccagggag

SEQ ID NO: 3042270 - DNA, 17 bp, Homo sapiens
acggtttccagggaggg

SEQ ID NO: 3042271 - DNA, 15 bp, Homo sapiens
acgtaaagaactttt

SEQ ID NO: 3042272 - DNA, 13 bp, Homo sapiens
acgtaaatgtttt

SEQ ID NO: 3042273 - DNA, 18 bp, Homo sapiens
acgtaccaagccaccgca

SEQ ID NO: 3042274 - DNA, 15 bp, Homo sapiens
acgtagccacaggag

SEQ ID NO: 3042275 - DNA, 17 bp, Homo sapiens
acgtagccacaggagcc

SEQ ID NO: 3042276 - DNA, 18 bp, Homo sapiens
acgtatggaatgcttctt

SEQ ID NO: 3042277 - DNA, 13 bp, Homo sapiens
acgtatgtatttc

SEQ ID NO: 3042278 - DNA, 16 bp, Homo sapiens
acgtatgtatttcatt

SEQ ID NO: 3042279 - DNA, 15 bp, Homo sapiens
acgtatgtgctctta

SEQ ID NO: 3042280 - DNA, 16 bp, Homo sapiens
acgtattggtccagct

SEQ ID NO: 3042281 - DNA, 16 bp, Homo sapiens
acgtcaaacatgaagt

SEQ ID NO: 3042282 - DNA, 17 bp, Homo sapiens
acgtcaaacatgaagtg

SEQ ID NO: 3042283 - DNA, 17 bp, Homo sapiens
acgtctctctgcctgct

SEQ ID NO: 3042284 - DNA, 23 bp, Homo sapiens
acgtctgggagaaattgacagat

SEQ ID NO: 3042285 - DNA, 12 bp, Homo sapiens
acgtcttctaaa

SEQ ID NO: 3042286 - DNA, 19 bp, Homo sapiens
acgtgacacaaacacacac

SEQ ID NO: 3042287 - DNA, 18 bp, Homo sapiens
acgtgactgccccaactc

SEQ ID NO: 3042288 - DNA, 14 bp, Homo sapiens
acgtgagagtgtct

SEQ ID NO: 3042289 - DNA, 15 bp, Homo sapiens
acgtgagagtgtctt

SEQ ID NO: 3042290 - DNA, 19 bp, Homo sapiens
acgtgcaactgacactccc

SEQ ID NO: 3042291 - DNA, 17 bp, Homo sapiens
acgtgcaggacagctct

SEQ ID NO: 3042292 - DNA, 13 bp, Homo sapiens
acgtgccagcagc

SEQ ID NO: 3042293 - DNA, 14 bp, Homo sapiens
acgtgccagcagcc

SEQ ID NO: 3042294 - DNA, 18 bp, Homo sapiens
acgtgccaggcccggggc

SEQ ID NO: 3042295 - DNA, 20 bp, Homo sapiens
acgtgcgctgggcacttccc

SEQ ID NO: 3042296 - DNA, 23 bp, Homo sapiens
acgtgctggccttggtatgtgcc

SEQ ID NO: 3042297 - DNA, 21 bp, Homo sapiens
acgtggctgcgtgcccctgct

SEQ ID NO: 3042298 - DNA, 17 bp, Homo sapiens
acgtgggccctgcaggc

SEQ ID NO: 3042299 - DNA, 23 bp, Homo sapiens
acgtgggctgggcccacaaaggc

SEQ ID NO: 3042300 - DNA, 15 bp, Homo sapiens
acgtgtagtgtccat

SEQ ID NO: 3042301 - DNA, 15 bp, Homo sapiens
acgtgtgaaatctgt

SEQ ID NO: 3042302 - DNA, 23 bp, Homo sapiens
acgtgtgggccgtggcttgggct

SEQ ID NO: 3042303 - DNA, 22 bp, Homo sapiens
acgtgttttattcctgtatgtt

SEQ ID NO: 3042304 - DNA, 18 bp, Homo sapiens
acgttaaaagtgtacaag

SEQ ID NO: 3042305 - DNA, 22 bp, Homo sapiens
acgttaaaagtgtacaagttgc

SEQ ID NO: 3042306 - DNA, 19 bp, Homo sapiens
acgttccttactgcagaat

SEQ ID NO: 3042307 - DNA, 19 bp, Homo sapiens
acgttggcctcagggccag

SEQ ID NO: 3042308 - DNA, 21 bp, Homo sapiens
acgttggcctcagggccagga

SEQ ID NO: 3042309 - DNA, 22 bp, Homo sapiens
acgttggcctcagggccaggaa

SEQ ID NO: 3042310 - DNA, 16 bp, Homo sapiens
acgttgtttcttatag

SEQ ID NO: 3042311 - DNA, 20 bp, Homo sapiens
acgttgtttcttatagattt

SEQ ID NO: 3042312 - DNA, 20 bp, Homo sapiens
acgtttaatcccagcacttt

SEQ ID NO: 3042313 - DNA, 12 bp, Homo sapiens
acgtttcttcac

SEQ ID NO: 3042314 - DNA, 14 bp, Homo sapiens
acgtttgcaccgcc

SEQ ID NO: 3042315 - DNA, 20 bp, Homo sapiens
acgtttggaagatcctgtga

SEQ ID NO: 3042316 - DNA, 13 bp, Homo sapiens
acgtttgtatgtg

SEQ ID NO: 3042317 - DNA, 12 bp, Homo sapiens
acgttttagaaa

SEQ ID NO: 3042318 - DNA, 16 bp, Homo sapiens
acgttttttcttcttt

SEQ ID NO: 3042319 - DNA, 12 bp, Homo sapiens
actaaaagtgtg

SEQ ID NO: 3042320 - DNA, 13 bp, Homo sapiens
actaaagcaatag

SEQ ID NO: 3042321 - DNA, 14 bp, Homo sapiens
actaaagcaataga

SEQ ID NO: 3042322 - DNA, 15 bp, Homo sapiens
actaaagcaatagaa

SEQ ID NO: 3042323 - DNA, 16 bp, Homo sapiens
actaaagccaaacata

SEQ ID NO: 3042324 - DNA, 23 bp, Homo sapiens
actaaagccaaacatatatatac

SEQ ID NO: 3042325 - DNA, 17 bp, Homo sapiens
actaaaggtggccacaa

SEQ ID NO: 3042326 - DNA, 20 bp, Homo sapiens
actaactagacaccaaagtt

SEQ ID NO: 3042327 - DNA, 22 bp, Homo sapiens
actaactagacaccaaagttct

SEQ ID NO: 3042328 - DNA, 15 bp, Homo sapiens
actaactatgcatgg

SEQ ID NO: 3042329 - DNA, 22 bp, Homo sapiens
actaagaagtggtgttccatga

SEQ ID NO: 3042330 - DNA, 18 bp, Homo sapiens
actaagaattcaaactgg

SEQ ID NO: 3042331 - DNA, 16 bp, Homo sapiens
actaagactcccgccc

SEQ ID NO: 3042332 - DNA, 20 bp, Homo sapiens
actaagatgacattgctaag

SEQ ID NO: 3042333 - DNA, 13 bp, Homo sapiens
actaagcagagga

SEQ ID NO: 3042334 - DNA, 15 bp, Homo sapiens
actaagcagaggagg

SEQ ID NO: 3042335 - DNA, 19 bp, Homo sapiens
actaagcagaggaggggcc

SEQ ID NO: 3042336 - DNA, 13 bp, Homo sapiens
actaagccaggag

SEQ ID NO: 3042337 - DNA, 12 bp, Homo sapiens
actaaggagaat

SEQ ID NO: 3042338 - DNA, 22 bp, Homo sapiens
actaaggggcccggccagccat

SEQ ID NO: 3042339 - DNA, 18 bp, Homo sapiens
actaaggtgactttctga

SEQ ID NO: 3042340 - DNA, 22 bp, Homo sapiens
actaaggtgactttctgaaact

SEQ ID NO: 3042341 - DNA, 15 bp, Homo sapiens
actaatgaattgaaa

SEQ ID NO: 3042342 - DNA, 17 bp, Homo sapiens
actaatgaattgaaatt

SEQ ID NO: 3042343 - DNA, 15 bp, Homo sapiens
actaatgcaaactgg

SEQ ID NO: 3042344 - DNA, 14 bp, Homo sapiens
actaatgctttctg

SEQ ID NO: 3042345 - DNA, 12 bp, Homo sapiens
actaatggcatg

SEQ ID NO: 3042346 - DNA, 14 bp, Homo sapiens
actaattgtataac

SEQ ID NO: 3042347 - DNA, 18 bp, Homo sapiens
actaattgtataacaggt

SEQ ID NO: 3042348 - DNA, 19 bp, Homo sapiens
actaatttcaaaatgcttt

SEQ ID NO: 3042349 - DNA, 21 bp, Homo sapiens
actaattttacatgtttataa

SEQ ID NO: 3042350 - DNA, 13 bp, Homo sapiens
actaatttttgta

SEQ ID NO: 3042351 - DNA, 19 bp, Homo sapiens
actacaaacaaaagcagcc

SEQ ID NO: 3042352 - DNA, 11 bp, Homo sapiens
actacaaatca

SEQ ID NO: 3042353 - DNA, 22 bp, Homo sapiens
actacaagtttataagcccaaa

SEQ ID NO: 3042354 - DNA, 16 bp, Homo sapiens
actacaccacacacaa

SEQ ID NO: 3042355 - DNA, 14 bp, Homo sapiens
actacagaaatgag

SEQ ID NO: 3042356 - DNA, 14 bp, Homo sapiens
actacccaaatcta

SEQ ID NO: 3042357 - DNA, 13 bp, Homo sapiens
actaccctcaccc

SEQ ID NO: 3042358 - DNA, 21 bp, Homo sapiens
actacctacgtttgcaccgcc

SEQ ID NO: 3042359 - DNA, 14 bp, Homo sapiens
actacctactggtg

SEQ ID NO: 3042360 - DNA, 16 bp, Homo sapiens
actacctagaagtaag

SEQ ID NO: 3042361 - DNA, 21 bp, Homo sapiens
actacctagaagtaagaagag

SEQ ID NO: 3042362 - DNA, 14 bp, Homo sapiens
actacctataggaa

SEQ ID NO: 3042363 - DNA, 16 bp, Homo sapiens
actacctataggaaag

SEQ ID NO: 3042364 - DNA, 17 bp, Homo sapiens
actacctataggaaagt

SEQ ID NO: 3042365 - DNA, 22 bp, Homo sapiens
actacctgccatgcatacatgc

SEQ ID NO: 3042366 - DNA, 15 bp, Homo sapiens
actactcgagcccac

SEQ ID NO: 3042367 - DNA, 22 bp, Homo sapiens
actactgtagaactgattttac

SEQ ID NO: 3042368 - DNA, 20 bp, Homo sapiens
actactgtagaagaagtgaa

SEQ ID NO: 3042369 - DNA, 23 bp, Homo sapiens
actactgttatcagtaatgctaa

SEQ ID NO: 3042370 - DNA, 21 bp, Homo sapiens
actacttatctctaaaccatc

SEQ ID NO: 3042371 - DNA, 19 bp, Homo sapiens
actacttgattttattgta

SEQ ID NO: 3042372 - DNA, 17 bp, Homo sapiens
actacttgggagcaccg

SEQ ID NO: 3042373 - DNA, 19 bp, Homo sapiens
actactttgttaggatttt

SEQ ID NO: 3042374 - DNA, 15 bp, Homo sapiens
actagaaataaataa

SEQ ID NO: 3042375 - DNA, 16 bp, Homo sapiens
accaccacacccggct

SEQ ID NO: 3042376 - DNA, 14 bp, Homo sapiens
accaccaggtctcc

SEQ ID NO: 3042377 - DNA, 17 bp, Homo sapiens
accaccaggtctcccgg

SEQ ID NO: 3042378 - DNA, 12 bp, Homo sapiens
accacctcatgt

SEQ ID NO: 3042379 - DNA, 16 bp, Homo sapiens
accacctcatgtcatt

SEQ ID NO: 3042380 - DNA, 15 bp, Homo sapiens
accaccttatacatc

SEQ ID NO: 3042381 - DNA, 22 bp, Homo sapiens
accaccttatacatcacttcct

SEQ ID NO: 3042382 - DNA, 13 bp, Homo sapiens
accaccttcccag

SEQ ID NO: 3042383 - DNA, 14 bp, Homo sapiens
accaccttcccagc

SEQ ID NO: 3042384 - DNA, 16 bp, Homo sapiens
accaccttcccagctc

SEQ ID NO: 3042385 - DNA, 17 bp, Homo sapiens
accaccttcccagctct

SEQ ID NO: 3042386 - DNA, 19 bp, Homo sapiens
accaccttcccagctctcc

SEQ ID NO: 3042387 - DNA, 16 bp, Homo sapiens
accacgactggccagg

SEQ ID NO: 3042388 - DNA, 13 bp, Homo sapiens
accacgcccagct

SEQ ID NO: 3042389 - DNA, 18 bp, Homo sapiens
accacgccttgaccttcc

SEQ ID NO: 3042390 - DNA, 22 bp, Homo sapiens
accacgggacatcacagggtgg

SEQ ID NO: 3042391 - DNA, 14 bp, Homo sapiens
accactataaaatg

SEQ ID NO: 3042392 - DNA, 13 bp, Homo sapiens
accactccagaga

SEQ ID NO: 3042393 - DNA, 15 bp, Homo sapiens
accactcctgccagc

SEQ ID NO: 3042394 - DNA, 13 bp, Homo sapiens
accactcttgact

SEQ ID NO: 3042395 - DNA, 16 bp, Homo sapiens
accactgagctctgcc

SEQ ID NO: 3042396 - DNA, 17 bp, Homo sapiens
accactgagctctgcct

SEQ ID NO: 3042397 - DNA, 18 bp, Homo sapiens
accactgagctctgcctc

SEQ ID NO: 3042398 - DNA, 15 bp, Homo sapiens
accactgcaagtcct

SEQ ID NO: 3042399 - DNA, 22 bp, Homo sapiens
accactgcaagtccttttgtaa

SEQ ID NO: 3042400 - DNA, 14 bp, Homo sapiens
accactgcactcca

SEQ ID NO: 3042401 - DNA, 18 bp, Homo sapiens
accactgcactccagcct

SEQ ID NO: 3042402 - DNA, 20 bp, Homo sapiens
accactgcactccagcctgg

SEQ ID NO: 3042403 - DNA, 18 bp, Homo sapiens
accactgccattacccag

SEQ ID NO: 3042404 - DNA, 14 bp, Homo sapiens
accactgggcccct

SEQ ID NO: 3042405 - DNA, 17 bp, Homo sapiens
accactgggcccctcag

SEQ ID NO: 3042406 - DNA, 16 bp, Homo sapiens
accactggtaacatgt

SEQ ID NO: 3042407 - DNA, 15 bp, Homo sapiens
accactgtctttttc

SEQ ID NO: 3042408 - DNA, 13 bp, Homo sapiens
accacttcgaaac

SEQ ID NO: 3042409 - DNA, 22 bp, Homo sapiens
accacttggagatctttgcttc

SEQ ID NO: 3042410 - DNA, 15 bp, Homo sapiens
accactttattgcaa

SEQ ID NO: 3042411 - DNA, 17 bp, Homo sapiens
accacttttcattgcaa

SEQ ID NO: 3042412 - DNA, 20 bp, Homo sapiens
accagaagctgttgggagaa

SEQ ID NO: 3042413 - DNA, 14 bp, Homo sapiens
accagacaatgttg

SEQ ID NO: 3042414 - DNA, 21 bp, Homo sapiens
accagacaatgttgtgtttgg

SEQ ID NO: 3042415 - DNA, 14 bp, Homo sapiens
accagacacccagg

SEQ ID NO: 3042416 - DNA, 16 bp, Homo sapiens
accagacagagggtca

SEQ ID NO: 3042417 - DNA, 19 bp, Homo sapiens
accagacagagggtcacag

SEQ ID NO: 3042418 - DNA, 13 bp, Homo sapiens
accagacccttct

SEQ ID NO: 3042419 - DNA, 16 bp, Homo sapiens
accagactcgccaaca

SEQ ID NO: 3042420 - DNA, 17 bp, Homo sapiens
accagactcgccaacat

SEQ ID NO: 3042421 - DNA, 20 bp, Homo sapiens
accagagaaaaagggagggg

SEQ ID NO: 3042422 - DNA, 20 bp, Homo sapiens
accagagataatatgagaat

SEQ ID NO: 3042423 - DNA, 17 bp, Homo sapiens
accagagcaaaaatgta

SEQ ID NO: 3042424 - DNA, 21 bp, Homo sapiens
accagagcaggggctgctggg

SEQ ID NO: 3042425 - DNA, 12 bp, Homo sapiens
accagagctgcc

SEQ ID NO: 3042426 - DNA, 13 bp, Homo sapiens
accagagctgcct

SEQ ID NO: 3042427 - DNA, 15 bp, Homo sapiens
accagagctgcctcc

SEQ ID NO: 3042428 - DNA, 15 bp, Homo sapiens
accagaggaatcact

SEQ ID NO: 3042429 - DNA, 18 bp, Homo sapiens
accagaggaatcactctt

SEQ ID NO: 3042430 - DNA, 16 bp, Homo sapiens
accagaggagcctttt

SEQ ID NO: 3042431 - DNA, 20 bp, Homo sapiens
accagataaaattatagatg

SEQ ID NO: 3042432 - DNA, 21 bp, Homo sapiens
accagatgcgtcccaagatgt

SEQ ID NO: 3042433 - DNA, 22 bp, Homo sapiens
accagatgcgtcccaagatgtt

SEQ ID NO: 3042434 - DNA, 14 bp, Homo sapiens
accagcagaacagc

SEQ ID NO: 3042435 - DNA, 18 bp, Homo sapiens
accagcagcactggaacc

SEQ ID NO: 3042436 - DNA, 18 bp, Homo sapiens
accagcatcacctgcctg

SEQ ID NO: 3042437 - DNA, 10 bp, Homo sapiens
accagccact

SEQ ID NO: 3042438 - DNA, 21 bp, Homo sapiens
accagccattggctatttaaa

SEQ ID NO: 3042439 - DNA, 19 bp, Homo sapiens
accagcccatcgccacaaa

SEQ ID NO: 3042440 - DNA, 15 bp, Homo sapiens
accagccctgctgct

SEQ ID NO: 3042441 - DNA, 20 bp, Homo sapiens
accagccctgctgcttccta

SEQ ID NO: 3042442 - DNA, 23 bp, Homo sapiens
accagccctgctgcttcctaact

SEQ ID NO: 3042443 - DNA, 18 bp, Homo sapiens
accagcccttgagggaga

SEQ ID NO: 3042444 - DNA, 22 bp, Homo sapiens
accagcccttgagggagaactt

SEQ ID NO: 3042445 - DNA, 14 bp, Homo sapiens
accagccgtgagca

SEQ ID NO: 3042446 - DNA, 12 bp, Homo sapiens
accagcctcagc

SEQ ID NO: 3042447 - DNA, 13 bp, Homo sapiens
accagcctgtcca

SEQ ID NO: 3042448 - DNA, 13 bp, Homo sapiens
accagcctttctt

SEQ ID NO: 3042449 - DNA, 14 bp, Homo sapiens
accagcctttcttc

SEQ ID NO: 3042450 - DNA, 19 bp, Homo sapiens
accagcctttgggtcctgg

SEQ ID NO: 3042451 - DNA, 14 bp, Homo sapiens
accagcgaagggag

SEQ ID NO: 3042452 - DNA, 23 bp, Homo sapiens
accagcgtatatataagaaagac

SEQ ID NO: 3042453 - DNA, 10 bp, Homo sapiens
accagctgca

SEQ ID NO: 3042454 - DNA, 11 bp, Homo sapiens
accagctgcaa

SEQ ID NO: 3042455 - DNA, 13 bp, Homo sapiens
accagctgcaaag

SEQ ID NO: 3042456 - DNA, 15 bp, Homo sapiens
accagctgcaaagtg

SEQ ID NO: 3042457 - DNA, 19 bp, Homo sapiens
accaggaatatttcctcca

SEQ ID NO: 3042458 - DNA, 15 bp, Homo sapiens
accaggacaggacca

SEQ ID NO: 3042459 - DNA, 14 bp, Homo sapiens
accaggacccaggg

SEQ ID NO: 3042460 - DNA, 16 bp, Homo sapiens
accaggacccagggag

SEQ ID NO: 3042461 - DNA, 17 bp, Homo sapiens
accaggacccagggaga

SEQ ID NO: 3042462 - DNA, 14 bp, Homo sapiens
accaggagcacctg

SEQ ID NO: 3042463 - DNA, 16 bp, Homo sapiens
accaggatagagactg

SEQ ID NO: 3042464 - DNA, 18 bp, Homo sapiens
accaggcacatggctggg

SEQ ID NO: 3042465 - DNA, 20 bp, Homo sapiens
accaggcacgaacccacctg

SEQ ID NO: 3042466 - DNA, 12 bp, Homo sapiens
accaggccctgg

SEQ ID NO: 3042467 - DNA, 15 bp, Homo sapiens
accaggccctggcta

SEQ ID NO: 3042468 - DNA, 20 bp, Homo sapiens
accaggcctcactggctcat

SEQ ID NO: 3042469 - DNA, 13 bp, Homo sapiens
accaggctgggca

SEQ ID NO: 3042470 - DNA, 15 bp, Homo sapiens
accagggcagggcca

SEQ ID NO: 3042471 - DNA, 18 bp, Homo sapiens
accaggggtaccaggcac

SEQ ID NO: 3042472 - DNA, 21 bp, Homo sapiens
accagggttgaccccagagga

SEQ ID NO: 3042473 - DNA, 14 bp, Homo sapiens
accaggtcctgctc

SEQ ID NO: 3042474 - DNA, 23 bp, Homo sapiens
accaggtgcctttcaaatttaga

SEQ ID NO: 3042475 - DNA, 15 bp, Homo sapiens
accaggtttgcacct

SEQ ID NO: 3042476 - DNA, 18 bp, Homo sapiens
accagtaggatatttcta

SEQ ID NO: 3042477 - DNA, 18 bp, Homo sapiens
accagtagtcacctctgg

SEQ ID NO: 3042478 - DNA, 13 bp, Homo sapiens
accagtccctgtc

SEQ ID NO: 3042479 - DNA, 13 bp, Homo sapiens
accagtgaatttt

SEQ ID NO: 3042480 - DNA, 18 bp, Homo sapiens
accagtgaatttttgcaa

SEQ ID NO: 3042481 - DNA, 14 bp, Homo sapiens
accagtgagtggcc

SEQ ID NO: 3042482 - DNA, 18 bp, Homo sapiens
accagtgagtggccccac

SEQ ID NO: 3042483 - DNA, 16 bp, Homo sapiens
accagtgggcatgtat

SEQ ID NO: 3042484 - DNA, 20 bp, Homo sapiens
accagtgtaaattcagtctt

SEQ ID NO: 3042485 - DNA, 22 bp, Homo sapiens
accagtgtgacaggaaagattc

SEQ ID NO: 3042486 - DNA, 17 bp, Homo sapiens
accagtttcttaaactg

SEQ ID NO: 3042487 - DNA, 21 bp, Homo sapiens
accagtttcttttcttttgtt

SEQ ID NO: 3042488 - DNA, 21 bp, Homo sapiens
accatagttatttacttgaaa

SEQ ID NO: 3042489 - DNA, 17 bp, Homo sapiens
accatatagcaaaactt

SEQ ID NO: 3042490 - DNA, 21 bp, Homo sapiens
accatatagcaaaacttttaa

SEQ ID NO: 3042491 - DNA, 14 bp, Homo sapiens
accatatttgaatt

SEQ ID NO: 3042492 - DNA, 14 bp, Homo sapiens
actagtttatgcta

SEQ ID NO: 3042493 - DNA, 18 bp, Homo sapiens
actataaaatgtcttcaa

SEQ ID NO: 3042494 - DNA, 20 bp, Homo sapiens
actataaagttttatttgaa

SEQ ID NO: 3042495 - DNA, 16 bp, Homo sapiens
actataaatacaaatc

SEQ ID NO: 3042496 - DNA, 18 bp, Homo sapiens
actataaatacaaatctg

SEQ ID NO: 3042497 - DNA, 14 bp, Homo sapiens
actataagaacttt

SEQ ID NO: 3042498 - DNA, 18 bp, Homo sapiens
actataagaactttgagc

SEQ ID NO: 3042499 - DNA, 18 bp, Homo sapiens
actatattgattgtcctt

SEQ ID NO: 3042500 - DNA, 19 bp, Homo sapiens
actatattgattgtccttt

SEQ ID NO: 3042501 - DNA, 15 bp, Homo sapiens
actatcaaaattgcc

SEQ ID NO: 3042502 - DNA, 17 bp, Homo sapiens
actatgcagaggcctgg

SEQ ID NO: 3042503 - DNA, 21 bp, Homo sapiens
actatgcatggtgccccagga

SEQ ID NO: 3042504 - DNA, 22 bp, Homo sapiens
actatgcatggtgccccaggac

SEQ ID NO: 3042505 - DNA, 24 bp, Homo sapiens
actatgcatggtgccccaggacca

SEQ ID NO: 3042506 - DNA, 12 bp, Homo sapiens
actatgcctgtg

SEQ ID NO: 3042507 - DNA, 16 bp, Homo sapiens
actatgcctgtgtctt

SEQ ID NO: 3042508 - DNA, 19 bp, Homo sapiens
actatggaatgtcagtgtt

SEQ ID NO: 3042509 - DNA, 21 bp, Homo sapiens
actatggataaactaaacacg

SEQ ID NO: 3042510 - DNA, 24 bp, Homo sapiens
actatggataaactaaacacgtga

SEQ ID NO: 3042511 - DNA, 12 bp, Homo sapiens
actatggttttt

SEQ ID NO: 3042512 - DNA, 14 bp, Homo sapiens
actatgtaacatgt

SEQ ID NO: 3042513 - DNA, 22 bp, Homo sapiens
actatgtgggacacctcaaata

SEQ ID NO: 3042514 - DNA, 13 bp, Homo sapiens
actattcaaggat

SEQ ID NO: 3042515 - DNA, 14 bp, Homo sapiens
actattcagttgtg

SEQ ID NO: 3042516 - DNA, 22 bp, Homo sapiens
actattccatcaataggcaaaa

SEQ ID NO: 3042517 - DNA, 20 bp, Homo sapiens
actattccctaggacaagga

SEQ ID NO: 3042518 - DNA, 15 bp, Homo sapiens
actattgcattttac

SEQ ID NO: 3042519 - DNA, 23 bp, Homo sapiens
actattgtgttttttttttttgg

SEQ ID NO: 3042520 - DNA, 21 bp, Homo sapiens
actatttatataacattagat

SEQ ID NO: 3042521 - DNA, 14 bp, Homo sapiens
actatttcttcaga

SEQ ID NO: 3042522 - DNA, 15 bp, Homo sapiens
actatttcttcagag

SEQ ID NO: 3042523 - DNA, 11 bp, Homo sapiens
actatttgtga

SEQ ID NO: 3042524 - DNA, 14 bp, Homo sapiens
actatttgtgactt

SEQ ID NO: 3042525 - DNA, 17 bp, Homo sapiens
actatttttctttccaa

SEQ ID NO: 3042526 - DNA, 18 bp, Homo sapiens
actcaaaatctgtcataa

SEQ ID NO: 3042527 - DNA, 22 bp, Homo sapiens
actcaaacttctggctccctct

SEQ ID NO: 3042528 - DNA, 22 bp, Homo sapiens
actcaaagtttcagagaccatt

SEQ ID NO: 3042529 - DNA, 20 bp, Homo sapiens
actcaaatggggccagatcc

SEQ ID NO: 3042530 - DNA, 16 bp, Homo sapiens
actcaaatgttctaag

SEQ ID NO: 3042531 - DNA, 17 bp, Homo sapiens
actcaaatgttctaagt

SEQ ID NO: 3042532 - DNA, 18 bp, Homo sapiens
actcaaatgttctaagtt

SEQ ID NO: 3042533 - DNA, 22 bp, Homo sapiens
actcaaatgttctaagtttcta

SEQ ID NO: 3042534 - DNA, 11 bp, Homo sapiens
actcaagccaa

SEQ ID NO: 3042535 - DNA, 18 bp, Homo sapiens
actcaagttgtttaactg

SEQ ID NO: 3042536 - DNA, 18 bp, Homo sapiens
actcaatccatccatgta

SEQ ID NO: 3042537 - DNA, 16 bp, Homo sapiens
actcaatggatttgat

SEQ ID NO: 3042538 - DNA, 22 bp, Homo sapiens
actcaatgggagaatcagcaga

SEQ ID NO: 3042539 - DNA, 21 bp, Homo sapiens
actcacaacctgaacctagga

SEQ ID NO: 3042540 - DNA, 18 bp, Homo sapiens
actcacatagccaactct

SEQ ID NO: 3042541 - DNA, 21 bp, Homo sapiens
actcacatagccaactctccc

SEQ ID NO: 3042542 - DNA, 22 bp, Homo sapiens
actcaccatatttgaattggcc

SEQ ID NO: 3042543 - DNA, 23 bp, Homo sapiens
actcaccccaaacccagaacatg

SEQ ID NO: 3042544 - DNA, 13 bp, Homo sapiens
actcacctctgcc

SEQ ID NO: 3042545 - DNA, 16 bp, Homo sapiens
actcacctctgcctca

SEQ ID NO: 3042546 - DNA, 18 bp, Homo sapiens
actcactggcagccccag

SEQ ID NO: 3042547 - DNA, 20 bp, Homo sapiens
actcactggcagccccagca

SEQ ID NO: 3042548 - DNA, 22 bp, Homo sapiens
actcactggggcctacagcttt

SEQ ID NO: 3042549 - DNA, 15 bp, Homo sapiens
actcagaaacatcag

SEQ ID NO: 3042550 - DNA, 21 bp, Homo sapiens
actcagaaatttaattcatgt

SEQ ID NO: 3042551 - DNA, 21 bp, Homo sapiens
actcagaactgtcggaggaaa

SEQ ID NO: 3042552 - DNA, 16 bp, Homo sapiens
actcagaagcctctgg

SEQ ID NO: 3042553 - DNA, 15 bp, Homo sapiens
actcagaatgaaaat

SEQ ID NO: 3042554 - DNA, 16 bp, Homo sapiens
actcagaatgggggct

SEQ ID NO: 3042555 - DNA, 15 bp, Homo sapiens
actcagaccagagaa

SEQ ID NO: 3042556 - DNA, 20 bp, Homo sapiens
actcagagctgcgggctgag

SEQ ID NO: 3042557 - DNA, 21 bp, Homo sapiens
actcagagctgcgggctgagg

SEQ ID NO: 3042558 - DNA, 11 bp, Homo sapiens
actcagagctt

SEQ ID NO: 3042559 - DNA, 22 bp, Homo sapiens
actcagataaggtaaaatgcca

SEQ ID NO: 3042560 - DNA, 12 bp, Homo sapiens
actcagatccag

SEQ ID NO: 3042561 - DNA, 14 bp, Homo sapiens
actcagcagccctc

SEQ ID NO: 3042562 - DNA, 21 bp, Homo sapiens
actcagcagccctcctcaccc

SEQ ID NO: 3042563 - DNA, 23 bp, Homo sapiens
actcagcagccctcctcaccccg

SEQ ID NO: 3042564 - DNA, 23 bp, Homo sapiens
actcagcatttgattaacatttg

SEQ ID NO: 3042565 - DNA, 16 bp, Homo sapiens
actcagccaagcacag

SEQ ID NO: 3042566 - DNA, 22 bp, Homo sapiens
actcagccatttctaagcagat

SEQ ID NO: 3042567 - DNA, 15 bp, Homo sapiens
actcagcccctaccc

SEQ ID NO: 3042568 - DNA, 19 bp, Homo sapiens
actcagcccctacccctgc

SEQ ID NO: 3042569 - DNA, 21 bp, Homo sapiens
actcagccctcattggctctt

SEQ ID NO: 3042570 - DNA, 13 bp, Homo sapiens
actcagccctggg

SEQ ID NO: 3042571 - DNA, 21 bp, Homo sapiens
actcagccctgggccccacca

SEQ ID NO: 3042572 - DNA, 22 bp, Homo sapiens
actcagccctgggccccaccac

SEQ ID NO: 3042573 - DNA, 12 bp, Homo sapiens
actcagcctgca

SEQ ID NO: 3042574 - DNA, 11 bp, Homo sapiens
actcagctctg

SEQ ID NO: 3042575 - DNA, 12 bp, Homo sapiens
actcaggaggct

SEQ ID NO: 3042576 - DNA, 14 bp, Homo sapiens
actcaggctctcca

SEQ ID NO: 3042577 - DNA, 21 bp, Homo sapiens
actcagggcagcgccaggctg

SEQ ID NO: 3042578 - DNA, 22 bp, Homo sapiens
actcagggcagcgccaggctga

SEQ ID NO: 3042579 - DNA, 15 bp, Homo sapiens
actcagggcagctgc

SEQ ID NO: 3042580 - DNA, 17 bp, Homo sapiens
actcagggcagctgcct

SEQ ID NO: 3042581 - DNA, 21 bp, Homo sapiens
actcagggcagctgcctggcc

SEQ ID NO: 3042582 - DNA, 16 bp, Homo sapiens
actcagggctcctggg

SEQ ID NO: 3042583 - DNA, 15 bp, Homo sapiens
actcaggggtcactg

SEQ ID NO: 3042584 - DNA, 21 bp, Homo sapiens
actcaggttcacagcagcttt

SEQ ID NO: 3042585 - DNA, 11 bp, Homo sapiens
actcagtgcag

SEQ ID NO: 3042586 - DNA, 14 bp, Homo sapiens
actcataatgtgaa

SEQ ID NO: 3042587 - DNA, 18 bp, Homo sapiens
actcatagatgttatgca

SEQ ID NO: 3042588 - DNA, 13 bp, Homo sapiens
actcatcactgtg

SEQ ID NO: 3042589 - DNA, 16 bp, Homo sapiens
actcatcactgtggct

SEQ ID NO: 3042590 - DNA, 16 bp, Homo sapiens
actcatcctgaacagc

SEQ ID NO: 3042591 - DNA, 17 bp, Homo sapiens
actcatcgggcccaggg

SEQ ID NO: 3042592 - DNA, 18 bp, Homo sapiens
actcatcgggcccaggga

SEQ ID NO: 3042593 - DNA, 19 bp, Homo sapiens
actcatcgggcccagggac

SEQ ID NO: 3042594 - DNA, 19 bp, Homo sapiens
actcatcttactgtacctg

SEQ ID NO: 3042595 - DNA, 14 bp, Homo sapiens
actcatgcctctga

SEQ ID NO: 3042596 - DNA, 18 bp, Homo sapiens
actcatgcctctgagctt

SEQ ID NO: 3042597 - DNA, 12 bp, Homo sapiens
actcatgtgtat

SEQ ID NO: 3042598 - DNA, 21 bp, Homo sapiens
actcattagactggaacttga

SEQ ID NO: 3042599 - DNA, 15 bp, Homo sapiens
actcattctgaagga

SEQ ID NO: 3042600 - DNA, 16 bp, Homo sapiens
actcattgaaatgtaa

SEQ ID NO: 3042601 - DNA, 15 bp, Homo sapiens
actcattgctgagcc

SEQ ID NO: 3042602 - DNA, 20 bp, Homo sapiens
actcattgctgagcctctgc

SEQ ID NO: 3042603 - DNA, 16 bp, Homo sapiens
actcatttcctatgta

SEQ ID NO: 3042604 - DNA, 14 bp, Homo sapiens
actccatttctttc

SEQ ID NO: 3042605 - DNA, 19 bp, Homo sapiens
actccatttctttcttcca

SEQ ID NO: 3042606 - DNA, 20 bp, Homo sapiens
actcccacccagtctctgct

SEQ ID NO: 3042607 - DNA, 14 bp, Homo sapiens
actcccactcctaa

SEQ ID NO: 3042608 - DNA, 18 bp, Homo sapiens
actcccgccccgggctgg

SEQ ID NO: 3042609 - DNA, 21 bp, Homo sapiens
actcccgccccgggctggccc

SEQ ID NO: 3042610 - DNA, 14 bp, Homo sapiens
actccctacactga

SEQ ID NO: 3042611 - DNA, 16 bp, Homo sapiens
actccctacactgatg

SEQ ID NO: 3042612 - DNA, 18 bp, Homo sapiens
actccctacactgatgca

SEQ ID NO: 3042613 - DNA, 23 bp, Homo sapiens
actccctacactgatgcaaggat

SEQ ID NO: 3042614 - DNA, 18 bp, Homo sapiens
actccctaggcccaagtc

SEQ ID NO: 3042615 - DNA, 21 bp, Homo sapiens
actccctccatagcgacaccc

SEQ ID NO: 3042616 - DNA, 12 bp, Homo sapiens
actccctcccca

SEQ ID NO: 3042617 - DNA, 20 bp, Homo sapiens
actccctccccacccaagag

SEQ ID NO: 3042618 - DNA, 16 bp, Homo sapiens
actccctcctggagct

SEQ ID NO: 3042619 - DNA, 13 bp, Homo sapiens
actccctggcctt

SEQ ID NO: 3042620 - DNA, 13 bp, Homo sapiens
actccggccctcc

SEQ ID NO: 3042621 - DNA, 15 bp, Homo sapiens
actccggcctgggtg

SEQ ID NO: 3042622 - DNA, 15 bp, Homo sapiens
actccgtgaggctgc

SEQ ID NO: 3042623 - DNA, 23 bp, Homo sapiens
actccgtgaggctgctgccatcc

SEQ ID NO: 3042624 - DNA, 16 bp, Homo sapiens
actcctaatcaagagt

SEQ ID NO: 3042625 - DNA, 22 bp, Homo sapiens
actcctaatcaagagtctctcc

SEQ ID NO: 3042626 - DNA, 24 bp, Homo sapiens
actcctaatcaagagtctctccag

SEQ ID NO: 3042627 - DNA, 22 bp, Homo sapiens
actcctactgcttcctctgaat

SEQ ID NO: 3042628 - DNA, 14 bp, Homo sapiens
actcctaggccctt

SEQ ID NO: 3042629 - DNA, 15 bp, Homo sapiens
actcctccccaccct

SEQ ID NO: 3042630 - DNA, 21 bp, Homo sapiens
actcctccccaccctcctggc

SEQ ID NO: 3042631 - DNA, 12 bp, Homo sapiens
actcctcctgcc

SEQ ID NO: 3042632 - DNA, 13 bp, Homo sapiens
actcctcctgcca

SEQ ID NO: 3042633 - DNA, 15 bp, Homo sapiens
actcctcctgccagc

SEQ ID NO: 3042634 - DNA, 19 bp, Homo sapiens
actcctcctgccagctctg

SEQ ID NO: 3042635 - DNA, 22 bp, Homo sapiens
actcctcctgccagctctgtca

SEQ ID NO: 3042636 - DNA, 22 bp, Homo sapiens
actcctctcaactgcctcagcg

SEQ ID NO: 3042637 - DNA, 19 bp, Homo sapiens
actcctgaaggtctgggtc

SEQ ID NO: 3042638 - DNA, 12 bp, Homo sapiens
actcctgatttt

SEQ ID NO: 3042639 - DNA, 17 bp, Homo sapiens
actcctgccaaggagga

SEQ ID NO: 3042640 - DNA, 20 bp, Homo sapiens
actcctgccaccagcatcca

SEQ ID NO: 3042641 - DNA, 14 bp, Homo sapiens
actcctgccagccc

SEQ ID NO: 3042642 - DNA, 17 bp, Homo sapiens
actcctggcctcaagcc

SEQ ID NO: 3042643 - DNA, 20 bp, Homo sapiens
actccttccccttgtccctg

SEQ ID NO: 3042644 - DNA, 22 bp, Homo sapiens
actccttccccttgtccctggg

SEQ ID NO: 3042645 - DNA, 11 bp, Homo sapiens
actccttgcat

SEQ ID NO: 3042646 - DNA, 20 bp, Homo sapiens
actccttgcatcaaggggtc

SEQ ID NO: 3042647 - DNA, 17 bp, Homo sapiens
actcctttcagccacat

SEQ ID NO: 3042648 - DNA, 19 bp, Homo sapiens
actcctttggtatttcact

SEQ ID NO: 3042649 - DNA, 14 bp, Homo sapiens
actcgaaaataagg

SEQ ID NO: 3042650 - DNA, 18 bp, Homo sapiens
actcgagaccataaagat

SEQ ID NO: 3042651 - DNA, 21 bp, Homo sapiens
actcgaggactgtatttgtga

SEQ ID NO: 3042652 - DNA, 16 bp, Homo sapiens
actcgccatttcctca

SEQ ID NO: 3042653 - DNA, 13 bp, Homo sapiens
actcgcctcagcc

SEQ ID NO: 3042654 - DNA, 17 bp, Homo sapiens
actcgcctcagcctgat

SEQ ID NO: 3042655 - DNA, 16 bp, Homo sapiens
actcggcccagggccg

SEQ ID NO: 3042656 - DNA, 22 bp, Homo sapiens
actcggctttggagactttctt

SEQ ID NO: 3042657 - DNA, 20 bp, Homo sapiens
actcgggaggctgaggcaca

SEQ ID NO: 3042658 - DNA, 21 bp, Homo sapiens
actcgggaggctgaggcacaa

SEQ ID NO: 3042659 - DNA, 12 bp, Homo sapiens
actctaagatct

SEQ ID NO: 3042660 - DNA, 13 bp, Homo sapiens
actctaagatctt

SEQ ID NO: 3042661 - DNA, 17 bp, Homo sapiens
actctaagatcttagat

SEQ ID NO: 3042662 - DNA, 21 bp, Homo sapiens
actctacatgtaactatttct

SEQ ID NO: 3042663 - DNA, 14 bp, Homo sapiens
actctacatttaaa

SEQ ID NO: 3042664 - DNA, 16 bp, Homo sapiens
actctacatttaaaca

SEQ ID NO: 3042665 - DNA, 18 bp, Homo sapiens
actctaccagtgcaggct

SEQ ID NO: 3042666 - DNA, 14 bp, Homo sapiens
actctagagtccaa

SEQ ID NO: 3042667 - DNA, 19 bp, Homo sapiens
actctagagtccaaggttt

SEQ ID NO: 3042668 - DNA, 20 bp, Homo sapiens
actctagatacctaaaacat

SEQ ID NO: 3042669 - DNA, 21 bp, Homo sapiens
actctagatgaagttttacat

SEQ ID NO: 3042670 - DNA, 17 bp, Homo sapiens
actctaggtgcccttgg

SEQ ID NO: 3042671 - DNA, 20 bp, Homo sapiens
actctatcggagaacatgaa

SEQ ID NO: 3042672 - DNA, 23 bp, Homo sapiens
actctatcggagaacatgaatca

SEQ ID NO: 3042673 - DNA, 14 bp, Homo sapiens
actctcagtctctg

SEQ ID NO: 3042674 - DNA, 18 bp, Homo sapiens
actctcagtctctgagca

SEQ ID NO: 3042675 - DNA, 15 bp, Homo sapiens
actctcattccccag

SEQ ID NO: 3042676 - DNA, 17 bp, Homo sapiens
actctcattccccaggt

SEQ ID NO: 3042677 - DNA, 19 bp, Homo sapiens
actctccaatgttctatta

SEQ ID NO: 3042678 - DNA, 19 bp, Homo sapiens
actctcccaaagggcacac

SEQ ID NO: 3042679 - DNA, 19 bp, Homo sapiens
actctccccacgagggctg

SEQ ID NO: 3042680 - DNA, 18 bp, Homo sapiens
actctcccctccccatct

SEQ ID NO: 3042681 - DNA, 15 bp, Homo sapiens
actctcctatgcctt

SEQ ID NO: 3042682 - DNA, 23 bp, Homo sapiens
actctcctgcctcagcctcccca

SEQ ID NO: 3042683 - DNA, 12 bp, Homo sapiens
actctctcccag

SEQ ID NO: 3042684 - DNA, 21 bp, Homo sapiens
actctctgaacccctccctcc

SEQ ID NO: 3042685 - DNA, 15 bp, Homo sapiens
actctctgagtacat

SEQ ID NO: 3042686 - DNA, 19 bp, Homo sapiens
actctctgagtacattgtg

SEQ ID NO: 3042687 - DNA, 21 bp, Homo sapiens
actctctgcttggattcacta

SEQ ID NO: 3042688 - DNA, 15 bp, Homo sapiens
actctctgtcttctc

SEQ ID NO: 3042689 - DNA, 16 bp, Homo sapiens
actctctgtcttctct

SEQ ID NO: 3042690 - DNA, 14 bp, Homo sapiens
actctcttcccttt

SEQ ID NO: 3042691 - DNA, 15 bp, Homo sapiens
actctcttcttccat

SEQ ID NO: 3042692 - DNA, 23 bp, Homo sapiens
actctcttcttccattagaatgc

SEQ ID NO: 3042693 - DNA, 23 bp, Homo sapiens
actctgaagctgacgaacttcca

SEQ ID NO: 3042694 - DNA, 19 bp, Homo sapiens
actctgagacaaaagaaaa

SEQ ID NO: 3042695 - DNA, 20 bp, Homo sapiens
actctgagacaaaagaaaaa

SEQ ID NO: 3042696 - DNA, 22 bp, Homo sapiens
actctgatagaattatttcaca

SEQ ID NO: 3042697 - DNA, 23 bp, Homo sapiens
actctgcaagtgtctggagcggc

SEQ ID NO: 3042698 - DNA, 13 bp, Homo sapiens
actctgcacatgt

SEQ ID NO: 3042699 - DNA, 13 bp, Homo sapiens
actctgccccccc

SEQ ID NO: 3042700 - DNA, 11 bp, Homo sapiens
actctgccctc

SEQ ID NO: 3042701 - DNA, 14 bp, Homo sapiens
actctgccctctgc

SEQ ID NO: 3042702 - DNA, 14 bp, Homo sapiens
actctgcctgcctg

SEQ ID NO: 3042703 - DNA, 19 bp, Homo sapiens
actctgcggatagcatttg

SEQ ID NO: 3042704 - DNA, 18 bp, Homo sapiens
actctgcggcccgggccg

SEQ ID NO: 3042705 - DNA, 23 bp, Homo sapiens
actctgctgtctaacctgtgacc

SEQ ID NO: 3042706 - DNA, 15 bp, Homo sapiens
actctggcttggcct

SEQ ID NO: 3042707 - DNA, 14 bp, Homo sapiens
actctgggctccag

SEQ ID NO: 3042708 - DNA, 16 bp, Homo sapiens
actctgggctccagag

SEQ ID NO: 3042709 - DNA, 22 bp, Homo sapiens
actctggttcttttaaaattaa

SEQ ID NO: 3042710 - DNA, 17 bp, Homo sapiens
actctgttccttcacat

SEQ ID NO: 3042711 - DNA, 15 bp, Homo sapiens
actctgttgaatatt

SEQ ID NO: 3042712 - DNA, 16 bp, Homo sapiens
actctgttgaatattt

SEQ ID NO: 3042713 - DNA, 22 bp, Homo sapiens
actctgttgaatatttagcata

SEQ ID NO: 3042714 - DNA, 17 bp, Homo sapiens
actctgttgatctaccc

SEQ ID NO: 3042715 - DNA, 15 bp, Homo sapiens
actctgttgcctcct

SEQ ID NO: 3042716 - DNA, 16 bp, Homo sapiens
actctgttgcctcctc

SEQ ID NO: 3042717 - DNA, 18 bp, Homo sapiens
actctgttgcctcctctc

SEQ ID NO: 3042718 - DNA, 13 bp, Homo sapiens
actctgtttttca

SEQ ID NO: 3042719 - DNA, 21 bp, Homo sapiens
actcttaaaaatgttttttca

SEQ ID NO: 3042720 - DNA, 13 bp, Homo sapiens
actcttaagccat

SEQ ID NO: 3042721 - DNA, 14 bp, Homo sapiens
actcttaagccatc

SEQ ID NO: 3042722 - DNA, 19 bp, Homo sapiens
actcttaagtcctaaaagt

SEQ ID NO: 3042723 - DNA, 23 bp, Homo sapiens
actcttaccatcccggtgcatgc

SEQ ID NO: 3042724 - DNA, 10 bp, Homo sapiens
actcttaggc

SEQ ID NO: 3042725 - DNA, 18 bp, Homo sapiens
actcttccaccagagcag

SEQ ID NO: 3042726 - DNA, 20 bp, Homo sapiens
actcttccaccagagcaggg

SEQ ID NO: 3042727 - DNA, 16 bp, Homo sapiens
actcttcccttcccct

SEQ ID NO: 3042728 - DNA, 20 bp, Homo sapiens
actcttcctcatcctgcttc

SEQ ID NO: 3042729 - DNA, 18 bp, Homo sapiens
actcttctatgacccagc

SEQ ID NO: 3042730 - DNA, 19 bp, Homo sapiens
actcttctctccaaggaaa

SEQ ID NO: 3042731 - DNA, 15 bp, Homo sapiens
actcttgaagtccag

SEQ ID NO: 3042732 - DNA, 21 bp, Homo sapiens
actcttgaagtccaggactgg

SEQ ID NO: 3042733 - DNA, 16 bp, Homo sapiens
actcttgattatccat

SEQ ID NO: 3042734 - DNA, 20 bp, Homo sapiens
actcttgtattgctccattt

SEQ ID NO: 3042735 - DNA, 14 bp, Homo sapiens
actctttctcccta

SEQ ID NO: 3042736 - DNA, 21 bp, Homo sapiens
actctttctgtatatactttt

SEQ ID NO: 3042737 - DNA, 16 bp, Homo sapiens
actctttgctttgtag

SEQ ID NO: 3042738 - DNA, 18 bp, Homo sapiens
actctttgctttgtagtt

SEQ ID NO: 3042739 - DNA, 21 bp, Homo sapiens
actctttgctttgtagtttgc

SEQ ID NO: 3042740 - DNA, 14 bp, Homo sapiens
aattccagatttgt

SEQ ID NO: 3042741 - DNA, 15 bp, Homo sapiens
aattccagttgcaat

SEQ ID NO: 3042742 - DNA, 19 bp, Homo sapiens
aattccagttgcaattcat

SEQ ID NO: 3042743 - DNA, 16 bp, Homo sapiens
aattccatcttgtaaa

SEQ ID NO: 3042744 - DNA, 16 bp, Homo sapiens
aattccatgaatcgct

SEQ ID NO: 3042745 - DNA, 15 bp, Homo sapiens
aattcccttttaatc

SEQ ID NO: 3042746 - DNA, 13 bp, Homo sapiens
aattcctaacttt

SEQ ID NO: 3042747 - DNA, 17 bp, Homo sapiens
aattcctacaacttaat

SEQ ID NO: 3042748 - DNA, 21 bp, Homo sapiens
aattcctcatcctcagatgct

SEQ ID NO: 3042749 - DNA, 23 bp, Homo sapiens
aattccttcagggtgatgccagg

SEQ ID NO: 3042750 - DNA, 19 bp, Homo sapiens
aattcgatgcgtattctgt

SEQ ID NO: 3042751 - DNA, 14 bp, Homo sapiens
aattcgcatgttta

SEQ ID NO: 3042752 - DNA, 20 bp, Homo sapiens
aattcgttgaaacgatttca

SEQ ID NO: 3042753 - DNA, 16 bp, Homo sapiens
aattctactaagttat

SEQ ID NO: 3042754 - DNA, 17 bp, Homo sapiens
aattctagcttttttcc

SEQ ID NO: 3042755 - DNA, 13 bp, Homo sapiens
aattctatactgt

SEQ ID NO: 3042756 - DNA, 14 bp, Homo sapiens
aattctatactgtt

SEQ ID NO: 3042757 - DNA, 15 bp, Homo sapiens
aattctattaaagtg

SEQ ID NO: 3042758 - DNA, 16 bp, Homo sapiens
aattctcaaagtttta

SEQ ID NO: 3042759 - DNA, 19 bp, Homo sapiens
aattctcctgcctcagcct

SEQ ID NO: 3042760 - DNA, 15 bp, Homo sapiens
aattctcctgccttt

SEQ ID NO: 3042761 - DNA, 20 bp, Homo sapiens
aattctctgtggaatgaata

SEQ ID NO: 3042762 - DNA, 19 bp, Homo sapiens
aattctgaatttgcaaagt

SEQ ID NO: 3042763 - DNA, 20 bp, Homo sapiens
aattctgaatttgcaaagta

SEQ ID NO: 3042764 - DNA, 13 bp, Homo sapiens
aattctgctgtta

SEQ ID NO: 3042765 - DNA, 22 bp, Homo sapiens
aattctgctgttacgacaaaga

SEQ ID NO: 3042766 - DNA, 15 bp, Homo sapiens
aattctggtcctgtt

SEQ ID NO: 3042767 - DNA, 17 bp, Homo sapiens
aattctggtcctgtttt

SEQ ID NO: 3042768 - DNA, 19 bp, Homo sapiens
aattctgtttttaatgcta

SEQ ID NO: 3042769 - DNA, 20 bp, Homo sapiens
aattcttaaaaaattgaaaa

SEQ ID NO: 3042770 - DNA, 21 bp, Homo sapiens
aattcttaatttggatctatt

SEQ ID NO: 3042771 - DNA, 21 bp, Homo sapiens
aattcttatttttaatttttc

SEQ ID NO: 3042772 - DNA, 18 bp, Homo sapiens
aattcttcaggtggaaaa

SEQ ID NO: 3042773 - DNA, 22 bp, Homo sapiens
aattcttcctgtttgtgtaata

SEQ ID NO: 3042774 - DNA, 18 bp, Homo sapiens
aattcttggttgaggaaa

SEQ ID NO: 3042775 - DNA, 22 bp, Homo sapiens
aattctttatacaacagtgcta

SEQ ID NO: 3042776 - DNA, 14 bp, Homo sapiens
aattcttttgaatt

SEQ ID NO: 3042777 - DNA, 13 bp, Homo sapiens
aattcttttgcca

SEQ ID NO: 3042778 - DNA, 12 bp, Homo sapiens
aattgaaatttt

SEQ ID NO: 3042779 - DNA, 23 bp, Homo sapiens
aattgaagatgtaaggaattgaa

SEQ ID NO: 3042780 - DNA, 23 bp, Homo sapiens
aattgaataatggtaccagataa

SEQ ID NO: 3042781 - DNA, 23 bp, Homo sapiens
aattgacagatcaagctgtgaga

SEQ ID NO: 3042782 - DNA, 16 bp, Homo sapiens
aattgacattctctat

SEQ ID NO: 3042783 - DNA, 12 bp, Homo sapiens
aattgagacagt

SEQ ID NO: 3042784 - DNA, 19 bp, Homo sapiens
aattgagatgattaaaatg

SEQ ID NO: 3042785 - DNA, 15 bp, Homo sapiens
aattgattaaaatct

SEQ ID NO: 3042786 - DNA, 14 bp, Homo sapiens
aattgatttgcatt

SEQ ID NO: 3042787 - DNA, 23 bp, Homo sapiens
aattgatttgcattgaacacaaa

SEQ ID NO: 3042788 - DNA, 18 bp, Homo sapiens
aattgcacagaagtcctg

SEQ ID NO: 3042789 - DNA, 22 bp, Homo sapiens
aattgcacagaagtcctgtatg

SEQ ID NO: 3042790 - DNA, 16 bp, Homo sapiens
aattgcactgaagttt

SEQ ID NO: 3042791 - DNA, 15 bp, Homo sapiens
aattgccaatcttgt

SEQ ID NO: 3042792 - DNA, 18 bp, Homo sapiens
aattgcgttggtctctgc

SEQ ID NO: 3042793 - DNA, 19 bp, Homo sapiens
aattgctgttgaaagcaaa

SEQ ID NO: 3042794 - DNA, 20 bp, Homo sapiens
aattgctgttgaaagcaaaa

SEQ ID NO: 3042795 - DNA, 16 bp, Homo sapiens
aattggaaaagagtta

SEQ ID NO: 3042796 - DNA, 16 bp, Homo sapiens
aattggcctgaacaga

SEQ ID NO: 3042797 - DNA, 17 bp, Homo sapiens
aattggcctgaacagat

SEQ ID NO: 3042798 - DNA, 19 bp, Homo sapiens
aattggcctgaacagatgt

SEQ ID NO: 3042799 - DNA, 17 bp, Homo sapiens
aattggccttcgatttt

SEQ ID NO: 3042800 - DNA, 13 bp, Homo sapiens
aattggtcattcc

SEQ ID NO: 3042801 - DNA, 20 bp, Homo sapiens
aattggtgtatatcatgaag

SEQ ID NO: 3042802 - DNA, 15 bp, Homo sapiens
aattggttctttatt

SEQ ID NO: 3042803 - DNA, 15 bp, Homo sapiens
aattggttgtatata

SEQ ID NO: 3042804 - DNA, 18 bp, Homo sapiens
aattggttgtatataaag

SEQ ID NO: 3042805 - DNA, 17 bp, Homo sapiens
aattgtactaaagccaa

SEQ ID NO: 3042806 - DNA, 15 bp, Homo sapiens
aattgtataacaggt

SEQ ID NO: 3042807 - DNA, 18 bp, Homo sapiens
aattgtataacaggttat

SEQ ID NO: 3042808 - DNA, 19 bp, Homo sapiens
aattgtatcgtatagctgt

SEQ ID NO: 3042809 - DNA, 21 bp, Homo sapiens
aattgtatcgtatagctgtat

SEQ ID NO: 3042810 - DNA, 17 bp, Homo sapiens
aattgtccgtgttcata

SEQ ID NO: 3042811 - DNA, 16 bp, Homo sapiens
aattgtcttcatgtac

SEQ ID NO: 3042812 - DNA, 20 bp, Homo sapiens
aattgtgaccaatacatttg

SEQ ID NO: 3042813 - DNA, 15 bp, Homo sapiens
aattgttccttgctt

SEQ ID NO: 3042814 - DNA, 21 bp, Homo sapiens
aattgttccttgcttttatag

SEQ ID NO: 3042815 - DNA, 14 bp, Homo sapiens
aattgttctgggtg

SEQ ID NO: 3042816 - DNA, 14 bp, Homo sapiens
aattgttgacaaat

SEQ ID NO: 3042817 - DNA, 14 bp, Homo sapiens
aattgtttagaaat

SEQ ID NO: 3042818 - DNA, 19 bp, Homo sapiens
aattgttttaaagagatac

SEQ ID NO: 3042819 - DNA, 12 bp, Homo sapiens
aatttaaaatta

SEQ ID NO: 3042820 - DNA, 18 bp, Homo sapiens
aatttaaaattaagtaga

SEQ ID NO: 3042821 - DNA, 19 bp, Homo sapiens
aatttaaaattaagtagaa

SEQ ID NO: 3042822 - DNA, 18 bp, Homo sapiens
aatttaaacccattttag

SEQ ID NO: 3042823 - DNA, 12 bp, Homo sapiens
aatttaaatgtt

SEQ ID NO: 3042824 - DNA, 16 bp, Homo sapiens
aatttaactttccagt

SEQ ID NO: 3042825 - DNA, 18 bp, Homo sapiens
aatttaagctgtaaatta

SEQ ID NO: 3042826 - DNA, 19 bp, Homo sapiens
aatttaattcatgtttctt

SEQ ID NO: 3042827 - DNA, 20 bp, Homo sapiens
aatttaattcctctttttag

SEQ ID NO: 3042828 - DNA, 19 bp, Homo sapiens
aatttacaggttcttaggc

SEQ ID NO: 3042829 - DNA, 18 bp, Homo sapiens
aatttacagtcaatctat

SEQ ID NO: 3042830 - DNA, 23 bp, Homo sapiens
aatttactttttaaacagtgttt

SEQ ID NO: 3042831 - DNA, 15 bp, Homo sapiens
aatttagaaaaagaa

SEQ ID NO: 3042832 - DNA, 22 bp, Homo sapiens
aatttagaaaaagaacatgcag

SEQ ID NO: 3042833 - DNA, 14 bp, Homo sapiens
aatttagtaaatgt

SEQ ID NO: 3042834 - DNA, 15 bp, Homo sapiens
aatttagtaaatgtt

SEQ ID NO: 3042835 - DNA, 16 bp, Homo sapiens
aatttagtaaatgtta

SEQ ID NO: 3042836 - DNA, 20 bp, Homo sapiens
aatttagtaaatgttatctt

SEQ ID NO: 3042837 - DNA, 16 bp, Homo sapiens
aatttagtaagtgacc

SEQ ID NO: 3042838 - DNA, 13 bp, Homo sapiens
aatttagtcatta

SEQ ID NO: 3042839 - DNA, 16 bp, Homo sapiens
aatttagttaataaaa

SEQ ID NO: 3042840 - DNA, 13 bp, Homo sapiens
aatttataattca

SEQ ID NO: 3042841 - DNA, 15 bp, Homo sapiens
aatttatagtaatga

SEQ ID NO: 3042842 - DNA, 18 bp, Homo sapiens
aatttatagtaatgagtt

SEQ ID NO: 3042843 - DNA, 16 bp, Homo sapiens
aatttattaatctaaa

SEQ ID NO: 3042844 - DNA, 17 bp, Homo sapiens
aatttattaattgcttt

SEQ ID NO: 3042845 - DNA, 20 bp, Homo sapiens
aatttatttcttaacctttg

SEQ ID NO: 3042846 - DNA, 12 bp, Homo sapiens
aatttattttgc

SEQ ID NO: 3042847 - DNA, 18 bp, Homo sapiens
aatttattttgctcttgt

SEQ ID NO: 3042848 - DNA, 18 bp, Homo sapiens
aatttcaaacatttgtca

SEQ ID NO: 3042849 - DNA, 14 bp, Homo sapiens
aatttcaaatctgt

SEQ ID NO: 3042850 - DNA, 15 bp, Homo sapiens
aatttcaaatctgta

SEQ ID NO: 3042851 - DNA, 15 bp, Homo sapiens
aatttcaaggttcta

SEQ ID NO: 3042852 - DNA, 13 bp, Homo sapiens
aatttcactgtct

SEQ ID NO: 3042853 - DNA, 14 bp, Homo sapiens
aatttcactgtctt

SEQ ID NO: 3042854 - DNA, 15 bp, Homo sapiens
aatttcatatctaca

SEQ ID NO: 3042855 - DNA, 17 bp, Homo sapiens
aatttccatatccttct

SEQ ID NO: 3042856 - DNA, 12 bp, Homo sapiens
aatttcccagga

SEQ ID NO: 3042857 - DNA, 14 bp, Homo sapiens
aatttcccaggacc

SEQ ID NO: 3042858 - DNA, 21 bp, Homo sapiens
aatttcccaggaccctgaagg

SEQ ID NO: 3042859 - DNA, 21 bp, Homo sapiens
aatttccccaacagtgtgaag

SEQ ID NO: 3042860 - DNA, 22 bp, Homo sapiens
aatttcctggtgtgaaggtcct

SEQ ID NO: 3042861 - DNA, 11 bp, Homo sapiens
aatttctacta

SEQ ID NO: 3042862 - DNA, 17 bp, Homo sapiens
aatttctactttgaagt

SEQ ID NO: 3042863 - DNA, 22 bp, Homo sapiens
aatttctgtgtctaaatttctt

SEQ ID NO: 3042864 - DNA, 13 bp, Homo sapiens
aatttctttaaaa

SEQ ID NO: 3042865 - DNA, 22 bp, Homo sapiens
aatttctttttttcctttttaa

SEQ ID NO: 3042866 - DNA, 19 bp, Homo sapiens
aatttgaaaataattgttc

SEQ ID NO: 3042867 - DNA, 16 bp, Homo sapiens
aatttgactaatttta

SEQ ID NO: 3042868 - DNA, 17 bp, Homo sapiens
aatttgactaattttac

SEQ ID NO: 3042869 - DNA, 14 bp, Homo sapiens
aatttgacttttgt

SEQ ID NO: 3042870 - DNA, 14 bp, Homo sapiens
aatttgattgattt

SEQ ID NO: 3042871 - DNA, 17 bp, Homo sapiens
aatttgattgatttgaa

SEQ ID NO: 3042872 - DNA, 20 bp, Homo sapiens
aatttgattgatttgaagaa

SEQ ID NO: 3042873 - DNA, 13 bp, Homo sapiens
aatttgcaaagta

SEQ ID NO: 3042874 - DNA, 18 bp, Homo sapiens
aatttgcaaagtactgta

SEQ ID NO: 3042875 - DNA, 19 bp, Homo sapiens
aatttgcaaagtactgtaa

SEQ ID NO: 3042876 - DNA, 18 bp, Homo sapiens
aatttgcaaccatcagaa

SEQ ID NO: 3042877 - DNA, 12 bp, Homo sapiens
acagccacacac

SEQ ID NO: 3042878 - DNA, 14 bp, Homo sapiens
acagccacacacac

SEQ ID NO: 3042879 - DNA, 17 bp, Homo sapiens
acagccacacacacaga

SEQ ID NO: 3042880 - DNA, 20 bp, Homo sapiens
acagccacacacacagaaaa

SEQ ID NO: 3042881 - DNA, 22 bp, Homo sapiens
acagccacacacacagaaaata

SEQ ID NO: 3042882 - DNA, 13 bp, Homo sapiens
acagcccacctgg

SEQ ID NO: 3042883 - DNA, 13 bp, Homo sapiens
acagcccccaccc

SEQ ID NO: 3042884 - DNA, 21 bp, Homo sapiens
acagcctcccctgccagggca

SEQ ID NO: 3042885 - DNA, 22 bp, Homo sapiens
acagcctcccctgccagggcag

SEQ ID NO: 3042886 - DNA, 20 bp, Homo sapiens
acagcctgaataaaccaaga

SEQ ID NO: 3042887 - DNA, 21 bp, Homo sapiens
acagcctgaataaaccaagac

SEQ ID NO: 3042888 - DNA, 10 bp, Homo sapiens
acagccttca

SEQ ID NO: 3042889 - DNA, 21 bp, Homo sapiens
acagccttcagcagcagctca

SEQ ID NO: 3042890 - DNA, 12 bp, Homo sapiens
acagcgctgggt

SEQ ID NO: 3042891 - DNA, 23 bp, Homo sapiens
acagcggccttgaagacagagca

SEQ ID NO: 3042892 - DNA, 14 bp, Homo sapiens
acagcggctgcctc

SEQ ID NO: 3042893 - DNA, 20 bp, Homo sapiens
acagcgtgtcaactttcatt

SEQ ID NO: 3042894 - DNA, 21 bp, Homo sapiens
acagctacaacagcctcactt

SEQ ID NO: 3042895 - DNA, 20 bp, Homo sapiens
acagctacagctttgggtca

SEQ ID NO: 3042896 - DNA, 14 bp, Homo sapiens
acagctactctccc

SEQ ID NO: 3042897 - DNA, 23 bp, Homo sapiens
acagctactctccccacgagggc

SEQ ID NO: 3042898 - DNA, 18 bp, Homo sapiens
acagctcaagcattctgt

SEQ ID NO: 3042899 - DNA, 21 bp, Homo sapiens
acagctcaagcattctgttta

SEQ ID NO: 3042900 - DNA, 13 bp, Homo sapiens
acagctcctcccc

SEQ ID NO: 3042901 - DNA, 15 bp, Homo sapiens
acagctcctcccctg

SEQ ID NO: 3042902 - DNA, 19 bp, Homo sapiens
acagctctttttgtgaagt

SEQ ID NO: 3042903 - DNA, 15 bp, Homo sapiens
acagctgccttagct

SEQ ID NO: 3042904 - DNA, 15 bp, Homo sapiens
acagctgctcagagc

SEQ ID NO: 3042905 - DNA, 17 bp, Homo sapiens
acagctgctcagagcca

SEQ ID NO: 3042906 - DNA, 14 bp, Homo sapiens
acagctgtagtcat

SEQ ID NO: 3042907 - DNA, 14 bp, Homo sapiens
acagctgtccctgt

SEQ ID NO: 3042908 - DNA, 16 bp, Homo sapiens
acagctgtccctgtca

SEQ ID NO: 3042909 - DNA, 18 bp, Homo sapiens
acagctgtccctgtcacc

SEQ ID NO: 3042910 - DNA, 16 bp, Homo sapiens
acagcttatggcatct

SEQ ID NO: 3042911 - DNA, 22 bp, Homo sapiens
acagcttcccctctctcctcct

SEQ ID NO: 3042912 - DNA, 15 bp, Homo sapiens
acagcttcctgtccc

SEQ ID NO: 3042913 - DNA, 22 bp, Homo sapiens
acagcttcctgtccccatctgt

SEQ ID NO: 3042914 - DNA, 12 bp, Homo sapiens
acagctttgact

SEQ ID NO: 3042915 - DNA, 15 bp, Homo sapiens
acagctttgctgctg

SEQ ID NO: 3042916 - DNA, 21 bp, Homo sapiens
acagctttgctgctgaaggct

SEQ ID NO: 3042917 - DNA, 20 bp, Homo sapiens
acagctttgggtcattttta

SEQ ID NO: 3042918 - DNA, 22 bp, Homo sapiens
acagctttgggtcatttttaac

SEQ ID NO: 3042919 - DNA, 20 bp, Homo sapiens
acagcttttcccaggagacc

SEQ ID NO: 3042920 - DNA, 16 bp, Homo sapiens
acaggaaaatcctctg

SEQ ID NO: 3042921 - DNA, 18 bp, Homo sapiens
acaggaaaatcctctggc

SEQ ID NO: 3042922 - DNA, 18 bp, Homo sapiens
acaggaaaatgtatccag

SEQ ID NO: 3042923 - DNA, 22 bp, Homo sapiens
acaggaaagttcagagttttct

SEQ ID NO: 3042924 - DNA, 22 bp, Homo sapiens
acaggaacggccctgcaggagc

SEQ ID NO: 3042925 - DNA, 13 bp, Homo sapiens
acaggaagaccaa

SEQ ID NO: 3042926 - DNA, 15 bp, Homo sapiens
acaggaagcctcaag

SEQ ID NO: 3042927 - DNA, 19 bp, Homo sapiens
acaggaaggtctgatttgc

SEQ ID NO: 3042928 - DNA, 21 bp, Homo sapiens
acaggaaggtctgatttgcag

SEQ ID NO: 3042929 - DNA, 17 bp, Homo sapiens
acaggagacccaacaat

SEQ ID NO: 3042930 - DNA, 15 bp, Homo sapiens
acaggaggacaattc

SEQ ID NO: 3042931 - DNA, 13 bp, Homo sapiens
acaggaggcaggc

SEQ ID NO: 3042932 - DNA, 21 bp, Homo sapiens
acaggagtgtcctcttccctc

SEQ ID NO: 3042933 - DNA, 23 bp, Homo sapiens
acaggagtgtcctcttccctctc

SEQ ID NO: 3042934 - DNA, 20 bp, Homo sapiens
acaggagttgtgagccctct

SEQ ID NO: 3042935 - DNA, 22 bp, Homo sapiens
acaggatgtgtttgctttctga

SEQ ID NO: 3042936 - DNA, 16 bp, Homo sapiens
acaggcagaaatataa

SEQ ID NO: 3042937 - DNA, 22 bp, Homo sapiens
acaggcagaaatataaacacat

SEQ ID NO: 3042938 - DNA, 13 bp, Homo sapiens
acaggcagcacag

SEQ ID NO: 3042939 - DNA, 17 bp, Homo sapiens
acaggcagcacagagac

SEQ ID NO: 3042940 - DNA, 22 bp, Homo sapiens
acaggcagcctggacatagaga

SEQ ID NO: 3042941 - DNA, 22 bp, Homo sapiens
acaggcccggcgcggtggctca

SEQ ID NO: 3042942 - DNA, 22 bp, Homo sapiens
acaggccctccctgttccccag

SEQ ID NO: 3042943 - DNA, 16 bp, Homo sapiens
acaggccgccctgcgg

SEQ ID NO: 3042944 - DNA, 14 bp, Homo sapiens
acaggcggggccca

SEQ ID NO: 3042945 - DNA, 15 bp, Homo sapiens
acagggaagctacag

SEQ ID NO: 3042946 - DNA, 16 bp, Homo sapiens
acagggaagctacagg

SEQ ID NO: 3042947 - DNA, 14 bp, Homo sapiens
acagggcggggggg

SEQ ID NO: 3042948 - DNA, 21 bp, Homo sapiens
acagggcgggggggggggcgg

SEQ ID NO: 3042949 - DNA, 22 bp, Homo sapiens
acagggctatcccgtaattgga

SEQ ID NO: 3042950 - DNA, 21 bp, Homo sapiens
acagggctgataagctaacac

SEQ ID NO: 3042951 - DNA, 14 bp, Homo sapiens
acagggtgggcctc

SEQ ID NO: 3042952 - DNA, 15 bp, Homo sapiens
acagggtgggcctcg

SEQ ID NO: 3042953 - DNA, 18 bp, Homo sapiens
acagggtttggcccaagt

SEQ ID NO: 3042954 - DNA, 19 bp, Homo sapiens
acaggtcaggggtgacaca

SEQ ID NO: 3042955 - DNA, 20 bp, Homo sapiens
acaggtcaggggtgacacag

SEQ ID NO: 3042956 - DNA, 15 bp, Homo sapiens
acaggtccctcccct

SEQ ID NO: 3042957 - DNA, 13 bp, Homo sapiens
acaggtctagact

SEQ ID NO: 3042958 - DNA, 18 bp, Homo sapiens
acaggtctctgagacagg

SEQ ID NO: 3042959 - DNA, 12 bp, Homo sapiens
acaggtctctgt

SEQ ID NO: 3042960 - DNA, 15 bp, Homo sapiens
acaggtctctgttta

SEQ ID NO: 3042961 - DNA, 16 bp, Homo sapiens
acaggtctctgtttag

SEQ ID NO: 3042962 - DNA, 20 bp, Homo sapiens
acaggtgcgggaccatctga

SEQ ID NO: 3042963 - DNA, 13 bp, Homo sapiens
acaggtgctggcc

SEQ ID NO: 3042964 - DNA, 15 bp, Homo sapiens
acaggtgctggccca

SEQ ID NO: 3042965 - DNA, 19 bp, Homo sapiens
acaggtgctggcccagcat

SEQ ID NO: 3042966 - DNA, 15 bp, Homo sapiens
acaggtggtgtcact

SEQ ID NO: 3042967 - DNA, 18 bp, Homo sapiens
acaggtggtgtcactgtc

SEQ ID NO: 3042968 - DNA, 19 bp, Homo sapiens
acaggtggtgtcactgtcc

SEQ ID NO: 3042969 - DNA, 17 bp, Homo sapiens
acacatagcatgtaatg

SEQ ID NO: 3042970 - DNA, 16 bp, Homo sapiens
acacatatatattaca

SEQ ID NO: 3042971 - DNA, 17 bp, Homo sapiens
acacatatgagggggaa

SEQ ID NO: 3042972 - DNA, 18 bp, Homo sapiens
acacatcaccaggtgcat

SEQ ID NO: 3042973 - DNA, 18 bp, Homo sapiens
acacatcagcatgttttc

SEQ ID NO: 3042974 - DNA, 22 bp, Homo sapiens
acacatcagcatgttttctgct

SEQ ID NO: 3042975 - DNA, 16 bp, Homo sapiens
acacatcccagcccaa

SEQ ID NO: 3042976 - DNA, 20 bp, Homo sapiens
acacatctgggtgccctgaa

SEQ ID NO: 3042977 - DNA, 15 bp, Homo sapiens
acacatcttcaacag

SEQ ID NO: 3042978 - DNA, 14 bp, Homo sapiens
acacatggaaaccc

SEQ ID NO: 3042979 - DNA, 19 bp, Homo sapiens
acacatggaaacccatagg

SEQ ID NO: 3042980 - DNA, 17 bp, Homo sapiens
acacattgtgcttggcc

SEQ ID NO: 3042981 - DNA, 13 bp, Homo sapiens
acacattgttatt

SEQ ID NO: 3042982 - DNA, 22 bp, Homo sapiens
acacattgttattttcagtgat

SEQ ID NO: 3042983 - DNA, 21 bp, Homo sapiens
acacatttggaatgcacacag

SEQ ID NO: 3042984 - DNA, 21 bp, Homo sapiens
acacattttggttcttctcaa

SEQ ID NO: 3042985 - DNA, 15 bp, Homo sapiens
acacattttgtataa

SEQ ID NO: 3042986 - DNA, 14 bp, Homo sapiens
acaccaaagttcta

SEQ ID NO: 3042987 - DNA, 18 bp, Homo sapiens
acaccaagcacagcagcc

SEQ ID NO: 3042988 - DNA, 18 bp, Homo sapiens
acaccacaattctcccta

SEQ ID NO: 3042989 - DNA, 13 bp, Homo sapiens
acaccacacacaa

SEQ ID NO: 3042990 - DNA, 17 bp, Homo sapiens
acaccacacacaacagc

SEQ ID NO: 3042991 - DNA, 20 bp, Homo sapiens
acaccacacacaacagccaa

SEQ ID NO: 3042992 - DNA, 15 bp, Homo sapiens
acaccacgcccagct

SEQ ID NO: 3042993 - DNA, 13 bp, Homo sapiens
acaccactcctgc

SEQ ID NO: 3042994 - DNA, 14 bp, Homo sapiens
acaccactcctgcc

SEQ ID NO: 3042995 - DNA, 15 bp, Homo sapiens
acaccactcctgcca

SEQ ID NO: 3042996 - DNA, 21 bp, Homo sapiens
acaccactcctgccagcccgg

SEQ ID NO: 3042997 - DNA, 22 bp, Homo sapiens
acaccagaagctgttgggagaa

SEQ ID NO: 3042998 - DNA, 17 bp, Homo sapiens
acaccagcagcactgga

SEQ ID NO: 3042999 - DNA, 14 bp, Homo sapiens
acaccagcattcct

SEQ ID NO: 3043000 - DNA, 16 bp, Homo sapiens
acaccagcattccttt

SEQ ID NO: 3043001 - DNA, 23 bp, Homo sapiens
acaccagccctgctgcttcctaa

SEQ ID NO: 3043002 - DNA, 17 bp, Homo sapiens
acaccataggtagaatg

SEQ ID NO: 3043003 - DNA, 18 bp, Homo sapiens
acaccatcgctggcccct

SEQ ID NO: 3043004 - DNA, 14 bp, Homo sapiens
acaccatcttttgt

SEQ ID NO: 3043005 - DNA, 23 bp, Homo sapiens
acaccatgtttgagctcagaccc

SEQ ID NO: 3043006 - DNA, 17 bp, Homo sapiens
acacccagcccccacat

SEQ ID NO: 3043007 - DNA, 14 bp, Homo sapiens
acaccctaccttcc

SEQ ID NO: 3043008 - DNA, 18 bp, Homo sapiens
acaccctaccttccccag

SEQ ID NO: 3043009 - DNA, 23 bp, Homo sapiens
acaccctgcctcgcccccacttt

SEQ ID NO: 3043010 - DNA, 17 bp, Homo sapiens
acaccctgcctgctgtg

SEQ ID NO: 3043011 - DNA, 23 bp, Homo sapiens
acaccctgcctgctgtggagccc

SEQ ID NO: 3043012 - DNA, 13 bp, Homo sapiens
acaccctttctgt

SEQ ID NO: 3043013 - DNA, 14 bp, Homo sapiens
acaccgtggggaag

SEQ ID NO: 3043014 - DNA, 14 bp, Homo sapiens
acacctaagggaca

SEQ ID NO: 3043015 - DNA, 15 bp, Homo sapiens
acacctcaaatacat

SEQ ID NO: 3043016 - DNA, 15 bp, Homo sapiens
acacctctgctttct

SEQ ID NO: 3043017 - DNA, 16 bp, Homo sapiens
acacctcttggggagt

SEQ ID NO: 3043018 - DNA, 15 bp, Homo sapiens
acacctgatgtgtac

SEQ ID NO: 3043019 - DNA, 11 bp, Homo sapiens
acacctgcacc

SEQ ID NO: 3043020 - DNA, 12 bp, Homo sapiens
acacctgcacct

SEQ ID NO: 3043021 - DNA, 24 bp, Homo sapiens
acacctgcacctccccccactgca

SEQ ID NO: 3043022 - DNA, 13 bp, Homo sapiens
acacctgcctgcg

SEQ ID NO: 3043023 - DNA, 16 bp, Homo sapiens
acacctgttcacagaa

SEQ ID NO: 3043024 - DNA, 23 bp, Homo sapiens
acacctgttcacagaaaaagcat

SEQ ID NO: 3043025 - DNA, 15 bp, Homo sapiens
acacctttaggttct

SEQ ID NO: 3043026 - DNA, 16 bp, Homo sapiens
acacctttaggttctt

SEQ ID NO: 3043027 - DNA, 17 bp, Homo sapiens
acacctttctcctttgt

SEQ ID NO: 3043028 - DNA, 23 bp, Homo sapiens
acaccttttattgacacagaaaa

SEQ ID NO: 3043029 - DNA, 23 bp, Homo sapiens
acacgcaaaccaacctttctgac

SEQ ID NO: 3043030 - DNA, 14 bp, Homo sapiens
acacgcacctgcct

SEQ ID NO: 3043031 - DNA, 20 bp, Homo sapiens
acacgcgcccccctcccaga

SEQ ID NO: 3043032 - DNA, 23 bp, Homo sapiens
acacgcgcccccctcccagaggc

SEQ ID NO: 3043033 - DNA, 18 bp, Homo sapiens
acacggagcccagccctc

SEQ ID NO: 3043034 - DNA, 20 bp, Homo sapiens
acacgggagccgctggcaga

SEQ ID NO: 3043035 - DNA, 20 bp, Homo sapiens
acacgtaatgaaacttggat

SEQ ID NO: 3043036 - DNA, 15 bp, Homo sapiens
acacgtgatgtgata

SEQ ID NO: 3043037 - DNA, 15 bp, Homo sapiens
acactacaacatatg

SEQ ID NO: 3043038 - DNA, 15 bp, Homo sapiens
acactacaccacaca

SEQ ID NO: 3043039 - DNA, 17 bp, Homo sapiens
acactacaccacacaca

SEQ ID NO: 3043040 - DNA, 14 bp, Homo sapiens
acactatgtgtgtt

SEQ ID NO: 3043041 - DNA, 19 bp, Homo sapiens
acactatgtgtgttgtttc

SEQ ID NO: 3043042 - DNA, 20 bp, Homo sapiens
acactatgtgtgttgtttcc

SEQ ID NO: 3043043 - DNA, 13 bp, Homo sapiens
acactatttgtga

SEQ ID NO: 3043044 - DNA, 16 bp, Homo sapiens
acactatttgtgactt

SEQ ID NO: 3043045 - DNA, 13 bp, Homo sapiens
acactcagggcag

SEQ ID NO: 3043046 - DNA, 18 bp, Homo sapiens
acactcagggcagctgcc

SEQ ID NO: 3043047 - DNA, 19 bp, Homo sapiens
acactcagggcagctgcct

SEQ ID NO: 3043048 - DNA, 23 bp, Homo sapiens
acactccagaattacccttcctc

SEQ ID NO: 3043049 - DNA, 22 bp, Homo sapiens
acaggtggtgtcactgtccctc

SEQ ID NO: 3043050 - DNA, 23 bp, Homo sapiens
acaggtggtgtcactgtccctcc

SEQ ID NO: 3043051 - DNA, 12 bp, Homo sapiens
acaggttacaac

SEQ ID NO: 3043052 - DNA, 15 bp, Homo sapiens
acaggttacaacaga

SEQ ID NO: 3043053 - DNA, 16 bp, Homo sapiens
acaggttacaacagat

SEQ ID NO: 3043054 - DNA, 20 bp, Homo sapiens
acaggttacaacagatttgt

SEQ ID NO: 3043055 - DNA, 22 bp, Homo sapiens
acaggttacaacagatttgtga

SEQ ID NO: 3043056 - DNA, 14 bp, Homo sapiens
acaggttattttag

SEQ ID NO: 3043057 - DNA, 15 bp, Homo sapiens
acaggtttgggaccc

SEQ ID NO: 3043058 - DNA, 21 bp, Homo sapiens
acagtaaatatcccaaactgt

SEQ ID NO: 3043059 - DNA, 21 bp, Homo sapiens
acagtaattattatttaactc

SEQ ID NO: 3043060 - DNA, 16 bp, Homo sapiens
acagtacaggcagcac

SEQ ID NO: 3043061 - DNA, 20 bp, Homo sapiens
acagtacaggcagcacagag

SEQ ID NO: 3043062 - DNA, 18 bp, Homo sapiens
acagtagagtagggtaga

SEQ ID NO: 3043063 - DNA, 23 bp, Homo sapiens
acagtagtcttgatgaccaaagt

SEQ ID NO: 3043064 - DNA, 20 bp, Homo sapiens
acagtattatacgctggcaa

SEQ ID NO: 3043065 - DNA, 20 bp, Homo sapiens
acagtatttttcagatataa

SEQ ID NO: 3043066 - DNA, 19 bp, Homo sapiens
acagtcaatctatgagggt

SEQ ID NO: 3043067 - DNA, 15 bp, Homo sapiens
acagtcagctcttca

SEQ ID NO: 3043068 - DNA, 16 bp, Homo sapiens
acagtcagctcttcat

SEQ ID NO: 3043069 - DNA, 17 bp, Homo sapiens
acagtccgtcaaaacag

SEQ ID NO: 3043070 - DNA, 18 bp, Homo sapiens
acagtccttaaaaatcac

SEQ ID NO: 3043071 - DNA, 16 bp, Homo sapiens
acagtcggtgacccca

SEQ ID NO: 3043072 - DNA, 17 bp, Homo sapiens
acagtctcaattttgta

SEQ ID NO: 3043073 - DNA, 20 bp, Homo sapiens
acagtctcaattttgtattt

SEQ ID NO: 3043074 - DNA, 17 bp, Homo sapiens
acagtctgaagctcgca

SEQ ID NO: 3043075 - DNA, 20 bp, Homo sapiens
acagtctgatcgtgacgctg

SEQ ID NO: 3043076 - DNA, 12 bp, Homo sapiens
acagtctgtctt

SEQ ID NO: 3043077 - DNA, 18 bp, Homo sapiens
acagtctgtcttctgtat

SEQ ID NO: 3043078 - DNA, 19 bp, Homo sapiens
acagtctgtcttctgtata

SEQ ID NO: 3043079 - DNA, 20 bp, Homo sapiens
acagtctgtcttctgtatat

SEQ ID NO: 3043080 - DNA, 14 bp, Homo sapiens
acagtcttccattt

SEQ ID NO: 3043081 - DNA, 20 bp, Homo sapiens
acagtgaaagaaaataacaa

SEQ ID NO: 3043082 - DNA, 13 bp, Homo sapiens
acagtgaaagtca

SEQ ID NO: 3043083 - DNA, 22 bp, Homo sapiens
acagtgaaagtcaattcagtga

SEQ ID NO: 3043084 - DNA, 23 bp, Homo sapiens
acagtgaaagtcaattcagtgat

SEQ ID NO: 3043085 - DNA, 13 bp, Homo sapiens
acagtgaagacag

SEQ ID NO: 3043086 - DNA, 14 bp, Homo sapiens
acagtgaagacaga

SEQ ID NO: 3043087 - DNA, 12 bp, Homo sapiens
acatcaaaatga

SEQ ID NO: 3043088 - DNA, 13 bp, Homo sapiens
acatcaaaatgag

SEQ ID NO: 3043089 - DNA, 14 bp, Homo sapiens
acatcaatatgtat

SEQ ID NO: 3043090 - DNA, 17 bp, Homo sapiens
acatcacatttaaattg

SEQ ID NO: 3043091 - DNA, 14 bp, Homo sapiens
acatcactgtatac

SEQ ID NO: 3043092 - DNA, 17 bp, Homo sapiens
acatcactgttcatgct

SEQ ID NO: 3043093 - DNA, 20 bp, Homo sapiens
acatcagaagtaactcccac

SEQ ID NO: 3043094 - DNA, 19 bp, Homo sapiens
acatcagcatgttttctgc

SEQ ID NO: 3043095 - DNA, 23 bp, Homo sapiens
acatcagcatgttttctgcttta

SEQ ID NO: 3043096 - DNA, 14 bp, Homo sapiens
acatcagccagctg

SEQ ID NO: 3043097 - DNA, 16 bp, Homo sapiens
acatcagccagctgcc

SEQ ID NO: 3043098 - DNA, 14 bp, Homo sapiens
acatcagcctcctt

SEQ ID NO: 3043099 - DNA, 21 bp, Homo sapiens
acatcaggagactgggctctg

SEQ ID NO: 3043100 - DNA, 15 bp, Homo sapiens
acatcagttactctg

SEQ ID NO: 3043101 - DNA, 20 bp, Homo sapiens
acatcagttactctgaaggg

SEQ ID NO: 3043102 - DNA, 18 bp, Homo sapiens
acatcattactataagaa

SEQ ID NO: 3043103 - DNA, 13 bp, Homo sapiens
acatcatttggga

SEQ ID NO: 3043104 - DNA, 16 bp, Homo sapiens
acatccaaagcagaca

SEQ ID NO: 3043105 - DNA, 17 bp, Homo sapiens
acatccaaagcagacag

SEQ ID NO: 3043106 - DNA, 19 bp, Homo sapiens
acatccataaagaagcaat

SEQ ID NO: 3043107 - DNA, 14 bp, Homo sapiens
acatcccagcccaa

SEQ ID NO: 3043108 - DNA, 16 bp, Homo sapiens
acatcccatgtaacag

SEQ ID NO: 3043109 - DNA, 20 bp, Homo sapiens
acatcccatgtaacagaaag

SEQ ID NO: 3043110 - DNA, 16 bp, Homo sapiens
acatcccattgccctg

SEQ ID NO: 3043111 - DNA, 13 bp, Homo sapiens
acatccccagagc

SEQ ID NO: 3043112 - DNA, 18 bp, Homo sapiens
acatccccccgccaaaag

SEQ ID NO: 3043113 - DNA, 19 bp, Homo sapiens
acatccctcccccagcaga

SEQ ID NO: 3043114 - DNA, 17 bp, Homo sapiens
acatccctgccagctct

SEQ ID NO: 3043115 - DNA, 21 bp, Homo sapiens
acatccgcgtgtgcctgtgtg

SEQ ID NO: 3043116 - DNA, 16 bp, Homo sapiens
acatcctgtgtttcta

SEQ ID NO: 3043117 - DNA, 17 bp, Homo sapiens
acatcctttttctgcta

SEQ ID NO: 3043118 - DNA, 16 bp, Homo sapiens
acatcgatatgaaaaa

SEQ ID NO: 3043119 - DNA, 16 bp, Homo sapiens
acatcgcgatgggaac

SEQ ID NO: 3043120 - DNA, 19 bp, Homo sapiens
acatctatccacactgtca

SEQ ID NO: 3043121 - DNA, 18 bp, Homo sapiens
acatctattttggattgt

SEQ ID NO: 3043122 - DNA, 18 bp, Homo sapiens
acatctcccttccacctc

SEQ ID NO: 3043123 - DNA, 17 bp, Homo sapiens
acatctctgtcagtgtg

SEQ ID NO: 3043124 - DNA, 13 bp, Homo sapiens
acatctcttcctc

SEQ ID NO: 3043125 - DNA, 17 bp, Homo sapiens
acatctctttgaatttt

SEQ ID NO: 3043126 - DNA, 17 bp, Homo sapiens
acatctggcatggctcc

SEQ ID NO: 3043127 - DNA, 15 bp, Homo sapiens
acatctgtgtctctg

SEQ ID NO: 3043128 - DNA, 11 bp, Homo sapiens
acatcttcata

SEQ ID NO: 3043129 - DNA, 15 bp, Homo sapiens
acatcttcatataaa

SEQ ID NO: 3043130 - DNA, 16 bp, Homo sapiens
acatcttgtcttttcc

SEQ ID NO: 3043131 - DNA, 16 bp, Homo sapiens
acatcttttaagacaa

SEQ ID NO: 3043132 - DNA, 13 bp, Homo sapiens
acatgaaaacatt

SEQ ID NO: 3043133 - DNA, 17 bp, Homo sapiens
acatgaaaacattgatg

SEQ ID NO: 3043134 - DNA, 15 bp, Homo sapiens
acatgaaaagttatt

SEQ ID NO: 3043135 - DNA, 14 bp, Homo sapiens
acatgaaacattat

SEQ ID NO: 3043136 - DNA, 15 bp, Homo sapiens
acatgaagattcttt

SEQ ID NO: 3043137 - DNA, 22 bp, Homo sapiens
acatgaagattctttcccaatt

SEQ ID NO: 3043138 - DNA, 16 bp, Homo sapiens
acatgaagcataattt

SEQ ID NO: 3043139 - DNA, 19 bp, Homo sapiens
acatgaagtgtgtttcctt

SEQ ID NO: 3043140 - DNA, 21 bp, Homo sapiens
acatgaagtgtgtttccttca

SEQ ID NO: 3043141 - DNA, 21 bp, Homo sapiens
acatgaatcaaaagtgcctca

SEQ ID NO: 3043142 - DNA, 21 bp, Homo sapiens
acatgaatcccacccacatgt

SEQ ID NO: 3043143 - DNA, 14 bp, Homo sapiens
acatgaattaaagt

SEQ ID NO: 3043144 - DNA, 16 bp, Homo sapiens
acatgaccctctgtcc

SEQ ID NO: 3043145 - DNA, 17 bp, Homo sapiens
acatgaccctctgtccc

SEQ ID NO: 3043146 - DNA, 18 bp, Homo sapiens
acatgaccctctgtcccc

SEQ ID NO: 3043147 - DNA, 15 bp, Homo sapiens
acatgagaacaaaca

SEQ ID NO: 3043148 - DNA, 18 bp, Homo sapiens
acatgagatgtgtggact

SEQ ID NO: 3043149 - DNA, 20 bp, Homo sapiens
acatgagatgtgtggactgt

SEQ ID NO: 3043150 - DNA, 14 bp, Homo sapiens
acatgagatttata

SEQ ID NO: 3043151 - DNA, 14 bp, Homo sapiens
acatgaggaactgt

SEQ ID NO: 3043152 - DNA, 17 bp, Homo sapiens
acatgaggaactgtaga

SEQ ID NO: 3043153 - DNA, 17 bp, Homo sapiens
acatgagtatcatcaga

SEQ ID NO: 3043154 - DNA, 13 bp, Homo sapiens
acatgagtcaaga

SEQ ID NO: 3043155 - DNA, 18 bp, Homo sapiens
acatgatgcttttactga

SEQ ID NO: 3043156 - DNA, 17 bp, Homo sapiens
acatgatttccttgaat

SEQ ID NO: 3043157 - DNA, 11 bp, Homo sapiens
acatgcagttt

SEQ ID NO: 3043158 - DNA, 13 bp, Homo sapiens
acatgcagtttga

SEQ ID NO: 3043159 - DNA, 14 bp, Homo sapiens
acatgcataaaagg

SEQ ID NO: 3043160 - DNA, 15 bp, Homo sapiens
acatgcatacacaca

SEQ ID NO: 3043161 - DNA, 17 bp, Homo sapiens
acatgcatacttcaaaa

SEQ ID NO: 3043162 - DNA, 19 bp, Homo sapiens
acatgcatacttcaaaagt

SEQ ID NO: 3043163 - DNA, 15 bp, Homo sapiens
acatgccccaggctc

SEQ ID NO: 3043164 - DNA, 18 bp, Homo sapiens
acatgctaaataactata

SEQ ID NO: 3043165 - DNA, 14 bp, Homo sapiens
acatgctgtttatg

SEQ ID NO: 3043166 - DNA, 16 bp, Homo sapiens
acatggaaagggtctt

SEQ ID NO: 3043167 - DNA, 21 bp, Homo sapiens
acatggaaagggtcttccttc

SEQ ID NO: 3043168 - DNA, 23 bp, Homo sapiens
acatggaatctacatgtgtttga

SEQ ID NO: 3043169 - DNA, 15 bp, Homo sapiens
acatggacagaattt

SEQ ID NO: 3043170 - DNA, 12 bp, Homo sapiens
acatggagctct

SEQ ID NO: 3043171 - DNA, 19 bp, Homo sapiens
acatggaggcactgaagcc

SEQ ID NO: 3043172 - DNA, 15 bp, Homo sapiens
acatggaggttctaa

SEQ ID NO: 3043173 - DNA, 17 bp, Homo sapiens
acatggaggttctaagg

SEQ ID NO: 3043174 - DNA, 18 bp, Homo sapiens
acatggaggttctaaggc

SEQ ID NO: 3043175 - DNA, 19 bp, Homo sapiens
acatggaggttctaaggcc

SEQ ID NO: 3043176 - DNA, 13 bp, Homo sapiens
acatggatgtgtt

SEQ ID NO: 3043177 - DNA, 19 bp, Homo sapiens
acatggattccaaagcatt

SEQ ID NO: 3043178 - DNA, 15 bp, Homo sapiens
acatggcagccattc

SEQ ID NO: 3043179 - DNA, 17 bp, Homo sapiens
acatggcctatgcacat

SEQ ID NO: 3043180 - DNA, 20 bp, Homo sapiens
acatggcctatgcacatatg

SEQ ID NO: 3043181 - DNA, 14 bp, Homo sapiens
acatggcttctcct

SEQ ID NO: 3043182 - DNA, 20 bp, Homo sapiens
acatgggagccgggtctgcc

SEQ ID NO: 3043183 - DNA, 18 bp, Homo sapiens
acatggtgaaacccccat

SEQ ID NO: 3043184 - DNA, 20 bp, Homo sapiens
acatggtgagcctagccctg

SEQ ID NO: 3043185 - DNA, 15 bp, Homo sapiens
acatggtgtgtgtct

SEQ ID NO: 3043186 - DNA, 16 bp, Homo sapiens
acatggtgtgtgtctc

SEQ ID NO: 3043187 - DNA, 15 bp, Homo sapiens
acatgtatctgtcta

SEQ ID NO: 3043188 - DNA, 17 bp, Homo sapiens
acatgtatctgtctact

SEQ ID NO: 3043189 - DNA, 19 bp, Homo sapiens
acatgtatctgtctacttt

SEQ ID NO: 3043190 - DNA, 20 bp, Homo sapiens
acatgtatctgtctactttc

SEQ ID NO: 3043191 - DNA, 22 bp, Homo sapiens
acatgtatctgtctactttctc

SEQ ID NO: 3043192 - DNA, 18 bp, Homo sapiens
acatgtatgtggatacag

SEQ ID NO: 3043193 - DNA, 21 bp, Homo sapiens
acatgtcagtaccttcaaact

SEQ ID NO: 3043194 - DNA, 20 bp, Homo sapiens
acatgtccagcaccttgtgc

SEQ ID NO: 3043195 - DNA, 23 bp, Homo sapiens
acatgtccagcaccttgtgcctg

SEQ ID NO: 3043196 - DNA, 16 bp, Homo sapiens
acatgtccttgtgtgt

SEQ ID NO: 3043197 - DNA, 13 bp, Homo sapiens
acatgtcttgtac

SEQ ID NO: 3043198 - DNA, 14 bp, Homo sapiens
acatgtcttgtaca

SEQ ID NO: 3043199 - DNA, 19 bp, Homo sapiens
acatgtcttgtacatgtgt

SEQ ID NO: 3043200 - DNA, 22 bp, Homo sapiens
acatgtcttgtacatgtgtagc

SEQ ID NO: 3043201 - DNA, 12 bp, Homo sapiens
acatgtgacaca

SEQ ID NO: 3043202 - DNA, 14 bp, Homo sapiens
acatgtgacacata

SEQ ID NO: 3043203 - DNA, 15 bp, Homo sapiens
acatgtgacacatat

SEQ ID NO: 3043204 - DNA, 21 bp, Homo sapiens
acatgtgacacatatgcacct

SEQ ID NO: 3043205 - DNA, 22 bp, Homo sapiens
acatgtgccagggcaatgatga

SEQ ID NO: 3043206 - DNA, 17 bp, Homo sapiens
acatgtgtagcctgtgc

SEQ ID NO: 3043207 - DNA, 20 bp, Homo sapiens
acatgtgttaagtattttca

SEQ ID NO: 3043208 - DNA, 19 bp, Homo sapiens
acatgttaccatgtctgac

SEQ ID NO: 3043209 - DNA, 17 bp, Homo sapiens
acatgttattgttttca

SEQ ID NO: 3043210 - DNA, 18 bp, Homo sapiens
acatgttcccaaaacaat

SEQ ID NO: 3043211 - DNA, 21 bp, Homo sapiens
acatgttcccaaaacaatggt

SEQ ID NO: 3043212 - DNA, 22 bp, Homo sapiens
acatgtttgcacctttctagtt

SEQ ID NO: 3043213 - DNA, 21 bp, Homo sapiens
acatgttttgataaagtagta

SEQ ID NO: 3043214 - DNA, 17 bp, Homo sapiens
acatgtttttatacaaa

SEQ ID NO: 3043215 - DNA, 15 bp, Homo sapiens
acattaaaaagcctt

SEQ ID NO: 3043216 - DNA, 15 bp, Homo sapiens
acattaaaacaatat

SEQ ID NO: 3043217 - DNA, 15 bp, Homo sapiens
acattaaaataaacc

SEQ ID NO: 3043218 - DNA, 16 bp, Homo sapiens
acattaaaataaacca

SEQ ID NO: 3043219 - DNA, 17 bp, Homo sapiens
acattaaaataaaccaa

SEQ ID NO: 3043220 - DNA, 18 bp, Homo sapiens
acattaaaataaaccaaa

SEQ ID NO: 3043221 - DNA, 21 bp, Homo sapiens
acattaaactccctttcatgt

SEQ ID NO: 3043222 - DNA, 17 bp, Homo sapiens
acattaaagaaatttaa

SEQ ID NO: 3043223 - DNA, 21 bp, Homo sapiens
acattaaaggcataaatgact

SEQ ID NO: 3043224 - DNA, 14 bp, Homo sapiens
aagaaagatactta

SEQ ID NO: 3043225 - DNA, 12 bp, Homo sapiens
aagaaagcaact

SEQ ID NO: 3043226 - DNA, 20 bp, Homo sapiens
aagaaagcctcagtgaaaca

SEQ ID NO: 3043227 - DNA, 16 bp, Homo sapiens
aagaaagggtgttttt

SEQ ID NO: 3043228 - DNA, 23 bp, Homo sapiens
aagaaaggtgccatgtctttact

SEQ ID NO: 3043229 - DNA, 22 bp, Homo sapiens
aagaaagtggtcttaagaaatg

SEQ ID NO: 3043230 - DNA, 13 bp, Homo sapiens
aagaaataataat

SEQ ID NO: 3043231 - DNA, 22 bp, Homo sapiens
aagaaatataaacacaaatata

SEQ ID NO: 3043232 - DNA, 20 bp, Homo sapiens
aagaaatcgccttatgagaa

SEQ ID NO: 3043233 - DNA, 13 bp, Homo sapiens
aagaaatgatgtt

SEQ ID NO: 3043234 - DNA, 15 bp, Homo sapiens
aagaaattataaaga

SEQ ID NO: 3043235 - DNA, 15 bp, Homo sapiens
aagaaattatcttta

SEQ ID NO: 3043236 - DNA, 17 bp, Homo sapiens
aagaaattatctttagt

SEQ ID NO: 3043237 - DNA, 16 bp, Homo sapiens
aagaacaccctctaaa

SEQ ID NO: 3043238 - DNA, 16 bp, Homo sapiens
aagaacagctcatctt

SEQ ID NO: 3043239 - DNA, 14 bp, Homo sapiens
aagaacatgcagtt

SEQ ID NO: 3043240 - DNA, 15 bp, Homo sapiens
aagaaccatgcagga

SEQ ID NO: 3043241 - DNA, 14 bp, Homo sapiens
aagaacctggaact

SEQ ID NO: 3043242 - DNA, 18 bp, Homo sapiens
aagaacgaacacaagaaa

SEQ ID NO: 3043243 - DNA, 13 bp, Homo sapiens
aagaactttgagc

SEQ ID NO: 3043244 - DNA, 18 bp, Homo sapiens
aagaactttgagctactg

SEQ ID NO: 3043245 - DNA, 19 bp, Homo sapiens
aagaactttttcttttccc

SEQ ID NO: 3043246 - DNA, 15 bp, Homo sapiens
aagaagaaagtgttc

SEQ ID NO: 3043247 - DNA, 15 bp, Homo sapiens
aagaagaacagctgt

SEQ ID NO: 3043248 - DNA, 13 bp, Homo sapiens
aagaagaatgtgt

SEQ ID NO: 3043249 - DNA, 15 bp, Homo sapiens
aagaagacatgtttt

SEQ ID NO: 3043250 - DNA, 17 bp, Homo sapiens
aagaagacatgttttag

SEQ ID NO: 3043251 - DNA, 14 bp, Homo sapiens
aagaagaggagcct

SEQ ID NO: 3043252 - DNA, 18 bp, Homo sapiens
aagaagaggagcctcaga

SEQ ID NO: 3043253 - DNA, 22 bp, Homo sapiens
aagaagatgctccagcaacaca

SEQ ID NO: 3043254 - DNA, 12 bp, Homo sapiens
aagaagccacag

SEQ ID NO: 3043255 - DNA, 16 bp, Homo sapiens
aagaagcccccagcta

SEQ ID NO: 3043256 - DNA, 14 bp, Homo sapiens
aagaagccctgttc

SEQ ID NO: 3043257 - DNA, 15 bp, Homo sapiens
aagaagccctgttct

SEQ ID NO: 3043258 - DNA, 13 bp, Homo sapiens
aagaaggaagctg

SEQ ID NO: 3043259 - DNA, 14 bp, Homo sapiens
aagaaggaagctgt

SEQ ID NO: 3043260 - DNA, 21 bp, Homo sapiens
aagaaggttaccaagaagcct

SEQ ID NO: 3043261 - DNA, 22 bp, Homo sapiens
aagaagtcagagaaaacacttt

SEQ ID NO: 3043262 - DNA, 14 bp, Homo sapiens
aagaagtgaacact

SEQ ID NO: 3043263 - DNA, 21 bp, Homo sapiens
aagaagtgagtgtttctatga

SEQ ID NO: 3043264 - DNA, 16 bp, Homo sapiens
aagaagtggtgttcca

SEQ ID NO: 3043265 - DNA, 22 bp, Homo sapiens
aagaagttaaaaaacagctgca

SEQ ID NO: 3043266 - DNA, 13 bp, Homo sapiens
aagaataataaaa

SEQ ID NO: 3043267 - DNA, 13 bp, Homo sapiens
aagaataatttat

SEQ ID NO: 3043268 - DNA, 20 bp, Homo sapiens
aagaataatttatagtaatg

SEQ ID NO: 3043269 - DNA, 15 bp, Homo sapiens
aagaatacagctttc

SEQ ID NO: 3043270 - DNA, 14 bp, Homo sapiens
aagaatacttgaac

SEQ ID NO: 3043271 - DNA, 15 bp, Homo sapiens
aagaatacttgaact

SEQ ID NO: 3043272 - DNA, 16 bp, Homo sapiens
aagaatagcatctgta

SEQ ID NO: 3043273 - DNA, 21 bp, Homo sapiens
aagaatagcatctgtacaaag

SEQ ID NO: 3043274 - DNA, 14 bp, Homo sapiens
aagaatatgacttt

SEQ ID NO: 3043275 - DNA, 11 bp, Homo sapiens
aagaatatttg

SEQ ID NO: 3043276 - DNA, 15 bp, Homo sapiens
aagaatatttgaatg

SEQ ID NO: 3043277 - DNA, 17 bp, Homo sapiens
aagaatcggcagtattt

SEQ ID NO: 3043278 - DNA, 20 bp, Homo sapiens
aagaatcggcagtattttct

SEQ ID NO: 3043279 - DNA, 22 bp, Homo sapiens
aagaatcggcagtattttctgt

SEQ ID NO: 3043280 - DNA, 20 bp, Homo sapiens
aagaatgcattgatattgtg

SEQ ID NO: 3043281 - DNA, 19 bp, Homo sapiens
aagaatggaagcctgaact

SEQ ID NO: 3043282 - DNA, 20 bp, Homo sapiens
aagaatgggcagttacatgc

SEQ ID NO: 3043283 - DNA, 21 bp, Homo sapiens
aagaatgggcagttacatgca

SEQ ID NO: 3043284 - DNA, 18 bp, Homo sapiens
aagaatggtgtgtttccc

SEQ ID NO: 3043285 - DNA, 12 bp, Homo sapiens
aagaatgttaag

SEQ ID NO: 3043286 - DNA, 16 bp, Homo sapiens
aagaatgttagagcac

SEQ ID NO: 3043287 - DNA, 20 bp, Homo sapiens
aagaattaaacccacaagct

SEQ ID NO: 3043288 - DNA, 22 bp, Homo sapiens
aagaattaccaagagaagggga

SEQ ID NO: 3043289 - DNA, 18 bp, Homo sapiens
aagaattgaacccaggag

SEQ ID NO: 3043290 - DNA, 16 bp, Homo sapiens
aagaattttaaaaatg

SEQ ID NO: 3043291 - DNA, 19 bp, Homo sapiens
aagaattttaaaaatgaat

SEQ ID NO: 3043292 - DNA, 22 bp, Homo sapiens
aagaattttcagaccccagcgg

SEQ ID NO: 3043293 - DNA, 12 bp, Homo sapiens
aagacaacacaa

SEQ ID NO: 3043294 - DNA, 15 bp, Homo sapiens
aagacaattctttat

SEQ ID NO: 3043295 - DNA, 15 bp, Homo sapiens
aagacacagaaccaa

SEQ ID NO: 3043296 - DNA, 11 bp, Homo sapiens
aagacactgcc

SEQ ID NO: 3043297 - DNA, 21 bp, Homo sapiens
aagacactggtgtatctcaga

SEQ ID NO: 3043298 - DNA, 16 bp, Homo sapiens
aagacagaagtttgca

SEQ ID NO: 3043299 - DNA, 18 bp, Homo sapiens
aagacagaagtttgcact

SEQ ID NO: 3043300 - DNA, 21 bp, Homo sapiens
aagacagattttcggaacaca

SEQ ID NO: 3043301 - DNA, 21 bp, Homo sapiens
aagacagcagacaaaatgaaa

SEQ ID NO: 3043302 - DNA, 19 bp, Homo sapiens
aagacagctcttcttgaaa

SEQ ID NO: 3043303 - DNA, 20 bp, Homo sapiens
aagacagctcttcttgaaaa

SEQ ID NO: 3043304 - DNA, 18 bp, Homo sapiens
aagacaggaaagttcaga

SEQ ID NO: 3043305 - DNA, 21 bp, Homo sapiens
aagacagggctgataagctaa

SEQ ID NO: 3043306 - DNA, 21 bp, Homo sapiens
aagacatatattatatataga

SEQ ID NO: 3043307 - DNA, 21 bp, Homo sapiens
aagacatccataaagaagcaa

SEQ ID NO: 3043308 - DNA, 14 bp, Homo sapiens
aagacatgatttcc

SEQ ID NO: 3043309 - DNA, 21 bp, Homo sapiens
aagacatgatttccttgaatg

SEQ ID NO: 3043310 - DNA, 13 bp, Homo sapiens
aagacatgtttta

SEQ ID NO: 3043311 - DNA, 22 bp, Homo sapiens
aagacattaagagaacaaagag

SEQ ID NO: 3043312 - DNA, 18 bp, Homo sapiens
aagacattgggtctattc

SEQ ID NO: 3043313 - DNA, 23 bp, Homo sapiens
aagacattgggtctattccagct

SEQ ID NO: 3043314 - DNA, 14 bp, Homo sapiens
aagacatttccttt

SEQ ID NO: 3043315 - DNA, 14 bp, Homo sapiens
aagaccaaattttg

SEQ ID NO: 3043316 - DNA, 12 bp, Homo sapiens
aagaccagcctg

SEQ ID NO: 3043317 - DNA, 13 bp, Homo sapiens
aagacccccagca

SEQ ID NO: 3043318 - DNA, 14 bp, Homo sapiens
aagaccctctcagg

SEQ ID NO: 3043319 - DNA, 13 bp, Homo sapiens
aagacccttctcg

SEQ ID NO: 3043320 - DNA, 22 bp, Homo sapiens
aagacctaccagggacaagcag

SEQ ID NO: 3043321 - DNA, 17 bp, Homo sapiens
aagacctcacctagaaa

SEQ ID NO: 3043322 - DNA, 17 bp, Homo sapiens
aagacctggcagctctg

SEQ ID NO: 3043323 - DNA, 16 bp, Homo sapiens
aagacggatggcagga

SEQ ID NO: 3043324 - DNA, 13 bp, Homo sapiens
aagccctcccagg

SEQ ID NO: 3043325 - DNA, 13 bp, Homo sapiens
aagccctccttcc

SEQ ID NO: 3043326 - DNA, 14 bp, Homo sapiens
aagccctgcctctg

SEQ ID NO: 3043327 - DNA, 15 bp, Homo sapiens
aagccctgcctctgt

SEQ ID NO: 3043328 - DNA, 12 bp, Homo sapiens
aagccctgttct

SEQ ID NO: 3043329 - DNA, 19 bp, Homo sapiens
aagccctgttctcgttgcc

SEQ ID NO: 3043330 - DNA, 12 bp, Homo sapiens
aagccctttgcc

SEQ ID NO: 3043331 - DNA, 18 bp, Homo sapiens
aagccctttgcctgtaga

SEQ ID NO: 3043332 - DNA, 22 bp, Homo sapiens
aagccctttgcctgtagagcca

SEQ ID NO: 3043333 - DNA, 21 bp, Homo sapiens
aagccggggaagagatccaaa

SEQ ID NO: 3043334 - DNA, 22 bp, Homo sapiens
aagccgtgctcgccccagcagg

SEQ ID NO: 3043335 - DNA, 20 bp, Homo sapiens
aagcctaattgtcacatcaa

SEQ ID NO: 3043336 - DNA, 15 bp, Homo sapiens
aagcctactatttaa

SEQ ID NO: 3043337 - DNA, 23 bp, Homo sapiens
aagcctcacgtatttcacagagc

SEQ ID NO: 3043338 - DNA, 18 bp, Homo sapiens
aagcctcctgtctcccct

SEQ ID NO: 3043339 - DNA, 18 bp, Homo sapiens
aagcctccttacattaaa

SEQ ID NO: 3043340 - DNA, 24 bp, Homo sapiens
aagcctgaaggggcgtctgttccc

SEQ ID NO: 3043341 - DNA, 12 bp, Homo sapiens
aagcctgacaac

SEQ ID NO: 3043342 - DNA, 18 bp, Homo sapiens
aagcctgtcccaggactc

SEQ ID NO: 3043343 - DNA, 13 bp, Homo sapiens
aagcctgtgcaaa

SEQ ID NO: 3043344 - DNA, 17 bp, Homo sapiens
aagcctgtgcaaaaaaa

SEQ ID NO: 3043345 - DNA, 15 bp, Homo sapiens
aagcctgtggctgtg

SEQ ID NO: 3043346 - DNA, 14 bp, Homo sapiens
aagcgaacatcttc

SEQ ID NO: 3043347 - DNA, 18 bp, Homo sapiens
aagcgaacatcttcatat

SEQ ID NO: 3043348 - DNA, 21 bp, Homo sapiens
aagcgaacatcttcatataaa

SEQ ID NO: 3043349 - DNA, 15 bp, Homo sapiens
aagcgattctcctgc

SEQ ID NO: 3043350 - DNA, 20 bp, Homo sapiens
aagcgattctcctgcctcag

SEQ ID NO: 3043351 - DNA, 14 bp, Homo sapiens
aagcgcccacccag

SEQ ID NO: 3043352 - DNA, 15 bp, Homo sapiens
aagcgcccacccagg

SEQ ID NO: 3043353 - DNA, 17 bp, Homo sapiens
aagcgcccacccaggtc

SEQ ID NO: 3043354 - DNA, 22 bp, Homo sapiens
aagcgcctggctgctgcttctt

SEQ ID NO: 3043355 - DNA, 15 bp, Homo sapiens
aagcgctgtttcctt

SEQ ID NO: 3043356 - DNA, 22 bp, Homo sapiens
aagcggaataaactagagaagg

SEQ ID NO: 3043357 - DNA, 15 bp, Homo sapiens
aagcggtcagactgg

SEQ ID NO: 3043358 - DNA, 15 bp, Homo sapiens
aagcgtctttaagag

SEQ ID NO: 3043359 - DNA, 21 bp, Homo sapiens
aagcgtctttaagagactcac

SEQ ID NO: 3043360 - DNA, 15 bp, Homo sapiens
aagctaatttgcatt

SEQ ID NO: 3043361 - DNA, 13 bp, Homo sapiens
aagctacaggtta

SEQ ID NO: 3043362 - DNA, 15 bp, Homo sapiens
aagctacaggttaca

SEQ ID NO: 3043363 - DNA, 23 bp, Homo sapiens
aagctactgtgtgtgtgaatgaa

SEQ ID NO: 3043364 - DNA, 21 bp, Homo sapiens
aagctataaattcctctttgc

SEQ ID NO: 3043365 - DNA, 15 bp, Homo sapiens
aagctatggtgagat

SEQ ID NO: 3043366 - DNA, 23 bp, Homo sapiens
aagctatggtgagatgcagctgg

SEQ ID NO: 3043367 - DNA, 21 bp, Homo sapiens
aagctattccctcaaatctga

SEQ ID NO: 3043368 - DNA, 18 bp, Homo sapiens
aagctatttatgggcccc

SEQ ID NO: 3043369 - DNA, 22 bp, Homo sapiens
aagctatttatgggcccctggc

SEQ ID NO: 3043370 - DNA, 11 bp, Homo sapiens
aagctcacagt

SEQ ID NO: 3043371 - DNA, 15 bp, Homo sapiens
aagctcacagttcct

SEQ ID NO: 3043372 - DNA, 13 bp, Homo sapiens
aagctcgcatcca

SEQ ID NO: 3043373 - DNA, 15 bp, Homo sapiens
aagctctagaatctg

SEQ ID NO: 3043374 - DNA, 16 bp, Homo sapiens
aagctctagtgggaag

SEQ ID NO: 3043375 - DNA, 16 bp, Homo sapiens
aagctctcaaatgtga

SEQ ID NO: 3043376 - DNA, 14 bp, Homo sapiens
aagctcttgtttct

SEQ ID NO: 3043377 - DNA, 22 bp, Homo sapiens
aagctgacattgccaaaaagga

SEQ ID NO: 3043378 - DNA, 22 bp, Homo sapiens
aagctgacgaacttccatggcc

SEQ ID NO: 3043379 - DNA, 22 bp, Homo sapiens
aagctgggactcattcacattt

SEQ ID NO: 3043380 - DNA, 18 bp, Homo sapiens
aagctggtggcctctgca

SEQ ID NO: 3043381 - DNA, 16 bp, Homo sapiens
aagctgtaaattacat

SEQ ID NO: 3043382 - DNA, 13 bp, Homo sapiens
aagctgtgagaca

SEQ ID NO: 3043383 - DNA, 12 bp, Homo sapiens
aagctgtgtcct

SEQ ID NO: 3043384 - DNA, 20 bp, Homo sapiens
aagctgtgtccttgcacctg

SEQ ID NO: 3043385 - DNA, 20 bp, Homo sapiens
aagctgtgtctctgtatata

SEQ ID NO: 3043386 - DNA, 13 bp, Homo sapiens
aagctgtgttact

SEQ ID NO: 3043387 - DNA, 14 bp, Homo sapiens
aagctgtgttactt

SEQ ID NO: 3043388 - DNA, 19 bp, Homo sapiens
aagctgtgttacttgaagt

SEQ ID NO: 3043389 - DNA, 17 bp, Homo sapiens
aagctgtgttcatccag

SEQ ID NO: 3043390 - DNA, 21 bp, Homo sapiens
aagctgtgttgaaacagaaaa

SEQ ID NO: 3043391 - DNA, 21 bp, Homo sapiens
aagctgttaaagatattttta

SEQ ID NO: 3043392 - DNA, 23 bp, Homo sapiens
aagctgttctcattcctgttctt

SEQ ID NO: 3043393 - DNA, 16 bp, Homo sapiens
aagctgttgggagaaa

SEQ ID NO: 3043394 - DNA, 13 bp, Homo sapiens
aagcttactaaag

SEQ ID NO: 3043395 - DNA, 18 bp, Homo sapiens
aagcttagattttctgta

SEQ ID NO: 3043396 - DNA, 13 bp, Homo sapiens
aagcttagcagga

SEQ ID NO: 3043397 - DNA, 15 bp, Homo sapiens
aagcttagcaggaga

SEQ ID NO: 3043398 - DNA, 16 bp, Homo sapiens
aagcttagcaggagag

SEQ ID NO: 3043399 - DNA, 13 bp, Homo sapiens
aagcttatgtttc

SEQ ID NO: 3043400 - DNA, 14 bp, Homo sapiens
aagcttatgtttct

SEQ ID NO: 3043401 - DNA, 19 bp, Homo sapiens
aagcttcattataaaatat

SEQ ID NO: 3043402 - DNA, 15 bp, Homo sapiens
aagcttccatgattc

SEQ ID NO: 3043403 - DNA, 21 bp, Homo sapiens
aagcttccatgattctattta

SEQ ID NO: 3043404 - DNA, 19 bp, Homo sapiens
aagcttcctagcttatctc

SEQ ID NO: 3043405 - DNA, 21 bp, Homo sapiens
aagcttcctagcttatctccc

SEQ ID NO: 3043406 - DNA, 13 bp, Homo sapiens
aagcttccttggc

SEQ ID NO: 3043407 - DNA, 15 bp, Homo sapiens
aagcttgaaaagatt

SEQ ID NO: 3043408 - DNA, 20 bp, Homo sapiens
aagcttgtaaatatggggat

SEQ ID NO: 3043409 - DNA, 13 bp, Homo sapiens
aagcttgtgtatc

SEQ ID NO: 3043410 - DNA, 23 bp, Homo sapiens
aagcttgtgtatccattatcatg

SEQ ID NO: 3043411 - DNA, 21 bp, Homo sapiens
aagctttatttatagaaatga

SEQ ID NO: 3043412 - DNA, 23 bp, Homo sapiens
aagctttgcttatggtaataaaa

SEQ ID NO: 3043413 - DNA, 21 bp, Homo sapiens
aagctttggacccaaggaaaa

SEQ ID NO: 3043414 - DNA, 22 bp, Homo sapiens
aagctttggtgagaacctgggt

SEQ ID NO: 3043415 - DNA, 15 bp, Homo sapiens
aagctttgtcccctg

SEQ ID NO: 3043416 - DNA, 22 bp, Homo sapiens
aagctttgtcccctgcttcaga

SEQ ID NO: 3043417 - DNA, 14 bp, Homo sapiens
aaggaaaaaaagac

SEQ ID NO: 3043418 - DNA, 23 bp, Homo sapiens
aaggaaaaaattatgtttttcag

SEQ ID NO: 3043419 - DNA, 21 bp, Homo sapiens
aaggaaaactatgtattaatt

SEQ ID NO: 3043420 - DNA, 12 bp, Homo sapiens
aaggaaaagcac

SEQ ID NO: 3043421 - DNA, 17 bp, Homo sapiens
aaggaaaatagtaatgt

SEQ ID NO: 3043422 - DNA, 16 bp, Homo sapiens
aaggaaacaacatttt

SEQ ID NO: 3043423 - DNA, 12 bp, Homo sapiens
aaggaaagaaac

SEQ ID NO: 3043424 - DNA, 13 bp, Homo sapiens
aaggaaagcaata

SEQ ID NO: 3043425 - DNA, 14 bp, Homo sapiens
aaggaaagcatgtc

SEQ ID NO: 3043426 - DNA, 13 bp, Homo sapiens
aaggaaaggcaga

SEQ ID NO: 3043427 - DNA, 14 bp, Homo sapiens
aaggaaatccaaaa

SEQ ID NO: 3043428 - DNA, 14 bp, Homo sapiens
aaggaaatgattga

SEQ ID NO: 3043429 - DNA, 23 bp, Homo sapiens
aaggaactaggtcaaaaatctgt

SEQ ID NO: 3043430 - DNA, 14 bp, Homo sapiens
aaggaagctgtgtt

SEQ ID NO: 3043431 - DNA, 18 bp, Homo sapiens
aaggaagctgtgttgaaa

SEQ ID NO: 3043432 - DNA, 22 bp, Homo sapiens
aaggaaggagactcacctctgc

SEQ ID NO: 3043433 - DNA, 18 bp, Homo sapiens
aaggaagtatcagcacta

SEQ ID NO: 3043434 - DNA, 17 bp, Homo sapiens
aaggaatctggcattct

SEQ ID NO: 3043435 - DNA, 12 bp, Homo sapiens
aaggacaaacag

SEQ ID NO: 3043436 - DNA, 21 bp, Homo sapiens
aaggacaaacagtgaatttaa

SEQ ID NO: 3043437 - DNA, 13 bp, Homo sapiens
aaggacagctgtg

SEQ ID NO: 3043438 - DNA, 16 bp, Homo sapiens
aaggacaggtctctga

SEQ ID NO: 3043439 - DNA, 16 bp, Homo sapiens
aaggacatgatgcttt

SEQ ID NO: 3043440 - DNA, 18 bp, Homo sapiens
aaggacatgatgctttta

SEQ ID NO: 3043441 - DNA, 20 bp, Homo sapiens
aaggaccagcccttgaggga

SEQ ID NO: 3043442 - DNA, 16 bp, Homo sapiens
aaggacgtaaaattta

SEQ ID NO: 3043443 - DNA, 21 bp, Homo sapiens
aaggactggaaaaatgaactg

SEQ ID NO: 3043444 - DNA, 16 bp, Homo sapiens
aaggacttccacattt

SEQ ID NO: 3043445 - DNA, 17 bp, Homo sapiens
aaggacttccacatttt

SEQ ID NO: 3043446 - DNA, 20 bp, Homo sapiens
aaggactttccaaatccagg

SEQ ID NO: 3043447 - DNA, 21 bp, Homo sapiens
aaggactttccaaatccagga

SEQ ID NO: 3043448 - DNA, 17 bp, Homo sapiens
aaggagacaaagcagga

SEQ ID NO: 3043449 - DNA, 13 bp, Homo sapiens
aaggagacacaga

SEQ ID NO: 3043450 - DNA, 17 bp, Homo sapiens
aaggagacacagatgtt

SEQ ID NO: 3043451 - DNA, 17 bp, Homo sapiens
aaggagactcacctctg

SEQ ID NO: 3043452 - DNA, 22 bp, Homo sapiens
aaggagactcacctctgcctca

SEQ ID NO: 3043453 - DNA, 19 bp, Homo sapiens
aaggagactggtaggagga

SEQ ID NO: 3043454 - DNA, 18 bp, Homo sapiens
aaggagcacatactacct

SEQ ID NO: 3043455 - DNA, 23 bp, Homo sapiens
aaggagcacatactacctagaag

SEQ ID NO: 3043456 - DNA, 12 bp, Homo sapiens
aaggagcagaga

SEQ ID NO: 3043457 - DNA, 20 bp, Homo sapiens
aaggagcagagaggtggcca

SEQ ID NO: 3043458 - DNA, 17 bp, Homo sapiens
aaggagccccattcctg

SEQ ID NO: 3043459 - DNA, 19 bp, Homo sapiens
aaggagccccattcctggg

SEQ ID NO: 3043460 - DNA, 12 bp, Homo sapiens
aaggagcccctg

SEQ ID NO: 3043461 - DNA, 20 bp, Homo sapiens
aaggaggtaaaggatgaggg

SEQ ID NO: 3043462 - DNA, 19 bp, Homo sapiens
aaggagtaatctgtgtaca

SEQ ID NO: 3043463 - DNA, 20 bp, Homo sapiens
aaggagtttaaatgagacta

SEQ ID NO: 3043464 - DNA, 14 bp, Homo sapiens
aaggatacataatg

SEQ ID NO: 3043465 - DNA, 19 bp, Homo sapiens
aaggatagatgctggccca

SEQ ID NO: 3043466 - DNA, 17 bp, Homo sapiens
aaggatcacagattttt

SEQ ID NO: 3043467 - DNA, 15 bp, Homo sapiens
aaggatcagaagtat

SEQ ID NO: 3043468 - DNA, 13 bp, Homo sapiens
aaggatcatctga

SEQ ID NO: 3043469 - DNA, 18 bp, Homo sapiens
aaggatctttgtggccaa

SEQ ID NO: 3043470 - DNA, 11 bp, Homo sapiens
aaggatgaggg

SEQ ID NO: 3043471 - DNA, 20 bp, Homo sapiens
aaggatgggaaaaactgcag

SEQ ID NO: 3043472 - DNA, 23 bp, Homo sapiens
aaggatgtaaacagtgcctgctg

SEQ ID NO: 3043473 - DNA, 23 bp, Homo sapiens
aaggatgtagcttttcaccttta

SEQ ID NO: 3043474 - DNA, 22 bp, Homo sapiens
aaggatgtgattgtggaatgga

SEQ ID NO: 3043475 - DNA, 15 bp, Homo sapiens
aaggatgttggtgtt

SEQ ID NO: 3043476 - DNA, 22 bp, Homo sapiens
aaggattaattgctgcaaggac

SEQ ID NO: 3043477 - DNA, 16 bp, Homo sapiens
aaggattacagaaact

SEQ ID NO: 3043478 - DNA, 18 bp, Homo sapiens
aaggattacagaaactga

SEQ ID NO: 3043479 - DNA, 16 bp, Homo sapiens
aaggattcatgtggaa

SEQ ID NO: 3043480 - DNA, 17 bp, Homo sapiens
aaggattctaaacagat

SEQ ID NO: 3043481 - DNA, 20 bp, Homo sapiens
aaggattctgaagttttatt

SEQ ID NO: 3043482 - DNA, 19 bp, Homo sapiens
aaggattgttaacatgcct

SEQ ID NO: 3043483 - DNA, 12 bp, Homo sapiens
aaggcaaaattg

SEQ ID NO: 3043484 - DNA, 11 bp, Homo sapiens
aaggcaaaggc

SEQ ID NO: 3043485 - DNA, 16 bp, Homo sapiens
aaggcaaaggcagagg

SEQ ID NO: 3043486 - DNA, 15 bp, Homo sapiens
aaggcaacttgaaga

SEQ ID NO: 3043487 - DNA, 22 bp, Homo sapiens
aaggcacctataaaacaggtca

SEQ ID NO: 3043488 - DNA, 19 bp, Homo sapiens
aaggcactctagattccat

SEQ ID NO: 3043489 - DNA, 22 bp, Homo sapiens
aaggcagatgtaaatgatgtgt

SEQ ID NO: 3043490 - DNA, 12 bp, Homo sapiens
aaggcaggaaga

SEQ ID NO: 3043491 - DNA, 13 bp, Homo sapiens
aaggcaggaagag

SEQ ID NO: 3043492 - DNA, 14 bp, Homo sapiens
aaggcaggaagaga

SEQ ID NO: 3043493 - DNA, 20 bp, Homo sapiens
aaggcaggagttgggggcag

SEQ ID NO: 3043494 - DNA, 19 bp, Homo sapiens
aaggcaggcctttcctaca

SEQ ID NO: 3043495 - DNA, 22 bp, Homo sapiens
aaggcatacgagagcagaggtc

SEQ ID NO: 3043496 - DNA, 21 bp, Homo sapiens
aaggcatacttttaatcaagt

SEQ ID NO: 3043497 - DNA, 20 bp, Homo sapiens
aaggcatatcatgctttgaa

SEQ ID NO: 3043498 - DNA, 20 bp, Homo sapiens
aaggcatgtacaaaaattat

SEQ ID NO: 3043499 - DNA, 15 bp, Homo sapiens
aaggcattccacagg

SEQ ID NO: 3043500 - DNA, 15 bp, Homo sapiens
aaggcattgtttgag

SEQ ID NO: 3043501 - DNA, 21 bp, Homo sapiens
aaggccaattcctatacgcag

SEQ ID NO: 3043502 - DNA, 19 bp, Homo sapiens
aaggccagctggcagcaga

SEQ ID NO: 3043503 - DNA, 14 bp, Homo sapiens
aaggccataaaaca

SEQ ID NO: 3043504 - DNA, 24 bp, Homo sapiens
aaggccataaaacaggtaatataa

SEQ ID NO: 3043505 - DNA, 22 bp, Homo sapiens
aaggccctatctgtttacagtg

SEQ ID NO: 3043506 - DNA, 13 bp, Homo sapiens
aaggccctttcct

SEQ ID NO: 3043507 - DNA, 14 bp, Homo sapiens
aaggccgagaagca

SEQ ID NO: 3043508 - DNA, 15 bp, Homo sapiens
aaggccgtgtgttta

SEQ ID NO: 3043509 - DNA, 21 bp, Homo sapiens
aaggccgtgtgtttagaagcc

SEQ ID NO: 3043510 - DNA, 23 bp, Homo sapiens
aaggccgtgtgtttagaagccta

SEQ ID NO: 3043511 - DNA, 16 bp, Homo sapiens
aaggcctaggattcta

SEQ ID NO: 3043512 - DNA, 10 bp, Homo sapiens
aaggcctccc

SEQ ID NO: 3043513 - DNA, 17 bp, Homo sapiens
aaggcctcggcagaact

SEQ ID NO: 3043514 - DNA, 13 bp, Homo sapiens
aaggcctggtctg

SEQ ID NO: 3043515 - DNA, 15 bp, Homo sapiens
aaggcctggtctggg

SEQ ID NO: 3043516 - DNA, 11 bp, Homo sapiens
aaggctctaga

SEQ ID NO: 3043517 - DNA, 20 bp, Homo sapiens
aaggctctatgagtctagat

SEQ ID NO: 3043518 - DNA, 22 bp, Homo sapiens
aaggctctcgggtgggggagcc

SEQ ID NO: 3043519 - DNA, 23 bp, Homo sapiens
aaggctctcgggtgggggagcca

SEQ ID NO: 3043520 - DNA, 12 bp, Homo sapiens
aaggctctgaga

SEQ ID NO: 3043521 - DNA, 13 bp, Homo sapiens
aaggctctgagag

SEQ ID NO: 3043522 - DNA, 14 bp, Homo sapiens
aaggctctgagagt

SEQ ID NO: 3043523 - DNA, 16 bp, Homo sapiens
aaggctctgagagtct

SEQ ID NO: 3043524 - DNA, 17 bp, Homo sapiens
aaggctctgagagtcta

SEQ ID NO: 3043525 - DNA, 16 bp, Homo sapiens
aaggctctgtgccttg

SEQ ID NO: 3043526 - DNA, 21 bp, Homo sapiens
aaggctctgttatcagctggg

SEQ ID NO: 3043527 - DNA, 20 bp, Homo sapiens
aaggctgaggaaaggccagc

SEQ ID NO: 3043528 - DNA, 21 bp, Homo sapiens
aaggcttgccgcacatgaaac

SEQ ID NO: 3043529 - DNA, 22 bp, Homo sapiens
aaggcttgccgcacatgaaaca

SEQ ID NO: 3043530 - DNA, 19 bp, Homo sapiens
aaggcttgttgtgctttta

SEQ ID NO: 3043531 - DNA, 11 bp, Homo sapiens
aaggctttgtg

SEQ ID NO: 3043532 - DNA, 11 bp, Homo sapiens
aagggaaaaaa

SEQ ID NO: 3043533 - DNA, 17 bp, Homo sapiens
aagggaaaaaataaaaa

SEQ ID NO: 3043534 - DNA, 16 bp, Homo sapiens
aagggaaactggctga

SEQ ID NO: 3043535 - DNA, 22 bp, Homo sapiens
aagggaaggcaaaggcagagga

SEQ ID NO: 3043536 - DNA, 12 bp, Homo sapiens
aagggaatcctc

SEQ ID NO: 3043537 - DNA, 17 bp, Homo sapiens
aagggaatcctcctcca

SEQ ID NO: 3043538 - DNA, 16 bp, Homo sapiens
aagggacatgttttga

SEQ ID NO: 3043539 - DNA, 14 bp, Homo sapiens
aagggagagctgag

SEQ ID NO: 3043540 - DNA, 22 bp, Homo sapiens
aagggaggcacttcctcccctc

SEQ ID NO: 3043541 - DNA, 20 bp, Homo sapiens
aagggaggcccagccgcagg

SEQ ID NO: 3043542 - DNA, 15 bp, Homo sapiens
aagggaggggaaggg

SEQ ID NO: 3043543 - DNA, 18 bp, Homo sapiens
aagggatgatgtggtttt

SEQ ID NO: 3043544 - DNA, 21 bp, Homo sapiens
aagggcaataccgtgttggtt

SEQ ID NO: 3043545 - DNA, 11 bp, Homo sapiens
aagggcagccc

SEQ ID NO: 3043546 - DNA, 13 bp, Homo sapiens
aagggcagccctc

SEQ ID NO: 3043547 - DNA, 17 bp, Homo sapiens
aagggcagccctccatg

SEQ ID NO: 3043548 - DNA, 11 bp, Homo sapiens
aagggccagag

SEQ ID NO: 3043549 - DNA, 13 bp, Homo sapiens
aagggccagagcc

SEQ ID NO: 3043550 - DNA, 18 bp, Homo sapiens
aagggccaggtgcggcct

SEQ ID NO: 3043551 - DNA, 21 bp, Homo sapiens
aagggccaggtgcggcctggg

SEQ ID NO: 3043552 - DNA, 20 bp, Homo sapiens
aagggcccttcccctccccc

SEQ ID NO: 3043553 - DNA, 12 bp, Homo sapiens
aagggcctggac

SEQ ID NO: 3043554 - DNA, 14 bp, Homo sapiens
aagggcctggccag

SEQ ID NO: 3043555 - DNA, 20 bp, Homo sapiens
aagggcctggccagtcctgg

SEQ ID NO: 3043556 - DNA, 15 bp, Homo sapiens
aagggcgcaaagggc

SEQ ID NO: 3043557 - DNA, 21 bp, Homo sapiens
aagggctggggccggggctga

SEQ ID NO: 3043558 - DNA, 18 bp, Homo sapiens
aagggctttgttttgcac

SEQ ID NO: 3043559 - DNA, 18 bp, Homo sapiens
aaggggaaacgtctccca

SEQ ID NO: 3043560 - DNA, 20 bp, Homo sapiens
aaggggaaacgtctcccaga

SEQ ID NO: 3043561 - DNA, 16 bp, Homo sapiens
aaggggacccccgccc

SEQ ID NO: 3043562 - DNA, 13 bp, Homo sapiens
aaggggagcccac

SEQ ID NO: 3043563 - DNA, 22 bp, Homo sapiens
aaggggcagcagttgaggtggg

SEQ ID NO: 3043564 - DNA, 23 bp, Homo sapiens
aaggggccatttggcataccttt

SEQ ID NO: 3043565 - DNA, 13 bp, Homo sapiens
aaggggcctccct

SEQ ID NO: 3043566 - DNA, 22 bp, Homo sapiens
aagggggcggggactgctggct

SEQ ID NO: 3043567 - DNA, 20 bp, Homo sapiens
aaggggttggttgaggtgga

SEQ ID NO: 3043568 - DNA, 15 bp, Homo sapiens
aagggtcaaacctgt

SEQ ID NO: 3043569 - DNA, 16 bp, Homo sapiens
aagggttccctcaaga

SEQ ID NO: 3043570 - DNA, 14 bp, Homo sapiens
aaggtaaaatgcca

SEQ ID NO: 3043571 - DNA, 22 bp, Homo sapiens
aaggtaaaatgccatgatgcct

SEQ ID NO: 3043572 - DNA, 16 bp, Homo sapiens
aaggtaactattagaa

SEQ ID NO: 3043573 - DNA, 19 bp, Homo sapiens
aaggtatttgggaaacttg

SEQ ID NO: 3043574 - DNA, 22 bp, Homo sapiens
aaggtatttgggaaacttgtca

SEQ ID NO: 3043575 - DNA, 14 bp, Homo sapiens
aaggtcaaatttat

SEQ ID NO: 3043576 - DNA, 19 bp, Homo sapiens
aaggtcagcgagaaggagt

SEQ ID NO: 3043577 - DNA, 15 bp, Homo sapiens
aaggtcctagcttta

SEQ ID NO: 3043578 - DNA, 12 bp, Homo sapiens
aaggtctttcag

SEQ ID NO: 3043579 - DNA, 19 bp, Homo sapiens
aaggtctttcagtactttt

SEQ ID NO: 3043580 - DNA, 19 bp, Homo sapiens
aaggtgaagtgaggacaaa

SEQ ID NO: 3043581 - DNA, 21 bp, Homo sapiens
aaggtgaagtgaggacaaaat

SEQ ID NO: 3043582 - DNA, 17 bp, Homo sapiens
aaggtgacccaatgatt

SEQ ID NO: 3043583 - DNA, 15 bp, Homo sapiens
aaggtgactttctga

SEQ ID NO: 3043584 - DNA, 14 bp, Homo sapiens
aaggtgaggcctgt

SEQ ID NO: 3043585 - DNA, 19 bp, Homo sapiens
aaggtgaggcctgtctgtg

SEQ ID NO: 3043586 - DNA, 19 bp, Homo sapiens
aaggtgcatatagaaaaca

SEQ ID NO: 3043587 - DNA, 18 bp, Homo sapiens
aaggtgccagaaggaagg

SEQ ID NO: 3043588 - DNA, 14 bp, Homo sapiens
aaggtgccatgtct

SEQ ID NO: 3043589 - DNA, 19 bp, Homo sapiens
aaggtgctaaatctgcgat

SEQ ID NO: 3043590 - DNA, 16 bp, Homo sapiens
aataacaagtcgatga

SEQ ID NO: 3043591 - DNA, 15 bp, Homo sapiens
aataacaataaaaga

SEQ ID NO: 3043592 - DNA, 17 bp, Homo sapiens
aataacatatctaaagt

SEQ ID NO: 3043593 - DNA, 18 bp, Homo sapiens
aataacatatctaaagtc

SEQ ID NO: 3043594 - DNA, 14 bp, Homo sapiens
aataacatgtttct

SEQ ID NO: 3043595 - DNA, 20 bp, Homo sapiens
aataactatataagacatta

SEQ ID NO: 3043596 - DNA, 17 bp, Homo sapiens
aataactgaaccaaatt

SEQ ID NO: 3043597 - DNA, 20 bp, Homo sapiens
aataactgatctcaagtata

SEQ ID NO: 3043598 - DNA, 20 bp, Homo sapiens
aataactggaacaaattatt

SEQ ID NO: 3043599 - DNA, 13 bp, Homo sapiens
aataacttctata

SEQ ID NO: 3043600 - DNA, 20 bp, Homo sapiens
aataacttctatattttaat

SEQ ID NO: 3043601 - DNA, 21 bp, Homo sapiens
aataacttctatattttaata

SEQ ID NO: 3043602 - DNA, 19 bp, Homo sapiens
aataagagtctccttctct

SEQ ID NO: 3043603 - DNA, 12 bp, Homo sapiens
aataagattcta

SEQ ID NO: 3043604 - DNA, 15 bp, Homo sapiens
aataagcaactaaat

SEQ ID NO: 3043605 - DNA, 17 bp, Homo sapiens
aataagcaactaaatga

SEQ ID NO: 3043606 - DNA, 18 bp, Homo sapiens
aataagcataagaccaat

SEQ ID NO: 3043607 - DNA, 18 bp, Homo sapiens
aataagtatttctgattt

SEQ ID NO: 3043608 - DNA, 18 bp, Homo sapiens
aataagttattgcagttt

SEQ ID NO: 3043609 - DNA, 16 bp, Homo sapiens
aataataaaatacttt

SEQ ID NO: 3043610 - DNA, 18 bp, Homo sapiens
aataataaaatacttttt

SEQ ID NO: 3043611 - DNA, 14 bp, Homo sapiens
aataataaaatcaa

SEQ ID NO: 3043612 - DNA, 19 bp, Homo sapiens
aataataaagatgtgaaaa

SEQ ID NO: 3043613 - DNA, 13 bp, Homo sapiens
aataataaataca

SEQ ID NO: 3043614 - DNA, 15 bp, Homo sapiens
aataataataataat

SEQ ID NO: 3043615 - DNA, 16 bp, Homo sapiens
aataataataataata

SEQ ID NO: 3043616 - DNA, 15 bp, Homo sapiens
aataataatatccag

SEQ ID NO: 3043617 - DNA, 16 bp, Homo sapiens
aataatataatgaatt

SEQ ID NO: 3043618 - DNA, 19 bp, Homo sapiens
aataatatattttctgttt

SEQ ID NO: 3043619 - DNA, 20 bp, Homo sapiens
aataatatccaggtcaacag

SEQ ID NO: 3043620 - DNA, 11 bp, Homo sapiens
aataatcaaga

SEQ ID NO: 3043621 - DNA, 23 bp, Homo sapiens
aataatccattttcactaaaagt

SEQ ID NO: 3043622 - DNA, 15 bp, Homo sapiens
aataatgcagtatgg

SEQ ID NO: 3043623 - DNA, 17 bp, Homo sapiens
aataatgcagtatggta

SEQ ID NO: 3043624 - DNA, 13 bp, Homo sapiens
aataatggtacca

SEQ ID NO: 3043625 - DNA, 17 bp, Homo sapiens
aataatggtaccagata

SEQ ID NO: 3043626 - DNA, 19 bp, Homo sapiens
aataattaaccaaccttgt

SEQ ID NO: 3043627 - DNA, 12 bp, Homo sapiens
aataattattat

SEQ ID NO: 3043628 - DNA, 14 bp, Homo sapiens
aataattgaagaat

SEQ ID NO: 3043629 - DNA, 21 bp, Homo sapiens
aataattgcagaactaaactc

SEQ ID NO: 3043630 - DNA, 19 bp, Homo sapiens
aataattggccttcgattt

SEQ ID NO: 3043631 - DNA, 15 bp, Homo sapiens
aataatttaagttgg

SEQ ID NO: 3043632 - DNA, 19 bp, Homo sapiens
aataatttaagttggctag

SEQ ID NO: 3043633 - DNA, 15 bp, Homo sapiens
aataatttatagtaa

SEQ ID NO: 3043634 - DNA, 16 bp, Homo sapiens
aataatttatagtaat

SEQ ID NO: 3043635 - DNA, 20 bp, Homo sapiens
aataatttcctggtgtgaag

SEQ ID NO: 3043636 - DNA, 21 bp, Homo sapiens
aataatttcctggtgtgaagg

SEQ ID NO: 3043637 - DNA, 13 bp, Homo sapiens
aataatttctaat

SEQ ID NO: 3043638 - DNA, 16 bp, Homo sapiens
aataatttctaatgtt

SEQ ID NO: 3043639 - DNA, 16 bp, Homo sapiens
aataatttgaactttg

SEQ ID NO: 3043640 - DNA, 12 bp, Homo sapiens
aataattttcta

SEQ ID NO: 3043641 - DNA, 21 bp, Homo sapiens
aatacaaaaatcagccagaca

SEQ ID NO: 3043642 - DNA, 14 bp, Homo sapiens
aatacaaaaattag

SEQ ID NO: 3043643 - DNA, 16 bp, Homo sapiens
aatacaaaatgtatta

SEQ ID NO: 3043644 - DNA, 21 bp, Homo sapiens
aatacaaatctgtataaatgt

SEQ ID NO: 3043645 - DNA, 22 bp, Homo sapiens
aatacaaatctgtataaatgtc

SEQ ID NO: 3043646 - DNA, 15 bp, Homo sapiens
aatacaagttctttt

SEQ ID NO: 3043647 - DNA, 16 bp, Homo sapiens
aatacaattattgtat

SEQ ID NO: 3043648 - DNA, 23 bp, Homo sapiens
aatacacatagcatgtaatggta

SEQ ID NO: 3043649 - DNA, 15 bp, Homo sapiens
aatacacatctctgt

SEQ ID NO: 3043650 - DNA, 14 bp, Homo sapiens
aatacacttgccct

SEQ ID NO: 3043651 - DNA, 17 bp, Homo sapiens
aatacacttgccctgct

SEQ ID NO: 3043652 - DNA, 16 bp, Homo sapiens
aatacagcagcaagaa

SEQ ID NO: 3043653 - DNA, 18 bp, Homo sapiens
aatacagcagcaagaaaa

SEQ ID NO: 3043654 - DNA, 22 bp, Homo sapiens
aatacaggagacccaacaatga

SEQ ID NO: 3043655 - DNA, 15 bp, Homo sapiens
aatacagtacaggca

SEQ ID NO: 3043656 - DNA, 21 bp, Homo sapiens
aatacagtacaggcagcacag

SEQ ID NO: 3043657 - DNA, 14 bp, Homo sapiens
aatacataaaacaa

SEQ ID NO: 3043658 - DNA, 13 bp, Homo sapiens
aatacataaatag

SEQ ID NO: 3043659 - DNA, 22 bp, Homo sapiens
aatacataaatagtagaaaaat

SEQ ID NO: 3043660 - DNA, 23 bp, Homo sapiens
aatacatgacatttatttttcat

SEQ ID NO: 3043661 - DNA, 22 bp, Homo sapiens
aatacatttgtattttgtgatg

SEQ ID NO: 3043662 - DNA, 20 bp, Homo sapiens
aataccattttttaaggaaa

SEQ ID NO: 3043663 - DNA, 22 bp, Homo sapiens
aataccattttttaaggaaaca

SEQ ID NO: 3043664 - DNA, 16 bp, Homo sapiens
aatacctctgtgtgct

SEQ ID NO: 3043665 - DNA, 14 bp, Homo sapiens
aatacctttgtagt

SEQ ID NO: 3043666 - DNA, 19 bp, Homo sapiens
aatacctttgtagttactc

SEQ ID NO: 3043667 - DNA, 20 bp, Homo sapiens
aatacgtaattcttcctgtt

SEQ ID NO: 3043668 - DNA, 20 bp, Homo sapiens
aatactacctataggaaagt

SEQ ID NO: 3043669 - DNA, 15 bp, Homo sapiens
aatactaccttgaaa

SEQ ID NO: 3043670 - DNA, 16 bp, Homo sapiens
aatactaccttgaaaa

SEQ ID NO: 3043671 - DNA, 15 bp, Homo sapiens
aatactactactgtt

SEQ ID NO: 3043672 - DNA, 14 bp, Homo sapiens
aatactagttgtga

SEQ ID NO: 3043673 - DNA, 23 bp, Homo sapiens
aatactcataatgtgaagtgtta

SEQ ID NO: 3043674 - DNA, 19 bp, Homo sapiens
aatactgaatttctttgat

SEQ ID NO: 3043675 - DNA, 16 bp, Homo sapiens
aatactgacaatgtat

SEQ ID NO: 3043676 - DNA, 11 bp, Homo sapiens
aatactgcact

SEQ ID NO: 3043677 - DNA, 17 bp, Homo sapiens
aatactgccaaaacatt

SEQ ID NO: 3043678 - DNA, 22 bp, Homo sapiens
aatactgccaaaacatttatga

SEQ ID NO: 3043679 - DNA, 17 bp, Homo sapiens
aatactgccagatgctg

SEQ ID NO: 3043680 - DNA, 20 bp, Homo sapiens
aatactgccagatgctgatg

SEQ ID NO: 3043681 - DNA, 23 bp, Homo sapiens
aatactgccagatgctgatgttc

SEQ ID NO: 3043682 - DNA, 24 bp, Homo sapiens
aatactgccagatgctgatgttca

SEQ ID NO: 3043683 - DNA, 21 bp, Homo sapiens
aatactgctgagatacataca

SEQ ID NO: 3043684 - DNA, 23 bp, Homo sapiens
aatactggttatcctgtgctaca

SEQ ID NO: 3043685 - DNA, 18 bp, Homo sapiens
aatacttaaaaatagtct

SEQ ID NO: 3043686 - DNA, 15 bp, Homo sapiens
aatacttttccttac

SEQ ID NO: 3043687 - DNA, 17 bp, Homo sapiens
aatactttttctaatga

SEQ ID NO: 3043688 - DNA, 13 bp, Homo sapiens
aatagaacacaga

SEQ ID NO: 3043689 - DNA, 19 bp, Homo sapiens
aatagaaggatgtacattt

SEQ ID NO: 3043690 - DNA, 20 bp, Homo sapiens
aatagaaggatgtacatttc

SEQ ID NO: 3043691 - DNA, 13 bp, Homo sapiens
aatagaatgataa

SEQ ID NO: 3043692 - DNA, 16 bp, Homo sapiens
aatagaatttcctaat

SEQ ID NO: 3043693 - DNA, 13 bp, Homo sapiens
aatagagctgcca

SEQ ID NO: 3043694 - DNA, 14 bp, Homo sapiens
aatagagtgttttt

SEQ ID NO: 3043695 - DNA, 22 bp, Homo sapiens
aatagagtttgctattagagca

SEQ ID NO: 3043696 - DNA, 20 bp, Homo sapiens
aatagataactgctctttta

SEQ ID NO: 3043697 - DNA, 22 bp, Homo sapiens
aatagatgttttaacttattta

SEQ ID NO: 3043698 - DNA, 11 bp, Homo sapiens
aatagattctc

SEQ ID NO: 3043699 - DNA, 20 bp, Homo sapiens
aatagcatctgtacaaaggg

SEQ ID NO: 3043700 - DNA, 16 bp, Homo sapiens
aatagccccagactgg

SEQ ID NO: 3043701 - DNA, 16 bp, Homo sapiens
aatagctccaagctgt

SEQ ID NO: 3043702 - DNA, 21 bp, Homo sapiens
aatagctgcccatttcgtgag

SEQ ID NO: 3043703 - DNA, 22 bp, Homo sapiens
aatagctttagtgaattaaatt

SEQ ID NO: 3043704 - DNA, 13 bp, Homo sapiens
aataggaaacaag

SEQ ID NO: 3043705 - DNA, 11 bp, Homo sapiens
aataggagtct

SEQ ID NO: 3043706 - DNA, 15 bp, Homo sapiens
aataggatcctggag

SEQ ID NO: 3043707 - DNA, 16 bp, Homo sapiens
aataggatcctggagg

SEQ ID NO: 3043708 - DNA, 14 bp, Homo sapiens
aataggcaggaagc

SEQ ID NO: 3043709 - DNA, 13 bp, Homo sapiens
aataggccacaga

SEQ ID NO: 3043710 - DNA, 14 bp, Homo sapiens
aatagtagaaaaat

SEQ ID NO: 3043711 - DNA, 21 bp, Homo sapiens
aatagtctagatggctcctct

SEQ ID NO: 3043712 - DNA, 15 bp, Homo sapiens
aatagtgaaatgaat

SEQ ID NO: 3043713 - DNA, 15 bp, Homo sapiens
aatagtgttaatcaa

SEQ ID NO: 3043714 - DNA, 16 bp, Homo sapiens
aatagtgttaatcaat

SEQ ID NO: 3043715 - DNA, 20 bp, Homo sapiens
aatagttactccagtgccaa

SEQ ID NO: 3043716 - DNA, 22 bp, Homo sapiens
aatataaaaggcaaatgtgtac

SEQ ID NO: 3043717 - DNA, 23 bp, Homo sapiens
aatataaaaggcaaatgtgtaca

SEQ ID NO: 3043718 - DNA, 17 bp, Homo sapiens
aatcattttcattccta

SEQ ID NO: 3043719 - DNA, 16 bp, Homo sapiens
aatccaaatctgtcct

SEQ ID NO: 3043720 - DNA, 22 bp, Homo sapiens
aatccaagatattttaaaatct

SEQ ID NO: 3043721 - DNA, 23 bp, Homo sapiens
aatccaagcgaggtcaacagaga

SEQ ID NO: 3043722 - DNA, 23 bp, Homo sapiens
aatccaatcaatttaaatgttta

SEQ ID NO: 3043723 - DNA, 15 bp, Homo sapiens
aatccaatgaaatga

SEQ ID NO: 3043724 - DNA, 16 bp, Homo sapiens
aatccacatttctaaa

SEQ ID NO: 3043725 - DNA, 18 bp, Homo sapiens
aatccacctgcctcggcc

SEQ ID NO: 3043726 - DNA, 22 bp, Homo sapiens
aatccagcattgttgagctgtc

SEQ ID NO: 3043727 - DNA, 18 bp, Homo sapiens
aatccaggcagatccagg

SEQ ID NO: 3043728 - DNA, 22 bp, Homo sapiens
aatccaggcagatccaggacta

SEQ ID NO: 3043729 - DNA, 12 bp, Homo sapiens
aatccatcagca

SEQ ID NO: 3043730 - DNA, 11 bp, Homo sapiens
aatcccaaatt

SEQ ID NO: 3043731 - DNA, 16 bp, Homo sapiens
aatcccaaatttgatt

SEQ ID NO: 3043732 - DNA, 18 bp, Homo sapiens
aatcccagctactcagga

SEQ ID NO: 3043733 - DNA, 16 bp, Homo sapiens
aatccccccttcagaa

SEQ ID NO: 3043734 - DNA, 23 bp, Homo sapiens
aatccccccttcagaacagaggc

SEQ ID NO: 3043735 - DNA, 14 bp, Homo sapiens
aatcccctcattca

SEQ ID NO: 3043736 - DNA, 23 bp, Homo sapiens
aatccctagactttaggctttca

SEQ ID NO: 3043737 - DNA, 10 bp, Homo sapiens
aatccctcaa

SEQ ID NO: 3043738 - DNA, 19 bp, Homo sapiens
aatccctcaccttctgagt

SEQ ID NO: 3043739 - DNA, 21 bp, Homo sapiens
aatccctgggcattgctttcc

SEQ ID NO: 3043740 - DNA, 18 bp, Homo sapiens
aatccgtagttattttgc

SEQ ID NO: 3043741 - DNA, 13 bp, Homo sapiens
aatcctccccgct

SEQ ID NO: 3043742 - DNA, 13 bp, Homo sapiens
aatcctcctccag

SEQ ID NO: 3043743 - DNA, 11 bp, Homo sapiens
aatcctctggc

SEQ ID NO: 3043744 - DNA, 12 bp, Homo sapiens
aatcctgggccc

SEQ ID NO: 3043745 - DNA, 20 bp, Homo sapiens
aatcctgtcgattagactgg

SEQ ID NO: 3043746 - DNA, 20 bp, Homo sapiens
aatccttactaagtaggtga

SEQ ID NO: 3043747 - DNA, 17 bp, Homo sapiens
aagtggtgctcagttgt

SEQ ID NO: 3043748 - DNA, 19 bp, Homo sapiens
aagtggtgctcagttgtag

SEQ ID NO: 3043749 - DNA, 17 bp, Homo sapiens
aagtggtggtaaccctg

SEQ ID NO: 3043750 - DNA, 22 bp, Homo sapiens
aagtgtaaaatattttgaatca

SEQ ID NO: 3043751 - DNA, 11 bp, Homo sapiens
aagtgtaaagc

SEQ ID NO: 3043752 - DNA, 19 bp, Homo sapiens
aatgaacccatagggagct

SEQ ID NO: 3043753 - DNA, 13 bp, Homo sapiens
aatgaactgtatt

SEQ ID NO: 3043754 - DNA, 14 bp, Homo sapiens
aatgaactgtatta

SEQ ID NO: 3043755 - DNA, 21 bp, Homo sapiens
aatgaagaaagggaggcccag

SEQ ID NO: 3043756 - DNA, 13 bp, Homo sapiens
aatgaagaaggaa

SEQ ID NO: 3043757 - DNA, 16 bp, Homo sapiens
aatgaagatctttata

SEQ ID NO: 3043758 - DNA, 17 bp, Homo sapiens
aatgaaggtgtgctaca

SEQ ID NO: 3043759 - DNA, 23 bp, Homo sapiens
aatgaatagcttgtttctgtcaa

SEQ ID NO: 3043760 - DNA, 20 bp, Homo sapiens
aatgaatcgtaatgaagttg

SEQ ID NO: 3043761 - DNA, 21 bp, Homo sapiens
aatgaattcctagaattaaac

SEQ ID NO: 3043762 - DNA, 23 bp, Homo sapiens
aatgaattcctatatacctaata

SEQ ID NO: 3043763 - DNA, 14 bp, Homo sapiens
aatgaattctaaac

SEQ ID NO: 3043764 - DNA, 14 bp, Homo sapiens
aatgaattcttgat

SEQ ID NO: 3043765 - DNA, 19 bp, Homo sapiens
aatgacaaatgtattaatg

SEQ ID NO: 3043766 - DNA, 13 bp, Homo sapiens
aatgactaagcca

SEQ ID NO: 3043767 - DNA, 21 bp, Homo sapiens
aatgactaagccaagctgtgt

SEQ ID NO: 3043768 - DNA, 20 bp, Homo sapiens
aatgactcaggacatccccc

SEQ ID NO: 3043769 - DNA, 14 bp, Homo sapiens
aatgactgaaagaa

SEQ ID NO: 3043770 - DNA, 19 bp, Homo sapiens
aatgacttattgtggataa

SEQ ID NO: 3043771 - DNA, 16 bp, Homo sapiens
aatgacttttaaaatt

SEQ ID NO: 3043772 - DNA, 14 bp, Homo sapiens
aatgagaaccaaca

SEQ ID NO: 3043773 - DNA, 22 bp, Homo sapiens
aatgagatatatctttatactt

SEQ ID NO: 3043774 - DNA, 21 bp, Homo sapiens
aatgagcatctcaaatgtttt

SEQ ID NO: 3043775 - DNA, 18 bp, Homo sapiens
aatgaggaatagttttct

SEQ ID NO: 3043776 - DNA, 22 bp, Homo sapiens
aatgaggagagaaaatatatgt

SEQ ID NO: 3043777 - DNA, 23 bp, Homo sapiens
aatgaggtagctgacacagaaaa

SEQ ID NO: 3043778 - DNA, 20 bp, Homo sapiens
aatgagtcaggcaattgatt

SEQ ID NO: 3043779 - DNA, 14 bp, Homo sapiens
aatgagtggccagc

SEQ ID NO: 3043780 - DNA, 18 bp, Homo sapiens
aatgagtggccagcgcca

SEQ ID NO: 3043781 - DNA, 21 bp, Homo sapiens
aatgagtttaaaaatcaactt

SEQ ID NO: 3043782 - DNA, 21 bp, Homo sapiens
aatgagtttttatggggctga

SEQ ID NO: 3043783 - DNA, 16 bp, Homo sapiens
aatgatactgatggtg

SEQ ID NO: 3043784 - DNA, 18 bp, Homo sapiens
aatgatagatttgacctc

SEQ ID NO: 3043785 - DNA, 18 bp, Homo sapiens
aatgatagtaagaaaagt

SEQ ID NO: 3043786 - DNA, 16 bp, Homo sapiens
aatgatagtagagtga

SEQ ID NO: 3043787 - DNA, 16 bp, Homo sapiens
aatgggatcatgaaag

SEQ ID NO: 3043788 - DNA, 23 bp, Homo sapiens
aatgggatgtatgaatacagcag

SEQ ID NO: 3043789 - DNA, 15 bp, Homo sapiens
aatgggatttgaatc

SEQ ID NO: 3043790 - DNA, 22 bp, Homo sapiens
aatgggattttctagtttcctg

SEQ ID NO: 3043791 - DNA, 18 bp, Homo sapiens
aatgggcaggtggcctct

SEQ ID NO: 3043792 - DNA, 14 bp, Homo sapiens
aatggggccagatc

SEQ ID NO: 3043793 - DNA, 17 bp, Homo sapiens
aatggggtcctggccat

SEQ ID NO: 3043794 - DNA, 15 bp, Homo sapiens
aatgggtcatgacaa

SEQ ID NO: 3043795 - DNA, 16 bp, Homo sapiens
aatggtggcttcagct

SEQ ID NO: 3043796 - DNA, 15 bp, Homo sapiens
aatggtgtgtttccc

SEQ ID NO: 3043797 - DNA, 17 bp, Homo sapiens
aatggttataaaagtga

SEQ ID NO: 3043798 - DNA, 13 bp, Homo sapiens
aatggttgtgtag

SEQ ID NO: 3043799 - DNA, 16 bp, Homo sapiens
aatggtttcctctgga

SEQ ID NO: 3043800 - DNA, 16 bp, Homo sapiens
aatggtttgtcctgat

SEQ ID NO: 3043801 - DNA, 17 bp, Homo sapiens
aatggtttttaaatttt

SEQ ID NO: 3043802 - DNA, 17 bp, Homo sapiens
aatgtaaaaaagaaaaa

SEQ ID NO: 3043803 - DNA, 15 bp, Homo sapiens
aatgtaaaacacata

SEQ ID NO: 3043804 - DNA, 23 bp, Homo sapiens
aatgtaaaacacatacaaaagaa

SEQ ID NO: 3043805 - DNA, 13 bp, Homo sapiens
aatgtaaacattt

SEQ ID NO: 3043806 - DNA, 14 bp, Homo sapiens
aatgtaaacatttt

SEQ ID NO: 3043807 - DNA, 15 bp, Homo sapiens
aatgtaaagccatgc

SEQ ID NO: 3043808 - DNA, 23 bp, Homo sapiens
aatgtaaaggagtcaaaactaca

SEQ ID NO: 3043809 - DNA, 13 bp, Homo sapiens
aatgtaacatgat

SEQ ID NO: 3043810 - DNA, 16 bp, Homo sapiens
aatgtaagattataga

SEQ ID NO: 3043811 - DNA, 20 bp, Homo sapiens
aatgtaagattatagattct

SEQ ID NO: 3043812 - DNA, 15 bp, Homo sapiens
aatgtaagtgggccc

SEQ ID NO: 3043813 - DNA, 21 bp, Homo sapiens
aatgtaatatactgagctgct

SEQ ID NO: 3043814 - DNA, 15 bp, Homo sapiens
aatgtaattgtaatt

SEQ ID NO: 3043815 - DNA, 16 bp, Homo sapiens
aatgtacagttgaaat

SEQ ID NO: 3043816 - DNA, 18 bp, Homo sapiens
aatgtacgtccagcctgc

SEQ ID NO: 3043817 - DNA, 20 bp, Homo sapiens
aatgtactggtaattgtaca

SEQ ID NO: 3043818 - DNA, 15 bp, Homo sapiens
aatgtacttatatta

SEQ ID NO: 3043819 - DNA, 12 bp, Homo sapiens
aatgtagagggg

SEQ ID NO: 3043820 - DNA, 23 bp, Homo sapiens
aatgtagttctttgttcctgctt

SEQ ID NO: 3043821 - DNA, 18 bp, Homo sapiens
aatgtagttttgtttatg

SEQ ID NO: 3043822 - DNA, 22 bp, Homo sapiens
aatgtatgctatcctcttattc

SEQ ID NO: 3043823 - DNA, 15 bp, Homo sapiens
aatgtatgcttcata

SEQ ID NO: 3043824 - DNA, 20 bp, Homo sapiens
aatgtattaatatctccata

SEQ ID NO: 3043825 - DNA, 16 bp, Homo sapiens
aatgtattgtaccttt

SEQ ID NO: 3043826 - DNA, 23 bp, Homo sapiens
aatgtattgtaccttttaacacc

SEQ ID NO: 3043827 - DNA, 22 bp, Homo sapiens
aatgtattttggaagacatata

SEQ ID NO: 3043828 - DNA, 14 bp, Homo sapiens
aatgtatttttcct

SEQ ID NO: 3043829 - DNA, 18 bp, Homo sapiens
aatgtcaccaccttccca

SEQ ID NO: 3043830 - DNA, 19 bp, Homo sapiens
aattacaattttatctgtt

SEQ ID NO: 3043831 - DNA, 16 bp, Homo sapiens
aattaccaagagaagg

SEQ ID NO: 3043832 - DNA, 15 bp, Homo sapiens
aattacccttcctca

SEQ ID NO: 3043833 - DNA, 20 bp, Homo sapiens
aattacgataaggaagaaac

SEQ ID NO: 3043834 - DNA, 20 bp, Homo sapiens
aattacggtgtacagtttaa

SEQ ID NO: 3043835 - DNA, 19 bp, Homo sapiens
aattactcaggaagaacac

SEQ ID NO: 3043836 - DNA, 12 bp, Homo sapiens
aattactccaaa

SEQ ID NO: 3043837 - DNA, 20 bp, Homo sapiens
aattactccaaaaagacaag

SEQ ID NO: 3043838 - DNA, 19 bp, Homo sapiens
aattacttatccctgccca

SEQ ID NO: 3043839 - DNA, 19 bp, Homo sapiens
aattactttgattccattt

SEQ ID NO: 3043840 - DNA, 17 bp, Homo sapiens
aattagacttgaaatac

SEQ ID NO: 3043841 - DNA, 17 bp, Homo sapiens
aattagatgcatgttga

SEQ ID NO: 3043842 - DNA, 21 bp, Homo sapiens
aattagatgcatgttgaccat

SEQ ID NO: 3043843 - DNA, 17 bp, Homo sapiens
aattagatgtttatatc

SEQ ID NO: 3043844 - DNA, 17 bp, Homo sapiens
aattagcttggggccag

SEQ ID NO: 3043845 - DNA, 20 bp, Homo sapiens
aattaggaataaataaaaat

SEQ ID NO: 3043846 - DNA, 17 bp, Homo sapiens
aattagtaacatgtgtt

SEQ ID NO: 3043847 - DNA, 19 bp, Homo sapiens
aattagttggtttgtgtga

SEQ ID NO: 3043848 - DNA, 14 bp, Homo sapiens
aattatactttgtt

SEQ ID NO: 3043849 - DNA, 21 bp, Homo sapiens
aattataggaatatcaatata

SEQ ID NO: 3043850 - DNA, 13 bp, Homo sapiens
aattatagtttct

SEQ ID NO: 3043851 - DNA, 14 bp, Homo sapiens
aattatagtttctg

SEQ ID NO: 3043852 - DNA, 16 bp, Homo sapiens
aattatagtttctgag

SEQ ID NO: 3043853 - DNA, 17 bp, Homo sapiens
aattatagtttctgagg

SEQ ID NO: 3043854 - DNA, 21 bp, Homo sapiens
aattatatagcaaagatatat

SEQ ID NO: 3043855 - DNA, 20 bp, Homo sapiens
aattatatttgtgctatagt

SEQ ID NO: 3043856 - DNA, 22 bp, Homo sapiens
aattatatttgtgctatagtat

SEQ ID NO: 3043857 - DNA, 16 bp, Homo sapiens
aattatcctatttcag

SEQ ID NO: 3043858 - DNA, 15 bp, Homo sapiens
aattatctttagttg

SEQ ID NO: 3043859 - DNA, 20 bp, Homo sapiens
aattatctttagttgaattc

SEQ ID NO: 3043860 - DNA, 23 bp, Homo sapiens
aattatggagtattttaagtcta

SEQ ID NO: 3043861 - DNA, 16 bp, Homo sapiens
aattatgtaaataact

SEQ ID NO: 3043862 - DNA, 23 bp, Homo sapiens
aattatgtttttcagtttaattc

SEQ ID NO: 3043863 - DNA, 19 bp, Homo sapiens
aattattatttaactctta

SEQ ID NO: 3043864 - DNA, 15 bp, Homo sapiens
aattatttaaatgta

SEQ ID NO: 3043865 - DNA, 17 bp, Homo sapiens
aattatttaaatgtact

SEQ ID NO: 3043866 - DNA, 18 bp, Homo sapiens
aattatttaaatgtactt

SEQ ID NO: 3043867 - DNA, 19 bp, Homo sapiens
aattatttcacaaataata

SEQ ID NO: 3043868 - DNA, 17 bp, Homo sapiens
aattatttttaatttaa

SEQ ID NO: 3043869 - DNA, 16 bp, Homo sapiens
aattcagtatgtttta

SEQ ID NO: 3043870 - DNA, 16 bp, Homo sapiens
aattcagtgctgtact

SEQ ID NO: 3043871 - DNA, 17 bp, Homo sapiens
aattcagtgtatttcag

SEQ ID NO: 3043872 - DNA, 15 bp, Homo sapiens
aattcatactctgtt

SEQ ID NO: 3043873 - DNA, 19 bp, Homo sapiens
aattcatactctgttgcct

SEQ ID NO: 3043874 - DNA, 17 bp, Homo sapiens
aattcatatttttcctt

SEQ ID NO: 3043875 - DNA, 20 bp, Homo sapiens
aattcatatttttccttata

SEQ ID NO: 3043876 - DNA, 18 bp, Homo sapiens
aattccaaagtctctaat

SEQ ID NO: 3043877 - DNA, 18 bp, Homo sapiens
aattccaagtgtatttta

SEQ ID NO: 3043878 - DNA, 23 bp, Homo sapiens
aattccaagtgtattttaaaata

SEQ ID NO: 3043879 - DNA, 17 bp, Homo sapiens
aattccaattaaattta

SEQ ID NO: 3043880 - DNA, 22 bp, Homo sapiens
accttccccagacttgcactgg

SEQ ID NO: 3043881 - DNA, 14 bp, Homo sapiens
accttcctcctccc

SEQ ID NO: 3043882 - DNA, 19 bp, Homo sapiens
accttcctttttttaaatt

SEQ ID NO: 3043883 - DNA, 15 bp, Homo sapiens
accttcgggctgtgc

SEQ ID NO: 3043884 - DNA, 23 bp, Homo sapiens
accttctctatggggcatcctct

SEQ ID NO: 3043885 - DNA, 14 bp, Homo sapiens
aggaatcagctgca

SEQ ID NO: 3043886 - DNA, 15 bp, Homo sapiens
aggaatcagctgcag

SEQ ID NO: 3043887 - DNA, 17 bp, Homo sapiens
aggaatctgccttccag

SEQ ID NO: 3043888 - DNA, 23 bp, Homo sapiens
aggaatctgccttccagcccaga

SEQ ID NO: 3043889 - DNA, 20 bp, Homo sapiens
aggaatggacagacagagga

SEQ ID NO: 3043890 - DNA, 22 bp, Homo sapiens
aggaatgttaaagtcagtggga

SEQ ID NO: 3043891 - DNA, 12 bp, Homo sapiens
aggaatgtttca

SEQ ID NO: 3043892 - DNA, 22 bp, Homo sapiens
aggaattgaagatgtaaggaat

SEQ ID NO: 3043893 - DNA, 17 bp, Homo sapiens
aggaattgattgtcagc

SEQ ID NO: 3043894 - DNA, 15 bp, Homo sapiens
aggaatttggctgct

SEQ ID NO: 3043895 - DNA, 16 bp, Homo sapiens
aggacaaacagtgaat

SEQ ID NO: 3043896 - DNA, 17 bp, Homo sapiens
aggacaaagtgccaaag

SEQ ID NO: 3043897 - DNA, 20 bp, Homo sapiens
aggacaaagtgccaaagaaa

SEQ ID NO: 3043898 - DNA, 16 bp, Homo sapiens
aggacaaattgagaca

SEQ ID NO: 3043899 - DNA, 23 bp, Homo sapiens
aggacaaattgagacagtgcaca

SEQ ID NO: 3043900 - DNA, 15 bp, Homo sapiens
aggacaagaccctct

SEQ ID NO: 3043901 - DNA, 18 bp, Homo sapiens
aggacaattcatgaactt

SEQ ID NO: 3043902 - DNA, 22 bp, Homo sapiens
aggacacgcgcccccctcccag

SEQ ID NO: 3043903 - DNA, 16 bp, Homo sapiens
aggacagaccaaaaat

SEQ ID NO: 3043904 - DNA, 13 bp, Homo sapiens
aggacagactggc

SEQ ID NO: 3043905 - DNA, 23 bp, Homo sapiens
aggacagactggccgggcaggcg

SEQ ID NO: 3043906 - DNA, 16 bp, Homo sapiens
aggacagagggcacat

SEQ ID NO: 3043907 - DNA, 13 bp, Homo sapiens
aggacagctcttg

SEQ ID NO: 3043908 - DNA, 13 bp, Homo sapiens
aggacagctgtcc

SEQ ID NO: 3043909 - DNA, 15 bp, Homo sapiens
aggacagctgtcctc

SEQ ID NO: 3043910 - DNA, 12 bp, Homo sapiens
aggacagctgtg

SEQ ID NO: 3043911 - DNA, 15 bp, Homo sapiens
aggacagctgtgccc

SEQ ID NO: 3043912 - DNA, 17 bp, Homo sapiens
aggacatgatgctttta

SEQ ID NO: 3043913 - DNA, 22 bp, Homo sapiens
aggacatgcggtagccagcaca

SEQ ID NO: 3043914 - DNA, 14 bp, Homo sapiens
aggaccaagggggc

SEQ ID NO: 3043915 - DNA, 15 bp, Homo sapiens
aggaccagctcagga

SEQ ID NO: 3043916 - DNA, 17 bp, Homo sapiens
aggaccaggacccaggg

SEQ ID NO: 3043917 - DNA, 13 bp, Homo sapiens
aggaccagggcct

SEQ ID NO: 3043918 - DNA, 20 bp, Homo sapiens
aggaccagtcaacctgggca

SEQ ID NO: 3043919 - DNA, 15 bp, Homo sapiens
aggacccaagcagag

SEQ ID NO: 3043920 - DNA, 13 bp, Homo sapiens
aggacccagagga

SEQ ID NO: 3043921 - DNA, 18 bp, Homo sapiens
aggacccctcaccacccc

SEQ ID NO: 3043922 - DNA, 19 bp, Homo sapiens
aggacccctcaccaccccc

SEQ ID NO: 3043923 - DNA, 19 bp, Homo sapiens
aggacccgccagccccgct

SEQ ID NO: 3043924 - DNA, 20 bp, Homo sapiens
aggacccgccagccccgctc

SEQ ID NO: 3043925 - DNA, 19 bp, Homo sapiens
aggaccgccatggtgctgg

SEQ ID NO: 3043926 - DNA, 16 bp, Homo sapiens
aggaccggcggctcgg

SEQ ID NO: 3043927 - DNA, 21 bp, Homo sapiens
aggaccgggcactcccgggat

SEQ ID NO: 3043928 - DNA, 13 bp, Homo sapiens
aggacctgcctgt

SEQ ID NO: 3043929 - DNA, 13 bp, Homo sapiens
aggacctggctgc

SEQ ID NO: 3043930 - DNA, 20 bp, Homo sapiens
aggacgaacatccaaccttc

SEQ ID NO: 3043931 - DNA, 14 bp, Homo sapiens
aggacgtaaaattt

SEQ ID NO: 3043932 - DNA, 19 bp, Homo sapiens
aggacgtaaaatttacagt

SEQ ID NO: 3043933 - DNA, 15 bp, Homo sapiens
aggacgtgggctggg

SEQ ID NO: 3043934 - DNA, 16 bp, Homo sapiens
aggactcaccctccac

SEQ ID NO: 3043935 - DNA, 21 bp, Homo sapiens
aggaggccctggtcctggcct

SEQ ID NO: 3043936 - DNA, 16 bp, Homo sapiens
aggaggcgcggcctcc

SEQ ID NO: 3043937 - DNA, 13 bp, Homo sapiens
aggaggctccaga

SEQ ID NO: 3043938 - DNA, 16 bp, Homo sapiens
aggaggctccagaggg

SEQ ID NO: 3043939 - DNA, 17 bp, Homo sapiens
aggaggctccagagggc

SEQ ID NO: 3043940 - DNA, 18 bp, Homo sapiens
aggaggctccagagggca

SEQ ID NO: 3043941 - DNA, 15 bp, Homo sapiens
aggaggctgagacag

SEQ ID NO: 3043942 - DNA, 18 bp, Homo sapiens
aggaggctgccctgaggg

SEQ ID NO: 3043943 - DNA, 19 bp, Homo sapiens
aggaggctgccctgagggg

SEQ ID NO: 3043944 - DNA, 19 bp, Homo sapiens
aggaggctttaagctccag

SEQ ID NO: 3043945 - DNA, 15 bp, Homo sapiens
aggagggagaaagga

SEQ ID NO: 3043946 - DNA, 20 bp, Homo sapiens
aggagggagggtttctctcc

SEQ ID NO: 3043947 - DNA, 15 bp, Homo sapiens
aggagggaggtgctt

SEQ ID NO: 3043948 - DNA, 12 bp, Homo sapiens
aggagggcactg

SEQ ID NO: 3043949 - DNA, 21 bp, Homo sapiens
aggagggcgttcttaggctgc

SEQ ID NO: 3043950 - DNA, 17 bp, Homo sapiens
aggaggggacgggacag

SEQ ID NO: 3043951 - DNA, 22 bp, Homo sapiens
aggaggggacttgtaggaatct

SEQ ID NO: 3043952 - DNA, 21 bp, Homo sapiens
aggaggggcccccctgccctg

SEQ ID NO: 3043953 - DNA, 22 bp, Homo sapiens
aggagtcaactggctggccagt

SEQ ID NO: 3043954 - DNA, 22 bp, Homo sapiens
aggagtgaggaaggcaggaaga

SEQ ID NO: 3043955 - DNA, 22 bp, Homo sapiens
aggagtggttgggctgtgcctg

SEQ ID NO: 3043956 - DNA, 14 bp, Homo sapiens
aggagttgctgttt

SEQ ID NO: 3043957 - DNA, 14 bp, Homo sapiens
aggagtttcatgtt

SEQ ID NO: 3043958 - DNA, 20 bp, Homo sapiens
aggagtttgaggctgcaatg

SEQ ID NO: 3043959 - DNA, 17 bp, Homo sapiens
aggataacttgctttct

SEQ ID NO: 3043960 - DNA, 19 bp, Homo sapiens
aggataacttgctttcttc

SEQ ID NO: 3043961 - DNA, 18 bp, Homo sapiens
aggatagatgctggccca

SEQ ID NO: 3043962 - DNA, 21 bp, Homo sapiens
aggatagatgctggcccaggg

SEQ ID NO: 3043963 - DNA, 15 bp, Homo sapiens
aggatattatctacc

SEQ ID NO: 3043964 - DNA, 18 bp, Homo sapiens
aggatattatctacctgt

SEQ ID NO: 3043965 - DNA, 23 bp, Homo sapiens
aggatattatctacctgttctgt

SEQ ID NO: 3043966 - DNA, 17 bp, Homo sapiens
aggatcatcatttaaaa

SEQ ID NO: 3043967 - DNA, 19 bp, Homo sapiens
aggatcccatgagctcctt

SEQ ID NO: 3043968 - DNA, 14 bp, Homo sapiens
aggatcccctgtcc

SEQ ID NO: 3043969 - DNA, 16 bp, Homo sapiens
aggatcccctgtcccc

SEQ ID NO: 3043970 - DNA, 22 bp, Homo sapiens
aggatccgtgctgtctcctttg

SEQ ID NO: 3043971 - DNA, 14 bp, Homo sapiens
aggatcctggaggc

SEQ ID NO: 3043972 - DNA, 15 bp, Homo sapiens
aggatcctggaggct

SEQ ID NO: 3043973 - DNA, 21 bp, Homo sapiens
aggatcgaggcatggggcatg

SEQ ID NO: 3043974 - DNA, 21 bp, Homo sapiens
aggatctcctgtttttttcag

SEQ ID NO: 3043975 - DNA, 19 bp, Homo sapiens
aggatctgctccaacagaa

SEQ ID NO: 3043976 - DNA, 13 bp, Homo sapiens
aggatctttgtgg

SEQ ID NO: 3043977 - DNA, 20 bp, Homo sapiens
aggatctttgtggccaagga

SEQ ID NO: 3043978 - DNA, 17 bp, Homo sapiens
aggccccacaaggcctg

SEQ ID NO: 3043979 - DNA, 18 bp, Homo sapiens
aggccccacaaggcctgg

SEQ ID NO: 3043980 - DNA, 19 bp, Homo sapiens
aggccccacaaggcctggt

SEQ ID NO: 3043981 - DNA, 20 bp, Homo sapiens
aggccccacaaggcctggtc

SEQ ID NO: 3043982 - DNA, 14 bp, Homo sapiens
aggccccaggaagc

SEQ ID NO: 3043983 - DNA, 18 bp, Homo sapiens
aggcccccccagaagcaa

SEQ ID NO: 3043984 - DNA, 23 bp, Homo sapiens
aggccccctaggattccccctgc

SEQ ID NO: 3043985 - DNA, 21 bp, Homo sapiens
aggccccctctcaggagccat

SEQ ID NO: 3043986 - DNA, 13 bp, Homo sapiens
aggccccggcgcc

SEQ ID NO: 3043987 - DNA, 13 bp, Homo sapiens
aggcccctctcct

SEQ ID NO: 3043988 - DNA, 16 bp, Homo sapiens
aggcccctctcctccg

SEQ ID NO: 3043989 - DNA, 21 bp, Homo sapiens
aggcccctctgcaactggaga

SEQ ID NO: 3043990 - DNA, 13 bp, Homo sapiens
aggcccctgtgta

SEQ ID NO: 3043991 - DNA, 13 bp, Homo sapiens
aggcccggggctg

SEQ ID NO: 3043992 - DNA, 19 bp, Homo sapiens
aggcccgtcggagctgcct

SEQ ID NO: 3043993 - DNA, 21 bp, Homo sapiens
aggcccgtcggagctgcctgc

SEQ ID NO: 3043994 - DNA, 16 bp, Homo sapiens
aggcccgtctgtccat

SEQ ID NO: 3043995 - DNA, 20 bp, Homo sapiens
aggcccgtctgtccatctgc

SEQ ID NO: 3043996 - DNA, 12 bp, Homo sapiens
aggccctcccac

SEQ ID NO: 3043997 - DNA, 17 bp, Homo sapiens
aggccctcccaccaccc

SEQ ID NO: 3043998 - DNA, 20 bp, Homo sapiens
aggccctcccaccaccccat

SEQ ID NO: 3043999 - DNA, 20 bp, Homo sapiens
aggccctccctgttccccag

SEQ ID NO: 3044000 - DNA, 12 bp, Homo sapiens
aggccctctgcc

SEQ ID NO: 3044001 - DNA, 14 bp, Homo sapiens
aggccctctgcctg

SEQ ID NO: 3044002 - DNA, 23 bp, Homo sapiens
aggccctctgcctgcactccctg

SEQ ID NO: 3044003 - DNA, 19 bp, Homo sapiens
aggccctggagggcagaga

SEQ ID NO: 3044004 - DNA, 17 bp, Homo sapiens
aggccctggttcctgct

SEQ ID NO: 3044005 - DNA, 23 bp, Homo sapiens
aggccctggttcctgctgtcctg

SEQ ID NO: 3044006 - DNA, 13 bp, Homo sapiens
aggccctgtccag

SEQ ID NO: 3044007 - DNA, 16 bp, Homo sapiens
aggccctttcctttgg

SEQ ID NO: 3044008 - DNA, 16 bp, Homo sapiens
aggccgaagctgctgt

SEQ ID NO: 3044009 - DNA, 17 bp, Homo sapiens
aggccgacaccactcct

SEQ ID NO: 3044010 - DNA, 15 bp, Homo sapiens
aggccgagaagcaag

SEQ ID NO: 3044011 - DNA, 15 bp, Homo sapiens
aggccgaggtcccat

SEQ ID NO: 3044012 - DNA, 20 bp, Homo sapiens
aggccgcgcgtccagctgcc

SEQ ID NO: 3044013 - DNA, 15 bp, Homo sapiens
aggccgcggcccaga

SEQ ID NO: 3044014 - DNA, 20 bp, Homo sapiens
aggccgcggcctccccgagg

SEQ ID NO: 3044015 - DNA, 13 bp, Homo sapiens
aggccggagccca

SEQ ID NO: 3044016 - DNA, 21 bp, Homo sapiens
aggccggccctgcccctccct

SEQ ID NO: 3044017 - DNA, 20 bp, Homo sapiens
aggccgggcctgtacagtct

SEQ ID NO: 3044018 - DNA, 13 bp, Homo sapiens
aggccggggctgg

SEQ ID NO: 3044019 - DNA, 21 bp, Homo sapiens
aggccgtgtgtttagaagcct

SEQ ID NO: 3044020 - DNA, 22 bp, Homo sapiens
aggcctaggtgcagctcctcag

SEQ ID NO: 3044021 - DNA, 14 bp, Homo sapiens
aggcctcagccaga

SEQ ID NO: 3044022 - DNA, 16 bp, Homo sapiens
aggcctcagccagaga

SEQ ID NO: 3044023 - DNA, 15 bp, Homo sapiens
aggcctccagctcag

SEQ ID NO: 3044024 - DNA, 16 bp, Homo sapiens
aggcctccagctcagc

SEQ ID NO: 3044025 - DNA, 18 bp, Homo sapiens
aggcctccagctcagcag

SEQ ID NO: 3044026 - DNA, 11 bp, Homo sapiens
aggcctcccct

SEQ ID NO: 3044027 - DNA, 12 bp, Homo sapiens
aggcctcccctg

SEQ ID NO: 3044028 - DNA, 13 bp, Homo sapiens
aggcctcccctga

SEQ ID NO: 3044029 - DNA, 22 bp, Homo sapiens
aggcctcccctgaggatcccct

SEQ ID NO: 3044030 - DNA, 16 bp, Homo sapiens
aggcctcgcacttgca

SEQ ID NO: 3044031 - DNA, 13 bp, Homo sapiens
aggcctcgcctgc

SEQ ID NO: 3044032 - DNA, 16 bp, Homo sapiens
aggcctcgcctgccct

SEQ ID NO: 3044033 - DNA, 17 bp, Homo sapiens
aggcctcgcctgccctc

SEQ ID NO: 3044034 - DNA, 21 bp, Homo sapiens
aggcctcgcctgccctcctct

SEQ ID NO: 3044035 - DNA, 22 bp, Homo sapiens
aggcctcgcctgccctcctctc

SEQ ID NO: 3044036 - DNA, 14 bp, Homo sapiens
aggcctcggcagaa

SEQ ID NO: 3044037 - DNA, 22 bp, Homo sapiens
aggcctcggcagaactctctgt

SEQ ID NO: 3044038 - DNA, 20 bp, Homo sapiens
aggcctctcacctctgtgcc

SEQ ID NO: 3044039 - DNA, 14 bp, Homo sapiens
aggcctgagaccca

SEQ ID NO: 3044040 - DNA, 16 bp, Homo sapiens
aggcctgccttctcag

SEQ ID NO: 3044041 - DNA, 18 bp, Homo sapiens
aggcctgccttctcaggg

SEQ ID NO: 3044042 - DNA, 19 bp, Homo sapiens
aggcctgcgaccctggggg

SEQ ID NO: 3044043 - DNA, 21 bp, Homo sapiens
aggcctgcgaccctgggggca

SEQ ID NO: 3044044 - DNA, 20 bp, Homo sapiens
aggcctggagcgtttgctgt

SEQ ID NO: 3044045 - DNA, 12 bp, Homo sapiens
aggcctggctcc

SEQ ID NO: 3044046 - DNA, 16 bp, Homo sapiens
aggcctggctccccga

SEQ ID NO: 3044047 - DNA, 22 bp, Homo sapiens
aggcctgggggacccctggctc

SEQ ID NO: 3044048 - DNA, 17 bp, Homo sapiens
aggcctgtctgtgacct

SEQ ID NO: 3044049 - DNA, 22 bp, Homo sapiens
aggcctgtctgtgacctgcatc

SEQ ID NO: 3044050 - DNA, 17 bp, Homo sapiens
aggcctgtggggagccg

SEQ ID NO: 3044051 - DNA, 19 bp, Homo sapiens
aggccttatctccaagacc

SEQ ID NO: 3044052 - DNA, 18 bp, Homo sapiens
aggccttatgagggtcct

SEQ ID NO: 3044053 - DNA, 16 bp, Homo sapiens
aggccttgcctggcct

SEQ ID NO: 3044054 - DNA, 18 bp, Homo sapiens
aggccttgcctggcctga

SEQ ID NO: 3044055 - DNA, 22 bp, Homo sapiens
aggccttgctgactctctgagc

SEQ ID NO: 3044056 - DNA, 21 bp, Homo sapiens
aggccttggggtgggggccag

SEQ ID NO: 3044057 - DNA, 17 bp, Homo sapiens
aggccttgtgtgtcagg

SEQ ID NO: 3044058 - DNA, 14 bp, Homo sapiens
aggcctttcctaca

SEQ ID NO: 3044059 - DNA, 18 bp, Homo sapiens
aggcctttttcaaccaga

SEQ ID NO: 3044060 - DNA, 13 bp, Homo sapiens
aggcgaattgtag

SEQ ID NO: 3044061 - DNA, 23 bp, Homo sapiens
aggcgacgcggttttttcacttc

SEQ ID NO: 3044062 - DNA, 18 bp, Homo sapiens
aggcgcctataatcccag

SEQ ID NO: 3044063 - DNA, 19 bp, Homo sapiens
aggcgcggcggctctgccc

SEQ ID NO: 3044064 - DNA, 19 bp, Homo sapiens
aggcggaggcgctcctccc

SEQ ID NO: 3044065 - DNA, 23 bp, Homo sapiens
aggcggcactccaacctaacctg

SEQ ID NO: 3044066 - DNA, 14 bp, Homo sapiens
aggcggccagggcg

SEQ ID NO: 3044067 - DNA, 20 bp, Homo sapiens
aggcggccagggcggccagg

SEQ ID NO: 3044068 - DNA, 15 bp, Homo sapiens
aggcgggagctctcc

SEQ ID NO: 3044069 - DNA, 19 bp, Homo sapiens
aggcgtcttcatctccctg

SEQ ID NO: 3044070 - DNA, 21 bp, Homo sapiens
aggcgtcttcatctccctgcc

SEQ ID NO: 3044071 - DNA, 23 bp, Homo sapiens
aggcgtcttcatctccctgccat

SEQ ID NO: 3044072 - DNA, 14 bp, Homo sapiens
aggcgtgactcagc

SEQ ID NO: 3044073 - DNA, 17 bp, Homo sapiens
aggcgtgtgcaggccga

SEQ ID NO: 3044074 - DNA, 13 bp, Homo sapiens
aggcgtgtggcag

SEQ ID NO: 3044075 - DNA, 16 bp, Homo sapiens
aggcgtgtggcagcca

SEQ ID NO: 3044076 - DNA, 13 bp, Homo sapiens
agctccaactccc

SEQ ID NO: 3044077 - DNA, 14 bp, Homo sapiens
agctccaagctgtt

SEQ ID NO: 3044078 - DNA, 18 bp, Homo sapiens
agctcccaagagcttcca

SEQ ID NO: 3044079 - DNA, 13 bp, Homo sapiens
agctcccacccca

SEQ ID NO: 3044080 - DNA, 17 bp, Homo sapiens
agctcccaccccacccc

SEQ ID NO: 3044081 - DNA, 23 bp, Homo sapiens
agctcccaccccacccccttcag

SEQ ID NO: 3044082 - DNA, 12 bp, Homo sapiens
agctcccaggcc

SEQ ID NO: 3044083 - DNA, 20 bp, Homo sapiens
agctcccaggtgcagccaga

SEQ ID NO: 3044084 - DNA, 21 bp, Homo sapiens
agctcccaggtgcagccagag

SEQ ID NO: 3044085 - DNA, 16 bp, Homo sapiens
agctccgacctctctc

SEQ ID NO: 3044086 - DNA, 12 bp, Homo sapiens
agctcctcagcg

SEQ ID NO: 3044087 - DNA, 12 bp, Homo sapiens
agctcctcccct

SEQ ID NO: 3044088 - DNA, 15 bp, Homo sapiens
agctcctcccctgcc

SEQ ID NO: 3044089 - DNA, 22 bp, Homo sapiens
agctcctcccctgccgcctccc

SEQ ID NO: 3044090 - DNA, 17 bp, Homo sapiens
agctcctcctccctgca

SEQ ID NO: 3044091 - DNA, 23 bp, Homo sapiens
agctcctcctccctgcatctgac

SEQ ID NO: 3044092 - DNA, 17 bp, Homo sapiens
agctcctcctcctgggc

SEQ ID NO: 3044093 - DNA, 18 bp, Homo sapiens
agctcctctccccagccc

SEQ ID NO: 3044094 - DNA, 21 bp, Homo sapiens
agctcctctccccagcccaga

SEQ ID NO: 3044095 - DNA, 23 bp, Homo sapiens
agctcctctccccagcccagaga

SEQ ID NO: 3044096 - DNA, 18 bp, Homo sapiens
agctccttaaggctcttt

SEQ ID NO: 3044097 - DNA, 15 bp, Homo sapiens
agctccttcctggag

SEQ ID NO: 3044098 - DNA, 20 bp, Homo sapiens
agctccttgggaggccccac

SEQ ID NO: 3044099 - DNA, 15 bp, Homo sapiens
agctccttttctgtg

SEQ ID NO: 3044100 - DNA, 15 bp, Homo sapiens
agctcgcagcccccg

SEQ ID NO: 3044101 - DNA, 15 bp, Homo sapiens
agctcggggagcctt

SEQ ID NO: 3044102 - DNA, 18 bp, Homo sapiens
agctcgttacttcagccc

SEQ ID NO: 3044103 - DNA, 13 bp, Homo sapiens
agctctacccagg

SEQ ID NO: 3044104 - DNA, 17 bp, Homo sapiens
agctctagtcctttata

SEQ ID NO: 3044105 - DNA, 19 bp, Homo sapiens
agctctagtcctttataag

SEQ ID NO: 3044106 - DNA, 16 bp, Homo sapiens
agctctatctgcaatg

SEQ ID NO: 3044107 - DNA, 16 bp, Homo sapiens
agctctcaaatgtgac

SEQ ID NO: 3044108 - DNA, 15 bp, Homo sapiens
agctctccaggccag

SEQ ID NO: 3044109 - DNA, 17 bp, Homo sapiens
agctctccaggccaggt

SEQ ID NO: 3044110 - DNA, 21 bp, Homo sapiens
agctctccaggccaggtggga

SEQ ID NO: 3044111 - DNA, 18 bp, Homo sapiens
agctctgaaaccagtgtt

SEQ ID NO: 3044112 - DNA, 19 bp, Homo sapiens
agctctgaaaccagtgtta

SEQ ID NO: 3044113 - DNA, 20 bp, Homo sapiens
agctctgacattctgattcg

SEQ ID NO: 3044114 - DNA, 15 bp, Homo sapiens
agctctgacccacag

SEQ ID NO: 3044115 - DNA, 12 bp, Homo sapiens
agctctgcaggc

SEQ ID NO: 3044116 - DNA, 18 bp, Homo sapiens
agctctgccgtctctgga

SEQ ID NO: 3044117 - DNA, 13 bp, Homo sapiens
agctctgcgccag

SEQ ID NO: 3044118 - DNA, 16 bp, Homo sapiens
agctctgcgccaggca

SEQ ID NO: 3044119 - DNA, 21 bp, Homo sapiens
agctctgcgccaggcagagct

SEQ ID NO: 3044120 - DNA, 18 bp, Homo sapiens
agctctggacagccccac

SEQ ID NO: 3044121 - DNA, 20 bp, Homo sapiens
agctctggcttcctgctgag

SEQ ID NO: 3044122 - DNA, 18 bp, Homo sapiens
agctctgtcaccctggcc

SEQ ID NO: 3044123 - DNA, 13 bp, Homo sapiens
agctctgtctgct

SEQ ID NO: 3044124 - DNA, 15 bp, Homo sapiens
agctctgtctgctca

SEQ ID NO: 3044125 - DNA, 17 bp, Homo sapiens
agctctgtctgctcaat

SEQ ID NO: 3044126 - DNA, 17 bp, Homo sapiens
agctctgtgggaaaaaa

SEQ ID NO: 3044127 - DNA, 23 bp, Homo sapiens
agctctgtgggaaaaaagaaaaa

SEQ ID NO: 3044128 - DNA, 17 bp, Homo sapiens
agctcttcatctgccca

SEQ ID NO: 3044129 - DNA, 23 bp, Homo sapiens
agctcttcatctgcccaactgtg

SEQ ID NO: 3044130 - DNA, 15 bp, Homo sapiens
agctcttctgggcag

SEQ ID NO: 3044131 - DNA, 19 bp, Homo sapiens
agctcttgatttgggtgga

SEQ ID NO: 3044132 - DNA, 15 bp, Homo sapiens
agctcttgctctctt

SEQ ID NO: 3044133 - DNA, 19 bp, Homo sapiens
agctcttgctctcttgtga

SEQ ID NO: 3044134 - DNA, 13 bp, Homo sapiens
agctcttgggcct

SEQ ID NO: 3044135 - DNA, 15 bp, Homo sapiens
agctcttgggcctga

SEQ ID NO: 3044136 - DNA, 18 bp, Homo sapiens
agctcttgggtcagagaa

SEQ ID NO: 3044137 - DNA, 21 bp, Homo sapiens
actcttttgctttattccaga

SEQ ID NO: 3044138 - DNA, 18 bp, Homo sapiens
actctttttgttttttgt

SEQ ID NO: 3044139 - DNA, 13 bp, Homo sapiens
actgaaaaaatac

SEQ ID NO: 3044140 - DNA, 14 bp, Homo sapiens
actgaaaaaatact

SEQ ID NO: 3044141 - DNA, 16 bp, Homo sapiens
actgaaaacatctgga

SEQ ID NO: 3044142 - DNA, 17 bp, Homo sapiens
actgaaaacatctggaa

SEQ ID NO: 3044143 - DNA, 18 bp, Homo sapiens
actgaaaacatctggaag

SEQ ID NO: 3044144 - DNA, 16 bp, Homo sapiens
actgaaaacctctcct

SEQ ID NO: 3044145 - DNA, 20 bp, Homo sapiens
actgaaaaggaggggtctgg

SEQ ID NO: 3044146 - DNA, 13 bp, Homo sapiens
actgaaaccattt

SEQ ID NO: 3044147 - DNA, 13 bp, Homo sapiens
actgaaaggttac

SEQ ID NO: 3044148 - DNA, 17 bp, Homo sapiens
actgaaattacatattg

SEQ ID NO: 3044149 - DNA, 12 bp, Homo sapiens
actgaaccaaat

SEQ ID NO: 3044150 - DNA, 14 bp, Homo sapiens
actgaaccaaattg

SEQ ID NO: 3044151 - DNA, 19 bp, Homo sapiens
actgaaccaaattgcactg

SEQ ID NO: 3044152 - DNA, 18 bp, Homo sapiens
actgaactcactttcctc

SEQ ID NO: 3044153 - DNA, 21 bp, Homo sapiens
actgaactgtgtgtaattgtt

SEQ ID NO: 3044154 - DNA, 22 bp, Homo sapiens
actgaactgtgtgtaattgttc

SEQ ID NO: 3044155 - DNA, 13 bp, Homo sapiens
actgaactttctt

SEQ ID NO: 3044156 - DNA, 16 bp, Homo sapiens
actgaactttcttatc

SEQ ID NO: 3044157 - DNA, 17 bp, Homo sapiens
actgaagatattccaac

SEQ ID NO: 3044158 - DNA, 15 bp, Homo sapiens
actgaagatggcttt

SEQ ID NO: 3044159 - DNA, 13 bp, Homo sapiens
actgaagatttat

SEQ ID NO: 3044160 - DNA, 15 bp, Homo sapiens
actgaagcgaacatc

SEQ ID NO: 3044161 - DNA, 19 bp, Homo sapiens
actgaagcgaacatcttca

SEQ ID NO: 3044162 - DNA, 14 bp, Homo sapiens
actgaaggagaagg

SEQ ID NO: 3044163 - DNA, 21 bp, Homo sapiens
actgaaggatattttcaacaa

SEQ ID NO: 3044164 - DNA, 13 bp, Homo sapiens
actgaaggtgtgt

SEQ ID NO: 3044165 - DNA, 20 bp, Homo sapiens
actgaagtgcttgcagatca

SEQ ID NO: 3044166 - DNA, 14 bp, Homo sapiens
actgaagtttttga

SEQ ID NO: 3044167 - DNA, 15 bp, Homo sapiens
actgaagtttttgaa

SEQ ID NO: 3044168 - DNA, 22 bp, Homo sapiens
actgaagtttttgaaatacctt

SEQ ID NO: 3044169 - DNA, 14 bp, Homo sapiens
actgaatacaaata

SEQ ID NO: 3044170 - DNA, 21 bp, Homo sapiens
actgaatacttgaagtaggaa

SEQ ID NO: 3044171 - DNA, 19 bp, Homo sapiens
actgaatgaaacccccaca

SEQ ID NO: 3044172 - DNA, 18 bp, Homo sapiens
actgaatgtttacatgtc

SEQ ID NO: 3044173 - DNA, 13 bp, Homo sapiens
actgaatttcttt

SEQ ID NO: 3044174 - DNA, 23 bp, Homo sapiens
actgaatttctttgatttaactg

SEQ ID NO: 3044175 - DNA, 14 bp, Homo sapiens
actgacacatcagc

SEQ ID NO: 3044176 - DNA, 15 bp, Homo sapiens
actgacacatcagca

SEQ ID NO: 3044177 - DNA, 21 bp, Homo sapiens
actgacacatcagcatgtttt

SEQ ID NO: 3044178 - DNA, 19 bp, Homo sapiens
actgaccaataccccgact

SEQ ID NO: 3044179 - DNA, 17 bp, Homo sapiens
actgaccctggggctgg

SEQ ID NO: 3044180 - DNA, 21 bp, Homo sapiens
actgacctggtccacagggca

SEQ ID NO: 3044181 - DNA, 15 bp, Homo sapiens
actgaccttgtaaaa

SEQ ID NO: 3044182 - DNA, 23 bp, Homo sapiens
actgacttggatcccaaagcaag

SEQ ID NO: 3044183 - DNA, 14 bp, Homo sapiens
actgactttaagta

SEQ ID NO: 3044184 - DNA, 14 bp, Homo sapiens
actgagcaccttac

SEQ ID NO: 3044185 - DNA, 20 bp, Homo sapiens
actgagcatcactagtgaca

SEQ ID NO: 3044186 - DNA, 13 bp, Homo sapiens
actgagcatctcc

SEQ ID NO: 3044187 - DNA, 22 bp, Homo sapiens
actgagccagattggccaatta

SEQ ID NO: 3044188 - DNA, 19 bp, Homo sapiens
actgagcgcaagccacagc

SEQ ID NO: 3044189 - DNA, 21 bp, Homo sapiens
actgagcggccgcagagactg

SEQ ID NO: 3044190 - DNA, 16 bp, Homo sapiens
actgagctctccaggc

SEQ ID NO: 3044191 - DNA, 19 bp, Homo sapiens
actgagctctccaggccag

SEQ ID NO: 3044192 - DNA, 20 bp, Homo sapiens
actgagctctccaggccagg

SEQ ID NO: 3044193 - DNA, 20 bp, Homo sapiens
actgaggccttgtgtgtcag

SEQ ID NO: 3044194 - DNA, 20 bp, Homo sapiens
actgagtagctctcctgact

SEQ ID NO: 3044195 - DNA, 18 bp, Homo sapiens
actgagtccctggcaaga

SEQ ID NO: 3044196 - DNA, 21 bp, Homo sapiens
actgagtccctggcaagactg

SEQ ID NO: 3044197 - DNA, 12 bp, Homo sapiens
actgagtgactc

SEQ ID NO: 3044198 - DNA, 13 bp, Homo sapiens
actgagttttcca

SEQ ID NO: 3044199 - DNA, 18 bp, Homo sapiens
actgagttttccatggca

SEQ ID NO: 3044200 - DNA, 23 bp, Homo sapiens
actgatagttactgttgtgacct

SEQ ID NO: 3044201 - DNA, 17 bp, Homo sapiens
actgatccagccctgag

SEQ ID NO: 3044202 - DNA, 15 bp, Homo sapiens
actgatgacttacta

SEQ ID NO: 3044203 - DNA, 17 bp, Homo sapiens
actgatgcaaggattac

SEQ ID NO: 3044204 - DNA, 22 bp, Homo sapiens
actgatgcaaggattacagaaa

SEQ ID NO: 3044205 - DNA, 23 bp, Homo sapiens
actgatgcaaggattacagaaac

SEQ ID NO: 3044206 - DNA, 15 bp, Homo sapiens
actgatggaagcaca

SEQ ID NO: 3044207 - DNA, 17 bp, Homo sapiens
actgattagtattcagg

SEQ ID NO: 3044208 - DNA, 13 bp, Homo sapiens
actgattctgttg

SEQ ID NO: 3044209 - DNA, 13 bp, Homo sapiens
actgattttacaa

SEQ ID NO: 3044210 - DNA, 16 bp, Homo sapiens
actgcaacctctgcct

SEQ ID NO: 3044211 - DNA, 17 bp, Homo sapiens
actgcaacctctgcctc

SEQ ID NO: 3044212 - DNA, 15 bp, Homo sapiens
actgcaaccttcacc

SEQ ID NO: 3044213 - DNA, 18 bp, Homo sapiens
actgcaagagccttggtg

SEQ ID NO: 3044214 - DNA, 14 bp, Homo sapiens
actgcaatcactgt

SEQ ID NO: 3044215 - DNA, 16 bp, Homo sapiens
actgcaatcactgtgc

SEQ ID NO: 3044216 - DNA, 18 bp, Homo sapiens
actgcaatcactgtgcta

SEQ ID NO: 3044217 - DNA, 19 bp, Homo sapiens
actgcacaataaaaccaag

SEQ ID NO: 3044218 - DNA, 14 bp, Homo sapiens
actgcacacagggt

SEQ ID NO: 3044219 - DNA, 16 bp, Homo sapiens
actgcacagcgtcctg

SEQ ID NO: 3044220 - DNA, 18 bp, Homo sapiens
actgcacagcgtcctgtc

SEQ ID NO: 3044221 - DNA, 21 bp, Homo sapiens
actgcacccacctacttagat

SEQ ID NO: 3044222 - DNA, 13 bp, Homo sapiens
actgcacccagga

SEQ ID NO: 3044223 - DNA, 14 bp, Homo sapiens
actgcacccaggag

SEQ ID NO: 3044224 - DNA, 18 bp, Homo sapiens
actgcactccagcctgag

SEQ ID NO: 3044225 - DNA, 19 bp, Homo sapiens
actgcactccagcctgggt

SEQ ID NO: 3044226 - DNA, 20 bp, Homo sapiens
actgcactccagcctgggtc

SEQ ID NO: 3044227 - DNA, 13 bp, Homo sapiens
actgcagaagcaa

SEQ ID NO: 3044228 - DNA, 19 bp, Homo sapiens
actgcagcaatctttgaaa

SEQ ID NO: 3044229 - DNA, 15 bp, Homo sapiens
actgcaggccccgct

SEQ ID NO: 3044230 - DNA, 23 bp, Homo sapiens
actgcaggccccgcttgtccagc

SEQ ID NO: 3044231 - DNA, 19 bp, Homo sapiens
actgcagtcatcaacaatg

SEQ ID NO: 3044232 - DNA, 19 bp, Homo sapiens
actgcagtcggcatgccag

SEQ ID NO: 3044233 - DNA, 20 bp, Homo sapiens
actgcagtcggcatgccagg

SEQ ID NO: 3044234 - DNA, 21 bp, Homo sapiens
actgcagtcggcatgccagga

SEQ ID NO: 3044235 - DNA, 16 bp, Homo sapiens
actgcataccaacctg

SEQ ID NO: 3044236 - DNA, 20 bp, Homo sapiens
actgcataccaacctgggca

SEQ ID NO: 3044237 - DNA, 22 bp, Homo sapiens
actgcataccaacctgggcaat

SEQ ID NO: 3044238 - DNA, 16 bp, Homo sapiens
actgcattagaaatga

SEQ ID NO: 3044239 - DNA, 13 bp, Homo sapiens
actgcatttgtgt

SEQ ID NO: 3044240 - DNA, 12 bp, Homo sapiens
actgcattttag

SEQ ID NO: 3044241 - DNA, 15 bp, Homo sapiens
actgccaaaacattt

SEQ ID NO: 3044242 - DNA, 20 bp, Homo sapiens
actgccacgtgccttaggaa

SEQ ID NO: 3044243 - DNA, 21 bp, Homo sapiens
actgccaggattttgtattgc

SEQ ID NO: 3044244 - DNA, 23 bp, Homo sapiens
actgccattacccagtgccgagg

SEQ ID NO: 3044245 - DNA, 12 bp, Homo sapiens
actgcccagcca

SEQ ID NO: 3044246 - DNA, 14 bp, Homo sapiens
actgcccagccact

SEQ ID NO: 3044247 - DNA, 16 bp, Homo sapiens
actgcccagccactcc

SEQ ID NO: 3044248 - DNA, 17 bp, Homo sapiens
actgccccaactcctgg

SEQ ID NO: 3044249 - DNA, 21 bp, Homo sapiens
actgccccaactcctggaagc

SEQ ID NO: 3044250 - DNA, 16 bp, Homo sapiens
actgccccagccaacg

SEQ ID NO: 3044251 - DNA, 14 bp, Homo sapiens
actgccctctgaaa

SEQ ID NO: 3044252 - DNA, 17 bp, Homo sapiens
actgccctgtttctgtt

SEQ ID NO: 3044253 - DNA, 17 bp, Homo sapiens
actgccgacatccctcc

SEQ ID NO: 3044254 - DNA, 15 bp, Homo sapiens
actgccgccttctcg

SEQ ID NO: 3044255 - DNA, 18 bp, Homo sapiens
actgcctaaggccctttg

SEQ ID NO: 3044256 - DNA, 12 bp, Homo sapiens
actgcctcagcg

SEQ ID NO: 3044257 - DNA, 14 bp, Homo sapiens
actgcctccctctc

SEQ ID NO: 3044258 - DNA, 19 bp, Homo sapiens
actgcctcctccctggctg

SEQ ID NO: 3044259 - DNA, 21 bp, Homo sapiens
actgcctcctccctggctgca

SEQ ID NO: 3044260 - DNA, 23 bp, Homo sapiens
actgcctcctccctggctgcagc

SEQ ID NO: 3044261 - DNA, 18 bp, Homo sapiens
actgcctccttgccagcc

SEQ ID NO: 3044262 - DNA, 17 bp, Homo sapiens
actgcctcgaaacacag

SEQ ID NO: 3044263 - DNA, 19 bp, Homo sapiens
actgcctcgaaacacagaa

SEQ ID NO: 3044264 - DNA, 14 bp, Homo sapiens
actgcctgaataaa

SEQ ID NO: 3044265 - DNA, 19 bp, Homo sapiens
actgcctgaataaagagcc

SEQ ID NO: 3044266 - DNA, 16 bp, Homo sapiens
actgcctgtctccatg

SEQ ID NO: 3044267 - DNA, 17 bp, Homo sapiens
actgcctgtctccatga

SEQ ID NO: 3044268 - DNA, 19 bp, Homo sapiens
actgccttcgtttatattt

SEQ ID NO: 3044269 - DNA, 18 bp, Homo sapiens
actgcgctttattttctt

SEQ ID NO: 3044270 - DNA, 14 bp, Homo sapiens
actgcgttagatgg

SEQ ID NO: 3044271 - DNA, 13 bp, Homo sapiens
actgctaaataaa

SEQ ID NO: 3044272 - DNA, 15 bp, Homo sapiens
actgctaaataaaat

SEQ ID NO: 3044273 - DNA, 18 bp, Homo sapiens
actgctaagaatatttga

SEQ ID NO: 3044274 - DNA, 19 bp, Homo sapiens
agggctggaggcccaggct

SEQ ID NO: 3044275 - DNA, 12 bp, Homo sapiens
agggctggctgg

SEQ ID NO: 3044276 - DNA, 22 bp, Homo sapiens
agggctgggaaacactccttgc

SEQ ID NO: 3044277 - DNA, 23 bp, Homo sapiens
agggctgggaaacactccttgca

SEQ ID NO: 3044278 - DNA, 15 bp, Homo sapiens
agggctgggtcacag

SEQ ID NO: 3044279 - DNA, 17 bp, Homo sapiens
agggctgggtcacagga

SEQ ID NO: 3044280 - DNA, 18 bp, Homo sapiens
agggctgggtcacaggaa

SEQ ID NO: 3044281 - DNA, 12 bp, Homo sapiens
agggctggtttg

SEQ ID NO: 3044282 - DNA, 19 bp, Homo sapiens
agggctgtcatctgtgcac

SEQ ID NO: 3044283 - DNA, 16 bp, Homo sapiens
aggggaaacgagaagg

SEQ ID NO: 3044284 - DNA, 19 bp, Homo sapiens
aggggaaacgtctcccaga

SEQ ID NO: 3044285 - DNA, 20 bp, Homo sapiens
aggggaaacgtctcccagat

SEQ ID NO: 3044286 - DNA, 20 bp, Homo sapiens
aggggaaaggcctgtgggga

SEQ ID NO: 3044287 - DNA, 15 bp, Homo sapiens
aggtcagtgcaaata

SEQ ID NO: 3044288 - DNA, 16 bp, Homo sapiens
aggtcatagattcttg

SEQ ID NO: 3044289 - DNA, 18 bp, Homo sapiens
aggtcatggccacactgt

SEQ ID NO: 3044290 - DNA, 19 bp, Homo sapiens
aggtcatggccacactgtg

SEQ ID NO: 3044291 - DNA, 21 bp, Homo sapiens
aggtccaaatgtttatgtttt

SEQ ID NO: 3044292 - DNA, 24 bp, Homo sapiens
aggtccaattctcgagcttggggc

SEQ ID NO: 3044293 - DNA, 14 bp, Homo sapiens
aggtccacaggtct

SEQ ID NO: 3044294 - DNA, 19 bp, Homo sapiens
aggtccacaggtctagact

SEQ ID NO: 3044295 - DNA, 20 bp, Homo sapiens
aggtccattctgtttaaatc

SEQ ID NO: 3044296 - DNA, 16 bp, Homo sapiens
aggtcccagcgagcca

SEQ ID NO: 3044297 - DNA, 19 bp, Homo sapiens
aggtcccagcgagccacag

SEQ ID NO: 3044298 - DNA, 15 bp, Homo sapiens
aggtcccctggcagt

SEQ ID NO: 3044299 - DNA, 14 bp, Homo sapiens
aggtcccttgtttc

SEQ ID NO: 3044300 - DNA, 19 bp, Homo sapiens
aggtcctctgtcagtcaca

SEQ ID NO: 3044301 - DNA, 15 bp, Homo sapiens
aggtcgaagcaatca

SEQ ID NO: 3044302 - DNA, 18 bp, Homo sapiens
aggtctaaataggatcct

SEQ ID NO: 3044303 - DNA, 13 bp, Homo sapiens
aggtctcccggga

SEQ ID NO: 3044304 - DNA, 21 bp, Homo sapiens
aggtctcgggggtccggaagg

SEQ ID NO: 3044305 - DNA, 15 bp, Homo sapiens
aggtctcgtcccagc

SEQ ID NO: 3044306 - DNA, 19 bp, Homo sapiens
aggtctcgtcccagccctc

SEQ ID NO: 3044307 - DNA, 14 bp, Homo sapiens
aggtctctgagaca

SEQ ID NO: 3044308 - DNA, 21 bp, Homo sapiens
aggtctctgttgactggctgt

SEQ ID NO: 3044309 - DNA, 14 bp, Homo sapiens
aggtctctgtttag

SEQ ID NO: 3044310 - DNA, 13 bp, Homo sapiens
aggtctgatttgc

SEQ ID NO: 3044311 - DNA, 15 bp, Homo sapiens
aggtctgatttgcag

SEQ ID NO: 3044312 - DNA, 21 bp, Homo sapiens
aggtctgcaagggcccagagt

SEQ ID NO: 3044313 - DNA, 17 bp, Homo sapiens
aggtcttacattgcctg

SEQ ID NO: 3044314 - DNA, 21 bp, Homo sapiens
aggtcttcctgtggctccctc

SEQ ID NO: 3044315 - DNA, 20 bp, Homo sapiens
aggtcttggttagagaagta

SEQ ID NO: 3044316 - DNA, 19 bp, Homo sapiens
aggtctttgtaaaatcttg

SEQ ID NO: 3044317 - DNA, 20 bp, Homo sapiens
aggtctttgtaagaactaaa

SEQ ID NO: 3044318 - DNA, 23 bp, Homo sapiens
aggtctttgtaagaactaaagaa

SEQ ID NO: 3044319 - DNA, 20 bp, Homo sapiens
aggtgaaaatgaagaaggaa

SEQ ID NO: 3044320 - DNA, 15 bp, Homo sapiens
aggtgaattaatgga

SEQ ID NO: 3044321 - DNA, 19 bp, Homo sapiens
aggtgaccaaatcagtgtg

SEQ ID NO: 3044322 - DNA, 19 bp, Homo sapiens
aggtgacccaatgattcag

SEQ ID NO: 3044323 - DNA, 17 bp, Homo sapiens
aggtgaccgcccagctc

SEQ ID NO: 3044324 - DNA, 21 bp, Homo sapiens
aggtgaccgcccagctctccc

SEQ ID NO: 3044325 - DNA, 22 bp, Homo sapiens
aggtgaccgcccagctctccca

SEQ ID NO: 3044326 - DNA, 16 bp, Homo sapiens
aggtgactttctgaaa

SEQ ID NO: 3044327 - DNA, 15 bp, Homo sapiens
aggtgagagtgcaga

SEQ ID NO: 3044328 - DNA, 20 bp, Homo sapiens
aggtgaggcctgtctgtgac

SEQ ID NO: 3044329 - DNA, 20 bp, Homo sapiens
aggtgattatttttctcctg

SEQ ID NO: 3044330 - DNA, 16 bp, Homo sapiens
aggtgcaatttcaagg

SEQ ID NO: 3044331 - DNA, 12 bp, Homo sapiens
aggtgcagaggt

SEQ ID NO: 3044332 - DNA, 14 bp, Homo sapiens
aggtgcagccagag

SEQ ID NO: 3044333 - DNA, 16 bp, Homo sapiens
aggtgcagccagaggc

SEQ ID NO: 3044334 - DNA, 16 bp, Homo sapiens
aggtgcagctcctcag

SEQ ID NO: 3044335 - DNA, 15 bp, Homo sapiens
aggtgcagctgcgtt

SEQ ID NO: 3044336 - DNA, 18 bp, Homo sapiens
aggtgcagctgcgttctg

SEQ ID NO: 3044337 - DNA, 22 bp, Homo sapiens
aggtgcagctgcgttctgaggg

SEQ ID NO: 3044338 - DNA, 19 bp, Homo sapiens
aggtgcatatagaaaacaa

SEQ ID NO: 3044339 - DNA, 18 bp, Homo sapiens
aggtgcatctgcaggcac

SEQ ID NO: 3044340 - DNA, 13 bp, Homo sapiens
aggtgccagaagg

SEQ ID NO: 3044341 - DNA, 17 bp, Homo sapiens
aggtgccagaaggaagg

SEQ ID NO: 3044342 - DNA, 15 bp, Homo sapiens
aggtgccatgtcttt

SEQ ID NO: 3044343 - DNA, 21 bp, Homo sapiens
aggtgcccagaataagttatt

SEQ ID NO: 3044344 - DNA, 18 bp, Homo sapiens
aggtgcccagaatgaggc

SEQ ID NO: 3044345 - DNA, 22 bp, Homo sapiens
aggtgcccttggaggccagcca

SEQ ID NO: 3044346 - DNA, 18 bp, Homo sapiens
aggtgcctgtgaggcagg

SEQ ID NO: 3044347 - DNA, 19 bp, Homo sapiens
aggtgcctgtgaggcaggg

SEQ ID NO: 3044348 - DNA, 13 bp, Homo sapiens
aggtgccttcttc

SEQ ID NO: 3044349 - DNA, 17 bp, Homo sapiens
aggtgccttcttcaggg

SEQ ID NO: 3044350 - DNA, 21 bp, Homo sapiens
aggtgctgatctgtggtctac

SEQ ID NO: 3044351 - DNA, 23 bp, Homo sapiens
aggtgctgcggcgcgggcccctc

SEQ ID NO: 3044352 - DNA, 14 bp, Homo sapiens
aggtgctggcccag

SEQ ID NO: 3044353 - DNA, 16 bp, Homo sapiens
aggtgctggcccagca

SEQ ID NO: 3044354 - DNA, 23 bp, Homo sapiens
aggtgctggtagctgaggggacg

SEQ ID NO: 3044355 - DNA, 20 bp, Homo sapiens
aggtggaagccctccttcca

SEQ ID NO: 3044356 - DNA, 17 bp, Homo sapiens
aggtggaattattttaa

SEQ ID NO: 3044357 - DNA, 15 bp, Homo sapiens
aggtggacctggcag

SEQ ID NO: 3044358 - DNA, 17 bp, Homo sapiens
aggtggagagcactaga

SEQ ID NO: 3044359 - DNA, 19 bp, Homo sapiens
aggtggattttgtttaaaa

SEQ ID NO: 3044360 - DNA, 19 bp, Homo sapiens
aggtggcactagggatcaa

SEQ ID NO: 3044361 - DNA, 15 bp, Homo sapiens
aggtggccgcccctg

SEQ ID NO: 3044362 - DNA, 17 bp, Homo sapiens
aggtggccgcccctgag

SEQ ID NO: 3044363 - DNA, 20 bp, Homo sapiens
aggtggccgcccctgaggct

SEQ ID NO: 3044364 - DNA, 13 bp, Homo sapiens
aggtggcctctgc

SEQ ID NO: 3044365 - DNA, 14 bp, Homo sapiens
aggtggctattttg

SEQ ID NO: 3044366 - DNA, 14 bp, Homo sapiens
aggtggctgagccc

SEQ ID NO: 3044367 - DNA, 17 bp, Homo sapiens
aggtggctgagcccctg

SEQ ID NO: 3044368 - DNA, 12 bp, Homo sapiens
aggtggctgcct

SEQ ID NO: 3044369 - DNA, 17 bp, Homo sapiens
aggtggctgcctggagc

SEQ ID NO: 3044370 - DNA, 13 bp, Homo sapiens
aggtgggaggcca

SEQ ID NO: 3044371 - DNA, 15 bp, Homo sapiens
aggtgggaggccagg

SEQ ID NO: 3044372 - DNA, 21 bp, Homo sapiens
aggtgggaggccaggcgagcc

SEQ ID NO: 3044373 - DNA, 21 bp, Homo sapiens
aggtgggcggacaaaagggcc

SEQ ID NO: 3044374 - DNA, 15 bp, Homo sapiens
aggtggggtgagaat

SEQ ID NO: 3044375 - DNA, 16 bp, Homo sapiens
aggtggggtgatggcc

SEQ ID NO: 3044376 - DNA, 23 bp, Homo sapiens
aggtggggtttcctgcatggaca

SEQ ID NO: 3044377 - DNA, 18 bp, Homo sapiens
aggtggtgtcactgtccc

SEQ ID NO: 3044378 - DNA, 14 bp, Homo sapiens
aggtgtccctgcct

SEQ ID NO: 3044379 - DNA, 15 bp, Homo sapiens
aggtgtccctgcctt

SEQ ID NO: 3044380 - DNA, 15 bp, Homo sapiens
aggtgtctgccactt

SEQ ID NO: 3044381 - DNA, 14 bp, Homo sapiens
aggtgtctggcctg

SEQ ID NO: 3044382 - DNA, 15 bp, Homo sapiens
aggtgtctggcctga

SEQ ID NO: 3044383 - DNA, 16 bp, Homo sapiens
aggtgtctggcctgag

SEQ ID NO: 3044384 - DNA, 17 bp, Homo sapiens
aggtgtctggcctgagg

SEQ ID NO: 3044385 - DNA, 14 bp, Homo sapiens
aggtgtgcaagaga

SEQ ID NO: 3044386 - DNA, 22 bp, Homo sapiens
aggtgttgaagaaattataaag

SEQ ID NO: 3044387 - DNA, 16 bp, Homo sapiens
aggtgttgtcccttct

SEQ ID NO: 3044388 - DNA, 12 bp, Homo sapiens
aggtgtttatac

SEQ ID NO: 3044389 - DNA, 16 bp, Homo sapiens
aggtgttttctgtgta

SEQ ID NO: 3044390 - DNA, 16 bp, Homo sapiens
aggttaaggctgagga

SEQ ID NO: 3044391 - DNA, 24 bp, Homo sapiens
aggttaaggctgaggaaaggccag

SEQ ID NO: 3044392 - DNA, 16 bp, Homo sapiens
aggttaatttttcctt

SEQ ID NO: 3044393 - DNA, 14 bp, Homo sapiens
aggttacaacagat

SEQ ID NO: 3044394 - DNA, 23 bp, Homo sapiens
aggttacaacagatttgtgaact

SEQ ID NO: 3044395 - DNA, 20 bp, Homo sapiens
aggttactcagcagcagaga

SEQ ID NO: 3044396 - DNA, 15 bp, Homo sapiens
aggttataagaaaca

SEQ ID NO: 3044397 - DNA, 16 bp, Homo sapiens
aggttataagaaacag

SEQ ID NO: 3044398 - DNA, 20 bp, Homo sapiens
aggttattttagtttctgtt

SEQ ID NO: 3044399 - DNA, 16 bp, Homo sapiens
aggttcacagcagctt

SEQ ID NO: 3044400 - DNA, 16 bp, Homo sapiens
aggttcacgtgcagct

SEQ ID NO: 3044401 - DNA, 21 bp, Homo sapiens
aggttcacttaaaagctggct

SEQ ID NO: 3044402 - DNA, 17 bp, Homo sapiens
aggttccaactgtatat

SEQ ID NO: 3044403 - DNA, 15 bp, Homo sapiens
aggttcccgacacca

SEQ ID NO: 3044404 - DNA, 19 bp, Homo sapiens
aggttcccgacaccagaag

SEQ ID NO: 3044405 - DNA, 16 bp, Homo sapiens
aggttccgatgttatt

SEQ ID NO: 3044406 - DNA, 12 bp, Homo sapiens
aggttcctaaga

SEQ ID NO: 3044407 - DNA, 11 bp, Homo sapiens
aggttctaaag

SEQ ID NO: 3044408 - DNA, 14 bp, Homo sapiens
aggttctaaagttc

SEQ ID NO: 3044409 - DNA, 15 bp, Homo sapiens
aggttctaaagttct

SEQ ID NO: 3044410 - DNA, 20 bp, Homo sapiens
aggttctaaagttctaagat

SEQ ID NO: 3044411 - DNA, 23 bp, Homo sapiens
aggttctaaagttctaagattct

SEQ ID NO: 3044412 - DNA, 14 bp, Homo sapiens
aggttctaacccta

SEQ ID NO: 3044413 - DNA, 12 bp, Homo sapiens
aggttctaaggc

SEQ ID NO: 3044414 - DNA, 13 bp, Homo sapiens
aggttctaaggcc

SEQ ID NO: 3044415 - DNA, 22 bp, Homo sapiens
aggttctaaggcctaggattct

SEQ ID NO: 3044416 - DNA, 17 bp, Homo sapiens
aggttctaggtttcaaa

SEQ ID NO: 3044417 - DNA, 17 bp, Homo sapiens
aggttctatttggaatt

SEQ ID NO: 3044418 - DNA, 15 bp, Homo sapiens
aggttcttaaaagtg

SEQ ID NO: 3044419 - DNA, 19 bp, Homo sapiens
aggttcttcccttttacat

SEQ ID NO: 3044420 - DNA, 21 bp, Homo sapiens
agtatgttttacactgtacca

SEQ ID NO: 3044421 - DNA, 20 bp, Homo sapiens
agtattaactctgtaaaagt

SEQ ID NO: 3044422 - DNA, 17 bp, Homo sapiens
agtattcaggcactgag

SEQ ID NO: 3044423 - DNA, 18 bp, Homo sapiens
agtattctgtaaagctta

SEQ ID NO: 3044424 - DNA, 14 bp, Homo sapiens
agtattcttctctt

SEQ ID NO: 3044425 - DNA, 19 bp, Homo sapiens
agtattgcagccaaagaat

SEQ ID NO: 3044426 - DNA, 23 bp, Homo sapiens
agtattgggacgtagagcacagc

SEQ ID NO: 3044427 - DNA, 14 bp, Homo sapiens
agtattgtaaatta

SEQ ID NO: 3044428 - DNA, 17 bp, Homo sapiens
agtatttaattgtttca

SEQ ID NO: 3044429 - DNA, 14 bp, Homo sapiens
agtccttggctgta

SEQ ID NO: 3044430 - DNA, 16 bp, Homo sapiens
agtcctttataagttg

SEQ ID NO: 3044431 - DNA, 21 bp, Homo sapiens
agtcctttataagttgctttc

SEQ ID NO: 3044432 - DNA, 14 bp, Homo sapiens
agtcctttatgtgg

SEQ ID NO: 3044433 - DNA, 20 bp, Homo sapiens
agtcctttgatagaagataa

SEQ ID NO: 3044434 - DNA, 23 bp, Homo sapiens
agtccttttactacagctatgaa

SEQ ID NO: 3044435 - DNA, 12 bp, Homo sapiens
agtccttttctt

SEQ ID NO: 3044436 - DNA, 16 bp, Homo sapiens
agtcctttttttccat

SEQ ID NO: 3044437 - DNA, 16 bp, Homo sapiens
agtcgctgcagggagc

SEQ ID NO: 3044438 - DNA, 22 bp, Homo sapiens
agtcggaaaagcgtctttaaga

SEQ ID NO: 3044439 - DNA, 14 bp, Homo sapiens
agtcggcatgccag

SEQ ID NO: 3044440 - DNA, 15 bp, Homo sapiens
agtcggcatgccagg

SEQ ID NO: 3044441 - DNA, 16 bp, Homo sapiens
agtcggcatgccagga

SEQ ID NO: 3044442 - DNA, 18 bp, Homo sapiens
agtctacccgacataagt

SEQ ID NO: 3044443 - DNA, 18 bp, Homo sapiens
agtctacctgagcattca

SEQ ID NO: 3044444 - DNA, 14 bp, Homo sapiens
agtctacgctctcc

SEQ ID NO: 3044445 - DNA, 13 bp, Homo sapiens
agtctactcttaa

SEQ ID NO: 3044446 - DNA, 19 bp, Homo sapiens
agtctagatggctcctctc

SEQ ID NO: 3044447 - DNA, 17 bp, Homo sapiens
agtgatatggagcaaga

SEQ ID NO: 3044448 - DNA, 23 bp, Homo sapiens
agtgatatggtactaaggagaat

SEQ ID NO: 3044449 - DNA, 18 bp, Homo sapiens
agtgatcagcaatgaaga

SEQ ID NO: 3044450 - DNA, 13 bp, Homo sapiens
agtgatctgtcca

SEQ ID NO: 3044451 - DNA, 16 bp, Homo sapiens
agtgatgatgcatgga

SEQ ID NO: 3044452 - DNA, 15 bp, Homo sapiens
agtgattcatcttca

SEQ ID NO: 3044453 - DNA, 16 bp, Homo sapiens
agtgatttccacaggt

SEQ ID NO: 3044454 - DNA, 20 bp, Homo sapiens
agtgattttcaagtctgtgt

SEQ ID NO: 3044455 - DNA, 23 bp, Homo sapiens
agtgatttttagtaacctttaaa

SEQ ID NO: 3044456 - DNA, 21 bp, Homo sapiens
agtgatttttatgccacctga

SEQ ID NO: 3044457 - DNA, 16 bp, Homo sapiens
agtgcaaaagattaag

SEQ ID NO: 3044458 - DNA, 13 bp, Homo sapiens
agtgcaaaatgtc

SEQ ID NO: 3044459 - DNA, 16 bp, Homo sapiens
agtgcaacctctgctt

SEQ ID NO: 3044460 - DNA, 24 bp, Homo sapiens
agtgcaacttagatctctcctgca

SEQ ID NO: 3044461 - DNA, 15 bp, Homo sapiens
agtgcaaggaatgac

SEQ ID NO: 3044462 - DNA, 22 bp, Homo sapiens
agtgcaataaatctgacccagt

SEQ ID NO: 3044463 - DNA, 19 bp, Homo sapiens
agtgcaatatgggcgggca

SEQ ID NO: 3044464 - DNA, 20 bp, Homo sapiens
agtgcaatatgggcgggcag

SEQ ID NO: 3044465 - DNA, 22 bp, Homo sapiens
agtgcaatatgggcgggcagtc

SEQ ID NO: 3044466 - DNA, 15 bp, Homo sapiens
agtgcaatggtgcaa

SEQ ID NO: 3044467 - DNA, 23 bp, Homo sapiens
agtgcaatggtgcaatcacagct

SEQ ID NO: 3044468 - DNA, 12 bp, Homo sapiens
agtgcacatctg

SEQ ID NO: 3044469 - DNA, 19 bp, Homo sapiens
agtgcacatctgacccaga

SEQ ID NO: 3044470 - DNA, 12 bp, Homo sapiens
agtgcacatgaa

SEQ ID NO: 3044471 - DNA, 13 bp, Homo sapiens
agtgcacatgaac

SEQ ID NO: 3044472 - DNA, 17 bp, Homo sapiens
agtgcacctgcctcagc

SEQ ID NO: 3044473 - DNA, 13 bp, Homo sapiens
agtgtccattttg

SEQ ID NO: 3044474 - DNA, 21 bp, Homo sapiens
agtgtccattttgtgaagccc

SEQ ID NO: 3044475 - DNA, 22 bp, Homo sapiens
agtgtcccccaggttccgaaga

SEQ ID NO: 3044476 - DNA, 22 bp, Homo sapiens
agtgtcctcttccctctctgca

SEQ ID NO: 3044477 - DNA, 18 bp, Homo sapiens
agtgtcctggctgtgaat

SEQ ID NO: 3044478 - DNA, 14 bp, Homo sapiens
agtgtctctgcctg

SEQ ID NO: 3044479 - DNA, 20 bp, Homo sapiens
agtgtctctgcctggagcag

SEQ ID NO: 3044480 - DNA, 16 bp, Homo sapiens
agtgtctggagcggct

SEQ ID NO: 3044481 - DNA, 22 bp, Homo sapiens
agtgtctgggtttggcccaaga

SEQ ID NO: 3044482 - DNA, 15 bp, Homo sapiens
agtgtgaaatagaca

SEQ ID NO: 3044483 - DNA, 20 bp, Homo sapiens
agtgtgaagcttccttggct

SEQ ID NO: 3044484 - DNA, 12 bp, Homo sapiens
agtgtgaagtta

SEQ ID NO: 3044485 - DNA, 13 bp, Homo sapiens
agtgtgaagttag

SEQ ID NO: 3044486 - DNA, 14 bp, Homo sapiens
agtgtgaagttaga

SEQ ID NO: 3044487 - DNA, 22 bp, Homo sapiens
agtgtgaagttagaattccttc

SEQ ID NO: 3044488 - DNA, 22 bp, Homo sapiens
agtgtgaccaaaagttacatgt

SEQ ID NO: 3044489 - DNA, 14 bp, Homo sapiens
agtgtgagggcagc

SEQ ID NO: 3044490 - DNA, 19 bp, Homo sapiens
agtgtgattgggaataaat

SEQ ID NO: 3044491 - DNA, 20 bp, Homo sapiens
agtgtgattgggaataaata

SEQ ID NO: 3044492 - DNA, 17 bp, Homo sapiens
agtgtgcactaaggggc

SEQ ID NO: 3044493 - DNA, 15 bp, Homo sapiens
agtgtgcatattgta

SEQ ID NO: 3044494 - DNA, 16 bp, Homo sapiens
agtgtgcatattgtac

SEQ ID NO: 3044495 - DNA, 19 bp, Homo sapiens
agtgtgcatattgtacact

SEQ ID NO: 3044496 - DNA, 14 bp, Homo sapiens
agtgtgcgcccggc

SEQ ID NO: 3044497 - DNA, 19 bp, Homo sapiens
agtgtgctgctgtaagaaa

SEQ ID NO: 3044498 - DNA, 22 bp, Homo sapiens
agtgtgggactccaggccagct

SEQ ID NO: 3044499 - DNA, 16 bp, Homo sapiens
agtgtgggaggctcct

SEQ ID NO: 3044500 - DNA, 18 bp, Homo sapiens
agtgtgggcgctctccct

SEQ ID NO: 3044501 - DNA, 17 bp, Homo sapiens
agtgtgtcagagcccag

SEQ ID NO: 3044502 - DNA, 20 bp, Homo sapiens
agtgtgtcagagcccagggg

SEQ ID NO: 3044503 - DNA, 14 bp, Homo sapiens
agtgtgtccatcct

SEQ ID NO: 3044504 - DNA, 17 bp, Homo sapiens
agtgtgtgtgcagagtc

SEQ ID NO: 3044505 - DNA, 20 bp, Homo sapiens
agtgtgtgtggcagcaggca

SEQ ID NO: 3044506 - DNA, 19 bp, Homo sapiens
agtgtgtttttgcactgtc

SEQ ID NO: 3044507 - DNA, 15 bp, Homo sapiens
agtgttaatactagt

SEQ ID NO: 3044508 - DNA, 15 bp, Homo sapiens
agtgttagggaaggg

SEQ ID NO: 3044509 - DNA, 13 bp, Homo sapiens
agtgttatgtatt

SEQ ID NO: 3044510 - DNA, 15 bp, Homo sapiens
agtgttatgtatttc

SEQ ID NO: 3044511 - DNA, 15 bp, Homo sapiens
agtgttcacaacctg

SEQ ID NO: 3044512 - DNA, 17 bp, Homo sapiens
agtgttccaagtctctg

SEQ ID NO: 3044513 - DNA, 13 bp, Homo sapiens
agtgttcctgtct

SEQ ID NO: 3044514 - DNA, 14 bp, Homo sapiens
agtgttcctgtctc

SEQ ID NO: 3044515 - DNA, 12 bp, Homo sapiens
agtgttcctgtg

SEQ ID NO: 3044516 - DNA, 19 bp, Homo sapiens
agtgttcctttttaaatgt

SEQ ID NO: 3044517 - DNA, 15 bp, Homo sapiens
agtgttctaaaatga

SEQ ID NO: 3044518 - DNA, 16 bp, Homo sapiens
agtgttctaaaatgaa

SEQ ID NO: 3044519 - DNA, 15 bp, Homo sapiens
agtgttcttcagtgt

SEQ ID NO: 3044520 - DNA, 21 bp, Homo sapiens
agtgttgcctcttgcaatgcc

SEQ ID NO: 3044521 - DNA, 20 bp, Homo sapiens
agtgttgggattacaggcgt

SEQ ID NO: 3044522 - DNA, 15 bp, Homo sapiens
agtgtttctgaatgt

SEQ ID NO: 3044523 - DNA, 16 bp, Homo sapiens
agtgtttctgaatgtt

SEQ ID NO: 3044524 - DNA, 15 bp, Homo sapiens
agtgtttctgtgcat

SEQ ID NO: 3044525 - DNA, 18 bp, Homo sapiens
agtgtttcttcacttctt

SEQ ID NO: 3044526 - DNA, 13 bp, Homo sapiens
agtgtttgctgca

SEQ ID NO: 3044527 - DNA, 22 bp, Homo sapiens
agtgtttggaattttctgttca

SEQ ID NO: 3044528 - DNA, 23 bp, Homo sapiens
agtgtttgggggacgtttctcat

SEQ ID NO: 3044529 - DNA, 21 bp, Homo sapiens
agtgttttatgagaaagcctt

SEQ ID NO: 3044530 - DNA, 17 bp, Homo sapiens
agtgttttgcacatcat

SEQ ID NO: 3044531 - DNA, 14 bp, Homo sapiens
agtgttttggactc

SEQ ID NO: 3044532 - DNA, 18 bp, Homo sapiens
agtgttttggactccatc

SEQ ID NO: 3044533 - DNA, 20 bp, Homo sapiens
agtgttttggactccatctc

SEQ ID NO: 3044534 - DNA, 22 bp, Homo sapiens
agtgttttgtaccagtgaattt

SEQ ID NO: 3044535 - DNA, 17 bp, Homo sapiens
agtgtttttacctctgt

SEQ ID NO: 3044536 - DNA, 21 bp, Homo sapiens
agtgtttttacctctgtcttg

SEQ ID NO: 3044537 - DNA, 21 bp, Homo sapiens
agtgtttttcatggaaaagcc

SEQ ID NO: 3044538 - DNA, 12 bp, Homo sapiens
agtgtttttcct

SEQ ID NO: 3044539 - DNA, 15 bp, Homo sapiens
agtgtttttgtaaag

SEQ ID NO: 3044540 - DNA, 18 bp, Homo sapiens
agtgtttttgtaaagtgt

SEQ ID NO: 3044541 - DNA, 22 bp, Homo sapiens
agttaaaaaaaaaaaaaggaaa

SEQ ID NO: 3044542 - DNA, 23 bp, Homo sapiens
agttaaaaaaaaaaaaaggaaaa

SEQ ID NO: 3044543 - DNA, 23 bp, Homo sapiens
agttaaaatgtttactgtaaatt

SEQ ID NO: 3044544 - DNA, 13 bp, Homo sapiens
agttaaaggcagt

SEQ ID NO: 3044545 - DNA, 20 bp, Homo sapiens
agttaaaggcagtccagagc

SEQ ID NO: 3044546 - DNA, 17 bp, Homo sapiens
agttaaaggctgactac

SEQ ID NO: 3044547 - DNA, 12 bp, Homo sapiens
agttaaatcttc

SEQ ID NO: 3044548 - DNA, 18 bp, Homo sapiens
agttaaatgtatcacatt

SEQ ID NO: 3044549 - DNA, 20 bp, Homo sapiens
agttaacacaatgtgaattt

SEQ ID NO: 3044550 - DNA, 21 bp, Homo sapiens
agttaacatcatgaatttatt

SEQ ID NO: 3044551 - DNA, 22 bp, Homo sapiens
agttaacgtcacccaaaagcac

SEQ ID NO: 3044552 - DNA, 19 bp, Homo sapiens
agttaagacatgatttcct

SEQ ID NO: 3044553 - DNA, 16 bp, Homo sapiens
agttaagacctggcag

SEQ ID NO: 3044554 - DNA, 22 bp, Homo sapiens
agttaatgaaggtgtgctacag

SEQ ID NO: 3044555 - DNA, 19 bp, Homo sapiens
agttaattgtatttatgta

SEQ ID NO: 3044556 - DNA, 12 bp, Homo sapiens
agttacagaaag

SEQ ID NO: 3044557 - DNA, 13 bp, Homo sapiens
agttacagaaagt

SEQ ID NO: 3044558 - DNA, 16 bp, Homo sapiens
agttacagaaagtggt

SEQ ID NO: 3044559 - DNA, 13 bp, Homo sapiens
agttacagctgtg

SEQ ID NO: 3044560 - DNA, 22 bp, Homo sapiens
agttacataattcactctgagt

SEQ ID NO: 3044561 - DNA, 12 bp, Homo sapiens
agttacatgcat

SEQ ID NO: 3044562 - DNA, 18 bp, Homo sapiens
agttacatgcataaaagg

SEQ ID NO: 3044563 - DNA, 21 bp, Homo sapiens
agttacatgcatacttcaaaa

SEQ ID NO: 3044564 - DNA, 15 bp, Homo sapiens
agttacatgtttgca

SEQ ID NO: 3044565 - DNA, 19 bp, Homo sapiens
agttacattaaaataaacc

SEQ ID NO: 3044566 - DNA, 23 bp, Homo sapiens
agttacattaaaataaaccaaat

SEQ ID NO: 3044567 - DNA, 16 bp, Homo sapiens
agttactcagccctgg

SEQ ID NO: 3044568 - DNA, 21 bp, Homo sapiens
agttactccagtgccaacaat

SEQ ID NO: 3044569 - DNA, 17 bp, Homo sapiens
agttactccctacactg

SEQ ID NO: 3044570 - DNA, 15 bp, Homo sapiens
agttactgaaatctt

SEQ ID NO: 3044571 - DNA, 20 bp, Homo sapiens
agttacttaagattcagttt

SEQ ID NO: 3044572 - DNA, 19 bp, Homo sapiens
agttactttgtcagaggca

SEQ ID NO: 3044573 - DNA, 11 bp, Homo sapiens
agttagcacca

SEQ ID NO: 3044574 - DNA, 13 bp, Homo sapiens
agttagcagacag

SEQ ID NO: 3044575 - DNA, 19 bp, Homo sapiens
agttagcatccaggctggc

SEQ ID NO: 3044576 - DNA, 15 bp, Homo sapiens
agttaggaatgagaa

SEQ ID NO: 3044577 - DNA, 16 bp, Homo sapiens
agttagggttttgcaa

SEQ ID NO: 3044578 - DNA, 15 bp, Homo sapiens
agttaggttataaga

SEQ ID NO: 3044579 - DNA, 16 bp, Homo sapiens
agttagtaatggtgct

SEQ ID NO: 3044580 - DNA, 15 bp, Homo sapiens
agttatagatgtcta

SEQ ID NO: 3044581 - DNA, 22 bp, Homo sapiens
agttatataggttttgtttgct

SEQ ID NO: 3044582 - DNA, 23 bp, Homo sapiens
agttatatttcagatgtaatgtt

SEQ ID NO: 3044583 - DNA, 15 bp, Homo sapiens
agttatcctgcaagg

SEQ ID NO: 3044584 - DNA, 17 bp, Homo sapiens
agttatctaagaataca

SEQ ID NO: 3044585 - DNA, 15 bp, Homo sapiens
agttatctaagttaa

SEQ ID NO: 3044586 - DNA, 23 bp, Homo sapiens
agttatgaacacttaaattatga

SEQ ID NO: 3044587 - DNA, 20 bp, Homo sapiens
agttattacatgtaatttga

SEQ ID NO: 3044588 - DNA, 19 bp, Homo sapiens
agttattcatattctgttg

SEQ ID NO: 3044589 - DNA, 20 bp, Homo sapiens
agttattggatcagtgaaaa

SEQ ID NO: 3044590 - DNA, 12 bp, Homo sapiens
agttattggtgg

SEQ ID NO: 3044591 - DNA, 16 bp, Homo sapiens
agttatttacttgaaa

SEQ ID NO: 3044592 - DNA, 21 bp, Homo sapiens
agttatttacttgaaagatgg

SEQ ID NO: 3044593 - DNA, 13 bp, Homo sapiens
agttatttatgct

SEQ ID NO: 3044594 - DNA, 21 bp, Homo sapiens
agttattttatgacatgaaaa

SEQ ID NO: 3044595 - DNA, 24 bp, Homo sapiens
agttattttatgacatgaaaagtt

SEQ ID NO: 3044596 - DNA, 13 bp, Homo sapiens
agttcaaaattct

SEQ ID NO: 3044597 - DNA, 16 bp, Homo sapiens
agttcaagaccagcct

SEQ ID NO: 3044598 - DNA, 22 bp, Homo sapiens
agttcaaggaacttgaaaaata

SEQ ID NO: 3044599 - DNA, 23 bp, Homo sapiens
agttcaaggaacttgaaaaatac

SEQ ID NO: 3044600 - DNA, 19 bp, Homo sapiens
agttcaataaatgtctgtt

SEQ ID NO: 3044601 - DNA, 14 bp, Homo sapiens
agttcaccattaaa

SEQ ID NO: 3044602 - DNA, 22 bp, Homo sapiens
agttcacttctttgcagagcct

SEQ ID NO: 3044603 - DNA, 16 bp, Homo sapiens
agttcagagttttctg

SEQ ID NO: 3044604 - DNA, 19 bp, Homo sapiens
agttcaggtagctgcccct

SEQ ID NO: 3044605 - DNA, 19 bp, Homo sapiens
agttcagtggcactcaaca

SEQ ID NO: 3044606 - DNA, 19 bp, Homo sapiens
agttcatttttatcccttc

SEQ ID NO: 3044607 - DNA, 18 bp, Homo sapiens
agttccacagattgtttc

SEQ ID NO: 3044608 - DNA, 19 bp, Homo sapiens
agttccagttttgttttga

SEQ ID NO: 3044609 - DNA, 23 bp, Homo sapiens
agttccatcaggtcccccccagg

SEQ ID NO: 3044610 - DNA, 16 bp, Homo sapiens
agttccattcttggca

SEQ ID NO: 3044611 - DNA, 19 bp, Homo sapiens
agttccctgaaaacccaga

SEQ ID NO: 3044612 - DNA, 14 bp, Homo sapiens
agttcctcgccctg

SEQ ID NO: 3044613 - DNA, 15 bp, Homo sapiens
agttcgaacatgttt

SEQ ID NO: 3044614 - DNA, 19 bp, Homo sapiens
agttcgaacatgtttcact

SEQ ID NO: 3044615 - DNA, 16 bp, Homo sapiens
agttcgcctggagccc

SEQ ID NO: 3044616 - DNA, 18 bp, Homo sapiens
agttcgcctggagccctc

SEQ ID NO: 3044617 - DNA, 15 bp, Homo sapiens
agttctaagattcta

SEQ ID NO: 3044618 - DNA, 19 bp, Homo sapiens
agttctaagattctaatga

SEQ ID NO: 3044619 - DNA, 16 bp, Homo sapiens
agttctaagattctga

SEQ ID NO: 3044620 - DNA, 17 bp, Homo sapiens
agttctaagattctgat

SEQ ID NO: 3044621 - DNA, 19 bp, Homo sapiens
agttctaataatttctaat

SEQ ID NO: 3044622 - DNA, 21 bp, Homo sapiens
agttctaataatttctaatgt

SEQ ID NO: 3044623 - DNA, 22 bp, Homo sapiens
agttctagacatggaggttcta

SEQ ID NO: 3044624 - DNA, 19 bp, Homo sapiens
agttctagctctatttact

SEQ ID NO: 3044625 - DNA, 21 bp, Homo sapiens
agttctagctctatttacttc

SEQ ID NO: 3044626 - DNA, 18 bp, Homo sapiens
agttctatactgtaaagc

SEQ ID NO: 3044627 - DNA, 20 bp, Homo sapiens
agttctatactgtaaagcgc

SEQ ID NO: 3044628 - DNA, 18 bp, Homo sapiens
agttctcaaatgtgtgtg

SEQ ID NO: 3044629 - DNA, 15 bp, Homo sapiens
agttctcactatgtt

SEQ ID NO: 3044630 - DNA, 17 bp, Homo sapiens
agttctcactatgtttc

SEQ ID NO: 3044631 - DNA, 22 bp, Homo sapiens
agttctgattcatttgaataaa

SEQ ID NO: 3044632 - DNA, 12 bp, Homo sapiens
agttctgccagg

SEQ ID NO: 3044633 - DNA, 14 bp, Homo sapiens
agttctgccaggag

SEQ ID NO: 3044634 - DNA, 12 bp, Homo sapiens
agttctgggtgc

SEQ ID NO: 3044635 - DNA, 19 bp, Homo sapiens
agttctgggtgctccctac

SEQ ID NO: 3044636 - DNA, 14 bp, Homo sapiens
agttctgtaaaata

SEQ ID NO: 3044637 - DNA, 19 bp, Homo sapiens
agttcttactgcttaattc

SEQ ID NO: 3044638 - DNA, 21 bp, Homo sapiens
agttcttagattcaggggaag

SEQ ID NO: 3044639 - DNA, 12 bp, Homo sapiens
agttcttgtgcc

SEQ ID NO: 3044640 - DNA, 13 bp, Homo sapiens
agttcttgtgcca

SEQ ID NO: 3044641 - DNA, 19 bp, Homo sapiens
agttctttccataataaaa

SEQ ID NO: 3044642 - DNA, 17 bp, Homo sapiens
agttctttggctctatt

SEQ ID NO: 3044643 - DNA, 15 bp, Homo sapiens
agttctttgggccag

SEQ ID NO: 3044644 - DNA, 18 bp, Homo sapiens
agttctttgggccagaca

SEQ ID NO: 3044645 - DNA, 13 bp, Homo sapiens
agttctttgttcc

SEQ ID NO: 3044646 - DNA, 19 bp, Homo sapiens
agttctttgttcctgcttt

SEQ ID NO: 3044647 - DNA, 21 bp, Homo sapiens
agttctttgttcctgctttct

SEQ ID NO: 3044648 - DNA, 22 bp, Homo sapiens
agttcttttttgtacagtattt

SEQ ID NO: 3044649 - DNA, 18 bp, Homo sapiens
agttgaaaaaagaagttt

SEQ ID NO: 3044650 - DNA, 17 bp, Homo sapiens
agttgaagactttgttt

SEQ ID NO: 3044651 - DNA, 21 bp, Homo sapiens
agttgaattccaagtgtattt

SEQ ID NO: 3044652 - DNA, 17 bp, Homo sapiens
agttgacacctgagaaa

SEQ ID NO: 3044653 - DNA, 23 bp, Homo sapiens
agttgagagacagtaacacaatt

SEQ ID NO: 3044654 - DNA, 19 bp, Homo sapiens
agttgaggtggggtagtgc

SEQ ID NO: 3044655 - DNA, 22 bp, Homo sapiens
agttgatatgttttatttcatt

SEQ ID NO: 3044656 - DNA, 23 bp, Homo sapiens
agttgatctggaacccagactca

SEQ ID NO: 3044657 - DNA, 23 bp, Homo sapiens
agttgattgtacgtagccacagg

SEQ ID NO: 3044658 - DNA, 20 bp, Homo sapiens
agttgcaattgaattaaatt

SEQ ID NO: 3044659 - DNA, 20 bp, Homo sapiens
agttgcatgaaattttgcct

SEQ ID NO: 3044660 - DNA, 20 bp, Homo sapiens
agttgccatgggaaacaaat

SEQ ID NO: 3044661 - DNA, 18 bp, Homo sapiens
agttgccattttgtaaac

SEQ ID NO: 3044662 - DNA, 20 bp, Homo sapiens
agttgcgtggactctgcaca

SEQ ID NO: 3044663 - DNA, 17 bp, Homo sapiens
agttgctggcatgtctt

SEQ ID NO: 3044664 - DNA, 21 bp, Homo sapiens
agttgctggcatgtcttcatt

SEQ ID NO: 3044665 - DNA, 21 bp, Homo sapiens
agttggaatgactgaaagaag

SEQ ID NO: 3044666 - DNA, 20 bp, Homo sapiens
agttggagttttttgtacca

SEQ ID NO: 3044667 - DNA, 19 bp, Homo sapiens
agttggcgttgtgggcagg

SEQ ID NO: 3044668 - DNA, 15 bp, Homo sapiens
agttggggaaggcaa

SEQ ID NO: 3044669 - DNA, 18 bp, Homo sapiens
agttggggaaggcaagat

SEQ ID NO: 3044670 - DNA, 17 bp, Homo sapiens
agttggggcccagtcct

SEQ ID NO: 3044671 - DNA, 14 bp, Homo sapiens
agttgggggcaggt

SEQ ID NO: 3044672 - DNA, 18 bp, Homo sapiens
agttgggggcaggtcagg

SEQ ID NO: 3044673 - DNA, 17 bp, Homo sapiens
agttggggtctggcagc

SEQ ID NO: 3044674 - DNA, 21 bp, Homo sapiens
agttggggtctggcagcctcc

SEQ ID NO: 3044675 - DNA, 22 bp, Homo sapiens
agttgggtttcacgagtgttcc

SEQ ID NO: 3044676 - DNA, 17 bp, Homo sapiens
agttggtacacaactag

SEQ ID NO: 3044677 - DNA, 15 bp, Homo sapiens
agttggtcttacttt

SEQ ID NO: 3044678 - DNA, 22 bp, Homo sapiens
agttggtcttactttgtgcaaa

SEQ ID NO: 3044679 - DNA, 14 bp, Homo sapiens
agttggtgagaaac

SEQ ID NO: 3044680 - DNA, 22 bp, Homo sapiens
agttggtgagaaacctgtatct

SEQ ID NO: 3044681 - DNA, 24 bp, Homo sapiens
agttggtgagaaacctgtatcttt

SEQ ID NO: 3044682 - DNA, 16 bp, Homo sapiens
agttggtttggatttt

SEQ ID NO: 3044683 - DNA, 15 bp, Homo sapiens
agttgtaaaatgtca

SEQ ID NO: 3044684 - DNA, 19 bp, Homo sapiens
agttgtaccttttaatatg

SEQ ID NO: 3044685 - DNA, 13 bp, Homo sapiens
agttgtagaatgt

SEQ ID NO: 3044686 - DNA, 22 bp, Homo sapiens
agttgtagactatggaatgtca

SEQ ID NO: 3044687 - DNA, 18 bp, Homo sapiens
agttgtattttgtacatt

SEQ ID NO: 3044688 - DNA, 19 bp, Homo sapiens
agttgtattttgtacattt

SEQ ID NO: 3044689 - DNA, 21 bp, Homo sapiens
agttgtcactgcttttggcct

SEQ ID NO: 3044690 - DNA, 23 bp, Homo sapiens
agttgtcactgcttttggcctgg

SEQ ID NO: 3044691 - DNA, 18 bp, Homo sapiens
agttgtcctatggacaac

SEQ ID NO: 3044692 - DNA, 14 bp, Homo sapiens
agttgtctttcttt

SEQ ID NO: 3044693 - DNA, 18 bp, Homo sapiens
agttgtctttctttgctg

SEQ ID NO: 3044694 - DNA, 20 bp, Homo sapiens
agttgtgcagcttttggtca

SEQ ID NO: 3044695 - DNA, 17 bp, Homo sapiens
agttgtgggtgggagag

SEQ ID NO: 3044696 - DNA, 15 bp, Homo sapiens
agttgttaccaaata

SEQ ID NO: 3044697 - DNA, 17 bp, Homo sapiens
agttgttcaactatttt

SEQ ID NO: 3044698 - DNA, 13 bp, Homo sapiens
agttgttcctaga

SEQ ID NO: 3044699 - DNA, 22 bp, Homo sapiens
agttgttgtgggttctatgttt

SEQ ID NO: 3044700 - DNA, 13 bp, Homo sapiens
agttgtttgcatg

SEQ ID NO: 3044701 - DNA, 18 bp, Homo sapiens
agttgttttttgtgtttc

SEQ ID NO: 3044702 - DNA, 19 bp, Homo sapiens
agtttaaaaatcaactttt

SEQ ID NO: 3044703 - DNA, 20 bp, Homo sapiens
agtttaaaatcttgcatggc

SEQ ID NO: 3044704 - DNA, 16 bp, Homo sapiens
agtttaaatgagacta

SEQ ID NO: 3044705 - DNA, 17 bp, Homo sapiens
agtttaaattgtaatag

SEQ ID NO: 3044706 - DNA, 20 bp, Homo sapiens
agtttaaattgtaataggcg

SEQ ID NO: 3044707 - DNA, 23 bp, Homo sapiens
agtttaagtgtgcagccatagtt

SEQ ID NO: 3044708 - DNA, 14 bp, Homo sapiens
agtttaattctgtt

SEQ ID NO: 3044709 - DNA, 23 bp, Homo sapiens
agtttacagctctgactttacac

SEQ ID NO: 3044710 - DNA, 16 bp, Homo sapiens
agtttacctctttaaa

SEQ ID NO: 3044711 - DNA, 20 bp, Homo sapiens
agtttacctctttaaaaaca

SEQ ID NO: 3044712 - DNA, 13 bp, Homo sapiens
agtttagggtggg

SEQ ID NO: 3044713 - DNA, 17 bp, Homo sapiens
agtttagtgcatctttg

SEQ ID NO: 3044714 - DNA, 19 bp, Homo sapiens
agtttagtgtgtgtgcaga

SEQ ID NO: 3044715 - DNA, 20 bp, Homo sapiens
agtttagtgtgtgtgcagag

SEQ ID NO: 3044716 - DNA, 12 bp, Homo sapiens
agtttataaagc

SEQ ID NO: 3044717 - DNA, 17 bp, Homo sapiens
agtttatacagtgtaca

SEQ ID NO: 3044718 - DNA, 15 bp, Homo sapiens
agtttatcattcaag

SEQ ID NO: 3044719 - DNA, 16 bp, Homo sapiens
agtttatttgttgaga

SEQ ID NO: 3044720 - DNA, 18 bp, Homo sapiens
agtttatttgttgagagt

SEQ ID NO: 3044721 - DNA, 19 bp, Homo sapiens
agtttatttgttgagagtg

SEQ ID NO: 3044722 - DNA, 20 bp, Homo sapiens
agtttatttgttgagagtgt

SEQ ID NO: 3044723 - DNA, 22 bp, Homo sapiens
agtttatttttttgatggctaa

SEQ ID NO: 3044724 - DNA, 15 bp, Homo sapiens
agtttcagctggaaa

SEQ ID NO: 3044725 - DNA, 14 bp, Homo sapiens
agtttcagctttct

SEQ ID NO: 3044726 - DNA, 16 bp, Homo sapiens
agtttcatgtaaagaa

SEQ ID NO: 3044727 - DNA, 18 bp, Homo sapiens
agtttcatgtacaagatg

SEQ ID NO: 3044728 - DNA, 11 bp, Homo sapiens
agtttcccttc

SEQ ID NO: 3044729 - DNA, 19 bp, Homo sapiens
agtttcctgccttcagagt

SEQ ID NO: 3044730 - DNA, 22 bp, Homo sapiens
agtttcctgccttcagagtatc

SEQ ID NO: 3044731 - DNA, 19 bp, Homo sapiens
agtttccttttctgtctct

SEQ ID NO: 3044732 - DNA, 18 bp, Homo sapiens
agtttctaaccaaagagt

SEQ ID NO: 3044733 - DNA, 16 bp, Homo sapiens
agtttctaagattcta

SEQ ID NO: 3044734 - DNA, 17 bp, Homo sapiens
agtttctattgtaaatt

SEQ ID NO: 3044735 - DNA, 11 bp, Homo sapiens
agtttctattt

SEQ ID NO: 3044736 - DNA, 13 bp, Homo sapiens
agtttctgttctg

SEQ ID NO: 3044737 - DNA, 19 bp, Homo sapiens
agtttctgttctgtggaaa

SEQ ID NO: 3044738 - DNA, 22 bp, Homo sapiens
agtttctgttctgtggaaagtg

SEQ ID NO: 3044739 - DNA, 23 bp, Homo sapiens
agtttctgttctgtggaaagtgt

SEQ ID NO: 3044740 - DNA, 16 bp, Homo sapiens
agtttcttggtaaagt

SEQ ID NO: 3044741 - DNA, 14 bp, Homo sapiens
agtttctttagaaa

SEQ ID NO: 3044742 - DNA, 16 bp, Homo sapiens
agtttgaaggaaacag

SEQ ID NO: 3044743 - DNA, 19 bp, Homo sapiens
agtttgacagtttttgaca

SEQ ID NO: 3044744 - DNA, 15 bp, Homo sapiens
agtgggcatgtatta

SEQ ID NO: 3044745 - DNA, 16 bp, Homo sapiens
agtgggccaggacagg

SEQ ID NO: 3044746 - DNA, 19 bp, Homo sapiens
agtgggccaggacaggccc

SEQ ID NO: 3044747 - DNA, 21 bp, Homo sapiens
agtgggccaggacaggcccgg

SEQ ID NO: 3044748 - DNA, 18 bp, Homo sapiens
agtgggcccacccggtgg

SEQ ID NO: 3044749 - DNA, 20 bp, Homo sapiens
agtgggctgcacgctcccct

SEQ ID NO: 3044750 - DNA, 17 bp, Homo sapiens
agtggggctaaatgaag

SEQ ID NO: 3044751 - DNA, 21 bp, Homo sapiens
agtggggtcaagctgagctgg

SEQ ID NO: 3044752 - DNA, 17 bp, Homo sapiens
agtggggtgaacagctg

SEQ ID NO: 3044753 - DNA, 19 bp, Homo sapiens
agtgggtaaaattagatgc

SEQ ID NO: 3044754 - DNA, 17 bp, Homo sapiens
agtggtcctcattcttg

SEQ ID NO: 3044755 - DNA, 19 bp, Homo sapiens
agtggtctcctctcagctt

SEQ ID NO: 3044756 - DNA, 23 bp, Homo sapiens
agtggtgccatcattgctgtctg

SEQ ID NO: 3044757 - DNA, 11 bp, Homo sapiens
agtggtggcag

SEQ ID NO: 3044758 - DNA, 13 bp, Homo sapiens
agtggtggcaggg

SEQ ID NO: 3044759 - DNA, 20 bp, Homo sapiens
agtggtgtgatctcggctca

SEQ ID NO: 3044760 - DNA, 18 bp, Homo sapiens
agtggttgggctgtgcct

SEQ ID NO: 3044761 - DNA, 20 bp, Homo sapiens
agtggttgggctgtgcctgg

SEQ ID NO: 3044762 - DNA, 14 bp, Homo sapiens
agtgtaaaatattt

SEQ ID NO: 3044763 - DNA, 14 bp, Homo sapiens
agtgtaaagcattc

SEQ ID NO: 3044764 - DNA, 21 bp, Homo sapiens
agtgtaaatagttactccagt

SEQ ID NO: 3044765 - DNA, 15 bp, Homo sapiens
agtgtaagtgaatta

SEQ ID NO: 3044766 - DNA, 12 bp, Homo sapiens
agtgtaatgtga

SEQ ID NO: 3044767 - DNA, 18 bp, Homo sapiens
agtgtaatgtgacttcat

SEQ ID NO: 3044768 - DNA, 14 bp, Homo sapiens
agtgtaattgagaa

SEQ ID NO: 3044769 - DNA, 13 bp, Homo sapiens
agtgtacatgtac

SEQ ID NO: 3044770 - DNA, 21 bp, Homo sapiens
agtgtacctgtaaatgtcctg

SEQ ID NO: 3044771 - DNA, 17 bp, Homo sapiens
agtgtagtttacagaaa

SEQ ID NO: 3044772 - DNA, 17 bp, Homo sapiens
agtgtatgtagaagcat

SEQ ID NO: 3044773 - DNA, 14 bp, Homo sapiens
agtgtatttcagtt

SEQ ID NO: 3044774 - DNA, 19 bp, Homo sapiens
agtgtattttaaaatagag

SEQ ID NO: 3044775 - DNA, 15 bp, Homo sapiens
agtgtattttattca

SEQ ID NO: 3044776 - DNA, 16 bp, Homo sapiens
agtgtcaccttttctt

SEQ ID NO: 3044777 - DNA, 13 bp, Homo sapiens
agtgtcagtacta

SEQ ID NO: 3044778 - DNA, 14 bp, Homo sapiens
agtgtcagtactaa

SEQ ID NO: 3044779 - DNA, 15 bp, Homo sapiens
agtttgacttgtata

SEQ ID NO: 3044780 - DNA, 18 bp, Homo sapiens
agtttgagaccaggctgg

SEQ ID NO: 3044781 - DNA, 14 bp, Homo sapiens
agtttgaggctgca

SEQ ID NO: 3044782 - DNA, 16 bp, Homo sapiens
agtttgatcagacagc

SEQ ID NO: 3044783 - DNA, 22 bp, Homo sapiens
agtttgcagaaaagcacctgcc

SEQ ID NO: 3044784 - DNA, 23 bp, Homo sapiens
agtttgcagaaaagcacctgccg

SEQ ID NO: 3044785 - DNA, 20 bp, Homo sapiens
agtttgcattcctgatatga

SEQ ID NO: 3044786 - DNA, 18 bp, Homo sapiens
agtttggattcttatgta

SEQ ID NO: 3044787 - DNA, 15 bp, Homo sapiens
agtttggcatttgca

SEQ ID NO: 3044788 - DNA, 20 bp, Homo sapiens
agtttgggatccctgtcttt

SEQ ID NO: 3044789 - DNA, 23 bp, Homo sapiens
agtttgggatccctgtctttcct

SEQ ID NO: 3044790 - DNA, 17 bp, Homo sapiens
agtttgggcttcagcct

SEQ ID NO: 3044791 - DNA, 21 bp, Homo sapiens
agtttggggcaagtcatgtaa

SEQ ID NO: 3044792 - DNA, 14 bp, Homo sapiens
agtttgggtatttt

SEQ ID NO: 3044793 - DNA, 15 bp, Homo sapiens
agtttgtaaaaatat

SEQ ID NO: 3044794 - DNA, 19 bp, Homo sapiens
agtttgtgaatgtgactac

SEQ ID NO: 3044795 - DNA, 15 bp, Homo sapiens
agtttgttactttaa

SEQ ID NO: 3044796 - DNA, 15 bp, Homo sapiens
agtttgttactttga

SEQ ID NO: 3044797 - DNA, 22 bp, Homo sapiens
agtttgttatgtgtctggaaga

SEQ ID NO: 3044798 - DNA, 19 bp, Homo sapiens
agttttatagcctggactg

SEQ ID NO: 3044799 - DNA, 14 bp, Homo sapiens
agttttatttgaat

SEQ ID NO: 3044800 - DNA, 14 bp, Homo sapiens
agttttattttaaa

SEQ ID NO: 3044801 - DNA, 18 bp, Homo sapiens
agttttattttaaattat

SEQ ID NO: 3044802 - DNA, 20 bp, Homo sapiens
agttttccatggcaggaagg

SEQ ID NO: 3044803 - DNA, 16 bp, Homo sapiens
agttttcctatgcttt

SEQ ID NO: 3044804 - DNA, 12 bp, Homo sapiens
agttttccttct

SEQ ID NO: 3044805 - DNA, 20 bp, Homo sapiens
agttttcttatatatatatt

SEQ ID NO: 3044806 - DNA, 23 bp, Homo sapiens
agttttgacatcagccagctgcc

SEQ ID NO: 3044807 - DNA, 19 bp, Homo sapiens
agttttgatgactggcatt

SEQ ID NO: 3044808 - DNA, 14 bp, Homo sapiens
agttttggttttta

SEQ ID NO: 3044809 - DNA, 15 bp, Homo sapiens
agttttgtaaatgta

SEQ ID NO: 3044810 - DNA, 12 bp, Homo sapiens
agttttgtcttg

SEQ ID NO: 3044811 - DNA, 23 bp, Homo sapiens
agttttgtggactgagcgaggaa

SEQ ID NO: 3044812 - DNA, 20 bp, Homo sapiens
agttttgtttggtttacttt

SEQ ID NO: 3044813 - DNA, 23 bp, Homo sapiens
agttttgtttggtttactttcaa

SEQ ID NO: 3044814 - DNA, 23 bp, Homo sapiens
agttttgttttaaaactggacct

SEQ ID NO: 3044815 - DNA, 19 bp, Homo sapiens
agtttttaaaattggcctt

SEQ ID NO: 3044816 - DNA, 12 bp, Homo sapiens
agtttttacaaa

SEQ ID NO: 3044817 - DNA, 22 bp, Homo sapiens
agtttttctgttttgtttggca

SEQ ID NO: 3044818 - DNA, 14 bp, Homo sapiens
agtttttgaaatac

SEQ ID NO: 3044819 - DNA, 14 bp, Homo sapiens
agtttttgacattt

SEQ ID NO: 3044820 - DNA, 22 bp, Homo sapiens
agtttttggagtgttatgtatt

SEQ ID NO: 3044821 - DNA, 15 bp, Homo sapiens
agttttttaaacaaa

SEQ ID NO: 3044822 - DNA, 19 bp, Homo sapiens
agttttttaaacaaatgag

SEQ ID NO: 3044823 - DNA, 14 bp, Homo sapiens
agttttttttttct

SEQ ID NO: 3044824 - DNA, 17 bp, Homo sapiens
ataaaaaagaaaacatt

SEQ ID NO: 3044825 - DNA, 13 bp, Homo sapiens
ataaaaagttaaa

SEQ ID NO: 3044826 - DNA, 23 bp, Homo sapiens
ataaaaagtttcacaggtcaata

SEQ ID NO: 3044827 - DNA, 16 bp, Homo sapiens
ataaaaatatatgttg

SEQ ID NO: 3044828 - DNA, 13 bp, Homo sapiens
ataaaaatgacag

SEQ ID NO: 3044829 - DNA, 12 bp, Homo sapiens
ataaaaatggat

SEQ ID NO: 3044830 - DNA, 14 bp, Homo sapiens
ataaaaattgatga

SEQ ID NO: 3044831 - DNA, 15 bp, Homo sapiens
ataaaaatttattat

SEQ ID NO: 3044832 - DNA, 13 bp, Homo sapiens
ataaaacaaaggg

SEQ ID NO: 3044833 - DNA, 12 bp, Homo sapiens
ataaaacatttt

SEQ ID NO: 3044834 - DNA, 20 bp, Homo sapiens
ataaaaccaagcctctggaa

SEQ ID NO: 3044835 - DNA, 12 bp, Homo sapiens
ataaaacttgat

SEQ ID NO: 3044836 - DNA, 19 bp, Homo sapiens
ataaaacttgataaatgga

SEQ ID NO: 3044837 - DNA, 23 bp, Homo sapiens
ataaaagatagcaatatgagaca

SEQ ID NO: 3044838 - DNA, 15 bp, Homo sapiens
ataaaagctatggtg

SEQ ID NO: 3044839 - DNA, 19 bp, Homo sapiens
ataaaaggaagccaaagag

SEQ ID NO: 3044840 - DNA, 17 bp, Homo sapiens
ataaaaggaatctggca

SEQ ID NO: 3044841 - DNA, 20 bp, Homo sapiens
ataaaagggtcaaacctgta

SEQ ID NO: 3044842 - DNA, 21 bp, Homo sapiens
ataaaagggtcaaacctgtag

SEQ ID NO: 3044843 - DNA, 23 bp, Homo sapiens
ataaaagttcctctcccttccct

SEQ ID NO: 3044844 - DNA, 19 bp, Homo sapiens
ataaaataaaaaccaaatt

SEQ ID NO: 3044845 - DNA, 16 bp, Homo sapiens
ataaaatcaagtttta

SEQ ID NO: 3044846 - DNA, 15 bp, Homo sapiens
ataaaatgaggcagt

SEQ ID NO: 3044847 - DNA, 15 bp, Homo sapiens
ataaaatgatgttat

SEQ ID NO: 3044848 - DNA, 16 bp, Homo sapiens
ataaaattaatgaaga

SEQ ID NO: 3044849 - DNA, 20 bp, Homo sapiens
ataaaattatagatgggaat

SEQ ID NO: 3044850 - DNA, 16 bp, Homo sapiens
ataaaatttgttgcat

SEQ ID NO: 3044851 - DNA, 19 bp, Homo sapiens
ataaaattttttttcatgt

SEQ ID NO: 3044852 - DNA, 16 bp, Homo sapiens
ataaacaatccaaatg

SEQ ID NO: 3044853 - DNA, 16 bp, Homo sapiens
ataaacacaactgact

SEQ ID NO: 3044854 - DNA, 21 bp, Homo sapiens
ataaacagaaatgctctgatt

SEQ ID NO: 3044855 - DNA, 14 bp, Homo sapiens
ataaacagacaata

SEQ ID NO: 3044856 - DNA, 12 bp, Homo sapiens
ataaacagcagg

SEQ ID NO: 3044857 - DNA, 21 bp, Homo sapiens
ataaacagcagggtttgagca

SEQ ID NO: 3044858 - DNA, 22 bp, Homo sapiens
ataaacagtggaatataaggaa

SEQ ID NO: 3044859 - DNA, 22 bp, Homo sapiens
ataaaccaaatatgttaaagtt

SEQ ID NO: 3044860 - DNA, 18 bp, Homo sapiens
ataaaccaagacaagacc

SEQ ID NO: 3044861 - DNA, 15 bp, Homo sapiens
ataaaccaataaatc

SEQ ID NO: 3044862 - DNA, 19 bp, Homo sapiens
ataaaccaggtttgcacct

SEQ ID NO: 3044863 - DNA, 22 bp, Homo sapiens
ataaaccattggacagatttca

SEQ ID NO: 3044864 - DNA, 20 bp, Homo sapiens
ataaaccttatgaactacag

SEQ ID NO: 3044865 - DNA, 15 bp, Homo sapiens
ataaactagagaagg

SEQ ID NO: 3044866 - DNA, 16 bp, Homo sapiens
ataaactagagaaggg

SEQ ID NO: 3044867 - DNA, 23 bp, Homo sapiens
ataaactagggttttggcctgcc

SEQ ID NO: 3044868 - DNA, 23 bp, Homo sapiens
ataaactggtatgaataattgca

SEQ ID NO: 3044869 - DNA, 14 bp, Homo sapiens
ataaactttcaaat

SEQ ID NO: 3044870 - DNA, 19 bp, Homo sapiens
ataaagaaagaaatattaa

SEQ ID NO: 3044871 - DNA, 12 bp, Homo sapiens
ataaagaatact

SEQ ID NO: 3044872 - DNA, 13 bp, Homo sapiens
ataaagaatactt

SEQ ID NO: 3044873 - DNA, 20 bp, Homo sapiens
ataaagaatacttgaacttg

SEQ ID NO: 3044874 - DNA, 20 bp, Homo sapiens
ataaagatttcttgagtttt

SEQ ID NO: 3044875 - DNA, 14 bp, Homo sapiens
ataaagccctggga

SEQ ID NO: 3044876 - DNA, 20 bp, Homo sapiens
ataaagccctgggatcactg

SEQ ID NO: 3044877 - DNA, 17 bp, Homo sapiens
ataaagcctcaaatctt

SEQ ID NO: 3044878 - DNA, 18 bp, Homo sapiens
ataaagcctcaaggtttt

SEQ ID NO: 3044879 - DNA, 14 bp, Homo sapiens
ataaagcctgcttt

SEQ ID NO: 3044880 - DNA, 20 bp, Homo sapiens
ataaagctgttattcttgtt

SEQ ID NO: 3044881 - DNA, 23 bp, Homo sapiens
ataaagctgttattcttgttata

SEQ ID NO: 3044882 - DNA, 17 bp, Homo sapiens
ataaaggaacatggttt

SEQ ID NO: 3044883 - DNA, 20 bp, Homo sapiens
ataaagggaacatgcagctc

SEQ ID NO: 3044884 - DNA, 15 bp, Homo sapiens
ataaaggtaaaacaa

SEQ ID NO: 3044885 - DNA, 16 bp, Homo sapiens
ataaagtacttgacta

SEQ ID NO: 3044886 - DNA, 17 bp, Homo sapiens
ataaagtgcttgtgtaa

SEQ ID NO: 3044887 - DNA, 18 bp, Homo sapiens
ataaagtgcttgtgtaat

SEQ ID NO: 3044888 - DNA, 13 bp, Homo sapiens
ataaagtgtaata

SEQ ID NO: 3044889 - DNA, 19 bp, Homo sapiens
ataaagtttgcttagaaaa

SEQ ID NO: 3044890 - DNA, 20 bp, Homo sapiens
ataaagtttttttatttctt

SEQ ID NO: 3044891 - DNA, 22 bp, Homo sapiens
ataaagtttttttatttctttt

SEQ ID NO: 3044892 - DNA, 13 bp, Homo sapiens
ataaataaaaata

SEQ ID NO: 3044893 - DNA, 17 bp, Homo sapiens
ataaataaaaatggata

SEQ ID NO: 3044894 - DNA, 15 bp, Homo sapiens
ataaataaaagcctc

SEQ ID NO: 3044895 - DNA, 18 bp, Homo sapiens
ataaatacaaatctgtat

SEQ ID NO: 3044896 - DNA, 21 bp, Homo sapiens
ataaatacaaatctgtataaa

SEQ ID NO: 3044897 - DNA, 21 bp, Homo sapiens
ataaataccaattatggaaat

SEQ ID NO: 3044898 - DNA, 19 bp, Homo sapiens
ataaatactgacaatgtat

SEQ ID NO: 3044899 - DNA, 20 bp, Homo sapiens
ataaatatattttctttcta

SEQ ID NO: 3044900 - DNA, 14 bp, Homo sapiens
ataaatatgaagct

SEQ ID NO: 3044901 - DNA, 22 bp, Homo sapiens
ataaatatttggtaattctgtg

SEQ ID NO: 3044902 - DNA, 18 bp, Homo sapiens
ataaatatttgtttgggt

SEQ ID NO: 3044903 - DNA, 14 bp, Homo sapiens
ataaatctcttctt

SEQ ID NO: 3044904 - DNA, 15 bp, Homo sapiens
ataaatctgacccag

SEQ ID NO: 3044905 - DNA, 20 bp, Homo sapiens
ataaatgacaaagtgttgaa

SEQ ID NO: 3044906 - DNA, 15 bp, Homo sapiens
ataaatgcagcccat

SEQ ID NO: 3044907 - DNA, 18 bp, Homo sapiens
ataaatgcagcccatttc

SEQ ID NO: 3044908 - DNA, 12 bp, Homo sapiens
ataaatgtctgt

SEQ ID NO: 3044909 - DNA, 20 bp, Homo sapiens
ataaatgtcttttttttaat

SEQ ID NO: 3044910 - DNA, 12 bp, Homo sapiens
ataaatgtttcc

SEQ ID NO: 3044911 - DNA, 15 bp, Homo sapiens
ataaatgtttggaaa

SEQ ID NO: 3044912 - DNA, 16 bp, Homo sapiens
ataaattaatattgta

SEQ ID NO: 3044913 - DNA, 17 bp, Homo sapiens
ataaattaatattgtat

SEQ ID NO: 3044914 - DNA, 14 bp, Homo sapiens
ataaattaatgatt

SEQ ID NO: 3044915 - DNA, 17 bp, Homo sapiens
atagctgtattgaatca

SEQ ID NO: 3044916 - DNA, 22 bp, Homo sapiens
atagctgtattgaatcatgtag

SEQ ID NO: 3044917 - DNA, 22 bp, Homo sapiens
atagcttacaagccagctggag

SEQ ID NO: 3044918 - DNA, 15 bp, Homo sapiens
atagctttagtgaat

SEQ ID NO: 3044919 - DNA, 16 bp, Homo sapiens
atagcttttgattagt

SEQ ID NO: 3044920 - DNA, 15 bp, Homo sapiens
ataggaacatatgaa

SEQ ID NO: 3044921 - DNA, 22 bp, Homo sapiens
ataggactcaaagtttcagaga

SEQ ID NO: 3044922 - DNA, 20 bp, Homo sapiens
ataggactccatttctttct

SEQ ID NO: 3044923 - DNA, 23 bp, Homo sapiens
ataggactccatttctttcttcc

SEQ ID NO: 3044924 - DNA, 20 bp, Homo sapiens
ataggactgtggcaaacaaa

SEQ ID NO: 3044925 - DNA, 18 bp, Homo sapiens
ataggactttcttctaaa

SEQ ID NO: 3044926 - DNA, 14 bp, Homo sapiens
ataggatcctggag

SEQ ID NO: 3044927 - DNA, 22 bp, Homo sapiens
ataggccacagaaggtgaactt

SEQ ID NO: 3044928 - DNA, 14 bp, Homo sapiens
ataggcccacacac

SEQ ID NO: 3044929 - DNA, 17 bp, Homo sapiens
ataggcgtaactaattt

SEQ ID NO: 3044930 - DNA, 17 bp, Homo sapiens
atagggaatatatctct

SEQ ID NO: 3044931 - DNA, 13 bp, Homo sapiens
ataggggtcctgg

SEQ ID NO: 3044932 - DNA, 22 bp, Homo sapiens
atagggtctaccaatacaaaat

SEQ ID NO: 3044933 - DNA, 22 bp, Homo sapiens
ataggttttgtttgctatctta

SEQ ID NO: 3044934 - DNA, 16 bp, Homo sapiens
atagtaaagtattttt

SEQ ID NO: 3044935 - DNA, 13 bp, Homo sapiens
atagtaaatggta

SEQ ID NO: 3044936 - DNA, 19 bp, Homo sapiens
atagtaactgacatgatta

SEQ ID NO: 3044937 - DNA, 20 bp, Homo sapiens
atagtaactgacatgattag

SEQ ID NO: 3044938 - DNA, 18 bp, Homo sapiens
atagtactctttgtagca

SEQ ID NO: 3044939 - DNA, 15 bp, Homo sapiens
atagtagaaaaatca

SEQ ID NO: 3044940 - DNA, 21 bp, Homo sapiens
atagtagagtgatatggagca

SEQ ID NO: 3044941 - DNA, 17 bp, Homo sapiens
atagtaggcatgttatg

SEQ ID NO: 3044942 - DNA, 14 bp, Homo sapiens
atagtatgtaattt

SEQ ID NO: 3044943 - DNA, 16 bp, Homo sapiens
atagtatgtaatttct

SEQ ID NO: 3044944 - DNA, 13 bp, Homo sapiens
atagtatttaatt

SEQ ID NO: 3044945 - DNA, 14 bp, Homo sapiens
atagtatttaattg

SEQ ID NO: 3044946 - DNA, 23 bp, Homo sapiens
atagtctctacctatagaaatgt

SEQ ID NO: 3044947 - DNA, 23 bp, Homo sapiens
atagtctgggtcagacccatctc

SEQ ID NO: 3044948 - DNA, 14 bp, Homo sapiens
atagtcttccacaa

SEQ ID NO: 3044949 - DNA, 20 bp, Homo sapiens
atagtgatgtaatcttgaat

SEQ ID NO: 3044950 - DNA, 18 bp, Homo sapiens
atagtggatctcagtttt

SEQ ID NO: 3044951 - DNA, 20 bp, Homo sapiens
atagtgggcaccccactgca

SEQ ID NO: 3044952 - DNA, 20 bp, Homo sapiens
atagtgttaatcaatttaaa

SEQ ID NO: 3044953 - DNA, 21 bp, Homo sapiens
atagttaatgaaggtgtgcta

SEQ ID NO: 3044954 - DNA, 20 bp, Homo sapiens
atagttactccagtgccaac

SEQ ID NO: 3044955 - DNA, 12 bp, Homo sapiens
atagttactgtt

SEQ ID NO: 3044956 - DNA, 17 bp, Homo sapiens
atagttatttacttgaa

SEQ ID NO: 3044957 - DNA, 19 bp, Homo sapiens
atagttatttacttgaaag

SEQ ID NO: 3044958 - DNA, 13 bp, Homo sapiens
atagttctagaca

SEQ ID NO: 3044959 - DNA, 13 bp, Homo sapiens
atagtttctgagg

SEQ ID NO: 3044960 - DNA, 14 bp, Homo sapiens
atagtttctgaggc

SEQ ID NO: 3044961 - DNA, 20 bp, Homo sapiens
atagtttgggcttcagccta

SEQ ID NO: 3044962 - DNA, 12 bp, Homo sapiens
atagttttctcc

SEQ ID NO: 3044963 - DNA, 20 bp, Homo sapiens
atagttttgatgactggcat

SEQ ID NO: 3044964 - DNA, 22 bp, Homo sapiens
atagttttgatgactggcattt

SEQ ID NO: 3044965 - DNA, 13 bp, Homo sapiens
atataaaaacaaa

SEQ ID NO: 3044966 - DNA, 14 bp, Homo sapiens
atataaaaacaaaa

SEQ ID NO: 3044967 - DNA, 23 bp, Homo sapiens
atataaaaaccccaaactgttga

SEQ ID NO: 3044968 - DNA, 18 bp, Homo sapiens
atataaaaatatatgttg

SEQ ID NO: 3044969 - DNA, 23 bp, Homo sapiens
atataaaaggcaaatgtgtacat

SEQ ID NO: 3044970 - DNA, 13 bp, Homo sapiens
atataaaataatg

SEQ ID NO: 3044971 - DNA, 14 bp, Homo sapiens
atataaaataatgc

SEQ ID NO: 3044972 - DNA, 16 bp, Homo sapiens
atataaaatgctgata

SEQ ID NO: 3044973 - DNA, 13 bp, Homo sapiens
atataaaatgtgg

SEQ ID NO: 3044974 - DNA, 13 bp, Homo sapiens
atataaatgggaa

SEQ ID NO: 3044975 - DNA, 13 bp, Homo sapiens
atataacatatat

SEQ ID NO: 3044976 - DNA, 16 bp, Homo sapiens
atataacatgaaatga

SEQ ID NO: 3044977 - DNA, 20 bp, Homo sapiens
atataacatgaaatgataga

SEQ ID NO: 3044978 - DNA, 23 bp, Homo sapiens
atataaccacaaagcacagtttg

SEQ ID NO: 3044979 - DNA, 12 bp, Homo sapiens
atataagacatt

SEQ ID NO: 3044980 - DNA, 15 bp, Homo sapiens
atataagacattaag

SEQ ID NO: 3044981 - DNA, 23 bp, Homo sapiens
atataaggaaagcaataaatgaa

SEQ ID NO: 3044982 - DNA, 21 bp, Homo sapiens
atataaggacagaccaaaaat

SEQ ID NO: 3044983 - DNA, 22 bp, Homo sapiens
atataaggtcatagattcttga

SEQ ID NO: 3044984 - DNA, 14 bp, Homo sapiens
atataagtttcttt

SEQ ID NO: 3044985 - DNA, 22 bp, Homo sapiens
atataataaatacaagttcttt

SEQ ID NO: 3044986 - DNA, 17 bp, Homo sapiens
atataatatctaaagtt

SEQ ID NO: 3044987 - DNA, 14 bp, Homo sapiens
atataattctggag

SEQ ID NO: 3044988 - DNA, 21 bp, Homo sapiens
atatacaacctgcttgggtgg

SEQ ID NO: 3044989 - DNA, 21 bp, Homo sapiens
atatacaactgtaaagcaaat

SEQ ID NO: 3044990 - DNA, 14 bp, Homo sapiens
atatacaagctaca

SEQ ID NO: 3044991 - DNA, 19 bp, Homo sapiens
atatacaagctacagttgt

SEQ ID NO: 3044992 - DNA, 13 bp, Homo sapiens
atatacaataatg

SEQ ID NO: 3044993 - DNA, 14 bp, Homo sapiens
atatacaattatat

SEQ ID NO: 3044994 - DNA, 14 bp, Homo sapiens
atatacatatatat

SEQ ID NO: 3044995 - DNA, 22 bp, Homo sapiens
atatactctagatgaagtttta

SEQ ID NO: 3044996 - DNA, 19 bp, Homo sapiens
atatactgagctgctaaaa

SEQ ID NO: 3044997 - DNA, 20 bp, Homo sapiens
atatactgagctgctaaaat

SEQ ID NO: 3044998 - DNA, 15 bp, Homo sapiens
atatactgattttga

SEQ ID NO: 3044999 - DNA, 18 bp, Homo sapiens
atatattttctttctagt

SEQ ID NO: 3045000 - DNA, 14 bp, Homo sapiens
atatatttttgtga

SEQ ID NO: 3045001 - DNA, 13 bp, Homo sapiens
atatcaaatgcag

SEQ ID NO: 3045002 - DNA, 21 bp, Homo sapiens
atatcaaatgcagtatatttc

SEQ ID NO: 3045003 - DNA, 15 bp, Homo sapiens
atatcagagctggga

SEQ ID NO: 3045004 - DNA, 19 bp, Homo sapiens
atatcagttactcagccct

SEQ ID NO: 3045005 - DNA, 22 bp, Homo sapiens
atatcagttactcagccctggg

SEQ ID NO: 3045006 - DNA, 23 bp, Homo sapiens
atatcatcaatgtgacatttaca

SEQ ID NO: 3045007 - DNA, 22 bp, Homo sapiens
atatccaggtcaacagaatgaa

SEQ ID NO: 3045008 - DNA, 15 bp, Homo sapiens
atatcctccgccctt

SEQ ID NO: 3045009 - DNA, 21 bp, Homo sapiens
atatctaaagttatatttcag

SEQ ID NO: 3045010 - DNA, 14 bp, Homo sapiens
atatctaaattgaa

SEQ ID NO: 3045011 - DNA, 17 bp, Homo sapiens
atatctaaattgaataa

SEQ ID NO: 3045012 - DNA, 16 bp, Homo sapiens
atatctagatttctag

SEQ ID NO: 3045013 - DNA, 19 bp, Homo sapiens
atatctatatatataattt

SEQ ID NO: 3045014 - DNA, 16 bp, Homo sapiens
atatctctatttgaga

SEQ ID NO: 3045015 - DNA, 16 bp, Homo sapiens
atatctctcccttctt

SEQ ID NO: 3045016 - DNA, 23 bp, Homo sapiens
atatcttggcctaaacctcagtt

SEQ ID NO: 3045017 - DNA, 15 bp, Homo sapiens
atatcttttctttag

SEQ ID NO: 3045018 - DNA, 23 bp, Homo sapiens
atatcttttctttagagaactga

SEQ ID NO: 3045019 - DNA, 11 bp, Homo sapiens
atatgaaaaca

SEQ ID NO: 3045020 - DNA, 16 bp, Homo sapiens
atatgaaaatacaact

SEQ ID NO: 3045021 - DNA, 18 bp, Homo sapiens
atatgaaactctacattt

SEQ ID NO: 3045022 - DNA, 15 bp, Homo sapiens
atatgaaatattttg

SEQ ID NO: 3045023 - DNA, 20 bp, Homo sapiens
atatgaacagggcccaggcc

SEQ ID NO: 3045024 - DNA, 14 bp, Homo sapiens
atatgaagacataa

SEQ ID NO: 3045025 - DNA, 18 bp, Homo sapiens
atatgaagcaagctgtgt

SEQ ID NO: 3045026 - DNA, 19 bp, Homo sapiens
atatgaagcaagctgtgtt

SEQ ID NO: 3045027 - DNA, 20 bp, Homo sapiens
atatgaagcaagctgtgtta

SEQ ID NO: 3045028 - DNA, 23 bp, Homo sapiens
atatgaagcaagctgtgttactt

SEQ ID NO: 3045029 - DNA, 21 bp, Homo sapiens
atatgaagctcacctgttgct

SEQ ID NO: 3045030 - DNA, 16 bp, Homo sapiens
atatgaaggtttgaga

SEQ ID NO: 3045031 - DNA, 13 bp, Homo sapiens
atatgaatgaaac

SEQ ID NO: 3045032 - DNA, 15 bp, Homo sapiens
atatgacagctgtcc

SEQ ID NO: 3045033 - DNA, 16 bp, Homo sapiens
atatgactgcatttgt

SEQ ID NO: 3045034 - DNA, 21 bp, Homo sapiens
atatgactgtttttcggacag

SEQ ID NO: 3045035 - DNA, 15 bp, Homo sapiens
atatgactttttata

SEQ ID NO: 3045036 - DNA, 15 bp, Homo sapiens
atatgatactgatgc

SEQ ID NO: 3045037 - DNA, 21 bp, Homo sapiens
atatgattctagtacataatt

SEQ ID NO: 3045038 - DNA, 16 bp, Homo sapiens
atatgatttaaaacat

SEQ ID NO: 3045039 - DNA, 20 bp, Homo sapiens
atatgatttaaaacatgtaa

SEQ ID NO: 3045040 - DNA, 15 bp, Homo sapiens
atatgatttatatta

SEQ ID NO: 3045041 - DNA, 15 bp, Homo sapiens
atatgcaccttgtgt

SEQ ID NO: 3045042 - DNA, 19 bp, Homo sapiens
atatgcaccttgtgtctgt

SEQ ID NO: 3045043 - DNA, 13 bp, Homo sapiens
atatgcacttata

SEQ ID NO: 3045044 - DNA, 17 bp, Homo sapiens
atatgcagttttcctta

SEQ ID NO: 3045045 - DNA, 19 bp, Homo sapiens
atatgcccacatttagtct

SEQ ID NO: 3045046 - DNA, 18 bp, Homo sapiens
atatgccctcaagtaaaa

SEQ ID NO: 3045047 - DNA, 21 bp, Homo sapiens
atatgccctcaagtaaaagaa

SEQ ID NO: 3045048 - DNA, 18 bp, Homo sapiens
atatgctcttttgtttgg

SEQ ID NO: 3045049 - DNA, 23 bp, Homo sapiens
atatgctgtacatgacatcaaaa

SEQ ID NO: 3045050 - DNA, 15 bp, Homo sapiens
atatgcttagtaatg

SEQ ID NO: 3045051 - DNA, 18 bp, Homo sapiens
atatggaagtaaaggcat

SEQ ID NO: 3045052 - DNA, 21 bp, Homo sapiens
atatggacactgtgacaatga

SEQ ID NO: 3045053 - DNA, 16 bp, Homo sapiens
atatggcctcaagatc

SEQ ID NO: 3045054 - DNA, 17 bp, Homo sapiens
atatgggcgggcagtcg

SEQ ID NO: 3045055 - DNA, 21 bp, Homo sapiens
atatggggatagtctgggtca

SEQ ID NO: 3045056 - DNA, 16 bp, Homo sapiens
atatgtaaatttttca

SEQ ID NO: 3045057 - DNA, 14 bp, Homo sapiens
atatgtacatgaga

SEQ ID NO: 3045058 - DNA, 15 bp, Homo sapiens
atatgtagaatgtaa

SEQ ID NO: 3045059 - DNA, 14 bp, Homo sapiens
atatgtattaataa

SEQ ID NO: 3045060 - DNA, 18 bp, Homo sapiens
atatgtattttttgaatc

SEQ ID NO: 3045061 - DNA, 23 bp, Homo sapiens
atatgtattttttgaatctatga

SEQ ID NO: 3045062 - DNA, 15 bp, Homo sapiens
atatgtcaaattgtc

SEQ ID NO: 3045063 - DNA, 14 bp, Homo sapiens
atatgtcatttact

SEQ ID NO: 3045064 - DNA, 19 bp, Homo sapiens
atatgtgagtgaaagtact

SEQ ID NO: 3045065 - DNA, 12 bp, Homo sapiens
atatgtgtatgt

SEQ ID NO: 3045066 - DNA, 15 bp, Homo sapiens
atatgttaaagttta

SEQ ID NO: 3045067 - DNA, 14 bp, Homo sapiens
atatgttgaatact

SEQ ID NO: 3045068 - DNA, 16 bp, Homo sapiens
atatgttgaatacttt

SEQ ID NO: 3045069 - DNA, 18 bp, Homo sapiens
atatgttgctataataaa

SEQ ID NO: 3045070 - DNA, 15 bp, Homo sapiens
atattaaaaaaatgc

SEQ ID NO: 3045071 - DNA, 18 bp, Homo sapiens
atattaaaagtcacaatg

SEQ ID NO: 3045072 - DNA, 21 bp, Homo sapiens
atattaaaatttggtgcttat

SEQ ID NO: 3045073 - DNA, 21 bp, Homo sapiens
atattaaataacatgtttctc

SEQ ID NO: 3045074 - DNA, 12 bp, Homo sapiens
atattaaatctg

SEQ ID NO: 3045075 - DNA, 21 bp, Homo sapiens
atattaaattctcaaagtttt

SEQ ID NO: 3045076 - DNA, 16 bp, Homo sapiens
atattaatataagttt

SEQ ID NO: 3045077 - DNA, 23 bp, Homo sapiens
atattaccttaagatttttcttt

SEQ ID NO: 3045078 - DNA, 14 bp, Homo sapiens
atattacgttgttt

SEQ ID NO: 3045079 - DNA, 16 bp, Homo sapiens
atattacgttgtttct

SEQ ID NO: 3045080 - DNA, 13 bp, Homo sapiens
atattagatgtga

SEQ ID NO: 3045081 - DNA, 14 bp, Homo sapiens
atattagcaaagaa

SEQ ID NO: 3045082 - DNA, 17 bp, Homo sapiens
atattataagggagagc

SEQ ID NO: 3045083 - DNA, 14 bp, Homo sapiens
atattatagagagt

SEQ ID NO: 3045084 - DNA, 21 bp, Homo sapiens
atattatctacctgttctgta

SEQ ID NO: 3045085 - DNA, 16 bp, Homo sapiens
atattattattaattt

SEQ ID NO: 3045086 - DNA, 20 bp, Homo sapiens
atattattccgtattacatt

SEQ ID NO: 3045087 - DNA, 21 bp, Homo sapiens
atattattccgtattacattt

SEQ ID NO: 3045088 - DNA, 23 bp, Homo sapiens
atattattccgtattacattttt

SEQ ID NO: 3045089 - DNA, 20 bp, Homo sapiens
atattatttctaggaagaat

SEQ ID NO: 3045090 - DNA, 20 bp, Homo sapiens
atattcaacacactgcctta

SEQ ID NO: 3045091 - DNA, 22 bp, Homo sapiens
atattcaacacactgccttatt

SEQ ID NO: 3045092 - DNA, 20 bp, Homo sapiens
atattcaactcataagactt

SEQ ID NO: 3045093 - DNA, 15 bp, Homo sapiens
atattcaccaatgtt

SEQ ID NO: 3045094 - DNA, 17 bp, Homo sapiens
atattcactttcatttt

SEQ ID NO: 3045095 - DNA, 20 bp, Homo sapiens
atattcagaatctttgttaa

SEQ ID NO: 3045096 - DNA, 20 bp, Homo sapiens
atattcatcaaataaacctt

SEQ ID NO: 3045097 - DNA, 17 bp, Homo sapiens
atattccctagaaactt

SEQ ID NO: 3045098 - DNA, 13 bp, Homo sapiens
atattctaagact

SEQ ID NO: 3045099 - DNA, 14 bp, Homo sapiens
atattctaagactt

SEQ ID NO: 3045100 - DNA, 23 bp, Homo sapiens
atattctaagacttactctaaga

SEQ ID NO: 3045101 - DNA, 14 bp, Homo sapiens
atattctctgatgt

SEQ ID NO: 3045102 - DNA, 16 bp, Homo sapiens
atattctgctctatta

SEQ ID NO: 3045103 - DNA, 21 bp, Homo sapiens
atattctgctctattatataa

SEQ ID NO: 3045104 - DNA, 21 bp, Homo sapiens
atattctggccagactcgatg

SEQ ID NO: 3045105 - DNA, 15 bp, Homo sapiens
atattcttgtaaata

SEQ ID NO: 3045106 - DNA, 14 bp, Homo sapiens
atattgaccatgtg

SEQ ID NO: 3045107 - DNA, 19 bp, Homo sapiens
atattgaccatgtgattat

SEQ ID NO: 3045108 - DNA, 17 bp, Homo sapiens
atattgagtcaaatggt

SEQ ID NO: 3045109 - DNA, 20 bp, Homo sapiens
atattgatggagatagtggt

SEQ ID NO: 3045110 - DNA, 16 bp, Homo sapiens
atattgattgtccttt

SEQ ID NO: 3045111 - DNA, 19 bp, Homo sapiens
atattgcaggagacatttt

SEQ ID NO: 3045112 - DNA, 14 bp, Homo sapiens
atattgccatgtgt

SEQ ID NO: 3045113 - DNA, 20 bp, Homo sapiens
atattgctctatatgtaata

SEQ ID NO: 3045114 - DNA, 15 bp, Homo sapiens
atattggaagagaga

SEQ ID NO: 3045115 - DNA, 15 bp, Homo sapiens
atattggtgcgtttt

SEQ ID NO: 3045116 - DNA, 20 bp, Homo sapiens
atattggtgcgtttttacag

SEQ ID NO: 3045117 - DNA, 21 bp, Homo sapiens
atattggtgcgtttttacagt

SEQ ID NO: 3045118 - DNA, 14 bp, Homo sapiens
atattgtaaatgct

SEQ ID NO: 3045119 - DNA, 15 bp, Homo sapiens
atattgtaaatgcta

SEQ ID NO: 3045120 - DNA, 21 bp, Homo sapiens
atattgtaaatgctattatac

SEQ ID NO: 3045121 - DNA, 12 bp, Homo sapiens
atattgtaatct

SEQ ID NO: 3045122 - DNA, 15 bp, Homo sapiens
atattgtctgtaaaa

SEQ ID NO: 3045123 - DNA, 14 bp, Homo sapiens
atatttaaaaatgt

SEQ ID NO: 3045124 - DNA, 21 bp, Homo sapiens
atatttaaaagacaaacacct

SEQ ID NO: 3045125 - DNA, 14 bp, Homo sapiens
atatttacattttg

SEQ ID NO: 3045126 - DNA, 20 bp, Homo sapiens
atatttagcataaatttaat

SEQ ID NO: 3045127 - DNA, 17 bp, Homo sapiens
atcagaagaaaggccaa

SEQ ID NO: 3045128 - DNA, 19 bp, Homo sapiens
atcagaagtaactcccact

SEQ ID NO: 3045129 - DNA, 21 bp, Homo sapiens
atcagaagtatggaattttct

SEQ ID NO: 3045130 - DNA, 22 bp, Homo sapiens
atcagaatagccacatttggaa

SEQ ID NO: 3045131 - DNA, 18 bp, Homo sapiens
atcagaattgaaacactt

SEQ ID NO: 3045132 - DNA, 19 bp, Homo sapiens
atcagaccctaccccacca

SEQ ID NO: 3045133 - DNA, 18 bp, Homo sapiens
atcagacttcacactgca

SEQ ID NO: 3045134 - DNA, 15 bp, Homo sapiens
atcagatagcatctt

SEQ ID NO: 3045135 - DNA, 16 bp, Homo sapiens
atcagatatacctaga

SEQ ID NO: 3045136 - DNA, 22 bp, Homo sapiens
atcagatcatttcaaaactcat

SEQ ID NO: 3045137 - DNA, 21 bp, Homo sapiens
atcagatgctccaagattcta

SEQ ID NO: 3045138 - DNA, 21 bp, Homo sapiens
atcagatgttttggtcaagta

SEQ ID NO: 3045139 - DNA, 16 bp, Homo sapiens
atcagattgcatgtga

SEQ ID NO: 3045140 - DNA, 18 bp, Homo sapiens
atcagattgcatgtgact

SEQ ID NO: 3045141 - DNA, 20 bp, Homo sapiens
atcagatttggtgatggaaa

SEQ ID NO: 3045142 - DNA, 14 bp, Homo sapiens
atcagatttgtaat

SEQ ID NO: 3045143 - DNA, 17 bp, Homo sapiens
atcagattttaacagct

SEQ ID NO: 3045144 - DNA, 13 bp, Homo sapiens
atcagcaaaaaag

SEQ ID NO: 3045145 - DNA, 15 bp, Homo sapiens
atcagcaaacacaat

SEQ ID NO: 3045146 - DNA, 18 bp, Homo sapiens
atcagcaaacacaataag

SEQ ID NO: 3045147 - DNA, 21 bp, Homo sapiens
atcagcaagtctctttatatg

SEQ ID NO: 3045148 - DNA, 18 bp, Homo sapiens
atcagcatgttttctgct

SEQ ID NO: 3045149 - DNA, 13 bp, Homo sapiens
atcagccagacat

SEQ ID NO: 3045150 - DNA, 14 bp, Homo sapiens
atcagccagctgcc

SEQ ID NO: 3045151 - DNA, 16 bp, Homo sapiens
atcagccatttttaga

SEQ ID NO: 3045152 - DNA, 12 bp, Homo sapiens
atcagctgggca

SEQ ID NO: 3045153 - DNA, 11 bp, Homo sapiens
atcgccccacc

SEQ ID NO: 3045154 - DNA, 21 bp, Homo sapiens
atcgccccaccgcagctactc

SEQ ID NO: 3045155 - DNA, 22 bp, Homo sapiens
atcgccttatgagaacatggtg

SEQ ID NO: 3045156 - DNA, 18 bp, Homo sapiens
atcgccttatttatattc

SEQ ID NO: 3045157 - DNA, 16 bp, Homo sapiens
atcgctgtattttgag

SEQ ID NO: 3045158 - DNA, 18 bp, Homo sapiens
atcgcttgaacctgggaa

SEQ ID NO: 3045159 - DNA, 23 bp, Homo sapiens
atcggcccacagctcccacccca

SEQ ID NO: 3045160 - DNA, 21 bp, Homo sapiens
atcggccctgtcccctggagt

SEQ ID NO: 3045161 - DNA, 12 bp, Homo sapiens
atcgggaaggat

SEQ ID NO: 3045162 - DNA, 14 bp, Homo sapiens
atcgggcccaggga

SEQ ID NO: 3045163 - DNA, 18 bp, Homo sapiens
atcggggagccgggagcc

SEQ ID NO: 3045164 - DNA, 14 bp, Homo sapiens
atcgtatagctgta

SEQ ID NO: 3045165 - DNA, 15 bp, Homo sapiens
atcgtccactgtcaa

SEQ ID NO: 3045166 - DNA, 12 bp, Homo sapiens
atcgtccaggga

SEQ ID NO: 3045167 - DNA, 23 bp, Homo sapiens
atcgtccagggagcattttcctc

SEQ ID NO: 3045168 - DNA, 20 bp, Homo sapiens
atcgtcccctcccccacccc

SEQ ID NO: 3045169 - DNA, 15 bp, Homo sapiens
atcgttcaactccac

SEQ ID NO: 3045170 - DNA, 15 bp, Homo sapiens
atcgttccccacccc

SEQ ID NO: 3045171 - DNA, 14 bp, Homo sapiens
atcgttctctgcct

SEQ ID NO: 3045172 - DNA, 15 bp, Homo sapiens
atcgtttaatgttta

SEQ ID NO: 3045173 - DNA, 19 bp, Homo sapiens
atcgtttaatgtttataca

SEQ ID NO: 3045174 - DNA, 14 bp, Homo sapiens
atcgtttttgtttt

SEQ ID NO: 3045175 - DNA, 19 bp, Homo sapiens
atctaaaggatggaaaaat

SEQ ID NO: 3045176 - DNA, 14 bp, Homo sapiens
atctaaagttatat

SEQ ID NO: 3045177 - DNA, 17 bp, Homo sapiens
atctaaagttatatttc

SEQ ID NO: 3045178 - DNA, 18 bp, Homo sapiens
atctaaatagatactttt

SEQ ID NO: 3045179 - DNA, 23 bp, Homo sapiens
atctaaatagatacttttgataa

SEQ ID NO: 3045180 - DNA, 15 bp, Homo sapiens
atctaaatcaccaga

SEQ ID NO: 3045181 - DNA, 13 bp, Homo sapiens
atctaacctcatc

SEQ ID NO: 3045182 - DNA, 14 bp, Homo sapiens
atctaacctcatct

SEQ ID NO: 3045183 - DNA, 15 bp, Homo sapiens
atctaacctcatctt

SEQ ID NO: 3045184 - DNA, 18 bp, Homo sapiens
atctaacctcatcttctt

SEQ ID NO: 3045185 - DNA, 13 bp, Homo sapiens
atctaagcctgaa

SEQ ID NO: 3045186 - DNA, 17 bp, Homo sapiens
atctaaggctgtttgct

SEQ ID NO: 3045187 - DNA, 16 bp, Homo sapiens
atctaagttaatttaa

SEQ ID NO: 3045188 - DNA, 18 bp, Homo sapiens
atctaagttaatttaaag

SEQ ID NO: 3045189 - DNA, 13 bp, Homo sapiens
atctaagttataa

SEQ ID NO: 3045190 - DNA, 16 bp, Homo sapiens
atctaatatggccaca

SEQ ID NO: 3045191 - DNA, 18 bp, Homo sapiens
atctaatcctttaatgat

SEQ ID NO: 3045192 - DNA, 22 bp, Homo sapiens
atctacagatagagagttgttg

SEQ ID NO: 3045193 - DNA, 14 bp, Homo sapiens
atctacatcttttt

SEQ ID NO: 3045194 - DNA, 23 bp, Homo sapiens
atctacctgcaacacaacatttg

SEQ ID NO: 3045195 - DNA, 21 bp, Homo sapiens
atctacctgttctgtagcttt

SEQ ID NO: 3045196 - DNA, 17 bp, Homo sapiens
atctactaagtttcctt

SEQ ID NO: 3045197 - DNA, 20 bp, Homo sapiens
atctactctggaccaaggag

SEQ ID NO: 3045198 - DNA, 17 bp, Homo sapiens
atctagcgcaattgaag

SEQ ID NO: 3045199 - DNA, 21 bp, Homo sapiens
atctatagttgatatgtttta

SEQ ID NO: 3045200 - DNA, 22 bp, Homo sapiens
atctatatatacgtatgtatat

SEQ ID NO: 3045201 - DNA, 15 bp, Homo sapiens
atctatatatgtgta

SEQ ID NO: 3045202 - DNA, 15 bp, Homo sapiens
atctatccacactgt

SEQ ID NO: 3045203 - DNA, 16 bp, Homo sapiens
atctatgaaaaccagt

SEQ ID NO: 3045204 - DNA, 23 bp, Homo sapiens
atctatgcagaacaggcagaaat

SEQ ID NO: 3045205 - DNA, 23 bp, Homo sapiens
atctatgggagagtgtcaaccag

SEQ ID NO: 3045206 - DNA, 22 bp, Homo sapiens
atctattaagggattagtattt

SEQ ID NO: 3045207 - DNA, 17 bp, Homo sapiens
atctattctgagaaaac

SEQ ID NO: 3045208 - DNA, 22 bp, Homo sapiens
atctattctgagaaaacaagca

SEQ ID NO: 3045209 - DNA, 13 bp, Homo sapiens
atctcaaatgttt

SEQ ID NO: 3045210 - DNA, 15 bp, Homo sapiens
atctcagccatccgc

SEQ ID NO: 3045211 - DNA, 17 bp, Homo sapiens
atctcagccatccgcag

SEQ ID NO: 3045212 - DNA, 22 bp, Homo sapiens
atctcagccatccgcagactgc

SEQ ID NO: 3045213 - DNA, 18 bp, Homo sapiens
atctcagctcactgcaag

SEQ ID NO: 3045214 - DNA, 23 bp, Homo sapiens
atctcaggttggcggcagacaca

SEQ ID NO: 3045215 - DNA, 20 bp, Homo sapiens
atctcagtggtgtgtgaagt

SEQ ID NO: 3045216 - DNA, 14 bp, Homo sapiens
atctcagtttttaa

SEQ ID NO: 3045217 - DNA, 23 bp, Homo sapiens
atctcatcctattacttttcatc

SEQ ID NO: 3045218 - DNA, 23 bp, Homo sapiens
atctcatgcccctggctgggacg

SEQ ID NO: 3045219 - DNA, 18 bp, Homo sapiens
atctccaagaccagagat

SEQ ID NO: 3045220 - DNA, 12 bp, Homo sapiens
atctccaagtgg

SEQ ID NO: 3045221 - DNA, 15 bp, Homo sapiens
atctccatactttgg

SEQ ID NO: 3045222 - DNA, 20 bp, Homo sapiens
atctcccacctagcagcacc

SEQ ID NO: 3045223 - DNA, 17 bp, Homo sapiens
atctccctagcccaccc

SEQ ID NO: 3045224 - DNA, 19 bp, Homo sapiens
atctccctgccgcctcaat

SEQ ID NO: 3045225 - DNA, 13 bp, Homo sapiens
atctccctgcttc

SEQ ID NO: 3045226 - DNA, 19 bp, Homo sapiens
atctcccttccacctcaca

SEQ ID NO: 3045227 - DNA, 14 bp, Homo sapiens
atctcctgacctca

SEQ ID NO: 3045228 - DNA, 22 bp, Homo sapiens
atctcgcagtgtttctgtgaat

SEQ ID NO: 3045229 - DNA, 14 bp, Homo sapiens
atctcgcctggaaa

SEQ ID NO: 3045230 - DNA, 17 bp, Homo sapiens
atctcgctccctcccag

SEQ ID NO: 3045231 - DNA, 18 bp, Homo sapiens
atctcgtcaggctgccag

SEQ ID NO: 3045232 - DNA, 14 bp, Homo sapiens
atctcgtttagtgc

SEQ ID NO: 3045233 - DNA, 14 bp, Homo sapiens
atctcgtttcaaaa

SEQ ID NO: 3045234 - DNA, 16 bp, Homo sapiens
atctctcatcctccag

SEQ ID NO: 3045235 - DNA, 15 bp, Homo sapiens
atctctcccttaccc

SEQ ID NO: 3045236 - DNA, 15 bp, Homo sapiens
atctctcccttcttt

SEQ ID NO: 3045237 - DNA, 19 bp, Homo sapiens
atctctcccttctttacct

SEQ ID NO: 3045238 - DNA, 13 bp, Homo sapiens
atctctctccctt

SEQ ID NO: 3045239 - DNA, 13 bp, Homo sapiens
atctctgagtgtc

SEQ ID NO: 3045240 - DNA, 20 bp, Homo sapiens
atctctgagtgtctctgcct

SEQ ID NO: 3045241 - DNA, 23 bp, Homo sapiens
atctctgagtgtctctgcctgga

SEQ ID NO: 3045242 - DNA, 15 bp, Homo sapiens
atctctgcctttgag

SEQ ID NO: 3045243 - DNA, 14 bp, Homo sapiens
atctcttaaactct

SEQ ID NO: 3045244 - DNA, 20 bp, Homo sapiens
atctcttgattataaatgtt

SEQ ID NO: 3045245 - DNA, 15 bp, Homo sapiens
atctcttgcccttcc

SEQ ID NO: 3045246 - DNA, 17 bp, Homo sapiens
atctcttgctgttaaat

SEQ ID NO: 3045247 - DNA, 21 bp, Homo sapiens
atctctttgaattttctgtgt

SEQ ID NO: 3045248 - DNA, 22 bp, Homo sapiens
atctctttgtcctgaatggctt

SEQ ID NO: 3045249 - DNA, 22 bp, Homo sapiens
atctctttgttctaaagatgga

SEQ ID NO: 3045250 - DNA, 19 bp, Homo sapiens
atctcttttatatttgtag

SEQ ID NO: 3045251 - DNA, 20 bp, Homo sapiens
atctcttttatatttgtagg

SEQ ID NO: 3045252 - DNA, 16 bp, Homo sapiens
atctctttttaagata

SEQ ID NO: 3045253 - DNA, 19 bp, Homo sapiens
atctctttttgctttcgaa

SEQ ID NO: 3045254 - DNA, 21 bp, Homo sapiens
atctgaaataggaaacaagtg

SEQ ID NO: 3045255 - DNA, 14 bp, Homo sapiens
atctgaacatctgg

SEQ ID NO: 3045256 - DNA, 21 bp, Homo sapiens
atctgaagagctattatataa

SEQ ID NO: 3045257 - DNA, 15 bp, Homo sapiens
atctgaagccctccc

SEQ ID NO: 3045258 - DNA, 18 bp, Homo sapiens
atctgaatgaaaataact

SEQ ID NO: 3045259 - DNA, 14 bp, Homo sapiens
atctgaccagcagc

SEQ ID NO: 3045260 - DNA, 15 bp, Homo sapiens
atctgaccagcagcg

SEQ ID NO: 3045261 - DNA, 20 bp, Homo sapiens
atctgaccatctgtgactat

SEQ ID NO: 3045262 - DNA, 12 bp, Homo sapiens
atctgacccagt

SEQ ID NO: 3045263 - DNA, 18 bp, Homo sapiens
atctgacccagtgccccc

SEQ ID NO: 3045264 - DNA, 23 bp, Homo sapiens
atctgagaaacctgttgaagatt

SEQ ID NO: 3045265 - DNA, 18 bp, Homo sapiens
atctgagcaaggagttta

SEQ ID NO: 3045266 - DNA, 12 bp, Homo sapiens
atctgataaagt

SEQ ID NO: 3045267 - DNA, 17 bp, Homo sapiens
atctgatacttatttac

SEQ ID NO: 3045268 - DNA, 24 bp, Homo sapiens
atctgatggctcctgcagcacttt

SEQ ID NO: 3045269 - DNA, 14 bp, Homo sapiens
atctgcaatatgaa

SEQ ID NO: 3045270 - DNA, 18 bp, Homo sapiens
atctgcaccaccatgccc

SEQ ID NO: 3045271 - DNA, 19 bp, Homo sapiens
atctgcacccccctgggct

SEQ ID NO: 3045272 - DNA, 21 bp, Homo sapiens
atctgcacccccctgggctga

SEQ ID NO: 3045273 - DNA, 23 bp, Homo sapiens
atctgcaggcaccgggctggctg

SEQ ID NO: 3045274 - DNA, 18 bp, Homo sapiens
atctgcatgtaaaatctt

SEQ ID NO: 3045275 - DNA, 22 bp, Homo sapiens
atctgcattgcccagtctttca

SEQ ID NO: 3045276 - DNA, 22 bp, Homo sapiens
atctgccacaaaaatgttcact

SEQ ID NO: 3045277 - DNA, 13 bp, Homo sapiens
atctgcccgcctg

SEQ ID NO: 3045278 - DNA, 15 bp, Homo sapiens
atctgcccgcctgcc

SEQ ID NO: 3045279 - DNA, 20 bp, Homo sapiens
atctgcccgcctgcccacct

SEQ ID NO: 3045280 - DNA, 20 bp, Homo sapiens
atctgcctcccctgtggaaa

SEQ ID NO: 3045281 - DNA, 21 bp, Homo sapiens
atctgccttccagcccagacc

SEQ ID NO: 3045282 - DNA, 15 bp, Homo sapiens
atctgcgcagggtgg

SEQ ID NO: 3045283 - DNA, 14 bp, Homo sapiens
atctgctcacttta

SEQ ID NO: 3045284 - DNA, 18 bp, Homo sapiens
atctgctggagtttcatg

SEQ ID NO: 3045285 - DNA, 19 bp, Homo sapiens
atctgcttcttagagaggc

SEQ ID NO: 3045286 - DNA, 16 bp, Homo sapiens
atctgctttctgttca

SEQ ID NO: 3045287 - DNA, 17 bp, Homo sapiens
atctgctttctgttcat

SEQ ID NO: 3045288 - DNA, 18 bp, Homo sapiens
atctgctttctgttcatc

SEQ ID NO: 3045289 - DNA, 11 bp, Homo sapiens
atctggaaccc

SEQ ID NO: 3045290 - DNA, 16 bp, Homo sapiens
atctggaacccagact

SEQ ID NO: 3045291 - DNA, 23 bp, Homo sapiens
atctggaacccagactcagacat

SEQ ID NO: 3045292 - DNA, 16 bp, Homo sapiens
atctggaacctcagcc

SEQ ID NO: 3045293 - DNA, 19 bp, Homo sapiens
atctggaacctcagcctgg

SEQ ID NO: 3045294 - DNA, 20 bp, Homo sapiens
atctggagaccagggagcct

SEQ ID NO: 3045295 - DNA, 17 bp, Homo sapiens
atctggatgccttcccc

SEQ ID NO: 3045296 - DNA, 12 bp, Homo sapiens
atctggcagggt

SEQ ID NO: 3045297 - DNA, 20 bp, Homo sapiens
atctggcccaagtgaagcat

SEQ ID NO: 3045298 - DNA, 20 bp, Homo sapiens
atctggcttctggccaggaa

SEQ ID NO: 3045299 - DNA, 23 bp, Homo sapiens
atctgggaccctttccttccttc

SEQ ID NO: 3045300 - DNA, 15 bp, Homo sapiens
atctgggtatctttc

SEQ ID NO: 3045301 - DNA, 14 bp, Homo sapiens
atctgggtgccctg

SEQ ID NO: 3045302 - DNA, 23 bp, Homo sapiens
atctggtatggtgctaatatttt

SEQ ID NO: 3045303 - DNA, 16 bp, Homo sapiens
atctggtctaatttat

SEQ ID NO: 3045304 - DNA, 15 bp, Homo sapiens
atctgtaaggaactg

SEQ ID NO: 3045305 - DNA, 18 bp, Homo sapiens
atctgtaaggaactggaa

SEQ ID NO: 3045306 - DNA, 14 bp, Homo sapiens
atctgtataaatgt

SEQ ID NO: 3045307 - DNA, 15 bp, Homo sapiens
atctgtataaatgtc

SEQ ID NO: 3045308 - DNA, 21 bp, Homo sapiens
atctgtataaatgtctattat

SEQ ID NO: 3045309 - DNA, 22 bp, Homo sapiens
atctgtcaagagtagttatata

SEQ ID NO: 3045310 - DNA, 21 bp, Homo sapiens
atctgtccacatccccagagc

SEQ ID NO: 3045311 - DNA, 22 bp, Homo sapiens
atctgtccacatccccagagcc

SEQ ID NO: 3045312 - DNA, 19 bp, Homo sapiens
atctgtccatcctcctctc

SEQ ID NO: 3045313 - DNA, 21 bp, Homo sapiens
atctgtccatcctcctctcca

SEQ ID NO: 3045314 - DNA, 22 bp, Homo sapiens
atctgtccgtccagagccggca

SEQ ID NO: 3045315 - DNA, 14 bp, Homo sapiens
atctgtcctcagcc

SEQ ID NO: 3045316 - DNA, 17 bp, Homo sapiens
atctgtcctcagccttg

SEQ ID NO: 3045317 - DNA, 18 bp, Homo sapiens
atctgtcctcagccttgc

SEQ ID NO: 3045318 - DNA, 12 bp, Homo sapiens
atctgtcctctg

SEQ ID NO: 3045319 - DNA, 13 bp, Homo sapiens
atctgtcctctgt

SEQ ID NO: 3045320 - DNA, 13 bp, Homo sapiens
atctgtgactata

SEQ ID NO: 3045321 - DNA, 15 bp, Homo sapiens
atctgtgactataaa

SEQ ID NO: 3045322 - DNA, 20 bp, Homo sapiens
atctgtgactataaagctgt

SEQ ID NO: 3045323 - DNA, 21 bp, Homo sapiens
atctgtgactataaagctgtt

SEQ ID NO: 3045324 - DNA, 17 bp, Homo sapiens
atctgtgcagggctggt

SEQ ID NO: 3045325 - DNA, 16 bp, Homo sapiens
atctgtggagttcctg

SEQ ID NO: 3045326 - DNA, 18 bp, Homo sapiens
atctgtggagttcctgct

SEQ ID NO: 3045327 - DNA, 19 bp, Homo sapiens
atctgtggagttcctgctc

SEQ ID NO: 3045328 - DNA, 16 bp, Homo sapiens
atctgtgtacaaagaa

SEQ ID NO: 3045329 - DNA, 18 bp, Homo sapiens
atctgtgtacaaagaaat

SEQ ID NO: 3045330 - DNA, 13 bp, Homo sapiens
atctgtgtctctg

SEQ ID NO: 3045331 - DNA, 14 bp, Homo sapiens
atctgtgtctctgg

SEQ ID NO: 3045332 - DNA, 16 bp, Homo sapiens
atctgtgtctctggaa

SEQ ID NO: 3045333 - DNA, 15 bp, Homo sapiens
atctgtgtcttgttt

SEQ ID NO: 3045334 - DNA, 9 bp, Homo sapiens
atctgtgtt

SEQ ID NO: 3045335 - DNA, 13 bp, Homo sapiens
atctgtgttctaa

SEQ ID NO: 3045336 - DNA, 18 bp, Homo sapiens
atctgtgtttttgaaata

SEQ ID NO: 3045337 - DNA, 22 bp, Homo sapiens
atctgttaaccaaataaaacat

SEQ ID NO: 3045338 - DNA, 21 bp, Homo sapiens
atctgtttacactctttgcca

SEQ ID NO: 3045339 - DNA, 17 bp, Homo sapiens
atctgtttacagtgttc

SEQ ID NO: 3045340 - DNA, 17 bp, Homo sapiens
atctgttttgaaggcaa

SEQ ID NO: 3045341 - DNA, 18 bp, Homo sapiens
atctgttttgaaggcaaa

SEQ ID NO: 3045342 - DNA, 19 bp, Homo sapiens
atctgttttgaaggcaaaa

SEQ ID NO: 3045343 - DNA, 19 bp, Homo sapiens
atcttaaatcagaataaat

SEQ ID NO: 3045344 - DNA, 16 bp, Homo sapiens
atcttaacactgaaat

SEQ ID NO: 3045345 - DNA, 17 bp, Homo sapiens
atcttaacactgaaatt

SEQ ID NO: 3045346 - DNA, 13 bp, Homo sapiens
atcttaattttgg

SEQ ID NO: 3045347 - DNA, 19 bp, Homo sapiens
atcttaattttggttgtat

SEQ ID NO: 3045348 - DNA, 14 bp, Homo sapiens
atcttacaaaatcc

SEQ ID NO: 3045349 - DNA, 21 bp, Homo sapiens
atcttacaaaatcctggaaga

SEQ ID NO: 3045350 - DNA, 18 bp, Homo sapiens
atcttaccaggttcactt

SEQ ID NO: 3045351 - DNA, 15 bp, Homo sapiens
atcttagttctgtat

SEQ ID NO: 3045352 - DNA, 14 bp, Homo sapiens
atcttagtttggat

SEQ ID NO: 3045353 - DNA, 23 bp, Homo sapiens
atcttagtttggattcttatgta

SEQ ID NO: 3045354 - DNA, 14 bp, Homo sapiens
atcttatttggaat

SEQ ID NO: 3045355 - DNA, 15 bp, Homo sapiens
atcttatttttctaa

SEQ ID NO: 3045356 - DNA, 19 bp, Homo sapiens
atcttatttttctaaacgt

SEQ ID NO: 3045357 - DNA, 19 bp, Homo sapiens
atcttcaaaagtaatgcct

SEQ ID NO: 3045358 - DNA, 22 bp, Homo sapiens
atcttcaaaagtaatgcctctg

SEQ ID NO: 3045359 - DNA, 23 bp, Homo sapiens
atcttcaaaagtaatgcctctgt

SEQ ID NO: 3045360 - DNA, 18 bp, Homo sapiens
atcttcaatttggatatt

SEQ ID NO: 3045361 - DNA, 22 bp, Homo sapiens
atcttcaccagaggaatcactc

SEQ ID NO: 3045362 - DNA, 17 bp, Homo sapiens
atcttcacccaggccta

SEQ ID NO: 3045363 - DNA, 22 bp, Homo sapiens
atcttcactgcaattttgtgta

SEQ ID NO: 3045364 - DNA, 13 bp, Homo sapiens
atcttcagctggt

SEQ ID NO: 3045365 - DNA, 14 bp, Homo sapiens
atcttcagctggtg

SEQ ID NO: 3045366 - DNA, 12 bp, Homo sapiens
atcttcatataa

SEQ ID NO: 3045367 - DNA, 20 bp, Homo sapiens
atcttccagaagctgtactt

SEQ ID NO: 3045368 - DNA, 17 bp, Homo sapiens
atcttccagaagtgtga

SEQ ID NO: 3045369 - DNA, 18 bp, Homo sapiens
atcttccctgcccctgtg

SEQ ID NO: 3045370 - DNA, 22 bp, Homo sapiens
atcttccctgcccctgtgcctc

SEQ ID NO: 3045371 - DNA, 15 bp, Homo sapiens
atcttcgggaccagg

SEQ ID NO: 3045372 - DNA, 18 bp, Homo sapiens
atcttcgggaccaggatt

SEQ ID NO: 3045373 - DNA, 19 bp, Homo sapiens
atcttctatttttatcatg

SEQ ID NO: 3045374 - DNA, 23 bp, Homo sapiens
atcttctatttttatcatgaatt

SEQ ID NO: 3045375 - DNA, 19 bp, Homo sapiens
atcttctccatctggcagg

SEQ ID NO: 3045376 - DNA, 17 bp, Homo sapiens
atcttctccccgaggct

SEQ ID NO: 3045377 - DNA, 20 bp, Homo sapiens
atcttctccccgaggctgcc

SEQ ID NO: 3045378 - DNA, 11 bp, Homo sapiens
atcttcttaac

SEQ ID NO: 3045379 - DNA, 22 bp, Homo sapiens
atcttgaaattaagaaggcaaa

SEQ ID NO: 3045380 - DNA, 23 bp, Homo sapiens
atcttgaaattaagaaggcaaaa

SEQ ID NO: 3045381 - DNA, 16 bp, Homo sapiens
atcttgaattgtaact

SEQ ID NO: 3045382 - DNA, 17 bp, Homo sapiens
atcttgactacagtcag

SEQ ID NO: 3045383 - DNA, 15 bp, Homo sapiens
atcttgagagagaaa

SEQ ID NO: 3045384 - DNA, 16 bp, Homo sapiens
atcttgagagagaaat

SEQ ID NO: 3045385 - DNA, 17 bp, Homo sapiens
atcttgagagagaaatg

SEQ ID NO: 3045386 - DNA, 22 bp, Homo sapiens
atcttgagcaagttccttctgg

SEQ ID NO: 3045387 - DNA, 22 bp, Homo sapiens
atcttgaggtggtagtaaaaca

SEQ ID NO: 3045388 - DNA, 14 bp, Homo sapiens
atcttgagtgttat

SEQ ID NO: 3045389 - DNA, 11 bp, Homo sapiens
atcttgcatgg

SEQ ID NO: 3045390 - DNA, 21 bp, Homo sapiens
atcttgcccctccagagacag

SEQ ID NO: 3045391 - DNA, 14 bp, Homo sapiens
atcttgcctccagg

SEQ ID NO: 3045392 - DNA, 22 bp, Homo sapiens
atcttgctccaataaaggaaca

SEQ ID NO: 3045393 - DNA, 15 bp, Homo sapiens
atcttgctctgcttg

SEQ ID NO: 3045394 - DNA, 18 bp, Homo sapiens
atcttgcttccaagacca

SEQ ID NO: 3045395 - DNA, 21 bp, Homo sapiens
atcttggactcatgaggaggg

SEQ ID NO: 3045396 - DNA, 23 bp, Homo sapiens
atcttggggacatctctttgaat

SEQ ID NO: 3045397 - DNA, 20 bp, Homo sapiens
atcttggtttgccttccaga

SEQ ID NO: 3045398 - DNA, 15 bp, Homo sapiens
atcttgtcttttccc

SEQ ID NO: 3045399 - DNA, 18 bp, Homo sapiens
atcttgtcttttcccctc

SEQ ID NO: 3045400 - DNA, 14 bp, Homo sapiens
atcttgttattatt

SEQ ID NO: 3045401 - DNA, 19 bp, Homo sapiens
atcttgttccaaggccagg

SEQ ID NO: 3045402 - DNA, 15 bp, Homo sapiens
atcttgttttaagca

SEQ ID NO: 3045403 - DNA, 17 bp, Homo sapiens
atcttgttttaagcaaa

SEQ ID NO: 3045404 - DNA, 21 bp, Homo sapiens
atcttgttttaagcaaatgca

SEQ ID NO: 3045405 - DNA, 20 bp, Homo sapiens
atctttaaaagatgctttta

SEQ ID NO: 3045406 - DNA, 17 bp, Homo sapiens
atctttacaaaactaca

SEQ ID NO: 3045407 - DNA, 16 bp, Homo sapiens
atctttagttgaattc

SEQ ID NO: 3045408 - DNA, 14 bp, Homo sapiens
atctttatacttaa

SEQ ID NO: 3045409 - DNA, 18 bp, Homo sapiens
atctttatacttaaacag

SEQ ID NO: 3045410 - DNA, 21 bp, Homo sapiens
atctttatacttaaacagctt

SEQ ID NO: 3045411 - DNA, 22 bp, Homo sapiens
atctttatacttaaacagcttt

SEQ ID NO: 3045412 - DNA, 15 bp, Homo sapiens
atctttattcaaact

SEQ ID NO: 3045413 - DNA, 19 bp, Homo sapiens
atctttattcaaactttta

SEQ ID NO: 3045414 - DNA, 15 bp, Homo sapiens
atctttcacttgaaa

SEQ ID NO: 3045415 - DNA, 21 bp, Homo sapiens
atctttcacttgaaagatttt

SEQ ID NO: 3045416 - DNA, 13 bp, Homo sapiens
atctttcctcaag

SEQ ID NO: 3045417 - DNA, 20 bp, Homo sapiens
atctttcctcaagtatcttc

SEQ ID NO: 3045418 - DNA, 20 bp, Homo sapiens
atctttcgttggttgtttct

SEQ ID NO: 3045419 - DNA, 16 bp, Homo sapiens
atctttctatgctgct

SEQ ID NO: 3045420 - DNA, 22 bp, Homo sapiens
atctttgaatttcttgattttt

SEQ ID NO: 3045421 - DNA, 16 bp, Homo sapiens
atctttgcatcataga

SEQ ID NO: 3045422 - DNA, 13 bp, Homo sapiens
atctttgcctctc

SEQ ID NO: 3045423 - DNA, 15 bp, Homo sapiens
atgcaccttgtgtct

SEQ ID NO: 3045424 - DNA, 19 bp, Homo sapiens
atgcaccttgtgtctgtac

SEQ ID NO: 3045425 - DNA, 17 bp, Homo sapiens
atgcacggtttctgttc

SEQ ID NO: 3045426 - DNA, 14 bp, Homo sapiens
atgcacgttaacag

SEQ ID NO: 3045427 - DNA, 18 bp, Homo sapiens
atgcacgttaacagcgtg

SEQ ID NO: 3045428 - DNA, 14 bp, Homo sapiens
atgcactcagctct

SEQ ID NO: 3045429 - DNA, 18 bp, Homo sapiens
atgcactgtgaaggaccc

SEQ ID NO: 3045430 - DNA, 21 bp, Homo sapiens
atgcactgttccccctgtgca

SEQ ID NO: 3045431 - DNA, 22 bp, Homo sapiens
atgcactttctatcctctgtaa

SEQ ID NO: 3045432 - DNA, 14 bp, Homo sapiens
atgcagaaaaagaa

SEQ ID NO: 3045433 - DNA, 18 bp, Homo sapiens
atgcagaagcagagatga

SEQ ID NO: 3045434 - DNA, 15 bp, Homo sapiens
atgcagaagtattct

SEQ ID NO: 3045435 - DNA, 19 bp, Homo sapiens
atgcagaatgttgattaca

SEQ ID NO: 3045436 - DNA, 21 bp, Homo sapiens
atgcagaatgttgattacagt

SEQ ID NO: 3045437 - DNA, 16 bp, Homo sapiens
atgcagcccaccagga

SEQ ID NO: 3045438 - DNA, 19 bp, Homo sapiens
atgcagcccaccaggagca

SEQ ID NO: 3045439 - DNA, 23 bp, Homo sapiens
atgcagcccaccaggagcacctg

SEQ ID NO: 3045440 - DNA, 13 bp, Homo sapiens
atgcagctcaaga

SEQ ID NO: 3045441 - DNA, 15 bp, Homo sapiens
atgcaggaaggaaaa

SEQ ID NO: 3045442 - DNA, 19 bp, Homo sapiens
atgcaggatttgttctctg

SEQ ID NO: 3045443 - DNA, 19 bp, Homo sapiens
atgcttcatcattccctct

SEQ ID NO: 3045444 - DNA, 20 bp, Homo sapiens
atgcttcatcattccctctc

SEQ ID NO: 3045445 - DNA, 17 bp, Homo sapiens
atgcttgtttatgatat

SEQ ID NO: 3045446 - DNA, 18 bp, Homo sapiens
atgctttaccaaacagca

SEQ ID NO: 3045447 - DNA, 19 bp, Homo sapiens
atgctttaccaaacagcaa

SEQ ID NO: 3045448 - DNA, 20 bp, Homo sapiens
atgctttaccaaacagcaaa

SEQ ID NO: 3045449 - DNA, 14 bp, Homo sapiens
atgctttgctttgt

SEQ ID NO: 3045450 - DNA, 15 bp, Homo sapiens
atgctttgctttgtc

SEQ ID NO: 3045451 - DNA, 18 bp, Homo sapiens
atgctttgctttgtctgg

SEQ ID NO: 3045452 - DNA, 14 bp, Homo sapiens
atgcttttctctca

SEQ ID NO: 3045453 - DNA, 18 bp, Homo sapiens
atgcttttgcttgcaatg

SEQ ID NO: 3045454 - DNA, 16 bp, Homo sapiens
atgctttttatttctg

SEQ ID NO: 3045455 - DNA, 19 bp, Homo sapiens
atggaaaaaaacataaaaa

SEQ ID NO: 3045456 - DNA, 15 bp, Homo sapiens
atggaaaaacttgtg

SEQ ID NO: 3045457 - DNA, 17 bp, Homo sapiens
atggaaagaaatatgat

SEQ ID NO: 3045458 - DNA, 16 bp, Homo sapiens
atggaaccaggcttgg

SEQ ID NO: 3045459 - DNA, 17 bp, Homo sapiens
atggaaccgcaggaagc

SEQ ID NO: 3045460 - DNA, 15 bp, Homo sapiens
atggaagacaggaaa

SEQ ID NO: 3045461 - DNA, 20 bp, Homo sapiens
atggaagaggaaaaggctgg

SEQ ID NO: 3045462 - DNA, 16 bp, Homo sapiens
atggaaggtgccagaa

SEQ ID NO: 3045463 - DNA, 21 bp, Homo sapiens
atggaaggtgccagaaggaag

SEQ ID NO: 3045464 - DNA, 22 bp, Homo sapiens
atggaaggtgccagaaggaagg

SEQ ID NO: 3045465 - DNA, 23 bp, Homo sapiens
atggaaggtgccagaaggaaggt

SEQ ID NO: 3045466 - DNA, 15 bp, Homo sapiens
atggaagtaaaggca

SEQ ID NO: 3045467 - DNA, 14 bp, Homo sapiens
atggaataataaat

SEQ ID NO: 3045468 - DNA, 13 bp, Homo sapiens
atggaatgcttct

SEQ ID NO: 3045469 - DNA, 18 bp, Homo sapiens
atggaatggttataaaag

SEQ ID NO: 3045470 - DNA, 12 bp, Homo sapiens
atggaattactc

SEQ ID NO: 3045471 - DNA, 16 bp, Homo sapiens
atggaattactccaaa

SEQ ID NO: 3045472 - DNA, 18 bp, Homo sapiens
atggaattgatttgcatt

SEQ ID NO: 3045473 - DNA, 19 bp, Homo sapiens
atggaattgatttgcattg

SEQ ID NO: 3045474 - DNA, 16 bp, Homo sapiens
atggacaaagaaaacg

SEQ ID NO: 3045475 - DNA, 14 bp, Homo sapiens
atggacactgtgac

SEQ ID NO: 3045476 - DNA, 19 bp, Homo sapiens
atggacaggctggctccag

SEQ ID NO: 3045477 - DNA, 18 bp, Homo sapiens
atggacagtttgtttcct

SEQ ID NO: 3045478 - DNA, 22 bp, Homo sapiens
atggacagtttgtttcctgtct

SEQ ID NO: 3045479 - DNA, 16 bp, Homo sapiens
atggacgcaggccctg

SEQ ID NO: 3045480 - DNA, 15 bp, Homo sapiens
atggactcagctctg

SEQ ID NO: 3045481 - DNA, 18 bp, Homo sapiens
atggactcagctctgtct

SEQ ID NO: 3045482 - DNA, 19 bp, Homo sapiens
atggactcagctctgtctg

SEQ ID NO: 3045483 - DNA, 23 bp, Homo sapiens
atggagatagccccacaggaggt

SEQ ID NO: 3045484 - DNA, 13 bp, Homo sapiens
atggagcaagaga

SEQ ID NO: 3045485 - DNA, 11 bp, Homo sapiens
atggagccagc

SEQ ID NO: 3045486 - DNA, 23 bp, Homo sapiens
atggagccagctccctctattta

SEQ ID NO: 3045487 - DNA, 15 bp, Homo sapiens
atggagctttctgta

SEQ ID NO: 3045488 - DNA, 16 bp, Homo sapiens
atggagctttctgtat

SEQ ID NO: 3045489 - DNA, 13 bp, Homo sapiens
atggaggagaaga

SEQ ID NO: 3045490 - DNA, 17 bp, Homo sapiens
atggaggagaagaattt

SEQ ID NO: 3045491 - DNA, 15 bp, Homo sapiens
atggaggagacagga

SEQ ID NO: 3045492 - DNA, 21 bp, Homo sapiens
atggagtcatttgagtctctt

SEQ ID NO: 3045493 - DNA, 17 bp, Homo sapiens
atggagtgagacccagg

SEQ ID NO: 3045494 - DNA, 13 bp, Homo sapiens
atggagtgtttga

SEQ ID NO: 3045495 - DNA, 15 bp, Homo sapiens
atggagttcttgtgc

SEQ ID NO: 3045496 - DNA, 17 bp, Homo sapiens
atggagtttacaaagat

SEQ ID NO: 3045497 - DNA, 14 bp, Homo sapiens
atggagtttctaag

SEQ ID NO: 3045498 - DNA, 16 bp, Homo sapiens
atggagtttctaaggt

SEQ ID NO: 3045499 - DNA, 14 bp, Homo sapiens
atggagtttctctc

SEQ ID NO: 3045500 - DNA, 15 bp, Homo sapiens
atggagtttctctct

SEQ ID NO: 3045501 - DNA, 16 bp, Homo sapiens
atggagtttctctctt

SEQ ID NO: 3045502 - DNA, 13 bp, Homo sapiens
atggataaactga

SEQ ID NO: 3045503 - DNA, 19 bp, Homo sapiens
atggatacgtgttttgaat

SEQ ID NO: 3045504 - DNA, 16 bp, Homo sapiens
atggatcttttctaaa

SEQ ID NO: 3045505 - DNA, 15 bp, Homo sapiens
atggattccaaacca

SEQ ID NO: 3045506 - DNA, 16 bp, Homo sapiens
atggattccaaagcat

SEQ ID NO: 3045507 - DNA, 17 bp, Homo sapiens
atggattccaaagcatt

SEQ ID NO: 3045508 - DNA, 19 bp, Homo sapiens
atggattctccactcagtt

SEQ ID NO: 3045509 - DNA, 19 bp, Homo sapiens
atggatttgatgctgtttg

SEQ ID NO: 3045510 - DNA, 19 bp, Homo sapiens
atggcaaataaacagtttg

SEQ ID NO: 3045511 - DNA, 16 bp, Homo sapiens
atggcaacagatctgg

SEQ ID NO: 3045512 - DNA, 24 bp, Homo sapiens
atggcaacagatctggaacctcag

SEQ ID NO: 3045513 - DNA, 22 bp, Homo sapiens
atggcagagtttgtgtgttgtc

SEQ ID NO: 3045514 - DNA, 14 bp, Homo sapiens
atggcagctgccac

SEQ ID NO: 3045515 - DNA, 14 bp, Homo sapiens
atggcagctgggcc

SEQ ID NO: 3045516 - DNA, 16 bp, Homo sapiens
atggcagctgggccca

SEQ ID NO: 3045517 - DNA, 18 bp, Homo sapiens
atggcagctgggcccaca

SEQ ID NO: 3045518 - DNA, 20 bp, Homo sapiens
atggcaggacgtgggctggg

SEQ ID NO: 3045519 - DNA, 19 bp, Homo sapiens
atggcatccagggctgcca

SEQ ID NO: 3045520 - DNA, 20 bp, Homo sapiens
atggcatccagggctgccag

SEQ ID NO: 3045521 - DNA, 18 bp, Homo sapiens
atggcatgagaaatacaa

SEQ ID NO: 3045522 - DNA, 22 bp, Homo sapiens
atggcattaattgttccttgct

SEQ ID NO: 3045523 - DNA, 11 bp, Homo sapiens
atggccagagg

SEQ ID NO: 3045524 - DNA, 12 bp, Homo sapiens
atggccagagga

SEQ ID NO: 3045525 - DNA, 20 bp, Homo sapiens
atggccctgctgcccctccc

SEQ ID NO: 3045526 - DNA, 18 bp, Homo sapiens
atggcctatgcacatatg

SEQ ID NO: 3045527 - DNA, 21 bp, Homo sapiens
atggcctcaagatcaatgaaa

SEQ ID NO: 3045528 - DNA, 23 bp, Homo sapiens
atggccttttgctacgtgcctcc

SEQ ID NO: 3045529 - DNA, 18 bp, Homo sapiens
atggctacctaaaaagat

SEQ ID NO: 3045530 - DNA, 17 bp, Homo sapiens
atggctagattctaaca

SEQ ID NO: 3045531 - DNA, 18 bp, Homo sapiens
atggctctaaaaagtttt

SEQ ID NO: 3045532 - DNA, 18 bp, Homo sapiens
atggctgactttgctctt

SEQ ID NO: 3045533 - DNA, 20 bp, Homo sapiens
atggctgggtccttgggcct

SEQ ID NO: 3045534 - DNA, 14 bp, Homo sapiens
atggcttctaacaa

SEQ ID NO: 3045535 - DNA, 22 bp, Homo sapiens
atggcttttcccaacccccagc

SEQ ID NO: 3045536 - DNA, 14 bp, Homo sapiens
atggcttttcctgg

SEQ ID NO: 3045537 - DNA, 17 bp, Homo sapiens
atgggaaaaactgcagt

SEQ ID NO: 3045538 - DNA, 13 bp, Homo sapiens
atgggaaagtatt

SEQ ID NO: 3045539 - DNA, 21 bp, Homo sapiens
atgggaacactggcagactgt

SEQ ID NO: 3045540 - DNA, 11 bp, Homo sapiens
atgggaacatt

SEQ ID NO: 3045541 - DNA, 21 bp, Homo sapiens
atgggaacatttattttatga

SEQ ID NO: 3045542 - DNA, 18 bp, Homo sapiens
atgtacttgtcaaagaag

SEQ ID NO: 3045543 - DNA, 19 bp, Homo sapiens
atgtacttgtcaaagaagg

SEQ ID NO: 3045544 - DNA, 22 bp, Homo sapiens
atgtacttttattttacacaga

SEQ ID NO: 3045545 - DNA, 15 bp, Homo sapiens
atgtactttttagta

SEQ ID NO: 3045546 - DNA, 16 bp, Homo sapiens
atgtagaaacatttag

SEQ ID NO: 3045547 - DNA, 17 bp, Homo sapiens
atgtagaaagatacact

SEQ ID NO: 3045548 - DNA, 22 bp, Homo sapiens
atgtagaaagatacactgactt

SEQ ID NO: 3045549 - DNA, 12 bp, Homo sapiens
atgtagacattg

SEQ ID NO: 3045550 - DNA, 16 bp, Homo sapiens
atgtagacattgtaaa

SEQ ID NO: 3045551 - DNA, 21 bp, Homo sapiens
atgtagcaaaatacatgacat

SEQ ID NO: 3045552 - DNA, 19 bp, Homo sapiens
atgtagccccctggcctct

SEQ ID NO: 3045553 - DNA, 23 bp, Homo sapiens
atgtagccccctggcctctgtgc

SEQ ID NO: 3045554 - DNA, 17 bp, Homo sapiens
atgtaggaaaaaaatag

SEQ ID NO: 3045555 - DNA, 14 bp, Homo sapiens
atgtaggaagtagg

SEQ ID NO: 3045556 - DNA, 13 bp, Homo sapiens
atgtagtaattga

SEQ ID NO: 3045557 - DNA, 21 bp, Homo sapiens
atgtagtatcaaatattagat

SEQ ID NO: 3045558 - DNA, 21 bp, Homo sapiens
atgtagttctttgttcctgct

SEQ ID NO: 3045559 - DNA, 17 bp, Homo sapiens
atgtagttttgtttatg

SEQ ID NO: 3045560 - DNA, 21 bp, Homo sapiens
atgtataaactttagagtaga

SEQ ID NO: 3045561 - DNA, 21 bp, Homo sapiens
atgtatatacacacatgtata

SEQ ID NO: 3045562 - DNA, 13 bp, Homo sapiens
atgtatatatgta

SEQ ID NO: 3045563 - DNA, 19 bp, Homo sapiens
atgtatcgggaagatttct

SEQ ID NO: 3045564 - DNA, 17 bp, Homo sapiens
atgtatgaatacagcag

SEQ ID NO: 3045565 - DNA, 14 bp, Homo sapiens
atgtatgagacaga

SEQ ID NO: 3045566 - DNA, 17 bp, Homo sapiens
atgtatgcttcatacag

SEQ ID NO: 3045567 - DNA, 19 bp, Homo sapiens
atgtatggaaacacatact

SEQ ID NO: 3045568 - DNA, 13 bp, Homo sapiens
atgtatgtaaagt

SEQ ID NO: 3045569 - DNA, 18 bp, Homo sapiens
atgtattagtagagcaac

SEQ ID NO: 3045570 - DNA, 16 bp, Homo sapiens
atgtattagtgatatt

SEQ ID NO: 3045571 - DNA, 23 bp, Homo sapiens
atgtattagtgatatttctctag

SEQ ID NO: 3045572 - DNA, 15 bp, Homo sapiens
atgtattatttcatt

SEQ ID NO: 3045573 - DNA, 22 bp, Homo sapiens
atgtattgaagaggatattctt

SEQ ID NO: 3045574 - DNA, 14 bp, Homo sapiens
atgtattttggaag

SEQ ID NO: 3045575 - DNA, 15 bp, Homo sapiens
atgtattttttgaat

SEQ ID NO: 3045576 - DNA, 13 bp, Homo sapiens
atgtcaaacaaat

SEQ ID NO: 3045577 - DNA, 19 bp, Homo sapiens
atgtcaaagtgaaagacat

SEQ ID NO: 3045578 - DNA, 20 bp, Homo sapiens
atgtcaagaaattctgctgt

SEQ ID NO: 3045579 - DNA, 15 bp, Homo sapiens
atgtcaccaccttcc

SEQ ID NO: 3045580 - DNA, 23 bp, Homo sapiens
atgtcaccaccttcccagctctc

SEQ ID NO: 3045581 - DNA, 20 bp, Homo sapiens
atgtcaccggatcctgggtg

SEQ ID NO: 3045582 - DNA, 16 bp, Homo sapiens
atgtcacgaatatgga

SEQ ID NO: 3045583 - DNA, 16 bp, Homo sapiens
atgtcagcaaatgtaa

SEQ ID NO: 3045584 - DNA, 21 bp, Homo sapiens
atgtcagctgctgttgaactt

SEQ ID NO: 3045585 - DNA, 14 bp, Homo sapiens
atgtccaaaattta

SEQ ID NO: 3045586 - DNA, 16 bp, Homo sapiens
atgtccactgtgtata

SEQ ID NO: 3045587 - DNA, 21 bp, Homo sapiens
atgtccagcaccttgtgcctg

SEQ ID NO: 3045588 - DNA, 14 bp, Homo sapiens
atgtggcctgccca

SEQ ID NO: 3045589 - DNA, 17 bp, Homo sapiens
atgtggcttttatttca

SEQ ID NO: 3045590 - DNA, 17 bp, Homo sapiens
atgtgggaatctcccag

SEQ ID NO: 3045591 - DNA, 15 bp, Homo sapiens
atgtgggttgtgata

SEQ ID NO: 3045592 - DNA, 19 bp, Homo sapiens
atgtggtcctatttaagcc

SEQ ID NO: 3045593 - DNA, 21 bp, Homo sapiens
atgtggtctgccaatctgtac

SEQ ID NO: 3045594 - DNA, 13 bp, Homo sapiens
atgtggtgatgat

SEQ ID NO: 3045595 - DNA, 16 bp, Homo sapiens
atgtggttttagattt

SEQ ID NO: 3045596 - DNA, 21 bp, Homo sapiens
atgtgtaaagatctacatgaa

SEQ ID NO: 3045597 - DNA, 22 bp, Homo sapiens
atgtgtaaagatctacatgaat

SEQ ID NO: 3045598 - DNA, 17 bp, Homo sapiens
atgtgtaataatgtaac

SEQ ID NO: 3045599 - DNA, 14 bp, Homo sapiens
atgtgtacatggca

SEQ ID NO: 3045600 - DNA, 16 bp, Homo sapiens
atgtgtacatggcaga

SEQ ID NO: 3045601 - DNA, 15 bp, Homo sapiens
atgtgtactctaact

SEQ ID NO: 3045602 - DNA, 10 bp, Homo sapiens
atgtgtatat

SEQ ID NO: 3045603 - DNA, 16 bp, Homo sapiens
atgtgtatatatgtca

SEQ ID NO: 3045604 - DNA, 20 bp, Homo sapiens
atgtgtatgggcaaaaaact

SEQ ID NO: 3045605 - DNA, 16 bp, Homo sapiens
atgtgtatttcttata

SEQ ID NO: 3045606 - DNA, 16 bp, Homo sapiens
atgtgtcaaatacaaa

SEQ ID NO: 3045607 - DNA, 22 bp, Homo sapiens
atgtgtcccagtgaacagtttg

SEQ ID NO: 3045608 - DNA, 18 bp, Homo sapiens
atgtgtccctggcgctgt

SEQ ID NO: 3045609 - DNA, 22 bp, Homo sapiens
atgtgtcccttccaagctgtgt

SEQ ID NO: 3045610 - DNA, 13 bp, Homo sapiens
atgtgtctgcaac

SEQ ID NO: 3045611 - DNA, 18 bp, Homo sapiens
atgtgtctgcaacatgga

SEQ ID NO: 3045612 - DNA, 16 bp, Homo sapiens
atgtgtgagaaaaact

SEQ ID NO: 3045613 - DNA, 21 bp, Homo sapiens
atgtgtgagataacttccttc

SEQ ID NO: 3045614 - DNA, 23 bp, Homo sapiens
atgtgtggagtgtgctgaacaca

SEQ ID NO: 3045615 - DNA, 15 bp, Homo sapiens
atgtgtggcagattt

SEQ ID NO: 3045616 - DNA, 17 bp, Homo sapiens
atgtgtgttgtttccat

SEQ ID NO: 3045617 - DNA, 23 bp, Homo sapiens
atgtgttcggttttgttgttccc

SEQ ID NO: 3045618 - DNA, 19 bp, Homo sapiens
atgtgttgaccggctgccg

SEQ ID NO: 3045619 - DNA, 20 bp, Homo sapiens
atgtgttgacgtaagctcta

SEQ ID NO: 3045620 - DNA, 20 bp, Homo sapiens
atgtgttgataattttttaa

SEQ ID NO: 3045621 - DNA, 18 bp, Homo sapiens
atgtgttgcataaacaat

SEQ ID NO: 3045622 - DNA, 17 bp, Homo sapiens
atgtgttggacaaatgt

SEQ ID NO: 3045623 - DNA, 20 bp, Homo sapiens
atgtgttggacaaatgtgaa

SEQ ID NO: 3045624 - DNA, 15 bp, Homo sapiens
atgtgtttgctttct

SEQ ID NO: 3045625 - DNA, 17 bp, Homo sapiens
atgtgtttgctttctga

SEQ ID NO: 3045626 - DNA, 16 bp, Homo sapiens
atgtgtttgtgtgtgt

SEQ ID NO: 3045627 - DNA, 19 bp, Homo sapiens
atgtgttttcatcatttca

SEQ ID NO: 3045628 - DNA, 13 bp, Homo sapiens
atgttaaagcatt

SEQ ID NO: 3045629 - DNA, 12 bp, Homo sapiens
atgttaacacat

SEQ ID NO: 3045630 - DNA, 13 bp, Homo sapiens
atgttaacacatt

SEQ ID NO: 3045631 - DNA, 16 bp, Homo sapiens
atgttaacacattttg

SEQ ID NO: 3045632 - DNA, 20 bp, Homo sapiens
atgttaacacattttgtata

SEQ ID NO: 3045633 - DNA, 23 bp, Homo sapiens
atgttaacacattttgtataatt

SEQ ID NO: 3045634 - DNA, 17 bp, Homo sapiens
atgttaacaggtatttt

SEQ ID NO: 3045635 - DNA, 20 bp, Homo sapiens
atgttaagacttgacagtgg

SEQ ID NO: 3045636 - DNA, 14 bp, Homo sapiens
atgttaatcaaaca

SEQ ID NO: 3045637 - DNA, 19 bp, Homo sapiens
atgttaattttttggtaca

SEQ ID NO: 3045638 - DNA, 14 bp, Homo sapiens
atgttacttaaaca

SEQ ID NO: 3045639 - DNA, 22 bp, Homo sapiens
atgttagactcatggtgtgtta

SEQ ID NO: 3045640 - DNA, 21 bp, Homo sapiens
atgttagttctagctctattt

SEQ ID NO: 3045641 - DNA, 21 bp, Homo sapiens
atgttatcttatactgtacaa

SEQ ID NO: 3045642 - DNA, 17 bp, Homo sapiens
atgtttttgtgtagagt

SEQ ID NO: 3045643 - DNA, 23 bp, Homo sapiens
atgtttttgttttaaaacgtgta

SEQ ID NO: 3045644 - DNA, 16 bp, Homo sapiens
atgttttttctgcaat

SEQ ID NO: 3045645 - DNA, 16 bp, Homo sapiens
atgttttttttcagca

SEQ ID NO: 3045646 - DNA, 20 bp, Homo sapiens
attaaaaaaaaagatctgtt

SEQ ID NO: 3045647 - DNA, 14 bp, Homo sapiens
attaaaaaacaatt

SEQ ID NO: 3045648 - DNA, 20 bp, Homo sapiens
attaaaaaacaattaactgc

SEQ ID NO: 3045649 - DNA, 18 bp, Homo sapiens
attaaaaaagcatacttc

SEQ ID NO: 3045650 - DNA, 21 bp, Homo sapiens
attaaaaacgaaaacctgact

SEQ ID NO: 3045651 - DNA, 22 bp, Homo sapiens
attaaaaacgaaaacctgacta

SEQ ID NO: 3045652 - DNA, 16 bp, Homo sapiens
attaaaaactagtagt

SEQ ID NO: 3045653 - DNA, 22 bp, Homo sapiens
attaaaaactagtagttctctt

SEQ ID NO: 3045654 - DNA, 13 bp, Homo sapiens
attaaaaactgag

SEQ ID NO: 3045655 - DNA, 12 bp, Homo sapiens
attaaaaagcct

SEQ ID NO: 3045656 - DNA, 22 bp, Homo sapiens
attaaaaagggagaaagaaaac

SEQ ID NO: 3045657 - DNA, 18 bp, Homo sapiens
attaaaacaatattgttt

SEQ ID NO: 3045658 - DNA, 16 bp, Homo sapiens
attaaaacgggaatca

SEQ ID NO: 3045659 - DNA, 18 bp, Homo sapiens
attaaaacgggaatcaca

SEQ ID NO: 3045660 - DNA, 18 bp, Homo sapiens
attaaaagacaaatatgt

SEQ ID NO: 3045661 - DNA, 14 bp, Homo sapiens
attaaaataaaaca

SEQ ID NO: 3045662 - DNA, 18 bp, Homo sapiens
attaaaataaaccaaata

SEQ ID NO: 3045663 - DNA, 12 bp, Homo sapiens
attaaaataact

SEQ ID NO: 3045664 - DNA, 14 bp, Homo sapiens
attaaaataactat

SEQ ID NO: 3045665 - DNA, 20 bp, Homo sapiens
attaaaataactatcaggca

SEQ ID NO: 3045666 - DNA, 14 bp, Homo sapiens
attaaaatcctcaa

SEQ ID NO: 3045667 - DNA, 14 bp, Homo sapiens
attaaaatctcttg

SEQ ID NO: 3045668 - DNA, 21 bp, Homo sapiens
attaaaatggtgacttaatcc

SEQ ID NO: 3045669 - DNA, 15 bp, Homo sapiens
attaaaatttattct

SEQ ID NO: 3045670 - DNA, 17 bp, Homo sapiens
attaaacgtaaatgttt

SEQ ID NO: 3045671 - DNA, 21 bp, Homo sapiens
attaaacgtatgcatgtgaag

SEQ ID NO: 3045672 - DNA, 14 bp, Homo sapiens
attaaactctcctt

SEQ ID NO: 3045673 - DNA, 15 bp, Homo sapiens
attaaactctccttt

SEQ ID NO: 3045674 - DNA, 19 bp, Homo sapiens
attaaactgcgaagtcaag

SEQ ID NO: 3045675 - DNA, 13 bp, Homo sapiens
attaaacttatga

SEQ ID NO: 3045676 - DNA, 17 bp, Homo sapiens
attaaacttatgaatgt

SEQ ID NO: 3045677 - DNA, 17 bp, Homo sapiens
attaaacttgaagcagt

SEQ ID NO: 3045678 - DNA, 19 bp, Homo sapiens
attaaagaaatttaatgtt

SEQ ID NO: 3045679 - DNA, 22 bp, Homo sapiens
attaaaggtgaaaattgtataa

SEQ ID NO: 3045680 - DNA, 17 bp, Homo sapiens
attaaagtgctaaggtt

SEQ ID NO: 3045681 - DNA, 19 bp, Homo sapiens
attaaagtgctaaggttct

SEQ ID NO: 3045682 - DNA, 19 bp, Homo sapiens
attaaagttctagtgaccg

SEQ ID NO: 3045683 - DNA, 21 bp, Homo sapiens
attaaagttctgtaaaatata

SEQ ID NO: 3045684 - DNA, 13 bp, Homo sapiens
attaaataaaatg

SEQ ID NO: 3045685 - DNA, 14 bp, Homo sapiens
attaaataaataaa

SEQ ID NO: 3045686 - DNA, 16 bp, Homo sapiens
attaaataagattcta

SEQ ID NO: 3045687 - DNA, 18 bp, Homo sapiens
attaaatcgtttaatgtt

SEQ ID NO: 3045688 - DNA, 20 bp, Homo sapiens
attaaatgacttagaaacaa

SEQ ID NO: 3045689 - DNA, 22 bp, Homo sapiens
attaaatgacttagaaacaatg

SEQ ID NO: 3045690 - DNA, 14 bp, Homo sapiens
attaaatgccactt

SEQ ID NO: 3045691 - DNA, 18 bp, Homo sapiens
attaaatggtgatttctt

SEQ ID NO: 3045692 - DNA, 22 bp, Homo sapiens
attaaatggtgatttcttgcta

SEQ ID NO: 3045693 - DNA, 13 bp, Homo sapiens
attaaattaagac

SEQ ID NO: 3045694 - DNA, 13 bp, Homo sapiens
attaaattaggaa

SEQ ID NO: 3045695 - DNA, 18 bp, Homo sapiens
attaaattcacaaacttt

SEQ ID NO: 3045696 - DNA, 14 bp, Homo sapiens
attaaattctcaaa

SEQ ID NO: 3045697 - DNA, 17 bp, Homo sapiens
attaaattctctctaac

SEQ ID NO: 3045698 - DNA, 16 bp, Homo sapiens
attaaccgatgcttta

SEQ ID NO: 3045699 - DNA, 17 bp, Homo sapiens
attaaccgatgctttac

SEQ ID NO: 3045700 - DNA, 21 bp, Homo sapiens
attaaccgatgctttaccaaa

SEQ ID NO: 3045701 - DNA, 20 bp, Homo sapiens
attaaccttgccttagaaac

SEQ ID NO: 3045702 - DNA, 21 bp, Homo sapiens
attaactatcttctttggact

SEQ ID NO: 3045703 - DNA, 22 bp, Homo sapiens
attaactcttagaagtgttgta

SEQ ID NO: 3045704 - DNA, 18 bp, Homo sapiens
attagataatcttttaca

SEQ ID NO: 3045705 - DNA, 13 bp, Homo sapiens
attagatgtgatt

SEQ ID NO: 3045706 - DNA, 15 bp, Homo sapiens
attagccaggtaatg

SEQ ID NO: 3045707 - DNA, 14 bp, Homo sapiens
attaggcagactct

SEQ ID NO: 3045708 - DNA, 15 bp, Homo sapiens
attagggatgcctcc

SEQ ID NO: 3045709 - DNA, 13 bp, Homo sapiens
attagtaacatgt

SEQ ID NO: 3045710 - DNA, 19 bp, Homo sapiens
attagtacacagcaccaga

SEQ ID NO: 3045711 - DNA, 15 bp, Homo sapiens
attagtattcaggca

SEQ ID NO: 3045712 - DNA, 20 bp, Homo sapiens
attagtattcaggcactgag

SEQ ID NO: 3045713 - DNA, 13 bp, Homo sapiens
attagtgatattt

SEQ ID NO: 3045714 - DNA, 13 bp, Homo sapiens
attagtggatttt

SEQ ID NO: 3045715 - DNA, 17 bp, Homo sapiens
attagttggtttgtgtg

SEQ ID NO: 3045716 - DNA, 18 bp, Homo sapiens
attagtttacatcatttt

SEQ ID NO: 3045717 - DNA, 15 bp, Homo sapiens
attagttttcttgtt

SEQ ID NO: 3045718 - DNA, 12 bp, Homo sapiens
attataaacagc

SEQ ID NO: 3045719 - DNA, 19 bp, Homo sapiens
attataaatgttagttcta

SEQ ID NO: 3045720 - DNA, 20 bp, Homo sapiens
attataaatgttagttctag

SEQ ID NO: 3045721 - DNA, 16 bp, Homo sapiens
attataccagcaaaga

SEQ ID NO: 3045722 - DNA, 14 bp, Homo sapiens
attatacgctggca

SEQ ID NO: 3045723 - DNA, 14 bp, Homo sapiens
attatactgttatc

SEQ ID NO: 3045724 - DNA, 17 bp, Homo sapiens
attatactgttatccat

SEQ ID NO: 3045725 - DNA, 18 bp, Homo sapiens
attatactgttatccata

SEQ ID NO: 3045726 - DNA, 21 bp, Homo sapiens
attatactgttatccatatta

SEQ ID NO: 3045727 - DNA, 20 bp, Homo sapiens
attatactttgttgttttta

SEQ ID NO: 3045728 - DNA, 14 bp, Homo sapiens
attatagattctaa

SEQ ID NO: 3045729 - DNA, 15 bp, Homo sapiens
attatagattctaaa

SEQ ID NO: 3045730 - DNA, 16 bp, Homo sapiens
attatagattctaaag

SEQ ID NO: 3045731 - DNA, 17 bp, Homo sapiens
attatagattctaaaga

SEQ ID NO: 3045732 - DNA, 18 bp, Homo sapiens
attatagattctaaagat

SEQ ID NO: 3045733 - DNA, 17 bp, Homo sapiens
attatagcaatgtgatt

SEQ ID NO: 3045734 - DNA, 18 bp, Homo sapiens
attatagcaatgtgattt

SEQ ID NO: 3045735 - DNA, 21 bp, Homo sapiens
attatagcaatgtgattttgt

SEQ ID NO: 3045736 - DNA, 19 bp, Homo sapiens
attatagcctcagattcga

SEQ ID NO: 3045737 - DNA, 14 bp, Homo sapiens
attatagcgcctgt

SEQ ID NO: 3045738 - DNA, 16 bp, Homo sapiens
attatagcgcctgtat

SEQ ID NO: 3045739 - DNA, 15 bp, Homo sapiens
attatagcttttaag

SEQ ID NO: 3045740 - DNA, 16 bp, Homo sapiens
attatagtttctgagg

SEQ ID NO: 3045741 - DNA, 13 bp, Homo sapiens
attatatagcaaa

SEQ ID NO: 3045742 - DNA, 20 bp, Homo sapiens
attatatagcaaagatatat

SEQ ID NO: 3045743 - DNA, 13 bp, Homo sapiens
attatatatagaa

SEQ ID NO: 3045744 - DNA, 15 bp, Homo sapiens
attatatttacaaat

SEQ ID NO: 3045745 - DNA, 19 bp, Homo sapiens
attatatttgtgctatagt

SEQ ID NO: 3045746 - DNA, 12 bp, Homo sapiens
attatcagatgc

SEQ ID NO: 3045747 - DNA, 17 bp, Homo sapiens
attatcatgcaaatgct

SEQ ID NO: 3045748 - DNA, 13 bp, Homo sapiens
attatcatgtgta

SEQ ID NO: 3045749 - DNA, 21 bp, Homo sapiens
attatcatgtgtaatcaataa

SEQ ID NO: 3045750 - DNA, 17 bp, Homo sapiens
attatccatattgagtc

SEQ ID NO: 3045751 - DNA, 21 bp, Homo sapiens
attatcctcctgttctgaaac

SEQ ID NO: 3045752 - DNA, 16 bp, Homo sapiens
attatccttgctatga

SEQ ID NO: 3045753 - DNA, 15 bp, Homo sapiens
attatctacccacgt

SEQ ID NO: 3045754 - DNA, 17 bp, Homo sapiens
attatcttcttaacagt

SEQ ID NO: 3045755 - DNA, 19 bp, Homo sapiens
attatctttagttgaattc

SEQ ID NO: 3045756 - DNA, 12 bp, Homo sapiens
attatgatattt

SEQ ID NO: 3045757 - DNA, 14 bp, Homo sapiens
attatgcattctta

SEQ ID NO: 3045758 - DNA, 15 bp, Homo sapiens
attatgcattcttat

SEQ ID NO: 3045759 - DNA, 23 bp, Homo sapiens
attatgcattcttataacataac

SEQ ID NO: 3045760 - DNA, 19 bp, Homo sapiens
attatgccttttttgatca

SEQ ID NO: 3045761 - DNA, 18 bp, Homo sapiens
attatgcggaaaggtatt

SEQ ID NO: 3045762 - DNA, 23 bp, Homo sapiens
attatggatacgtgttttgaatt

SEQ ID NO: 3045763 - DNA, 22 bp, Homo sapiens
attatgtaaaatgttttagcaa

SEQ ID NO: 3045764 - DNA, 15 bp, Homo sapiens
attatgtacaacatt

SEQ ID NO: 3045765 - DNA, 18 bp, Homo sapiens
attatgtattaacttgta

SEQ ID NO: 3045766 - DNA, 19 bp, Homo sapiens
attatgtattaacttgtag

SEQ ID NO: 3045767 - DNA, 19 bp, Homo sapiens
attatgtccactgtgtata

SEQ ID NO: 3045768 - DNA, 17 bp, Homo sapiens
attatgtggttttagat

SEQ ID NO: 3045769 - DNA, 18 bp, Homo sapiens
attatgtttttattaaga

SEQ ID NO: 3045770 - DNA, 22 bp, Homo sapiens
attattaaatcgtttaatgttt

SEQ ID NO: 3045771 - DNA, 16 bp, Homo sapiens
attattaatttatgca

SEQ ID NO: 3045772 - DNA, 21 bp, Homo sapiens
attattagtaagaaaacatca

SEQ ID NO: 3045773 - DNA, 22 bp, Homo sapiens
attattatgaagaattgccaat

SEQ ID NO: 3045774 - DNA, 13 bp, Homo sapiens
attattattatta

SEQ ID NO: 3045775 - DNA, 20 bp, Homo sapiens
attgcagaactaaactcatt

SEQ ID NO: 3045776 - DNA, 22 bp, Homo sapiens
attgcagaactaaactcattta

SEQ ID NO: 3045777 - DNA, 14 bp, Homo sapiens
attgcaggatggtg

SEQ ID NO: 3045778 - DNA, 19 bp, Homo sapiens
attgcagtcatagaagaga

SEQ ID NO: 3045779 - DNA, 17 bp, Homo sapiens
attgcagtttatcattc

SEQ ID NO: 3045780 - DNA, 11 bp, Homo sapiens
attgcattgac

SEQ ID NO: 3045781 - DNA, 15 bp, Homo sapiens
attgccaaaaaggat

SEQ ID NO: 3045782 - DNA, 16 bp, Homo sapiens
attgccaggaatgttt

SEQ ID NO: 3045783 - DNA, 20 bp, Homo sapiens
attgccatcgggtgccaaat

SEQ ID NO: 3045784 - DNA, 17 bp, Homo sapiens
attgccattatagcgcc

SEQ ID NO: 3045785 - DNA, 18 bp, Homo sapiens
attgccattatagcgcct

SEQ ID NO: 3045786 - DNA, 19 bp, Homo sapiens
attgccattatagcgcctg

SEQ ID NO: 3045787 - DNA, 15 bp, Homo sapiens
attgcccaggctggt

SEQ ID NO: 3045788 - DNA, 15 bp, Homo sapiens
attgcccagtctttc

SEQ ID NO: 3045789 - DNA, 20 bp, Homo sapiens
attgcctgaaacccatttac

SEQ ID NO: 3045790 - DNA, 17 bp, Homo sapiens
attgcctgggcagtgcc

SEQ ID NO: 3045791 - DNA, 16 bp, Homo sapiens
attgccttgcatttgt

SEQ ID NO: 3045792 - DNA, 16 bp, Homo sapiens
attgcctttgaatgtt

SEQ ID NO: 3045793 - DNA, 17 bp, Homo sapiens
attgcgttggtctctgc

SEQ ID NO: 3045794 - DNA, 20 bp, Homo sapiens
attgcgtttgaccttttatg

SEQ ID NO: 3045795 - DNA, 13 bp, Homo sapiens
attgctaaatgta

SEQ ID NO: 3045796 - DNA, 14 bp, Homo sapiens
attgctaaatgtaa

SEQ ID NO: 3045797 - DNA, 16 bp, Homo sapiens
attgctaattgctgtt

SEQ ID NO: 3045798 - DNA, 23 bp, Homo sapiens
attgctaattgctgttgaaagca

SEQ ID NO: 3045799 - DNA, 21 bp, Homo sapiens
attgctccaagatgttctcct

SEQ ID NO: 3045800 - DNA, 14 bp, Homo sapiens
attgctgagcctct

SEQ ID NO: 3045801 - DNA, 20 bp, Homo sapiens
attgctgataccatatgaat

SEQ ID NO: 3045802 - DNA, 21 bp, Homo sapiens
attgctgccactttttaacta

SEQ ID NO: 3045803 - DNA, 21 bp, Homo sapiens
attgctgccccatcagtgctc

SEQ ID NO: 3045804 - DNA, 20 bp, Homo sapiens
attgctgcccgtttgtacat

SEQ ID NO: 3045805 - DNA, 21 bp, Homo sapiens
attgctgctccttagctgcca

SEQ ID NO: 3045806 - DNA, 21 bp, Homo sapiens
attgctgctgtgcgtggaaaa

SEQ ID NO: 3045807 - DNA, 17 bp, Homo sapiens
attgctggaaaccaagt

SEQ ID NO: 3045808 - DNA, 16 bp, Homo sapiens
attgctgtctagcctt

SEQ ID NO: 3045809 - DNA, 21 bp, Homo sapiens
attgctgtctagccttagtca

SEQ ID NO: 3045810 - DNA, 15 bp, Homo sapiens
attgctgttgaaagc

SEQ ID NO: 3045811 - DNA, 17 bp, Homo sapiens
attgctgttgaaagcaa

SEQ ID NO: 3045812 - DNA, 18 bp, Homo sapiens
attgctgttgaaagcaaa

SEQ ID NO: 3045813 - DNA, 23 bp, Homo sapiens
attgctgttgaaagcaaaaatgc

SEQ ID NO: 3045814 - DNA, 16 bp, Homo sapiens
attgcttcctcctccc

SEQ ID NO: 3045815 - DNA, 18 bp, Homo sapiens
atttcaggccctcagctg

SEQ ID NO: 3045816 - DNA, 16 bp, Homo sapiens
atttcagggaaattaa

SEQ ID NO: 3045817 - DNA, 21 bp, Homo sapiens
atttcaggtcaactctgaaga

SEQ ID NO: 3045818 - DNA, 23 bp, Homo sapiens
atttcaggttgttggtgactatc

SEQ ID NO: 3045819 - DNA, 14 bp, Homo sapiens
atttcagtacttca

SEQ ID NO: 3045820 - DNA, 18 bp, Homo sapiens
atttcagtacttcagcaa

SEQ ID NO: 3045821 - DNA, 19 bp, Homo sapiens
atttcagtacttcagcaag

SEQ ID NO: 3045822 - DNA, 22 bp, Homo sapiens
atttcagtacttcagcaagaga

SEQ ID NO: 3045823 - DNA, 19 bp, Homo sapiens
atttcagtgccatacatgt

SEQ ID NO: 3045824 - DNA, 10 bp, Homo sapiens
atttcagttt

SEQ ID NO: 3045825 - DNA, 22 bp, Homo sapiens
atttcatatctacagatagaga

SEQ ID NO: 3045826 - DNA, 20 bp, Homo sapiens
atttcatcctgttggctgct

SEQ ID NO: 3045827 - DNA, 16 bp, Homo sapiens
atttcatgtgctatag

SEQ ID NO: 3045828 - DNA, 21 bp, Homo sapiens
atttcatgtgctatagacatt

SEQ ID NO: 3045829 - DNA, 14 bp, Homo sapiens
atttcatgtgtcaa

SEQ ID NO: 3045830 - DNA, 14 bp, Homo sapiens
atttcattcatatc

SEQ ID NO: 3045831 - DNA, 17 bp, Homo sapiens
atttcattgctgtgtca

SEQ ID NO: 3045832 - DNA, 19 bp, Homo sapiens
atttcattggttaattttt

SEQ ID NO: 3045833 - DNA, 20 bp, Homo sapiens
atttccagaaggatttcttg

SEQ ID NO: 3045834 - DNA, 12 bp, Homo sapiens
atttccatatcc

SEQ ID NO: 3045835 - DNA, 12 bp, Homo sapiens
atttcccaggac

SEQ ID NO: 3045836 - DNA, 19 bp, Homo sapiens
atttcccaggaccctgaag

SEQ ID NO: 3045837 - DNA, 17 bp, Homo sapiens
atttccccaacagtgtg

SEQ ID NO: 3045838 - DNA, 20 bp, Homo sapiens
atttggataataaaaattgt

SEQ ID NO: 3045839 - DNA, 14 bp, Homo sapiens
atttggatctattt

SEQ ID NO: 3045840 - DNA, 19 bp, Homo sapiens
atttggcaatgccatcatc

SEQ ID NO: 3045841 - DNA, 20 bp, Homo sapiens
atttggcagaactgctgggg

SEQ ID NO: 3045842 - DNA, 16 bp, Homo sapiens
atttgggaccctgctt

SEQ ID NO: 3045843 - DNA, 22 bp, Homo sapiens
atttgggcctgctccagacctg

SEQ ID NO: 3045844 - DNA, 15 bp, Homo sapiens
atttggtttttactc

SEQ ID NO: 3045845 - DNA, 23 bp, Homo sapiens
atttgtaaaaacagcattgcttt

SEQ ID NO: 3045846 - DNA, 19 bp, Homo sapiens
atttgtaaaaataatgaat

SEQ ID NO: 3045847 - DNA, 22 bp, Homo sapiens
atttgtactgtttaatgttctg

SEQ ID NO: 3045848 - DNA, 14 bp, Homo sapiens
atttgtacttggaa

SEQ ID NO: 3045849 - DNA, 17 bp, Homo sapiens
atttgtatttctcttgt

SEQ ID NO: 3045850 - DNA, 23 bp, Homo sapiens
atttgtcatcgttccccacccct

SEQ ID NO: 3045851 - DNA, 15 bp, Homo sapiens
atttgtccaaacagg

SEQ ID NO: 3045852 - DNA, 12 bp, Homo sapiens
atttgtcctttt

SEQ ID NO: 3045853 - DNA, 14 bp, Homo sapiens
atttgtctcctact

SEQ ID NO: 3045854 - DNA, 18 bp, Homo sapiens
atttgtctcctactctgt

SEQ ID NO: 3045855 - DNA, 15 bp, Homo sapiens
atttgtcttctcctt

SEQ ID NO: 3045856 - DNA, 22 bp, Homo sapiens
atttgtctttttgttgtaaaac

SEQ ID NO: 3045857 - DNA, 17 bp, Homo sapiens
atttgtgaactcagcca

SEQ ID NO: 3045858 - DNA, 19 bp, Homo sapiens
atttgtgactaattgtata

SEQ ID NO: 3045859 - DNA, 22 bp, Homo sapiens
atttgtgactaattgtataaca

SEQ ID NO: 3045860 - DNA, 14 bp, Homo sapiens
atttgtgacttttt

SEQ ID NO: 3045861 - DNA, 15 bp, Homo sapiens
atttgtgctttgaaa

SEQ ID NO: 3045862 - DNA, 18 bp, Homo sapiens
atttgtgctttgaaaaaa

SEQ ID NO: 3045863 - DNA, 19 bp, Homo sapiens
atttgtgtcactgtacagt

SEQ ID NO: 3045864 - DNA, 13 bp, Homo sapiens
atttgtgtttttc

SEQ ID NO: 3045865 - DNA, 22 bp, Homo sapiens
atttgttaaaatacagttctgt

SEQ ID NO: 3045866 - DNA, 19 bp, Homo sapiens
atttgttaactgtactgaa

SEQ ID NO: 3045867 - DNA, 15 bp, Homo sapiens
atttgttatggcaga

SEQ ID NO: 3045868 - DNA, 13 bp, Homo sapiens
atttgttctctgt

SEQ ID NO: 3045869 - DNA, 14 bp, Homo sapiens
atttgttctctgtc

SEQ ID NO: 3045870 - DNA, 15 bp, Homo sapiens
atttgttctgggagt

SEQ ID NO: 3045871 - DNA, 16 bp, Homo sapiens
atttgttctgggagta

SEQ ID NO: 3045872 - DNA, 15 bp, Homo sapiens
atttgttgctgctgc

SEQ ID NO: 3045873 - DNA, 18 bp, Homo sapiens
atttgttgtcatgtgtat

SEQ ID NO: 3045874 - DNA, 16 bp, Homo sapiens
atttgtttaaaaggat

SEQ ID NO: 3045875 - DNA, 17 bp, Homo sapiens
atttgtttgattttcat

SEQ ID NO: 3045876 - DNA, 15 bp, Homo sapiens
atttgtttgtagctt

SEQ ID NO: 3045877 - DNA, 22 bp, Homo sapiens
atttgtttgtagctttcctgga

SEQ ID NO: 3045878 - DNA, 14 bp, Homo sapiens
atttgtttgtattc

SEQ ID NO: 3045879 - DNA, 15 bp, Homo sapiens
atttgttttgaattt

SEQ ID NO: 3045880 - DNA, 19 bp, Homo sapiens
atttgtttttacctgtatt

SEQ ID NO: 3045881 - DNA, 14 bp, Homo sapiens
atttgtttttctca

SEQ ID NO: 3045882 - DNA, 13 bp, Homo sapiens
attttaaaacatg

SEQ ID NO: 3045883 - DNA, 20 bp, Homo sapiens
attttaaaagatgcaatgta

SEQ ID NO: 3045884 - DNA, 13 bp, Homo sapiens
attttaaaataga

SEQ ID NO: 3045885 - DNA, 14 bp, Homo sapiens
attttaaaatattt

SEQ ID NO: 3045886 - DNA, 17 bp, Homo sapiens
attttaaactagatgac

SEQ ID NO: 3045887 - DNA, 21 bp, Homo sapiens
attttaaactagatgacctca

SEQ ID NO: 3045888 - DNA, 12 bp, Homo sapiens
attttaaatgaa

SEQ ID NO: 3045889 - DNA, 14 bp, Homo sapiens
attttaaatgaaag

SEQ ID NO: 3045890 - DNA, 17 bp, Homo sapiens
attttaacaagaagatg

SEQ ID NO: 3045891 - DNA, 18 bp, Homo sapiens
attttaacaagaagatga

SEQ ID NO: 3045892 - DNA, 19 bp, Homo sapiens
attttaacaagaagatgaa

SEQ ID NO: 3045893 - DNA, 14 bp, Homo sapiens
attttaactctgtc

SEQ ID NO: 3045894 - DNA, 20 bp, Homo sapiens
attttaagacgtgtttgtgt

SEQ ID NO: 3045895 - DNA, 21 bp, Homo sapiens
attttaagacgtgtttgtgtt

SEQ ID NO: 3045896 - DNA, 19 bp, Homo sapiens
attttaagcattgtgagta

SEQ ID NO: 3045897 - DNA, 23 bp, Homo sapiens
attttaagccctatcactgacac

SEQ ID NO: 3045898 - DNA, 16 bp, Homo sapiens
attttaagtctacaaa

SEQ ID NO: 3045899 - DNA, 21 bp, Homo sapiens
attttaataacatatctaaag

SEQ ID NO: 3045900 - DNA, 13 bp, Homo sapiens
attttaatgtgaa

SEQ ID NO: 3045901 - DNA, 20 bp, Homo sapiens
attttaatttagtaaatgtt

SEQ ID NO: 3045902 - DNA, 21 bp, Homo sapiens
attttacaaattaatatttgt

SEQ ID NO: 3045903 - DNA, 13 bp, Homo sapiens
attttacaattga

SEQ ID NO: 3045904 - DNA, 17 bp, Homo sapiens
attttacacagaaacac

SEQ ID NO: 3045905 - DNA, 19 bp, Homo sapiens
attttacacagaaacactg

SEQ ID NO: 3045906 - DNA, 20 bp, Homo sapiens
attttacacagaaacactgc

SEQ ID NO: 3045907 - DNA, 22 bp, Homo sapiens
attttacagttaaggaatataa

SEQ ID NO: 3045908 - DNA, 17 bp, Homo sapiens
attttacgttttagaaa

SEQ ID NO: 3045909 - DNA, 13 bp, Homo sapiens
attttacttgaat

SEQ ID NO: 3045910 - DNA, 12 bp, Homo sapiens
attttagacttt

SEQ ID NO: 3045911 - DNA, 22 bp, Homo sapiens
attttaggagctaaggctctat

SEQ ID NO: 3045912 - DNA, 21 bp, Homo sapiens
attttaggatctcgcctggaa

SEQ ID NO: 3045913 - DNA, 22 bp, Homo sapiens
attttagtggataaaatttgta

SEQ ID NO: 3045914 - DNA, 16 bp, Homo sapiens
attttagtttctgttc

SEQ ID NO: 3045915 - DNA, 12 bp, Homo sapiens
attttataaagt

SEQ ID NO: 3045916 - DNA, 15 bp, Homo sapiens
attttataaagtgct

SEQ ID NO: 3045917 - DNA, 23 bp, Homo sapiens
attttatactgcactttagtgta

SEQ ID NO: 3045918 - DNA, 19 bp, Homo sapiens
attttatagacaccctggc

SEQ ID NO: 3045919 - DNA, 17 bp, Homo sapiens
attttatagctactaat

SEQ ID NO: 3045920 - DNA, 16 bp, Homo sapiens
attttatattgaaaaa

SEQ ID NO: 3045921 - DNA, 22 bp, Homo sapiens
attttatattgaaaaaaataat

SEQ ID NO: 3045922 - DNA, 22 bp, Homo sapiens
attttatctacccagtcatgta

SEQ ID NO: 3045923 - DNA, 15 bp, Homo sapiens
attttatgacagtat

SEQ ID NO: 3045924 - DNA, 16 bp, Homo sapiens
attttatgacagtatc

SEQ ID NO: 3045925 - DNA, 17 bp, Homo sapiens
attttatgagaaatgta

SEQ ID NO: 3045926 - DNA, 12 bp, Homo sapiens
attttattactg

SEQ ID NO: 3045927 - DNA, 14 bp, Homo sapiens
attttattactggc

SEQ ID NO: 3045928 - DNA, 21 bp, Homo sapiens
attttattactggcgtggatt

SEQ ID NO: 3045929 - DNA, 12 bp, Homo sapiens
attttattatgc

SEQ ID NO: 3045930 - DNA, 22 bp, Homo sapiens
attttattctagggtttcttaa

SEQ ID NO: 3045931 - DNA, 14 bp, Homo sapiens
attttattgcttga

SEQ ID NO: 3045932 - DNA, 15 bp, Homo sapiens
attttatttttgcaa

SEQ ID NO: 3045933 - DNA, 13 bp, Homo sapiens
attttcaaagact

SEQ ID NO: 3045934 - DNA, 12 bp, Homo sapiens
attttcaagtaa

SEQ ID NO: 3045935 - DNA, 16 bp, Homo sapiens
attttcaccctctgta

SEQ ID NO: 3045936 - DNA, 12 bp, Homo sapiens
attttcagaccc

SEQ ID NO: 3045937 - DNA, 21 bp, Homo sapiens
attttcagcatcaaacatgaa

SEQ ID NO: 3045938 - DNA, 22 bp, Homo sapiens
attttcagcatcaaacatgaaa

SEQ ID NO: 3045939 - DNA, 20 bp, Homo sapiens
attttcataagtatttcaaa

SEQ ID NO: 3045940 - DNA, 13 bp, Homo sapiens
attttcatctatt

SEQ ID NO: 3045941 - DNA, 18 bp, Homo sapiens
attttcattaaacttgaa

SEQ ID NO: 3045942 - DNA, 23 bp, Homo sapiens
attttccacaagattcccagaga

SEQ ID NO: 3045943 - DNA, 16 bp, Homo sapiens
attttcctaaggccac

SEQ ID NO: 3045944 - DNA, 21 bp, Homo sapiens
attttcctaataaagttctgt

SEQ ID NO: 3045945 - DNA, 13 bp, Homo sapiens
attttcctgcttc

SEQ ID NO: 3045946 - DNA, 22 bp, Homo sapiens
attttccttccatgctcccaac

SEQ ID NO: 3045947 - DNA, 16 bp, Homo sapiens
attttcggaacacatt

SEQ ID NO: 3045948 - DNA, 19 bp, Homo sapiens
attttctataatttaaata

SEQ ID NO: 3045949 - DNA, 17 bp, Homo sapiens
attttctatgtgttgtg

SEQ ID NO: 3045950 - DNA, 17 bp, Homo sapiens
attttctatttctctgt

SEQ ID NO: 3045951 - DNA, 20 bp, Homo sapiens
attttctgcccaactttcat

SEQ ID NO: 3045952 - DNA, 14 bp, Homo sapiens
attttctggttcta

SEQ ID NO: 3045953 - DNA, 19 bp, Homo sapiens
attttctggttctaacatt

SEQ ID NO: 3045954 - DNA, 16 bp, Homo sapiens
attttctgtaaatgaa

SEQ ID NO: 3045955 - DNA, 17 bp, Homo sapiens
attttctgtcactgtag

SEQ ID NO: 3045956 - DNA, 13 bp, Homo sapiens
attttctttaaaa

SEQ ID NO: 3045957 - DNA, 19 bp, Homo sapiens
attttctttaaaagaatgg

SEQ ID NO: 3045958 - DNA, 18 bp, Homo sapiens
attttctttatcattgct

SEQ ID NO: 3045959 - DNA, 21 bp, Homo sapiens
attttgaaaacacttatttta

SEQ ID NO: 3045960 - DNA, 15 bp, Homo sapiens
attttgaaatgaact

SEQ ID NO: 3045961 - DNA, 19 bp, Homo sapiens
attttgaaatgaactttgt

SEQ ID NO: 3045962 - DNA, 12 bp, Homo sapiens
attttgaatcaa

SEQ ID NO: 3045963 - DNA, 14 bp, Homo sapiens
attttgaatcaata

SEQ ID NO: 3045964 - DNA, 17 bp, Homo sapiens
attttgaatcaataata

SEQ ID NO: 3045965 - DNA, 13 bp, Homo sapiens
attttgacaacat

SEQ ID NO: 3045966 - DNA, 19 bp, Homo sapiens
attttgacaacatggcttc

SEQ ID NO: 3045967 - DNA, 23 bp, Homo sapiens
attttgacaacatggcttctcct

SEQ ID NO: 3045968 - DNA, 17 bp, Homo sapiens
attttgacctactctca

SEQ ID NO: 3045969 - DNA, 18 bp, Homo sapiens
attttgacctactctcat

SEQ ID NO: 3045970 - DNA, 20 bp, Homo sapiens
attttgacttagtaactttt

SEQ ID NO: 3045971 - DNA, 18 bp, Homo sapiens
attttgagtaaagctcct

SEQ ID NO: 3045972 - DNA, 21 bp, Homo sapiens
attttgatgagatattaaatt

SEQ ID NO: 3045973 - DNA, 22 bp, Homo sapiens
attttgatgagatattaaattc

SEQ ID NO: 3045974 - DNA, 23 bp, Homo sapiens
attttgcccttgacaaagtcaag

SEQ ID NO: 3045975 - DNA, 12 bp, Homo sapiens
caccgcagctgc

SEQ ID NO: 3045976 - DNA, 18 bp, Homo sapiens
caccgcagctgctgccac

SEQ ID NO: 3045977 - DNA, 19 bp, Homo sapiens
caccgcagctgctgccact

SEQ ID NO: 3045978 - DNA, 14 bp, Homo sapiens
caccgccggggtcc

SEQ ID NO: 3045979 - DNA, 17 bp, Homo sapiens
caccgccggggtcctgg

SEQ ID NO: 3045980 - DNA, 18 bp, Homo sapiens
caccgccggggtcctggg

SEQ ID NO: 3045981 - DNA, 15 bp, Homo sapiens
caccgcctgccctcc

SEQ ID NO: 3045982 - DNA, 12 bp, Homo sapiens
caccgctgccta

SEQ ID NO: 3045983 - DNA, 19 bp, Homo sapiens
caccgctgcctaagtggct

SEQ ID NO: 3045984 - DNA, 15 bp, Homo sapiens
caccggatcctgggt

SEQ ID NO: 3045985 - DNA, 22 bp, Homo sapiens
caccggccccatttacccaact

SEQ ID NO: 3045986 - DNA, 21 bp, Homo sapiens
caccgggcatgtctgcctgga

SEQ ID NO: 3045987 - DNA, 23 bp, Homo sapiens
caccgggcatgtctgcctggagt

SEQ ID NO: 3045988 - DNA, 16 bp, Homo sapiens
caccgggctggctgct

SEQ ID NO: 3045989 - DNA, 22 bp, Homo sapiens
caccggggcctgggcaggaggg

SEQ ID NO: 3045990 - DNA, 17 bp, Homo sapiens
caccgggggtggctctg

SEQ ID NO: 3045991 - DNA, 22 bp, Homo sapiens
caccgtacatctgcaatatgaa

SEQ ID NO: 3045992 - DNA, 14 bp, Homo sapiens
caccgtactgtgga

SEQ ID NO: 3045993 - DNA, 13 bp, Homo sapiens
caccgtggcctgg

SEQ ID NO: 3045994 - DNA, 15 bp, Homo sapiens
caccgtggcctgggc

SEQ ID NO: 3045995 - DNA, 13 bp, Homo sapiens
caccgtgggctcc

SEQ ID NO: 3045996 - DNA, 17 bp, Homo sapiens
caccgtgggctccctga

SEQ ID NO: 3045997 - DNA, 14 bp, Homo sapiens
caccgttctgtgca

SEQ ID NO: 3045998 - DNA, 14 bp, Homo sapiens
cacctaaccctctg

SEQ ID NO: 3045999 - DNA, 18 bp, Homo sapiens
cacctaaccctctgtcac

SEQ ID NO: 3046000 - DNA, 18 bp, Homo sapiens
cacctaagagattctgat

SEQ ID NO: 3046001 - DNA, 18 bp, Homo sapiens
cacctaagggacatgttt

SEQ ID NO: 3046002 - DNA, 19 bp, Homo sapiens
cacctaagggacatgtttt

SEQ ID NO: 3046003 - DNA, 17 bp, Homo sapiens
cacctaatccaggcaga

SEQ ID NO: 3046004 - DNA, 18 bp, Homo sapiens
cacctaggcaatgaagaa

SEQ ID NO: 3046005 - DNA, 13 bp, Homo sapiens
cacctagtgcccc

SEQ ID NO: 3046006 - DNA, 19 bp, Homo sapiens
cacctagtgccccagactg

SEQ ID NO: 3046007 - DNA, 19 bp, Homo sapiens
cacctataaaacaggtcaa

SEQ ID NO: 3046008 - DNA, 18 bp, Homo sapiens
cacctatccctaacaggc

SEQ ID NO: 3046009 - DNA, 21 bp, Homo sapiens
cacctatccctaacaggctgt

SEQ ID NO: 3046010 - DNA, 17 bp, Homo sapiens
cacctatctcagccata

SEQ ID NO: 3046011 - DNA, 18 bp, Homo sapiens
cacctatctcagccatag

SEQ ID NO: 3046012 - DNA, 19 bp, Homo sapiens
cacctatctcagccatagg

SEQ ID NO: 3046013 - DNA, 13 bp, Homo sapiens
cacctatttccat

SEQ ID NO: 3046014 - DNA, 14 bp, Homo sapiens
cacctcacaactcc

SEQ ID NO: 3046015 - DNA, 12 bp, Homo sapiens
cacctcacctct

SEQ ID NO: 3046016 - DNA, 21 bp, Homo sapiens
cacctcactgaaaacatctgg

SEQ ID NO: 3046017 - DNA, 13 bp, Homo sapiens
cacctcagcctcc

SEQ ID NO: 3046018 - DNA, 19 bp, Homo sapiens
cacctcattctgaaccctt

SEQ ID NO: 3046019 - DNA, 12 bp, Homo sapiens
cacctccaggct

SEQ ID NO: 3046020 - DNA, 12 bp, Homo sapiens
cacctccatatc

SEQ ID NO: 3046021 - DNA, 16 bp, Homo sapiens
cacctcccatcctaat

SEQ ID NO: 3046022 - DNA, 15 bp, Homo sapiens
cacctccccccactg

SEQ ID NO: 3046023 - DNA, 17 bp, Homo sapiens
cacctccccccactgca

SEQ ID NO: 3046024 - DNA, 18 bp, Homo sapiens
cacctcccctatccaccc

SEQ ID NO: 3046025 - DNA, 19 bp, Homo sapiens
cacctcccctatccaccca

SEQ ID NO: 3046026 - DNA, 13 bp, Homo sapiens
cacctccctctgc

SEQ ID NO: 3046027 - DNA, 17 bp, Homo sapiens
cacctccctctgccagt

SEQ ID NO: 3046028 - DNA, 10 bp, Homo sapiens
cacctccctg

SEQ ID NO: 3046029 - DNA, 12 bp, Homo sapiens
cacctccctgcc

SEQ ID NO: 3046030 - DNA, 17 bp, Homo sapiens
cacctccctgcctccag

SEQ ID NO: 3046031 - DNA, 14 bp, Homo sapiens
cacctccttcaatt

SEQ ID NO: 3046032 - DNA, 17 bp, Homo sapiens
cacctcggccctccctg

SEQ ID NO: 3046033 - DNA, 15 bp, Homo sapiens
cacctctctgtcttt

SEQ ID NO: 3046034 - DNA, 18 bp, Homo sapiens
cacctctctgtctttttc

SEQ ID NO: 3046035 - DNA, 20 bp, Homo sapiens
cacctctctgtctttttcct

SEQ ID NO: 3046036 - DNA, 21 bp, Homo sapiens
cacctctctgtctttttcctt

SEQ ID NO: 3046037 - DNA, 23 bp, Homo sapiens
cacctctcttttcctctctgtct

SEQ ID NO: 3046038 - DNA, 12 bp, Homo sapiens
cacctctgcttt

SEQ ID NO: 3046039 - DNA, 16 bp, Homo sapiens
cacctctgctttctga

SEQ ID NO: 3046040 - DNA, 13 bp, Homo sapiens
cacctctggctgt

SEQ ID NO: 3046041 - DNA, 21 bp, Homo sapiens
cacctgagcaggacctctgaa

SEQ ID NO: 3046042 - DNA, 12 bp, Homo sapiens
cacctgaggtca

SEQ ID NO: 3046043 - DNA, 16 bp, Homo sapiens
cacctgatgacatggt

SEQ ID NO: 3046044 - DNA, 15 bp, Homo sapiens
cacctgatgtgtaca

SEQ ID NO: 3046045 - DNA, 17 bp, Homo sapiens
cacctgattcaactaaa

SEQ ID NO: 3046046 - DNA, 21 bp, Homo sapiens
cacctgattcaactaaaaaaa

SEQ ID NO: 3046047 - DNA, 13 bp, Homo sapiens
cacctgcacctcc

SEQ ID NO: 3046048 - DNA, 14 bp, Homo sapiens
cacctgcacctccc

SEQ ID NO: 3046049 - DNA, 15 bp, Homo sapiens
cacctgcacctcccc

SEQ ID NO: 3046050 - DNA, 17 bp, Homo sapiens
cacctgcacctcccccc

SEQ ID NO: 3046051 - DNA, 23 bp, Homo sapiens
cacctgcacttaaggcactctgt

SEQ ID NO: 3046052 - DNA, 13 bp, Homo sapiens
cacctgcagtgcc

SEQ ID NO: 3046053 - DNA, 18 bp, Homo sapiens
cacctgcagtgccagctc

SEQ ID NO: 3046054 - DNA, 13 bp, Homo sapiens
cacctgcctagct

SEQ ID NO: 3046055 - DNA, 18 bp, Homo sapiens
cacctgcctcagctacct

SEQ ID NO: 3046056 - DNA, 20 bp, Homo sapiens
cacctgcctcaggactgcga

SEQ ID NO: 3046057 - DNA, 16 bp, Homo sapiens
cacctgcctggccggc

SEQ ID NO: 3046058 - DNA, 20 bp, Homo sapiens
cacctgcctggccggccagc

SEQ ID NO: 3046059 - DNA, 21 bp, Homo sapiens
cacctgcctggccggccagcc

SEQ ID NO: 3046060 - DNA, 18 bp, Homo sapiens
cacctgcctgttaggaga

SEQ ID NO: 3046061 - DNA, 18 bp, Homo sapiens
cacctgctgagagaccca

SEQ ID NO: 3046062 - DNA, 22 bp, Homo sapiens
cacctgctgagagacccaagga

SEQ ID NO: 3046063 - DNA, 21 bp, Homo sapiens
cacctggaagcatttgtttct

SEQ ID NO: 3046064 - DNA, 22 bp, Homo sapiens
cacctggaccatttgattgttt

SEQ ID NO: 3046065 - DNA, 18 bp, Homo sapiens
cacctggaccccctgccc

SEQ ID NO: 3046066 - DNA, 19 bp, Homo sapiens
cacctggacgaagagcagg

SEQ ID NO: 3046067 - DNA, 14 bp, Homo sapiens
cacctggccccatg

SEQ ID NO: 3046068 - DNA, 16 bp, Homo sapiens
cacctggccccatgtc

SEQ ID NO: 3046069 - DNA, 22 bp, Homo sapiens
cacctggccccatgtctctcag

SEQ ID NO: 3046070 - DNA, 19 bp, Homo sapiens
cacctggccgggtcaccct

SEQ ID NO: 3046071 - DNA, 20 bp, Homo sapiens
cacctggccgggtcaccctg

SEQ ID NO: 3046072 - DNA, 21 bp, Homo sapiens
cacctggcttgtttattttgt

SEQ ID NO: 3046073 - DNA, 16 bp, Homo sapiens
cacctgggagaaatct

SEQ ID NO: 3046074 - DNA, 17 bp, Homo sapiens
cacctggtcctccgcct

SEQ ID NO: 3046075 - DNA, 22 bp, Homo sapiens
cacctggtgggtggtgtcctga

SEQ ID NO: 3046076 - DNA, 16 bp, Homo sapiens
cacctgtaatcccagc

SEQ ID NO: 3046077 - DNA, 11 bp, Homo sapiens
cacctgtacag

SEQ ID NO: 3046078 - DNA, 13 bp, Homo sapiens
cacctgtagtccc

SEQ ID NO: 3046079 - DNA, 20 bp, Homo sapiens
cacctgtcaaacaaagccag

SEQ ID NO: 3046080 - DNA, 21 bp, Homo sapiens
cacctgtcaaacaaagccaga

SEQ ID NO: 3046081 - DNA, 23 bp, Homo sapiens
cacctgtcaaacaaagccagaag

SEQ ID NO: 3046082 - DNA, 19 bp, Homo sapiens
cacctgttgcttacaattt

SEQ ID NO: 3046083 - DNA, 20 bp, Homo sapiens
cacctgttgcttacaatttt

SEQ ID NO: 3046084 - DNA, 16 bp, Homo sapiens
caccttatacatcact

SEQ ID NO: 3046085 - DNA, 20 bp, Homo sapiens
caccttatacatcacttcct

SEQ ID NO: 3046086 - DNA, 12 bp, Homo sapiens
caccttcccagc

SEQ ID NO: 3046087 - DNA, 21 bp, Homo sapiens
caccttcccagctctccctct

SEQ ID NO: 3046088 - DNA, 12 bp, Homo sapiens
caccttcctcct

SEQ ID NO: 3046089 - DNA, 14 bp, Homo sapiens
caccttcctcctgt

SEQ ID NO: 3046090 - DNA, 16 bp, Homo sapiens
caccttgattttcttc

SEQ ID NO: 3046091 - DNA, 12 bp, Homo sapiens
caccttgctgca

SEQ ID NO: 3046092 - DNA, 16 bp, Homo sapiens
caccttgctgcagtgt

SEQ ID NO: 3046093 - DNA, 19 bp, Homo sapiens
caccttgcttttttactta

SEQ ID NO: 3046094 - DNA, 15 bp, Homo sapiens
caccttggagcattt

SEQ ID NO: 3046095 - DNA, 17 bp, Homo sapiens
caccttggagcatttat

SEQ ID NO: 3046096 - DNA, 23 bp, Homo sapiens
caccttggagcatttatgtagac

SEQ ID NO: 3046097 - DNA, 17 bp, Homo sapiens
caccttgtgtctgtaca

SEQ ID NO: 3046098 - DNA, 21 bp, Homo sapiens
caccttgtgtctgtacacgtg

SEQ ID NO: 3046099 - DNA, 12 bp, Homo sapiens
cacctttctagt

SEQ ID NO: 3046100 - DNA, 19 bp, Homo sapiens
cacctttctccactgggtg

SEQ ID NO: 3046101 - DNA, 17 bp, Homo sapiens
caccttttcttgcctga

SEQ ID NO: 3046102 - DNA, 16 bp, Homo sapiens
caccttttgtttttcc

SEQ ID NO: 3046103 - DNA, 22 bp, Homo sapiens
cacgaacccacctgctgagaga

SEQ ID NO: 3046104 - DNA, 20 bp, Homo sapiens
cacgacccctgcctcgaggg

SEQ ID NO: 3046105 - DNA, 17 bp, Homo sapiens
cacgactggccagggcc

SEQ ID NO: 3046106 - DNA, 16 bp, Homo sapiens
cacgagaccccggctt

SEQ ID NO: 3046107 - DNA, 23 bp, Homo sapiens
cacgaggaatctgtgggtctggg

SEQ ID NO: 3046108 - DNA, 13 bp, Homo sapiens
cacgagggctggc

SEQ ID NO: 3046109 - DNA, 22 bp, Homo sapiens
cacgaggggacccatgggggct

SEQ ID NO: 3046110 - DNA, 16 bp, Homo sapiens
cacgatggaatgtaaa

SEQ ID NO: 3046111 - DNA, 15 bp, Homo sapiens
cacgatgtggccctg

SEQ ID NO: 3046112 - DNA, 17 bp, Homo sapiens
cacgatgtggccctggc

SEQ ID NO: 3046113 - DNA, 19 bp, Homo sapiens
cacgattatgactaaagta

SEQ ID NO: 3046114 - DNA, 20 bp, Homo sapiens
cacgcaaaccaacctttctg

SEQ ID NO: 3046115 - DNA, 18 bp, Homo sapiens
cacgcacctccacgccac

SEQ ID NO: 3046116 - DNA, 12 bp, Homo sapiens
cacgcacctccc

SEQ ID NO: 3046117 - DNA, 14 bp, Homo sapiens
cacgcacctcccat

SEQ ID NO: 3046118 - DNA, 13 bp, Homo sapiens
cacgcacctgggt

SEQ ID NO: 3046119 - DNA, 21 bp, Homo sapiens
cacgcacctgtagtcccagct

SEQ ID NO: 3046120 - DNA, 12 bp, Homo sapiens
cacgcaggagca

SEQ ID NO: 3046121 - DNA, 20 bp, Homo sapiens
cacgcaggagcacacccagc

SEQ ID NO: 3046122 - DNA, 18 bp, Homo sapiens
cacgcaggcggccagggc

SEQ ID NO: 3046123 - DNA, 20 bp, Homo sapiens
cacgccaagtggaagccact

SEQ ID NO: 3046124 - DNA, 22 bp, Homo sapiens
cacgccacccccgcccccaccg

SEQ ID NO: 3046125 - DNA, 20 bp, Homo sapiens
cacgccattgtactccagcc

SEQ ID NO: 3046126 - DNA, 22 bp, Homo sapiens
cacgccattgtactccagcctg

SEQ ID NO: 3046127 - DNA, 16 bp, Homo sapiens
cacgccccgctgtgtc

SEQ ID NO: 3046128 - DNA, 20 bp, Homo sapiens
cacgccgggagaagccacct

SEQ ID NO: 3046129 - DNA, 22 bp, Homo sapiens
cacgccgggagaagccaccttc

SEQ ID NO: 3046130 - DNA, 13 bp, Homo sapiens
cacgcctcccact

SEQ ID NO: 3046131 - DNA, 18 bp, Homo sapiens
cacgcctcccactggggt

SEQ ID NO: 3046132 - DNA, 22 bp, Homo sapiens
cacgcctcccactggggtccag

SEQ ID NO: 3046133 - DNA, 23 bp, Homo sapiens
cacgcctgcaaacgctgcctgcc

SEQ ID NO: 3046134 - DNA, 20 bp, Homo sapiens
cacgcctgtaatcccagcag

SEQ ID NO: 3046135 - DNA, 15 bp, Homo sapiens
cacgccttggcctcc

SEQ ID NO: 3046136 - DNA, 19 bp, Homo sapiens
cacgcgcccccctcccaga

SEQ ID NO: 3046137 - DNA, 19 bp, Homo sapiens
cacgcggccacctcaccct

SEQ ID NO: 3046138 - DNA, 12 bp, Homo sapiens
cacgctccagct

SEQ ID NO: 3046139 - DNA, 13 bp, Homo sapiens
cacgctccagctg

SEQ ID NO: 3046140 - DNA, 18 bp, Homo sapiens
cacgctccagctgccccg

SEQ ID NO: 3046141 - DNA, 14 bp, Homo sapiens
cacgctttttgact

SEQ ID NO: 3046142 - DNA, 21 bp, Homo sapiens
cacggagcagttcagagtgga

SEQ ID NO: 3046143 - DNA, 16 bp, Homo sapiens
cacggagccactcctc

SEQ ID NO: 3046144 - DNA, 20 bp, Homo sapiens
cacggcaggacaacgaggaa

SEQ ID NO: 3046145 - DNA, 22 bp, Homo sapiens
cacggcaggacaacgaggaagc

SEQ ID NO: 3046146 - DNA, 19 bp, Homo sapiens
cacggccacatcaaagagg

SEQ ID NO: 3046147 - DNA, 13 bp, Homo sapiens
cacggcccaggga

SEQ ID NO: 3046148 - DNA, 14 bp, Homo sapiens
cacggcccagggag

SEQ ID NO: 3046149 - DNA, 17 bp, Homo sapiens
cacggcccggcccctca

SEQ ID NO: 3046150 - DNA, 22 bp, Homo sapiens
cacggctcctcgagatcccaac

SEQ ID NO: 3046151 - DNA, 13 bp, Homo sapiens
cacggctggtcac

SEQ ID NO: 3046152 - DNA, 18 bp, Homo sapiens
cacggctggtcactctgc

SEQ ID NO: 3046153 - DNA, 19 bp, Homo sapiens
cacggctggtcactctgcc

SEQ ID NO: 3046154 - DNA, 21 bp, Homo sapiens
cacggctggtcactctgccct

SEQ ID NO: 3046155 - DNA, 15 bp, Homo sapiens
cacgggagatttctt

SEQ ID NO: 3046156 - DNA, 14 bp, Homo sapiens
cacgggcatgcaca

SEQ ID NO: 3046157 - DNA, 17 bp, Homo sapiens
cacgggcggtcctgcac

SEQ ID NO: 3046158 - DNA, 18 bp, Homo sapiens
cacggggaccactgggcc

SEQ ID NO: 3046159 - DNA, 20 bp, Homo sapiens
cacggggaccactgggcccc

SEQ ID NO: 3046160 - DNA, 17 bp, Homo sapiens
cacggtccgcggcctgc

SEQ ID NO: 3046161 - DNA, 14 bp, Homo sapiens
cacggtctgttctt

SEQ ID NO: 3046162 - DNA, 20 bp, Homo sapiens
cacggtgactctgtccagct

SEQ ID NO: 3046163 - DNA, 13 bp, Homo sapiens
cacggtttctgtt

SEQ ID NO: 3046164 - DNA, 20 bp, Homo sapiens
cacgtaagttaataagcaaa

SEQ ID NO: 3046165 - DNA, 15 bp, Homo sapiens
cacgtaccaagccac

SEQ ID NO: 3046166 - DNA, 21 bp, Homo sapiens
cacgtaccaagccaccgcagc

SEQ ID NO: 3046167 - DNA, 18 bp, Homo sapiens
cacgtatagtcctagctg

SEQ ID NO: 3046168 - DNA, 16 bp, Homo sapiens
cacgtcgttctaatta

SEQ ID NO: 3046169 - DNA, 15 bp, Homo sapiens
cacgtctctctgcct

SEQ ID NO: 3046170 - DNA, 17 bp, Homo sapiens
cacgtctctctgcctgc

SEQ ID NO: 3046171 - DNA, 22 bp, Homo sapiens
cacgtctctctgcctgctgggc

SEQ ID NO: 3046172 - DNA, 23 bp, Homo sapiens
cacgtctctctgcctgctgggct

SEQ ID NO: 3046173 - DNA, 14 bp, Homo sapiens
cacgtgacacaaac

SEQ ID NO: 3046174 - DNA, 17 bp, Homo sapiens
cacgtgacacaaacaca

SEQ ID NO: 3046175 - DNA, 20 bp, Homo sapiens
cacgtgcaggacagctcttg

SEQ ID NO: 3046176 - DNA, 14 bp, Homo sapiens
cacgtgccaggccc

SEQ ID NO: 3046177 - DNA, 21 bp, Homo sapiens
cacgtgcgctgggcacttccc

SEQ ID NO: 3046178 - DNA, 14 bp, Homo sapiens
cacgtgtatgcaag

SEQ ID NO: 3046179 - DNA, 13 bp, Homo sapiens
cacgttatggtgt

SEQ ID NO: 3046180 - DNA, 15 bp, Homo sapiens
cacgttcagggaggg

SEQ ID NO: 3046181 - DNA, 19 bp, Homo sapiens
cacgttcagggaggggccg

SEQ ID NO: 3046182 - DNA, 16 bp, Homo sapiens
cacgttgcctctactt

SEQ ID NO: 3046183 - DNA, 13 bp, Homo sapiens
cacgttgctgcca

SEQ ID NO: 3046184 - DNA, 16 bp, Homo sapiens
cacgtttaatcccagc

SEQ ID NO: 3046185 - DNA, 17 bp, Homo sapiens
cacgtttaatcccagca

SEQ ID NO: 3046186 - DNA, 21 bp, Homo sapiens
cacgtttaatcccagcacttt

SEQ ID NO: 3046187 - DNA, 18 bp, Homo sapiens
cactaacccgttttattc

SEQ ID NO: 3046188 - DNA, 16 bp, Homo sapiens
cactaagcagaggagg

SEQ ID NO: 3046189 - DNA, 17 bp, Homo sapiens
cactaagcagaggaggg

SEQ ID NO: 3046190 - DNA, 18 bp, Homo sapiens
cactaagcagaggagggg

SEQ ID NO: 3046191 - DNA, 22 bp, Homo sapiens
cactaatgttagaattgatttc

SEQ ID NO: 3046192 - DNA, 13 bp, Homo sapiens
cactacaccacac

SEQ ID NO: 3046193 - DNA, 22 bp, Homo sapiens
cactaccctgagatctgcacag

SEQ ID NO: 3046194 - DNA, 19 bp, Homo sapiens
cactacctgccatgcatac

SEQ ID NO: 3046195 - DNA, 17 bp, Homo sapiens
cactagaaattgggcag

SEQ ID NO: 3046196 - DNA, 14 bp, Homo sapiens
cactagacaagcca

SEQ ID NO: 3046197 - DNA, 16 bp, Homo sapiens
cactagtcaccgacag

SEQ ID NO: 3046198 - DNA, 21 bp, Homo sapiens
cactagtcaccgacagcggcc

SEQ ID NO: 3046199 - DNA, 15 bp, Homo sapiens
cactagtttatgcta

SEQ ID NO: 3046200 - DNA, 14 bp, Homo sapiens
cactatacagattc

SEQ ID NO: 3046201 - DNA, 11 bp, Homo sapiens
cactatagctc

SEQ ID NO: 3046202 - DNA, 15 bp, Homo sapiens
cactatatcatgggc

SEQ ID NO: 3046203 - DNA, 20 bp, Homo sapiens
cactatctgaaaatacattt

SEQ ID NO: 3046204 - DNA, 11 bp, Homo sapiens
cactatctggg

SEQ ID NO: 3046205 - DNA, 17 bp, Homo sapiens
cagatgttttacgtctg

SEQ ID NO: 3046206 - DNA, 22 bp, Homo sapiens
cagatgttttacgtctgggaga

SEQ ID NO: 3046207 - DNA, 12 bp, Homo sapiens
cagattaatatt

SEQ ID NO: 3046208 - DNA, 14 bp, Homo sapiens
cagattatgtatta

SEQ ID NO: 3046209 - DNA, 15 bp, Homo sapiens
cagattattaaaatt

SEQ ID NO: 3046210 - DNA, 18 bp, Homo sapiens
cagattcccaggccaggg

SEQ ID NO: 3046211 - DNA, 15 bp, Homo sapiens
cagattgcatgtgac

SEQ ID NO: 3046212 - DNA, 15 bp, Homo sapiens
cagattggaaggaga

SEQ ID NO: 3046213 - DNA, 15 bp, Homo sapiens
cagattggccaatta

SEQ ID NO: 3046214 - DNA, 16 bp, Homo sapiens
cagattggccaattaa

SEQ ID NO: 3046215 - DNA, 21 bp, Homo sapiens
cagattgtatcatgtgctaga

SEQ ID NO: 3046216 - DNA, 20 bp, Homo sapiens
cagattgtcttaatttctat

SEQ ID NO: 3046217 - DNA, 19 bp, Homo sapiens
cagattgtttctatacaaa

SEQ ID NO: 3046218 - DNA, 20 bp, Homo sapiens
cagattgtttctatacaaat

SEQ ID NO: 3046219 - DNA, 21 bp, Homo sapiens
cagatttactccactatggaa

SEQ ID NO: 3046220 - DNA, 22 bp, Homo sapiens
cagatttatttgtttgattttc

SEQ ID NO: 3046221 - DNA, 24 bp, Homo sapiens
cagatttgtctttttgttgtaaaa

SEQ ID NO: 3046222 - DNA, 12 bp, Homo sapiens
cagatttgtgaa

SEQ ID NO: 3046223 - DNA, 14 bp, Homo sapiens
cagatttgtgaact

SEQ ID NO: 3046224 - DNA, 17 bp, Homo sapiens
cagatttgtgaactcag

SEQ ID NO: 3046225 - DNA, 24 bp, Homo sapiens
cagatttgtgaactcagccaagca

SEQ ID NO: 3046226 - DNA, 14 bp, Homo sapiens
cagatttgtgttat

SEQ ID NO: 3046227 - DNA, 18 bp, Homo sapiens
cagattttcctaaggcca

SEQ ID NO: 3046228 - DNA, 11 bp, Homo sapiens
cagcaaaatcc

SEQ ID NO: 3046229 - DNA, 20 bp, Homo sapiens
cagcaaaatccaaactgctg

SEQ ID NO: 3046230 - DNA, 21 bp, Homo sapiens
cagcaaaatccaaactgctgt

SEQ ID NO: 3046231 - DNA, 23 bp, Homo sapiens
cagcaaaatccaaactgctgtct

SEQ ID NO: 3046232 - DNA, 19 bp, Homo sapiens
cagcaaaatccttacttcc

SEQ ID NO: 3046233 - DNA, 14 bp, Homo sapiens
cagcaaaccaagag

SEQ ID NO: 3046234 - DNA, 21 bp, Homo sapiens
cagcaaagagaatgtatttcc

SEQ ID NO: 3046235 - DNA, 23 bp, Homo sapiens
cagcaacaaaatcatggcttagg

SEQ ID NO: 3046236 - DNA, 14 bp, Homo sapiens
cagcaacacagcct

SEQ ID NO: 3046237 - DNA, 16 bp, Homo sapiens
cagcaacacagcctgg

SEQ ID NO: 3046238 - DNA, 18 bp, Homo sapiens
cagcaacacagcctgggc

SEQ ID NO: 3046239 - DNA, 16 bp, Homo sapiens
cagcaaccagaagtta

SEQ ID NO: 3046240 - DNA, 16 bp, Homo sapiens
cagcaaccccaggctg

SEQ ID NO: 3046241 - DNA, 12 bp, Homo sapiens
cagcaagagaga

SEQ ID NO: 3046242 - DNA, 15 bp, Homo sapiens
cagcaatattctgat

SEQ ID NO: 3046243 - DNA, 15 bp, Homo sapiens
cagcacaaacacaag

SEQ ID NO: 3046244 - DNA, 16 bp, Homo sapiens
cagcacaaggccatct

SEQ ID NO: 3046245 - DNA, 14 bp, Homo sapiens
cagcacagagaaga

SEQ ID NO: 3046246 - DNA, 17 bp, Homo sapiens
cagcacagagaagacaa

SEQ ID NO: 3046247 - DNA, 16 bp, Homo sapiens
cagcacagagaccccc

SEQ ID NO: 3046248 - DNA, 16 bp, Homo sapiens
cagcacatcacctctt

SEQ ID NO: 3046249 - DNA, 21 bp, Homo sapiens
cagcaccatccgccagggccc

SEQ ID NO: 3046250 - DNA, 19 bp, Homo sapiens
cagcaccccctctcctgga

SEQ ID NO: 3046251 - DNA, 20 bp, Homo sapiens
cagcaccccctctcctggag

SEQ ID NO: 3046252 - DNA, 14 bp, Homo sapiens
cagcaccgccggct

SEQ ID NO: 3046253 - DNA, 16 bp, Homo sapiens
cagcacctcagcctgc

SEQ ID NO: 3046254 - DNA, 14 bp, Homo sapiens
cagcaccttggccc

SEQ ID NO: 3046255 - DNA, 21 bp, Homo sapiens
cagcaccttggcccaggagct

SEQ ID NO: 3046256 - DNA, 22 bp, Homo sapiens
cagcaccttggcccaggagctc

SEQ ID NO: 3046257 - DNA, 23 bp, Homo sapiens
cagcaccttggcccaggagctct

SEQ ID NO: 3046258 - DNA, 13 bp, Homo sapiens
cagcaccttgtgc

SEQ ID NO: 3046259 - DNA, 20 bp, Homo sapiens
cagcactagaaattgggcag

SEQ ID NO: 3046260 - DNA, 20 bp, Homo sapiens
cagcactatgacattttggg

SEQ ID NO: 3046261 - DNA, 17 bp, Homo sapiens
cagcactgctgcctcag

SEQ ID NO: 3046262 - DNA, 18 bp, Homo sapiens
cagcactgctgcctcagc

SEQ ID NO: 3046263 - DNA, 20 bp, Homo sapiens
cagcactgctgcctcagctc

SEQ ID NO: 3046264 - DNA, 19 bp, Homo sapiens
cagcactttgagaggctga

SEQ ID NO: 3046265 - DNA, 20 bp, Homo sapiens
cagcactttgagaggctgag

SEQ ID NO: 3046266 - DNA, 18 bp, Homo sapiens
cagcactttgggaggcag

SEQ ID NO: 3046267 - DNA, 12 bp, Homo sapiens
cagcagaacagc

SEQ ID NO: 3046268 - DNA, 16 bp, Homo sapiens
cagcagaacagccatt

SEQ ID NO: 3046269 - DNA, 13 bp, Homo sapiens
cagcagaacctgt

SEQ ID NO: 3046270 - DNA, 16 bp, Homo sapiens
cagcagaacctgtagg

SEQ ID NO: 3046271 - DNA, 15 bp, Homo sapiens
cagcagaatggaggc

SEQ ID NO: 3046272 - DNA, 18 bp, Homo sapiens
cagcagaatggaggcagg

SEQ ID NO: 3046273 - DNA, 19 bp, Homo sapiens
cagcagaatggaggcaggg

SEQ ID NO: 3046274 - DNA, 17 bp, Homo sapiens
cagcagacaaaatgaaa

SEQ ID NO: 3046275 - DNA, 18 bp, Homo sapiens
cagcagactgatcaggac

SEQ ID NO: 3046276 - DNA, 13 bp, Homo sapiens
cagcagagagccc

SEQ ID NO: 3046277 - DNA, 17 bp, Homo sapiens
cagcagagagccctggg

SEQ ID NO: 3046278 - DNA, 13 bp, Homo sapiens
cagcagagtgtgg

SEQ ID NO: 3046279 - DNA, 16 bp, Homo sapiens
cagcagcatcccagcc

SEQ ID NO: 3046280 - DNA, 21 bp, Homo sapiens
cagcagcatcccagccttgag

SEQ ID NO: 3046281 - DNA, 13 bp, Homo sapiens
cagcagccctcct

SEQ ID NO: 3046282 - DNA, 17 bp, Homo sapiens
cagcagccctcctcacc

SEQ ID NO: 3046283 - DNA, 18 bp, Homo sapiens
cagcagccctcctcaccc

SEQ ID NO: 3046284 - DNA, 16 bp, Homo sapiens
cagcagcctgccagca

SEQ ID NO: 3046285 - DNA, 20 bp, Homo sapiens
cagcagcctgcgctcggcag

SEQ ID NO: 3046286 - DNA, 21 bp, Homo sapiens
cagcagcctgcgctcggcagg

SEQ ID NO: 3046287 - DNA, 22 bp, Homo sapiens
cagcagcctgcgctcggcagga

SEQ ID NO: 3046288 - DNA, 20 bp, Homo sapiens
cagcagcctgtgagggagtg

SEQ ID NO: 3046289 - DNA, 21 bp, Homo sapiens
cagcagcgcgcaggcctgcgt

SEQ ID NO: 3046290 - DNA, 17 bp, Homo sapiens
cagcagcggaaccgccc

SEQ ID NO: 3046291 - DNA, 20 bp, Homo sapiens
cagcagctcacaccctacct

SEQ ID NO: 3046292 - DNA, 14 bp, Homo sapiens
cagcaggaggccag

SEQ ID NO: 3046293 - DNA, 19 bp, Homo sapiens
cagcaggcacggcccgcag

SEQ ID NO: 3046294 - DNA, 20 bp, Homo sapiens
cagcaggcacggcccgcagc

SEQ ID NO: 3046295 - DNA, 15 bp, Homo sapiens
cagcaggcagcgcct

SEQ ID NO: 3046296 - DNA, 20 bp, Homo sapiens
cagcaggcagcgcctgtccc

SEQ ID NO: 3046297 - DNA, 18 bp, Homo sapiens
cagcagggatgccctgga

SEQ ID NO: 3046298 - DNA, 11 bp, Homo sapiens
cagcagggcta

SEQ ID NO: 3046299 - DNA, 21 bp, Homo sapiens
cagcagggctaccctgagctg

SEQ ID NO: 3046300 - DNA, 17 bp, Homo sapiens
cagcaggggccctcact

SEQ ID NO: 3046301 - DNA, 18 bp, Homo sapiens
cagcagggtcttttcatc

SEQ ID NO: 3046302 - DNA, 21 bp, Homo sapiens
cagcagggtcttttcatctgg

SEQ ID NO: 3046303 - DNA, 21 bp, Homo sapiens
cagcaggtccccagctttggc

SEQ ID NO: 3046304 - DNA, 15 bp, Homo sapiens
cagcagtagacattt

SEQ ID NO: 3046305 - DNA, 12 bp, Homo sapiens
cagcagttgagg

SEQ ID NO: 3046306 - DNA, 19 bp, Homo sapiens
cagcatcaaacatgaaaac

SEQ ID NO: 3046307 - DNA, 20 bp, Homo sapiens
cagcatcaaacatgaaaaca

SEQ ID NO: 3046308 - DNA, 15 bp, Homo sapiens
cagcatcacctgcct

SEQ ID NO: 3046309 - DNA, 15 bp, Homo sapiens
cagcatcccagcctt

SEQ ID NO: 3046310 - DNA, 13 bp, Homo sapiens
cagcatctgacca

SEQ ID NO: 3046311 - DNA, 17 bp, Homo sapiens
cagcatctgaccatctg

SEQ ID NO: 3046312 - DNA, 19 bp, Homo sapiens
cagcatctgaccatctgtg

SEQ ID NO: 3046313 - DNA, 21 bp, Homo sapiens
cagcatctgaccatctgtgac

SEQ ID NO: 3046314 - DNA, 19 bp, Homo sapiens
cagcatgacaaaagtgaca

SEQ ID NO: 3046315 - DNA, 21 bp, Homo sapiens
cagcatggaatctgatgaaaa

SEQ ID NO: 3046316 - DNA, 21 bp, Homo sapiens
cagcatggcactccctccagc

SEQ ID NO: 3046317 - DNA, 16 bp, Homo sapiens
cagcatgttttctgct

SEQ ID NO: 3046318 - DNA, 18 bp, Homo sapiens
cagcattctcaggcacca

SEQ ID NO: 3046319 - DNA, 19 bp, Homo sapiens
cagcattctcaggcaccag

SEQ ID NO: 3046320 - DNA, 13 bp, Homo sapiens
cagcattgtaatt

SEQ ID NO: 3046321 - DNA, 18 bp, Homo sapiens
cagcattgtaattatgta

SEQ ID NO: 3046322 - DNA, 18 bp, Homo sapiens
cagcatttagctggccac

SEQ ID NO: 3046323 - DNA, 21 bp, Homo sapiens
cagcatttccacaccaagcag

SEQ ID NO: 3046324 - DNA, 15 bp, Homo sapiens
cagcatttcccttcc

SEQ ID NO: 3046325 - DNA, 19 bp, Homo sapiens
cagccaacacgcacctgcc

SEQ ID NO: 3046326 - DNA, 23 bp, Homo sapiens
cagccaacacgcacctgcctcag

SEQ ID NO: 3046327 - DNA, 18 bp, Homo sapiens
cagccaacagctacaaca

SEQ ID NO: 3046328 - DNA, 20 bp, Homo sapiens
cagccaacagctacaacagc

SEQ ID NO: 3046329 - DNA, 16 bp, Homo sapiens
cagccaacattgcctt

SEQ ID NO: 3046330 - DNA, 19 bp, Homo sapiens
cagccaactagcccctggg

SEQ ID NO: 3046331 - DNA, 20 bp, Homo sapiens
cagccaactagcccctgggg

SEQ ID NO: 3046332 - DNA, 14 bp, Homo sapiens
cagccaagcacagt

SEQ ID NO: 3046333 - DNA, 16 bp, Homo sapiens
cagccaagcacagtgg

SEQ ID NO: 3046334 - DNA, 19 bp, Homo sapiens
cagccaagcacagtggtgg

SEQ ID NO: 3046335 - DNA, 17 bp, Homo sapiens
cagccaaggccgagacc

SEQ ID NO: 3046336 - DNA, 16 bp, Homo sapiens
cagccaatctggacac

SEQ ID NO: 3046337 - DNA, 18 bp, Homo sapiens
cagccaatctggacactt

SEQ ID NO: 3046338 - DNA, 22 bp, Homo sapiens
cagccaatctggacacttcttt

SEQ ID NO: 3046339 - DNA, 16 bp, Homo sapiens
cagccaatttgtctcc

SEQ ID NO: 3046340 - DNA, 18 bp, Homo sapiens
cagccacacacacagaaa

SEQ ID NO: 3046341 - DNA, 21 bp, Homo sapiens
cagccacacacacagaaaata

SEQ ID NO: 3046342 - DNA, 16 bp, Homo sapiens
cagccacaccactgcc

SEQ ID NO: 3046343 - DNA, 18 bp, Homo sapiens
cagccacacgcaggcggc

SEQ ID NO: 3046344 - DNA, 19 bp, Homo sapiens
cagccacacgcaggcggcc

SEQ ID NO: 3046345 - DNA, 13 bp, Homo sapiens
cagccacaggcca

SEQ ID NO: 3046346 - DNA, 14 bp, Homo sapiens
cagccacaggccaa

SEQ ID NO: 3046347 - DNA, 12 bp, Homo sapiens
cagccacatgcc

SEQ ID NO: 3046348 - DNA, 22 bp, Homo sapiens
cagccacccctgccactcaccc

SEQ ID NO: 3046349 - DNA, 21 bp, Homo sapiens
cagccaccgaagccgcctgtg

SEQ ID NO: 3046350 - DNA, 15 bp, Homo sapiens
cagccacctctcttt

SEQ ID NO: 3046351 - DNA, 16 bp, Homo sapiens
cagccacctctctttt

SEQ ID NO: 3046352 - DNA, 14 bp, Homo sapiens
cagccactccaagc

SEQ ID NO: 3046353 - DNA, 16 bp, Homo sapiens
cagccactccccggca

SEQ ID NO: 3046354 - DNA, 10 bp, Homo sapiens
cagccactct

SEQ ID NO: 3046355 - DNA, 22 bp, Homo sapiens
cagccacttttagctactgcta

SEQ ID NO: 3046356 - DNA, 17 bp, Homo sapiens
cagccagaacgtggctc

SEQ ID NO: 3046357 - DNA, 21 bp, Homo sapiens
cagccagaacgtggctctgct

SEQ ID NO: 3046358 - DNA, 13 bp, Homo sapiens
cagccagccaccc

SEQ ID NO: 3046359 - DNA, 21 bp, Homo sapiens
cagccagccacccctgccact

SEQ ID NO: 3046360 - DNA, 12 bp, Homo sapiens
cagccagccact

SEQ ID NO: 3046361 - DNA, 13 bp, Homo sapiens
cagccagccactc

SEQ ID NO: 3046362 - DNA, 20 bp, Homo sapiens
cagccagcccaaaccttggg

SEQ ID NO: 3046363 - DNA, 12 bp, Homo sapiens
cagccagcccag

SEQ ID NO: 3046364 - DNA, 14 bp, Homo sapiens
cagccagcccagcc

SEQ ID NO: 3046365 - DNA, 15 bp, Homo sapiens
cagccagcccagccc

SEQ ID NO: 3046366 - DNA, 19 bp, Homo sapiens
cagccagcccagcccagct

SEQ ID NO: 3046367 - DNA, 17 bp, Homo sapiens
cagccaggagaaggtca

SEQ ID NO: 3046368 - DNA, 11 bp, Homo sapiens
cagccaggagg

SEQ ID NO: 3046369 - DNA, 13 bp, Homo sapiens
cagccaggcctcg

SEQ ID NO: 3046370 - DNA, 17 bp, Homo sapiens
cagccaggcctcgcctg

SEQ ID NO: 3046371 - DNA, 21 bp, Homo sapiens
cagccaggcctcgcctgccct

SEQ ID NO: 3046372 - DNA, 23 bp, Homo sapiens
cagccaggcctcgcctgccctcc

SEQ ID NO: 3046373 - DNA, 16 bp, Homo sapiens
cagccaggctgggccg

SEQ ID NO: 3046374 - DNA, 17 bp, Homo sapiens
cagccaggctgggccgc

SEQ ID NO: 3046375 - DNA, 16 bp, Homo sapiens
cagccatcaaaatgct

SEQ ID NO: 3046376 - DNA, 18 bp, Homo sapiens
cagccatcaagagactga

SEQ ID NO: 3046377 - DNA, 21 bp, Homo sapiens
cagccatcaagagactgagtc

SEQ ID NO: 3046378 - DNA, 21 bp, Homo sapiens
cagccatgcgcgcgctctctc

SEQ ID NO: 3046379 - DNA, 17 bp, Homo sapiens
cagccatgtctgcattt

SEQ ID NO: 3046380 - DNA, 15 bp, Homo sapiens
cagccattgcaccca

SEQ ID NO: 3046381 - DNA, 22 bp, Homo sapiens
cagccattgcacccagcccaga

SEQ ID NO: 3046382 - DNA, 19 bp, Homo sapiens
cagccattggctatttaaa

SEQ ID NO: 3046383 - DNA, 15 bp, Homo sapiens
cagccatttttcaat

SEQ ID NO: 3046384 - DNA, 15 bp, Homo sapiens
cagcccaacagcact

SEQ ID NO: 3046385 - DNA, 16 bp, Homo sapiens
cagcccaacagcactt

SEQ ID NO: 3046386 - DNA, 23 bp, Homo sapiens
cagcccaatccaggtacgcacag

SEQ ID NO: 3046387 - DNA, 12 bp, Homo sapiens
cagcccacagag

SEQ ID NO: 3046388 - DNA, 12 bp, Homo sapiens
cagcccaccagg

SEQ ID NO: 3046389 - DNA, 16 bp, Homo sapiens
cagcccacctggcttt

SEQ ID NO: 3046390 - DNA, 19 bp, Homo sapiens
cagcccagacccccagtgt

SEQ ID NO: 3046391 - DNA, 17 bp, Homo sapiens
cagcccagcccagctgg

SEQ ID NO: 3046392 - DNA, 21 bp, Homo sapiens
cagcccaggagtttgaggctg

SEQ ID NO: 3046393 - DNA, 12 bp, Homo sapiens
cagcccaggcct

SEQ ID NO: 3046394 - DNA, 17 bp, Homo sapiens
cagcccaggcctccagc

SEQ ID NO: 3046395 - DNA, 18 bp, Homo sapiens
cagcccattctctctcct

SEQ ID NO: 3046396 - DNA, 20 bp, Homo sapiens
cagcccattctctctcctgt

SEQ ID NO: 3046397 - DNA, 22 bp, Homo sapiens
cagcccattctctctcctgtcc

SEQ ID NO: 3046398 - DNA, 12 bp, Homo sapiens
cagcccatttct

SEQ ID NO: 3046399 - DNA, 16 bp, Homo sapiens
cagcccatttctccag

SEQ ID NO: 3046400 - DNA, 18 bp, Homo sapiens
cagcccccaccccagcac

SEQ ID NO: 3046401 - DNA, 22 bp, Homo sapiens
cagcccccaccccagcacagct

SEQ ID NO: 3046402 - DNA, 17 bp, Homo sapiens
cagcccccagtgcgctc

SEQ ID NO: 3046403 - DNA, 22 bp, Homo sapiens
cagcccccgcgccctccctccg

SEQ ID NO: 3046404 - DNA, 22 bp, Homo sapiens
cagcccccgggacaccgtgggg

SEQ ID NO: 3046405 - DNA, 14 bp, Homo sapiens
cagccccgctccca

SEQ ID NO: 3046406 - DNA, 15 bp, Homo sapiens
cagccccgctcccac

SEQ ID NO: 3046407 - DNA, 15 bp, Homo sapiens
cagcccctcctctgc

SEQ ID NO: 3046408 - DNA, 12 bp, Homo sapiens
cagcccctgcag

SEQ ID NO: 3046409 - DNA, 23 bp, Homo sapiens
cagccccttaagcatgcttctat

SEQ ID NO: 3046410 - DNA, 23 bp, Homo sapiens
cagcccctttccaaaatttttca

SEQ ID NO: 3046411 - DNA, 22 bp, Homo sapiens
cagcccgagtggtctcctctca

SEQ ID NO: 3046412 - DNA, 14 bp, Homo sapiens
cagcccggacctct

SEQ ID NO: 3046413 - DNA, 18 bp, Homo sapiens
cagccctagggtggagag

SEQ ID NO: 3046414 - DNA, 13 bp, Homo sapiens
cagccctcatccc

SEQ ID NO: 3046415 - DNA, 14 bp, Homo sapiens
cagccctcatcccg

SEQ ID NO: 3046416 - DNA, 20 bp, Homo sapiens
cagccctccctgtcctcctc

SEQ ID NO: 3046417 - DNA, 22 bp, Homo sapiens
cagccctcctcaccccgtctgg

SEQ ID NO: 3046418 - DNA, 11 bp, Homo sapiens
cagccctctgc

SEQ ID NO: 3046419 - DNA, 12 bp, Homo sapiens
cagccctgccag

SEQ ID NO: 3046420 - DNA, 15 bp, Homo sapiens
cagccctgctgcttc

SEQ ID NO: 3046421 - DNA, 21 bp, Homo sapiens
cagccctggcagggggcatgc

SEQ ID NO: 3046422 - DNA, 17 bp, Homo sapiens
cagccctggcccctcca

SEQ ID NO: 3046423 - DNA, 13 bp, Homo sapiens
cagccctgggccc

SEQ ID NO: 3046424 - DNA, 17 bp, Homo sapiens
cagccctgggccccacc

SEQ ID NO: 3046425 - DNA, 22 bp, Homo sapiens
cagccctgggccccaccaccta

SEQ ID NO: 3046426 - DNA, 20 bp, Homo sapiens
cagccgaattgtggtgtctt

SEQ ID NO: 3046427 - DNA, 16 bp, Homo sapiens
cagccgctctcctgcc

SEQ ID NO: 3046428 - DNA, 20 bp, Homo sapiens
cagccgctctcctgccacat

SEQ ID NO: 3046429 - DNA, 14 bp, Homo sapiens
cagccgtcagccat

SEQ ID NO: 3046430 - DNA, 16 bp, Homo sapiens
cagcctcacagatgct

SEQ ID NO: 3046431 - DNA, 23 bp, Homo sapiens
cagcctcacttggtctgccaggc

SEQ ID NO: 3046432 - DNA, 21 bp, Homo sapiens
cagcctcagcggaccactctt

SEQ ID NO: 3046433 - DNA, 14 bp, Homo sapiens
cagcctcccatcca

SEQ ID NO: 3046434 - DNA, 21 bp, Homo sapiens
cagcctccccagtagctggga

SEQ ID NO: 3046435 - DNA, 23 bp, Homo sapiens
cagcctccccctgtcccctctat

SEQ ID NO: 3046436 - DNA, 22 bp, Homo sapiens
cagcctcccctgccagggcagg

SEQ ID NO: 3046437 - DNA, 17 bp, Homo sapiens
cagcctccctgaagcct

SEQ ID NO: 3046438 - DNA, 20 bp, Homo sapiens
cagcctcctgagtagctgga

SEQ ID NO: 3046439 - DNA, 14 bp, Homo sapiens
cagcctcctggggg

SEQ ID NO: 3046440 - DNA, 16 bp, Homo sapiens
cagcctcctgggggat

SEQ ID NO: 3046441 - DNA, 14 bp, Homo sapiens
cagcctcctgtctc

SEQ ID NO: 3046442 - DNA, 16 bp, Homo sapiens
cagcctcgcacaggcc

SEQ ID NO: 3046443 - DNA, 22 bp, Homo sapiens
cagcctcgcacaggccctagct

SEQ ID NO: 3046444 - DNA, 14 bp, Homo sapiens
cagcctctcctcct

SEQ ID NO: 3046445 - DNA, 15 bp, Homo sapiens
cagcctgaataaacc

SEQ ID NO: 3046446 - DNA, 19 bp, Homo sapiens
cagcctgaataaaccaaga

SEQ ID NO: 3046447 - DNA, 21 bp, Homo sapiens
cagcctgagcaactcttgatt

SEQ ID NO: 3046448 - DNA, 15 bp, Homo sapiens
cagcctgagtgacag

SEQ ID NO: 3046449 - DNA, 22 bp, Homo sapiens
cagcctgatcaggcttcctggt

SEQ ID NO: 3046450 - DNA, 14 bp, Homo sapiens
cagcctgcacagtg

SEQ ID NO: 3046451 - DNA, 12 bp, Homo sapiens
cagcctgccact

SEQ ID NO: 3046452 - DNA, 17 bp, Homo sapiens
cagcctgccactcaggc

SEQ ID NO: 3046453 - DNA, 20 bp, Homo sapiens
cagcctgcgctcggcaggaa

SEQ ID NO: 3046454 - DNA, 22 bp, Homo sapiens
cagcctgcgctcggcaggaagg

SEQ ID NO: 3046455 - DNA, 23 bp, Homo sapiens
cagcctgcgctcggcaggaagga

SEQ ID NO: 3046456 - DNA, 13 bp, Homo sapiens
cagcctggcatct

SEQ ID NO: 3046457 - DNA, 15 bp, Homo sapiens
cagcctggcatctgt

SEQ ID NO: 3046458 - DNA, 17 bp, Homo sapiens
cagcctggcatctgtgc

SEQ ID NO: 3046459 - DNA, 14 bp, Homo sapiens
cagcctggccagac

SEQ ID NO: 3046460 - DNA, 20 bp, Homo sapiens
cagcctggccagacacaggc

SEQ ID NO: 3046461 - DNA, 20 bp, Homo sapiens
cagcctgggaggcacagcaa

SEQ ID NO: 3046462 - DNA, 23 bp, Homo sapiens
cagcctggggcaaacctagccgg

SEQ ID NO: 3046463 - DNA, 18 bp, Homo sapiens
cagcctggggctggcctc

SEQ ID NO: 3046464 - DNA, 15 bp, Homo sapiens
cagcctgggtcacag

SEQ ID NO: 3046465 - DNA, 20 bp, Homo sapiens
cagcctgggtcacagagtga

SEQ ID NO: 3046466 - DNA, 20 bp, Homo sapiens
cagcctgtcttgtcaggtgg

SEQ ID NO: 3046467 - DNA, 18 bp, Homo sapiens
cagcctgtggcggtgcct

SEQ ID NO: 3046468 - DNA, 17 bp, Homo sapiens
cagccttagatgcctcg

SEQ ID NO: 3046469 - DNA, 14 bp, Homo sapiens
cagccttgccagag

SEQ ID NO: 3046470 - DNA, 21 bp, Homo sapiens
cagccttggataatgctgttg

SEQ ID NO: 3046471 - DNA, 14 bp, Homo sapiens
cagccttgggcctt

SEQ ID NO: 3046472 - DNA, 15 bp, Homo sapiens
cagccttgggggggc

SEQ ID NO: 3046473 - DNA, 13 bp, Homo sapiens
cagcctttaagat

SEQ ID NO: 3046474 - DNA, 15 bp, Homo sapiens
cagcctttgggtcct

SEQ ID NO: 3046475 - DNA, 20 bp, Homo sapiens
cagcctttgggtcctgggca

SEQ ID NO: 3046476 - DNA, 22 bp, Homo sapiens
cagcctttgggtcctgggcagg

SEQ ID NO: 3046477 - DNA, 14 bp, Homo sapiens
cagccttttccctt

SEQ ID NO: 3046478 - DNA, 19 bp, Homo sapiens
cactttagtgattgctttt

SEQ ID NO: 3046479 - DNA, 21 bp, Homo sapiens
cactttagtgattgcttttat

SEQ ID NO: 3046480 - DNA, 20 bp, Homo sapiens
cactttagtgtattttctgt

SEQ ID NO: 3046481 - DNA, 17 bp, Homo sapiens
cactttattgtagaaaa

SEQ ID NO: 3046482 - DNA, 22 bp, Homo sapiens
cactttattgtagaaaaaccca

SEQ ID NO: 3046483 - DNA, 12 bp, Homo sapiens
cactttcaaaac

SEQ ID NO: 3046484 - DNA, 23 bp, Homo sapiens
cactttcctggataaaaaagaaa

SEQ ID NO: 3046485 - DNA, 11 bp, Homo sapiens
cactttctctt

SEQ ID NO: 3046486 - DNA, 22 bp, Homo sapiens
cactttctcttcttgtttctcc

SEQ ID NO: 3046487 - DNA, 18 bp, Homo sapiens
cactttcttattctgtat

SEQ ID NO: 3046488 - DNA, 17 bp, Homo sapiens
cactttgagcctgggaa

SEQ ID NO: 3046489 - DNA, 13 bp, Homo sapiens
cagcgagagggag

SEQ ID NO: 3046490 - DNA, 22 bp, Homo sapiens
cagcgagccacaggaacggccc

SEQ ID NO: 3046491 - DNA, 18 bp, Homo sapiens
cagcgatggtgctgccca

SEQ ID NO: 3046492 - DNA, 12 bp, Homo sapiens
cagcgccagggc

SEQ ID NO: 3046493 - DNA, 21 bp, Homo sapiens
cagcgcccccaggcctgccct

SEQ ID NO: 3046494 - DNA, 22 bp, Homo sapiens
cagcgcctagtggggtctccct

SEQ ID NO: 3046495 - DNA, 12 bp, Homo sapiens
cagcgcctgtcc

SEQ ID NO: 3046496 - DNA, 20 bp, Homo sapiens
cagcgcctgtcccctcacag

SEQ ID NO: 3046497 - DNA, 14 bp, Homo sapiens
cagcgctctcctgg

SEQ ID NO: 3046498 - DNA, 20 bp, Homo sapiens
cagcgctggccgggaccccg

SEQ ID NO: 3046499 - DNA, 19 bp, Homo sapiens
cagcgctgggtccacccca

SEQ ID NO: 3046500 - DNA, 13 bp, Homo sapiens
cagcggcccaaga

SEQ ID NO: 3046501 - DNA, 17 bp, Homo sapiens
cagcggcccaagagccc

SEQ ID NO: 3046502 - DNA, 18 bp, Homo sapiens
cagcggctggacttggag

SEQ ID NO: 3046503 - DNA, 16 bp, Homo sapiens
cagcgggaatggcagc

SEQ ID NO: 3046504 - DNA, 18 bp, Homo sapiens
cagcgggggccttgaaga

SEQ ID NO: 3046505 - DNA, 18 bp, Homo sapiens
cagcggtccatgggtctg

SEQ ID NO: 3046506 - DNA, 16 bp, Homo sapiens
cagcggtgggaaggaa

SEQ ID NO: 3046507 - DNA, 18 bp, Homo sapiens
cagcggtgtggaccgagg

SEQ ID NO: 3046508 - DNA, 16 bp, Homo sapiens
cagcgtcctcctctgt

SEQ ID NO: 3046509 - DNA, 18 bp, Homo sapiens
cagcgtcctcctctgtga

SEQ ID NO: 3046510 - DNA, 22 bp, Homo sapiens
cagcgtgctggcgacactcagg

SEQ ID NO: 3046511 - DNA, 13 bp, Homo sapiens
cagctaagaacct

SEQ ID NO: 3046512 - DNA, 16 bp, Homo sapiens
cagctaagaacctgga

SEQ ID NO: 3046513 - DNA, 21 bp, Homo sapiens
cagctaatttttgtattttta

SEQ ID NO: 3046514 - DNA, 13 bp, Homo sapiens
cagctacaacagc

SEQ ID NO: 3046515 - DNA, 17 bp, Homo sapiens
cagctacaacagcctca

SEQ ID NO: 3046516 - DNA, 16 bp, Homo sapiens
cagctacacagagctt

SEQ ID NO: 3046517 - DNA, 18 bp, Homo sapiens
cagctactcaggaggctg

SEQ ID NO: 3046518 - DNA, 23 bp, Homo sapiens
cagctactctccccacgagggct

SEQ ID NO: 3046519 - DNA, 19 bp, Homo sapiens
cagctactggggaggctga

SEQ ID NO: 3046520 - DNA, 20 bp, Homo sapiens
cagctacttagctggccaag

SEQ ID NO: 3046521 - DNA, 17 bp, Homo sapiens
cagctacttgggagcct

SEQ ID NO: 3046522 - DNA, 18 bp, Homo sapiens
cagctacttgggagcctg

SEQ ID NO: 3046523 - DNA, 22 bp, Homo sapiens
cagctagaaaacacaaaatctt

SEQ ID NO: 3046524 - DNA, 17 bp, Homo sapiens
cagctatacctgtgcct

SEQ ID NO: 3046525 - DNA, 23 bp, Homo sapiens
cagctatctggtcaacctcctgg

SEQ ID NO: 3046526 - DNA, 20 bp, Homo sapiens
cagctatgttatattgaaaa

SEQ ID NO: 3046527 - DNA, 19 bp, Homo sapiens
cagctcaaaggcacagtga

SEQ ID NO: 3046528 - DNA, 22 bp, Homo sapiens
cagctcaagagatcccaagtag

SEQ ID NO: 3046529 - DNA, 23 bp, Homo sapiens
cagctcacaccctaccttcccca

SEQ ID NO: 3046530 - DNA, 24 bp, Homo sapiens
cagctcacaccctaccttccccag

SEQ ID NO: 3046531 - DNA, 16 bp, Homo sapiens
cagctcaggacagatg

SEQ ID NO: 3046532 - DNA, 19 bp, Homo sapiens
cagctcaggggacactggc

SEQ ID NO: 3046533 - DNA, 23 bp, Homo sapiens
cagctcatagtgaacacagcaga

SEQ ID NO: 3046534 - DNA, 16 bp, Homo sapiens
cagctcattcatttta

SEQ ID NO: 3046535 - DNA, 23 bp, Homo sapiens
cagctccaacctgcaaagatctg

SEQ ID NO: 3046536 - DNA, 13 bp, Homo sapiens
cagctccaccctg

SEQ ID NO: 3046537 - DNA, 14 bp, Homo sapiens
cagctccaggccca

SEQ ID NO: 3046538 - DNA, 15 bp, Homo sapiens
cagctccaggcccac

SEQ ID NO: 3046539 - DNA, 17 bp, Homo sapiens
cagctccaggcccaccg

SEQ ID NO: 3046540 - DNA, 15 bp, Homo sapiens
cagctcccaccccac

SEQ ID NO: 3046541 - DNA, 19 bp, Homo sapiens
cagctcccaccccaccccc

SEQ ID NO: 3046542 - DNA, 20 bp, Homo sapiens
cagctcccaccccaccccct

SEQ ID NO: 3046543 - DNA, 13 bp, Homo sapiens
cagctcccaggcc

SEQ ID NO: 3046544 - DNA, 13 bp, Homo sapiens
cagctcctcagcg

SEQ ID NO: 3046545 - DNA, 13 bp, Homo sapiens
cagctcctcccct

SEQ ID NO: 3046546 - DNA, 14 bp, Homo sapiens
cagctcctcccctg

SEQ ID NO: 3046547 - DNA, 18 bp, Homo sapiens
cagctcctcccctgccgc

SEQ ID NO: 3046548 - DNA, 22 bp, Homo sapiens
cagctcctcccctgccgcctcc

SEQ ID NO: 3046549 - DNA, 16 bp, Homo sapiens
cagctccttcctggag

SEQ ID NO: 3046550 - DNA, 12 bp, Homo sapiens
cagctccttttc

SEQ ID NO: 3046551 - DNA, 13 bp, Homo sapiens
cagctcggggagc

SEQ ID NO: 3046552 - DNA, 19 bp, Homo sapiens
cagctctaaaacatagact

SEQ ID NO: 3046553 - DNA, 17 bp, Homo sapiens
cagctctaagcagccag

SEQ ID NO: 3046554 - DNA, 18 bp, Homo sapiens
cagctctaagcagccagg

SEQ ID NO: 3046555 - DNA, 17 bp, Homo sapiens
cagctctcatctgaggc

SEQ ID NO: 3046556 - DNA, 12 bp, Homo sapiens
cagctctcccct

SEQ ID NO: 3046557 - DNA, 17 bp, Homo sapiens
cagctctccctctggcc

SEQ ID NO: 3046558 - DNA, 18 bp, Homo sapiens
cagctctccctctggccc

SEQ ID NO: 3046559 - DNA, 12 bp, Homo sapiens
cagctctgcctt

SEQ ID NO: 3046560 - DNA, 13 bp, Homo sapiens
cagctctgccttc

SEQ ID NO: 3046561 - DNA, 17 bp, Homo sapiens
cagctctggacagcccc

SEQ ID NO: 3046562 - DNA, 12 bp, Homo sapiens
cagctctgggcc

SEQ ID NO: 3046563 - DNA, 20 bp, Homo sapiens
cagctctgtcaccctggcca

SEQ ID NO: 3046564 - DNA, 23 bp, Homo sapiens
cagctctgtcaccctggccacca

SEQ ID NO: 3046565 - DNA, 19 bp, Homo sapiens
cagctctgtcctgttaggc

SEQ ID NO: 3046566 - DNA, 19 bp, Homo sapiens
cagctctgtctgctcaatg

SEQ ID NO: 3046567 - DNA, 12 bp, Homo sapiens
cagctcttctgg

SEQ ID NO: 3046568 - DNA, 17 bp, Homo sapiens
cagctcttctgggcaga

SEQ ID NO: 3046569 - DNA, 23 bp, Homo sapiens
cagctcttctgggcagagcctgt

SEQ ID NO: 3046570 - DNA, 16 bp, Homo sapiens
cagctcttgctctctt

SEQ ID NO: 3046571 - DNA, 18 bp, Homo sapiens
cagctcttggctccactg

SEQ ID NO: 3046572 - DNA, 15 bp, Homo sapiens
cagctcttgtttgga

SEQ ID NO: 3046573 - DNA, 21 bp, Homo sapiens
cagctgaaatatgctggctgg

SEQ ID NO: 3046574 - DNA, 18 bp, Homo sapiens
cagctgaccccctccccc

SEQ ID NO: 3046575 - DNA, 11 bp, Homo sapiens
cagctgcaaag

SEQ ID NO: 3046576 - DNA, 12 bp, Homo sapiens
cagctgcaaagt

SEQ ID NO: 3046577 - DNA, 16 bp, Homo sapiens
cagctgcaaagtgttt

SEQ ID NO: 3046578 - DNA, 16 bp, Homo sapiens
cagctgcccctcctgg

SEQ ID NO: 3046579 - DNA, 20 bp, Homo sapiens
cagctgcccctcctggagca

SEQ ID NO: 3046580 - DNA, 22 bp, Homo sapiens
cagctgcccctcctggagcaga

SEQ ID NO: 3046581 - DNA, 15 bp, Homo sapiens
cagctgcccttccgc

SEQ ID NO: 3046582 - DNA, 21 bp, Homo sapiens
cagctgcccttccgcagtgtg

SEQ ID NO: 3046583 - DNA, 13 bp, Homo sapiens
cagctgcctggcc

SEQ ID NO: 3046584 - DNA, 15 bp, Homo sapiens
cagctgcctggccat

SEQ ID NO: 3046585 - DNA, 15 bp, Homo sapiens
cagctgccttagctt

SEQ ID NO: 3046586 - DNA, 19 bp, Homo sapiens
cagctgccttagcttcagg

SEQ ID NO: 3046587 - DNA, 21 bp, Homo sapiens
cagctgccttagcttcaggaa

SEQ ID NO: 3046588 - DNA, 15 bp, Homo sapiens
cagctgcgttctgag

SEQ ID NO: 3046589 - DNA, 14 bp, Homo sapiens
cagctgctcagagc

SEQ ID NO: 3046590 - DNA, 17 bp, Homo sapiens
caggctgatttctaggt

SEQ ID NO: 3046591 - DNA, 20 bp, Homo sapiens
caggctgcaggagggcactg

SEQ ID NO: 3046592 - DNA, 21 bp, Homo sapiens
caggctgcaggagggcactgg

SEQ ID NO: 3046593 - DNA, 17 bp, Homo sapiens
caggctggaatgaggga

SEQ ID NO: 3046594 - DNA, 12 bp, Homo sapiens
caggctggccag

SEQ ID NO: 3046595 - DNA, 17 bp, Homo sapiens
caggctggctccagatg

SEQ ID NO: 3046596 - DNA, 18 bp, Homo sapiens
caggctggctccagatgc

SEQ ID NO: 3046597 - DNA, 12 bp, Homo sapiens
caggctgggaac

SEQ ID NO: 3046598 - DNA, 18 bp, Homo sapiens
caggctgggaactcatct

SEQ ID NO: 3046599 - DNA, 16 bp, Homo sapiens
caggctgggctgagcc

SEQ ID NO: 3046600 - DNA, 21 bp, Homo sapiens
caggctgggctgagccaaagc

SEQ ID NO: 3046601 - DNA, 18 bp, Homo sapiens
caggctgggtgacagagc

SEQ ID NO: 3046602 - DNA, 16 bp, Homo sapiens
caggctggtctaaaac

SEQ ID NO: 3046603 - DNA, 20 bp, Homo sapiens
caggctggtctcaaactcct

SEQ ID NO: 3046604 - DNA, 24 bp, Homo sapiens
caggctggtcttgaactgggctca

SEQ ID NO: 3046605 - DNA, 21 bp, Homo sapiens
caggctggtcttgaagtcctg

SEQ ID NO: 3046606 - DNA, 18 bp, Homo sapiens
caggctgtctcatttatt

SEQ ID NO: 3046607 - DNA, 16 bp, Homo sapiens
caggctgtctggccag

SEQ ID NO: 3046608 - DNA, 16 bp, Homo sapiens
caggcttaataaaaat

SEQ ID NO: 3046609 - DNA, 15 bp, Homo sapiens
caggcttcctggtga

SEQ ID NO: 3046610 - DNA, 22 bp, Homo sapiens
caggcttcctggtgagaactga

SEQ ID NO: 3046611 - DNA, 15 bp, Homo sapiens
caggcttctcccgga

SEQ ID NO: 3046612 - DNA, 18 bp, Homo sapiens
caggcttgcctgggctgg

SEQ ID NO: 3046613 - DNA, 18 bp, Homo sapiens
caggcttggatggaacat

SEQ ID NO: 3046614 - DNA, 15 bp, Homo sapiens
cagggaaaataggca

SEQ ID NO: 3046615 - DNA, 18 bp, Homo sapiens
cagggaaaataggcagga

SEQ ID NO: 3046616 - DNA, 15 bp, Homo sapiens
cagggaaattaatca

SEQ ID NO: 3046617 - DNA, 15 bp, Homo sapiens
cagggaagccccaca

SEQ ID NO: 3046618 - DNA, 17 bp, Homo sapiens
cagggaagccccacatg

SEQ ID NO: 3046619 - DNA, 22 bp, Homo sapiens
cagggaagccccacatgtccag

SEQ ID NO: 3046620 - DNA, 23 bp, Homo sapiens
cagggaagccccacatgtccagc

SEQ ID NO: 3046621 - DNA, 18 bp, Homo sapiens
cagggaaggatcccatga

SEQ ID NO: 3046622 - DNA, 21 bp, Homo sapiens
cagggaagggactgggagggg

SEQ ID NO: 3046623 - DNA, 23 bp, Homo sapiens
cagggaagtccccaggccccagg

SEQ ID NO: 3046624 - DNA, 15 bp, Homo sapiens
cagggaagtggggag

SEQ ID NO: 3046625 - DNA, 21 bp, Homo sapiens
cagggaagtggggagaggtgg

SEQ ID NO: 3046626 - DNA, 13 bp, Homo sapiens
cagggacaaagaa

SEQ ID NO: 3046627 - DNA, 17 bp, Homo sapiens
cagggacagagacacct

SEQ ID NO: 3046628 - DNA, 21 bp, Homo sapiens
cagggacagagacacctgcac

SEQ ID NO: 3046629 - DNA, 23 bp, Homo sapiens
cagggacagagacacctgcacct

SEQ ID NO: 3046630 - DNA, 14 bp, Homo sapiens
cagggacagaggcc

SEQ ID NO: 3046631 - DNA, 21 bp, Homo sapiens
cagggacccggggtctcctgg

SEQ ID NO: 3046632 - DNA, 23 bp, Homo sapiens
cagggacccggggtctcctggac

SEQ ID NO: 3046633 - DNA, 19 bp, Homo sapiens
cagggacgaagaagagcca

SEQ ID NO: 3046634 - DNA, 19 bp, Homo sapiens
cagggactcggcccagggc

SEQ ID NO: 3046635 - DNA, 20 bp, Homo sapiens
cagggactcggcccagggcc

SEQ ID NO: 3046636 - DNA, 20 bp, Homo sapiens
cagggactgaaaacctctcc

SEQ ID NO: 3046637 - DNA, 15 bp, Homo sapiens
cagggacttctgcgg

SEQ ID NO: 3046638 - DNA, 19 bp, Homo sapiens
cagggagacccgtccattt

SEQ ID NO: 3046639 - DNA, 20 bp, Homo sapiens
cagggagacctggacacagg

SEQ ID NO: 3046640 - DNA, 21 bp, Homo sapiens
cagggagacggtttccaggga

SEQ ID NO: 3046641 - DNA, 17 bp, Homo sapiens
cagggagaggctgtgtc

SEQ ID NO: 3046642 - DNA, 19 bp, Homo sapiens
cagggagaggctgtgtccc

SEQ ID NO: 3046643 - DNA, 21 bp, Homo sapiens
cagggagcaccacggccagaa

SEQ ID NO: 3046644 - DNA, 22 bp, Homo sapiens
cagggagcctttggttctggcc

SEQ ID NO: 3046645 - DNA, 16 bp, Homo sapiens
cagggagcggaaagca

SEQ ID NO: 3046646 - DNA, 22 bp, Homo sapiens
cagggagcggaaagcagctcaa

SEQ ID NO: 3046647 - DNA, 23 bp, Homo sapiens
cagggagcggccggccagcccct

SEQ ID NO: 3046648 - DNA, 14 bp, Homo sapiens
cagggaggcagagc

SEQ ID NO: 3046649 - DNA, 20 bp, Homo sapiens
cagggaggcagagcgggagg

SEQ ID NO: 3046650 - DNA, 18 bp, Homo sapiens
cagggagggccagggagg

SEQ ID NO: 3046651 - DNA, 12 bp, Homo sapiens
cagggaggggcc

SEQ ID NO: 3046652 - DNA, 20 bp, Homo sapiens
cagggaggggccggctggcc

SEQ ID NO: 3046653 - DNA, 23 bp, Homo sapiens
cagggagggtgagctggtgcctg

SEQ ID NO: 3046654 - DNA, 16 bp, Homo sapiens
cagggatgccctggag

SEQ ID NO: 3046655 - DNA, 21 bp, Homo sapiens
cagggatgccctggaggtggc

SEQ ID NO: 3046656 - DNA, 19 bp, Homo sapiens
cagggatgggcagcccaac

SEQ ID NO: 3046657 - DNA, 16 bp, Homo sapiens
cagggatggtgttcaa

SEQ ID NO: 3046658 - DNA, 16 bp, Homo sapiens
cagggattgctgccac

SEQ ID NO: 3046659 - DNA, 22 bp, Homo sapiens
cagggcaaaatcgccataggcc

SEQ ID NO: 3046660 - DNA, 19 bp, Homo sapiens
cagggcacagatgaccaaa

SEQ ID NO: 3046661 - DNA, 15 bp, Homo sapiens
cagggcacctgccac

SEQ ID NO: 3046662 - DNA, 19 bp, Homo sapiens
cagggcagagtgagaccca

SEQ ID NO: 3046663 - DNA, 15 bp, Homo sapiens
caggggtgacacaga

SEQ ID NO: 3046664 - DNA, 16 bp, Homo sapiens
caggggtgacacagac

SEQ ID NO: 3046665 - DNA, 19 bp, Homo sapiens
caggggtgacacagactca

SEQ ID NO: 3046666 - DNA, 14 bp, Homo sapiens
caggggtgagagca

SEQ ID NO: 3046667 - DNA, 21 bp, Homo sapiens
caggggtgcacagtccacagc

SEQ ID NO: 3046668 - DNA, 18 bp, Homo sapiens
cagggtagagcaaaggag

SEQ ID NO: 3046669 - DNA, 13 bp, Homo sapiens
cagggtagcaggt

SEQ ID NO: 3046670 - DNA, 19 bp, Homo sapiens
cagggtattgcttgccact

SEQ ID NO: 3046671 - DNA, 13 bp, Homo sapiens
cagggtcccctgc

SEQ ID NO: 3046672 - DNA, 20 bp, Homo sapiens
cagggtctaaggagcgctag

SEQ ID NO: 3046673 - DNA, 19 bp, Homo sapiens
cagggtctagccgctgccc

SEQ ID NO: 3046674 - DNA, 17 bp, Homo sapiens
cagggtctctgctccag

SEQ ID NO: 3046675 - DNA, 18 bp, Homo sapiens
cagggtctctgctccagc

SEQ ID NO: 3046676 - DNA, 15 bp, Homo sapiens
cagggtcttttcatc

SEQ ID NO: 3046677 - DNA, 23 bp, Homo sapiens
cagggtcttttcatctgggaaag

SEQ ID NO: 3046678 - DNA, 15 bp, Homo sapiens
cagggtgatgccagg

SEQ ID NO: 3046679 - DNA, 16 bp, Homo sapiens
cagggtgatgccaggt

SEQ ID NO: 3046680 - DNA, 22 bp, Homo sapiens
cagggtgcagtgtgagtgtgat

SEQ ID NO: 3046681 - DNA, 14 bp, Homo sapiens
cagggtggagctga

SEQ ID NO: 3046682 - DNA, 22 bp, Homo sapiens
cagggtggagctgagaagagga

SEQ ID NO: 3046683 - DNA, 20 bp, Homo sapiens
cagggtggagtgcagtggtg

SEQ ID NO: 3046684 - DNA, 17 bp, Homo sapiens
cagggtgggagccggga

SEQ ID NO: 3046685 - DNA, 20 bp, Homo sapiens
cagggtgggcctcggcccct

SEQ ID NO: 3046686 - DNA, 21 bp, Homo sapiens
cagggtggtggtattctgtca

SEQ ID NO: 3046687 - DNA, 19 bp, Homo sapiens
cagggttgaccccagagga

SEQ ID NO: 3046688 - DNA, 16 bp, Homo sapiens
cagggtttgagcacaa

SEQ ID NO: 3046689 - DNA, 13 bp, Homo sapiens
caggtaatgtgaa

SEQ ID NO: 3046690 - DNA, 15 bp, Homo sapiens
caggtacgcacagac

SEQ ID NO: 3046691 - DNA, 18 bp, Homo sapiens
caggtacgcacagacagg

SEQ ID NO: 3046692 - DNA, 21 bp, Homo sapiens
caggtagcagcaaatagcaaa

SEQ ID NO: 3046693 - DNA, 22 bp, Homo sapiens
caggtagtactaagagtatgtg

SEQ ID NO: 3046694 - DNA, 14 bp, Homo sapiens
caggtatgttgcct

SEQ ID NO: 3046695 - DNA, 12 bp, Homo sapiens
caggtcaacaga

SEQ ID NO: 3046696 - DNA, 23 bp, Homo sapiens
caggtcaacagaatgaaaaatga

SEQ ID NO: 3046697 - DNA, 18 bp, Homo sapiens
caggtcaactctgaagag

SEQ ID NO: 3046698 - DNA, 18 bp, Homo sapiens
caggtcaggggtgacaca

SEQ ID NO: 3046699 - DNA, 21 bp, Homo sapiens
caggtcaggggtgacacagac

SEQ ID NO: 3046700 - DNA, 23 bp, Homo sapiens
caggtcaggggtgacacagactc

SEQ ID NO: 3046701 - DNA, 22 bp, Homo sapiens
caggtccacggtctgttcttga

SEQ ID NO: 3046702 - DNA, 18 bp, Homo sapiens
caggtccagctttactgt

SEQ ID NO: 3046703 - DNA, 22 bp, Homo sapiens
caggtccagctttactgtggct

SEQ ID NO: 3046704 - DNA, 13 bp, Homo sapiens
caggtccattctg

SEQ ID NO: 3046705 - DNA, 14 bp, Homo sapiens
caggtccattctgt

SEQ ID NO: 3046706 - DNA, 18 bp, Homo sapiens
caggtccccagctttggc

SEQ ID NO: 3046707 - DNA, 18 bp, Homo sapiens
caggtcccccgactgcct

SEQ ID NO: 3046708 - DNA, 19 bp, Homo sapiens
caggtcccccgactgcctg

SEQ ID NO: 3046709 - DNA, 23 bp, Homo sapiens
caggtcccccgactgcctgtctc

SEQ ID NO: 3046710 - DNA, 14 bp, Homo sapiens
caggtccccctgca

SEQ ID NO: 3046711 - DNA, 17 bp, Homo sapiens
caggtccccctgcagct

SEQ ID NO: 3046712 - DNA, 20 bp, Homo sapiens
caggtcctagtcgggcaggg

SEQ ID NO: 3046713 - DNA, 19 bp, Homo sapiens
caggtcctgctccgctgcc

SEQ ID NO: 3046714 - DNA, 20 bp, Homo sapiens
caggtcctgctccgctgcct

SEQ ID NO: 3046715 - DNA, 14 bp, Homo sapiens
caggtctgcaaggg

SEQ ID NO: 3046716 - DNA, 16 bp, Homo sapiens
caggtctgcaagggcc

SEQ ID NO: 3046717 - DNA, 21 bp, Homo sapiens
caggtctgcaagggcccagag

SEQ ID NO: 3046718 - DNA, 22 bp, Homo sapiens
caggtctgcaagggcccagagt

SEQ ID NO: 3046719 - DNA, 14 bp, Homo sapiens
caggtctttcctaa

SEQ ID NO: 3046720 - DNA, 19 bp, Homo sapiens
caggtctttcctaaggctg

SEQ ID NO: 3046721 - DNA, 21 bp, Homo sapiens
caggtctttcctaaggctgca

SEQ ID NO: 3046722 - DNA, 17 bp, Homo sapiens
caggtgagcagacagga

SEQ ID NO: 3046723 - DNA, 22 bp, Homo sapiens
caggtgagtcctagagctacag

SEQ ID NO: 3046724 - DNA, 23 bp, Homo sapiens
caggtgagtcctagagctacagg

SEQ ID NO: 3046725 - DNA, 21 bp, Homo sapiens
caggtgagtgtgagggcagca

SEQ ID NO: 3046726 - DNA, 20 bp, Homo sapiens
caggtgcacacatcaccagg

SEQ ID NO: 3046727 - DNA, 14 bp, Homo sapiens
caggtgcagaggaa

SEQ ID NO: 3046728 - DNA, 14 bp, Homo sapiens
cagtggacgtgctg

SEQ ID NO: 3046729 - DNA, 14 bp, Homo sapiens
cagtggagagggct

SEQ ID NO: 3046730 - DNA, 12 bp, Homo sapiens
cagtggatggat

SEQ ID NO: 3046731 - DNA, 19 bp, Homo sapiens
cagtggatggattcatcat

SEQ ID NO: 3046732 - DNA, 22 bp, Homo sapiens
cagtggccacgttcagggaggg

SEQ ID NO: 3046733 - DNA, 23 bp, Homo sapiens
cagtggccacgttcagggagggg

SEQ ID NO: 3046734 - DNA, 13 bp, Homo sapiens
cagtggcctggcc

SEQ ID NO: 3046735 - DNA, 14 bp, Homo sapiens
cagtggcctggccg

SEQ ID NO: 3046736 - DNA, 18 bp, Homo sapiens
cagtggccttacccctgc

SEQ ID NO: 3046737 - DNA, 21 bp, Homo sapiens
cagtggccttacccctgcctt

SEQ ID NO: 3046738 - DNA, 17 bp, Homo sapiens
cagtggctcacgcctgt

SEQ ID NO: 3046739 - DNA, 18 bp, Homo sapiens
cagtggcttagctgccat

SEQ ID NO: 3046740 - DNA, 20 bp, Homo sapiens
cagtgggaacgtgactgccc

SEQ ID NO: 3046741 - DNA, 22 bp, Homo sapiens
cagtgggattatcgagcatgtt

SEQ ID NO: 3046742 - DNA, 18 bp, Homo sapiens
cagtgggatttggtaatg

SEQ ID NO: 3046743 - DNA, 14 bp, Homo sapiens
cagtgggcaggtgg

SEQ ID NO: 3046744 - DNA, 16 bp, Homo sapiens
cagtgggcatgtatta

SEQ ID NO: 3046745 - DNA, 14 bp, Homo sapiens
cagtgggcctggcc

SEQ ID NO: 3046746 - DNA, 11 bp, Homo sapiens
cagtgggctgt

SEQ ID NO: 3046747 - DNA, 21 bp, Homo sapiens
cagtggggtcaagctgagctg

SEQ ID NO: 3046748 - DNA, 23 bp, Homo sapiens
cagtggggtcaagctgagctggc

SEQ ID NO: 3046749 - DNA, 20 bp, Homo sapiens
cagtggggtttcgcagcctg

SEQ ID NO: 3046750 - DNA, 21 bp, Homo sapiens
cagtggggtttcgcagcctga

SEQ ID NO: 3046751 - DNA, 16 bp, Homo sapiens
cagtgggtaaaattag

SEQ ID NO: 3046752 - DNA, 15 bp, Homo sapiens
cagtggtgccatcat

SEQ ID NO: 3046753 - DNA, 14 bp, Homo sapiens
cagtggtggcaggg

SEQ ID NO: 3046754 - DNA, 19 bp, Homo sapiens
cagtggtggcagggcctag

SEQ ID NO: 3046755 - DNA, 20 bp, Homo sapiens
cagtggtgtgatcccagctc

SEQ ID NO: 3046756 - DNA, 11 bp, Homo sapiens
cagtggttaag

SEQ ID NO: 3046757 - DNA, 14 bp, Homo sapiens
cagtggttatttag

SEQ ID NO: 3046758 - DNA, 19 bp, Homo sapiens
cagtgtaaatagttactcc

SEQ ID NO: 3046759 - DNA, 17 bp, Homo sapiens
cagtgtaatttctttgc

SEQ ID NO: 3046760 - DNA, 15 bp, Homo sapiens
cagtgtacatgtaca

SEQ ID NO: 3046761 - DNA, 21 bp, Homo sapiens
cagtgtacatgtacatagtaa

SEQ ID NO: 3046762 - DNA, 15 bp, Homo sapiens
cagtgtatttcagtt

SEQ ID NO: 3046763 - DNA, 12 bp, Homo sapiens
cagtgtattttg

SEQ ID NO: 3046764 - DNA, 17 bp, Homo sapiens
cagtgtcacatgaggaa

SEQ ID NO: 3046765 - DNA, 14 bp, Homo sapiens
cagtgtccatgttg

SEQ ID NO: 3046766 - DNA, 23 bp, Homo sapiens
cagtgtcttaaggagactggtag

SEQ ID NO: 3046767 - DNA, 14 bp, Homo sapiens
cagtgtgaagttag

SEQ ID NO: 3046768 - DNA, 18 bp, Homo sapiens
cagtgtgaggccagggca

SEQ ID NO: 3046769 - DNA, 15 bp, Homo sapiens
cagtgtgcactaagg

SEQ ID NO: 3046770 - DNA, 14 bp, Homo sapiens
cagtgtgcccatct

SEQ ID NO: 3046771 - DNA, 16 bp, Homo sapiens
cagtgtggccaggctg

SEQ ID NO: 3046772 - DNA, 20 bp, Homo sapiens
cagtgtgggcgctctcccta

SEQ ID NO: 3046773 - DNA, 18 bp, Homo sapiens
cagtgtgtccatcatatt

SEQ ID NO: 3046774 - DNA, 23 bp, Homo sapiens
cagtgttcagccaaacagtatga

SEQ ID NO: 3046775 - DNA, 22 bp, Homo sapiens
cagtgttccaagtctctgtgta

SEQ ID NO: 3046776 - DNA, 14 bp, Homo sapiens
cagtgttgtctcat

SEQ ID NO: 3046777 - DNA, 14 bp, Homo sapiens
cagtgtttctgaat

SEQ ID NO: 3046778 - DNA, 11 bp, Homo sapiens
cataaattatg

SEQ ID NO: 3046779 - DNA, 15 bp, Homo sapiens
cataaatttaatgta

SEQ ID NO: 3046780 - DNA, 16 bp, Homo sapiens
cataacaattcctcta

SEQ ID NO: 3046781 - DNA, 17 bp, Homo sapiens
cataacaattcctctac

SEQ ID NO: 3046782 - DNA, 21 bp, Homo sapiens
cataacagagtagttttggtt

SEQ ID NO: 3046783 - DNA, 16 bp, Homo sapiens
cataacagattatgta

SEQ ID NO: 3046784 - DNA, 19 bp, Homo sapiens
cataacagattatgtatta

SEQ ID NO: 3046785 - DNA, 18 bp, Homo sapiens
cataactaatgaattgaa

SEQ ID NO: 3046786 - DNA, 23 bp, Homo sapiens
cataacttcctgtacttgaagtc

SEQ ID NO: 3046787 - DNA, 12 bp, Homo sapiens
cataagaccaat

SEQ ID NO: 3046788 - DNA, 18 bp, Homo sapiens
cataagactttgggatag

SEQ ID NO: 3046789 - DNA, 19 bp, Homo sapiens
cataagagaaagaggccag

SEQ ID NO: 3046790 - DNA, 22 bp, Homo sapiens
cataagagaaagaggccagaca

SEQ ID NO: 3046791 - DNA, 22 bp, Homo sapiens
cataagataaaatgatgttata

SEQ ID NO: 3046792 - DNA, 15 bp, Homo sapiens
cataagtatttcaaa

SEQ ID NO: 3046793 - DNA, 21 bp, Homo sapiens
cataagtttaactttaaaact

SEQ ID NO: 3046794 - DNA, 18 bp, Homo sapiens
cataataaatatctgtac

SEQ ID NO: 3046795 - DNA, 15 bp, Homo sapiens
cataatagaatttcc

SEQ ID NO: 3046796 - DNA, 17 bp, Homo sapiens
cataatagaatttccta

SEQ ID NO: 3046797 - DNA, 17 bp, Homo sapiens
cataatccagtaaaata

SEQ ID NO: 3046798 - DNA, 18 bp, Homo sapiens
cataatctgtacaatgaa

SEQ ID NO: 3046799 - DNA, 12 bp, Homo sapiens
cataatgcagaa

SEQ ID NO: 3046800 - DNA, 13 bp, Homo sapiens
cataatgcagaag

SEQ ID NO: 3046801 - DNA, 20 bp, Homo sapiens
cataatgcagaagtattctt

SEQ ID NO: 3046802 - DNA, 22 bp, Homo sapiens
cataatgggccactgaaatctg

SEQ ID NO: 3046803 - DNA, 11 bp, Homo sapiens
cataatgtgaa

SEQ ID NO: 3046804 - DNA, 16 bp, Homo sapiens
cataatgtgaagtgtt

SEQ ID NO: 3046805 - DNA, 23 bp, Homo sapiens
cataattccgaaacaaaactgtg

SEQ ID NO: 3046806 - DNA, 14 bp, Homo sapiens
cataattgattaaa

SEQ ID NO: 3046807 - DNA, 18 bp, Homo sapiens
cataattgattaaaatct

SEQ ID NO: 3046808 - DNA, 14 bp, Homo sapiens
cataattgtgacca

SEQ ID NO: 3046809 - DNA, 23 bp, Homo sapiens
cataattgttgtggtttaaatac

SEQ ID NO: 3046810 - DNA, 16 bp, Homo sapiens
cataatttgtttaaaa

SEQ ID NO: 3046811 - DNA, 23 bp, Homo sapiens
cataatttgtttaaaattctctt

SEQ ID NO: 3046812 - DNA, 14 bp, Homo sapiens
cataattttatcta

SEQ ID NO: 3046813 - DNA, 16 bp, Homo sapiens
catacaagcaacagca

SEQ ID NO: 3046814 - DNA, 12 bp, Homo sapiens
catacacacaca

SEQ ID NO: 3046815 - DNA, 22 bp, Homo sapiens
catacacacacacacacagcca

SEQ ID NO: 3046816 - DNA, 18 bp, Homo sapiens
catacaccagcattcctt

SEQ ID NO: 3046817 - DNA, 20 bp, Homo sapiens
catacaccagcattcctttt

SEQ ID NO: 3046818 - DNA, 18 bp, Homo sapiens
catacagagattgtagta

SEQ ID NO: 3046819 - DNA, 14 bp, Homo sapiens
catacataaactgt

SEQ ID NO: 3046820 - DNA, 15 bp, Homo sapiens
cattggtccaccctt

SEQ ID NO: 3046821 - DNA, 21 bp, Homo sapiens
cattgtaaaccacaaggctgt

SEQ ID NO: 3046822 - DNA, 17 bp, Homo sapiens
cattgtaaataaatttt

SEQ ID NO: 3046823 - DNA, 22 bp, Homo sapiens
cattgtaacctcgtgtctagta

SEQ ID NO: 3046824 - DNA, 14 bp, Homo sapiens
cattgtaattatgt

SEQ ID NO: 3046825 - DNA, 22 bp, Homo sapiens
cattgtaattatgtaaataact

SEQ ID NO: 3046826 - DNA, 23 bp, Homo sapiens
cattgtaattatgtaaataactc

SEQ ID NO: 3046827 - DNA, 15 bp, Homo sapiens
cattgtactccagcc

SEQ ID NO: 3046828 - DNA, 17 bp, Homo sapiens
cattgtatcgatgttat

SEQ ID NO: 3046829 - DNA, 19 bp, Homo sapiens
cattgtccaatcctatgtt

SEQ ID NO: 3046830 - DNA, 15 bp, Homo sapiens
cattgtccctctgcc

SEQ ID NO: 3046831 - DNA, 18 bp, Homo sapiens
cattgtccctctgcccca

SEQ ID NO: 3046832 - DNA, 21 bp, Homo sapiens
cattgtccctctgccccatcc

SEQ ID NO: 3046833 - DNA, 18 bp, Homo sapiens
cattgtcgtttcattcat

SEQ ID NO: 3046834 - DNA, 19 bp, Homo sapiens
cattgtgagtaaatcagat

SEQ ID NO: 3046835 - DNA, 22 bp, Homo sapiens
cattgtgccatgtcaaacaaat

SEQ ID NO: 3046836 - DNA, 15 bp, Homo sapiens
cattgttcaaaagga

SEQ ID NO: 3046837 - DNA, 17 bp, Homo sapiens
cattgttcacctttgta

SEQ ID NO: 3046838 - DNA, 18 bp, Homo sapiens
cattgttcacctttgtag

SEQ ID NO: 3046839 - DNA, 17 bp, Homo sapiens
cattgttcaggtgaata

SEQ ID NO: 3046840 - DNA, 13 bp, Homo sapiens
cattgttgagcta

SEQ ID NO: 3046841 - DNA, 20 bp, Homo sapiens
cattgttgagctattgctgt

SEQ ID NO: 3046842 - DNA, 21 bp, Homo sapiens
cattgtttctgtgggcgggcc

SEQ ID NO: 3046843 - DNA, 19 bp, Homo sapiens
cattgtttgaaacaaagaa

SEQ ID NO: 3046844 - DNA, 22 bp, Homo sapiens
cattgtttgaaacaaagaaggt

SEQ ID NO: 3046845 - DNA, 19 bp, Homo sapiens
cattgtttggatttccttt

SEQ ID NO: 3046846 - DNA, 13 bp, Homo sapiens
cattgttttaaaa

SEQ ID NO: 3046847 - DNA, 16 bp, Homo sapiens
cattgttttaaaaaga

SEQ ID NO: 3046848 - DNA, 17 bp, Homo sapiens
cattgttttaaaaagaa

SEQ ID NO: 3046849 - DNA, 14 bp, Homo sapiens
cattgttttgcaaa

SEQ ID NO: 3046850 - DNA, 15 bp, Homo sapiens
catttaaaaaaaaag

SEQ ID NO: 3046851 - DNA, 16 bp, Homo sapiens
catttaaactaacctt

SEQ ID NO: 3046852 - DNA, 17 bp, Homo sapiens
catttaaactaaccttt

SEQ ID NO: 3046853 - DNA, 18 bp, Homo sapiens
catttaaatacagtcttc

SEQ ID NO: 3046854 - DNA, 13 bp, Homo sapiens
catttaaatcctt

SEQ ID NO: 3046855 - DNA, 20 bp, Homo sapiens
catttaataactttgctgga

SEQ ID NO: 3046856 - DNA, 13 bp, Homo sapiens
catttaatgccat

SEQ ID NO: 3046857 - DNA, 12 bp, Homo sapiens
catttacatgta

SEQ ID NO: 3046858 - DNA, 13 bp, Homo sapiens
catttaccaacat

SEQ ID NO: 3046859 - DNA, 20 bp, Homo sapiens
catttaccaacatgtatctg

SEQ ID NO: 3046860 - DNA, 22 bp, Homo sapiens
catttaccaacatgtatctgtc

SEQ ID NO: 3046861 - DNA, 20 bp, Homo sapiens
catttactcaccatatttga

SEQ ID NO: 3046862 - DNA, 22 bp, Homo sapiens
catttactcaccatatttgaat

SEQ ID NO: 3046863 - DNA, 23 bp, Homo sapiens
catttactcaccatatttgaatt

SEQ ID NO: 3046864 - DNA, 12 bp, Homo sapiens
catttagaaaat

SEQ ID NO: 3046865 - DNA, 22 bp, Homo sapiens
catttagaaaatagagctttta

SEQ ID NO: 3046866 - DNA, 23 bp, Homo sapiens
catttagagaactgtggccgtta

SEQ ID NO: 3046867 - DNA, 20 bp, Homo sapiens
catttagagaggaaaagtaa

SEQ ID NO: 3046868 - DNA, 18 bp, Homo sapiens
catttaggagaagttggt

SEQ ID NO: 3046869 - DNA, 16 bp, Homo sapiens
catttaggggcaagca

SEQ ID NO: 3046870 - DNA, 13 bp, Homo sapiens
catttagtctctt

SEQ ID NO: 3046871 - DNA, 22 bp, Homo sapiens
catttagtctctttattcctag

SEQ ID NO: 3046872 - DNA, 17 bp, Homo sapiens
catttatatattgtctg

SEQ ID NO: 3046873 - DNA, 21 bp, Homo sapiens
catttatattaaataacatgt

SEQ ID NO: 3046874 - DNA, 22 bp, Homo sapiens
catttatctaaaagaatttaaa

SEQ ID NO: 3046875 - DNA, 20 bp, Homo sapiens
catttatgtagacattgtaa

SEQ ID NO: 3046876 - DNA, 13 bp, Homo sapiens
catttattgttta

SEQ ID NO: 3046877 - DNA, 16 bp, Homo sapiens
catttattttatgaga

SEQ ID NO: 3046878 - DNA, 18 bp, Homo sapiens
catttattttatgagaaa

SEQ ID NO: 3046879 - DNA, 17 bp, Homo sapiens
catttcaaagccctgcc

SEQ ID NO: 3046880 - DNA, 19 bp, Homo sapiens
catttcaaagccctgcctc

SEQ ID NO: 3046881 - DNA, 21 bp, Homo sapiens
catttcaaagccctgcctctg

SEQ ID NO: 3046882 - DNA, 14 bp, Homo sapiens
catttcaaatctgt

SEQ ID NO: 3046883 - DNA, 15 bp, Homo sapiens
catttcaaatctgta

SEQ ID NO: 3046884 - DNA, 18 bp, Homo sapiens
catttcaagatccaaatg

SEQ ID NO: 3046885 - DNA, 16 bp, Homo sapiens
catttcaattcctggc

SEQ ID NO: 3046886 - DNA, 19 bp, Homo sapiens
catttcaattcctggccct

SEQ ID NO: 3046887 - DNA, 14 bp, Homo sapiens
catttcacatgcct

SEQ ID NO: 3046888 - DNA, 15 bp, Homo sapiens
catttcaccatggcc

SEQ ID NO: 3046889 - DNA, 14 bp, Homo sapiens
catttcaggaattt

SEQ ID NO: 3046890 - DNA, 15 bp, Homo sapiens
catttcatagtttca

SEQ ID NO: 3046891 - DNA, 18 bp, Homo sapiens
catttcatcctgttggct

SEQ ID NO: 3046892 - DNA, 12 bp, Homo sapiens
catttccagcct

SEQ ID NO: 3046893 - DNA, 17 bp, Homo sapiens
catttcccacatctttc

SEQ ID NO: 3046894 - DNA, 22 bp, Homo sapiens
catttccctccctctcttcccc

SEQ ID NO: 3046895 - DNA, 16 bp, Homo sapiens
catttccgtccccccc

SEQ ID NO: 3046896 - DNA, 16 bp, Homo sapiens
catttccgttttgcct

SEQ ID NO: 3046897 - DNA, 23 bp, Homo sapiens
catttcctatcacctatttccat

SEQ ID NO: 3046898 - DNA, 17 bp, Homo sapiens
catttcctatgtaactg

SEQ ID NO: 3046899 - DNA, 20 bp, Homo sapiens
catttcctcagcttatctct

SEQ ID NO: 3046900 - DNA, 16 bp, Homo sapiens
catttccttcaaggca

SEQ ID NO: 3046901 - DNA, 12 bp, Homo sapiens
catttccttttt

SEQ ID NO: 3046902 - DNA, 21 bp, Homo sapiens
catttcgcccctcatttatcc

SEQ ID NO: 3046903 - DNA, 19 bp, Homo sapiens
catttcgtgagccccatct

SEQ ID NO: 3046904 - DNA, 21 bp, Homo sapiens
catttcgtgagccccatcttc

SEQ ID NO: 3046905 - DNA, 23 bp, Homo sapiens
catttctagaacatccctgccag

SEQ ID NO: 3046906 - DNA, 15 bp, Homo sapiens
catttctccagaacc

SEQ ID NO: 3046907 - DNA, 16 bp, Homo sapiens
catttctgtctcccct

SEQ ID NO: 3046908 - DNA, 14 bp, Homo sapiens
catttgaaagaaag

SEQ ID NO: 3046909 - DNA, 23 bp, Homo sapiens
catttgaggatttagaagtgtca

SEQ ID NO: 3046910 - DNA, 14 bp, Homo sapiens
catttgatttaaac

SEQ ID NO: 3046911 - DNA, 21 bp, Homo sapiens
catttgcactggagttctatg

SEQ ID NO: 3046912 - DNA, 19 bp, Homo sapiens
catttgcagggtcctcttc

SEQ ID NO: 3046913 - DNA, 17 bp, Homo sapiens
catttgccaattttcct

SEQ ID NO: 3046914 - DNA, 21 bp, Homo sapiens
catttgctgagtttcccttcc

SEQ ID NO: 3046915 - DNA, 20 bp, Homo sapiens
catttgcttcaggagtttca

SEQ ID NO: 3046916 - DNA, 14 bp, Homo sapiens
catttggaaccaaa

SEQ ID NO: 3046917 - DNA, 16 bp, Homo sapiens
catttggaaccaaagt

SEQ ID NO: 3046918 - DNA, 15 bp, Homo sapiens
catttggaatacttt

SEQ ID NO: 3046919 - DNA, 22 bp, Homo sapiens
catttggagctcttgggtcaga

SEQ ID NO: 3046920 - DNA, 12 bp, Homo sapiens
catttggccagg

SEQ ID NO: 3046921 - DNA, 14 bp, Homo sapiens
catttgtagtgagc

SEQ ID NO: 3046922 - DNA, 15 bp, Homo sapiens
catttgtattttgtg

SEQ ID NO: 3046923 - DNA, 19 bp, Homo sapiens
catttgtattttgtgatga

SEQ ID NO: 3046924 - DNA, 22 bp, Homo sapiens
catttgtcatcgttccccaccc

SEQ ID NO: 3046925 - DNA, 16 bp, Homo sapiens
catttgtctctacttt

SEQ ID NO: 3046926 - DNA, 19 bp, Homo sapiens
catttgtgatatatgtatt

SEQ ID NO: 3046927 - DNA, 22 bp, Homo sapiens
catttgtgatatatgtattaat

SEQ ID NO: 3046928 - DNA, 15 bp, Homo sapiens
catttgtgtcactgt

SEQ ID NO: 3046929 - DNA, 16 bp, Homo sapiens
catttgttgctgctgc

SEQ ID NO: 3046930 - DNA, 15 bp, Homo sapiens
catttgtttgtattc

SEQ ID NO: 3046931 - DNA, 16 bp, Homo sapiens
catttgtttgtattca

SEQ ID NO: 3046932 - DNA, 14 bp, Homo sapiens
cattttaaatgaaa

SEQ ID NO: 3046933 - DNA, 15 bp, Homo sapiens
cattttaaatgaaag

SEQ ID NO: 3046934 - DNA, 14 bp, Homo sapiens
cattttaacaagaa

SEQ ID NO: 3046935 - DNA, 15 bp, Homo sapiens
cattttaacaagaag

SEQ ID NO: 3046936 - DNA, 22 bp, Homo sapiens
cattttaaggaaaactacctgt

SEQ ID NO: 3046937 - DNA, 23 bp, Homo sapiens
cattttaatttattaattgcttt

SEQ ID NO: 3046938 - DNA, 14 bp, Homo sapiens
cattttacaagcat

SEQ ID NO: 3046939 - DNA, 17 bp, Homo sapiens
cattttacgttttagaa

SEQ ID NO: 3046940 - DNA, 17 bp, Homo sapiens
cattttagaattaaaat

SEQ ID NO: 3046941 - DNA, 23 bp, Homo sapiens
cattttaggatctcgcctggaaa

SEQ ID NO: 3046942 - DNA, 23 bp, Homo sapiens
cattttataaagtgcttgtgtaa

SEQ ID NO: 3046943 - DNA, 19 bp, Homo sapiens
cattttatattgaaaaaaa

SEQ ID NO: 3046944 - DNA, 12 bp, Homo sapiens
cattttcagagt

SEQ ID NO: 3046945 - DNA, 22 bp, Homo sapiens
cattttcagcatcaaacatgaa

SEQ ID NO: 3046946 - DNA, 19 bp, Homo sapiens
cattttcatattgtaatct

SEQ ID NO: 3046947 - DNA, 14 bp, Homo sapiens
cattttcccatcat

SEQ ID NO: 3046948 - DNA, 23 bp, Homo sapiens
cattttcccatcatcctttgttc

SEQ ID NO: 3046949 - DNA, 14 bp, Homo sapiens
cattttctccacct

SEQ ID NO: 3046950 - DNA, 18 bp, Homo sapiens
cattttctctttaaaaga

SEQ ID NO: 3046951 - DNA, 12 bp, Homo sapiens
cattttcttgtc

SEQ ID NO: 3046952 - DNA, 14 bp, Homo sapiens
cattttgaatgtga

SEQ ID NO: 3046953 - DNA, 15 bp, Homo sapiens
cattttgacaacatg

SEQ ID NO: 3046954 - DNA, 15 bp, Homo sapiens
cattttggatttctt

SEQ ID NO: 3046955 - DNA, 13 bp, Homo sapiens
cattttggcatct

SEQ ID NO: 3046956 - DNA, 16 bp, Homo sapiens
catcttttgtgagatg

SEQ ID NO: 3046957 - DNA, 21 bp, Homo sapiens
catctttttaacctgcaaaat

SEQ ID NO: 3046958 - DNA, 14 bp, Homo sapiens
catctttttctttt

SEQ ID NO: 3046959 - DNA, 22 bp, Homo sapiens
catgaaaatggcatccagggct

SEQ ID NO: 3046960 - DNA, 23 bp, Homo sapiens
catgaaagaacccaagacatcat

SEQ ID NO: 3046961 - DNA, 22 bp, Homo sapiens
catgaacagaaaacattctgat

SEQ ID NO: 3046962 - DNA, 18 bp, Homo sapiens
catgaactggcttgtaca

SEQ ID NO: 3046963 - DNA, 19 bp, Homo sapiens
catgaactggcttgtacat

SEQ ID NO: 3046964 - DNA, 21 bp, Homo sapiens
catgaactggcttgtacattt

SEQ ID NO: 3046965 - DNA, 21 bp, Homo sapiens
catgaacttcgcatcaaaaga

SEQ ID NO: 3046966 - DNA, 14 bp, Homo sapiens
catgaagcataatt

SEQ ID NO: 3046967 - DNA, 17 bp, Homo sapiens
catgaagccacagccca

SEQ ID NO: 3046968 - DNA, 24 bp, Homo sapiens
catgaagccacagcccaggcctcc

SEQ ID NO: 3046969 - DNA, 13 bp, Homo sapiens
catgaagccttgc

SEQ ID NO: 3046970 - DNA, 13 bp, Homo sapiens
catgaaggaaact

SEQ ID NO: 3046971 - DNA, 12 bp, Homo sapiens
catggccctggg

SEQ ID NO: 3046972 - DNA, 13 bp, Homo sapiens
catggccctgggc

SEQ ID NO: 3046973 - DNA, 17 bp, Homo sapiens
catggcctatgcacata

SEQ ID NO: 3046974 - DNA, 22 bp, Homo sapiens
catggctataaacaattacatg

SEQ ID NO: 3046975 - DNA, 16 bp, Homo sapiens
catggctcagggtggt

SEQ ID NO: 3046976 - DNA, 16 bp, Homo sapiens
catggctccggcctct

SEQ ID NO: 3046977 - DNA, 17 bp, Homo sapiens
catggctgggggaggga

SEQ ID NO: 3046978 - DNA, 18 bp, Homo sapiens
catggctgggggagggac

SEQ ID NO: 3046979 - DNA, 23 bp, Homo sapiens
catggctgggggagggactgctg

SEQ ID NO: 3046980 - DNA, 15 bp, Homo sapiens
catggctggtgcctg

SEQ ID NO: 3046981 - DNA, 16 bp, Homo sapiens
catggctggtgcctga

SEQ ID NO: 3046982 - DNA, 15 bp, Homo sapiens
catggcttcctgaga

SEQ ID NO: 3046983 - DNA, 15 bp, Homo sapiens
catggcttctccttt

SEQ ID NO: 3046984 - DNA, 22 bp, Homo sapiens
catggctttcatcctgtgtccc

SEQ ID NO: 3046985 - DNA, 16 bp, Homo sapiens
catgggaacgcagcct

SEQ ID NO: 3046986 - DNA, 17 bp, Homo sapiens
catgggaacgcagcctc

SEQ ID NO: 3046987 - DNA, 20 bp, Homo sapiens
catgggaacgcagcctccag

SEQ ID NO: 3046988 - DNA, 20 bp, Homo sapiens
catgggaatacaaaaggttt

SEQ ID NO: 3046989 - DNA, 17 bp, Homo sapiens
catgggaccacaactat

SEQ ID NO: 3046990 - DNA, 21 bp, Homo sapiens
catgggactgattctgttgtg

SEQ ID NO: 3046991 - DNA, 22 bp, Homo sapiens
catgggagccgggtctgcctct

SEQ ID NO: 3046992 - DNA, 15 bp, Homo sapiens
catgggcagagccca

SEQ ID NO: 3046993 - DNA, 20 bp, Homo sapiens
catgggcatctatgggagag

SEQ ID NO: 3046994 - DNA, 18 bp, Homo sapiens
catgggggctgtctttgc

SEQ ID NO: 3046995 - DNA, 17 bp, Homo sapiens
catggtcacacactgat

SEQ ID NO: 3046996 - DNA, 19 bp, Homo sapiens
catggtcagccctagggtg

SEQ ID NO: 3046997 - DNA, 12 bp, Homo sapiens
catggtcctgtc

SEQ ID NO: 3046998 - DNA, 15 bp, Homo sapiens
catggtcctgtctgt

SEQ ID NO: 3046999 - DNA, 22 bp, Homo sapiens
catggtcctgtctgtccttctg

SEQ ID NO: 3047000 - DNA, 20 bp, Homo sapiens
catggtgacttttgaaaaga

SEQ ID NO: 3047001 - DNA, 15 bp, Homo sapiens
catggtgagcctagc

SEQ ID NO: 3047002 - DNA, 14 bp, Homo sapiens
catggtggcaggcg

SEQ ID NO: 3047003 - DNA, 22 bp, Homo sapiens
catggtgggtccatgggcagag

SEQ ID NO: 3047004 - DNA, 14 bp, Homo sapiens
catggtgtgttaca

SEQ ID NO: 3047005 - DNA, 15 bp, Homo sapiens
catggtgtgttacac

SEQ ID NO: 3047006 - DNA, 17 bp, Homo sapiens
catggttaacgaggaag

SEQ ID NO: 3047007 - DNA, 13 bp, Homo sapiens
catggttaagagt

SEQ ID NO: 3047008 - DNA, 18 bp, Homo sapiens
catgtaaaatcttcagct

SEQ ID NO: 3047009 - DNA, 23 bp, Homo sapiens
catgtaaaatcttcagctggtgg

SEQ ID NO: 3047010 - DNA, 16 bp, Homo sapiens
catgtaaactgtgcac

SEQ ID NO: 3047011 - DNA, 14 bp, Homo sapiens
catgtaaaggcctt

SEQ ID NO: 3047012 - DNA, 22 bp, Homo sapiens
catgtaaatgtattggcacagt

SEQ ID NO: 3047013 - DNA, 13 bp, Homo sapiens
catgtaacagaaa

SEQ ID NO: 3047014 - DNA, 14 bp, Homo sapiens
catgtaacagaaag

SEQ ID NO: 3047015 - DNA, 17 bp, Homo sapiens
catgtacatttggaact

SEQ ID NO: 3047016 - DNA, 18 bp, Homo sapiens
catgtaccccctttccct

SEQ ID NO: 3047017 - DNA, 20 bp, Homo sapiens
catgtacttccctcttgaaa

SEQ ID NO: 3047018 - DNA, 18 bp, Homo sapiens
catgtagaataaatgaag

SEQ ID NO: 3047019 - DNA, 14 bp, Homo sapiens
catgtagcaggact

SEQ ID NO: 3047020 - DNA, 20 bp, Homo sapiens
catgtagcaggactgaattg

SEQ ID NO: 3047021 - DNA, 19 bp, Homo sapiens
catgtagccccagtcagaa

SEQ ID NO: 3047022 - DNA, 18 bp, Homo sapiens
catgtagccccctggcct

SEQ ID NO: 3047023 - DNA, 19 bp, Homo sapiens
catgtagtatcaaatatta

SEQ ID NO: 3047024 - DNA, 22 bp, Homo sapiens
catgtatctctctgtggtggtt

SEQ ID NO: 3047025 - DNA, 22 bp, Homo sapiens
catgtatctgtctactttctct

SEQ ID NO: 3047026 - DNA, 23 bp, Homo sapiens
catgtatctgtctactttctctt

SEQ ID NO: 3047027 - DNA, 14 bp, Homo sapiens
catgtatgcctgcc

SEQ ID NO: 3047028 - DNA, 19 bp, Homo sapiens
catgtatgtatgagacaga

SEQ ID NO: 3047029 - DNA, 18 bp, Homo sapiens
catgtatgtcttggacac

SEQ ID NO: 3047030 - DNA, 21 bp, Homo sapiens
catgtatgtcttggacactgt

SEQ ID NO: 3047031 - DNA, 21 bp, Homo sapiens
catgtatgtggatacagtcat

SEQ ID NO: 3047032 - DNA, 20 bp, Homo sapiens
catgtattagccagtcattg

SEQ ID NO: 3047033 - DNA, 22 bp, Homo sapiens
catgtattgaagaggatattct

SEQ ID NO: 3047034 - DNA, 14 bp, Homo sapiens
catgtcaaacaaat

SEQ ID NO: 3047035 - DNA, 15 bp, Homo sapiens
catgtcatttctcat

SEQ ID NO: 3047036 - DNA, 22 bp, Homo sapiens
catgtccagcaccttgtgcctg

SEQ ID NO: 3047037 - DNA, 16 bp, Homo sapiens
catgtcccctcccaga

SEQ ID NO: 3047038 - DNA, 18 bp, Homo sapiens
catgtcccctcccagagc

SEQ ID NO: 3047039 - DNA, 18 bp, Homo sapiens
catgtcctaattcttctg

SEQ ID NO: 3047040 - DNA, 15 bp, Homo sapiens
catgtcctatccaaa

SEQ ID NO: 3047041 - DNA, 19 bp, Homo sapiens
catgtccttgtgtgttttg

SEQ ID NO: 3047042 - DNA, 20 bp, Homo sapiens
catgtcctttccatctgtcc

SEQ ID NO: 3047043 - DNA, 19 bp, Homo sapiens
catgtctaattcatttact

SEQ ID NO: 3047044 - DNA, 21 bp, Homo sapiens
catgtctaattcatttactca

SEQ ID NO: 3047045 - DNA, 16 bp, Homo sapiens
catgtctctgcttcca

SEQ ID NO: 3047046 - DNA, 17 bp, Homo sapiens
catgtctctgcttccat

SEQ ID NO: 3047047 - DNA, 14 bp, Homo sapiens
catgtctgcatttc

SEQ ID NO: 3047048 - DNA, 23 bp, Homo sapiens
catgtctgcatttcggtggctag

SEQ ID NO: 3047049 - DNA, 12 bp, Homo sapiens
catgtctgcctg

SEQ ID NO: 3047050 - DNA, 20 bp, Homo sapiens
catgtctgcctggagtgctg

SEQ ID NO: 3047051 - DNA, 18 bp, Homo sapiens
catgtcttatcttgtttc

SEQ ID NO: 3047052 - DNA, 15 bp, Homo sapiens
catgtcttgtacatg

SEQ ID NO: 3047053 - DNA, 23 bp, Homo sapiens
catgtcttgtacatgtgtagcct

SEQ ID NO: 3047054 - DNA, 14 bp, Homo sapiens
catgtctttactag

SEQ ID NO: 3047055 - DNA, 15 bp, Homo sapiens
catgtcttttaaaat

SEQ ID NO: 3047056 - DNA, 17 bp, Homo sapiens
catgtgaaaatcaaata

SEQ ID NO: 3047057 - DNA, 14 bp, Homo sapiens
catgtgacacatat

SEQ ID NO: 3047058 - DNA, 13 bp, Homo sapiens
catgtgactctga

SEQ ID NO: 3047059 - DNA, 15 bp, Homo sapiens
catgtgcaactcttg

SEQ ID NO: 3047060 - DNA, 16 bp, Homo sapiens
catgtgcataacaaat

SEQ ID NO: 3047061 - DNA, 22 bp, Homo sapiens
catgtgccacaacgcctggcta

SEQ ID NO: 3047062 - DNA, 24 bp, Homo sapiens
catgtgccagggcaatgatgaatg

SEQ ID NO: 3047063 - DNA, 16 bp, Homo sapiens
catgtgcctctgtcct

SEQ ID NO: 3047064 - DNA, 15 bp, Homo sapiens
catgtgcgtggaagt

SEQ ID NO: 3047065 - DNA, 21 bp, Homo sapiens
catgtgcgtggaagtgttcct

SEQ ID NO: 3047066 - DNA, 14 bp, Homo sapiens
catgtggcagcagg

SEQ ID NO: 3047067 - DNA, 18 bp, Homo sapiens
catgtggcagcaggcatg

SEQ ID NO: 3047068 - DNA, 21 bp, Homo sapiens
catgtggcagcaggcatggct

SEQ ID NO: 3047069 - DNA, 15 bp, Homo sapiens
catgtggccatggcc

SEQ ID NO: 3047070 - DNA, 18 bp, Homo sapiens
catgtggcttctctgtct

SEQ ID NO: 3047071 - DNA, 17 bp, Homo sapiens
catgtgggttgtgatat

SEQ ID NO: 3047072 - DNA, 14 bp, Homo sapiens
catgtgtagcctgt

SEQ ID NO: 3047073 - DNA, 12 bp, Homo sapiens
catgtgtatata

SEQ ID NO: 3047074 - DNA, 15 bp, Homo sapiens
catgtgtcatgcatg

SEQ ID NO: 3047075 - DNA, 21 bp, Homo sapiens
catgtgtgagataacttcctt

SEQ ID NO: 3047076 - DNA, 14 bp, Homo sapiens
catgtgtgtatttt

SEQ ID NO: 3047077 - DNA, 15 bp, Homo sapiens
catgtgtgtattttt

SEQ ID NO: 3047078 - DNA, 23 bp, Homo sapiens
catgtgtgtccacgactgtctcc

SEQ ID NO: 3047079 - DNA, 15 bp, Homo sapiens
catgtgttttcatca

SEQ ID NO: 3047080 - DNA, 16 bp, Homo sapiens
catgtgttttcatcat

SEQ ID NO: 3047081 - DNA, 23 bp, Homo sapiens
catgtgttttcatcatttcagcc

SEQ ID NO: 3047082 - DNA, 13 bp, Homo sapiens
catgtgttttgct

SEQ ID NO: 3047083 - DNA, 13 bp, Homo sapiens
catgttaatttca

SEQ ID NO: 3047084 - DNA, 20 bp, Homo sapiens
catgttactacagaggaaag

SEQ ID NO: 3047085 - DNA, 22 bp, Homo sapiens
catgttctcatgcatgtctaac

SEQ ID NO: 3047086 - DNA, 21 bp, Homo sapiens
catgttgatcatgtacttttt

SEQ ID NO: 3047087 - DNA, 16 bp, Homo sapiens
catgttggccaggctg

SEQ ID NO: 3047088 - DNA, 21 bp, Homo sapiens
catgttggccaggctggtctt

SEQ ID NO: 3047089 - DNA, 20 bp, Homo sapiens
catgtttaattgtgatattt

SEQ ID NO: 3047090 - DNA, 22 bp, Homo sapiens
catgtttaattgtgatatttga

SEQ ID NO: 3047091 - DNA, 21 bp, Homo sapiens
catgtttataactattcagtt

SEQ ID NO: 3047092 - DNA, 18 bp, Homo sapiens
catgtttgagctcagacc

SEQ ID NO: 3047093 - DNA, 20 bp, Homo sapiens
catgtttgcacctttctagt

SEQ ID NO: 3047094 - DNA, 16 bp, Homo sapiens
catgtttggaaagctg

SEQ ID NO: 3047095 - DNA, 14 bp, Homo sapiens
catgttttaaaatt

SEQ ID NO: 3047096 - DNA, 14 bp, Homo sapiens
catgttttaacaaa

SEQ ID NO: 3047097 - DNA, 15 bp, Homo sapiens
catgttttaacaaaa

SEQ ID NO: 3047098 - DNA, 13 bp, Homo sapiens
cattaaaaacata

SEQ ID NO: 3047099 - DNA, 14 bp, Homo sapiens
cattaaaaagcctt

SEQ ID NO: 3047100 - DNA, 18 bp, Homo sapiens
cattttggcatctgcaaa

SEQ ID NO: 3047101 - DNA, 21 bp, Homo sapiens
cattttggtgtgcatctgtgt

SEQ ID NO: 3047102 - DNA, 17 bp, Homo sapiens
cattttgtataattgta

SEQ ID NO: 3047103 - DNA, 20 bp, Homo sapiens
cattttgtgaagccctgttg

SEQ ID NO: 3047104 - DNA, 14 bp, Homo sapiens
cattttgtgtacag

SEQ ID NO: 3047105 - DNA, 17 bp, Homo sapiens
cattttgtttctgtata

SEQ ID NO: 3047106 - DNA, 13 bp, Homo sapiens
cattttgtttgaa

SEQ ID NO: 3047107 - DNA, 23 bp, Homo sapiens
catttttaaaggacaaacagtga

SEQ ID NO: 3047108 - DNA, 13 bp, Homo sapiens
catttttaaatgt

SEQ ID NO: 3047109 - DNA, 19 bp, Homo sapiens
catttttaaattcttactc

SEQ ID NO: 3047110 - DNA, 19 bp, Homo sapiens
catttttaactactgtatt

SEQ ID NO: 3047111 - DNA, 23 bp, Homo sapiens
catttttaactactgtattccca

SEQ ID NO: 3047112 - DNA, 16 bp, Homo sapiens
catttttagaaatcac

SEQ ID NO: 3047113 - DNA, 20 bp, Homo sapiens
catttttagtttaaaatctt

SEQ ID NO: 3047114 - DNA, 14 bp, Homo sapiens
catttttcaacttt

SEQ ID NO: 3047115 - DNA, 13 bp, Homo sapiens
catttttcttcca

SEQ ID NO: 3047116 - DNA, 11 bp, Homo sapiens
catttttgaat

SEQ ID NO: 3047117 - DNA, 15 bp, Homo sapiens
catttttgtgagcct

SEQ ID NO: 3047118 - DNA, 18 bp, Homo sapiens
cattttttaaggaaacaa

SEQ ID NO: 3047119 - DNA, 13 bp, Homo sapiens
cattttttcagtc

SEQ ID NO: 3047120 - DNA, 16 bp, Homo sapiens
catttttttagtttgt

SEQ ID NO: 3047121 - DNA, 17 bp, Homo sapiens
catttttttctctctgg

SEQ ID NO: 3047122 - DNA, 19 bp, Homo sapiens
catttttttctctctggag

SEQ ID NO: 3047123 - DNA, 16 bp, Homo sapiens
ccaaaaaaaggaaaaa

SEQ ID NO: 3047124 - DNA, 22 bp, Homo sapiens
ccaaaaaaaggaaaaataatca

SEQ ID NO: 3047125 - DNA, 21 bp, Homo sapiens
ccaaaaaaggacgtaaaattt

SEQ ID NO: 3047126 - DNA, 17 bp, Homo sapiens
ccaaaaagacaagtgct

SEQ ID NO: 3047127 - DNA, 18 bp, Homo sapiens
ccaaaacattttaaatga

SEQ ID NO: 3047128 - DNA, 16 bp, Homo sapiens
ccaaaactgtgcagag

SEQ ID NO: 3047129 - DNA, 22 bp, Homo sapiens
ccaaaagaagcccccagctaag

SEQ ID NO: 3047130 - DNA, 15 bp, Homo sapiens
ccaaaagcacaaaat

SEQ ID NO: 3047131 - DNA, 14 bp, Homo sapiens
ccaaaagctgctca

SEQ ID NO: 3047132 - DNA, 16 bp, Homo sapiens
ccaaaagggaaaaaat

SEQ ID NO: 3047133 - DNA, 19 bp, Homo sapiens
ccaaaagggaaaaaataaa

SEQ ID NO: 3047134 - DNA, 18 bp, Homo sapiens
ccaaaagtaaagatgcta

SEQ ID NO: 3047135 - DNA, 18 bp, Homo sapiens
ccaaaagtggaagtgaca

SEQ ID NO: 3047136 - DNA, 13 bp, Homo sapiens
ccaaacaattatt

SEQ ID NO: 3047137 - DNA, 12 bp, Homo sapiens
ccaaacagcaaa

SEQ ID NO: 3047138 - DNA, 23 bp, Homo sapiens
ccaaacagcaaaccaagagattg

SEQ ID NO: 3047139 - DNA, 16 bp, Homo sapiens
ccaaacaggctcagag

SEQ ID NO: 3047140 - DNA, 17 bp, Homo sapiens
ccaaacaggtgctggcc

SEQ ID NO: 3047141 - DNA, 15 bp, Homo sapiens
ccaaaccccttccca

SEQ ID NO: 3047142 - DNA, 13 bp, Homo sapiens
ccaaaccggcagg

SEQ ID NO: 3047143 - DNA, 19 bp, Homo sapiens
ccaaaccttgggccctgga

SEQ ID NO: 3047144 - DNA, 21 bp, Homo sapiens
ccaaacgccctttcctcctca

SEQ ID NO: 3047145 - DNA, 17 bp, Homo sapiens
ccaaactgctgtctctt

SEQ ID NO: 3047146 - DNA, 19 bp, Homo sapiens
ccaaagaatgttagagcac

SEQ ID NO: 3047147 - DNA, 11 bp, Homo sapiens
ccaaagagaaa

SEQ ID NO: 3047148 - DNA, 14 bp, Homo sapiens
ccaaagagtctctg

SEQ ID NO: 3047149 - DNA, 22 bp, Homo sapiens
ccaaagagtctctggctcagct

SEQ ID NO: 3047150 - DNA, 15 bp, Homo sapiens
ccaaagagtgtggaa

SEQ ID NO: 3047151 - DNA, 14 bp, Homo sapiens
ccaaagcagacagc

SEQ ID NO: 3047152 - DNA, 18 bp, Homo sapiens
ccaaagcagattttccta

SEQ ID NO: 3047153 - DNA, 17 bp, Homo sapiens
ccaaagccaagaaagaa

SEQ ID NO: 3047154 - DNA, 14 bp, Homo sapiens
ccaaagccaatgtg

SEQ ID NO: 3047155 - DNA, 19 bp, Homo sapiens
ccaaagccactggaaggag

SEQ ID NO: 3047156 - DNA, 12 bp, Homo sapiens
ccaaagcctgtc

SEQ ID NO: 3047157 - DNA, 17 bp, Homo sapiens
ccaaagcttgtaaatat

SEQ ID NO: 3047158 - DNA, 17 bp, Homo sapiens
ccaaaggaaatccaaaa

SEQ ID NO: 3047159 - DNA, 20 bp, Homo sapiens
ccaaagggatggtattgaga

SEQ ID NO: 3047160 - DNA, 23 bp, Homo sapiens
ccaaagggcacacccctggggct

SEQ ID NO: 3047161 - DNA, 23 bp, Homo sapiens
ccaaagggtgaagctatttatct

SEQ ID NO: 3047162 - DNA, 14 bp, Homo sapiens
ccaaagtcccttcc

SEQ ID NO: 3047163 - DNA, 15 bp, Homo sapiens
ccaaagtctctaatt

SEQ ID NO: 3047164 - DNA, 18 bp, Homo sapiens
ccaaagtctctaattcta

SEQ ID NO: 3047165 - DNA, 13 bp, Homo sapiens
ccaaatacacatt

SEQ ID NO: 3047166 - DNA, 15 bp, Homo sapiens
ccaaatacacatttc

SEQ ID NO: 3047167 - DNA, 20 bp, Homo sapiens
ccaaatacacatttcacatt

SEQ ID NO: 3047168 - DNA, 15 bp, Homo sapiens
ccaaatagccccaga

SEQ ID NO: 3047169 - DNA, 23 bp, Homo sapiens
ccaaataggatcatatgaattgc

SEQ ID NO: 3047170 - DNA, 23 bp, Homo sapiens
ccaaatccgaacctcctctgtga

SEQ ID NO: 3047171 - DNA, 21 bp, Homo sapiens
ccaaatccttggagtcccagg

SEQ ID NO: 3047172 - DNA, 14 bp, Homo sapiens
ccaaatctgtcctc

SEQ ID NO: 3047173 - DNA, 16 bp, Homo sapiens
ccaaatctgtcctctg

SEQ ID NO: 3047174 - DNA, 19 bp, Homo sapiens
ccaaatctgtcctctgtag

SEQ ID NO: 3047175 - DNA, 13 bp, Homo sapiens
ccaaatgcattca

SEQ ID NO: 3047176 - DNA, 13 bp, Homo sapiens
ccaaatgcccaag

SEQ ID NO: 3047177 - DNA, 14 bp, Homo sapiens
ccaaatgcccaagg

SEQ ID NO: 3047178 - DNA, 15 bp, Homo sapiens
ccaaatgcccaagga

SEQ ID NO: 3047179 - DNA, 19 bp, Homo sapiens
ccaaatggctctgtgaaat

SEQ ID NO: 3047180 - DNA, 16 bp, Homo sapiens
ccaaattgcactgaag

SEQ ID NO: 3047181 - DNA, 14 bp, Homo sapiens
ccaaattgcttcta

SEQ ID NO: 3047182 - DNA, 16 bp, Homo sapiens
ccaaattgcttctagg

SEQ ID NO: 3047183 - DNA, 17 bp, Homo sapiens
ccaaattttctttttat

SEQ ID NO: 3047184 - DNA, 13 bp, Homo sapiens
ccaacaccaagca

SEQ ID NO: 3047185 - DNA, 23 bp, Homo sapiens
ccaacaccaagcacagcagcctg

SEQ ID NO: 3047186 - DNA, 19 bp, Homo sapiens
ccaacaccccgcctgcctc

SEQ ID NO: 3047187 - DNA, 13 bp, Homo sapiens
ccaacactgccag

SEQ ID NO: 3047188 - DNA, 15 bp, Homo sapiens
ccaacactgccagca

SEQ ID NO: 3047189 - DNA, 20 bp, Homo sapiens
ccaacactgtgggtgtgtga

SEQ ID NO: 3047190 - DNA, 13 bp, Homo sapiens
ccaacacttccag

SEQ ID NO: 3047191 - DNA, 17 bp, Homo sapiens
ccaacagacacaattta

SEQ ID NO: 3047192 - DNA, 17 bp, Homo sapiens
ccaacagacctggtgct

SEQ ID NO: 3047193 - DNA, 11 bp, Homo sapiens
ccaacagctac

SEQ ID NO: 3047194 - DNA, 13 bp, Homo sapiens
ccaacagctacaa

SEQ ID NO: 3047195 - DNA, 18 bp, Homo sapiens
ccaacagctacaacagcc

SEQ ID NO: 3047196 - DNA, 21 bp, Homo sapiens
ccaacagctacaacagcctca

SEQ ID NO: 3047197 - DNA, 23 bp, Homo sapiens
ccaacagctacaacagcctcact

SEQ ID NO: 3047198 - DNA, 20 bp, Homo sapiens
ccaacagcttttcccaggag

SEQ ID NO: 3047199 - DNA, 17 bp, Homo sapiens
ccaacaggaggacaatt

SEQ ID NO: 3047200 - DNA, 18 bp, Homo sapiens
ccaacaggaggacaattc

SEQ ID NO: 3047201 - DNA, 20 bp, Homo sapiens
ccaacaggcgtgggatcaga

SEQ ID NO: 3047202 - DNA, 12 bp, Homo sapiens
ccaacagtgtga

SEQ ID NO: 3047203 - DNA, 16 bp, Homo sapiens
ccaacagtgtgaagtt

SEQ ID NO: 3047204 - DNA, 22 bp, Homo sapiens
ccaacagtgtgaagttagaatt

SEQ ID NO: 3047205 - DNA, 13 bp, Homo sapiens
ccaacatataaaa

SEQ ID NO: 3047206 - DNA, 12 bp, Homo sapiens
ccaacatctttg

SEQ ID NO: 3047207 - DNA, 22 bp, Homo sapiens
ccaacatggagaaaccctgtct

SEQ ID NO: 3047208 - DNA, 19 bp, Homo sapiens
ccaacatggatgtgttgcc

SEQ ID NO: 3047209 - DNA, 20 bp, Homo sapiens
ccaacatggtgaaaccccca

SEQ ID NO: 3047210 - DNA, 20 bp, Homo sapiens
ccaacatgtatctgtctact

SEQ ID NO: 3047211 - DNA, 14 bp, Homo sapiens
ccaacccatcagaa

SEQ ID NO: 3047212 - DNA, 17 bp, Homo sapiens
ccaacccccagccccca

SEQ ID NO: 3047213 - DNA, 18 bp, Homo sapiens
ccaacccccagcccccac

SEQ ID NO: 3047214 - DNA, 12 bp, Homo sapiens
ccagcctgtcca

SEQ ID NO: 3047215 - DNA, 12 bp, Homo sapiens
ccagcctttctt

SEQ ID NO: 3047216 - DNA, 22 bp, Homo sapiens
ccagcctttgggtcctgggcag

SEQ ID NO: 3047217 - DNA, 13 bp, Homo sapiens
ccagcgagccaca

SEQ ID NO: 3047218 - DNA, 15 bp, Homo sapiens
ccagcgagctctcaa

SEQ ID NO: 3047219 - DNA, 16 bp, Homo sapiens
ccagcgaggaggctcc

SEQ ID NO: 3047220 - DNA, 14 bp, Homo sapiens
ccagcgatggtgct

SEQ ID NO: 3047221 - DNA, 15 bp, Homo sapiens
ccagcgatggtgctg

SEQ ID NO: 3047222 - DNA, 13 bp, Homo sapiens
ccagcgccagggc

SEQ ID NO: 3047223 - DNA, 14 bp, Homo sapiens
ccagcgccagggcc

SEQ ID NO: 3047224 - DNA, 15 bp, Homo sapiens
ccagcgccagggccc

SEQ ID NO: 3047225 - DNA, 18 bp, Homo sapiens
ccagcgccagggcccagg

SEQ ID NO: 3047226 - DNA, 22 bp, Homo sapiens
ccagcgcctagtggggtctccc

SEQ ID NO: 3047227 - DNA, 12 bp, Homo sapiens
ccagcgctctcc

SEQ ID NO: 3047228 - DNA, 14 bp, Homo sapiens
ccagcggcccaaga

SEQ ID NO: 3047229 - DNA, 17 bp, Homo sapiens
ccagcggcccaagagcc

SEQ ID NO: 3047230 - DNA, 17 bp, Homo sapiens
ccagcggcctcagggtc

SEQ ID NO: 3047231 - DNA, 23 bp, Homo sapiens
ccagcggcctcagggtctaagga

SEQ ID NO: 3047232 - DNA, 13 bp, Homo sapiens
ccagcggctgagt

SEQ ID NO: 3047233 - DNA, 21 bp, Homo sapiens
ccagcgtatatataagaaaga

SEQ ID NO: 3047234 - DNA, 22 bp, Homo sapiens
ccagcgtatatataagaaagac

SEQ ID NO: 3047235 - DNA, 23 bp, Homo sapiens
ccagcgtatatataagaaagaca

SEQ ID NO: 3047236 - DNA, 14 bp, Homo sapiens
ccagctaaataatc

SEQ ID NO: 3047237 - DNA, 23 bp, Homo sapiens
ccagctaaggacatttcccaggg

SEQ ID NO: 3047238 - DNA, 17 bp, Homo sapiens
ccagctacacctttctc

SEQ ID NO: 3047239 - DNA, 17 bp, Homo sapiens
ccagctaccaagtcaga

SEQ ID NO: 3047240 - DNA, 13 bp, Homo sapiens
ccagctactcagg

SEQ ID NO: 3047241 - DNA, 16 bp, Homo sapiens
ccagctactcaggagg

SEQ ID NO: 3047242 - DNA, 21 bp, Homo sapiens
ccagctactgaaccagccacg

SEQ ID NO: 3047243 - DNA, 21 bp, Homo sapiens
ccagctacttagctggccaag

SEQ ID NO: 3047244 - DNA, 22 bp, Homo sapiens
ccagctacttagctggccaagg

SEQ ID NO: 3047245 - DNA, 18 bp, Homo sapiens
ccagctacttgggagcct

SEQ ID NO: 3047246 - DNA, 23 bp, Homo sapiens
ccagctaggaagagcaggactcc

SEQ ID NO: 3047247 - DNA, 15 bp, Homo sapiens
ccagctatactgtat

SEQ ID NO: 3047248 - DNA, 12 bp, Homo sapiens
ccagctcagggg

SEQ ID NO: 3047249 - DNA, 17 bp, Homo sapiens
ccagctcaggggacact

SEQ ID NO: 3047250 - DNA, 21 bp, Homo sapiens
ccagctcaggggacactggcc

SEQ ID NO: 3047251 - DNA, 14 bp, Homo sapiens
ccagctcagtgttt

SEQ ID NO: 3047252 - DNA, 16 bp, Homo sapiens
ccagctcattcatttt

SEQ ID NO: 3047253 - DNA, 14 bp, Homo sapiens
ccagctccaacctg

SEQ ID NO: 3047254 - DNA, 20 bp, Homo sapiens
ccagctccaacctgcaaaga

SEQ ID NO: 3047255 - DNA, 18 bp, Homo sapiens
ccagctccaggcccaccg

SEQ ID NO: 3047256 - DNA, 21 bp, Homo sapiens
ccagctcccgctgtggccgca

SEQ ID NO: 3047257 - DNA, 18 bp, Homo sapiens
ccagctccgacctctctc

SEQ ID NO: 3047258 - DNA, 15 bp, Homo sapiens
ccagctctcccacat

SEQ ID NO: 3047259 - DNA, 18 bp, Homo sapiens
ccagctctccctctggcc

SEQ ID NO: 3047260 - DNA, 20 bp, Homo sapiens
ccagctctccctctggccct

SEQ ID NO: 3047261 - DNA, 20 bp, Homo sapiens
ccagctctgaaaccagtgtt

SEQ ID NO: 3047262 - DNA, 20 bp, Homo sapiens
ccagctctgccgtctctgga

SEQ ID NO: 3047263 - DNA, 18 bp, Homo sapiens
ccagctctgggaactgaa

SEQ ID NO: 3047264 - DNA, 14 bp, Homo sapiens
ccagctctgtatca

SEQ ID NO: 3047265 - DNA, 18 bp, Homo sapiens
ccagctctgtatcaggac

SEQ ID NO: 3047266 - DNA, 20 bp, Homo sapiens
ccagctctgtcaccctggcc

SEQ ID NO: 3047267 - DNA, 12 bp, Homo sapiens
ccagctcttgct

SEQ ID NO: 3047268 - DNA, 13 bp, Homo sapiens
ccagctgcaaagt

SEQ ID NO: 3047269 - DNA, 16 bp, Homo sapiens
ccagctgcaaagtgtt

SEQ ID NO: 3047270 - DNA, 18 bp, Homo sapiens
ccagctgccccagccaga

SEQ ID NO: 3047271 - DNA, 16 bp, Homo sapiens
ccagctgcccttccgc

SEQ ID NO: 3047272 - DNA, 17 bp, Homo sapiens
ccagctgcccttccgca

SEQ ID NO: 3047273 - DNA, 15 bp, Homo sapiens
ccagctggcagcaga

SEQ ID NO: 3047274 - DNA, 16 bp, Homo sapiens
ccagctggcagcagag

SEQ ID NO: 3047275 - DNA, 17 bp, Homo sapiens
ccagctggtgcccccag

SEQ ID NO: 3047276 - DNA, 14 bp, Homo sapiens
ccagctgtcagcct

SEQ ID NO: 3047277 - DNA, 15 bp, Homo sapiens
ccagctgtcagcctg

SEQ ID NO: 3047278 - DNA, 22 bp, Homo sapiens
ccagcttattgtgtgcgctgcc

SEQ ID NO: 3047279 - DNA, 15 bp, Homo sapiens
ccagcttgccagatg

SEQ ID NO: 3047280 - DNA, 19 bp, Homo sapiens
ccagctttaaaaagaaaaa

SEQ ID NO: 3047281 - DNA, 21 bp, Homo sapiens
ccagctttaagggttgtgagc

SEQ ID NO: 3047282 - DNA, 17 bp, Homo sapiens
ccagctttactgtggct

SEQ ID NO: 3047283 - DNA, 23 bp, Homo sapiens
ccagctttactgtggctgtctgg

SEQ ID NO: 3047284 - DNA, 22 bp, Homo sapiens
ccaggaaacaagggaaggggcc

SEQ ID NO: 3047285 - DNA, 11 bp, Homo sapiens
ccaggaaagca

SEQ ID NO: 3047286 - DNA, 22 bp, Homo sapiens
ccaggaagaatggtgtgtttcc

SEQ ID NO: 3047287 - DNA, 15 bp, Homo sapiens
ccaggaagcagggag

SEQ ID NO: 3047288 - DNA, 16 bp, Homo sapiens
ccaggaagcagggaga

SEQ ID NO: 3047289 - DNA, 20 bp, Homo sapiens
ccaggaagcagggagagttg

SEQ ID NO: 3047290 - DNA, 21 bp, Homo sapiens
ccaggaagcccactgcctcct

SEQ ID NO: 3047291 - DNA, 20 bp, Homo sapiens
ccaggaaggacagactggcc

SEQ ID NO: 3047292 - DNA, 19 bp, Homo sapiens
ccaggaagggagggagctg

SEQ ID NO: 3047293 - DNA, 20 bp, Homo sapiens
ccaggaagggagggagctga

SEQ ID NO: 3047294 - DNA, 20 bp, Homo sapiens
ccaggaatgttaaagtcagt

SEQ ID NO: 3047295 - DNA, 15 bp, Homo sapiens
ccaggaatgtttcag

SEQ ID NO: 3047296 - DNA, 17 bp, Homo sapiens
ccaggaatttcccagga

SEQ ID NO: 3047297 - DNA, 23 bp, Homo sapiens
ccaggaatttgggaccctgcttt

SEQ ID NO: 3047298 - DNA, 18 bp, Homo sapiens
ccaggacactaccctgag

SEQ ID NO: 3047299 - DNA, 19 bp, Homo sapiens
ccaggacactaccctgaga

SEQ ID NO: 3047300 - DNA, 13 bp, Homo sapiens
ccaggacaggacc

SEQ ID NO: 3047301 - DNA, 17 bp, Homo sapiens
ccaggacaggcccggcg

SEQ ID NO: 3047302 - DNA, 20 bp, Homo sapiens
ccaggaccagctcaggacag

SEQ ID NO: 3047303 - DNA, 18 bp, Homo sapiens
ccaggacccgccagcccc

SEQ ID NO: 3047304 - DNA, 19 bp, Homo sapiens
ccaggacctcggatgacca

SEQ ID NO: 3047305 - DNA, 20 bp, Homo sapiens
ccaggactatatttgggcct

SEQ ID NO: 3047306 - DNA, 17 bp, Homo sapiens
ccaggactcaccctcca

SEQ ID NO: 3047307 - DNA, 11 bp, Homo sapiens
ccaggactctg

SEQ ID NO: 3047308 - DNA, 21 bp, Homo sapiens
ccaggactgggtctgacctgg

SEQ ID NO: 3047309 - DNA, 20 bp, Homo sapiens
ccaggagaagggctggggcc

SEQ ID NO: 3047310 - DNA, 15 bp, Homo sapiens
ccaggagaaggtcag

SEQ ID NO: 3047311 - DNA, 20 bp, Homo sapiens
ccaggagaataaaagaaatt

SEQ ID NO: 3047312 - DNA, 23 bp, Homo sapiens
ccaggagaataaaagaaattcct

SEQ ID NO: 3047313 - DNA, 13 bp, Homo sapiens
ccaggagacctgc

SEQ ID NO: 3047314 - DNA, 17 bp, Homo sapiens
ccaggagagccagccct

SEQ ID NO: 3047315 - DNA, 19 bp, Homo sapiens
ccaggagagccagccctcc

SEQ ID NO: 3047316 - DNA, 17 bp, Homo sapiens
ccaggagattcagagct

SEQ ID NO: 3047317 - DNA, 19 bp, Homo sapiens
ccaggagccggacacttct

SEQ ID NO: 3047318 - DNA, 21 bp, Homo sapiens
ccaggagccggacacttctca

SEQ ID NO: 3047319 - DNA, 15 bp, Homo sapiens
ccaggagctctgcgc

SEQ ID NO: 3047320 - DNA, 19 bp, Homo sapiens
ccaggagctctgcgccagg

SEQ ID NO: 3047321 - DNA, 22 bp, Homo sapiens
ccaggagctctgcgccaggcag

SEQ ID NO: 3047322 - DNA, 23 bp, Homo sapiens
ccaggagctctgcgccaggcaga

SEQ ID NO: 3047323 - DNA, 13 bp, Homo sapiens
ccaggaggcggca

SEQ ID NO: 3047324 - DNA, 14 bp, Homo sapiens
ccaggaggcggcag

SEQ ID NO: 3047325 - DNA, 15 bp, Homo sapiens
ccaggaggcggcagc

SEQ ID NO: 3047326 - DNA, 17 bp, Homo sapiens
ccaggaggggaacactg

SEQ ID NO: 3047327 - DNA, 21 bp, Homo sapiens
ccaggaggggaacactgccct

SEQ ID NO: 3047328 - DNA, 21 bp, Homo sapiens
ccaggaggtttttttgtcaac

SEQ ID NO: 3047329 - DNA, 16 bp, Homo sapiens
ccaggatagagactgg

SEQ ID NO: 3047330 - DNA, 23 bp, Homo sapiens
ccaggatagtgggcaccccactg

SEQ ID NO: 3047331 - DNA, 21 bp, Homo sapiens
ccaggatcagattgcatgtga

SEQ ID NO: 3047332 - DNA, 18 bp, Homo sapiens
ccaggatcgttttttccc

SEQ ID NO: 3047333 - DNA, 21 bp, Homo sapiens
ccaggatctgctccaacagaa

SEQ ID NO: 3047334 - DNA, 17 bp, Homo sapiens
ccaggatttgcacagaa

SEQ ID NO: 3047335 - DNA, 19 bp, Homo sapiens
ccaggattttgtattgcca

SEQ ID NO: 3047336 - DNA, 17 bp, Homo sapiens
ccaggcacatggctggg

SEQ ID NO: 3047337 - DNA, 19 bp, Homo sapiens
ccaggcacgaacccacctg

SEQ ID NO: 3047338 - DNA, 13 bp, Homo sapiens
ccaggcactgcaa

SEQ ID NO: 3047339 - DNA, 13 bp, Homo sapiens
ccaggcagaagga

SEQ ID NO: 3047340 - DNA, 14 bp, Homo sapiens
ccaggcagagctga

SEQ ID NO: 3047341 - DNA, 18 bp, Homo sapiens
ccaggcagagctgagggc

SEQ ID NO: 3047342 - DNA, 18 bp, Homo sapiens
ccaggcagatccaggact

SEQ ID NO: 3047343 - DNA, 19 bp, Homo sapiens
ccaggcagatccaggacta

SEQ ID NO: 3047344 - DNA, 22 bp, Homo sapiens
ccaggcaggtctgcaagggccc

SEQ ID NO: 3047345 - DNA, 16 bp, Homo sapiens
ccaggcattgccaagg

SEQ ID NO: 3047346 - DNA, 22 bp, Homo sapiens
ccaggccagctccttttctgtg

SEQ ID NO: 3047347 - DNA, 20 bp, Homo sapiens
ccaggccatgtggcctgccc

SEQ ID NO: 3047348 - DNA, 15 bp, Homo sapiens
ccaggcccaaggctc

SEQ ID NO: 3047349 - DNA, 22 bp, Homo sapiens
ccaggcccgcgggcacagccag

SEQ ID NO: 3047350 - DNA, 15 bp, Homo sapiens
ccaggcccggggctg

SEQ ID NO: 3047351 - DNA, 16 bp, Homo sapiens
ccaggcccgtctgtcc

SEQ ID NO: 3047352 - DNA, 20 bp, Homo sapiens
ccaggccctcccaccacccc

SEQ ID NO: 3047353 - DNA, 22 bp, Homo sapiens
ccaggccctcccaccaccccat

SEQ ID NO: 3047354 - DNA, 14 bp, Homo sapiens
ccaggccctgccag

SEQ ID NO: 3047355 - DNA, 23 bp, Homo sapiens
ccaggccctgccagtggggaagg

SEQ ID NO: 3047356 - DNA, 15 bp, Homo sapiens
ccaggccctggaggg

SEQ ID NO: 3047357 - DNA, 17 bp, Homo sapiens
ccaggccctggagggca

SEQ ID NO: 3047358 - DNA, 21 bp, Homo sapiens
ccaggccctggagggcagaga

SEQ ID NO: 3047359 - DNA, 17 bp, Homo sapiens
ccaggccggagcccaga

SEQ ID NO: 3047360 - DNA, 18 bp, Homo sapiens
ccaggccggagcccagat

SEQ ID NO: 3047361 - DNA, 19 bp, Homo sapiens
ccaggccggagcccagata

SEQ ID NO: 3047362 - DNA, 17 bp, Homo sapiens
ccaggccgggcctgtac

SEQ ID NO: 3047363 - DNA, 23 bp, Homo sapiens
ccaggccgggcctgtacagtctg

SEQ ID NO: 3047364 - DNA, 17 bp, Homo sapiens
ccaggcctcactggctc

SEQ ID NO: 3047365 - DNA, 23 bp, Homo sapiens
ccaggcctcactggctcatgccc

SEQ ID NO: 3047366 - DNA, 15 bp, Homo sapiens
ccaggcctccagctc

SEQ ID NO: 3047367 - DNA, 16 bp, Homo sapiens
ccaggcctccagctca

SEQ ID NO: 3047368 - DNA, 13 bp, Homo sapiens
ccaggcctcgcac

SEQ ID NO: 3047369 - DNA, 16 bp, Homo sapiens
ccaggcctcgcctgcc

SEQ ID NO: 3047370 - DNA, 17 bp, Homo sapiens
ccaggcctcgcctgccc

SEQ ID NO: 3047371 - DNA, 22 bp, Homo sapiens
ccaggcctctcggtgctccatc

SEQ ID NO: 3047372 - DNA, 16 bp, Homo sapiens
ccaggcctcttggcag

SEQ ID NO: 3047373 - DNA, 17 bp, Homo sapiens
ccaggcctgccctgcta

SEQ ID NO: 3047374 - DNA, 12 bp, Homo sapiens
ccaggcctggct

SEQ ID NO: 3047375 - DNA, 14 bp, Homo sapiens
ccaggcctggctcc

SEQ ID NO: 3047376 - DNA, 15 bp, Homo sapiens
ccaggcctggctccc

SEQ ID NO: 3047377 - DNA, 17 bp, Homo sapiens
ccaggcctggctccccg

SEQ ID NO: 3047378 - DNA, 19 bp, Homo sapiens
ccaggcctggctccccgag

SEQ ID NO: 3047379 - DNA, 17 bp, Homo sapiens
ccaggccttgctgactc

SEQ ID NO: 3047380 - DNA, 18 bp, Homo sapiens
ccaggcgagcctgactct

SEQ ID NO: 3047381 - DNA, 17 bp, Homo sapiens
ccaggcgctgcagggcc

SEQ ID NO: 3047382 - DNA, 18 bp, Homo sapiens
ccaggctagctggagcct

SEQ ID NO: 3047383 - DNA, 19 bp, Homo sapiens
ccaggctagctggagcctg

SEQ ID NO: 3047384 - DNA, 16 bp, Homo sapiens
ccaggctcctccctcc

SEQ ID NO: 3047385 - DNA, 19 bp, Homo sapiens
ccaggctgaccacagcaca

SEQ ID NO: 3047386 - DNA, 20 bp, Homo sapiens
ccaggctgaccacagcacag

SEQ ID NO: 3047387 - DNA, 20 bp, Homo sapiens
ccaggctgcagatgatcagg

SEQ ID NO: 3047388 - DNA, 19 bp, Homo sapiens
ccaggctgcggtgggcagc

SEQ ID NO: 3047389 - DNA, 20 bp, Homo sapiens
ccaggctggagtgcaatggt

SEQ ID NO: 3047390 - DNA, 18 bp, Homo sapiens
ccaggctggccagtgctg

SEQ ID NO: 3047391 - DNA, 13 bp, Homo sapiens
ccaggctgggctg

SEQ ID NO: 3047392 - DNA, 14 bp, Homo sapiens
ccaggctgggctga

SEQ ID NO: 3047393 - DNA, 16 bp, Homo sapiens
ccaggctgggctgagc

SEQ ID NO: 3047394 - DNA, 22 bp, Homo sapiens
ccaggctgggctgagccaaagc

SEQ ID NO: 3047395 - DNA, 16 bp, Homo sapiens
ccaggctgggtgacag

SEQ ID NO: 3047396 - DNA, 17 bp, Homo sapiens
ccaggctgggtgacaga

SEQ ID NO: 3047397 - DNA, 16 bp, Homo sapiens
ccaggcttctcccgga

SEQ ID NO: 3047398 - DNA, 19 bp, Homo sapiens
ccaggcttctcccggacct

SEQ ID NO: 3047399 - DNA, 17 bp, Homo sapiens
ccaggcttgcctgggct

SEQ ID NO: 3047400 - DNA, 12 bp, Homo sapiens
ccaggcttggaa

SEQ ID NO: 3047401 - DNA, 19 bp, Homo sapiens
ccagggacccaaagcagga

SEQ ID NO: 3047402 - DNA, 22 bp, Homo sapiens
ccagggagacctggacacaggc

SEQ ID NO: 3047403 - DNA, 14 bp, Homo sapiens
ccagggagaggctg

SEQ ID NO: 3047404 - DNA, 15 bp, Homo sapiens
ccagggagaggctgt

SEQ ID NO: 3047405 - DNA, 23 bp, Homo sapiens
ccagggagaggctgtgtccctgc

SEQ ID NO: 3047406 - DNA, 19 bp, Homo sapiens
ccagggagcattttcctcc

SEQ ID NO: 3047407 - DNA, 14 bp, Homo sapiens
ccagggagcctttg

SEQ ID NO: 3047408 - DNA, 22 bp, Homo sapiens
ccagggagcctttggttctggc

SEQ ID NO: 3047409 - DNA, 19 bp, Homo sapiens
ccagggagcggaaagcagc

SEQ ID NO: 3047410 - DNA, 14 bp, Homo sapiens
ccagggaggggccg

SEQ ID NO: 3047411 - DNA, 23 bp, Homo sapiens
ccagggaggggccggccctgtgt

SEQ ID NO: 3047412 - DNA, 19 bp, Homo sapiens
ccagggagggtgagctggt

SEQ ID NO: 3047413 - DNA, 21 bp, Homo sapiens
ccagggagggtgagctggtgc

SEQ ID NO: 3047414 - DNA, 13 bp, Homo sapiens
ccagggcagggcc

SEQ ID NO: 3047415 - DNA, 14 bp, Homo sapiens
ccagggccacgctc

SEQ ID NO: 3047416 - DNA, 22 bp, Homo sapiens
ccagggccagcaggcagcgcct

SEQ ID NO: 3047417 - DNA, 14 bp, Homo sapiens
ccagggcccagagc

SEQ ID NO: 3047418 - DNA, 15 bp, Homo sapiens
ccagggcccaggcca

SEQ ID NO: 3047419 - DNA, 17 bp, Homo sapiens
ccagggcccccatctca

SEQ ID NO: 3047420 - DNA, 17 bp, Homo sapiens
ccagggctctgggggca

SEQ ID NO: 3047421 - DNA, 12 bp, Homo sapiens
ccagggctgggt

SEQ ID NO: 3047422 - DNA, 14 bp, Homo sapiens
ccagggctgggtca

SEQ ID NO: 3047423 - DNA, 20 bp, Homo sapiens
ccaggggagaatgcagccca

SEQ ID NO: 3047424 - DNA, 21 bp, Homo sapiens
ccaggggagaatgcagcccac

SEQ ID NO: 3047425 - DNA, 18 bp, Homo sapiens
ccaggggagagggtctgg

SEQ ID NO: 3047426 - DNA, 21 bp, Homo sapiens
ccaggggagagggtctggaga

SEQ ID NO: 3047427 - DNA, 16 bp, Homo sapiens
ccaggggagttgtgtc

SEQ ID NO: 3047428 - DNA, 14 bp, Homo sapiens
ccaggggcagccac

SEQ ID NO: 3047429 - DNA, 15 bp, Homo sapiens
ccaggggcagccaca

SEQ ID NO: 3047430 - DNA, 17 bp, Homo sapiens
ccagggtcagaaacagg

SEQ ID NO: 3047431 - DNA, 14 bp, Homo sapiens
ccagggtcccctgc

SEQ ID NO: 3047432 - DNA, 21 bp, Homo sapiens
ccagggtcccctgccaccgac

SEQ ID NO: 3047433 - DNA, 18 bp, Homo sapiens
ccagggtctagccgctgc

SEQ ID NO: 3047434 - DNA, 21 bp, Homo sapiens
ccagggtctagccgctgccct

SEQ ID NO: 3047435 - DNA, 23 bp, Homo sapiens
ccaggtaatggcatgagatagct

SEQ ID NO: 3047436 - DNA, 16 bp, Homo sapiens
ccaggtacgcacagac

SEQ ID NO: 3047437 - DNA, 16 bp, Homo sapiens
ccaggtagcagcaaat

SEQ ID NO: 3047438 - DNA, 13 bp, Homo sapiens
ccaggtagctggg

SEQ ID NO: 3047439 - DNA, 14 bp, Homo sapiens
ccaggtagctggga

SEQ ID NO: 3047440 - DNA, 20 bp, Homo sapiens
ccaggtagctgggattacag

SEQ ID NO: 3047441 - DNA, 19 bp, Homo sapiens
ccaggtcaacagaatgaaa

SEQ ID NO: 3047442 - DNA, 21 bp, Homo sapiens
ccaggtcccccgactgcctgt

SEQ ID NO: 3047443 - DNA, 15 bp, Homo sapiens
ccaggtccccctgca

SEQ ID NO: 3047444 - DNA, 13 bp, Homo sapiens
ccaggtcctgctc

SEQ ID NO: 3047445 - DNA, 15 bp, Homo sapiens
ccaggtcctgctccg

SEQ ID NO: 3047446 - DNA, 21 bp, Homo sapiens
ccaggtcttgacctgaactct

SEQ ID NO: 3047447 - DNA, 13 bp, Homo sapiens
ccaggtgcagagg

SEQ ID NO: 3047448 - DNA, 22 bp, Homo sapiens
ccaggtgcagaggtaccctggg

SEQ ID NO: 3047449 - DNA, 13 bp, Homo sapiens
ccaggtgcatctg

SEQ ID NO: 3047450 - DNA, 13 bp, Homo sapiens
ccaggtgcccagc

SEQ ID NO: 3047451 - DNA, 15 bp, Homo sapiens
ccaggtgcccagcta

SEQ ID NO: 3047452 - DNA, 21 bp, Homo sapiens
ccaggtgcctttcaaatttag

SEQ ID NO: 3047453 - DNA, 16 bp, Homo sapiens
ccaggtgcggcctggg

SEQ ID NO: 3047454 - DNA, 17 bp, Homo sapiens
ccaggtgcggcctgggg

SEQ ID NO: 3047455 - DNA, 19 bp, Homo sapiens
ccaggtggctgacccagtc

SEQ ID NO: 3047456 - DNA, 22 bp, Homo sapiens
ccaggtggctgacccagtccct

SEQ ID NO: 3047457 - DNA, 20 bp, Homo sapiens
ccaggtggggtttcctgcat

SEQ ID NO: 3047458 - DNA, 17 bp, Homo sapiens
ccaggtgttactgtaat

SEQ ID NO: 3047459 - DNA, 21 bp, Homo sapiens
ccaggtgttactgtaattcct

SEQ ID NO: 3047460 - DNA, 17 bp, Homo sapiens
ccaggttaggaaggcag

SEQ ID NO: 3047461 - DNA, 13 bp, Homo sapiens
ccaggttcactta

SEQ ID NO: 3047462 - DNA, 17 bp, Homo sapiens
ccaggtttttgcccatc

SEQ ID NO: 3047463 - DNA, 22 bp, Homo sapiens
ccagtaacgggtcgtaatgact

SEQ ID NO: 3047464 - DNA, 19 bp, Homo sapiens
ccagtagctgggattacag

SEQ ID NO: 3047465 - DNA, 16 bp, Homo sapiens
ccagtagtaccttgtt

SEQ ID NO: 3047466 - DNA, 14 bp, Homo sapiens
ccagtatctatata

SEQ ID NO: 3047467 - DNA, 17 bp, Homo sapiens
ccagtattactgctgct

SEQ ID NO: 3047468 - DNA, 19 bp, Homo sapiens
ccagtattactgctgctgt

SEQ ID NO: 3047469 - DNA, 20 bp, Homo sapiens
ccagtattactgctgctgtg

SEQ ID NO: 3047470 - DNA, 19 bp, Homo sapiens
ccagtcaggtagttgcaat

SEQ ID NO: 3047471 - DNA, 13 bp, Homo sapiens
ccagtcatcatct

SEQ ID NO: 3047472 - DNA, 23 bp, Homo sapiens
ccagtccctgggggaagccctgg

SEQ ID NO: 3047473 - DNA, 15 bp, Homo sapiens
ccagtcctaacaaat

SEQ ID NO: 3047474 - DNA, 16 bp, Homo sapiens
ccagtcctgctggcct

SEQ ID NO: 3047475 - DNA, 13 bp, Homo sapiens
ccagtcctggtcc

SEQ ID NO: 3047476 - DNA, 14 bp, Homo sapiens
ccagtcctggtcct

SEQ ID NO: 3047477 - DNA, 20 bp, Homo sapiens
ccagtcctggtcctggctgc

SEQ ID NO: 3047478 - DNA, 17 bp, Homo sapiens
ccagtccttccacctcg

SEQ ID NO: 3047479 - DNA, 23 bp, Homo sapiens
ccagtcgcccttacttcttgccc

SEQ ID NO: 3047480 - DNA, 21 bp, Homo sapiens
ccagtcgggagagccaggctt

SEQ ID NO: 3047481 - DNA, 23 bp, Homo sapiens
ccagtctctgctccacctttcag

SEQ ID NO: 3047482 - DNA, 12 bp, Homo sapiens
ccagtctgaccc

SEQ ID NO: 3047483 - DNA, 13 bp, Homo sapiens
ccagtctgaccct

SEQ ID NO: 3047484 - DNA, 19 bp, Homo sapiens
ccagtcttcctcttagcct

SEQ ID NO: 3047485 - DNA, 21 bp, Homo sapiens
ccagtgaagacgtcaggggca

SEQ ID NO: 3047486 - DNA, 12 bp, Homo sapiens
ccagtgaatttt

SEQ ID NO: 3047487 - DNA, 15 bp, Homo sapiens
ccagtgacctgagga

SEQ ID NO: 3047488 - DNA, 19 bp, Homo sapiens
ccagtgacctgaggaagcg

SEQ ID NO: 3047489 - DNA, 22 bp, Homo sapiens
ccagtgagggacgtcagacttg

SEQ ID NO: 3047490 - DNA, 17 bp, Homo sapiens
ccagtgagtggccccac

SEQ ID NO: 3047491 - DNA, 15 bp, Homo sapiens
ccagtgcaggctggc

SEQ ID NO: 3047492 - DNA, 16 bp, Homo sapiens
ccagtgcaggctggcc

SEQ ID NO: 3047493 - DNA, 18 bp, Homo sapiens
ccagtgcaggctggccag

SEQ ID NO: 3047494 - DNA, 21 bp, Homo sapiens
ccagtgcaggctggccagccg

SEQ ID NO: 3047495 - DNA, 13 bp, Homo sapiens
ccagtgccgagga

SEQ ID NO: 3047496 - DNA, 15 bp, Homo sapiens
ccagtgcctcctagc

SEQ ID NO: 3047497 - DNA, 17 bp, Homo sapiens
ccagtgccttacctcct

SEQ ID NO: 3047498 - DNA, 13 bp, Homo sapiens
ccagtgctgcatg

SEQ ID NO: 3047499 - DNA, 13 bp, Homo sapiens
ccagtggtctcac

SEQ ID NO: 3047500 - DNA, 20 bp, Homo sapiens
ccagtgttagggaagggcct

SEQ ID NO: 3047501 - DNA, 22 bp, Homo sapiens
ccagttagttagaattggaaat

SEQ ID NO: 3047502 - DNA, 21 bp, Homo sapiens
ccagttcacttctttgcagag

SEQ ID NO: 3047503 - DNA, 13 bp, Homo sapiens
ccagttccaggac

SEQ ID NO: 3047504 - DNA, 23 bp, Homo sapiens
ccagttggagttttttgtaccaa

SEQ ID NO: 3047505 - DNA, 22 bp, Homo sapiens
ccagtttaagacaccaaatata

SEQ ID NO: 3047506 - DNA, 19 bp, Homo sapiens
ccagtttctgtaaggtctt

SEQ ID NO: 3047507 - DNA, 18 bp, Homo sapiens
ccagttttactgtgattc

SEQ ID NO: 3047508 - DNA, 15 bp, Homo sapiens
ccataaccactgaag

SEQ ID NO: 3047509 - DNA, 22 bp, Homo sapiens
ccataagtttaactttaaaact

SEQ ID NO: 3047510 - DNA, 14 bp, Homo sapiens
ccataatacaaaag

SEQ ID NO: 3047511 - DNA, 13 bp, Homo sapiens
ccatagcaccctg

SEQ ID NO: 3047512 - DNA, 20 bp, Homo sapiens
ccatagctcttcacttcctc

SEQ ID NO: 3047513 - DNA, 17 bp, Homo sapiens
ccataggccaaggtgca

SEQ ID NO: 3047514 - DNA, 14 bp, Homo sapiens
ccataggcccacac

SEQ ID NO: 3047515 - DNA, 16 bp, Homo sapiens
ccataggcccacacac

SEQ ID NO: 3047516 - DNA, 18 bp, Homo sapiens
ccataggcccacacacag

SEQ ID NO: 3047517 - DNA, 12 bp, Homo sapiens
ccatagggagct

SEQ ID NO: 3047518 - DNA, 16 bp, Homo sapiens
ccatagtaactgacat

SEQ ID NO: 3047519 - DNA, 18 bp, Homo sapiens
ccatagtaactgacatga

SEQ ID NO: 3047520 - DNA, 15 bp, Homo sapiens
ccatagtcacatggc

SEQ ID NO: 3047521 - DNA, 21 bp, Homo sapiens
ccatagtttgggtatttttgg

SEQ ID NO: 3047522 - DNA, 16 bp, Homo sapiens
ccatataagtttgaag

SEQ ID NO: 3047523 - DNA, 22 bp, Homo sapiens
ccatataagtttgaaggaaaca

SEQ ID NO: 3047524 - DNA, 14 bp, Homo sapiens
ccatatatatatat

SEQ ID NO: 3047525 - DNA, 18 bp, Homo sapiens
ccatatccttaccctcct

SEQ ID NO: 3047526 - DNA, 20 bp, Homo sapiens
ccatatcttctgtttcataa

SEQ ID NO: 3047527 - DNA, 17 bp, Homo sapiens
ccatatggacactgtga

SEQ ID NO: 3047528 - DNA, 20 bp, Homo sapiens
ccatatttgaattggcctga

SEQ ID NO: 3047529 - DNA, 21 bp, Homo sapiens
ccatatttgaattggcctgaa

SEQ ID NO: 3047530 - DNA, 15 bp, Homo sapiens
ccatatttgtgttca

SEQ ID NO: 3047531 - DNA, 17 bp, Homo sapiens
ccatcaacaaaaattgt

SEQ ID NO: 3047532 - DNA, 17 bp, Homo sapiens
ccatcaagcacttccca

SEQ ID NO: 3047533 - DNA, 19 bp, Homo sapiens
ccatcaagcacttcccagg

SEQ ID NO: 3047534 - DNA, 19 bp, Homo sapiens
ccatcactagagtgctctg

SEQ ID NO: 3047535 - DNA, 20 bp, Homo sapiens
ccatcactagagtgctctga

SEQ ID NO: 3047536 - DNA, 20 bp, Homo sapiens
ccatcactcagcccctaccc

SEQ ID NO: 3047537 - DNA, 21 bp, Homo sapiens
ccatcactcgcaggaccaagg

SEQ ID NO: 3047538 - DNA, 15 bp, Homo sapiens
ccatcagtgccagcc

SEQ ID NO: 3047539 - DNA, 17 bp, Homo sapiens
ccatcagtgccagcccc

SEQ ID NO: 3047540 - DNA, 15 bp, Homo sapiens
ccatcatctctgcct

SEQ ID NO: 3047541 - DNA, 18 bp, Homo sapiens
ccatcatctctgcctttg

SEQ ID NO: 3047542 - DNA, 13 bp, Homo sapiens
ccatcatctgctg

SEQ ID NO: 3047543 - DNA, 22 bp, Homo sapiens
ccatcattgctgtctgcagcct

SEQ ID NO: 3047544 - DNA, 16 bp, Homo sapiens
ccatccaacagacctg

SEQ ID NO: 3047545 - DNA, 15 bp, Homo sapiens
ccatccagcttgcca

SEQ ID NO: 3047546 - DNA, 24 bp, Homo sapiens
ccatccatgtgctagtcactggca

SEQ ID NO: 3047547 - DNA, 17 bp, Homo sapiens
ccatcccactgctcccc

SEQ ID NO: 3047548 - DNA, 22 bp, Homo sapiens
ccatccgcagactgcttggcca

SEQ ID NO: 3047549 - DNA, 23 bp, Homo sapiens
ccatccgcagactgcttggccag

SEQ ID NO: 3047550 - DNA, 22 bp, Homo sapiens
ccatcctaatcatccaatgctc

SEQ ID NO: 3047551 - DNA, 18 bp, Homo sapiens
ccatcctaccccctgtgc

SEQ ID NO: 3047552 - DNA, 19 bp, Homo sapiens
ccatcctcaagatcattca

SEQ ID NO: 3047553 - DNA, 15 bp, Homo sapiens
ccatcctccagcagg

SEQ ID NO: 3047554 - DNA, 16 bp, Homo sapiens
ccatcctccagccctg

SEQ ID NO: 3047555 - DNA, 23 bp, Homo sapiens
ccatcctccagccctgcccaccc

SEQ ID NO: 3047556 - DNA, 24 bp, Homo sapiens
ccatcctgtgtccccttcatcctt

SEQ ID NO: 3047557 - DNA, 22 bp, Homo sapiens
ccatcggccctgtcccctggag

SEQ ID NO: 3047558 - DNA, 17 bp, Homo sapiens
ccatcgggtgccaaata

SEQ ID NO: 3047559 - DNA, 23 bp, Homo sapiens
ccatcgtattaaaaaacaattaa

SEQ ID NO: 3047560 - DNA, 19 bp, Homo sapiens
ccatctaatgcttgtttat

SEQ ID NO: 3047561 - DNA, 19 bp, Homo sapiens
ccatctactcttttgaagt

SEQ ID NO: 3047562 - DNA, 14 bp, Homo sapiens
ccatctcaggttgg

SEQ ID NO: 3047563 - DNA, 17 bp, Homo sapiens
ccatctccgcctccaca

SEQ ID NO: 3047564 - DNA, 18 bp, Homo sapiens
ccatctctcatcctccag

SEQ ID NO: 3047565 - DNA, 20 bp, Homo sapiens
ccatctctcccttacccatc

SEQ ID NO: 3047566 - DNA, 13 bp, Homo sapiens
ccatctctctccc

SEQ ID NO: 3047567 - DNA, 22 bp, Homo sapiens
ccatctgatgtgatgtgaatac

SEQ ID NO: 3047568 - DNA, 20 bp, Homo sapiens
ccatctgcacccccctgggc

SEQ ID NO: 3047569 - DNA, 18 bp, Homo sapiens
ccatctgcccgcctgccc

SEQ ID NO: 3047570 - DNA, 23 bp, Homo sapiens
ccatctgcccgcctgcccacctg

SEQ ID NO: 3047571 - DNA, 13 bp, Homo sapiens
ccatctgtccaca

SEQ ID NO: 3047572 - DNA, 15 bp, Homo sapiens
ccatctgtccatcct

SEQ ID NO: 3047573 - DNA, 19 bp, Homo sapiens
ccatctgtccatcctcctc

SEQ ID NO: 3047574 - DNA, 22 bp, Homo sapiens
ccatctgtgactataaagctgt

SEQ ID NO: 3047575 - DNA, 12 bp, Homo sapiens
ccatctgtgcat

SEQ ID NO: 3047576 - DNA, 14 bp, Homo sapiens
ccatctgtgcattc

SEQ ID NO: 3047577 - DNA, 15 bp, Homo sapiens
ccatcttagtttgga

SEQ ID NO: 3047578 - DNA, 16 bp, Homo sapiens
ccatcttcacccaggc

SEQ ID NO: 3047579 - DNA, 21 bp, Homo sapiens
ccatcttcacccaggcctatg

SEQ ID NO: 3047580 - DNA, 14 bp, Homo sapiens
ccatcttccagcca

SEQ ID NO: 3047581 - DNA, 21 bp, Homo sapiens
ccatcttcccgcctcagcctc

SEQ ID NO: 3047582 - DNA, 15 bp, Homo sapiens
ccatcttgcttccaa

SEQ ID NO: 3047583 - DNA, 13 bp, Homo sapiens
ccatcttggtaaa

SEQ ID NO: 3047584 - DNA, 17 bp, Homo sapiens
ccatcttggtaaatttc

SEQ ID NO: 3047585 - DNA, 15 bp, Homo sapiens
ccatgaagccacagc

SEQ ID NO: 3047586 - DNA, 16 bp, Homo sapiens
ccatgaagccacagcc

SEQ ID NO: 3047587 - DNA, 18 bp, Homo sapiens
ccatgaatcgcttctctt

SEQ ID NO: 3047588 - DNA, 19 bp, Homo sapiens
ccatgaatcgcttctcttt

SEQ ID NO: 3047589 - DNA, 13 bp, Homo sapiens
ccatgacattttt

SEQ ID NO: 3047590 - DNA, 19 bp, Homo sapiens
ccatgaccttggggtacaa

SEQ ID NO: 3047591 - DNA, 20 bp, Homo sapiens
ccatgagaacaaaacctctt

SEQ ID NO: 3047592 - DNA, 20 bp, Homo sapiens
ccatgagactgatccctggc

SEQ ID NO: 3047593 - DNA, 12 bp, Homo sapiens
ccatgagcaagc

SEQ ID NO: 3047594 - DNA, 12 bp, Homo sapiens
ccatgagctcct

SEQ ID NO: 3047595 - DNA, 21 bp, Homo sapiens
ccatgagctccttaaggctct

SEQ ID NO: 3047596 - DNA, 20 bp, Homo sapiens
ccatgaggagttgctgtttg

SEQ ID NO: 3047597 - DNA, 14 bp, Homo sapiens
ccatgatgcctctg

SEQ ID NO: 3047598 - DNA, 18 bp, Homo sapiens
ccatgatttcccactgca

SEQ ID NO: 3047599 - DNA, 17 bp, Homo sapiens
ccatgcaagcagaggac

SEQ ID NO: 3047600 - DNA, 16 bp, Homo sapiens
ccatgcaggaaggaaa

SEQ ID NO: 3047601 - DNA, 18 bp, Homo sapiens
ccatgcaggaaggaaaac

SEQ ID NO: 3047602 - DNA, 16 bp, Homo sapiens
ccatgcctcagccctg

SEQ ID NO: 3047603 - DNA, 18 bp, Homo sapiens
ccatgcctgtggctgcgc

SEQ ID NO: 3047604 - DNA, 19 bp, Homo sapiens
ccatgcgcgcgctctctct

SEQ ID NO: 3047605 - DNA, 16 bp, Homo sapiens
ccatgctccagggtca

SEQ ID NO: 3047606 - DNA, 21 bp, Homo sapiens
ccatgctccagggtcaggcgg

SEQ ID NO: 3047607 - DNA, 21 bp, Homo sapiens
ccatgctgttgattgctaaat

SEQ ID NO: 3047608 - DNA, 11 bp, Homo sapiens
ccatggaaggt

SEQ ID NO: 3047609 - DNA, 15 bp, Homo sapiens
ccatggaaggtgcca

SEQ ID NO: 3047610 - DNA, 23 bp, Homo sapiens
ccatggaaggtgccagaaggaag

SEQ ID NO: 3047611 - DNA, 18 bp, Homo sapiens
ccatggagccagctccct

SEQ ID NO: 3047612 - DNA, 19 bp, Homo sapiens
ccatggagtgagacccagg

SEQ ID NO: 3047613 - DNA, 18 bp, Homo sapiens
ccatggatttccactgct

SEQ ID NO: 3047614 - DNA, 14 bp, Homo sapiens
ccatggcaggaagg

SEQ ID NO: 3047615 - DNA, 16 bp, Homo sapiens
ccatggctcagggtgg

SEQ ID NO: 3047616 - DNA, 17 bp, Homo sapiens
ccatggctgcacagttg

SEQ ID NO: 3047617 - DNA, 16 bp, Homo sapiens
ccatggcttcctgaga

SEQ ID NO: 3047618 - DNA, 17 bp, Homo sapiens
ccatgggcagagcccaa

SEQ ID NO: 3047619 - DNA, 20 bp, Homo sapiens
ccatgggggctgtctttgca

SEQ ID NO: 3047620 - DNA, 16 bp, Homo sapiens
ccatggtagaaaatgc

SEQ ID NO: 3047621 - DNA, 15 bp, Homo sapiens
ccatggtcctgtctg

SEQ ID NO: 3047622 - DNA, 20 bp, Homo sapiens
ccatggtgatggtgtagccc

SEQ ID NO: 3047623 - DNA, 19 bp, Homo sapiens
ccatggtgtgatcgtctga

SEQ ID NO: 3047624 - DNA, 16 bp, Homo sapiens
ccatgtagcaggactg

SEQ ID NO: 3047625 - DNA, 22 bp, Homo sapiens
ccatgtagccccctggcctctg

SEQ ID NO: 3047626 - DNA, 22 bp, Homo sapiens
ccatgtcaccggatcctgggtg

SEQ ID NO: 3047627 - DNA, 15 bp, Homo sapiens
ccatgtcccctccca

SEQ ID NO: 3047628 - DNA, 16 bp, Homo sapiens
ccatgtctctcagaat

SEQ ID NO: 3047629 - DNA, 13 bp, Homo sapiens
ccatgtctgcatt

SEQ ID NO: 3047630 - DNA, 14 bp, Homo sapiens
ccatgtctgtgctg

SEQ ID NO: 3047631 - DNA, 20 bp, Homo sapiens
ccatgtgcggagcagccttt

SEQ ID NO: 3047632 - DNA, 17 bp, Homo sapiens
ccatgtggagacttcat

SEQ ID NO: 3047633 - DNA, 14 bp, Homo sapiens
ccatgtggcctgcc

SEQ ID NO: 3047634 - DNA, 16 bp, Homo sapiens
ccatgtggcctgccca

SEQ ID NO: 3047635 - DNA, 17 bp, Homo sapiens
ccatgtggcctgcccag

SEQ ID NO: 3047636 - DNA, 18 bp, Homo sapiens
ccatgtggcctgcccagc

SEQ ID NO: 3047637 - DNA, 14 bp, Homo sapiens
ccatgtgtggagtg

SEQ ID NO: 3047638 - DNA, 17 bp, Homo sapiens
ccatgtgttttgctttt

SEQ ID NO: 3047639 - DNA, 18 bp, Homo sapiens
ccatgtgttttgctttta

SEQ ID NO: 3047640 - DNA, 19 bp, Homo sapiens
ccatgtgttttgcttttat

SEQ ID NO: 3047641 - DNA, 20 bp, Homo sapiens
ccatgttagccgggatggtc

SEQ ID NO: 3047642 - DNA, 21 bp, Homo sapiens
ccatgtttgagctcagacccc

SEQ ID NO: 3047643 - DNA, 17 bp, Homo sapiens
ccatgtttttgccaaaa

SEQ ID NO: 3047644 - DNA, 14 bp, Homo sapiens
ccattacccagtgc

SEQ ID NO: 3047645 - DNA, 17 bp, Homo sapiens
ccattagccagatttgt

SEQ ID NO: 3047646 - DNA, 19 bp, Homo sapiens
ccattagctttcaattccg

SEQ ID NO: 3047647 - DNA, 14 bp, Homo sapiens
ccattatagcgcct

SEQ ID NO: 3047648 - DNA, 20 bp, Homo sapiens
ccattatagcgcctgtataa

SEQ ID NO: 3047649 - DNA, 13 bp, Homo sapiens
ccattatcatgtg

SEQ ID NO: 3047650 - DNA, 14 bp, Homo sapiens
ccattatcatgtgt

SEQ ID NO: 3047651 - DNA, 15 bp, Homo sapiens
ccattatgtcctagt

SEQ ID NO: 3047652 - DNA, 23 bp, Homo sapiens
ccattcatctctaacatatgata

SEQ ID NO: 3047653 - DNA, 15 bp, Homo sapiens
ccattcatgtcctgt

SEQ ID NO: 3047654 - DNA, 12 bp, Homo sapiens
ccattcctgctc

SEQ ID NO: 3047655 - DNA, 14 bp, Homo sapiens
ccattctcctgcct

SEQ ID NO: 3047656 - DNA, 12 bp, Homo sapiens
ccattctttccc

SEQ ID NO: 3047657 - DNA, 16 bp, Homo sapiens
ccattctttcttcctc

SEQ ID NO: 3047658 - DNA, 22 bp, Homo sapiens
ccattcttttgtaatttaaatg

SEQ ID NO: 3047659 - DNA, 13 bp, Homo sapiens
ccattgaattctt

SEQ ID NO: 3047660 - DNA, 13 bp, Homo sapiens
ccattgcacccag

SEQ ID NO: 3047661 - DNA, 15 bp, Homo sapiens
ccattgctgctcctt

SEQ ID NO: 3047662 - DNA, 19 bp, Homo sapiens
ccattgctgttctactttt

SEQ ID NO: 3047663 - DNA, 15 bp, Homo sapiens
ccattggatctcatt

SEQ ID NO: 3047664 - DNA, 21 bp, Homo sapiens
ccattggctatttaaaacttg

SEQ ID NO: 3047665 - DNA, 22 bp, Homo sapiens
ccattggctgcgctaaccccca

SEQ ID NO: 3047666 - DNA, 14 bp, Homo sapiens
ccattggtccaaga

SEQ ID NO: 3047667 - DNA, 16 bp, Homo sapiens
ccattgtactccagcc

SEQ ID NO: 3047668 - DNA, 21 bp, Homo sapiens
ccattgtttgaaacaaagaag

SEQ ID NO: 3047669 - DNA, 20 bp, Homo sapiens
ccatttaaactaacctttta

SEQ ID NO: 3047670 - DNA, 16 bp, Homo sapiens
ccatttcccacatctt

SEQ ID NO: 3047671 - DNA, 21 bp, Homo sapiens
ccatttcgtgagccccatctt

SEQ ID NO: 3047672 - DNA, 14 bp, Homo sapiens
ccatttctccagaa

SEQ ID NO: 3047673 - DNA, 13 bp, Homo sapiens
ccatttctttctt

SEQ ID NO: 3047674 - DNA, 16 bp, Homo sapiens
ccatttctttcttcca

SEQ ID NO: 3047675 - DNA, 17 bp, Homo sapiens
ccatttgattgttttat

SEQ ID NO: 3047676 - DNA, 13 bp, Homo sapiens
ccatttgtaattt

SEQ ID NO: 3047677 - DNA, 14 bp, Homo sapiens
ccatttgtaatttg

SEQ ID NO: 3047678 - DNA, 15 bp, Homo sapiens
ccatttgtagtgagc

SEQ ID NO: 3047679 - DNA, 22 bp, Homo sapiens
ccatttgtcatcgttccccacc

SEQ ID NO: 3047680 - DNA, 22 bp, Homo sapiens
ccatttgttgctgctgctgctc

SEQ ID NO: 3047681 - DNA, 21 bp, Homo sapiens
ccattttcccatcatcctttg

SEQ ID NO: 3047682 - DNA, 19 bp, Homo sapiens
ccattttgcccttccatag

SEQ ID NO: 3047683 - DNA, 21 bp, Homo sapiens
ccattttgcctgacaattgca

SEQ ID NO: 3047684 - DNA, 12 bp, Homo sapiens
ccattttgtgaa

SEQ ID NO: 3047685 - DNA, 14 bp, Homo sapiens
ccattttgtgaagc

SEQ ID NO: 3047686 - DNA, 17 bp, Homo sapiens
ccattttttaaggaaac

SEQ ID NO: 3047687 - DNA, 23 bp, Homo sapiens
cccaaaagtcaaaaggtgcctgt

SEQ ID NO: 3047688 - DNA, 12 bp, Homo sapiens
cccaaactgtga

SEQ ID NO: 3047689 - DNA, 23 bp, Homo sapiens
cccaaactgttgattattagcca

SEQ ID NO: 3047690 - DNA, 13 bp, Homo sapiens
cccaaagccactg

SEQ ID NO: 3047691 - DNA, 21 bp, Homo sapiens
cccaaagccactggaaggagc

SEQ ID NO: 3047692 - DNA, 17 bp, Homo sapiens
cccaaagcctgtcccag

SEQ ID NO: 3047693 - DNA, 21 bp, Homo sapiens
cccaaagcggccgatgggagt

SEQ ID NO: 3047694 - DNA, 19 bp, Homo sapiens
cccaaagcttgtaaatatg

SEQ ID NO: 3047695 - DNA, 20 bp, Homo sapiens
cccaaagtgctgagattaca

SEQ ID NO: 3047696 - DNA, 17 bp, Homo sapiens
cccaaatccgccagtgt

SEQ ID NO: 3047697 - DNA, 18 bp, Homo sapiens
cccaaatccgccagtgtt

SEQ ID NO: 3047698 - DNA, 19 bp, Homo sapiens
cccaaatccgccagtgttt

SEQ ID NO: 3047699 - DNA, 15 bp, Homo sapiens
cccaacactgccagc

SEQ ID NO: 3047700 - DNA, 16 bp, Homo sapiens
cccaacactgccagca

SEQ ID NO: 3047701 - DNA, 13 bp, Homo sapiens
cccaacagcactt

SEQ ID NO: 3047702 - DNA, 16 bp, Homo sapiens
cccaacagtgtgaagt

SEQ ID NO: 3047703 - DNA, 14 bp, Homo sapiens
cccaacatataaaa

SEQ ID NO: 3047704 - DNA, 20 bp, Homo sapiens
cccaaccaaggaaggagccc

SEQ ID NO: 3047705 - DNA, 23 bp, Homo sapiens
cccaaccaaggaaggagcccctg

SEQ ID NO: 3047706 - DNA, 23 bp, Homo sapiens
cccaaccccttaagccctggccc

SEQ ID NO: 3047707 - DNA, 17 bp, Homo sapiens
cccaacctgtccttact

SEQ ID NO: 3047708 - DNA, 15 bp, Homo sapiens
cccaactcctggaag

SEQ ID NO: 3047709 - DNA, 23 bp, Homo sapiens
cccaactcctggaagctgtgtcc

SEQ ID NO: 3047710 - DNA, 15 bp, Homo sapiens
cccaactctagctgg

SEQ ID NO: 3047711 - DNA, 15 bp, Homo sapiens
cccaactctcccctg

SEQ ID NO: 3047712 - DNA, 22 bp, Homo sapiens
cccaactgtggtagctccagcg

SEQ ID NO: 3047713 - DNA, 17 bp, Homo sapiens
cccaagaagagagaact

SEQ ID NO: 3047714 - DNA, 17 bp, Homo sapiens
cccaagacctaagggtt

SEQ ID NO: 3047715 - DNA, 15 bp, Homo sapiens
cccaagactgggctg

SEQ ID NO: 3047716 - DNA, 20 bp, Homo sapiens
cccaagagaggaaggacccc

SEQ ID NO: 3047717 - DNA, 19 bp, Homo sapiens
cccaagcaaaatcatggaa

SEQ ID NO: 3047718 - DNA, 12 bp, Homo sapiens
cccaagctcaga

SEQ ID NO: 3047719 - DNA, 20 bp, Homo sapiens
cccaaggacttccacatttt

SEQ ID NO: 3047720 - DNA, 14 bp, Homo sapiens
cccaaggaggaaaa

SEQ ID NO: 3047721 - DNA, 14 bp, Homo sapiens
cccaaggatgcctt

SEQ ID NO: 3047722 - DNA, 23 bp, Homo sapiens
cccaagtagctgggattacaggt

SEQ ID NO: 3047723 - DNA, 22 bp, Homo sapiens
cccaagtcatttccgtcccccc

SEQ ID NO: 3047724 - DNA, 14 bp, Homo sapiens
cccaagtgaccagg

SEQ ID NO: 3047725 - DNA, 19 bp, Homo sapiens
cccaagtgggggcagaggg

SEQ ID NO: 3047726 - DNA, 15 bp, Homo sapiens
cccaagtgtgaacaa

SEQ ID NO: 3047727 - DNA, 16 bp, Homo sapiens
cccaagtgtgaacaaa

SEQ ID NO: 3047728 - DNA, 16 bp, Homo sapiens
cccaagtttctaaggg

SEQ ID NO: 3047729 - DNA, 14 bp, Homo sapiens
cccaatatatgtat

SEQ ID NO: 3047730 - DNA, 22 bp, Homo sapiens
cccaatatcctcgctcccggga

SEQ ID NO: 3047731 - DNA, 24 bp, Homo sapiens
cccaatccaggtacgcacagacag

SEQ ID NO: 3047732 - DNA, 21 bp, Homo sapiens
cccaatccctttattaccccc

SEQ ID NO: 3047733 - DNA, 20 bp, Homo sapiens
cccaatctcaatacagcctg

SEQ ID NO: 3047734 - DNA, 14 bp, Homo sapiens
cccaattgctggag

SEQ ID NO: 3047735 - DNA, 15 bp, Homo sapiens
cccacaagctgcctc

SEQ ID NO: 3047736 - DNA, 15 bp, Homo sapiens
cccacaaggcctggt

SEQ ID NO: 3047737 - DNA, 18 bp, Homo sapiens
cccacaaggcctggtctg

SEQ ID NO: 3047738 - DNA, 13 bp, Homo sapiens
cccacaagtggtg

SEQ ID NO: 3047739 - DNA, 16 bp, Homo sapiens
cccacaagtggtggta

SEQ ID NO: 3047740 - DNA, 15 bp, Homo sapiens
cccacaatttcttta

SEQ ID NO: 3047741 - DNA, 23 bp, Homo sapiens
cccacaatttctttaaaaaagaa

SEQ ID NO: 3047742 - DNA, 11 bp, Homo sapiens
cccacacacac

SEQ ID NO: 3047743 - DNA, 17 bp, Homo sapiens
cccacacacacacacat

SEQ ID NO: 3047744 - DNA, 18 bp, Homo sapiens
cccacacacacacacatg

SEQ ID NO: 3047745 - DNA, 20 bp, Homo sapiens
cccacacacacacacatgca

SEQ ID NO: 3047746 - DNA, 21 bp, Homo sapiens
cccacacacactccttcccct

SEQ ID NO: 3047747 - DNA, 13 bp, Homo sapiens
cccacacacagat

SEQ ID NO: 3047748 - DNA, 13 bp, Homo sapiens
cccacacacaggt

SEQ ID NO: 3047749 - DNA, 15 bp, Homo sapiens
cccacacacaggtgg

SEQ ID NO: 3047750 - DNA, 19 bp, Homo sapiens
cccacacctgcagtgccag

SEQ ID NO: 3047751 - DNA, 15 bp, Homo sapiens
cccacactgctacac

SEQ ID NO: 3047752 - DNA, 17 bp, Homo sapiens
cccacacttgtgccagc

SEQ ID NO: 3047753 - DNA, 16 bp, Homo sapiens
cccacactttatatac

SEQ ID NO: 3047754 - DNA, 23 bp, Homo sapiens
cccacagactcaaatgctcagac

SEQ ID NO: 3047755 - DNA, 14 bp, Homo sapiens
cccacagactgccc

SEQ ID NO: 3047756 - DNA, 16 bp, Homo sapiens
cccacagcccccaccc

SEQ ID NO: 3047757 - DNA, 13 bp, Homo sapiens
cccacagcgctgg

SEQ ID NO: 3047758 - DNA, 19 bp, Homo sapiens
cccacagcgctggccggga

SEQ ID NO: 3047759 - DNA, 14 bp, Homo sapiens
cccacagctcccac

SEQ ID NO: 3047760 - DNA, 19 bp, Homo sapiens
cccacaggacatttctcta

SEQ ID NO: 3047761 - DNA, 20 bp, Homo sapiens
cccacaggacatttctctaa

SEQ ID NO: 3047762 - DNA, 16 bp, Homo sapiens
cccacaggaggtggtc

SEQ ID NO: 3047763 - DNA, 21 bp, Homo sapiens
cccacaggaggtggtctggga

SEQ ID NO: 3047764 - DNA, 22 bp, Homo sapiens
cccacaggagttgtgagccctc

SEQ ID NO: 3047765 - DNA, 16 bp, Homo sapiens
cccacatgtgacacat

SEQ ID NO: 3047766 - DNA, 18 bp, Homo sapiens
cccaccaaggtctcacac

SEQ ID NO: 3047767 - DNA, 21 bp, Homo sapiens
cccaccacctaggccactcct

SEQ ID NO: 3047768 - DNA, 19 bp, Homo sapiens
cccaccacgatgtggccct

SEQ ID NO: 3047769 - DNA, 20 bp, Homo sapiens
cccaccacgatgtggccctg

SEQ ID NO: 3047770 - DNA, 12 bp, Homo sapiens
cccaccagagct

SEQ ID NO: 3047771 - DNA, 15 bp, Homo sapiens
cccaccagagctgcc

SEQ ID NO: 3047772 - DNA, 18 bp, Homo sapiens
cccaccagagctgcctcc

SEQ ID NO: 3047773 - DNA, 15 bp, Homo sapiens
cccacccacatgtga

SEQ ID NO: 3047774 - DNA, 13 bp, Homo sapiens
cccacccagtctc

SEQ ID NO: 3047775 - DNA, 20 bp, Homo sapiens
cccacccagtctctgctcca

SEQ ID NO: 3047776 - DNA, 13 bp, Homo sapiens
cccaccccagcac

SEQ ID NO: 3047777 - DNA, 13 bp, Homo sapiens
cccacccggtggg

SEQ ID NO: 3047778 - DNA, 21 bp, Homo sapiens
cccacccggtggttcttcctg

SEQ ID NO: 3047779 - DNA, 14 bp, Homo sapiens
cccaccctcctggc

SEQ ID NO: 3047780 - DNA, 14 bp, Homo sapiens
cccaccctgggacc

SEQ ID NO: 3047781 - DNA, 21 bp, Homo sapiens
cccaccctgggtttggcccct

SEQ ID NO: 3047782 - DNA, 22 bp, Homo sapiens
cccaccctgggtttggcccctg

SEQ ID NO: 3047783 - DNA, 17 bp, Homo sapiens
cccaccctgtttggatt

SEQ ID NO: 3047784 - DNA, 16 bp, Homo sapiens
cccaccgccggggtcc

SEQ ID NO: 3047785 - DNA, 21 bp, Homo sapiens
cccaccgccggggtcctggga

SEQ ID NO: 3047786 - DNA, 19 bp, Homo sapiens
cccaccgtgggcagggagc

SEQ ID NO: 3047787 - DNA, 19 bp, Homo sapiens
cccacctagtgccccagac

SEQ ID NO: 3047788 - DNA, 12 bp, Homo sapiens
cccacctcagcc

SEQ ID NO: 3047789 - DNA, 14 bp, Homo sapiens
cccacctccaggct

SEQ ID NO: 3047790 - DNA, 12 bp, Homo sapiens
cccacctccctg

SEQ ID NO: 3047791 - DNA, 13 bp, Homo sapiens
cccacctcggccc

SEQ ID NO: 3047792 - DNA, 19 bp, Homo sapiens
cccacctcggccctccctg

SEQ ID NO: 3047793 - DNA, 14 bp, Homo sapiens
cccacctgaaagcc

SEQ ID NO: 3047794 - DNA, 18 bp, Homo sapiens
cccacctgaaagcctgtc

SEQ ID NO: 3047795 - DNA, 19 bp, Homo sapiens
cccacctgaaagcctgtct

SEQ ID NO: 3047796 - DNA, 16 bp, Homo sapiens
cccacctgggctgggc

SEQ ID NO: 3047797 - DNA, 22 bp, Homo sapiens
cccacctgtcaaacaaagccag

SEQ ID NO: 3047798 - DNA, 15 bp, Homo sapiens
cccacgagggctggc

SEQ ID NO: 3047799 - DNA, 17 bp, Homo sapiens
cccacgggacctggggc

SEQ ID NO: 3047800 - DNA, 17 bp, Homo sapiens
cccacggggaccactgg

SEQ ID NO: 3047801 - DNA, 20 bp, Homo sapiens
cccacggggaccactgggcc

SEQ ID NO: 3047802 - DNA, 21 bp, Homo sapiens
cccacggggaccactgggccc

SEQ ID NO: 3047803 - DNA, 15 bp, Homo sapiens
cccacgtcagctggg

SEQ ID NO: 3047804 - DNA, 13 bp, Homo sapiens
cccacgtctctct

SEQ ID NO: 3047805 - DNA, 22 bp, Homo sapiens
cccacgtctctctgcctgctgg

SEQ ID NO: 3047806 - DNA, 24 bp, Homo sapiens
cccacgtctctctgcctgctgggc

SEQ ID NO: 3047807 - DNA, 17 bp, Homo sapiens
cccactcaagccaagca

SEQ ID NO: 3047808 - DNA, 17 bp, Homo sapiens
cccactcacctttctcc

SEQ ID NO: 3047809 - DNA, 12 bp, Homo sapiens
cccactcctcta

SEQ ID NO: 3047810 - DNA, 13 bp, Homo sapiens
cccactctcattc

SEQ ID NO: 3047811 - DNA, 14 bp, Homo sapiens
cccactctcattcc

SEQ ID NO: 3047812 - DNA, 21 bp, Homo sapiens
cccactctcattccccaggtg

SEQ ID NO: 3047813 - DNA, 15 bp, Homo sapiens
cccactctgcggccc

SEQ ID NO: 3047814 - DNA, 19 bp, Homo sapiens
cccactctgcggcccgggc

SEQ ID NO: 3047815 - DNA, 21 bp, Homo sapiens
cccactgaattgacatgaccc

SEQ ID NO: 3047816 - DNA, 16 bp, Homo sapiens
cccactgcactccagc

SEQ ID NO: 3047817 - DNA, 19 bp, Homo sapiens
cccactgcactccagcctg

SEQ ID NO: 3047818 - DNA, 22 bp, Homo sapiens
cccactgccaggattttgtatt

SEQ ID NO: 3047819 - DNA, 12 bp, Homo sapiens
cccactgctggc

SEQ ID NO: 3047820 - DNA, 23 bp, Homo sapiens
cccactggggttggaagtgcaga

SEQ ID NO: 3047821 - DNA, 17 bp, Homo sapiens
cccactgtatgatttat

SEQ ID NO: 3047822 - DNA, 16 bp, Homo sapiens
cccactgtcctgggcc

SEQ ID NO: 3047823 - DNA, 12 bp, Homo sapiens
cccacttctcat

SEQ ID NO: 3047824 - DNA, 23 bp, Homo sapiens
cccacttctcatcacacacatgg

SEQ ID NO: 3047825 - DNA, 22 bp, Homo sapiens
cccagaacacactccatcagct

SEQ ID NO: 3047826 - DNA, 20 bp, Homo sapiens
cccagaactttgggaggcca

SEQ ID NO: 3047827 - DNA, 16 bp, Homo sapiens
cccagacaaggagagc

SEQ ID NO: 3047828 - DNA, 14 bp, Homo sapiens
cccagacagctgct

SEQ ID NO: 3047829 - DNA, 20 bp, Homo sapiens
cccagacagctgctcagagc

SEQ ID NO: 3047830 - DNA, 19 bp, Homo sapiens
cccagacagttcttttcta

SEQ ID NO: 3047831 - DNA, 16 bp, Homo sapiens
cccagaccggcttctc

SEQ ID NO: 3047832 - DNA, 21 bp, Homo sapiens
cccagacctgtcgtctctccc

SEQ ID NO: 3047833 - DNA, 21 bp, Homo sapiens
cccagacctgttagcagacag

SEQ ID NO: 3047834 - DNA, 21 bp, Homo sapiens
cccagactgagctctccaggc

SEQ ID NO: 3047835 - DNA, 22 bp, Homo sapiens
cccagactgagctctccaggcc

SEQ ID NO: 3047836 - DNA, 15 bp, Homo sapiens
cccagactgggccca

SEQ ID NO: 3047837 - DNA, 23 bp, Homo sapiens
cccagacttgcactggggtggga

SEQ ID NO: 3047838 - DNA, 17 bp, Homo sapiens
cccagacttgtttcctg

SEQ ID NO: 3047839 - DNA, 19 bp, Homo sapiens
cccagacttgtttcctgtg

SEQ ID NO: 3047840 - DNA, 20 bp, Homo sapiens
cccagacttgtttcctgtgc

SEQ ID NO: 3047841 - DNA, 15 bp, Homo sapiens
cccagagacaggaaa

SEQ ID NO: 3047842 - DNA, 22 bp, Homo sapiens
cccagagacatacttgaagggc

SEQ ID NO: 3047843 - DNA, 19 bp, Homo sapiens
cccagagacctttgcccac

SEQ ID NO: 3047844 - DNA, 20 bp, Homo sapiens
cccagagacctttgcccaca

SEQ ID NO: 3047845 - DNA, 15 bp, Homo sapiens
cccagagaggaatca

SEQ ID NO: 3047846 - DNA, 19 bp, Homo sapiens
cccagagatgcctccaccg

SEQ ID NO: 3047847 - DNA, 16 bp, Homo sapiens
cccagagccacacatg

SEQ ID NO: 3047848 - DNA, 21 bp, Homo sapiens
cccagagccacacatgggcat

SEQ ID NO: 3047849 - DNA, 12 bp, Homo sapiens
cccagagcccag

SEQ ID NO: 3047850 - DNA, 17 bp, Homo sapiens
cccagagcccagctcca

SEQ ID NO: 3047851 - DNA, 18 bp, Homo sapiens
cccagagcccagctcttg

SEQ ID NO: 3047852 - DNA, 16 bp, Homo sapiens
cccagagctgcacagg

SEQ ID NO: 3047853 - DNA, 20 bp, Homo sapiens
cccagagctggtggacccag

SEQ ID NO: 3047854 - DNA, 23 bp, Homo sapiens
cccagaggaaggggccagaggct

SEQ ID NO: 3047855 - DNA, 24 bp, Homo sapiens
cccagaggaaggggccagaggctc

SEQ ID NO: 3047856 - DNA, 18 bp, Homo sapiens
cccagaggagcccagcgg

SEQ ID NO: 3047857 - DNA, 23 bp, Homo sapiens
cccagaggcgtcccgcacctgtc

SEQ ID NO: 3047858 - DNA, 24 bp, Homo sapiens
cccagaggcgtcccgcacctgtct

SEQ ID NO: 3047859 - DNA, 16 bp, Homo sapiens
cccagaggctgcccca

SEQ ID NO: 3047860 - DNA, 20 bp, Homo sapiens
cccagagtgctgggattaca

SEQ ID NO: 3047861 - DNA, 21 bp, Homo sapiens
cccagatacgggggctgtgac

SEQ ID NO: 3047862 - DNA, 22 bp, Homo sapiens
cccagatccaaggccgcggccc

SEQ ID NO: 3047863 - DNA, 20 bp, Homo sapiens
cccagatcgctcccttggct

SEQ ID NO: 3047864 - DNA, 12 bp, Homo sapiens
cccagattccct

SEQ ID NO: 3047865 - DNA, 13 bp, Homo sapiens
cccagcacagctc

SEQ ID NO: 3047866 - DNA, 17 bp, Homo sapiens
cccagcacagctcctcc

SEQ ID NO: 3047867 - DNA, 18 bp, Homo sapiens
cccagcacagctcctccc

SEQ ID NO: 3047868 - DNA, 17 bp, Homo sapiens
cccagcaccaccaggtc

SEQ ID NO: 3047869 - DNA, 18 bp, Homo sapiens
cccagcaccccctctcct

SEQ ID NO: 3047870 - DNA, 22 bp, Homo sapiens
cccagcaccccctctcctggag

SEQ ID NO: 3047871 - DNA, 17 bp, Homo sapiens
cccagcacctcagcctg

SEQ ID NO: 3047872 - DNA, 17 bp, Homo sapiens
cccagcactttgagagg

SEQ ID NO: 3047873 - DNA, 23 bp, Homo sapiens
cccagcactttgagaggctgagg

SEQ ID NO: 3047874 - DNA, 21 bp, Homo sapiens
cccagcaggggccctcactct

SEQ ID NO: 3047875 - DNA, 22 bp, Homo sapiens
cccagcagggtcttttcatctg

SEQ ID NO: 3047876 - DNA, 16 bp, Homo sapiens
cccagcagtttgggag

SEQ ID NO: 3047877 - DNA, 13 bp, Homo sapiens
cccagcatctctg

SEQ ID NO: 3047878 - DNA, 13 bp, Homo sapiens
cccagcattctca

SEQ ID NO: 3047879 - DNA, 19 bp, Homo sapiens
cccagcattctcaggcacc

SEQ ID NO: 3047880 - DNA, 14 bp, Homo sapiens
cccagccaacgaga

SEQ ID NO: 3047881 - DNA, 11 bp, Homo sapiens
cccagccacag

SEQ ID NO: 3047882 - DNA, 23 bp, Homo sapiens
cccagccactccaagccccctgg

SEQ ID NO: 3047883 - DNA, 14 bp, Homo sapiens
cccagccagccacc

SEQ ID NO: 3047884 - DNA, 16 bp, Homo sapiens
cccagccagccacccc

SEQ ID NO: 3047885 - DNA, 17 bp, Homo sapiens
cccagccagccacccct

SEQ ID NO: 3047886 - DNA, 22 bp, Homo sapiens
cccagccagccacccctgccac

SEQ ID NO: 3047887 - DNA, 12 bp, Homo sapiens
cccagcccaatc

SEQ ID NO: 3047888 - DNA, 12 bp, Homo sapiens
cccagcccacag

SEQ ID NO: 3047889 - DNA, 18 bp, Homo sapiens
cccagcccacagagcctg

SEQ ID NO: 3047890 - DNA, 15 bp, Homo sapiens
cccagcccagagaca

SEQ ID NO: 3047891 - DNA, 13 bp, Homo sapiens
cccagcccagagc

SEQ ID NO: 3047892 - DNA, 13 bp, Homo sapiens
cccagcccagctg

SEQ ID NO: 3047893 - DNA, 16 bp, Homo sapiens
cccagcccagctggtg

SEQ ID NO: 3047894 - DNA, 12 bp, Homo sapiens
cccagcccagga

SEQ ID NO: 3047895 - DNA, 22 bp, Homo sapiens
cccagcccattctctctcctgt

SEQ ID NO: 3047896 - DNA, 17 bp, Homo sapiens
cccagcctccctgaagc

SEQ ID NO: 3047897 - DNA, 15 bp, Homo sapiens
cccagccttagatgc

SEQ ID NO: 3047898 - DNA, 19 bp, Homo sapiens
cccagcgagccacaggaac

SEQ ID NO: 3047899 - DNA, 17 bp, Homo sapiens
cccagcgctctcctgga

SEQ ID NO: 3047900 - DNA, 13 bp, Homo sapiens
cccagcggcctca

SEQ ID NO: 3047901 - DNA, 17 bp, Homo sapiens
cccagcggcctcagggt

SEQ ID NO: 3047902 - DNA, 22 bp, Homo sapiens
cccagctaagaacctggaactt

SEQ ID NO: 3047903 - DNA, 22 bp, Homo sapiens
cccagctacctcaaccaatgcc

SEQ ID NO: 3047904 - DNA, 20 bp, Homo sapiens
cccagctactcaggaggctg

SEQ ID NO: 3047905 - DNA, 21 bp, Homo sapiens
cccagctactgaaccagccac

SEQ ID NO: 3047906 - DNA, 16 bp, Homo sapiens
cccagctactggggag

SEQ ID NO: 3047907 - DNA, 20 bp, Homo sapiens
cccagctactgtatgccccc

SEQ ID NO: 3047908 - DNA, 20 bp, Homo sapiens
cccagctacttgggagcctg

SEQ ID NO: 3047909 - DNA, 20 bp, Homo sapiens
cccagctatacctgtgcctc

SEQ ID NO: 3047910 - DNA, 22 bp, Homo sapiens
cccagctccgacctctctcagc

SEQ ID NO: 3047911 - DNA, 17 bp, Homo sapiens
cccagctccggcctgtc

SEQ ID NO: 3047912 - DNA, 13 bp, Homo sapiens
cccagctctaagc

SEQ ID NO: 3047913 - DNA, 20 bp, Homo sapiens
cccagctctaagcagccagg

SEQ ID NO: 3047914 - DNA, 17 bp, Homo sapiens
cccagctctccctctgg

SEQ ID NO: 3047915 - DNA, 21 bp, Homo sapiens
cccagctctccctctggccct

SEQ ID NO: 3047916 - DNA, 11 bp, Homo sapiens
cccagctggcc

SEQ ID NO: 3047917 - DNA, 16 bp, Homo sapiens
cccagctggtgggaag

SEQ ID NO: 3047918 - DNA, 21 bp, Homo sapiens
cccagctttaaaaagaaaaaa

SEQ ID NO: 3047919 - DNA, 16 bp, Homo sapiens
cccaggaaaggcccag

SEQ ID NO: 3047920 - DNA, 19 bp, Homo sapiens
cccaggaagcccactgcct

SEQ ID NO: 3047921 - DNA, 20 bp, Homo sapiens
cccaggaagcccactgcctc

SEQ ID NO: 3047922 - DNA, 12 bp, Homo sapiens
cccaggaagccg

SEQ ID NO: 3047923 - DNA, 23 bp, Homo sapiens
cccaggaagggagggagctgagg

SEQ ID NO: 3047924 - DNA, 24 bp, Homo sapiens
cccaggaagggagggagctgaggc

SEQ ID NO: 3047925 - DNA, 12 bp, Homo sapiens
cccaggaagtcc

SEQ ID NO: 3047926 - DNA, 12 bp, Homo sapiens
cccaggaccagc

SEQ ID NO: 3047927 - DNA, 19 bp, Homo sapiens
cccaggacggatgggccct

SEQ ID NO: 3047928 - DNA, 13 bp, Homo sapiens
cccaggactcctc

SEQ ID NO: 3047929 - DNA, 15 bp, Homo sapiens
cccaggactctgacc

SEQ ID NO: 3047930 - DNA, 23 bp, Homo sapiens
cccaggactgtcattttggcatc

SEQ ID NO: 3047931 - DNA, 14 bp, Homo sapiens
cccaggagagccag

SEQ ID NO: 3047932 - DNA, 15 bp, Homo sapiens
cccaggagctctgcg

SEQ ID NO: 3047933 - DNA, 16 bp, Homo sapiens
cccaggagctctgcgc

SEQ ID NO: 3047934 - DNA, 20 bp, Homo sapiens
cccaggaggaggattgtgct

SEQ ID NO: 3047935 - DNA, 17 bp, Homo sapiens
cccaggagtttgaggct

SEQ ID NO: 3047936 - DNA, 20 bp, Homo sapiens
cccaggagtttgaggctgca

SEQ ID NO: 3047937 - DNA, 16 bp, Homo sapiens
cccaggatctgctcca

SEQ ID NO: 3047938 - DNA, 18 bp, Homo sapiens
cccaggattgtgcaatag

SEQ ID NO: 3047939 - DNA, 15 bp, Homo sapiens
cccaggcagggccaa

SEQ ID NO: 3047940 - DNA, 13 bp, Homo sapiens
cccaggcaggtct

SEQ ID NO: 3047941 - DNA, 17 bp, Homo sapiens
cccaggccagggctggg

SEQ ID NO: 3047942 - DNA, 12 bp, Homo sapiens
cccaggccctcc

SEQ ID NO: 3047943 - DNA, 17 bp, Homo sapiens
cccaggccctcccacca

SEQ ID NO: 3047944 - DNA, 18 bp, Homo sapiens
cccaggccctcccaccac

SEQ ID NO: 3047945 - DNA, 19 bp, Homo sapiens
cccaggccctcccaccacc

SEQ ID NO: 3047946 - DNA, 21 bp, Homo sapiens
cccaggccctcccaccacccc

SEQ ID NO: 3047947 - DNA, 18 bp, Homo sapiens
cccaggccggagcccaga

SEQ ID NO: 3047948 - DNA, 18 bp, Homo sapiens
cccaggcctccagctcag

SEQ ID NO: 3047949 - DNA, 20 bp, Homo sapiens
cccaggcctccagctcagca

SEQ ID NO: 3047950 - DNA, 15 bp, Homo sapiens
cccaggcctgccctg

SEQ ID NO: 3047951 - DNA, 11 bp, Homo sapiens
cccaggcctgg

SEQ ID NO: 3047952 - DNA, 14 bp, Homo sapiens
cccaggcctggagc

SEQ ID NO: 3047953 - DNA, 15 bp, Homo sapiens
cccaggcctggagcg

SEQ ID NO: 3047954 - DNA, 13 bp, Homo sapiens
cccaggcctggct

SEQ ID NO: 3047955 - DNA, 17 bp, Homo sapiens
cccaggccttgctgact

SEQ ID NO: 3047956 - DNA, 22 bp, Homo sapiens
cccaggccttgctgactctctg

SEQ ID NO: 3047957 - DNA, 13 bp, Homo sapiens
cccaggctggagt

SEQ ID NO: 3047958 - DNA, 14 bp, Homo sapiens
cccaggctgggaac

SEQ ID NO: 3047959 - DNA, 16 bp, Homo sapiens
cccaggctggtcttga

SEQ ID NO: 3047960 - DNA, 19 bp, Homo sapiens
cccagggacacctgggaga

SEQ ID NO: 3047961 - DNA, 21 bp, Homo sapiens
cccagggacagaaaccaaggc

SEQ ID NO: 3047962 - DNA, 17 bp, Homo sapiens
cccagggagaggctgtg

SEQ ID NO: 3047963 - DNA, 19 bp, Homo sapiens
cccagggagaggctgtgtc

SEQ ID NO: 3047964 - DNA, 20 bp, Homo sapiens
cccagggagaggctgtgtcc

SEQ ID NO: 3047965 - DNA, 15 bp, Homo sapiens
cccagggagcggaaa

SEQ ID NO: 3047966 - DNA, 22 bp, Homo sapiens
cccagggagggtgagctggtgc

SEQ ID NO: 3047967 - DNA, 15 bp, Homo sapiens
cccagggcccagagc

SEQ ID NO: 3047968 - DNA, 17 bp, Homo sapiens
cccagggctgtcatctg

SEQ ID NO: 3047969 - DNA, 19 bp, Homo sapiens
cccaggggagaatgcagcc

SEQ ID NO: 3047970 - DNA, 22 bp, Homo sapiens
cccaggggagagggtctggaga

SEQ ID NO: 3047971 - DNA, 16 bp, Homo sapiens
cccaggggcagccaca

SEQ ID NO: 3047972 - DNA, 17 bp, Homo sapiens
cccaggggcagccacac

SEQ ID NO: 3047973 - DNA, 17 bp, Homo sapiens
cccagggtgcagtgtga

SEQ ID NO: 3047974 - DNA, 12 bp, Homo sapiens
cccaggtggcta

SEQ ID NO: 3047975 - DNA, 21 bp, Homo sapiens
cccaggtggggtttcctgcat

SEQ ID NO: 3047976 - DNA, 23 bp, Homo sapiens
cccaggtttttgcccatcctccc

SEQ ID NO: 3047977 - DNA, 23 bp, Homo sapiens
cccagtccatgctccagggtcag

SEQ ID NO: 3047978 - DNA, 16 bp, Homo sapiens
cccagtccttccacct

SEQ ID NO: 3047979 - DNA, 14 bp, Homo sapiens
cccagtccttggct

SEQ ID NO: 3047980 - DNA, 15 bp, Homo sapiens
cccagtgaccttact

SEQ ID NO: 3047981 - DNA, 12 bp, Homo sapiens
cccagtgcagaa

SEQ ID NO: 3047982 - DNA, 14 bp, Homo sapiens
cccagtgcatggtg

SEQ ID NO: 3047983 - DNA, 18 bp, Homo sapiens
cccagtgcatggtggcca

SEQ ID NO: 3047984 - DNA, 20 bp, Homo sapiens
cccagtgcatggtggccaga

SEQ ID NO: 3047985 - DNA, 22 bp, Homo sapiens
cccagtgcatggtggccagagg

SEQ ID NO: 3047986 - DNA, 19 bp, Homo sapiens
cccagtgcccccactgacc

SEQ ID NO: 3047987 - DNA, 18 bp, Homo sapiens
cccagtgggctgcacgct

SEQ ID NO: 3047988 - DNA, 22 bp, Homo sapiens
cccagttcccgtgacgaggctc

SEQ ID NO: 3047989 - DNA, 15 bp, Homo sapiens
cccagttgccatctg

SEQ ID NO: 3047990 - DNA, 19 bp, Homo sapiens
cccagttgtggcaactaaa

SEQ ID NO: 3047991 - DNA, 22 bp, Homo sapiens
cccagtttgcagaaaagcacct

SEQ ID NO: 3047992 - DNA, 18 bp, Homo sapiens
cccataaaaatttttcct

SEQ ID NO: 3047993 - DNA, 24 bp, Homo sapiens
cccatagcaccctgccctcatggg

SEQ ID NO: 3047994 - DNA, 18 bp, Homo sapiens
cccataggcccacacaca

SEQ ID NO: 3047995 - DNA, 16 bp, Homo sapiens
cccatatttgtgttca

SEQ ID NO: 3047996 - DNA, 18 bp, Homo sapiens
cccatcactcgcaggacc

SEQ ID NO: 3047997 - DNA, 13 bp, Homo sapiens
cccatcactggag

SEQ ID NO: 3047998 - DNA, 15 bp, Homo sapiens
cccatcactggagca

SEQ ID NO: 3047999 - DNA, 20 bp, Homo sapiens
cccatcactggagcaccagg

SEQ ID NO: 3048000 - DNA, 13 bp, Homo sapiens
cccatcagtgcca

SEQ ID NO: 3048001 - DNA, 23 bp, Homo sapiens
cccatcagtgctccctcacatgt

SEQ ID NO: 3048002 - DNA, 16 bp, Homo sapiens
cccatcatctctgcct

SEQ ID NO: 3048003 - DNA, 14 bp, Homo sapiens
cccatcctccagca

SEQ ID NO: 3048004 - DNA, 15 bp, Homo sapiens
cccatcctccagcag

SEQ ID NO: 3048005 - DNA, 16 bp, Homo sapiens
cccatcctccagcagg

SEQ ID NO: 3048006 - DNA, 15 bp, Homo sapiens
cccatcctgctcagc

SEQ ID NO: 3048007 - DNA, 23 bp, Homo sapiens
cccatctcaggccagagccaagg

SEQ ID NO: 3048008 - DNA, 14 bp, Homo sapiens
cccatctcatgccc

SEQ ID NO: 3048009 - DNA, 21 bp, Homo sapiens
cccatctcatgcccctggctg

SEQ ID NO: 3048010 - DNA, 21 bp, Homo sapiens
cccatctcgctccctcccagg

SEQ ID NO: 3048011 - DNA, 21 bp, Homo sapiens
cccatctgcacccccctgggc

SEQ ID NO: 3048012 - DNA, 16 bp, Homo sapiens
cccatctgtccatcct

SEQ ID NO: 3048013 - DNA, 21 bp, Homo sapiens
cccatctgtccatcctcctct

SEQ ID NO: 3048014 - DNA, 13 bp, Homo sapiens
cccatctgtgttc

SEQ ID NO: 3048015 - DNA, 15 bp, Homo sapiens
cccatcttcgggacc

SEQ ID NO: 3048016 - DNA, 15 bp, Homo sapiens
cccatcttgcttcca

SEQ ID NO: 3048017 - DNA, 12 bp, Homo sapiens
cccatgaagcca

SEQ ID NO: 3048018 - DNA, 22 bp, Homo sapiens
cccatgaccttatccttcctct

SEQ ID NO: 3048019 - DNA, 23 bp, Homo sapiens
cccatgagttggggtctggcagc

SEQ ID NO: 3048020 - DNA, 17 bp, Homo sapiens
cccatgcaagcagagga

SEQ ID NO: 3048021 - DNA, 12 bp, Homo sapiens
cccatgcactgt

SEQ ID NO: 3048022 - DNA, 14 bp, Homo sapiens
cccatgcactgtga

SEQ ID NO: 3048023 - DNA, 16 bp, Homo sapiens
cccatgcactgtgaag

SEQ ID NO: 3048024 - DNA, 22 bp, Homo sapiens
cccatgcactgtgaaggaccct

SEQ ID NO: 3048025 - DNA, 14 bp, Homo sapiens
cccatgctgttgat

SEQ ID NO: 3048026 - DNA, 20 bp, Homo sapiens
cccatgcttacgtgatcctc

SEQ ID NO: 3048027 - DNA, 20 bp, Homo sapiens
cccatggacaggctggctcc

SEQ ID NO: 3048028 - DNA, 22 bp, Homo sapiens
cccatggaggagacaggaagcc

SEQ ID NO: 3048029 - DNA, 18 bp, Homo sapiens
cccatgggggctgtcttt

SEQ ID NO: 3048030 - DNA, 17 bp, Homo sapiens
cccatgtaacagaaagg

SEQ ID NO: 3048031 - DNA, 14 bp, Homo sapiens
cccatgtagccccc

SEQ ID NO: 3048032 - DNA, 13 bp, Homo sapiens
cccattcctgaag

SEQ ID NO: 3048033 - DNA, 20 bp, Homo sapiens
cccattcgcgctctgctcag

SEQ ID NO: 3048034 - DNA, 18 bp, Homo sapiens
cccattctacacagagca

SEQ ID NO: 3048035 - DNA, 19 bp, Homo sapiens
cccattctacacagagcag

SEQ ID NO: 3048036 - DNA, 20 bp, Homo sapiens
cccattcttttgtaatttaa

SEQ ID NO: 3048037 - DNA, 21 bp, Homo sapiens
cccattgttggcgctgaggtg

SEQ ID NO: 3048038 - DNA, 13 bp, Homo sapiens
cccatttcaggaa

SEQ ID NO: 3048039 - DNA, 14 bp, Homo sapiens
cccatttctccaga

SEQ ID NO: 3048040 - DNA, 15 bp, Homo sapiens
cccatttgttgctgc

SEQ ID NO: 3048041 - DNA, 17 bp, Homo sapiens
cccatttgttgctgctg

SEQ ID NO: 3048042 - DNA, 19 bp, Homo sapiens
cccatttgttgctgctgct

SEQ ID NO: 3048043 - DNA, 20 bp, Homo sapiens
cccattttagtcactttttt

SEQ ID NO: 3048044 - DNA, 17 bp, Homo sapiens
ccccaaagcagcccttc

SEQ ID NO: 3048045 - DNA, 21 bp, Homo sapiens
ccccaaagggcctcctcaccc

SEQ ID NO: 3048046 - DNA, 18 bp, Homo sapiens
ccccaaagtaaaagaaac

SEQ ID NO: 3048047 - DNA, 11 bp, Homo sapiens
ccccaaatccg

SEQ ID NO: 3048048 - DNA, 19 bp, Homo sapiens
ccccaaatccgaacctcct

SEQ ID NO: 3048049 - DNA, 18 bp, Homo sapiens
ccccaacatataaaataa

SEQ ID NO: 3048050 - DNA, 15 bp, Homo sapiens
ccccaacctgcactc

SEQ ID NO: 3048051 - DNA, 20 bp, Homo sapiens
ccccaactacccccagctgt

SEQ ID NO: 3048052 - DNA, 19 bp, Homo sapiens
ccccaactccctctctgtg

SEQ ID NO: 3048053 - DNA, 20 bp, Homo sapiens
ccccaactgtggtagctcca

SEQ ID NO: 3048054 - DNA, 22 bp, Homo sapiens
ccccaactgtggtagctccagc

SEQ ID NO: 3048055 - DNA, 15 bp, Homo sapiens
ccccaataattgcag

SEQ ID NO: 3048056 - DNA, 13 bp, Homo sapiens
ccccaatcccagc

SEQ ID NO: 3048057 - DNA, 14 bp, Homo sapiens
ccccacaaggcctg

SEQ ID NO: 3048058 - DNA, 19 bp, Homo sapiens
ccccacaaggcctggtctg

SEQ ID NO: 3048059 - DNA, 14 bp, Homo sapiens
ccccacacacacac

SEQ ID NO: 3048060 - DNA, 20 bp, Homo sapiens
ccccacaggcacattaactg

SEQ ID NO: 3048061 - DNA, 13 bp, Homo sapiens
ccccaccagagct

SEQ ID NO: 3048062 - DNA, 14 bp, Homo sapiens
ccccaccagagctg

SEQ ID NO: 3048063 - DNA, 16 bp, Homo sapiens
ccccaccagagctgcc

SEQ ID NO: 3048064 - DNA, 12 bp, Homo sapiens
ccccacccagct

SEQ ID NO: 3048065 - DNA, 17 bp, Homo sapiens
ccccaccccctccccag

SEQ ID NO: 3048066 - DNA, 19 bp, Homo sapiens
ccccacccctgggggctct

SEQ ID NO: 3048067 - DNA, 14 bp, Homo sapiens
ccccaccccttcga

SEQ ID NO: 3048068 - DNA, 12 bp, Homo sapiens
ccccaccctcat

SEQ ID NO: 3048069 - DNA, 12 bp, Homo sapiens
ccccaccctcct

SEQ ID NO: 3048070 - DNA, 21 bp, Homo sapiens
ccccaccctcctggcctcaga

SEQ ID NO: 3048071 - DNA, 20 bp, Homo sapiens
ccccaccctgtttggatttt

SEQ ID NO: 3048072 - DNA, 22 bp, Homo sapiens
ccccaccgccggggtcctggga

SEQ ID NO: 3048073 - DNA, 12 bp, Homo sapiens
ccccacctctcc

SEQ ID NO: 3048074 - DNA, 13 bp, Homo sapiens
ccccacctgtgtc

SEQ ID NO: 3048075 - DNA, 22 bp, Homo sapiens
ccccacgacccctgcctcgagg

SEQ ID NO: 3048076 - DNA, 23 bp, Homo sapiens
ccccacgacccctgcctcgaggg

SEQ ID NO: 3048077 - DNA, 16 bp, Homo sapiens
ccccacgagggctggc

SEQ ID NO: 3048078 - DNA, 17 bp, Homo sapiens
ccccacgagggctggct

SEQ ID NO: 3048079 - DNA, 17 bp, Homo sapiens
ccccacgaggggaccca

SEQ ID NO: 3048080 - DNA, 17 bp, Homo sapiens
ccccacgtctctctgcc

SEQ ID NO: 3048081 - DNA, 20 bp, Homo sapiens
ccccactctcattccccagg

SEQ ID NO: 3048082 - DNA, 11 bp, Homo sapiens
ccccactctgc

SEQ ID NO: 3048083 - DNA, 12 bp, Homo sapiens
ccccactggact

SEQ ID NO: 3048084 - DNA, 19 bp, Homo sapiens
ccccactggactgacctgg

SEQ ID NO: 3048085 - DNA, 20 bp, Homo sapiens
ccccactggactgacctggt

SEQ ID NO: 3048086 - DNA, 14 bp, Homo sapiens
ccccagaagcagag

SEQ ID NO: 3048087 - DNA, 15 bp, Homo sapiens
ccccagactgagctc

SEQ ID NO: 3048088 - DNA, 22 bp, Homo sapiens
ccccagactgagctctccaggc

SEQ ID NO: 3048089 - DNA, 15 bp, Homo sapiens
ccccagactgggccc

SEQ ID NO: 3048090 - DNA, 15 bp, Homo sapiens
ccccagagccacaca

SEQ ID NO: 3048091 - DNA, 17 bp, Homo sapiens
ccccagcacagctcctc

SEQ ID NO: 3048092 - DNA, 18 bp, Homo sapiens
ccccagcaggtgctgact

SEQ ID NO: 3048093 - DNA, 18 bp, Homo sapiens
ccccagcattctcaggca

SEQ ID NO: 3048094 - DNA, 11 bp, Homo sapiens
ccccagccaca

SEQ ID NO: 3048095 - DNA, 16 bp, Homo sapiens
ccccagcccagagaca

SEQ ID NO: 3048096 - DNA, 17 bp, Homo sapiens
ccccagccctggcccct

SEQ ID NO: 3048097 - DNA, 15 bp, Homo sapiens
ccccagcctccctga

SEQ ID NO: 3048098 - DNA, 21 bp, Homo sapiens
ccccagctccgacctctctca

SEQ ID NO: 3048099 - DNA, 22 bp, Homo sapiens
ccccagctctaagcagccagga

SEQ ID NO: 3048100 - DNA, 21 bp, Homo sapiens
ccccaggaagcccactgcctc

SEQ ID NO: 3048101 - DNA, 23 bp, Homo sapiens
ccccaggaagcccactgcctcct

SEQ ID NO: 3048102 - DNA, 13 bp, Homo sapiens
ccccaggaccagc

SEQ ID NO: 3048103 - DNA, 15 bp, Homo sapiens
ccccaggaccagctc

SEQ ID NO: 3048104 - DNA, 18 bp, Homo sapiens
ccccaggattgtgcaata

SEQ ID NO: 3048105 - DNA, 12 bp, Homo sapiens
ccccaggcccca

SEQ ID NO: 3048106 - DNA, 18 bp, Homo sapiens
ccccaggccccaggaagc

SEQ ID NO: 3048107 - DNA, 14 bp, Homo sapiens
ccccaggccctccc

SEQ ID NO: 3048108 - DNA, 17 bp, Homo sapiens
ccccaggccggagccca

SEQ ID NO: 3048109 - DNA, 16 bp, Homo sapiens
ccccaggcctgccctg

SEQ ID NO: 3048110 - DNA, 19 bp, Homo sapiens
ccccaggcctggctccccg

SEQ ID NO: 3048111 - DNA, 19 bp, Homo sapiens
ccccagggcctgagcctgg

SEQ ID NO: 3048112 - DNA, 22 bp, Homo sapiens
ccccaggggacgtgggccctgc

SEQ ID NO: 3048113 - DNA, 21 bp, Homo sapiens
ccccagtgtattttgtccaag

SEQ ID NO: 3048114 - DNA, 13 bp, Homo sapiens
ccccatcagtgct

SEQ ID NO: 3048115 - DNA, 17 bp, Homo sapiens
ccccatctcaggccaga

SEQ ID NO: 3048116 - DNA, 21 bp, Homo sapiens
ccccatctcatgcccctggct

SEQ ID NO: 3048117 - DNA, 18 bp, Homo sapiens
ccccatctcggggctgct

SEQ ID NO: 3048118 - DNA, 16 bp, Homo sapiens
ccccatcttcacccag

SEQ ID NO: 3048119 - DNA, 17 bp, Homo sapiens
ccccatcttcacccagg

SEQ ID NO: 3048120 - DNA, 16 bp, Homo sapiens
ccccatcttcgggacc

SEQ ID NO: 3048121 - DNA, 20 bp, Homo sapiens
ccccatgaagccacagccca

SEQ ID NO: 3048122 - DNA, 13 bp, Homo sapiens
ccccatgcactgt

SEQ ID NO: 3048123 - DNA, 17 bp, Homo sapiens
ccccatggctgcacagt

SEQ ID NO: 3048124 - DNA, 13 bp, Homo sapiens
ccccatttgattt

SEQ ID NO: 3048125 - DNA, 13 bp, Homo sapiens
cccccaagcctgc

SEQ ID NO: 3048126 - DNA, 13 bp, Homo sapiens
cccccaatccatg

SEQ ID NO: 3048127 - DNA, 15 bp, Homo sapiens
cccccaatccctcaa

SEQ ID NO: 3048128 - DNA, 14 bp, Homo sapiens
cccccaccacacat

SEQ ID NO: 3048129 - DNA, 14 bp, Homo sapiens
cccccaccccagca

SEQ ID NO: 3048130 - DNA, 17 bp, Homo sapiens
cccccaccccagcacag

SEQ ID NO: 3048131 - DNA, 13 bp, Homo sapiens
cccccaccgggct

SEQ ID NO: 3048132 - DNA, 22 bp, Homo sapiens
cccccacgtctctctgcctgct

SEQ ID NO: 3048133 - DNA, 21 bp, Homo sapiens
cccccactctcattccccagg

SEQ ID NO: 3048134 - DNA, 14 bp, Homo sapiens
cccccactgcaggc

SEQ ID NO: 3048135 - DNA, 20 bp, Homo sapiens
cccccactggtgagacagtt

SEQ ID NO: 3048136 - DNA, 12 bp, Homo sapiens
cccccagagacc

SEQ ID NO: 3048137 - DNA, 23 bp, Homo sapiens
cccccagagacctttgcccacac

SEQ ID NO: 3048138 - DNA, 12 bp, Homo sapiens
cccccagcactt

SEQ ID NO: 3048139 - DNA, 19 bp, Homo sapiens
cccccagcccacagagcct

SEQ ID NO: 3048140 - DNA, 13 bp, Homo sapiens
cccccagccctgg

SEQ ID NO: 3048141 - DNA, 13 bp, Homo sapiens
cccccagctaaga

SEQ ID NO: 3048142 - DNA, 18 bp, Homo sapiens
cccccagctaagaacctg

SEQ ID NO: 3048143 - DNA, 22 bp, Homo sapiens
cccccagctctaagcagccagg

SEQ ID NO: 3048144 - DNA, 11 bp, Homo sapiens
cccccagctgg

SEQ ID NO: 3048145 - DNA, 12 bp, Homo sapiens
cccccagctggc

SEQ ID NO: 3048146 - DNA, 18 bp, Homo sapiens
cccccaggccctcccacc

SEQ ID NO: 3048147 - DNA, 14 bp, Homo sapiens
cccccagtgcgctc

SEQ ID NO: 3048148 - DNA, 21 bp, Homo sapiens
cccccatagcaccctgccctc

SEQ ID NO: 3048149 - DNA, 12 bp, Homo sapiens
cccccatctccc

SEQ ID NO: 3048150 - DNA, 24 bp, Homo sapiens
cccccatgcatacgtacattcctg

SEQ ID NO: 3048151 - DNA, 17 bp, Homo sapiens
cccccattagaatgtga

SEQ ID NO: 3048152 - DNA, 12 bp, Homo sapiens
ccccccacccct

SEQ ID NO: 3048153 - DNA, 12 bp, Homo sapiens
ccccccactgca

SEQ ID NO: 3048154 - DNA, 12 bp, Homo sapiens
ccccccagggct

SEQ ID NO: 3048155 - DNA, 12 bp, Homo sapiens
ccccccttccac

SEQ ID NO: 3048156 - DNA, 15 bp, Homo sapiens
cccccgactgcctgt

SEQ ID NO: 3048157 - DNA, 16 bp, Homo sapiens
cccccgactgcctgtc

SEQ ID NO: 3048158 - DNA, 12 bp, Homo sapiens
cccccgccccct

SEQ ID NO: 3048159 - DNA, 14 bp, Homo sapiens
cccccgccccctgc

SEQ ID NO: 3048160 - DNA, 17 bp, Homo sapiens
cccccgggatcctgccc

SEQ ID NO: 3048161 - DNA, 12 bp, Homo sapiens
ccccctcatccc

SEQ ID NO: 3048162 - DNA, 15 bp, Homo sapiens
ccccctcccagaggc

SEQ ID NO: 3048163 - DNA, 13 bp, Homo sapiens
ccccctccccagg

SEQ ID NO: 3048164 - DNA, 11 bp, Homo sapiens
ccccctcctga

SEQ ID NO: 3048165 - DNA, 12 bp, Homo sapiens
ccccctctgtcc

SEQ ID NO: 3048166 - DNA, 11 bp, Homo sapiens
ccccctgcagc

SEQ ID NO: 3048167 - DNA, 19 bp, Homo sapiens
ccccctggcagctgcccct

SEQ ID NO: 3048168 - DNA, 22 bp, Homo sapiens
ccccctggcctctgtgccttct

SEQ ID NO: 3048169 - DNA, 12 bp, Homo sapiens
ccccctgtgcag

SEQ ID NO: 3048170 - DNA, 14 bp, Homo sapiens
cttcctggagactg

SEQ ID NO: 3048171 - DNA, 15 bp, Homo sapiens
cttcctggcccaggc

SEQ ID NO: 3048172 - DNA, 19 bp, Homo sapiens
atatatgcactatgtatat

SEQ ID NO: 3048173 - DNA, 13 bp, Homo sapiens
atatatgctaagt

SEQ ID NO: 3048174 - DNA, 13 bp, Homo sapiens
atatatgctactt

SEQ ID NO: 3048175 - DNA, 15 bp, Homo sapiens
atatatggaagagga

SEQ ID NO: 3048176 - DNA, 19 bp, Homo sapiens
agggcaggtggggtgagaa

SEQ ID NO: 3048177 - DNA, 20 bp, Homo sapiens
agggcagtcattggctgtct

SEQ ID NO: 3048178 - DNA, 20 bp, Homo sapiens
agggcagtcgatagagctgt

SEQ ID NO: 3048179 - DNA, 18 bp, Homo sapiens
agggcagtggacgtgctg

SEQ ID NO: 3048180 - DNA, 23 bp, Homo sapiens
agggcatctctgagtgtctctgc

SEQ ID NO: 3048181 - DNA, 16 bp, Homo sapiens
agggcatgggtcggga

SEQ ID NO: 3048182 - DNA, 16 bp, Homo sapiens
agggccaacccttctc

SEQ ID NO: 3048183 - DNA, 21 bp, Homo sapiens
agggccaagcccagcactgct

SEQ ID NO: 3048184 - DNA, 14 bp, Homo sapiens
agatggctcctctc

SEQ ID NO: 3048185 - DNA, 18 bp, Homo sapiens
agatgggaatgaagcttg

SEQ ID NO: 3048186 - DNA, 23 bp, Homo sapiens
agatgggaatgaagcttgtgtat

SEQ ID NO: 3048187 - DNA, 17 bp, Homo sapiens
agatgggacagcaacaa

SEQ ID NO: 3048188 - DNA, 20 bp, Homo sapiens
agatgggaggagaccagcgg

SEQ ID NO: 3048189 - DNA, 22 bp, Homo sapiens
agatgggcatatgtgtcagtgg

SEQ ID NO: 3048190 - DNA, 24 bp, Homo sapiens
agatgggtctccgcacttggaaag

SEQ ID NO: 3048191 - DNA, 18 bp, Homo sapiens
agatggtttgagcctgag

SEQ ID NO: 3048192 - DNA, 16 bp, Homo sapiens
agatgtaaatcgggaa

SEQ ID NO: 3048193 - DNA, 20 bp, Homo sapiens
agatgtaaatcgggaaggat

SEQ ID NO: 3048194 - DNA, 17 bp, Homo sapiens
agatgtaaatgatgtgt

SEQ ID NO: 3048195 - DNA, 13 bp, Homo sapiens
agatgtccagggc

SEQ ID NO: 3048196 - DNA, 12 bp, Homo sapiens
agatgtccctga

SEQ ID NO: 3048197 - DNA, 23 bp, Homo sapiens
agatgtgatgcttgatattttct

SEQ ID NO: 3048198 - DNA, 12 bp, Homo sapiens
agatgtgattta

SEQ ID NO: 3048199 - DNA, 17 bp, Homo sapiens
agatgtgcagcagattg

SEQ ID NO: 3048200 - DNA, 22 bp, Homo sapiens
agatgtggggctgagctgggga

SEQ ID NO: 3048201 - DNA, 16 bp, Homo sapiens
agatgtgggttctttt

SEQ ID NO: 3048202 - DNA, 23 bp, Homo sapiens
agatgttatttttgtatttttaa

SEQ ID NO: 3048203 - DNA, 17 bp, Homo sapiens
agatgttctaagtcttt

SEQ ID NO: 3048204 - DNA, 21 bp, Homo sapiens
agatgttctaagtctttccat

SEQ ID NO: 3048205 - DNA, 22 bp, Homo sapiens
agatgttctaagtctttccatt

SEQ ID NO: 3048206 - DNA, 16 bp, Homo sapiens
agatgttgatttttac

SEQ ID NO: 3048207 - DNA, 14 bp, Homo sapiens
agatgttgccatgt

SEQ ID NO: 3048208 - DNA, 20 bp, Homo sapiens
agatgtttattcttctagag

SEQ ID NO: 3048209 - DNA, 22 bp, Homo sapiens
agatgtttattcttctagagtt

SEQ ID NO: 3048210 - DNA, 17 bp, Homo sapiens
agatgttttaacttatt

SEQ ID NO: 3048211 - DNA, 23 bp, Homo sapiens
agatgttttaacttatttatatg

SEQ ID NO: 3048212 - DNA, 21 bp, Homo sapiens
agatgttttacgcaaggaagg

SEQ ID NO: 3048213 - DNA, 22 bp, Homo sapiens
agatgttttacgcaaggaagga

SEQ ID NO: 3048214 - DNA, 23 bp, Homo sapiens
agatgttttacgcaaggaaggac

SEQ ID NO: 3048215 - DNA, 16 bp, Homo sapiens
agattaaaaattatag

SEQ ID NO: 3048216 - DNA, 12 bp, Homo sapiens
agattaaaatat

SEQ ID NO: 3048217 - DNA, 20 bp, Homo sapiens
agattaatattgttctctgt

SEQ ID NO: 3048218 - DNA, 17 bp, Homo sapiens
agattaatgctatcaat

SEQ ID NO: 3048219 - DNA, 21 bp, Homo sapiens
agattagaatggctaccccat

SEQ ID NO: 3048220 - DNA, 21 bp, Homo sapiens
agattagcccttccttgccag

SEQ ID NO: 3048221 - DNA, 19 bp, Homo sapiens
agattatagattctaaaga

SEQ ID NO: 3048222 - DNA, 13 bp, Homo sapiens
agattattaaatc

SEQ ID NO: 3048223 - DNA, 21 bp, Homo sapiens
agattattaaatcgtttaatg

SEQ ID NO: 3048224 - DNA, 15 bp, Homo sapiens
agattatttaaatgc

SEQ ID NO: 3048225 - DNA, 18 bp, Homo sapiens
agattatttaaatgcttt

SEQ ID NO: 3048226 - DNA, 16 bp, Homo sapiens
agattattttattatg

SEQ ID NO: 3048227 - DNA, 20 bp, Homo sapiens
agattattttggaaagtttt

SEQ ID NO: 3048228 - DNA, 16 bp, Homo sapiens
agattcaaaggttcta

SEQ ID NO: 3048229 - DNA, 17 bp, Homo sapiens
agattcaaaggttctag

SEQ ID NO: 3048230 - DNA, 21 bp, Homo sapiens
agattcaaatctcttgctttc

SEQ ID NO: 3048231 - DNA, 16 bp, Homo sapiens
agattcacctaagaga

SEQ ID NO: 3048232 - DNA, 17 bp, Homo sapiens
agattcacctaagagat

SEQ ID NO: 3048233 - DNA, 14 bp, Homo sapiens
agattcaggggaag

SEQ ID NO: 3048234 - DNA, 20 bp, Homo sapiens
agattcaggtatgttgcctt

SEQ ID NO: 3048235 - DNA, 16 bp, Homo sapiens
agattcagttttccca

SEQ ID NO: 3048236 - DNA, 22 bp, Homo sapiens
agattcatcattttctccacct

SEQ ID NO: 3048237 - DNA, 18 bp, Homo sapiens
agattcatgatttataaa

SEQ ID NO: 3048238 - DNA, 20 bp, Homo sapiens
agattccattggtccaagat

SEQ ID NO: 3048239 - DNA, 22 bp, Homo sapiens
agattccattggtccaagattc

SEQ ID NO: 3048240 - DNA, 23 bp, Homo sapiens
agattccattggtccaagattcc

SEQ ID NO: 3048241 - DNA, 11 bp, Homo sapiens
agattcccagg

SEQ ID NO: 3048242 - DNA, 13 bp, Homo sapiens
agattcccaggcc

SEQ ID NO: 3048243 - DNA, 16 bp, Homo sapiens
agattcccaggccagg

SEQ ID NO: 3048244 - DNA, 20 bp, Homo sapiens
agattccggatcctaagcat

SEQ ID NO: 3048245 - DNA, 16 bp, Homo sapiens
agattcgctgtcccct

SEQ ID NO: 3048246 - DNA, 15 bp, Homo sapiens
agattctaaagattc

SEQ ID NO: 3048247 - DNA, 17 bp, Homo sapiens
agattctaaagattcta

SEQ ID NO: 3048248 - DNA, 15 bp, Homo sapiens
agattctaacatatt

SEQ ID NO: 3048249 - DNA, 12 bp, Homo sapiens
agattctagatc

SEQ ID NO: 3048250 - DNA, 14 bp, Homo sapiens
agattctagatcag

SEQ ID NO: 3048251 - DNA, 15 bp, Homo sapiens
agattctatagttct

SEQ ID NO: 3048252 - DNA, 21 bp, Homo sapiens
agattctctgcccagccgggc

SEQ ID NO: 3048253 - DNA, 19 bp, Homo sapiens
agattctgtgtcagagccc

SEQ ID NO: 3048254 - DNA, 23 bp, Homo sapiens
agattctgtgtcagagcccagcc

SEQ ID NO: 3048255 - DNA, 19 bp, Homo sapiens
agattcttgagctgttgtg

SEQ ID NO: 3048256 - DNA, 20 bp, Homo sapiens
agattgaaattccagttgca

SEQ ID NO: 3048257 - DNA, 20 bp, Homo sapiens
agattgaaatttgaactatg

SEQ ID NO: 3048258 - DNA, 11 bp, Homo sapiens
agattgaactt

SEQ ID NO: 3048259 - DNA, 13 bp, Homo sapiens
agattgcatgtga

SEQ ID NO: 3048260 - DNA, 16 bp, Homo sapiens
agattgcatgtgactc

SEQ ID NO: 3048261 - DNA, 18 bp, Homo sapiens
agattgctaattgctgtt

SEQ ID NO: 3048262 - DNA, 21 bp, Homo sapiens
agattgctggaaaccaagtca

SEQ ID NO: 3048263 - DNA, 14 bp, Homo sapiens
agattggaaggaga

SEQ ID NO: 3048264 - DNA, 15 bp, Homo sapiens
agattggaaggagac

SEQ ID NO: 3048265 - DNA, 22 bp, Homo sapiens
agattggaaggagacacagatg

SEQ ID NO: 3048266 - DNA, 18 bp, Homo sapiens
agattggccaattaaaaa

SEQ ID NO: 3048267 - DNA, 16 bp, Homo sapiens
agattggttctgtttt

SEQ ID NO: 3048268 - DNA, 17 bp, Homo sapiens
agattgtattaactatc

SEQ ID NO: 3048269 - DNA, 17 bp, Homo sapiens
agattgtattactttaa

SEQ ID NO: 3048270 - DNA, 17 bp, Homo sapiens
agattgtcttaatttct

SEQ ID NO: 3048271 - DNA, 12 bp, Homo sapiens
agattgtttgca

SEQ ID NO: 3048272 - DNA, 21 bp, Homo sapiens
agatttaagttcctgctgcct

SEQ ID NO: 3048273 - DNA, 18 bp, Homo sapiens
agatttagggtactttta

SEQ ID NO: 3048274 - DNA, 13 bp, Homo sapiens
agatttatcaaat

SEQ ID NO: 3048275 - DNA, 15 bp, Homo sapiens
agatttatcaaatca

SEQ ID NO: 3048276 - DNA, 12 bp, Homo sapiens
agatttattaga

SEQ ID NO: 3048277 - DNA, 14 bp, Homo sapiens
agatttcaggtgta

SEQ ID NO: 3048278 - DNA, 14 bp, Homo sapiens
agatttcagtaatg

SEQ ID NO: 3048279 - DNA, 16 bp, Homo sapiens
agatttcagtaatgtc

SEQ ID NO: 3048280 - DNA, 17 bp, Homo sapiens
agatttcttaaatcttt

SEQ ID NO: 3048281 - DNA, 18 bp, Homo sapiens
agatttcttaaatctttc

SEQ ID NO: 3048282 - DNA, 22 bp, Homo sapiens
agatttcttaaatctttcttca

SEQ ID NO: 3048283 - DNA, 19 bp, Homo sapiens
agatttgaagatctgattt

SEQ ID NO: 3048284 - DNA, 12 bp, Homo sapiens
agatttgacctc

SEQ ID NO: 3048285 - DNA, 18 bp, Homo sapiens
agatttgggtcatttaga

SEQ ID NO: 3048286 - DNA, 11 bp, Homo sapiens
agatttgtgaa

SEQ ID NO: 3048287 - DNA, 17 bp, Homo sapiens
agcagccctcctcaccc

SEQ ID NO: 3048288 - DNA, 18 bp, Homo sapiens
agcagccctcctcacccc

SEQ ID NO: 3048289 - DNA, 12 bp, Homo sapiens
agcagcctcgca

SEQ ID NO: 3048290 - DNA, 14 bp, Homo sapiens
agcagcctcgcaca

SEQ ID NO: 3048291 - DNA, 19 bp, Homo sapiens
agcagcctgcgctcggcag

SEQ ID NO: 3048292 - DNA, 21 bp, Homo sapiens
agcagcctgcgctcggcagga

SEQ ID NO: 3048293 - DNA, 16 bp, Homo sapiens
agcagcctgtgaggga

SEQ ID NO: 3048294 - DNA, 15 bp, Homo sapiens
agcagcgcgcaggcc

SEQ ID NO: 3048295 - DNA, 18 bp, Homo sapiens
agcagcgctagtggaggg

SEQ ID NO: 3048296 - DNA, 18 bp, Homo sapiens
agcagctaaattttctga

SEQ ID NO: 3048297 - DNA, 19 bp, Homo sapiens
agcagctcaaaggcacagt

SEQ ID NO: 3048298 - DNA, 13 bp, Homo sapiens
agcagctctgcct

SEQ ID NO: 3048299 - DNA, 15 bp, Homo sapiens
agcagctctgccttc

SEQ ID NO: 3048300 - DNA, 11 bp, Homo sapiens
agcagctgcta

SEQ ID NO: 3048301 - DNA, 23 bp, Homo sapiens
agcaggaaatgaaaatgtcttgt

SEQ ID NO: 3048302 - DNA, 14 bp, Homo sapiens
agcaggaagctcag

SEQ ID NO: 3048303 - DNA, 16 bp, Homo sapiens
agcaggaatttctttt

SEQ ID NO: 3048304 - DNA, 19 bp, Homo sapiens
agcaggactccaggcccaa

SEQ ID NO: 3048305 - DNA, 19 bp, Homo sapiens
agcaggagaggagagccag

SEQ ID NO: 3048306 - DNA, 21 bp, Homo sapiens
agcaggagaggagagccagag

SEQ ID NO: 3048307 - DNA, 22 bp, Homo sapiens
agcaggcagcgcctgtcccctc

SEQ ID NO: 3048308 - DNA, 16 bp, Homo sapiens
agcaggccagcccgga

SEQ ID NO: 3048309 - DNA, 17 bp, Homo sapiens
agcaggccccctaggat

SEQ ID NO: 3048310 - DNA, 24 bp, Homo sapiens
agcagggatgccctggaggtggct

SEQ ID NO: 3048311 - DNA, 16 bp, Homo sapiens
agcagggcggctgccg

SEQ ID NO: 3048312 - DNA, 16 bp, Homo sapiens
agcaggggctgctggg

SEQ ID NO: 3048313 - DNA, 17 bp, Homo sapiens
agcaggggctgctgggg

SEQ ID NO: 3048314 - DNA, 22 bp, Homo sapiens
agcagggtcttttcatctggga

SEQ ID NO: 3048315 - DNA, 18 bp, Homo sapiens
agcagggtttgagcacaa

SEQ ID NO: 3048316 - DNA, 19 bp, Homo sapiens
agcagggtttgagcacaat

SEQ ID NO: 3048317 - DNA, 14 bp, Homo sapiens
agcaggtaagagct

SEQ ID NO: 3048318 - DNA, 17 bp, Homo sapiens
agcaggttcccaagctc

SEQ ID NO: 3048319 - DNA, 22 bp, Homo sapiens
agcaggtttcactattcctatg

SEQ ID NO: 3048320 - DNA, 23 bp, Homo sapiens
agcagtcaggggtcaggtgtcag

SEQ ID NO: 3048321 - DNA, 15 bp, Homo sapiens
agcagtctctgcctt

SEQ ID NO: 3048322 - DNA, 16 bp, Homo sapiens
agcagtctctgccttg

SEQ ID NO: 3048323 - DNA, 19 bp, Homo sapiens
agcagtctctgccttgcct

SEQ ID NO: 3048324 - DNA, 20 bp, Homo sapiens
agcagtctctgccttgcctt

SEQ ID NO: 3048325 - DNA, 21 bp, Homo sapiens
agcagtgaatgattcagtgtt

SEQ ID NO: 3048326 - DNA, 22 bp, Homo sapiens
agcagtgaatgattcagtgtta

SEQ ID NO: 3048327 - DNA, 23 bp, Homo sapiens
agcagtgcacatttcatagtttc

SEQ ID NO: 3048328 - DNA, 20 bp, Homo sapiens
agcagtggcctttgcaattg

SEQ ID NO: 3048329 - DNA, 15 bp, Homo sapiens
agcagtgtgaggcca

SEQ ID NO: 3048330 - DNA, 13 bp, Homo sapiens
agcagttactgtg

SEQ ID NO: 3048331 - DNA, 14 bp, Homo sapiens
agcagttttgtaaa

SEQ ID NO: 3048332 - DNA, 22 bp, Homo sapiens
agcatactccgtgaggctgctg

SEQ ID NO: 3048333 - DNA, 13 bp, Homo sapiens
agcatactttgta

SEQ ID NO: 3048334 - DNA, 13 bp, Homo sapiens
agcatagagaaca

SEQ ID NO: 3048335 - DNA, 17 bp, Homo sapiens
agcatagagaacaaagt

SEQ ID NO: 3048336 - DNA, 14 bp, Homo sapiens
agcataggtatgct

SEQ ID NO: 3048337 - DNA, 17 bp, Homo sapiens
agcatcaaacatgaaaa

SEQ ID NO: 3048338 - DNA, 19 bp, Homo sapiens
agcatcaaacatgaaaaca

SEQ ID NO: 3048339 - DNA, 20 bp, Homo sapiens
agcatcacatgaacttgtaa

SEQ ID NO: 3048340 - DNA, 13 bp, Homo sapiens
agcatcacctgcc

SEQ ID NO: 3048341 - DNA, 15 bp, Homo sapiens
agcatcagagggctg

SEQ ID NO: 3048342 - DNA, 20 bp, Homo sapiens
agcatcattgtccccatgca

SEQ ID NO: 3048343 - DNA, 13 bp, Homo sapiens
agcatccaggctg

SEQ ID NO: 3048344 - DNA, 18 bp, Homo sapiens
agcatccaggctggccag

SEQ ID NO: 3048345 - DNA, 14 bp, Homo sapiens
agcatcccacagga

SEQ ID NO: 3048346 - DNA, 12 bp, Homo sapiens
agcatcccagcc

SEQ ID NO: 3048347 - DNA, 13 bp, Homo sapiens
agcatcccagcct

SEQ ID NO: 3048348 - DNA, 14 bp, Homo sapiens
agcatcccagcctt

SEQ ID NO: 3048349 - DNA, 18 bp, Homo sapiens
agcatccccttgaactct

SEQ ID NO: 3048350 - DNA, 17 bp, Homo sapiens
agcatcctccccaccag

SEQ ID NO: 3048351 - DNA, 18 bp, Homo sapiens
agcatcggtcatgtgtgt

SEQ ID NO: 3048352 - DNA, 22 bp, Homo sapiens
agcatctcttcttccctgtcag

SEQ ID NO: 3048353 - DNA, 20 bp, Homo sapiens
agcatctgaccatctgtgac

SEQ ID NO: 3048354 - DNA, 24 bp, Homo sapiens
agcatctgcattgcccagtctttc

SEQ ID NO: 3048355 - DNA, 21 bp, Homo sapiens
agcatctgccacaaaaatgtt

SEQ ID NO: 3048356 - DNA, 22 bp, Homo sapiens
agcatcttccagaagtgtgatt

SEQ ID NO: 3048357 - DNA, 23 bp, Homo sapiens
agcatcttccagaagtgtgattg

SEQ ID NO: 3048358 - DNA, 23 bp, Homo sapiens
agcatgacaaaagtgacagatgt

SEQ ID NO: 3048359 - DNA, 18 bp, Homo sapiens
agcatgattttaagaggc

SEQ ID NO: 3048360 - DNA, 20 bp, Homo sapiens
agcatgccaacaagaatgca

SEQ ID NO: 3048361 - DNA, 14 bp, Homo sapiens
agcatgctgcctga

SEQ ID NO: 3048362 - DNA, 21 bp, Homo sapiens
agcatgctgtgattgtgccta

SEQ ID NO: 3048363 - DNA, 17 bp, Homo sapiens
agcatgcttgtgaaaat

SEQ ID NO: 3048364 - DNA, 12 bp, Homo sapiens
agcatggaatct

SEQ ID NO: 3048365 - DNA, 20 bp, Homo sapiens
agcatggaatctgatgaaaa

SEQ ID NO: 3048366 - DNA, 16 bp, Homo sapiens
agcatggcactccctc

SEQ ID NO: 3048367 - DNA, 17 bp, Homo sapiens
agcatggcactccctcc

SEQ ID NO: 3048368 - DNA, 23 bp, Homo sapiens
agcatggcactccctccagcaca

SEQ ID NO: 3048369 - DNA, 17 bp, Homo sapiens
agcatgggaatacaaaa

SEQ ID NO: 3048370 - DNA, 19 bp, Homo sapiens
agcatggttccaatttttt

SEQ ID NO: 3048371 - DNA, 21 bp, Homo sapiens
agcatgtaatgttaatgttat

SEQ ID NO: 3048372 - DNA, 17 bp, Homo sapiens
agcatgtctctgcttcc

SEQ ID NO: 3048373 - DNA, 16 bp, Homo sapiens
agcatgttttctgctt

SEQ ID NO: 3048374 - DNA, 17 bp, Homo sapiens
agcattaaaataactat

SEQ ID NO: 3048375 - DNA, 13 bp, Homo sapiens
agcattactttat

SEQ ID NO: 3048376 - DNA, 16 bp, Homo sapiens
agcattagattccttt

SEQ ID NO: 3048377 - DNA, 15 bp, Homo sapiens
agcattatttacaaa

SEQ ID NO: 3048378 - DNA, 13 bp, Homo sapiens
agcattccaacaa

SEQ ID NO: 3048379 - DNA, 23 bp, Homo sapiens
agcccacctcggccctccctgcg

SEQ ID NO: 3048380 - DNA, 11 bp, Homo sapiens
agcccacctga

SEQ ID NO: 3048381 - DNA, 21 bp, Homo sapiens
agcccacctgaaagcctgtct

SEQ ID NO: 3048382 - DNA, 12 bp, Homo sapiens
agcccacctggg

SEQ ID NO: 3048383 - DNA, 23 bp, Homo sapiens
agcccacgtcacgtgtagtgtcc

SEQ ID NO: 3048384 - DNA, 14 bp, Homo sapiens
agcccactgtcctg

SEQ ID NO: 3048385 - DNA, 17 bp, Homo sapiens
agcccactgtcctgggc

SEQ ID NO: 3048386 - DNA, 23 bp, Homo sapiens
agcccactgtcctgggcctgcag

SEQ ID NO: 3048387 - DNA, 18 bp, Homo sapiens
agcccagacccccagtgt

SEQ ID NO: 3048388 - DNA, 22 bp, Homo sapiens
agcccagatgttttacgtctgg

SEQ ID NO: 3048389 - DNA, 21 bp, Homo sapiens
agcccagattgtgccactgct

SEQ ID NO: 3048390 - DNA, 15 bp, Homo sapiens
agcccagcccagctg

SEQ ID NO: 3048391 - DNA, 16 bp, Homo sapiens
agcccagcccagctgg

SEQ ID NO: 3048392 - DNA, 13 bp, Homo sapiens
agcccagcccagg

SEQ ID NO: 3048393 - DNA, 15 bp, Homo sapiens
agcccagcggcccaa

SEQ ID NO: 3048394 - DNA, 16 bp, Homo sapiens
agcccagcggcccaag

SEQ ID NO: 3048395 - DNA, 12 bp, Homo sapiens
agcccagctcca

SEQ ID NO: 3048396 - DNA, 14 bp, Homo sapiens
agcccagctctgaa

SEQ ID NO: 3048397 - DNA, 12 bp, Homo sapiens
agcccagctctt

SEQ ID NO: 3048398 - DNA, 15 bp, Homo sapiens
agcccagctcttgct

SEQ ID NO: 3048399 - DNA, 19 bp, Homo sapiens
agcccagctgggtcaggca

SEQ ID NO: 3048400 - DNA, 13 bp, Homo sapiens
agcccagctggtg

SEQ ID NO: 3048401 - DNA, 18 bp, Homo sapiens
agcccagggagcggaaag

SEQ ID NO: 3048402 - DNA, 19 bp, Homo sapiens
agcccagggagcggaaagc

SEQ ID NO: 3048403 - DNA, 20 bp, Homo sapiens
agcccagggagcggaaagca

SEQ ID NO: 3048404 - DNA, 23 bp, Homo sapiens
agcccagggagcggaaagcagct

SEQ ID NO: 3048405 - DNA, 14 bp, Homo sapiens
agcccagtgcttct

SEQ ID NO: 3048406 - DNA, 18 bp, Homo sapiens
agcccatccttccctttg

SEQ ID NO: 3048407 - DNA, 18 bp, Homo sapiens
agcccatcgccacaaact

SEQ ID NO: 3048408 - DNA, 19 bp, Homo sapiens
agcccatcgccacaaactc

SEQ ID NO: 3048409 - DNA, 17 bp, Homo sapiens
agcccatgccctgccgt

SEQ ID NO: 3048410 - DNA, 16 bp, Homo sapiens
agcccattctctctcc

SEQ ID NO: 3048411 - DNA, 18 bp, Homo sapiens
agcccattctctctcctg

SEQ ID NO: 3048412 - DNA, 21 bp, Homo sapiens
agcccattctctctcctgtcc

SEQ ID NO: 3048413 - DNA, 21 bp, Homo sapiens
agcccattgtggaggcggtgg

SEQ ID NO: 3048414 - DNA, 14 bp, Homo sapiens
agcccatttctcca

SEQ ID NO: 3048415 - DNA, 19 bp, Homo sapiens
agcccatttctccagaacc

SEQ ID NO: 3048416 - DNA, 12 bp, Homo sapiens
agccccagactg

SEQ ID NO: 3048417 - DNA, 22 bp, Homo sapiens
agccccagactgggcccaggca

SEQ ID NO: 3048418 - DNA, 15 bp, Homo sapiens
agccccagtcagaag

SEQ ID NO: 3048419 - DNA, 17 bp, Homo sapiens
agccccagtgacagcta

SEQ ID NO: 3048420 - DNA, 18 bp, Homo sapiens
agccccatcctgccgccc

SEQ ID NO: 3048421 - DNA, 13 bp, Homo sapiens
agccccatctgtc

SEQ ID NO: 3048422 - DNA, 16 bp, Homo sapiens
agccccatctgtgcat

SEQ ID NO: 3048423 - DNA, 23 bp, Homo sapiens
agccccatctgtgcattctcctg

SEQ ID NO: 3048424 - DNA, 13 bp, Homo sapiens
agccccattcctg

SEQ ID NO: 3048425 - DNA, 16 bp, Homo sapiens
agcccccaccccagca

SEQ ID NO: 3048426 - DNA, 20 bp, Homo sapiens
agcccccagctaagaacctg

SEQ ID NO: 3048427 - DNA, 17 bp, Homo sapiens
agccccctggcagctgc

SEQ ID NO: 3048428 - DNA, 20 bp, Homo sapiens
agctacaacagcctcacttg

SEQ ID NO: 3048429 - DNA, 21 bp, Homo sapiens
agctacacctttctcctttgt

SEQ ID NO: 3048430 - DNA, 22 bp, Homo sapiens
agctacactcattgaaatgtaa

SEQ ID NO: 3048431 - DNA, 12 bp, Homo sapiens
agctacagttgt

SEQ ID NO: 3048432 - DNA, 22 bp, Homo sapiens
agctacgtggcactatattctg

SEQ ID NO: 3048433 - DNA, 14 bp, Homo sapiens
agctactcagaaat

SEQ ID NO: 3048434 - DNA, 18 bp, Homo sapiens
agctactcaggaggctga

SEQ ID NO: 3048435 - DNA, 13 bp, Homo sapiens
agctactggggag

SEQ ID NO: 3048436 - DNA, 17 bp, Homo sapiens
agctactggggaggctg

SEQ ID NO: 3048437 - DNA, 21 bp, Homo sapiens
agctactggggaggctgaggc

SEQ ID NO: 3048438 - DNA, 20 bp, Homo sapiens
agctactgtgtgtgtgaatg

SEQ ID NO: 3048439 - DNA, 17 bp, Homo sapiens
agctacttgggagcctg

SEQ ID NO: 3048440 - DNA, 17 bp, Homo sapiens
agctagagagaaaaaga

SEQ ID NO: 3048441 - DNA, 12 bp, Homo sapiens
agctagccagag

SEQ ID NO: 3048442 - DNA, 19 bp, Homo sapiens
agctagccagaggactgtg

SEQ ID NO: 3048443 - DNA, 12 bp, Homo sapiens
agctagccagcc

SEQ ID NO: 3048444 - DNA, 13 bp, Homo sapiens
agctagccagcca

SEQ ID NO: 3048445 - DNA, 16 bp, Homo sapiens
agctagcgctgccgca

SEQ ID NO: 3048446 - DNA, 18 bp, Homo sapiens
agctagcgctgccgcacc

SEQ ID NO: 3048447 - DNA, 21 bp, Homo sapiens
agctagcgctgccgcacccca

SEQ ID NO: 3048448 - DNA, 18 bp, Homo sapiens
agctaggaagagcaggac

SEQ ID NO: 3048449 - DNA, 16 bp, Homo sapiens
agctagtgtacctcct

SEQ ID NO: 3048450 - DNA, 18 bp, Homo sapiens
agctagtgtacctcctct

SEQ ID NO: 3048451 - DNA, 19 bp, Homo sapiens
agctagtgtacctcctctc

SEQ ID NO: 3048452 - DNA, 21 bp, Homo sapiens
agctagtgtacctcctctcag

SEQ ID NO: 3048453 - DNA, 23 bp, Homo sapiens
agctagtgtacctcctctcagtg

SEQ ID NO: 3048454 - DNA, 15 bp, Homo sapiens
agctagttggggagc

SEQ ID NO: 3048455 - DNA, 16 bp, Homo sapiens
agctatacctgtgcct

SEQ ID NO: 3048456 - DNA, 17 bp, Homo sapiens
agctatacctgtgcctc

SEQ ID NO: 3048457 - DNA, 19 bp, Homo sapiens
agctatagacccgaggaaa

SEQ ID NO: 3048458 - DNA, 21 bp, Homo sapiens
agctatcaagaggctgagaca

SEQ ID NO: 3048459 - DNA, 22 bp, Homo sapiens
agctatgataagattgaaattc

SEQ ID NO: 3048460 - DNA, 15 bp, Homo sapiens
agctatgcagggagg

SEQ ID NO: 3048461 - DNA, 17 bp, Homo sapiens
agctatggtgagatgca

SEQ ID NO: 3048462 - DNA, 16 bp, Homo sapiens
agctatttagtgatat

SEQ ID NO: 3048463 - DNA, 17 bp, Homo sapiens
agctatttatgggcccc

SEQ ID NO: 3048464 - DNA, 22 bp, Homo sapiens
agctatttatgggcccctggca

SEQ ID NO: 3048465 - DNA, 13 bp, Homo sapiens
agctcaaaggcac

SEQ ID NO: 3048466 - DNA, 16 bp, Homo sapiens
agctcaaaggcacagt

SEQ ID NO: 3048467 - DNA, 17 bp, Homo sapiens
agctcaagcattctgtt

SEQ ID NO: 3048468 - DNA, 19 bp, Homo sapiens
agctcaaggaaaggcctga

SEQ ID NO: 3048469 - DNA, 21 bp, Homo sapiens
agctcacaccctaccttcccc

SEQ ID NO: 3048470 - DNA, 21 bp, Homo sapiens
agctcacagttcctcgccctg

SEQ ID NO: 3048471 - DNA, 21 bp, Homo sapiens
agctcacctgttgcttacaat

SEQ ID NO: 3048472 - DNA, 20 bp, Homo sapiens
agctcagacccccactctca

SEQ ID NO: 3048473 - DNA, 20 bp, Homo sapiens
agctcaggaaccgaggcagg

SEQ ID NO: 3048474 - DNA, 13 bp, Homo sapiens
agctcaggacaga

SEQ ID NO: 3048475 - DNA, 12 bp, Homo sapiens
agctcagggcag

SEQ ID NO: 3048476 - DNA, 15 bp, Homo sapiens
agctcagttgggttt

SEQ ID NO: 3048477 - DNA, 16 bp, Homo sapiens
agctcattcattttat

SEQ ID NO: 3048478 - DNA, 17 bp, Homo sapiens
agctccaccctggccga

SEQ ID NO: 3048479 - DNA, 16 bp, Homo sapiens
agctccagcccctttc

SEQ ID NO: 3048480 - DNA, 19 bp, Homo sapiens
agctccagcgatggtgctg

SEQ ID NO: 3048481 - DNA, 20 bp, Homo sapiens
agctccagcgatggtgctgc

SEQ ID NO: 3048482 - DNA, 24 bp, Homo sapiens
agctccagcgatggtgctgcccag

SEQ ID NO: 3048483 - DNA, 12 bp, Homo sapiens
agctcccaagag

SEQ ID NO: 3048484 - DNA, 11 bp, Homo sapiens
agctcccaggc

SEQ ID NO: 3048485 - DNA, 22 bp, Homo sapiens
agctcccaggtgcagccagagg

SEQ ID NO: 3048486 - DNA, 14 bp, Homo sapiens
agctccgacctctc

SEQ ID NO: 3048487 - DNA, 17 bp, Homo sapiens
agctccgacctctctca

SEQ ID NO: 3048488 - DNA, 14 bp, Homo sapiens
agctcctcactgtg

SEQ ID NO: 3048489 - DNA, 14 bp, Homo sapiens
agctcctcccctgc

SEQ ID NO: 3048490 - DNA, 19 bp, Homo sapiens
agcgaggaggctccagagg

SEQ ID NO: 3048491 - DNA, 15 bp, Homo sapiens
agcgagtggatgctg

SEQ ID NO: 3048492 - DNA, 17 bp, Homo sapiens
agcgagtggatgctgtg

SEQ ID NO: 3048493 - DNA, 19 bp, Homo sapiens
agcgagtggatgctgtgct

SEQ ID NO: 3048494 - DNA, 21 bp, Homo sapiens
agcgatggtgctgcccaggcc

SEQ ID NO: 3048495 - DNA, 16 bp, Homo sapiens
agcgatgtatgcagct

SEQ ID NO: 3048496 - DNA, 20 bp, Homo sapiens
agcgattctcctgcctcagc

SEQ ID NO: 3048497 - DNA, 13 bp, Homo sapiens
agcgccacccagt

SEQ ID NO: 3048498 - DNA, 12 bp, Homo sapiens
agcgccaggctg

SEQ ID NO: 3048499 - DNA, 13 bp, Homo sapiens
agcgcccacccag

SEQ ID NO: 3048500 - DNA, 16 bp, Homo sapiens
agcgcccacccaggtc

SEQ ID NO: 3048501 - DNA, 21 bp, Homo sapiens
agcgcctagtggggtctccct

SEQ ID NO: 3048502 - DNA, 17 bp, Homo sapiens
agcgcctggctgctgct

SEQ ID NO: 3048503 - DNA, 18 bp, Homo sapiens
agcgcctgtcccctcaca

SEQ ID NO: 3048504 - DNA, 19 bp, Homo sapiens
agcgcctgtcccctcacag

SEQ ID NO: 3048505 - DNA, 14 bp, Homo sapiens
agcgcggctggctc

SEQ ID NO: 3048506 - DNA, 13 bp, Homo sapiens
agcgctctcctgg

SEQ ID NO: 3048507 - DNA, 14 bp, Homo sapiens
agcgctctcctgga

SEQ ID NO: 3048508 - DNA, 15 bp, Homo sapiens
agcgctctcctggac

SEQ ID NO: 3048509 - DNA, 11 bp, Homo sapiens
agcgctctgga

SEQ ID NO: 3048510 - DNA, 12 bp, Homo sapiens
agcgctctggac

SEQ ID NO: 3048511 - DNA, 17 bp, Homo sapiens
agcgctgccgcacccca

SEQ ID NO: 3048512 - DNA, 18 bp, Homo sapiens
agcgctgccgcaccccag

SEQ ID NO: 3048513 - DNA, 21 bp, Homo sapiens
agcgctgccgcaccccagagt

SEQ ID NO: 3048514 - DNA, 16 bp, Homo sapiens
agcgctggccgggacc

SEQ ID NO: 3048515 - DNA, 15 bp, Homo sapiens
agcgctgtttccttg

SEQ ID NO: 3048516 - DNA, 21 bp, Homo sapiens
agcgctttgggaggccgaggc

SEQ ID NO: 3048517 - DNA, 12 bp, Homo sapiens
agcggaataaac

SEQ ID NO: 3048518 - DNA, 22 bp, Homo sapiens
agcggaataaactagagaaggg

SEQ ID NO: 3048519 - DNA, 21 bp, Homo sapiens
agcggccgatgggagtctccc

SEQ ID NO: 3048520 - DNA, 22 bp, Homo sapiens
agcggccggccagcccctggcc

SEQ ID NO: 3048521 - DNA, 12 bp, Homo sapiens
agcggcctcagg

SEQ ID NO: 3048522 - DNA, 14 bp, Homo sapiens
agcggcctcagggt

SEQ ID NO: 3048523 - DNA, 21 bp, Homo sapiens
agcggcctcagggtctaagga

SEQ ID NO: 3048524 - DNA, 17 bp, Homo sapiens
agcggcgccctggactt

SEQ ID NO: 3048525 - DNA, 20 bp, Homo sapiens
agcggcgccctggacttggt

SEQ ID NO: 3048526 - DNA, 17 bp, Homo sapiens
agcggctggacttggag

SEQ ID NO: 3048527 - DNA, 12 bp, Homo sapiens
agcgggcagggc

SEQ ID NO: 3048528 - DNA, 14 bp, Homo sapiens
agcgggcagggccg

SEQ ID NO: 3048529 - DNA, 22 bp, Homo sapiens
agcggtccatgggtctggcctg

SEQ ID NO: 3048530 - DNA, 17 bp, Homo sapiens
agcggtgtggaccgagg

SEQ ID NO: 3048531 - DNA, 22 bp, Homo sapiens
agcggtgtggaccgaggaacaa

SEQ ID NO: 3048532 - DNA, 21 bp, Homo sapiens
agcgtatatataagaaagaca

SEQ ID NO: 3048533 - DNA, 16 bp, Homo sapiens
agcgtcctcctctgtg

SEQ ID NO: 3048534 - DNA, 11 bp, Homo sapiens
agcgtcctgcc

SEQ ID NO: 3048535 - DNA, 20 bp, Homo sapiens
agcgtgctggcgacactcag

SEQ ID NO: 3048536 - DNA, 21 bp, Homo sapiens
agcgtgctggcgacactcagg

SEQ ID NO: 3048537 - DNA, 20 bp, Homo sapiens
agcgttcaaactgctggaaa

SEQ ID NO: 3048538 - DNA, 15 bp, Homo sapiens
agcgttctaaatatg

SEQ ID NO: 3048539 - DNA, 20 bp, Homo sapiens
agcgttctaaatatgaatga

SEQ ID NO: 3048540 - DNA, 18 bp, Homo sapiens
agcgtttgctgtgccagg

SEQ ID NO: 3048541 - DNA, 17 bp, Homo sapiens
agctaaaagaggcctgt

SEQ ID NO: 3048542 - DNA, 23 bp, Homo sapiens
agctaaaagcatggccctgctgc

SEQ ID NO: 3048543 - DNA, 22 bp, Homo sapiens
agctaacatgagtatcatcaga

SEQ ID NO: 3048544 - DNA, 15 bp, Homo sapiens
agctaactgtaaatc

SEQ ID NO: 3048545 - DNA, 16 bp, Homo sapiens
agctaactgtaaatca

SEQ ID NO: 3048546 - DNA, 13 bp, Homo sapiens
agctaagaacctg

SEQ ID NO: 3048547 - DNA, 16 bp, Homo sapiens
agctaagaacctggaa

SEQ ID NO: 3048548 - DNA, 17 bp, Homo sapiens
agctaagaacctggaac

SEQ ID NO: 3048549 - DNA, 16 bp, Homo sapiens
agctaaggacatttcc

SEQ ID NO: 3048550 - DNA, 19 bp, Homo sapiens
agctaaggacatttcccag

SEQ ID NO: 3048551 - DNA, 15 bp, Homo sapiens
agctaaggctctatg

SEQ ID NO: 3048552 - DNA, 18 bp, Homo sapiens
agctaaggctctatgagt

SEQ ID NO: 3048553 - DNA, 12 bp, Homo sapiens
agctaataaatc

SEQ ID NO: 3048554 - DNA, 13 bp, Homo sapiens
agctaatttgcat

SEQ ID NO: 3048555 - DNA, 20 bp, Homo sapiens
aggccgggagaggatgtctt

SEQ ID NO: 3048556 - DNA, 17 bp, Homo sapiens
aggccgggcctgtacag

SEQ ID NO: 3048557 - DNA, 22 bp, Homo sapiens
aggccgggcctgtacagtctgt

SEQ ID NO: 3048558 - DNA, 14 bp, Homo sapiens
aggccggggctgga

SEQ ID NO: 3048559 - DNA, 15 bp, Homo sapiens
aggcctaggattcta

SEQ ID NO: 3048560 - DNA, 16 bp, Homo sapiens
aggcctaggattctaa

SEQ ID NO: 3048561 - DNA, 17 bp, Homo sapiens
aggcctaggctaggacg

SEQ ID NO: 3048562 - DNA, 19 bp, Homo sapiens
aggcctaggctaggacgtt

SEQ ID NO: 3048563 - DNA, 20 bp, Homo sapiens
aggcctaggctaggacgttg

SEQ ID NO: 3048564 - DNA, 17 bp, Homo sapiens
aggcctaggtgcagctc

SEQ ID NO: 3048565 - DNA, 18 bp, Homo sapiens
aggcctaggtgcagctcc

SEQ ID NO: 3048566 - DNA, 13 bp, Homo sapiens
aggcctcagccag

SEQ ID NO: 3048567 - DNA, 15 bp, Homo sapiens
aggcctcagccagag

SEQ ID NO: 3048568 - DNA, 14 bp, Homo sapiens
aggcctccagctca

SEQ ID NO: 3048569 - DNA, 17 bp, Homo sapiens
aggcctccagctcagca

SEQ ID NO: 3048570 - DNA, 13 bp, Homo sapiens
aggcctccctcaa

SEQ ID NO: 3048571 - DNA, 16 bp, Homo sapiens
aggcctccctgcctca

SEQ ID NO: 3048572 - DNA, 21 bp, Homo sapiens
aggcctcgcacttgcagagga

SEQ ID NO: 3048573 - DNA, 14 bp, Homo sapiens
aggcctcgcctgcc

SEQ ID NO: 3048574 - DNA, 14 bp, Homo sapiens
aggcctctcagaaa

SEQ ID NO: 3048575 - DNA, 19 bp, Homo sapiens
aggcctcttttcctgaaga

SEQ ID NO: 3048576 - DNA, 16 bp, Homo sapiens
aggcctgaagctgagc

SEQ ID NO: 3048577 - DNA, 17 bp, Homo sapiens
aggcctgagacccagga

SEQ ID NO: 3048578 - DNA, 18 bp, Homo sapiens
aggcctgagacccaggac

SEQ ID NO: 3048579 - DNA, 14 bp, Homo sapiens
aggcctgccctgct

SEQ ID NO: 3048580 - DNA, 17 bp, Homo sapiens
aggcctgcgaccctggg

SEQ ID NO: 3048581 - DNA, 14 bp, Homo sapiens
aggcctgtctgtga

SEQ ID NO: 3048582 - DNA, 15 bp, Homo sapiens
aggccttcctctctc

SEQ ID NO: 3048583 - DNA, 18 bp, Homo sapiens
aggccttcctctctccag

SEQ ID NO: 3048584 - DNA, 19 bp, Homo sapiens
aggccttcctctctccaga

SEQ ID NO: 3048585 - DNA, 15 bp, Homo sapiens
aggccttgcctggcc

SEQ ID NO: 3048586 - DNA, 14 bp, Homo sapiens
aggccttgctgact

SEQ ID NO: 3048587 - DNA, 23 bp, Homo sapiens
aggccttgctgactctctgagct

SEQ ID NO: 3048588 - DNA, 23 bp, Homo sapiens
aggccttggggcatgacccagtg

SEQ ID NO: 3048589 - DNA, 23 bp, Homo sapiens
aggccttggggtgggggccaggc

SEQ ID NO: 3048590 - DNA, 20 bp, Homo sapiens
aggccttgtgtgtcaggccc

SEQ ID NO: 3048591 - DNA, 23 bp, Homo sapiens
aggcctttttcaaccagatttag

SEQ ID NO: 3048592 - DNA, 22 bp, Homo sapiens
aggcgcactgtgacccccagct

SEQ ID NO: 3048593 - DNA, 23 bp, Homo sapiens
aggcgcctataatcccagctact

SEQ ID NO: 3048594 - DNA, 24 bp, Homo sapiens
aggcgcctataatcccagctactg

SEQ ID NO: 3048595 - DNA, 14 bp, Homo sapiens
aggcgcggcctccc

SEQ ID NO: 3048596 - DNA, 18 bp, Homo sapiens
aggcgcggcctcccgagg

SEQ ID NO: 3048597 - DNA, 11 bp, Homo sapiens
aggcggccagg

SEQ ID NO: 3048598 - DNA, 18 bp, Homo sapiens
aggcggccagggcggcca

SEQ ID NO: 3048599 - DNA, 19 bp, Homo sapiens
aggcggccagggcggccag

SEQ ID NO: 3048600 - DNA, 18 bp, Homo sapiens
aggcggccctcagtgcat

SEQ ID NO: 3048601 - DNA, 14 bp, Homo sapiens
aggcgggcttggaa

SEQ ID NO: 3048602 - DNA, 17 bp, Homo sapiens
aggcgggggctgccctt

SEQ ID NO: 3048603 - DNA, 17 bp, Homo sapiens
aggcgtcccgcacctgt

SEQ ID NO: 3048604 - DNA, 19 bp, Homo sapiens
aggcgtcccgcacctgtct

SEQ ID NO: 3048605 - DNA, 22 bp, Homo sapiens
aggcgtcttcatctccctgcca

SEQ ID NO: 3048606 - DNA, 17 bp, Homo sapiens
aggcgtgggatcagatt

SEQ ID NO: 3048607 - DNA, 14 bp, Homo sapiens
aggcgtgtggcagc

SEQ ID NO: 3048608 - DNA, 18 bp, Homo sapiens
aggcgttcttcgaggtgg

SEQ ID NO: 3048609 - DNA, 19 bp, Homo sapiens
aggctaaattactcaggaa

SEQ ID NO: 3048610 - DNA, 17 bp, Homo sapiens
aggctaattcagtgtca

SEQ ID NO: 3048611 - DNA, 19 bp, Homo sapiens
aggctaattcagtgtcaca

SEQ ID NO: 3048612 - DNA, 18 bp, Homo sapiens
aggctagctggagcctgg

SEQ ID NO: 3048613 - DNA, 15 bp, Homo sapiens
aggctagggtgggga

SEQ ID NO: 3048614 - DNA, 16 bp, Homo sapiens
aggctagggtggggag

SEQ ID NO: 3048615 - DNA, 19 bp, Homo sapiens
aggctagggtggggagaga

SEQ ID NO: 3048616 - DNA, 21 bp, Homo sapiens
aggctattgtcccctaaacca

SEQ ID NO: 3048617 - DNA, 23 bp, Homo sapiens
aggctcaaaaacttgatcacatg

SEQ ID NO: 3048618 - DNA, 13 bp, Homo sapiens
aggctcagaagga

SEQ ID NO: 3048619 - DNA, 18 bp, Homo sapiens
aggctcagagggtgtcct

SEQ ID NO: 3048620 - DNA, 16 bp, Homo sapiens
aggctcaggtccctgg

SEQ ID NO: 3048621 - DNA, 15 bp, Homo sapiens
aggctcatctttctg

SEQ ID NO: 3048622 - DNA, 22 bp, Homo sapiens
aggctcatctttctgcccggct

SEQ ID NO: 3048623 - DNA, 13 bp, Homo sapiens
aggctccagaggg

SEQ ID NO: 3048624 - DNA, 18 bp, Homo sapiens
aggctcctccctctgcct

SEQ ID NO: 3048625 - DNA, 20 bp, Homo sapiens
aggctcctccctctgcctca

SEQ ID NO: 3048626 - DNA, 21 bp, Homo sapiens
aggctcctccctctgcctcat

SEQ ID NO: 3048627 - DNA, 23 bp, Homo sapiens
aggctcctccctctgcctcatcc

SEQ ID NO: 3048628 - DNA, 19 bp, Homo sapiens
aggctctatgagtctagat

SEQ ID NO: 3048629 - DNA, 21 bp, Homo sapiens
aggctctatgagtctagatgt

SEQ ID NO: 3048630 - DNA, 16 bp, Homo sapiens
aggctctgagagtcta

SEQ ID NO: 3048631 - DNA, 19 bp, Homo sapiens
aggctctgagagtctagat

SEQ ID NO: 3048632 - DNA, 13 bp, Homo sapiens
aggctctgccttc

SEQ ID NO: 3048633 - DNA, 17 bp, Homo sapiens
aggctctgtgccttggt

SEQ ID NO: 3048634 - DNA, 21 bp, Homo sapiens
aggctctgttatcagctgggc

SEQ ID NO: 3048635 - DNA, 14 bp, Homo sapiens
aggctgaccacagc

SEQ ID NO: 3048636 - DNA, 18 bp, Homo sapiens
aggctgaccacagcacag

SEQ ID NO: 3048637 - DNA, 13 bp, Homo sapiens
aggctgagacagg

SEQ ID NO: 3048638 - DNA, 17 bp, Homo sapiens
aggctgagacaggagaa

SEQ ID NO: 3048639 - DNA, 22 bp, Homo sapiens
aggctgaggaaaggccagctgg

SEQ ID NO: 3048640 - DNA, 13 bp, Homo sapiens
aggctgaggcaca

SEQ ID NO: 3048641 - DNA, 14 bp, Homo sapiens
aggctgaggcacaa

SEQ ID NO: 3048642 - DNA, 18 bp, Homo sapiens
aggctgaggctggcacag

SEQ ID NO: 3048643 - DNA, 13 bp, Homo sapiens
aggctgaggtggc

SEQ ID NO: 3048644 - DNA, 19 bp, Homo sapiens
aggctgcactggagccaca

SEQ ID NO: 3048645 - DNA, 23 bp, Homo sapiens
aggctgcagataacagaaaggct

SEQ ID NO: 3048646 - DNA, 13 bp, Homo sapiens
aggctgcagccag

SEQ ID NO: 3048647 - DNA, 15 bp, Homo sapiens
aggctgcagccaggc

SEQ ID NO: 3048648 - DNA, 20 bp, Homo sapiens
aggctgcagccaggcctcgc

SEQ ID NO: 3048649 - DNA, 18 bp, Homo sapiens
aggctgcagtcagccctg

SEQ ID NO: 3048650 - DNA, 12 bp, Homo sapiens
aggctgccccag

SEQ ID NO: 3048651 - DNA, 17 bp, Homo sapiens
aggctgccccaggccgg

SEQ ID NO: 3048652 - DNA, 19 bp, Homo sapiens
aggctgccccaggccggag

SEQ ID NO: 3048653 - DNA, 20 bp, Homo sapiens
aggctgccccaggccggagc

SEQ ID NO: 3048654 - DNA, 22 bp, Homo sapiens
aggctgccccaggccggagccc

SEQ ID NO: 3048655 - DNA, 23 bp, Homo sapiens
aggctgccccaggccggagccca

SEQ ID NO: 3048656 - DNA, 24 bp, Homo sapiens
aggctgccccaggccggagcccag

SEQ ID NO: 3048657 - DNA, 17 bp, Homo sapiens
aggctgccctgaggggc

SEQ ID NO: 3048658 - DNA, 13 bp, Homo sapiens
aggctgctgccat

SEQ ID NO: 3048659 - DNA, 20 bp, Homo sapiens
aggctgctggggcctcagac

SEQ ID NO: 3048660 - DNA, 19 bp, Homo sapiens
aggctgctttccaaagcca

SEQ ID NO: 3048661 - DNA, 16 bp, Homo sapiens
aggctggaggcagggc

SEQ ID NO: 3048662 - DNA, 19 bp, Homo sapiens
aggctggaggcagggcctt

SEQ ID NO: 3048663 - DNA, 22 bp, Homo sapiens
aggctggagggcagtggcacga

SEQ ID NO: 3048664 - DNA, 22 bp, Homo sapiens
aggctggattttgaattttctt

SEQ ID NO: 3048665 - DNA, 15 bp, Homo sapiens
aggctggccagccgc

SEQ ID NO: 3048666 - DNA, 16 bp, Homo sapiens
aggctggccagccgct

SEQ ID NO: 3048667 - DNA, 17 bp, Homo sapiens
aggctggccagccgctc

SEQ ID NO: 3048668 - DNA, 20 bp, Homo sapiens
aggctggctcgtaggcctgc

SEQ ID NO: 3048669 - DNA, 14 bp, Homo sapiens
aggctggcttgtcc

SEQ ID NO: 3048670 - DNA, 22 bp, Homo sapiens
aggctggcttgtcccctcctca

SEQ ID NO: 3048671 - DNA, 18 bp, Homo sapiens
aggctgggaactcatctg

SEQ ID NO: 3048672 - DNA, 22 bp, Homo sapiens
aggctgggcagcacaaggcctt

SEQ ID NO: 3048673 - DNA, 13 bp, Homo sapiens
aggctgggcatca

SEQ ID NO: 3048674 - DNA, 13 bp, Homo sapiens
aggctgggctgag

SEQ ID NO: 3048675 - DNA, 17 bp, Homo sapiens
aggctggggatggtagg

SEQ ID NO: 3048676 - DNA, 19 bp, Homo sapiens
aggctggtacaacggaggc

SEQ ID NO: 3048677 - DNA, 20 bp, Homo sapiens
aggctggtccgagctgagga

SEQ ID NO: 3048678 - DNA, 15 bp, Homo sapiens
aggctggtcttgaag

SEQ ID NO: 3048679 - DNA, 12 bp, Homo sapiens
aggctgtcccaa

SEQ ID NO: 3048680 - DNA, 20 bp, Homo sapiens
aggctgtgctgccctgaaga

SEQ ID NO: 3048681 - DNA, 18 bp, Homo sapiens
aggctgtgtccctgctgg

SEQ ID NO: 3048682 - DNA, 21 bp, Homo sapiens
aggctgtgtccctgctggggt

SEQ ID NO: 3048683 - DNA, 19 bp, Homo sapiens
aggctgtttgcttcaccgt

SEQ ID NO: 3048684 - DNA, 17 bp, Homo sapiens
aggcttaataaaaatga

SEQ ID NO: 3048685 - DNA, 15 bp, Homo sapiens
aggaggtgggggctg

SEQ ID NO: 3048686 - DNA, 20 bp, Homo sapiens
aggaggtgtgatagagcctt

SEQ ID NO: 3048687 - DNA, 20 bp, Homo sapiens
aggagtaatctgtgtacaaa

SEQ ID NO: 3048688 - DNA, 21 bp, Homo sapiens
aggagtcaactggctggccag

SEQ ID NO: 3048689 - DNA, 21 bp, Homo sapiens
aggagtgggaaaacactgcca

SEQ ID NO: 3048690 - DNA, 16 bp, Homo sapiens
aggagtgtcctggctg

SEQ ID NO: 3048691 - DNA, 17 bp, Homo sapiens
aggagttcaagaccagc

SEQ ID NO: 3048692 - DNA, 19 bp, Homo sapiens
aggagttcaagaccagcct

SEQ ID NO: 3048693 - DNA, 21 bp, Homo sapiens
aggagttcaagactagcctgg

SEQ ID NO: 3048694 - DNA, 22 bp, Homo sapiens
aggagttcaagactagcctggc

SEQ ID NO: 3048695 - DNA, 23 bp, Homo sapiens
aggagttcagggtcatagcatgc

SEQ ID NO: 3048696 - DNA, 16 bp, Homo sapiens
aggagttcgagaccaa

SEQ ID NO: 3048697 - DNA, 18 bp, Homo sapiens
aggagttctttggctcta

SEQ ID NO: 3048698 - DNA, 19 bp, Homo sapiens
aggagttctttggctctat

SEQ ID NO: 3048699 - DNA, 22 bp, Homo sapiens
aggagtttgagaccaggctggg

SEQ ID NO: 3048700 - DNA, 17 bp, Homo sapiens
aggagtttgaggctgca

SEQ ID NO: 3048701 - DNA, 15 bp, Homo sapiens
aggagtttgtgtgtc

SEQ ID NO: 3048702 - DNA, 16 bp, Homo sapiens
aggataaaaaggaagg

SEQ ID NO: 3048703 - DNA, 17 bp, Homo sapiens
aggataaaaaggaagga

SEQ ID NO: 3048704 - DNA, 18 bp, Homo sapiens
aggataaaaaggaaggag

SEQ ID NO: 3048705 - DNA, 18 bp, Homo sapiens
aggatactcaaagtggaa

SEQ ID NO: 3048706 - DNA, 17 bp, Homo sapiens
aggatagctaactgtaa

SEQ ID NO: 3048707 - DNA, 22 bp, Homo sapiens
aggatattatctacctgttctg

SEQ ID NO: 3048708 - DNA, 20 bp, Homo sapiens
aggatattttcaacaattag

SEQ ID NO: 3048709 - DNA, 13 bp, Homo sapiens
aggatcaagggct

SEQ ID NO: 3048710 - DNA, 14 bp, Homo sapiens
aggatcacctgagg

SEQ ID NO: 3048711 - DNA, 20 bp, Homo sapiens
aggatcacctgaggtcagga

SEQ ID NO: 3048712 - DNA, 16 bp, Homo sapiens
aggatcagattgcatg

SEQ ID NO: 3048713 - DNA, 13 bp, Homo sapiens
aggatcagccagg

SEQ ID NO: 3048714 - DNA, 22 bp, Homo sapiens
aggatcatatgaattgctgtct

SEQ ID NO: 3048715 - DNA, 23 bp, Homo sapiens
aggatcatcatttaaaaaaaaag

SEQ ID NO: 3048716 - DNA, 13 bp, Homo sapiens
aggatcatctgaa

SEQ ID NO: 3048717 - DNA, 15 bp, Homo sapiens
aggatccagcctcac

SEQ ID NO: 3048718 - DNA, 16 bp, Homo sapiens
aggatcccctccaagc

SEQ ID NO: 3048719 - DNA, 18 bp, Homo sapiens
aggatcccctgtcccctg

SEQ ID NO: 3048720 - DNA, 19 bp, Homo sapiens
aggatcccctgtcccctgg

SEQ ID NO: 3048721 - DNA, 14 bp, Homo sapiens
aggatctaaggctg

SEQ ID NO: 3048722 - DNA, 17 bp, Homo sapiens
aggatctcgcctggaaa

SEQ ID NO: 3048723 - DNA, 12 bp, Homo sapiens
aggatcttattt

SEQ ID NO: 3048724 - DNA, 15 bp, Homo sapiens
aggatctttgtggcc

SEQ ID NO: 3048725 - DNA, 18 bp, Homo sapiens
aggatcttttgaacccag

SEQ ID NO: 3048726 - DNA, 21 bp, Homo sapiens
aggatgaggacagagggcaca

SEQ ID NO: 3048727 - DNA, 22 bp, Homo sapiens
aggatgaggggttaatttatca

SEQ ID NO: 3048728 - DNA, 21 bp, Homo sapiens
aggatgatttcagaaggagaa

SEQ ID NO: 3048729 - DNA, 19 bp, Homo sapiens
aggatgcccagacatcagc

SEQ ID NO: 3048730 - DNA, 20 bp, Homo sapiens
aggatgctctttcccaggac

SEQ ID NO: 3048731 - DNA, 21 bp, Homo sapiens
aggatgctctttcccaggacg

SEQ ID NO: 3048732 - DNA, 15 bp, Homo sapiens
aggatggaaaaataa

SEQ ID NO: 3048733 - DNA, 19 bp, Homo sapiens
aggatggaacacggccaca

SEQ ID NO: 3048734 - DNA, 15 bp, Homo sapiens
aggatggcaggacgt

SEQ ID NO: 3048735 - DNA, 15 bp, Homo sapiens
aggatgggaaaaact

SEQ ID NO: 3048736 - DNA, 15 bp, Homo sapiens
aggatgggaatcagg

SEQ ID NO: 3048737 - DNA, 21 bp, Homo sapiens
aggatgggaatcaggcatgtg

SEQ ID NO: 3048738 - DNA, 19 bp, Homo sapiens
aggatggttagacagcaca

SEQ ID NO: 3048739 - DNA, 19 bp, Homo sapiens
aggatgtaaacagtgcctg

SEQ ID NO: 3048740 - DNA, 20 bp, Homo sapiens
aggatgtatcgggaagattt

SEQ ID NO: 3048741 - DNA, 13 bp, Homo sapiens
aggatgtgtttgc

SEQ ID NO: 3048742 - DNA, 18 bp, Homo sapiens
aggatgtgtttgctttct

SEQ ID NO: 3048743 - DNA, 18 bp, Homo sapiens
aggattacagaaactgat

SEQ ID NO: 3048744 - DNA, 23 bp, Homo sapiens
aggattacagaaactgatgccaa

SEQ ID NO: 3048745 - DNA, 14 bp, Homo sapiens
aggattccccctgc

SEQ ID NO: 3048746 - DNA, 12 bp, Homo sapiens
aggattctaaaa

SEQ ID NO: 3048747 - DNA, 17 bp, Homo sapiens
aggattctaaacagatg

SEQ ID NO: 3048748 - DNA, 13 bp, Homo sapiens
aggatttcttaaa

SEQ ID NO: 3048749 - DNA, 14 bp, Homo sapiens
aggatttcttgtat

SEQ ID NO: 3048750 - DNA, 18 bp, Homo sapiens
aggatttgatgcttttct

SEQ ID NO: 3048751 - DNA, 19 bp, Homo sapiens
aggatttgatgcttttctc

SEQ ID NO: 3048752 - DNA, 14 bp, Homo sapiens
aggatttgatttct

SEQ ID NO: 3048753 - DNA, 16 bp, Homo sapiens
aggatttgctgggaga

SEQ ID NO: 3048754 - DNA, 12 bp, Homo sapiens
aggatttttaga

SEQ ID NO: 3048755 - DNA, 17 bp, Homo sapiens
aggatttttagagcatt

SEQ ID NO: 3048756 - DNA, 21 bp, Homo sapiens
aggatttttagagcattaaaa

SEQ ID NO: 3048757 - DNA, 15 bp, Homo sapiens
aggatttttatcttt

SEQ ID NO: 3048758 - DNA, 21 bp, Homo sapiens
aggcaaaaataatttattttg

SEQ ID NO: 3048759 - DNA, 17 bp, Homo sapiens
aggcaaaattgcaaatc

SEQ ID NO: 3048760 - DNA, 20 bp, Homo sapiens
aggcaaaattgcaaatcttg

SEQ ID NO: 3048761 - DNA, 15 bp, Homo sapiens
aggcaaaggcagagg

SEQ ID NO: 3048762 - DNA, 16 bp, Homo sapiens
aggcaaaggcagagga

SEQ ID NO: 3048763 - DNA, 17 bp, Homo sapiens
aggcaaaggcagaggaa

SEQ ID NO: 3048764 - DNA, 16 bp, Homo sapiens
aggcaaagggtccaga

SEQ ID NO: 3048765 - DNA, 19 bp, Homo sapiens
aggcaagattggaaagaca

SEQ ID NO: 3048766 - DNA, 21 bp, Homo sapiens
aggcaagattggaaagacagg

SEQ ID NO: 3048767 - DNA, 17 bp, Homo sapiens
aggcaagccagcatgtg

SEQ ID NO: 3048768 - DNA, 22 bp, Homo sapiens
aggcaatcgtggatgtctctga

SEQ ID NO: 3048769 - DNA, 17 bp, Homo sapiens
aggcacagtgaaggctg

SEQ ID NO: 3048770 - DNA, 15 bp, Homo sapiens
aggcacattaactgt

SEQ ID NO: 3048771 - DNA, 15 bp, Homo sapiens
aggcaccgcagcctg

SEQ ID NO: 3048772 - DNA, 21 bp, Homo sapiens
aggcaccgcagcctgtcagcc

SEQ ID NO: 3048773 - DNA, 12 bp, Homo sapiens
aggcacctcaag

SEQ ID NO: 3048774 - DNA, 20 bp, Homo sapiens
aggcactctgttatttagac

SEQ ID NO: 3048775 - DNA, 23 bp, Homo sapiens
aggcactgagataccagcgagga

SEQ ID NO: 3048776 - DNA, 19 bp, Homo sapiens
aggcactgcaaaccgccac

SEQ ID NO: 3048777 - DNA, 21 bp, Homo sapiens
aggcactgtagttctaagact

SEQ ID NO: 3048778 - DNA, 14 bp, Homo sapiens
aggcacttcctccc

SEQ ID NO: 3048779 - DNA, 16 bp, Homo sapiens
aggcacttcctcccct

SEQ ID NO: 3048780 - DNA, 21 bp, Homo sapiens
aggcacttcctcccctcgccc

SEQ ID NO: 3048781 - DNA, 23 bp, Homo sapiens
aggcactttgggggtttgagggt

SEQ ID NO: 3048782 - DNA, 17 bp, Homo sapiens
aggcagaaatataaaca

SEQ ID NO: 3048783 - DNA, 20 bp, Homo sapiens
aggcagaaatataaacacat

SEQ ID NO: 3048784 - DNA, 13 bp, Homo sapiens
aggcagaagaatc

SEQ ID NO: 3048785 - DNA, 21 bp, Homo sapiens
aggcagaagaatctttcttct

SEQ ID NO: 3048786 - DNA, 21 bp, Homo sapiens
aggcagactctttatgcttgc

SEQ ID NO: 3048787 - DNA, 13 bp, Homo sapiens
aggcagagaaagg

SEQ ID NO: 3048788 - DNA, 17 bp, Homo sapiens
aggcagagcgggaggga

SEQ ID NO: 3048789 - DNA, 19 bp, Homo sapiens
aggcagagcgggagggagt

SEQ ID NO: 3048790 - DNA, 12 bp, Homo sapiens
aggcagagctga

SEQ ID NO: 3048791 - DNA, 21 bp, Homo sapiens
aggcagagctgagggccctgt

SEQ ID NO: 3048792 - DNA, 13 bp, Homo sapiens
aggcagaggctgc

SEQ ID NO: 3048793 - DNA, 22 bp, Homo sapiens
aggcagaggttgcagtgagctg

SEQ ID NO: 3048794 - DNA, 18 bp, Homo sapiens
aggacccaagcagagaag

SEQ ID NO: 3048795 - DNA, 13 bp, Homo sapiens
aggacccagggag

SEQ ID NO: 3048796 - DNA, 20 bp, Homo sapiens
aggacccagggagaggctgt

SEQ ID NO: 3048797 - DNA, 12 bp, Homo sapiens
aggacccctcac

SEQ ID NO: 3048798 - DNA, 14 bp, Homo sapiens
aggacccctcacca

SEQ ID NO: 3048799 - DNA, 20 bp, Homo sapiens
aggacccctcaccaccccca

SEQ ID NO: 3048800 - DNA, 22 bp, Homo sapiens
aggacccctcaccacccccact

SEQ ID NO: 3048801 - DNA, 15 bp, Homo sapiens
aggacccgccagccc

SEQ ID NO: 3048802 - DNA, 19 bp, Homo sapiens
aggaccctgaaggggccat

SEQ ID NO: 3048803 - DNA, 21 bp, Homo sapiens
aggacctccaagccactgagc

SEQ ID NO: 3048804 - DNA, 21 bp, Homo sapiens
aggacctcggatgaccatact

SEQ ID NO: 3048805 - DNA, 22 bp, Homo sapiens
aggacctcggatgaccatactc

SEQ ID NO: 3048806 - DNA, 18 bp, Homo sapiens
aggacctgaaattccaaa

SEQ ID NO: 3048807 - DNA, 20 bp, Homo sapiens
aggacctgaaattccaaagt

SEQ ID NO: 3048808 - DNA, 14 bp, Homo sapiens
aggacgaggcagaa

SEQ ID NO: 3048809 - DNA, 15 bp, Homo sapiens
aggacgtaaaattta

SEQ ID NO: 3048810 - DNA, 15 bp, Homo sapiens
aggactccaggccca

SEQ ID NO: 3048811 - DNA, 20 bp, Homo sapiens
aggactccaggcccaaggct

SEQ ID NO: 3048812 - DNA, 23 bp, Homo sapiens
aggactccaggcccaaggctccc

SEQ ID NO: 3048813 - DNA, 15 bp, Homo sapiens
aggactcctccccac

SEQ ID NO: 3048814 - DNA, 22 bp, Homo sapiens
aggactctgcaagtgtctggag

SEQ ID NO: 3048815 - DNA, 24 bp, Homo sapiens
aggactctgcaagtgtctggagcg

SEQ ID NO: 3048816 - DNA, 20 bp, Homo sapiens
aggactgaattgtccccagt

SEQ ID NO: 3048817 - DNA, 12 bp, Homo sapiens
aggactgcacca

SEQ ID NO: 3048818 - DNA, 23 bp, Homo sapiens
aggactggaaaaatgaactgtat

SEQ ID NO: 3048819 - DNA, 17 bp, Homo sapiens
aggactgggtctgacct

SEQ ID NO: 3048820 - DNA, 18 bp, Homo sapiens
aggactgggtctgacctg

SEQ ID NO: 3048821 - DNA, 16 bp, Homo sapiens
aggactgtatttgtga

SEQ ID NO: 3048822 - DNA, 17 bp, Homo sapiens
aggactgtatttgtgac

SEQ ID NO: 3048823 - DNA, 21 bp, Homo sapiens
aggactgtcattttggcatct

SEQ ID NO: 3048824 - DNA, 17 bp, Homo sapiens
aggactgtggcaaacaa

SEQ ID NO: 3048825 - DNA, 22 bp, Homo sapiens
aggacttcctgtccagctccaa

SEQ ID NO: 3048826 - DNA, 21 bp, Homo sapiens
aggactttcctaaatgtttaa

SEQ ID NO: 3048827 - DNA, 15 bp, Homo sapiens
aggactttcttctaa

SEQ ID NO: 3048828 - DNA, 18 bp, Homo sapiens
aggacttttaaacaaaag

SEQ ID NO: 3048829 - DNA, 20 bp, Homo sapiens
aggagaaacacttgaacctg

SEQ ID NO: 3048830 - DNA, 20 bp, Homo sapiens
aggagaaattttggtttttc

SEQ ID NO: 3048831 - DNA, 14 bp, Homo sapiens
aggagaagccagga

SEQ ID NO: 3048832 - DNA, 15 bp, Homo sapiens
aggagaagccaggaa

SEQ ID NO: 3048833 - DNA, 16 bp, Homo sapiens
aggagaaggaaggaga

SEQ ID NO: 3048834 - DNA, 15 bp, Homo sapiens
aggagaagggctggg

SEQ ID NO: 3048835 - DNA, 14 bp, Homo sapiens
aggagaaggtcagc

SEQ ID NO: 3048836 - DNA, 22 bp, Homo sapiens
aggagaaggtcagcgagaagga

SEQ ID NO: 3048837 - DNA, 22 bp, Homo sapiens
aggagaagtggggaccccaccc

SEQ ID NO: 3048838 - DNA, 14 bp, Homo sapiens
aggagaatcacctg

SEQ ID NO: 3048839 - DNA, 20 bp, Homo sapiens
aggagaatcgcttgaaccca

SEQ ID NO: 3048840 - DNA, 21 bp, Homo sapiens
aggagaatcgcttgaacctgg

SEQ ID NO: 3048841 - DNA, 16 bp, Homo sapiens
aggagaatgaaatgta

SEQ ID NO: 3048842 - DNA, 20 bp, Homo sapiens
aggagaattgcttgaacctg

SEQ ID NO: 3048843 - DNA, 22 bp, Homo sapiens
aggagacaaagcaggagtggaa

SEQ ID NO: 3048844 - DNA, 13 bp, Homo sapiens
aggagacacaggg

SEQ ID NO: 3048845 - DNA, 13 bp, Homo sapiens
aggagacaggcag

SEQ ID NO: 3048846 - DNA, 11 bp, Homo sapiens
aggagactcac

SEQ ID NO: 3048847 - DNA, 17 bp, Homo sapiens
aggagactcacctctgc

SEQ ID NO: 3048848 - DNA, 18 bp, Homo sapiens
aggagactcacctctgcc

SEQ ID NO: 3048849 - DNA, 18 bp, Homo sapiens
aggagactggtaggagga

SEQ ID NO: 3048850 - DNA, 14 bp, Homo sapiens
aggagagaaaatat

SEQ ID NO: 3048851 - DNA, 14 bp, Homo sapiens
aggagagaagaatg

SEQ ID NO: 3048852 - DNA, 17 bp, Homo sapiens
aggagagacacctagct

SEQ ID NO: 3048853 - DNA, 18 bp, Homo sapiens
aggagagatagcctgtgg

SEQ ID NO: 3048854 - DNA, 20 bp, Homo sapiens
aggagagatgacccctaccc

SEQ ID NO: 3048855 - DNA, 15 bp, Homo sapiens
aggagagccagagaa

SEQ ID NO: 3048856 - DNA, 21 bp, Homo sapiens
aggagagccagagaagtgaca

SEQ ID NO: 3048857 - DNA, 15 bp, Homo sapiens
aggagagccagccct

SEQ ID NO: 3048858 - DNA, 14 bp, Homo sapiens
aggagaggagagcc

SEQ ID NO: 3048859 - DNA, 17 bp, Homo sapiens
aggagaggagagccaga

SEQ ID NO: 3048860 - DNA, 14 bp, Homo sapiens
aggagagtggccat

SEQ ID NO: 3048861 - DNA, 16 bp, Homo sapiens
aggagagtttggggtt

SEQ ID NO: 3048862 - DNA, 22 bp, Homo sapiens
aggagatgctccttgggccctt

SEQ ID NO: 3048863 - DNA, 18 bp, Homo sapiens
aggagcaatcacaggaaa

SEQ ID NO: 3048864 - DNA, 15 bp, Homo sapiens
aggagcacacccagc

SEQ ID NO: 3048865 - DNA, 13 bp, Homo sapiens
aggagcacctgga

SEQ ID NO: 3048866 - DNA, 14 bp, Homo sapiens
aggagcagagaggt

SEQ ID NO: 3048867 - DNA, 11 bp, Homo sapiens
aggagcagggt

SEQ ID NO: 3048868 - DNA, 19 bp, Homo sapiens
aggagccagagaaggtggt

SEQ ID NO: 3048869 - DNA, 21 bp, Homo sapiens
aggagcccagcggcccaagag

SEQ ID NO: 3048870 - DNA, 15 bp, Homo sapiens
aggagcccagtgggc

SEQ ID NO: 3048871 - DNA, 19 bp, Homo sapiens
aggagccccattcctggga

SEQ ID NO: 3048872 - DNA, 23 bp, Homo sapiens
aggagcccttatctgtgctcagg

SEQ ID NO: 3048873 - DNA, 21 bp, Homo sapiens
aggagcctcagaagaaaacaa

SEQ ID NO: 3048874 - DNA, 14 bp, Homo sapiens
aggagcctctgcag

SEQ ID NO: 3048875 - DNA, 19 bp, Homo sapiens
aggagcgctagtgccttgc

SEQ ID NO: 3048876 - DNA, 20 bp, Homo sapiens
aggagcgctagtgccttgcc

SEQ ID NO: 3048877 - DNA, 22 bp, Homo sapiens
aggagcgctagtgccttgccca

SEQ ID NO: 3048878 - DNA, 15 bp, Homo sapiens
aggagcggcgccctg

SEQ ID NO: 3048879 - DNA, 17 bp, Homo sapiens
aggagcggcgccctgga

SEQ ID NO: 3048880 - DNA, 18 bp, Homo sapiens
aggagcggcgccctggac

SEQ ID NO: 3048881 - DNA, 19 bp, Homo sapiens
aggagcggcgccctggact

SEQ ID NO: 3048882 - DNA, 22 bp, Homo sapiens
aggagcggcgccctggacttgg

SEQ ID NO: 3048883 - DNA, 15 bp, Homo sapiens
aggagctaaggctct

SEQ ID NO: 3048884 - DNA, 21 bp, Homo sapiens
aggagctaaggctctatgagt

SEQ ID NO: 3048885 - DNA, 16 bp, Homo sapiens
aggagctgagggaggg

SEQ ID NO: 3048886 - DNA, 20 bp, Homo sapiens
aggagctgagggagggagcc

SEQ ID NO: 3048887 - DNA, 21 bp, Homo sapiens
aggagctgagggagggagcca

SEQ ID NO: 3048888 - DNA, 19 bp, Homo sapiens
aggagctgccttggctcag

SEQ ID NO: 3048889 - DNA, 21 bp, Homo sapiens
aggagctgccttggctcagac

SEQ ID NO: 3048890 - DNA, 20 bp, Homo sapiens
aggagctgctatagcctggg

SEQ ID NO: 3048891 - DNA, 18 bp, Homo sapiens
aggagctgggatcctaag

SEQ ID NO: 3048892 - DNA, 20 bp, Homo sapiens
aggagctggggatccctccc

SEQ ID NO: 3048893 - DNA, 16 bp, Homo sapiens
aggagcttcctgtcct

SEQ ID NO: 3048894 - DNA, 19 bp, Homo sapiens
agctgagaagaggaggagg

SEQ ID NO: 3048895 - DNA, 22 bp, Homo sapiens
agctgagatcgtgccactgcac

SEQ ID NO: 3048896 - DNA, 12 bp, Homo sapiens
agctgagcgcca

SEQ ID NO: 3048897 - DNA, 15 bp, Homo sapiens
agctgaggactctgc

SEQ ID NO: 3048898 - DNA, 15 bp, Homo sapiens
agctgaggcctccct

SEQ ID NO: 3048899 - DNA, 15 bp, Homo sapiens
agctgagggccctgt

SEQ ID NO: 3048900 - DNA, 23 bp, Homo sapiens
agctgagggccctgtggagtcca

SEQ ID NO: 3048901 - DNA, 15 bp, Homo sapiens
agctgaggggacggg

SEQ ID NO: 3048902 - DNA, 19 bp, Homo sapiens
agctgaggggacgggcaag

SEQ ID NO: 3048903 - DNA, 21 bp, Homo sapiens
agctgatgtgagtgtgtgtga

SEQ ID NO: 3048904 - DNA, 14 bp, Homo sapiens
agctgcaaagtgtt

SEQ ID NO: 3048905 - DNA, 21 bp, Homo sapiens
agctgcaagtgacatctcttt

SEQ ID NO: 3048906 - DNA, 15 bp, Homo sapiens
agctgcatctgataa

SEQ ID NO: 3048907 - DNA, 16 bp, Homo sapiens
agctgccaagccccat

SEQ ID NO: 3048908 - DNA, 18 bp, Homo sapiens
agctgccactgggcacct

SEQ ID NO: 3048909 - DNA, 14 bp, Homo sapiens
agctgccccagcca

SEQ ID NO: 3048910 - DNA, 19 bp, Homo sapiens
agctgccccggcccctccc

SEQ ID NO: 3048911 - DNA, 13 bp, Homo sapiens
agctgcccctcct

SEQ ID NO: 3048912 - DNA, 15 bp, Homo sapiens
agctgcccctcctgg

SEQ ID NO: 3048913 - DNA, 21 bp, Homo sapiens
agctgcccctcctggagcaga

SEQ ID NO: 3048914 - DNA, 15 bp, Homo sapiens
agctgcccctctctg

SEQ ID NO: 3048915 - DNA, 17 bp, Homo sapiens
agctgcccctggcacct

SEQ ID NO: 3048916 - DNA, 21 bp, Homo sapiens
agctgcccctggcacctgtgt

SEQ ID NO: 3048917 - DNA, 16 bp, Homo sapiens
agctgcccggcgcctg

SEQ ID NO: 3048918 - DNA, 22 bp, Homo sapiens
agctgcccggcgcctgccctgc

SEQ ID NO: 3048919 - DNA, 15 bp, Homo sapiens
agctgcccttccgca

SEQ ID NO: 3048920 - DNA, 17 bp, Homo sapiens
agctgcctccccaatcc

SEQ ID NO: 3048921 - DNA, 18 bp, Homo sapiens
agctgcctccccaatcca

SEQ ID NO: 3048922 - DNA, 20 bp, Homo sapiens
agctgcctcccctctccttc

SEQ ID NO: 3048923 - DNA, 23 bp, Homo sapiens
agctgcctcccctctccttcctg

SEQ ID NO: 3048924 - DNA, 16 bp, Homo sapiens
agctgcctctgacagc

SEQ ID NO: 3048925 - DNA, 19 bp, Homo sapiens
agctgcctctgacagcagc

SEQ ID NO: 3048926 - DNA, 20 bp, Homo sapiens
agctgcctctgacagcagcc

SEQ ID NO: 3048927 - DNA, 17 bp, Homo sapiens
agctgccttagcttcag

SEQ ID NO: 3048928 - DNA, 20 bp, Homo sapiens
agctgccttagcttcaggaa

SEQ ID NO: 3048929 - DNA, 14 bp, Homo sapiens
agctgccttggctc

SEQ ID NO: 3048930 - DNA, 16 bp, Homo sapiens
agctgccttggctcag

SEQ ID NO: 3048931 - DNA, 17 bp, Homo sapiens
agctgccttggctcaga

SEQ ID NO: 3048932 - DNA, 19 bp, Homo sapiens
agctgccttggctcagaca

SEQ ID NO: 3048933 - DNA, 16 bp, Homo sapiens
agctgcgggctgaggg

SEQ ID NO: 3048934 - DNA, 22 bp, Homo sapiens
agctgcgggctgagggcatctc

SEQ ID NO: 3048935 - DNA, 23 bp, Homo sapiens
agctgcgggctgagggcatctct

SEQ ID NO: 3048936 - DNA, 15 bp, Homo sapiens
agctgcgggctgggt

SEQ ID NO: 3048937 - DNA, 13 bp, Homo sapiens
agctgctacaaag

SEQ ID NO: 3048938 - DNA, 15 bp, Homo sapiens
agctgctacaaagaa

SEQ ID NO: 3048939 - DNA, 18 bp, Homo sapiens
agctgctacaaagaagac

SEQ ID NO: 3048940 - DNA, 21 bp, Homo sapiens
agctgctacaaagaagacatg

SEQ ID NO: 3048941 - DNA, 15 bp, Homo sapiens
agctgctaccttctt

SEQ ID NO: 3048942 - DNA, 20 bp, Homo sapiens
agctgctaggggaaggactg

SEQ ID NO: 3048943 - DNA, 21 bp, Homo sapiens
agctgctaggggaaggactgg

SEQ ID NO: 3048944 - DNA, 17 bp, Homo sapiens
agctgctcagagccaag

SEQ ID NO: 3048945 - DNA, 22 bp, Homo sapiens
agctgctcagagccaagggggc

SEQ ID NO: 3048946 - DNA, 12 bp, Homo sapiens
agctttgcagtg

SEQ ID NO: 3048947 - DNA, 19 bp, Homo sapiens
agctttggacccaaggaaa

SEQ ID NO: 3048948 - DNA, 20 bp, Homo sapiens
agctttggctatgagggcct

SEQ ID NO: 3048949 - DNA, 20 bp, Homo sapiens
agctttgtcccctgcttcag

SEQ ID NO: 3048950 - DNA, 12 bp, Homo sapiens
agcttttcacct

SEQ ID NO: 3048951 - DNA, 22 bp, Homo sapiens
agcttttcacctttactttaga

SEQ ID NO: 3048952 - DNA, 18 bp, Homo sapiens
agcttttcccaggagacc

SEQ ID NO: 3048953 - DNA, 15 bp, Homo sapiens
agcttttcctcaggg

SEQ ID NO: 3048954 - DNA, 15 bp, Homo sapiens
agcttttctttcttt

SEQ ID NO: 3048955 - DNA, 19 bp, Homo sapiens
agcttttgattagtataat

SEQ ID NO: 3048956 - DNA, 16 bp, Homo sapiens
agctttttaatgctgt

SEQ ID NO: 3048957 - DNA, 13 bp, Homo sapiens
agctttttattaa

SEQ ID NO: 3048958 - DNA, 14 bp, Homo sapiens
agctttttattaag

SEQ ID NO: 3048959 - DNA, 21 bp, Homo sapiens
agctttttgatgtataaaact

SEQ ID NO: 3048960 - DNA, 18 bp, Homo sapiens
agcttttttcctcctttc

SEQ ID NO: 3048961 - DNA, 21 bp, Homo sapiens
agcttttttcctcctttctct

SEQ ID NO: 3048962 - DNA, 22 bp, Homo sapiens
agcttttttcctcctttctctg

SEQ ID NO: 3048963 - DNA, 21 bp, Homo sapiens
aggaaaaaaatcgtccaggga

SEQ ID NO: 3048964 - DNA, 22 bp, Homo sapiens
aggaaaaaaatcgtccagggag

SEQ ID NO: 3048965 - DNA, 18 bp, Homo sapiens
aggaaaaaataacaatga

SEQ ID NO: 3048966 - DNA, 13 bp, Homo sapiens
aggaaaaaattat

SEQ ID NO: 3048967 - DNA, 12 bp, Homo sapiens
aggaaaaacaac

SEQ ID NO: 3048968 - DNA, 14 bp, Homo sapiens
aggaaaaataatca

SEQ ID NO: 3048969 - DNA, 13 bp, Homo sapiens
aggaaaactattc

SEQ ID NO: 3048970 - DNA, 11 bp, Homo sapiens
aggaaaactgc

SEQ ID NO: 3048971 - DNA, 13 bp, Homo sapiens
aggaaaagaaaag

SEQ ID NO: 3048972 - DNA, 12 bp, Homo sapiens
aggaaaagcaca

SEQ ID NO: 3048973 - DNA, 22 bp, Homo sapiens
aggaaaataatgtaattgtaat

SEQ ID NO: 3048974 - DNA, 16 bp, Homo sapiens
aggaaaatagtaatgt

SEQ ID NO: 3048975 - DNA, 14 bp, Homo sapiens
aggaaaatcctctg

SEQ ID NO: 3048976 - DNA, 14 bp, Homo sapiens
aggaaacaacagct

SEQ ID NO: 3048977 - DNA, 15 bp, Homo sapiens
aggaaacaacagctt

SEQ ID NO: 3048978 - DNA, 14 bp, Homo sapiens
aggaaacaagtgaa

SEQ ID NO: 3048979 - DNA, 18 bp, Homo sapiens
aggaaaggccagctggca

SEQ ID NO: 3048980 - DNA, 15 bp, Homo sapiens
aggaaagggcctggc

SEQ ID NO: 3048981 - DNA, 18 bp, Homo sapiens
aggaaaggggagaaggga

SEQ ID NO: 3048982 - DNA, 19 bp, Homo sapiens
aggaaatccaaaaaagcaa

SEQ ID NO: 3048983 - DNA, 22 bp, Homo sapiens
aggaaatccccgggaagagtta

SEQ ID NO: 3048984 - DNA, 17 bp, Homo sapiens
aggaaatgagtggccag

SEQ ID NO: 3048985 - DNA, 18 bp, Homo sapiens
aggaaatgagtggccagc

SEQ ID NO: 3048986 - DNA, 17 bp, Homo sapiens
aggaacatttaggggca

SEQ ID NO: 3048987 - DNA, 13 bp, Homo sapiens
aggaaccaaagcg

SEQ ID NO: 3048988 - DNA, 15 bp, Homo sapiens
aggaaccaaagcgaa

SEQ ID NO: 3048989 - DNA, 16 bp, Homo sapiens
aggaaccataatcaat

SEQ ID NO: 3048990 - DNA, 16 bp, Homo sapiens
aggaaccgaggcaggg

SEQ ID NO: 3048991 - DNA, 17 bp, Homo sapiens
aggaacctcgagtactg

SEQ ID NO: 3048992 - DNA, 14 bp, Homo sapiens
aggaacggccctgc

SEQ ID NO: 3048993 - DNA, 16 bp, Homo sapiens
aggaacggtaaatttc

SEQ ID NO: 3048994 - DNA, 16 bp, Homo sapiens
aggaactcgcctcagc

SEQ ID NO: 3048995 - DNA, 22 bp, Homo sapiens
aggaactcttaagcaatggtaa

SEQ ID NO: 3048996 - DNA, 13 bp, Homo sapiens
aggaactgcagca

SEQ ID NO: 3048997 - DNA, 18 bp, Homo sapiens
aggaacttgaaaaatact

SEQ ID NO: 3048998 - DNA, 12 bp, Homo sapiens
aggaagaaaacg

SEQ ID NO: 3048999 - DNA, 20 bp, Homo sapiens
aggaagaaaacggaaatgtg

SEQ ID NO: 3049000 - DNA, 17 bp, Homo sapiens
aggaagaaacagaagag

SEQ ID NO: 3049001 - DNA, 19 bp, Homo sapiens
aggaagaaacagaagagag

SEQ ID NO: 3049002 - DNA, 19 bp, Homo sapiens
aggaagaccaaggcctcgg

SEQ ID NO: 3049003 - DNA, 20 bp, Homo sapiens
aggaagaccaaggcctcggc

SEQ ID NO: 3049004 - DNA, 16 bp, Homo sapiens
aggaagacgagacagg

SEQ ID NO: 3049005 - DNA, 23 bp, Homo sapiens
aggaagagacatgagaaagggag

SEQ ID NO: 3049006 - DNA, 21 bp, Homo sapiens
aggaagatctctgcagggccg

SEQ ID NO: 3049007 - DNA, 15 bp, Homo sapiens
aggaagccaaagagt

SEQ ID NO: 3049008 - DNA, 19 bp, Homo sapiens
aggaagcccaattgctgga

SEQ ID NO: 3049009 - DNA, 18 bp, Homo sapiens
aggaagcccactgcctcc

SEQ ID NO: 3049010 - DNA, 19 bp, Homo sapiens
aggaagcccactgcctcct

SEQ ID NO: 3049011 - DNA, 21 bp, Homo sapiens
aggaagccgtgccctgccccc

SEQ ID NO: 3049012 - DNA, 20 bp, Homo sapiens
aggaagcctcaagttccagt

SEQ ID NO: 3049013 - DNA, 20 bp, Homo sapiens
aggaagctcagactggttga

SEQ ID NO: 3049014 - DNA, 21 bp, Homo sapiens
aggaagctgtgttgaaacaga

SEQ ID NO: 3049015 - DNA, 23 bp, Homo sapiens
aggaagctgtgttgaaacagaaa

SEQ ID NO: 3049016 - DNA, 13 bp, Homo sapiens
aggaaggaaaact

SEQ ID NO: 3049017 - DNA, 13 bp, Homo sapiens
aggaaggaaacaa

SEQ ID NO: 3049018 - DNA, 20 bp, Homo sapiens
aggaaggacagactggccgg

SEQ ID NO: 3049019 - DNA, 14 bp, Homo sapiens
aggaaggagagatg

SEQ ID NO: 3049020 - DNA, 14 bp, Homo sapiens
aggaaggagcggcg

SEQ ID NO: 3049021 - DNA, 15 bp, Homo sapiens
aggaaggcaggaaga

SEQ ID NO: 3049022 - DNA, 14 bp, Homo sapiens
aggaagggagggag

SEQ ID NO: 3049023 - DNA, 21 bp, Homo sapiens
aggaaggtctgatttgcagga

SEQ ID NO: 3049024 - DNA, 15 bp, Homo sapiens
aggaagtaggaagta

SEQ ID NO: 3049025 - DNA, 18 bp, Homo sapiens
aggaagtcacagattctt

SEQ ID NO: 3049026 - DNA, 23 bp, Homo sapiens
aggaagtcagaatttttaactgt

SEQ ID NO: 3049027 - DNA, 20 bp, Homo sapiens
aggaagtcctaagaagtggg

SEQ ID NO: 3049028 - DNA, 17 bp, Homo sapiens
aggaagtctaggagctg

SEQ ID NO: 3049029 - DNA, 19 bp, Homo sapiens
aggaataaataaaaatgga

SEQ ID NO: 3049030 - DNA, 15 bp, Homo sapiens
aggaatataaatatt

SEQ ID NO: 3049031 - DNA, 17 bp, Homo sapiens
aggaatcaaatcttaca

SEQ ID NO: 3049032 - DNA, 15 bp, Homo sapiens
aggaatcactcttgt

SEQ ID NO: 3049033 - DNA, 14 bp, Homo sapiens
aggaatctgccttc

SEQ ID NO: 3049034 - DNA, 15 bp, Homo sapiens
aggaatctgccttcc

SEQ ID NO: 3049035 - DNA, 20 bp, Homo sapiens
aggaatctgccttccagccc

SEQ ID NO: 3049036 - DNA, 22 bp, Homo sapiens
aggaatctgtgggtctgggagt

SEQ ID NO: 3049037 - DNA, 22 bp, Homo sapiens
atacatgaaaatttgtttgaca

SEQ ID NO: 3049038 - DNA, 13 bp, Homo sapiens
atacatttgtatt

SEQ ID NO: 3049039 - DNA, 14 bp, Homo sapiens
ataccaactgaagt

SEQ ID NO: 3049040 - DNA, 14 bp, Homo sapiens
ataccaattatgga

SEQ ID NO: 3049041 - DNA, 15 bp, Homo sapiens
ataccaattatggaa

SEQ ID NO: 3049042 - DNA, 22 bp, Homo sapiens
ataccacttttcattgcaaagt

SEQ ID NO: 3049043 - DNA, 16 bp, Homo sapiens
ataccagcgaggaggc

SEQ ID NO: 3049044 - DNA, 15 bp, Homo sapiens
ataccatatgaatga

SEQ ID NO: 3049045 - DNA, 17 bp, Homo sapiens
ataccatttcctcagct

SEQ ID NO: 3049046 - DNA, 22 bp, Homo sapiens
ataccattttttaaggaaacaa

SEQ ID NO: 3049047 - DNA, 16 bp, Homo sapiens
ataccgcctcgtgcca

SEQ ID NO: 3049048 - DNA, 22 bp, Homo sapiens
ataccgcctcgtgccagcagcc

SEQ ID NO: 3049049 - DNA, 16 bp, Homo sapiens
ataccggaattacttt

SEQ ID NO: 3049050 - DNA, 14 bp, Homo sapiens
atacctaaaacata

SEQ ID NO: 3049051 - DNA, 18 bp, Homo sapiens
atacctacaataaactgg

SEQ ID NO: 3049052 - DNA, 21 bp, Homo sapiens
atacctcctccctaatgctca

SEQ ID NO: 3049053 - DNA, 12 bp, Homo sapiens
atacctctgtgt

SEQ ID NO: 3049054 - DNA, 14 bp, Homo sapiens
atacctctgtgtgc

SEQ ID NO: 3049055 - DNA, 16 bp, Homo sapiens
atacctgtgcctcggc

SEQ ID NO: 3049056 - DNA, 22 bp, Homo sapiens
atacctttcacagcttttatca

SEQ ID NO: 3049057 - DNA, 20 bp, Homo sapiens
atacctttgctactactatg

SEQ ID NO: 3049058 - DNA, 16 bp, Homo sapiens
atacgagagcagaggt

SEQ ID NO: 3049059 - DNA, 17 bp, Homo sapiens
atacgagagcagaggtc

SEQ ID NO: 3049060 - DNA, 15 bp, Homo sapiens
atacgcttttctttg

SEQ ID NO: 3049061 - DNA, 24 bp, Homo sapiens
atacgcttttctttgttataccat

SEQ ID NO: 3049062 - DNA, 19 bp, Homo sapiens
atacgggagtgacccagct

SEQ ID NO: 3049063 - DNA, 18 bp, Homo sapiens
atacgtgttttgaattgc

SEQ ID NO: 3049064 - DNA, 14 bp, Homo sapiens
atactacctagaag

SEQ ID NO: 3049065 - DNA, 15 bp, Homo sapiens
atactaccttgaaaa

SEQ ID NO: 3049066 - DNA, 16 bp, Homo sapiens
atactagggagccatt

SEQ ID NO: 3049067 - DNA, 20 bp, Homo sapiens
atactagggagccatttgag

SEQ ID NO: 3049068 - DNA, 16 bp, Homo sapiens
atactagttgtgacct

SEQ ID NO: 3049069 - DNA, 13 bp, Homo sapiens
atactatgtggga

SEQ ID NO: 3049070 - DNA, 21 bp, Homo sapiens
atactattaaaaaggtttaca

SEQ ID NO: 3049071 - DNA, 14 bp, Homo sapiens
atactcaagcaggt

SEQ ID NO: 3049072 - DNA, 18 bp, Homo sapiens
atactcataatgtgaagt

SEQ ID NO: 3049073 - DNA, 21 bp, Homo sapiens
atactccgtgaggctgctgcc

SEQ ID NO: 3049074 - DNA, 15 bp, Homo sapiens
atactctctgagtac

SEQ ID NO: 3049075 - DNA, 13 bp, Homo sapiens
atactctcttccc

SEQ ID NO: 3049076 - DNA, 15 bp, Homo sapiens
atactctgttgcctc

SEQ ID NO: 3049077 - DNA, 21 bp, Homo sapiens
atactctgttgcctcctctct

SEQ ID NO: 3049078 - DNA, 14 bp, Homo sapiens
atactctttctgta

SEQ ID NO: 3049079 - DNA, 15 bp, Homo sapiens
atactctttctgtat

SEQ ID NO: 3049080 - DNA, 13 bp, Homo sapiens
atactgaatttct

SEQ ID NO: 3049081 - DNA, 16 bp, Homo sapiens
atactgaatttctttg

SEQ ID NO: 3049082 - DNA, 15 bp, Homo sapiens
atactgacaatgtat

SEQ ID NO: 3049083 - DNA, 18 bp, Homo sapiens
atactgacaatgtatttt

SEQ ID NO: 3049084 - DNA, 23 bp, Homo sapiens
atactgagctgctaaaataaacc

SEQ ID NO: 3049085 - DNA, 23 bp, Homo sapiens
atactgccaaaacatttatgaca

SEQ ID NO: 3049086 - DNA, 19 bp, Homo sapiens
atactgccagatgctgatg

SEQ ID NO: 3049087 - DNA, 12 bp, Homo sapiens
atactgctgaga

SEQ ID NO: 3049088 - DNA, 10 bp, Homo sapiens
atactgcttg

SEQ ID NO: 3049089 - DNA, 14 bp, Homo sapiens
atactgcttgctta

SEQ ID NO: 3049090 - DNA, 21 bp, Homo sapiens
atactggtgcagtcattatga

SEQ ID NO: 3049091 - DNA, 15 bp, Homo sapiens
atactgtaaagaaag

SEQ ID NO: 3049092 - DNA, 16 bp, Homo sapiens
atactgtaaagaaaga

SEQ ID NO: 3049093 - DNA, 21 bp, Homo sapiens
atactgtaaagaaagagagaa

SEQ ID NO: 3049094 - DNA, 23 bp, Homo sapiens
atactgtaaagaaagagagaaaa

SEQ ID NO: 3049095 - DNA, 13 bp, Homo sapiens
atactgtacaata

SEQ ID NO: 3049096 - DNA, 20 bp, Homo sapiens
atactgtacaataaaaacat

SEQ ID NO: 3049097 - DNA, 22 bp, Homo sapiens
atactgtagggaaaaaaatgct

SEQ ID NO: 3049098 - DNA, 19 bp, Homo sapiens
atactgtattttgtattgt

SEQ ID NO: 3049099 - DNA, 20 bp, Homo sapiens
atactgtgaagttacatgca

SEQ ID NO: 3049100 - DNA, 23 bp, Homo sapiens
atactgtgaagttacatgcataa

SEQ ID NO: 3049101 - DNA, 20 bp, Homo sapiens
atactgtgagcttacattga

SEQ ID NO: 3049102 - DNA, 13 bp, Homo sapiens
atacttaataaaa

SEQ ID NO: 3049103 - DNA, 12 bp, Homo sapiens
atacttgaactt

SEQ ID NO: 3049104 - DNA, 21 bp, Homo sapiens
atacttgaagggccagagcca

SEQ ID NO: 3049105 - DNA, 23 bp, Homo sapiens
atacttgaagggccagagccagg

SEQ ID NO: 3049106 - DNA, 15 bp, Homo sapiens
atactttatttctga

SEQ ID NO: 3049107 - DNA, 10 bp, Homo sapiens
atactttgga

SEQ ID NO: 3049108 - DNA, 22 bp, Homo sapiens
atactttggatgacttgttcat

SEQ ID NO: 3049109 - DNA, 13 bp, Homo sapiens
atactttgtctga

SEQ ID NO: 3049110 - DNA, 11 bp, Homo sapiens
atactttgttg

SEQ ID NO: 3049111 - DNA, 12 bp, Homo sapiens
atacttttatgc

SEQ ID NO: 3049112 - DNA, 13 bp, Homo sapiens
atacttttcctta

SEQ ID NO: 3049113 - DNA, 21 bp, Homo sapiens
atacttttttttctttaaaaa

SEQ ID NO: 3049114 - DNA, 19 bp, Homo sapiens
atagaaaaatgatgtcttt

SEQ ID NO: 3049115 - DNA, 16 bp, Homo sapiens
atagaaaacaaaggag

SEQ ID NO: 3049116 - DNA, 15 bp, Homo sapiens
atagaaaagcacttg

SEQ ID NO: 3049117 - DNA, 14 bp, Homo sapiens
atagaaaagttatt

SEQ ID NO: 3049118 - DNA, 12 bp, Homo sapiens
atagaaagcatt

SEQ ID NO: 3049119 - DNA, 13 bp, Homo sapiens
atagaaataaatt

SEQ ID NO: 3049120 - DNA, 18 bp, Homo sapiens
atagaaataaattcctaa

SEQ ID NO: 3049121 - DNA, 12 bp, Homo sapiens
atagaaatgcca

SEQ ID NO: 3049122 - DNA, 19 bp, Homo sapiens
atagaaatggtttcctctg

SEQ ID NO: 3049123 - DNA, 16 bp, Homo sapiens
atagaaatgtattttg

SEQ ID NO: 3049124 - DNA, 23 bp, Homo sapiens
atagaacacagagtgtgtttttg

SEQ ID NO: 3049125 - DNA, 15 bp, Homo sapiens
atagaacagaaatat

SEQ ID NO: 3049126 - DNA, 14 bp, Homo sapiens
atagaactgaatga

SEQ ID NO: 3049127 - DNA, 16 bp, Homo sapiens
atagaactgtactgtt

SEQ ID NO: 3049128 - DNA, 16 bp, Homo sapiens
atagaagataatgact

SEQ ID NO: 3049129 - DNA, 19 bp, Homo sapiens
atagaaggatgtacatttc

SEQ ID NO: 3049130 - DNA, 19 bp, Homo sapiens
atagaatgatatcttgtaa

SEQ ID NO: 3049131 - DNA, 16 bp, Homo sapiens
atagaattcacaatgc

SEQ ID NO: 3049132 - DNA, 14 bp, Homo sapiens
atagaattctagct

SEQ ID NO: 3049133 - DNA, 15 bp, Homo sapiens
atagacagctttgac

SEQ ID NO: 3049134 - DNA, 16 bp, Homo sapiens
atagacagctttgact

SEQ ID NO: 3049135 - DNA, 15 bp, Homo sapiens
atagacatttcaaaa

SEQ ID NO: 3049136 - DNA, 21 bp, Homo sapiens
atagaccctctttcttgtttg

SEQ ID NO: 3049137 - DNA, 23 bp, Homo sapiens
atagaccctctttcttgtttgtc

SEQ ID NO: 3049138 - DNA, 15 bp, Homo sapiens
atagacttattcttt

SEQ ID NO: 3049139 - DNA, 14 bp, Homo sapiens
atagagaacaaagt

SEQ ID NO: 3049140 - DNA, 14 bp, Homo sapiens
atagagatatttaa

SEQ ID NO: 3049141 - DNA, 12 bp, Homo sapiens
atagagctgcca

SEQ ID NO: 3049142 - DNA, 12 bp, Homo sapiens
atagagctttta

SEQ ID NO: 3049143 - DNA, 16 bp, Homo sapiens
atagagcttttaaaaa

SEQ ID NO: 3049144 - DNA, 23 bp, Homo sapiens
atagagtgtagtttacagaaaaa

SEQ ID NO: 3049145 - DNA, 15 bp, Homo sapiens
atagagtttgctatt

SEQ ID NO: 3049146 - DNA, 22 bp, Homo sapiens
atagataactgctcttttacta

SEQ ID NO: 3049147 - DNA, 13 bp, Homo sapiens
atagatacttttg

SEQ ID NO: 3049148 - DNA, 18 bp, Homo sapiens
atagataggtcagtgcaa

SEQ ID NO: 3049149 - DNA, 15 bp, Homo sapiens
atagatattggaaga

SEQ ID NO: 3049150 - DNA, 20 bp, Homo sapiens
atagatgctggcccagggcc

SEQ ID NO: 3049151 - DNA, 22 bp, Homo sapiens
atagatggacagtttgtttcct

SEQ ID NO: 3049152 - DNA, 18 bp, Homo sapiens
atagatgtctaggtactt

SEQ ID NO: 3049153 - DNA, 19 bp, Homo sapiens
atagatgttttaacttatt

SEQ ID NO: 3049154 - DNA, 13 bp, Homo sapiens
atagattctaaag

SEQ ID NO: 3049155 - DNA, 14 bp, Homo sapiens
atagattctaaaga

SEQ ID NO: 3049156 - DNA, 15 bp, Homo sapiens
atagattctaaagat

SEQ ID NO: 3049157 - DNA, 14 bp, Homo sapiens
atagcaaagatata

SEQ ID NO: 3049158 - DNA, 15 bp, Homo sapiens
atagcaaagatatat

SEQ ID NO: 3049159 - DNA, 22 bp, Homo sapiens
atagcaagtgaatttttctcta

SEQ ID NO: 3049160 - DNA, 16 bp, Homo sapiens
atagcaagtgctattt

SEQ ID NO: 3049161 - DNA, 21 bp, Homo sapiens
atagcaccctgccctcatggg

SEQ ID NO: 3049162 - DNA, 14 bp, Homo sapiens
atagcagctgctac

SEQ ID NO: 3049163 - DNA, 17 bp, Homo sapiens
atagcatccaagtggca

SEQ ID NO: 3049164 - DNA, 19 bp, Homo sapiens
atagcatctgtacaaaggg

SEQ ID NO: 3049165 - DNA, 19 bp, Homo sapiens
ataaacagtctaaagaaga

SEQ ID NO: 3049166 - DNA, 16 bp, Homo sapiens
ataaacattaattgga

SEQ ID NO: 3049167 - DNA, 13 bp, Homo sapiens
ataaacatttgag

SEQ ID NO: 3049168 - DNA, 13 bp, Homo sapiens
ataaaccaaatat

SEQ ID NO: 3049169 - DNA, 13 bp, Homo sapiens
ataaacctggaga

SEQ ID NO: 3049170 - DNA, 22 bp, Homo sapiens
ataaactaatggtccacaccca

SEQ ID NO: 3049171 - DNA, 13 bp, Homo sapiens
ataaactgagcct

SEQ ID NO: 3049172 - DNA, 14 bp, Homo sapiens
ataaactgagcctc

SEQ ID NO: 3049173 - DNA, 13 bp, Homo sapiens
ataaactgcaaat

SEQ ID NO: 3049174 - DNA, 17 bp, Homo sapiens
ataaacttagaggaaaa

SEQ ID NO: 3049175 - DNA, 20 bp, Homo sapiens
ataaacttgtaggactttta

SEQ ID NO: 3049176 - DNA, 17 bp, Homo sapiens
ataaactttagagtaga

SEQ ID NO: 3049177 - DNA, 23 bp, Homo sapiens
ataaagaagcaataaagaagagt

SEQ ID NO: 3049178 - DNA, 16 bp, Homo sapiens
ataaagaatacttgaa

SEQ ID NO: 3049179 - DNA, 19 bp, Homo sapiens
ataaagaatacttgaactt

SEQ ID NO: 3049180 - DNA, 19 bp, Homo sapiens
ataaagaggcgttgctttc

SEQ ID NO: 3049181 - DNA, 18 bp, Homo sapiens
ataaagatggctgacttt

SEQ ID NO: 3049182 - DNA, 13 bp, Homo sapiens
ataaagatgtgaa

SEQ ID NO: 3049183 - DNA, 16 bp, Homo sapiens
ataaagatgtgaaaac

SEQ ID NO: 3049184 - DNA, 13 bp, Homo sapiens
ataaagccaagaa

SEQ ID NO: 3049185 - DNA, 14 bp, Homo sapiens
ataaagccaagaat

SEQ ID NO: 3049186 - DNA, 21 bp, Homo sapiens
ataaagcctcaaggttttagg

SEQ ID NO: 3049187 - DNA, 22 bp, Homo sapiens
ataaagcctcaaggttttaggt

SEQ ID NO: 3049188 - DNA, 12 bp, Homo sapiens
ataaagctgtta

SEQ ID NO: 3049189 - DNA, 13 bp, Homo sapiens
ataaagctgttat

SEQ ID NO: 3049190 - DNA, 14 bp, Homo sapiens
ataaagctgttatt

SEQ ID NO: 3049191 - DNA, 16 bp, Homo sapiens
ataaagctgttattct

SEQ ID NO: 3049192 - DNA, 14 bp, Homo sapiens
ataaagggaacaaa

SEQ ID NO: 3049193 - DNA, 16 bp, Homo sapiens
ataaagggaacatgca

SEQ ID NO: 3049194 - DNA, 17 bp, Homo sapiens
ataaagggtgccaggtc

SEQ ID NO: 3049195 - DNA, 11 bp, Homo sapiens
ataaagttaaa

SEQ ID NO: 3049196 - DNA, 18 bp, Homo sapiens
ataaagttgagagacagt

SEQ ID NO: 3049197 - DNA, 23 bp, Homo sapiens
ataaagttgagagacagtaacac

SEQ ID NO: 3049198 - DNA, 13 bp, Homo sapiens
ataaagtttctca

SEQ ID NO: 3049199 - DNA, 12 bp, Homo sapiens
ataaagtttgct

SEQ ID NO: 3049200 - DNA, 12 bp, Homo sapiens
ataaagtttgta

SEQ ID NO: 3049201 - DNA, 20 bp, Homo sapiens
ataaagttttatttgaatga

SEQ ID NO: 3049202 - DNA, 15 bp, Homo sapiens
ataaataaaaatgga

SEQ ID NO: 3049203 - DNA, 14 bp, Homo sapiens
ataaataaaagata

SEQ ID NO: 3049204 - DNA, 12 bp, Homo sapiens
ataaataaaagc

SEQ ID NO: 3049205 - DNA, 16 bp, Homo sapiens
ataaataaataatcga

SEQ ID NO: 3049206 - DNA, 18 bp, Homo sapiens
ataaataattgaaacaat

SEQ ID NO: 3049207 - DNA, 16 bp, Homo sapiens
ataaatacaaatctgt

SEQ ID NO: 3049208 - DNA, 17 bp, Homo sapiens
ataaatacaaatctgta

SEQ ID NO: 3049209 - DNA, 20 bp, Homo sapiens
ataaatactgacaatgtatt

SEQ ID NO: 3049210 - DNA, 14 bp, Homo sapiens
ataaatagagcaat

SEQ ID NO: 3049211 - DNA, 21 bp, Homo sapiens
ataaatagatgctgtgtatat

SEQ ID NO: 3049212 - DNA, 22 bp, Homo sapiens
ataaataggtcaatacaaatgt

SEQ ID NO: 3049213 - DNA, 12 bp, Homo sapiens
ataaatatgaag

SEQ ID NO: 3049214 - DNA, 13 bp, Homo sapiens
ataaatctgaagt

SEQ ID NO: 3049215 - DNA, 19 bp, Homo sapiens
ataaatctgacccagtgcc

SEQ ID NO: 3049216 - DNA, 14 bp, Homo sapiens
ataaatcttaaaaa

SEQ ID NO: 3049217 - DNA, 11 bp, Homo sapiens
ataaatgaatg

SEQ ID NO: 3049218 - DNA, 14 bp, Homo sapiens
ataaatgcagccca

SEQ ID NO: 3049219 - DNA, 19 bp, Homo sapiens
ataaatgggaacatttatt

SEQ ID NO: 3049220 - DNA, 15 bp, Homo sapiens
ataaatgtctgttga

SEQ ID NO: 3049221 - DNA, 12 bp, Homo sapiens
ataaatgtcttt

SEQ ID NO: 3049222 - DNA, 23 bp, Homo sapiens
ataaatgttagttctagctctat

SEQ ID NO: 3049223 - DNA, 13 bp, Homo sapiens
ataaatgtttcaa

SEQ ID NO: 3049224 - DNA, 15 bp, Homo sapiens
ataaatgtttccccc

SEQ ID NO: 3049225 - DNA, 21 bp, Homo sapiens
ataaatgtttggaaaggttct

SEQ ID NO: 3049226 - DNA, 16 bp, Homo sapiens
ataaattaagaagagt

SEQ ID NO: 3049227 - DNA, 17 bp, Homo sapiens
ataaattaattgtgcct

SEQ ID NO: 3049228 - DNA, 14 bp, Homo sapiens
ataaattaatttgt

SEQ ID NO: 3049229 - DNA, 21 bp, Homo sapiens
ataaattattagtttacatca

SEQ ID NO: 3049230 - DNA, 16 bp, Homo sapiens
ataaattctactaagt

SEQ ID NO: 3049231 - DNA, 19 bp, Homo sapiens
ataaattgtaattgtaaag

SEQ ID NO: 3049232 - DNA, 13 bp, Homo sapiens
ataaatttaatgt

SEQ ID NO: 3049233 - DNA, 15 bp, Homo sapiens
ataaatttatatgaa

SEQ ID NO: 3049234 - DNA, 22 bp, Homo sapiens
ataaatttgttgtcatgtgtat

SEQ ID NO: 3049235 - DNA, 15 bp, Homo sapiens
ataaattttgtgcaa

SEQ ID NO: 3049236 - DNA, 15 bp, Homo sapiens
ataaattttttgaaa

SEQ ID NO: 3049237 - DNA, 20 bp, Homo sapiens
ataaattttttgaaacacaa

SEQ ID NO: 3049238 - DNA, 15 bp, Homo sapiens
ataacaaagatatct

SEQ ID NO: 3049239 - DNA, 21 bp, Homo sapiens
ataacaactggatgcatcaag

SEQ ID NO: 3049240 - DNA, 14 bp, Homo sapiens
ataacaatgaaagt

SEQ ID NO: 3049241 - DNA, 14 bp, Homo sapiens
ataacaattcctct

SEQ ID NO: 3049242 - DNA, 17 bp, Homo sapiens
ataacagagtagttttg

SEQ ID NO: 3049243 - DNA, 22 bp, Homo sapiens
ataacaggttattttagtttct

SEQ ID NO: 3049244 - DNA, 20 bp, Homo sapiens
ataacatatatggaagagga

SEQ ID NO: 3049245 - DNA, 14 bp, Homo sapiens
ataacatatctaaa

SEQ ID NO: 3049246 - DNA, 17 bp, Homo sapiens
ataacatatctaaagtc

SEQ ID NO: 3049247 - DNA, 13 bp, Homo sapiens
ataacatcactgt

SEQ ID NO: 3049248 - DNA, 14 bp, Homo sapiens
ataacatcactgtc

SEQ ID NO: 3049249 - DNA, 16 bp, Homo sapiens
ataacatgaaatgata

SEQ ID NO: 3049250 - DNA, 15 bp, Homo sapiens
ataacattttgttta

SEQ ID NO: 3049251 - DNA, 15 bp, Homo sapiens
ataaccccttgaaac

SEQ ID NO: 3049252 - DNA, 13 bp, Homo sapiens
ataacccttcaac

SEQ ID NO: 3049253 - DNA, 22 bp, Homo sapiens
ataacgataaaagacagtgaaa

SEQ ID NO: 3049254 - DNA, 15 bp, Homo sapiens
ataactatataagac

SEQ ID NO: 3049255 - DNA, 19 bp, Homo sapiens
ataactatataagacatta

SEQ ID NO: 3049256 - DNA, 21 bp, Homo sapiens
ataactatataagacattaag

SEQ ID NO: 3049257 - DNA, 16 bp, Homo sapiens
ataactatcaggcaga

SEQ ID NO: 3049258 - DNA, 14 bp, Homo sapiens
ataactattcagtt

SEQ ID NO: 3049259 - DNA, 18 bp, Homo sapiens
ataactgaaccaaattgc

SEQ ID NO: 3049260 - DNA, 18 bp, Homo sapiens
ataactgaaggagaaggt

SEQ ID NO: 3049261 - DNA, 16 bp, Homo sapiens
ataactgatctattta

SEQ ID NO: 3049262 - DNA, 21 bp, Homo sapiens
ataactgatctatttattatc

SEQ ID NO: 3049263 - DNA, 19 bp, Homo sapiens
ataactgatctcaagtata

SEQ ID NO: 3049264 - DNA, 23 bp, Homo sapiens
ataactgctcttttactaagaca

SEQ ID NO: 3049265 - DNA, 12 bp, Homo sapiens
ataacttcataa

SEQ ID NO: 3049266 - DNA, 17 bp, Homo sapiens
ataacttctcatgtata

SEQ ID NO: 3049267 - DNA, 18 bp, Homo sapiens
ataacttgctttcttctt

SEQ ID NO: 3049268 - DNA, 20 bp, Homo sapiens
ataacttgctttcttctttc

SEQ ID NO: 3049269 - DNA, 17 bp, Homo sapiens
ataactttatgaagtgc

SEQ ID NO: 3049270 - DNA, 14 bp, Homo sapiens
ataactttgcttgc

SEQ ID NO: 3049271 - DNA, 13 bp, Homo sapiens
ataagaaaaagaa

SEQ ID NO: 3049272 - DNA, 22 bp, Homo sapiens
ataagaaaaccaccccttagat

SEQ ID NO: 3049273 - DNA, 13 bp, Homo sapiens
agttgtctttctt

SEQ ID NO: 3049274 - DNA, 15 bp, Homo sapiens
agttgtctttctttg

SEQ ID NO: 3049275 - DNA, 21 bp, Homo sapiens
agttgtgaccttagtgtttct

SEQ ID NO: 3049276 - DNA, 14 bp, Homo sapiens
agttgtgagccctc

SEQ ID NO: 3049277 - DNA, 21 bp, Homo sapiens
agttgtgagccctctagggca

SEQ ID NO: 3049278 - DNA, 21 bp, Homo sapiens
agttgtgcagcttttggtcat

SEQ ID NO: 3049279 - DNA, 16 bp, Homo sapiens
agttgtggatttcagt

SEQ ID NO: 3049280 - DNA, 15 bp, Homo sapiens
agttgttcaactatt

SEQ ID NO: 3049281 - DNA, 19 bp, Homo sapiens
agttgttgtgggttctatg

SEQ ID NO: 3049282 - DNA, 14 bp, Homo sapiens
agttgtttaactgt

SEQ ID NO: 3049283 - DNA, 19 bp, Homo sapiens
agttgtttaactgtgcatg

SEQ ID NO: 3049284 - DNA, 16 bp, Homo sapiens
agttgttttacagctg

SEQ ID NO: 3049285 - DNA, 19 bp, Homo sapiens
agttgtttttttttgtttt

SEQ ID NO: 3049286 - DNA, 20 bp, Homo sapiens
agtttaaaaatcaacttttt

SEQ ID NO: 3049287 - DNA, 18 bp, Homo sapiens
agtttaaaatcttgcatg

SEQ ID NO: 3049288 - DNA, 18 bp, Homo sapiens
agtttaagacaccaaata

SEQ ID NO: 3049289 - DNA, 16 bp, Homo sapiens
agtttaagatgacact

SEQ ID NO: 3049290 - DNA, 12 bp, Homo sapiens
agtttagggtgg

SEQ ID NO: 3049291 - DNA, 14 bp, Homo sapiens
agtttagggtgggg

SEQ ID NO: 3049292 - DNA, 15 bp, Homo sapiens
agtttataagcccaa

SEQ ID NO: 3049293 - DNA, 23 bp, Homo sapiens
agtttataagcccaaatggctct

SEQ ID NO: 3049294 - DNA, 19 bp, Homo sapiens
agtttatacagtgtacatg

SEQ ID NO: 3049295 - DNA, 20 bp, Homo sapiens
agtttatacagtgtacatgt

SEQ ID NO: 3049296 - DNA, 14 bp, Homo sapiens
agtttatcattcaa

SEQ ID NO: 3049297 - DNA, 17 bp, Homo sapiens
agtttatcattcaagtg

SEQ ID NO: 3049298 - DNA, 15 bp, Homo sapiens
agtttatgaaacaga

SEQ ID NO: 3049299 - DNA, 17 bp, Homo sapiens
agtttatggcagaaggg

SEQ ID NO: 3049300 - DNA, 23 bp, Homo sapiens
agtttatttgttgagagtgtgac

SEQ ID NO: 3049301 - DNA, 20 bp, Homo sapiens
agtttatttttttgatggct

SEQ ID NO: 3049302 - DNA, 21 bp, Homo sapiens
agtttatttttttgatggcta

SEQ ID NO: 3049303 - DNA, 14 bp, Homo sapiens
agtttcaaatctgt

SEQ ID NO: 3049304 - DNA, 16 bp, Homo sapiens
agtttcagctggaaac

SEQ ID NO: 3049305 - DNA, 16 bp, Homo sapiens
agtttcatatattatt

SEQ ID NO: 3049306 - DNA, 18 bp, Homo sapiens
agtttccaattatttgac

SEQ ID NO: 3049307 - DNA, 23 bp, Homo sapiens
agtttccttttctgtctctctct

SEQ ID NO: 3049308 - DNA, 17 bp, Homo sapiens
agtttctaagattctaa

SEQ ID NO: 3049309 - DNA, 23 bp, Homo sapiens
agtttctaaggtccggtgttcta

SEQ ID NO: 3049310 - DNA, 15 bp, Homo sapiens
agtttctattgtaaa

SEQ ID NO: 3049311 - DNA, 20 bp, Homo sapiens
agtttctatttagttattta

SEQ ID NO: 3049312 - DNA, 23 bp, Homo sapiens
agtttctcagatccttgtttcaa

SEQ ID NO: 3049313 - DNA, 20 bp, Homo sapiens
agtttctctcttgttgtcca

SEQ ID NO: 3049314 - DNA, 18 bp, Homo sapiens
agtttctgttctgtggaa

SEQ ID NO: 3049315 - DNA, 15 bp, Homo sapiens
agtttcttctgtaaa

SEQ ID NO: 3049316 - DNA, 12 bp, Homo sapiens
agtttgaaattc

SEQ ID NO: 3049317 - DNA, 14 bp, Homo sapiens
agtttgaaattctg

SEQ ID NO: 3049318 - DNA, 18 bp, Homo sapiens
agtttgaaattctgaatt

SEQ ID NO: 3049319 - DNA, 22 bp, Homo sapiens
agtttgaaattctgaatttgca

SEQ ID NO: 3049320 - DNA, 23 bp, Homo sapiens
agtttgaaattctgaatttgcaa

SEQ ID NO: 3049321 - DNA, 17 bp, Homo sapiens
agtttgaggggcctgtg

SEQ ID NO: 3049322 - DNA, 20 bp, Homo sapiens
agtttgcagaaaagcacctg

SEQ ID NO: 3049323 - DNA, 23 bp, Homo sapiens
agtttgctgttttaaattgcatt

SEQ ID NO: 3049324 - DNA, 11 bp, Homo sapiens
agtttgcttag

SEQ ID NO: 3049325 - DNA, 14 bp, Homo sapiens
agtttgcttagaaa

SEQ ID NO: 3049326 - DNA, 16 bp, Homo sapiens
agtttggcaaactctc

SEQ ID NO: 3049327 - DNA, 12 bp, Homo sapiens
agtttgggcttc

SEQ ID NO: 3049328 - DNA, 15 bp, Homo sapiens
agtttgggcttcagc

SEQ ID NO: 3049329 - DNA, 20 bp, Homo sapiens
agtttggggcaagtcatgta

SEQ ID NO: 3049330 - DNA, 16 bp, Homo sapiens
agtttggttttgacag

SEQ ID NO: 3049331 - DNA, 22 bp, Homo sapiens
agtttgtatgccaagtgagaag

SEQ ID NO: 3049332 - DNA, 13 bp, Homo sapiens
agtttgtccttta

SEQ ID NO: 3049333 - DNA, 16 bp, Homo sapiens
agtttgtgtgttgtct

SEQ ID NO: 3049334 - DNA, 18 bp, Homo sapiens
agtttgtgtgttgtcttg

SEQ ID NO: 3049335 - DNA, 19 bp, Homo sapiens
agtttgtgtgttgtcttga

SEQ ID NO: 3049336 - DNA, 20 bp, Homo sapiens
agtttgtgtgttgtcttgaa

SEQ ID NO: 3049337 - DNA, 20 bp, Homo sapiens
agtttgttatgtgtctggaa

SEQ ID NO: 3049338 - DNA, 14 bp, Homo sapiens
agtttgtttagtta

SEQ ID NO: 3049339 - DNA, 15 bp, Homo sapiens
agttttatttaactt

SEQ ID NO: 3049340 - DNA, 17 bp, Homo sapiens
agttttattttaaatta

SEQ ID NO: 3049341 - DNA, 16 bp, Homo sapiens
agttttcccacttttt

SEQ ID NO: 3049342 - DNA, 22 bp, Homo sapiens
agttttcgtattgcaaataaga

SEQ ID NO: 3049343 - DNA, 15 bp, Homo sapiens
agttttcttgttgct

SEQ ID NO: 3049344 - DNA, 19 bp, Homo sapiens
agttttcttgttgctttgt

SEQ ID NO: 3049345 - DNA, 18 bp, Homo sapiens
agttttgacatcagccag

SEQ ID NO: 3049346 - DNA, 20 bp, Homo sapiens
agttttgatgactggcattt

SEQ ID NO: 3049347 - DNA, 14 bp, Homo sapiens
agttttgtcttgaa

SEQ ID NO: 3049348 - DNA, 12 bp, Homo sapiens
agttttgtttat

SEQ ID NO: 3049349 - DNA, 15 bp, Homo sapiens
agttttgtttatgca

SEQ ID NO: 3049350 - DNA, 22 bp, Homo sapiens
agttttgtttgttcacactcct

SEQ ID NO: 3049351 - DNA, 15 bp, Homo sapiens
agtttttaattttaa

SEQ ID NO: 3049352 - DNA, 14 bp, Homo sapiens
agtttttctttaat

SEQ ID NO: 3049353 - DNA, 23 bp, Homo sapiens
agtttttgaaatacctttgtagt

SEQ ID NO: 3049354 - DNA, 15 bp, Homo sapiens
agttttttgtaccaa

SEQ ID NO: 3049355 - DNA, 15 bp, Homo sapiens
agtttttttatttct

SEQ ID NO: 3049356 - DNA, 16 bp, Homo sapiens
agtttttttatttctt

SEQ ID NO: 3049357 - DNA, 17 bp, Homo sapiens
agtttttttatttcttt

SEQ ID NO: 3049358 - DNA, 19 bp, Homo sapiens
agttttttttttgtttgtt

SEQ ID NO: 3049359 - DNA, 20 bp, Homo sapiens
agttttttttttgtttgttt

SEQ ID NO: 3049360 - DNA, 17 bp, Homo sapiens
ataaaaaacagaaaccg

SEQ ID NO: 3049361 - DNA, 13 bp, Homo sapiens
ataaaaaattatg

SEQ ID NO: 3049362 - DNA, 14 bp, Homo sapiens
ataaaaaattatgg

SEQ ID NO: 3049363 - DNA, 19 bp, Homo sapiens
ataaaaagaaagattttat

SEQ ID NO: 3049364 - DNA, 13 bp, Homo sapiens
ataaaaagcagaa

SEQ ID NO: 3049365 - DNA, 18 bp, Homo sapiens
ataaaaagcagaatttta

SEQ ID NO: 3049366 - DNA, 20 bp, Homo sapiens
ataaaaagcagaattttaat

SEQ ID NO: 3049367 - DNA, 21 bp, Homo sapiens
ataaaaagcttccatgattct

SEQ ID NO: 3049368 - DNA, 13 bp, Homo sapiens
ataaaaaggaagg

SEQ ID NO: 3049369 - DNA, 15 bp, Homo sapiens
agtgtgtcagagccc

SEQ ID NO: 3049370 - DNA, 15 bp, Homo sapiens
agtgtgtccatcata

SEQ ID NO: 3049371 - DNA, 19 bp, Homo sapiens
agtgtgtccatcctgacct

SEQ ID NO: 3049372 - DNA, 20 bp, Homo sapiens
agtgtgtcctgtgtaaatta

SEQ ID NO: 3049373 - DNA, 23 bp, Homo sapiens
agtgtgtgtgatgggatctgtaa

SEQ ID NO: 3049374 - DNA, 16 bp, Homo sapiens
agtgtgtgtgtgtcca

SEQ ID NO: 3049375 - DNA, 20 bp, Homo sapiens
agtgtgtttttgcactgtct

SEQ ID NO: 3049376 - DNA, 19 bp, Homo sapiens
agtgttaatactagttgtg

SEQ ID NO: 3049377 - DNA, 15 bp, Homo sapiens
agtgttaatcaattt

SEQ ID NO: 3049378 - DNA, 20 bp, Homo sapiens
agtgttaatcaatttaaacc

SEQ ID NO: 3049379 - DNA, 22 bp, Homo sapiens
agtgttacaatcagtgtgaatg

SEQ ID NO: 3049380 - DNA, 19 bp, Homo sapiens
agtgttagggaagggcctg

SEQ ID NO: 3049381 - DNA, 14 bp, Homo sapiens
agtgttatgtattt

SEQ ID NO: 3049382 - DNA, 19 bp, Homo sapiens
agtgttcagccaaacagta

SEQ ID NO: 3049383 - DNA, 21 bp, Homo sapiens
agtgttccccttccactgagg

SEQ ID NO: 3049384 - DNA, 21 bp, Homo sapiens
agtgttcctttttaaatgtga

SEQ ID NO: 3049385 - DNA, 23 bp, Homo sapiens
agtgttcctttttaaatgtgaat

SEQ ID NO: 3049386 - DNA, 16 bp, Homo sapiens
agtgttgcatggatgt

SEQ ID NO: 3049387 - DNA, 20 bp, Homo sapiens
agtgttgcctcttgcaatgc

SEQ ID NO: 3049388 - DNA, 17 bp, Homo sapiens
agtgtttctgaatgttt

SEQ ID NO: 3049389 - DNA, 18 bp, Homo sapiens
agtgtttctgaatgtttg

SEQ ID NO: 3049390 - DNA, 19 bp, Homo sapiens
agtgtttctgaatgtttgt

SEQ ID NO: 3049391 - DNA, 14 bp, Homo sapiens
agtgtttctgtgca

SEQ ID NO: 3049392 - DNA, 22 bp, Homo sapiens
agtgtttgatttttattttata

SEQ ID NO: 3049393 - DNA, 15 bp, Homo sapiens
agtgtttgccctttg

SEQ ID NO: 3049394 - DNA, 23 bp, Homo sapiens
agtgttttagtctagttattgga

SEQ ID NO: 3049395 - DNA, 18 bp, Homo sapiens
agtgttttatgagaaagc

SEQ ID NO: 3049396 - DNA, 15 bp, Homo sapiens
agtgttttggactcc

SEQ ID NO: 3049397 - DNA, 22 bp, Homo sapiens
agtgttttggactccatctctc

SEQ ID NO: 3049398 - DNA, 22 bp, Homo sapiens
agtgttttggtggaaaaaacat

SEQ ID NO: 3049399 - DNA, 14 bp, Homo sapiens
agtgttttgtacca

SEQ ID NO: 3049400 - DNA, 16 bp, Homo sapiens
agtgttttgtaccagt

SEQ ID NO: 3049401 - DNA, 17 bp, Homo sapiens
agtgttttttaggaaaa

SEQ ID NO: 3049402 - DNA, 13 bp, Homo sapiens
agttaaaatgttt

SEQ ID NO: 3049403 - DNA, 20 bp, Homo sapiens
agttaaaatgtttactgtaa

SEQ ID NO: 3049404 - DNA, 14 bp, Homo sapiens
agttaaactgatta

SEQ ID NO: 3049405 - DNA, 19 bp, Homo sapiens
agttaaaggcagtccagag

SEQ ID NO: 3049406 - DNA, 21 bp, Homo sapiens
agttaaaggcagtccagagct

SEQ ID NO: 3049407 - DNA, 12 bp, Homo sapiens
agttaaatgtat

SEQ ID NO: 3049408 - DNA, 21 bp, Homo sapiens
agttaaccaatcgcaaagcaa

SEQ ID NO: 3049409 - DNA, 20 bp, Homo sapiens
agttaagacatgatttcctt

SEQ ID NO: 3049410 - DNA, 19 bp, Homo sapiens
agttaagatgtctgagaga

SEQ ID NO: 3049411 - DNA, 20 bp, Homo sapiens
agttaatgcttaagagggaa

SEQ ID NO: 3049412 - DNA, 14 bp, Homo sapiens
agttaattagcatt

SEQ ID NO: 3049413 - DNA, 14 bp, Homo sapiens
agttaatttaaagt

SEQ ID NO: 3049414 - DNA, 15 bp, Homo sapiens
agttacagaaagtgg

SEQ ID NO: 3049415 - DNA, 17 bp, Homo sapiens
agttacatgcatacttc

SEQ ID NO: 3049416 - DNA, 16 bp, Homo sapiens
agttacattaaaataa

SEQ ID NO: 3049417 - DNA, 18 bp, Homo sapiens
agttacattaaaataaac

SEQ ID NO: 3049418 - DNA, 17 bp, Homo sapiens
agttacctcaaggccta

SEQ ID NO: 3049419 - DNA, 16 bp, Homo sapiens
agttactcaagcagtt

SEQ ID NO: 3049420 - DNA, 18 bp, Homo sapiens
agttactcagccctgggc

SEQ ID NO: 3049421 - DNA, 18 bp, Homo sapiens
agttactccctacactga

SEQ ID NO: 3049422 - DNA, 16 bp, Homo sapiens
agttactctgaagggc

SEQ ID NO: 3049423 - DNA, 11 bp, Homo sapiens
agttactgtga

SEQ ID NO: 3049424 - DNA, 13 bp, Homo sapiens
agttactgtgcat

SEQ ID NO: 3049425 - DNA, 21 bp, Homo sapiens
agttacttaagattcagtttt

SEQ ID NO: 3049426 - DNA, 16 bp, Homo sapiens
agttactttcttaatg

SEQ ID NO: 3049427 - DNA, 14 bp, Homo sapiens
agttagaattcctt

SEQ ID NO: 3049428 - DNA, 15 bp, Homo sapiens
agttagaattccttc

SEQ ID NO: 3049429 - DNA, 19 bp, Homo sapiens
agttagaattccttcaggg

SEQ ID NO: 3049430 - DNA, 15 bp, Homo sapiens
agttagaattggaaa

SEQ ID NO: 3049431 - DNA, 15 bp, Homo sapiens
agttagcaaactttg

SEQ ID NO: 3049432 - DNA, 22 bp, Homo sapiens
agttagcaaactttgtatgtca

SEQ ID NO: 3049433 - DNA, 18 bp, Homo sapiens
agttagcatttaccaaca

SEQ ID NO: 3049434 - DNA, 23 bp, Homo sapiens
agttagccatctaatgcttgttt

SEQ ID NO: 3049435 - DNA, 16 bp, Homo sapiens
agttaggatgctcagt

SEQ ID NO: 3049436 - DNA, 18 bp, Homo sapiens
agttagggttttgcaata

SEQ ID NO: 3049437 - DNA, 18 bp, Homo sapiens
agttaggttataagaaac

SEQ ID NO: 3049438 - DNA, 19 bp, Homo sapiens
agttaggttataagaaaca

SEQ ID NO: 3049439 - DNA, 17 bp, Homo sapiens
agttagtctactcttaa

SEQ ID NO: 3049440 - DNA, 22 bp, Homo sapiens
agttagtctactcttaagccat

SEQ ID NO: 3049441 - DNA, 19 bp, Homo sapiens
agttatagatgtctaggta

SEQ ID NO: 3049442 - DNA, 17 bp, Homo sapiens
agttatcctgcaaggga

SEQ ID NO: 3049443 - DNA, 23 bp, Homo sapiens
agttatcctgcaagggacaggaa

SEQ ID NO: 3049444 - DNA, 21 bp, Homo sapiens
agttatctaagaatacagctt

SEQ ID NO: 3049445 - DNA, 22 bp, Homo sapiens
agttatctaagttaatttaaag

SEQ ID NO: 3049446 - DNA, 22 bp, Homo sapiens
agttattaatttttaaggatgt

SEQ ID NO: 3049447 - DNA, 15 bp, Homo sapiens
agttattcaaatgaa

SEQ ID NO: 3049448 - DNA, 19 bp, Homo sapiens
agttattgagattgtcctc

SEQ ID NO: 3049449 - DNA, 13 bp, Homo sapiens
agttattgcagtt

SEQ ID NO: 3049450 - DNA, 19 bp, Homo sapiens
agttattgcagtttatcat

SEQ ID NO: 3049451 - DNA, 22 bp, Homo sapiens
agttattgttaattatgtacaa

SEQ ID NO: 3049452 - DNA, 19 bp, Homo sapiens
agttatttacttgaaagat

SEQ ID NO: 3049453 - DNA, 20 bp, Homo sapiens
agttatttacttgaaagatg

SEQ ID NO: 3049454 - DNA, 13 bp, Homo sapiens
agttattttatga

SEQ ID NO: 3049455 - DNA, 23 bp, Homo sapiens
agttattttgcacccactgaaag

SEQ ID NO: 3049456 - DNA, 17 bp, Homo sapiens
agttcaagaccagcctg

SEQ ID NO: 3049457 - DNA, 16 bp, Homo sapiens
agttcactgctgcatg

SEQ ID NO: 3049458 - DNA, 18 bp, Homo sapiens
agttcagaaatttggcat

SEQ ID NO: 3049459 - DNA, 20 bp, Homo sapiens
agttcagagtccttaaaatg

SEQ ID NO: 3049460 - DNA, 15 bp, Homo sapiens
agttcagagttttct

SEQ ID NO: 3049461 - DNA, 14 bp, Homo sapiens
agttcagcttgggg

SEQ ID NO: 3049462 - DNA, 23 bp, Homo sapiens
agttcagtgtatggcgttggttt

SEQ ID NO: 3049463 - DNA, 15 bp, Homo sapiens
agttcataaatttgt

SEQ ID NO: 3049464 - DNA, 21 bp, Homo sapiens
agttccaacaaagaaaggtgc

SEQ ID NO: 3049465 - DNA, 20 bp, Homo sapiens
agttccaagagtctaaagat

SEQ ID NO: 3049466 - DNA, 16 bp, Homo sapiens
agttccagcttttgta

SEQ ID NO: 3049467 - DNA, 18 bp, Homo sapiens
agttccagttttgttttg

SEQ ID NO: 3049468 - DNA, 19 bp, Homo sapiens
agttccatcaggtcccccc

SEQ ID NO: 3049469 - DNA, 21 bp, Homo sapiens
agttccctgaaaacccagaga

SEQ ID NO: 3049470 - DNA, 12 bp, Homo sapiens
agttcctcgccc

SEQ ID NO: 3049471 - DNA, 15 bp, Homo sapiens
agttcctcgccctgg

SEQ ID NO: 3049472 - DNA, 19 bp, Homo sapiens
agttcctctcccttccctt

SEQ ID NO: 3049473 - DNA, 20 bp, Homo sapiens
agttcctctcccttcccttc

SEQ ID NO: 3049474 - DNA, 13 bp, Homo sapiens
agttcctgctccg

SEQ ID NO: 3049475 - DNA, 15 bp, Homo sapiens
agttcctgctccgtg

SEQ ID NO: 3049476 - DNA, 18 bp, Homo sapiens
agttcctgctgcctgggt

SEQ ID NO: 3049477 - DNA, 20 bp, Homo sapiens
agttccttcagcttccattt

SEQ ID NO: 3049478 - DNA, 19 bp, Homo sapiens
agttccttctctttaaatc

SEQ ID NO: 3049479 - DNA, 17 bp, Homo sapiens
agttcgcctggagccct

SEQ ID NO: 3049480 - DNA, 13 bp, Homo sapiens
agttctaaaaaga

SEQ ID NO: 3049481 - DNA, 23 bp, Homo sapiens
agttctaagactcaaatgttcta

SEQ ID NO: 3049482 - DNA, 16 bp, Homo sapiens
agttctaagattctaa

SEQ ID NO: 3049483 - DNA, 17 bp, Homo sapiens
agttctaagattctaat

SEQ ID NO: 3049484 - DNA, 18 bp, Homo sapiens
agttctaagattctaatg

SEQ ID NO: 3049485 - DNA, 15 bp, Homo sapiens
agttctaagattctg

SEQ ID NO: 3049486 - DNA, 16 bp, Homo sapiens
agttctcaaatgtgtg

SEQ ID NO: 3049487 - DNA, 19 bp, Homo sapiens
agttctcaaatgtgtgtgg

SEQ ID NO: 3049488 - DNA, 15 bp, Homo sapiens
agttctcaatgtaga

SEQ ID NO: 3049489 - DNA, 18 bp, Homo sapiens
agttctcactatgtttct

SEQ ID NO: 3049490 - DNA, 20 bp, Homo sapiens
agttctcactatgtttctca

SEQ ID NO: 3049491 - DNA, 18 bp, Homo sapiens
agttctccttttgaactt

SEQ ID NO: 3049492 - DNA, 17 bp, Homo sapiens
agttctcttatctttga

SEQ ID NO: 3049493 - DNA, 17 bp, Homo sapiens
agttctgagctgccagt

SEQ ID NO: 3049494 - DNA, 19 bp, Homo sapiens
agttctgccttatctaaat

SEQ ID NO: 3049495 - DNA, 11 bp, Homo sapiens
agttctgtata

SEQ ID NO: 3049496 - DNA, 13 bp, Homo sapiens
agttcttaataca

SEQ ID NO: 3049497 - DNA, 23 bp, Homo sapiens
agttcttagattcaggggaaggg

SEQ ID NO: 3049498 - DNA, 23 bp, Homo sapiens
agttcttggtccctccagaacca

SEQ ID NO: 3049499 - DNA, 15 bp, Homo sapiens
agttctttgcaagct

SEQ ID NO: 3049500 - DNA, 16 bp, Homo sapiens
agttctttgggccaga

SEQ ID NO: 3049501 - DNA, 12 bp, Homo sapiens
agttcttttcta

SEQ ID NO: 3049502 - DNA, 16 bp, Homo sapiens
agttcttttttgtaca

SEQ ID NO: 3049503 - DNA, 19 bp, Homo sapiens
agttcttttttgtacagta

SEQ ID NO: 3049504 - DNA, 20 bp, Homo sapiens
agttcttttttgtacagtat

SEQ ID NO: 3049505 - DNA, 17 bp, Homo sapiens
agtgcccaactgttata

SEQ ID NO: 3049506 - DNA, 12 bp, Homo sapiens
agtgccccagac

SEQ ID NO: 3049507 - DNA, 14 bp, Homo sapiens
agtgccccagactg

SEQ ID NO: 3049508 - DNA, 16 bp, Homo sapiens
agtgccccagactgag

SEQ ID NO: 3049509 - DNA, 22 bp, Homo sapiens
agtgccccagactgagctctcc

SEQ ID NO: 3049510 - DNA, 14 bp, Homo sapiens
agtgccgaggacat

SEQ ID NO: 3049511 - DNA, 16 bp, Homo sapiens
agtgccttacctcctg

SEQ ID NO: 3049512 - DNA, 19 bp, Homo sapiens
agtgccttacctcctgccc

SEQ ID NO: 3049513 - DNA, 13 bp, Homo sapiens
agtgccttctctc

SEQ ID NO: 3049514 - DNA, 20 bp, Homo sapiens
agtgccttttgcagaagagg

SEQ ID NO: 3049515 - DNA, 14 bp, Homo sapiens
agtgcctttttcct

SEQ ID NO: 3049516 - DNA, 14 bp, Homo sapiens
agtgcgagtatgtg

SEQ ID NO: 3049517 - DNA, 15 bp, Homo sapiens
agtgcgagtatgtgt

SEQ ID NO: 3049518 - DNA, 16 bp, Homo sapiens
agtgctaaaaatggga

SEQ ID NO: 3049519 - DNA, 17 bp, Homo sapiens
agtgctaaggttctaag

SEQ ID NO: 3049520 - DNA, 21 bp, Homo sapiens
agtgctaaggttctaaggcct

SEQ ID NO: 3049521 - DNA, 18 bp, Homo sapiens
agtgctacagaaagcaca

SEQ ID NO: 3049522 - DNA, 18 bp, Homo sapiens
agtgctcaagcagcaaaa

SEQ ID NO: 3049523 - DNA, 14 bp, Homo sapiens
agtgctcccctctg

SEQ ID NO: 3049524 - DNA, 14 bp, Homo sapiens
agtgctccctcaca

SEQ ID NO: 3049525 - DNA, 17 bp, Homo sapiens
agtgctctgaccctggg

SEQ ID NO: 3049526 - DNA, 22 bp, Homo sapiens
agtgctctgaccctgggctttc

SEQ ID NO: 3049527 - DNA, 11 bp, Homo sapiens
agtgctctgat

SEQ ID NO: 3049528 - DNA, 16 bp, Homo sapiens
agtgctctgatccctc

SEQ ID NO: 3049529 - DNA, 17 bp, Homo sapiens
agtgctctgatccctct

SEQ ID NO: 3049530 - DNA, 17 bp, Homo sapiens
agtgctggcccacccag

SEQ ID NO: 3049531 - DNA, 20 bp, Homo sapiens
agtgctgggattacaggtgt

SEQ ID NO: 3049532 - DNA, 19 bp, Homo sapiens
agtgctgtgctgtgtttaa

SEQ ID NO: 3049533 - DNA, 16 bp, Homo sapiens
agtgctgtttagattt

SEQ ID NO: 3049534 - DNA, 16 bp, Homo sapiens
agtgctgtttgggcag

SEQ ID NO: 3049535 - DNA, 20 bp, Homo sapiens
agtgctgtttgggcaggagt

SEQ ID NO: 3049536 - DNA, 19 bp, Homo sapiens
agtgcttcaagggtaatct

SEQ ID NO: 3049537 - DNA, 16 bp, Homo sapiens
agtgcttcttgtaata

SEQ ID NO: 3049538 - DNA, 18 bp, Homo sapiens
agtgcttcttgtaatatt

SEQ ID NO: 3049539 - DNA, 19 bp, Homo sapiens
agtgctttaagaatgaaca

SEQ ID NO: 3049540 - DNA, 22 bp, Homo sapiens
agtgctttccttttttaaaaat

SEQ ID NO: 3049541 - DNA, 18 bp, Homo sapiens
agtggaaaggatcacaga

SEQ ID NO: 3049542 - DNA, 15 bp, Homo sapiens
agtggacagtctgct

SEQ ID NO: 3049543 - DNA, 15 bp, Homo sapiens
agtggaccaggacag

SEQ ID NO: 3049544 - DNA, 19 bp, Homo sapiens
agtggaccaggacaggacc

SEQ ID NO: 3049545 - DNA, 16 bp, Homo sapiens
agtggaccgccctttt

SEQ ID NO: 3049546 - DNA, 22 bp, Homo sapiens
agtggaccgcccttttccccta

SEQ ID NO: 3049547 - DNA, 17 bp, Homo sapiens
agtggaccttaggcctt

SEQ ID NO: 3049548 - DNA, 21 bp, Homo sapiens
agtggactgttccctgaggtg

SEQ ID NO: 3049549 - DNA, 13 bp, Homo sapiens
agtggacttgttt

SEQ ID NO: 3049550 - DNA, 18 bp, Homo sapiens
agtggagtttccaacaga

SEQ ID NO: 3049551 - DNA, 12 bp, Homo sapiens
agtggatgggaa

SEQ ID NO: 3049552 - DNA, 17 bp, Homo sapiens
agtggatgggaatttgt

SEQ ID NO: 3049553 - DNA, 18 bp, Homo sapiens
agtggatgggaatttgtc

SEQ ID NO: 3049554 - DNA, 17 bp, Homo sapiens
agtggcagtttttaaaa

SEQ ID NO: 3049555 - DNA, 23 bp, Homo sapiens
agtggcatgtgggttgtgatatt

SEQ ID NO: 3049556 - DNA, 14 bp, Homo sapiens
agtggccacggccc

SEQ ID NO: 3049557 - DNA, 16 bp, Homo sapiens
agtggccacggcccag

SEQ ID NO: 3049558 - DNA, 18 bp, Homo sapiens
agtggccacggcccaggg

SEQ ID NO: 3049559 - DNA, 21 bp, Homo sapiens
agtggccacgttcagggaggg

SEQ ID NO: 3049560 - DNA, 22 bp, Homo sapiens
agtggccactaagcagaggagg

SEQ ID NO: 3049561 - DNA, 14 bp, Homo sapiens
agtggccagcgcca

SEQ ID NO: 3049562 - DNA, 16 bp, Homo sapiens
agtggccagcgccagg

SEQ ID NO: 3049563 - DNA, 18 bp, Homo sapiens
agtggctgacaagggact

SEQ ID NO: 3049564 - DNA, 22 bp, Homo sapiens
agtggctgccccttgctggacc

SEQ ID NO: 3049565 - DNA, 23 bp, Homo sapiens
agtctccctcacagcacagagaa

SEQ ID NO: 3049566 - DNA, 19 bp, Homo sapiens
agtctccctccgactccag

SEQ ID NO: 3049567 - DNA, 21 bp, Homo sapiens
agtctccctccgactccagat

SEQ ID NO: 3049568 - DNA, 16 bp, Homo sapiens
agtctccgcctcctga

SEQ ID NO: 3049569 - DNA, 13 bp, Homo sapiens
agtctccttctct

SEQ ID NO: 3049570 - DNA, 15 bp, Homo sapiens
agtctctatcattaa

SEQ ID NO: 3049571 - DNA, 18 bp, Homo sapiens
agtctctatcattaaagt

SEQ ID NO: 3049572 - DNA, 19 bp, Homo sapiens
agtctctatcattaaagtt

SEQ ID NO: 3049573 - DNA, 18 bp, Homo sapiens
agtctctccagcctcaca

SEQ ID NO: 3049574 - DNA, 19 bp, Homo sapiens
agtctctccagcctcacag

SEQ ID NO: 3049575 - DNA, 12 bp, Homo sapiens
agtctctgaaca

SEQ ID NO: 3049576 - DNA, 17 bp, Homo sapiens
agtctctgccttgcctt

SEQ ID NO: 3049577 - DNA, 13 bp, Homo sapiens
agtctctgctcca

SEQ ID NO: 3049578 - DNA, 21 bp, Homo sapiens
agtctctggctcagctgtggt

SEQ ID NO: 3049579 - DNA, 16 bp, Homo sapiens
agtctctttattccta

SEQ ID NO: 3049580 - DNA, 23 bp, Homo sapiens
agtctctttattcctagttggtg

SEQ ID NO: 3049581 - DNA, 20 bp, Homo sapiens
agtctgaacctatttcttaa

SEQ ID NO: 3049582 - DNA, 20 bp, Homo sapiens
agtctgatcgtgacgctgaa

SEQ ID NO: 3049583 - DNA, 19 bp, Homo sapiens
agtctgatggtgagcagta

SEQ ID NO: 3049584 - DNA, 12 bp, Homo sapiens
agtctgccaact

SEQ ID NO: 3049585 - DNA, 19 bp, Homo sapiens
agtctgcctatcctggcca

SEQ ID NO: 3049586 - DNA, 13 bp, Homo sapiens
agtctgctttctc

SEQ ID NO: 3049587 - DNA, 15 bp, Homo sapiens
agtctggatctggga

SEQ ID NO: 3049588 - DNA, 17 bp, Homo sapiens
agtctggcaaacatgtg

SEQ ID NO: 3049589 - DNA, 20 bp, Homo sapiens
agtctggcaaacatgtgcaa

SEQ ID NO: 3049590 - DNA, 13 bp, Homo sapiens
agtctggccattt

SEQ ID NO: 3049591 - DNA, 12 bp, Homo sapiens
agtctgggtcag

SEQ ID NO: 3049592 - DNA, 13 bp, Homo sapiens
agtctgggtcaga

SEQ ID NO: 3049593 - DNA, 16 bp, Homo sapiens
agtctggtggaggagc

SEQ ID NO: 3049594 - DNA, 17 bp, Homo sapiens
agtctggtggaggagct

SEQ ID NO: 3049595 - DNA, 15 bp, Homo sapiens
agtctgtcttctgta

SEQ ID NO: 3049596 - DNA, 16 bp, Homo sapiens
agtctgtcttctgtat

SEQ ID NO: 3049597 - DNA, 14 bp, Homo sapiens
agtctgtggaactt

SEQ ID NO: 3049598 - DNA, 21 bp, Homo sapiens
agtctgttcactgcattcacc

SEQ ID NO: 3049599 - DNA, 17 bp, Homo sapiens
agtctgttgctgctcca

SEQ ID NO: 3049600 - DNA, 17 bp, Homo sapiens
agtctgtttactgcaag

SEQ ID NO: 3049601 - DNA, 23 bp, Homo sapiens
agtcttaacaaaccaacatcttt

SEQ ID NO: 3049602 - DNA, 22 bp, Homo sapiens
agtcttaatgttgaatgctgct

SEQ ID NO: 3049603 - DNA, 23 bp, Homo sapiens
agtcttcaatttgttaacagagc

SEQ ID NO: 3049604 - DNA, 15 bp, Homo sapiens
agtcttccatttgca

SEQ ID NO: 3049605 - DNA, 17 bp, Homo sapiens
agtcttgacgagtgtga

SEQ ID NO: 3049606 - DNA, 16 bp, Homo sapiens
agtcttgcattcatgg

SEQ ID NO: 3049607 - DNA, 15 bp, Homo sapiens
agtcttgcattgaat

SEQ ID NO: 3049608 - DNA, 14 bp, Homo sapiens
agtctttaatattt

SEQ ID NO: 3049609 - DNA, 21 bp, Homo sapiens
agtctttaggtctttgtaaga

SEQ ID NO: 3049610 - DNA, 12 bp, Homo sapiens
agtctttccccc

SEQ ID NO: 3049611 - DNA, 19 bp, Homo sapiens
agtctttcccccaggaaaa

SEQ ID NO: 3049612 - DNA, 22 bp, Homo sapiens
agtctttgccagtcattcagca

SEQ ID NO: 3049613 - DNA, 15 bp, Homo sapiens
agtctttggttctaa

SEQ ID NO: 3049614 - DNA, 17 bp, Homo sapiens
agtctttggttctaagg

SEQ ID NO: 3049615 - DNA, 16 bp, Homo sapiens
agtcttttctctgaaa

SEQ ID NO: 3049616 - DNA, 17 bp, Homo sapiens
agtgaaacacttgcttg

SEQ ID NO: 3049617 - DNA, 21 bp, Homo sapiens
agtgaaagacatttcaaatct

SEQ ID NO: 3049618 - DNA, 18 bp, Homo sapiens
agtgaaatattgtaaatg

SEQ ID NO: 3049619 - DNA, 17 bp, Homo sapiens
agtgaaccgtcctttca

SEQ ID NO: 3049620 - DNA, 22 bp, Homo sapiens
agtgaacctcaccccgaggccc

SEQ ID NO: 3049621 - DNA, 15 bp, Homo sapiens
agtgaagcatggcat

SEQ ID NO: 3049622 - DNA, 21 bp, Homo sapiens
agtgaagtcatgacctccagg

SEQ ID NO: 3049623 - DNA, 15 bp, Homo sapiens
agtgaatatgcctgt

SEQ ID NO: 3049624 - DNA, 16 bp, Homo sapiens
agtgaatctaaggata

SEQ ID NO: 3049625 - DNA, 21 bp, Homo sapiens
agtgaatctaaggataatgaa

SEQ ID NO: 3049626 - DNA, 14 bp, Homo sapiens
agtgaatttttgca

SEQ ID NO: 3049627 - DNA, 23 bp, Homo sapiens
agtgaatttttgcaataatgcag

SEQ ID NO: 3049628 - DNA, 21 bp, Homo sapiens
agtgacacccaagagggctgc

SEQ ID NO: 3049629 - DNA, 13 bp, Homo sapiens
agtgacagagcga

SEQ ID NO: 3049630 - DNA, 21 bp, Homo sapiens
agtgacagagcgagactccat

SEQ ID NO: 3049631 - DNA, 19 bp, Homo sapiens
agtgacagggaagctacag

SEQ ID NO: 3049632 - DNA, 17 bp, Homo sapiens
agtgacatttaatgcca

SEQ ID NO: 3049633 - DNA, 13 bp, Homo sapiens
agtgacccagcta

SEQ ID NO: 3049634 - DNA, 14 bp, Homo sapiens
agtcacagattctt

SEQ ID NO: 3049635 - DNA, 13 bp, Homo sapiens
agtcacagccacc

SEQ ID NO: 3049636 - DNA, 14 bp, Homo sapiens
agtcacatctcttc

SEQ ID NO: 3049637 - DNA, 16 bp, Homo sapiens
agtcacatctcttcct

SEQ ID NO: 3049638 - DNA, 13 bp, Homo sapiens
agtcaccaggaat

SEQ ID NO: 3049639 - DNA, 15 bp, Homo sapiens
agtcaccatgcaagg

SEQ ID NO: 3049640 - DNA, 23 bp, Homo sapiens
agtcaccctagccctctccctct

SEQ ID NO: 3049641 - DNA, 19 bp, Homo sapiens
agtcacctaaccctctgtc

SEQ ID NO: 3049642 - DNA, 20 bp, Homo sapiens
agtcacctaaccctctgtca

SEQ ID NO: 3049643 - DNA, 12 bp, Homo sapiens
agtcactgagca

SEQ ID NO: 3049644 - DNA, 18 bp, Homo sapiens
agtcactggcagcctgca

SEQ ID NO: 3049645 - DNA, 23 bp, Homo sapiens
agtcactgtgagctcccaggtgc

SEQ ID NO: 3049646 - DNA, 17 bp, Homo sapiens
agtcactttttttttcc

SEQ ID NO: 3049647 - DNA, 12 bp, Homo sapiens
agtcagaacagc

SEQ ID NO: 3049648 - DNA, 14 bp, Homo sapiens
agtcagaacagcag

SEQ ID NO: 3049649 - DNA, 22 bp, Homo sapiens
agtcagaacagcagactcagct

SEQ ID NO: 3049650 - DNA, 14 bp, Homo sapiens
agtcagaagttctg

SEQ ID NO: 3049651 - DNA, 18 bp, Homo sapiens
agtcagaagttctgggtg

SEQ ID NO: 3049652 - DNA, 19 bp, Homo sapiens
agtcagaatttttaactgt

SEQ ID NO: 3049653 - DNA, 12 bp, Homo sapiens
agtcagagaaaa

SEQ ID NO: 3049654 - DNA, 16 bp, Homo sapiens
agtcagagaaaacact

SEQ ID NO: 3049655 - DNA, 17 bp, Homo sapiens
agtcagagaaaacactt

SEQ ID NO: 3049656 - DNA, 19 bp, Homo sapiens
agtcagagaaaacactttc

SEQ ID NO: 3049657 - DNA, 17 bp, Homo sapiens
agtcagagagagtgttt

SEQ ID NO: 3049658 - DNA, 16 bp, Homo sapiens
agtcagagtgtccctt

SEQ ID NO: 3049659 - DNA, 22 bp, Homo sapiens
agtcagcaccttggcccaggag

SEQ ID NO: 3049660 - DNA, 20 bp, Homo sapiens
agtcagccatgtctgtgctg

SEQ ID NO: 3049661 - DNA, 16 bp, Homo sapiens
agtcagctgaccccct

SEQ ID NO: 3049662 - DNA, 17 bp, Homo sapiens
agtcagctgaccccctc

SEQ ID NO: 3049663 - DNA, 18 bp, Homo sapiens
agtcagctgaccccctcc

SEQ ID NO: 3049664 - DNA, 21 bp, Homo sapiens
agtcagctgaccccctccccc

SEQ ID NO: 3049665 - DNA, 16 bp, Homo sapiens
agtcagggacccctgc

SEQ ID NO: 3049666 - DNA, 14 bp, Homo sapiens
agtcagttaacgtc

SEQ ID NO: 3049667 - DNA, 23 bp, Homo sapiens
agtcatacctgctcctcatctgc

SEQ ID NO: 3049668 - DNA, 23 bp, Homo sapiens
agtcatcaacaatgattaatcag

SEQ ID NO: 3049669 - DNA, 15 bp, Homo sapiens
agtcatcatctcttg

SEQ ID NO: 3049670 - DNA, 18 bp, Homo sapiens
agtcatcatgaactggct

SEQ ID NO: 3049671 - DNA, 19 bp, Homo sapiens
agtcatcatgaactggctt

SEQ ID NO: 3049672 - DNA, 14 bp, Homo sapiens
agtcatctatagtt

SEQ ID NO: 3049673 - DNA, 13 bp, Homo sapiens
agtcatggacatt

SEQ ID NO: 3049674 - DNA, 22 bp, Homo sapiens
agtcatgggaacgcagcctcca

SEQ ID NO: 3049675 - DNA, 15 bp, Homo sapiens
agtcatgtaaatact

SEQ ID NO: 3049676 - DNA, 23 bp, Homo sapiens
agtcatgtactggagagtggcaa

SEQ ID NO: 3049677 - DNA, 13 bp, Homo sapiens
agtcatgtgcctc

SEQ ID NO: 3049678 - DNA, 20 bp, Homo sapiens
agtcatgtgcctctgtcctt

SEQ ID NO: 3049679 - DNA, 20 bp, Homo sapiens
agtcattatccttgctatga

SEQ ID NO: 3049680 - DNA, 22 bp, Homo sapiens
agtcattatgagaggcaatgat

SEQ ID NO: 3049681 - DNA, 13 bp, Homo sapiens
agtcattcagcag

SEQ ID NO: 3049682 - DNA, 22 bp, Homo sapiens
agtcattcagcagcaaattttc

SEQ ID NO: 3049683 - DNA, 23 bp, Homo sapiens
agtcattcagcagcaaattttca

SEQ ID NO: 3049684 - DNA, 16 bp, Homo sapiens
agtcattgctgtagga

SEQ ID NO: 3049685 - DNA, 17 bp, Homo sapiens
agtcatttaactgaaga

SEQ ID NO: 3049686 - DNA, 16 bp, Homo sapiens
agtccaagaccagact

SEQ ID NO: 3049687 - DNA, 14 bp, Homo sapiens
agtccaagctggga

SEQ ID NO: 3049688 - DNA, 16 bp, Homo sapiens
agtccaagctgggaga

SEQ ID NO: 3049689 - DNA, 16 bp, Homo sapiens
agtccaaggtttaaag

SEQ ID NO: 3049690 - DNA, 21 bp, Homo sapiens
agtccaattttaatttagtaa

SEQ ID NO: 3049691 - DNA, 17 bp, Homo sapiens
agtccacagctgaagag

SEQ ID NO: 3049692 - DNA, 12 bp, Homo sapiens
agtccagagctt

SEQ ID NO: 3049693 - DNA, 16 bp, Homo sapiens
agtccagcagtttcca

SEQ ID NO: 3049694 - DNA, 12 bp, Homo sapiens
agtccagctcta

SEQ ID NO: 3049695 - DNA, 23 bp, Homo sapiens
agtccaggactgggtctgacctg

SEQ ID NO: 3049696 - DNA, 15 bp, Homo sapiens
agtccatcagatgtt

SEQ ID NO: 3049697 - DNA, 13 bp, Homo sapiens
agtccatcagcct

SEQ ID NO: 3049698 - DNA, 16 bp, Homo sapiens
agtccatcagcctcca

SEQ ID NO: 3049699 - DNA, 13 bp, Homo sapiens
agtccatgctcca

SEQ ID NO: 3049700 - DNA, 20 bp, Homo sapiens
agtccatttcccacatcttt

SEQ ID NO: 3049701 - DNA, 21 bp, Homo sapiens
agtccatttcccacatctttc

SEQ ID NO: 3049702 - DNA, 19 bp, Homo sapiens
agtccatttcctaatgtat

SEQ ID NO: 3049703 - DNA, 17 bp, Homo sapiens
agtcccagacaaggaga

SEQ ID NO: 3049704 - DNA, 18 bp, Homo sapiens
agtcccaggggcagccac

SEQ ID NO: 3049705 - DNA, 19 bp, Homo sapiens
agtcccaggggcagccaca

SEQ ID NO: 3049706 - DNA, 21 bp, Homo sapiens
agtcccaggggcagccacacc

SEQ ID NO: 3049707 - DNA, 23 bp, Homo sapiens
agtcccaggggcagccacaccac

SEQ ID NO: 3049708 - DNA, 18 bp, Homo sapiens
agtccccaacctgcactc

SEQ ID NO: 3049709 - DNA, 12 bp, Homo sapiens
agtccccagact

SEQ ID NO: 3049710 - DNA, 19 bp, Homo sapiens
agtccccagactctgccta

SEQ ID NO: 3049711 - DNA, 17 bp, Homo sapiens
agtccccaggccccagg

SEQ ID NO: 3049712 - DNA, 15 bp, Homo sapiens
attgacagctttgct

SEQ ID NO: 3049713 - DNA, 17 bp, Homo sapiens
attgaccgcgactaatt

SEQ ID NO: 3049714 - DNA, 14 bp, Homo sapiens
attgacgaactggc

SEQ ID NO: 3049715 - DNA, 21 bp, Homo sapiens
attgacttcttggtgctgttg

SEQ ID NO: 3049716 - DNA, 13 bp, Homo sapiens
attgactttgtct

SEQ ID NO: 3049717 - DNA, 14 bp, Homo sapiens
attgagaactgcat

SEQ ID NO: 3049718 - DNA, 14 bp, Homo sapiens
attgagagttttgt

SEQ ID NO: 3049719 - DNA, 19 bp, Homo sapiens
attgaggataaaaaggaag

SEQ ID NO: 3049720 - DNA, 22 bp, Homo sapiens
attgaggataaaaaggaaggag

SEQ ID NO: 3049721 - DNA, 17 bp, Homo sapiens
attgagtaatgggattt

SEQ ID NO: 3049722 - DNA, 16 bp, Homo sapiens
attgataagatggttt

SEQ ID NO: 3049723 - DNA, 15 bp, Homo sapiens
attgatcattcataa

SEQ ID NO: 3049724 - DNA, 16 bp, Homo sapiens
attgatggggaaggag

SEQ ID NO: 3049725 - DNA, 17 bp, Homo sapiens
attgattaaaatctctt

SEQ ID NO: 3049726 - DNA, 18 bp, Homo sapiens
attgattaaaatctcttg

SEQ ID NO: 3049727 - DNA, 12 bp, Homo sapiens
attgattagaaa

SEQ ID NO: 3049728 - DNA, 18 bp, Homo sapiens
attgattatttgttttac

SEQ ID NO: 3049729 - DNA, 17 bp, Homo sapiens
attgattcatgttcatc

SEQ ID NO: 3049730 - DNA, 16 bp, Homo sapiens
attgattgtcagccac

SEQ ID NO: 3049731 - DNA, 12 bp, Homo sapiens
attgatttcttt

SEQ ID NO: 3049732 - DNA, 15 bp, Homo sapiens
attgatttgcattga

SEQ ID NO: 3049733 - DNA, 23 bp, Homo sapiens
attgcaaaggttccaactgtata

SEQ ID NO: 3049734 - DNA, 12 bp, Homo sapiens
attgcaaatctt

SEQ ID NO: 3049735 - DNA, 16 bp, Homo sapiens
attgcaaatcttgaaa

SEQ ID NO: 3049736 - DNA, 16 bp, Homo sapiens
attgcaatatctgaag

SEQ ID NO: 3049737 - DNA, 20 bp, Homo sapiens
attgcactgaagtttttgaa

SEQ ID NO: 3049738 - DNA, 21 bp, Homo sapiens
attgcactgaagtttttgaaa

SEQ ID NO: 3049739 - DNA, 22 bp, Homo sapiens
attgcagatttctgccttgaaa

SEQ ID NO: 3049740 - DNA, 20 bp, Homo sapiens
attgcaggagacattttcat

SEQ ID NO: 3049741 - DNA, 15 bp, Homo sapiens
attgcagtgcggctc

SEQ ID NO: 3049742 - DNA, 21 bp, Homo sapiens
attgcagtgcggctcacatca

SEQ ID NO: 3049743 - DNA, 14 bp, Homo sapiens
attgcagtttatat

SEQ ID NO: 3049744 - DNA, 14 bp, Homo sapiens
attgcagtttatca

SEQ ID NO: 3049745 - DNA, 18 bp, Homo sapiens
attgcagtttatcattca

SEQ ID NO: 3049746 - DNA, 23 bp, Homo sapiens
attgcagtttatcattcaagtgt

SEQ ID NO: 3049747 - DNA, 15 bp, Homo sapiens
attgcatctcccaga

SEQ ID NO: 3049748 - DNA, 19 bp, Homo sapiens
attgcatgagaagccatac

SEQ ID NO: 3049749 - DNA, 15 bp, Homo sapiens
attgcatgtgactct

SEQ ID NO: 3049750 - DNA, 23 bp, Homo sapiens
attgcattaaatataatatgcac

SEQ ID NO: 3049751 - DNA, 17 bp, Homo sapiens
attgcattcattgactt

SEQ ID NO: 3049752 - DNA, 19 bp, Homo sapiens
attgcatttattgcagttt

SEQ ID NO: 3049753 - DNA, 17 bp, Homo sapiens
attgccaatcttgtttt

SEQ ID NO: 3049754 - DNA, 23 bp, Homo sapiens
attgccatcgggtgccaaataaa

SEQ ID NO: 3049755 - DNA, 18 bp, Homo sapiens
attgccgaagtccagctt

SEQ ID NO: 3049756 - DNA, 23 bp, Homo sapiens
attgccgaagtccagctttctgc

SEQ ID NO: 3049757 - DNA, 18 bp, Homo sapiens
attgcctgactaaaatgt

SEQ ID NO: 3049758 - DNA, 18 bp, Homo sapiens
attgcctgggcagtgccc

SEQ ID NO: 3049759 - DNA, 15 bp, Homo sapiens
attgccttctcacca

SEQ ID NO: 3049760 - DNA, 22 bp, Homo sapiens
attgcctttgaatgttaatttt

SEQ ID NO: 3049761 - DNA, 17 bp, Homo sapiens
attgccttttaattttt

SEQ ID NO: 3049762 - DNA, 14 bp, Homo sapiens
attgctaacgtttt

SEQ ID NO: 3049763 - DNA, 20 bp, Homo sapiens
attgctaacgttttttcttc

SEQ ID NO: 3049764 - DNA, 14 bp, Homo sapiens
attgctaattgctg

SEQ ID NO: 3049765 - DNA, 20 bp, Homo sapiens
attgctaattgctgttgaaa

SEQ ID NO: 3049766 - DNA, 20 bp, Homo sapiens
attgctccattttcttgtca

SEQ ID NO: 3049767 - DNA, 23 bp, Homo sapiens
attgctgcaaggacattcttgta

SEQ ID NO: 3049768 - DNA, 18 bp, Homo sapiens
attgctggaaaccaagtc

SEQ ID NO: 3049769 - DNA, 17 bp, Homo sapiens
attgctgtctagcctta

SEQ ID NO: 3049770 - DNA, 17 bp, Homo sapiens
attgctgtgtgtcccag

SEQ ID NO: 3049771 - DNA, 18 bp, Homo sapiens
attgctgtgtgtcccagg

SEQ ID NO: 3049772 - DNA, 19 bp, Homo sapiens
attgctgtgtgtcccaggc

SEQ ID NO: 3049773 - DNA, 19 bp, Homo sapiens
attgctgttgaaagcaaaa

SEQ ID NO: 3049774 - DNA, 22 bp, Homo sapiens
attgctgttgaaagcaaaaatg

SEQ ID NO: 3049775 - DNA, 17 bp, Homo sapiens
attgcttcaattaaaat

SEQ ID NO: 3049776 - DNA, 16 bp, Homo sapiens
attgcttgagctcagg

SEQ ID NO: 3049777 - DNA, 16 bp, Homo sapiens
attgcttgagcttggg

SEQ ID NO: 3049778 - DNA, 11 bp, Homo sapiens
attgctttctg

SEQ ID NO: 3049779 - DNA, 13 bp, Homo sapiens
attgctttctgaa

SEQ ID NO: 3049780 - DNA, 15 bp, Homo sapiens
attggaaagacagga

SEQ ID NO: 3049781 - DNA, 15 bp, Homo sapiens
attggaaagtgattt

SEQ ID NO: 3049782 - DNA, 15 bp, Homo sapiens
attggaacagtgaat

SEQ ID NO: 3049783 - DNA, 14 bp, Homo sapiens
attggaacttttct

SEQ ID NO: 3049784 - DNA, 20 bp, Homo sapiens
attggaaggagacacagatg

SEQ ID NO: 3049785 - DNA, 21 bp, Homo sapiens
attggaaggagacacagatgt

SEQ ID NO: 3049786 - DNA, 22 bp, Homo sapiens
attggaaggagacacagatgtt

SEQ ID NO: 3049787 - DNA, 23 bp, Homo sapiens
attggatacagcagtagacattt

SEQ ID NO: 3049788 - DNA, 19 bp, Homo sapiens
attggattctgagagctgt

SEQ ID NO: 3049789 - DNA, 18 bp, Homo sapiens
attggatttgtccaaaca

SEQ ID NO: 3049790 - DNA, 19 bp, Homo sapiens
attggatttgtccaaacag

SEQ ID NO: 3049791 - DNA, 11 bp, Homo sapiens
attggcacagt

SEQ ID NO: 3049792 - DNA, 18 bp, Homo sapiens
attggcattctttgcaat

SEQ ID NO: 3049793 - DNA, 23 bp, Homo sapiens
attggcattctttgcaatactgc

SEQ ID NO: 3049794 - DNA, 18 bp, Homo sapiens
attggcctgaacagatgt

SEQ ID NO: 3049795 - DNA, 17 bp, Homo sapiens
attggctatataaaatg

SEQ ID NO: 3049796 - DNA, 20 bp, Homo sapiens
attgggaaggggacccccgc

SEQ ID NO: 3049797 - DNA, 15 bp, Homo sapiens
attgggaataaatat

SEQ ID NO: 3049798 - DNA, 20 bp, Homo sapiens
attgggaataaatatgcctc

SEQ ID NO: 3049799 - DNA, 19 bp, Homo sapiens
attgggacgtagagcacag

SEQ ID NO: 3049800 - DNA, 21 bp, Homo sapiens
attgggcagaatcctgggccc

SEQ ID NO: 3049801 - DNA, 15 bp, Homo sapiens
attgggcccctgcca

SEQ ID NO: 3049802 - DNA, 21 bp, Homo sapiens
attgggtctattccagctcat

SEQ ID NO: 3049803 - DNA, 20 bp, Homo sapiens
attgggtggggggcttcata

SEQ ID NO: 3049804 - DNA, 21 bp, Homo sapiens
attgggtggggggcttcatac

SEQ ID NO: 3049805 - DNA, 22 bp, Homo sapiens
attgggtggggggcttcataca

SEQ ID NO: 3049806 - DNA, 23 bp, Homo sapiens
attcccagagacaggaaaatcct

SEQ ID NO: 3049807 - DNA, 20 bp, Homo sapiens
attcccaggccagggctggg

SEQ ID NO: 3049808 - DNA, 20 bp, Homo sapiens
attccccatatttgtgttca

SEQ ID NO: 3049809 - DNA, 16 bp, Homo sapiens
attccccctgccctgt

SEQ ID NO: 3049810 - DNA, 23 bp, Homo sapiens
attcccggagggaaactgtgaat

SEQ ID NO: 3049811 - DNA, 18 bp, Homo sapiens
attcccgggcccttcagt

SEQ ID NO: 3049812 - DNA, 20 bp, Homo sapiens
attccctagaaacttccaaa

SEQ ID NO: 3049813 - DNA, 16 bp, Homo sapiens
attccctctcatctca

SEQ ID NO: 3049814 - DNA, 23 bp, Homo sapiens
attccgtagccagctgctcccca

SEQ ID NO: 3049815 - DNA, 18 bp, Homo sapiens
attccgttgtctgtggat

SEQ ID NO: 3049816 - DNA, 17 bp, Homo sapiens
attcctaaagaaaaata

SEQ ID NO: 3049817 - DNA, 14 bp, Homo sapiens
attcctacaactta

SEQ ID NO: 3049818 - DNA, 16 bp, Homo sapiens
attcctagttggtgag

SEQ ID NO: 3049819 - DNA, 20 bp, Homo sapiens
attcctctactaacaatcag

SEQ ID NO: 3049820 - DNA, 17 bp, Homo sapiens
attcctctttgctttgc

SEQ ID NO: 3049821 - DNA, 24 bp, Homo sapiens
attcctgaactataacacctgcca

SEQ ID NO: 3049822 - DNA, 19 bp, Homo sapiens
attcctgaagaaccagtcc

SEQ ID NO: 3049823 - DNA, 23 bp, Homo sapiens
attcctgatatgatttaaaacat

SEQ ID NO: 3049824 - DNA, 17 bp, Homo sapiens
attcctgggaaatattc

SEQ ID NO: 3049825 - DNA, 15 bp, Homo sapiens
attcctgtaaatgtg

SEQ ID NO: 3049826 - DNA, 23 bp, Homo sapiens
attcctgtaacttttaatcccta

SEQ ID NO: 3049827 - DNA, 17 bp, Homo sapiens
attcctgtatgttgtcc

SEQ ID NO: 3049828 - DNA, 22 bp, Homo sapiens
attccttctatagctagagctt

SEQ ID NO: 3049829 - DNA, 22 bp, Homo sapiens
attcctttaaagtgagtactgt

SEQ ID NO: 3049830 - DNA, 14 bp, Homo sapiens
attccttttctgta

SEQ ID NO: 3049831 - DNA, 17 bp, Homo sapiens
attcgagacagaacctt

SEQ ID NO: 3049832 - DNA, 14 bp, Homo sapiens
attcgctgtcccct

SEQ ID NO: 3049833 - DNA, 21 bp, Homo sapiens
attcggtgtgcaccagggttg

SEQ ID NO: 3049834 - DNA, 20 bp, Homo sapiens
attctaaaatgtgatgttct

SEQ ID NO: 3049835 - DNA, 15 bp, Homo sapiens
attctaaacagatgt

SEQ ID NO: 3049836 - DNA, 15 bp, Homo sapiens
attctaaagattcta

SEQ ID NO: 3049837 - DNA, 18 bp, Homo sapiens
attctaaagattctatag

SEQ ID NO: 3049838 - DNA, 14 bp, Homo sapiens
attctaaaggtcca

SEQ ID NO: 3049839 - DNA, 23 bp, Homo sapiens
attctaatgatgatcaattatag

SEQ ID NO: 3049840 - DNA, 13 bp, Homo sapiens
attctacacctgg

SEQ ID NO: 3049841 - DNA, 17 bp, Homo sapiens
attctacacctggacca

SEQ ID NO: 3049842 - DNA, 14 bp, Homo sapiens
attctactaagtta

SEQ ID NO: 3049843 - DNA, 22 bp, Homo sapiens
attctagatcagatgctccaag

SEQ ID NO: 3049844 - DNA, 20 bp, Homo sapiens
attctagatgcaagtctctt

SEQ ID NO: 3049845 - DNA, 17 bp, Homo sapiens
attctagcctgcacttt

SEQ ID NO: 3049846 - DNA, 21 bp, Homo sapiens
attctagctgtatgatttgtt

SEQ ID NO: 3049847 - DNA, 19 bp, Homo sapiens
attctagcttttttcctcc

SEQ ID NO: 3049848 - DNA, 17 bp, Homo sapiens
attctagggtttcttaa

SEQ ID NO: 3049849 - DNA, 20 bp, Homo sapiens
attctagggtttcttaaata

SEQ ID NO: 3049850 - DNA, 23 bp, Homo sapiens
attctagggtttcttaaatatat

SEQ ID NO: 3049851 - DNA, 20 bp, Homo sapiens
attctagtacataattgatt

SEQ ID NO: 3049852 - DNA, 16 bp, Homo sapiens
attctagttttgtcaa

SEQ ID NO: 3049853 - DNA, 15 bp, Homo sapiens
attctatactgttga

SEQ ID NO: 3049854 - DNA, 14 bp, Homo sapiens
attctatagttcta

SEQ ID NO: 3049855 - DNA, 20 bp, Homo sapiens
attctatttatatgtacatg

SEQ ID NO: 3049856 - DNA, 14 bp, Homo sapiens
attctcaaagtttt

SEQ ID NO: 3049857 - DNA, 15 bp, Homo sapiens
attctcactccacca

SEQ ID NO: 3049858 - DNA, 13 bp, Homo sapiens
attctcaggcacc

SEQ ID NO: 3049859 - DNA, 19 bp, Homo sapiens
attctcatgggaaggggag

SEQ ID NO: 3049860 - DNA, 13 bp, Homo sapiens
attctccacagca

SEQ ID NO: 3049861 - DNA, 23 bp, Homo sapiens
attctccagccatcaagagactg

SEQ ID NO: 3049862 - DNA, 12 bp, Homo sapiens
attctcctgcct

SEQ ID NO: 3049863 - DNA, 13 bp, Homo sapiens
attctcctgcctc

SEQ ID NO: 3049864 - DNA, 18 bp, Homo sapiens
attctcctgcctcagcct

SEQ ID NO: 3049865 - DNA, 15 bp, Homo sapiens
attctcctggatgct

SEQ ID NO: 3049866 - DNA, 17 bp, Homo sapiens
attctctaataagaaaa

SEQ ID NO: 3049867 - DNA, 19 bp, Homo sapiens
attctctcctaatgatgac

SEQ ID NO: 3049868 - DNA, 22 bp, Homo sapiens
attctctcctaatgatgacttg

SEQ ID NO: 3049869 - DNA, 23 bp, Homo sapiens
attctctcctaatgatgacttga

SEQ ID NO: 3049870 - DNA, 10 bp, Homo sapiens
attctctctc

SEQ ID NO: 3049871 - DNA, 15 bp, Homo sapiens
attctctctcctgtc

SEQ ID NO: 3049872 - DNA, 22 bp, Homo sapiens
attctctcttcctgcagtgttt

SEQ ID NO: 3049873 - DNA, 17 bp, Homo sapiens
attctctgagctgtgca

SEQ ID NO: 3049874 - DNA, 14 bp, Homo sapiens
attctctgcccagc

SEQ ID NO: 3049875 - DNA, 19 bp, Homo sapiens
attctctggctgtaaggct

SEQ ID NO: 3049876 - DNA, 20 bp, Homo sapiens
attctctggctgtaaggctc

SEQ ID NO: 3049877 - DNA, 21 bp, Homo sapiens
attctctggctgtaaggctct

SEQ ID NO: 3049878 - DNA, 10 bp, Homo sapiens
attctctgtg

SEQ ID NO: 3049879 - DNA, 11 bp, Homo sapiens
attctctgtgg

SEQ ID NO: 3049880 - DNA, 18 bp, Homo sapiens
attctctgtgtctaagat

SEQ ID NO: 3049881 - DNA, 22 bp, Homo sapiens
attctctgtgtctaagattcta

SEQ ID NO: 3049882 - DNA, 14 bp, Homo sapiens
attctctgtttgct

SEQ ID NO: 3049883 - DNA, 22 bp, Homo sapiens
attctcttgtataagatcctag

SEQ ID NO: 3049884 - DNA, 23 bp, Homo sapiens
attctcttgttctttggcaacaa

SEQ ID NO: 3049885 - DNA, 18 bp, Homo sapiens
attctctttggtcattga

SEQ ID NO: 3049886 - DNA, 21 bp, Homo sapiens
attctgaaaccacagtttcat

SEQ ID NO: 3049887 - DNA, 22 bp, Homo sapiens
attctgaaaccacagtttcatt

SEQ ID NO: 3049888 - DNA, 16 bp, Homo sapiens
attctgaaggagcccc

SEQ ID NO: 3049889 - DNA, 14 bp, Homo sapiens
attctgaagtatga

SEQ ID NO: 3049890 - DNA, 19 bp, Homo sapiens
attctgaagtatgaagtct

SEQ ID NO: 3049891 - DNA, 13 bp, Homo sapiens
attctgaatattt

SEQ ID NO: 3049892 - DNA, 14 bp, Homo sapiens
attctgaatttgca

SEQ ID NO: 3049893 - DNA, 16 bp, Homo sapiens
attctgaatttgcaaa

SEQ ID NO: 3049894 - DNA, 15 bp, Homo sapiens
attctgagaaaacaa

SEQ ID NO: 3049895 - DNA, 16 bp, Homo sapiens
attctgataatgctca

SEQ ID NO: 3049896 - DNA, 22 bp, Homo sapiens
attctgattcgaatgacactgt

SEQ ID NO: 3049897 - DNA, 23 bp, Homo sapiens
attctgcagtaaatcttttacaa

SEQ ID NO: 3049898 - DNA, 23 bp, Homo sapiens
attctgccaggcccccaagcctg

SEQ ID NO: 3049899 - DNA, 12 bp, Homo sapiens
attctgctgtta

SEQ ID NO: 3049900 - DNA, 22 bp, Homo sapiens
attctggacagtcagctcttca

SEQ ID NO: 3049901 - DNA, 14 bp, Homo sapiens
attctggccagact

SEQ ID NO: 3049902 - DNA, 15 bp, Homo sapiens
attctgtacattttt

SEQ ID NO: 3049903 - DNA, 14 bp, Homo sapiens
attctgtactctta

SEQ ID NO: 3049904 - DNA, 15 bp, Homo sapiens
attctgtcatttaca

SEQ ID NO: 3049905 - DNA, 14 bp, Homo sapiens
attctgttgtgttc

SEQ ID NO: 3049906 - DNA, 18 bp, Homo sapiens
attctgttttaggttaaa

SEQ ID NO: 3049907 - DNA, 17 bp, Homo sapiens
attcttaacaaactctt

SEQ ID NO: 3049908 - DNA, 15 bp, Homo sapiens
attcttataaatatg

SEQ ID NO: 3049909 - DNA, 15 bp, Homo sapiens
attcttatttttaat

SEQ ID NO: 3049910 - DNA, 20 bp, Homo sapiens
attatgtggcttttatttca

SEQ ID NO: 3049911 - DNA, 16 bp, Homo sapiens
attatgtttttattaa

SEQ ID NO: 3049912 - DNA, 14 bp, Homo sapiens
attattaatgaaaa

SEQ ID NO: 3049913 - DNA, 12 bp, Homo sapiens
attattaatttt

SEQ ID NO: 3049914 - DNA, 15 bp, Homo sapiens
attattactgttgat

SEQ ID NO: 3049915 - DNA, 21 bp, Homo sapiens
attattactgttgataattct

SEQ ID NO: 3049916 - DNA, 15 bp, Homo sapiens
attattagtactgct

SEQ ID NO: 3049917 - DNA, 20 bp, Homo sapiens
attattatcttcttaacagt

SEQ ID NO: 3049918 - DNA, 12 bp, Homo sapiens
attattattatt

SEQ ID NO: 3049919 - DNA, 10 bp, Homo sapiens
attattattt

SEQ ID NO: 3049920 - DNA, 18 bp, Homo sapiens
attattatttaactctta

SEQ ID NO: 3049921 - DNA, 15 bp, Homo sapiens
attattatttgtact

SEQ ID NO: 3049922 - DNA, 13 bp, Homo sapiens
attattcagtgtc

SEQ ID NO: 3049923 - DNA, 13 bp, Homo sapiens
attattgtatatt

SEQ ID NO: 3049924 - DNA, 13 bp, Homo sapiens
attattgttaata

SEQ ID NO: 3049925 - DNA, 14 bp, Homo sapiens
attatttaaagaaa

SEQ ID NO: 3049926 - DNA, 13 bp, Homo sapiens
attatttaaagca

SEQ ID NO: 3049927 - DNA, 15 bp, Homo sapiens
attatttaaagcaca

SEQ ID NO: 3049928 - DNA, 14 bp, Homo sapiens
attatttaaatgct

SEQ ID NO: 3049929 - DNA, 15 bp, Homo sapiens
attatttaaatgctt

SEQ ID NO: 3049930 - DNA, 16 bp, Homo sapiens
attatttaaatgcttt

SEQ ID NO: 3049931 - DNA, 14 bp, Homo sapiens
attatttaaatgta

SEQ ID NO: 3049932 - DNA, 15 bp, Homo sapiens
attatttaaatgtac

SEQ ID NO: 3049933 - DNA, 22 bp, Homo sapiens
attatttaaatgtacttatatt

SEQ ID NO: 3049934 - DNA, 13 bp, Homo sapiens
attatttaactct

SEQ ID NO: 3049935 - DNA, 21 bp, Homo sapiens
attatttaactcttaactgaa

SEQ ID NO: 3049936 - DNA, 15 bp, Homo sapiens
attatttatttattt

SEQ ID NO: 3049937 - DNA, 18 bp, Homo sapiens
attatttcacaaataata

SEQ ID NO: 3049938 - DNA, 20 bp, Homo sapiens
attatttctaggaagaattt

SEQ ID NO: 3049939 - DNA, 14 bp, Homo sapiens
attatttgaaaaca

SEQ ID NO: 3049940 - DNA, 22 bp, Homo sapiens
attatttgagtttgacatttaa

SEQ ID NO: 3049941 - DNA, 13 bp, Homo sapiens
attattttaaaat

SEQ ID NO: 3049942 - DNA, 18 bp, Homo sapiens
attattttaaaatattta

SEQ ID NO: 3049943 - DNA, 13 bp, Homo sapiens
attattttccaaa

SEQ ID NO: 3049944 - DNA, 20 bp, Homo sapiens
attattttccttccatgctc

SEQ ID NO: 3049945 - DNA, 12 bp, Homo sapiens
attattttgatg

SEQ ID NO: 3049946 - DNA, 13 bp, Homo sapiens
attatttttctcc

SEQ ID NO: 3049947 - DNA, 16 bp, Homo sapiens
attattttttgttgaa

SEQ ID NO: 3049948 - DNA, 22 bp, Homo sapiens
attcaaaaaactctctcccagg

SEQ ID NO: 3049949 - DNA, 22 bp, Homo sapiens
attcaaaaagacagcagacaaa

SEQ ID NO: 3049950 - DNA, 23 bp, Homo sapiens
attcaaaaagacagcagacaaaa

SEQ ID NO: 3049951 - DNA, 14 bp, Homo sapiens
attcaaaagttcca

SEQ ID NO: 3049952 - DNA, 17 bp, Homo sapiens
attcaaaagttccaaga

SEQ ID NO: 3049953 - DNA, 16 bp, Homo sapiens
attcaaaagttgaaat

SEQ ID NO: 3049954 - DNA, 14 bp, Homo sapiens
attcaaaatattta

SEQ ID NO: 3049955 - DNA, 22 bp, Homo sapiens
attcaaaatatttaaaaatgtc

SEQ ID NO: 3049956 - DNA, 18 bp, Homo sapiens
attcaaactacctatatt

SEQ ID NO: 3049957 - DNA, 17 bp, Homo sapiens
attcaaactggggcctc

SEQ ID NO: 3049958 - DNA, 19 bp, Homo sapiens
attcaaactggggcctcca

SEQ ID NO: 3049959 - DNA, 22 bp, Homo sapiens
attcaaactggggcctccagaa

SEQ ID NO: 3049960 - DNA, 16 bp, Homo sapiens
attcaaaggtatccaa

SEQ ID NO: 3049961 - DNA, 13 bp, Homo sapiens
attcaaaggttct

SEQ ID NO: 3049962 - DNA, 18 bp, Homo sapiens
attcaaaggttctaggtt

SEQ ID NO: 3049963 - DNA, 12 bp, Homo sapiens
attcaacacact

SEQ ID NO: 3049964 - DNA, 17 bp, Homo sapiens
attcaacacactgcctt

SEQ ID NO: 3049965 - DNA, 17 bp, Homo sapiens
attcaaccccagaaatt

SEQ ID NO: 3049966 - DNA, 23 bp, Homo sapiens
attcaactaaaaaaaaaaaagta

SEQ ID NO: 3049967 - DNA, 20 bp, Homo sapiens
attcaaggagaatatgataa

SEQ ID NO: 3049968 - DNA, 13 bp, Homo sapiens
attcaaggctcag

SEQ ID NO: 3049969 - DNA, 18 bp, Homo sapiens
attcaaggctcagaagga

SEQ ID NO: 3049970 - DNA, 19 bp, Homo sapiens
attcaaggctcagaaggaa

SEQ ID NO: 3049971 - DNA, 20 bp, Homo sapiens
attcaagtgtaaaatatttt

SEQ ID NO: 3049972 - DNA, 21 bp, Homo sapiens
attcaagtgtaaaatattttg

SEQ ID NO: 3049973 - DNA, 14 bp, Homo sapiens
attcacagcctttc

SEQ ID NO: 3049974 - DNA, 23 bp, Homo sapiens
attcacagttctttgggccagac

SEQ ID NO: 3049975 - DNA, 16 bp, Homo sapiens
attcacatctcatttt

SEQ ID NO: 3049976 - DNA, 20 bp, Homo sapiens
attcaccaatgttgtacaga

SEQ ID NO: 3049977 - DNA, 23 bp, Homo sapiens
attcacctaagagattctgattt

SEQ ID NO: 3049978 - DNA, 19 bp, Homo sapiens
attcacctgccccaactct

SEQ ID NO: 3049979 - DNA, 21 bp, Homo sapiens
attcactctgagtgttttatg

SEQ ID NO: 3049980 - DNA, 18 bp, Homo sapiens
attcacttagcagaacct

SEQ ID NO: 3049981 - DNA, 14 bp, Homo sapiens
attcacttctgcat

SEQ ID NO: 3049982 - DNA, 22 bp, Homo sapiens
attcacttctgcattcctgtaa

SEQ ID NO: 3049983 - DNA, 18 bp, Homo sapiens
attcagaatcaaaccttt

SEQ ID NO: 3049984 - DNA, 13 bp, Homo sapiens
attcagacagatg

SEQ ID NO: 3049985 - DNA, 22 bp, Homo sapiens
attcaggaaaactgacagagga

SEQ ID NO: 3049986 - DNA, 21 bp, Homo sapiens
attcaggaatgtgtggcctgc

SEQ ID NO: 3049987 - DNA, 15 bp, Homo sapiens
attcaggcactgaga

SEQ ID NO: 3049988 - DNA, 16 bp, Homo sapiens
attcaggcagcactga

SEQ ID NO: 3049989 - DNA, 20 bp, Homo sapiens
attcaggggctgacacttca

SEQ ID NO: 3049990 - DNA, 13 bp, Homo sapiens
attcaggtatgtt

SEQ ID NO: 3049991 - DNA, 20 bp, Homo sapiens
attcaggtatgttgccttta

SEQ ID NO: 3049992 - DNA, 23 bp, Homo sapiens
attcaggtatgttgcctttatgg

SEQ ID NO: 3049993 - DNA, 17 bp, Homo sapiens
attcaggtgcagaggaa

SEQ ID NO: 3049994 - DNA, 18 bp, Homo sapiens
attcaggtgcagaggaag

SEQ ID NO: 3049995 - DNA, 13 bp, Homo sapiens
attcagtagtttg

SEQ ID NO: 3049996 - DNA, 14 bp, Homo sapiens
attcagtatgtttt

SEQ ID NO: 3049997 - DNA, 16 bp, Homo sapiens
attcagtatgttttac

SEQ ID NO: 3049998 - DNA, 22 bp, Homo sapiens
attcagtatgttttacactgta

SEQ ID NO: 3049999 - DNA, 15 bp, Homo sapiens
attcagtctgctctc

SEQ ID NO: 3050000 - DNA, 13 bp, Homo sapiens
attcagtgatggc

SEQ ID NO: 3050001 - DNA, 18 bp, Homo sapiens
attcagtgtatttcagtt

SEQ ID NO: 3050002 - DNA, 19 bp, Homo sapiens
attcagttttcccactttt

SEQ ID NO: 3050003 - DNA, 17 bp, Homo sapiens
attcataactaatgaat

SEQ ID NO: 3050004 - DNA, 11 bp, Homo sapiens
attcataataa

SEQ ID NO: 3050005 - DNA, 14 bp, Homo sapiens
attcatactctgtt

SEQ ID NO: 3050006 - DNA, 21 bp, Homo sapiens
attcatactctgttgcctcct

SEQ ID NO: 3050007 - DNA, 13 bp, Homo sapiens
attcatactgaca

SEQ ID NO: 3050008 - DNA, 17 bp, Homo sapiens
attcatagtaacttctt

SEQ ID NO: 3050009 - DNA, 14 bp, Homo sapiens
attcatattgaata

SEQ ID NO: 3050010 - DNA, 17 bp, Homo sapiens
attcatattgaatataa

SEQ ID NO: 3050011 - DNA, 13 bp, Homo sapiens
attcatatttttc

SEQ ID NO: 3050012 - DNA, 19 bp, Homo sapiens
attcatcaaataaaccttg

SEQ ID NO: 3050013 - DNA, 20 bp, Homo sapiens
attcatcaaataaaccttgt

SEQ ID NO: 3050014 - DNA, 13 bp, Homo sapiens
attcatcttttaa

SEQ ID NO: 3050015 - DNA, 17 bp, Homo sapiens
attcatgaacttcgcat

SEQ ID NO: 3050016 - DNA, 15 bp, Homo sapiens
attcatggttatgaa

SEQ ID NO: 3050017 - DNA, 15 bp, Homo sapiens
attcatgttcatcaa

SEQ ID NO: 3050018 - DNA, 17 bp, Homo sapiens
attcatgttcatgtgat

SEQ ID NO: 3050019 - DNA, 19 bp, Homo sapiens
attcatgttcatgtgatta

SEQ ID NO: 3050020 - DNA, 15 bp, Homo sapiens
attcattgttttgca

SEQ ID NO: 3050021 - DNA, 15 bp, Homo sapiens
attccaaaccaggac

SEQ ID NO: 3050022 - DNA, 14 bp, Homo sapiens
attccaaaggggac

SEQ ID NO: 3050023 - DNA, 16 bp, Homo sapiens
attccaaagtctctaa

SEQ ID NO: 3050024 - DNA, 23 bp, Homo sapiens
attccaacaaagggttttaatgt

SEQ ID NO: 3050025 - DNA, 19 bp, Homo sapiens
attccaaccttcctttttt

SEQ ID NO: 3050026 - DNA, 19 bp, Homo sapiens
atgtcctaattcttctgtc

SEQ ID NO: 3050027 - DNA, 17 bp, Homo sapiens
atgtcctcaaagaagtg

SEQ ID NO: 3050028 - DNA, 20 bp, Homo sapiens
atgtcctcggtttcccattt

SEQ ID NO: 3050029 - DNA, 15 bp, Homo sapiens
atgtcctgcctttta

SEQ ID NO: 3050030 - DNA, 22 bp, Homo sapiens
atgtcgtgttttcaaggaagaa

SEQ ID NO: 3050031 - DNA, 16 bp, Homo sapiens
atgtctattattatga

SEQ ID NO: 3050032 - DNA, 20 bp, Homo sapiens
atgtctattattatgaagaa

SEQ ID NO: 3050033 - DNA, 17 bp, Homo sapiens
atgtctctcagaattct

SEQ ID NO: 3050034 - DNA, 13 bp, Homo sapiens
atgtctgaacttt

SEQ ID NO: 3050035 - DNA, 20 bp, Homo sapiens
atgtctgagagaccatctcc

SEQ ID NO: 3050036 - DNA, 13 bp, Homo sapiens
atgtctgcagccc

SEQ ID NO: 3050037 - DNA, 19 bp, Homo sapiens
atgtctgcagccctgagaa

SEQ ID NO: 3050038 - DNA, 13 bp, Homo sapiens
atgtctgccaatt

SEQ ID NO: 3050039 - DNA, 13 bp, Homo sapiens
atgtctgcctgga

SEQ ID NO: 3050040 - DNA, 12 bp, Homo sapiens
atgtctgtgctg

SEQ ID NO: 3050041 - DNA, 15 bp, Homo sapiens
atgtctgtgctgtgt

SEQ ID NO: 3050042 - DNA, 13 bp, Homo sapiens
atgtctgtttgct

SEQ ID NO: 3050043 - DNA, 15 bp, Homo sapiens
atgtctgtttgctga

SEQ ID NO: 3050044 - DNA, 17 bp, Homo sapiens
atgtcttcaaggcttca

SEQ ID NO: 3050045 - DNA, 13 bp, Homo sapiens
atgtcttggacac

SEQ ID NO: 3050046 - DNA, 17 bp, Homo sapiens
atgtcttgtacatgtgt

SEQ ID NO: 3050047 - DNA, 22 bp, Homo sapiens
atgtcttgtgtatttctctgtg

SEQ ID NO: 3050048 - DNA, 23 bp, Homo sapiens
atgtcttgtgtatttctctgtga

SEQ ID NO: 3050049 - DNA, 14 bp, Homo sapiens
atgtcttttaaaat

SEQ ID NO: 3050050 - DNA, 16 bp, Homo sapiens
atgtcttttgaatatt

SEQ ID NO: 3050051 - DNA, 19 bp, Homo sapiens
atgtcttttgatgaataga

SEQ ID NO: 3050052 - DNA, 16 bp, Homo sapiens
atgtgaaaatcaaata

SEQ ID NO: 3050053 - DNA, 14 bp, Homo sapiens
atgtgaaagattat

SEQ ID NO: 3050054 - DNA, 21 bp, Homo sapiens
atgtgaagatgcattgtagtt

SEQ ID NO: 3050055 - DNA, 22 bp, Homo sapiens
atgtgaagccaattcagacagg

SEQ ID NO: 3050056 - DNA, 13 bp, Homo sapiens
atgtgaagtgtta

SEQ ID NO: 3050057 - DNA, 19 bp, Homo sapiens
atgtgaatatggacagtta

SEQ ID NO: 3050058 - DNA, 11 bp, Homo sapiens
atgtgaatttt

SEQ ID NO: 3050059 - DNA, 19 bp, Homo sapiens
atgtgaatttttatttctt

SEQ ID NO: 3050060 - DNA, 13 bp, Homo sapiens
atgtgacaaaatt

SEQ ID NO: 3050061 - DNA, 18 bp, Homo sapiens
atgtgacaattttgtaca

SEQ ID NO: 3050062 - DNA, 23 bp, Homo sapiens
atgtgacattcttaaaaaaagaa

SEQ ID NO: 3050063 - DNA, 17 bp, Homo sapiens
atgtgaccatgtgaatc

SEQ ID NO: 3050064 - DNA, 21 bp, Homo sapiens
atgtgactctttccaaccggc

SEQ ID NO: 3050065 - DNA, 11 bp, Homo sapiens
atgtgagcaga

SEQ ID NO: 3050066 - DNA, 12 bp, Homo sapiens
atgtgaggatgt

SEQ ID NO: 3050067 - DNA, 20 bp, Homo sapiens
atgtgagggcaccaccaaga

SEQ ID NO: 3050068 - DNA, 22 bp, Homo sapiens
atgtgagtgaaagtacttcagg

SEQ ID NO: 3050069 - DNA, 22 bp, Homo sapiens
atgtgagtgccttttgcagaag

SEQ ID NO: 3050070 - DNA, 23 bp, Homo sapiens
atgtgagtgccttttgcagaaga

SEQ ID NO: 3050071 - DNA, 17 bp, Homo sapiens
atgtgataaggaaatca

SEQ ID NO: 3050072 - DNA, 14 bp, Homo sapiens
atgtgatattctaa

SEQ ID NO: 3050073 - DNA, 15 bp, Homo sapiens
atgtgatattctaag

SEQ ID NO: 3050074 - DNA, 17 bp, Homo sapiens
atgtgatcatctttgct

SEQ ID NO: 3050075 - DNA, 19 bp, Homo sapiens
atgtgatgttctaaggctc

SEQ ID NO: 3050076 - DNA, 13 bp, Homo sapiens
atgtgatttaata

SEQ ID NO: 3050077 - DNA, 20 bp, Homo sapiens
atgtgatttaatagtgttaa

SEQ ID NO: 3050078 - DNA, 21 bp, Homo sapiens
atgtgatttaatagtgttaat

SEQ ID NO: 3050079 - DNA, 15 bp, Homo sapiens
atgtgattttaactc

SEQ ID NO: 3050080 - DNA, 22 bp, Homo sapiens
atgtgattttgtaggttatttt

SEQ ID NO: 3050081 - DNA, 17 bp, Homo sapiens
atgtgcaaaaaaagaaa

SEQ ID NO: 3050082 - DNA, 22 bp, Homo sapiens
atgtgcacatatcaagaagtca

SEQ ID NO: 3050083 - DNA, 20 bp, Homo sapiens
atgtgcagcagattggaagg

SEQ ID NO: 3050084 - DNA, 23 bp, Homo sapiens
atgtgcagttcagtttgtctctt

SEQ ID NO: 3050085 - DNA, 17 bp, Homo sapiens
atgtgcattctccagcc

SEQ ID NO: 3050086 - DNA, 17 bp, Homo sapiens
atgtgccaaaactagta

SEQ ID NO: 3050087 - DNA, 14 bp, Homo sapiens
atgtgccaattttg

SEQ ID NO: 3050088 - DNA, 20 bp, Homo sapiens
atgtgccaattttgtcacag

SEQ ID NO: 3050089 - DNA, 11 bp, Homo sapiens
atgtgccacta

SEQ ID NO: 3050090 - DNA, 23 bp, Homo sapiens
atgtgccaggaaactcttgctat

SEQ ID NO: 3050091 - DNA, 22 bp, Homo sapiens
atgtgccaggcttgcctgggct

SEQ ID NO: 3050092 - DNA, 14 bp, Homo sapiens
atgtgcctctgtcc

SEQ ID NO: 3050093 - DNA, 20 bp, Homo sapiens
atgtgcgtggaagtgttcct

SEQ ID NO: 3050094 - DNA, 21 bp, Homo sapiens
atgtgctagtcactggcagcc

SEQ ID NO: 3050095 - DNA, 18 bp, Homo sapiens
atgtgctgtgtaaagtta

SEQ ID NO: 3050096 - DNA, 20 bp, Homo sapiens
atgtgctgtgtaaagttagt

SEQ ID NO: 3050097 - DNA, 20 bp, Homo sapiens
atgtgcttgtgctcatgtgt

SEQ ID NO: 3050098 - DNA, 22 bp, Homo sapiens
atgtgcttgtgctcatgtgtgt

SEQ ID NO: 3050099 - DNA, 18 bp, Homo sapiens
atgtgctttgtggcttct

SEQ ID NO: 3050100 - DNA, 23 bp, Homo sapiens
atgtggaaaagccaagaggctgc

SEQ ID NO: 3050101 - DNA, 17 bp, Homo sapiens
atgtggaatataaagat

SEQ ID NO: 3050102 - DNA, 14 bp, Homo sapiens
atgtggagccaggc

SEQ ID NO: 3050103 - DNA, 13 bp, Homo sapiens
atgtggccctggc

SEQ ID NO: 3050104 - DNA, 15 bp, Homo sapiens
atgtggccctggcct

SEQ ID NO: 3050105 - DNA, 19 bp, Homo sapiens
atgtggccctggcctgctg

SEQ ID NO: 3050106 - DNA, 17 bp, Homo sapiens
atgtggcttctctgtct

SEQ ID NO: 3050107 - DNA, 21 bp, Homo sapiens
atgtggcttgagaaatatgga

SEQ ID NO: 3050108 - DNA, 21 bp, Homo sapiens
atgtggcttttatttcagtgc

SEQ ID NO: 3050109 - DNA, 20 bp, Homo sapiens
atgtgggaattaagcaaaat

SEQ ID NO: 3050110 - DNA, 18 bp, Homo sapiens
atgtggggctgagctggg

SEQ ID NO: 3050111 - DNA, 14 bp, Homo sapiens
atgtgggttgtgat

SEQ ID NO: 3050112 - DNA, 19 bp, Homo sapiens
atgtggtctgccaatctgt

SEQ ID NO: 3050113 - DNA, 20 bp, Homo sapiens
atgtggttgcaaggccgctg

SEQ ID NO: 3050114 - DNA, 16 bp, Homo sapiens
atgtggttttttgcca

SEQ ID NO: 3050115 - DNA, 18 bp, Homo sapiens
atgtgtaataatgtaaca

SEQ ID NO: 3050116 - DNA, 21 bp, Homo sapiens
atgtgtaataatgtaacatga

SEQ ID NO: 3050117 - DNA, 16 bp, Homo sapiens
atgtgtaatcaataaa

SEQ ID NO: 3050118 - DNA, 21 bp, Homo sapiens
atgtgtaatcaataaacgatt

SEQ ID NO: 3050119 - DNA, 22 bp, Homo sapiens
atgtgtacacaaaggatttgat

SEQ ID NO: 3050120 - DNA, 21 bp, Homo sapiens
atgtgtacatcccatgtaaca

SEQ ID NO: 3050121 - DNA, 22 bp, Homo sapiens
atgtgtacatggcagagtttgt

SEQ ID NO: 3050122 - DNA, 15 bp, Homo sapiens
atgtgtagcctgtgc

SEQ ID NO: 3050123 - DNA, 16 bp, Homo sapiens
atgtgtagcctgtgca

SEQ ID NO: 3050124 - DNA, 12 bp, Homo sapiens
atgtgtatatat

SEQ ID NO: 3050125 - DNA, 22 bp, Homo sapiens
atgtgtatatatatgtgaggat

SEQ ID NO: 3050126 - DNA, 13 bp, Homo sapiens
atgtgtatgagaa

SEQ ID NO: 3050127 - DNA, 19 bp, Homo sapiens
atgtgtatgagaagtactt

SEQ ID NO: 3050128 - DNA, 20 bp, Homo sapiens
atgtgtattcatactgacat

SEQ ID NO: 3050129 - DNA, 16 bp, Homo sapiens
atgtgtcccagtgaac

SEQ ID NO: 3050130 - DNA, 14 bp, Homo sapiens
atgtgtcccttcca

SEQ ID NO: 3050131 - DNA, 16 bp, Homo sapiens
atgtgtctgcaacatg

SEQ ID NO: 3050132 - DNA, 15 bp, Homo sapiens
atgtgtctggaagaa

SEQ ID NO: 3050133 - DNA, 21 bp, Homo sapiens
atgtgtctggaagaagcagcg

SEQ ID NO: 3050134 - DNA, 20 bp, Homo sapiens
atgtgtgtattttttcatag

SEQ ID NO: 3050135 - DNA, 22 bp, Homo sapiens
atgtgtgtccacgactgtctcc

SEQ ID NO: 3050136 - DNA, 23 bp, Homo sapiens
atgtgtgtccacgactgtctcca

SEQ ID NO: 3050137 - DNA, 13 bp, Homo sapiens
atgtgtgtgcatg

SEQ ID NO: 3050138 - DNA, 14 bp, Homo sapiens
atgtgtgttgtttc

SEQ ID NO: 3050139 - DNA, 18 bp, Homo sapiens
atgtgtgttgtttccata

SEQ ID NO: 3050140 - DNA, 19 bp, Homo sapiens
atgtgttcggttttgttgt

SEQ ID NO: 3050141 - DNA, 16 bp, Homo sapiens
atgtgttggacaaatg

SEQ ID NO: 3050142 - DNA, 21 bp, Homo sapiens
atgtgtttctggtatgaaaca

SEQ ID NO: 3050143 - DNA, 22 bp, Homo sapiens
atgtgtttctggtatgaaacaa

SEQ ID NO: 3050144 - DNA, 15 bp, Homo sapiens
atgtgttttagatgg

SEQ ID NO: 3050145 - DNA, 17 bp, Homo sapiens
atgtgttttgcttttat

SEQ ID NO: 3050146 - DNA, 18 bp, Homo sapiens
atgtgttttgtttattaa

SEQ ID NO: 3050147 - DNA, 13 bp, Homo sapiens
atgttaaactctt

SEQ ID NO: 3050148 - DNA, 17 bp, Homo sapiens
attaaattcacaaactt

SEQ ID NO: 3050149 - DNA, 15 bp, Homo sapiens
attaaattctcaaag

SEQ ID NO: 3050150 - DNA, 17 bp, Homo sapiens
attaaattctcaaagtt

SEQ ID NO: 3050151 - DNA, 22 bp, Homo sapiens
attaaattctcaaagttttatt

SEQ ID NO: 3050152 - DNA, 16 bp, Homo sapiens
attaaatttatttgaa

SEQ ID NO: 3050153 - DNA, 20 bp, Homo sapiens
attaaatttatttgaaaatg

SEQ ID NO: 3050154 - DNA, 18 bp, Homo sapiens
attaacagaaatgtttct

SEQ ID NO: 3050155 - DNA, 13 bp, Homo sapiens
attaacctctcac

SEQ ID NO: 3050156 - DNA, 14 bp, Homo sapiens
attaactatcttct

SEQ ID NO: 3050157 - DNA, 22 bp, Homo sapiens
attaactatcttctttggactt

SEQ ID NO: 3050158 - DNA, 16 bp, Homo sapiens
attaactctggacctc

SEQ ID NO: 3050159 - DNA, 23 bp, Homo sapiens
attaactctggacctctcttgtg

SEQ ID NO: 3050160 - DNA, 13 bp, Homo sapiens
attaactgttgca

SEQ ID NO: 3050161 - DNA, 21 bp, Homo sapiens
attaactgttgcacttttgaa

SEQ ID NO: 3050162 - DNA, 17 bp, Homo sapiens
attaagaaacaatttaa

SEQ ID NO: 3050163 - DNA, 17 bp, Homo sapiens
attaagaatagtctctg

SEQ ID NO: 3050164 - DNA, 17 bp, Homo sapiens
attaagagaacaaagag

SEQ ID NO: 3050165 - DNA, 22 bp, Homo sapiens
attaagagaacaaagagtgaaa

SEQ ID NO: 3050166 - DNA, 23 bp, Homo sapiens
attaagccaggaaacatgaagca

SEQ ID NO: 3050167 - DNA, 22 bp, Homo sapiens
attaagctgttcctgttcagta

SEQ ID NO: 3050168 - DNA, 21 bp, Homo sapiens
attaagtagaacaaaaaaccc

SEQ ID NO: 3050169 - DNA, 21 bp, Homo sapiens
attaagtgttgaaaaatatct

SEQ ID NO: 3050170 - DNA, 13 bp, Homo sapiens
attaataaataga

SEQ ID NO: 3050171 - DNA, 18 bp, Homo sapiens
attaatagaacacagagt

SEQ ID NO: 3050172 - DNA, 18 bp, Homo sapiens
attaatattgtattgctg

SEQ ID NO: 3050173 - DNA, 21 bp, Homo sapiens
attaatatttgtgctttgaaa

SEQ ID NO: 3050174 - DNA, 18 bp, Homo sapiens
attaatcacctctctgta

SEQ ID NO: 3050175 - DNA, 17 bp, Homo sapiens
attaatcagctgttgca

SEQ ID NO: 3050176 - DNA, 16 bp, Homo sapiens
attaatgacacttgtc

SEQ ID NO: 3050177 - DNA, 21 bp, Homo sapiens
attaatgattctgaagcttat

SEQ ID NO: 3050178 - DNA, 14 bp, Homo sapiens
attaatgcactttc

SEQ ID NO: 3050179 - DNA, 14 bp, Homo sapiens
attaattgctgcaa

SEQ ID NO: 3050180 - DNA, 12 bp, Homo sapiens
attaattgcttt

SEQ ID NO: 3050181 - DNA, 16 bp, Homo sapiens
attaatttagaatggt

SEQ ID NO: 3050182 - DNA, 17 bp, Homo sapiens
attaatttatgcagaat

SEQ ID NO: 3050183 - DNA, 21 bp, Homo sapiens
attaatttgcatctgaaatag

SEQ ID NO: 3050184 - DNA, 16 bp, Homo sapiens
attaattttctatgtg

SEQ ID NO: 3050185 - DNA, 22 bp, Homo sapiens
attacaaatatatagcacatca

SEQ ID NO: 3050186 - DNA, 20 bp, Homo sapiens
attacaaattttcactgctg

SEQ ID NO: 3050187 - DNA, 14 bp, Homo sapiens
attacaattttatc

SEQ ID NO: 3050188 - DNA, 18 bp, Homo sapiens
attacaattttatctgtt

SEQ ID NO: 3050189 - DNA, 14 bp, Homo sapiens
attacacttggtaa

SEQ ID NO: 3050190 - DNA, 17 bp, Homo sapiens
attacactttattcttt

SEQ ID NO: 3050191 - DNA, 13 bp, Homo sapiens
attacagaaactg

SEQ ID NO: 3050192 - DNA, 16 bp, Homo sapiens
attacagaaactgatg

SEQ ID NO: 3050193 - DNA, 22 bp, Homo sapiens
attacaggcacctgccaccatg

SEQ ID NO: 3050194 - DNA, 14 bp, Homo sapiens
attacattagttaa

SEQ ID NO: 3050195 - DNA, 16 bp, Homo sapiens
attaccaggtccattt

SEQ ID NO: 3050196 - DNA, 13 bp, Homo sapiens
attacccaagcaa

SEQ ID NO: 3050197 - DNA, 13 bp, Homo sapiens
attacccaatgga

SEQ ID NO: 3050198 - DNA, 14 bp, Homo sapiens
attacccagtgccg

SEQ ID NO: 3050199 - DNA, 12 bp, Homo sapiens
attacccttcct

SEQ ID NO: 3050200 - DNA, 13 bp, Homo sapiens
attacctcctgag

SEQ ID NO: 3050201 - DNA, 22 bp, Homo sapiens
attacgaatgcccctgttcatg

SEQ ID NO: 3050202 - DNA, 14 bp, Homo sapiens
attacggtgtacag

SEQ ID NO: 3050203 - DNA, 15 bp, Homo sapiens
attactaacctccct

SEQ ID NO: 3050204 - DNA, 20 bp, Homo sapiens
attactaaggagtaatctgt

SEQ ID NO: 3050205 - DNA, 14 bp, Homo sapiens
attactccaaaaag

SEQ ID NO: 3050206 - DNA, 20 bp, Homo sapiens
attactctttgctttgtagt

SEQ ID NO: 3050207 - DNA, 17 bp, Homo sapiens
attactgcaatcactgt

SEQ ID NO: 3050208 - DNA, 13 bp, Homo sapiens
attactgctgctg

SEQ ID NO: 3050209 - DNA, 17 bp, Homo sapiens
attactgctgctgtgct

SEQ ID NO: 3050210 - DNA, 17 bp, Homo sapiens
attactggcgtggatta

SEQ ID NO: 3050211 - DNA, 18 bp, Homo sapiens
attactgtctctggcatt

SEQ ID NO: 3050212 - DNA, 15 bp, Homo sapiens
attacttatccctgc

SEQ ID NO: 3050213 - DNA, 22 bp, Homo sapiens
attacttcactatacaaacaaa

SEQ ID NO: 3050214 - DNA, 22 bp, Homo sapiens
attacttgtaaataaagtctat

SEQ ID NO: 3050215 - DNA, 14 bp, Homo sapiens
attactttgtttta

SEQ ID NO: 3050216 - DNA, 15 bp, Homo sapiens
attacttttttccaa

SEQ ID NO: 3050217 - DNA, 20 bp, Homo sapiens
attagaaaaggtatgaaaat

SEQ ID NO: 3050218 - DNA, 11 bp, Homo sapiens
attagaacttc

SEQ ID NO: 3050219 - DNA, 21 bp, Homo sapiens
attagaatataatatttgaag

SEQ ID NO: 3050220 - DNA, 11 bp, Homo sapiens
attagaatgct

SEQ ID NO: 3050221 - DNA, 12 bp, Homo sapiens
attagaatgtga

SEQ ID NO: 3050222 - DNA, 13 bp, Homo sapiens
attagaatgtgat

SEQ ID NO: 3050223 - DNA, 18 bp, Homo sapiens
attagacttgaaatacgt

SEQ ID NO: 3050224 - DNA, 14 bp, Homo sapiens
attagagcattgaa

SEQ ID NO: 3050225 - DNA, 19 bp, Homo sapiens
attagatcccatatttact

SEQ ID NO: 3050226 - DNA, 11 bp, Homo sapiens
attagatgaat

SEQ ID NO: 3050227 - DNA, 20 bp, Homo sapiens
attagatgcatgttgaccat

SEQ ID NO: 3050228 - DNA, 14 bp, Homo sapiens
attagatgtgattt

SEQ ID NO: 3050229 - DNA, 21 bp, Homo sapiens
attagatgtgatttaatagtg

SEQ ID NO: 3050230 - DNA, 22 bp, Homo sapiens
attagatgtgatttaatagtgt

SEQ ID NO: 3050231 - DNA, 14 bp, Homo sapiens
attagatgtttata

SEQ ID NO: 3050232 - DNA, 18 bp, Homo sapiens
attagcaaagaagcttca

SEQ ID NO: 3050233 - DNA, 14 bp, Homo sapiens
attagccagtcatt

SEQ ID NO: 3050234 - DNA, 21 bp, Homo sapiens
attagccgggcatgatggtgc

SEQ ID NO: 3050235 - DNA, 13 bp, Homo sapiens
attagcttgctta

SEQ ID NO: 3050236 - DNA, 15 bp, Homo sapiens
attagctttttcatc

SEQ ID NO: 3050237 - DNA, 13 bp, Homo sapiens
attaggaataaat

SEQ ID NO: 3050238 - DNA, 21 bp, Homo sapiens
attaggcaaaaataatttatt

SEQ ID NO: 3050239 - DNA, 21 bp, Homo sapiens
attaggcagactctttatgct

SEQ ID NO: 3050240 - DNA, 23 bp, Homo sapiens
attaggtgatcccgttttcccca

SEQ ID NO: 3050241 - DNA, 23 bp, Homo sapiens
attagtaaaacacaagacttcag

SEQ ID NO: 3050242 - DNA, 16 bp, Homo sapiens
attagtaacatgtgtt

SEQ ID NO: 3050243 - DNA, 18 bp, Homo sapiens
attagtaagctagcaaat

SEQ ID NO: 3050244 - DNA, 19 bp, Homo sapiens
attagtataatatttctta

SEQ ID NO: 3050245 - DNA, 20 bp, Homo sapiens
attagtcactgctgctactg

SEQ ID NO: 3050246 - DNA, 23 bp, Homo sapiens
attagtcattcaataaattgtaa

SEQ ID NO: 3050247 - DNA, 14 bp, Homo sapiens
attagttttcttgt

SEQ ID NO: 3050248 - DNA, 19 bp, Homo sapiens
attagttttcttgttgctt

SEQ ID NO: 3050249 - DNA, 21 bp, Homo sapiens
attagttttcttgttgctttg

SEQ ID NO: 3050250 - DNA, 15 bp, Homo sapiens
attataaacagcagg

SEQ ID NO: 3050251 - DNA, 16 bp, Homo sapiens
attataaatgttagtt

SEQ ID NO: 3050252 - DNA, 14 bp, Homo sapiens
attataaatgtttg

SEQ ID NO: 3050253 - DNA, 15 bp, Homo sapiens
attataagggagagc

SEQ ID NO: 3050254 - DNA, 23 bp, Homo sapiens
attataagggagagctgagccag

SEQ ID NO: 3050255 - DNA, 23 bp, Homo sapiens
attataatgccagaatataatgt

SEQ ID NO: 3050256 - DNA, 20 bp, Homo sapiens
attatactgttatccatatt

SEQ ID NO: 3050257 - DNA, 18 bp, Homo sapiens
attatactttatcaaaga

SEQ ID NO: 3050258 - DNA, 21 bp, Homo sapiens
attatactttgttgtttttaa

SEQ ID NO: 3050259 - DNA, 21 bp, Homo sapiens
attatagatgggaatgaagct

SEQ ID NO: 3050260 - DNA, 19 bp, Homo sapiens
attatagcaatgtgatttt

SEQ ID NO: 3050261 - DNA, 22 bp, Homo sapiens
attatagcgcctgtataagtag

SEQ ID NO: 3050262 - DNA, 16 bp, Homo sapiens
attataggaagttctt

SEQ ID NO: 3050263 - DNA, 17 bp, Homo sapiens
attataggaagttcttt

SEQ ID NO: 3050264 - DNA, 19 bp, Homo sapiens
attataggaatatcaatat

SEQ ID NO: 3050265 - DNA, 17 bp, Homo sapiens
attatatagcaaagata

SEQ ID NO: 3050266 - DNA, 15 bp, Homo sapiens
attatatcaaagtat

SEQ ID NO: 3050267 - DNA, 23 bp, Homo sapiens
attatattggtgcgtttttacag

SEQ ID NO: 3050268 - DNA, 16 bp, Homo sapiens
attatatttacaaatg

SEQ ID NO: 3050269 - DNA, 19 bp, Homo sapiens
attatcaccaggatttata

SEQ ID NO: 3050270 - DNA, 17 bp, Homo sapiens
attatcatgtgtaatca

SEQ ID NO: 3050271 - DNA, 19 bp, Homo sapiens
attatcatgtgtaatcaat

SEQ ID NO: 3050272 - DNA, 13 bp, Homo sapiens
atgttaaagttta

SEQ ID NO: 3050273 - DNA, 22 bp, Homo sapiens
atgttaaagtttaagtgtgcag

SEQ ID NO: 3050274 - DNA, 16 bp, Homo sapiens
atgttaagacttgaca

SEQ ID NO: 3050275 - DNA, 18 bp, Homo sapiens
atgttaagacttgacagt

SEQ ID NO: 3050276 - DNA, 23 bp, Homo sapiens
atgttaagcagctaaattttctg

SEQ ID NO: 3050277 - DNA, 17 bp, Homo sapiens
atgttaattttttggta

SEQ ID NO: 3050278 - DNA, 20 bp, Homo sapiens
atgttaattttttggtacaa

SEQ ID NO: 3050279 - DNA, 22 bp, Homo sapiens
atgttaattttttggtacaaaa

SEQ ID NO: 3050280 - DNA, 20 bp, Homo sapiens
atgttacaagtttatatata

SEQ ID NO: 3050281 - DNA, 17 bp, Homo sapiens
atgttagaattgatttc

SEQ ID NO: 3050282 - DNA, 20 bp, Homo sapiens
atgttagctccaaagcattt

SEQ ID NO: 3050283 - DNA, 11 bp, Homo sapiens
atgttagttct

SEQ ID NO: 3050284 - DNA, 12 bp, Homo sapiens
atgttagttcta

SEQ ID NO: 3050285 - DNA, 16 bp, Homo sapiens
atgttatatcatatgt

SEQ ID NO: 3050286 - DNA, 18 bp, Homo sapiens
atgttatatcatatgtat

SEQ ID NO: 3050287 - DNA, 19 bp, Homo sapiens
atgttatatcatatgtata

SEQ ID NO: 3050288 - DNA, 17 bp, Homo sapiens
atgttatcttctcaagt

SEQ ID NO: 3050289 - DNA, 18 bp, Homo sapiens
atgttatgcataaagtca

SEQ ID NO: 3050290 - DNA, 19 bp, Homo sapiens
atgttatggcttattgtgt

SEQ ID NO: 3050291 - DNA, 21 bp, Homo sapiens
atgttatgtaaaaggccaaac

SEQ ID NO: 3050292 - DNA, 15 bp, Homo sapiens
atgttattacttgta

SEQ ID NO: 3050293 - DNA, 14 bp, Homo sapiens
atgttattgttttc

SEQ ID NO: 3050294 - DNA, 14 bp, Homo sapiens
atgttcacttcgaa

SEQ ID NO: 3050295 - DNA, 14 bp, Homo sapiens
atgttcacttttga

SEQ ID NO: 3050296 - DNA, 20 bp, Homo sapiens
atgttcacttttgacaaagg

SEQ ID NO: 3050297 - DNA, 19 bp, Homo sapiens
atgttcagacatttatgtg

SEQ ID NO: 3050298 - DNA, 22 bp, Homo sapiens
atgttcagtgtaatttctttgc

SEQ ID NO: 3050299 - DNA, 13 bp, Homo sapiens
atgttcatgtgat

SEQ ID NO: 3050300 - DNA, 15 bp, Homo sapiens
atgttcatgtgatta

SEQ ID NO: 3050301 - DNA, 16 bp, Homo sapiens
atgttcccaaaacaat

SEQ ID NO: 3050302 - DNA, 12 bp, Homo sapiens
atgttctaaggc

SEQ ID NO: 3050303 - DNA, 17 bp, Homo sapiens
atgttctaaggctctga

SEQ ID NO: 3050304 - DNA, 23 bp, Homo sapiens
atgttctaagtttctaagattct

SEQ ID NO: 3050305 - DNA, 16 bp, Homo sapiens
atgttcttatagaata

SEQ ID NO: 3050306 - DNA, 20 bp, Homo sapiens
atgttctttatatacaataa

SEQ ID NO: 3050307 - DNA, 20 bp, Homo sapiens
atgttgaaactgcttgagca

SEQ ID NO: 3050308 - DNA, 19 bp, Homo sapiens
atgttgacataccttttat

SEQ ID NO: 3050309 - DNA, 20 bp, Homo sapiens
atgttgaccaggctggtctc

SEQ ID NO: 3050310 - DNA, 22 bp, Homo sapiens
atgttgagaatcccaaatttga

SEQ ID NO: 3050311 - DNA, 13 bp, Homo sapiens
atgttgaggtgga

SEQ ID NO: 3050312 - DNA, 16 bp, Homo sapiens
atgttgataatttcag

SEQ ID NO: 3050313 - DNA, 19 bp, Homo sapiens
atgttgataatttcaggga

SEQ ID NO: 3050314 - DNA, 24 bp, Homo sapiens
atgttgatccatccagcttgccag

SEQ ID NO: 3050315 - DNA, 21 bp, Homo sapiens
atgttgcacacccactcagct

SEQ ID NO: 3050316 - DNA, 22 bp, Homo sapiens
atgttgcacacccactcagctc

SEQ ID NO: 3050317 - DNA, 17 bp, Homo sapiens
atgttgctataataaag

SEQ ID NO: 3050318 - DNA, 15 bp, Homo sapiens
atgttgctattgtaa

SEQ ID NO: 3050319 - DNA, 19 bp, Homo sapiens
atgttggacacctttaggt

SEQ ID NO: 3050320 - DNA, 22 bp, Homo sapiens
atgttggacacctttaggttct

SEQ ID NO: 3050321 - DNA, 23 bp, Homo sapiens
atgttggacacctttaggttctt

SEQ ID NO: 3050322 - DNA, 23 bp, Homo sapiens
atgttggccaccaggtgcctttc

SEQ ID NO: 3050323 - DNA, 17 bp, Homo sapiens
atgttggccaggctggt

SEQ ID NO: 3050324 - DNA, 12 bp, Homo sapiens
atgttgggactg

SEQ ID NO: 3050325 - DNA, 16 bp, Homo sapiens
atgttggtcaggctgg

SEQ ID NO: 3050326 - DNA, 12 bp, Homo sapiens
atgttggtgcaa

SEQ ID NO: 3050327 - DNA, 20 bp, Homo sapiens
atgttggtgcaattaactct

SEQ ID NO: 3050328 - DNA, 21 bp, Homo sapiens
atgttggtgcaattaactctg

SEQ ID NO: 3050329 - DNA, 22 bp, Homo sapiens
atgttgtccaattgttgacagt

SEQ ID NO: 3050330 - DNA, 17 bp, Homo sapiens
atgttgtgtgttgcact

SEQ ID NO: 3050331 - DNA, 22 bp, Homo sapiens
atgttgtgtttctgttcacctt

SEQ ID NO: 3050332 - DNA, 20 bp, Homo sapiens
atgttgtgtttggatttgta

SEQ ID NO: 3050333 - DNA, 16 bp, Homo sapiens
atgttgttttttcata

SEQ ID NO: 3050334 - DNA, 18 bp, Homo sapiens
atgtttaaaaaaacatta

SEQ ID NO: 3050335 - DNA, 13 bp, Homo sapiens
atgtttaatgtga

SEQ ID NO: 3050336 - DNA, 15 bp, Homo sapiens
atgtttaatgtgaac

SEQ ID NO: 3050337 - DNA, 11 bp, Homo sapiens
atgtttactgt

SEQ ID NO: 3050338 - DNA, 15 bp, Homo sapiens
atgtttactgtaaat

SEQ ID NO: 3050339 - DNA, 21 bp, Homo sapiens
atgtttagcagaaataggcag

SEQ ID NO: 3050340 - DNA, 20 bp, Homo sapiens
atgtttataaatcttatgct

SEQ ID NO: 3050341 - DNA, 12 bp, Homo sapiens
atgtttatatca

SEQ ID NO: 3050342 - DNA, 16 bp, Homo sapiens
atgtttatatcaaatg

SEQ ID NO: 3050343 - DNA, 17 bp, Homo sapiens
atgtttattaatagaat

SEQ ID NO: 3050344 - DNA, 17 bp, Homo sapiens
atgtttattcttctaga

SEQ ID NO: 3050345 - DNA, 17 bp, Homo sapiens
atgtttcagctgcagtt

SEQ ID NO: 3050346 - DNA, 18 bp, Homo sapiens
atgtttccaccaaatgaa

SEQ ID NO: 3050347 - DNA, 12 bp, Homo sapiens
atgtttccccca

SEQ ID NO: 3050348 - DNA, 14 bp, Homo sapiens
atgtttcccccact

SEQ ID NO: 3050349 - DNA, 15 bp, Homo sapiens
atgtttcccccactc

SEQ ID NO: 3050350 - DNA, 15 bp, Homo sapiens
atgtttctgtgtcat

SEQ ID NO: 3050351 - DNA, 17 bp, Homo sapiens
atgtttgcacctttcta

SEQ ID NO: 3050352 - DNA, 19 bp, Homo sapiens
atgtttgcacctttctagt

SEQ ID NO: 3050353 - DNA, 21 bp, Homo sapiens
atgtttgcacctttctagttg

SEQ ID NO: 3050354 - DNA, 15 bp, Homo sapiens
atgtttgctgttcca

SEQ ID NO: 3050355 - DNA, 23 bp, Homo sapiens
atgtttgtcctgaacacttttgt

SEQ ID NO: 3050356 - DNA, 15 bp, Homo sapiens
atgtttgtgtctgtg

SEQ ID NO: 3050357 - DNA, 17 bp, Homo sapiens
atgtttgtgtctgtggt

SEQ ID NO: 3050358 - DNA, 19 bp, Homo sapiens
atgttttaaaattatatag

SEQ ID NO: 3050359 - DNA, 12 bp, Homo sapiens
atgttttaaaga

SEQ ID NO: 3050360 - DNA, 14 bp, Homo sapiens
atgttttaaatgta

SEQ ID NO: 3050361 - DNA, 13 bp, Homo sapiens
atgttttaactta

SEQ ID NO: 3050362 - DNA, 16 bp, Homo sapiens
atgttttaattccatg

SEQ ID NO: 3050363 - DNA, 21 bp, Homo sapiens
atgttttacgcaaggaaggac

SEQ ID NO: 3050364 - DNA, 18 bp, Homo sapiens
atgttttctgaaaatata

SEQ ID NO: 3050365 - DNA, 21 bp, Homo sapiens
atgttttctgaaaatataacc

SEQ ID NO: 3050366 - DNA, 20 bp, Homo sapiens
atgttttgataaagtagtaa

SEQ ID NO: 3050367 - DNA, 22 bp, Homo sapiens
atgttttgataaagtagtaaaa

SEQ ID NO: 3050368 - DNA, 13 bp, Homo sapiens
atgtttttaatat

SEQ ID NO: 3050369 - DNA, 15 bp, Homo sapiens
atgtttttatacaaa

SEQ ID NO: 3050370 - DNA, 20 bp, Homo sapiens
atgtttttattaagattatt

SEQ ID NO: 3050371 - DNA, 13 bp, Homo sapiens
atgtttttgccaa

SEQ ID NO: 3050372 - DNA, 13 bp, Homo sapiens
atgtttttgtgta

SEQ ID NO: 3050373 - DNA, 19 bp, Homo sapiens
atgtttttgttcaaagcca

SEQ ID NO: 3050374 - DNA, 15 bp, Homo sapiens
atgttttttcatgtg

SEQ ID NO: 3050375 - DNA, 21 bp, Homo sapiens
atgttttttctgcaatgactg

SEQ ID NO: 3050376 - DNA, 19 bp, Homo sapiens
attaaaaaacaattaactg

SEQ ID NO: 3050377 - DNA, 17 bp, Homo sapiens
attaaaaacatagaaaa

SEQ ID NO: 3050378 - DNA, 18 bp, Homo sapiens
attaaaaacgaaaacctg

SEQ ID NO: 3050379 - DNA, 14 bp, Homo sapiens
attaaaaactgagt

SEQ ID NO: 3050380 - DNA, 20 bp, Homo sapiens
attaaaaactgagtgactct

SEQ ID NO: 3050381 - DNA, 18 bp, Homo sapiens
attaaaaaggtttacaga

SEQ ID NO: 3050382 - DNA, 19 bp, Homo sapiens
attaaaaaggtttacagaa

SEQ ID NO: 3050383 - DNA, 14 bp, Homo sapiens
attaaaacaatatt

SEQ ID NO: 3050384 - DNA, 20 bp, Homo sapiens
attaaaacaatattgtttct

SEQ ID NO: 3050385 - DNA, 14 bp, Homo sapiens
attaaaagacaaat

SEQ ID NO: 3050386 - DNA, 16 bp, Homo sapiens
attaaaagacaaatat

SEQ ID NO: 3050387 - DNA, 22 bp, Homo sapiens
attaaaagggattacccaagca

SEQ ID NO: 3050388 - DNA, 13 bp, Homo sapiens
attaaaagtcaca

SEQ ID NO: 3050389 - DNA, 21 bp, Homo sapiens
attaaaataactatcaggcag

SEQ ID NO: 3050390 - DNA, 16 bp, Homo sapiens
attaaaatcctcaatc

SEQ ID NO: 3050391 - DNA, 15 bp, Homo sapiens
attaaaatctcttga

SEQ ID NO: 3050392 - DNA, 19 bp, Homo sapiens
attaaaatctttctttggg

SEQ ID NO: 3050393 - DNA, 12 bp, Homo sapiens
attaaaatggat

SEQ ID NO: 3050394 - DNA, 13 bp, Homo sapiens
attaaaatggatg

SEQ ID NO: 3050395 - DNA, 15 bp, Homo sapiens
attaaaattacaaaa

SEQ ID NO: 3050396 - DNA, 13 bp, Homo sapiens
attaaacatgctc

SEQ ID NO: 3050397 - DNA, 18 bp, Homo sapiens
attaaacgtatgcatgtg

SEQ ID NO: 3050398 - DNA, 19 bp, Homo sapiens
attaaacgtatgcatgtga

SEQ ID NO: 3050399 - DNA, 12 bp, Homo sapiens
attaaacttgaa

SEQ ID NO: 3050400 - DNA, 13 bp, Homo sapiens
attaaacttgaag

SEQ ID NO: 3050401 - DNA, 22 bp, Homo sapiens
attaaagcttatttttctgtga

SEQ ID NO: 3050402 - DNA, 13 bp, Homo sapiens
attaaatataaat

SEQ ID NO: 3050403 - DNA, 20 bp, Homo sapiens
attaaatcgtttaatgttta

SEQ ID NO: 3050404 - DNA, 15 bp, Homo sapiens
attaaatctgaattt

SEQ ID NO: 3050405 - DNA, 17 bp, Homo sapiens
attaaatgccacttttt

SEQ ID NO: 3050406 - DNA, 19 bp, Homo sapiens
attaaatgccactttttca

SEQ ID NO: 3050407 - DNA, 21 bp, Homo sapiens
attaaatggtgatttcttgct

SEQ ID NO: 3050408 - DNA, 12 bp, Homo sapiens
attaaattacct

SEQ ID NO: 3050409 - DNA, 20 bp, Homo sapiens
atggtcacacactgatgctt

SEQ ID NO: 3050410 - DNA, 17 bp, Homo sapiens
atggtcacgcacctggg

SEQ ID NO: 3050411 - DNA, 16 bp, Homo sapiens
atggtccaggagaagg

SEQ ID NO: 3050412 - DNA, 11 bp, Homo sapiens
atggtcccagg

SEQ ID NO: 3050413 - DNA, 18 bp, Homo sapiens
atggtcccaggaagcagg

SEQ ID NO: 3050414 - DNA, 21 bp, Homo sapiens
atggtcctatttttgtgaaga

SEQ ID NO: 3050415 - DNA, 22 bp, Homo sapiens
atggtcctgtctgtccttctga

SEQ ID NO: 3050416 - DNA, 18 bp, Homo sapiens
atggtgccccaggaccag

SEQ ID NO: 3050417 - DNA, 19 bp, Homo sapiens
atggtgctgcccaggcctc

SEQ ID NO: 3050418 - DNA, 20 bp, Homo sapiens
atggtggactcgcctgtaat

SEQ ID NO: 3050419 - DNA, 13 bp, Homo sapiens
atggtggagggcc

SEQ ID NO: 3050420 - DNA, 17 bp, Homo sapiens
atggtggcttcagctcc

SEQ ID NO: 3050421 - DNA, 23 bp, Homo sapiens
atggtgggcttcagggcaggtgg

SEQ ID NO: 3050422 - DNA, 23 bp, Homo sapiens
atggtggttggttgggttttttg

SEQ ID NO: 3050423 - DNA, 18 bp, Homo sapiens
atggtgtctcttctttag

SEQ ID NO: 3050424 - DNA, 18 bp, Homo sapiens
atggtgtggtgaatgtgt

SEQ ID NO: 3050425 - DNA, 16 bp, Homo sapiens
atggtgtgtttcccta

SEQ ID NO: 3050426 - DNA, 14 bp, Homo sapiens
atggtgttactgca

SEQ ID NO: 3050427 - DNA, 18 bp, Homo sapiens
atggtgttactgcagttg

SEQ ID NO: 3050428 - DNA, 18 bp, Homo sapiens
atggtgtttttcttgtaa

SEQ ID NO: 3050429 - DNA, 22 bp, Homo sapiens
atggtgtttttcttgtaaatgt

SEQ ID NO: 3050430 - DNA, 23 bp, Homo sapiens
atggttaagagtccaagaatcca

SEQ ID NO: 3050431 - DNA, 22 bp, Homo sapiens
atggttgtaacatatgtattcc

SEQ ID NO: 3050432 - DNA, 16 bp, Homo sapiens
atggtttagataaagg

SEQ ID NO: 3050433 - DNA, 14 bp, Homo sapiens
atggtttcctctgg

SEQ ID NO: 3050434 - DNA, 15 bp, Homo sapiens
atggtttcctctgga

SEQ ID NO: 3050435 - DNA, 15 bp, Homo sapiens
atggtttcttgcaag

SEQ ID NO: 3050436 - DNA, 15 bp, Homo sapiens
atggtttgtcctgat

SEQ ID NO: 3050437 - DNA, 16 bp, Homo sapiens
atggtttttaaatttt

SEQ ID NO: 3050438 - DNA, 20 bp, Homo sapiens
atgtaaaaaacaaaaaaaac

SEQ ID NO: 3050439 - DNA, 23 bp, Homo sapiens
atgtaaaaaacaaaaaaaacaac

SEQ ID NO: 3050440 - DNA, 12 bp, Homo sapiens
atgtaaaagaca

SEQ ID NO: 3050441 - DNA, 14 bp, Homo sapiens
atgtaaaagacact

SEQ ID NO: 3050442 - DNA, 21 bp, Homo sapiens
atgtaaaagacactggtgtat

SEQ ID NO: 3050443 - DNA, 22 bp, Homo sapiens
atgtaaaaggccaaacctctgt

SEQ ID NO: 3050444 - DNA, 20 bp, Homo sapiens
atgtaaaatcttcagctggt

SEQ ID NO: 3050445 - DNA, 21 bp, Homo sapiens
atgtaaaatcttcagctggtg

SEQ ID NO: 3050446 - DNA, 23 bp, Homo sapiens
atgtaaaatcttcagctggtgga

SEQ ID NO: 3050447 - DNA, 15 bp, Homo sapiens
atgtaaacagtgcct

SEQ ID NO: 3050448 - DNA, 15 bp, Homo sapiens
atgtaaactcttcac

SEQ ID NO: 3050449 - DNA, 20 bp, Homo sapiens
atgtaaatcgggaaggatgg

SEQ ID NO: 3050450 - DNA, 15 bp, Homo sapiens
atgtaaatttgttga

SEQ ID NO: 3050451 - DNA, 13 bp, Homo sapiens
atgtaacagaaag

SEQ ID NO: 3050452 - DNA, 23 bp, Homo sapiens
atgtaacatgatttccctccaga

SEQ ID NO: 3050453 - DNA, 12 bp, Homo sapiens
atgtaacttgaa

SEQ ID NO: 3050454 - DNA, 15 bp, Homo sapiens
atgtaagattataga

SEQ ID NO: 3050455 - DNA, 19 bp, Homo sapiens
atgtaagattatagattct

SEQ ID NO: 3050456 - DNA, 20 bp, Homo sapiens
atgtaagattatagattcta

SEQ ID NO: 3050457 - DNA, 21 bp, Homo sapiens
atgtaagattatagattctaa

SEQ ID NO: 3050458 - DNA, 16 bp, Homo sapiens
atgtaagcatactttg

SEQ ID NO: 3050459 - DNA, 22 bp, Homo sapiens
atgtaagcatactttgtaaata

SEQ ID NO: 3050460 - DNA, 14 bp, Homo sapiens
atgtaaggaattga

SEQ ID NO: 3050461 - DNA, 14 bp, Homo sapiens
atgtaagtgggccc

SEQ ID NO: 3050462 - DNA, 22 bp, Homo sapiens
atgtaatcggcttgaattttga

SEQ ID NO: 3050463 - DNA, 14 bp, Homo sapiens
atgtaatgatcttg

SEQ ID NO: 3050464 - DNA, 15 bp, Homo sapiens
atgtaatgcaactac

SEQ ID NO: 3050465 - DNA, 18 bp, Homo sapiens
atgtaatgtagttctttg

SEQ ID NO: 3050466 - DNA, 17 bp, Homo sapiens
atgtaattgtaattttg

SEQ ID NO: 3050467 - DNA, 14 bp, Homo sapiens
atgtacaagatgaa

SEQ ID NO: 3050468 - DNA, 16 bp, Homo sapiens
atgtacaaggtatgta

SEQ ID NO: 3050469 - DNA, 18 bp, Homo sapiens
atgtacagtctcaatttt

SEQ ID NO: 3050470 - DNA, 22 bp, Homo sapiens
atgtacagtctcaattttgtat

SEQ ID NO: 3050471 - DNA, 19 bp, Homo sapiens
atgtacatagtaaagtatt

SEQ ID NO: 3050472 - DNA, 15 bp, Homo sapiens
atgtacatgagaagg

SEQ ID NO: 3050473 - DNA, 20 bp, Homo sapiens
atgtacatttccaaattcac

SEQ ID NO: 3050474 - DNA, 15 bp, Homo sapiens
atgtaccccctttcc

SEQ ID NO: 3050475 - DNA, 18 bp, Homo sapiens
atgtacgtccagcctgcc

SEQ ID NO: 3050476 - DNA, 20 bp, Homo sapiens
atgtacgtccagcctgcccc

SEQ ID NO: 3050477 - DNA, 21 bp, Homo sapiens
atgtacgtttgtatgtgtgta

SEQ ID NO: 3050478 - DNA, 20 bp, Homo sapiens
atgtactggagagtggcaaa

SEQ ID NO: 3050479 - DNA, 14 bp, Homo sapiens
atgtactttttagt

SEQ ID NO: 3050480 - DNA, 17 bp, Homo sapiens
atgtagaaacatttaga

SEQ ID NO: 3050481 - DNA, 17 bp, Homo sapiens
atgtagaataaatgaag

SEQ ID NO: 3050482 - DNA, 22 bp, Homo sapiens
atgtagacattatcttttggct

SEQ ID NO: 3050483 - DNA, 21 bp, Homo sapiens
atgtagacattgtaaataaat

SEQ ID NO: 3050484 - DNA, 19 bp, Homo sapiens
atgtagaggggaaaagaga

SEQ ID NO: 3050485 - DNA, 19 bp, Homo sapiens
atgtagataaactcagaaa

SEQ ID NO: 3050486 - DNA, 18 bp, Homo sapiens
atgtagcagcagcctact

SEQ ID NO: 3050487 - DNA, 21 bp, Homo sapiens
atgtagcagcagcctactgag

SEQ ID NO: 3050488 - DNA, 16 bp, Homo sapiens
atgtagcccatccttc

SEQ ID NO: 3050489 - DNA, 18 bp, Homo sapiens
atgtagccccagtcagaa

SEQ ID NO: 3050490 - DNA, 18 bp, Homo sapiens
atgtagccccctggcctc

SEQ ID NO: 3050491 - DNA, 21 bp, Homo sapiens
atgtaggaaaaaaatagtcta

SEQ ID NO: 3050492 - DNA, 22 bp, Homo sapiens
atgtataaaacttgataaatgg

SEQ ID NO: 3050493 - DNA, 19 bp, Homo sapiens
atgtataatgacttttaaa

SEQ ID NO: 3050494 - DNA, 19 bp, Homo sapiens
atgtatacacaaatatata

SEQ ID NO: 3050495 - DNA, 18 bp, Homo sapiens
atgtatacttaatactga

SEQ ID NO: 3050496 - DNA, 19 bp, Homo sapiens
atgtatatatatatatgca

SEQ ID NO: 3050497 - DNA, 14 bp, Homo sapiens
atgtatccagagga

SEQ ID NO: 3050498 - DNA, 15 bp, Homo sapiens
atgtatctctctgtg

SEQ ID NO: 3050499 - DNA, 17 bp, Homo sapiens
atgtatctgtctacttt

SEQ ID NO: 3050500 - DNA, 14 bp, Homo sapiens
atgtatgcagctat

SEQ ID NO: 3050501 - DNA, 14 bp, Homo sapiens
atgtatgcttcata

SEQ ID NO: 3050502 - DNA, 21 bp, Homo sapiens
atgtatgtatgagacagaaac

SEQ ID NO: 3050503 - DNA, 21 bp, Homo sapiens
atgtatgtggatacagtcatt

SEQ ID NO: 3050504 - DNA, 21 bp, Homo sapiens
atgtattaataaatagagcaa

SEQ ID NO: 3050505 - DNA, 18 bp, Homo sapiens
atgtattagccagtcatt

SEQ ID NO: 3050506 - DNA, 22 bp, Homo sapiens
atgtattagtgatatttctcta

SEQ ID NO: 3050507 - DNA, 23 bp, Homo sapiens
atgtattcccttcctctgatttg

SEQ ID NO: 3050508 - DNA, 12 bp, Homo sapiens
atgtattgtacc

SEQ ID NO: 3050509 - DNA, 15 bp, Homo sapiens
atgtattgtaccttt

SEQ ID NO: 3050510 - DNA, 18 bp, Homo sapiens
atgtatttatttaaaaga

SEQ ID NO: 3050511 - DNA, 21 bp, Homo sapiens
atgtatttatttaaaagattc

SEQ ID NO: 3050512 - DNA, 22 bp, Homo sapiens
atgtatttatttaaaagattca

SEQ ID NO: 3050513 - DNA, 14 bp, Homo sapiens
atgtatttcctgaa

SEQ ID NO: 3050514 - DNA, 16 bp, Homo sapiens
atgtatttgatgtctt

SEQ ID NO: 3050515 - DNA, 14 bp, Homo sapiens
atgtattttaaaat

SEQ ID NO: 3050516 - DNA, 15 bp, Homo sapiens
atgtattttaaaata

SEQ ID NO: 3050517 - DNA, 15 bp, Homo sapiens
atgtattttggaaga

SEQ ID NO: 3050518 - DNA, 20 bp, Homo sapiens
atgtattttggaagacatat

SEQ ID NO: 3050519 - DNA, 19 bp, Homo sapiens
atgtatttttcaaaacata

SEQ ID NO: 3050520 - DNA, 21 bp, Homo sapiens
atgtattttttgaatctatga

SEQ ID NO: 3050521 - DNA, 14 bp, Homo sapiens
atggaagcacacaa

SEQ ID NO: 3050522 - DNA, 21 bp, Homo sapiens
atggaagcacacaagtggaga

SEQ ID NO: 3050523 - DNA, 15 bp, Homo sapiens
atggaaggtgccaga

SEQ ID NO: 3050524 - DNA, 23 bp, Homo sapiens
atggaagtaaaggcattccacag

SEQ ID NO: 3050525 - DNA, 18 bp, Homo sapiens
atggaagtatttgagaga

SEQ ID NO: 3050526 - DNA, 20 bp, Homo sapiens
atggaatggttataaaagtg

SEQ ID NO: 3050527 - DNA, 18 bp, Homo sapiens
atggaatgtcagtgttca

SEQ ID NO: 3050528 - DNA, 15 bp, Homo sapiens
atggaattactccaa

SEQ ID NO: 3050529 - DNA, 13 bp, Homo sapiens
atggaattgattt

SEQ ID NO: 3050530 - DNA, 17 bp, Homo sapiens
atggaattgatttgcat

SEQ ID NO: 3050531 - DNA, 21 bp, Homo sapiens
atggaatttataattcagtat

SEQ ID NO: 3050532 - DNA, 13 bp, Homo sapiens
atggaatttcata

SEQ ID NO: 3050533 - DNA, 22 bp, Homo sapiens
atggacaacttatttaaaaata

SEQ ID NO: 3050534 - DNA, 14 bp, Homo sapiens
atggacagattaat

SEQ ID NO: 3050535 - DNA, 16 bp, Homo sapiens
atggacagttagcatt

SEQ ID NO: 3050536 - DNA, 20 bp, Homo sapiens
atggacatcgatatgaaaaa

SEQ ID NO: 3050537 - DNA, 14 bp, Homo sapiens
atggaccccagcat

SEQ ID NO: 3050538 - DNA, 15 bp, Homo sapiens
atggactctgcacat

SEQ ID NO: 3050539 - DNA, 18 bp, Homo sapiens
atggagacgcatttcggt

SEQ ID NO: 3050540 - DNA, 18 bp, Homo sapiens
atggagattctgattcag

SEQ ID NO: 3050541 - DNA, 18 bp, Homo sapiens
atggagccagctccctct

SEQ ID NO: 3050542 - DNA, 11 bp, Homo sapiens
atggaggagaa

SEQ ID NO: 3050543 - DNA, 15 bp, Homo sapiens
atggaggagaagaat

SEQ ID NO: 3050544 - DNA, 22 bp, Homo sapiens
atggaggagacaggaagcctca

SEQ ID NO: 3050545 - DNA, 13 bp, Homo sapiens
atggaggttctaa

SEQ ID NO: 3050546 - DNA, 19 bp, Homo sapiens
atggagtgagacccaggag

SEQ ID NO: 3050547 - DNA, 21 bp, Homo sapiens
atggagtgagacccaggagcc

SEQ ID NO: 3050548 - DNA, 13 bp, Homo sapiens
atggagtttctaa

SEQ ID NO: 3050549 - DNA, 15 bp, Homo sapiens
atggagtttctaagg

SEQ ID NO: 3050550 - DNA, 17 bp, Homo sapiens
atggataaactgagcct

SEQ ID NO: 3050551 - DNA, 20 bp, Homo sapiens
atggatcttttctaaatgtt

SEQ ID NO: 3050552 - DNA, 12 bp, Homo sapiens
atggatgaaacc

SEQ ID NO: 3050553 - DNA, 19 bp, Homo sapiens
atggatgggggaactcaga

SEQ ID NO: 3050554 - DNA, 22 bp, Homo sapiens
atggatgttttagccattgttg

SEQ ID NO: 3050555 - DNA, 16 bp, Homo sapiens
atggattctatttatt

SEQ ID NO: 3050556 - DNA, 20 bp, Homo sapiens
atggattgataattgcattc

SEQ ID NO: 3050557 - DNA, 17 bp, Homo sapiens
atggatttgatgctgtt

SEQ ID NO: 3050558 - DNA, 17 bp, Homo sapiens
atggatttggttatgat

SEQ ID NO: 3050559 - DNA, 22 bp, Homo sapiens
atggatttggttatgatggaaa

SEQ ID NO: 3050560 - DNA, 20 bp, Homo sapiens
atggattttagtcaaatatt

SEQ ID NO: 3050561 - DNA, 22 bp, Homo sapiens
atggcaagttgccattttgtaa

SEQ ID NO: 3050562 - DNA, 19 bp, Homo sapiens
atggcacgttgctgccagt

SEQ ID NO: 3050563 - DNA, 20 bp, Homo sapiens
atggcactccctccagcaca

SEQ ID NO: 3050564 - DNA, 23 bp, Homo sapiens
atggcactccctccagcacaaac

SEQ ID NO: 3050565 - DNA, 15 bp, Homo sapiens
atggcagaaggcaaa

SEQ ID NO: 3050566 - DNA, 21 bp, Homo sapiens
atggcagaaggcaaacccatc

SEQ ID NO: 3050567 - DNA, 13 bp, Homo sapiens
atggcagaaggga

SEQ ID NO: 3050568 - DNA, 19 bp, Homo sapiens
atggcagagtttgtgtgtt

SEQ ID NO: 3050569 - DNA, 13 bp, Homo sapiens
atggcagctgggc

SEQ ID NO: 3050570 - DNA, 16 bp, Homo sapiens
atggcatcctgtgaag

SEQ ID NO: 3050571 - DNA, 20 bp, Homo sapiens
atggcatcttcgtcttcact

SEQ ID NO: 3050572 - DNA, 17 bp, Homo sapiens
atggcatgagaaataca

SEQ ID NO: 3050573 - DNA, 21 bp, Homo sapiens
atggcatgcgccaccatgccc

SEQ ID NO: 3050574 - DNA, 18 bp, Homo sapiens
atggccacactgtgacac

SEQ ID NO: 3050575 - DNA, 22 bp, Homo sapiens
atggccacactgtgacacacta

SEQ ID NO: 3050576 - DNA, 23 bp, Homo sapiens
atggccacactgtgacacactac

SEQ ID NO: 3050577 - DNA, 17 bp, Homo sapiens
atggccaccttttcagc

SEQ ID NO: 3050578 - DNA, 13 bp, Homo sapiens
atggccctgggcg

SEQ ID NO: 3050579 - DNA, 15 bp, Homo sapiens
atggcctaaatttat

SEQ ID NO: 3050580 - DNA, 22 bp, Homo sapiens
atggccttccacgtcttcctcc

SEQ ID NO: 3050581 - DNA, 20 bp, Homo sapiens
atggcgccaccagctctgcc

SEQ ID NO: 3050582 - DNA, 20 bp, Homo sapiens
atggcgtagagggtgctgcc

SEQ ID NO: 3050583 - DNA, 24 bp, Homo sapiens
atggcgtccgtgggttgctaactg

SEQ ID NO: 3050584 - DNA, 15 bp, Homo sapiens
atggcgttggtttgt

SEQ ID NO: 3050585 - DNA, 11 bp, Homo sapiens
atggctggggg

SEQ ID NO: 3050586 - DNA, 15 bp, Homo sapiens
atggctgggtccttg

SEQ ID NO: 3050587 - DNA, 16 bp, Homo sapiens
atggctgtggagtgtg

SEQ ID NO: 3050588 - DNA, 13 bp, Homo sapiens
atggcttcctgag

SEQ ID NO: 3050589 - DNA, 21 bp, Homo sapiens
atggcttctcctttggcatgt

SEQ ID NO: 3050590 - DNA, 20 bp, Homo sapiens
atggctttcatcctgtgtcc

SEQ ID NO: 3050591 - DNA, 17 bp, Homo sapiens
atggctttgtcttgaaa

SEQ ID NO: 3050592 - DNA, 18 bp, Homo sapiens
atggctttgtcttgaaaa

SEQ ID NO: 3050593 - DNA, 21 bp, Homo sapiens
atggctttgtcttgaaaaaaa

SEQ ID NO: 3050594 - DNA, 13 bp, Homo sapiens
atgggaaaaactg

SEQ ID NO: 3050595 - DNA, 18 bp, Homo sapiens
atgggaaaaactgcagtc

SEQ ID NO: 3050596 - DNA, 12 bp, Homo sapiens
atgggaaaagag

SEQ ID NO: 3050597 - DNA, 12 bp, Homo sapiens
atgggaaacaaa

SEQ ID NO: 3050598 - DNA, 20 bp, Homo sapiens
atgggaaagagaaagagaca

SEQ ID NO: 3050599 - DNA, 21 bp, Homo sapiens
atgggaaagtattctgtactc

SEQ ID NO: 3050600 - DNA, 15 bp, Homo sapiens
atgggaacatttatt

SEQ ID NO: 3050601 - DNA, 23 bp, Homo sapiens
atgggaactgatgtagaaggcag

SEQ ID NO: 3050602 - DNA, 13 bp, Homo sapiens
atgggaagcaata

SEQ ID NO: 3050603 - DNA, 13 bp, Homo sapiens
atgggaatgaagc

SEQ ID NO: 3050604 - DNA, 19 bp, Homo sapiens
atgggacaaattgcacaga

SEQ ID NO: 3050605 - DNA, 13 bp, Homo sapiens
atgggacttcttt

SEQ ID NO: 3050606 - DNA, 23 bp, Homo sapiens
atgggacttcttttcacattctt

SEQ ID NO: 3050607 - DNA, 17 bp, Homo sapiens
atgggagaatcagcaga

SEQ ID NO: 3050608 - DNA, 22 bp, Homo sapiens
atgggagaatcagcagaacctg

SEQ ID NO: 3050609 - DNA, 14 bp, Homo sapiens
atgggagagtcaag

SEQ ID NO: 3050610 - DNA, 19 bp, Homo sapiens
atgggagagtgtcaaccag

SEQ ID NO: 3050611 - DNA, 20 bp, Homo sapiens
atgggagccgggtctgcctc

SEQ ID NO: 3050612 - DNA, 23 bp, Homo sapiens
atgggaggctcacccccttctcc

SEQ ID NO: 3050613 - DNA, 15 bp, Homo sapiens
atgggatcatgaaag

SEQ ID NO: 3050614 - DNA, 14 bp, Homo sapiens
atgggattctggac

SEQ ID NO: 3050615 - DNA, 14 bp, Homo sapiens
atgggcagagccca

SEQ ID NO: 3050616 - DNA, 10 bp, Homo sapiens
atgggcaggt

SEQ ID NO: 3050617 - DNA, 12 bp, Homo sapiens
atgggcaggtgg

SEQ ID NO: 3050618 - DNA, 21 bp, Homo sapiens
atgggcaggtggcctctgctg

SEQ ID NO: 3050619 - DNA, 14 bp, Homo sapiens
atgggcagttacat

SEQ ID NO: 3050620 - DNA, 19 bp, Homo sapiens
atgggcagttacatgcata

SEQ ID NO: 3050621 - DNA, 12 bp, Homo sapiens
atgggccaccgg

SEQ ID NO: 3050622 - DNA, 20 bp, Homo sapiens
atgggccagcccctccatct

SEQ ID NO: 3050623 - DNA, 20 bp, Homo sapiens
atgggccctatgtctcagga

SEQ ID NO: 3050624 - DNA, 22 bp, Homo sapiens
atgccgtgtgtctcgtctcctg

SEQ ID NO: 3050625 - DNA, 22 bp, Homo sapiens
atgcctaccgggttctcctgat

SEQ ID NO: 3050626 - DNA, 19 bp, Homo sapiens
atgcctagcacaagtacca

SEQ ID NO: 3050627 - DNA, 17 bp, Homo sapiens
atgcctataaaatgccc

SEQ ID NO: 3050628 - DNA, 20 bp, Homo sapiens
atgcctcactaatttttgta

SEQ ID NO: 3050629 - DNA, 20 bp, Homo sapiens
atgcctcagccctgaccctg

SEQ ID NO: 3050630 - DNA, 21 bp, Homo sapiens
atgcctcagtagcatctcagt

SEQ ID NO: 3050631 - DNA, 18 bp, Homo sapiens
atgcctcataaattaatg

SEQ ID NO: 3050632 - DNA, 20 bp, Homo sapiens
atgcctcataaattaatgat

SEQ ID NO: 3050633 - DNA, 20 bp, Homo sapiens
atgcctctcctttgtatatt

SEQ ID NO: 3050634 - DNA, 12 bp, Homo sapiens
atgcctctgagc

SEQ ID NO: 3050635 - DNA, 19 bp, Homo sapiens
atgcctctgtcttctggac

SEQ ID NO: 3050636 - DNA, 17 bp, Homo sapiens
atgcctgattttaaaag

SEQ ID NO: 3050637 - DNA, 23 bp, Homo sapiens
atgcctgcccgcaccctggcctg

SEQ ID NO: 3050638 - DNA, 18 bp, Homo sapiens
atgcctggaagctttgtc

SEQ ID NO: 3050639 - DNA, 17 bp, Homo sapiens
atgcctgggattgggaa

SEQ ID NO: 3050640 - DNA, 20 bp, Homo sapiens
atgcctgtaatcccagaact

SEQ ID NO: 3050641 - DNA, 18 bp, Homo sapiens
atgcctgtaattcagtgt

SEQ ID NO: 3050642 - DNA, 15 bp, Homo sapiens
atgcctgtggctgcg

SEQ ID NO: 3050643 - DNA, 22 bp, Homo sapiens
atgccttgcaatggatcagcca

SEQ ID NO: 3050644 - DNA, 16 bp, Homo sapiens
atgcctttttgtttac

SEQ ID NO: 3050645 - DNA, 18 bp, Homo sapiens
atgcgattttattactgg

SEQ ID NO: 3050646 - DNA, 16 bp, Homo sapiens
atgcgccaccatgccc

SEQ ID NO: 3050647 - DNA, 17 bp, Homo sapiens
atgcgggcattttgaat

SEQ ID NO: 3050648 - DNA, 14 bp, Homo sapiens
atgcggggacaggc

SEQ ID NO: 3050649 - DNA, 15 bp, Homo sapiens
atgcggggacaggct

SEQ ID NO: 3050650 - DNA, 14 bp, Homo sapiens
atgcggtagccagc

SEQ ID NO: 3050651 - DNA, 17 bp, Homo sapiens
atgcgtattctgtggcc

SEQ ID NO: 3050652 - DNA, 18 bp, Homo sapiens
atgcgtattctgtggccg

SEQ ID NO: 3050653 - DNA, 14 bp, Homo sapiens
atgctaaataacta

SEQ ID NO: 3050654 - DNA, 19 bp, Homo sapiens
atgctaaattattatttag

SEQ ID NO: 3050655 - DNA, 18 bp, Homo sapiens
atgctacaggatttgaaa

SEQ ID NO: 3050656 - DNA, 16 bp, Homo sapiens
atgctacccagccatt

SEQ ID NO: 3050657 - DNA, 14 bp, Homo sapiens
atgctacgtgtgat

SEQ ID NO: 3050658 - DNA, 15 bp, Homo sapiens
atgctacgtgtgatt

SEQ ID NO: 3050659 - DNA, 20 bp, Homo sapiens
atgctactgtctcactgaaa

SEQ ID NO: 3050660 - DNA, 23 bp, Homo sapiens
atgctactgtctcactgaaacat

SEQ ID NO: 3050661 - DNA, 13 bp, Homo sapiens
atgctacttccca

SEQ ID NO: 3050662 - DNA, 18 bp, Homo sapiens
atgctacttcccactgta

SEQ ID NO: 3050663 - DNA, 18 bp, Homo sapiens
atgctacttttacttgtt

SEQ ID NO: 3050664 - DNA, 16 bp, Homo sapiens
atgctaggcctgtagt

SEQ ID NO: 3050665 - DNA, 13 bp, Homo sapiens
atgctataaattt

SEQ ID NO: 3050666 - DNA, 20 bp, Homo sapiens
atgctataaattttttgaaa

SEQ ID NO: 3050667 - DNA, 17 bp, Homo sapiens
atgctatttcagccaat

SEQ ID NO: 3050668 - DNA, 13 bp, Homo sapiens
atgctatttgaac

SEQ ID NO: 3050669 - DNA, 19 bp, Homo sapiens
atgctcaaagatgtaatgt

SEQ ID NO: 3050670 - DNA, 16 bp, Homo sapiens
atgctcaatttcagca

SEQ ID NO: 3050671 - DNA, 17 bp, Homo sapiens
atgctcagaccagctct

SEQ ID NO: 3050672 - DNA, 17 bp, Homo sapiens
atgctcagtacctgtgt

SEQ ID NO: 3050673 - DNA, 15 bp, Homo sapiens
atgctccaagattct

SEQ ID NO: 3050674 - DNA, 18 bp, Homo sapiens
atgctccaagattctaga

SEQ ID NO: 3050675 - DNA, 20 bp, Homo sapiens
atgctccatcccattcactt

SEQ ID NO: 3050676 - DNA, 18 bp, Homo sapiens
atgctcccaactcccttc

SEQ ID NO: 3050677 - DNA, 21 bp, Homo sapiens
atgctcccaactcccttctgc

SEQ ID NO: 3050678 - DNA, 15 bp, Homo sapiens
atgctccttgggccc

SEQ ID NO: 3050679 - DNA, 16 bp, Homo sapiens
atgctccttgggccct

SEQ ID NO: 3050680 - DNA, 16 bp, Homo sapiens
atgctctagtgccttc

SEQ ID NO: 3050681 - DNA, 22 bp, Homo sapiens
atgctctcactgtttgttttta

SEQ ID NO: 3050682 - DNA, 13 bp, Homo sapiens
atgctctctgcag

SEQ ID NO: 3050683 - DNA, 15 bp, Homo sapiens
atgctgaaataaact

SEQ ID NO: 3050684 - DNA, 17 bp, Homo sapiens
atgctgaaataaactag

SEQ ID NO: 3050685 - DNA, 19 bp, Homo sapiens
atgctgacattcacctgcc

SEQ ID NO: 3050686 - DNA, 20 bp, Homo sapiens
atgctgacattcacctgccc

SEQ ID NO: 3050687 - DNA, 22 bp, Homo sapiens
atgctgacattcacctgcccca

SEQ ID NO: 3050688 - DNA, 22 bp, Homo sapiens
atgctgacctcacctggtcctc

SEQ ID NO: 3050689 - DNA, 20 bp, Homo sapiens
atgctgagggtgtttcttcc

SEQ ID NO: 3050690 - DNA, 23 bp, Homo sapiens
atgctgagggtgtttcttcctgc

SEQ ID NO: 3050691 - DNA, 16 bp, Homo sapiens
atgctgatatttactg

SEQ ID NO: 3050692 - DNA, 12 bp, Homo sapiens
atgctgatcatc

SEQ ID NO: 3050693 - DNA, 14 bp, Homo sapiens
atgctgatcatcgc

SEQ ID NO: 3050694 - DNA, 20 bp, Homo sapiens
atgctgatgttcagtgtaat

SEQ ID NO: 3050695 - DNA, 22 bp, Homo sapiens
atgctgatgttcagtgtaattt

SEQ ID NO: 3050696 - DNA, 21 bp, Homo sapiens
atgctgcccagggtcagtgta

SEQ ID NO: 3050697 - DNA, 22 bp, Homo sapiens
atgctgcccagggtcagtgtat

SEQ ID NO: 3050698 - DNA, 12 bp, Homo sapiens
atgctgctggcc

SEQ ID NO: 3050699 - DNA, 16 bp, Homo sapiens
atgctgcttttatatc

SEQ ID NO: 3050700 - DNA, 21 bp, Homo sapiens
atgctgcttttatatctgtat

SEQ ID NO: 3050701 - DNA, 16 bp, Homo sapiens
atgctggaggccctcg

SEQ ID NO: 3050702 - DNA, 22 bp, Homo sapiens
atgctggatgtctgccaatttt

SEQ ID NO: 3050703 - DNA, 16 bp, Homo sapiens
atgctggcatctctgc

SEQ ID NO: 3050704 - DNA, 13 bp, Homo sapiens
atgctggcccagg

SEQ ID NO: 3050705 - DNA, 20 bp, Homo sapiens
atgctggcccagggcccaga

SEQ ID NO: 3050706 - DNA, 21 bp, Homo sapiens
atgctggcccagggcccagag

SEQ ID NO: 3050707 - DNA, 20 bp, Homo sapiens
atgctggggtacacagtgag

SEQ ID NO: 3050708 - DNA, 16 bp, Homo sapiens
atgctgtacatctatt

SEQ ID NO: 3050709 - DNA, 19 bp, Homo sapiens
atgctgtattcttctttgg

SEQ ID NO: 3050710 - DNA, 13 bp, Homo sapiens
atgctgtctttgt

SEQ ID NO: 3050711 - DNA, 12 bp, Homo sapiens
atgctgtgaata

SEQ ID NO: 3050712 - DNA, 12 bp, Homo sapiens
atgctgtgcaaa

SEQ ID NO: 3050713 - DNA, 17 bp, Homo sapiens
atgctgtgcaaacagtg

SEQ ID NO: 3050714 - DNA, 14 bp, Homo sapiens
atgctgtgcctggc

SEQ ID NO: 3050715 - DNA, 12 bp, Homo sapiens
atgctgtgctac

SEQ ID NO: 3050716 - DNA, 13 bp, Homo sapiens
atgctgtgctacg

SEQ ID NO: 3050717 - DNA, 14 bp, Homo sapiens
atgattaaagaaaa

SEQ ID NO: 3050718 - DNA, 17 bp, Homo sapiens
atgattaaataagattc

SEQ ID NO: 3050719 - DNA, 18 bp, Homo sapiens
atgattaaataagattct

SEQ ID NO: 3050720 - DNA, 14 bp, Homo sapiens
atgattaatcagct

SEQ ID NO: 3050721 - DNA, 17 bp, Homo sapiens
atgattaatcagctgtt

SEQ ID NO: 3050722 - DNA, 23 bp, Homo sapiens
atgattaatcagctgttgcaggc

SEQ ID NO: 3050723 - DNA, 23 bp, Homo sapiens
atgattagcaagttacagtgatg

SEQ ID NO: 3050724 - DNA, 23 bp, Homo sapiens
atgattagcagaagaaaggaaca

SEQ ID NO: 3050725 - DNA, 22 bp, Homo sapiens
atgattcaggtgcagaggaagt

SEQ ID NO: 3050726 - DNA, 18 bp, Homo sapiens
atgattcccttttcttta

SEQ ID NO: 3050727 - DNA, 19 bp, Homo sapiens
atgattctagtacataatt

SEQ ID NO: 3050728 - DNA, 22 bp, Homo sapiens
atgattctagtacataattgat

SEQ ID NO: 3050729 - DNA, 13 bp, Homo sapiens
atgattctctgtg

SEQ ID NO: 3050730 - DNA, 23 bp, Homo sapiens
atgattctcttagacacttttat

SEQ ID NO: 3050731 - DNA, 12 bp, Homo sapiens
atgattctgaag

SEQ ID NO: 3050732 - DNA, 13 bp, Homo sapiens
atgatttaaaaca

SEQ ID NO: 3050733 - DNA, 16 bp, Homo sapiens
atgatttccttgaatg

SEQ ID NO: 3050734 - DNA, 17 bp, Homo sapiens
atgatttccttgaatgt

SEQ ID NO: 3050735 - DNA, 18 bp, Homo sapiens
atgatttccttgaatgtg

SEQ ID NO: 3050736 - DNA, 17 bp, Homo sapiens
atgatttgttttgaatt

SEQ ID NO: 3050737 - DNA, 21 bp, Homo sapiens
atgatttgttttgaattttgt

SEQ ID NO: 3050738 - DNA, 15 bp, Homo sapiens
atgatttttgtcatc

SEQ ID NO: 3050739 - DNA, 18 bp, Homo sapiens
atgattttttaagtctat

SEQ ID NO: 3050740 - DNA, 23 bp, Homo sapiens
atgcaaaaaaaaaaaaagcaatt

SEQ ID NO: 3050741 - DNA, 18 bp, Homo sapiens
atgcaaaagcaatcatag

SEQ ID NO: 3050742 - DNA, 14 bp, Homo sapiens
atgcaaaaggttta

SEQ ID NO: 3050743 - DNA, 16 bp, Homo sapiens
atgcaaatagcaaaac

SEQ ID NO: 3050744 - DNA, 11 bp, Homo sapiens
atgcaaatcct

SEQ ID NO: 3050745 - DNA, 18 bp, Homo sapiens
atgcaaatcctatgtgat

SEQ ID NO: 3050746 - DNA, 17 bp, Homo sapiens
atgcaaccaaaagggaa

SEQ ID NO: 3050747 - DNA, 18 bp, Homo sapiens
atgcaaccaaaagggaaa

SEQ ID NO: 3050748 - DNA, 21 bp, Homo sapiens
atgcaagcagaggaccagggc

SEQ ID NO: 3050749 - DNA, 22 bp, Homo sapiens
atgcaagcagaggaccagggcc

SEQ ID NO: 3050750 - DNA, 23 bp, Homo sapiens
atgcaagcagaggaccagggcct

SEQ ID NO: 3050751 - DNA, 17 bp, Homo sapiens
atgcaaggattacagaa

SEQ ID NO: 3050752 - DNA, 18 bp, Homo sapiens
atgcaaggattacagaaa

SEQ ID NO: 3050753 - DNA, 22 bp, Homo sapiens
atgcaatatgtttatcaactca

SEQ ID NO: 3050754 - DNA, 13 bp, Homo sapiens
atgcaatgtgcta

SEQ ID NO: 3050755 - DNA, 16 bp, Homo sapiens
atgcaatgtgctactg

SEQ ID NO: 3050756 - DNA, 15 bp, Homo sapiens
atgcacacagcggct

SEQ ID NO: 3050757 - DNA, 21 bp, Homo sapiens
atgcacacagtgctttccgtg

SEQ ID NO: 3050758 - DNA, 15 bp, Homo sapiens
atgcacacggctggt

SEQ ID NO: 3050759 - DNA, 24 bp, Homo sapiens
atgcacacggctggtcactctgcc

SEQ ID NO: 3050760 - DNA, 14 bp, Homo sapiens
atgcacatccctgg

SEQ ID NO: 3050761 - DNA, 18 bp, Homo sapiens
atgcacccctggaaccag

SEQ ID NO: 3050762 - DNA, 20 bp, Homo sapiens
atgcaccctcatacacagaa

SEQ ID NO: 3050763 - DNA, 20 bp, Homo sapiens
atgcacctgcaatcccagct

SEQ ID NO: 3050764 - DNA, 21 bp, Homo sapiens
atgcaccttgtgtctgtacac

SEQ ID NO: 3050765 - DNA, 18 bp, Homo sapiens
atgcacggtttctgttct

SEQ ID NO: 3050766 - DNA, 20 bp, Homo sapiens
atgcacggtttctgttctgc

SEQ ID NO: 3050767 - DNA, 22 bp, Homo sapiens
atgcacggtttctgttctgccc

SEQ ID NO: 3050768 - DNA, 13 bp, Homo sapiens
atgcactgtgaag

SEQ ID NO: 3050769 - DNA, 19 bp, Homo sapiens
atgcactgtgaaggaccct

SEQ ID NO: 3050770 - DNA, 15 bp, Homo sapiens
atgcagaaaaagaaa

SEQ ID NO: 3050771 - DNA, 21 bp, Homo sapiens
atgcagaacaggcagaaatat

SEQ ID NO: 3050772 - DNA, 22 bp, Homo sapiens
atgcagaacaggcagaaatata

SEQ ID NO: 3050773 - DNA, 13 bp, Homo sapiens
atgcagaagcaat

SEQ ID NO: 3050774 - DNA, 14 bp, Homo sapiens
atgcagaagtattc

SEQ ID NO: 3050775 - DNA, 17 bp, Homo sapiens
atgcagaggaggagaaa

SEQ ID NO: 3050776 - DNA, 20 bp, Homo sapiens
atgcagagtaagtattatgc

SEQ ID NO: 3050777 - DNA, 19 bp, Homo sapiens
atgcagagttgacatgaga

SEQ ID NO: 3050778 - DNA, 22 bp, Homo sapiens
atgcagattttgcccttgacaa

SEQ ID NO: 3050779 - DNA, 18 bp, Homo sapiens
atgcagcactgctgcctc

SEQ ID NO: 3050780 - DNA, 11 bp, Homo sapiens
atgcagcccac

SEQ ID NO: 3050781 - DNA, 17 bp, Homo sapiens
atgcagcccaccaggag

SEQ ID NO: 3050782 - DNA, 20 bp, Homo sapiens
atgcagcgccgtgtcctctc

SEQ ID NO: 3050783 - DNA, 23 bp, Homo sapiens
atgcagcggtgtggaccgaggaa

SEQ ID NO: 3050784 - DNA, 17 bp, Homo sapiens
atgcaggaaggaaaact

SEQ ID NO: 3050785 - DNA, 15 bp, Homo sapiens
atgcaggctcccctg

SEQ ID NO: 3050786 - DNA, 16 bp, Homo sapiens
atgcaggctcccctga

SEQ ID NO: 3050787 - DNA, 21 bp, Homo sapiens
atgcaggtcgctactggcata

SEQ ID NO: 3050788 - DNA, 22 bp, Homo sapiens
atgcaggtttgaccaggaaagc

SEQ ID NO: 3050789 - DNA, 23 bp, Homo sapiens
atgcaggtttgaccaggaaagca

SEQ ID NO: 3050790 - DNA, 17 bp, Homo sapiens
atgcagtagcactttgg

SEQ ID NO: 3050791 - DNA, 19 bp, Homo sapiens
atgcagtctgtccaggctc

SEQ ID NO: 3050792 - DNA, 20 bp, Homo sapiens
atgcagtctgtccaggctcg

SEQ ID NO: 3050793 - DNA, 13 bp, Homo sapiens
atgcagtttgaaa

SEQ ID NO: 3050794 - DNA, 10 bp, Homo sapiens
atgcatacac

SEQ ID NO: 3050795 - DNA, 12 bp, Homo sapiens
atgcatacacac

SEQ ID NO: 3050796 - DNA, 14 bp, Homo sapiens
atgcatacacacac

SEQ ID NO: 3050797 - DNA, 23 bp, Homo sapiens
atgcatacacacacacacacagc

SEQ ID NO: 3050798 - DNA, 17 bp, Homo sapiens
atgcatattcaacacac

SEQ ID NO: 3050799 - DNA, 17 bp, Homo sapiens
atgcatcaagaactatt

SEQ ID NO: 3050800 - DNA, 15 bp, Homo sapiens
atgaatgtatttatt

SEQ ID NO: 3050801 - DNA, 22 bp, Homo sapiens
atgaatgtcttttttcaaactt

SEQ ID NO: 3050802 - DNA, 14 bp, Homo sapiens
atgaattcatactc

SEQ ID NO: 3050803 - DNA, 23 bp, Homo sapiens
atgaattcatactctgttgcctc

SEQ ID NO: 3050804 - DNA, 22 bp, Homo sapiens
atgaattcccttttaatcaact

SEQ ID NO: 3050805 - DNA, 23 bp, Homo sapiens
atgaattcgatgcgtattctgtg

SEQ ID NO: 3050806 - DNA, 13 bp, Homo sapiens
atgaattgaaatt

SEQ ID NO: 3050807 - DNA, 15 bp, Homo sapiens
atgaattttaagggt

SEQ ID NO: 3050808 - DNA, 16 bp, Homo sapiens
atgaattttaagggtt

SEQ ID NO: 3050809 - DNA, 22 bp, Homo sapiens
atgaattttcaagtaattgtga

SEQ ID NO: 3050810 - DNA, 22 bp, Homo sapiens
atgaatttttttcatcttctct

SEQ ID NO: 3050811 - DNA, 15 bp, Homo sapiens
atgacaaaagtgaca

SEQ ID NO: 3050812 - DNA, 13 bp, Homo sapiens
atgacaagatggt

SEQ ID NO: 3050813 - DNA, 13 bp, Homo sapiens
atgacaagcattt

SEQ ID NO: 3050814 - DNA, 14 bp, Homo sapiens
atgacaatcaaagc

SEQ ID NO: 3050815 - DNA, 21 bp, Homo sapiens
atgacagtccgtcaaaacaga

SEQ ID NO: 3050816 - DNA, 22 bp, Homo sapiens
atgacagtccgtcaaaacagat

SEQ ID NO: 3050817 - DNA, 16 bp, Homo sapiens
atgacatcaaaatgag

SEQ ID NO: 3050818 - DNA, 20 bp, Homo sapiens
atgacatggaggcactgaag

SEQ ID NO: 3050819 - DNA, 13 bp, Homo sapiens
atgacattgctaa

SEQ ID NO: 3050820 - DNA, 14 bp, Homo sapiens
atgacattgctaag

SEQ ID NO: 3050821 - DNA, 18 bp, Homo sapiens
atgacatttatttttcat

SEQ ID NO: 3050822 - DNA, 13 bp, Homo sapiens
atgacattttaaa

SEQ ID NO: 3050823 - DNA, 19 bp, Homo sapiens
atgaccagaaacagggaca

SEQ ID NO: 3050824 - DNA, 14 bp, Homo sapiens
atgaccagagcaaa

SEQ ID NO: 3050825 - DNA, 15 bp, Homo sapiens
atgaccagagcaaaa

SEQ ID NO: 3050826 - DNA, 18 bp, Homo sapiens
atgaccagatgcgtccca

SEQ ID NO: 3050827 - DNA, 19 bp, Homo sapiens
atgacccctaccccctcat

SEQ ID NO: 3050828 - DNA, 16 bp, Homo sapiens
atgaccctctgtcccc

SEQ ID NO: 3050829 - DNA, 20 bp, Homo sapiens
atgacctcattaaccgatgc

SEQ ID NO: 3050830 - DNA, 23 bp, Homo sapiens
atgacgagacctcagatgtgttg

SEQ ID NO: 3050831 - DNA, 19 bp, Homo sapiens
atgacgggttgtgagactt

SEQ ID NO: 3050832 - DNA, 16 bp, Homo sapiens
atgactggcattttat

SEQ ID NO: 3050833 - DNA, 20 bp, Homo sapiens
atgactggcattttatagac

SEQ ID NO: 3050834 - DNA, 19 bp, Homo sapiens
atgactgtttttcggacag

SEQ ID NO: 3050835 - DNA, 21 bp, Homo sapiens
atgactgtttttcggacagtt

SEQ ID NO: 3050836 - DNA, 20 bp, Homo sapiens
atgacttcagagtacatcca

SEQ ID NO: 3050837 - DNA, 13 bp, Homo sapiens
atgactttgcaga

SEQ ID NO: 3050838 - DNA, 21 bp, Homo sapiens
atgacttttaaaatttgtaga

SEQ ID NO: 3050839 - DNA, 18 bp, Homo sapiens
atgagaaaggacagagcc

SEQ ID NO: 3050840 - DNA, 19 bp, Homo sapiens
atgagaaaggacagagcca

SEQ ID NO: 3050841 - DNA, 11 bp, Homo sapiens
atgagaaatgt

SEQ ID NO: 3050842 - DNA, 15 bp, Homo sapiens
atgagaaatgtaatg

SEQ ID NO: 3050843 - DNA, 16 bp, Homo sapiens
atgagaactggttctt

SEQ ID NO: 3050844 - DNA, 18 bp, Homo sapiens
atgagaactggttcttgc

SEQ ID NO: 3050845 - DNA, 21 bp, Homo sapiens
atgagaagaaaatggaaccag

SEQ ID NO: 3050846 - DNA, 22 bp, Homo sapiens
atgagaagatcctgtcacaatt

SEQ ID NO: 3050847 - DNA, 23 bp, Homo sapiens
atgagaagtactttgtgctgatc

SEQ ID NO: 3050848 - DNA, 21 bp, Homo sapiens
atgagacccttacgtgattgt

SEQ ID NO: 3050849 - DNA, 17 bp, Homo sapiens
atgagactgatccctgg

SEQ ID NO: 3050850 - DNA, 23 bp, Homo sapiens
atgagactgatccctggccactg

SEQ ID NO: 3050851 - DNA, 16 bp, Homo sapiens
atgagacttaattttg

SEQ ID NO: 3050852 - DNA, 21 bp, Homo sapiens
atgagacttaattttgtcttt

SEQ ID NO: 3050853 - DNA, 14 bp, Homo sapiens
atgagatgctggct

SEQ ID NO: 3050854 - DNA, 15 bp, Homo sapiens
atgagatgctggctt

SEQ ID NO: 3050855 - DNA, 15 bp, Homo sapiens
atgagattcagtgaa

SEQ ID NO: 3050856 - DNA, 19 bp, Homo sapiens
atgagattcagtgaactaa

SEQ ID NO: 3050857 - DNA, 16 bp, Homo sapiens
atgagattttttttaa

SEQ ID NO: 3050858 - DNA, 20 bp, Homo sapiens
atgagcatctcaaatgtttt

SEQ ID NO: 3050859 - DNA, 19 bp, Homo sapiens
atgagccatgatttcccac

SEQ ID NO: 3050860 - DNA, 15 bp, Homo sapiens
atgagcctgtttatt

SEQ ID NO: 3050861 - DNA, 15 bp, Homo sapiens
atgagctaaaaatat

SEQ ID NO: 3050862 - DNA, 22 bp, Homo sapiens
atgagctacttcttattcactt

SEQ ID NO: 3050863 - DNA, 21 bp, Homo sapiens
atgagctcgcatttgtcaatg

SEQ ID NO: 3050864 - DNA, 17 bp, Homo sapiens
atgagcttagggtgttt

SEQ ID NO: 3050865 - DNA, 21 bp, Homo sapiens
atgaggaacaatcacaaaagc

SEQ ID NO: 3050866 - DNA, 16 bp, Homo sapiens
atgaggaatagttttc

SEQ ID NO: 3050867 - DNA, 19 bp, Homo sapiens
atgaggacagagggcacat

SEQ ID NO: 3050868 - DNA, 17 bp, Homo sapiens
atgaggaccagggtgga

SEQ ID NO: 3050869 - DNA, 19 bp, Homo sapiens
atgaggagagaaaatatat

SEQ ID NO: 3050870 - DNA, 13 bp, Homo sapiens
atgaggaggatgc

SEQ ID NO: 3050871 - DNA, 22 bp, Homo sapiens
atgaggatctgaaaacttggct

SEQ ID NO: 3050872 - DNA, 19 bp, Homo sapiens
atgagggcagaaaccttgt

SEQ ID NO: 3050873 - DNA, 12 bp, Homo sapiens
atcttccctgcc

SEQ ID NO: 3050874 - DNA, 16 bp, Homo sapiens
atcttcgtcttcactc

SEQ ID NO: 3050875 - DNA, 21 bp, Homo sapiens
atcttctaaacccaatccaaa

SEQ ID NO: 3050876 - DNA, 23 bp, Homo sapiens
atcttctcaagttctaagattct

SEQ ID NO: 3050877 - DNA, 19 bp, Homo sapiens
atcttctccccgaggctgc

SEQ ID NO: 3050878 - DNA, 21 bp, Homo sapiens
atcttctccccgaggctgccc

SEQ ID NO: 3050879 - DNA, 22 bp, Homo sapiens
atcttctccccgaggctgcccc

SEQ ID NO: 3050880 - DNA, 14 bp, Homo sapiens
atcttcttcaccat

SEQ ID NO: 3050881 - DNA, 22 bp, Homo sapiens
atcttctttggacttctgaaga

SEQ ID NO: 3050882 - DNA, 17 bp, Homo sapiens
atcttgaccaagcagga

SEQ ID NO: 3050883 - DNA, 21 bp, Homo sapiens
atcttgaccaagcaggaagct

SEQ ID NO: 3050884 - DNA, 22 bp, Homo sapiens
atcttgaccaagcaggaagctc

SEQ ID NO: 3050885 - DNA, 16 bp, Homo sapiens
atcttgaggtggtagt

SEQ ID NO: 3050886 - DNA, 15 bp, Homo sapiens
atcttgcagttttgt

SEQ ID NO: 3050887 - DNA, 20 bp, Homo sapiens
atcttgcatggcattaattg

SEQ ID NO: 3050888 - DNA, 24 bp, Homo sapiens
atcttgcccctccagagacaggaa

SEQ ID NO: 3050889 - DNA, 21 bp, Homo sapiens
atcttgcctccaggtgcagag

SEQ ID NO: 3050890 - DNA, 22 bp, Homo sapiens
atcttgctctgtaatctcgttt

SEQ ID NO: 3050891 - DNA, 17 bp, Homo sapiens
atcttgcttccaagacc

SEQ ID NO: 3050892 - DNA, 16 bp, Homo sapiens
atcttgctttggagga

SEQ ID NO: 3050893 - DNA, 14 bp, Homo sapiens
atcttgggtttcta

SEQ ID NO: 3050894 - DNA, 23 bp, Homo sapiens
atcttggtaaatttccccaacag

SEQ ID NO: 3050895 - DNA, 14 bp, Homo sapiens
atcttggtttgcct

SEQ ID NO: 3050896 - DNA, 17 bp, Homo sapiens
atcttggtttgccttcc

SEQ ID NO: 3050897 - DNA, 22 bp, Homo sapiens
atcttgttttaagcaaatgcat

SEQ ID NO: 3050898 - DNA, 15 bp, Homo sapiens
atcttgtttttccac

SEQ ID NO: 3050899 - DNA, 21 bp, Homo sapiens
atctttaaaagatgcttttaa

SEQ ID NO: 3050900 - DNA, 14 bp, Homo sapiens
atctttaagaaaaa

SEQ ID NO: 3050901 - DNA, 20 bp, Homo sapiens
atctttaatcaatgtgacat

SEQ ID NO: 3050902 - DNA, 18 bp, Homo sapiens
atctttatcctaaaaatc

SEQ ID NO: 3050903 - DNA, 19 bp, Homo sapiens
atctttatcctaaaaatct

SEQ ID NO: 3050904 - DNA, 17 bp, Homo sapiens
atctttattcaaacttt

SEQ ID NO: 3050905 - DNA, 14 bp, Homo sapiens
atctttcacttgaa

SEQ ID NO: 3050906 - DNA, 17 bp, Homo sapiens
atctttcacttgaaaga

SEQ ID NO: 3050907 - DNA, 16 bp, Homo sapiens
atctttcctcaagtat

SEQ ID NO: 3050908 - DNA, 22 bp, Homo sapiens
atctttcctcaagtatcttcta

SEQ ID NO: 3050909 - DNA, 13 bp, Homo sapiens
atctttctgcaga

SEQ ID NO: 3050910 - DNA, 11 bp, Homo sapiens
atctttcttct

SEQ ID NO: 3050911 - DNA, 20 bp, Homo sapiens
atctttgatcgtatatttct

SEQ ID NO: 3050912 - DNA, 14 bp, Homo sapiens
atctttgcgaaaag

SEQ ID NO: 3050913 - DNA, 23 bp, Homo sapiens
atctttgcgaaaagataaacctg

SEQ ID NO: 3050914 - DNA, 22 bp, Homo sapiens
atctttggacagaagcagctct

SEQ ID NO: 3050915 - DNA, 23 bp, Homo sapiens
atctttggacagaagcagctctt

SEQ ID NO: 3050916 - DNA, 15 bp, Homo sapiens
atctttgtggccaag

SEQ ID NO: 3050917 - DNA, 16 bp, Homo sapiens
atctttgtggccaagg

SEQ ID NO: 3050918 - DNA, 19 bp, Homo sapiens
atctttgtggccaaggagc

SEQ ID NO: 3050919 - DNA, 18 bp, Homo sapiens
atctttgtggtttagttt

SEQ ID NO: 3050920 - DNA, 21 bp, Homo sapiens
atctttgtggtttagtttatt

SEQ ID NO: 3050921 - DNA, 18 bp, Homo sapiens
atctttgtgttgctttca

SEQ ID NO: 3050922 - DNA, 21 bp, Homo sapiens
atctttgttaaggtcctgaaa

SEQ ID NO: 3050923 - DNA, 16 bp, Homo sapiens
atcttttaatcatgag

SEQ ID NO: 3050924 - DNA, 20 bp, Homo sapiens
atcttttaatcatgagcctg

SEQ ID NO: 3050925 - DNA, 22 bp, Homo sapiens
atcttttacaactgcctcgaaa

SEQ ID NO: 3050926 - DNA, 18 bp, Homo sapiens
atcttttctttagagaac

SEQ ID NO: 3050927 - DNA, 19 bp, Homo sapiens
atcttttctttagagaact

SEQ ID NO: 3050928 - DNA, 20 bp, Homo sapiens
atcttttctttagagaactg

SEQ ID NO: 3050929 - DNA, 22 bp, Homo sapiens
atcttttctttagagaactgaa

SEQ ID NO: 3050930 - DNA, 21 bp, Homo sapiens
atcttttgtaagacatttcct

SEQ ID NO: 3050931 - DNA, 16 bp, Homo sapiens
atctttttctttttaa

SEQ ID NO: 3050932 - DNA, 17 bp, Homo sapiens
atctttttgaaaatgtt

SEQ ID NO: 3050933 - DNA, 15 bp, Homo sapiens
atctttttgtgtgca

SEQ ID NO: 3050934 - DNA, 19 bp, Homo sapiens
atcttttttagcataaaat

SEQ ID NO: 3050935 - DNA, 23 bp, Homo sapiens
atcttttttagcataaaattttc

SEQ ID NO: 3050936 - DNA, 14 bp, Homo sapiens
atcttttttcacaa

SEQ ID NO: 3050937 - DNA, 18 bp, Homo sapiens
atctccgcctccacactg

SEQ ID NO: 3050938 - DNA, 20 bp, Homo sapiens
atctcctgccttcctcctgg

SEQ ID NO: 3050939 - DNA, 16 bp, Homo sapiens
atctcggctcactgca

SEQ ID NO: 3050940 - DNA, 18 bp, Homo sapiens
atctcgtttagtgccaat

SEQ ID NO: 3050941 - DNA, 13 bp, Homo sapiens
atctcgtttcaaa

SEQ ID NO: 3050942 - DNA, 15 bp, Homo sapiens
atctctagtccctgt

SEQ ID NO: 3050943 - DNA, 12 bp, Homo sapiens
atctctcatcct

SEQ ID NO: 3050944 - DNA, 18 bp, Homo sapiens
atctctgagtgtctctgc

SEQ ID NO: 3050945 - DNA, 19 bp, Homo sapiens
atctctgagtgtctctgcc

SEQ ID NO: 3050946 - DNA, 14 bp, Homo sapiens
atctcttcttccct

SEQ ID NO: 3050947 - DNA, 15 bp, Homo sapiens
atctctttgaatttt

SEQ ID NO: 3050948 - DNA, 11 bp, Homo sapiens
atctctttgtc

SEQ ID NO: 3050949 - DNA, 15 bp, Homo sapiens
atctctttgtcctga

SEQ ID NO: 3050950 - DNA, 10 bp, Homo sapiens
atctcttttc

SEQ ID NO: 3050951 - DNA, 13 bp, Homo sapiens
atctgaacccagc

SEQ ID NO: 3050952 - DNA, 18 bp, Homo sapiens
atctgaagccctcccagg

SEQ ID NO: 3050953 - DNA, 18 bp, Homo sapiens
atctgaaggggcaaattc

SEQ ID NO: 3050954 - DNA, 23 bp, Homo sapiens
atctgaaggggcaaattcttttg

SEQ ID NO: 3050955 - DNA, 19 bp, Homo sapiens
atctgaatgaaaataactg

SEQ ID NO: 3050956 - DNA, 22 bp, Homo sapiens
atctgaatgaaaataactgaac

SEQ ID NO: 3050957 - DNA, 12 bp, Homo sapiens
atctgaatgttc

SEQ ID NO: 3050958 - DNA, 12 bp, Homo sapiens
atctgacaaatt

SEQ ID NO: 3050959 - DNA, 16 bp, Homo sapiens
atctgaccagcagcgc

SEQ ID NO: 3050960 - DNA, 12 bp, Homo sapiens
atctgaccatct

SEQ ID NO: 3050961 - DNA, 14 bp, Homo sapiens
atctgaccatctgt

SEQ ID NO: 3050962 - DNA, 14 bp, Homo sapiens
atctgacccagtgc

SEQ ID NO: 3050963 - DNA, 20 bp, Homo sapiens
atctgacccagtgcccccac

SEQ ID NO: 3050964 - DNA, 21 bp, Homo sapiens
atctgacccagtgcccccact

SEQ ID NO: 3050965 - DNA, 16 bp, Homo sapiens
atctgaggatgagaca

SEQ ID NO: 3050966 - DNA, 15 bp, Homo sapiens
atctgcaatatgaat

SEQ ID NO: 3050967 - DNA, 18 bp, Homo sapiens
atctgcacccccctgggc

SEQ ID NO: 3050968 - DNA, 14 bp, Homo sapiens
atctgcagcacatt

SEQ ID NO: 3050969 - DNA, 23 bp, Homo sapiens
atctgcatgtaaaatcttcagct

SEQ ID NO: 3050970 - DNA, 15 bp, Homo sapiens
atctgcatgtctact

SEQ ID NO: 3050971 - DNA, 16 bp, Homo sapiens
atctgcattgcccagt

SEQ ID NO: 3050972 - DNA, 17 bp, Homo sapiens
atctgcattgcccagtc

SEQ ID NO: 3050973 - DNA, 21 bp, Homo sapiens
atctgcattgcccagtctttc

SEQ ID NO: 3050974 - DNA, 14 bp, Homo sapiens
atctgccacaaaaa

SEQ ID NO: 3050975 - DNA, 19 bp, Homo sapiens
atctgccacaaaaatgttc

SEQ ID NO: 3050976 - DNA, 23 bp, Homo sapiens
atctgcccacctcagcctcccaa

SEQ ID NO: 3050977 - DNA, 17 bp, Homo sapiens
atctgcccgcctgccca

SEQ ID NO: 3050978 - DNA, 18 bp, Homo sapiens
atctgcccgcctgcccac

SEQ ID NO: 3050979 - DNA, 19 bp, Homo sapiens
atctgcccgcctgcccacc

SEQ ID NO: 3050980 - DNA, 18 bp, Homo sapiens
atctgcctcccctgtgga

SEQ ID NO: 3050981 - DNA, 22 bp, Homo sapiens
atctgcctggaaagtcctccta

SEQ ID NO: 3050982 - DNA, 13 bp, Homo sapiens
atctgccttccag

SEQ ID NO: 3050983 - DNA, 18 bp, Homo sapiens
atctgccttccagcccag

SEQ ID NO: 3050984 - DNA, 20 bp, Homo sapiens
atctgccttccagcccagac

SEQ ID NO: 3050985 - DNA, 16 bp, Homo sapiens
atctgcgtgacaataa

SEQ ID NO: 3050986 - DNA, 17 bp, Homo sapiens
atctgcgtgacaataaa

SEQ ID NO: 3050987 - DNA, 13 bp, Homo sapiens
atctgctcacttt

SEQ ID NO: 3050988 - DNA, 15 bp, Homo sapiens
atctgctccaacaga

SEQ ID NO: 3050989 - DNA, 14 bp, Homo sapiens
atctgctgcacata

SEQ ID NO: 3050990 - DNA, 14 bp, Homo sapiens
atctgctggagttt

SEQ ID NO: 3050991 - DNA, 15 bp, Homo sapiens
atctgctgtgactgt

SEQ ID NO: 3050992 - DNA, 14 bp, Homo sapiens
atctgctttctgtt

SEQ ID NO: 3050993 - DNA, 19 bp, Homo sapiens
atcctgcaagggacaggaa

SEQ ID NO: 3050994 - DNA, 21 bp, Homo sapiens
atcctgcaagggacaggaagg

SEQ ID NO: 3050995 - DNA, 18 bp, Homo sapiens
atcctgctagcaggcccc

SEQ ID NO: 3050996 - DNA, 16 bp, Homo sapiens
atcctgctcaggaaac

SEQ ID NO: 3050997 - DNA, 13 bp, Homo sapiens
atcctgcttctct

SEQ ID NO: 3050998 - DNA, 23 bp, Homo sapiens
atcctgcttctcttttcctcgca

SEQ ID NO: 3050999 - DNA, 19 bp, Homo sapiens
atcctgcttctgatatgca

SEQ ID NO: 3051000 - DNA, 17 bp, Homo sapiens
atcctggaggcccagtt

SEQ ID NO: 3051001 - DNA, 20 bp, Homo sapiens
atcctggaggcccagttcac

SEQ ID NO: 3051002 - DNA, 19 bp, Homo sapiens
atcctggaggtcttttcta

SEQ ID NO: 3051003 - DNA, 16 bp, Homo sapiens
atcctggcaagaaagc

SEQ ID NO: 3051004 - DNA, 23 bp, Homo sapiens
atcctggctggagaatgtggaga

SEQ ID NO: 3051005 - DNA, 17 bp, Homo sapiens
atcctgggcccccagag

SEQ ID NO: 3051006 - DNA, 12 bp, Homo sapiens
atcctgggctgg

SEQ ID NO: 3051007 - DNA, 18 bp, Homo sapiens
atcctgtattcagacaga

SEQ ID NO: 3051008 - DNA, 19 bp, Homo sapiens
atcctgtctctaaaaagaa

SEQ ID NO: 3051009 - DNA, 23 bp, Homo sapiens
atcctgtctttctgagcacactt

SEQ ID NO: 3051010 - DNA, 21 bp, Homo sapiens
atcctgtgtccccttcatcct

SEQ ID NO: 3051011 - DNA, 16 bp, Homo sapiens
atccttaaatatgtga

SEQ ID NO: 3051012 - DNA, 13 bp, Homo sapiens
atccttaacagat

SEQ ID NO: 3051013 - DNA, 13 bp, Homo sapiens
atccttacttcca

SEQ ID NO: 3051014 - DNA, 19 bp, Homo sapiens
atccttcccaagaagagag

SEQ ID NO: 3051015 - DNA, 13 bp, Homo sapiens
atccttcccaagg

SEQ ID NO: 3051016 - DNA, 22 bp, Homo sapiens
atccttcccaagtaagaggctg

SEQ ID NO: 3051017 - DNA, 15 bp, Homo sapiens
atccttcctctcctt

SEQ ID NO: 3051018 - DNA, 13 bp, Homo sapiens
atccttctggctg

SEQ ID NO: 3051019 - DNA, 13 bp, Homo sapiens
atccttgactgaa

SEQ ID NO: 3051020 - DNA, 22 bp, Homo sapiens
atccttgcagtttaagatgaca

SEQ ID NO: 3051021 - DNA, 14 bp, Homo sapiens
atccttgtttcaaa

SEQ ID NO: 3051022 - DNA, 17 bp, Homo sapiens
atcctttaaatccttcc

SEQ ID NO: 3051023 - DNA, 20 bp, Homo sapiens
atcctttcctcattaaatta

SEQ ID NO: 3051024 - DNA, 17 bp, Homo sapiens
atcctttgttctgagca

SEQ ID NO: 3051025 - DNA, 15 bp, Homo sapiens
atccttttcttctat

SEQ ID NO: 3051026 - DNA, 18 bp, Homo sapiens
atccttttcttctatgta

SEQ ID NO: 3051027 - DNA, 11 bp, Homo sapiens
atccttttgta

SEQ ID NO: 3051028 - DNA, 17 bp, Homo sapiens
atccttttttctcttct

SEQ ID NO: 3051029 - DNA, 22 bp, Homo sapiens
atccttttttctcttctgtcca

SEQ ID NO: 3051030 - DNA, 18 bp, Homo sapiens
atcgaatctactaattcc

SEQ ID NO: 3051031 - DNA, 18 bp, Homo sapiens
atcgaccacaccagcctc

SEQ ID NO: 3051032 - DNA, 14 bp, Homo sapiens
atcgactttttaaa

SEQ ID NO: 3051033 - DNA, 23 bp, Homo sapiens
atcgatgggggagtctgaagcag

SEQ ID NO: 3051034 - DNA, 13 bp, Homo sapiens
atcgatgttatgt

SEQ ID NO: 3051035 - DNA, 20 bp, Homo sapiens
atcgcatcccggctgaccct

SEQ ID NO: 3051036 - DNA, 14 bp, Homo sapiens
atcgccacaaactc

SEQ ID NO: 3051037 - DNA, 18 bp, Homo sapiens
cattgctggtcatccttg

SEQ ID NO: 3051038 - DNA, 13 bp, Homo sapiens
cattgctgtagga

SEQ ID NO: 3051039 - DNA, 14 bp, Homo sapiens
cattgctgtaggat

SEQ ID NO: 3051040 - DNA, 22 bp, Homo sapiens
cattgctgtaggatctaaggct

SEQ ID NO: 3051041 - DNA, 13 bp, Homo sapiens
cattgctgtgtca

SEQ ID NO: 3051042 - DNA, 14 bp, Homo sapiens
cattgctttctgaa

SEQ ID NO: 3051043 - DNA, 16 bp, Homo sapiens
cattggacccttccat

SEQ ID NO: 3051044 - DNA, 18 bp, Homo sapiens
cattggatgcatttctat

SEQ ID NO: 3051045 - DNA, 15 bp, Homo sapiens
cattggattctgaga

SEQ ID NO: 3051046 - DNA, 20 bp, Homo sapiens
cattggcacctaatccaggc

SEQ ID NO: 3051047 - DNA, 22 bp, Homo sapiens
cattgggtctattccagctcat

SEQ ID NO: 3051048 - DNA, 20 bp, Homo sapiens
cattgggtgaggtaataaac

SEQ ID NO: 3051049 - DNA, 20 bp, Homo sapiens
cattgtaacctcgtgtctag

SEQ ID NO: 3051050 - DNA, 14 bp, Homo sapiens
cattgtactccagc

SEQ ID NO: 3051051 - DNA, 16 bp, Homo sapiens
cattgtactccagcct

SEQ ID NO: 3051052 - DNA, 18 bp, Homo sapiens
cattgtactccagcctgg

SEQ ID NO: 3051053 - DNA, 22 bp, Homo sapiens
cattgtactccagcctgggtga

SEQ ID NO: 3051054 - DNA, 23 bp, Homo sapiens
cattgtcatcagaggggagcagc

SEQ ID NO: 3051055 - DNA, 13 bp, Homo sapiens
cattgtccctctg

SEQ ID NO: 3051056 - DNA, 21 bp, Homo sapiens
cattgtctcctatatatttct

SEQ ID NO: 3051057 - DNA, 17 bp, Homo sapiens
cattgtctcgtttgtga

SEQ ID NO: 3051058 - DNA, 13 bp, Homo sapiens
cattgtcttcgga

SEQ ID NO: 3051059 - DNA, 20 bp, Homo sapiens
cattgtctttttagatgccc

SEQ ID NO: 3051060 - DNA, 13 bp, Homo sapiens
cattgttattttc

SEQ ID NO: 3051061 - DNA, 14 bp, Homo sapiens
cattgttattttca

SEQ ID NO: 3051062 - DNA, 16 bp, Homo sapiens
cattgttcaaaaggaa

SEQ ID NO: 3051063 - DNA, 17 bp, Homo sapiens
cattgttcaaaaggaac

SEQ ID NO: 3051064 - DNA, 20 bp, Homo sapiens
cattgttggagtgtaaacca

SEQ ID NO: 3051065 - DNA, 18 bp, Homo sapiens
cattgttggcgctgaggt

SEQ ID NO: 3051066 - DNA, 12 bp, Homo sapiens
cattgtttctgt

SEQ ID NO: 3051067 - DNA, 14 bp, Homo sapiens
cattgtttgaaaca

SEQ ID NO: 3051068 - DNA, 20 bp, Homo sapiens
cattgtttgaaacaaagaag

SEQ ID NO: 3051069 - DNA, 15 bp, Homo sapiens
cattgttttgcaaaa

SEQ ID NO: 3051070 - DNA, 20 bp, Homo sapiens
catttaaaaatatatagctt

SEQ ID NO: 3051071 - DNA, 22 bp, Homo sapiens
catttaaaatgtaaactcttca

SEQ ID NO: 3051072 - DNA, 18 bp, Homo sapiens
catttaataactttgctg

SEQ ID NO: 3051073 - DNA, 16 bp, Homo sapiens
catttaatacagataa

SEQ ID NO: 3051074 - DNA, 21 bp, Homo sapiens
catttaatacagataagtgtt

SEQ ID NO: 3051075 - DNA, 11 bp, Homo sapiens
catttacacac

SEQ ID NO: 3051076 - DNA, 21 bp, Homo sapiens
catttacaccacactttcaaa

SEQ ID NO: 3051077 - DNA, 20 bp, Homo sapiens
catttacataggaaccaaat

SEQ ID NO: 3051078 - DNA, 21 bp, Homo sapiens
catttaccaacatgtatctgt

SEQ ID NO: 3051079 - DNA, 18 bp, Homo sapiens
catttactcaccatattt

SEQ ID NO: 3051080 - DNA, 20 bp, Homo sapiens
catttactgatcatctgctg

SEQ ID NO: 3051081 - DNA, 21 bp, Homo sapiens
catttactgatcatctgctgt

SEQ ID NO: 3051082 - DNA, 15 bp, Homo sapiens
catttacttaggact

SEQ ID NO: 3051083 - DNA, 21 bp, Homo sapiens
catttagaacgagcctggaag

SEQ ID NO: 3051084 - DNA, 21 bp, Homo sapiens
catttagagaggaaaagtaac

SEQ ID NO: 3051085 - DNA, 18 bp, Homo sapiens
catttagagtttcacaga

SEQ ID NO: 3051086 - DNA, 19 bp, Homo sapiens
catttagattgaaaacttt

SEQ ID NO: 3051087 - DNA, 14 bp, Homo sapiens
catttagctggcca

SEQ ID NO: 3051088 - DNA, 21 bp, Homo sapiens
catttagctggccacatggcg

SEQ ID NO: 3051089 - DNA, 18 bp, Homo sapiens
catttataaagctaaaat

SEQ ID NO: 3051090 - DNA, 16 bp, Homo sapiens
catttataagaagaga

SEQ ID NO: 3051091 - DNA, 14 bp, Homo sapiens
catttatagaagaa

SEQ ID NO: 3051092 - DNA, 18 bp, Homo sapiens
catttatatattgtctgt

SEQ ID NO: 3051093 - DNA, 15 bp, Homo sapiens
catttatattaaata

SEQ ID NO: 3051094 - DNA, 18 bp, Homo sapiens
catttatgacaagctgta

SEQ ID NO: 3051095 - DNA, 21 bp, Homo sapiens
catttatgacaagctgtatca

SEQ ID NO: 3051096 - DNA, 17 bp, Homo sapiens
catttatgtagacattg

SEQ ID NO: 3051097 - DNA, 22 bp, Homo sapiens
catttatgtagacattgtaaat

SEQ ID NO: 3051098 - DNA, 15 bp, Homo sapiens
catttattgcagttt

SEQ ID NO: 3051099 - DNA, 16 bp, Homo sapiens
catttcaaaattaata

SEQ ID NO: 3051100 - DNA, 17 bp, Homo sapiens
catttcaattcctggcc

SEQ ID NO: 3051101 - DNA, 18 bp, Homo sapiens
catttcacatgccttgca

SEQ ID NO: 3051102 - DNA, 17 bp, Homo sapiens
catttcaggaatttaaa

SEQ ID NO: 3051103 - DNA, 20 bp, Homo sapiens
catttcatattctttcaatt

SEQ ID NO: 3051104 - DNA, 14 bp, Homo sapiens
catttcatcctgtt

SEQ ID NO: 3051105 - DNA, 21 bp, Homo sapiens
catttccatgtcccctcccag

SEQ ID NO: 3051106 - DNA, 18 bp, Homo sapiens
catttcccacatctttcc

SEQ ID NO: 3051107 - DNA, 21 bp, Homo sapiens
catttccgtccccccccaggc

SEQ ID NO: 3051108 - DNA, 22 bp, Homo sapiens
catttccgtccccccccaggcc

SEQ ID NO: 3051109 - DNA, 11 bp, Homo sapiens
catttcctttt

SEQ ID NO: 3051110 - DNA, 17 bp, Homo sapiens
catttcgcccctcattt

SEQ ID NO: 3051111 - DNA, 20 bp, Homo sapiens
catttcgggaagggcatgca

SEQ ID NO: 3051112 - DNA, 16 bp, Homo sapiens
catttcgtgtaatatt

SEQ ID NO: 3051113 - DNA, 13 bp, Homo sapiens
catttctccagaa

SEQ ID NO: 3051114 - DNA, 18 bp, Homo sapiens
catttctccagattatct

SEQ ID NO: 3051115 - DNA, 15 bp, Homo sapiens
catttctctaagaga

SEQ ID NO: 3051116 - DNA, 12 bp, Homo sapiens
catttctgtctc

SEQ ID NO: 3051117 - DNA, 12 bp, Homo sapiens
catttcttagac

SEQ ID NO: 3051118 - DNA, 21 bp, Homo sapiens
catttgaaagtgggtttcaat

SEQ ID NO: 3051119 - DNA, 23 bp, Homo sapiens
catttgaaagtgggtttcaattt

SEQ ID NO: 3051120 - DNA, 21 bp, Homo sapiens
catttgaataaagcctgcttt

SEQ ID NO: 3051121 - DNA, 14 bp, Homo sapiens
catttgagtctctt

SEQ ID NO: 3051122 - DNA, 17 bp, Homo sapiens
catttgatgcatgtctt

SEQ ID NO: 3051123 - DNA, 19 bp, Homo sapiens
catttgatgcatgtctttt

SEQ ID NO: 3051124 - DNA, 22 bp, Homo sapiens
catttgatgcatgtcttttaaa

SEQ ID NO: 3051125 - DNA, 14 bp, Homo sapiens
catttgattaacat

SEQ ID NO: 3051126 - DNA, 14 bp, Homo sapiens
catttgattgtttt

SEQ ID NO: 3051127 - DNA, 14 bp, Homo sapiens
catttgatttcgat

SEQ ID NO: 3051128 - DNA, 20 bp, Homo sapiens
catttgcactggagttctat

SEQ ID NO: 3051129 - DNA, 15 bp, Homo sapiens
catttgctggcctgg

SEQ ID NO: 3051130 - DNA, 23 bp, Homo sapiens
catttggaatttttgcttgactt

SEQ ID NO: 3051131 - DNA, 15 bp, Homo sapiens
catttggagctcttg

SEQ ID NO: 3051132 - DNA, 22 bp, Homo sapiens
catttggcagaactgctggggc

SEQ ID NO: 3051133 - DNA, 18 bp, Homo sapiens
catttggccccaggggac

SEQ ID NO: 3051134 - DNA, 20 bp, Homo sapiens
catttggccccaggggacgt

SEQ ID NO: 3051135 - DNA, 17 bp, Homo sapiens
catttgggataccagat

SEQ ID NO: 3051136 - DNA, 20 bp, Homo sapiens
catttggttcattaattcta

SEQ ID NO: 3051137 - DNA, 21 bp, Homo sapiens
catttggttcattaattctat

SEQ ID NO: 3051138 - DNA, 11 bp, Homo sapiens
catttgtattt

SEQ ID NO: 3051139 - DNA, 12 bp, Homo sapiens
catttgtatttt

SEQ ID NO: 3051140 - DNA, 12 bp, Homo sapiens
catttgtgatat

SEQ ID NO: 3051141 - DNA, 18 bp, Homo sapiens
catttgtgatatatgtat

SEQ ID NO: 3051142 - DNA, 20 bp, Homo sapiens
catttgtgctagaaattttc

SEQ ID NO: 3051143 - DNA, 21 bp, Homo sapiens
catttgtgctagaaattttca

SEQ ID NO: 3051144 - DNA, 14 bp, Homo sapiens
ccaacagtgtgaag

SEQ ID NO: 3051145 - DNA, 15 bp, Homo sapiens
ccaacagtgtgaagt

SEQ ID NO: 3051146 - DNA, 21 bp, Homo sapiens
ccaacatcatcaggaagcctg

SEQ ID NO: 3051147 - DNA, 22 bp, Homo sapiens
ccaacatccagtcctgctgact

SEQ ID NO: 3051148 - DNA, 18 bp, Homo sapiens
ccaacatgtatctgtcta

SEQ ID NO: 3051149 - DNA, 13 bp, Homo sapiens
ccaacattgcctt

SEQ ID NO: 3051150 - DNA, 15 bp, Homo sapiens
ccaaccaaggaagga

SEQ ID NO: 3051151 - DNA, 12 bp, Homo sapiens
ccaacccatcag

SEQ ID NO: 3051152 - DNA, 17 bp, Homo sapiens
ccaaccccacccagctc

SEQ ID NO: 3051153 - DNA, 15 bp, Homo sapiens
ccaacccccatctcc

SEQ ID NO: 3051154 - DNA, 16 bp, Homo sapiens
ccaacccccatctccc

SEQ ID NO: 3051155 - DNA, 17 bp, Homo sapiens
ccaaccccgcggcccag

SEQ ID NO: 3051156 - DNA, 13 bp, Homo sapiens
ccaacccttctcc

SEQ ID NO: 3051157 - DNA, 21 bp, Homo sapiens
ccaacccttctcctcttgtaa

SEQ ID NO: 3051158 - DNA, 18 bp, Homo sapiens
ccaacctaacccctttcc

SEQ ID NO: 3051159 - DNA, 13 bp, Homo sapiens
ccaacctaacctg

SEQ ID NO: 3051160 - DNA, 17 bp, Homo sapiens
ccaacctctcggcccca

SEQ ID NO: 3051161 - DNA, 22 bp, Homo sapiens
ccaacctgaaggtcccctggca

SEQ ID NO: 3051162 - DNA, 22 bp, Homo sapiens
ccaacctgaccaacatggagaa

SEQ ID NO: 3051163 - DNA, 12 bp, Homo sapiens
ccaacctgtcct

SEQ ID NO: 3051164 - DNA, 23 bp, Homo sapiens
ccaacctgtccttactcagagct

SEQ ID NO: 3051165 - DNA, 13 bp, Homo sapiens
ccaaccttgttta

SEQ ID NO: 3051166 - DNA, 21 bp, Homo sapiens
ccaacggagagcgcctgcccc

SEQ ID NO: 3051167 - DNA, 13 bp, Homo sapiens
ccaacgtttggaa

SEQ ID NO: 3051168 - DNA, 23 bp, Homo sapiens
ccaacgtttggaagatcctgtga

SEQ ID NO: 3051169 - DNA, 17 bp, Homo sapiens
ccaactagcccctgggg

SEQ ID NO: 3051170 - DNA, 14 bp, Homo sapiens
ccaactcagaaggg

SEQ ID NO: 3051171 - DNA, 14 bp, Homo sapiens
ccaactccctctct

SEQ ID NO: 3051172 - DNA, 18 bp, Homo sapiens
ccaactcctttcagccac

SEQ ID NO: 3051173 - DNA, 19 bp, Homo sapiens
ccaactcctttcagccaca

SEQ ID NO: 3051174 - DNA, 20 bp, Homo sapiens
ccaactcctttcagccacat

SEQ ID NO: 3051175 - DNA, 12 bp, Homo sapiens
ccaactgcctcc

SEQ ID NO: 3051176 - DNA, 22 bp, Homo sapiens
ccaactgcctccttgccagccc

SEQ ID NO: 3051177 - DNA, 23 bp, Homo sapiens
ccaactgcctccttgccagcccc

SEQ ID NO: 3051178 - DNA, 17 bp, Homo sapiens
ccaacttccctgttctt

SEQ ID NO: 3051179 - DNA, 14 bp, Homo sapiens
ccaagaaaatgaag

SEQ ID NO: 3051180 - DNA, 20 bp, Homo sapiens
ccaagaatagcatctgtaca

SEQ ID NO: 3051181 - DNA, 11 bp, Homo sapiens
ccaagaatctt

SEQ ID NO: 3051182 - DNA, 11 bp, Homo sapiens
ccaagaatgta

SEQ ID NO: 3051183 - DNA, 23 bp, Homo sapiens
catgttgcacacccactcagctc

SEQ ID NO: 3051184 - DNA, 18 bp, Homo sapiens
catgttggggttgtgtgt

SEQ ID NO: 3051185 - DNA, 18 bp, Homo sapiens
catgttggtcaggctggt

SEQ ID NO: 3051186 - DNA, 16 bp, Homo sapiens
catgttgttttttcat

SEQ ID NO: 3051187 - DNA, 21 bp, Homo sapiens
catgttgttttttcatagtgc

SEQ ID NO: 3051188 - DNA, 14 bp, Homo sapiens
catgtttaaacctg

SEQ ID NO: 3051189 - DNA, 13 bp, Homo sapiens
catgtttaatgtg

SEQ ID NO: 3051190 - DNA, 18 bp, Homo sapiens
catgtttaatgtgaactc

SEQ ID NO: 3051191 - DNA, 19 bp, Homo sapiens
catgtttaatgtgaactct

SEQ ID NO: 3051192 - DNA, 23 bp, Homo sapiens
catgtttaatgtgaactctcccc

SEQ ID NO: 3051193 - DNA, 18 bp, Homo sapiens
catgaggaactgtagatg

SEQ ID NO: 3051194 - DNA, 16 bp, Homo sapiens
catgaggagttgctgt

SEQ ID NO: 3051195 - DNA, 13 bp, Homo sapiens
catgaggcagctt

SEQ ID NO: 3051196 - DNA, 22 bp, Homo sapiens
catgaggccactgctgcttctc

SEQ ID NO: 3051197 - DNA, 22 bp, Homo sapiens
catgaggtactggtcccttcct

SEQ ID NO: 3051198 - DNA, 19 bp, Homo sapiens
catgagtccttgaaaatat

SEQ ID NO: 3051199 - DNA, 21 bp, Homo sapiens
catgagtccttgaaaatattt

SEQ ID NO: 3051200 - DNA, 22 bp, Homo sapiens
catgagtctacctgagcattca

SEQ ID NO: 3051201 - DNA, 17 bp, Homo sapiens
catgagtggagtttcca

SEQ ID NO: 3051202 - DNA, 22 bp, Homo sapiens
catgagtggagtttccaacaga

SEQ ID NO: 3051203 - DNA, 22 bp, Homo sapiens
catgatccacccacctcagcct

SEQ ID NO: 3051204 - DNA, 16 bp, Homo sapiens
catgatctccctgccg

SEQ ID NO: 3051205 - DNA, 20 bp, Homo sapiens
catgatgcctctgtcttctg

SEQ ID NO: 3051206 - DNA, 22 bp, Homo sapiens
catgatgcctctgtcttctgga

SEQ ID NO: 3051207 - DNA, 23 bp, Homo sapiens
catgatgcctctgtcttctggac

SEQ ID NO: 3051208 - DNA, 14 bp, Homo sapiens
catgatgctagcca

SEQ ID NO: 3051209 - DNA, 23 bp, Homo sapiens
catgatggactttggtttgaaca

SEQ ID NO: 3051210 - DNA, 12 bp, Homo sapiens
catgatgggaaa

SEQ ID NO: 3051211 - DNA, 20 bp, Homo sapiens
catgatgggaaaatatttcc

SEQ ID NO: 3051212 - DNA, 22 bp, Homo sapiens
catgatgggaaaatatttcctg

SEQ ID NO: 3051213 - DNA, 23 bp, Homo sapiens
catgatgggaaaatatttcctga

SEQ ID NO: 3051214 - DNA, 23 bp, Homo sapiens
catgatttcccactgcactccag

SEQ ID NO: 3051215 - DNA, 21 bp, Homo sapiens
catgatttccctccagagaaa

SEQ ID NO: 3051216 - DNA, 16 bp, Homo sapiens
catgatttccttgaat

SEQ ID NO: 3051217 - DNA, 18 bp, Homo sapiens
catgatttccttgaatgt

SEQ ID NO: 3051218 - DNA, 18 bp, Homo sapiens
catgattttaagaggctt

SEQ ID NO: 3051219 - DNA, 18 bp, Homo sapiens
catgcaaaagaaagcaaa

SEQ ID NO: 3051220 - DNA, 22 bp, Homo sapiens
catgcaaaagcaatcatagaga

SEQ ID NO: 3051221 - DNA, 17 bp, Homo sapiens
catgcaagcagaggacc

SEQ ID NO: 3051222 - DNA, 22 bp, Homo sapiens
catgcaagcagaggaccagggc

SEQ ID NO: 3051223 - DNA, 23 bp, Homo sapiens
catgcaagcagaggaccagggcc

SEQ ID NO: 3051224 - DNA, 18 bp, Homo sapiens
catgcaccaggactggct

SEQ ID NO: 3051225 - DNA, 17 bp, Homo sapiens
catgcacccctgatgtt

SEQ ID NO: 3051226 - DNA, 18 bp, Homo sapiens
catgcacccctgatgttc

SEQ ID NO: 3051227 - DNA, 16 bp, Homo sapiens
catgcacgggcatgca

SEQ ID NO: 3051228 - DNA, 21 bp, Homo sapiens
catgcacgggcatgcacacgg

SEQ ID NO: 3051229 - DNA, 22 bp, Homo sapiens
catgcacgggcatgcacacggc

SEQ ID NO: 3051230 - DNA, 16 bp, Homo sapiens
catgcactcagctctt

SEQ ID NO: 3051231 - DNA, 13 bp, Homo sapiens
catgcactgtgaa

SEQ ID NO: 3051232 - DNA, 17 bp, Homo sapiens
catgcactgtgaaggac

SEQ ID NO: 3051233 - DNA, 13 bp, Homo sapiens
catgcaggaagga

SEQ ID NO: 3051234 - DNA, 18 bp, Homo sapiens
catgcaggtctccatgaa

SEQ ID NO: 3051235 - DNA, 21 bp, Homo sapiens
catgcaggtctccatgaagaa

SEQ ID NO: 3051236 - DNA, 10 bp, Homo sapiens
catgcagttt

SEQ ID NO: 3051237 - DNA, 14 bp, Homo sapiens
catgcagtttgaaa

SEQ ID NO: 3051238 - DNA, 16 bp, Homo sapiens
catgcagtttgaaatt

SEQ ID NO: 3051239 - DNA, 20 bp, Homo sapiens
catgcagtttgaaattctga

SEQ ID NO: 3051240 - DNA, 22 bp, Homo sapiens
catgcataaaagggtcaaacct

SEQ ID NO: 3051241 - DNA, 13 bp, Homo sapiens
catgcatacacac

SEQ ID NO: 3051242 - DNA, 16 bp, Homo sapiens
catgcatacacacaca

SEQ ID NO: 3051243 - DNA, 15 bp, Homo sapiens
catgcatacttcaaa

SEQ ID NO: 3051244 - DNA, 16 bp, Homo sapiens
catgcatacttcaaaa

SEQ ID NO: 3051245 - DNA, 21 bp, Homo sapiens
catgcatacttcaaaagtatt

SEQ ID NO: 3051246 - DNA, 22 bp, Homo sapiens
catgcatctgtttattctatag

SEQ ID NO: 3051247 - DNA, 14 bp, Homo sapiens
catgcatcttactg

SEQ ID NO: 3051248 - DNA, 16 bp, Homo sapiens
catgcatcttactgaa

SEQ ID NO: 3051249 - DNA, 18 bp, Homo sapiens
catgcatttgatttgttt

SEQ ID NO: 3051250 - DNA, 22 bp, Homo sapiens
catgccaacaagaatgcattga

SEQ ID NO: 3051251 - DNA, 21 bp, Homo sapiens
catgccaggacccgccagccc

SEQ ID NO: 3051252 - DNA, 13 bp, Homo sapiens
catgccccaggct

SEQ ID NO: 3051253 - DNA, 13 bp, Homo sapiens
catgccccttggg

SEQ ID NO: 3051254 - DNA, 17 bp, Homo sapiens
catgccctgtgtggctg

SEQ ID NO: 3051255 - DNA, 14 bp, Homo sapiens
catgcctcagccct

SEQ ID NO: 3051256 - DNA, 13 bp, Homo sapiens
catgcctctgagc

SEQ ID NO: 3051257 - DNA, 16 bp, Homo sapiens
catgcctgtagtctca

SEQ ID NO: 3051258 - DNA, 20 bp, Homo sapiens
catgcctgtagtctcagcta

SEQ ID NO: 3051259 - DNA, 14 bp, Homo sapiens
catgcctgtggctg

SEQ ID NO: 3051260 - DNA, 15 bp, Homo sapiens
catgcctgtggctgc

SEQ ID NO: 3051261 - DNA, 19 bp, Homo sapiens
catgcgcgcgctctctctc

SEQ ID NO: 3051262 - DNA, 14 bp, Homo sapiens
catgcggtagccag

SEQ ID NO: 3051263 - DNA, 16 bp, Homo sapiens
catgcggtagccagca

SEQ ID NO: 3051264 - DNA, 13 bp, Homo sapiens
catgcggtcgggc

SEQ ID NO: 3051265 - DNA, 14 bp, Homo sapiens
catgctaaaattct

SEQ ID NO: 3051266 - DNA, 16 bp, Homo sapiens
catgctaaataactat

SEQ ID NO: 3051267 - DNA, 17 bp, Homo sapiens
catgctatatatctttt

SEQ ID NO: 3051268 - DNA, 17 bp, Homo sapiens
catgctatgtgcacagc

SEQ ID NO: 3051269 - DNA, 11 bp, Homo sapiens
catgctcccaa

SEQ ID NO: 3051270 - DNA, 13 bp, Homo sapiens
catgctctctgca

SEQ ID NO: 3051271 - DNA, 19 bp, Homo sapiens
catgctctctgcagccagc

SEQ ID NO: 3051272 - DNA, 19 bp, Homo sapiens
catgctgaaggctgaaaga

SEQ ID NO: 3051273 - DNA, 22 bp, Homo sapiens
catgctgcctgagtattactag

SEQ ID NO: 3051274 - DNA, 22 bp, Homo sapiens
catgctggaacctgcaaaaaat

SEQ ID NO: 3051275 - DNA, 23 bp, Homo sapiens
catgctggaacctgcaaaaaata

SEQ ID NO: 3051276 - DNA, 15 bp, Homo sapiens
catgctgtccctgca

SEQ ID NO: 3051277 - DNA, 18 bp, Homo sapiens
catgctgtccctgcactg

SEQ ID NO: 3051278 - DNA, 19 bp, Homo sapiens
catgctgtccctgcactgt

SEQ ID NO: 3051279 - DNA, 15 bp, Homo sapiens
catgcttttacttta

SEQ ID NO: 3051280 - DNA, 20 bp, Homo sapiens
catgcttttcttcctagtta

SEQ ID NO: 3051281 - DNA, 16 bp, Homo sapiens
catggaaaccaaaagg

SEQ ID NO: 3051282 - DNA, 14 bp, Homo sapiens
catggaaagactgg

SEQ ID NO: 3051283 - DNA, 13 bp, Homo sapiens
catggaacacaaa

SEQ ID NO: 3051284 - DNA, 23 bp, Homo sapiens
catggaacacaaacacattgtta

SEQ ID NO: 3051285 - DNA, 14 bp, Homo sapiens
catggaaggtgcca

SEQ ID NO: 3051286 - DNA, 14 bp, Homo sapiens
catggaatggttat

SEQ ID NO: 3051287 - DNA, 17 bp, Homo sapiens
catggaatggttataaa

SEQ ID NO: 3051288 - DNA, 21 bp, Homo sapiens
catggaatggttataaaagtg

SEQ ID NO: 3051289 - DNA, 16 bp, Homo sapiens
catggacaggctggct

SEQ ID NO: 3051290 - DNA, 14 bp, Homo sapiens
catggagaaaccct

SEQ ID NO: 3051291 - DNA, 16 bp, Homo sapiens
catggagaaaccctgt

SEQ ID NO: 3051292 - DNA, 17 bp, Homo sapiens
catggagaaaccctgtc

SEQ ID NO: 3051293 - DNA, 10 bp, Homo sapiens
catggagcca

SEQ ID NO: 3051294 - DNA, 17 bp, Homo sapiens
catggagccagctccct

SEQ ID NO: 3051295 - DNA, 12 bp, Homo sapiens
catggaggagac

SEQ ID NO: 3051296 - DNA, 17 bp, Homo sapiens
catggaggagacaggaa

SEQ ID NO: 3051297 - DNA, 16 bp, Homo sapiens
catggaggcactgaag

SEQ ID NO: 3051298 - DNA, 17 bp, Homo sapiens
catggaggttctaaggc

SEQ ID NO: 3051299 - DNA, 14 bp, Homo sapiens
catggagtgtttga

SEQ ID NO: 3051300 - DNA, 21 bp, Homo sapiens
catggagtgtttgacgaagaa

SEQ ID NO: 3051301 - DNA, 14 bp, Homo sapiens
catggatcctggat

SEQ ID NO: 3051302 - DNA, 13 bp, Homo sapiens
catggatgtgttg

SEQ ID NO: 3051303 - DNA, 19 bp, Homo sapiens
catggattccaaagcattt

SEQ ID NO: 3051304 - DNA, 17 bp, Homo sapiens
catggatttccactgct

SEQ ID NO: 3051305 - DNA, 21 bp, Homo sapiens
catggatttctctgctcacag

SEQ ID NO: 3051306 - DNA, 22 bp, Homo sapiens
catggatttctctgctcacaga

SEQ ID NO: 3051307 - DNA, 13 bp, Homo sapiens
catggatttggtt

SEQ ID NO: 3051308 - DNA, 13 bp, Homo sapiens
catggcactccct

SEQ ID NO: 3051309 - DNA, 17 bp, Homo sapiens
catggcactccctccag

SEQ ID NO: 3051310 - DNA, 22 bp, Homo sapiens
catggcactccctccagcacaa

SEQ ID NO: 3051311 - DNA, 17 bp, Homo sapiens
catggcagagtttgtgt

SEQ ID NO: 3051312 - DNA, 12 bp, Homo sapiens
catggcagctgg

SEQ ID NO: 3051313 - DNA, 13 bp, Homo sapiens
catggcagctggg

SEQ ID NO: 3051314 - DNA, 14 bp, Homo sapiens
catggcagctgggc

SEQ ID NO: 3051315 - DNA, 15 bp, Homo sapiens
catggcagctgggcc

SEQ ID NO: 3051316 - DNA, 14 bp, Homo sapiens
catacaccagcatt

SEQ ID NO: 3051317 - DNA, 16 bp, Homo sapiens
catacagggatggtgt

SEQ ID NO: 3051318 - DNA, 19 bp, Homo sapiens
catacagggatggtgttca

SEQ ID NO: 3051319 - DNA, 23 bp, Homo sapiens
catacatagacatttcaaaatta

SEQ ID NO: 3051320 - DNA, 15 bp, Homo sapiens
catacatatgtagaa

SEQ ID NO: 3051321 - DNA, 22 bp, Homo sapiens
catacatatgtagaaacattta

SEQ ID NO: 3051322 - DNA, 17 bp, Homo sapiens
catacattaaggagcag

SEQ ID NO: 3051323 - DNA, 23 bp, Homo sapiens
catacattaaggagcagggtcct

SEQ ID NO: 3051324 - DNA, 19 bp, Homo sapiens
catacccgtgacagtggct

SEQ ID NO: 3051325 - DNA, 19 bp, Homo sapiens
cataccgcctcgtgccagc

SEQ ID NO: 3051326 - DNA, 24 bp, Homo sapiens
cataccgcctcgtgccagcagcct

SEQ ID NO: 3051327 - DNA, 21 bp, Homo sapiens
catacctttcacagcttttat

SEQ ID NO: 3051328 - DNA, 17 bp, Homo sapiens
cataccttttatttttt

SEQ ID NO: 3051329 - DNA, 18 bp, Homo sapiens
catactacctagaagtaa

SEQ ID NO: 3051330 - DNA, 19 bp, Homo sapiens
catactacctagaagtaag

SEQ ID NO: 3051331 - DNA, 14 bp, Homo sapiens
catactaggtgcct

SEQ ID NO: 3051332 - DNA, 17 bp, Homo sapiens
catactaggtgcctttt

SEQ ID NO: 3051333 - DNA, 19 bp, Homo sapiens
catactcaatgttactatc

SEQ ID NO: 3051334 - DNA, 19 bp, Homo sapiens
catactccgtgaggctgct

SEQ ID NO: 3051335 - DNA, 23 bp, Homo sapiens
catactccgtgaggctgctgcca

SEQ ID NO: 3051336 - DNA, 14 bp, Homo sapiens
catactctgttgcc

SEQ ID NO: 3051337 - DNA, 17 bp, Homo sapiens
catactggtctcacagt

SEQ ID NO: 3051338 - DNA, 15 bp, Homo sapiens
catacttcaaaagta

SEQ ID NO: 3051339 - DNA, 18 bp, Homo sapiens
catacttcaaaagtattt

SEQ ID NO: 3051340 - DNA, 13 bp, Homo sapiens
catacttgaaggg

SEQ ID NO: 3051341 - DNA, 20 bp, Homo sapiens
catacttgaagggccagagc

SEQ ID NO: 3051342 - DNA, 15 bp, Homo sapiens
catactttgtaaata

SEQ ID NO: 3051343 - DNA, 22 bp, Homo sapiens
catactttgtaaataggatttt

SEQ ID NO: 3051344 - DNA, 13 bp, Homo sapiens
catactttgtctg

SEQ ID NO: 3051345 - DNA, 11 bp, Homo sapiens
catacttttaa

SEQ ID NO: 3051346 - DNA, 13 bp, Homo sapiens
catagaaaaatga

SEQ ID NO: 3051347 - DNA, 23 bp, Homo sapiens
catagaaatggaaattttgctat

SEQ ID NO: 3051348 - DNA, 20 bp, Homo sapiens
catagaacagaaatatataa

SEQ ID NO: 3051349 - DNA, 22 bp, Homo sapiens
catagaccctctttcttgtttg

SEQ ID NO: 3051350 - DNA, 13 bp, Homo sapiens
catagagaacaaa

SEQ ID NO: 3051351 - DNA, 15 bp, Homo sapiens
catagagaggcctgc

SEQ ID NO: 3051352 - DNA, 19 bp, Homo sapiens
catagagagggagaagaag

SEQ ID NO: 3051353 - DNA, 17 bp, Homo sapiens
catagccaactctccca

SEQ ID NO: 3051354 - DNA, 18 bp, Homo sapiens
catagccaactctcccaa

SEQ ID NO: 3051355 - DNA, 20 bp, Homo sapiens
catagccctggtgctcctgc

SEQ ID NO: 3051356 - DNA, 23 bp, Homo sapiens
catagccctggtgctcctgccca

SEQ ID NO: 3051357 - DNA, 19 bp, Homo sapiens
catagcctaatccctgggc

SEQ ID NO: 3051358 - DNA, 17 bp, Homo sapiens
catagcgtcctgccctg

SEQ ID NO: 3051359 - DNA, 20 bp, Homo sapiens
catctctcccttacccatct

SEQ ID NO: 3051360 - DNA, 14 bp, Homo sapiens
catctctctccctt

SEQ ID NO: 3051361 - DNA, 21 bp, Homo sapiens
catctctgagtgtctctgcct

SEQ ID NO: 3051362 - DNA, 22 bp, Homo sapiens
catctctgcagctcaaagatgt

SEQ ID NO: 3051363 - DNA, 13 bp, Homo sapiens
catctctgccttt

SEQ ID NO: 3051364 - DNA, 15 bp, Homo sapiens
catctctgcctttga

SEQ ID NO: 3051365 - DNA, 14 bp, Homo sapiens
catctctgtcagtg

SEQ ID NO: 3051366 - DNA, 13 bp, Homo sapiens
catctctttgaat

SEQ ID NO: 3051367 - DNA, 15 bp, Homo sapiens
catctctttgaattt

SEQ ID NO: 3051368 - DNA, 22 bp, Homo sapiens
catctctttgaattttctgtgt

SEQ ID NO: 3051369 - DNA, 22 bp, Homo sapiens
catctgaaggggcaaattcttt

SEQ ID NO: 3051370 - DNA, 18 bp, Homo sapiens
catctgaatgaaaataac

SEQ ID NO: 3051371 - DNA, 21 bp, Homo sapiens
catctgaatgaaaataactga

SEQ ID NO: 3051372 - DNA, 12 bp, Homo sapiens
catctgaccatc

SEQ ID NO: 3051373 - DNA, 15 bp, Homo sapiens
catctgaccatctgt

SEQ ID NO: 3051374 - DNA, 16 bp, Homo sapiens
catctgaccatctgtg

SEQ ID NO: 3051375 - DNA, 13 bp, Homo sapiens
catctgacccaga

SEQ ID NO: 3051376 - DNA, 20 bp, Homo sapiens
catctgagaaacctgttgaa

SEQ ID NO: 3051377 - DNA, 11 bp, Homo sapiens
catctgcaaag

SEQ ID NO: 3051378 - DNA, 13 bp, Homo sapiens
catctgcatgtct

SEQ ID NO: 3051379 - DNA, 16 bp, Homo sapiens
catctgcattgcccag

SEQ ID NO: 3051380 - DNA, 19 bp, Homo sapiens
catctgccacaaaaatgtt

SEQ ID NO: 3051381 - DNA, 23 bp, Homo sapiens
catctgccacaaaaatgttcact

SEQ ID NO: 3051382 - DNA, 21 bp, Homo sapiens
catctgcccgcctgcccacct

SEQ ID NO: 3051383 - DNA, 20 bp, Homo sapiens
catctgccgtgcctggatcc

SEQ ID NO: 3051384 - DNA, 19 bp, Homo sapiens
catctgcgtgacaataaaa

SEQ ID NO: 3051385 - DNA, 23 bp, Homo sapiens
catctgcgtgacaataaaacatt

SEQ ID NO: 3051386 - DNA, 11 bp, Homo sapiens
catctgctgca

SEQ ID NO: 3051387 - DNA, 14 bp, Homo sapiens
catctgctgcacat

SEQ ID NO: 3051388 - DNA, 18 bp, Homo sapiens
catctggatgccttcccc

SEQ ID NO: 3051389 - DNA, 17 bp, Homo sapiens
catctgggctcctccag

SEQ ID NO: 3051390 - DNA, 17 bp, Homo sapiens
catctgggtgccctgaa

SEQ ID NO: 3051391 - DNA, 19 bp, Homo sapiens
catctgggtgccctgaaag

SEQ ID NO: 3051392 - DNA, 21 bp, Homo sapiens
catctgtccacatccccagag

SEQ ID NO: 3051393 - DNA, 15 bp, Homo sapiens
catctgtccatcctc

SEQ ID NO: 3051394 - DNA, 16 bp, Homo sapiens
catctgtccatcctcc

SEQ ID NO: 3051395 - DNA, 21 bp, Homo sapiens
catctgtccatcctcctctcc

SEQ ID NO: 3051396 - DNA, 22 bp, Homo sapiens
catctgtccatcctcctctcca

SEQ ID NO: 3051397 - DNA, 16 bp, Homo sapiens
catctgtcctgacaga

SEQ ID NO: 3051398 - DNA, 21 bp, Homo sapiens
catctgtgactataaagctgt

SEQ ID NO: 3051399 - DNA, 15 bp, Homo sapiens
catctgtgattccct

SEQ ID NO: 3051400 - DNA, 16 bp, Homo sapiens
catctgtgcagggctg

SEQ ID NO: 3051401 - DNA, 18 bp, Homo sapiens
catctgtgcagggctggt

SEQ ID NO: 3051402 - DNA, 13 bp, Homo sapiens
catctgtgcgtgt

SEQ ID NO: 3051403 - DNA, 16 bp, Homo sapiens
catctgtggttttcct

SEQ ID NO: 3051404 - DNA, 11 bp, Homo sapiens
catctgtgtct

SEQ ID NO: 3051405 - DNA, 13 bp, Homo sapiens
catctgtgtcttg

SEQ ID NO: 3051406 - DNA, 11 bp, Homo sapiens
catctgtgttc

SEQ ID NO: 3051407 - DNA, 13 bp, Homo sapiens
catcttactgaag

SEQ ID NO: 3051408 - DNA, 15 bp, Homo sapiens
catcttactgaaggt

SEQ ID NO: 3051409 - DNA, 17 bp, Homo sapiens
catcttagttctgtata

SEQ ID NO: 3051410 - DNA, 23 bp, Homo sapiens
catcttagttctgtatataaata

SEQ ID NO: 3051411 - DNA, 13 bp, Homo sapiens
catcttcacccag

SEQ ID NO: 3051412 - DNA, 18 bp, Homo sapiens
catcttcacccaggccta

SEQ ID NO: 3051413 - DNA, 13 bp, Homo sapiens
catcttcatataa

SEQ ID NO: 3051414 - DNA, 22 bp, Homo sapiens
catcttccacctcacctctttg

SEQ ID NO: 3051415 - DNA, 18 bp, Homo sapiens
catcttccagaagtgtga

SEQ ID NO: 3051416 - DNA, 21 bp, Homo sapiens
catcttccagaagtgtgattg

SEQ ID NO: 3051417 - DNA, 13 bp, Homo sapiens
catcttccagcca

SEQ ID NO: 3051418 - DNA, 16 bp, Homo sapiens
catcttccctgcccct

SEQ ID NO: 3051419 - DNA, 18 bp, Homo sapiens
catcttcgggaccaggat

SEQ ID NO: 3051420 - DNA, 23 bp, Homo sapiens
catcttcgtcttcactcttaggc

SEQ ID NO: 3051421 - DNA, 20 bp, Homo sapiens
catcttctgttgctctctgt

SEQ ID NO: 3051422 - DNA, 16 bp, Homo sapiens
catcttgaccaagcag

SEQ ID NO: 3051423 - DNA, 17 bp, Homo sapiens
catcttgaccaagcagg

SEQ ID NO: 3051424 - DNA, 20 bp, Homo sapiens
catcttgaccaagcaggaag

SEQ ID NO: 3051425 - DNA, 24 bp, Homo sapiens
catcttgaccaagcaggaagctca

SEQ ID NO: 3051426 - DNA, 19 bp, Homo sapiens
catcttgccaagggtccct

SEQ ID NO: 3051427 - DNA, 15 bp, Homo sapiens
catcttgcctccagg

SEQ ID NO: 3051428 - DNA, 14 bp, Homo sapiens
catcttgcttccaa

SEQ ID NO: 3051429 - DNA, 15 bp, Homo sapiens
catcttgtgttttat

SEQ ID NO: 3051430 - DNA, 21 bp, Homo sapiens
catctttaatcaatgtgacat

SEQ ID NO: 3051431 - DNA, 12 bp, Homo sapiens
catctttcacat

SEQ ID NO: 3051432 - DNA, 23 bp, Homo sapiens
catctttcctcaagtatcttcta

SEQ ID NO: 3051433 - DNA, 11 bp, Homo sapiens
catctttctct

SEQ ID NO: 3051434 - DNA, 11 bp, Homo sapiens
catctttgggg

SEQ ID NO: 3051435 - DNA, 15 bp, Homo sapiens
catctttggggaggt

SEQ ID NO: 3051436 - DNA, 18 bp, Homo sapiens
catctttggggaggtgtt

SEQ ID NO: 3051437 - DNA, 21 bp, Homo sapiens
catctttggggaggtgttcac

SEQ ID NO: 3051438 - DNA, 14 bp, Homo sapiens
catcttttaagaca

SEQ ID NO: 3051439 - DNA, 16 bp, Homo sapiens
catcttttaagacaaa

SEQ ID NO: 3051440 - DNA, 21 bp, Homo sapiens
catcttttaatcatgagcctg

SEQ ID NO: 3051441 - DNA, 22 bp, Homo sapiens
catcttttaatcatgagcctgt

SEQ ID NO: 3051442 - DNA, 23 bp, Homo sapiens
catcttttaatcatgagcctgtt

SEQ ID NO: 3051443 - DNA, 14 bp, Homo sapiens
catcttttgtgaga

SEQ ID NO: 3051444 - DNA, 21 bp, Homo sapiens
catcttttgtgagatgtaatt

SEQ ID NO: 3051445 - DNA, 17 bp, Homo sapiens
catgaaaaaccattttt

SEQ ID NO: 3051446 - DNA, 13 bp, Homo sapiens
catgaaaacattg

SEQ ID NO: 3051447 - DNA, 14 bp, Homo sapiens
catgaaaatttgtt

SEQ ID NO: 3051448 - DNA, 17 bp, Homo sapiens
catgaaaatttgtttga

SEQ ID NO: 3051449 - DNA, 12 bp, Homo sapiens
catgaaacatta

SEQ ID NO: 3051450 - DNA, 16 bp, Homo sapiens
catgaaatttttgtaa

SEQ ID NO: 3051451 - DNA, 18 bp, Homo sapiens
catgaaatttttgtaaat

SEQ ID NO: 3051452 - DNA, 23 bp, Homo sapiens
catgaacttcgcatcaaaagaca

SEQ ID NO: 3051453 - DNA, 18 bp, Homo sapiens
catgaagattctttccca

SEQ ID NO: 3051454 - DNA, 14 bp, Homo sapiens
catgaagccttgct

SEQ ID NO: 3051455 - DNA, 18 bp, Homo sapiens
catgaatcaaaagtgcct

SEQ ID NO: 3051456 - DNA, 18 bp, Homo sapiens
catgaatcgcttctcttt

SEQ ID NO: 3051457 - DNA, 17 bp, Homo sapiens
catgaatctttgtttca

SEQ ID NO: 3051458 - DNA, 14 bp, Homo sapiens
catgaattcatact

SEQ ID NO: 3051459 - DNA, 16 bp, Homo sapiens
catgaattcatactct

SEQ ID NO: 3051460 - DNA, 17 bp, Homo sapiens
catgaattcatactctg

SEQ ID NO: 3051461 - DNA, 12 bp, Homo sapiens
catgaattccct

SEQ ID NO: 3051462 - DNA, 22 bp, Homo sapiens
catgaatttattgcacattgtt

SEQ ID NO: 3051463 - DNA, 23 bp, Homo sapiens
catgaatttattgcacattgttc

SEQ ID NO: 3051464 - DNA, 19 bp, Homo sapiens
catgacaagatgggacagc

SEQ ID NO: 3051465 - DNA, 16 bp, Homo sapiens
catgacatcaaaatga

SEQ ID NO: 3051466 - DNA, 17 bp, Homo sapiens
catgacatttaccagca

SEQ ID NO: 3051467 - DNA, 11 bp, Homo sapiens
catgacccagt

SEQ ID NO: 3051468 - DNA, 13 bp, Homo sapiens
catgaccctctgt

SEQ ID NO: 3051469 - DNA, 14 bp, Homo sapiens
catgaccctctgtc

SEQ ID NO: 3051470 - DNA, 18 bp, Homo sapiens
catgaccctctgtcccca

SEQ ID NO: 3051471 - DNA, 23 bp, Homo sapiens
catgaccctctgtccccaggcct

SEQ ID NO: 3051472 - DNA, 20 bp, Homo sapiens
catgaccttatccttcctct

SEQ ID NO: 3051473 - DNA, 18 bp, Homo sapiens
cagtgacgtgactcagag

SEQ ID NO: 3051474 - DNA, 14 bp, Homo sapiens
cagtgatgcctgcc

SEQ ID NO: 3051475 - DNA, 20 bp, Homo sapiens
cagtgatgctggatgctcct

SEQ ID NO: 3051476 - DNA, 23 bp, Homo sapiens
cagtgattcgcttttggtatttg

SEQ ID NO: 3051477 - DNA, 21 bp, Homo sapiens
cagtgatttttagtaaccttt

SEQ ID NO: 3051478 - DNA, 22 bp, Homo sapiens
cagtgatttttagtaaccttta

SEQ ID NO: 3051479 - DNA, 16 bp, Homo sapiens
cagtgcaacctctgct

SEQ ID NO: 3051480 - DNA, 21 bp, Homo sapiens
cagtgcaacctctgcttccca

SEQ ID NO: 3051481 - DNA, 19 bp, Homo sapiens
cagtgcacctgcctcagct

SEQ ID NO: 3051482 - DNA, 19 bp, Homo sapiens
cagtgcactaattctgcat

SEQ ID NO: 3051483 - DNA, 22 bp, Homo sapiens
cagtgcactccggcctgggtga

SEQ ID NO: 3051484 - DNA, 15 bp, Homo sapiens
cagtgcagaatgtaa

SEQ ID NO: 3051485 - DNA, 18 bp, Homo sapiens
cagtgcaggctggccagc

SEQ ID NO: 3051486 - DNA, 20 bp, Homo sapiens
cagtgcaggctggccagccg

SEQ ID NO: 3051487 - DNA, 20 bp, Homo sapiens
cagtgcatggtggccagagg

SEQ ID NO: 3051488 - DNA, 17 bp, Homo sapiens
cagtgcattttgtttct

SEQ ID NO: 3051489 - DNA, 21 bp, Homo sapiens
cagtgcattttgtttctgtat

SEQ ID NO: 3051490 - DNA, 23 bp, Homo sapiens
cagtgcattttgtttctgtatat

SEQ ID NO: 3051491 - DNA, 20 bp, Homo sapiens
cagtgccaactgtggctggt

SEQ ID NO: 3051492 - DNA, 14 bp, Homo sapiens
cagtgccagccaat

SEQ ID NO: 3051493 - DNA, 20 bp, Homo sapiens
cagtgccagcccctgctggc

SEQ ID NO: 3051494 - DNA, 22 bp, Homo sapiens
cagtgccagcccctgctggctg

SEQ ID NO: 3051495 - DNA, 15 bp, Homo sapiens
cagtgccagctccct

SEQ ID NO: 3051496 - DNA, 21 bp, Homo sapiens
cagtgcccaccaacatcccat

SEQ ID NO: 3051497 - DNA, 13 bp, Homo sapiens
cagtgccctgaga

SEQ ID NO: 3051498 - DNA, 14 bp, Homo sapiens
cagtgccgaggaca

SEQ ID NO: 3051499 - DNA, 12 bp, Homo sapiens
cagtgcctgctg

SEQ ID NO: 3051500 - DNA, 12 bp, Homo sapiens
cagtgccttctc

SEQ ID NO: 3051501 - DNA, 15 bp, Homo sapiens
cagtgccttctctca

SEQ ID NO: 3051502 - DNA, 23 bp, Homo sapiens
cagtgccttctctcagctcccag

SEQ ID NO: 3051503 - DNA, 23 bp, Homo sapiens
cagtgctgaccagacagcctccc

SEQ ID NO: 3051504 - DNA, 13 bp, Homo sapiens
cagtgctgcatgc

SEQ ID NO: 3051505 - DNA, 20 bp, Homo sapiens
cagtgctgcccatgagcaag

SEQ ID NO: 3051506 - DNA, 12 bp, Homo sapiens
cagtgctgtgct

SEQ ID NO: 3051507 - DNA, 19 bp, Homo sapiens
cagtgctgtgctgtgctat

SEQ ID NO: 3051508 - DNA, 23 bp, Homo sapiens
cagtgcttctccaacactgaagt

SEQ ID NO: 3051509 - DNA, 20 bp, Homo sapiens
cagtgcttgagtttggggaa

SEQ ID NO: 3051510 - DNA, 21 bp, Homo sapiens
cagtggaacacaaatgaaaat

SEQ ID NO: 3051511 - DNA, 17 bp, Homo sapiens
cagtggaaggacactct

SEQ ID NO: 3051512 - DNA, 23 bp, Homo sapiens
cagtggaatataaggaaagcaat

SEQ ID NO: 3051513 - DNA, 11 bp, Homo sapiens
cagtggagagg

SEQ ID NO: 3051514 - DNA, 19 bp, Homo sapiens
cagtggcacgatctcagct

SEQ ID NO: 3051515 - DNA, 22 bp, Homo sapiens
cagtggcctggccgttcagcct

SEQ ID NO: 3051516 - DNA, 19 bp, Homo sapiens
cagtggccttacccctgcc

SEQ ID NO: 3051517 - DNA, 15 bp, Homo sapiens
cagtggccttgcttc

SEQ ID NO: 3051518 - DNA, 20 bp, Homo sapiens
cagtggcgcattctaggctc

SEQ ID NO: 3051519 - DNA, 22 bp, Homo sapiens
cagtggctggaagaaccactgt

SEQ ID NO: 3051520 - DNA, 19 bp, Homo sapiens
cagtgggaacgtgactgcc

SEQ ID NO: 3051521 - DNA, 13 bp, Homo sapiens
cagtgggagaaaa

SEQ ID NO: 3051522 - DNA, 13 bp, Homo sapiens
cagtgggcaggtg

SEQ ID NO: 3051523 - DNA, 17 bp, Homo sapiens
cagtgggcaggtggccg

SEQ ID NO: 3051524 - DNA, 21 bp, Homo sapiens
cagtgggcctggccagcaggt

SEQ ID NO: 3051525 - DNA, 20 bp, Homo sapiens
cagtgggctgcacgctcccc

SEQ ID NO: 3051526 - DNA, 15 bp, Homo sapiens
cagtggggcagtcat

SEQ ID NO: 3051527 - DNA, 19 bp, Homo sapiens
cagtggggctctctgagtc

SEQ ID NO: 3051528 - DNA, 20 bp, Homo sapiens
cagtggggctctctgagtcc

SEQ ID NO: 3051529 - DNA, 22 bp, Homo sapiens
cagtggggtcaagctgagctgg

SEQ ID NO: 3051530 - DNA, 15 bp, Homo sapiens
cagtgggtaaaatta

SEQ ID NO: 3051531 - DNA, 13 bp, Homo sapiens
cagtggtctcaca

SEQ ID NO: 3051532 - DNA, 22 bp, Homo sapiens
cagtggtggcaacattcattgc

SEQ ID NO: 3051533 - DNA, 12 bp, Homo sapiens
cagtggtggcag

SEQ ID NO: 3051534 - DNA, 16 bp, Homo sapiens
cagtggtgtgtgaagt

SEQ ID NO: 3051535 - DNA, 20 bp, Homo sapiens
cagtggtgtgtgaagtttgg

SEQ ID NO: 3051536 - DNA, 19 bp, Homo sapiens
cagtgtaatgtgacttcat

SEQ ID NO: 3051537 - DNA, 12 bp, Homo sapiens
cagtgtaatttc

SEQ ID NO: 3051538 - DNA, 16 bp, Homo sapiens
cagtgtaatttctttg

SEQ ID NO: 3051539 - DNA, 20 bp, Homo sapiens
cagtgtaatttctttgcctg

SEQ ID NO: 3051540 - DNA, 16 bp, Homo sapiens
cagtgtacatgtacat

SEQ ID NO: 3051541 - DNA, 17 bp, Homo sapiens
cagtgtacatgtacata

SEQ ID NO: 3051542 - DNA, 11 bp, Homo sapiens
cagtgtcattt

SEQ ID NO: 3051543 - DNA, 12 bp, Homo sapiens
cagtgtcatttg

SEQ ID NO: 3051544 - DNA, 20 bp, Homo sapiens
cagtgtccttggcaggctga

SEQ ID NO: 3051545 - DNA, 17 bp, Homo sapiens
cagtgtctggctgcaga

SEQ ID NO: 3051546 - DNA, 13 bp, Homo sapiens
caggcttcctggt

SEQ ID NO: 3051547 - DNA, 16 bp, Homo sapiens
caggcttgcctgggct

SEQ ID NO: 3051548 - DNA, 21 bp, Homo sapiens
caggcttgcctgggctgggca

SEQ ID NO: 3051549 - DNA, 17 bp, Homo sapiens
cagggaaaagcagctct

SEQ ID NO: 3051550 - DNA, 20 bp, Homo sapiens
cagggaaaagcagctctccc

SEQ ID NO: 3051551 - DNA, 21 bp, Homo sapiens
cagggaaaagcagctctcccc

SEQ ID NO: 3051552 - DNA, 13 bp, Homo sapiens
cagggaaattaat

SEQ ID NO: 3051553 - DNA, 20 bp, Homo sapiens
cagggaacatatttaaggaa

SEQ ID NO: 3051554 - DNA, 20 bp, Homo sapiens
cagggaactgcttgcccagg

SEQ ID NO: 3051555 - DNA, 15 bp, Homo sapiens
cagggaagctacagg

SEQ ID NO: 3051556 - DNA, 17 bp, Homo sapiens
cagggaagctacaggtt

SEQ ID NO: 3051557 - DNA, 18 bp, Homo sapiens
cagggaagctacaggtta

SEQ ID NO: 3051558 - DNA, 22 bp, Homo sapiens
cagggaagctacaggttacaac

SEQ ID NO: 3051559 - DNA, 16 bp, Homo sapiens
cagggaagtccccagg

SEQ ID NO: 3051560 - DNA, 17 bp, Homo sapiens
cagggaagtccccaggc

SEQ ID NO: 3051561 - DNA, 21 bp, Homo sapiens
cagggaagtgtaagaaacaca

SEQ ID NO: 3051562 - DNA, 14 bp, Homo sapiens
cagggacagagaca

SEQ ID NO: 3051563 - DNA, 20 bp, Homo sapiens
cagggacagagacacctgca

SEQ ID NO: 3051564 - DNA, 22 bp, Homo sapiens
cagggacagagacacctgcacc

SEQ ID NO: 3051565 - DNA, 16 bp, Homo sapiens
cagggacagaggcccc

SEQ ID NO: 3051566 - DNA, 19 bp, Homo sapiens
cagggacatgccctgtgtg

SEQ ID NO: 3051567 - DNA, 16 bp, Homo sapiens
cagggacccaaagcag

SEQ ID NO: 3051568 - DNA, 16 bp, Homo sapiens
cagggacccctgccct

SEQ ID NO: 3051569 - DNA, 19 bp, Homo sapiens
cagggacccggggtctcct

SEQ ID NO: 3051570 - DNA, 19 bp, Homo sapiens
cagggaccctggagtattt

SEQ ID NO: 3051571 - DNA, 22 bp, Homo sapiens
cagggacgaagaagagccacag

SEQ ID NO: 3051572 - DNA, 21 bp, Homo sapiens
cagggactcggcccagggccg

SEQ ID NO: 3051573 - DNA, 12 bp, Homo sapiens
cagggagaagct

SEQ ID NO: 3051574 - DNA, 21 bp, Homo sapiens
cagggagacctggacacaggc

SEQ ID NO: 3051575 - DNA, 22 bp, Homo sapiens
cagggagacggtttccagggag

SEQ ID NO: 3051576 - DNA, 13 bp, Homo sapiens
cagggagaggctg

SEQ ID NO: 3051577 - DNA, 21 bp, Homo sapiens
cagggagaggctgtgtccctg

SEQ ID NO: 3051578 - DNA, 22 bp, Homo sapiens
cagggagaggctgtgtccctgc

SEQ ID NO: 3051579 - DNA, 18 bp, Homo sapiens
cagggagagttggggaag

SEQ ID NO: 3051580 - DNA, 22 bp, Homo sapiens
cagggagagttggggaaggcaa

SEQ ID NO: 3051581 - DNA, 17 bp, Homo sapiens
cagggagcaccacggcc

SEQ ID NO: 3051582 - DNA, 19 bp, Homo sapiens
cagggagcaccacggccag

SEQ ID NO: 3051583 - DNA, 19 bp, Homo sapiens
cagggagcattttcctcca

SEQ ID NO: 3051584 - DNA, 13 bp, Homo sapiens
cagggagcggaaa

SEQ ID NO: 3051585 - DNA, 18 bp, Homo sapiens
cagggagcggaaagcagc

SEQ ID NO: 3051586 - DNA, 21 bp, Homo sapiens
cagggagcggccggccagccc

SEQ ID NO: 3051587 - DNA, 15 bp, Homo sapiens
cagggagctgggaca

SEQ ID NO: 3051588 - DNA, 15 bp, Homo sapiens
cagggagctgggccc

SEQ ID NO: 3051589 - DNA, 13 bp, Homo sapiens
caggcagagctga

SEQ ID NO: 3051590 - DNA, 17 bp, Homo sapiens
caggcagataactgctg

SEQ ID NO: 3051591 - DNA, 19 bp, Homo sapiens
caggcagataactgctgta

SEQ ID NO: 3051592 - DNA, 13 bp, Homo sapiens
caggcagatccag

SEQ ID NO: 3051593 - DNA, 18 bp, Homo sapiens
caggcagatccaggacta

SEQ ID NO: 3051594 - DNA, 22 bp, Homo sapiens
caggcagggccaacccttctcc

SEQ ID NO: 3051595 - DNA, 17 bp, Homo sapiens
caggcaggtctgcaagg

SEQ ID NO: 3051596 - DNA, 20 bp, Homo sapiens
caggcaggtctgcaagggcc

SEQ ID NO: 3051597 - DNA, 22 bp, Homo sapiens
caggcaggtctgcaagggccca

SEQ ID NO: 3051598 - DNA, 23 bp, Homo sapiens
caggcaggtctgcaagggcccag

SEQ ID NO: 3051599 - DNA, 22 bp, Homo sapiens
caggcagtgtcttaaggagact

SEQ ID NO: 3051600 - DNA, 21 bp, Homo sapiens
caggcatcggggagccgggag

SEQ ID NO: 3051601 - DNA, 23 bp, Homo sapiens
caggcatgagccaccacacctgg

SEQ ID NO: 3051602 - DNA, 17 bp, Homo sapiens
caggcatggccctgggc

SEQ ID NO: 3051603 - DNA, 19 bp, Homo sapiens
caggcatggctggtgcctg

SEQ ID NO: 3051604 - DNA, 14 bp, Homo sapiens
caggcatggggggt

SEQ ID NO: 3051605 - DNA, 18 bp, Homo sapiens
caggcatgtgtcccttcc

SEQ ID NO: 3051606 - DNA, 19 bp, Homo sapiens
caggcattgccaagggctt

SEQ ID NO: 3051607 - DNA, 16 bp, Homo sapiens
caggccacaaatgtgt

SEQ ID NO: 3051608 - DNA, 19 bp, Homo sapiens
caggccagctccttttctg

SEQ ID NO: 3051609 - DNA, 21 bp, Homo sapiens
caggccagctccttttctgtg

SEQ ID NO: 3051610 - DNA, 15 bp, Homo sapiens
caggccagctgcctc

SEQ ID NO: 3051611 - DNA, 21 bp, Homo sapiens
caggccagggctcctgtggca

SEQ ID NO: 3051612 - DNA, 16 bp, Homo sapiens
caggccagggctgggt

SEQ ID NO: 3051613 - DNA, 17 bp, Homo sapiens
caggccagggctgggtc

SEQ ID NO: 3051614 - DNA, 12 bp, Homo sapiens
caggccaggtgg

SEQ ID NO: 3051615 - DNA, 18 bp, Homo sapiens
caggccaggtgggcggac

SEQ ID NO: 3051616 - DNA, 20 bp, Homo sapiens
caggccaggtgggcggacaa

SEQ ID NO: 3051617 - DNA, 17 bp, Homo sapiens
caggccatgtggcctgc

SEQ ID NO: 3051618 - DNA, 18 bp, Homo sapiens
caggccatgtggcctgcc

SEQ ID NO: 3051619 - DNA, 23 bp, Homo sapiens
caggccatgtggcctgcccagcc

SEQ ID NO: 3051620 - DNA, 13 bp, Homo sapiens
caggccccaggaa

SEQ ID NO: 3051621 - DNA, 17 bp, Homo sapiens
caggcccccaagcctgc

SEQ ID NO: 3051622 - DNA, 14 bp, Homo sapiens
caggaactgtcatg

SEQ ID NO: 3051623 - DNA, 16 bp, Homo sapiens
caggaagcagggagag

SEQ ID NO: 3051624 - DNA, 20 bp, Homo sapiens
caggaagcagggagagttgg

SEQ ID NO: 3051625 - DNA, 23 bp, Homo sapiens
caggaagcccactgcctcctccc

SEQ ID NO: 3051626 - DNA, 13 bp, Homo sapiens
caggaagccccca

SEQ ID NO: 3051627 - DNA, 23 bp, Homo sapiens
caggaagctttggtgagaacctg

SEQ ID NO: 3051628 - DNA, 17 bp, Homo sapiens
caggaaggaaaactatg

SEQ ID NO: 3051629 - DNA, 15 bp, Homo sapiens
caggaaggacagact

SEQ ID NO: 3051630 - DNA, 21 bp, Homo sapiens
caggaaggacagactggccgg

SEQ ID NO: 3051631 - DNA, 22 bp, Homo sapiens
caggaaggacagactggccggg

SEQ ID NO: 3051632 - DNA, 22 bp, Homo sapiens
caggaaggagcggcgccctgga

SEQ ID NO: 3051633 - DNA, 13 bp, Homo sapiens
caggaaggcagaa

SEQ ID NO: 3051634 - DNA, 14 bp, Homo sapiens
caggaaggcctagg

SEQ ID NO: 3051635 - DNA, 22 bp, Homo sapiens
caggaagggcctacagcccatt

SEQ ID NO: 3051636 - DNA, 22 bp, Homo sapiens
caggaaggtctgatttgcagga

SEQ ID NO: 3051637 - DNA, 19 bp, Homo sapiens
caggaatattgtcatcctt

SEQ ID NO: 3051638 - DNA, 14 bp, Homo sapiens
caggaatgatctct

SEQ ID NO: 3051639 - DNA, 19 bp, Homo sapiens
caggaatgttaaagtcagt

SEQ ID NO: 3051640 - DNA, 20 bp, Homo sapiens
caggaatttcccaggaccct

SEQ ID NO: 3051641 - DNA, 21 bp, Homo sapiens
caggaatttcccaggaccctg

SEQ ID NO: 3051642 - DNA, 20 bp, Homo sapiens
caggaatttgggaccctgct

SEQ ID NO: 3051643 - DNA, 18 bp, Homo sapiens
caggacaacgaggaagcc

SEQ ID NO: 3051644 - DNA, 19 bp, Homo sapiens
caggacaacgaggaagccc

SEQ ID NO: 3051645 - DNA, 19 bp, Homo sapiens
cagctactcaggaggctga

SEQ ID NO: 3051646 - DNA, 23 bp, Homo sapiens
cagctactggggaggctgaggca

SEQ ID NO: 3051647 - DNA, 18 bp, Homo sapiens
cagctacttagctggcca

SEQ ID NO: 3051648 - DNA, 22 bp, Homo sapiens
cagctacttagctggccaagga

SEQ ID NO: 3051649 - DNA, 19 bp, Homo sapiens
cagctacttgggaggctga

SEQ ID NO: 3051650 - DNA, 16 bp, Homo sapiens
cagctaggaagagcag

SEQ ID NO: 3051651 - DNA, 21 bp, Homo sapiens
cagctagttggggagctaagg

SEQ ID NO: 3051652 - DNA, 19 bp, Homo sapiens
cagctatacctgtgcctcg

SEQ ID NO: 3051653 - DNA, 22 bp, Homo sapiens
cagctatacctgtgcctcggct

SEQ ID NO: 3051654 - DNA, 22 bp, Homo sapiens
cagctcacaccctaccttcccc

SEQ ID NO: 3051655 - DNA, 18 bp, Homo sapiens
cagctcactgcaagctcc

SEQ ID NO: 3051656 - DNA, 14 bp, Homo sapiens
cagctcagcttccc

SEQ ID NO: 3051657 - DNA, 12 bp, Homo sapiens
cagctcaggaca

SEQ ID NO: 3051658 - DNA, 17 bp, Homo sapiens
cagctcaggggacactg

SEQ ID NO: 3051659 - DNA, 21 bp, Homo sapiens
cagagctgaagagttgccccg

SEQ ID NO: 3051660 - DNA, 13 bp, Homo sapiens
cagagctgcacag

SEQ ID NO: 3051661 - DNA, 14 bp, Homo sapiens
cagagctgcctccc

SEQ ID NO: 3051662 - DNA, 15 bp, Homo sapiens
cagagctgcttctgt

SEQ ID NO: 3051663 - DNA, 19 bp, Homo sapiens
cagagctgcttctgtctgg

SEQ ID NO: 3051664 - DNA, 20 bp, Homo sapiens
cagagcttcttccaggtgcc

SEQ ID NO: 3051665 - DNA, 15 bp, Homo sapiens
cagagctttggtctg

SEQ ID NO: 3051666 - DNA, 16 bp, Homo sapiens
cagaggaaggggccag

SEQ ID NO: 3051667 - DNA, 18 bp, Homo sapiens
cagaggaatcactcttgt

SEQ ID NO: 3051668 - DNA, 22 bp, Homo sapiens
cagaggaattgattgtcagcca

SEQ ID NO: 3051669 - DNA, 19 bp, Homo sapiens
cagaggaatttggctgctt

SEQ ID NO: 3051670 - DNA, 21 bp, Homo sapiens
cagaggactgtgatgccctgc

SEQ ID NO: 3051671 - DNA, 20 bp, Homo sapiens
cagaggagagatagcctgtg

SEQ ID NO: 3051672 - DNA, 11 bp, Homo sapiens
cagaggagccc

SEQ ID NO: 3051673 - DNA, 22 bp, Homo sapiens
cagaggagcccagtgggctgca

SEQ ID NO: 3051674 - DNA, 23 bp, Homo sapiens
cagaggagcccagtgggctgcac

SEQ ID NO: 3051675 - DNA, 15 bp, Homo sapiens
cagaggagccttttt

SEQ ID NO: 3051676 - DNA, 14 bp, Homo sapiens
cagaggaggggccg

SEQ ID NO: 3051677 - DNA, 23 bp, Homo sapiens
cagaggatgagctctacccaggg

SEQ ID NO: 3051678 - DNA, 13 bp, Homo sapiens
cagaggcagaggt

SEQ ID NO: 3051679 - DNA, 18 bp, Homo sapiens
cagaggcagaggttgcag

SEQ ID NO: 3051680 - DNA, 21 bp, Homo sapiens
cagaggcagcccgcacacctg

SEQ ID NO: 3051681 - DNA, 20 bp, Homo sapiens
cagaggccctcgctgccagc

SEQ ID NO: 3051682 - DNA, 21 bp, Homo sapiens
cagaggccgcgcgtccagctg

SEQ ID NO: 3051683 - DNA, 12 bp, Homo sapiens
cagaggcctctt

SEQ ID NO: 3051684 - DNA, 23 bp, Homo sapiens
cagaggcctgggggacccctggc

SEQ ID NO: 3051685 - DNA, 18 bp, Homo sapiens
cagaggcgcactgtgacc

SEQ ID NO: 3051686 - DNA, 23 bp, Homo sapiens
cagaggctaattcagtgtcacat

SEQ ID NO: 3051687 - DNA, 16 bp, Homo sapiens
cagaggctggaggcag

SEQ ID NO: 3051688 - DNA, 18 bp, Homo sapiens
cagaggctggaggcaggg

SEQ ID NO: 3051689 - DNA, 20 bp, Homo sapiens
cagaggctggaggcagggcc

SEQ ID NO: 3051690 - DNA, 15 bp, Homo sapiens
cagaggcttcttcag

SEQ ID NO: 3051691 - DNA, 16 bp, Homo sapiens
cagaggcttcttcaga

SEQ ID NO: 3051692 - DNA, 19 bp, Homo sapiens
cagagggaagaaaagagct

SEQ ID NO: 3051693 - DNA, 16 bp, Homo sapiens
cagagggcagaggctg

SEQ ID NO: 3051694 - DNA, 17 bp, Homo sapiens
cagagggcagaggctgg

SEQ ID NO: 3051695 - DNA, 18 bp, Homo sapiens
cagagggcagaggctgga

SEQ ID NO: 3051696 - DNA, 15 bp, Homo sapiens
cagagggcgctcctg

SEQ ID NO: 3051697 - DNA, 11 bp, Homo sapiens
cagagggctgg

SEQ ID NO: 3051698 - DNA, 17 bp, Homo sapiens
cagagggctggaggccc

SEQ ID NO: 3051699 - DNA, 13 bp, Homo sapiens
cagagggctttca

SEQ ID NO: 3051700 - DNA, 22 bp, Homo sapiens
cagagggctttcagcgccccca

SEQ ID NO: 3051701 - DNA, 23 bp, Homo sapiens
cagagggctttcagcgcccccag

SEQ ID NO: 3051702 - DNA, 12 bp, Homo sapiens
cagaggggagca

SEQ ID NO: 3051703 - DNA, 13 bp, Homo sapiens
cagaggggagcag

SEQ ID NO: 3051704 - DNA, 18 bp, Homo sapiens
cagaggggagcagcggct

SEQ ID NO: 3051705 - DNA, 20 bp, Homo sapiens
cagaggggctccccgggtct

SEQ ID NO: 3051706 - DNA, 15 bp, Homo sapiens
cagagggtcacagtg

SEQ ID NO: 3051707 - DNA, 18 bp, Homo sapiens
cagagggtggctggagtg

SEQ ID NO: 3051708 - DNA, 17 bp, Homo sapiens
cagagggtttgtgccca

SEQ ID NO: 3051709 - DNA, 14 bp, Homo sapiens
cagaggtaaaaaaa

SEQ ID NO: 3051710 - DNA, 17 bp, Homo sapiens
cagaggtaaaaaaaaga

SEQ ID NO: 3051711 - DNA, 18 bp, Homo sapiens
cagaggtaaaaaaaagaa

SEQ ID NO: 3051712 - DNA, 13 bp, Homo sapiens
cagaggtaccctg

SEQ ID NO: 3051713 - DNA, 16 bp, Homo sapiens
cagaggtaccctgggt

SEQ ID NO: 3051714 - DNA, 21 bp, Homo sapiens
cagaggttgcagtgagctgag

SEQ ID NO: 3051715 - DNA, 20 bp, Homo sapiens
cagaggttgtagtgagccaa

SEQ ID NO: 3051716 - DNA, 14 bp, Homo sapiens
cagagtaagacatt

SEQ ID NO: 3051717 - DNA, 16 bp, Homo sapiens
cagagtatctaatcct

SEQ ID NO: 3051718 - DNA, 13 bp, Homo sapiens
cagagtatgaaca

SEQ ID NO: 3051719 - DNA, 21 bp, Homo sapiens
cagagtatgaacacctgggct

SEQ ID NO: 3051720 - DNA, 21 bp, Homo sapiens
cagagtccatttcccacatct

SEQ ID NO: 3051721 - DNA, 14 bp, Homo sapiens
cagagtcctttcca

SEQ ID NO: 3051722 - DNA, 23 bp, Homo sapiens
cagagtcggaacggagaaaggtg

SEQ ID NO: 3051723 - DNA, 17 bp, Homo sapiens
cagagtctcgctctgtc

SEQ ID NO: 3051724 - DNA, 20 bp, Homo sapiens
cagagtctgtatttttctaa

SEQ ID NO: 3051725 - DNA, 14 bp, Homo sapiens
cagagtgagaccca

SEQ ID NO: 3051726 - DNA, 20 bp, Homo sapiens
cagagtgagaccctgtctca

SEQ ID NO: 3051727 - DNA, 20 bp, Homo sapiens
cagagtgcaagcccctgctc

SEQ ID NO: 3051728 - DNA, 15 bp, Homo sapiens
cagagtggccacggc

SEQ ID NO: 3051729 - DNA, 21 bp, Homo sapiens
cagagtggccacggcccaggg

SEQ ID NO: 3051730 - DNA, 16 bp, Homo sapiens
cagagtggcctagagc

SEQ ID NO: 3051731 - DNA, 20 bp, Homo sapiens
cagagtggcgtgagctgccc

SEQ ID NO: 3051732 - DNA, 21 bp, Homo sapiens
cagagtggcgtgagctgcccg

SEQ ID NO: 3051733 - DNA, 17 bp, Homo sapiens
cagagtgtagccaggtc

SEQ ID NO: 3051734 - DNA, 19 bp, Homo sapiens
cagagtgtgggaagggaga

SEQ ID NO: 3051735 - DNA, 20 bp, Homo sapiens
cagagtgtgggaagggagag

SEQ ID NO: 3051736 - DNA, 14 bp, Homo sapiens
cagagtgtgttttt

SEQ ID NO: 3051737 - DNA, 23 bp, Homo sapiens
cagagttaaaatgtttactgtaa

SEQ ID NO: 3051738 - DNA, 13 bp, Homo sapiens
cagagttctttgc

SEQ ID NO: 3051739 - DNA, 14 bp, Homo sapiens
cagagttctttgca

SEQ ID NO: 3051740 - DNA, 17 bp, Homo sapiens
cagagtttgtgtgttgt

SEQ ID NO: 3051741 - DNA, 19 bp, Homo sapiens
cagagtttgtgtgttgtct

SEQ ID NO: 3051742 - DNA, 16 bp, Homo sapiens
cagataaaattataga

SEQ ID NO: 3051743 - DNA, 14 bp, Homo sapiens
cagataactgagga

SEQ ID NO: 3051744 - DNA, 20 bp, Homo sapiens
cagataactgaggaggggag

SEQ ID NO: 3051745 - DNA, 20 bp, Homo sapiens
cagataaggtaaaatgccat

SEQ ID NO: 3051746 - DNA, 22 bp, Homo sapiens
cagataaggtaaaatgccatga

SEQ ID NO: 3051747 - DNA, 17 bp, Homo sapiens
cagatacaatgtattta

SEQ ID NO: 3051748 - DNA, 17 bp, Homo sapiens
cagataccttgaaagga

SEQ ID NO: 3051749 - DNA, 18 bp, Homo sapiens
cagataccttgaaaggaa

SEQ ID NO: 3051750 - DNA, 15 bp, Homo sapiens
cagatagaaagcatt

SEQ ID NO: 3051751 - DNA, 21 bp, Homo sapiens
cagatagagagttgttgtgta

SEQ ID NO: 3051752 - DNA, 22 bp, Homo sapiens
cagatagctcaatactctctga

SEQ ID NO: 3051753 - DNA, 16 bp, Homo sapiens
cagatatcaaaattct

SEQ ID NO: 3051754 - DNA, 13 bp, Homo sapiens
cagatatcttttt

SEQ ID NO: 3051755 - DNA, 19 bp, Homo sapiens
cagatcaagctgtgagaca

SEQ ID NO: 3051756 - DNA, 17 bp, Homo sapiens
cagatcatccgtctgtg

SEQ ID NO: 3051757 - DNA, 23 bp, Homo sapiens
cagatcatccgtctgtgtggggt

SEQ ID NO: 3051758 - DNA, 13 bp, Homo sapiens
cagatcatctggg

SEQ ID NO: 3051759 - DNA, 15 bp, Homo sapiens
cagatcatctgggga

SEQ ID NO: 3051760 - DNA, 12 bp, Homo sapiens
cagatccagcct

SEQ ID NO: 3051761 - DNA, 14 bp, Homo sapiens
cagatccagcctgg

SEQ ID NO: 3051762 - DNA, 13 bp, Homo sapiens
cagatccaggact

SEQ ID NO: 3051763 - DNA, 13 bp, Homo sapiens
cagatccagggac

SEQ ID NO: 3051764 - DNA, 14 bp, Homo sapiens
cagatccagggaca

SEQ ID NO: 3051765 - DNA, 15 bp, Homo sapiens
cagatccagggacag

SEQ ID NO: 3051766 - DNA, 14 bp, Homo sapiens
cagatcctccattt

SEQ ID NO: 3051767 - DNA, 17 bp, Homo sapiens
cagatcgctcccttggc

SEQ ID NO: 3051768 - DNA, 14 bp, Homo sapiens
cagatctggaacct

SEQ ID NO: 3051769 - DNA, 22 bp, Homo sapiens
cagatctggaacctcagcctgg

SEQ ID NO: 3051770 - DNA, 19 bp, Homo sapiens
cagatcttggactcatgag

SEQ ID NO: 3051771 - DNA, 19 bp, Homo sapiens
cagatgaatgtatttattt

SEQ ID NO: 3051772 - DNA, 13 bp, Homo sapiens
cacttttaaacta

SEQ ID NO: 3051773 - DNA, 18 bp, Homo sapiens
cacttttatatttgaaaa

SEQ ID NO: 3051774 - DNA, 12 bp, Homo sapiens
cacttttcacct

SEQ ID NO: 3051775 - DNA, 12 bp, Homo sapiens
cacttttgcaag

SEQ ID NO: 3051776 - DNA, 14 bp, Homo sapiens
cactttttttttcc

SEQ ID NO: 3051777 - DNA, 19 bp, Homo sapiens
cagaaaaaatgtctgtaaa

SEQ ID NO: 3051778 - DNA, 20 bp, Homo sapiens
cagaaaaaatgtctgtaaat

SEQ ID NO: 3051779 - DNA, 13 bp, Homo sapiens
cagaaaaataagt

SEQ ID NO: 3051780 - DNA, 22 bp, Homo sapiens
cagaaaaataagtcaaaaggaa

SEQ ID NO: 3051781 - DNA, 13 bp, Homo sapiens
cagaaaaatggag

SEQ ID NO: 3051782 - DNA, 18 bp, Homo sapiens
cagaaaacaattgttctg

SEQ ID NO: 3051783 - DNA, 17 bp, Homo sapiens
cagaaaagcacctgccg

SEQ ID NO: 3051784 - DNA, 11 bp, Homo sapiens
cagaaaatata

SEQ ID NO: 3051785 - DNA, 13 bp, Homo sapiens
cagaaaatatact

SEQ ID NO: 3051786 - DNA, 20 bp, Homo sapiens
cagaaaatatactgtaaaga

SEQ ID NO: 3051787 - DNA, 18 bp, Homo sapiens
cagaaaatgttgagaatc

SEQ ID NO: 3051788 - DNA, 16 bp, Homo sapiens
cagaaaattgcacaat

SEQ ID NO: 3051789 - DNA, 14 bp, Homo sapiens
cagaaacagggaca

SEQ ID NO: 3051790 - DNA, 19 bp, Homo sapiens
cagaaacatcagttactct

SEQ ID NO: 3051791 - DNA, 22 bp, Homo sapiens
cagaaaccaagtctacttcact

SEQ ID NO: 3051792 - DNA, 20 bp, Homo sapiens
cagaaacttgtgaagtggaa

SEQ ID NO: 3051793 - DNA, 20 bp, Homo sapiens
cagaaaggaaaagattcctg

SEQ ID NO: 3051794 - DNA, 13 bp, Homo sapiens
cagaaaggagagt

SEQ ID NO: 3051795 - DNA, 12 bp, Homo sapiens
cagaaaggggct

SEQ ID NO: 3051796 - DNA, 12 bp, Homo sapiens
cagaaagtgcct

SEQ ID NO: 3051797 - DNA, 18 bp, Homo sapiens
cagaaagtggtgctcagt

SEQ ID NO: 3051798 - DNA, 20 bp, Homo sapiens
cagaaagtttgtaaaaatat

SEQ ID NO: 3051799 - DNA, 17 bp, Homo sapiens
cagaaatgtttctgtgt

SEQ ID NO: 3051800 - DNA, 19 bp, Homo sapiens
cagaaatgtttctgtgtca

SEQ ID NO: 3051801 - DNA, 18 bp, Homo sapiens
cagaacacactccatcag

SEQ ID NO: 3051802 - DNA, 12 bp, Homo sapiens
cagaacacctgg

SEQ ID NO: 3051803 - DNA, 11 bp, Homo sapiens
cagaacagagg

SEQ ID NO: 3051804 - DNA, 13 bp, Homo sapiens
cagaacagaggca

SEQ ID NO: 3051805 - DNA, 20 bp, Homo sapiens
cagaacaggtgttggtgaca

SEQ ID NO: 3051806 - DNA, 17 bp, Homo sapiens
cagaacagtggtggcaa

SEQ ID NO: 3051807 - DNA, 18 bp, Homo sapiens
cagaacatcattagaaca

SEQ ID NO: 3051808 - DNA, 15 bp, Homo sapiens
cagaaccatccatag

SEQ ID NO: 3051809 - DNA, 19 bp, Homo sapiens
cagaacccttggcttgccc

SEQ ID NO: 3051810 - DNA, 21 bp, Homo sapiens
cagaacctgtaggatcttatt

SEQ ID NO: 3051811 - DNA, 15 bp, Homo sapiens
cagaactcactgggg

SEQ ID NO: 3051812 - DNA, 15 bp, Homo sapiens
cagaactctctgtct

SEQ ID NO: 3051813 - DNA, 20 bp, Homo sapiens
cagaactcttaaaaatgttt

SEQ ID NO: 3051814 - DNA, 14 bp, Homo sapiens
cagaactctttcaa

SEQ ID NO: 3051815 - DNA, 13 bp, Homo sapiens
cagaactgaaata

SEQ ID NO: 3051816 - DNA, 16 bp, Homo sapiens
cagaactgctggggct

SEQ ID NO: 3051817 - DNA, 20 bp, Homo sapiens
cagaactgctggggctggtg

SEQ ID NO: 3051818 - DNA, 16 bp, Homo sapiens
cagaacttccaaagag

SEQ ID NO: 3051819 - DNA, 18 bp, Homo sapiens
cagaactttgggaggcca

SEQ ID NO: 3051820 - DNA, 12 bp, Homo sapiens
cagaagaaaaca

SEQ ID NO: 3051821 - DNA, 13 bp, Homo sapiens
cagaagaaaattt

SEQ ID NO: 3051822 - DNA, 15 bp, Homo sapiens
cagaagaaaggaaca

SEQ ID NO: 3051823 - DNA, 19 bp, Homo sapiens
cagaagaattgaacccagg

SEQ ID NO: 3051824 - DNA, 16 bp, Homo sapiens
cagaagacccctgact

SEQ ID NO: 3051825 - DNA, 23 bp, Homo sapiens
cagaagactatttaccagggacc

SEQ ID NO: 3051826 - DNA, 19 bp, Homo sapiens
cagaagactcctaggccct

SEQ ID NO: 3051827 - DNA, 20 bp, Homo sapiens
cagaagactcctaggccctt

SEQ ID NO: 3051828 - DNA, 22 bp, Homo sapiens
cagaagcaagggggtgatgtag

SEQ ID NO: 3051829 - DNA, 20 bp, Homo sapiens
cagaagcactgggatcacag

SEQ ID NO: 3051830 - DNA, 14 bp, Homo sapiens
cagaagcagagatg

SEQ ID NO: 3051831 - DNA, 16 bp, Homo sapiens
cagaagctgagcacca

SEQ ID NO: 3051832 - DNA, 22 bp, Homo sapiens
cagaagctgttgggagaaagca

SEQ ID NO: 3051833 - DNA, 21 bp, Homo sapiens
cagaaggaatggtgcgtggct

SEQ ID NO: 3051834 - DNA, 21 bp, Homo sapiens
cagaaggacaggtctctgaga

SEQ ID NO: 3051835 - DNA, 23 bp, Homo sapiens
cagaaggagaaggaaaaagaaag

SEQ ID NO: 3051836 - DNA, 13 bp, Homo sapiens
cagaaggagacag

SEQ ID NO: 3051837 - DNA, 14 bp, Homo sapiens
cagaaggagagtga

SEQ ID NO: 3051838 - DNA, 16 bp, Homo sapiens
cagaaggatgcccaga

SEQ ID NO: 3051839 - DNA, 14 bp, Homo sapiens
cagaaggatttctt

SEQ ID NO: 3051840 - DNA, 15 bp, Homo sapiens
cagaagggaattgct

SEQ ID NO: 3051841 - DNA, 21 bp, Homo sapiens
cagaagggcagatggacttct

SEQ ID NO: 3051842 - DNA, 15 bp, Homo sapiens
cagaagtaactccca

SEQ ID NO: 3051843 - DNA, 15 bp, Homo sapiens
cagaagtaacttatt

SEQ ID NO: 3051844 - DNA, 17 bp, Homo sapiens
cagaagtaacttatttt

SEQ ID NO: 3051845 - DNA, 13 bp, Homo sapiens
cagaagtattctt

SEQ ID NO: 3051846 - DNA, 20 bp, Homo sapiens
cagaagtcctgtatgtctgt

SEQ ID NO: 3051847 - DNA, 14 bp, Homo sapiens
cagaagtgcaaagg

SEQ ID NO: 3051848 - DNA, 22 bp, Homo sapiens
cagaagtgtgattgggaataaa

SEQ ID NO: 3051849 - DNA, 18 bp, Homo sapiens
cagaagtttgcactatct

SEQ ID NO: 3051850 - DNA, 19 bp, Homo sapiens
cagaagtttgtcaagtcaa

SEQ ID NO: 3051851 - DNA, 22 bp, Homo sapiens
cagaataaaagttcctctccct

SEQ ID NO: 3051852 - DNA, 20 bp, Homo sapiens
cagaataagttattgcagtt

SEQ ID NO: 3051853 - DNA, 14 bp, Homo sapiens
cagaatacacttaa

SEQ ID NO: 3051854 - DNA, 22 bp, Homo sapiens
cagaatattgctaggttttgct

SEQ ID NO: 3051855 - DNA, 16 bp, Homo sapiens
cagaatcaaacctttt

SEQ ID NO: 3051856 - DNA, 13 bp, Homo sapiens
cagaatcctgggc

SEQ ID NO: 3051857 - DNA, 23 bp, Homo sapiens
cagaatcctgggcccccagagac

SEQ ID NO: 3051858 - DNA, 15 bp, Homo sapiens
cagaatctctatgta

SEQ ID NO: 3051859 - DNA, 15 bp, Homo sapiens
cagaatctttgttaa

SEQ ID NO: 3051860 - DNA, 16 bp, Homo sapiens
cagaatctttgttaag

SEQ ID NO: 3051861 - DNA, 15 bp, Homo sapiens
cagaatgaaaaatga

SEQ ID NO: 3051862 - DNA, 17 bp, Homo sapiens
cagaatgaaaaatgaaa

SEQ ID NO: 3051863 - DNA, 18 bp, Homo sapiens
cagaatgaaaaatgaaag

SEQ ID NO: 3051864 - DNA, 18 bp, Homo sapiens
cagaatgaacccataggg

SEQ ID NO: 3051865 - DNA, 18 bp, Homo sapiens
cagaatgctgcaggactt

SEQ ID NO: 3051866 - DNA, 15 bp, Homo sapiens
cactaagcagaggag

SEQ ID NO: 3051867 - DNA, 21 bp, Homo sapiens
cactaatactggttatcctgt

SEQ ID NO: 3051868 - DNA, 16 bp, Homo sapiens
cactaatgttagaatt

SEQ ID NO: 3051869 - DNA, 18 bp, Homo sapiens
cactaatttttgtattat

SEQ ID NO: 3051870 - DNA, 19 bp, Homo sapiens
cactaatttttgtattatt

SEQ ID NO: 3051871 - DNA, 20 bp, Homo sapiens
cactaatttttgtattattt

SEQ ID NO: 3051872 - DNA, 23 bp, Homo sapiens
cactaatttttgtattatttttg

SEQ ID NO: 3051873 - DNA, 23 bp, Homo sapiens
cactaccagcgtatatataagaa

SEQ ID NO: 3051874 - DNA, 13 bp, Homo sapiens
cactaccctgaga

SEQ ID NO: 3051875 - DNA, 17 bp, Homo sapiens
cactaccctgagatctg

SEQ ID NO: 3051876 - DNA, 23 bp, Homo sapiens
cactactcgagcccacccagcat

SEQ ID NO: 3051877 - DNA, 16 bp, Homo sapiens
cactagacaagccaga

SEQ ID NO: 3051878 - DNA, 21 bp, Homo sapiens
cactagacaagccagaacttg

SEQ ID NO: 3051879 - DNA, 14 bp, Homo sapiens
cactagagtgctct

SEQ ID NO: 3051880 - DNA, 22 bp, Homo sapiens
cactagtcaccgacagcggcct

SEQ ID NO: 3051881 - DNA, 13 bp, Homo sapiens
cactatttgtgac

SEQ ID NO: 3051882 - DNA, 12 bp, Homo sapiens
cactatttttat

SEQ ID NO: 3051883 - DNA, 12 bp, Homo sapiens
cactcaagccaa

SEQ ID NO: 3051884 - DNA, 18 bp, Homo sapiens
cactcaagccaagcagcc

SEQ ID NO: 3051885 - DNA, 19 bp, Homo sapiens
cactcaaggcggtgcttga

SEQ ID NO: 3051886 - DNA, 19 bp, Homo sapiens
cactcaatccatccatgta

SEQ ID NO: 3051887 - DNA, 16 bp, Homo sapiens
cactcaatgggagaat

SEQ ID NO: 3051888 - DNA, 21 bp, Homo sapiens
cactcacatagccaactctcc

SEQ ID NO: 3051889 - DNA, 23 bp, Homo sapiens
cactcacatagccaactctccca

SEQ ID NO: 3051890 - DNA, 15 bp, Homo sapiens
cactcacccttcctg

SEQ ID NO: 3051891 - DNA, 12 bp, Homo sapiens
cactcagcacaa

SEQ ID NO: 3051892 - DNA, 18 bp, Homo sapiens
cactcagcccctacccct

SEQ ID NO: 3051893 - DNA, 21 bp, Homo sapiens
cactcagccgcagacaagtaa

SEQ ID NO: 3051894 - DNA, 13 bp, Homo sapiens
cactcagggcagc

SEQ ID NO: 3051895 - DNA, 17 bp, Homo sapiens
cactcagggcagctgcc

SEQ ID NO: 3051896 - DNA, 18 bp, Homo sapiens
cactcagggcagctgcct

SEQ ID NO: 3051897 - DNA, 22 bp, Homo sapiens
cactcatgtgactctttccaac

SEQ ID NO: 3051898 - DNA, 21 bp, Homo sapiens
cactcattgctgagcctctgc

SEQ ID NO: 3051899 - DNA, 23 bp, Homo sapiens
cactcattgctgagcctctgctc

SEQ ID NO: 3051900 - DNA, 22 bp, Homo sapiens
cactccaacctaacctgtgtct

SEQ ID NO: 3051901 - DNA, 14 bp, Homo sapiens
cactccaagccccc

SEQ ID NO: 3051902 - DNA, 15 bp, Homo sapiens
cactccaagccccct

SEQ ID NO: 3051903 - DNA, 17 bp, Homo sapiens
cactccaagccccctgg

SEQ ID NO: 3051904 - DNA, 10 bp, Homo sapiens
cactccacca

SEQ ID NO: 3051905 - DNA, 19 bp, Homo sapiens
cactccaccacccaaaagt

SEQ ID NO: 3051906 - DNA, 14 bp, Homo sapiens
cactccagcctgag

SEQ ID NO: 3051907 - DNA, 13 bp, Homo sapiens
cactccagcctgg

SEQ ID NO: 3051908 - DNA, 13 bp, Homo sapiens
cactccagctcct

SEQ ID NO: 3051909 - DNA, 13 bp, Homo sapiens
cactcccactgcc

SEQ ID NO: 3051910 - DNA, 19 bp, Homo sapiens
cactcccactgccaggatt

SEQ ID NO: 3051911 - DNA, 20 bp, Homo sapiens
cactcccccaggattgtgca

SEQ ID NO: 3051912 - DNA, 17 bp, Homo sapiens
cactcccgggatgggtg

SEQ ID NO: 3051913 - DNA, 15 bp, Homo sapiens
cactccctaggccca

SEQ ID NO: 3051914 - DNA, 20 bp, Homo sapiens
cactccctccagcacaaaca

SEQ ID NO: 3051915 - DNA, 18 bp, Homo sapiens
cactccctggccttgccc

SEQ ID NO: 3051916 - DNA, 16 bp, Homo sapiens
cactcccttgggctcc

SEQ ID NO: 3051917 - DNA, 13 bp, Homo sapiens
cactcctcctagc

SEQ ID NO: 3051918 - DNA, 18 bp, Homo sapiens
cactcctcctagccaccc

SEQ ID NO: 3051919 - DNA, 15 bp, Homo sapiens
cactcctcctgccag

SEQ ID NO: 3051920 - DNA, 11 bp, Homo sapiens
cactcctgatt

SEQ ID NO: 3051921 - DNA, 13 bp, Homo sapiens
cactcctgccaag

SEQ ID NO: 3051922 - DNA, 14 bp, Homo sapiens
cactccttcccctt

SEQ ID NO: 3051923 - DNA, 14 bp, Homo sapiens
cactcgcaggacca

SEQ ID NO: 3051924 - DNA, 22 bp, Homo sapiens
cactcgccatctcctgggccgt

SEQ ID NO: 3051925 - DNA, 17 bp, Homo sapiens
cactcgccatttcctca

SEQ ID NO: 3051926 - DNA, 14 bp, Homo sapiens
cactctcaccccaa

SEQ ID NO: 3051927 - DNA, 13 bp, Homo sapiens
cactctccttgca

SEQ ID NO: 3051928 - DNA, 22 bp, Homo sapiens
cactctctattgtcatggggat

SEQ ID NO: 3051929 - DNA, 15 bp, Homo sapiens
cactctgccctctgc

SEQ ID NO: 3051930 - DNA, 19 bp, Homo sapiens
cactctgccctctgctgct

SEQ ID NO: 3051931 - DNA, 15 bp, Homo sapiens
cactctgcctgcctg

SEQ ID NO: 3051932 - DNA, 18 bp, Homo sapiens
cactctgcggcccgggcc

SEQ ID NO: 3051933 - DNA, 12 bp, Homo sapiens
cactctgctgcc

SEQ ID NO: 3051934 - DNA, 16 bp, Homo sapiens
cactctgcttgttatt

SEQ ID NO: 3051935 - DNA, 13 bp, Homo sapiens
cactctgttattt

SEQ ID NO: 3051936 - DNA, 18 bp, Homo sapiens
cactctgttgcccaggct

SEQ ID NO: 3051937 - DNA, 11 bp, Homo sapiens
cactcttaggc

SEQ ID NO: 3051938 - DNA, 18 bp, Homo sapiens
cactcttcctcatcctgc

SEQ ID NO: 3051939 - DNA, 17 bp, Homo sapiens
cactcttgaagtccagg

SEQ ID NO: 3051940 - DNA, 16 bp, Homo sapiens
cactcttggagcctgc

SEQ ID NO: 3051941 - DNA, 19 bp, Homo sapiens
caccactgcactccagcct

SEQ ID NO: 3051942 - DNA, 20 bp, Homo sapiens
caccactgcactccagcctg

SEQ ID NO: 3051943 - DNA, 14 bp, Homo sapiens
caccagacacccag

SEQ ID NO: 3051944 - DNA, 16 bp, Homo sapiens
caccagagcaggggct

SEQ ID NO: 3051945 - DNA, 18 bp, Homo sapiens
caccagagcaggggctgc

SEQ ID NO: 3051946 - DNA, 16 bp, Homo sapiens
caccagagctgcctcc

SEQ ID NO: 3051947 - DNA, 18 bp, Homo sapiens
caccagagctgcctcccc

SEQ ID NO: 3051948 - DNA, 21 bp, Homo sapiens
caccagccctgctgcttccta

SEQ ID NO: 3051949 - DNA, 22 bp, Homo sapiens
caccagcggtccaacgccgcct

SEQ ID NO: 3051950 - DNA, 10 bp, Homo sapiens
caccagctgc

SEQ ID NO: 3051951 - DNA, 13 bp, Homo sapiens
caccagctgcaaa

SEQ ID NO: 3051952 - DNA, 14 bp, Homo sapiens
caccagctgcaaag

SEQ ID NO: 3051953 - DNA, 17 bp, Homo sapiens
caccaggaatgttaaag

SEQ ID NO: 3051954 - DNA, 16 bp, Homo sapiens
caccaggactggctgt

SEQ ID NO: 3051955 - DNA, 17 bp, Homo sapiens
caccaggagcacctgga

SEQ ID NO: 3051956 - DNA, 20 bp, Homo sapiens
caccaggcacgaacccacct

SEQ ID NO: 3051957 - DNA, 23 bp, Homo sapiens
caccaggcacgaacccacctgct

SEQ ID NO: 3051958 - DNA, 18 bp, Homo sapiens
caccaggcctcactggct

SEQ ID NO: 3051959 - DNA, 23 bp, Homo sapiens
caccagggactcggcccagggcc

SEQ ID NO: 3051960 - DNA, 22 bp, Homo sapiens
caccagggccagcaggcagcgc

SEQ ID NO: 3051961 - DNA, 14 bp, Homo sapiens
caccaggtctcccg

SEQ ID NO: 3051962 - DNA, 14 bp, Homo sapiens
caccagtccctgtc

SEQ ID NO: 3051963 - DNA, 22 bp, Homo sapiens
caccagtgtgacaggaaagatt

SEQ ID NO: 3051964 - DNA, 15 bp, Homo sapiens
caccatatttgaatt

SEQ ID NO: 3051965 - DNA, 21 bp, Homo sapiens
caccatgcccagctaattttt

SEQ ID NO: 3051966 - DNA, 23 bp, Homo sapiens
caccatggcatgcgccaccatgc

SEQ ID NO: 3051967 - DNA, 15 bp, Homo sapiens
caccatgtattttgt

SEQ ID NO: 3051968 - DNA, 18 bp, Homo sapiens
caccatgtttgagctcag

SEQ ID NO: 3051969 - DNA, 23 bp, Homo sapiens
caccatgtttgagctcagacccc

SEQ ID NO: 3051970 - DNA, 17 bp, Homo sapiens
caccatttggcaatgcc

SEQ ID NO: 3051971 - DNA, 14 bp, Homo sapiens
cacccaaaagcaca

SEQ ID NO: 3051972 - DNA, 14 bp, Homo sapiens
cacccaaaagtcaa

SEQ ID NO: 3051973 - DNA, 18 bp, Homo sapiens
cacccaaaccccttccca

SEQ ID NO: 3051974 - DNA, 21 bp, Homo sapiens
cacccaaaccccttcccacga

SEQ ID NO: 3051975 - DNA, 21 bp, Homo sapiens
cacccaaaccggcaggtgcga

SEQ ID NO: 3051976 - DNA, 12 bp, Homo sapiens
cacccaaagctg

SEQ ID NO: 3051977 - DNA, 15 bp, Homo sapiens
cacccaaagctgagc

SEQ ID NO: 3051978 - DNA, 16 bp, Homo sapiens
cacccaaagctgagcc

SEQ ID NO: 3051979 - DNA, 19 bp, Homo sapiens
cacccaaagctgagcctgc

SEQ ID NO: 3051980 - DNA, 14 bp, Homo sapiens
cacccacccctgca

SEQ ID NO: 3051981 - DNA, 15 bp, Homo sapiens
cacccacctcagcct

SEQ ID NO: 3051982 - DNA, 13 bp, Homo sapiens
cacccagcccatt

SEQ ID NO: 3051983 - DNA, 12 bp, Homo sapiens
cacccagctcca

SEQ ID NO: 3051984 - DNA, 16 bp, Homo sapiens
cacccagctccaggcc

SEQ ID NO: 3051985 - DNA, 22 bp, Homo sapiens
cacccaggaagggagggagctg

SEQ ID NO: 3051986 - DNA, 23 bp, Homo sapiens
cacccaggaagggagggagctga

SEQ ID NO: 3051987 - DNA, 20 bp, Homo sapiens
cacccaggctggagtgcagt

SEQ ID NO: 3051988 - DNA, 23 bp, Homo sapiens
cacccaggctggagtgcagtggc

SEQ ID NO: 3051989 - DNA, 15 bp, Homo sapiens
cacccagggtctagc

SEQ ID NO: 3051990 - DNA, 23 bp, Homo sapiens
cacccagggtctagccgctgccc

SEQ ID NO: 3051991 - DNA, 22 bp, Homo sapiens
cacccaggtcccccgactgcct

SEQ ID NO: 3051992 - DNA, 20 bp, Homo sapiens
cacccagtcctctgcctcca

SEQ ID NO: 3051993 - DNA, 14 bp, Homo sapiens
cacccagtggaagg

SEQ ID NO: 3051994 - DNA, 22 bp, Homo sapiens
cacccatgcaagcagaggacca

SEQ ID NO: 3051995 - DNA, 13 bp, Homo sapiens
cacccatggtacc

SEQ ID NO: 3051996 - DNA, 18 bp, Homo sapiens
caccccacgccttatccc

SEQ ID NO: 3051997 - DNA, 22 bp, Homo sapiens
caccccactgcaatcctgtctt

SEQ ID NO: 3051998 - DNA, 11 bp, Homo sapiens
caccccagagc

SEQ ID NO: 3051999 - DNA, 12 bp, Homo sapiens
caccccagagcc

SEQ ID NO: 3052000 - DNA, 14 bp, Homo sapiens
caccccagagccac

SEQ ID NO: 3052001 - DNA, 15 bp, Homo sapiens
caccccagagccaca

SEQ ID NO: 3052002 - DNA, 22 bp, Homo sapiens
caccccagagccacacatgggc

SEQ ID NO: 3052003 - DNA, 19 bp, Homo sapiens
caccccagcacagctcctc

SEQ ID NO: 3052004 - DNA, 16 bp, Homo sapiens
caccccagggcctgag

SEQ ID NO: 3052005 - DNA, 12 bp, Homo sapiens
caccccatgctg

SEQ ID NO: 3052006 - DNA, 22 bp, Homo sapiens
caccccatgctgttgattgcta

SEQ ID NO: 3052007 - DNA, 16 bp, Homo sapiens
cacccccttcagtgcc

SEQ ID NO: 3052008 - DNA, 17 bp, Homo sapiens
cacccccttcagtgccc

SEQ ID NO: 3052009 - DNA, 20 bp, Homo sapiens
cacccccttcagtgcccacc

SEQ ID NO: 3052010 - DNA, 21 bp, Homo sapiens
cacccccttcagtgcccacca

SEQ ID NO: 3052011 - DNA, 15 bp, Homo sapiens
caccccgaggccctg

SEQ ID NO: 3052012 - DNA, 16 bp, Homo sapiens
caccccgaggccctgc

SEQ ID NO: 3052013 - DNA, 22 bp, Homo sapiens
caccccgaggccctgcatgggc

SEQ ID NO: 3052014 - DNA, 21 bp, Homo sapiens
caccccgcctgcctcctggct

SEQ ID NO: 3052015 - DNA, 18 bp, Homo sapiens
cacccctcagttgtgcag

SEQ ID NO: 3052016 - DNA, 13 bp, Homo sapiens
cacccctgccact

SEQ ID NO: 3052017 - DNA, 19 bp, Homo sapiens
cacccctgccactcaccct

SEQ ID NO: 3052018 - DNA, 14 bp, Homo sapiens
cacccctgggggct

SEQ ID NO: 3052019 - DNA, 12 bp, Homo sapiens
caccccttagat

SEQ ID NO: 3052020 - DNA, 22 bp, Homo sapiens
caccccttcgacatgctgccag

SEQ ID NO: 3052021 - DNA, 14 bp, Homo sapiens
cacccgacaccagc

SEQ ID NO: 3052022 - DNA, 20 bp, Homo sapiens
cacccgacaccagccctgct

SEQ ID NO: 3052023 - DNA, 22 bp, Homo sapiens
cacccgacaccagccctgctgc

SEQ ID NO: 3052024 - DNA, 21 bp, Homo sapiens
cacccgttcccactgccctgg

SEQ ID NO: 3052025 - DNA, 16 bp, Homo sapiens
caccctaagggcagcc

SEQ ID NO: 3052026 - DNA, 18 bp, Homo sapiens
caccctaagggcagccct

SEQ ID NO: 3052027 - DNA, 13 bp, Homo sapiens
caccctaccttcc

SEQ ID NO: 3052028 - DNA, 20 bp, Homo sapiens
caccctaccttccccagact

SEQ ID NO: 3052029 - DNA, 11 bp, Homo sapiens
cacctggcccc

SEQ ID NO: 3052030 - DNA, 15 bp, Homo sapiens
cacctggccccatgt

SEQ ID NO: 3052031 - DNA, 14 bp, Homo sapiens
cacctggcttgttt

SEQ ID NO: 3052032 - DNA, 22 bp, Homo sapiens
cacctggcttgtttattttgtg

SEQ ID NO: 3052033 - DNA, 17 bp, Homo sapiens
cacctgggagaaatctg

SEQ ID NO: 3052034 - DNA, 16 bp, Homo sapiens
cacctgggcttaagaa

SEQ ID NO: 3052035 - DNA, 18 bp, Homo sapiens
cacctgggtctttatgca

SEQ ID NO: 3052036 - DNA, 22 bp, Homo sapiens
cacctggtacctggacggtgcg

SEQ ID NO: 3052037 - DNA, 20 bp, Homo sapiens
cacctggtactccctctcag

SEQ ID NO: 3052038 - DNA, 22 bp, Homo sapiens
cacctggtcctccgcctactgt

SEQ ID NO: 3052039 - DNA, 23 bp, Homo sapiens
cacctggtgggtggtgtcctgaa

SEQ ID NO: 3052040 - DNA, 11 bp, Homo sapiens
cacctggttgc

SEQ ID NO: 3052041 - DNA, 18 bp, Homo sapiens
cacctgtaatcccagcac

SEQ ID NO: 3052042 - DNA, 20 bp, Homo sapiens
cacctgtaatcccagcacac

SEQ ID NO: 3052043 - DNA, 18 bp, Homo sapiens
cacctgtaggatattgga

SEQ ID NO: 3052044 - DNA, 14 bp, Homo sapiens
cacctgtagtccca

SEQ ID NO: 3052045 - DNA, 17 bp, Homo sapiens
cacctgtagtcccagct

SEQ ID NO: 3052046 - DNA, 18 bp, Homo sapiens
cacctgtagtcccagcta

SEQ ID NO: 3052047 - DNA, 13 bp, Homo sapiens
cacctgtcaaaca

SEQ ID NO: 3052048 - DNA, 13 bp, Homo sapiens
cacctgtgctgga

SEQ ID NO: 3052049 - DNA, 23 bp, Homo sapiens
cacctgttcacagaaaaagcatg

SEQ ID NO: 3052050 - DNA, 16 bp, Homo sapiens
cacctgttgcttacaa

SEQ ID NO: 3052051 - DNA, 13 bp, Homo sapiens
caccttaggcagg

SEQ ID NO: 3052052 - DNA, 17 bp, Homo sapiens
caccttaggcagggaag

SEQ ID NO: 3052053 - DNA, 22 bp, Homo sapiens
caccttatctatgatgtttctt

SEQ ID NO: 3052054 - DNA, 15 bp, Homo sapiens
caccttcccacccct

SEQ ID NO: 3052055 - DNA, 13 bp, Homo sapiens
caccttcccagct

SEQ ID NO: 3052056 - DNA, 19 bp, Homo sapiens
caccttcccagctctccct

SEQ ID NO: 3052057 - DNA, 22 bp, Homo sapiens
caccttcccagctctccctctg

SEQ ID NO: 3052058 - DNA, 13 bp, Homo sapiens
caccttcctcctc

SEQ ID NO: 3052059 - DNA, 19 bp, Homo sapiens
caccttcctcctccccgct

SEQ ID NO: 3052060 - DNA, 16 bp, Homo sapiens
caccttggagcattta

SEQ ID NO: 3052061 - DNA, 20 bp, Homo sapiens
caccttggagcatttatgta

SEQ ID NO: 3052062 - DNA, 14 bp, Homo sapiens
caccttggcccagg

SEQ ID NO: 3052063 - DNA, 22 bp, Homo sapiens
caccttggcccaggagctctgc

SEQ ID NO: 3052064 - DNA, 23 bp, Homo sapiens
caccttggcccaggagctctgcg

SEQ ID NO: 3052065 - DNA, 15 bp, Homo sapiens
caccttgtgcctggg

SEQ ID NO: 3052066 - DNA, 17 bp, Homo sapiens
caccttgtgcctggggt

SEQ ID NO: 3052067 - DNA, 18 bp, Homo sapiens
caccttgtgcctggggtg

SEQ ID NO: 3052068 - DNA, 15 bp, Homo sapiens
caccttgtgtctgta

SEQ ID NO: 3052069 - DNA, 23 bp, Homo sapiens
caccttgtgtggcgcacttcaga

SEQ ID NO: 3052070 - DNA, 20 bp, Homo sapiens
cacctttaagtagataagca

SEQ ID NO: 3052071 - DNA, 17 bp, Homo sapiens
cacctttctagttgaaa

SEQ ID NO: 3052072 - DNA, 16 bp, Homo sapiens
cacctttctcctttgt

SEQ ID NO: 3052073 - DNA, 14 bp, Homo sapiens
cacctttgtagcac

SEQ ID NO: 3052074 - DNA, 20 bp, Homo sapiens
cacctttgtagcactcaggc

SEQ ID NO: 3052075 - DNA, 14 bp, Homo sapiens
caccttttgttttt

SEQ ID NO: 3052076 - DNA, 16 bp, Homo sapiens
cacgaacccacctgct

SEQ ID NO: 3052077 - DNA, 18 bp, Homo sapiens
cacgaacccacctgctga

SEQ ID NO: 3052078 - DNA, 15 bp, Homo sapiens
cacgaagtgttgcat

SEQ ID NO: 3052079 - DNA, 23 bp, Homo sapiens
cacgacctaggcagtaggccggt

SEQ ID NO: 3052080 - DNA, 13 bp, Homo sapiens
cacgactgtctcc

SEQ ID NO: 3052081 - DNA, 12 bp, Homo sapiens
cacgagccacct

SEQ ID NO: 3052082 - DNA, 12 bp, Homo sapiens
cacgagggctgg

SEQ ID NO: 3052083 - DNA, 17 bp, Homo sapiens
cacgagggctggctggc

SEQ ID NO: 3052084 - DNA, 17 bp, Homo sapiens
cacgaggggacccatgg

SEQ ID NO: 3052085 - DNA, 18 bp, Homo sapiens
cacgaggggacccatggg

SEQ ID NO: 3052086 - DNA, 14 bp, Homo sapiens
cacgatgtggccct

SEQ ID NO: 3052087 - DNA, 21 bp, Homo sapiens
cacgcaaaccaacctttctga

SEQ ID NO: 3052088 - DNA, 19 bp, Homo sapiens
attgtgatgtatattcctt

SEQ ID NO: 3052089 - DNA, 14 bp, Homo sapiens
attgtggtgtctta

SEQ ID NO: 3052090 - DNA, 23 bp, Homo sapiens
attgtgtgaaggtaactaagaag

SEQ ID NO: 3052091 - DNA, 22 bp, Homo sapiens
attgtgtgttctcacagtgaca

SEQ ID NO: 3052092 - DNA, 22 bp, Homo sapiens
attgttaatgcctataactttt

SEQ ID NO: 3052093 - DNA, 16 bp, Homo sapiens
attgttatttctgtag

SEQ ID NO: 3052094 - DNA, 18 bp, Homo sapiens
attgttccaaatgaatgt

SEQ ID NO: 3052095 - DNA, 15 bp, Homo sapiens
attgttccttgcttt

SEQ ID NO: 3052096 - DNA, 10 bp, Homo sapiens
attgttctgg

SEQ ID NO: 3052097 - DNA, 16 bp, Homo sapiens
attgttcttttgtttc

SEQ ID NO: 3052098 - DNA, 18 bp, Homo sapiens
attgttggcacatcctat

SEQ ID NO: 3052099 - DNA, 18 bp, Homo sapiens
attgttgtggtttaaata

SEQ ID NO: 3052100 - DNA, 13 bp, Homo sapiens
attgtttatgtaa

SEQ ID NO: 3052101 - DNA, 13 bp, Homo sapiens
attgtttcaattg

SEQ ID NO: 3052102 - DNA, 22 bp, Homo sapiens
attgtttcaattgcatctccca

SEQ ID NO: 3052103 - DNA, 15 bp, Homo sapiens
attgtttctatacaa

SEQ ID NO: 3052104 - DNA, 16 bp, Homo sapiens
attgtttctatacaaa

SEQ ID NO: 3052105 - DNA, 19 bp, Homo sapiens
attgtttcttcttcatgct

SEQ ID NO: 3052106 - DNA, 21 bp, Homo sapiens
attgtttctttatcacctggc

SEQ ID NO: 3052107 - DNA, 20 bp, Homo sapiens
attgtttgaaacaaagaagg

SEQ ID NO: 3052108 - DNA, 14 bp, Homo sapiens
attgtttggatttc

SEQ ID NO: 3052109 - DNA, 17 bp, Homo sapiens
attgttttaacacagta

SEQ ID NO: 3052110 - DNA, 19 bp, Homo sapiens
attgttttattttggaatt

SEQ ID NO: 3052111 - DNA, 19 bp, Homo sapiens
attgttttctttttctacc

SEQ ID NO: 3052112 - DNA, 17 bp, Homo sapiens
atttaaaaatagaaaca

SEQ ID NO: 3052113 - DNA, 14 bp, Homo sapiens
atttaaaaatattt

SEQ ID NO: 3052114 - DNA, 16 bp, Homo sapiens
atttaaaaatatttca

SEQ ID NO: 3052115 - DNA, 18 bp, Homo sapiens
atttaaaaatatttcaga

SEQ ID NO: 3052116 - DNA, 22 bp, Homo sapiens
atttaaaaatatttcagatatc

SEQ ID NO: 3052117 - DNA, 15 bp, Homo sapiens
atttaaaaatgccaa

SEQ ID NO: 3052118 - DNA, 21 bp, Homo sapiens
atttaaaaatgccaaaactta

SEQ ID NO: 3052119 - DNA, 12 bp, Homo sapiens
atttaaaaatgt

SEQ ID NO: 3052120 - DNA, 18 bp, Homo sapiens
atttaaaaatgtcttgct

SEQ ID NO: 3052121 - DNA, 21 bp, Homo sapiens
atttaaaagggaagtctagag

SEQ ID NO: 3052122 - DNA, 19 bp, Homo sapiens
atttaaaattaagtagaac

SEQ ID NO: 3052123 - DNA, 15 bp, Homo sapiens
atttaaacaaacaaa

SEQ ID NO: 3052124 - DNA, 18 bp, Homo sapiens
atttaaacaatgccaagt

SEQ ID NO: 3052125 - DNA, 15 bp, Homo sapiens
atttaaacccatttt

SEQ ID NO: 3052126 - DNA, 20 bp, Homo sapiens
atttaaacccattttagtca

SEQ ID NO: 3052127 - DNA, 15 bp, Homo sapiens
atttaaacctttttc

SEQ ID NO: 3052128 - DNA, 15 bp, Homo sapiens
atttaaagaaagtga

SEQ ID NO: 3052129 - DNA, 18 bp, Homo sapiens
atttaaagacaaagacat

SEQ ID NO: 3052130 - DNA, 23 bp, Homo sapiens
atttaaagacaaagacattattt

SEQ ID NO: 3052131 - DNA, 13 bp, Homo sapiens
atttaaagcacat

SEQ ID NO: 3052132 - DNA, 22 bp, Homo sapiens
atttaaaggcttaggcatgttc

SEQ ID NO: 3052133 - DNA, 13 bp, Homo sapiens
atttaaatctgtt

SEQ ID NO: 3052134 - DNA, 12 bp, Homo sapiens
atttaaatgttt

SEQ ID NO: 3052135 - DNA, 21 bp, Homo sapiens
atttaaatgtttactatagac

SEQ ID NO: 3052136 - DNA, 18 bp, Homo sapiens
atttaaattctttttcaa

SEQ ID NO: 3052137 - DNA, 19 bp, Homo sapiens
atttaaattgttataactt

SEQ ID NO: 3052138 - DNA, 19 bp, Homo sapiens
atttaacccatttgtctct

SEQ ID NO: 3052139 - DNA, 20 bp, Homo sapiens
atttaacgttgatgtaatga

SEQ ID NO: 3052140 - DNA, 13 bp, Homo sapiens
atttaactgaaga

SEQ ID NO: 3052141 - DNA, 13 bp, Homo sapiens
atttaactgactt

SEQ ID NO: 3052142 - DNA, 21 bp, Homo sapiens
atttaactggtgcactttgta

SEQ ID NO: 3052143 - DNA, 22 bp, Homo sapiens
atttaactttccagtcttagct

SEQ ID NO: 3052144 - DNA, 18 bp, Homo sapiens
atttaaggaatcaaatct

SEQ ID NO: 3052145 - DNA, 20 bp, Homo sapiens
atttaaggaatcaaatctta

SEQ ID NO: 3052146 - DNA, 15 bp, Homo sapiens
atttaataatctgta

SEQ ID NO: 3052147 - DNA, 15 bp, Homo sapiens
atttaatattttgca

SEQ ID NO: 3052148 - DNA, 18 bp, Homo sapiens
atttaatgatgattatgg

SEQ ID NO: 3052149 - DNA, 19 bp, Homo sapiens
atttaatgttttaaatgta

SEQ ID NO: 3052150 - DNA, 20 bp, Homo sapiens
atttaatgttttaaatgtac

SEQ ID NO: 3052151 - DNA, 14 bp, Homo sapiens
atttaatgttttca

SEQ ID NO: 3052152 - DNA, 21 bp, Homo sapiens
atttaattaggaaaaaaacta

SEQ ID NO: 3052153 - DNA, 15 bp, Homo sapiens
atttaattcatgttt

SEQ ID NO: 3052154 - DNA, 14 bp, Homo sapiens
atttaatttttaaa

SEQ ID NO: 3052155 - DNA, 19 bp, Homo sapiens
atttacaaaaatataaaat

SEQ ID NO: 3052156 - DNA, 20 bp, Homo sapiens
atttacaaaaatataaaata

SEQ ID NO: 3052157 - DNA, 12 bp, Homo sapiens
atttacaatgtg

SEQ ID NO: 3052158 - DNA, 13 bp, Homo sapiens
atttacaccacac

SEQ ID NO: 3052159 - DNA, 14 bp, Homo sapiens
atttacaccacact

SEQ ID NO: 3052160 - DNA, 20 bp, Homo sapiens
atttacaccacactttcaaa

SEQ ID NO: 3052161 - DNA, 18 bp, Homo sapiens
atttacatttaatacaga

SEQ ID NO: 3052162 - DNA, 16 bp, Homo sapiens
atttaccaacatgtat

SEQ ID NO: 3052163 - DNA, 20 bp, Homo sapiens
atttaccaacatgtatctgt

SEQ ID NO: 3052164 - DNA, 17 bp, Homo sapiens
atttaccataatgttcc

SEQ ID NO: 3052165 - DNA, 23 bp, Homo sapiens
atttacctccccttttctatgtt

SEQ ID NO: 3052166 - DNA, 17 bp, Homo sapiens
atttacgctttgattca

SEQ ID NO: 3052167 - DNA, 20 bp, Homo sapiens
atttactcaccatatttgaa

SEQ ID NO: 3052168 - DNA, 21 bp, Homo sapiens
atttactcaccatatttgaat

SEQ ID NO: 3052169 - DNA, 16 bp, Homo sapiens
atttactctgttgaat

SEQ ID NO: 3052170 - DNA, 19 bp, Homo sapiens
atttacttctaatcttaaa

SEQ ID NO: 3052171 - DNA, 20 bp, Homo sapiens
atttagaaaaagaacatgca

SEQ ID NO: 3052172 - DNA, 18 bp, Homo sapiens
atttagaaactaattgac

SEQ ID NO: 3052173 - DNA, 20 bp, Homo sapiens
cgtctgtgtgtgacccctcc

SEQ ID NO: 3052174 - DNA, 22 bp, Homo sapiens
cgtctgtgtgtgacccctcctg

SEQ ID NO: 3052175 - DNA, 14 bp, Homo sapiens
cgtcttcaaattaa

SEQ ID NO: 3052176 - DNA, 21 bp, Homo sapiens
cgtcttcaaattaaagtgctg

SEQ ID NO: 3052177 - DNA, 15 bp, Homo sapiens
cgtcttcatctccct

SEQ ID NO: 3052178 - DNA, 19 bp, Homo sapiens
cgtcttcatctccctgcca

SEQ ID NO: 3052179 - DNA, 21 bp, Homo sapiens
cgtcttcatctccctgccatc

SEQ ID NO: 3052180 - DNA, 19 bp, Homo sapiens
cgtcttctgtatactgtgg

SEQ ID NO: 3052181 - DNA, 13 bp, Homo sapiens
cgtctttaagaga

SEQ ID NO: 3052182 - DNA, 16 bp, Homo sapiens
cgtgaaaacggagctg

SEQ ID NO: 3052183 - DNA, 13 bp, Homo sapiens
cgtgaaagttttt

SEQ ID NO: 3052184 - DNA, 15 bp, Homo sapiens
cgtgaaggacttagc

SEQ ID NO: 3052185 - DNA, 19 bp, Homo sapiens
cgtgaaggccgagaagcaa

SEQ ID NO: 3052186 - DNA, 17 bp, Homo sapiens
cgtgaagtatactgtat

SEQ ID NO: 3052187 - DNA, 17 bp, Homo sapiens
cgtgacaataaaacatt

SEQ ID NO: 3052188 - DNA, 19 bp, Homo sapiens
cgtgacaataaaacattaa

SEQ ID NO: 3052189 - DNA, 16 bp, Homo sapiens
cgtgacactctccttg

SEQ ID NO: 3052190 - DNA, 21 bp, Homo sapiens
cgtgacactctccttgcagtt

SEQ ID NO: 3052191 - DNA, 16 bp, Homo sapiens
cgtgacagactcctga

SEQ ID NO: 3052192 - DNA, 17 bp, Homo sapiens
cgtgacagactcctgag

SEQ ID NO: 3052193 - DNA, 13 bp, Homo sapiens
cgtgacagtggct

SEQ ID NO: 3052194 - DNA, 15 bp, Homo sapiens
cgtgactcacccaag

SEQ ID NO: 3052195 - DNA, 17 bp, Homo sapiens
cgtgactcacccaagca

SEQ ID NO: 3052196 - DNA, 15 bp, Homo sapiens
cgtgactcagagctt

SEQ ID NO: 3052197 - DNA, 16 bp, Homo sapiens
cgtgactgccccaact

SEQ ID NO: 3052198 - DNA, 21 bp, Homo sapiens
cgtgactgccccaactcctgg

SEQ ID NO: 3052199 - DNA, 23 bp, Homo sapiens
cgtgactgccccaactcctggaa

SEQ ID NO: 3052200 - DNA, 23 bp, Homo sapiens
cgtgagagtgtcttcacggcagg

SEQ ID NO: 3052201 - DNA, 12 bp, Homo sapiens
cgtgagctgccc

SEQ ID NO: 3052202 - DNA, 19 bp, Homo sapiens
cgtgagtgacatagcctca

SEQ ID NO: 3052203 - DNA, 19 bp, Homo sapiens
cgtgagtgtctcttgtcta

SEQ ID NO: 3052204 - DNA, 21 bp, Homo sapiens
cgtgatcaaagccacactctg

SEQ ID NO: 3052205 - DNA, 22 bp, Homo sapiens
cgtgatcaaagccacactctgg

SEQ ID NO: 3052206 - DNA, 23 bp, Homo sapiens
cgtgatgtagggtaaggtgcctt

SEQ ID NO: 3052207 - DNA, 20 bp, Homo sapiens
cgtgcactgtgaatcctggc

SEQ ID NO: 3052208 - DNA, 20 bp, Homo sapiens
cgtgccaaccccacccagct

SEQ ID NO: 3052209 - DNA, 12 bp, Homo sapiens
cgtgccagcagc

SEQ ID NO: 3052210 - DNA, 13 bp, Homo sapiens
cgtgccaggcccg

SEQ ID NO: 3052211 - DNA, 13 bp, Homo sapiens
cgtgcccctgctg

SEQ ID NO: 3052212 - DNA, 19 bp, Homo sapiens
cgtgccgttactctccaac

SEQ ID NO: 3052213 - DNA, 18 bp, Homo sapiens
cgtgcctgggcccctccc

SEQ ID NO: 3052214 - DNA, 17 bp, Homo sapiens
cgtgcctgggggagaga

SEQ ID NO: 3052215 - DNA, 18 bp, Homo sapiens
cgtgccttaggaatactg

SEQ ID NO: 3052216 - DNA, 22 bp, Homo sapiens
cgtgcgctggttccgccaggcg

SEQ ID NO: 3052217 - DNA, 19 bp, Homo sapiens
cgtgctcgccccagcaggt

SEQ ID NO: 3052218 - DNA, 17 bp, Homo sapiens
cgtgctgacagctgctc

SEQ ID NO: 3052219 - DNA, 13 bp, Homo sapiens
cgtgctggccttg

SEQ ID NO: 3052220 - DNA, 19 bp, Homo sapiens
cgtgctggcgacactcagg

SEQ ID NO: 3052221 - DNA, 21 bp, Homo sapiens
cgtgctggcgacactcagggc

SEQ ID NO: 3052222 - DNA, 16 bp, Homo sapiens
cgtgctgtctcctttg

SEQ ID NO: 3052223 - DNA, 23 bp, Homo sapiens
cgtggaaaaagacgatgtttatg

SEQ ID NO: 3052224 - DNA, 18 bp, Homo sapiens
cgtggaagtgttcctgtc

SEQ ID NO: 3052225 - DNA, 20 bp, Homo sapiens
cgtggaagtgttcctgtctc

SEQ ID NO: 3052226 - DNA, 14 bp, Homo sapiens
cgtggacagcgctg

SEQ ID NO: 3052227 - DNA, 15 bp, Homo sapiens
cgtggacagcgctgt

SEQ ID NO: 3052228 - DNA, 14 bp, Homo sapiens
cgtggagactggca

SEQ ID NO: 3052229 - DNA, 18 bp, Homo sapiens
cgtggagactggcaggcg

SEQ ID NO: 3052230 - DNA, 19 bp, Homo sapiens
cgtggagactggcaggcgg

SEQ ID NO: 3052231 - DNA, 13 bp, Homo sapiens
cgtggagggaggc

SEQ ID NO: 3052232 - DNA, 16 bp, Homo sapiens
cgtggagggaggcccc

SEQ ID NO: 3052233 - DNA, 20 bp, Homo sapiens
cgtggagggaggccccaggg

SEQ ID NO: 3052234 - DNA, 14 bp, Homo sapiens
cgtggatgctcttt

SEQ ID NO: 3052235 - DNA, 19 bp, Homo sapiens
cgtggattaaacttatgaa

SEQ ID NO: 3052236 - DNA, 20 bp, Homo sapiens
cgtggattaaacttatgaat

SEQ ID NO: 3052237 - DNA, 17 bp, Homo sapiens
cgtggccccgccctcag

SEQ ID NO: 3052238 - DNA, 19 bp, Homo sapiens
cgtggccccgccctcaggc

SEQ ID NO: 3052239 - DNA, 21 bp, Homo sapiens
cgtggcctcccaaagtgctgg

SEQ ID NO: 3052240 - DNA, 16 bp, Homo sapiens
cgtggcctggcatctg

SEQ ID NO: 3052241 - DNA, 22 bp, Homo sapiens
cgtggctaagagtgtcctagga

SEQ ID NO: 3052242 - DNA, 19 bp, Homo sapiens
cgtggcttggcatctgtgt

SEQ ID NO: 3052243 - DNA, 16 bp, Homo sapiens
cgtgggattcagagaa

SEQ ID NO: 3052244 - DNA, 15 bp, Homo sapiens
cgtgggccctgcagg

SEQ ID NO: 3052245 - DNA, 18 bp, Homo sapiens
cgtggggaaggggtgcag

SEQ ID NO: 3052246 - DNA, 23 bp, Homo sapiens
cgtggggcagggagctgggcccg

SEQ ID NO: 3052247 - DNA, 16 bp, Homo sapiens
cgtgggggggcgtgga

SEQ ID NO: 3052248 - DNA, 15 bp, Homo sapiens
cgtgggttcaatttg

SEQ ID NO: 3052249 - DNA, 19 bp, Homo sapiens
cgtgggttgctaactgaac

SEQ ID NO: 3052250 - DNA, 21 bp, Homo sapiens
cgtggtgtggcccgtggcctg

SEQ ID NO: 3052251 - DNA, 19 bp, Homo sapiens
cgtgtagtgtccattttgt

SEQ ID NO: 3052252 - DNA, 16 bp, Homo sapiens
cgtgtcacctgtgctt

SEQ ID NO: 3052253 - DNA, 16 bp, Homo sapiens
cgtgtccgtctgtctg

SEQ ID NO: 3052254 - DNA, 21 bp, Homo sapiens
cgtgtctggcacagcctggct

SEQ ID NO: 3052255 - DNA, 15 bp, Homo sapiens
cgtgtgatttttctg

SEQ ID NO: 3052256 - DNA, 18 bp, Homo sapiens
cgtgtgatttttctggag

SEQ ID NO: 3052257 - DNA, 20 bp, Homo sapiens
cgtgtgcatagcgtcctgcc

SEQ ID NO: 3052258 - DNA, 21 bp, Homo sapiens
cgtgtgcatagcgtcctgccc

SEQ ID NO: 3052259 - DNA, 23 bp, Homo sapiens
cgtgtgcatagcgtcctgccctg

SEQ ID NO: 3052260 - DNA, 20 bp, Homo sapiens
cgtgtgcgtgttcctttgct

SEQ ID NO: 3052261 - DNA, 21 bp, Homo sapiens
cgtgttaattataaacagcag

SEQ ID NO: 3052262 - DNA, 16 bp, Homo sapiens
cgttaaaagtgtacaa

SEQ ID NO: 3052263 - DNA, 20 bp, Homo sapiens
cgttaattttcctttgtcat

SEQ ID NO: 3052264 - DNA, 12 bp, Homo sapiens
cgttcagcctgt

SEQ ID NO: 3052265 - DNA, 13 bp, Homo sapiens
cgttcagcctgtc

SEQ ID NO: 3052266 - DNA, 12 bp, Homo sapiens
cgttccccaccc

SEQ ID NO: 3052267 - DNA, 19 bp, Homo sapiens
cgttccggtccccacagac

SEQ ID NO: 3052268 - DNA, 18 bp, Homo sapiens
cgttccttactgcagaat

SEQ ID NO: 3052269 - DNA, 17 bp, Homo sapiens
cgttcgcctctggccct

SEQ ID NO: 3052270 - DNA, 15 bp, Homo sapiens
cgttctaaatatgaa

SEQ ID NO: 3052271 - DNA, 11 bp, Homo sapiens
cgttctcctgc

SEQ ID NO: 3052272 - DNA, 12 bp, Homo sapiens
cgttctctgcct

SEQ ID NO: 3052273 - DNA, 17 bp, Homo sapiens
cgttgagggaatgacac

SEQ ID NO: 3052274 - DNA, 18 bp, Homo sapiens
cgttgccctaattcatct

SEQ ID NO: 3052275 - DNA, 16 bp, Homo sapiens
cgttggttgtttctct

SEQ ID NO: 3052276 - DNA, 17 bp, Homo sapiens
cgttggttgtttctctg

SEQ ID NO: 3052277 - DNA, 16 bp, Homo sapiens
cgttgtcctcagcccc

SEQ ID NO: 3052278 - DNA, 20 bp, Homo sapiens
cgttgtttacttaaagattt

SEQ ID NO: 3052279 - DNA, 13 bp, Homo sapiens
cgtttaatgttta

SEQ ID NO: 3052280 - DNA, 18 bp, Homo sapiens
cgtttaatgtttatacag

SEQ ID NO: 3052281 - DNA, 14 bp, Homo sapiens
cgtttactatgcct

SEQ ID NO: 3052282 - DNA, 21 bp, Homo sapiens
cgtttatatttttttaactgt

SEQ ID NO: 3052283 - DNA, 14 bp, Homo sapiens
cgtttcattcattt

SEQ ID NO: 3052284 - DNA, 15 bp, Homo sapiens
cgtttcttcactttt

SEQ ID NO: 3052285 - DNA, 21 bp, Homo sapiens
cgtttgatagtgcttcttgta

SEQ ID NO: 3052286 - DNA, 18 bp, Homo sapiens
cgtttgcaccgcctgccc

SEQ ID NO: 3052287 - DNA, 15 bp, Homo sapiens
cgtttgctgtgccag

SEQ ID NO: 3052288 - DNA, 18 bp, Homo sapiens
cgtttgctgtgccaggag

SEQ ID NO: 3052289 - DNA, 19 bp, Homo sapiens
cgtttgctgtgccaggagg

SEQ ID NO: 3052290 - DNA, 17 bp, Homo sapiens
cgtttggaagatcctgt

SEQ ID NO: 3052291 - DNA, 15 bp, Homo sapiens
cgtttgtatgtgtgt

SEQ ID NO: 3052292 - DNA, 14 bp, Homo sapiens
cgtttgtgtttcta

SEQ ID NO: 3052293 - DNA, 14 bp, Homo sapiens
cgttttccccatga

SEQ ID NO: 3052294 - DNA, 13 bp, Homo sapiens
cgttttgaagcta

SEQ ID NO: 3052295 - DNA, 23 bp, Homo sapiens
cgttttgtgtggtggcacctcct

SEQ ID NO: 3052296 - DNA, 16 bp, Homo sapiens
cgtttttcaagaaaac

SEQ ID NO: 3052297 - DNA, 12 bp, Homo sapiens
ctaaaacaataa

SEQ ID NO: 3052298 - DNA, 22 bp, Homo sapiens
ctaaaacatagactgaagattt

SEQ ID NO: 3052299 - DNA, 21 bp, Homo sapiens
ctaaaagcatggccctgctgc

SEQ ID NO: 3052300 - DNA, 12 bp, Homo sapiens
ctaaaagtgtca

SEQ ID NO: 3052301 - DNA, 19 bp, Homo sapiens
ctaaaagtgtgtgaaacct

SEQ ID NO: 3052302 - DNA, 23 bp, Homo sapiens
ctaaaatacacaaggagctttct

SEQ ID NO: 3052303 - DNA, 17 bp, Homo sapiens
ctaaaatcttatagttc

SEQ ID NO: 3052304 - DNA, 21 bp, Homo sapiens
ctaaaatcttatagttctagg

SEQ ID NO: 3052305 - DNA, 19 bp, Homo sapiens
ctaaaatggcgaacatgtg

SEQ ID NO: 3052306 - DNA, 20 bp, Homo sapiens
ctaaaatgtgatgttctaag

SEQ ID NO: 3052307 - DNA, 21 bp, Homo sapiens
ctaaaatgtgatgttctaagg

SEQ ID NO: 3052308 - DNA, 17 bp, Homo sapiens
ctaaacacgtgacacaa

SEQ ID NO: 3052309 - DNA, 16 bp, Homo sapiens
cgggtcctcagctgct

SEQ ID NO: 3052310 - DNA, 13 bp, Homo sapiens
cgggtctgcctct

SEQ ID NO: 3052311 - DNA, 20 bp, Homo sapiens
cgggtgaacaaagcagccac

SEQ ID NO: 3052312 - DNA, 19 bp, Homo sapiens
cgggtgtggcacgcacctg

SEQ ID NO: 3052313 - DNA, 21 bp, Homo sapiens
cgggtgtggcacgcacctgta

SEQ ID NO: 3052314 - DNA, 23 bp, Homo sapiens
cgggtgtggcacgcacctgtagt

SEQ ID NO: 3052315 - DNA, 20 bp, Homo sapiens
cgggttcaagtgactctcct

SEQ ID NO: 3052316 - DNA, 15 bp, Homo sapiens
cggtagccagcacac

SEQ ID NO: 3052317 - DNA, 13 bp, Homo sapiens
cggtccgcggcct

SEQ ID NO: 3052318 - DNA, 21 bp, Homo sapiens
cggtcctgcacagattcccag

SEQ ID NO: 3052319 - DNA, 23 bp, Homo sapiens
cggtcctgcacagattcccaggc

SEQ ID NO: 3052320 - DNA, 16 bp, Homo sapiens
cggtcctgggcgcttc

SEQ ID NO: 3052321 - DNA, 15 bp, Homo sapiens
cggtctcctgactgg

SEQ ID NO: 3052322 - DNA, 10 bp, Homo sapiens
cggtgcagct

SEQ ID NO: 3052323 - DNA, 17 bp, Homo sapiens
cggtgcagctgaggttc

SEQ ID NO: 3052324 - DNA, 14 bp, Homo sapiens
cggtgcagtctggg

SEQ ID NO: 3052325 - DNA, 16 bp, Homo sapiens
cggtgctccatctccg

SEQ ID NO: 3052326 - DNA, 22 bp, Homo sapiens
cggtgctccatctccgcctcca

SEQ ID NO: 3052327 - DNA, 21 bp, Homo sapiens
cggtgctgtcctcaggtggcc

SEQ ID NO: 3052328 - DNA, 13 bp, Homo sapiens
cggtggctgcctt

SEQ ID NO: 3052329 - DNA, 20 bp, Homo sapiens
cggtgggaaggaaaggcaga

SEQ ID NO: 3052330 - DNA, 18 bp, Homo sapiens
cggtgggacccccgtggg

SEQ ID NO: 3052331 - DNA, 18 bp, Homo sapiens
cggtgggcacccaccctg

SEQ ID NO: 3052332 - DNA, 15 bp, Homo sapiens
cggtgggcagccatg

SEQ ID NO: 3052333 - DNA, 15 bp, Homo sapiens
cggtggttcttcctg

SEQ ID NO: 3052334 - DNA, 19 bp, Homo sapiens
cggtgtacagtttaacaga

SEQ ID NO: 3052335 - DNA, 21 bp, Homo sapiens
cggtgtcaggtcccagcgagc

SEQ ID NO: 3052336 - DNA, 17 bp, Homo sapiens
cggttaagaaagcactt

SEQ ID NO: 3052337 - DNA, 17 bp, Homo sapiens
cggttcccacaagcctg

SEQ ID NO: 3052338 - DNA, 19 bp, Homo sapiens
cggttcccacaagcctgcc

SEQ ID NO: 3052339 - DNA, 21 bp, Homo sapiens
cggttcccacaagcctgcctc

SEQ ID NO: 3052340 - DNA, 23 bp, Homo sapiens
cggttcccacaagcctgcctcgc

SEQ ID NO: 3052341 - DNA, 19 bp, Homo sapiens
cggtttcccatttgttgct

SEQ ID NO: 3052342 - DNA, 18 bp, Homo sapiens
cggtttcgaagtcattaa

SEQ ID NO: 3052343 - DNA, 22 bp, Homo sapiens
cggtttcgaagtcattaaactg

SEQ ID NO: 3052344 - DNA, 19 bp, Homo sapiens
cggtttggataatcttaaa

SEQ ID NO: 3052345 - DNA, 13 bp, Homo sapiens
cggttttgttgtt

SEQ ID NO: 3052346 - DNA, 14 bp, Homo sapiens
cggttttgttgttc

SEQ ID NO: 3052347 - DNA, 13 bp, Homo sapiens
cgtaaaatttaca

SEQ ID NO: 3052348 - DNA, 17 bp, Homo sapiens
cgtaatgacttattgtg

SEQ ID NO: 3052349 - DNA, 21 bp, Homo sapiens
cgtaccaagccaccgcagctg

SEQ ID NO: 3052350 - DNA, 23 bp, Homo sapiens
cgtactagagggcattgactggt

SEQ ID NO: 3052351 - DNA, 14 bp, Homo sapiens
cgtacttataaaga

SEQ ID NO: 3052352 - DNA, 22 bp, Homo sapiens
cgtagatattggacaaagaacc

SEQ ID NO: 3052353 - DNA, 14 bp, Homo sapiens
cgtagccacaggag

SEQ ID NO: 3052354 - DNA, 18 bp, Homo sapiens
cgtagccacaggagccct

SEQ ID NO: 3052355 - DNA, 19 bp, Homo sapiens
cgtagccacaggagccctg

SEQ ID NO: 3052356 - DNA, 19 bp, Homo sapiens
cgtagccagctgctcccca

SEQ ID NO: 3052357 - DNA, 13 bp, Homo sapiens
cgtagttccctga

SEQ ID NO: 3052358 - DNA, 14 bp, Homo sapiens
cgtatacatttgtt

SEQ ID NO: 3052359 - DNA, 17 bp, Homo sapiens
cgtatatataagaaaga

SEQ ID NO: 3052360 - DNA, 17 bp, Homo sapiens
cgtatatctatatatac

SEQ ID NO: 3052361 - DNA, 21 bp, Homo sapiens
cgtatgagataggcacatgca

SEQ ID NO: 3052362 - DNA, 17 bp, Homo sapiens
cgtatggaatgcttctt

SEQ ID NO: 3052363 - DNA, 16 bp, Homo sapiens
cgtattaaaaaacaat

SEQ ID NO: 3052364 - DNA, 18 bp, Homo sapiens
cgtcagccatcagccatg

SEQ ID NO: 3052365 - DNA, 19 bp, Homo sapiens
cgtcagctgggacaccccg

SEQ ID NO: 3052366 - DNA, 14 bp, Homo sapiens
cgtcaggctgccag

SEQ ID NO: 3052367 - DNA, 14 bp, Homo sapiens
cgtcataggcttct

SEQ ID NO: 3052368 - DNA, 15 bp, Homo sapiens
cgtcatcttccctgc

SEQ ID NO: 3052369 - DNA, 20 bp, Homo sapiens
cgtcatcttccctgcccctg

SEQ ID NO: 3052370 - DNA, 14 bp, Homo sapiens
cgtccacagcttcc

SEQ ID NO: 3052371 - DNA, 15 bp, Homo sapiens
cgtccacagcttcct

SEQ ID NO: 3052372 - DNA, 12 bp, Homo sapiens
cgtccaccaggc

SEQ ID NO: 3052373 - DNA, 13 bp, Homo sapiens
cgtccagcctgcc

SEQ ID NO: 3052374 - DNA, 17 bp, Homo sapiens
cgtccagggtttacatt

SEQ ID NO: 3052375 - DNA, 18 bp, Homo sapiens
cgtccatagcagtacccc

SEQ ID NO: 3052376 - DNA, 13 bp, Homo sapiens
cgtccatctctct

SEQ ID NO: 3052377 - DNA, 14 bp, Homo sapiens
cgtcccagcggcct

SEQ ID NO: 3052378 - DNA, 20 bp, Homo sapiens
cgtcccagcggcctcagggt

SEQ ID NO: 3052379 - DNA, 17 bp, Homo sapiens
cgtccccccccaggccc

SEQ ID NO: 3052380 - DNA, 21 bp, Homo sapiens
cgtcccctcccccacccctgc

SEQ ID NO: 3052381 - DNA, 20 bp, Homo sapiens
cgtccgtgggttgctaactg

SEQ ID NO: 3052382 - DNA, 13 bp, Homo sapiens
cgtcctccccctg

SEQ ID NO: 3052383 - DNA, 18 bp, Homo sapiens
cgtcctgatgatttttat

SEQ ID NO: 3052384 - DNA, 14 bp, Homo sapiens
cgtcctgccctgcc

SEQ ID NO: 3052385 - DNA, 17 bp, Homo sapiens
cgtcctttcacacatct

SEQ ID NO: 3052386 - DNA, 16 bp, Homo sapiens
cgtcgaggaccgggca

SEQ ID NO: 3052387 - DNA, 16 bp, Homo sapiens
cgtcgccctcccaggc

SEQ ID NO: 3052388 - DNA, 18 bp, Homo sapiens
cgtcggagctgcctgcag

SEQ ID NO: 3052389 - DNA, 21 bp, Homo sapiens
cgtcggagctgcctgcagcac

SEQ ID NO: 3052390 - DNA, 16 bp, Homo sapiens
cgtcgtgtgctgaaga

SEQ ID NO: 3052391 - DNA, 22 bp, Homo sapiens
cgtctacgtatgcatgctaaat

SEQ ID NO: 3052392 - DNA, 21 bp, Homo sapiens
cgtctcattttgtccatgtcc

SEQ ID NO: 3052393 - DNA, 18 bp, Homo sapiens
cgtctctcccaccccctc

SEQ ID NO: 3052394 - DNA, 16 bp, Homo sapiens
cgtctctctgcctgct

SEQ ID NO: 3052395 - DNA, 21 bp, Homo sapiens
cgtctctctgcctgctgggct

SEQ ID NO: 3052396 - DNA, 19 bp, Homo sapiens
cgtctgccttggcatcctc

SEQ ID NO: 3052397 - DNA, 18 bp, Homo sapiens
cgtctggccctggcgggt

SEQ ID NO: 3052398 - DNA, 23 bp, Homo sapiens
cgtctggccctggcgggtggctg

SEQ ID NO: 3052399 - DNA, 22 bp, Homo sapiens
cgtctggcgagcccttagcctt

SEQ ID NO: 3052400 - DNA, 14 bp, Homo sapiens
cgtctgggagaaat

SEQ ID NO: 3052401 - DNA, 18 bp, Homo sapiens
cgtctggggttcagcccc

SEQ ID NO: 3052402 - DNA, 22 bp, Homo sapiens
cgtctgtgtggggttctcagtg

SEQ ID NO: 3052403 - DNA, 22 bp, Homo sapiens
cgcgactaatttcaaaatgctt

SEQ ID NO: 3052404 - DNA, 21 bp, Homo sapiens
cgcgcccccctcccagaggcg

SEQ ID NO: 3052405 - DNA, 15 bp, Homo sapiens
cgcgcctggcctaga

SEQ ID NO: 3052406 - DNA, 19 bp, Homo sapiens
cgcgctctctctctttctc

SEQ ID NO: 3052407 - DNA, 17 bp, Homo sapiens
cgcggccctggggcggg

SEQ ID NO: 3052408 - DNA, 20 bp, Homo sapiens
cgcggcctcccgaggagggg

SEQ ID NO: 3052409 - DNA, 22 bp, Homo sapiens
cgcggcctcccgaggaggggcc

SEQ ID NO: 3052410 - DNA, 20 bp, Homo sapiens
cgcggcctgcaccgacccga

SEQ ID NO: 3052411 - DNA, 18 bp, Homo sapiens
cgcggcggagctggcccc

SEQ ID NO: 3052412 - DNA, 23 bp, Homo sapiens
cgcggcggagctggccccgccgc

SEQ ID NO: 3052413 - DNA, 15 bp, Homo sapiens
cgcggctggctctgt

SEQ ID NO: 3052414 - DNA, 12 bp, Homo sapiens
cgcgggcacagc

SEQ ID NO: 3052415 - DNA, 15 bp, Homo sapiens
cgcggggacattggg

SEQ ID NO: 3052416 - DNA, 21 bp, Homo sapiens
cgcgtcgccctcccaggctct

SEQ ID NO: 3052417 - DNA, 22 bp, Homo sapiens
cgctaacccccagcccacagag

SEQ ID NO: 3052418 - DNA, 15 bp, Homo sapiens
cgctacctccctccc

SEQ ID NO: 3052419 - DNA, 14 bp, Homo sapiens
cgctcactgaactc

SEQ ID NO: 3052420 - DNA, 15 bp, Homo sapiens
cgctccagctgcccc

SEQ ID NO: 3052421 - DNA, 16 bp, Homo sapiens
cgctcccacctagtgc

SEQ ID NO: 3052422 - DNA, 19 bp, Homo sapiens
cgctcccacctagtgcccc

SEQ ID NO: 3052423 - DNA, 18 bp, Homo sapiens
cgctcccctccatcccca

SEQ ID NO: 3052424 - DNA, 13 bp, Homo sapiens
cgctccctcccag

SEQ ID NO: 3052425 - DNA, 15 bp, Homo sapiens
cgctccctcccagga

SEQ ID NO: 3052426 - DNA, 14 bp, Homo sapiens
cgctccgtctctgt

SEQ ID NO: 3052427 - DNA, 21 bp, Homo sapiens
cgctcgcttccgcatcctagt

SEQ ID NO: 3052428 - DNA, 17 bp, Homo sapiens
cgctctccctaccttgc

SEQ ID NO: 3052429 - DNA, 19 bp, Homo sapiens
cgctctgttgcccaggctg

SEQ ID NO: 3052430 - DNA, 14 bp, Homo sapiens
cgctgaaattaaat

SEQ ID NO: 3052431 - DNA, 15 bp, Homo sapiens
cgctgaagcggtcag

SEQ ID NO: 3052432 - DNA, 13 bp, Homo sapiens
cgctgaataaatg

SEQ ID NO: 3052433 - DNA, 14 bp, Homo sapiens
cgctgaataaatgt

SEQ ID NO: 3052434 - DNA, 15 bp, Homo sapiens
cgctgccagctctgt

SEQ ID NO: 3052435 - DNA, 17 bp, Homo sapiens
cgctgccctgggtcctg

SEQ ID NO: 3052436 - DNA, 16 bp, Homo sapiens
cgctgccctgtggaca

SEQ ID NO: 3052437 - DNA, 22 bp, Homo sapiens
cgctgcctggaacaccagcagc

SEQ ID NO: 3052438 - DNA, 21 bp, Homo sapiens
cgctgcctggccaggccctgg

SEQ ID NO: 3052439 - DNA, 16 bp, Homo sapiens
cgctgcttccaggctg

SEQ ID NO: 3052440 - DNA, 17 bp, Homo sapiens
cgctgcttccaggctgg

SEQ ID NO: 3052441 - DNA, 18 bp, Homo sapiens
cgctgggcacttccctgc

SEQ ID NO: 3052442 - DNA, 23 bp, Homo sapiens
cgctggggaagtacgtcccagcg

SEQ ID NO: 3052443 - DNA, 12 bp, Homo sapiens
cgctggtgctga

SEQ ID NO: 3052444 - DNA, 23 bp, Homo sapiens
cgctgtattttgagtttcagctg

SEQ ID NO: 3052445 - DNA, 11 bp, Homo sapiens
cgctgtcccct

SEQ ID NO: 3052446 - DNA, 15 bp, Homo sapiens
cgctgtcccctcagc

SEQ ID NO: 3052447 - DNA, 22 bp, Homo sapiens
cgctgtcccctcagcgggggcc

SEQ ID NO: 3052448 - DNA, 23 bp, Homo sapiens
cgctgtccctagtaaaaatacaa

SEQ ID NO: 3052449 - DNA, 15 bp, Homo sapiens
cgctgtgagtgagtg

SEQ ID NO: 3052450 - DNA, 14 bp, Homo sapiens
cgctgttcacccac

SEQ ID NO: 3052451 - DNA, 19 bp, Homo sapiens
cgcttagcgctctggacag

SEQ ID NO: 3052452 - DNA, 17 bp, Homo sapiens
cgcttgtccagcgccta

SEQ ID NO: 3052453 - DNA, 13 bp, Homo sapiens
cgctttattttct

SEQ ID NO: 3052454 - DNA, 20 bp, Homo sapiens
cgctttgaacgtgccagcag

SEQ ID NO: 3052455 - DNA, 16 bp, Homo sapiens
cgctttgattcatagt

SEQ ID NO: 3052456 - DNA, 20 bp, Homo sapiens
cggaaaagcgtctttaagag

SEQ ID NO: 3052457 - DNA, 23 bp, Homo sapiens
cggaaacaaaaatgatcctcagt

SEQ ID NO: 3052458 - DNA, 13 bp, Homo sapiens
cggaaagcagctc

SEQ ID NO: 3052459 - DNA, 17 bp, Homo sapiens
cggaacccaagcttaga

SEQ ID NO: 3052460 - DNA, 12 bp, Homo sapiens
cggaaggccgag

SEQ ID NO: 3052461 - DNA, 20 bp, Homo sapiens
cggaagtacttccctcaggc

SEQ ID NO: 3052462 - DNA, 17 bp, Homo sapiens
cggaataagagacctgt

SEQ ID NO: 3052463 - DNA, 21 bp, Homo sapiens
cggaataagagacctgtttta

SEQ ID NO: 3052464 - DNA, 18 bp, Homo sapiens
cggacaagacccccagca

SEQ ID NO: 3052465 - DNA, 14 bp, Homo sapiens
cggacaccgtggcc

SEQ ID NO: 3052466 - DNA, 16 bp, Homo sapiens
cggacaccgtggcctg

SEQ ID NO: 3052467 - DNA, 18 bp, Homo sapiens
cggacaccgtggcctggg

SEQ ID NO: 3052468 - DNA, 15 bp, Homo sapiens
cggacagtcggaaaa

SEQ ID NO: 3052469 - DNA, 17 bp, Homo sapiens
cggacagtcggaaaagc

SEQ ID NO: 3052470 - DNA, 20 bp, Homo sapiens
cggacctggactagggcctc

SEQ ID NO: 3052471 - DNA, 18 bp, Homo sapiens
cggacggggcaggcgctg

SEQ ID NO: 3052472 - DNA, 19 bp, Homo sapiens
cggacggggcaggcgctgc

SEQ ID NO: 3052473 - DNA, 23 bp, Homo sapiens
cggactcacttgatgtttcctgg

SEQ ID NO: 3052474 - DNA, 23 bp, Homo sapiens
cggagagcgcctgcccctcccag

SEQ ID NO: 3052475 - DNA, 11 bp, Homo sapiens
cggagaggaag

SEQ ID NO: 3052476 - DNA, 16 bp, Homo sapiens
cggagcaaactctgct

SEQ ID NO: 3052477 - DNA, 19 bp, Homo sapiens
cgagctggtttcctgccca

SEQ ID NO: 3052478 - DNA, 19 bp, Homo sapiens
cgagcttagattctgtatg

SEQ ID NO: 3052479 - DNA, 13 bp, Homo sapiens
cgaggaaaaacaa

SEQ ID NO: 3052480 - DNA, 18 bp, Homo sapiens
cgaggaactcgcctcagc

SEQ ID NO: 3052481 - DNA, 15 bp, Homo sapiens
cgaggaccgggcact

SEQ ID NO: 3052482 - DNA, 20 bp, Homo sapiens
cgaggactgtatttgtgact

SEQ ID NO: 3052483 - DNA, 15 bp, Homo sapiens
cgaggaggcgcggcc

SEQ ID NO: 3052484 - DNA, 22 bp, Homo sapiens
cgaggaggcgcggcctcccgag

SEQ ID NO: 3052485 - DNA, 20 bp, Homo sapiens
cgaggaggctccagagggca

SEQ ID NO: 3052486 - DNA, 23 bp, Homo sapiens
cgaggaggggcccggtggcggca

SEQ ID NO: 3052487 - DNA, 17 bp, Homo sapiens
cgaggaggtaatgaatt

SEQ ID NO: 3052488 - DNA, 13 bp, Homo sapiens
cgaggcaggcaga

SEQ ID NO: 3052489 - DNA, 11 bp, Homo sapiens
cgaggccctgc

SEQ ID NO: 3052490 - DNA, 12 bp, Homo sapiens
cgaggctgcccc

SEQ ID NO: 3052491 - DNA, 14 bp, Homo sapiens
cgaggctgccccag

SEQ ID NO: 3052492 - DNA, 15 bp, Homo sapiens
cgagggccgcctgcc

SEQ ID NO: 3052493 - DNA, 20 bp, Homo sapiens
cgagggccgcctgccttagc

SEQ ID NO: 3052494 - DNA, 15 bp, Homo sapiens
cgagggcgtcagaga

SEQ ID NO: 3052495 - DNA, 16 bp, Homo sapiens
cgagggcgtcagagag

SEQ ID NO: 3052496 - DNA, 15 bp, Homo sapiens
cgagggctggctggc

SEQ ID NO: 3052497 - DNA, 20 bp, Homo sapiens
cgagggttgattaaggcagt

SEQ ID NO: 3052498 - DNA, 15 bp, Homo sapiens
cgaggtcaacagaga

SEQ ID NO: 3052499 - DNA, 23 bp, Homo sapiens
cgaggtcaacagagaaggcagga

SEQ ID NO: 3052500 - DNA, 21 bp, Homo sapiens
cgaggtgccttcttcagggcc

SEQ ID NO: 3052501 - DNA, 20 bp, Homo sapiens
cgaggtggatcacagaggct

SEQ ID NO: 3052502 - DNA, 22 bp, Homo sapiens
cgaggtggatcacagaggcttc

SEQ ID NO: 3052503 - DNA, 23 bp, Homo sapiens
cgaggtggatcacagaggcttct

SEQ ID NO: 3052504 - DNA, 14 bp, Homo sapiens
cgaggttgtgggga

SEQ ID NO: 3052505 - DNA, 17 bp, Homo sapiens
cgaggttgtggggaggc

SEQ ID NO: 3052506 - DNA, 18 bp, Homo sapiens
cgaggttgtggggaggct

SEQ ID NO: 3052507 - DNA, 14 bp, Homo sapiens
cgagtactgtgggc

SEQ ID NO: 3052508 - DNA, 22 bp, Homo sapiens
cgagtactgtgggcaatttaga

SEQ ID NO: 3052509 - DNA, 13 bp, Homo sapiens
cgagtatgtgttt

SEQ ID NO: 3052510 - DNA, 21 bp, Homo sapiens
cgagtatgtgtttgtgtgtgt

SEQ ID NO: 3052511 - DNA, 20 bp, Homo sapiens
cgagtcaatcccctcattca

SEQ ID NO: 3052512 - DNA, 19 bp, Homo sapiens
cgagtcattcgttctgtgg

SEQ ID NO: 3052513 - DNA, 20 bp, Homo sapiens
cgagtcattcgttctgtgga

SEQ ID NO: 3052514 - DNA, 21 bp, Homo sapiens
cgagtgcggcgtggagactgg

SEQ ID NO: 3052515 - DNA, 14 bp, Homo sapiens
cgagtggatgctgt

SEQ ID NO: 3052516 - DNA, 18 bp, Homo sapiens
cgagtggtctcctctcag

SEQ ID NO: 3052517 - DNA, 13 bp, Homo sapiens
cgataaggaagaa

SEQ ID NO: 3052518 - DNA, 15 bp, Homo sapiens
cgataaggaagaaac

SEQ ID NO: 3052519 - DNA, 16 bp, Homo sapiens
cgataaggaagaaaca

SEQ ID NO: 3052520 - DNA, 18 bp, Homo sapiens
cgatcaggcacaggtcag

SEQ ID NO: 3052521 - DNA, 12 bp, Homo sapiens
cgatctcagctc

SEQ ID NO: 3052522 - DNA, 14 bp, Homo sapiens
cgatctcccacctt

SEQ ID NO: 3052523 - DNA, 17 bp, Homo sapiens
cgatgattcaggtgcag

SEQ ID NO: 3052524 - DNA, 22 bp, Homo sapiens
cgatgccgtgtgtctcgtctcc

SEQ ID NO: 3052525 - DNA, 17 bp, Homo sapiens
cgatgcctggcctgcca

SEQ ID NO: 3052526 - DNA, 14 bp, Homo sapiens
cgatgcctttgctg

SEQ ID NO: 3052527 - DNA, 17 bp, Homo sapiens
cgatgcctttgctgttt

SEQ ID NO: 3052528 - DNA, 15 bp, Homo sapiens
cgatgcgtattctgt

SEQ ID NO: 3052529 - DNA, 18 bp, Homo sapiens
cgatgcgtattctgtggc

SEQ ID NO: 3052530 - DNA, 19 bp, Homo sapiens
cgatgctgctggcctccct

SEQ ID NO: 3052531 - DNA, 18 bp, Homo sapiens
cgatgctggaggccctcg

SEQ ID NO: 3052532 - DNA, 22 bp, Homo sapiens
cgatggcggggatctgggaggg

SEQ ID NO: 3052533 - DNA, 18 bp, Homo sapiens
cgatgggcccctggcccc

SEQ ID NO: 3052534 - DNA, 18 bp, Homo sapiens
cgatggtacgtgaccctc

SEQ ID NO: 3052535 - DNA, 17 bp, Homo sapiens
cgatggtcccaggaagc

SEQ ID NO: 3052536 - DNA, 19 bp, Homo sapiens
cgatgtatgcagctatctg

SEQ ID NO: 3052537 - DNA, 20 bp, Homo sapiens
cgatgtatgcagctatctgg

SEQ ID NO: 3052538 - DNA, 13 bp, Homo sapiens
cgatgtggccctg

SEQ ID NO: 3052539 - DNA, 17 bp, Homo sapiens
cgatgtggccctggcct

SEQ ID NO: 3052540 - DNA, 18 bp, Homo sapiens
cgatgtggccctggcctg

SEQ ID NO: 3052541 - DNA, 14 bp, Homo sapiens
cgattttaaatatt

SEQ ID NO: 3052542 - DNA, 14 bp, Homo sapiens
cgattttattactg

SEQ ID NO: 3052543 - DNA, 19 bp, Homo sapiens
cgattttattactggcgtg

SEQ ID NO: 3052544 - DNA, 20 bp, Homo sapiens
cgcaaaccaacctttctgac

SEQ ID NO: 3052545 - DNA, 16 bp, Homo sapiens
cgcaaaccacactgga

SEQ ID NO: 3052546 - DNA, 22 bp, Homo sapiens
cgcaaagcaagggggaaggctg

SEQ ID NO: 3052547 - DNA, 17 bp, Homo sapiens
cgcaagccacagcctgt

SEQ ID NO: 3052548 - DNA, 20 bp, Homo sapiens
cgcaagcctgtaatcccagc

SEQ ID NO: 3052549 - DNA, 21 bp, Homo sapiens
cgcaagcctgtaatcccagct

SEQ ID NO: 3052550 - DNA, 16 bp, Homo sapiens
cgcaagggcctggacg

SEQ ID NO: 3052551 - DNA, 14 bp, Homo sapiens
cgcacagctcccgg

SEQ ID NO: 3052552 - DNA, 12 bp, Homo sapiens
cgcacatataca

SEQ ID NO: 3052553 - DNA, 20 bp, Homo sapiens
cgcacctccacgccactgcc

SEQ ID NO: 3052554 - DNA, 18 bp, Homo sapiens
cgcacctcccatcctaat

SEQ ID NO: 3052555 - DNA, 14 bp, Homo sapiens
cgcacctgtacagt

SEQ ID NO: 3052556 - DNA, 12 bp, Homo sapiens
cgcactctggcg

SEQ ID NO: 3052557 - DNA, 22 bp, Homo sapiens
cgcactgtcccagtagccaagg

SEQ ID NO: 3052558 - DNA, 17 bp, Homo sapiens
cgcacttaccgccctgc

SEQ ID NO: 3052559 - DNA, 19 bp, Homo sapiens
cgcacttaccgccctgcgg

SEQ ID NO: 3052560 - DNA, 22 bp, Homo sapiens
cgcacttaccgccctgcgggcc

SEQ ID NO: 3052561 - DNA, 19 bp, Homo sapiens
cgcacttgcagaggagccc

SEQ ID NO: 3052562 - DNA, 12 bp, Homo sapiens
cgcagaggcaga

SEQ ID NO: 3052563 - DNA, 16 bp, Homo sapiens
cgcagcaggaggccag

SEQ ID NO: 3052564 - DNA, 17 bp, Homo sapiens
cgcagcaggaggccagg

SEQ ID NO: 3052565 - DNA, 18 bp, Homo sapiens
cgcagcaggaggccaggc

SEQ ID NO: 3052566 - DNA, 12 bp, Homo sapiens
cgcagccccatc

SEQ ID NO: 3052567 - DNA, 18 bp, Homo sapiens
cgcagccccatctgtgca

SEQ ID NO: 3052568 - DNA, 12 bp, Homo sapiens
cgcagcctccag

SEQ ID NO: 3052569 - DNA, 13 bp, Homo sapiens
cgcagcctccagt

SEQ ID NO: 3052570 - DNA, 14 bp, Homo sapiens
cgcagcctccagtt

SEQ ID NO: 3052571 - DNA, 11 bp, Homo sapiens
cgcagcctgag

SEQ ID NO: 3052572 - DNA, 19 bp, Homo sapiens
cgcagcctggcatctgtgc

SEQ ID NO: 3052573 - DNA, 20 bp, Homo sapiens
cgcagctctagtcctttata

SEQ ID NO: 3052574 - DNA, 12 bp, Homo sapiens
cgcagctgaagt

SEQ ID NO: 3052575 - DNA, 18 bp, Homo sapiens
cgcagctgctgccactct

SEQ ID NO: 3052576 - DNA, 22 bp, Homo sapiens
cgcagctgctgccactctgctg

SEQ ID NO: 3052577 - DNA, 24 bp, Homo sapiens
cgcagctgctgccactctgctgcc

SEQ ID NO: 3052578 - DNA, 13 bp, Homo sapiens
cgcaggaagctgc

SEQ ID NO: 3052579 - DNA, 15 bp, Homo sapiens
cgcaggaagctgctc

SEQ ID NO: 3052580 - DNA, 14 bp, Homo sapiens
cgcaggcccctctc

SEQ ID NO: 3052581 - DNA, 17 bp, Homo sapiens
cgcaggcccctctcctc

SEQ ID NO: 3052582 - DNA, 19 bp, Homo sapiens
cgcaggcccctctcctccg

SEQ ID NO: 3052583 - DNA, 23 bp, Homo sapiens
cgcaggcccctctcctccgtggc

SEQ ID NO: 3052584 - DNA, 12 bp, Homo sapiens
cgcaggccctgt

SEQ ID NO: 3052585 - DNA, 16 bp, Homo sapiens
cgcaggccctgtccag

SEQ ID NO: 3052586 - DNA, 15 bp, Homo sapiens
cgcaggcctccctgc

SEQ ID NO: 3052587 - DNA, 20 bp, Homo sapiens
cgcaggcctgccttctcagg

SEQ ID NO: 3052588 - DNA, 14 bp, Homo sapiens
cgcaggcggccagg

SEQ ID NO: 3052589 - DNA, 23 bp, Homo sapiens
cgcagggtggtggtattctgtca

SEQ ID NO: 3052590 - DNA, 19 bp, Homo sapiens
cgcatcaaaagacaattct

SEQ ID NO: 3052591 - DNA, 14 bp, Homo sapiens
cgcatccagacagt

SEQ ID NO: 3052592 - DNA, 21 bp, Homo sapiens
cgcatccctgcttctggcgcc

SEQ ID NO: 3052593 - DNA, 15 bp, Homo sapiens
cgcatcctagtctct

SEQ ID NO: 3052594 - DNA, 13 bp, Homo sapiens
cgcatcttctcca

SEQ ID NO: 3052595 - DNA, 19 bp, Homo sapiens
cgcatcttgcctccaggtg

SEQ ID NO: 3052596 - DNA, 13 bp, Homo sapiens
cgcatggcagctg

SEQ ID NO: 3052597 - DNA, 16 bp, Homo sapiens
cgcatggcagctgggc

SEQ ID NO: 3052598 - DNA, 19 bp, Homo sapiens
cgcatggtcacacactgat

SEQ ID NO: 3052599 - DNA, 16 bp, Homo sapiens
cgcatgtttaatgtga

SEQ ID NO: 3052600 - DNA, 21 bp, Homo sapiens
cgccacagcctgggaaggagc

SEQ ID NO: 3052601 - DNA, 22 bp, Homo sapiens
cgccaccgggcatgtctgcctg

SEQ ID NO: 3052602 - DNA, 22 bp, Homo sapiens
cgccagaagactcctaggccct

SEQ ID NO: 3052603 - DNA, 17 bp, Homo sapiens
cgccagccccgctccca

SEQ ID NO: 3052604 - DNA, 18 bp, Homo sapiens
cgccagccccgctcccac

SEQ ID NO: 3052605 - DNA, 15 bp, Homo sapiens
cgccaggcagagctg

SEQ ID NO: 3052606 - DNA, 16 bp, Homo sapiens
cgccagggagacctgg

SEQ ID NO: 3052607 - DNA, 15 bp, Homo sapiens
cgccagggcccaggc

SEQ ID NO: 3052608 - DNA, 14 bp, Homo sapiens
cgccagtgtttctg

SEQ ID NO: 3052609 - DNA, 19 bp, Homo sapiens
cgccataggccaaggtgca

SEQ ID NO: 3052610 - DNA, 20 bp, Homo sapiens
cgccattctcctgcctcagc

SEQ ID NO: 3052611 - DNA, 22 bp, Homo sapiens
cgccattctcctgcctcagcct

SEQ ID NO: 3052612 - DNA, 16 bp, Homo sapiens
cgccattgtactccag

SEQ ID NO: 3052613 - DNA, 21 bp, Homo sapiens
cgccattgtactccagcctgg

SEQ ID NO: 3052614 - DNA, 22 bp, Homo sapiens
cctgtcgattagactggacagc

SEQ ID NO: 3052615 - DNA, 19 bp, Homo sapiens
cctgtcgtctctcccaccc

SEQ ID NO: 3052616 - DNA, 17 bp, Homo sapiens
cctgtctagagagggag

SEQ ID NO: 3052617 - DNA, 22 bp, Homo sapiens
cctgtctcaatagctccaagct

SEQ ID NO: 3052618 - DNA, 13 bp, Homo sapiens
cctgtctcagtga

SEQ ID NO: 3052619 - DNA, 15 bp, Homo sapiens
cctgtctctccttgt

SEQ ID NO: 3052620 - DNA, 14 bp, Homo sapiens
cctgtctctttcca

SEQ ID NO: 3052621 - DNA, 19 bp, Homo sapiens
cctgtctgaacctgccctt

SEQ ID NO: 3052622 - DNA, 23 bp, Homo sapiens
cctgtctgtccaacccctccccc

SEQ ID NO: 3052623 - DNA, 17 bp, Homo sapiens
cctgtctgtccttctga

SEQ ID NO: 3052624 - DNA, 18 bp, Homo sapiens
cctgtcttcggccgagct

SEQ ID NO: 3052625 - DNA, 19 bp, Homo sapiens
cctgtcttcggccgagctg

SEQ ID NO: 3052626 - DNA, 17 bp, Homo sapiens
cctgtcttgctcctggg

SEQ ID NO: 3052627 - DNA, 19 bp, Homo sapiens
cctgtcttgctcctgggga

SEQ ID NO: 3052628 - DNA, 13 bp, Homo sapiens
cctgtctttccta

SEQ ID NO: 3052629 - DNA, 21 bp, Homo sapiens
cctgtctttcctaagacctgg

SEQ ID NO: 3052630 - DNA, 19 bp, Homo sapiens
cctgtgaccagtctgaccc

SEQ ID NO: 3052631 - DNA, 22 bp, Homo sapiens
cctgtgaccctctcactttggt

SEQ ID NO: 3052632 - DNA, 15 bp, Homo sapiens
cctgtgaccttggga

SEQ ID NO: 3052633 - DNA, 15 bp, Homo sapiens
cctgtgagcccagct

SEQ ID NO: 3052634 - DNA, 21 bp, Homo sapiens
cctgtgaggagccccatctgt

SEQ ID NO: 3052635 - DNA, 13 bp, Homo sapiens
cctgtgaggcagg

SEQ ID NO: 3052636 - DNA, 18 bp, Homo sapiens
cctgtgagggagtgcaga

SEQ ID NO: 3052637 - DNA, 23 bp, Homo sapiens
cctgtgaggggcccctggcccag

SEQ ID NO: 3052638 - DNA, 15 bp, Homo sapiens
cctttagcttaagag

SEQ ID NO: 3052639 - DNA, 15 bp, Homo sapiens
cctttagctttgaca

SEQ ID NO: 3052640 - DNA, 19 bp, Homo sapiens
cctttagtacctgaaaagt

SEQ ID NO: 3052641 - DNA, 17 bp, Homo sapiens
cctttatactgtgaagt

SEQ ID NO: 3052642 - DNA, 23 bp, Homo sapiens
cctttattaccccctccttcaga

SEQ ID NO: 3052643 - DNA, 13 bp, Homo sapiens
cctttcaaagctt

SEQ ID NO: 3052644 - DNA, 22 bp, Homo sapiens
cctttcagcccacgtcacgtgt

SEQ ID NO: 3052645 - DNA, 13 bp, Homo sapiens
cctttcagccctg

SEQ ID NO: 3052646 - DNA, 16 bp, Homo sapiens
cctttccaaggcttct

SEQ ID NO: 3052647 - DNA, 15 bp, Homo sapiens
cctttccatctgtcc

SEQ ID NO: 3052648 - DNA, 15 bp, Homo sapiens
cctttcccatttcgt

SEQ ID NO: 3052649 - DNA, 15 bp, Homo sapiens
cctttccccttcctt

SEQ ID NO: 3052650 - DNA, 12 bp, Homo sapiens
cctttccttcct

SEQ ID NO: 3052651 - DNA, 19 bp, Homo sapiens
cctttctagagcactgcca

SEQ ID NO: 3052652 - DNA, 14 bp, Homo sapiens
cctttctagttgaa

SEQ ID NO: 3052653 - DNA, 15 bp, Homo sapiens
cctttctagttgaaa

SEQ ID NO: 3052654 - DNA, 15 bp, Homo sapiens
cctttctcctttgta

SEQ ID NO: 3052655 - DNA, 22 bp, Homo sapiens
cctttctgacatcagcacttta

SEQ ID NO: 3052656 - DNA, 11 bp, Homo sapiens
cctttctgccc

SEQ ID NO: 3052657 - DNA, 19 bp, Homo sapiens
cctttctgccccccagggc

SEQ ID NO: 3052658 - DNA, 18 bp, Homo sapiens
cctttgaattacagcagt

SEQ ID NO: 3052659 - DNA, 19 bp, Homo sapiens
cctttgagtgcagtcctga

SEQ ID NO: 3052660 - DNA, 22 bp, Homo sapiens
cctttgagtgcagtcctgatca

SEQ ID NO: 3052661 - DNA, 16 bp, Homo sapiens
cctttgagtgtgggac

SEQ ID NO: 3052662 - DNA, 18 bp, Homo sapiens
cctttgcccacacacact

SEQ ID NO: 3052663 - DNA, 14 bp, Homo sapiens
cctttgcctccaga

SEQ ID NO: 3052664 - DNA, 21 bp, Homo sapiens
cctttgcctgtagagccagcc

SEQ ID NO: 3052665 - DNA, 20 bp, Homo sapiens
cctttggaacaagacagcct

SEQ ID NO: 3052666 - DNA, 12 bp, Homo sapiens
cctttggaggga

SEQ ID NO: 3052667 - DNA, 15 bp, Homo sapiens
cctttggcagagttc

SEQ ID NO: 3052668 - DNA, 15 bp, Homo sapiens
cctttggcatgttta

SEQ ID NO: 3052669 - DNA, 16 bp, Homo sapiens
cctttggcatgtttaa

SEQ ID NO: 3052670 - DNA, 22 bp, Homo sapiens
cctttggcatgtttaattgtga

SEQ ID NO: 3052671 - DNA, 18 bp, Homo sapiens
cctttgggccctgcatgt

SEQ ID NO: 3052672 - DNA, 18 bp, Homo sapiens
cctttgggtcctgggcag

SEQ ID NO: 3052673 - DNA, 15 bp, Homo sapiens
cctttggttctggcc

SEQ ID NO: 3052674 - DNA, 12 bp, Homo sapiens
cctttgtcattt

SEQ ID NO: 3052675 - DNA, 19 bp, Homo sapiens
cctttgtcttttttttcat

SEQ ID NO: 3052676 - DNA, 15 bp, Homo sapiens
cctttgttctgagca

SEQ ID NO: 3052677 - DNA, 13 bp, Homo sapiens
cctttgttctggg

SEQ ID NO: 3052678 - DNA, 23 bp, Homo sapiens
cctttgttgtctacattaaatca

SEQ ID NO: 3052679 - DNA, 18 bp, Homo sapiens
ccttttaacacctgatgt

SEQ ID NO: 3052680 - DNA, 16 bp, Homo sapiens
ccttttaattctacca

SEQ ID NO: 3052681 - DNA, 18 bp, Homo sapiens
ccttttacatactgctgt

SEQ ID NO: 3052682 - DNA, 18 bp, Homo sapiens
ccttttaccattttatct

SEQ ID NO: 3052683 - DNA, 20 bp, Homo sapiens
ccttttactacagctatgaa

SEQ ID NO: 3052684 - DNA, 15 bp, Homo sapiens
ccttttattgacaca

SEQ ID NO: 3052685 - DNA, 23 bp, Homo sapiens
ccttttcagcgatgtatgcagct

SEQ ID NO: 3052686 - DNA, 16 bp, Homo sapiens
ccttttcattctcctc

SEQ ID NO: 3052687 - DNA, 11 bp, Homo sapiens
ccttttccaaa

SEQ ID NO: 3052688 - DNA, 18 bp, Homo sapiens
ccttttctcctctttgaa

SEQ ID NO: 3052689 - DNA, 20 bp, Homo sapiens
ccttttgataaaatgttcct

SEQ ID NO: 3052690 - DNA, 14 bp, Homo sapiens
ccttttgtttttcc

SEQ ID NO: 3052691 - DNA, 15 bp, Homo sapiens
cctttttaaaacaca

SEQ ID NO: 3052692 - DNA, 17 bp, Homo sapiens
cctttttatattttata

SEQ ID NO: 3052693 - DNA, 13 bp, Homo sapiens
cctttttatttat

SEQ ID NO: 3052694 - DNA, 11 bp, Homo sapiens
cctttttctgc

SEQ ID NO: 3052695 - DNA, 20 bp, Homo sapiens
cctttttgcaggggactggg

SEQ ID NO: 3052696 - DNA, 12 bp, Homo sapiens
ccttttttctct

SEQ ID NO: 3052697 - DNA, 17 bp, Homo sapiens
ccttttttctcttctgt

SEQ ID NO: 3052698 - DNA, 22 bp, Homo sapiens
cgaaaaccaggccttatctcca

SEQ ID NO: 3052699 - DNA, 17 bp, Homo sapiens
cgaaacacagaaacctt

SEQ ID NO: 3052700 - DNA, 23 bp, Homo sapiens
cgaaaggatgtaaacagtgcctg

SEQ ID NO: 3052701 - DNA, 12 bp, Homo sapiens
cgaaaggtgcag

SEQ ID NO: 3052702 - DNA, 17 bp, Homo sapiens
cgaaaggtgcagctgcg

SEQ ID NO: 3052703 - DNA, 16 bp, Homo sapiens
cgaacacaagaaaaag

SEQ ID NO: 3052704 - DNA, 19 bp, Homo sapiens
cgaacatccaaccttccca

SEQ ID NO: 3052705 - DNA, 15 bp, Homo sapiens
cgaacatcttcatat

SEQ ID NO: 3052706 - DNA, 12 bp, Homo sapiens
cgaacatgtgtt

SEQ ID NO: 3052707 - DNA, 13 bp, Homo sapiens
cgaacatgtgttt

SEQ ID NO: 3052708 - DNA, 16 bp, Homo sapiens
cgaacctcctctgtga

SEQ ID NO: 3052709 - DNA, 16 bp, Homo sapiens
cgaacctcggggtggg

SEQ ID NO: 3052710 - DNA, 15 bp, Homo sapiens
cgaactccaggctgg

SEQ ID NO: 3052711 - DNA, 16 bp, Homo sapiens
cgaactccaggctggg

SEQ ID NO: 3052712 - DNA, 11 bp, Homo sapiens
cgaactggcta

SEQ ID NO: 3052713 - DNA, 17 bp, Homo sapiens
cgaagaagagccacagt

SEQ ID NO: 3052714 - DNA, 15 bp, Homo sapiens
cgaagagcaggccag

SEQ ID NO: 3052715 - DNA, 15 bp, Homo sapiens
cgaagcgttgtcctc

SEQ ID NO: 3052716 - DNA, 21 bp, Homo sapiens
cgaagcgttgtcctcagcccc

SEQ ID NO: 3052717 - DNA, 16 bp, Homo sapiens
cgaagtcattaaactg

SEQ ID NO: 3052718 - DNA, 19 bp, Homo sapiens
cgaagtcattaaactggtt

SEQ ID NO: 3052719 - DNA, 15 bp, Homo sapiens
cgaagtccagctttc

SEQ ID NO: 3052720 - DNA, 16 bp, Homo sapiens
cgaagtccagctttct

SEQ ID NO: 3052721 - DNA, 17 bp, Homo sapiens
cgaagtccagctttctg

SEQ ID NO: 3052722 - DNA, 19 bp, Homo sapiens
cctgctgctggtgcacagc

SEQ ID NO: 3052723 - DNA, 23 bp, Homo sapiens
cctgctgctgtcacctctcccac

SEQ ID NO: 3052724 - DNA, 12 bp, Homo sapiens
cctgctggcctg

SEQ ID NO: 3052725 - DNA, 17 bp, Homo sapiens
cctgctggcctgctctt

SEQ ID NO: 3052726 - DNA, 19 bp, Homo sapiens
cctgctggcctgctcttac

SEQ ID NO: 3052727 - DNA, 23 bp, Homo sapiens
cctgctggctggtgcctgagccc

SEQ ID NO: 3052728 - DNA, 19 bp, Homo sapiens
cctgctgggctctccacct

SEQ ID NO: 3052729 - DNA, 23 bp, Homo sapiens
cctgctgggctctccacctcagc

SEQ ID NO: 3052730 - DNA, 24 bp, Homo sapiens
cctgctgggctctccacctcagcc

SEQ ID NO: 3052731 - DNA, 14 bp, Homo sapiens
cctgctgggctctt

SEQ ID NO: 3052732 - DNA, 23 bp, Homo sapiens
cctgctgggctcttaactgttgc

SEQ ID NO: 3052733 - DNA, 15 bp, Homo sapiens
cctgctgtctctctg

SEQ ID NO: 3052734 - DNA, 17 bp, Homo sapiens
cctgctgtctctctggg

SEQ ID NO: 3052735 - DNA, 11 bp, Homo sapiens
cctgctgtgga

SEQ ID NO: 3052736 - DNA, 16 bp, Homo sapiens
cctgctgtggagccca

SEQ ID NO: 3052737 - DNA, 22 bp, Homo sapiens
cctgctgttggtcctctctctg

SEQ ID NO: 3052738 - DNA, 21 bp, Homo sapiens
cctgcttagaacccttctgct

SEQ ID NO: 3052739 - DNA, 21 bp, Homo sapiens
cctgcttcagatgtggagcca

SEQ ID NO: 3052740 - DNA, 15 bp, Homo sapiens
cctgcttcatatctc

SEQ ID NO: 3052741 - DNA, 18 bp, Homo sapiens
cctgcttctcttttcctc

SEQ ID NO: 3052742 - DNA, 21 bp, Homo sapiens
cctgcttgatgggattctgga

SEQ ID NO: 3052743 - DNA, 22 bp, Homo sapiens
cctgcttgtactaagccaggag

SEQ ID NO: 3052744 - DNA, 17 bp, Homo sapiens
cctgctttgacgggcca

SEQ ID NO: 3052745 - DNA, 18 bp, Homo sapiens
cctgctttgacgggccag

SEQ ID NO: 3052746 - DNA, 22 bp, Homo sapiens
cctggaaatatcagttactcag

SEQ ID NO: 3052747 - DNA, 14 bp, Homo sapiens
cctggaacaccagc

SEQ ID NO: 3052748 - DNA, 17 bp, Homo sapiens
cctggaacaccagcagc

SEQ ID NO: 3052749 - DNA, 21 bp, Homo sapiens
cctggaaccagcaagtcccag

SEQ ID NO: 3052750 - DNA, 19 bp, Homo sapiens
cctggaacctttcccttgt

SEQ ID NO: 3052751 - DNA, 12 bp, Homo sapiens
cctggaagcact

SEQ ID NO: 3052752 - DNA, 13 bp, Homo sapiens
cctggaagcagag

SEQ ID NO: 3052753 - DNA, 14 bp, Homo sapiens
cctggaagcagagc

SEQ ID NO: 3052754 - DNA, 16 bp, Homo sapiens
cctggaagcagagcaa

SEQ ID NO: 3052755 - DNA, 13 bp, Homo sapiens
cctggaagctgtg

SEQ ID NO: 3052756 - DNA, 17 bp, Homo sapiens
cctggaagctgtgtcct

SEQ ID NO: 3052757 - DNA, 20 bp, Homo sapiens
cctggaagctgtgtccttgc

SEQ ID NO: 3052758 - DNA, 22 bp, Homo sapiens
cctggaaggacatccatgttcc

SEQ ID NO: 3052759 - DNA, 21 bp, Homo sapiens
cctggaagtcaaataaatgtt

SEQ ID NO: 3052760 - DNA, 13 bp, Homo sapiens
cctggacacaggc

SEQ ID NO: 3052761 - DNA, 21 bp, Homo sapiens
cctggacatgaagattctttc

SEQ ID NO: 3052762 - DNA, 24 bp, Homo sapiens
cctggacatgaagattctttccca

SEQ ID NO: 3052763 - DNA, 20 bp, Homo sapiens
cctggacattttttcagtca

SEQ ID NO: 3052764 - DNA, 16 bp, Homo sapiens
cctggaccagcctctc

SEQ ID NO: 3052765 - DNA, 14 bp, Homo sapiens
cctggaccccctgc

SEQ ID NO: 3052766 - DNA, 16 bp, Homo sapiens
cctggaccccctgccc

SEQ ID NO: 3052767 - DNA, 18 bp, Homo sapiens
cctggaccccctgcccgc

SEQ ID NO: 3052768 - DNA, 15 bp, Homo sapiens
cctggaccttgacag

SEQ ID NO: 3052769 - DNA, 23 bp, Homo sapiens
cctggaccttgacagagcagcta

SEQ ID NO: 3052770 - DNA, 22 bp, Homo sapiens
cctggacgaagagcaggccagc

SEQ ID NO: 3052771 - DNA, 19 bp, Homo sapiens
cctggagactaaccccacc

SEQ ID NO: 3052772 - DNA, 18 bp, Homo sapiens
cctggagactgcccagct

SEQ ID NO: 3052773 - DNA, 16 bp, Homo sapiens
cctggagagcgaggag

SEQ ID NO: 3052774 - DNA, 20 bp, Homo sapiens
cctggagagcgaggaggcgc

SEQ ID NO: 3052775 - DNA, 20 bp, Homo sapiens
cctggagcaatcacagatga

SEQ ID NO: 3052776 - DNA, 19 bp, Homo sapiens
cctggagcagaaagtgcct

SEQ ID NO: 3052777 - DNA, 15 bp, Homo sapiens
cctggagcaggggtg

SEQ ID NO: 3052778 - DNA, 18 bp, Homo sapiens
cctggagccccactgccc

SEQ ID NO: 3052779 - DNA, 21 bp, Homo sapiens
cctggagccctccgccttcac

SEQ ID NO: 3052780 - DNA, 18 bp, Homo sapiens
cctggagcgtttgctgtg

SEQ ID NO: 3052781 - DNA, 13 bp, Homo sapiens
cctggaggcccag

SEQ ID NO: 3052782 - DNA, 15 bp, Homo sapiens
cctggagggcagaga

SEQ ID NO: 3052783 - DNA, 19 bp, Homo sapiens
cctggagggcgcccagcag

SEQ ID NO: 3052784 - DNA, 17 bp, Homo sapiens
cctggaggtctgaaaag

SEQ ID NO: 3052785 - DNA, 14 bp, Homo sapiens
cctggaggtggctg

SEQ ID NO: 3052786 - DNA, 17 bp, Homo sapiens
cctggagtgctgtgctg

SEQ ID NO: 3052787 - DNA, 17 bp, Homo sapiens
cctggagtgtgtcagag

SEQ ID NO: 3052788 - DNA, 16 bp, Homo sapiens
cctggagttgcattga

SEQ ID NO: 3052789 - DNA, 17 bp, Homo sapiens
cctggatagccttgaaa

SEQ ID NO: 3052790 - DNA, 20 bp, Homo sapiens
cctggatagccttgaaaaca

SEQ ID NO: 3052791 - DNA, 22 bp, Homo sapiens
cctggatctaccagcataaata

SEQ ID NO: 3052792 - DNA, 21 bp, Homo sapiens
cctggatgtcatattggcagt

SEQ ID NO: 3052793 - DNA, 12 bp, Homo sapiens
cctggatgtctg

SEQ ID NO: 3052794 - DNA, 12 bp, Homo sapiens
cctggcacctgt

SEQ ID NO: 3052795 - DNA, 13 bp, Homo sapiens
cctggcacctgtg

SEQ ID NO: 3052796 - DNA, 12 bp, Homo sapiens
cctggcagacac

SEQ ID NO: 3052797 - DNA, 17 bp, Homo sapiens
cctggcagctctggaca

SEQ ID NO: 3052798 - DNA, 23 bp, Homo sapiens
cctggcagctctggacagcccca

SEQ ID NO: 3052799 - DNA, 13 bp, Homo sapiens
cctggcagggggt

SEQ ID NO: 3052800 - DNA, 13 bp, Homo sapiens
cctggcatctgtg

SEQ ID NO: 3052801 - DNA, 22 bp, Homo sapiens
cctggcatctgtgtgtgtggcg

SEQ ID NO: 3052802 - DNA, 14 bp, Homo sapiens
cctggccaacatgg

SEQ ID NO: 3052803 - DNA, 16 bp, Homo sapiens
cctggccaccacccaa

SEQ ID NO: 3052804 - DNA, 15 bp, Homo sapiens
cctggccagacacag

SEQ ID NO: 3052805 - DNA, 16 bp, Homo sapiens
cctggccagacacagg

SEQ ID NO: 3052806 - DNA, 16 bp, Homo sapiens
cctggccagtcctggt

SEQ ID NO: 3052807 - DNA, 17 bp, Homo sapiens
cctggccagtcttcctc

SEQ ID NO: 3052808 - DNA, 12 bp, Homo sapiens
cctggccatgct

SEQ ID NO: 3052809 - DNA, 23 bp, Homo sapiens
cctggccatgctgtccctgcact

SEQ ID NO: 3052810 - DNA, 15 bp, Homo sapiens
cctggcccaggagga

SEQ ID NO: 3052811 - DNA, 14 bp, Homo sapiens
cctggcccaggcct

SEQ ID NO: 3052812 - DNA, 22 bp, Homo sapiens
cctggcccaggccttgctgact

SEQ ID NO: 3052813 - DNA, 17 bp, Homo sapiens
cctggccccatgtctct

SEQ ID NO: 3052814 - DNA, 20 bp, Homo sapiens
cctggccccctcagctctgt

SEQ ID NO: 3052815 - DNA, 17 bp, Homo sapiens
cctggccccgcctgcct

SEQ ID NO: 3052816 - DNA, 22 bp, Homo sapiens
cctggccccgcctgcctgccac

SEQ ID NO: 3052817 - DNA, 19 bp, Homo sapiens
cctggccgagtccaagctg

SEQ ID NO: 3052818 - DNA, 12 bp, Homo sapiens
cctggccggcca

SEQ ID NO: 3052819 - DNA, 13 bp, Homo sapiens
cctggccggccag

SEQ ID NO: 3052820 - DNA, 23 bp, Homo sapiens
cctggccggccagccagccactc

SEQ ID NO: 3052821 - DNA, 18 bp, Homo sapiens
cctggccgggtcaccctg

SEQ ID NO: 3052822 - DNA, 19 bp, Homo sapiens
cctggccgggtcaccctgt

SEQ ID NO: 3052823 - DNA, 22 bp, Homo sapiens
cctggccgggtcaccctgtgac

SEQ ID NO: 3052824 - DNA, 16 bp, Homo sapiens
cctggccgttcagcct

SEQ ID NO: 3052825 - DNA, 14 bp, Homo sapiens
cctggcctccaggc

SEQ ID NO: 3052826 - DNA, 15 bp, Homo sapiens
cctggcctccaggcc

SEQ ID NO: 3052827 - DNA, 16 bp, Homo sapiens
cctggcctggcacaca

SEQ ID NO: 3052828 - DNA, 15 bp, Homo sapiens
cctggcgggtggctg

SEQ ID NO: 3052829 - DNA, 17 bp, Homo sapiens
cctggcgggtggctgca

SEQ ID NO: 3052830 - DNA, 18 bp, Homo sapiens
cctggcgggtggctgcaa

SEQ ID NO: 3052831 - DNA, 20 bp, Homo sapiens
cctggcgggtggctgcaagc

SEQ ID NO: 3052832 - DNA, 15 bp, Homo sapiens
cctggctcaggccca

SEQ ID NO: 3052833 - DNA, 22 bp, Homo sapiens
cctggctccaaaccctcgaggc

SEQ ID NO: 3052834 - DNA, 13 bp, Homo sapiens
cctggctccccga

SEQ ID NO: 3052835 - DNA, 16 bp, Homo sapiens
cctggctccccgaggg

SEQ ID NO: 3052836 - DNA, 21 bp, Homo sapiens
cctggctccccgagggctcag

SEQ ID NO: 3052837 - DNA, 17 bp, Homo sapiens
cctggctgaacagtgct

SEQ ID NO: 3052838 - DNA, 21 bp, Homo sapiens
cctggctgaacagtgctctgc

SEQ ID NO: 3052839 - DNA, 22 bp, Homo sapiens
cctggctgaacagtgctctgcc

SEQ ID NO: 3052840 - DNA, 12 bp, Homo sapiens
cctggctgcact

SEQ ID NO: 3052841 - DNA, 11 bp, Homo sapiens
cctggctgcag

SEQ ID NO: 3052842 - DNA, 12 bp, Homo sapiens
cctggctgcagc

SEQ ID NO: 3052843 - DNA, 14 bp, Homo sapiens
cctggctgcagcct

SEQ ID NO: 3052844 - DNA, 16 bp, Homo sapiens
cctggctgctgcttct

SEQ ID NO: 3052845 - DNA, 18 bp, Homo sapiens
cctggctgctgcttcttg

SEQ ID NO: 3052846 - DNA, 23 bp, Homo sapiens
cctggcttcactctccctgacgg

SEQ ID NO: 3052847 - DNA, 16 bp, Homo sapiens
cctggcttgtttattt

SEQ ID NO: 3052848 - DNA, 22 bp, Homo sapiens
cctgggagaaatctggcttctg

SEQ ID NO: 3052849 - DNA, 20 bp, Homo sapiens
cctgggagcaagttgcagtc

SEQ ID NO: 3052850 - DNA, 19 bp, Homo sapiens
cctgggaggaaatttgaat

SEQ ID NO: 3052851 - DNA, 16 bp, Homo sapiens
cctgggaggcacagca

SEQ ID NO: 3052852 - DNA, 13 bp, Homo sapiens
cctgggcaaagcc

SEQ ID NO: 3052853 - DNA, 17 bp, Homo sapiens
cctgggcaggtgggagc

SEQ ID NO: 3052854 - DNA, 19 bp, Homo sapiens
cctgggcagtgcccaccat

SEQ ID NO: 3052855 - DNA, 17 bp, Homo sapiens
cctgggcattgctttcc

SEQ ID NO: 3052856 - DNA, 15 bp, Homo sapiens
cctgggccccaccac

SEQ ID NO: 3052857 - DNA, 21 bp, Homo sapiens
cctgggccccaccacctaggc

SEQ ID NO: 3052858 - DNA, 16 bp, Homo sapiens
cctcaatttctgaaca

SEQ ID NO: 3052859 - DNA, 14 bp, Homo sapiens
cctcacaactcctt

SEQ ID NO: 3052860 - DNA, 15 bp, Homo sapiens
cctcacaactccttc

SEQ ID NO: 3052861 - DNA, 13 bp, Homo sapiens
cctcacactccag

SEQ ID NO: 3052862 - DNA, 19 bp, Homo sapiens
cctcacagactcttccacc

SEQ ID NO: 3052863 - DNA, 21 bp, Homo sapiens
cctcacagactcttccaccag

SEQ ID NO: 3052864 - DNA, 18 bp, Homo sapiens
cctcacagatgctggcct

SEQ ID NO: 3052865 - DNA, 19 bp, Homo sapiens
cctcacagatgctggcctc

SEQ ID NO: 3052866 - DNA, 15 bp, Homo sapiens
cctcacaggccccag

SEQ ID NO: 3052867 - DNA, 15 bp, Homo sapiens
cctcaccacccaaca

SEQ ID NO: 3052868 - DNA, 13 bp, Homo sapiens
cctcaccaccccc

SEQ ID NO: 3052869 - DNA, 14 bp, Homo sapiens
cctcaccaccccca

SEQ ID NO: 3052870 - DNA, 16 bp, Homo sapiens
cctcacccacccctgc

SEQ ID NO: 3052871 - DNA, 21 bp, Homo sapiens
cctcacccacccctgcacagt

SEQ ID NO: 3052872 - DNA, 15 bp, Homo sapiens
cctcacccaccctgt

SEQ ID NO: 3052873 - DNA, 14 bp, Homo sapiens
cctcaccccagctc

SEQ ID NO: 3052874 - DNA, 15 bp, Homo sapiens
cctcaccccagctcc

SEQ ID NO: 3052875 - DNA, 17 bp, Homo sapiens
cctcaccccgtctgggg

SEQ ID NO: 3052876 - DNA, 19 bp, Homo sapiens
cctcacctggtacctggac

SEQ ID NO: 3052877 - DNA, 12 bp, Homo sapiens
cctcacctggtc

SEQ ID NO: 3052878 - DNA, 15 bp, Homo sapiens
cctcaccttctgagt

SEQ ID NO: 3052879 - DNA, 19 bp, Homo sapiens
cctcacgccccctgtgact

SEQ ID NO: 3052880 - DNA, 20 bp, Homo sapiens
cctcacgtatttcacagagc

SEQ ID NO: 3052881 - DNA, 18 bp, Homo sapiens
cctcactactcgagccca

SEQ ID NO: 3052882 - DNA, 15 bp, Homo sapiens
cctcactcttcctca

SEQ ID NO: 3052883 - DNA, 18 bp, Homo sapiens
cctcactgaaaacatctg

SEQ ID NO: 3052884 - DNA, 20 bp, Homo sapiens
cctcactggctcatgcccct

SEQ ID NO: 3052885 - DNA, 22 bp, Homo sapiens
cctcactggctcatgccccttg

SEQ ID NO: 3052886 - DNA, 22 bp, Homo sapiens
cctcacttggtctgccaggccc

SEQ ID NO: 3052887 - DNA, 21 bp, Homo sapiens
cctcagaacccttggcttgcc

SEQ ID NO: 3052888 - DNA, 21 bp, Homo sapiens
cctcagaagaaaacaaagttc

SEQ ID NO: 3052889 - DNA, 12 bp, Homo sapiens
cctcagactgca

SEQ ID NO: 3052890 - DNA, 21 bp, Homo sapiens
cctcagactgcacccaggagg

SEQ ID NO: 3052891 - DNA, 12 bp, Homo sapiens
cctcagagccca

SEQ ID NO: 3052892 - DNA, 15 bp, Homo sapiens
cctcagatgtgttga

SEQ ID NO: 3052893 - DNA, 12 bp, Homo sapiens
cctcagcattta

SEQ ID NO: 3052894 - DNA, 18 bp, Homo sapiens
cctcagccccgcgtggaa

SEQ ID NO: 3052895 - DNA, 13 bp, Homo sapiens
cctcagccctgac

SEQ ID NO: 3052896 - DNA, 22 bp, Homo sapiens
cctcagcctcccaagtagctgg

SEQ ID NO: 3052897 - DNA, 20 bp, Homo sapiens
cctcagcctgatcaggcttc

SEQ ID NO: 3052898 - DNA, 23 bp, Homo sapiens
cctcagcctgatcaggcttcctg

SEQ ID NO: 3052899 - DNA, 13 bp, Homo sapiens
cctcagcctgcac

SEQ ID NO: 3052900 - DNA, 17 bp, Homo sapiens
cctcagcctgcaccctc

SEQ ID NO: 3052901 - DNA, 20 bp, Homo sapiens
cctcagcctggccagacaca

SEQ ID NO: 3052902 - DNA, 21 bp, Homo sapiens
cctcagcctggccagacacag

SEQ ID NO: 3052903 - DNA, 17 bp, Homo sapiens
cctcagccttgccagag

SEQ ID NO: 3052904 - DNA, 19 bp, Homo sapiens
cctcagccttgccagagat

SEQ ID NO: 3052905 - DNA, 22 bp, Homo sapiens
cctcagccttgccagagatcca

SEQ ID NO: 3052906 - DNA, 19 bp, Homo sapiens
cctcagcgggggccttgaa

SEQ ID NO: 3052907 - DNA, 22 bp, Homo sapiens
cctcagcgggggccttgaagac

SEQ ID NO: 3052908 - DNA, 21 bp, Homo sapiens
cctcagctcagcttcgtgcct

SEQ ID NO: 3052909 - DNA, 16 bp, Homo sapiens
cctcagctctgtcctg

SEQ ID NO: 3052910 - DNA, 13 bp, Homo sapiens
cctcagctgtcgg

SEQ ID NO: 3052911 - DNA, 14 bp, Homo sapiens
cctcagctgtcggg

SEQ ID NO: 3052912 - DNA, 20 bp, Homo sapiens
cctcagggacagagacacct

SEQ ID NO: 3052913 - DNA, 22 bp, Homo sapiens
cctcagggacagagacacctgc

SEQ ID NO: 3052914 - DNA, 17 bp, Homo sapiens
cctcagggatgtgggaa

SEQ ID NO: 3052915 - DNA, 14 bp, Homo sapiens
cctcagggccagga

SEQ ID NO: 3052916 - DNA, 16 bp, Homo sapiens
cctcagggccaggaag

SEQ ID NO: 3052917 - DNA, 17 bp, Homo sapiens
cctcagggctatgtgga

SEQ ID NO: 3052918 - DNA, 21 bp, Homo sapiens
cctcaggggaagctgctaggg

SEQ ID NO: 3052919 - DNA, 16 bp, Homo sapiens
cctcaggtggccatgc

SEQ ID NO: 3052920 - DNA, 15 bp, Homo sapiens
cctcaggtgtagctg

SEQ ID NO: 3052921 - DNA, 21 bp, Homo sapiens
cctcaggtgtagctgagctgt

SEQ ID NO: 3052922 - DNA, 17 bp, Homo sapiens
cctcagtgcaaaatgtc

SEQ ID NO: 3052923 - DNA, 19 bp, Homo sapiens
cctcagtggctctgggtac

SEQ ID NO: 3052924 - DNA, 22 bp, Homo sapiens
cctcagttctcaaatgtgtgtg

SEQ ID NO: 3052925 - DNA, 20 bp, Homo sapiens
cctcatcccgagcacctcca

SEQ ID NO: 3052926 - DNA, 13 bp, Homo sapiens
cctcatcctcaga

SEQ ID NO: 3052927 - DNA, 14 bp, Homo sapiens
cctcatcctgcttc

SEQ ID NO: 3052928 - DNA, 15 bp, Homo sapiens
cctcatcctgcttct

SEQ ID NO: 3052929 - DNA, 18 bp, Homo sapiens
cctcatcctgcttctctt

SEQ ID NO: 3052930 - DNA, 15 bp, Homo sapiens
cctcatctgtccctc

SEQ ID NO: 3052931 - DNA, 16 bp, Homo sapiens
cctcatctgtgcctgt

SEQ ID NO: 3052932 - DNA, 11 bp, Homo sapiens
cctcatgagga

SEQ ID NO: 3052933 - DNA, 15 bp, Homo sapiens
cctcattcaggaaaa

SEQ ID NO: 3052934 - DNA, 21 bp, Homo sapiens
cctcattctactaatgtgatg

SEQ ID NO: 3052935 - DNA, 12 bp, Homo sapiens
cctcattctgaa

SEQ ID NO: 3052936 - DNA, 13 bp, Homo sapiens
cctcattgcattt

SEQ ID NO: 3052937 - DNA, 19 bp, Homo sapiens
cctccaacaccaagcacag

SEQ ID NO: 3052938 - DNA, 11 bp, Homo sapiens
cctccaagcct

SEQ ID NO: 3052939 - DNA, 14 bp, Homo sapiens
cctccaagtcaggt

SEQ ID NO: 3052940 - DNA, 19 bp, Homo sapiens
cctccacaaagcaaaggca

SEQ ID NO: 3052941 - DNA, 20 bp, Homo sapiens
cctccacaaagcaaaggcag

SEQ ID NO: 3052942 - DNA, 21 bp, Homo sapiens
cctccacaactcagtttcata

SEQ ID NO: 3052943 - DNA, 21 bp, Homo sapiens
cctccacacaagggaaggaca

SEQ ID NO: 3052944 - DNA, 21 bp, Homo sapiens
cctccacactgaccaagtgct

SEQ ID NO: 3052945 - DNA, 14 bp, Homo sapiens
cctccacatcctcc

SEQ ID NO: 3052946 - DNA, 15 bp, Homo sapiens
cctccacatcctcca

SEQ ID NO: 3052947 - DNA, 14 bp, Homo sapiens
cctccaccaccgcc

SEQ ID NO: 3052948 - DNA, 22 bp, Homo sapiens
cctccaccatccccgcacaaag

SEQ ID NO: 3052949 - DNA, 13 bp, Homo sapiens
cctccaccgctgc

SEQ ID NO: 3052950 - DNA, 20 bp, Homo sapiens
cctccacggtccgcggcctg

SEQ ID NO: 3052951 - DNA, 21 bp, Homo sapiens
cctccacgttctgctcatcat

SEQ ID NO: 3052952 - DNA, 14 bp, Homo sapiens
cctccactcctctc

SEQ ID NO: 3052953 - DNA, 16 bp, Homo sapiens
cctccactcctctcaa

SEQ ID NO: 3052954 - DNA, 14 bp, Homo sapiens
cctccagaagcctc

SEQ ID NO: 3052955 - DNA, 16 bp, Homo sapiens
cctccagagacaggaa

SEQ ID NO: 3052956 - DNA, 20 bp, Homo sapiens
cctccagagacaggaaagaa

SEQ ID NO: 3052957 - DNA, 13 bp, Homo sapiens
cctccagcaggga

SEQ ID NO: 3052958 - DNA, 17 bp, Homo sapiens
cctccagctgtcagcct

SEQ ID NO: 3052959 - DNA, 15 bp, Homo sapiens
cctccaggaaccaca

SEQ ID NO: 3052960 - DNA, 22 bp, Homo sapiens
cctccaggaatgatctcttctt

SEQ ID NO: 3052961 - DNA, 21 bp, Homo sapiens
cctccaggcccgtctgtccat

SEQ ID NO: 3052962 - DNA, 16 bp, Homo sapiens
cctccagggccacgtg

SEQ ID NO: 3052963 - DNA, 18 bp, Homo sapiens
cctccagggccacgtgcc

SEQ ID NO: 3052964 - DNA, 21 bp, Homo sapiens
cctccagggccacgtgccagg

SEQ ID NO: 3052965 - DNA, 22 bp, Homo sapiens
cctccagggccacgtgccaggc

SEQ ID NO: 3052966 - DNA, 18 bp, Homo sapiens
cctccagtcctgctggcc

SEQ ID NO: 3052967 - DNA, 21 bp, Homo sapiens
cctccagtcctgctggcctgc

SEQ ID NO: 3052968 - DNA, 22 bp, Homo sapiens
cctccagtcctgctggcctgct

SEQ ID NO: 3052969 - DNA, 23 bp, Homo sapiens
cctccagtcctgctggcctgctc

SEQ ID NO: 3052970 - DNA, 16 bp, Homo sapiens
cctccagtctgttctc

SEQ ID NO: 3052971 - DNA, 23 bp, Homo sapiens
cctccatccatctgtccgtccag

SEQ ID NO: 3052972 - DNA, 21 bp, Homo sapiens
cctccatccccatcggccctg

SEQ ID NO: 3052973 - DNA, 22 bp, Homo sapiens
cctccatcctaccccctgtgcc

SEQ ID NO: 3052974 - DNA, 21 bp, Homo sapiens
cctccatctgtacttggtcca

SEQ ID NO: 3052975 - DNA, 17 bp, Homo sapiens
cctccatggtcctgtct

SEQ ID NO: 3052976 - DNA, 19 bp, Homo sapiens
cctccatggtcctgtctgt

SEQ ID NO: 3052977 - DNA, 22 bp, Homo sapiens
cctccatggtcctgtctgtcct

SEQ ID NO: 3052978 - DNA, 15 bp, Homo sapiens
cctccatttttgttg

SEQ ID NO: 3052979 - DNA, 18 bp, Homo sapiens
cctcccaaagtgctgaga

SEQ ID NO: 3052980 - DNA, 19 bp, Homo sapiens
cctcccaatttcagactcc

SEQ ID NO: 3052981 - DNA, 14 bp, Homo sapiens
cctcccacactcgc

SEQ ID NO: 3052982 - DNA, 16 bp, Homo sapiens
cctcccaccaccccat

SEQ ID NO: 3052983 - DNA, 18 bp, Homo sapiens
cctcccagaacacactcc

SEQ ID NO: 3052984 - DNA, 23 bp, Homo sapiens
cctcccagagctggtggacccag

SEQ ID NO: 3052985 - DNA, 13 bp, Homo sapiens
cctcccagctctg

SEQ ID NO: 3052986 - DNA, 22 bp, Homo sapiens
cctcccaggactctgaccccag

SEQ ID NO: 3052987 - DNA, 13 bp, Homo sapiens
cctccccaaagcc

SEQ ID NO: 3052988 - DNA, 15 bp, Homo sapiens
cctccccaaagccac

SEQ ID NO: 3052989 - DNA, 14 bp, Homo sapiens
cctccccaatccat

SEQ ID NO: 3052990 - DNA, 18 bp, Homo sapiens
cctcttcatggatggggg

SEQ ID NO: 3052991 - DNA, 13 bp, Homo sapiens
cctcttctgggag

SEQ ID NO: 3052992 - DNA, 18 bp, Homo sapiens
cctcttctgggagggcag

SEQ ID NO: 3052993 - DNA, 21 bp, Homo sapiens
cctcttctttcagacttgcca

SEQ ID NO: 3052994 - DNA, 22 bp, Homo sapiens
cctcttctttcagacttgccat

SEQ ID NO: 3052995 - DNA, 20 bp, Homo sapiens
cctcttggataccagctcag

SEQ ID NO: 3052996 - DNA, 21 bp, Homo sapiens
cctcttggataccagctcagg

SEQ ID NO: 3052997 - DNA, 14 bp, Homo sapiens
cctcttggcacctg

SEQ ID NO: 3052998 - DNA, 15 bp, Homo sapiens
cctcttggcacctgc

SEQ ID NO: 3052999 - DNA, 17 bp, Homo sapiens
cctctttaatgctgtct

SEQ ID NO: 3053000 - DNA, 15 bp, Homo sapiens
cctctttcatctgta

SEQ ID NO: 3053001 - DNA, 22 bp, Homo sapiens
cctctttcatctgtaagggact

SEQ ID NO: 3053002 - DNA, 15 bp, Homo sapiens
cctctttcccctcct

SEQ ID NO: 3053003 - DNA, 16 bp, Homo sapiens
cctctttcccctcctt

SEQ ID NO: 3053004 - DNA, 18 bp, Homo sapiens
cctctttcccctcctttg

SEQ ID NO: 3053005 - DNA, 13 bp, Homo sapiens
cctctttctagcc

SEQ ID NO: 3053006 - DNA, 21 bp, Homo sapiens
cctctttcttgtttgtcagca

SEQ ID NO: 3053007 - DNA, 11 bp, Homo sapiens
cctctttgctt

SEQ ID NO: 3053008 - DNA, 21 bp, Homo sapiens
cctctttggtggcatggaagg

SEQ ID NO: 3053009 - DNA, 16 bp, Homo sapiens
cctctttgtaataaaa

SEQ ID NO: 3053010 - DNA, 17 bp, Homo sapiens
cctctttgtaataaaat

SEQ ID NO: 3053011 - DNA, 15 bp, Homo sapiens
cctctttgtctaaaa

SEQ ID NO: 3053012 - DNA, 19 bp, Homo sapiens
cctctttgtctaaaacaat

SEQ ID NO: 3053013 - DNA, 22 bp, Homo sapiens
cctctttgtctaaaacaataaa

SEQ ID NO: 3053014 - DNA, 23 bp, Homo sapiens
cctctttgtctaaaacaataaaa

SEQ ID NO: 3053015 - DNA, 17 bp, Homo sapiens
cctcttttcctgaagaa

SEQ ID NO: 3053016 - DNA, 16 bp, Homo sapiens
cctctttttctctgta

SEQ ID NO: 3053017 - DNA, 13 bp, Homo sapiens
cctgaaaacccag

SEQ ID NO: 3053018 - DNA, 19 bp, Homo sapiens
cctgaaagcctgtctcttt

SEQ ID NO: 3053019 - DNA, 18 bp, Homo sapiens
cctgaaagggcccttccc

SEQ ID NO: 3053020 - DNA, 23 bp, Homo sapiens
cctgaaagttggggcccagtcct

SEQ ID NO: 3053021 - DNA, 20 bp, Homo sapiens
cctgaaatgccaagtgcctg

SEQ ID NO: 3053022 - DNA, 22 bp, Homo sapiens
cctgaaatgccaagtgcctgct

SEQ ID NO: 3053023 - DNA, 22 bp, Homo sapiens
cctgaacagcatggcactccct

SEQ ID NO: 3053024 - DNA, 17 bp, Homo sapiens
cctgaaccccagaggca

SEQ ID NO: 3053025 - DNA, 13 bp, Homo sapiens
cctgaagaaccag

SEQ ID NO: 3053026 - DNA, 16 bp, Homo sapiens
cctgaagaaccagtcc

SEQ ID NO: 3053027 - DNA, 21 bp, Homo sapiens
cctgaagagtcctctgaatga

SEQ ID NO: 3053028 - DNA, 15 bp, Homo sapiens
cctgaagctgctgga

SEQ ID NO: 3053029 - DNA, 14 bp, Homo sapiens
cctgaatggctttg

SEQ ID NO: 3053030 - DNA, 15 bp, Homo sapiens
cctgaatggctttgt

SEQ ID NO: 3053031 - DNA, 17 bp, Homo sapiens
cctgaatggctttgtct

SEQ ID NO: 3053032 - DNA, 23 bp, Homo sapiens
cctgaatggctttgtcttgaaaa

SEQ ID NO: 3053033 - DNA, 14 bp, Homo sapiens
cctgacatgtctca

SEQ ID NO: 3053034 - DNA, 23 bp, Homo sapiens
cctgaccaaacagccaactagcc

SEQ ID NO: 3053035 - DNA, 19 bp, Homo sapiens
cctgacccggattggccct

SEQ ID NO: 3053036 - DNA, 20 bp, Homo sapiens
cctgacccggattggccctg

SEQ ID NO: 3053037 - DNA, 21 bp, Homo sapiens
cctgacccggattggccctgc

SEQ ID NO: 3053038 - DNA, 19 bp, Homo sapiens
cctgaccctcatctttctt

SEQ ID NO: 3053039 - DNA, 17 bp, Homo sapiens
cctgaccgctgcccagg

SEQ ID NO: 3053040 - DNA, 14 bp, Homo sapiens
cctgacctccagtc

SEQ ID NO: 3053041 - DNA, 15 bp, Homo sapiens
cctgacctgtccagg

SEQ ID NO: 3053042 - DNA, 18 bp, Homo sapiens
cctgacctgtgagcccag

SEQ ID NO: 3053043 - DNA, 19 bp, Homo sapiens
cctgacctgtgagcccagc

SEQ ID NO: 3053044 - DNA, 22 bp, Homo sapiens
cctgacctgtgagcccagctgg

SEQ ID NO: 3053045 - DNA, 20 bp, Homo sapiens
cctgactaatttttgtattt

SEQ ID NO: 3053046 - DNA, 14 bp, Homo sapiens
cctgactgggctgg

SEQ ID NO: 3053047 - DNA, 13 bp, Homo sapiens
cctgactggtgct

SEQ ID NO: 3053048 - DNA, 19 bp, Homo sapiens
cctgactgtcagggagggc

SEQ ID NO: 3053049 - DNA, 23 bp, Homo sapiens
cctgacttgagtgttccttttta

SEQ ID NO: 3053050 - DNA, 14 bp, Homo sapiens
cctgagaaacacta

SEQ ID NO: 3053051 - DNA, 19 bp, Homo sapiens
cctgagaaacactatttgt

SEQ ID NO: 3053052 - DNA, 21 bp, Homo sapiens
cctgagaaacactatttgtga

SEQ ID NO: 3053053 - DNA, 13 bp, Homo sapiens
cctgagaatttaa

SEQ ID NO: 3053054 - DNA, 12 bp, Homo sapiens
cctgagacagaa

SEQ ID NO: 3053055 - DNA, 12 bp, Homo sapiens
cctgagaccaca

SEQ ID NO: 3053056 - DNA, 14 bp, Homo sapiens
cctgagacccagga

SEQ ID NO: 3053057 - DNA, 20 bp, Homo sapiens
cctgagagagaatagagctg

SEQ ID NO: 3053058 - DNA, 21 bp, Homo sapiens
cctgagagagaatagagctgc

SEQ ID NO: 3053059 - DNA, 15 bp, Homo sapiens
cctgagcaactcttg

SEQ ID NO: 3053060 - DNA, 23 bp, Homo sapiens
cctgagcaactcttgattatcca

SEQ ID NO: 3053061 - DNA, 15 bp, Homo sapiens
cctgagcagtccctg

SEQ ID NO: 3053062 - DNA, 20 bp, Homo sapiens
cctgagcagtctacttctgt

SEQ ID NO: 3053063 - DNA, 22 bp, Homo sapiens
cctgagcagtctacttctgtgt

SEQ ID NO: 3053064 - DNA, 12 bp, Homo sapiens
cctgagcattca

SEQ ID NO: 3053065 - DNA, 13 bp, Homo sapiens
cctgagcccctca

SEQ ID NO: 3053066 - DNA, 14 bp, Homo sapiens
cctgagcccctcag

SEQ ID NO: 3053067 - DNA, 15 bp, Homo sapiens
cctgagcccctcaga

SEQ ID NO: 3053068 - DNA, 19 bp, Homo sapiens
cctgagcccgcagcccaga

SEQ ID NO: 3053069 - DNA, 21 bp, Homo sapiens
cctgagcccgcagcccagacc

SEQ ID NO: 3053070 - DNA, 15 bp, Homo sapiens
cctgagcctggccag

SEQ ID NO: 3053071 - DNA, 16 bp, Homo sapiens
cctgagcctggccagc

SEQ ID NO: 3053072 - DNA, 18 bp, Homo sapiens
cctgaggaacccttacag

SEQ ID NO: 3053073 - DNA, 18 bp, Homo sapiens
cctgaggatcccctgtcc

SEQ ID NO: 3053074 - DNA, 14 bp, Homo sapiens
cctgaggcaggaga

SEQ ID NO: 3053075 - DNA, 20 bp, Homo sapiens
cctgaggctttggatttgac

SEQ ID NO: 3053076 - DNA, 15 bp, Homo sapiens
cctgagggagctcca

SEQ ID NO: 3053077 - DNA, 18 bp, Homo sapiens
cctgaggggctggggagg

SEQ ID NO: 3053078 - DNA, 19 bp, Homo sapiens
cctgaggggctggggaggg

SEQ ID NO: 3053079 - DNA, 22 bp, Homo sapiens
cctgaggtcaggagttcaagac

SEQ ID NO: 3053080 - DNA, 15 bp, Homo sapiens
cctgagtagctggat

SEQ ID NO: 3053081 - DNA, 20 bp, Homo sapiens
cctgagtagctggattacag

SEQ ID NO: 3053082 - DNA, 14 bp, Homo sapiens
cctgagtccgcctg

SEQ ID NO: 3053083 - DNA, 13 bp, Homo sapiens
cctgagtgacaga

SEQ ID NO: 3053084 - DNA, 19 bp, Homo sapiens
cctgagttcctagccaccg

SEQ ID NO: 3053085 - DNA, 23 bp, Homo sapiens
cctgagtttccttttctgtctct

SEQ ID NO: 3053086 - DNA, 19 bp, Homo sapiens
cctgataacaagcaaggat

SEQ ID NO: 3053087 - DNA, 19 bp, Homo sapiens
cctgatcagaccacggctc

SEQ ID NO: 3053088 - DNA, 13 bp, Homo sapiens
cctgatcagagcc

SEQ ID NO: 3053089 - DNA, 13 bp, Homo sapiens
cctgatcccagac

SEQ ID NO: 3053090 - DNA, 19 bp, Homo sapiens
cctgatgcttttgtctaat

SEQ ID NO: 3053091 - DNA, 14 bp, Homo sapiens
cctgatggagagtg

SEQ ID NO: 3053092 - DNA, 19 bp, Homo sapiens
cctgatggagagtgagagc

SEQ ID NO: 3053093 - DNA, 18 bp, Homo sapiens
cctgatgtagcttgagat

SEQ ID NO: 3053094 - DNA, 21 bp, Homo sapiens
cctgatgtcagctgctgttga

SEQ ID NO: 3053095 - DNA, 23 bp, Homo sapiens
cctgattaaaaagggagaaagaa

SEQ ID NO: 3053096 - DNA, 16 bp, Homo sapiens
cctgattcaactaaaa

SEQ ID NO: 3053097 - DNA, 18 bp, Homo sapiens
cctgatttaggagaagcc

SEQ ID NO: 3053098 - DNA, 22 bp, Homo sapiens
cctgatttattgaaatttttct

SEQ ID NO: 3053099 - DNA, 17 bp, Homo sapiens
cctgcaaaaggactctc

SEQ ID NO: 3053100 - DNA, 18 bp, Homo sapiens
cctgcaaacgctgcctgc

SEQ ID NO: 3053101 - DNA, 22 bp, Homo sapiens
cctgcaaacgctgcctgcccac

SEQ ID NO: 3053102 - DNA, 12 bp, Homo sapiens
ccctggcccagg

SEQ ID NO: 3053103 - DNA, 13 bp, Homo sapiens
ccctggcccagga

SEQ ID NO: 3053104 - DNA, 15 bp, Homo sapiens
ccctggcccaggagg

SEQ ID NO: 3053105 - DNA, 19 bp, Homo sapiens
ccctggcctctgtgccttc

SEQ ID NO: 3053106 - DNA, 15 bp, Homo sapiens
ccctggcctgagagg

SEQ ID NO: 3053107 - DNA, 14 bp, Homo sapiens
ccctggcctgctgg

SEQ ID NO: 3053108 - DNA, 16 bp, Homo sapiens
ccctggctccatgctt

SEQ ID NO: 3053109 - DNA, 14 bp, Homo sapiens
ccctggctctgggc

SEQ ID NO: 3053110 - DNA, 13 bp, Homo sapiens
ccctggctgcagc

SEQ ID NO: 3053111 - DNA, 23 bp, Homo sapiens
ccctgggacatcaggagactggg

SEQ ID NO: 3053112 - DNA, 18 bp, Homo sapiens
ccctgggccccaccacct

SEQ ID NO: 3053113 - DNA, 20 bp, Homo sapiens
ccctgggccccaccacctag

SEQ ID NO: 3053114 - DNA, 22 bp, Homo sapiens
ccctgggccccaccacctaggc

SEQ ID NO: 3053115 - DNA, 12 bp, Homo sapiens
ccctggggcact

SEQ ID NO: 3053116 - DNA, 16 bp, Homo sapiens
ccctggggcactcccc

SEQ ID NO: 3053117 - DNA, 20 bp, Homo sapiens
ccctggggcactcccccagg

SEQ ID NO: 3053118 - DNA, 16 bp, Homo sapiens
ccctggggctggcttt

SEQ ID NO: 3053119 - DNA, 18 bp, Homo sapiens
ccctggggctggcttttc

SEQ ID NO: 3053120 - DNA, 16 bp, Homo sapiens
ccctggggctggtgga

SEQ ID NO: 3053121 - DNA, 19 bp, Homo sapiens
ccctgggggaagccctgga

SEQ ID NO: 3053122 - DNA, 20 bp, Homo sapiens
ccctgggtcttgccatgtgc

SEQ ID NO: 3053123 - DNA, 23 bp, Homo sapiens
ccctgggtgtccccgctgctgtg

SEQ ID NO: 3053124 - DNA, 16 bp, Homo sapiens
ccctgggtttggcccc

SEQ ID NO: 3053125 - DNA, 17 bp, Homo sapiens
ccctgggtttggcccct

SEQ ID NO: 3053126 - DNA, 15 bp, Homo sapiens
ccctggtcctggcct

SEQ ID NO: 3053127 - DNA, 18 bp, Homo sapiens
ccctggtcctggcctcct

SEQ ID NO: 3053128 - DNA, 15 bp, Homo sapiens
ccctggtccttcact

SEQ ID NO: 3053129 - DNA, 16 bp, Homo sapiens
ccctggtccttcactg

SEQ ID NO: 3053130 - DNA, 18 bp, Homo sapiens
ccctggtccttcactggc

SEQ ID NO: 3053131 - DNA, 21 bp, Homo sapiens
ccctggtgctcctgcccagcc

SEQ ID NO: 3053132 - DNA, 23 bp, Homo sapiens
ccctggtgggccaacaaagaaca

SEQ ID NO: 3053133 - DNA, 16 bp, Homo sapiens
ccctggtggttgctgt

SEQ ID NO: 3053134 - DNA, 18 bp, Homo sapiens
ccctggttatattctcac

SEQ ID NO: 3053135 - DNA, 19 bp, Homo sapiens
ccctggttatattctcacg

SEQ ID NO: 3053136 - DNA, 17 bp, Homo sapiens
ccctggttcctgctgtc

SEQ ID NO: 3053137 - DNA, 22 bp, Homo sapiens
ccctggttcctgctgtcctggt

SEQ ID NO: 3053138 - DNA, 19 bp, Homo sapiens
ccctgtaacgtaacccatt

SEQ ID NO: 3053139 - DNA, 15 bp, Homo sapiens
ccctgtatatagccc

SEQ ID NO: 3053140 - DNA, 17 bp, Homo sapiens
ccctgtatatagcccag

SEQ ID NO: 3053141 - DNA, 13 bp, Homo sapiens
ccctgtcccctgg

SEQ ID NO: 3053142 - DNA, 17 bp, Homo sapiens
ccctgtcccctggggct

SEQ ID NO: 3053143 - DNA, 19 bp, Homo sapiens
ccctgtcccctggggctgg

SEQ ID NO: 3053144 - DNA, 13 bp, Homo sapiens
ccctgtcctgcca

SEQ ID NO: 3053145 - DNA, 15 bp, Homo sapiens
ccctgtcctgccatg

SEQ ID NO: 3053146 - DNA, 17 bp, Homo sapiens
ccctgtcgggctttgtg

SEQ ID NO: 3053147 - DNA, 16 bp, Homo sapiens
ccctgtctgccagggc

SEQ ID NO: 3053148 - DNA, 19 bp, Homo sapiens
ccctgtctttactcctcac

SEQ ID NO: 3053149 - DNA, 20 bp, Homo sapiens
ccctgtctttactcctcaca

SEQ ID NO: 3053150 - DNA, 14 bp, Homo sapiens
ccctgtctttccta

SEQ ID NO: 3053151 - DNA, 23 bp, Homo sapiens
ccctgtctttcctaagacctggg

SEQ ID NO: 3053152 - DNA, 22 bp, Homo sapiens
ccctgtgcaacctcttggcctg

SEQ ID NO: 3053153 - DNA, 14 bp, Homo sapiens
ccctgtgcagacct

SEQ ID NO: 3053154 - DNA, 17 bp, Homo sapiens
ccctgtgcagaccttac

SEQ ID NO: 3053155 - DNA, 22 bp, Homo sapiens
ccctgtgccttgtcacgccaga

SEQ ID NO: 3053156 - DNA, 18 bp, Homo sapiens
ccctgtggagtccagctc

SEQ ID NO: 3053157 - DNA, 19 bp, Homo sapiens
ccctgtggtgatgtgcctg

SEQ ID NO: 3053158 - DNA, 20 bp, Homo sapiens
ccctgtggtgatgtgcctgt

SEQ ID NO: 3053159 - DNA, 11 bp, Homo sapiens
ccctgtgtgca

SEQ ID NO: 3053160 - DNA, 21 bp, Homo sapiens
ccctgttattttcaagtagct

SEQ ID NO: 3053161 - DNA, 19 bp, Homo sapiens
ccctgttcagctactccca

SEQ ID NO: 3053162 - DNA, 19 bp, Homo sapiens
ccctgttcaggctggctcg

SEQ ID NO: 3053163 - DNA, 14 bp, Homo sapiens
ccctgttccccaga

SEQ ID NO: 3053164 - DNA, 17 bp, Homo sapiens
ccctgttccccagagaa

SEQ ID NO: 3053165 - DNA, 17 bp, Homo sapiens
ccctgttctcctcccca

SEQ ID NO: 3053166 - DNA, 11 bp, Homo sapiens
ccctgttctcg

SEQ ID NO: 3053167 - DNA, 18 bp, Homo sapiens
ccctgttctcgttgccct

SEQ ID NO: 3053168 - DNA, 12 bp, Homo sapiens
ccctgttcttta

SEQ ID NO: 3053169 - DNA, 19 bp, Homo sapiens
ccctgtttcctgctgcttt

SEQ ID NO: 3053170 - DNA, 22 bp, Homo sapiens
cccttaaaaattaaattctctc

SEQ ID NO: 3053171 - DNA, 15 bp, Homo sapiens
cccttaagcatgctt

SEQ ID NO: 3053172 - DNA, 21 bp, Homo sapiens
cccggcgcctggcctccaggc

SEQ ID NO: 3053173 - DNA, 22 bp, Homo sapiens
cccggcgcggtggctcacgcct

SEQ ID NO: 3053174 - DNA, 22 bp, Homo sapiens
cccggcggaaagcctctgtccg

SEQ ID NO: 3053175 - DNA, 15 bp, Homo sapiens
cccggctcggcccag

SEQ ID NO: 3053176 - DNA, 18 bp, Homo sapiens
cccggctctacgggggcc

SEQ ID NO: 3053177 - DNA, 12 bp, Homo sapiens
cccggctgggcc

SEQ ID NO: 3053178 - DNA, 16 bp, Homo sapiens
cccgggaaggaaggct

SEQ ID NO: 3053179 - DNA, 18 bp, Homo sapiens
cccgggacgcagcaggag

SEQ ID NO: 3053180 - DNA, 22 bp, Homo sapiens
cccggggaaaggcaaggtccgg

SEQ ID NO: 3053181 - DNA, 14 bp, Homo sapiens
cccggggcccaggg

SEQ ID NO: 3053182 - DNA, 16 bp, Homo sapiens
cccgggtctctcactg

SEQ ID NO: 3053183 - DNA, 21 bp, Homo sapiens
cccgggttcacgccattctcc

SEQ ID NO: 3053184 - DNA, 23 bp, Homo sapiens
cccgggttcacgccattctcctg

SEQ ID NO: 3053185 - DNA, 22 bp, Homo sapiens
cccggtctatgtcgagagctgg

SEQ ID NO: 3053186 - DNA, 13 bp, Homo sapiens
cccggtggcggca

SEQ ID NO: 3053187 - DNA, 18 bp, Homo sapiens
cccggtggcggcagggcc

SEQ ID NO: 3053188 - DNA, 18 bp, Homo sapiens
cccggtggcggccccagc

SEQ ID NO: 3053189 - DNA, 22 bp, Homo sapiens
cccgtactttgtcccgtggcat

SEQ ID NO: 3053190 - DNA, 17 bp, Homo sapiens
cccgtcggagctgcctg

SEQ ID NO: 3053191 - DNA, 21 bp, Homo sapiens
cccgtcggagctgcctgcagc

SEQ ID NO: 3053192 - DNA, 14 bp, Homo sapiens
cccgtctcgcctgc

SEQ ID NO: 3053193 - DNA, 19 bp, Homo sapiens
cccgtctgtccatctgccc

SEQ ID NO: 3053194 - DNA, 18 bp, Homo sapiens
cccgtgacagactcctga

SEQ ID NO: 3053195 - DNA, 15 bp, Homo sapiens
cccgtgcctgggccc

SEQ ID NO: 3053196 - DNA, 20 bp, Homo sapiens
cccgtgcctgggcccctccc

SEQ ID NO: 3053197 - DNA, 21 bp, Homo sapiens
cccgtggcttggcatctgtgt

SEQ ID NO: 3053198 - DNA, 14 bp, Homo sapiens
cccgtggggcaggg

SEQ ID NO: 3053199 - DNA, 22 bp, Homo sapiens
cccgtggggcagggagctgggc

SEQ ID NO: 3053200 - DNA, 20 bp, Homo sapiens
ccctaagctggctgtacctg

SEQ ID NO: 3053201 - DNA, 22 bp, Homo sapiens
ccctaagggcagccctccatgg

SEQ ID NO: 3053202 - DNA, 12 bp, Homo sapiens
ccctacaggagg

SEQ ID NO: 3053203 - DNA, 12 bp, Homo sapiens
ccctaccccctc

SEQ ID NO: 3053204 - DNA, 17 bp, Homo sapiens
ccctaccgcatggcagc

SEQ ID NO: 3053205 - DNA, 21 bp, Homo sapiens
ccctaccgcatggcagctggg

SEQ ID NO: 3053206 - DNA, 15 bp, Homo sapiens
ccctaccttccccag

SEQ ID NO: 3053207 - DNA, 13 bp, Homo sapiens
ccctaccttgcct

SEQ ID NO: 3053208 - DNA, 14 bp, Homo sapiens
ccctaccttgcctc

SEQ ID NO: 3053209 - DNA, 15 bp, Homo sapiens
ccctaccttgcctcc

SEQ ID NO: 3053210 - DNA, 13 bp, Homo sapiens
ccctacggaccag

SEQ ID NO: 3053211 - DNA, 22 bp, Homo sapiens
ccctacttcattttcagagtga

SEQ ID NO: 3053212 - DNA, 17 bp, Homo sapiens
ccctagaaaggagagaa

SEQ ID NO: 3053213 - DNA, 19 bp, Homo sapiens
ccctagaaaggagagaacg

SEQ ID NO: 3053214 - DNA, 16 bp, Homo sapiens
ccctagagacagtgat

SEQ ID NO: 3053215 - DNA, 19 bp, Homo sapiens
ccctagagacagtgatgcc

SEQ ID NO: 3053216 - DNA, 20 bp, Homo sapiens
ccctagagacagtgatgcct

SEQ ID NO: 3053217 - DNA, 23 bp, Homo sapiens
ccctagagacagtgatgcctgcc

SEQ ID NO: 3053218 - DNA, 20 bp, Homo sapiens
ccctagatccaggcttctcc

SEQ ID NO: 3053219 - DNA, 22 bp, Homo sapiens
ccctagatccaggcttctcccg

SEQ ID NO: 3053220 - DNA, 21 bp, Homo sapiens
ccctagctttacgctcatcac

SEQ ID NO: 3053221 - DNA, 22 bp, Homo sapiens
ccaggactctgaccccagcatt

SEQ ID NO: 3053222 - DNA, 15 bp, Homo sapiens
ccaggactgggtctg

SEQ ID NO: 3053223 - DNA, 19 bp, Homo sapiens
ccaggactgggtctgacct

SEQ ID NO: 3053224 - DNA, 22 bp, Homo sapiens
ccaggactgggtctgacctggt

SEQ ID NO: 3053225 - DNA, 12 bp, Homo sapiens
ccaggagacctg

SEQ ID NO: 3053226 - DNA, 17 bp, Homo sapiens
ccaggagacctgctctc

SEQ ID NO: 3053227 - DNA, 13 bp, Homo sapiens
ccaggagagccag

SEQ ID NO: 3053228 - DNA, 16 bp, Homo sapiens
ccaggagagccagccc

SEQ ID NO: 3053229 - DNA, 14 bp, Homo sapiens
ccaggagcacctgg

SEQ ID NO: 3053230 - DNA, 22 bp, Homo sapiens
ccaggagccggacacttctcag

SEQ ID NO: 3053231 - DNA, 23 bp, Homo sapiens
ccaggagccggacacttctcagg

SEQ ID NO: 3053232 - DNA, 23 bp, Homo sapiens
ccaggagctgtcaccaaggaaac

SEQ ID NO: 3053233 - DNA, 20 bp, Homo sapiens
ccaggaggaggattgtgctg

SEQ ID NO: 3053234 - DNA, 23 bp, Homo sapiens
ccaggaggaggattgtgctgatg

SEQ ID NO: 3053235 - DNA, 14 bp, Homo sapiens
ccaggatcagattg

SEQ ID NO: 3053236 - DNA, 18 bp, Homo sapiens
ccaggatcagattgcatg

SEQ ID NO: 3053237 - DNA, 19 bp, Homo sapiens
ccaggatcagattgcatgt

SEQ ID NO: 3053238 - DNA, 14 bp, Homo sapiens
ccaggatcagccag

SEQ ID NO: 3053239 - DNA, 19 bp, Homo sapiens
ccaggatgactagatcctg

SEQ ID NO: 3053240 - DNA, 21 bp, Homo sapiens
ccaggatggaacacggccaca

SEQ ID NO: 3053241 - DNA, 22 bp, Homo sapiens
ccaggattggggacctgatgga

SEQ ID NO: 3053242 - DNA, 15 bp, Homo sapiens
ccaggattttgtatt

SEQ ID NO: 3053243 - DNA, 16 bp, Homo sapiens
ccaggattttgtattg

SEQ ID NO: 3053244 - DNA, 15 bp, Homo sapiens
ccaggcacatggctg

SEQ ID NO: 3053245 - DNA, 18 bp, Homo sapiens
ccaggcacatggctgggg

SEQ ID NO: 3053246 - DNA, 21 bp, Homo sapiens
ccaggcacgaacccacctgct

SEQ ID NO: 3053247 - DNA, 12 bp, Homo sapiens
ccaggcactgca

SEQ ID NO: 3053248 - DNA, 21 bp, Homo sapiens
ccaggcagagctgagggccct

SEQ ID NO: 3053249 - DNA, 17 bp, Homo sapiens
ccaggcagatccaggac

SEQ ID NO: 3053250 - DNA, 10 bp, Homo sapiens
ccaggcaggg

SEQ ID NO: 3053251 - DNA, 12 bp, Homo sapiens
ccaggcagggag

SEQ ID NO: 3053252 - DNA, 13 bp, Homo sapiens
ccaggcagggaga

SEQ ID NO: 3053253 - DNA, 21 bp, Homo sapiens
ccaggcaggtctgcaagggcc

SEQ ID NO: 3053254 - DNA, 16 bp, Homo sapiens
ccaggccacaaatgtg

SEQ ID NO: 3053255 - DNA, 15 bp, Homo sapiens
ccaggccagctgcct

SEQ ID NO: 3053256 - DNA, 21 bp, Homo sapiens
ccaggccagggctcctgtggc

SEQ ID NO: 3053257 - DNA, 13 bp, Homo sapiens
ccaggccaggtgg

SEQ ID NO: 3053258 - DNA, 17 bp, Homo sapiens
ccaggccatgtggcctg

SEQ ID NO: 3053259 - DNA, 18 bp, Homo sapiens
ccaggccatgtggcctgc

SEQ ID NO: 3053260 - DNA, 18 bp, Homo sapiens
ccaggcccaaggctcccg

SEQ ID NO: 3053261 - DNA, 20 bp, Homo sapiens
ccaggcccccaccacacatc

SEQ ID NO: 3053262 - DNA, 21 bp, Homo sapiens
ccaggcccccaccacacatcc

SEQ ID NO: 3053263 - DNA, 22 bp, Homo sapiens
ccaggcccccaccacacatccc

SEQ ID NO: 3053264 - DNA, 12 bp, Homo sapiens
ccaggccctccc

SEQ ID NO: 3053265 - DNA, 14 bp, Homo sapiens
ccaggccctcccac

SEQ ID NO: 3053266 - DNA, 21 bp, Homo sapiens
ccaggccctcccaccacccca

SEQ ID NO: 3053267 - DNA, 19 bp, Homo sapiens
ccaggccctggagggcaga

SEQ ID NO: 3053268 - DNA, 14 bp, Homo sapiens
ccaggccctgggtc

SEQ ID NO: 3053269 - DNA, 17 bp, Homo sapiens
ccaggccctgtggcagg

SEQ ID NO: 3053270 - DNA, 14 bp, Homo sapiens
ccaggccggagccc

SEQ ID NO: 3053271 - DNA, 15 bp, Homo sapiens
ccaggccggagccca

SEQ ID NO: 3053272 - DNA, 20 bp, Homo sapiens
ccaggcctcactggctcatg

SEQ ID NO: 3053273 - DNA, 19 bp, Homo sapiens
ccaggcctccagctcagca

SEQ ID NO: 3053274 - DNA, 18 bp, Homo sapiens
ccaggcctcgcctgccct

SEQ ID NO: 3053275 - DNA, 19 bp, Homo sapiens
ccaggcctcgcctgccctc

SEQ ID NO: 3053276 - DNA, 21 bp, Homo sapiens
ccaggcctcgcctgccctcct

SEQ ID NO: 3053277 - DNA, 14 bp, Homo sapiens
ccaggcctggagcg

SEQ ID NO: 3053278 - DNA, 13 bp, Homo sapiens
ccaggcctggctc

SEQ ID NO: 3053279 - DNA, 19 bp, Homo sapiens
ccaggccttgctgactctc

SEQ ID NO: 3053280 - DNA, 19 bp, Homo sapiens
ccaggcgagcctgactctg

SEQ ID NO: 3053281 - DNA, 21 bp, Homo sapiens
ccaggctctcgctgccctgtg

SEQ ID NO: 3053282 - DNA, 16 bp, Homo sapiens
ccaggctgaccacagc

SEQ ID NO: 3053283 - DNA, 18 bp, Homo sapiens
ccaggctgaccacagcac

SEQ ID NO: 3053284 - DNA, 21 bp, Homo sapiens
ccaggctgcagatgatcaggg

SEQ ID NO: 3053285 - DNA, 24 bp, Homo sapiens
ccaggctgcggtgggcagccatga

SEQ ID NO: 3053286 - DNA, 19 bp, Homo sapiens
ccaggctggagtgcaatgg

SEQ ID NO: 3053287 - DNA, 13 bp, Homo sapiens
ccaggctgggccg

SEQ ID NO: 3053288 - DNA, 20 bp, Homo sapiens
ccaggctgggccgcaagggc

SEQ ID NO: 3053289 - DNA, 15 bp, Homo sapiens
ccaggctgggctgag

SEQ ID NO: 3053290 - DNA, 17 bp, Homo sapiens
ccaggctgggctgagcc

SEQ ID NO: 3053291 - DNA, 23 bp, Homo sapiens
ccaggctgggctgagccaaagcc

SEQ ID NO: 3053292 - DNA, 22 bp, Homo sapiens
ccaggctggtccgagctgagga

SEQ ID NO: 3053293 - DNA, 23 bp, Homo sapiens
ccaggctggtccgagctgaggac

SEQ ID NO: 3053294 - DNA, 15 bp, Homo sapiens
ccaggctggtctcaa

SEQ ID NO: 3053295 - DNA, 23 bp, Homo sapiens
ccaggctggtctcaaactcctga

SEQ ID NO: 3053296 - DNA, 21 bp, Homo sapiens
ccaggctggtcttgaactcct

SEQ ID NO: 3053297 - DNA, 21 bp, Homo sapiens
ccaggctgtaaatgagggcag

SEQ ID NO: 3053298 - DNA, 21 bp, Homo sapiens
ccaggcttctcccggacctgg

SEQ ID NO: 3053299 - DNA, 13 bp, Homo sapiens
ccaggcttgcctg

SEQ ID NO: 3053300 - DNA, 14 bp, Homo sapiens
ccaggcttgcctgg

SEQ ID NO: 3053301 - DNA, 18 bp, Homo sapiens
ccaggcttgcctgggctg

SEQ ID NO: 3053302 - DNA, 23 bp, Homo sapiens
ccaggcttgcctgggctgggcag

SEQ ID NO: 3053303 - DNA, 22 bp, Homo sapiens
ccagggaagtgtgtgtgtgtcc

SEQ ID NO: 3053304 - DNA, 20 bp, Homo sapiens
ccagggacacctgggagaaa

SEQ ID NO: 3053305 - DNA, 18 bp, Homo sapiens
ccagggacagaggcccca

SEQ ID NO: 3053306 - DNA, 23 bp, Homo sapiens
ccagggacagaggccccagcctc

SEQ ID NO: 3053307 - DNA, 16 bp, Homo sapiens
ccagggacccaaagca

SEQ ID NO: 3053308 - DNA, 21 bp, Homo sapiens
ccagggacgaagaagagccac

SEQ ID NO: 3053309 - DNA, 22 bp, Homo sapiens
ccagggactcggcccagggccg

SEQ ID NO: 3053310 - DNA, 13 bp, Homo sapiens
ccagggagaagct

SEQ ID NO: 3053311 - DNA, 14 bp, Homo sapiens
ccagggagaagctc

SEQ ID NO: 3053312 - DNA, 17 bp, Homo sapiens
ccagggagacctggaca

SEQ ID NO: 3053313 - DNA, 22 bp, Homo sapiens
ccagggagaggctgtgtccctg

SEQ ID NO: 3053314 - DNA, 14 bp, Homo sapiens
ccagggagcctaga

SEQ ID NO: 3053315 - DNA, 18 bp, Homo sapiens
ccagggagcctttggttc

SEQ ID NO: 3053316 - DNA, 23 bp, Homo sapiens
ccagggaggcagagcgggaggga

SEQ ID NO: 3053317 - DNA, 12 bp, Homo sapiens
ccagggagggtg

SEQ ID NO: 3053318 - DNA, 22 bp, Homo sapiens
ccagggagggtgagctggtgcc

SEQ ID NO: 3053319 - DNA, 14 bp, Homo sapiens
ccagggcagggcca

SEQ ID NO: 3053320 - DNA, 17 bp, Homo sapiens
ccagggccacgtgccag

SEQ ID NO: 3053321 - DNA, 22 bp, Homo sapiens
ccagggccacgtgccaggcccg

SEQ ID NO: 3053322 - DNA, 13 bp, Homo sapiens
ccagggcccagag

SEQ ID NO: 3053323 - DNA, 17 bp, Homo sapiens
ccagggcccagagccca

SEQ ID NO: 3053324 - DNA, 19 bp, Homo sapiens
ccagggcccagagcccagc

SEQ ID NO: 3053325 - DNA, 16 bp, Homo sapiens
ccagggcccaggccat

SEQ ID NO: 3053326 - DNA, 14 bp, Homo sapiens
ccagggcctgagcc

SEQ ID NO: 3053327 - DNA, 17 bp, Homo sapiens
ccagggcctgagcctgg

SEQ ID NO: 3053328 - DNA, 18 bp, Homo sapiens
ccagggcctgagcctggc

SEQ ID NO: 3053329 - DNA, 19 bp, Homo sapiens
ccagggcctgagcctggcc

SEQ ID NO: 3053330 - DNA, 23 bp, Homo sapiens
ccagggcctgcaggacctgcctg

SEQ ID NO: 3053331 - DNA, 19 bp, Homo sapiens
ccccaaagccactggaagg

SEQ ID NO: 3053332 - DNA, 22 bp, Homo sapiens
ccccaaccaaggaaggagcccc

SEQ ID NO: 3053333 - DNA, 15 bp, Homo sapiens
ccccaactcctggaa

SEQ ID NO: 3053334 - DNA, 15 bp, Homo sapiens
ccccaaggagggaga

SEQ ID NO: 3053335 - DNA, 19 bp, Homo sapiens
ccccaatatctcccttttt

SEQ ID NO: 3053336 - DNA, 22 bp, Homo sapiens
ccccaatccatttggcagaact

SEQ ID NO: 3053337 - DNA, 13 bp, Homo sapiens
ccccaatccctca

SEQ ID NO: 3053338 - DNA, 16 bp, Homo sapiens
ccccaatccctcaaac

SEQ ID NO: 3053339 - DNA, 19 bp, Homo sapiens
ccccaatgagacttgcctt

SEQ ID NO: 3053340 - DNA, 16 bp, Homo sapiens
ccccacaaggcctggt

SEQ ID NO: 3053341 - DNA, 22 bp, Homo sapiens
ccccacaatttctttaaaaaag

SEQ ID NO: 3053342 - DNA, 23 bp, Homo sapiens
ccccacaatttctttaaaaaaga

SEQ ID NO: 3053343 - DNA, 11 bp, Homo sapiens
ccccacacaca

SEQ ID NO: 3053344 - DNA, 21 bp, Homo sapiens
ccccacagactgccccagcca

SEQ ID NO: 3053345 - DNA, 23 bp, Homo sapiens
ccccacaggaggtggtctgggac

SEQ ID NO: 3053346 - DNA, 23 bp, Homo sapiens
ccccacaggagttgtgagccctc

SEQ ID NO: 3053347 - DNA, 13 bp, Homo sapiens
ccccaccacacat

SEQ ID NO: 3053348 - DNA, 14 bp, Homo sapiens
ccccaccacacatc

SEQ ID NO: 3053349 - DNA, 18 bp, Homo sapiens
ccccaccacacatcccag

SEQ ID NO: 3053350 - DNA, 19 bp, Homo sapiens
ccccaccacacatcccagc

SEQ ID NO: 3053351 - DNA, 16 bp, Homo sapiens
ccccaccactcttgac

SEQ ID NO: 3053352 - DNA, 15 bp, Homo sapiens
ccccaccagagctgc

SEQ ID NO: 3053353 - DNA, 15 bp, Homo sapiens
ccccacccagctcca

SEQ ID NO: 3053354 - DNA, 13 bp, Homo sapiens
ccccaccccagca

SEQ ID NO: 3053355 - DNA, 17 bp, Homo sapiens
ccccaccccccaggcct

SEQ ID NO: 3053356 - DNA, 23 bp, Homo sapiens
ccccaccccctccccaggggaga

SEQ ID NO: 3053357 - DNA, 12 bp, Homo sapiens
ccccaccccctt

SEQ ID NO: 3053358 - DNA, 17 bp, Homo sapiens
ccccacccccttcagtg

SEQ ID NO: 3053359 - DNA, 13 bp, Homo sapiens
ccccaccccttcg

SEQ ID NO: 3053360 - DNA, 21 bp, Homo sapiens
agcaaatggaaaatgtatatt

SEQ ID NO: 3053361 - DNA, 22 bp, Homo sapiens
agcaaatgtaaaaatttaattt

SEQ ID NO: 3053362 - DNA, 22 bp, Homo sapiens
agcaaattatttttaaaagaaa

SEQ ID NO: 3053363 - DNA, 18 bp, Homo sapiens
agcaacacagcctgggcc

SEQ ID NO: 3053364 - DNA, 20 bp, Homo sapiens
agcaacattttacccacaca

SEQ ID NO: 3053365 - DNA, 15 bp, Homo sapiens
agcaaccccaggctg

SEQ ID NO: 3053366 - DNA, 19 bp, Homo sapiens
agcaacctactgtctaagc

SEQ ID NO: 3053367 - DNA, 17 bp, Homo sapiens
agcaacgttagtagaac

SEQ ID NO: 3053368 - DNA, 19 bp, Homo sapiens
agcaagaaaaaaaaatgcc

SEQ ID NO: 3053369 - DNA, 12 bp, Homo sapiens
agcaagaaagaa

SEQ ID NO: 3053370 - DNA, 20 bp, Homo sapiens
agcaagaaggcaacttgaag

SEQ ID NO: 3053371 - DNA, 22 bp, Homo sapiens
agcaagaaggcaacttgaagaa

SEQ ID NO: 3053372 - DNA, 23 bp, Homo sapiens
agcaagaaggcaacttgaagaaa

SEQ ID NO: 3053373 - DNA, 13 bp, Homo sapiens
agcaagacctcat

SEQ ID NO: 3053374 - DNA, 16 bp, Homo sapiens
agcaagagatattttg

SEQ ID NO: 3053375 - DNA, 20 bp, Homo sapiens
agcaagcaaacagggtggcc

SEQ ID NO: 3053376 - DNA, 15 bp, Homo sapiens
agcaagctagaactg

SEQ ID NO: 3053377 - DNA, 19 bp, Homo sapiens
agcaagctgtgttacttga

SEQ ID NO: 3053378 - DNA, 19 bp, Homo sapiens
agcaaggtgtccctgcctt

SEQ ID NO: 3053379 - DNA, 22 bp, Homo sapiens
agcaaggtttcctttcagccct

SEQ ID NO: 3053380 - DNA, 14 bp, Homo sapiens
agcaagtcagggtt

SEQ ID NO: 3053381 - DNA, 20 bp, Homo sapiens
agcaagtcccagacaaggag

SEQ ID NO: 3053382 - DNA, 13 bp, Homo sapiens
agcaagtctcttt

SEQ ID NO: 3053383 - DNA, 21 bp, Homo sapiens
agcaagtgagtctggtggagg

SEQ ID NO: 3053384 - DNA, 22 bp, Homo sapiens
agcaagtgagtctggtggagga

SEQ ID NO: 3053385 - DNA, 16 bp, Homo sapiens
agcaagttacagtgat

SEQ ID NO: 3053386 - DNA, 14 bp, Homo sapiens
agcaataaagaaga

SEQ ID NO: 3053387 - DNA, 14 bp, Homo sapiens
agcaataaatgaat

SEQ ID NO: 3053388 - DNA, 15 bp, Homo sapiens
agcaataaatgaatg

SEQ ID NO: 3053389 - DNA, 22 bp, Homo sapiens
agcaataacattcccactgcca

SEQ ID NO: 3053390 - DNA, 21 bp, Homo sapiens
agcaatacgtttgtgcagaat

SEQ ID NO: 3053391 - DNA, 12 bp, Homo sapiens
agcaatatgcat

SEQ ID NO: 3053392 - DNA, 13 bp, Homo sapiens
agcaatcacagga

SEQ ID NO: 3053393 - DNA, 14 bp, Homo sapiens
agcaatcagcaaac

SEQ ID NO: 3053394 - DNA, 19 bp, Homo sapiens
agcaatcagcaaacacaat

SEQ ID NO: 3053395 - DNA, 22 bp, Homo sapiens
agcaatcagcaaacacaataag

SEQ ID NO: 3053396 - DNA, 21 bp, Homo sapiens
agcaatcctcctacctcagcc

SEQ ID NO: 3053397 - DNA, 23 bp, Homo sapiens
agcaatcctctcacctcagcctc

SEQ ID NO: 3053398 - DNA, 20 bp, Homo sapiens
agcaatcgcatcccggctga

SEQ ID NO: 3053399 - DNA, 13 bp, Homo sapiens
agcaatcggttcc

SEQ ID NO: 3053400 - DNA, 14 bp, Homo sapiens
agcaatgcattctg

SEQ ID NO: 3053401 - DNA, 22 bp, Homo sapiens
agcaatgcattctggagacaga

SEQ ID NO: 3053402 - DNA, 21 bp, Homo sapiens
agcaatgctgatgaatcactg

SEQ ID NO: 3053403 - DNA, 13 bp, Homo sapiens
agcaatgctgtga

SEQ ID NO: 3053404 - DNA, 16 bp, Homo sapiens
agcaatgctgtgaata

SEQ ID NO: 3053405 - DNA, 16 bp, Homo sapiens
agcaatgggggcctcc

SEQ ID NO: 3053406 - DNA, 17 bp, Homo sapiens
agcaatgggggcctccg

SEQ ID NO: 3053407 - DNA, 16 bp, Homo sapiens
agcaatgggtcttagc

SEQ ID NO: 3053408 - DNA, 16 bp, Homo sapiens
agcaattatttaaaga

SEQ ID NO: 3053409 - DNA, 17 bp, Homo sapiens
agcaattatttaaagaa

SEQ ID NO: 3053410 - DNA, 19 bp, Homo sapiens
agcaattatttaaagaaag

SEQ ID NO: 3053411 - DNA, 16 bp, Homo sapiens
agcaattctcctgcct

SEQ ID NO: 3053412 - DNA, 18 bp, Homo sapiens
agcaattctcctgcctca

SEQ ID NO: 3053413 - DNA, 22 bp, Homo sapiens
agcaattctcctgcctcagcct

SEQ ID NO: 3053414 - DNA, 17 bp, Homo sapiens
agcacaaacacaaggtc

SEQ ID NO: 3053415 - DNA, 17 bp, Homo sapiens
agcacaagttatttaaa

SEQ ID NO: 3053416 - DNA, 18 bp, Homo sapiens
agcacaagttatttaaat

SEQ ID NO: 3053417 - DNA, 15 bp, Homo sapiens
agcacaatctgttct

SEQ ID NO: 3053418 - DNA, 17 bp, Homo sapiens
agcacaatctgttctac

SEQ ID NO: 3053419 - DNA, 14 bp, Homo sapiens
agcacagctcctcc

SEQ ID NO: 3053420 - DNA, 21 bp, Homo sapiens
agcacagctcctcccctgccg

SEQ ID NO: 3053421 - DNA, 16 bp, Homo sapiens
agcacagtggtggcag

SEQ ID NO: 3053422 - DNA, 14 bp, Homo sapiens
agcacagtttgaac

SEQ ID NO: 3053423 - DNA, 23 bp, Homo sapiens
agcacatcacctctttgcccccg

SEQ ID NO: 3053424 - DNA, 15 bp, Homo sapiens
agcacatgccaggga

SEQ ID NO: 3053425 - DNA, 20 bp, Homo sapiens
agcacatgcgggctcgccca

SEQ ID NO: 3053426 - DNA, 15 bp, Homo sapiens
agcaccaccaggtct

SEQ ID NO: 3053427 - DNA, 15 bp, Homo sapiens
agcaccacggccaga

SEQ ID NO: 3053428 - DNA, 23 bp, Homo sapiens
agcaccaggcacgaacccacctg

SEQ ID NO: 3053429 - DNA, 20 bp, Homo sapiens
agcacccagtcctctgcctc

SEQ ID NO: 3053430 - DNA, 18 bp, Homo sapiens
agcaccccctctcctgga

SEQ ID NO: 3053431 - DNA, 18 bp, Homo sapiens
agcaccgaggggcctttg

SEQ ID NO: 3053432 - DNA, 22 bp, Homo sapiens
agcaccgccggctttcagggca

SEQ ID NO: 3053433 - DNA, 22 bp, Homo sapiens
agcaccgtgccaaccccaccca

SEQ ID NO: 3053434 - DNA, 14 bp, Homo sapiens
agcacctcagcctg

SEQ ID NO: 3053435 - DNA, 20 bp, Homo sapiens
agcacctgccgacctcgtcc

SEQ ID NO: 3053436 - DNA, 19 bp, Homo sapiens
agcacctggaccccctgcc

SEQ ID NO: 3053437 - DNA, 23 bp, Homo sapiens
agcacctggaccccctgcccgcc

SEQ ID NO: 3053438 - DNA, 22 bp, Homo sapiens
agcacctgtctcctttcacccc

SEQ ID NO: 3053439 - DNA, 24 bp, Homo sapiens
agcaccttggcccaggagctctgc

SEQ ID NO: 3053440 - DNA, 13 bp, Homo sapiens
agcacgcctgcca

SEQ ID NO: 3053441 - DNA, 18 bp, Homo sapiens
agcacggcccggcccctc

SEQ ID NO: 3053442 - DNA, 14 bp, Homo sapiens
agcactagaagtgg

SEQ ID NO: 3053443 - DNA, 14 bp, Homo sapiens
agcactatacagat

SEQ ID NO: 3053444 - DNA, 12 bp, Homo sapiens
agcactatgaca

SEQ ID NO: 3053445 - DNA, 18 bp, Homo sapiens
agcactcacgccctaagc

SEQ ID NO: 3053446 - DNA, 15 bp, Homo sapiens
agcactcaggctctc

SEQ ID NO: 3053447 - DNA, 15 bp, Homo sapiens
agcactgctgcctca

SEQ ID NO: 3053448 - DNA, 17 bp, Homo sapiens
agcactgctgcctcagc

SEQ ID NO: 3053449 - DNA, 18 bp, Homo sapiens
agcactgctgcctcagct

SEQ ID NO: 3053450 - DNA, 14 bp, Homo sapiens
agcactgtttttcc

SEQ ID NO: 3053451 - DNA, 23 bp, Homo sapiens
agcactgtttttccatagttttg

SEQ ID NO: 3053452 - DNA, 23 bp, Homo sapiens
agcacttcatctggctgcctttg

SEQ ID NO: 3053453 - DNA, 13 bp, Homo sapiens
agcacttgaagaa

SEQ ID NO: 3053454 - DNA, 12 bp, Homo sapiens
agcacttgtata

SEQ ID NO: 3053455 - DNA, 16 bp, Homo sapiens
agcacttgtccagctg

SEQ ID NO: 3053456 - DNA, 21 bp, Homo sapiens
agcacttgtgggtttttgttt

SEQ ID NO: 3053457 - DNA, 21 bp, Homo sapiens
agcactttgagaggctgaggt

SEQ ID NO: 3053458 - DNA, 14 bp, Homo sapiens
ctaaacagactcat

SEQ ID NO: 3053459 - DNA, 18 bp, Homo sapiens
ctaaacagatgtccctga

SEQ ID NO: 3053460 - DNA, 16 bp, Homo sapiens
ctaaacccaatccaaa

SEQ ID NO: 3053461 - DNA, 16 bp, Homo sapiens
ctaaacggattccaaa

SEQ ID NO: 3053462 - DNA, 16 bp, Homo sapiens
ctaaacttccccatct

SEQ ID NO: 3053463 - DNA, 21 bp, Homo sapiens
ctaaagaaaaatatcttggcc

SEQ ID NO: 3053464 - DNA, 23 bp, Homo sapiens
ctaaagaaaaatatcttggccta

SEQ ID NO: 3053465 - DNA, 17 bp, Homo sapiens
ctaaagatggagtttct

SEQ ID NO: 3053466 - DNA, 18 bp, Homo sapiens
ctaaagatggagtttcta

SEQ ID NO: 3053467 - DNA, 16 bp, Homo sapiens
ctaaagatgggaggag

SEQ ID NO: 3053468 - DNA, 23 bp, Homo sapiens
ctaaagatgggaggagaccagcg

SEQ ID NO: 3053469 - DNA, 18 bp, Homo sapiens
ctaaagattctatagttc

SEQ ID NO: 3053470 - DNA, 20 bp, Homo sapiens
ctaaagattctatagttcta

SEQ ID NO: 3053471 - DNA, 23 bp, Homo sapiens
ctaaagattctatagttctagac

SEQ ID NO: 3053472 - DNA, 14 bp, Homo sapiens
ctaaagcaatagaa

SEQ ID NO: 3053473 - DNA, 15 bp, Homo sapiens
ctaaagcaatagaaa

SEQ ID NO: 3053474 - DNA, 18 bp, Homo sapiens
ctaaagccaaacatatat

SEQ ID NO: 3053475 - DNA, 19 bp, Homo sapiens
ctaaagccaaccagccttt

SEQ ID NO: 3053476 - DNA, 23 bp, Homo sapiens
ctaaagccaagcactttatattt

SEQ ID NO: 3053477 - DNA, 15 bp, Homo sapiens
ctaaagcctgaattt

SEQ ID NO: 3053478 - DNA, 23 bp, Homo sapiens
ctaaaggtccacaggtctagact

SEQ ID NO: 3053479 - DNA, 22 bp, Homo sapiens
ctaaagtcatcatgaactggct

SEQ ID NO: 3053480 - DNA, 23 bp, Homo sapiens
ctaaagtcatcatgaactggctt

SEQ ID NO: 3053481 - DNA, 20 bp, Homo sapiens
ctctttaaaagaaagttagg

SEQ ID NO: 3053482 - DNA, 22 bp, Homo sapiens
ctctttaatgctgcctgccttt

SEQ ID NO: 3053483 - DNA, 12 bp, Homo sapiens
ctctttcaaaac

SEQ ID NO: 3053484 - DNA, 13 bp, Homo sapiens
ctctttcccagga

SEQ ID NO: 3053485 - DNA, 21 bp, Homo sapiens
ctctttcctgcccttttcctg

SEQ ID NO: 3053486 - DNA, 11 bp, Homo sapiens
ctctttctgta

SEQ ID NO: 3053487 - DNA, 13 bp, Homo sapiens
ctctttctgtata

SEQ ID NO: 3053488 - DNA, 17 bp, Homo sapiens
ctctttcttgtttgtca

SEQ ID NO: 3053489 - DNA, 23 bp, Homo sapiens
ctctttcttgtttgtcagcatct

SEQ ID NO: 3053490 - DNA, 10 bp, Homo sapiens
ctctttgaga

SEQ ID NO: 3053491 - DNA, 17 bp, Homo sapiens
ctctttgcaactcctgt

SEQ ID NO: 3053492 - DNA, 16 bp, Homo sapiens
ctctttgctttgcttt

SEQ ID NO: 3053493 - DNA, 18 bp, Homo sapiens
ctctttgctttgctttct

SEQ ID NO: 3053494 - DNA, 16 bp, Homo sapiens
ctctttggctgaaatt

SEQ ID NO: 3053495 - DNA, 21 bp, Homo sapiens
ctctttgggcagtgccatgga

SEQ ID NO: 3053496 - DNA, 16 bp, Homo sapiens
ctctttgtctaaaaca

SEQ ID NO: 3053497 - DNA, 21 bp, Homo sapiens
ctctttgtctaaaacaataaa

SEQ ID NO: 3053498 - DNA, 20 bp, Homo sapiens
ctctttgttcttcctgtctc

SEQ ID NO: 3053499 - DNA, 22 bp, Homo sapiens
ctcttttatatttgtaggagaa

SEQ ID NO: 3053500 - DNA, 13 bp, Homo sapiens
ctcttttcctctc

SEQ ID NO: 3053501 - DNA, 14 bp, Homo sapiens
ctcttttcctctct

SEQ ID NO: 3053502 - DNA, 17 bp, Homo sapiens
ctctttttctctgtata

SEQ ID NO: 3053503 - DNA, 13 bp, Homo sapiens
ctctttttgaaaa

SEQ ID NO: 3053504 - DNA, 15 bp, Homo sapiens
ctctttttgggtcca

SEQ ID NO: 3053505 - DNA, 19 bp, Homo sapiens
ctctttttggttgtcctca

SEQ ID NO: 3053506 - DNA, 17 bp, Homo sapiens
ctgaaaacccagagagg

SEQ ID NO: 3053507 - DNA, 15 bp, Homo sapiens
ctgaaaacctctcct

SEQ ID NO: 3053508 - DNA, 17 bp, Homo sapiens
ctgaaaacctctcctca

SEQ ID NO: 3053509 - DNA, 17 bp, Homo sapiens
ctgaaaagaaataataa

SEQ ID NO: 3053510 - DNA, 19 bp, Homo sapiens
ctgaaaagagagcagagaa

SEQ ID NO: 3053511 - DNA, 18 bp, Homo sapiens
ctgaaaaggatcgaggca

SEQ ID NO: 3053512 - DNA, 13 bp, Homo sapiens
ctgaaaatataac

SEQ ID NO: 3053513 - DNA, 15 bp, Homo sapiens
ctgaaaatataacca

SEQ ID NO: 3053514 - DNA, 17 bp, Homo sapiens
ctgaaacaaaaattgtc

SEQ ID NO: 3053515 - DNA, 23 bp, Homo sapiens
ctgaaacaaaaattgtctttatg

SEQ ID NO: 3053516 - DNA, 15 bp, Homo sapiens
ctgaaacaacttgga

SEQ ID NO: 3053517 - DNA, 10 bp, Homo sapiens
ctgaaacagc

SEQ ID NO: 3053518 - DNA, 11 bp, Homo sapiens
ctgaaacagct

SEQ ID NO: 3053519 - DNA, 14 bp, Homo sapiens
ctgaaacagctgcc

SEQ ID NO: 3053520 - DNA, 13 bp, Homo sapiens
ctgaaaccatttt

SEQ ID NO: 3053521 - DNA, 16 bp, Homo sapiens
ctgaaaccctggacca

SEQ ID NO: 3053522 - DNA, 14 bp, Homo sapiens
ctgaaacttcccaa

SEQ ID NO: 3053523 - DNA, 19 bp, Homo sapiens
ctgaaagaagaacagctgt

SEQ ID NO: 3053524 - DNA, 12 bp, Homo sapiens
ctgaaagccacg

SEQ ID NO: 3053525 - DNA, 14 bp, Homo sapiens
ctgaaagcctcacg

SEQ ID NO: 3053526 - DNA, 12 bp, Homo sapiens
ctgaaagcctgt

SEQ ID NO: 3053527 - DNA, 15 bp, Homo sapiens
ctgaaagcctgtctc

SEQ ID NO: 3053528 - DNA, 16 bp, Homo sapiens
ctgaaagcctgtctct

SEQ ID NO: 3053529 - DNA, 22 bp, Homo sapiens
ctgaaagcctgtctctttccac

SEQ ID NO: 3053530 - DNA, 17 bp, Homo sapiens
ctgaaaggatgtagaaa

SEQ ID NO: 3053531 - DNA, 15 bp, Homo sapiens
ctgaaagggaaggac

SEQ ID NO: 3053532 - DNA, 19 bp, Homo sapiens
ctgaaagttggggcccagt

SEQ ID NO: 3053533 - DNA, 14 bp, Homo sapiens
ctgaaagttgtaca

SEQ ID NO: 3053534 - DNA, 15 bp, Homo sapiens
ctgaaagttgtacat

SEQ ID NO: 3053535 - DNA, 16 bp, Homo sapiens
ctgaaagttgtacatg

SEQ ID NO: 3053536 - DNA, 18 bp, Homo sapiens
ctgaaataaaaaattatg

SEQ ID NO: 3053537 - DNA, 13 bp, Homo sapiens
ctgaaatgaagat

SEQ ID NO: 3053538 - DNA, 18 bp, Homo sapiens
ctgaaatgccaagtgcct

SEQ ID NO: 3053539 - DNA, 22 bp, Homo sapiens
ctgaaatgccaagtgcctgctt

SEQ ID NO: 3053540 - DNA, 13 bp, Homo sapiens
ctgaaatgtttgg

SEQ ID NO: 3053541 - DNA, 13 bp, Homo sapiens
ctgaaattaaatg

SEQ ID NO: 3053542 - DNA, 12 bp, Homo sapiens
ctgaaattccaa

SEQ ID NO: 3053543 - DNA, 14 bp, Homo sapiens
ctgaaattccaaag

SEQ ID NO: 3053544 - DNA, 16 bp, Homo sapiens
ctgaaattccaaagtc

SEQ ID NO: 3053545 - DNA, 20 bp, Homo sapiens
ctgaacaaaaactgtatgga

SEQ ID NO: 3053546 - DNA, 19 bp, Homo sapiens
ctgaacaataggctgttcc

SEQ ID NO: 3053547 - DNA, 16 bp, Homo sapiens
ctgaacagatgtaaat

SEQ ID NO: 3053548 - DNA, 12 bp, Homo sapiens
ctgaacagtgct

SEQ ID NO: 3053549 - DNA, 14 bp, Homo sapiens
ctgaacagtgctct

SEQ ID NO: 3053550 - DNA, 15 bp, Homo sapiens
ctgaacagtgctctg

SEQ ID NO: 3053551 - DNA, 18 bp, Homo sapiens
ctgaacagtgctctgcct

SEQ ID NO: 3053552 - DNA, 20 bp, Homo sapiens
ctgaacagtgctctgcctct

SEQ ID NO: 3053553 - DNA, 21 bp, Homo sapiens
ctgaacagtgctctgcctcta

SEQ ID NO: 3053554 - DNA, 11 bp, Homo sapiens
ctgaacattgt

SEQ ID NO: 3053555 - DNA, 17 bp, Homo sapiens
ctgaaccaaattgcact

SEQ ID NO: 3053556 - DNA, 20 bp, Homo sapiens
ctgaaccaaattgcactgaa

SEQ ID NO: 3053557 - DNA, 16 bp, Homo sapiens
ctgaacccctccctcc

SEQ ID NO: 3053558 - DNA, 23 bp, Homo sapiens
ctgaacctatttcttaaacactt

SEQ ID NO: 3053559 - DNA, 16 bp, Homo sapiens
ctgaaccttgagcaaa

SEQ ID NO: 3053560 - DNA, 17 bp, Homo sapiens
ctgaacggggagaaaag

SEQ ID NO: 3053561 - DNA, 13 bp, Homo sapiens
ctgaactcacttt

SEQ ID NO: 3053562 - DNA, 14 bp, Homo sapiens
ctgaactgaggcct

SEQ ID NO: 3053563 - DNA, 16 bp, Homo sapiens
ctgaactgaggccttg

SEQ ID NO: 3053564 - DNA, 18 bp, Homo sapiens
ctgaactttgaagacccg

SEQ ID NO: 3053565 - DNA, 14 bp, Homo sapiens
ctgaactttgggaa

SEQ ID NO: 3053566 - DNA, 17 bp, Homo sapiens
ctgaagaaagagaagtc

SEQ ID NO: 3053567 - DNA, 13 bp, Homo sapiens
ctgaagaaatcca

SEQ ID NO: 3053568 - DNA, 22 bp, Homo sapiens
ctgaagaaccagtccccccacc

SEQ ID NO: 3053569 - DNA, 21 bp, Homo sapiens
ctgaagaccccagatgtgagg

SEQ ID NO: 3053570 - DNA, 23 bp, Homo sapiens
ctgaagaccccagatgtgagggc

SEQ ID NO: 3053571 - DNA, 23 bp, Homo sapiens
ctgaagacgccgtctccatggca

SEQ ID NO: 3053572 - DNA, 20 bp, Homo sapiens
ctgaagagaccactcaatcc

SEQ ID NO: 3053573 - DNA, 20 bp, Homo sapiens
ctgaagagctattatataaa

SEQ ID NO: 3053574 - DNA, 23 bp, Homo sapiens
ctgaagagttgccccgtctctgt

SEQ ID NO: 3053575 - DNA, 23 bp, Homo sapiens
ctgaagatggcatcctgtgaagt

SEQ ID NO: 3053576 - DNA, 22 bp, Homo sapiens
ctgaagcagatgcaaagaggca

SEQ ID NO: 3053577 - DNA, 16 bp, Homo sapiens
ctgaagcccagacctc

SEQ ID NO: 3053578 - DNA, 23 bp, Homo sapiens
ctgaagcctttgcattttggaga

SEQ ID NO: 3053579 - DNA, 12 bp, Homo sapiens
ctgaagctgagg

SEQ ID NO: 3053580 - DNA, 21 bp, Homo sapiens
ctgaagctgctgcagccctgc

SEQ ID NO: 3053581 - DNA, 21 bp, Homo sapiens
ctgaaggagccccattcctgg

SEQ ID NO: 3053582 - DNA, 15 bp, Homo sapiens
ctgaaggctttgtga

SEQ ID NO: 3053583 - DNA, 19 bp, Homo sapiens
ctgaaggggccatgatggc

SEQ ID NO: 3053584 - DNA, 20 bp, Homo sapiens
ctgaaggggcgtctgttccc

SEQ ID NO: 3053585 - DNA, 15 bp, Homo sapiens
ctgaaggtaaaattg

SEQ ID NO: 3053586 - DNA, 14 bp, Homo sapiens
ctgaagtatgaagt

SEQ ID NO: 3053587 - DNA, 20 bp, Homo sapiens
ctgaagtcttactacagaaa

SEQ ID NO: 3053588 - DNA, 20 bp, Homo sapiens
ctgaagtgcttgcagatcat

SEQ ID NO: 3053589 - DNA, 21 bp, Homo sapiens
ctgaagtggttcagtctagaa

SEQ ID NO: 3053590 - DNA, 18 bp, Homo sapiens
ctgaagtgtgtccatcct

SEQ ID NO: 3053591 - DNA, 19 bp, Homo sapiens
ctgaagtgtgtccatcctg

SEQ ID NO: 3053592 - DNA, 23 bp, Homo sapiens
ctgaagtgtgtccatcctgacct

SEQ ID NO: 3053593 - DNA, 14 bp, Homo sapiens
ctgaagtttttgaa

SEQ ID NO: 3053594 - DNA, 15 bp, Homo sapiens
ctgaagtttttgaaa

SEQ ID NO: 3053595 - DNA, 13 bp, Homo sapiens
ctgaataaaccaa

SEQ ID NO: 3053596 - DNA, 12 bp, Homo sapiens
ctgaataaatgg

SEQ ID NO: 3053597 - DNA, 15 bp, Homo sapiens
ctgaatacaaataga

SEQ ID NO: 3053598 - DNA, 15 bp, Homo sapiens
ctgaatagcagaagg

SEQ ID NO: 3053599 - DNA, 15 bp, Homo sapiens
ctgaatccagcattg

SEQ ID NO: 3053600 - DNA, 17 bp, Homo sapiens
ctgaatccagcattgtt

SEQ ID NO: 3053601 - DNA, 16 bp, Homo sapiens
ctgaatctaaaataaa

SEQ ID NO: 3053602 - DNA, 21 bp, Homo sapiens
ctgaatgaaacccccacacac

SEQ ID NO: 3053603 - DNA, 22 bp, Homo sapiens
ctgaatgaaacccccacacaca

SEQ ID NO: 3053604 - DNA, 16 bp, Homo sapiens
ctgaatgttgggactg

SEQ ID NO: 3053605 - DNA, 19 bp, Homo sapiens
ctgaatgtttgtgtctgtg

SEQ ID NO: 3053606 - DNA, 22 bp, Homo sapiens
ctgaatgtttgtgtctgtggtt

SEQ ID NO: 3053607 - DNA, 15 bp, Homo sapiens
ctgaattaaataaat

SEQ ID NO: 3053608 - DNA, 16 bp, Homo sapiens
ctgaattgtccccagt

SEQ ID NO: 3053609 - DNA, 16 bp, Homo sapiens
ctgaatttataaaaat

SEQ ID NO: 3053610 - DNA, 19 bp, Homo sapiens
ctgaatttcttcttttcct

SEQ ID NO: 3053611 - DNA, 14 bp, Homo sapiens
ctgaatttctttga

SEQ ID NO: 3053612 - DNA, 12 bp, Homo sapiens
ctgaatttgcaa

SEQ ID NO: 3053613 - DNA, 22 bp, Homo sapiens
ctgaatttgcaaagtactgtaa

SEQ ID NO: 3053614 - DNA, 15 bp, Homo sapiens
ctgaatttgccctgg

SEQ ID NO: 3053615 - DNA, 19 bp, Homo sapiens
ctgaatttgccctgggaaa

SEQ ID NO: 3053616 - DNA, 22 bp, Homo sapiens
ctgaatttgtaagcaacttgct

SEQ ID NO: 3053617 - DNA, 14 bp, Homo sapiens
ctgaatttgtatat

SEQ ID NO: 3053618 - DNA, 22 bp, Homo sapiens
ctgaatttgtatatgactgcat

SEQ ID NO: 3053619 - DNA, 15 bp, Homo sapiens
ctgagctctgcctca

SEQ ID NO: 3053620 - DNA, 14 bp, Homo sapiens
ctgagctgccagtg

SEQ ID NO: 3053621 - DNA, 14 bp, Homo sapiens
ctgagctggcttcg

SEQ ID NO: 3053622 - DNA, 13 bp, Homo sapiens
ctgagctggggag

SEQ ID NO: 3053623 - DNA, 15 bp, Homo sapiens
ctgagctgtcccaag

SEQ ID NO: 3053624 - DNA, 16 bp, Homo sapiens
ctgagctgtcccaagt

SEQ ID NO: 3053625 - DNA, 18 bp, Homo sapiens
ctgagctgtcccaagtcc

SEQ ID NO: 3053626 - DNA, 15 bp, Homo sapiens
ctgagctgtgcaggt

SEQ ID NO: 3053627 - DNA, 12 bp, Homo sapiens
ctgagcttggaa

SEQ ID NO: 3053628 - DNA, 13 bp, Homo sapiens
ctgagctttgtta

SEQ ID NO: 3053629 - DNA, 15 bp, Homo sapiens
ctgaggaaaggccag

SEQ ID NO: 3053630 - DNA, 19 bp, Homo sapiens
ctgaggaaaggccagctgg

SEQ ID NO: 3053631 - DNA, 15 bp, Homo sapiens
ctgaggacagctgtc

SEQ ID NO: 3053632 - DNA, 16 bp, Homo sapiens
ctgaggacagctgtcc

SEQ ID NO: 3053633 - DNA, 12 bp, Homo sapiens
ctgaggactctg

SEQ ID NO: 3053634 - DNA, 15 bp, Homo sapiens
ctgaggactgcacca

SEQ ID NO: 3053635 - DNA, 23 bp, Homo sapiens
ctgaggactgcaccattgctgct

SEQ ID NO: 3053636 - DNA, 13 bp, Homo sapiens
ctgaggaggggag

SEQ ID NO: 3053637 - DNA, 18 bp, Homo sapiens
ctgaggatcccctgtccc

SEQ ID NO: 3053638 - DNA, 20 bp, Homo sapiens
ctgaggcacaagaatcactt

SEQ ID NO: 3053639 - DNA, 15 bp, Homo sapiens
ctgaggcagaagaat

SEQ ID NO: 3053640 - DNA, 22 bp, Homo sapiens
ctgaggcatccagcagtctctg

SEQ ID NO: 3053641 - DNA, 20 bp, Homo sapiens
ctgaggccacactcagcaca

SEQ ID NO: 3053642 - DNA, 21 bp, Homo sapiens
ctgaggccacactcagcacaa

SEQ ID NO: 3053643 - DNA, 24 bp, Homo sapiens
ctgaggccacactcagcacaaggc

SEQ ID NO: 3053644 - DNA, 12 bp, Homo sapiens
ctgaggcctccc

SEQ ID NO: 3053645 - DNA, 17 bp, Homo sapiens
ctgaggcctcccttgag

SEQ ID NO: 3053646 - DNA, 17 bp, Homo sapiens
ctgaggcctctcagaaa

SEQ ID NO: 3053647 - DNA, 19 bp, Homo sapiens
ctgaggcctgagacccagg

SEQ ID NO: 3053648 - DNA, 17 bp, Homo sapiens
ctgaggccttgtgtgtc

SEQ ID NO: 3053649 - DNA, 17 bp, Homo sapiens
ctgaggctgagaaagct

SEQ ID NO: 3053650 - DNA, 17 bp, Homo sapiens
ctgaggctggcacagga

SEQ ID NO: 3053651 - DNA, 18 bp, Homo sapiens
ctgaggctggcacaggac

SEQ ID NO: 3053652 - DNA, 20 bp, Homo sapiens
ctgaggcttcacgccgggag

SEQ ID NO: 3053653 - DNA, 18 bp, Homo sapiens
ctgaggctttggatttga

SEQ ID NO: 3053654 - DNA, 19 bp, Homo sapiens
ctgagggaccgagcccagc

SEQ ID NO: 3053655 - DNA, 13 bp, Homo sapiens
ctgagggagcctg

SEQ ID NO: 3053656 - DNA, 17 bp, Homo sapiens
ctgagggagggagccat

SEQ ID NO: 3053657 - DNA, 12 bp, Homo sapiens
ctgagggcatct

SEQ ID NO: 3053658 - DNA, 15 bp, Homo sapiens
ctgagggcatctctg

SEQ ID NO: 3053659 - DNA, 14 bp, Homo sapiens
ctgagggccctgtg

SEQ ID NO: 3053660 - DNA, 24 bp, Homo sapiens
ctgaggggacgggcaagtgagagg

SEQ ID NO: 3053661 - DNA, 17 bp, Homo sapiens
ctgaggggctggggagg

SEQ ID NO: 3053662 - DNA, 20 bp, Homo sapiens
ctgaggggtgtccgagaggc

SEQ ID NO: 3053663 - DNA, 21 bp, Homo sapiens
ctgaggggtgtccgagaggct

SEQ ID NO: 3053664 - DNA, 12 bp, Homo sapiens
ctgaggtccaag

SEQ ID NO: 3053665 - DNA, 21 bp, Homo sapiens
ctgaggtgggagatgtggaaa

SEQ ID NO: 3053666 - DNA, 18 bp, Homo sapiens
ctgaggtgtctggcctga

SEQ ID NO: 3053667 - DNA, 21 bp, Homo sapiens
ctgagtaaaaaagctgtgtgc

SEQ ID NO: 3053668 - DNA, 20 bp, Homo sapiens
ctgagtacattgtgcccttg

SEQ ID NO: 3053669 - DNA, 17 bp, Homo sapiens
ctgagtagctctcctga

SEQ ID NO: 3053670 - DNA, 12 bp, Homo sapiens
ctgagtattact

SEQ ID NO: 3053671 - DNA, 18 bp, Homo sapiens
ctgagtcatgatctccct

SEQ ID NO: 3053672 - DNA, 20 bp, Homo sapiens
ctgagtcatgatctccctgc

SEQ ID NO: 3053673 - DNA, 19 bp, Homo sapiens
ctgagtccgcctgcgcctc

SEQ ID NO: 3053674 - DNA, 14 bp, Homo sapiens
ctgagtcctggccc

SEQ ID NO: 3053675 - DNA, 15 bp, Homo sapiens
ctgagtctccagggc

SEQ ID NO: 3053676 - DNA, 22 bp, Homo sapiens
ctgagtctccagggccccccaa

SEQ ID NO: 3053677 - DNA, 21 bp, Homo sapiens
ctgagtctggcaaacatgtgc

SEQ ID NO: 3053678 - DNA, 14 bp, Homo sapiens
ctgagtctgggcag

SEQ ID NO: 3053679 - DNA, 16 bp, Homo sapiens
ctgagtgtctctgcct

SEQ ID NO: 3053680 - DNA, 22 bp, Homo sapiens
ctgagtgtctctgcctggagca

SEQ ID NO: 3053681 - DNA, 17 bp, Homo sapiens
ctgagttcctagccacc

SEQ ID NO: 3053682 - DNA, 14 bp, Homo sapiens
ctgagtttcccttc

SEQ ID NO: 3053683 - DNA, 16 bp, Homo sapiens
ctgagttttccatggc

SEQ ID NO: 3053684 - DNA, 19 bp, Homo sapiens
ctgataaaaccatgtagaa

SEQ ID NO: 3053685 - DNA, 23 bp, Homo sapiens
ctgataaaaccatgtagaaaatt

SEQ ID NO: 3053686 - DNA, 14 bp, Homo sapiens
ctgataatgtattg

SEQ ID NO: 3053687 - DNA, 20 bp, Homo sapiens
ctgataccatatgaatgaaa

SEQ ID NO: 3053688 - DNA, 13 bp, Homo sapiens
ctgataggagggg

SEQ ID NO: 3053689 - DNA, 18 bp, Homo sapiens
ctgataggagggggcggc

SEQ ID NO: 3053690 - DNA, 16 bp, Homo sapiens
ctgatagttactgttg

SEQ ID NO: 3053691 - DNA, 17 bp, Homo sapiens
ctgatagttactgttgt

SEQ ID NO: 3053692 - DNA, 22 bp, Homo sapiens
ctgatagttactgttgtgacct

SEQ ID NO: 3053693 - DNA, 13 bp, Homo sapiens
ctgatataatatc

SEQ ID NO: 3053694 - DNA, 18 bp, Homo sapiens
ctgatataatatcataat

SEQ ID NO: 3053695 - DNA, 22 bp, Homo sapiens
ctgatatatgtgtttttcacat

SEQ ID NO: 3053696 - DNA, 18 bp, Homo sapiens
ctgatatgatttaaaaca

SEQ ID NO: 3053697 - DNA, 22 bp, Homo sapiens
ctgatatgatttaaaacatgta

SEQ ID NO: 3053698 - DNA, 15 bp, Homo sapiens
ctgatcaaggcctta

SEQ ID NO: 3053699 - DNA, 14 bp, Homo sapiens
ctgatcaatgacag

SEQ ID NO: 3053700 - DNA, 20 bp, Homo sapiens
ctgatcagagccgtggtcct

SEQ ID NO: 3053701 - DNA, 18 bp, Homo sapiens
ctgatcaggcttcctggt

SEQ ID NO: 3053702 - DNA, 19 bp, Homo sapiens
ctgatcatcgccagaggtg

SEQ ID NO: 3053703 - DNA, 14 bp, Homo sapiens
ctgatcatctgctg

SEQ ID NO: 3053704 - DNA, 15 bp, Homo sapiens
ctgatcatctgctgt

SEQ ID NO: 3053705 - DNA, 13 bp, Homo sapiens
ctgatccctctac

SEQ ID NO: 3053706 - DNA, 14 bp, Homo sapiens
ctgatcgtgacgct

SEQ ID NO: 3053707 - DNA, 13 bp, Homo sapiens
ctgatctatttat

SEQ ID NO: 3053708 - DNA, 12 bp, Homo sapiens
ctgatcttggaa

SEQ ID NO: 3053709 - DNA, 23 bp, Homo sapiens
ctgatgaaaatattctgattggt

SEQ ID NO: 3053710 - DNA, 16 bp, Homo sapiens
ctgatgaaagctttgg

SEQ ID NO: 3053711 - DNA, 15 bp, Homo sapiens
ctgatgagactccac

SEQ ID NO: 3053712 - DNA, 23 bp, Homo sapiens
ctgatgagactccactcaggtgc

SEQ ID NO: 3053713 - DNA, 17 bp, Homo sapiens
ctgatgagatttttaaa

SEQ ID NO: 3053714 - DNA, 14 bp, Homo sapiens
ctgatgcaaggatt

SEQ ID NO: 3053715 - DNA, 16 bp, Homo sapiens
ctgatgcgctgggatc

SEQ ID NO: 3053716 - DNA, 14 bp, Homo sapiens
ctgatgctgaaata

SEQ ID NO: 3053717 - DNA, 19 bp, Homo sapiens
ctgatgcttttgtctaatt

SEQ ID NO: 3053718 - DNA, 18 bp, Homo sapiens
ctgatggaagcacacaag

SEQ ID NO: 3053719 - DNA, 15 bp, Homo sapiens
ctgatggattccaaa

SEQ ID NO: 3053720 - DNA, 19 bp, Homo sapiens
ctgatggattccaaccttc

SEQ ID NO: 3053721 - DNA, 22 bp, Homo sapiens
ctgatgggaaaactgccaatat

SEQ ID NO: 3053722 - DNA, 16 bp, Homo sapiens
ctgatggtgagcagta

SEQ ID NO: 3053723 - DNA, 21 bp, Homo sapiens
ctgatgtcagctgctgttgaa

SEQ ID NO: 3053724 - DNA, 13 bp, Homo sapiens
ctgatgttcagtg

SEQ ID NO: 3053725 - DNA, 14 bp, Homo sapiens
ctgatgttcagtgt

SEQ ID NO: 3053726 - DNA, 17 bp, Homo sapiens
ctgatgttcagtgtaat

SEQ ID NO: 3053727 - DNA, 21 bp, Homo sapiens
ctgatgttcagtgtaatttct

SEQ ID NO: 3053728 - DNA, 22 bp, Homo sapiens
ctgatgttgagggaacagacag

SEQ ID NO: 3053729 - DNA, 22 bp, Homo sapiens
ctgatgtttgggggttaccaaa

SEQ ID NO: 3053730 - DNA, 23 bp, Homo sapiens
ctgattagataatcttttacatt

SEQ ID NO: 3053731 - DNA, 14 bp, Homo sapiens
ctgattcaactaaa

SEQ ID NO: 3053732 - DNA, 17 bp, Homo sapiens
ctgattcaactaaaaaa

SEQ ID NO: 3053733 - DNA, 18 bp, Homo sapiens
ctgatttaggagaagcca

SEQ ID NO: 3053734 - DNA, 13 bp, Homo sapiens
ctgatttatacca

SEQ ID NO: 3053735 - DNA, 19 bp, Homo sapiens
ctgatttattgaaattttt

SEQ ID NO: 3053736 - DNA, 21 bp, Homo sapiens
ctgatttattgaaatttttct

SEQ ID NO: 3053737 - DNA, 20 bp, Homo sapiens
ctgatttgcaggatttttag

SEQ ID NO: 3053738 - DNA, 14 bp, Homo sapiens
ctgatttggaaaaa

SEQ ID NO: 3053739 - DNA, 20 bp, Homo sapiens
ctgattttacaaattaatat

SEQ ID NO: 3053740 - DNA, 23 bp, Homo sapiens
ctgattttaggagctaaggctct

SEQ ID NO: 3053741 - DNA, 15 bp, Homo sapiens
ctgatttttattaac

SEQ ID NO: 3053742 - DNA, 23 bp, Homo sapiens
ctgcaaaaaatactttttctaat

SEQ ID NO: 3053743 - DNA, 20 bp, Homo sapiens
ctgcaaacgctgcctgccca

SEQ ID NO: 3053744 - DNA, 22 bp, Homo sapiens
ctgcaaagatctgtcctcagcc

SEQ ID NO: 3053745 - DNA, 20 bp, Homo sapiens
ctgcaaagtgttttgtacca

SEQ ID NO: 3053746 - DNA, 23 bp, Homo sapiens
ctgcaaagtgttttgtaccagtg

SEQ ID NO: 3053747 - DNA, 22 bp, Homo sapiens
ctgcaaatattagcaaagaagc

SEQ ID NO: 3053748 - DNA, 16 bp, Homo sapiens
ctgcaaatccttgtgg

SEQ ID NO: 3053749 - DNA, 19 bp, Homo sapiens
ctgcaacacaacatttgtg

SEQ ID NO: 3053750 - DNA, 19 bp, Homo sapiens
ctgcaacagagagaaaaag

SEQ ID NO: 3053751 - DNA, 11 bp, Homo sapiens
ctgcaacatgg

SEQ ID NO: 3053752 - DNA, 14 bp, Homo sapiens
ctgcaacctccgcc

SEQ ID NO: 3053753 - DNA, 17 bp, Homo sapiens
ctgcaactgctcagctc

SEQ ID NO: 3053754 - DNA, 15 bp, Homo sapiens
ctgcaagagccttgg

SEQ ID NO: 3053755 - DNA, 16 bp, Homo sapiens
ctgaattttggaggca

SEQ ID NO: 3053756 - DNA, 17 bp, Homo sapiens
ctgacaacgtctcttca

SEQ ID NO: 3053757 - DNA, 13 bp, Homo sapiens
ctgacaacttgaa

SEQ ID NO: 3053758 - DNA, 14 bp, Homo sapiens
ctgacaattgcaaa

SEQ ID NO: 3053759 - DNA, 14 bp, Homo sapiens
ctgacacctttcat

SEQ ID NO: 3053760 - DNA, 15 bp, Homo sapiens
ctgacactcccaccc

SEQ ID NO: 3053761 - DNA, 17 bp, Homo sapiens
ctgacactcccttgggc

SEQ ID NO: 3053762 - DNA, 12 bp, Homo sapiens
ctgacagaggag

SEQ ID NO: 3053763 - DNA, 15 bp, Homo sapiens
ctgacagcactcctc

SEQ ID NO: 3053764 - DNA, 14 bp, Homo sapiens
ctgacagcagcctg

SEQ ID NO: 3053765 - DNA, 18 bp, Homo sapiens
ctgacagcagcctgtgag

SEQ ID NO: 3053766 - DNA, 12 bp, Homo sapiens
ctgacagctgct

SEQ ID NO: 3053767 - DNA, 14 bp, Homo sapiens
ctgacagctgctcc

SEQ ID NO: 3053768 - DNA, 14 bp, Homo sapiens
ctgacagtttttct

SEQ ID NO: 3053769 - DNA, 13 bp, Homo sapiens
ctgacatcagcac

SEQ ID NO: 3053770 - DNA, 21 bp, Homo sapiens
ctgacatcagcactttaccag

SEQ ID NO: 3053771 - DNA, 22 bp, Homo sapiens
ctgacatcagcactttaccaga

SEQ ID NO: 3053772 - DNA, 22 bp, Homo sapiens
ctgacatgtaccccctttccct

SEQ ID NO: 3053773 - DNA, 23 bp, Homo sapiens
ctgacatgtaccccctttccctt

SEQ ID NO: 3053774 - DNA, 14 bp, Homo sapiens
ctgacattgccaaa

SEQ ID NO: 3053775 - DNA, 21 bp, Homo sapiens
ctgacattgccaaaaaggata

SEQ ID NO: 3053776 - DNA, 14 bp, Homo sapiens
ctgacattgctcca

SEQ ID NO: 3053777 - DNA, 21 bp, Homo sapiens
ctgaccaagtgctggcccacc

SEQ ID NO: 3053778 - DNA, 13 bp, Homo sapiens
ctgaccagaacta

SEQ ID NO: 3053779 - DNA, 13 bp, Homo sapiens
ctgaccagcagcg

SEQ ID NO: 3053780 - DNA, 15 bp, Homo sapiens
ctgaccagcagcgcc

SEQ ID NO: 3053781 - DNA, 16 bp, Homo sapiens
ctgaccagcagcgcct

SEQ ID NO: 3053782 - DNA, 20 bp, Homo sapiens
ctgaccagcagcgcctttcc

SEQ ID NO: 3053783 - DNA, 22 bp, Homo sapiens
ctgaccagcagcgcctttccca

SEQ ID NO: 3053784 - DNA, 20 bp, Homo sapiens
ctgaccagccgtgagcatgt

SEQ ID NO: 3053785 - DNA, 23 bp, Homo sapiens
ctgaccagccgtgagcatgtttg

SEQ ID NO: 3053786 - DNA, 17 bp, Homo sapiens
ctgaccatctgtgacta

SEQ ID NO: 3053787 - DNA, 18 bp, Homo sapiens
ctgaccatctgtgactat

SEQ ID NO: 3053788 - DNA, 19 bp, Homo sapiens
ctgaccatgtgcggagcag

SEQ ID NO: 3053789 - DNA, 17 bp, Homo sapiens
ctgacccacagcctcca

SEQ ID NO: 3053790 - DNA, 17 bp, Homo sapiens
ctgacccaccaaggtct

SEQ ID NO: 3053791 - DNA, 21 bp, Homo sapiens
ctgacccagattcccttccgg

SEQ ID NO: 3053792 - DNA, 16 bp, Homo sapiens
ctgacccagtccctgg

SEQ ID NO: 3053793 - DNA, 18 bp, Homo sapiens
ctgacccagtgcccccac

SEQ ID NO: 3053794 - DNA, 20 bp, Homo sapiens
ctgaccccccccattagaat

SEQ ID NO: 3053795 - DNA, 23 bp, Homo sapiens
ctgacccggattggccctgcccc

SEQ ID NO: 3053796 - DNA, 18 bp, Homo sapiens
ctgaccctcatctttctt

SEQ ID NO: 3053797 - DNA, 12 bp, Homo sapiens
ctgaccctgggc

SEQ ID NO: 3053798 - DNA, 18 bp, Homo sapiens
ctgaccctgggcctggag

SEQ ID NO: 3053799 - DNA, 14 bp, Homo sapiens
ctgaccctggggct

SEQ ID NO: 3053800 - DNA, 15 bp, Homo sapiens
ctgaccctgtatata

SEQ ID NO: 3053801 - DNA, 18 bp, Homo sapiens
ctgaccctgtatatagcc

SEQ ID NO: 3053802 - DNA, 21 bp, Homo sapiens
ctgaccctgtatatagcccag

SEQ ID NO: 3053803 - DNA, 22 bp, Homo sapiens
ctgaccctgtatatagcccagc

SEQ ID NO: 3053804 - DNA, 23 bp, Homo sapiens
ctgacccttacagcctctgactt

SEQ ID NO: 3053805 - DNA, 15 bp, Homo sapiens
ctgaccgctgcccag

SEQ ID NO: 3053806 - DNA, 20 bp, Homo sapiens
ctgaccgctgcccaggtggg

SEQ ID NO: 3053807 - DNA, 18 bp, Homo sapiens
ctgaccgggctcacttgc

SEQ ID NO: 3053808 - DNA, 17 bp, Homo sapiens
ctgacctcaagtgatct

SEQ ID NO: 3053809 - DNA, 14 bp, Homo sapiens
ctgacctcacctgg

SEQ ID NO: 3053810 - DNA, 15 bp, Homo sapiens
ctgacctccacagct

SEQ ID NO: 3053811 - DNA, 16 bp, Homo sapiens
ctgacctccagtcctg

SEQ ID NO: 3053812 - DNA, 17 bp, Homo sapiens
ctgacctccagtcctgc

SEQ ID NO: 3053813 - DNA, 20 bp, Homo sapiens
ctgacctccagtcctgctgg

SEQ ID NO: 3053814 - DNA, 17 bp, Homo sapiens
ctgacctggtccacagg

SEQ ID NO: 3053815 - DNA, 12 bp, Homo sapiens
ctgacctggtgg

SEQ ID NO: 3053816 - DNA, 20 bp, Homo sapiens
ctgacctggtgggagcacct

SEQ ID NO: 3053817 - DNA, 23 bp, Homo sapiens
ctgacctggtgggagcacctgcc

SEQ ID NO: 3053818 - DNA, 13 bp, Homo sapiens
ctgacctgtccag

SEQ ID NO: 3053819 - DNA, 18 bp, Homo sapiens
ctgacctgtgagcccagc

SEQ ID NO: 3053820 - DNA, 21 bp, Homo sapiens
ctgacctgtgagcccagctgg

SEQ ID NO: 3053821 - DNA, 23 bp, Homo sapiens
ctgacgccaataataaaaaacaa

SEQ ID NO: 3053822 - DNA, 19 bp, Homo sapiens
ctgacggccagggagaagc

SEQ ID NO: 3053823 - DNA, 14 bp, Homo sapiens
ctgacgtcaagtga

SEQ ID NO: 3053824 - DNA, 16 bp, Homo sapiens
ctgactaaccattgat

SEQ ID NO: 3053825 - DNA, 18 bp, Homo sapiens
ctgactagggagccatgt

SEQ ID NO: 3053826 - DNA, 23 bp, Homo sapiens
ctgactattatgttgttagagaa

SEQ ID NO: 3053827 - DNA, 15 bp, Homo sapiens
ctgactcagggctcc

SEQ ID NO: 3053828 - DNA, 16 bp, Homo sapiens
ctgactcagggctcct

SEQ ID NO: 3053829 - DNA, 19 bp, Homo sapiens
ctgactcagggctcctggg

SEQ ID NO: 3053830 - DNA, 21 bp, Homo sapiens
ctgactcagggctcctgggtt

SEQ ID NO: 3053831 - DNA, 18 bp, Homo sapiens
ctgactctctgagctggg

SEQ ID NO: 3053832 - DNA, 23 bp, Homo sapiens
ctgactctctgagctggggaggt

SEQ ID NO: 3053833 - DNA, 15 bp, Homo sapiens
ctgactgatgacaaa

SEQ ID NO: 3053834 - DNA, 16 bp, Homo sapiens
ctgactggtgctgcag

SEQ ID NO: 3053835 - DNA, 23 bp, Homo sapiens
ctgactgtattttgttttccttt

SEQ ID NO: 3053836 - DNA, 16 bp, Homo sapiens
ctgactgtcagggagg

SEQ ID NO: 3053837 - DNA, 17 bp, Homo sapiens
ctgactgtcagggaggg

SEQ ID NO: 3053838 - DNA, 21 bp, Homo sapiens
ctgacttaggtttcaggaagt

SEQ ID NO: 3053839 - DNA, 12 bp, Homo sapiens
ctgacttgcttt

SEQ ID NO: 3053840 - DNA, 18 bp, Homo sapiens
ctgacttggatcccaaag

SEQ ID NO: 3053841 - DNA, 23 bp, Homo sapiens
ctgacttggatcccaaagcaagg

SEQ ID NO: 3053842 - DNA, 22 bp, Homo sapiens
ctgacttggggagatggagttc

SEQ ID NO: 3053843 - DNA, 13 bp, Homo sapiens
ctgactttacact

SEQ ID NO: 3053844 - DNA, 15 bp, Homo sapiens
ctgactttgctcttt

SEQ ID NO: 3053845 - DNA, 16 bp, Homo sapiens
ctgactttgctctttc

SEQ ID NO: 3053846 - DNA, 18 bp, Homo sapiens
ctgactttgctctttctt

SEQ ID NO: 3053847 - DNA, 22 bp, Homo sapiens
ctgagaaacgtccatctctctc

SEQ ID NO: 3053848 - DNA, 16 bp, Homo sapiens
ctgagaaagcccacct

SEQ ID NO: 3053849 - DNA, 23 bp, Homo sapiens
ctgagaaccataggactgtggca

SEQ ID NO: 3053850 - DNA, 20 bp, Homo sapiens
ctgagaatttaatttttaaa

SEQ ID NO: 3053851 - DNA, 18 bp, Homo sapiens
ctgagacccgttcgcccc

SEQ ID NO: 3053852 - DNA, 21 bp, Homo sapiens
ctgagacctctagagaaaaga

SEQ ID NO: 3053853 - DNA, 19 bp, Homo sapiens
ctgagagaccatctcctat

SEQ ID NO: 3053854 - DNA, 15 bp, Homo sapiens
ctgagagacccaagg

SEQ ID NO: 3053855 - DNA, 20 bp, Homo sapiens
ctgagagacccaaggaggaa

SEQ ID NO: 3053856 - DNA, 22 bp, Homo sapiens
ctgagagagaatagagctgcca

SEQ ID NO: 3053857 - DNA, 20 bp, Homo sapiens
ctgagaggtgtctgccactt

SEQ ID NO: 3053858 - DNA, 14 bp, Homo sapiens
ctgagagtctagat

SEQ ID NO: 3053859 - DNA, 17 bp, Homo sapiens
ctgagatacatacagaa

SEQ ID NO: 3053860 - DNA, 19 bp, Homo sapiens
ctgagatacatacagaatt

SEQ ID NO: 3053861 - DNA, 18 bp, Homo sapiens
ctgagataccagcgagga

SEQ ID NO: 3053862 - DNA, 16 bp, Homo sapiens
ctgagatctctgcagg

SEQ ID NO: 3053863 - DNA, 18 bp, Homo sapiens
ctgagatctctgcaggaa

SEQ ID NO: 3053864 - DNA, 20 bp, Homo sapiens
ctgagatctgcacagtcaga

SEQ ID NO: 3053865 - DNA, 14 bp, Homo sapiens
ctgagattccctca

SEQ ID NO: 3053866 - DNA, 14 bp, Homo sapiens
ctgagcaaggagtt

SEQ ID NO: 3053867 - DNA, 14 bp, Homo sapiens
ctgagcactggagt

SEQ ID NO: 3053868 - DNA, 16 bp, Homo sapiens
ctgagcactggagtgg

SEQ ID NO: 3053869 - DNA, 16 bp, Homo sapiens
ctgagcagtccctgct

SEQ ID NO: 3053870 - DNA, 16 bp, Homo sapiens
ctgcttgcagccagga

SEQ ID NO: 3053871 - DNA, 11 bp, Homo sapiens
ctgcttgctta

SEQ ID NO: 3053872 - DNA, 20 bp, Homo sapiens
ctgcttgggtggagaagcca

SEQ ID NO: 3053873 - DNA, 20 bp, Homo sapiens
ctgcttgtgcctcccttccc

SEQ ID NO: 3053874 - DNA, 21 bp, Homo sapiens
ctgcttgtgcctcccttccca

SEQ ID NO: 3053875 - DNA, 22 bp, Homo sapiens
ctgcttgtgcctcccttcccag

SEQ ID NO: 3053876 - DNA, 15 bp, Homo sapiens
ctgcttgttgtcaag

SEQ ID NO: 3053877 - DNA, 16 bp, Homo sapiens
ctgcttgttgtcaagt

SEQ ID NO: 3053878 - DNA, 20 bp, Homo sapiens
ctgcttgttgtcaagtataa

SEQ ID NO: 3053879 - DNA, 13 bp, Homo sapiens
ctgctttctccaa

SEQ ID NO: 3053880 - DNA, 16 bp, Homo sapiens
ctgctttctccattgt

SEQ ID NO: 3053881 - DNA, 14 bp, Homo sapiens
ctgctttctcccca

SEQ ID NO: 3053882 - DNA, 14 bp, Homo sapiens
ctgctttctggtat

SEQ ID NO: 3053883 - DNA, 13 bp, Homo sapiens
ctgctttctgttc

SEQ ID NO: 3053884 - DNA, 16 bp, Homo sapiens
ctgctttctgttcatc

SEQ ID NO: 3053885 - DNA, 21 bp, Homo sapiens
ctgctttctgttcatctcttt

SEQ ID NO: 3053886 - DNA, 20 bp, Homo sapiens
ctgctttgacgggccaggcc

SEQ ID NO: 3053887 - DNA, 21 bp, Homo sapiens
ctgctttgctcttcaagaaat

SEQ ID NO: 3053888 - DNA, 20 bp, Homo sapiens
ctgctttgggaagccgtgct

SEQ ID NO: 3053889 - DNA, 20 bp, Homo sapiens
ctgctttgttgttctgcctg

SEQ ID NO: 3053890 - DNA, 14 bp, Homo sapiens
ctgcttttggcctg

SEQ ID NO: 3053891 - DNA, 22 bp, Homo sapiens
ctgcttttggtgctctcacctt

SEQ ID NO: 3053892 - DNA, 14 bp, Homo sapiens
ctggaaaacctcct

SEQ ID NO: 3053893 - DNA, 19 bp, Homo sapiens
ctggaaaagggtcttggga

SEQ ID NO: 3053894 - DNA, 17 bp, Homo sapiens
ctggaaaataatactgc

SEQ ID NO: 3053895 - DNA, 20 bp, Homo sapiens
ctggaaaatctgtaaaaaag

SEQ ID NO: 3053896 - DNA, 17 bp, Homo sapiens
ctggaaacttctgtaag

SEQ ID NO: 3053897 - DNA, 17 bp, Homo sapiens
ctggaaagcaaacagga

SEQ ID NO: 3053898 - DNA, 18 bp, Homo sapiens
ctggaaaggaaagatgat

SEQ ID NO: 3053899 - DNA, 23 bp, Homo sapiens
ctggaaatactgatggaagcaca

SEQ ID NO: 3053900 - DNA, 23 bp, Homo sapiens
ctggaaatatcagttactcagcc

SEQ ID NO: 3053901 - DNA, 21 bp, Homo sapiens
ctggaacaccagcagcactgg

SEQ ID NO: 3053902 - DNA, 21 bp, Homo sapiens
ctggaacactagacaagccag

SEQ ID NO: 3053903 - DNA, 23 bp, Homo sapiens
ctggaacactagacaagccagaa

SEQ ID NO: 3053904 - DNA, 19 bp, Homo sapiens
ctggaacccagactcagac

SEQ ID NO: 3053905 - DNA, 12 bp, Homo sapiens
ctggaacctcag

SEQ ID NO: 3053906 - DNA, 16 bp, Homo sapiens
ctggaacctgcaaaaa

SEQ ID NO: 3053907 - DNA, 14 bp, Homo sapiens
ctggaacctttccc

SEQ ID NO: 3053908 - DNA, 16 bp, Homo sapiens
ctggaacttgaactga

SEQ ID NO: 3053909 - DNA, 19 bp, Homo sapiens
ctggaagcactacagagca

SEQ ID NO: 3053910 - DNA, 23 bp, Homo sapiens
ctggaagcatgtaggagaatcca

SEQ ID NO: 3053911 - DNA, 22 bp, Homo sapiens
ctggaagctaatttgcattaaa

SEQ ID NO: 3053912 - DNA, 20 bp, Homo sapiens
ctggaagctttgtcccctgc

SEQ ID NO: 3053913 - DNA, 12 bp, Homo sapiens
ctggaaggagca

SEQ ID NO: 3053914 - DNA, 18 bp, Homo sapiens
ctggaaggagcacatact

SEQ ID NO: 3053915 - DNA, 17 bp, Homo sapiens
ctggaaggggcccgtgg

SEQ ID NO: 3053916 - DNA, 20 bp, Homo sapiens
ctggaagtcaaataaatgtt

SEQ ID NO: 3053917 - DNA, 21 bp, Homo sapiens
ctggaagtcaaataaatgttt

SEQ ID NO: 3053918 - DNA, 19 bp, Homo sapiens
ctggaagtccaatgtggca

SEQ ID NO: 3053919 - DNA, 20 bp, Homo sapiens
ctggaatcagagatttttgt

SEQ ID NO: 3053920 - DNA, 18 bp, Homo sapiens
ctggaatctggagaccag

SEQ ID NO: 3053921 - DNA, 15 bp, Homo sapiens
ctggaatgagggagg

SEQ ID NO: 3053922 - DNA, 16 bp, Homo sapiens
ctggaatgagggaggc

SEQ ID NO: 3053923 - DNA, 17 bp, Homo sapiens
ctggaatgagggaggcg

SEQ ID NO: 3053924 - DNA, 19 bp, Homo sapiens
ctggacaatctcacacctt

SEQ ID NO: 3053925 - DNA, 23 bp, Homo sapiens
ctggacaatctcacaccttagct

SEQ ID NO: 3053926 - DNA, 15 bp, Homo sapiens
ctggacacaggcctg

SEQ ID NO: 3053927 - DNA, 23 bp, Homo sapiens
ctggacaccctcaccacccaaca

SEQ ID NO: 3053928 - DNA, 17 bp, Homo sapiens
ctggacaccgggccagt

SEQ ID NO: 3053929 - DNA, 22 bp, Homo sapiens
ctggacaccgggccagtatcta

SEQ ID NO: 3053930 - DNA, 13 bp, Homo sapiens
ctggacacttctt

SEQ ID NO: 3053931 - DNA, 15 bp, Homo sapiens
ctggacacttcttta

SEQ ID NO: 3053932 - DNA, 19 bp, Homo sapiens
ctggacagatggacgcagg

SEQ ID NO: 3053933 - DNA, 23 bp, Homo sapiens
ctggacagatggacgcaggccct

SEQ ID NO: 3053934 - DNA, 16 bp, Homo sapiens
ctggacagccccaccc

SEQ ID NO: 3053935 - DNA, 18 bp, Homo sapiens
ctggacagccccaccctg

SEQ ID NO: 3053936 - DNA, 19 bp, Homo sapiens
ctggacagtcagctcttca

SEQ ID NO: 3053937 - DNA, 23 bp, Homo sapiens
ctggacatagagagggagaagaa

SEQ ID NO: 3053938 - DNA, 17 bp, Homo sapiens
ctggacattttttcagt

SEQ ID NO: 3053939 - DNA, 14 bp, Homo sapiens
ctggaccaaggagc

SEQ ID NO: 3053940 - DNA, 12 bp, Homo sapiens
ctggaccagcct

SEQ ID NO: 3053941 - DNA, 14 bp, Homo sapiens
ctggaccagcctct

SEQ ID NO: 3053942 - DNA, 12 bp, Homo sapiens
ctggaccaggtc

SEQ ID NO: 3053943 - DNA, 13 bp, Homo sapiens
ctggaccaggtcc

SEQ ID NO: 3053944 - DNA, 13 bp, Homo sapiens
ctggaccttgaca

SEQ ID NO: 3053945 - DNA, 18 bp, Homo sapiens
ctggacgaagagcaggcc

SEQ ID NO: 3053946 - DNA, 13 bp, Homo sapiens
ctggacgtgaaat

SEQ ID NO: 3053947 - DNA, 18 bp, Homo sapiens
ctggactaaccctgtggt

SEQ ID NO: 3053948 - DNA, 19 bp, Homo sapiens
ctggactaaccctgtggtt

SEQ ID NO: 3053949 - DNA, 21 bp, Homo sapiens
ctggactagagggacctctcc

SEQ ID NO: 3053950 - DNA, 19 bp, Homo sapiens
ctggactcctgccaccagc

SEQ ID NO: 3053951 - DNA, 19 bp, Homo sapiens
ctggactctcagtctctga

SEQ ID NO: 3053952 - DNA, 20 bp, Homo sapiens
ctggactctcagtctctgag

SEQ ID NO: 3053953 - DNA, 23 bp, Homo sapiens
ctggactctcagtctctgagcag

SEQ ID NO: 3053954 - DNA, 14 bp, Homo sapiens
ctggactgacctgg

SEQ ID NO: 3053955 - DNA, 15 bp, Homo sapiens
ctggactgctgctgt

SEQ ID NO: 3053956 - DNA, 14 bp, Homo sapiens
ctggacttggtaca

SEQ ID NO: 3053957 - DNA, 14 bp, Homo sapiens
ctggagaagcagtg

SEQ ID NO: 3053958 - DNA, 17 bp, Homo sapiens
ctggagagcgaggaggc

SEQ ID NO: 3053959 - DNA, 20 bp, Homo sapiens
ctggagagctgtgtctattt

SEQ ID NO: 3053960 - DNA, 22 bp, Homo sapiens
ctggagaggccctctggagtgg

SEQ ID NO: 3053961 - DNA, 16 bp, Homo sapiens
ctggagagtggcaaaa

SEQ ID NO: 3053962 - DNA, 20 bp, Homo sapiens
ctggagatctgaacccagct

SEQ ID NO: 3053963 - DNA, 21 bp, Homo sapiens
ctggagatctgaacccagctg

SEQ ID NO: 3053964 - DNA, 18 bp, Homo sapiens
ctggagcaacctactgtc

SEQ ID NO: 3053965 - DNA, 14 bp, Homo sapiens
ctggagcaccaggc

SEQ ID NO: 3053966 - DNA, 13 bp, Homo sapiens
ctggagcagaaag

SEQ ID NO: 3053967 - DNA, 15 bp, Homo sapiens
ctggagccatgggca

SEQ ID NO: 3053968 - DNA, 14 bp, Homo sapiens
ctggagcccaggga

SEQ ID NO: 3053969 - DNA, 12 bp, Homo sapiens
ctggagccccac

SEQ ID NO: 3053970 - DNA, 23 bp, Homo sapiens
ctggagccccactgcccttctca

SEQ ID NO: 3053971 - DNA, 22 bp, Homo sapiens
ctggagcccctcctcccccggc

SEQ ID NO: 3053972 - DNA, 18 bp, Homo sapiens
ctggagcccgcactgtcc

SEQ ID NO: 3053973 - DNA, 20 bp, Homo sapiens
ctggagccctccgccttcac

SEQ ID NO: 3053974 - DNA, 21 bp, Homo sapiens
ctggagccctgttcctccctc

SEQ ID NO: 3053975 - DNA, 23 bp, Homo sapiens
ctggagcggctgctcgcccagga

SEQ ID NO: 3053976 - DNA, 22 bp, Homo sapiens
ctggagcgtttgctgtgccagg

SEQ ID NO: 3053977 - DNA, 23 bp, Homo sapiens
ctggagctctgtgggtctctgga

SEQ ID NO: 3053978 - DNA, 17 bp, Homo sapiens
ctggagctgggaggtct

SEQ ID NO: 3053979 - DNA, 18 bp, Homo sapiens
ctggaggaacacttgatg

SEQ ID NO: 3053980 - DNA, 15 bp, Homo sapiens
ctggaggcagggcct

SEQ ID NO: 3053981 - DNA, 22 bp, Homo sapiens
ctggaggcagggccttgcccag

SEQ ID NO: 3053982 - DNA, 18 bp, Homo sapiens
ctggaggcccaggctggg

SEQ ID NO: 3053983 - DNA, 15 bp, Homo sapiens
ctggaggcccagttc

SEQ ID NO: 3053984 - DNA, 23 bp, Homo sapiens
ctggaggctcaccttgcagaacc

SEQ ID NO: 3053985 - DNA, 19 bp, Homo sapiens
ctggaggctgcctgctgtg

SEQ ID NO: 3053986 - DNA, 11 bp, Homo sapiens
ctggaggctgg

SEQ ID NO: 3053987 - DNA, 16 bp, Homo sapiens
ctggagggcgcccagc

SEQ ID NO: 3053988 - DNA, 20 bp, Homo sapiens
ctggagggcgcccagcagcc

SEQ ID NO: 3053989 - DNA, 23 bp, Homo sapiens
ctggagggcgcccagcagcctgc

SEQ ID NO: 3053990 - DNA, 23 bp, Homo sapiens
ctggagggggagcaccagcggtc

SEQ ID NO: 3053991 - DNA, 22 bp, Homo sapiens
ctggaggggtcatccttgccca

SEQ ID NO: 3053992 - DNA, 17 bp, Homo sapiens
ctggaggtcgaagcaat

SEQ ID NO: 3053993 - DNA, 14 bp, Homo sapiens
ctggaggtgctggt

SEQ ID NO: 3053994 - DNA, 23 bp, Homo sapiens
ctggaggttcctaggttttgaga

SEQ ID NO: 3053995 - DNA, 17 bp, Homo sapiens
ctggaggttgataactt

SEQ ID NO: 3053996 - DNA, 15 bp, Homo sapiens
ctggagtatttggaa

SEQ ID NO: 3053997 - DNA, 19 bp, Homo sapiens
ctggagtgcccccagccca

SEQ ID NO: 3053998 - DNA, 20 bp, Homo sapiens
ctgtgggggtgtgccccctt

SEQ ID NO: 3053999 - DNA, 22 bp, Homo sapiens
ctgtggggtcaacccttctgga

SEQ ID NO: 3054000 - DNA, 15 bp, Homo sapiens
ctgtggtaaatgcca

SEQ ID NO: 3054001 - DNA, 17 bp, Homo sapiens
ctgtggtaaatgccaca

SEQ ID NO: 3054002 - DNA, 16 bp, Homo sapiens
ctgtggtagctccagc

SEQ ID NO: 3054003 - DNA, 19 bp, Homo sapiens
ctgtggtgatgtgcctgta

SEQ ID NO: 3054004 - DNA, 13 bp, Homo sapiens
ctgtggtggcctg

SEQ ID NO: 3054005 - DNA, 17 bp, Homo sapiens
ctgtggtggctccccct

SEQ ID NO: 3054006 - DNA, 20 bp, Homo sapiens
ctgtggtggctccccctctg

SEQ ID NO: 3054007 - DNA, 21 bp, Homo sapiens
ctgtggtggctccccctctgc

SEQ ID NO: 3054008 - DNA, 22 bp, Homo sapiens
ctgtggtggctccccctctgct

SEQ ID NO: 3054009 - DNA, 21 bp, Homo sapiens
ctgtggtggttcattccacag

SEQ ID NO: 3054010 - DNA, 22 bp, Homo sapiens
ctgtggttaatccaatcaattt

SEQ ID NO: 3054011 - DNA, 15 bp, Homo sapiens
ctgtggttgcctgcc

SEQ ID NO: 3054012 - DNA, 11 bp, Homo sapiens
ctgtggttttc

SEQ ID NO: 3054013 - DNA, 23 bp, Homo sapiens
ctgtgtaaccagctcagtgtttt

SEQ ID NO: 3054014 - DNA, 16 bp, Homo sapiens
ctgtgtaaccttgggt

SEQ ID NO: 3054015 - DNA, 19 bp, Homo sapiens
ctgtgtagccgccctgaga

SEQ ID NO: 3054016 - DNA, 15 bp, Homo sapiens
ctgtgtagtagtgca

SEQ ID NO: 3054017 - DNA, 21 bp, Homo sapiens
ctgtgtatatggtatatatac

SEQ ID NO: 3054018 - DNA, 16 bp, Homo sapiens
ctgtgtcagagcccag

SEQ ID NO: 3054019 - DNA, 15 bp, Homo sapiens
ctgtgtcccctgacc

SEQ ID NO: 3054020 - DNA, 20 bp, Homo sapiens
ctgtgtcccctgacctgtcc

SEQ ID NO: 3054021 - DNA, 21 bp, Homo sapiens
ctgtgtcccctgacctgtcca

SEQ ID NO: 3054022 - DNA, 17 bp, Homo sapiens
ctgtgtccctgctgggg

SEQ ID NO: 3054023 - DNA, 18 bp, Homo sapiens
ctgtgtccctgctggggt

SEQ ID NO: 3054024 - DNA, 23 bp, Homo sapiens
ctgtgtccctgctggggtctcag

SEQ ID NO: 3054025 - DNA, 16 bp, Homo sapiens
ctgtgtctaagattct

SEQ ID NO: 3054026 - DNA, 18 bp, Homo sapiens
ctgtgtctaagattctag

SEQ ID NO: 3054027 - DNA, 19 bp, Homo sapiens
ctgtgtctctatgtgaata

SEQ ID NO: 3054028 - DNA, 17 bp, Homo sapiens
ctgtgtctgtcaccaca

SEQ ID NO: 3054029 - DNA, 15 bp, Homo sapiens
ctgtgtgagaccagg

SEQ ID NO: 3054030 - DNA, 21 bp, Homo sapiens
ctgtgtgcgtggcgtggcccg

SEQ ID NO: 3054031 - DNA, 21 bp, Homo sapiens
ctgtgtgcgtggtgtggcccg

SEQ ID NO: 3054032 - DNA, 23 bp, Homo sapiens
ctgtgtgctcctccttggtgcct

SEQ ID NO: 3054033 - DNA, 21 bp, Homo sapiens
ctgtgtggccacttctgtcca

SEQ ID NO: 3054034 - DNA, 20 bp, Homo sapiens
ctgtgtggggttctcagtgc

SEQ ID NO: 3054035 - DNA, 22 bp, Homo sapiens
ctgtgtggggttctcagtgccg

SEQ ID NO: 3054036 - DNA, 22 bp, Homo sapiens
ctgtgtgtcccaggcagggaga

SEQ ID NO: 3054037 - DNA, 16 bp, Homo sapiens
ctgtgtgtgacccctc

SEQ ID NO: 3054038 - DNA, 14 bp, Homo sapiens
ctgtgtgtgtgaat

SEQ ID NO: 3054039 - DNA, 18 bp, Homo sapiens
ctgtgtgtgtgaatgaac

SEQ ID NO: 3054040 - DNA, 21 bp, Homo sapiens
ctgtgtgtgtgaatgaacact

SEQ ID NO: 3054041 - DNA, 19 bp, Homo sapiens
ctgtgtgtgtggcgtggcc

SEQ ID NO: 3054042 - DNA, 20 bp, Homo sapiens
ctgtgtgtgtggcgtggccc

SEQ ID NO: 3054043 - DNA, 21 bp, Homo sapiens
ctgtgtgtgtgtgtgtgcgtg

SEQ ID NO: 3054044 - DNA, 23 bp, Homo sapiens
ctgtgtgtgtgtgtgtgcgtgtg

SEQ ID NO: 3054045 - DNA, 16 bp, Homo sapiens
ctgtgttaactgttca

SEQ ID NO: 3054046 - DNA, 19 bp, Homo sapiens
ctgtgttacttgaagtaac

SEQ ID NO: 3054047 - DNA, 17 bp, Homo sapiens
ctgtgttctaacttatt

SEQ ID NO: 3054048 - DNA, 20 bp, Homo sapiens
ctgtgttgaaacagaaaaat

SEQ ID NO: 3054049 - DNA, 17 bp, Homo sapiens
ctgtgttgactgctgct

SEQ ID NO: 3054050 - DNA, 19 bp, Homo sapiens
ctgtgttgttgcttcttgt

SEQ ID NO: 3054051 - DNA, 17 bp, Homo sapiens
ctgtgtttctgtgctcc

SEQ ID NO: 3054052 - DNA, 17 bp, Homo sapiens
ctgtgtttggctttcag

SEQ ID NO: 3054053 - DNA, 18 bp, Homo sapiens
ctgtgttttataaaatag

SEQ ID NO: 3054054 - DNA, 13 bp, Homo sapiens
ctgtgttttgtga

SEQ ID NO: 3054055 - DNA, 15 bp, Homo sapiens
ctgtgttttgtgagg

SEQ ID NO: 3054056 - DNA, 13 bp, Homo sapiens
ctgttaaccaaat

SEQ ID NO: 3054057 - DNA, 20 bp, Homo sapiens
ctgttaaccaaataaaacat

SEQ ID NO: 3054058 - DNA, 21 bp, Homo sapiens
ctgttacctgatcaatgacag

SEQ ID NO: 3054059 - DNA, 21 bp, Homo sapiens
ctgttacctgtcttgctcctg

SEQ ID NO: 3054060 - DNA, 19 bp, Homo sapiens
ctgttacgacaaagaaaca

SEQ ID NO: 3054061 - DNA, 21 bp, Homo sapiens
ctgttactaaatccttttgtt

SEQ ID NO: 3054062 - DNA, 16 bp, Homo sapiens
ctgttactgggccctg

SEQ ID NO: 3054063 - DNA, 20 bp, Homo sapiens
ctgttactgggccctgagtc

SEQ ID NO: 3054064 - DNA, 22 bp, Homo sapiens
ctgttaggccaactgcctcctt

SEQ ID NO: 3054065 - DNA, 19 bp, Homo sapiens
ctgttatccatattacgtt

SEQ ID NO: 3054066 - DNA, 20 bp, Homo sapiens
ctgttattttcaagtagctg

SEQ ID NO: 3054067 - DNA, 16 bp, Homo sapiens
ctgttcaacatcactg

SEQ ID NO: 3054068 - DNA, 20 bp, Homo sapiens
ctgttcacagaaaaagcatg

SEQ ID NO: 3054069 - DNA, 15 bp, Homo sapiens
ctgttcactgcattc

SEQ ID NO: 3054070 - DNA, 16 bp, Homo sapiens
ctgttcactgcattca

SEQ ID NO: 3054071 - DNA, 14 bp, Homo sapiens
ctgttcagcttttc

SEQ ID NO: 3054072 - DNA, 19 bp, Homo sapiens
ctgttcagttacagaaagt

SEQ ID NO: 3054073 - DNA, 21 bp, Homo sapiens
ctgttcatagatattggaaga

SEQ ID NO: 3054074 - DNA, 18 bp, Homo sapiens
ctgttccaatgaaaaaat

SEQ ID NO: 3054075 - DNA, 20 bp, Homo sapiens
ctgttcccatgtagccccct

SEQ ID NO: 3054076 - DNA, 15 bp, Homo sapiens
ctgttccccctgtgc

SEQ ID NO: 3054077 - DNA, 16 bp, Homo sapiens
ctgttccccctgtgca

SEQ ID NO: 3054078 - DNA, 18 bp, Homo sapiens
ctgttcctccctcccaca

SEQ ID NO: 3054079 - DNA, 15 bp, Homo sapiens
ctgttccttcacatc

SEQ ID NO: 3054080 - DNA, 16 bp, Homo sapiens
ctgttctaaagctctg

SEQ ID NO: 3054081 - DNA, 15 bp, Homo sapiens
ctgttctaacatgta

SEQ ID NO: 3054082 - DNA, 16 bp, Homo sapiens
ctgttctcgttgccct

SEQ ID NO: 3054083 - DNA, 17 bp, Homo sapiens
ctgttctcgttgcccta

SEQ ID NO: 3054084 - DNA, 23 bp, Homo sapiens
ctgttctcgttgccctaattcat

SEQ ID NO: 3054085 - DNA, 15 bp, Homo sapiens
ctgttctcttgggaa

SEQ ID NO: 3054086 - DNA, 17 bp, Homo sapiens
ctgttctgccccctcag

SEQ ID NO: 3054087 - DNA, 14 bp, Homo sapiens
ctgttctgtagctt

SEQ ID NO: 3054088 - DNA, 15 bp, Homo sapiens
ctgttctgtggaaag

SEQ ID NO: 3054089 - DNA, 21 bp, Homo sapiens
ctgttctgtttcaaggcactc

SEQ ID NO: 3054090 - DNA, 18 bp, Homo sapiens
ctgttctttaagactttt

SEQ ID NO: 3054091 - DNA, 16 bp, Homo sapiens
ctgttgaaagcaaaaa

SEQ ID NO: 3054092 - DNA, 15 bp, Homo sapiens
ctgttgaatatttag

SEQ ID NO: 3054093 - DNA, 17 bp, Homo sapiens
ctgttgaatttcccaca

SEQ ID NO: 3054094 - DNA, 16 bp, Homo sapiens
ctgttgacatatttaa

SEQ ID NO: 3054095 - DNA, 19 bp, Homo sapiens
ctgttgacatatttaatgt

SEQ ID NO: 3054096 - DNA, 20 bp, Homo sapiens
ctgttgacatatttaatgtt

SEQ ID NO: 3054097 - DNA, 18 bp, Homo sapiens
ctgttgactcttccattc

SEQ ID NO: 3054098 - DNA, 17 bp, Homo sapiens
ctgttgagcatcacaga

SEQ ID NO: 3054099 - DNA, 18 bp, Homo sapiens
ctgttgataattcttatt

SEQ ID NO: 3054100 - DNA, 14 bp, Homo sapiens
ctgttgattgctaa

SEQ ID NO: 3054101 - DNA, 22 bp, Homo sapiens
ctgttgcctcctctctccctgc

SEQ ID NO: 3054102 - DNA, 23 bp, Homo sapiens
ctgttgcctcctctctccctgcc

SEQ ID NO: 3054103 - DNA, 14 bp, Homo sapiens
ctgttgctccagga

SEQ ID NO: 3054104 - DNA, 23 bp, Homo sapiens
ctgttgctccaggatgcattctg

SEQ ID NO: 3054105 - DNA, 15 bp, Homo sapiens
ctgttgcttacaatt

SEQ ID NO: 3054106 - DNA, 16 bp, Homo sapiens
ctgttgcttacaattt

SEQ ID NO: 3054107 - DNA, 14 bp, Homo sapiens
ctgttggctgctgc

SEQ ID NO: 3054108 - DNA, 16 bp, Homo sapiens
ctgttggctgctgcca

SEQ ID NO: 3054109 - DNA, 17 bp, Homo sapiens
ctgttgggaacagcatg

SEQ ID NO: 3054110 - DNA, 12 bp, Homo sapiens
ctgttgggagaa

SEQ ID NO: 3054111 - DNA, 17 bp, Homo sapiens
ctgttgggagaaagcaa

SEQ ID NO: 3054112 - DNA, 18 bp, Homo sapiens
ctgttggtcctctctctg

SEQ ID NO: 3054113 - DNA, 14 bp, Homo sapiens
ctgttgtctagagc

SEQ ID NO: 3054114 - DNA, 16 bp, Homo sapiens
ctgttgtgccacagag

SEQ ID NO: 3054115 - DNA, 23 bp, Homo sapiens
ctgttgtgccacagagtgtagcc

SEQ ID NO: 3054116 - DNA, 18 bp, Homo sapiens
ctgttgtgttcaccagag

SEQ ID NO: 3054117 - DNA, 14 bp, Homo sapiens
ctgttgtttgaaga

SEQ ID NO: 3054118 - DNA, 21 bp, Homo sapiens
ctgtttagcttcctccagagg

SEQ ID NO: 3054119 - DNA, 23 bp, Homo sapiens
ctgtttagcttcctccagaggag

SEQ ID NO: 3054120 - DNA, 14 bp, Homo sapiens
ctgtttattgccat

SEQ ID NO: 3054121 - DNA, 17 bp, Homo sapiens
ctgtttcaatcactgtc

SEQ ID NO: 3054122 - DNA, 22 bp, Homo sapiens
ctgtttcactgaaatgtttgga

SEQ ID NO: 3054123 - DNA, 19 bp, Homo sapiens
ctgtttcctgacattgtct

SEQ ID NO: 3054124 - DNA, 15 bp, Homo sapiens
ctgtttcctgctgct

SEQ ID NO: 3054125 - DNA, 15 bp, Homo sapiens
ctgtttccttgcctg

SEQ ID NO: 3054126 - DNA, 16 bp, Homo sapiens
ctgtttctgaaaagaa

SEQ ID NO: 3054127 - DNA, 21 bp, Homo sapiens
ctgtttgcttcaccgtggatt

SEQ ID NO: 3054128 - DNA, 15 bp, Homo sapiens
ctgtttgcttttgaa

SEQ ID NO: 3054129 - DNA, 19 bp, Homo sapiens
ctgtttggatttttaatta

SEQ ID NO: 3054130 - DNA, 21 bp, Homo sapiens
ctgtttggatttttaattaaa

SEQ ID NO: 3054131 - DNA, 15 bp, Homo sapiens
ctgtttgtatgaaat

SEQ ID NO: 3054132 - DNA, 24 bp, Homo sapiens
ctgtttgtttttaaaaagcaaatc

SEQ ID NO: 3054133 - DNA, 21 bp, Homo sapiens
cttaaataataaacagtggaa

SEQ ID NO: 3054134 - DNA, 20 bp, Homo sapiens
cttaaatatatgatttatat

SEQ ID NO: 3054135 - DNA, 19 bp, Homo sapiens
cttaaatcagaataaatta

SEQ ID NO: 3054136 - DNA, 21 bp, Homo sapiens
cttaaatcagaataaattaat

SEQ ID NO: 3054137 - DNA, 23 bp, Homo sapiens
cttaaatcagtttattaaatctg

SEQ ID NO: 3054138 - DNA, 13 bp, Homo sapiens
cttaaatctttct

SEQ ID NO: 3054139 - DNA, 16 bp, Homo sapiens
cttaaatctttcttca

SEQ ID NO: 3054140 - DNA, 15 bp, Homo sapiens
cttaacaaaccaaca

SEQ ID NO: 3054141 - DNA, 22 bp, Homo sapiens
cttaacaactgactaaccattg

SEQ ID NO: 3054142 - DNA, 13 bp, Homo sapiens
cttaacctttgct

SEQ ID NO: 3054143 - DNA, 17 bp, Homo sapiens
cttaactaagactcccg

SEQ ID NO: 3054144 - DNA, 20 bp, Homo sapiens
cttaactaagactcccgccc

SEQ ID NO: 3054145 - DNA, 19 bp, Homo sapiens
cttaactacttatctctaa

SEQ ID NO: 3054146 - DNA, 19 bp, Homo sapiens
cttaactgcatttttagac

SEQ ID NO: 3054147 - DNA, 12 bp, Homo sapiens
cttaacttgttt

SEQ ID NO: 3054148 - DNA, 22 bp, Homo sapiens
cttaagatttttcttttccgca

SEQ ID NO: 3054149 - DNA, 15 bp, Homo sapiens
cttaagccatcttgg

SEQ ID NO: 3054150 - DNA, 20 bp, Homo sapiens
cttaagccatcttggtaaat

SEQ ID NO: 3054151 - DNA, 23 bp, Homo sapiens
cttaagccatcttggtaaatttc

SEQ ID NO: 3054152 - DNA, 16 bp, Homo sapiens
cttaagccctggcccc

SEQ ID NO: 3054153 - DNA, 13 bp, Homo sapiens
cttaagctttgga

SEQ ID NO: 3054154 - DNA, 22 bp, Homo sapiens
cttaagctttggacccaaggaa

SEQ ID NO: 3054155 - DNA, 16 bp, Homo sapiens
cttaaggcactctgtt

SEQ ID NO: 3054156 - DNA, 22 bp, Homo sapiens
cttaagggaatatgcattgtct

SEQ ID NO: 3054157 - DNA, 18 bp, Homo sapiens
cttaagtcagaacagcag

SEQ ID NO: 3054158 - DNA, 23 bp, Homo sapiens
cttaagtcctaaaagttctcaat

SEQ ID NO: 3054159 - DNA, 14 bp, Homo sapiens
cttaataaaaatga

SEQ ID NO: 3054160 - DNA, 18 bp, Homo sapiens
cttaataaaaatgacaga

SEQ ID NO: 3054161 - DNA, 14 bp, Homo sapiens
cttaataaaacatt

SEQ ID NO: 3054162 - DNA, 19 bp, Homo sapiens
cttaataataattgaagaa

SEQ ID NO: 3054163 - DNA, 17 bp, Homo sapiens
cttaatactgaatttct

SEQ ID NO: 3054164 - DNA, 18 bp, Homo sapiens
cttaatattagcttgctt

SEQ ID NO: 3054165 - DNA, 20 bp, Homo sapiens
cttaatcattttcattccta

SEQ ID NO: 3054166 - DNA, 13 bp, Homo sapiens
cttaattcaaata

SEQ ID NO: 3054167 - DNA, 14 bp, Homo sapiens
cttaatttatttct

SEQ ID NO: 3054168 - DNA, 16 bp, Homo sapiens
cttaatttggataata

SEQ ID NO: 3054169 - DNA, 19 bp, Homo sapiens
cttaatttggataataaaa

SEQ ID NO: 3054170 - DNA, 15 bp, Homo sapiens
cttaatttggatcta

SEQ ID NO: 3054171 - DNA, 20 bp, Homo sapiens
cttaatttggatctatttat

SEQ ID NO: 3054172 - DNA, 16 bp, Homo sapiens
cttaattttggttgta

SEQ ID NO: 3054173 - DNA, 11 bp, Homo sapiens
cttacaaaatc

SEQ ID NO: 3054174 - DNA, 19 bp, Homo sapiens
cttacaaaatcctggaaga

SEQ ID NO: 3054175 - DNA, 18 bp, Homo sapiens
cttacaagaaaggcctga

SEQ ID NO: 3054176 - DNA, 16 bp, Homo sapiens
cttacaagccagctgg

SEQ ID NO: 3054177 - DNA, 16 bp, Homo sapiens
cttacaaggcaggcct

SEQ ID NO: 3054178 - DNA, 21 bp, Homo sapiens
cttacaatttttttaattttg

SEQ ID NO: 3054179 - DNA, 20 bp, Homo sapiens
cttacagcacatcacctctt

SEQ ID NO: 3054180 - DNA, 15 bp, Homo sapiens
cttacagcctctgac

SEQ ID NO: 3054181 - DNA, 21 bp, Homo sapiens
cttacaggcatggacatgcag

SEQ ID NO: 3054182 - DNA, 17 bp, Homo sapiens
cttacagtaaatgaact

SEQ ID NO: 3054183 - DNA, 20 bp, Homo sapiens
cttacatactaggtgccttt

SEQ ID NO: 3054184 - DNA, 14 bp, Homo sapiens
cttacatgttttct

SEQ ID NO: 3054185 - DNA, 21 bp, Homo sapiens
cttacatgttttctttgcttt

SEQ ID NO: 3054186 - DNA, 20 bp, Homo sapiens
cttacattctctaataagaa

SEQ ID NO: 3054187 - DNA, 23 bp, Homo sapiens
cttacattctctaataagaaaac

SEQ ID NO: 3054188 - DNA, 13 bp, Homo sapiens
cttacattgaaaa

SEQ ID NO: 3054189 - DNA, 15 bp, Homo sapiens
cttacattgaaaaca

SEQ ID NO: 3054190 - DNA, 23 bp, Homo sapiens
cttacattgcctgactaaaatgt

SEQ ID NO: 3054191 - DNA, 15 bp, Homo sapiens
cttaccagtctcctc

SEQ ID NO: 3054192 - DNA, 15 bp, Homo sapiens
cttacccatcttgct

SEQ ID NO: 3054193 - DNA, 21 bp, Homo sapiens
cttacccttagaatccacgta

SEQ ID NO: 3054194 - DNA, 16 bp, Homo sapiens
cttacgatcaggcaca

SEQ ID NO: 3054195 - DNA, 17 bp, Homo sapiens
cttacgatcaggcacag

SEQ ID NO: 3054196 - DNA, 23 bp, Homo sapiens
cttacgtgttagacaagaactat

SEQ ID NO: 3054197 - DNA, 15 bp, Homo sapiens
cttactacagaaatg

SEQ ID NO: 3054198 - DNA, 14 bp, Homo sapiens
cttactcagagctg

SEQ ID NO: 3054199 - DNA, 20 bp, Homo sapiens
cttactcagagctgcgggct

SEQ ID NO: 3054200 - DNA, 17 bp, Homo sapiens
cttactcgtataccgtg

SEQ ID NO: 3054201 - DNA, 13 bp, Homo sapiens
cttactgcagaat

SEQ ID NO: 3054202 - DNA, 22 bp, Homo sapiens
cttactgctatctactaagttt

SEQ ID NO: 3054203 - DNA, 15 bp, Homo sapiens
cttacttccagcaaa

SEQ ID NO: 3054204 - DNA, 16 bp, Homo sapiens
cttacttccagcaaaa

SEQ ID NO: 3054205 - DNA, 20 bp, Homo sapiens
cttacttccagcaaaatcca

SEQ ID NO: 3054206 - DNA, 16 bp, Homo sapiens
cttacttcccccaccc

SEQ ID NO: 3054207 - DNA, 15 bp, Homo sapiens
cttacttcttgccct

SEQ ID NO: 3054208 - DNA, 16 bp, Homo sapiens
cttagaaacaatgttt

SEQ ID NO: 3054209 - DNA, 21 bp, Homo sapiens
cttagaaacacataaattatg

SEQ ID NO: 3054210 - DNA, 17 bp, Homo sapiens
cttagaacctttctgtg

SEQ ID NO: 3054211 - DNA, 18 bp, Homo sapiens
cttagaagtggaccagga

SEQ ID NO: 3054212 - DNA, 18 bp, Homo sapiens
cttagaatgcatctcatc

SEQ ID NO: 3054213 - DNA, 16 bp, Homo sapiens
cttagaccttccataa

SEQ ID NO: 3054214 - DNA, 19 bp, Homo sapiens
cttagagggatttctttgc

SEQ ID NO: 3054215 - DNA, 14 bp, Homo sapiens
cttagatattaaaa

SEQ ID NO: 3054216 - DNA, 15 bp, Homo sapiens
cttagatattaaaat

SEQ ID NO: 3054217 - DNA, 15 bp, Homo sapiens
cttagatatttcatg

SEQ ID NO: 3054218 - DNA, 16 bp, Homo sapiens
cttagatggattctcc

SEQ ID NO: 3054219 - DNA, 20 bp, Homo sapiens
cttagatgttccagtaatct

SEQ ID NO: 3054220 - DNA, 16 bp, Homo sapiens
cttagattcaggggaa

SEQ ID NO: 3054221 - DNA, 11 bp, Homo sapiens
cttagattctc

SEQ ID NO: 3054222 - DNA, 24 bp, Homo sapiens
cttagattctctgtgtctaagatt

SEQ ID NO: 3054223 - DNA, 17 bp, Homo sapiens
cttagattgaagtaaac

SEQ ID NO: 3054224 - DNA, 13 bp, Homo sapiens
cttagattttctg

SEQ ID NO: 3054225 - DNA, 15 bp, Homo sapiens
cttagcagcccagca

SEQ ID NO: 3054226 - DNA, 21 bp, Homo sapiens
cttagcaggagaggagagcca

SEQ ID NO: 3054227 - DNA, 14 bp, Homo sapiens
cttagccttgctgt

SEQ ID NO: 3054228 - DNA, 21 bp, Homo sapiens
cttagccttgctgtagagact

SEQ ID NO: 3054229 - DNA, 14 bp, Homo sapiens
cttagctactgtat

SEQ ID NO: 3054230 - DNA, 12 bp, Homo sapiens
cttagctctgga

SEQ ID NO: 3054231 - DNA, 14 bp, Homo sapiens
cttagctctggacg

SEQ ID NO: 3054232 - DNA, 19 bp, Homo sapiens
cttagctctggacgtgaaa

SEQ ID NO: 3054233 - DNA, 12 bp, Homo sapiens
cttagctgccat

SEQ ID NO: 3054234 - DNA, 20 bp, Homo sapiens
cttagctgccatcttgcttt

SEQ ID NO: 3054235 - DNA, 12 bp, Homo sapiens
cttagctggcca

SEQ ID NO: 3054236 - DNA, 11 bp, Homo sapiens
cttagcttcag

SEQ ID NO: 3054237 - DNA, 15 bp, Homo sapiens
cttagcttcaggaac

SEQ ID NO: 3054238 - DNA, 22 bp, Homo sapiens
cttaggagacagatcactcctg

SEQ ID NO: 3054239 - DNA, 13 bp, Homo sapiens
cttaggccttcct

SEQ ID NO: 3054240 - DNA, 17 bp, Homo sapiens
cttaggccttcctctct

SEQ ID NO: 3054241 - DNA, 16 bp, Homo sapiens
cttaggctgctgggat

SEQ ID NO: 3054242 - DNA, 12 bp, Homo sapiens
cttagggaaaga

SEQ ID NO: 3054243 - DNA, 13 bp, Homo sapiens
cttagggagcccc

SEQ ID NO: 3054244 - DNA, 16 bp, Homo sapiens
cttaggggctgctgac

SEQ ID NO: 3054245 - DNA, 11 bp, Homo sapiens
cttaggtcttc

SEQ ID NO: 3054246 - DNA, 16 bp, Homo sapiens
cttaggtcttcctgtg

SEQ ID NO: 3054247 - DNA, 20 bp, Homo sapiens
cttaggtcttcctgtggctc

SEQ ID NO: 3054248 - DNA, 15 bp, Homo sapiens
ctgggcaaagcctag

SEQ ID NO: 3054249 - DNA, 16 bp, Homo sapiens
ctgggcacacgcctcc

SEQ ID NO: 3054250 - DNA, 18 bp, Homo sapiens
ctgggcacctgcgcacag

SEQ ID NO: 3054251 - DNA, 21 bp, Homo sapiens
ctgggcacctgcgcacaggtg

SEQ ID NO: 3054252 - DNA, 12 bp, Homo sapiens
ctgggcacttcc

SEQ ID NO: 3054253 - DNA, 17 bp, Homo sapiens
ctgggcacttccctgct

SEQ ID NO: 3054254 - DNA, 22 bp, Homo sapiens
ctgggcacttccctgctgcctg

SEQ ID NO: 3054255 - DNA, 17 bp, Homo sapiens
ctgggcagctgtccctt

SEQ ID NO: 3054256 - DNA, 17 bp, Homo sapiens
ctgggcattgctttcca

SEQ ID NO: 3054257 - DNA, 11 bp, Homo sapiens
ctgggccatgg

SEQ ID NO: 3054258 - DNA, 20 bp, Homo sapiens
ctgggcccacagcccccacc

SEQ ID NO: 3054259 - DNA, 18 bp, Homo sapiens
ctgggcccagcaggggcc

SEQ ID NO: 3054260 - DNA, 15 bp, Homo sapiens
ctgggcccaggcagg

SEQ ID NO: 3054261 - DNA, 13 bp, Homo sapiens
ctgggccccagct

SEQ ID NO: 3054262 - DNA, 13 bp, Homo sapiens
ctgggcccctcag

SEQ ID NO: 3054263 - DNA, 22 bp, Homo sapiens
ctgggcccctcaggggaagctg

SEQ ID NO: 3054264 - DNA, 13 bp, Homo sapiens
ctgggcccctccc

SEQ ID NO: 3054265 - DNA, 15 bp, Homo sapiens
ctgggcccctcccct

SEQ ID NO: 3054266 - DNA, 18 bp, Homo sapiens
ctgggcccctcccctcag

SEQ ID NO: 3054267 - DNA, 14 bp, Homo sapiens
ctgggccgcaaggg

SEQ ID NO: 3054268 - DNA, 21 bp, Homo sapiens
ctgggccgcaagggcctggac

SEQ ID NO: 3054269 - DNA, 17 bp, Homo sapiens
ctgggccggagggtcag

SEQ ID NO: 3054270 - DNA, 20 bp, Homo sapiens
ctgggcctgaccaaacagcc

SEQ ID NO: 3054271 - DNA, 13 bp, Homo sapiens
ctgggcctgcaga

SEQ ID NO: 3054272 - DNA, 20 bp, Homo sapiens
ctgggcctggcagctcagct

SEQ ID NO: 3054273 - DNA, 14 bp, Homo sapiens
ctgggccttctcag

SEQ ID NO: 3054274 - DNA, 15 bp, Homo sapiens
ctgggccttctcagc

SEQ ID NO: 3054275 - DNA, 15 bp, Homo sapiens
ctgggcgcggtggct

SEQ ID NO: 3054276 - DNA, 23 bp, Homo sapiens
ctgggcgtagtggctcacacctg

SEQ ID NO: 3054277 - DNA, 14 bp, Homo sapiens
ctgggctaccccac

SEQ ID NO: 3054278 - DNA, 18 bp, Homo sapiens
ctgggctatattcctgac

SEQ ID NO: 3054279 - DNA, 15 bp, Homo sapiens
ctgggctctccacct

SEQ ID NO: 3054280 - DNA, 21 bp, Homo sapiens
ctgggctctccacctcagcct

SEQ ID NO: 3054281 - DNA, 15 bp, Homo sapiens
ctgggctctggctct

SEQ ID NO: 3054282 - DNA, 20 bp, Homo sapiens
ctgggctcttaactgttgct

SEQ ID NO: 3054283 - DNA, 13 bp, Homo sapiens
ctgggctgagcca

SEQ ID NO: 3054284 - DNA, 22 bp, Homo sapiens
ctgggcttggcccgcggcctgc

SEQ ID NO: 3054285 - DNA, 19 bp, Homo sapiens
ctggggaaagacactgcct

SEQ ID NO: 3054286 - DNA, 21 bp, Homo sapiens
ctggggaaagacactgcctgg

SEQ ID NO: 3054287 - DNA, 23 bp, Homo sapiens
ctggggaaagacactgcctgggc

SEQ ID NO: 3054288 - DNA, 17 bp, Homo sapiens
ctggggaaataacagct

SEQ ID NO: 3054289 - DNA, 19 bp, Homo sapiens
ctggggacgctccgctgcc

SEQ ID NO: 3054290 - DNA, 22 bp, Homo sapiens
ctggggagaaagaggggcctga

SEQ ID NO: 3054291 - DNA, 15 bp, Homo sapiens
ctggggaggctgagg

SEQ ID NO: 3054292 - DNA, 19 bp, Homo sapiens
ctggggaggctgaggcagg

SEQ ID NO: 3054293 - DNA, 13 bp, Homo sapiens
ctggggagggggt

SEQ ID NO: 3054294 - DNA, 21 bp, Homo sapiens
ctggggaggtgggaggccagg

SEQ ID NO: 3054295 - DNA, 16 bp, Homo sapiens
ctggggattgggcccc

SEQ ID NO: 3054296 - DNA, 13 bp, Homo sapiens
ctggggcactccc

SEQ ID NO: 3054297 - DNA, 16 bp, Homo sapiens
ctggggcactccccca

SEQ ID NO: 3054298 - DNA, 17 bp, Homo sapiens
ctggggcactcccccag

SEQ ID NO: 3054299 - DNA, 14 bp, Homo sapiens
ctggggccaggccg

SEQ ID NO: 3054300 - DNA, 11 bp, Homo sapiens
ctggggcctcc

SEQ ID NO: 3054301 - DNA, 15 bp, Homo sapiens
ctggggcctccagaa

SEQ ID NO: 3054302 - DNA, 17 bp, Homo sapiens
ctggggcctccagaact

SEQ ID NO: 3054303 - DNA, 13 bp, Homo sapiens
ctggggcgggcag

SEQ ID NO: 3054304 - DNA, 14 bp, Homo sapiens
ctggggctggcttt

SEQ ID NO: 3054305 - DNA, 12 bp, Homo sapiens
ctggggctggtg

SEQ ID NO: 3054306 - DNA, 16 bp, Homo sapiens
ctggggctggtgaggc

SEQ ID NO: 3054307 - DNA, 13 bp, Homo sapiens
ctgggggaaaaag

SEQ ID NO: 3054308 - DNA, 14 bp, Homo sapiens
ctgggggaagccct

SEQ ID NO: 3054309 - DNA, 19 bp, Homo sapiens
ctgggggacccctggctct

SEQ ID NO: 3054310 - DNA, 22 bp, Homo sapiens
ctgtccatctgcccgcctgccc

SEQ ID NO: 3054311 - DNA, 21 bp, Homo sapiens
ctgtccattttcttttaaagt

SEQ ID NO: 3054312 - DNA, 19 bp, Homo sapiens
ctgtcccaagctcccaaga

SEQ ID NO: 3054313 - DNA, 21 bp, Homo sapiens
ctgtcccagtagccaaggccc

SEQ ID NO: 3054314 - DNA, 16 bp, Homo sapiens
ctgtccccacgagggg

SEQ ID NO: 3054315 - DNA, 17 bp, Homo sapiens
ctgtccccacgagggga

SEQ ID NO: 3054316 - DNA, 13 bp, Homo sapiens
ctgtccccaggcc

SEQ ID NO: 3054317 - DNA, 14 bp, Homo sapiens
ctgtccccaggcct

SEQ ID NO: 3054318 - DNA, 23 bp, Homo sapiens
ctgtccccgcagccctggcaggg

SEQ ID NO: 3054319 - DNA, 16 bp, Homo sapiens
ctgtccccgccttccc

SEQ ID NO: 3054320 - DNA, 14 bp, Homo sapiens
ctgtcccctcacag

SEQ ID NO: 3054321 - DNA, 17 bp, Homo sapiens
ctgtcccctcacagact

SEQ ID NO: 3054322 - DNA, 22 bp, Homo sapiens
ctgtcccctcacagactcttcc

SEQ ID NO: 3054323 - DNA, 12 bp, Homo sapiens
ctgtcccctgga

SEQ ID NO: 3054324 - DNA, 15 bp, Homo sapiens
ctgtcccctggggct

SEQ ID NO: 3054325 - DNA, 16 bp, Homo sapiens
ctgtcccctggggctg

SEQ ID NO: 3054326 - DNA, 19 bp, Homo sapiens
ctgtcccctggggctggtg

SEQ ID NO: 3054327 - DNA, 21 bp, Homo sapiens
ctgtcccctggggctggtgga

SEQ ID NO: 3054328 - DNA, 12 bp, Homo sapiens
ctgtccctcaca

SEQ ID NO: 3054329 - DNA, 13 bp, Homo sapiens
ctgtccctcacag

SEQ ID NO: 3054330 - DNA, 17 bp, Homo sapiens
ctgtccctgcactgtgc

SEQ ID NO: 3054331 - DNA, 18 bp, Homo sapiens
ctgtccctgcactgtgcc

SEQ ID NO: 3054332 - DNA, 17 bp, Homo sapiens
ctgtccctgctttctgg

SEQ ID NO: 3054333 - DNA, 17 bp, Homo sapiens
ctgtccctgtcaccaag

SEQ ID NO: 3054334 - DNA, 20 bp, Homo sapiens
ctgtccggaatgccacccac

SEQ ID NO: 3054335 - DNA, 16 bp, Homo sapiens
ctgtcctagtctcctt

SEQ ID NO: 3054336 - DNA, 19 bp, Homo sapiens
ctgtcctagtctcctttga

SEQ ID NO: 3054337 - DNA, 22 bp, Homo sapiens
ctgtcctagtctcctttgaagt

SEQ ID NO: 3054338 - DNA, 16 bp, Homo sapiens
ctgtcctatgaatgct

SEQ ID NO: 3054339 - DNA, 13 bp, Homo sapiens
ctgtcctcagcct

SEQ ID NO: 3054340 - DNA, 18 bp, Homo sapiens
ctgtcctcagccttgcca

SEQ ID NO: 3054341 - DNA, 12 bp, Homo sapiens
ctgtcctcaggt

SEQ ID NO: 3054342 - DNA, 18 bp, Homo sapiens
ctgtcctcaggtggccat

SEQ ID NO: 3054343 - DNA, 12 bp, Homo sapiens
ctgtcctccaag

SEQ ID NO: 3054344 - DNA, 12 bp, Homo sapiens
ctgtcctcctcg

SEQ ID NO: 3054345 - DNA, 14 bp, Homo sapiens
ctgtcctctgtagt

SEQ ID NO: 3054346 - DNA, 20 bp, Homo sapiens
ctgtcctgacagcactcctc

SEQ ID NO: 3054347 - DNA, 20 bp, Homo sapiens
ctgtcctgccatgcaagaac

SEQ ID NO: 3054348 - DNA, 18 bp, Homo sapiens
ctgtcctgggcctgcaga

SEQ ID NO: 3054349 - DNA, 17 bp, Homo sapiens
ctgtcctggtggctggg

SEQ ID NO: 3054350 - DNA, 22 bp, Homo sapiens
ctgtcctggtggctgggcccag

SEQ ID NO: 3054351 - DNA, 23 bp, Homo sapiens
ctgtcctggtggctgggcccagc

SEQ ID NO: 3054352 - DNA, 21 bp, Homo sapiens
ctgtcctgtgaggtttcccaa

SEQ ID NO: 3054353 - DNA, 22 bp, Homo sapiens
ctgtcctgtgaggtttcccaat

SEQ ID NO: 3054354 - DNA, 12 bp, Homo sapiens
ctgtccttaccc

SEQ ID NO: 3054355 - DNA, 21 bp, Homo sapiens
ctgtccttctgaagtgtgtcc

SEQ ID NO: 3054356 - DNA, 19 bp, Homo sapiens
ctgtccttggcaactttct

SEQ ID NO: 3054357 - DNA, 13 bp, Homo sapiens
ctgtcctttctag

SEQ ID NO: 3054358 - DNA, 20 bp, Homo sapiens
ctgtcctttctagagcactg

SEQ ID NO: 3054359 - DNA, 21 bp, Homo sapiens
ctgtcctttctagagcactgc

SEQ ID NO: 3054360 - DNA, 15 bp, Homo sapiens
ctgtcgattagactg

SEQ ID NO: 3054361 - DNA, 20 bp, Homo sapiens
ctgtcgattagactggacag

SEQ ID NO: 3054362 - DNA, 23 bp, Homo sapiens
ctgtcgattagactggacagctt

SEQ ID NO: 3054363 - DNA, 22 bp, Homo sapiens
ctgtcgcgtctcattttgtcca

SEQ ID NO: 3054364 - DNA, 15 bp, Homo sapiens
ctgtcgggctttgtg

SEQ ID NO: 3054365 - DNA, 19 bp, Homo sapiens
ctgtcgggctttgtgtgaa

SEQ ID NO: 3054366 - DNA, 14 bp, Homo sapiens
ctgtcgggggccac

SEQ ID NO: 3054367 - DNA, 19 bp, Homo sapiens
ctgtcgggggccactgtgt

SEQ ID NO: 3054368 - DNA, 23 bp, Homo sapiens
ctgtcggtgtggacgctgtgctg

SEQ ID NO: 3054369 - DNA, 21 bp, Homo sapiens
ctgtctaagcagttttgtaaa

SEQ ID NO: 3054370 - DNA, 22 bp, Homo sapiens
ctgtctaagcagttttgtaaat

SEQ ID NO: 3054371 - DNA, 14 bp, Homo sapiens
ctgtctactttctc

SEQ ID NO: 3054372 - DNA, 17 bp, Homo sapiens
ctgtctagaatcctgct

SEQ ID NO: 3054373 - DNA, 20 bp, Homo sapiens
ctgtctagaatcctgcttta

SEQ ID NO: 3054374 - DNA, 16 bp, Homo sapiens
ctgtctagactggcct

SEQ ID NO: 3054375 - DNA, 13 bp, Homo sapiens
ctgtctagagagg

SEQ ID NO: 3054376 - DNA, 14 bp, Homo sapiens
ctgtctagcatgcc

SEQ ID NO: 3054377 - DNA, 18 bp, Homo sapiens
ctgtctagcatgccaaca

SEQ ID NO: 3054378 - DNA, 21 bp, Homo sapiens
ctgtctagcatgccaacaaga

SEQ ID NO: 3054379 - DNA, 14 bp, Homo sapiens
ctgtctagccttag

SEQ ID NO: 3054380 - DNA, 20 bp, Homo sapiens
ctgtctatttttgtttttta

SEQ ID NO: 3054381 - DNA, 12 bp, Homo sapiens
ctgtctcagtga

SEQ ID NO: 3054382 - DNA, 15 bp, Homo sapiens
ctgtctcatccatca

SEQ ID NO: 3054383 - DNA, 13 bp, Homo sapiens
ctgtctcatttat

SEQ ID NO: 3054384 - DNA, 23 bp, Homo sapiens
ctgtctcctttcaccccagggcc

SEQ ID NO: 3054385 - DNA, 23 bp, Homo sapiens
ctgtctctaaaaagaagccacag

SEQ ID NO: 3054386 - DNA, 13 bp, Homo sapiens
ctgtctctctggg

SEQ ID NO: 3054387 - DNA, 15 bp, Homo sapiens
ctgtctctttccact

SEQ ID NO: 3054388 - DNA, 16 bp, Homo sapiens
ctgtctgaacaaaaac

SEQ ID NO: 3054389 - DNA, 12 bp, Homo sapiens
ctgtctgcagcc

SEQ ID NO: 3054390 - DNA, 18 bp, Homo sapiens
ctgtctgttacactggag

SEQ ID NO: 3054391 - DNA, 21 bp, Homo sapiens
ctgtcttacctggcagcaaac

SEQ ID NO: 3054392 - DNA, 22 bp, Homo sapiens
ctgtcttcacctgattcaacta

SEQ ID NO: 3054393 - DNA, 21 bp, Homo sapiens
ctgtcttcaggctctgcccag

SEQ ID NO: 3054394 - DNA, 23 bp, Homo sapiens
ctgtcttcggccgagctggtttc

SEQ ID NO: 3054395 - DNA, 16 bp, Homo sapiens
ctgtcttctctccact

SEQ ID NO: 3054396 - DNA, 22 bp, Homo sapiens
ctgtcttctctccacttctggt

SEQ ID NO: 3054397 - DNA, 15 bp, Homo sapiens
ctgtcttctggactg

SEQ ID NO: 3054398 - DNA, 23 bp, Homo sapiens
cttgttttaagcaaatgcattct

SEQ ID NO: 3054399 - DNA, 14 bp, Homo sapiens
cttgttttcagttt

SEQ ID NO: 3054400 - DNA, 19 bp, Homo sapiens
cttgttttgaaactagaaa

SEQ ID NO: 3054401 - DNA, 18 bp, Homo sapiens
cttgtttttccactactg

SEQ ID NO: 3054402 - DNA, 18 bp, Homo sapiens
cttgtttttggaaagaaa

SEQ ID NO: 3054403 - DNA, 15 bp, Homo sapiens
ctttaaaaagcagga

SEQ ID NO: 3054404 - DNA, 19 bp, Homo sapiens
ctttaaaactcgaaaataa

SEQ ID NO: 3054405 - DNA, 22 bp, Homo sapiens
ctttaaacctgtttttttttca

SEQ ID NO: 3054406 - DNA, 21 bp, Homo sapiens
ctttaaagccagtcatcatct

SEQ ID NO: 3054407 - DNA, 23 bp, Homo sapiens
ctttaaagtgactaatggcatga

SEQ ID NO: 3054408 - DNA, 14 bp, Homo sapiens
ctttaaattaaaat

SEQ ID NO: 3054409 - DNA, 22 bp, Homo sapiens
ctttaaattaaaattttatgac

SEQ ID NO: 3054410 - DNA, 17 bp, Homo sapiens
ctttaacctgaaccttg

SEQ ID NO: 3054411 - DNA, 22 bp, Homo sapiens
ctttaactcgttgcagtctgta

SEQ ID NO: 3054412 - DNA, 13 bp, Homo sapiens
ctttaagaatgaa

SEQ ID NO: 3054413 - DNA, 14 bp, Homo sapiens
ctttaagacatact

SEQ ID NO: 3054414 - DNA, 13 bp, Homo sapiens
ctttaagagactc

SEQ ID NO: 3054415 - DNA, 23 bp, Homo sapiens
ctttaagagactcactggtttta

SEQ ID NO: 3054416 - DNA, 20 bp, Homo sapiens
ctttaagcaaggtgtccctg

SEQ ID NO: 3054417 - DNA, 23 bp, Homo sapiens
ctttaagcaaggtgtccctgcct

SEQ ID NO: 3054418 - DNA, 20 bp, Homo sapiens
ctttaagcctgcattcttaa

SEQ ID NO: 3054419 - DNA, 15 bp, Homo sapiens
ctttaagtaaaaatc

SEQ ID NO: 3054420 - DNA, 20 bp, Homo sapiens
ctttaatatttccaatgtga

SEQ ID NO: 3054421 - DNA, 18 bp, Homo sapiens
ctttaatgctgtctttgt

SEQ ID NO: 3054422 - DNA, 23 bp, Homo sapiens
ctttaatttcaggaatcagaaat

SEQ ID NO: 3054423 - DNA, 22 bp, Homo sapiens
ctttacaggatcatgtaaatgc

SEQ ID NO: 3054424 - DNA, 14 bp, Homo sapiens
ctttaccaaacagc

SEQ ID NO: 3054425 - DNA, 16 bp, Homo sapiens
ctttaccaaacagcaa

SEQ ID NO: 3054426 - DNA, 23 bp, Homo sapiens
ctttaccaaacagcaaaccaaga

SEQ ID NO: 3054427 - DNA, 18 bp, Homo sapiens
ctttacccttgagccctc

SEQ ID NO: 3054428 - DNA, 19 bp, Homo sapiens
ctttacccttgagccctcc

SEQ ID NO: 3054429 - DNA, 17 bp, Homo sapiens
ctttaccttcatttcat

SEQ ID NO: 3054430 - DNA, 14 bp, Homo sapiens
ctttaccttcctca

SEQ ID NO: 3054431 - DNA, 18 bp, Homo sapiens
ctttacgctcatcaccta

SEQ ID NO: 3054432 - DNA, 18 bp, Homo sapiens
ctttacggacaccccctc

SEQ ID NO: 3054433 - DNA, 22 bp, Homo sapiens
ctttactaagatgacattgcta

SEQ ID NO: 3054434 - DNA, 17 bp, Homo sapiens
ctttactcctcacactt

SEQ ID NO: 3054435 - DNA, 18 bp, Homo sapiens
ctttactcctcacactta

SEQ ID NO: 3054436 - DNA, 16 bp, Homo sapiens
ctttactgaccctggg

SEQ ID NO: 3054437 - DNA, 19 bp, Homo sapiens
ctttactgaccctggggct

SEQ ID NO: 3054438 - DNA, 23 bp, Homo sapiens
ctttactgtggctgtctggatcc

SEQ ID NO: 3054439 - DNA, 12 bp, Homo sapiens
ctttactgtttg

SEQ ID NO: 3054440 - DNA, 15 bp, Homo sapiens
ctttactgtttgtta

SEQ ID NO: 3054441 - DNA, 17 bp, Homo sapiens
ctttactttagaagcac

SEQ ID NO: 3054442 - DNA, 13 bp, Homo sapiens
ctttagagaactg

SEQ ID NO: 3054443 - DNA, 19 bp, Homo sapiens
ctttagagaactgaaaaga

SEQ ID NO: 3054444 - DNA, 23 bp, Homo sapiens
ctttagcaaaaaaaacccatgtg

SEQ ID NO: 3054445 - DNA, 15 bp, Homo sapiens
ctttaggagcagtgg

SEQ ID NO: 3054446 - DNA, 18 bp, Homo sapiens
ctttaggctttcagctta

SEQ ID NO: 3054447 - DNA, 20 bp, Homo sapiens
ctttagggggtgggaggggg

SEQ ID NO: 3054448 - DNA, 17 bp, Homo sapiens
ctttagtacctgaaaag

SEQ ID NO: 3054449 - DNA, 17 bp, Homo sapiens
ctttagtgattgctttt

SEQ ID NO: 3054450 - DNA, 18 bp, Homo sapiens
ctttagttgaattccaag

SEQ ID NO: 3054451 - DNA, 19 bp, Homo sapiens
ctttagttgaattccaagt

SEQ ID NO: 3054452 - DNA, 17 bp, Homo sapiens
ctttatacaacagtgct

SEQ ID NO: 3054453 - DNA, 18 bp, Homo sapiens
ctttatacaacagtgcta

SEQ ID NO: 3054454 - DNA, 14 bp, Homo sapiens
ctttatactgtgaa

SEQ ID NO: 3054455 - DNA, 15 bp, Homo sapiens
ctttatactgtgaag

SEQ ID NO: 3054456 - DNA, 16 bp, Homo sapiens
ctttatacttaaacag

SEQ ID NO: 3054457 - DNA, 13 bp, Homo sapiens
ctttatagtaaaa

SEQ ID NO: 3054458 - DNA, 16 bp, Homo sapiens
ctttatataaggtcat

SEQ ID NO: 3054459 - DNA, 23 bp, Homo sapiens
ctttatatacaataatggaaaaa

SEQ ID NO: 3054460 - DNA, 23 bp, Homo sapiens
ctttatcaaggagatatatcagt

SEQ ID NO: 3054461 - DNA, 12 bp, Homo sapiens
ctttatcacctc

SEQ ID NO: 3054462 - DNA, 14 bp, Homo sapiens
ctttatccctgctt

SEQ ID NO: 3054463 - DNA, 17 bp, Homo sapiens
ctttatcctaaaaatct

SEQ ID NO: 3054464 - DNA, 22 bp, Homo sapiens
ctttatctaatacctctgtgtg

SEQ ID NO: 3054465 - DNA, 14 bp, Homo sapiens
ctttatgcatctct

SEQ ID NO: 3054466 - DNA, 14 bp, Homo sapiens
ctttattaccccct

SEQ ID NO: 3054467 - DNA, 11 bp, Homo sapiens
ctttattcaaa

SEQ ID NO: 3054468 - DNA, 18 bp, Homo sapiens
ctttattcttgaaagaag

SEQ ID NO: 3054469 - DNA, 21 bp, Homo sapiens
ctttattgaaaaaataaaaaa

SEQ ID NO: 3054470 - DNA, 15 bp, Homo sapiens
ctttattgccctaac

SEQ ID NO: 3054471 - DNA, 12 bp, Homo sapiens
ctttattggaaa

SEQ ID NO: 3054472 - DNA, 21 bp, Homo sapiens
ctttattgggtggaattatat

SEQ ID NO: 3054473 - DNA, 15 bp, Homo sapiens
ctttattgtcttggt

SEQ ID NO: 3054474 - DNA, 10 bp, Homo sapiens
ctttatttat

SEQ ID NO: 3054475 - DNA, 15 bp, Homo sapiens
ctttatttctgagca

SEQ ID NO: 3054476 - DNA, 21 bp, Homo sapiens
ctttatttctgagcaaagcat

SEQ ID NO: 3054477 - DNA, 11 bp, Homo sapiens
ctttattttct

SEQ ID NO: 3054478 - DNA, 15 bp, Homo sapiens
ctttcaaatttactg

SEQ ID NO: 3054479 - DNA, 21 bp, Homo sapiens
ctttcaaatttactgtcttaa

SEQ ID NO: 3054480 - DNA, 18 bp, Homo sapiens
ctttcacaaggtataata

SEQ ID NO: 3054481 - DNA, 20 bp, Homo sapiens
ctttcacaaggtataataag

SEQ ID NO: 3054482 - DNA, 18 bp, Homo sapiens
ctttcacacatctgggtg

SEQ ID NO: 3054483 - DNA, 23 bp, Homo sapiens
ctttcacacatctgggtgccctg

SEQ ID NO: 3054484 - DNA, 20 bp, Homo sapiens
ctttcagaactcacattggc

SEQ ID NO: 3054485 - DNA, 16 bp, Homo sapiens
ctttcagacttgccat

SEQ ID NO: 3054486 - DNA, 21 bp, Homo sapiens
ctttcagagtttggttaatca

SEQ ID NO: 3054487 - DNA, 17 bp, Homo sapiens
ctttcagcagactgatc

SEQ ID NO: 3054488 - DNA, 19 bp, Homo sapiens
ctttcagccacatgcccca

SEQ ID NO: 3054489 - DNA, 22 bp, Homo sapiens
ctttcagccacatgccccaggc

SEQ ID NO: 3054490 - DNA, 12 bp, Homo sapiens
ctttcagcgccc

SEQ ID NO: 3054491 - DNA, 18 bp, Homo sapiens
ctttcagcgcccccaggc

SEQ ID NO: 3054492 - DNA, 19 bp, Homo sapiens
ctttcagcgcccccaggcc

SEQ ID NO: 3054493 - DNA, 14 bp, Homo sapiens
ctttcagtactttt

SEQ ID NO: 3054494 - DNA, 21 bp, Homo sapiens
ctttcagtattaaactctcct

SEQ ID NO: 3054495 - DNA, 22 bp, Homo sapiens
ctttcagtattaaactctcctt

SEQ ID NO: 3054496 - DNA, 17 bp, Homo sapiens
ctttcataatctttgct

SEQ ID NO: 3054497 - DNA, 18 bp, Homo sapiens
ctttcatagagaggcctg

SEQ ID NO: 3054498 - DNA, 18 bp, Homo sapiens
ctttcatcacactgggtg

SEQ ID NO: 3054499 - DNA, 19 bp, Homo sapiens
ctttcatcacactgggtgg

SEQ ID NO: 3054500 - DNA, 14 bp, Homo sapiens
cttggccaggattt

SEQ ID NO: 3054501 - DNA, 18 bp, Homo sapiens
cttggcccagagacggag

SEQ ID NO: 3054502 - DNA, 12 bp, Homo sapiens
cttggcccagga

SEQ ID NO: 3054503 - DNA, 14 bp, Homo sapiens
cttggcccaggagc

SEQ ID NO: 3054504 - DNA, 23 bp, Homo sapiens
cttggcccaggagctctgcgcca

SEQ ID NO: 3054505 - DNA, 24 bp, Homo sapiens
cttggcccaggagctctgcgccag

SEQ ID NO: 3054506 - DNA, 15 bp, Homo sapiens
cttggcccgcggcct

SEQ ID NO: 3054507 - DNA, 19 bp, Homo sapiens
cttggcctaaacctcagtt

SEQ ID NO: 3054508 - DNA, 20 bp, Homo sapiens
cttggcctcccaaagtgctg

SEQ ID NO: 3054509 - DNA, 23 bp, Homo sapiens
cttggcctcccaaagtgctggga

SEQ ID NO: 3054510 - DNA, 14 bp, Homo sapiens
cttggcctcccaag

SEQ ID NO: 3054511 - DNA, 13 bp, Homo sapiens
cttggcctctctg

SEQ ID NO: 3054512 - DNA, 21 bp, Homo sapiens
cttggccttgcagctggccca

SEQ ID NO: 3054513 - DNA, 22 bp, Homo sapiens
cttggccttgcagctggcccac

SEQ ID NO: 3054514 - DNA, 14 bp, Homo sapiens
cttggctcagacat

SEQ ID NO: 3054515 - DNA, 14 bp, Homo sapiens
cttggcttaatcat

SEQ ID NO: 3054516 - DNA, 22 bp, Homo sapiens
cttggctttcattattagtact

SEQ ID NO: 3054517 - DNA, 15 bp, Homo sapiens
cttggctttgaggcc

SEQ ID NO: 3054518 - DNA, 18 bp, Homo sapiens
cttgggaagtcgaggctg

SEQ ID NO: 3054519 - DNA, 19 bp, Homo sapiens
cttgggagcctgaggcagg

SEQ ID NO: 3054520 - DNA, 21 bp, Homo sapiens
cttgggagcctgaggcaggag

SEQ ID NO: 3054521 - DNA, 14 bp, Homo sapiens
cttgggaggcccca

SEQ ID NO: 3054522 - DNA, 15 bp, Homo sapiens
cttgggaggccccac

SEQ ID NO: 3054523 - DNA, 22 bp, Homo sapiens
cttgggcagggtctctgctcca

SEQ ID NO: 3054524 - DNA, 16 bp, Homo sapiens
cttgggccctttgagt

SEQ ID NO: 3054525 - DNA, 17 bp, Homo sapiens
cttgggcctggccagtc

SEQ ID NO: 3054526 - DNA, 21 bp, Homo sapiens
cttgggcctggccagtcttcc

SEQ ID NO: 3054527 - DNA, 16 bp, Homo sapiens
cttgggcctttcagtc

SEQ ID NO: 3054528 - DNA, 21 bp, Homo sapiens
cttgggctccctgtaacctct

SEQ ID NO: 3054529 - DNA, 22 bp, Homo sapiens
cttgggctggtcagagtggcgt

SEQ ID NO: 3054530 - DNA, 15 bp, Homo sapiens
cttggggcaggcagt

SEQ ID NO: 3054531 - DNA, 17 bp, Homo sapiens
cttggggcccagtgcat

SEQ ID NO: 3054532 - DNA, 19 bp, Homo sapiens
cttggggcccagtgcatgg

SEQ ID NO: 3054533 - DNA, 18 bp, Homo sapiens
cttgggggggctgccttt

SEQ ID NO: 3054534 - DNA, 23 bp, Homo sapiens
cttgggggttcaggcccggcagg

SEQ ID NO: 3054535 - DNA, 18 bp, Homo sapiens
cttgggggttcagggaac

SEQ ID NO: 3054536 - DNA, 23 bp, Homo sapiens
cttgggggttcagggaactgctt

SEQ ID NO: 3054537 - DNA, 20 bp, Homo sapiens
cttggggttcataggggcag

SEQ ID NO: 3054538 - DNA, 23 bp, Homo sapiens
cttgggtagagtttacagctctg

SEQ ID NO: 3054539 - DNA, 23 bp, Homo sapiens
cttgggtggagaagccattgtct

SEQ ID NO: 3054540 - DNA, 19 bp, Homo sapiens
cttggtacagttgcaggag

SEQ ID NO: 3054541 - DNA, 20 bp, Homo sapiens
cttggtacagttgcaggagc

SEQ ID NO: 3054542 - DNA, 17 bp, Homo sapiens
cttggtatgtgccaggc

SEQ ID NO: 3054543 - DNA, 11 bp, Homo sapiens
cttggtcctag

SEQ ID NO: 3054544 - DNA, 22 bp, Homo sapiens
cttggtctgatcgacgtggtga

SEQ ID NO: 3054545 - DNA, 17 bp, Homo sapiens
cttggtctgccaggccc

SEQ ID NO: 3054546 - DNA, 20 bp, Homo sapiens
cttggtctgccaggccccca

SEQ ID NO: 3054547 - DNA, 13 bp, Homo sapiens
cttggtgccctga

SEQ ID NO: 3054548 - DNA, 15 bp, Homo sapiens
cttggtgctcttgct

SEQ ID NO: 3054549 - DNA, 13 bp, Homo sapiens
cttggtgctggga

SEQ ID NO: 3054550 - DNA, 19 bp, Homo sapiens
cttggtgtccacctggccc

SEQ ID NO: 3054551 - DNA, 16 bp, Homo sapiens
cttggttcccccactg

SEQ ID NO: 3054552 - DNA, 17 bp, Homo sapiens
cttggttgatgtttaaa

SEQ ID NO: 3054553 - DNA, 15 bp, Homo sapiens
cttggtttctggggg

SEQ ID NO: 3054554 - DNA, 16 bp, Homo sapiens
cttggtttctgggggc

SEQ ID NO: 3054555 - DNA, 18 bp, Homo sapiens
cttgtaaaagacagtgta

SEQ ID NO: 3054556 - DNA, 17 bp, Homo sapiens
cttgtaaacagaagcaa

SEQ ID NO: 3054557 - DNA, 19 bp, Homo sapiens
cttgtaaaggaatttaaaa

SEQ ID NO: 3054558 - DNA, 13 bp, Homo sapiens
cttgtaaatacat

SEQ ID NO: 3054559 - DNA, 13 bp, Homo sapiens
cttgtaaatatgg

SEQ ID NO: 3054560 - DNA, 14 bp, Homo sapiens
cttgtaactccacc

SEQ ID NO: 3054561 - DNA, 14 bp, Homo sapiens
cttgtacatgtgta

SEQ ID NO: 3054562 - DNA, 22 bp, Homo sapiens
cttgtacatgtgtagcctgtgc

SEQ ID NO: 3054563 - DNA, 23 bp, Homo sapiens
cttgtacatgtgtagcctgtgca

SEQ ID NO: 3054564 - DNA, 20 bp, Homo sapiens
cttgtacatttttaaattct

SEQ ID NO: 3054565 - DNA, 18 bp, Homo sapiens
cttgtactaagccaggag

SEQ ID NO: 3054566 - DNA, 20 bp, Homo sapiens
cttgtatatacgcatctata

SEQ ID NO: 3054567 - DNA, 13 bp, Homo sapiens
cttgtatctgaag

SEQ ID NO: 3054568 - DNA, 21 bp, Homo sapiens
cttgtatgatctccgtatgat

SEQ ID NO: 3054569 - DNA, 14 bp, Homo sapiens
cttgtcaaagaagg

SEQ ID NO: 3054570 - DNA, 20 bp, Homo sapiens
cttgtcaatggaagaaaccc

SEQ ID NO: 3054571 - DNA, 20 bp, Homo sapiens
cttgtcacccaaagcctgtc

SEQ ID NO: 3054572 - DNA, 22 bp, Homo sapiens
cttgtcacccaaagcctgtccc

SEQ ID NO: 3054573 - DNA, 13 bp, Homo sapiens
cttgtcacgccag

SEQ ID NO: 3054574 - DNA, 14 bp, Homo sapiens
cttgtccagcgcct

SEQ ID NO: 3054575 - DNA, 18 bp, Homo sapiens
cttgtcccactatctggg

SEQ ID NO: 3054576 - DNA, 16 bp, Homo sapiens
cttgtcccactcaagc

SEQ ID NO: 3054577 - DNA, 13 bp, Homo sapiens
cttgtccctgggg

SEQ ID NO: 3054578 - DNA, 15 bp, Homo sapiens
cttgtccctggggca

SEQ ID NO: 3054579 - DNA, 18 bp, Homo sapiens
cttgtccctggggcactc

SEQ ID NO: 3054580 - DNA, 15 bp, Homo sapiens
cttgtcctcagccag

SEQ ID NO: 3054581 - DNA, 20 bp, Homo sapiens
cttgtctcccagctcagggc

SEQ ID NO: 3054582 - DNA, 15 bp, Homo sapiens
cttgtcttagctctg

SEQ ID NO: 3054583 - DNA, 19 bp, Homo sapiens
cttgtcttttcccctcatt

SEQ ID NO: 3054584 - DNA, 13 bp, Homo sapiens
cttgtgaaaatgt

SEQ ID NO: 3054585 - DNA, 10 bp, Homo sapiens
cttgtgaagg

SEQ ID NO: 3054586 - DNA, 16 bp, Homo sapiens
cttgtgaaggccatga

SEQ ID NO: 3054587 - DNA, 21 bp, Homo sapiens
cttgtgaaggccatgatattt

SEQ ID NO: 3054588 - DNA, 18 bp, Homo sapiens
cttgtgacgtgcactgtg

SEQ ID NO: 3054589 - DNA, 18 bp, Homo sapiens
cttgtgactcagcagagg

SEQ ID NO: 3054590 - DNA, 15 bp, Homo sapiens
cttgtgattatttat

SEQ ID NO: 3054591 - DNA, 13 bp, Homo sapiens
cttgtgccagccc

SEQ ID NO: 3054592 - DNA, 14 bp, Homo sapiens
cttgtgccagcccg

SEQ ID NO: 3054593 - DNA, 18 bp, Homo sapiens
cttctccaaaggctctgt

SEQ ID NO: 3054594 - DNA, 14 bp, Homo sapiens
cttctccatctggc

SEQ ID NO: 3054595 - DNA, 21 bp, Homo sapiens
cttctccccgaggctgcccca

SEQ ID NO: 3054596 - DNA, 13 bp, Homo sapiens
cttctccgtcctc

SEQ ID NO: 3054597 - DNA, 14 bp, Homo sapiens
cttctcctctggct

SEQ ID NO: 3054598 - DNA, 14 bp, Homo sapiens
cttctccttggagg

SEQ ID NO: 3054599 - DNA, 16 bp, Homo sapiens
cttctccttggaggac

SEQ ID NO: 3054600 - DNA, 22 bp, Homo sapiens
cttctcctttggcatgtttaat

SEQ ID NO: 3054601 - DNA, 22 bp, Homo sapiens
cttctcgcctaggatttcagcc

SEQ ID NO: 3054602 - DNA, 13 bp, Homo sapiens
cttctctatcctc

SEQ ID NO: 3054603 - DNA, 13 bp, Homo sapiens
cttctctcagctc

SEQ ID NO: 3054604 - DNA, 14 bp, Homo sapiens
cttctctcagctcc

SEQ ID NO: 3054605 - DNA, 19 bp, Homo sapiens
cttctctcagctcccaggc

SEQ ID NO: 3054606 - DNA, 21 bp, Homo sapiens
cttctctcagctcccaggcca

SEQ ID NO: 3054607 - DNA, 15 bp, Homo sapiens
cttctctcatagtgt

SEQ ID NO: 3054608 - DNA, 13 bp, Homo sapiens
cttctctgtctct

SEQ ID NO: 3054609 - DNA, 20 bp, Homo sapiens
cttctctgtgacccacttct

SEQ ID NO: 3054610 - DNA, 17 bp, Homo sapiens
cttctcttgctttatac

SEQ ID NO: 3054611 - DNA, 14 bp, Homo sapiens
cttctcttttcctc

SEQ ID NO: 3054612 - DNA, 23 bp, Homo sapiens
cttctcttttcctcgcagatgat

SEQ ID NO: 3054613 - DNA, 15 bp, Homo sapiens
cttctgaggacattc

SEQ ID NO: 3054614 - DNA, 13 bp, Homo sapiens
cttctgagtggtg

SEQ ID NO: 3054615 - DNA, 14 bp, Homo sapiens
cttctgagtggtgt

SEQ ID NO: 3054616 - DNA, 19 bp, Homo sapiens
cttctgatatctgaatgtt

SEQ ID NO: 3054617 - DNA, 23 bp, Homo sapiens
cttctgatttagcaatgctgtga

SEQ ID NO: 3054618 - DNA, 16 bp, Homo sapiens
cttctgcaactgaaat

SEQ ID NO: 3054619 - DNA, 17 bp, Homo sapiens
cttctgcaactgaaatt

SEQ ID NO: 3054620 - DNA, 18 bp, Homo sapiens
cttctgccggccctgggg

SEQ ID NO: 3054621 - DNA, 19 bp, Homo sapiens
cttctgccggccctggggc

SEQ ID NO: 3054622 - DNA, 15 bp, Homo sapiens
cttctgcgcctcagg

SEQ ID NO: 3054623 - DNA, 16 bp, Homo sapiens
cttctgcgcctcaggc

SEQ ID NO: 3054624 - DNA, 15 bp, Homo sapiens
cttctgcgtccacca

SEQ ID NO: 3054625 - DNA, 16 bp, Homo sapiens
cttctgcgtccaccag

SEQ ID NO: 3054626 - DNA, 19 bp, Homo sapiens
cttctgctactggcaaaag

SEQ ID NO: 3054627 - DNA, 13 bp, Homo sapiens
cttctgctttcta

SEQ ID NO: 3054628 - DNA, 23 bp, Homo sapiens
cttctgctttctattacccctca

SEQ ID NO: 3054629 - DNA, 18 bp, Homo sapiens
cttctggaaactgtgaag

SEQ ID NO: 3054630 - DNA, 15 bp, Homo sapiens
cttctggactggttt

SEQ ID NO: 3054631 - DNA, 13 bp, Homo sapiens
cttctggccagga

SEQ ID NO: 3054632 - DNA, 18 bp, Homo sapiens
cttctgggcagagcctgt

SEQ ID NO: 3054633 - DNA, 19 bp, Homo sapiens
cttctgggcagagcctgtc

SEQ ID NO: 3054634 - DNA, 16 bp, Homo sapiens
cttctggtcccctgtg

SEQ ID NO: 3054635 - DNA, 20 bp, Homo sapiens
cttctggtcccctgtggtga

SEQ ID NO: 3054636 - DNA, 18 bp, Homo sapiens
cttctggtgaccttccaa

SEQ ID NO: 3054637 - DNA, 20 bp, Homo sapiens
cttctggtgaccttccaaga

SEQ ID NO: 3054638 - DNA, 20 bp, Homo sapiens
cttctgtatataaatgggaa

SEQ ID NO: 3054639 - DNA, 19 bp, Homo sapiens
cttctgtatttcactcttt

SEQ ID NO: 3054640 - DNA, 17 bp, Homo sapiens
cttctgtattttcaaag

SEQ ID NO: 3054641 - DNA, 20 bp, Homo sapiens
cttctgtccatcagtgcatg

SEQ ID NO: 3054642 - DNA, 13 bp, Homo sapiens
cttctgtgaagaa

SEQ ID NO: 3054643 - DNA, 15 bp, Homo sapiens
cttctgtgaagaagc

SEQ ID NO: 3054644 - DNA, 19 bp, Homo sapiens
cttctgtgaagaagccctg

SEQ ID NO: 3054645 - DNA, 22 bp, Homo sapiens
cttctgtgaagaagccctgttc

SEQ ID NO: 3054646 - DNA, 23 bp, Homo sapiens
cttcttaaaggggaactgtcaag

SEQ ID NO: 3054647 - DNA, 19 bp, Homo sapiens
cttcttatatctgaagatt

SEQ ID NO: 3054648 - DNA, 19 bp, Homo sapiens
cttcttatggaattgattt

SEQ ID NO: 3054649 - DNA, 13 bp, Homo sapiens
cttcttcagctga

SEQ ID NO: 3054650 - DNA, 12 bp, Homo sapiens
cttcttcagggc

SEQ ID NO: 3054651 - DNA, 14 bp, Homo sapiens
cttcttcagggcct

SEQ ID NO: 3054652 - DNA, 23 bp, Homo sapiens
cttcttccaaggagcagagaggt

SEQ ID NO: 3054653 - DNA, 14 bp, Homo sapiens
cttcttccacttct

SEQ ID NO: 3054654 - DNA, 20 bp, Homo sapiens
cttcttccccttccctgact

SEQ ID NO: 3054655 - DNA, 18 bp, Homo sapiens
cttcttccctgtcagcct

SEQ ID NO: 3054656 - DNA, 20 bp, Homo sapiens
cttcttccctgtcagcctga

SEQ ID NO: 3054657 - DNA, 14 bp, Homo sapiens
cttcttcctcaagt

SEQ ID NO: 3054658 - DNA, 20 bp, Homo sapiens
cttcttcggggaactcctgg

SEQ ID NO: 3054659 - DNA, 18 bp, Homo sapiens
cttcttggggcccagtgc

SEQ ID NO: 3054660 - DNA, 19 bp, Homo sapiens
cttcttggggcccagtgca

SEQ ID NO: 3054661 - DNA, 22 bp, Homo sapiens
cttcttggggcccagtgcatgg

SEQ ID NO: 3054662 - DNA, 22 bp, Homo sapiens
cttcttggtgctgttgaaaata

SEQ ID NO: 3054663 - DNA, 12 bp, Homo sapiens
cttcttgtaata

SEQ ID NO: 3054664 - DNA, 20 bp, Homo sapiens
cttcttgtaatatttcttca

SEQ ID NO: 3054665 - DNA, 16 bp, Homo sapiens
cttctttaccttcatt

SEQ ID NO: 3054666 - DNA, 22 bp, Homo sapiens
gaaatgtaggcatcatgcatgt

SEQ ID NO: 3054667 - DNA, 18 bp, Homo sapiens
gaaatgtttgctgagtga

SEQ ID NO: 3054668 - DNA, 17 bp, Homo sapiens
gaaattaagaaggcaaa

SEQ ID NO: 3054669 - DNA, 13 bp, Homo sapiens
gaaattatcttta

SEQ ID NO: 3054670 - DNA, 12 bp, Homo sapiens
gaaattccaaag

SEQ ID NO: 3054671 - DNA, 20 bp, Homo sapiens
gaaattcgcatgtttaatgt

SEQ ID NO: 3054672 - DNA, 16 bp, Homo sapiens
gaaattctgaatttgc

SEQ ID NO: 3054673 - DNA, 13 bp, Homo sapiens
gaaattctgagtt

SEQ ID NO: 3054674 - DNA, 22 bp, Homo sapiens
gaaattgattaaggctttcttt

SEQ ID NO: 3054675 - DNA, 17 bp, Homo sapiens
gaaattgcctgaaaccc

SEQ ID NO: 3054676 - DNA, 16 bp, Homo sapiens
gaaatttactgtgaga

SEQ ID NO: 3054677 - DNA, 18 bp, Homo sapiens
gaaatttggatcttcttt

SEQ ID NO: 3054678 - DNA, 20 bp, Homo sapiens
gaaatttggcattgatctta

SEQ ID NO: 3054679 - DNA, 18 bp, Homo sapiens
gaaattttggtttttcaa

SEQ ID NO: 3054680 - DNA, 17 bp, Homo sapiens
gaaatttttcagatgct

SEQ ID NO: 3054681 - DNA, 15 bp, Homo sapiens
gaaatttttccacac

SEQ ID NO: 3054682 - DNA, 15 bp, Homo sapiens
gaaatttttgtaaat

SEQ ID NO: 3054683 - DNA, 16 bp, Homo sapiens
gaaatttttgtaaatc

SEQ ID NO: 3054684 - DNA, 16 bp, Homo sapiens
gaacaaagagtgaaat

SEQ ID NO: 3054685 - DNA, 17 bp, Homo sapiens
gaacaaagagtgaaata

SEQ ID NO: 3054686 - DNA, 21 bp, Homo sapiens
gaacaaagagtgaaatattgt

SEQ ID NO: 3054687 - DNA, 14 bp, Homo sapiens
gaacaaagcagcca

SEQ ID NO: 3054688 - DNA, 15 bp, Homo sapiens
gaacaaagcagccac

SEQ ID NO: 3054689 - DNA, 14 bp, Homo sapiens
gaacaaattatttt

SEQ ID NO: 3054690 - DNA, 14 bp, Homo sapiens
gaacaacaaggaca

SEQ ID NO: 3054691 - DNA, 21 bp, Homo sapiens
gaacaacaaggacaactttat

SEQ ID NO: 3054692 - DNA, 20 bp, Homo sapiens
gaacaaccctgaagcagagg

SEQ ID NO: 3054693 - DNA, 23 bp, Homo sapiens
gaacaacttggaagatctacctg

SEQ ID NO: 3054694 - DNA, 23 bp, Homo sapiens
gaacacaatcacgttatagtcca

SEQ ID NO: 3054695 - DNA, 15 bp, Homo sapiens
gaacacaatgtgtat

SEQ ID NO: 3054696 - DNA, 20 bp, Homo sapiens
gaacacacccatcatctgac

SEQ ID NO: 3054697 - DNA, 16 bp, Homo sapiens
gaacacagcagaccta

SEQ ID NO: 3054698 - DNA, 19 bp, Homo sapiens
gaacaccagcagcactgga

SEQ ID NO: 3054699 - DNA, 20 bp, Homo sapiens
gaacacggagtggccgggcc

SEQ ID NO: 3054700 - DNA, 14 bp, Homo sapiens
gaacacggccacat

SEQ ID NO: 3054701 - DNA, 18 bp, Homo sapiens
gaacactagacaagccag

SEQ ID NO: 3054702 - DNA, 18 bp, Homo sapiens
gaacactcttttgcttta

SEQ ID NO: 3054703 - DNA, 13 bp, Homo sapiens
gaacactgccctc

SEQ ID NO: 3054704 - DNA, 22 bp, Homo sapiens
gaacactggcagactgtgtaaa

SEQ ID NO: 3054705 - DNA, 16 bp, Homo sapiens
gaacagaaatatataa

SEQ ID NO: 3054706 - DNA, 18 bp, Homo sapiens
gaacagacaggagaaatg

SEQ ID NO: 3054707 - DNA, 18 bp, Homo sapiens
gaacagataatccctgta

SEQ ID NO: 3054708 - DNA, 20 bp, Homo sapiens
gaacagcagactcagctctg

SEQ ID NO: 3054709 - DNA, 16 bp, Homo sapiens
gaacagcatggcactc

SEQ ID NO: 3054710 - DNA, 15 bp, Homo sapiens
gaacagctcatcttc

SEQ ID NO: 3054711 - DNA, 13 bp, Homo sapiens
gaacagggcccag

SEQ ID NO: 3054712 - DNA, 20 bp, Homo sapiens
gaacagggcccaggcctgga

SEQ ID NO: 3054713 - DNA, 21 bp, Homo sapiens
gaacagggcccaggcctggag

SEQ ID NO: 3054714 - DNA, 16 bp, Homo sapiens
gaacagtgctctgcct

SEQ ID NO: 3054715 - DNA, 17 bp, Homo sapiens
gaacagtgctctgcctc

SEQ ID NO: 3054716 - DNA, 21 bp, Homo sapiens
gaacagtggtggcaacattca

SEQ ID NO: 3054717 - DNA, 22 bp, Homo sapiens
gaacataacttctcatgtatat

SEQ ID NO: 3054718 - DNA, 14 bp, Homo sapiens
gaacatccctgcca

SEQ ID NO: 3054719 - DNA, 22 bp, Homo sapiens
gaacatcgcgatgggaaccgat

SEQ ID NO: 3054720 - DNA, 18 bp, Homo sapiens
gaacatcgttgttttgct

SEQ ID NO: 3054721 - DNA, 13 bp, Homo sapiens
gaacatcttcata

SEQ ID NO: 3054722 - DNA, 14 bp, Homo sapiens
gaacatgaatcaaa

SEQ ID NO: 3054723 - DNA, 19 bp, Homo sapiens
gaacatgcagctctgcagc

SEQ ID NO: 3054724 - DNA, 18 bp, Homo sapiens
gaacatgcagtttgaaat

SEQ ID NO: 3054725 - DNA, 20 bp, Homo sapiens
gaacatgcctgattttaaaa

SEQ ID NO: 3054726 - DNA, 23 bp, Homo sapiens
gaacatgcctgattttaaaaggt

SEQ ID NO: 3054727 - DNA, 17 bp, Homo sapiens
gaacatgcttttacttt

SEQ ID NO: 3054728 - DNA, 21 bp, Homo sapiens
gaacatgtgttttcatcattt

SEQ ID NO: 3054729 - DNA, 23 bp, Homo sapiens
gaacatgtgttttcatcatttca

SEQ ID NO: 3054730 - DNA, 11 bp, Homo sapiens
gaaccaaagcg

SEQ ID NO: 3054731 - DNA, 16 bp, Homo sapiens
gaaccaaagtctaaac

SEQ ID NO: 3054732 - DNA, 20 bp, Homo sapiens
gaaccaaattgcactgaagt

SEQ ID NO: 3054733 - DNA, 19 bp, Homo sapiens
gaaccaataaaataatttt

SEQ ID NO: 3054734 - DNA, 14 bp, Homo sapiens
gaaccagtgcagac

SEQ ID NO: 3054735 - DNA, 19 bp, Homo sapiens
gaaccatgcaggaaggaaa

SEQ ID NO: 3054736 - DNA, 23 bp, Homo sapiens
gaaccatgctcttgttctgttcc

SEQ ID NO: 3054737 - DNA, 13 bp, Homo sapiens
gaacccacctgct

SEQ ID NO: 3054738 - DNA, 15 bp, Homo sapiens
gaacccacctgctga

SEQ ID NO: 3054739 - DNA, 13 bp, Homo sapiens
gaacccataggga

SEQ ID NO: 3054740 - DNA, 18 bp, Homo sapiens
gaacccatagggagctga

SEQ ID NO: 3054741 - DNA, 15 bp, Homo sapiens
gaaccccagaggcag

SEQ ID NO: 3054742 - DNA, 19 bp, Homo sapiens
gaacccctagaaaggagag

SEQ ID NO: 3054743 - DNA, 16 bp, Homo sapiens
gaacccgggaggcaga

SEQ ID NO: 3054744 - DNA, 20 bp, Homo sapiens
gaacccggtgctccctctgt

SEQ ID NO: 3054745 - DNA, 23 bp, Homo sapiens
gaacccttctgctttctattacc

SEQ ID NO: 3054746 - DNA, 12 bp, Homo sapiens
gaacccttggct

SEQ ID NO: 3054747 - DNA, 15 bp, Homo sapiens
gaaccgaggcaggga

SEQ ID NO: 3054748 - DNA, 15 bp, Homo sapiens
gaaccgtaggaccca

SEQ ID NO: 3054749 - DNA, 12 bp, Homo sapiens
gaacctaactgt

SEQ ID NO: 3054750 - DNA, 17 bp, Homo sapiens
gaacctaactgtatctt

SEQ ID NO: 3054751 - DNA, 17 bp, Homo sapiens
gaacctcacgcacctcc

SEQ ID NO: 3054752 - DNA, 18 bp, Homo sapiens
gaacctcacgcacctccc

SEQ ID NO: 3054753 - DNA, 21 bp, Homo sapiens
gaacctcacgcacctcccatc

SEQ ID NO: 3054754 - DNA, 13 bp, Homo sapiens
gaacctcagcctg

SEQ ID NO: 3054755 - DNA, 16 bp, Homo sapiens
gaacctcctctgtgaa

SEQ ID NO: 3054756 - DNA, 16 bp, Homo sapiens
gaacctcgagtactgt

SEQ ID NO: 3054757 - DNA, 17 bp, Homo sapiens
gaacctcgagtactgtg

SEQ ID NO: 3054758 - DNA, 22 bp, Homo sapiens
gaacctcgagtactgtgggcaa

SEQ ID NO: 3054759 - DNA, 16 bp, Homo sapiens
gaacctcggggtgggg

SEQ ID NO: 3054760 - DNA, 21 bp, Homo sapiens
gaacctgggttgcagacagga

SEQ ID NO: 3054761 - DNA, 21 bp, Homo sapiens
gaaccttctggcctcccacag

SEQ ID NO: 3054762 - DNA, 22 bp, Homo sapiens
gaacgaggattaggggatgggg

SEQ ID NO: 3054763 - DNA, 12 bp, Homo sapiens
gaacgcagcctc

SEQ ID NO: 3054764 - DNA, 19 bp, Homo sapiens
gaacgcccccccccacccc

SEQ ID NO: 3054765 - DNA, 20 bp, Homo sapiens
gaacgcccccccccacccct

SEQ ID NO: 3054766 - DNA, 13 bp, Homo sapiens
gaacggccctgca

SEQ ID NO: 3054767 - DNA, 15 bp, Homo sapiens
gaacggtaaatttct

SEQ ID NO: 3054768 - DNA, 21 bp, Homo sapiens
gaacgtatgtgctcttataaa

SEQ ID NO: 3054769 - DNA, 22 bp, Homo sapiens
gaacgtgactgccccaactcct

SEQ ID NO: 3054770 - DNA, 13 bp, Homo sapiens
gaacgtgccagca

SEQ ID NO: 3054771 - DNA, 12 bp, Homo sapiens
gaactaaagaag

SEQ ID NO: 3054772 - DNA, 21 bp, Homo sapiens
gaactaatttggtttttactc

SEQ ID NO: 3054773 - DNA, 19 bp, Homo sapiens
gaactaccttggttccccc

SEQ ID NO: 3054774 - DNA, 19 bp, Homo sapiens
gaactagccttatttctca

SEQ ID NO: 3054775 - DNA, 19 bp, Homo sapiens
gaactataacacctgccac

SEQ ID NO: 3054776 - DNA, 15 bp, Homo sapiens
gaactcagatccagg

SEQ ID NO: 3054777 - DNA, 19 bp, Homo sapiens
gaactcagatccagggaca

SEQ ID NO: 3054778 - DNA, 21 bp, Homo sapiens
gaactcagatccagggacaga

SEQ ID NO: 3054779 - DNA, 17 bp, Homo sapiens
gaactcagccaagcaca

SEQ ID NO: 3054780 - DNA, 19 bp, Homo sapiens
gaactcagccaagcacagt

SEQ ID NO: 3054781 - DNA, 24 bp, Homo sapiens
gaactcagccaagcacagtggtgg

SEQ ID NO: 3054782 - DNA, 16 bp, Homo sapiens
gaactcatcactgtgg

SEQ ID NO: 3054783 - DNA, 19 bp, Homo sapiens
gaaacaaaaattgtcttta

SEQ ID NO: 3054784 - DNA, 14 bp, Homo sapiens
gaaacaaagaaggt

SEQ ID NO: 3054785 - DNA, 15 bp, Homo sapiens
gaaacaaataatttg

SEQ ID NO: 3054786 - DNA, 21 bp, Homo sapiens
gaaacaacagctttaaaagaa

SEQ ID NO: 3054787 - DNA, 11 bp, Homo sapiens
gaaacaacatt

SEQ ID NO: 3054788 - DNA, 16 bp, Homo sapiens
gaaacaacattttctt

SEQ ID NO: 3054789 - DNA, 14 bp, Homo sapiens
gaaacaacttggaa

SEQ ID NO: 3054790 - DNA, 21 bp, Homo sapiens
gaaacaatactcataatgtga

SEQ ID NO: 3054791 - DNA, 22 bp, Homo sapiens
gaaacaatactcataatgtgaa

SEQ ID NO: 3054792 - DNA, 14 bp, Homo sapiens
gaaacaatttaaat

SEQ ID NO: 3054793 - DNA, 22 bp, Homo sapiens
gaaacacaatacctacaataaa

SEQ ID NO: 3054794 - DNA, 13 bp, Homo sapiens
gaaacacagaaac

SEQ ID NO: 3054795 - DNA, 15 bp, Homo sapiens
gaaacacataaatta

SEQ ID NO: 3054796 - DNA, 16 bp, Homo sapiens
gaaacactccttgcat

SEQ ID NO: 3054797 - DNA, 13 bp, Homo sapiens
gaaacacttgctt

SEQ ID NO: 3054798 - DNA, 14 bp, Homo sapiens
gaaacacttgcttg

SEQ ID NO: 3054799 - DNA, 11 bp, Homo sapiens
gaaacagaaaa

SEQ ID NO: 3054800 - DNA, 13 bp, Homo sapiens
gaaacagaaaaat

SEQ ID NO: 3054801 - DNA, 22 bp, Homo sapiens
gaaacagaggcgtctcacattt

SEQ ID NO: 3054802 - DNA, 14 bp, Homo sapiens
gaaacagctgcctt

SEQ ID NO: 3054803 - DNA, 16 bp, Homo sapiens
gaaacagctgccttag

SEQ ID NO: 3054804 - DNA, 17 bp, Homo sapiens
gaaacatgaagcataat

SEQ ID NO: 3054805 - DNA, 16 bp, Homo sapiens
gaaacattttttaaaa

SEQ ID NO: 3054806 - DNA, 22 bp, Homo sapiens
gaaaccaattcctcatcctcag

SEQ ID NO: 3054807 - DNA, 20 bp, Homo sapiens
gaaaccattttcccatcatc

SEQ ID NO: 3054808 - DNA, 23 bp, Homo sapiens
gaaacccataggcccacacacag

SEQ ID NO: 3054809 - DNA, 16 bp, Homo sapiens
gaaacccccacacaca

SEQ ID NO: 3054810 - DNA, 23 bp, Homo sapiens
gaaacccccacacacacacacat

SEQ ID NO: 3054811 - DNA, 17 bp, Homo sapiens
gaaaccccgtctctact

SEQ ID NO: 3054812 - DNA, 19 bp, Homo sapiens
gaaaccccttctctgtgac

SEQ ID NO: 3054813 - DNA, 20 bp, Homo sapiens
gaaaccccttctctgtgacc

SEQ ID NO: 3054814 - DNA, 21 bp, Homo sapiens
gaaacctacacactgtcatgc

SEQ ID NO: 3054815 - DNA, 15 bp, Homo sapiens
gaaacctgggagaga

SEQ ID NO: 3054816 - DNA, 20 bp, Homo sapiens
gaaacctgtataaccctgtt

SEQ ID NO: 3054817 - DNA, 13 bp, Homo sapiens
gaaacctgtatct

SEQ ID NO: 3054818 - DNA, 18 bp, Homo sapiens
gaaacctgtatctttcta

SEQ ID NO: 3054819 - DNA, 16 bp, Homo sapiens
gaaaccttgtttgttt

SEQ ID NO: 3054820 - DNA, 21 bp, Homo sapiens
gaaacctttatccctgcttat

SEQ ID NO: 3054821 - DNA, 18 bp, Homo sapiens
gaaacgctacctctctgt

SEQ ID NO: 3054822 - DNA, 20 bp, Homo sapiens
gaaacgctacctctctgtcc

SEQ ID NO: 3054823 - DNA, 15 bp, Homo sapiens
gaaacgtctacgtat

SEQ ID NO: 3054824 - DNA, 15 bp, Homo sapiens
gaaacgtctcccaga

SEQ ID NO: 3054825 - DNA, 22 bp, Homo sapiens
gaaactaccagtgggcatgtat

SEQ ID NO: 3054826 - DNA, 15 bp, Homo sapiens
gaaactcccttgtgt

SEQ ID NO: 3054827 - DNA, 17 bp, Homo sapiens
gaaactcccttgtgttc

SEQ ID NO: 3054828 - DNA, 22 bp, Homo sapiens
gaaactccgtcttagaagtgga

SEQ ID NO: 3054829 - DNA, 16 bp, Homo sapiens
gaaactctacatttaa

SEQ ID NO: 3054830 - DNA, 22 bp, Homo sapiens
gaaactcttgctattgaattga

SEQ ID NO: 3054831 - DNA, 21 bp, Homo sapiens
gaaactgtcggtttgctttga

SEQ ID NO: 3054832 - DNA, 13 bp, Homo sapiens
gaaactgtgaatg

SEQ ID NO: 3054833 - DNA, 20 bp, Homo sapiens
gaaactgttcccacctgctg

SEQ ID NO: 3054834 - DNA, 22 bp, Homo sapiens
gaaactgttcccacctgctgga

SEQ ID NO: 3054835 - DNA, 18 bp, Homo sapiens
gaaacttcccaacttccc

SEQ ID NO: 3054836 - DNA, 22 bp, Homo sapiens
gaaacttcccaacttccctgtt

SEQ ID NO: 3054837 - DNA, 19 bp, Homo sapiens
gaaacttgtcacttgcatg

SEQ ID NO: 3054838 - DNA, 13 bp, Homo sapiens
gaaagaaaatgaa

SEQ ID NO: 3054839 - DNA, 15 bp, Homo sapiens
gaaagaaatattaac

SEQ ID NO: 3054840 - DNA, 19 bp, Homo sapiens
gaaagaagagccggagcct

SEQ ID NO: 3054841 - DNA, 14 bp, Homo sapiens
gaaagacaggaaga

SEQ ID NO: 3054842 - DNA, 22 bp, Homo sapiens
gaaagacatccataaagaagca

SEQ ID NO: 3054843 - DNA, 14 bp, Homo sapiens
gaaagacatctttc

SEQ ID NO: 3054844 - DNA, 19 bp, Homo sapiens
gaaagacatttcaaatctg

SEQ ID NO: 3054845 - DNA, 12 bp, Homo sapiens
gaaagagagaaa

SEQ ID NO: 3054846 - DNA, 17 bp, Homo sapiens
gaaagagagaaaataaa

SEQ ID NO: 3054847 - DNA, 23 bp, Homo sapiens
gaaagagagaaaataaaaagtta

SEQ ID NO: 3054848 - DNA, 16 bp, Homo sapiens
gaaagagatacagagg

SEQ ID NO: 3054849 - DNA, 18 bp, Homo sapiens
gaaagagccttctgggag

SEQ ID NO: 3054850 - DNA, 14 bp, Homo sapiens
gaaagaggccagac

SEQ ID NO: 3054851 - DNA, 17 bp, Homo sapiens
gaaagatgatgctcagt

SEQ ID NO: 3054852 - DNA, 17 bp, Homo sapiens
gaaagattatttaaatg

SEQ ID NO: 3054853 - DNA, 22 bp, Homo sapiens
gaaagattatttaaatgctttt

SEQ ID NO: 3054854 - DNA, 13 bp, Homo sapiens
gaaagattttatt

SEQ ID NO: 3054855 - DNA, 15 bp, Homo sapiens
gaaagcaaattattt

SEQ ID NO: 3054856 - DNA, 14 bp, Homo sapiens
gaaagcaataaatg

SEQ ID NO: 3054857 - DNA, 22 bp, Homo sapiens
gaaagcaatacgtttgtgcaga

SEQ ID NO: 3054858 - DNA, 20 bp, Homo sapiens
gaaagcagctcaaaggcaca

SEQ ID NO: 3054859 - DNA, 24 bp, Homo sapiens
gaaagcatccattaattaatgaga

SEQ ID NO: 3054860 - DNA, 20 bp, Homo sapiens
gaaagcatgtctctgcttcc

SEQ ID NO: 3054861 - DNA, 21 bp, Homo sapiens
gaaagcatgtctctgcttcca

SEQ ID NO: 3054862 - DNA, 19 bp, Homo sapiens
gaaagcccacctgggctgg

SEQ ID NO: 3054863 - DNA, 14 bp, Homo sapiens
gaaagcctctgtcc

SEQ ID NO: 3054864 - DNA, 20 bp, Homo sapiens
gaaagcctgtctctttccac

SEQ ID NO: 3054865 - DNA, 14 bp, Homo sapiens
gaaagccttctttt

SEQ ID NO: 3054866 - DNA, 14 bp, Homo sapiens
gaaagctaaagttt

SEQ ID NO: 3054867 - DNA, 13 bp, Homo sapiens
gaaagctctagaa

SEQ ID NO: 3054868 - DNA, 21 bp, Homo sapiens
gaaaggactctggggttttta

SEQ ID NO: 3054869 - DNA, 16 bp, Homo sapiens
gaaaggagtagaaaaa

SEQ ID NO: 3054870 - DNA, 16 bp, Homo sapiens
gaaaggccagctggca

SEQ ID NO: 3054871 - DNA, 18 bp, Homo sapiens
gaaaggcctgtggggagc

SEQ ID NO: 3054872 - DNA, 16 bp, Homo sapiens
gaaaggggagcccact

SEQ ID NO: 3054873 - DNA, 14 bp, Homo sapiens
gaaagggttaatca

SEQ ID NO: 3054874 - DNA, 14 bp, Homo sapiens
gaaaggtaaataca

SEQ ID NO: 3054875 - DNA, 22 bp, Homo sapiens
gaaaggtggtgtttctgtaaga

SEQ ID NO: 3054876 - DNA, 13 bp, Homo sapiens
gaaaggtttcaag

SEQ ID NO: 3054877 - DNA, 18 bp, Homo sapiens
gaaagtagcagtcatcat

SEQ ID NO: 3054878 - DNA, 15 bp, Homo sapiens
gaaagtatgttgtat

SEQ ID NO: 3054879 - DNA, 16 bp, Homo sapiens
gaaagtgaaagtccag

SEQ ID NO: 3054880 - DNA, 20 bp, Homo sapiens
gaaagtgaggaaataaagtt

SEQ ID NO: 3054881 - DNA, 22 bp, Homo sapiens
gaaagtgcctttatctcagcca

SEQ ID NO: 3054882 - DNA, 16 bp, Homo sapiens
gaaagtggtgctcagt

SEQ ID NO: 3054883 - DNA, 18 bp, Homo sapiens
gaaagtggtgctcagttg

SEQ ID NO: 3054884 - DNA, 12 bp, Homo sapiens
gaaagtgtaaag

SEQ ID NO: 3054885 - DNA, 13 bp, Homo sapiens
gaaagtgtaaagc

SEQ ID NO: 3054886 - DNA, 16 bp, Homo sapiens
gaaagtgtaaagcatt

SEQ ID NO: 3054887 - DNA, 17 bp, Homo sapiens
gaaagtgtcatcaattt

SEQ ID NO: 3054888 - DNA, 15 bp, Homo sapiens
gaaagtgttcaaatt

SEQ ID NO: 3054889 - DNA, 23 bp, Homo sapiens
gaaagtgttcaaattaaaaaagc

SEQ ID NO: 3054890 - DNA, 13 bp, Homo sapiens
gaaagttgtacat

SEQ ID NO: 3054891 - DNA, 21 bp, Homo sapiens
gaaagtttttaattcatattt

SEQ ID NO: 3054892 - DNA, 17 bp, Homo sapiens
gaaataaaaggaagcca

SEQ ID NO: 3054893 - DNA, 13 bp, Homo sapiens
gaaataaaccatt

SEQ ID NO: 3054894 - DNA, 15 bp, Homo sapiens
gaaataaatgtttca

SEQ ID NO: 3054895 - DNA, 13 bp, Homo sapiens
gaaataatgggat

SEQ ID NO: 3054896 - DNA, 21 bp, Homo sapiens
gaaataatgggattagaaaca

SEQ ID NO: 3054897 - DNA, 19 bp, Homo sapiens
gaaataccttgagcagaat

SEQ ID NO: 3054898 - DNA, 16 bp, Homo sapiens
gaaatacctttgtagt

SEQ ID NO: 3054899 - DNA, 21 bp, Homo sapiens
gaaatacctttgtagttactc

SEQ ID NO: 3054900 - DNA, 14 bp, Homo sapiens
gaaatacgtttgtg

SEQ ID NO: 3054901 - DNA, 20 bp, Homo sapiens
gaaatacgtttgtgtttcta

SEQ ID NO: 3054902 - DNA, 15 bp, Homo sapiens
gaaataggaaacaag

SEQ ID NO: 3054903 - DNA, 21 bp, Homo sapiens
gaaatatataaaaatatatgt

SEQ ID NO: 3054904 - DNA, 14 bp, Homo sapiens
gaaatatgaatgcc

SEQ ID NO: 3054905 - DNA, 15 bp, Homo sapiens
gaaatattccctaga

SEQ ID NO: 3054906 - DNA, 15 bp, Homo sapiens
gaaatatttagcaaa

SEQ ID NO: 3054907 - DNA, 15 bp, Homo sapiens
gaaatcaacttgctt

SEQ ID NO: 3054908 - DNA, 20 bp, Homo sapiens
gaaatctatgattccaggtg

SEQ ID NO: 3054909 - DNA, 20 bp, Homo sapiens
gaaatctggcttctggccag

SEQ ID NO: 3054910 - DNA, 23 bp, Homo sapiens
gaaatctggcttctggccaggaa

SEQ ID NO: 3054911 - DNA, 15 bp, Homo sapiens
gaactgagcatctcc

SEQ ID NO: 3054912 - DNA, 18 bp, Homo sapiens
gaactgagcatctccagc

SEQ ID NO: 3054913 - DNA, 22 bp, Homo sapiens
gaactgagcttggaagcttctg

SEQ ID NO: 3054914 - DNA, 24 bp, Homo sapiens
gaactgaggagcggactcacttga

SEQ ID NO: 3054915 - DNA, 22 bp, Homo sapiens
gaactgaggccttgtgtgtcag

SEQ ID NO: 3054916 - DNA, 18 bp, Homo sapiens
gaactgcctggattccat

SEQ ID NO: 3054917 - DNA, 12 bp, Homo sapiens
gaactgctgggg

SEQ ID NO: 3054918 - DNA, 13 bp, Homo sapiens
gaactgctggggc

SEQ ID NO: 3054919 - DNA, 14 bp, Homo sapiens
gaactggagggtga

SEQ ID NO: 3054920 - DNA, 20 bp, Homo sapiens
gaactggagggtgagaggaa

SEQ ID NO: 3054921 - DNA, 15 bp, Homo sapiens
gaactggcttgtaca

SEQ ID NO: 3054922 - DNA, 20 bp, Homo sapiens
gaactggttcaagagacact

SEQ ID NO: 3054923 - DNA, 16 bp, Homo sapiens
gaactggttcttgcct

SEQ ID NO: 3054924 - DNA, 17 bp, Homo sapiens
gaactggttcttgcctt

SEQ ID NO: 3054925 - DNA, 22 bp, Homo sapiens
gaactgtactgttttctgggcc

SEQ ID NO: 3054926 - DNA, 23 bp, Homo sapiens
gaactgtactgttttctgggcca

SEQ ID NO: 3054927 - DNA, 18 bp, Homo sapiens
gaactgtagatgatgtat

SEQ ID NO: 3054928 - DNA, 18 bp, Homo sapiens
gaactgtattattgcaat

SEQ ID NO: 3054929 - DNA, 18 bp, Homo sapiens
gaactgtcccagctacca

SEQ ID NO: 3054930 - DNA, 18 bp, Homo sapiens
gaactgtcggaggaaaga

SEQ ID NO: 3054931 - DNA, 20 bp, Homo sapiens
gaactgtcggaggaaagaca

SEQ ID NO: 3054932 - DNA, 13 bp, Homo sapiens
gaactgtgctccc

SEQ ID NO: 3054933 - DNA, 16 bp, Homo sapiens
gaactgtgctcccacg

SEQ ID NO: 3054934 - DNA, 18 bp, Homo sapiens
gaactgtgtgtaattgtt

SEQ ID NO: 3054935 - DNA, 17 bp, Homo sapiens
gaacttcacctgcaaag

SEQ ID NO: 3054936 - DNA, 19 bp, Homo sapiens
gaacttcagcattgtaatt

SEQ ID NO: 3054937 - DNA, 20 bp, Homo sapiens
gaacttcagcattgtaatta

SEQ ID NO: 3054938 - DNA, 23 bp, Homo sapiens
gaacttccaggtgttactgtaat

SEQ ID NO: 3054939 - DNA, 22 bp, Homo sapiens
gaacttgtaaaggaatttaaaa

SEQ ID NO: 3054940 - DNA, 19 bp, Homo sapiens
gaactttgcatagcagctg

SEQ ID NO: 3054941 - DNA, 11 bp, Homo sapiens
gaactttggga

SEQ ID NO: 3054942 - DNA, 15 bp, Homo sapiens
gaactttgtcagtgt

SEQ ID NO: 3054943 - DNA, 13 bp, Homo sapiens
gaactttgtgctt

SEQ ID NO: 3054944 - DNA, 15 bp, Homo sapiens
gaactttttaaagaa

SEQ ID NO: 3054945 - DNA, 20 bp, Homo sapiens
gaactttttaaagaagtgca

SEQ ID NO: 3054946 - DNA, 19 bp, Homo sapiens
gaagaaaaaaggccttgaa

SEQ ID NO: 3054947 - DNA, 22 bp, Homo sapiens
gaagaaaacatctattctctcc

SEQ ID NO: 3054948 - DNA, 15 bp, Homo sapiens
gaagaaaacattttg

SEQ ID NO: 3054949 - DNA, 12 bp, Homo sapiens
gaagaaaatttg

SEQ ID NO: 3054950 - DNA, 21 bp, Homo sapiens
gaagaaaatttgccaatcttt

SEQ ID NO: 3054951 - DNA, 21 bp, Homo sapiens
gaagaaagggtgtttttctgt

SEQ ID NO: 3054952 - DNA, 18 bp, Homo sapiens
gaagaaattataaagata

SEQ ID NO: 3054953 - DNA, 20 bp, Homo sapiens
gaagaacagctgttcctgtg

SEQ ID NO: 3054954 - DNA, 13 bp, Homo sapiens
gaagaaccagtcc

SEQ ID NO: 3054955 - DNA, 19 bp, Homo sapiens
gaagaaccagtccccccac

SEQ ID NO: 3054956 - DNA, 16 bp, Homo sapiens
gaagaaccgcattttg

SEQ ID NO: 3054957 - DNA, 14 bp, Homo sapiens
gaagaagagccaca

SEQ ID NO: 3054958 - DNA, 14 bp, Homo sapiens
gaagaatctttctt

SEQ ID NO: 3054959 - DNA, 20 bp, Homo sapiens
gaagaatgggaaagagaaag

SEQ ID NO: 3054960 - DNA, 14 bp, Homo sapiens
gaagaattttaaaa

SEQ ID NO: 3054961 - DNA, 23 bp, Homo sapiens
gaagaattttaaaaatgaatcct

SEQ ID NO: 3054962 - DNA, 20 bp, Homo sapiens
gaagacaacagaaagaggga

SEQ ID NO: 3054963 - DNA, 18 bp, Homo sapiens
gaagacaattgacaacag

SEQ ID NO: 3054964 - DNA, 12 bp, Homo sapiens
gaagacacagaa

SEQ ID NO: 3054965 - DNA, 20 bp, Homo sapiens
gaagacagagcaaagcgccc

SEQ ID NO: 3054966 - DNA, 12 bp, Homo sapiens
gaagacaggaaa

SEQ ID NO: 3054967 - DNA, 20 bp, Homo sapiens
gaagacattttttgctataa

SEQ ID NO: 3054968 - DNA, 22 bp, Homo sapiens
gaagaccatgtggagacttcat

SEQ ID NO: 3054969 - DNA, 19 bp, Homo sapiens
gaagacccctgactcatca

SEQ ID NO: 3054970 - DNA, 16 bp, Homo sapiens
gaagacgatgtgttga

SEQ ID NO: 3054971 - DNA, 20 bp, Homo sapiens
gaagactccctgatcccaga

SEQ ID NO: 3054972 - DNA, 22 bp, Homo sapiens
gaagactccctgatcccagacc

SEQ ID NO: 3054973 - DNA, 14 bp, Homo sapiens
gaagactggagaaa

SEQ ID NO: 3054974 - DNA, 18 bp, Homo sapiens
gaagactggagaaatgct

SEQ ID NO: 3054975 - DNA, 11 bp, Homo sapiens
gaagagaccac

SEQ ID NO: 3054976 - DNA, 14 bp, Homo sapiens
gaagagagaacttt

SEQ ID NO: 3054977 - DNA, 22 bp, Homo sapiens
gaagagagaaggggcgggaata

SEQ ID NO: 3054978 - DNA, 16 bp, Homo sapiens
gaagagagcatgagag

SEQ ID NO: 3054979 - DNA, 22 bp, Homo sapiens
gaagagcaggactccaggccca

SEQ ID NO: 3054980 - DNA, 23 bp, Homo sapiens
gaagagcaggactccaggcccaa

SEQ ID NO: 3054981 - DNA, 12 bp, Homo sapiens
gaagagccacag

SEQ ID NO: 3054982 - DNA, 13 bp, Homo sapiens
gaagagccacagt

SEQ ID NO: 3054983 - DNA, 16 bp, Homo sapiens
gaagaggaacagtgtg

SEQ ID NO: 3054984 - DNA, 15 bp, Homo sapiens
gaagaggagcctcag

SEQ ID NO: 3054985 - DNA, 22 bp, Homo sapiens
gaagaggagcctcagaagaaaa

SEQ ID NO: 3054986 - DNA, 14 bp, Homo sapiens
gaagaggaggaggt

SEQ ID NO: 3054987 - DNA, 15 bp, Homo sapiens
gaagaggaggaggtg

SEQ ID NO: 3054988 - DNA, 16 bp, Homo sapiens
gaagaggggtggtggg

SEQ ID NO: 3054989 - DNA, 18 bp, Homo sapiens
gaagagggtgtgtttgaa

SEQ ID NO: 3054990 - DNA, 18 bp, Homo sapiens
gaagagttgcatcaacaa

SEQ ID NO: 3054991 - DNA, 16 bp, Homo sapiens
gaagataacattttca

SEQ ID NO: 3054992 - DNA, 20 bp, Homo sapiens
gaagataatgtaaaggtttt

SEQ ID NO: 3054993 - DNA, 14 bp, Homo sapiens
gaagatcagatgca

SEQ ID NO: 3054994 - DNA, 21 bp, Homo sapiens
gaagatcatatacgtgaaaat

SEQ ID NO: 3054995 - DNA, 15 bp, Homo sapiens
gaagatcctgtgagg

SEQ ID NO: 3054996 - DNA, 15 bp, Homo sapiens
gaagatcgcatggca

SEQ ID NO: 3054997 - DNA, 15 bp, Homo sapiens
gaagatctgcaaaca

SEQ ID NO: 3054998 - DNA, 20 bp, Homo sapiens
gaagatctgcctcccctgtg

SEQ ID NO: 3054999 - DNA, 16 bp, Homo sapiens
gaagatcttatgcctt

SEQ ID NO: 3055000 - DNA, 17 bp, Homo sapiens
gaagatctttatatttc

SEQ ID NO: 3055001 - DNA, 18 bp, Homo sapiens
gaagatgcattgtagttt

SEQ ID NO: 3055002 - DNA, 20 bp, Homo sapiens
gaagatgctcatctgagcca

SEQ ID NO: 3055003 - DNA, 18 bp, Homo sapiens
gaagatgttgagaaacct

SEQ ID NO: 3055004 - DNA, 14 bp, Homo sapiens
gaagattctttccc

SEQ ID NO: 3055005 - DNA, 15 bp, Homo sapiens
gaagcaacgtgttaa

SEQ ID NO: 3055006 - DNA, 12 bp, Homo sapiens
gaagcaagctgt

SEQ ID NO: 3055007 - DNA, 13 bp, Homo sapiens
gaagcaagctgtg

SEQ ID NO: 3055008 - DNA, 15 bp, Homo sapiens
gaagcaagctgtgtt

SEQ ID NO: 3055009 - DNA, 14 bp, Homo sapiens
gaagcaaggcggtg

SEQ ID NO: 3055010 - DNA, 18 bp, Homo sapiens
gaagcaataaagaagagt

SEQ ID NO: 3055011 - DNA, 17 bp, Homo sapiens
gaagcaataataaagta

SEQ ID NO: 3055012 - DNA, 14 bp, Homo sapiens
gaagcaatcagcaa

SEQ ID NO: 3055013 - DNA, 16 bp, Homo sapiens
gaagcaatcagcaaac

SEQ ID NO: 3055014 - DNA, 18 bp, Homo sapiens
gaagcactgggatcacag

SEQ ID NO: 3055015 - DNA, 14 bp, Homo sapiens
gaagcagagcaaaa

SEQ ID NO: 3055016 - DNA, 22 bp, Homo sapiens
gaagcagagcaaaatgctcttg

SEQ ID NO: 3055017 - DNA, 19 bp, Homo sapiens
gaagcagatgcaaagaggc

SEQ ID NO: 3055018 - DNA, 20 bp, Homo sapiens
gaagcagatgcaaagaggca

SEQ ID NO: 3055019 - DNA, 13 bp, Homo sapiens
gaagcagctctgc

SEQ ID NO: 3055020 - DNA, 15 bp, Homo sapiens
gaagcaggacagaca

SEQ ID NO: 3055021 - DNA, 16 bp, Homo sapiens
gaagcagggagagttg

SEQ ID NO: 3055022 - DNA, 17 bp, Homo sapiens
gaagcagggagagttgg

SEQ ID NO: 3055023 - DNA, 23 bp, Homo sapiens
gaagcagggagagttggggaagg

SEQ ID NO: 3055024 - DNA, 12 bp, Homo sapiens
gaagcaggttcc

SEQ ID NO: 3055025 - DNA, 19 bp, Homo sapiens
gaagcaggttcccaagctc

SEQ ID NO: 3055026 - DNA, 23 bp, Homo sapiens
gaagcagtcgtggctttggcagt

SEQ ID NO: 3055027 - DNA, 15 bp, Homo sapiens
gaagcagtcttgctc

SEQ ID NO: 3055028 - DNA, 21 bp, Homo sapiens
gaagcatttcaaagccctgcc

SEQ ID NO: 3055029 - DNA, 23 bp, Homo sapiens
gaagcatttcaaagccctgcctc

SEQ ID NO: 3055030 - DNA, 13 bp, Homo sapiens
gaagcatttgttt

SEQ ID NO: 3055031 - DNA, 18 bp, Homo sapiens
gaagccaattcagacagg

SEQ ID NO: 3055032 - DNA, 20 bp, Homo sapiens
gaagccaattcagacaggca

SEQ ID NO: 3055033 - DNA, 12 bp, Homo sapiens
gaagccaccctc

SEQ ID NO: 3055034 - DNA, 19 bp, Homo sapiens
gaagccaccctcccagctc

SEQ ID NO: 3055035 - DNA, 20 bp, Homo sapiens
gaagccaccctcccagctct

SEQ ID NO: 3055036 - DNA, 22 bp, Homo sapiens
gaagccacccttccctgcctcc

SEQ ID NO: 3055037 - DNA, 15 bp, Homo sapiens
gaagccaccttccca

SEQ ID NO: 3055038 - DNA, 19 bp, Homo sapiens
gaagccaggaatttcccag

SEQ ID NO: 3055039 - DNA, 21 bp, Homo sapiens
gaagccaggaatttcccagga

SEQ ID NO: 3055040 - DNA, 12 bp, Homo sapiens
gaagccagttgc

SEQ ID NO: 3055041 - DNA, 12 bp, Homo sapiens
gaagccattgtc

SEQ ID NO: 3055042 - DNA, 13 bp, Homo sapiens
gaagccattgtct

SEQ ID NO: 3055043 - DNA, 15 bp, Homo sapiens
gaagcccactgcctc

SEQ ID NO: 3055044 - DNA, 17 bp, Homo sapiens
gaagcccactgcctcct

SEQ ID NO: 3055045 - DNA, 20 bp, Homo sapiens
gaagcccactgcctcctccc

SEQ ID NO: 3055046 - DNA, 18 bp, Homo sapiens
gaagccccacatgtccag

SEQ ID NO: 3055047 - DNA, 22 bp, Homo sapiens
gaagcccccagctaagaacctg

SEQ ID NO: 3055048 - DNA, 23 bp, Homo sapiens
gaattgtccccagtttgcagaaa

SEQ ID NO: 3055049 - DNA, 12 bp, Homo sapiens
gaattgttacat

SEQ ID NO: 3055050 - DNA, 22 bp, Homo sapiens
gaattgttgacaaatgtaaaca

SEQ ID NO: 3055051 - DNA, 20 bp, Homo sapiens
gaatttaaattctttttcaa

SEQ ID NO: 3055052 - DNA, 21 bp, Homo sapiens
gaatttaaattctttttcaaa

SEQ ID NO: 3055053 - DNA, 16 bp, Homo sapiens
gaatttaagctgtaaa

SEQ ID NO: 3055054 - DNA, 20 bp, Homo sapiens
gaatttaatttttaaaagac

SEQ ID NO: 3055055 - DNA, 17 bp, Homo sapiens
gaatttattgaatattt

SEQ ID NO: 3055056 - DNA, 12 bp, Homo sapiens
gaatttcactgt

SEQ ID NO: 3055057 - DNA, 15 bp, Homo sapiens
gaatttcactgtctt

SEQ ID NO: 3055058 - DNA, 19 bp, Homo sapiens
gaatttcactgtcttttaa

SEQ ID NO: 3055059 - DNA, 17 bp, Homo sapiens
gaatttcccacataccc

SEQ ID NO: 3055060 - DNA, 14 bp, Homo sapiens
gaatttcccaggac

SEQ ID NO: 3055061 - DNA, 22 bp, Homo sapiens
gaatttcccaggaccctgaagg

SEQ ID NO: 3055062 - DNA, 19 bp, Homo sapiens
gaatttctttgatttaact

SEQ ID NO: 3055063 - DNA, 17 bp, Homo sapiens
gaatttgagtgctctga

SEQ ID NO: 3055064 - DNA, 13 bp, Homo sapiens
gaatttgcaaagt

SEQ ID NO: 3055065 - DNA, 15 bp, Homo sapiens
gaatttgcaaagtac

SEQ ID NO: 3055066 - DNA, 15 bp, Homo sapiens
gaatttgctttatct

SEQ ID NO: 3055067 - DNA, 21 bp, Homo sapiens
gaatttgggaccctgctttag

SEQ ID NO: 3055068 - DNA, 22 bp, Homo sapiens
gaatttgtatatgactgcattt

SEQ ID NO: 3055069 - DNA, 21 bp, Homo sapiens
gaatttgtcagcgttctacca

SEQ ID NO: 3055070 - DNA, 15 bp, Homo sapiens
gaattttaaaagatg

SEQ ID NO: 3055071 - DNA, 21 bp, Homo sapiens
gaattttaaaagatgcaatgt

SEQ ID NO: 3055072 - DNA, 16 bp, Homo sapiens
gaattttatctgtgga

SEQ ID NO: 3055073 - DNA, 14 bp, Homo sapiens
gaatttttctctaa

SEQ ID NO: 3055074 - DNA, 14 bp, Homo sapiens
gaatttttgcaata

SEQ ID NO: 3055075 - DNA, 16 bp, Homo sapiens
gaatttttgcaataat

SEQ ID NO: 3055076 - DNA, 20 bp, Homo sapiens
gacaaaaacaagactgcctc

SEQ ID NO: 3055077 - DNA, 17 bp, Homo sapiens
gacaaaaacagcctcac

SEQ ID NO: 3055078 - DNA, 18 bp, Homo sapiens
gacaaaaacagcctcaca

SEQ ID NO: 3055079 - DNA, 13 bp, Homo sapiens
gacaaaagaaaaa

SEQ ID NO: 3055080 - DNA, 21 bp, Homo sapiens
gacaaaagaaaaaatattaaa

SEQ ID NO: 3055081 - DNA, 16 bp, Homo sapiens
gacaaaagggccaggt

SEQ ID NO: 3055082 - DNA, 19 bp, Homo sapiens
gacaaaagggccaggtgcg

SEQ ID NO: 3055083 - DNA, 19 bp, Homo sapiens
gacaaaagtgacagatgtt

SEQ ID NO: 3055084 - DNA, 19 bp, Homo sapiens
gacaaagaaaactgcacaa

SEQ ID NO: 3055085 - DNA, 13 bp, Homo sapiens
gacaaagaacctt

SEQ ID NO: 3055086 - DNA, 22 bp, Homo sapiens
gacaaagatgatttaaaaggga

SEQ ID NO: 3055087 - DNA, 17 bp, Homo sapiens
gacaaagtgccaaagaa

SEQ ID NO: 3055088 - DNA, 12 bp, Homo sapiens
gacaaattctgt

SEQ ID NO: 3055089 - DNA, 15 bp, Homo sapiens
gacaaattctgtttc

SEQ ID NO: 3055090 - DNA, 20 bp, Homo sapiens
gacaaattctgtttcttgag

SEQ ID NO: 3055091 - DNA, 16 bp, Homo sapiens
gacaaattgcacagaa

SEQ ID NO: 3055092 - DNA, 15 bp, Homo sapiens
gacaacgtctcttca

SEQ ID NO: 3055093 - DNA, 21 bp, Homo sapiens
gacaactcattttcatattgt

SEQ ID NO: 3055094 - DNA, 15 bp, Homo sapiens
gacaacttatttaaa

SEQ ID NO: 3055095 - DNA, 22 bp, Homo sapiens
gacaacttatttaaaaatattt

SEQ ID NO: 3055096 - DNA, 14 bp, Homo sapiens
gacaagaccctctc

SEQ ID NO: 3055097 - DNA, 21 bp, Homo sapiens
gacaagcagatactgctgtgt

SEQ ID NO: 3055098 - DNA, 16 bp, Homo sapiens
gacaagccagaacttg

SEQ ID NO: 3055099 - DNA, 16 bp, Homo sapiens
gacaaggaaaaaataa

SEQ ID NO: 3055100 - DNA, 21 bp, Homo sapiens
gacaaggagagcggaggagga

SEQ ID NO: 3055101 - DNA, 16 bp, Homo sapiens
gacaagggaggcagtg

SEQ ID NO: 3055102 - DNA, 17 bp, Homo sapiens
gacaagggaggcagtgg

SEQ ID NO: 3055103 - DNA, 12 bp, Homo sapiens
gacaagtgctca

SEQ ID NO: 3055104 - DNA, 15 bp, Homo sapiens
gacaagtggactcag

SEQ ID NO: 3055105 - DNA, 16 bp, Homo sapiens
gacaatacgtttgata

SEQ ID NO: 3055106 - DNA, 22 bp, Homo sapiens
gacaatagagggccacggggag

SEQ ID NO: 3055107 - DNA, 15 bp, Homo sapiens
gacaatgactaagcc

SEQ ID NO: 3055108 - DNA, 17 bp, Homo sapiens
gacaatgcgtggcacat

SEQ ID NO: 3055109 - DNA, 19 bp, Homo sapiens
gacaatgtctgcagccctg

SEQ ID NO: 3055110 - DNA, 15 bp, Homo sapiens
gacaattctttatac

SEQ ID NO: 3055111 - DNA, 23 bp, Homo sapiens
gacacaatgttgcactgaaaacc

SEQ ID NO: 3055112 - DNA, 11 bp, Homo sapiens
gacacagaaaa

SEQ ID NO: 3055113 - DNA, 18 bp, Homo sapiens
gacacagaaaatgttgag

SEQ ID NO: 3055114 - DNA, 12 bp, Homo sapiens
gacacagactca

SEQ ID NO: 3055115 - DNA, 12 bp, Homo sapiens
gacacaggcctg

SEQ ID NO: 3055116 - DNA, 22 bp, Homo sapiens
gacacatatgcaccttgtgtct

SEQ ID NO: 3055117 - DNA, 13 bp, Homo sapiens
gacacatcagcat

SEQ ID NO: 3055118 - DNA, 18 bp, Homo sapiens
gacacatcagcatgtttt

SEQ ID NO: 3055119 - DNA, 19 bp, Homo sapiens
gacacattgtcatcagagg

SEQ ID NO: 3055120 - DNA, 15 bp, Homo sapiens
gacaccactcctgcc

SEQ ID NO: 3055121 - DNA, 19 bp, Homo sapiens
gacaccactcctgccagcc

SEQ ID NO: 3055122 - DNA, 21 bp, Homo sapiens
gacaccactcctgccagcccg

SEQ ID NO: 3055123 - DNA, 21 bp, Homo sapiens
gacaccactgagctctgcctc

SEQ ID NO: 3055124 - DNA, 18 bp, Homo sapiens
gacaccagccctgctgct

SEQ ID NO: 3055125 - DNA, 23 bp, Homo sapiens
gacaccagccctgctgcttccta

SEQ ID NO: 3055126 - DNA, 22 bp, Homo sapiens
gacaccgggccagtatctatat

SEQ ID NO: 3055127 - DNA, 14 bp, Homo sapiens
gacaccgtggcctg

SEQ ID NO: 3055128 - DNA, 15 bp, Homo sapiens
gacacctaggctagg

SEQ ID NO: 3055129 - DNA, 15 bp, Homo sapiens
gacacctgcacctcc

SEQ ID NO: 3055130 - DNA, 17 bp, Homo sapiens
gacacctgcacctcccc

SEQ ID NO: 3055131 - DNA, 20 bp, Homo sapiens
gacacctgcacctcccccca

SEQ ID NO: 3055132 - DNA, 14 bp, Homo sapiens
gacaccttctgtgc

SEQ ID NO: 3055133 - DNA, 14 bp, Homo sapiens
gacacctttaggtt

SEQ ID NO: 3055134 - DNA, 21 bp, Homo sapiens
gacacgcgcccccctcccaga

SEQ ID NO: 3055135 - DNA, 23 bp, Homo sapiens
gacacgctcttctattttattcc

SEQ ID NO: 3055136 - DNA, 15 bp, Homo sapiens
gacactaccctgaga

SEQ ID NO: 3055137 - DNA, 22 bp, Homo sapiens
gacactaccctgagatctgcac

SEQ ID NO: 3055138 - DNA, 23 bp, Homo sapiens
gacactagggaaaggtaaataca

SEQ ID NO: 3055139 - DNA, 15 bp, Homo sapiens
gacactcagggcagc

SEQ ID NO: 3055140 - DNA, 21 bp, Homo sapiens
gacactcagggcagctgcctg

SEQ ID NO: 3055141 - DNA, 22 bp, Homo sapiens
gacactcagggcagctgcctgg

SEQ ID NO: 3055142 - DNA, 23 bp, Homo sapiens
gacactcccacccagtctctgct

SEQ ID NO: 3055143 - DNA, 16 bp, Homo sapiens
gacactccccgaagtc

SEQ ID NO: 3055144 - DNA, 21 bp, Homo sapiens
gacactccccgaagtcttttg

SEQ ID NO: 3055145 - DNA, 21 bp, Homo sapiens
gacactcccttgggctccctg

SEQ ID NO: 3055146 - DNA, 19 bp, Homo sapiens
gacactctccttgcagttc

SEQ ID NO: 3055147 - DNA, 15 bp, Homo sapiens
gacactgagggtcac

SEQ ID NO: 3055148 - DNA, 12 bp, Homo sapiens
gacactgcctgg

SEQ ID NO: 3055149 - DNA, 13 bp, Homo sapiens
gacactgcctggg

SEQ ID NO: 3055150 - DNA, 13 bp, Homo sapiens
gacactggcccca

SEQ ID NO: 3055151 - DNA, 17 bp, Homo sapiens
gacactggccccacagg

SEQ ID NO: 3055152 - DNA, 17 bp, Homo sapiens
gacactgggaggccagt

SEQ ID NO: 3055153 - DNA, 23 bp, Homo sapiens
gacactgggaggccagtgagcca

SEQ ID NO: 3055154 - DNA, 16 bp, Homo sapiens
gacactggtttgaaga

SEQ ID NO: 3055155 - DNA, 17 bp, Homo sapiens
gacactgtgacaatgac

SEQ ID NO: 3055156 - DNA, 22 bp, Homo sapiens
gacactgttctcccttcggtgg

SEQ ID NO: 3055157 - DNA, 23 bp, Homo sapiens
gacacttctttatactctcttcc

SEQ ID NO: 3055158 - DNA, 13 bp, Homo sapiens
gacacttttatat

SEQ ID NO: 3055159 - DNA, 22 bp, Homo sapiens
gacacttttatatttgaaaaaa

SEQ ID NO: 3055160 - DNA, 16 bp, Homo sapiens
gacagaaaacatgttt

SEQ ID NO: 3055161 - DNA, 19 bp, Homo sapiens
gacagaacttcagcattgt

SEQ ID NO: 3055162 - DNA, 23 bp, Homo sapiens
gacagaacttcagcattgtaatt

SEQ ID NO: 3055163 - DNA, 15 bp, Homo sapiens
gacagaaggaccagc

SEQ ID NO: 3055164 - DNA, 16 bp, Homo sapiens
gacagaaggaccagcc

SEQ ID NO: 3055165 - DNA, 20 bp, Homo sapiens
gacagaagtttgcactatct

SEQ ID NO: 3055166 - DNA, 18 bp, Homo sapiens
gacagaattttttttgtt

SEQ ID NO: 3055167 - DNA, 21 bp, Homo sapiens
gacagaattttttttgttgtt

SEQ ID NO: 3055168 - DNA, 14 bp, Homo sapiens
gacagaccctctgc

SEQ ID NO: 3055169 - DNA, 17 bp, Homo sapiens
gacagaccctctgccgc

SEQ ID NO: 3055170 - DNA, 16 bp, Homo sapiens
gacagactcctgagga

SEQ ID NO: 3055171 - DNA, 11 bp, Homo sapiens
gacagactggc

SEQ ID NO: 3055172 - DNA, 14 bp, Homo sapiens
gacagactggccgg

SEQ ID NO: 3055173 - DNA, 19 bp, Homo sapiens
gacagactggccgggcagg

SEQ ID NO: 3055174 - DNA, 21 bp, Homo sapiens
gacagactggccgggcaggcg

SEQ ID NO: 3055175 - DNA, 16 bp, Homo sapiens
gacagagacacctgca

SEQ ID NO: 3055176 - DNA, 18 bp, Homo sapiens
gacagaggccccagcctc

SEQ ID NO: 3055177 - DNA, 19 bp, Homo sapiens
gacagaggccccagcctcc

SEQ ID NO: 3055178 - DNA, 19 bp, Homo sapiens
gacagagggcacatgaaca

SEQ ID NO: 3055179 - DNA, 18 bp, Homo sapiens
gacagagggtcacagtgt

SEQ ID NO: 3055180 - DNA, 21 bp, Homo sapiens
gacagaggttgtagtgagcca

SEQ ID NO: 3055181 - DNA, 23 bp, Homo sapiens
gacagaggttgtagtgagccaag

SEQ ID NO: 3055182 - DNA, 22 bp, Homo sapiens
gacagagtgagaccctgtctca

SEQ ID NO: 3055183 - DNA, 17 bp, Homo sapiens
gacagatcaagctgtga

SEQ ID NO: 3055184 - DNA, 18 bp, Homo sapiens
gaatacagcagcaagaaa

SEQ ID NO: 3055185 - DNA, 17 bp, Homo sapiens
gaatactgccaaaacat

SEQ ID NO: 3055186 - DNA, 23 bp, Homo sapiens
gaatactgcttgcttacaatctt

SEQ ID NO: 3055187 - DNA, 18 bp, Homo sapiens
gaatactgttttatctcc

SEQ ID NO: 3055188 - DNA, 14 bp, Homo sapiens
gaatacttgaactt

SEQ ID NO: 3055189 - DNA, 15 bp, Homo sapiens
gaatacttgaacttg

SEQ ID NO: 3055190 - DNA, 14 bp, Homo sapiens
gaatactttataaa

SEQ ID NO: 3055191 - DNA, 14 bp, Homo sapiens
gaatactttttaca

SEQ ID NO: 3055192 - DNA, 20 bp, Homo sapiens
gaatactttttacaattaaa

SEQ ID NO: 3055193 - DNA, 13 bp, Homo sapiens
gaatagagctgcc

SEQ ID NO: 3055194 - DNA, 19 bp, Homo sapiens
gaatagagctgccactggg

SEQ ID NO: 3055195 - DNA, 23 bp, Homo sapiens
gaatagccacatttggaatactt

SEQ ID NO: 3055196 - DNA, 15 bp, Homo sapiens
gaatagcctgtggcc

SEQ ID NO: 3055197 - DNA, 14 bp, Homo sapiens
gaataggaaataaa

SEQ ID NO: 3055198 - DNA, 17 bp, Homo sapiens
gaatagtctctgggttt

SEQ ID NO: 3055199 - DNA, 14 bp, Homo sapiens
gaatagttttctcc

SEQ ID NO: 3055200 - DNA, 15 bp, Homo sapiens
gaatagttttctcct

SEQ ID NO: 3055201 - DNA, 14 bp, Homo sapiens
gaatataaatattt

SEQ ID NO: 3055202 - DNA, 13 bp, Homo sapiens
gaatataacatga

SEQ ID NO: 3055203 - DNA, 20 bp, Homo sapiens
gaatataacatgaaatgata

SEQ ID NO: 3055204 - DNA, 20 bp, Homo sapiens
gaatatatctctatttgaga

SEQ ID NO: 3055205 - DNA, 13 bp, Homo sapiens
gaatatcaatata

SEQ ID NO: 3055206 - DNA, 15 bp, Homo sapiens
gaatatcaatataat

SEQ ID NO: 3055207 - DNA, 20 bp, Homo sapiens
gaatatgcattgtctgcaat

SEQ ID NO: 3055208 - DNA, 15 bp, Homo sapiens
gaatattaagaaaca

SEQ ID NO: 3055209 - DNA, 19 bp, Homo sapiens
gaatattttatattaaaat

SEQ ID NO: 3055210 - DNA, 23 bp, Homo sapiens
gaatattttgttttgtgcagaga

SEQ ID NO: 3055211 - DNA, 15 bp, Homo sapiens
gaatcactgttttta

SEQ ID NO: 3055212 - DNA, 17 bp, Homo sapiens
gaatcactgtttttaga

SEQ ID NO: 3055213 - DNA, 18 bp, Homo sapiens
gaatcagaccctacccca

SEQ ID NO: 3055214 - DNA, 19 bp, Homo sapiens
gaatcagatcatttcaaaa

SEQ ID NO: 3055215 - DNA, 19 bp, Homo sapiens
gaatcagctgcagctgctt

SEQ ID NO: 3055216 - DNA, 17 bp, Homo sapiens
gaatccaaatctgtcct

SEQ ID NO: 3055217 - DNA, 18 bp, Homo sapiens
gaatccaaatctgtcctc

SEQ ID NO: 3055218 - DNA, 16 bp, Homo sapiens
gaatccacatttctaa

SEQ ID NO: 3055219 - DNA, 17 bp, Homo sapiens
gaatccacatttctaaa

SEQ ID NO: 3055220 - DNA, 18 bp, Homo sapiens
gaatccacatttctaaaa

SEQ ID NO: 3055221 - DNA, 19 bp, Homo sapiens
gaatccatgggtctggcta

SEQ ID NO: 3055222 - DNA, 16 bp, Homo sapiens
gaatcccactgtatga

SEQ ID NO: 3055223 - DNA, 23 bp, Homo sapiens
gaatcctacacacctaagggaca

SEQ ID NO: 3055224 - DNA, 19 bp, Homo sapiens
gaatcctggcaagaaagct

SEQ ID NO: 3055225 - DNA, 13 bp, Homo sapiens
gaatcctgggccc

SEQ ID NO: 3055226 - DNA, 21 bp, Homo sapiens
gaatcctgggcccccagagac

SEQ ID NO: 3055227 - DNA, 18 bp, Homo sapiens
gaatctaacagtgacttc

SEQ ID NO: 3055228 - DNA, 18 bp, Homo sapiens
gaatctaaggataatgaa

SEQ ID NO: 3055229 - DNA, 13 bp, Homo sapiens
gaatctacatttg

SEQ ID NO: 3055230 - DNA, 15 bp, Homo sapiens
gaatctacatttgtt

SEQ ID NO: 3055231 - DNA, 20 bp, Homo sapiens
gaatctacatttgtttgtat

SEQ ID NO: 3055232 - DNA, 19 bp, Homo sapiens
gaatctcgcagtgtttctg

SEQ ID NO: 3055233 - DNA, 18 bp, Homo sapiens
gaatctctttttgctttc

SEQ ID NO: 3055234 - DNA, 15 bp, Homo sapiens
gaatctgctcacttt

SEQ ID NO: 3055235 - DNA, 16 bp, Homo sapiens
gaatctggagaccagg

SEQ ID NO: 3055236 - DNA, 15 bp, Homo sapiens
gaatctggcattcta

SEQ ID NO: 3055237 - DNA, 20 bp, Homo sapiens
gaatctgtgggtctgggagt

SEQ ID NO: 3055238 - DNA, 22 bp, Homo sapiens
gaatcttaaggtgtagccacac

SEQ ID NO: 3055239 - DNA, 23 bp, Homo sapiens
gaatcttggtttgccttccagaa

SEQ ID NO: 3055240 - DNA, 19 bp, Homo sapiens
gaatctttaaaagatgctt

SEQ ID NO: 3055241 - DNA, 12 bp, Homo sapiens
gaatgaaaaatg

SEQ ID NO: 3055242 - DNA, 19 bp, Homo sapiens
gaatgaaaaatgaaagatg

SEQ ID NO: 3055243 - DNA, 21 bp, Homo sapiens
gaatgaaaaatgaaagatgat

SEQ ID NO: 3055244 - DNA, 14 bp, Homo sapiens
gaatgaaaataact

SEQ ID NO: 3055245 - DNA, 20 bp, Homo sapiens
gaatgaacccatagggagct

SEQ ID NO: 3055246 - DNA, 19 bp, Homo sapiens
gaatgactcatgcctctga

SEQ ID NO: 3055247 - DNA, 16 bp, Homo sapiens
gaatgaggaacaatca

SEQ ID NO: 3055248 - DNA, 12 bp, Homo sapiens
gaatgagggagg

SEQ ID NO: 3055249 - DNA, 13 bp, Homo sapiens
gaatgagggaggc

SEQ ID NO: 3055250 - DNA, 21 bp, Homo sapiens
gaatgcacacagcggctgcct

SEQ ID NO: 3055251 - DNA, 19 bp, Homo sapiens
gaatgcagcactgctgcct

SEQ ID NO: 3055252 - DNA, 22 bp, Homo sapiens
gaatgcagtctgtccaggctcg

SEQ ID NO: 3055253 - DNA, 23 bp, Homo sapiens
gaatgcatattcaacacactgcc

SEQ ID NO: 3055254 - DNA, 20 bp, Homo sapiens
gaatgcattgatattgtgaa

SEQ ID NO: 3055255 - DNA, 21 bp, Homo sapiens
gaatgcattgatattgtgaac

SEQ ID NO: 3055256 - DNA, 17 bp, Homo sapiens
gaatgcccccagctggc

SEQ ID NO: 3055257 - DNA, 20 bp, Homo sapiens
gaatgcccctgttcatgttt

SEQ ID NO: 3055258 - DNA, 19 bp, Homo sapiens
gaatgcctcataaattaat

SEQ ID NO: 3055259 - DNA, 17 bp, Homo sapiens
gaatgctgtacatctat

SEQ ID NO: 3055260 - DNA, 21 bp, Homo sapiens
gaatggcacgttgctgccagt

SEQ ID NO: 3055261 - DNA, 17 bp, Homo sapiens
gaatggctttgtcttga

SEQ ID NO: 3055262 - DNA, 16 bp, Homo sapiens
gaatgggatattttga

SEQ ID NO: 3055263 - DNA, 20 bp, Homo sapiens
gaatgggatattttgaaatg

SEQ ID NO: 3055264 - DNA, 12 bp, Homo sapiens
gaatgggcaggt

SEQ ID NO: 3055265 - DNA, 15 bp, Homo sapiens
gaatgggcagttaca

SEQ ID NO: 3055266 - DNA, 13 bp, Homo sapiens
gaatggttataaa

SEQ ID NO: 3055267 - DNA, 17 bp, Homo sapiens
gaatggttataaaagtg

SEQ ID NO: 3055268 - DNA, 14 bp, Homo sapiens
gaatggttgagtga

SEQ ID NO: 3055269 - DNA, 16 bp, Homo sapiens
gaatggtttttgttga

SEQ ID NO: 3055270 - DNA, 14 bp, Homo sapiens
gaatgtacgtccag

SEQ ID NO: 3055271 - DNA, 16 bp, Homo sapiens
gaatgtatgcttcata

SEQ ID NO: 3055272 - DNA, 18 bp, Homo sapiens
gaatgtatgcttcataca

SEQ ID NO: 3055273 - DNA, 22 bp, Homo sapiens
gaatgtattgtaccttttaaca

SEQ ID NO: 3055274 - DNA, 14 bp, Homo sapiens
gaatgtcagtgttc

SEQ ID NO: 3055275 - DNA, 15 bp, Homo sapiens
gaatgtccaaaattt

SEQ ID NO: 3055276 - DNA, 18 bp, Homo sapiens
gaatgtgataaggaaatc

SEQ ID NO: 3055277 - DNA, 19 bp, Homo sapiens
gaatgtgataaggaaatca

SEQ ID NO: 3055278 - DNA, 13 bp, Homo sapiens
gaatgtgattttt

SEQ ID NO: 3055279 - DNA, 14 bp, Homo sapiens
gaatgtgctgcctt

SEQ ID NO: 3055280 - DNA, 18 bp, Homo sapiens
gaatgtggcttgagaaat

SEQ ID NO: 3055281 - DNA, 19 bp, Homo sapiens
gaatgtgtttcaaactgta

SEQ ID NO: 3055282 - DNA, 14 bp, Homo sapiens
gaatgttgggactg

SEQ ID NO: 3055283 - DNA, 14 bp, Homo sapiens
gaattaaaaaagca

SEQ ID NO: 3055284 - DNA, 13 bp, Homo sapiens
gaattaaaattta

SEQ ID NO: 3055285 - DNA, 22 bp, Homo sapiens
gaattaaacccacaagctgcct

SEQ ID NO: 3055286 - DNA, 15 bp, Homo sapiens
gaattaaagcctttg

SEQ ID NO: 3055287 - DNA, 17 bp, Homo sapiens
gaattaattcagatgtt

SEQ ID NO: 3055288 - DNA, 17 bp, Homo sapiens
gaattaccaagagaagg

SEQ ID NO: 3055289 - DNA, 16 bp, Homo sapiens
gaattacccttcctca

SEQ ID NO: 3055290 - DNA, 12 bp, Homo sapiens
gaattactccaa

SEQ ID NO: 3055291 - DNA, 13 bp, Homo sapiens
gaattagatgttt

SEQ ID NO: 3055292 - DNA, 16 bp, Homo sapiens
gaattagatgtttata

SEQ ID NO: 3055293 - DNA, 22 bp, Homo sapiens
gaattatactttgttgttttta

SEQ ID NO: 3055294 - DNA, 23 bp, Homo sapiens
gaattatactttgttgtttttaa

SEQ ID NO: 3055295 - DNA, 22 bp, Homo sapiens
gaattatcctatttcagtactt

SEQ ID NO: 3055296 - DNA, 19 bp, Homo sapiens
gaattatttttttaaagtg

SEQ ID NO: 3055297 - DNA, 18 bp, Homo sapiens
gaattcaaactggggcct

SEQ ID NO: 3055298 - DNA, 21 bp, Homo sapiens
gaattccaagtgtattttaaa

SEQ ID NO: 3055299 - DNA, 15 bp, Homo sapiens
gaattccaattaaat

SEQ ID NO: 3055300 - DNA, 22 bp, Homo sapiens
gaattccatagtggaccacttg

SEQ ID NO: 3055301 - DNA, 14 bp, Homo sapiens
gaattccatcttgt

SEQ ID NO: 3055302 - DNA, 17 bp, Homo sapiens
gaattccatttgaggat

SEQ ID NO: 3055303 - DNA, 15 bp, Homo sapiens
gaattcccttttaat

SEQ ID NO: 3055304 - DNA, 17 bp, Homo sapiens
gaattcctagaattaaa

SEQ ID NO: 3055305 - DNA, 16 bp, Homo sapiens
gaattccttcagggtg

SEQ ID NO: 3055306 - DNA, 17 bp, Homo sapiens
gaattccttcagggtga

SEQ ID NO: 3055307 - DNA, 14 bp, Homo sapiens
gaattctagctttt

SEQ ID NO: 3055308 - DNA, 16 bp, Homo sapiens
gaattctggtcctgtt

SEQ ID NO: 3055309 - DNA, 19 bp, Homo sapiens
gaattctttacaataaaca

SEQ ID NO: 3055310 - DNA, 13 bp, Homo sapiens
gaattgaaacact

SEQ ID NO: 3055311 - DNA, 16 bp, Homo sapiens
gaattgacattctcta

SEQ ID NO: 3055312 - DNA, 18 bp, Homo sapiens
gaattgacattctctatt

SEQ ID NO: 3055313 - DNA, 17 bp, Homo sapiens
gaattgagatgattaaa

SEQ ID NO: 3055314 - DNA, 13 bp, Homo sapiens
gaattgatttgca

SEQ ID NO: 3055315 - DNA, 12 bp, Homo sapiens
gaattgcattga

SEQ ID NO: 3055316 - DNA, 22 bp, Homo sapiens
gaattggcatttcccaatattt

SEQ ID NO: 3055317 - DNA, 13 bp, Homo sapiens
gaattggcctgaa

SEQ ID NO: 3055318 - DNA, 19 bp, Homo sapiens
gaattggcctgaacagatg

SEQ ID NO: 3055319 - DNA, 22 bp, Homo sapiens
gaattggcctgaacagatgtaa

SEQ ID NO: 3055320 - DNA, 16 bp, Homo sapiens
gaattgtaactgttct

SEQ ID NO: 3055321 - DNA, 11 bp, Homo sapiens
gaagccctcct

SEQ ID NO: 3055322 - DNA, 19 bp, Homo sapiens
gaagccctccttccacgga

SEQ ID NO: 3055323 - DNA, 22 bp, Homo sapiens
gaagccctggatttcagaaaga

SEQ ID NO: 3055324 - DNA, 14 bp, Homo sapiens
gaagccctgttgtg

SEQ ID NO: 3055325 - DNA, 21 bp, Homo sapiens
gaagccctttgcctgtagagc

SEQ ID NO: 3055326 - DNA, 16 bp, Homo sapiens
gaagccgtgccctgcc

SEQ ID NO: 3055327 - DNA, 22 bp, Homo sapiens
gaagcctaattgtcacatcaag

SEQ ID NO: 3055328 - DNA, 18 bp, Homo sapiens
gaagcctaggaggactgg

SEQ ID NO: 3055329 - DNA, 22 bp, Homo sapiens
gaagcctgaactgaggccttgt

SEQ ID NO: 3055330 - DNA, 10 bp, Homo sapiens
gaagcctgtc

SEQ ID NO: 3055331 - DNA, 21 bp, Homo sapiens
gaagccttgctgaactaagtt

SEQ ID NO: 3055332 - DNA, 17 bp, Homo sapiens
gaagcgaacatcttcat

SEQ ID NO: 3055333 - DNA, 23 bp, Homo sapiens
gaagcgacttttgttctcttctg

SEQ ID NO: 3055334 - DNA, 20 bp, Homo sapiens
gaagcggtcagactggaggt

SEQ ID NO: 3055335 - DNA, 20 bp, Homo sapiens
gaagcgttgtcctcagcccc

SEQ ID NO: 3055336 - DNA, 16 bp, Homo sapiens
gaagctaatttgcatt

SEQ ID NO: 3055337 - DNA, 15 bp, Homo sapiens
gaagctacaggttac

SEQ ID NO: 3055338 - DNA, 22 bp, Homo sapiens
gaagctactgtgtgtgtgaatg

SEQ ID NO: 3055339 - DNA, 23 bp, Homo sapiens
gaagctactgtgtgtgtgaatga

SEQ ID NO: 3055340 - DNA, 22 bp, Homo sapiens
gaagctcacctgttgcttacaa

SEQ ID NO: 3055341 - DNA, 22 bp, Homo sapiens
gaagctcctctccccagcccag

SEQ ID NO: 3055342 - DNA, 18 bp, Homo sapiens
gaagctgcatccagaggc

SEQ ID NO: 3055343 - DNA, 19 bp, Homo sapiens
gaagctgctgcagccctgc

SEQ ID NO: 3055344 - DNA, 13 bp, Homo sapiens
gaagctggagtgc

SEQ ID NO: 3055345 - DNA, 19 bp, Homo sapiens
gaagctggagtgctgcttg

SEQ ID NO: 3055346 - DNA, 14 bp, Homo sapiens
gaagctgtactttt

SEQ ID NO: 3055347 - DNA, 17 bp, Homo sapiens
gaagctgtgtccttgca

SEQ ID NO: 3055348 - DNA, 23 bp, Homo sapiens
gaagcttgtgtatccattatcat

SEQ ID NO: 3055349 - DNA, 19 bp, Homo sapiens
gaagctttgtcccctgctt

SEQ ID NO: 3055350 - DNA, 21 bp, Homo sapiens
gaagctttgtcccctgcttca

SEQ ID NO: 3055351 - DNA, 20 bp, Homo sapiens
gaaggaaagcatgtctctgc

SEQ ID NO: 3055352 - DNA, 19 bp, Homo sapiens
gaaggaaatgagtggccag

SEQ ID NO: 3055353 - DNA, 14 bp, Homo sapiens
gaaggaaggctctc

SEQ ID NO: 3055354 - DNA, 18 bp, Homo sapiens
gaaggacaatcccaggaa

SEQ ID NO: 3055355 - DNA, 17 bp, Homo sapiens
gaaggacagactggccg

SEQ ID NO: 3055356 - DNA, 14 bp, Homo sapiens
gaaggacagctgtg

SEQ ID NO: 3055357 - DNA, 17 bp, Homo sapiens
gaaggactggccgtggc

SEQ ID NO: 3055358 - DNA, 17 bp, Homo sapiens
gaaggagaaggaaggag

SEQ ID NO: 3055359 - DNA, 13 bp, Homo sapiens
gaaggagacacag

SEQ ID NO: 3055360 - DNA, 14 bp, Homo sapiens
gaaggagacacaga

SEQ ID NO: 3055361 - DNA, 16 bp, Homo sapiens
gaaggagacacagatg

SEQ ID NO: 3055362 - DNA, 17 bp, Homo sapiens
gaaggagacacagatgt

SEQ ID NO: 3055363 - DNA, 15 bp, Homo sapiens
gaaggagacaggcag

SEQ ID NO: 3055364 - DNA, 15 bp, Homo sapiens
gaaggagactcacct

SEQ ID NO: 3055365 - DNA, 22 bp, Homo sapiens
gaaggagactcacctctgcctc

SEQ ID NO: 3055366 - DNA, 23 bp, Homo sapiens
gaaggagagatgacccctacccc

SEQ ID NO: 3055367 - DNA, 20 bp, Homo sapiens
gaaggagccccattcctggg

SEQ ID NO: 3055368 - DNA, 21 bp, Homo sapiens
gaaggagccccattcctggga

SEQ ID NO: 3055369 - DNA, 14 bp, Homo sapiens
gaaggagcccctga

SEQ ID NO: 3055370 - DNA, 18 bp, Homo sapiens
gaaggagcccctgagtcc

SEQ ID NO: 3055371 - DNA, 14 bp, Homo sapiens
gaaggagcggcgcc

SEQ ID NO: 3055372 - DNA, 19 bp, Homo sapiens
gaaggagcggcgccctgga

SEQ ID NO: 3055373 - DNA, 20 bp, Homo sapiens
gaaggagcggcgccctggac

SEQ ID NO: 3055374 - DNA, 19 bp, Homo sapiens
gaaggaggtaaaggatgag

SEQ ID NO: 3055375 - DNA, 19 bp, Homo sapiens
gaaggatattttcaacaat

SEQ ID NO: 3055376 - DNA, 18 bp, Homo sapiens
gaaggatggcatctccat

SEQ ID NO: 3055377 - DNA, 17 bp, Homo sapiens
gaaggatgtacatttcc

SEQ ID NO: 3055378 - DNA, 19 bp, Homo sapiens
gaaggcaaaggcagaggaa

SEQ ID NO: 3055379 - DNA, 21 bp, Homo sapiens
gaaggcaaaggcagaggaatt

SEQ ID NO: 3055380 - DNA, 17 bp, Homo sapiens
gaaggcagagaaaggga

SEQ ID NO: 3055381 - DNA, 13 bp, Homo sapiens
gaaggcaggaaga

SEQ ID NO: 3055382 - DNA, 22 bp, Homo sapiens
gaaggccgacaccactcctgcc

SEQ ID NO: 3055383 - DNA, 17 bp, Homo sapiens
gaaggccgagaagcaag

SEQ ID NO: 3055384 - DNA, 24 bp, Homo sapiens
gaaggcctaggctaggacgttggc

SEQ ID NO: 3055385 - DNA, 14 bp, Homo sapiens
gaaggcctcccctg

SEQ ID NO: 3055386 - DNA, 20 bp, Homo sapiens
gaaggctctcgggtggggga

SEQ ID NO: 3055387 - DNA, 22 bp, Homo sapiens
gaaggctctcgggtgggggagc

SEQ ID NO: 3055388 - DNA, 17 bp, Homo sapiens
gaaggcttgttgtgctt

SEQ ID NO: 3055389 - DNA, 19 bp, Homo sapiens
gaagggaatcctcctccag

SEQ ID NO: 3055390 - DNA, 20 bp, Homo sapiens
gaagggaatcctcctccagg

SEQ ID NO: 3055391 - DNA, 13 bp, Homo sapiens
gaagggagagggc

SEQ ID NO: 3055392 - DNA, 20 bp, Homo sapiens
gaagggagggagctgaggcc

SEQ ID NO: 3055393 - DNA, 13 bp, Homo sapiens
gaagggaggggaa

SEQ ID NO: 3055394 - DNA, 13 bp, Homo sapiens
gaagggccagagc

SEQ ID NO: 3055395 - DNA, 15 bp, Homo sapiens
gaagggccagagcca

SEQ ID NO: 3055396 - DNA, 20 bp, Homo sapiens
gaaggggacccccgccccct

SEQ ID NO: 3055397 - DNA, 23 bp, Homo sapiens
gaaggggcaaattcttttgaatt

SEQ ID NO: 3055398 - DNA, 16 bp, Homo sapiens
gaaggggccagaggct

SEQ ID NO: 3055399 - DNA, 22 bp, Homo sapiens
gaaggggtaggattactaggtg

SEQ ID NO: 3055400 - DNA, 16 bp, Homo sapiens
gaaggtcccctggcag

SEQ ID NO: 3055401 - DNA, 16 bp, Homo sapiens
gaaggtcctgctatta

SEQ ID NO: 3055402 - DNA, 20 bp, Homo sapiens
gaaggtgccagaaggaaggt

SEQ ID NO: 3055403 - DNA, 22 bp, Homo sapiens
gaaggtgccccaaaatgcaaga

SEQ ID NO: 3055404 - DNA, 23 bp, Homo sapiens
gaaggtgtgtcctcaagaagaaa

SEQ ID NO: 3055405 - DNA, 15 bp, Homo sapiens
gaaggttggcggggg

SEQ ID NO: 3055406 - DNA, 22 bp, Homo sapiens
gaaggttggtgaatttcacaag

SEQ ID NO: 3055407 - DNA, 19 bp, Homo sapiens
gaagtaaccatttgcactg

SEQ ID NO: 3055408 - DNA, 18 bp, Homo sapiens
gaagtaactcccactcct

SEQ ID NO: 3055409 - DNA, 20 bp, Homo sapiens
gaagtaactcccactcctaa

SEQ ID NO: 3055410 - DNA, 15 bp, Homo sapiens
gaagtaagaagagga

SEQ ID NO: 3055411 - DNA, 20 bp, Homo sapiens
gaagtacgtcccagcggcct

SEQ ID NO: 3055412 - DNA, 14 bp, Homo sapiens
gaagtactttgtgc

SEQ ID NO: 3055413 - DNA, 15 bp, Homo sapiens
gaagtactttgtgct

SEQ ID NO: 3055414 - DNA, 13 bp, Homo sapiens
gaagtaggaagta

SEQ ID NO: 3055415 - DNA, 17 bp, Homo sapiens
gaagtatctaaaagtgt

SEQ ID NO: 3055416 - DNA, 19 bp, Homo sapiens
gaagtatctaaaagtgtca

SEQ ID NO: 3055417 - DNA, 20 bp, Homo sapiens
gaagtattttcctccaaagt

SEQ ID NO: 3055418 - DNA, 17 bp, Homo sapiens
gaagtcaaataaatgtt

SEQ ID NO: 3055419 - DNA, 19 bp, Homo sapiens
gaagtcaaataaatgtttc

SEQ ID NO: 3055420 - DNA, 16 bp, Homo sapiens
gaagtcaagctcaaca

SEQ ID NO: 3055421 - DNA, 13 bp, Homo sapiens
gaagtcagagagg

SEQ ID NO: 3055422 - DNA, 17 bp, Homo sapiens
gaagtccaatgtggcaa

SEQ ID NO: 3055423 - DNA, 17 bp, Homo sapiens
gaagtccccaggcccca

SEQ ID NO: 3055424 - DNA, 15 bp, Homo sapiens
gaagtccctcagagg

SEQ ID NO: 3055425 - DNA, 15 bp, Homo sapiens
gaagtcttgcattga

SEQ ID NO: 3055426 - DNA, 14 bp, Homo sapiens
gaagtgacagggaa

SEQ ID NO: 3055427 - DNA, 15 bp, Homo sapiens
gaagtgacagggaag

SEQ ID NO: 3055428 - DNA, 18 bp, Homo sapiens
gaagtgacagggaagcta

SEQ ID NO: 3055429 - DNA, 22 bp, Homo sapiens
gaagtgacagggaagctacagg

SEQ ID NO: 3055430 - DNA, 13 bp, Homo sapiens
gaagtgatgttca

SEQ ID NO: 3055431 - DNA, 16 bp, Homo sapiens
gaagtgcatctacttg

SEQ ID NO: 3055432 - DNA, 20 bp, Homo sapiens
gaagtgctgctccatgtttc

SEQ ID NO: 3055433 - DNA, 20 bp, Homo sapiens
gaagtggtgttccatgactt

SEQ ID NO: 3055434 - DNA, 11 bp, Homo sapiens
gaagtgtgatt

SEQ ID NO: 3055435 - DNA, 12 bp, Homo sapiens
gaagtgttcctg

SEQ ID NO: 3055436 - DNA, 19 bp, Homo sapiens
gaagttacatgcataaaag

SEQ ID NO: 3055437 - DNA, 13 bp, Homo sapiens
gaagttagaattc

SEQ ID NO: 3055438 - DNA, 20 bp, Homo sapiens
gaagttagaattccttcagg

SEQ ID NO: 3055439 - DNA, 22 bp, Homo sapiens
gaagttcaccattaaaagggat

SEQ ID NO: 3055440 - DNA, 15 bp, Homo sapiens
gaagttctttgatcc

SEQ ID NO: 3055441 - DNA, 19 bp, Homo sapiens
gaagttggggcactgggcg

SEQ ID NO: 3055442 - DNA, 20 bp, Homo sapiens
gaagttgtggatttcagttt

SEQ ID NO: 3055443 - DNA, 17 bp, Homo sapiens
gaagttgtgtgacccta

SEQ ID NO: 3055444 - DNA, 14 bp, Homo sapiens
gaagttgtttgtca

SEQ ID NO: 3055445 - DNA, 13 bp, Homo sapiens
gaagttttacatt

SEQ ID NO: 3055446 - DNA, 17 bp, Homo sapiens
gaagtttttgaaatacc

SEQ ID NO: 3055447 - DNA, 18 bp, Homo sapiens
gaataaaaattgatgaga

SEQ ID NO: 3055448 - DNA, 18 bp, Homo sapiens
gaataaacgcagaagagg

SEQ ID NO: 3055449 - DNA, 13 bp, Homo sapiens
gaataaagaatac

SEQ ID NO: 3055450 - DNA, 18 bp, Homo sapiens
gaataaagaatacttgaa

SEQ ID NO: 3055451 - DNA, 16 bp, Homo sapiens
gaataaatatgcctct

SEQ ID NO: 3055452 - DNA, 21 bp, Homo sapiens
gaataacttgctactcatggc

SEQ ID NO: 3055453 - DNA, 21 bp, Homo sapiens
gaataatttatagtaatgagt

SEQ ID NO: 3055454 - DNA, 12 bp, Homo sapiens
gaatacaaaagg

SEQ ID NO: 3055455 - DNA, 21 bp, Homo sapiens
gaatacaaatagaaaaagtga

SEQ ID NO: 3055456 - DNA, 23 bp, Homo sapiens
gaatacacatctctgtcagtgtg

SEQ ID NO: 3055457 - DNA, 22 bp, Homo sapiens
gcaccattctttcttggtgcat

SEQ ID NO: 3055458 - DNA, 23 bp, Homo sapiens
gcacccaccaccatgcccagcta

SEQ ID NO: 3055459 - DNA, 17 bp, Homo sapiens
gcacccaccctgggacc

SEQ ID NO: 3055460 - DNA, 11 bp, Homo sapiens
gcacccagaac

SEQ ID NO: 3055461 - DNA, 14 bp, Homo sapiens
gcacccagaacagt

SEQ ID NO: 3055462 - DNA, 15 bp, Homo sapiens
gcaccccctctcctg

SEQ ID NO: 3055463 - DNA, 17 bp, Homo sapiens
gcaccccctctcctgga

SEQ ID NO: 3055464 - DNA, 16 bp, Homo sapiens
gcacccctttccccag

SEQ ID NO: 3055465 - DNA, 18 bp, Homo sapiens
gcacccctttccccagcc

SEQ ID NO: 3055466 - DNA, 19 bp, Homo sapiens
gcacccctttccccagcct

SEQ ID NO: 3055467 - DNA, 17 bp, Homo sapiens
gcaccctcatacacaga

SEQ ID NO: 3055468 - DNA, 20 bp, Homo sapiens
gcaccctcatacacagaaac

SEQ ID NO: 3055469 - DNA, 13 bp, Homo sapiens
gcaccctggcctg

SEQ ID NO: 3055470 - DNA, 14 bp, Homo sapiens
gcaccctggcctgg

SEQ ID NO: 3055471 - DNA, 16 bp, Homo sapiens
gcaccgaccccgggcc

SEQ ID NO: 3055472 - DNA, 20 bp, Homo sapiens
gcagacaggccccgtgaggc

SEQ ID NO: 3055473 - DNA, 20 bp, Homo sapiens
gcagaccttactcaggggat

SEQ ID NO: 3055474 - DNA, 21 bp, Homo sapiens
gcagaccttactcaggggatg

SEQ ID NO: 3055475 - DNA, 19 bp, Homo sapiens
gcagacgtctgccttggca

SEQ ID NO: 3055476 - DNA, 17 bp, Homo sapiens
gcagacgtctggccctg

SEQ ID NO: 3055477 - DNA, 20 bp, Homo sapiens
gcagacgtctggccctggcg

SEQ ID NO: 3055478 - DNA, 19 bp, Homo sapiens
gcagactagaattctggga

SEQ ID NO: 3055479 - DNA, 15 bp, Homo sapiens
gcagactcagctctg

SEQ ID NO: 3055480 - DNA, 18 bp, Homo sapiens
gcagactgcttggccaga

SEQ ID NO: 3055481 - DNA, 23 bp, Homo sapiens
gcagagaatataacatgaaatga

SEQ ID NO: 3055482 - DNA, 13 bp, Homo sapiens
gcagagagcacag

SEQ ID NO: 3055483 - DNA, 13 bp, Homo sapiens
gcagagcctgtcc

SEQ ID NO: 3055484 - DNA, 19 bp, Homo sapiens
gcagagcctgtccccgcct

SEQ ID NO: 3055485 - DNA, 21 bp, Homo sapiens
gcagagccttttacccctgca

SEQ ID NO: 3055486 - DNA, 20 bp, Homo sapiens
gcagagctgagggccctgtg

SEQ ID NO: 3055487 - DNA, 20 bp, Homo sapiens
gcagaggaatttggctgctt

SEQ ID NO: 3055488 - DNA, 14 bp, Homo sapiens
gcagaggagcccag

SEQ ID NO: 3055489 - DNA, 15 bp, Homo sapiens
gcagaggaggagaaa

SEQ ID NO: 3055490 - DNA, 14 bp, Homo sapiens
gcagaggaggggcc

SEQ ID NO: 3055491 - DNA, 21 bp, Homo sapiens
gcagaggaggggccgctgcca

SEQ ID NO: 3055492 - DNA, 12 bp, Homo sapiens
gcagaggcagaa

SEQ ID NO: 3055493 - DNA, 11 bp, Homo sapiens
gcagaggctgg

SEQ ID NO: 3055494 - DNA, 14 bp, Homo sapiens
gcagaggctttggg

SEQ ID NO: 3055495 - DNA, 19 bp, Homo sapiens
gcagagggcagaggctgga

SEQ ID NO: 3055496 - DNA, 16 bp, Homo sapiens
gcagagggctggaggc

SEQ ID NO: 3055497 - DNA, 19 bp, Homo sapiens
gcagagggctggaggccca

SEQ ID NO: 3055498 - DNA, 21 bp, Homo sapiens
gcagagggctggaggcccagg

SEQ ID NO: 3055499 - DNA, 15 bp, Homo sapiens
gcagaggtaccctgg

SEQ ID NO: 3055500 - DNA, 16 bp, Homo sapiens
gcagaggtaccctggg

SEQ ID NO: 3055501 - DNA, 22 bp, Homo sapiens
gcagaggttgcagtgagctgag

SEQ ID NO: 3055502 - DNA, 21 bp, Homo sapiens
gcagataacatttgtgtgtta

SEQ ID NO: 3055503 - DNA, 15 bp, Homo sapiens
gcagataactgctgt

SEQ ID NO: 3055504 - DNA, 15 bp, Homo sapiens
gcagatactgtctct

SEQ ID NO: 3055505 - DNA, 14 bp, Homo sapiens
gcagatcacctgag

SEQ ID NO: 3055506 - DNA, 16 bp, Homo sapiens
gcagatcacctgaggt

SEQ ID NO: 3055507 - DNA, 22 bp, Homo sapiens
gcagatcatccgtctgtgtggg

SEQ ID NO: 3055508 - DNA, 14 bp, Homo sapiens
gcagatccaggact

SEQ ID NO: 3055509 - DNA, 16 bp, Homo sapiens
gcagatgataaaagga

SEQ ID NO: 3055510 - DNA, 21 bp, Homo sapiens
gcagatgataaaaggaatctg

SEQ ID NO: 3055511 - DNA, 16 bp, Homo sapiens
gcagatgcaaagaggc

SEQ ID NO: 3055512 - DNA, 17 bp, Homo sapiens
gcagatgcaaagaggca

SEQ ID NO: 3055513 - DNA, 13 bp, Homo sapiens
gcagatgcaatga

SEQ ID NO: 3055514 - DNA, 23 bp, Homo sapiens
gcagatgctagcgcgttgcctgt

SEQ ID NO: 3055515 - DNA, 23 bp, Homo sapiens
gcagatttagtgaaagctagaga

SEQ ID NO: 3055516 - DNA, 13 bp, Homo sapiens
gcagatttctgcc

SEQ ID NO: 3055517 - DNA, 20 bp, Homo sapiens
gcagattttcctaaggccac

SEQ ID NO: 3055518 - DNA, 16 bp, Homo sapiens
gcagcaaaatccttac

SEQ ID NO: 3055519 - DNA, 16 bp, Homo sapiens
gcagcaacgtttttaa

SEQ ID NO: 3055520 - DNA, 15 bp, Homo sapiens
gcagcaagaaaaaaa

SEQ ID NO: 3055521 - DNA, 17 bp, Homo sapiens
gcagcacatgcgggctc

SEQ ID NO: 3055522 - DNA, 18 bp, Homo sapiens
gcagcaccgttctgtgca

SEQ ID NO: 3055523 - DNA, 22 bp, Homo sapiens
gcagcacggcccggcccctcac

SEQ ID NO: 3055524 - DNA, 13 bp, Homo sapiens
gcagcactgctgc

SEQ ID NO: 3055525 - DNA, 22 bp, Homo sapiens
gcagcactggaaccacctggac

SEQ ID NO: 3055526 - DNA, 18 bp, Homo sapiens
gcagcactgggaagctgg

SEQ ID NO: 3055527 - DNA, 19 bp, Homo sapiens
gcagcactgggaagctgga

SEQ ID NO: 3055528 - DNA, 14 bp, Homo sapiens
gcagcagagagccc

SEQ ID NO: 3055529 - DNA, 19 bp, Homo sapiens
gcagcagattggaaggaga

SEQ ID NO: 3055530 - DNA, 20 bp, Homo sapiens
gcagcagattggaaggagac

SEQ ID NO: 3055531 - DNA, 17 bp, Homo sapiens
gcagcagcatcccagcc

SEQ ID NO: 3055532 - DNA, 18 bp, Homo sapiens
gcagcagcatcccagcct

SEQ ID NO: 3055533 - DNA, 17 bp, Homo sapiens
gcagcagggatgccctg

SEQ ID NO: 3055534 - DNA, 19 bp, Homo sapiens
gcagcagggatgccctgga

SEQ ID NO: 3055535 - DNA, 20 bp, Homo sapiens
gcagcagggatgccctggag

SEQ ID NO: 3055536 - DNA, 15 bp, Homo sapiens
gcagcagtgtgaggc

SEQ ID NO: 3055537 - DNA, 23 bp, Homo sapiens
gcagcagtgtgaggccagggcag

SEQ ID NO: 3055538 - DNA, 15 bp, Homo sapiens
gcagcatcccagcct

SEQ ID NO: 3055539 - DNA, 23 bp, Homo sapiens
gcagcatcggacaagacccccag

SEQ ID NO: 3055540 - DNA, 13 bp, Homo sapiens
gcagccaaagaat

SEQ ID NO: 3055541 - DNA, 20 bp, Homo sapiens
gcagccaagctccttgggag

SEQ ID NO: 3055542 - DNA, 15 bp, Homo sapiens
gcagccacaccactg

SEQ ID NO: 3055543 - DNA, 22 bp, Homo sapiens
gcagccacacgcaggcggccag

SEQ ID NO: 3055544 - DNA, 12 bp, Homo sapiens
gcagccagaggc

SEQ ID NO: 3055545 - DNA, 16 bp, Homo sapiens
gcagccagcccagccc

SEQ ID NO: 3055546 - DNA, 21 bp, Homo sapiens
gcagccagcccagcccagctg

SEQ ID NO: 3055547 - DNA, 23 bp, Homo sapiens
gcagccagcccagcccagctggt

SEQ ID NO: 3055548 - DNA, 12 bp, Homo sapiens
gcagccaggcct

SEQ ID NO: 3055549 - DNA, 18 bp, Homo sapiens
gcagccaggcctcgcctg

SEQ ID NO: 3055550 - DNA, 23 bp, Homo sapiens
gcagccaggcctcgcctgccctc

SEQ ID NO: 3055551 - DNA, 15 bp, Homo sapiens
gcagccaggctgggc

SEQ ID NO: 3055552 - DNA, 16 bp, Homo sapiens
gcagcccaccaggagc

SEQ ID NO: 3055553 - DNA, 13 bp, Homo sapiens
gcagcccagcatt

SEQ ID NO: 3055554 - DNA, 21 bp, Homo sapiens
gcagcccatttctccagaacc

SEQ ID NO: 3055555 - DNA, 22 bp, Homo sapiens
gcagcccatttctccagaaccc

SEQ ID NO: 3055556 - DNA, 23 bp, Homo sapiens
gcagccccagcaccaccaggtct

SEQ ID NO: 3055557 - DNA, 16 bp, Homo sapiens
gcagcccccgcgccct

SEQ ID NO: 3055558 - DNA, 14 bp, Homo sapiens
gcagcccctgcaga

SEQ ID NO: 3055559 - DNA, 12 bp, Homo sapiens
gcagccctccat

SEQ ID NO: 3055560 - DNA, 14 bp, Homo sapiens
gcagccctccatgg

SEQ ID NO: 3055561 - DNA, 22 bp, Homo sapiens
gcagccctccatggtcctgtct

SEQ ID NO: 3055562 - DNA, 23 bp, Homo sapiens
gcagccctccatggtcctgtctg

SEQ ID NO: 3055563 - DNA, 21 bp, Homo sapiens
gcagccctgagaaagccctgt

SEQ ID NO: 3055564 - DNA, 16 bp, Homo sapiens
gcagcccttcccccag

SEQ ID NO: 3055565 - DNA, 17 bp, Homo sapiens
gcagccgctgagcgagg

SEQ ID NO: 3055566 - DNA, 21 bp, Homo sapiens
gcagccggagggaggcactag

SEQ ID NO: 3055567 - DNA, 22 bp, Homo sapiens
gcagcctactgagtagctttca

SEQ ID NO: 3055568 - DNA, 12 bp, Homo sapiens
gcagcctccagt

SEQ ID NO: 3055569 - DNA, 20 bp, Homo sapiens
gcagcctcccatccagggcc

SEQ ID NO: 3055570 - DNA, 14 bp, Homo sapiens
gcagcctccggggt

SEQ ID NO: 3055571 - DNA, 15 bp, Homo sapiens
gcagcctcgcacagg

SEQ ID NO: 3055572 - DNA, 14 bp, Homo sapiens
gcagcctgccagca

SEQ ID NO: 3055573 - DNA, 15 bp, Homo sapiens
gcagcctgccagcag

SEQ ID NO: 3055574 - DNA, 19 bp, Homo sapiens
gcagcctgcgctcggcagg

SEQ ID NO: 3055575 - DNA, 20 bp, Homo sapiens
gcagcctgcgctcggcagga

SEQ ID NO: 3055576 - DNA, 18 bp, Homo sapiens
gcagcctggacatagaga

SEQ ID NO: 3055577 - DNA, 15 bp, Homo sapiens
gcagcctgtgaggga

SEQ ID NO: 3055578 - DNA, 17 bp, Homo sapiens
gcagcctgtgagggagt

SEQ ID NO: 3055579 - DNA, 19 bp, Homo sapiens
gcagccttgaactctgggc

SEQ ID NO: 3055580 - DNA, 20 bp, Homo sapiens
gcagccttgaactctgggct

SEQ ID NO: 3055581 - DNA, 23 bp, Homo sapiens
gcagccttgggggggctgccttt

SEQ ID NO: 3055582 - DNA, 15 bp, Homo sapiens
gcagcctttatcaag

SEQ ID NO: 3055583 - DNA, 13 bp, Homo sapiens
gcagcgccaggct

SEQ ID NO: 3055584 - DNA, 18 bp, Homo sapiens
gcagcgccgtgtcctctc

SEQ ID NO: 3055585 - DNA, 21 bp, Homo sapiens
gcagcgcctgtcccctcacag

SEQ ID NO: 3055586 - DNA, 15 bp, Homo sapiens
gcagcgcctttccca

SEQ ID NO: 3055587 - DNA, 16 bp, Homo sapiens
gcagcgctagtggagg

SEQ ID NO: 3055588 - DNA, 17 bp, Homo sapiens
gcagcgctagtggaggg

SEQ ID NO: 3055589 - DNA, 17 bp, Homo sapiens
gcagcggctctggtcct

SEQ ID NO: 3055590 - DNA, 19 bp, Homo sapiens
gcagcggtgggaaggaaag

SEQ ID NO: 3055591 - DNA, 15 bp, Homo sapiens
gcagctcaaaggcac

SEQ ID NO: 3055592 - DNA, 17 bp, Homo sapiens
gcagctcaaaggcacag

SEQ ID NO: 3055593 - DNA, 16 bp, Homo sapiens
gcagctcacaccctac

SEQ ID NO: 3055594 - DNA, 14 bp, Homo sapiens
gcagctcctcagcg

SEQ ID NO: 3055595 - DNA, 11 bp, Homo sapiens
gcagctctgcc

SEQ ID NO: 3055596 - DNA, 13 bp, Homo sapiens
gcagctgcccctc

SEQ ID NO: 3055597 - DNA, 24 bp, Homo sapiens
gcagctgcccctcctggagcagaa

SEQ ID NO: 3055598 - DNA, 12 bp, Homo sapiens
gcagctgcctgg

SEQ ID NO: 3055599 - DNA, 13 bp, Homo sapiens
gcagctgcctggc

SEQ ID NO: 3055600 - DNA, 15 bp, Homo sapiens
gcagctgcctggcca

SEQ ID NO: 3055601 - DNA, 15 bp, Homo sapiens
gcagctgctgccact

SEQ ID NO: 3055602 - DNA, 13 bp, Homo sapiens
gcaagccacagcc

SEQ ID NO: 3055603 - DNA, 20 bp, Homo sapiens
gcaagcctgtaatcccagct

SEQ ID NO: 3055604 - DNA, 14 bp, Homo sapiens
gcaagctgtgttac

SEQ ID NO: 3055605 - DNA, 21 bp, Homo sapiens
gcaagctgtgttacttgaagt

SEQ ID NO: 3055606 - DNA, 14 bp, Homo sapiens
gcaaggattacaga

SEQ ID NO: 3055607 - DNA, 20 bp, Homo sapiens
gcaaggattacagaaactga

SEQ ID NO: 3055608 - DNA, 22 bp, Homo sapiens
gcaaggattacagaaactgatg

SEQ ID NO: 3055609 - DNA, 16 bp, Homo sapiens
gcaagggacaggaagg

SEQ ID NO: 3055610 - DNA, 17 bp, Homo sapiens
gcaagggacaggaaggt

SEQ ID NO: 3055611 - DNA, 12 bp, Homo sapiens
gcaagggcccag

SEQ ID NO: 3055612 - DNA, 13 bp, Homo sapiens
gcaagggcccaga

SEQ ID NO: 3055613 - DNA, 14 bp, Homo sapiens
gcaagggcctggac

SEQ ID NO: 3055614 - DNA, 20 bp, Homo sapiens
gcaaggtggctccagcacca

SEQ ID NO: 3055615 - DNA, 14 bp, Homo sapiens
gcaaggtgtccctg

SEQ ID NO: 3055616 - DNA, 16 bp, Homo sapiens
gcaaggttccacagag

SEQ ID NO: 3055617 - DNA, 20 bp, Homo sapiens
gcaaggtttaggctggtggc

SEQ ID NO: 3055618 - DNA, 21 bp, Homo sapiens
gcaaggtttaggctggtggcc

SEQ ID NO: 3055619 - DNA, 12 bp, Homo sapiens
gcaagtcatgta

SEQ ID NO: 3055620 - DNA, 18 bp, Homo sapiens
gcaagtcccagacaagga

SEQ ID NO: 3055621 - DNA, 17 bp, Homo sapiens
gcaagtccttttgtaaa

SEQ ID NO: 3055622 - DNA, 17 bp, Homo sapiens
gcaagtctggatctggg

SEQ ID NO: 3055623 - DNA, 11 bp, Homo sapiens
gcaagtcttaa

SEQ ID NO: 3055624 - DNA, 22 bp, Homo sapiens
gcaagtctttaggtctttgtaa

SEQ ID NO: 3055625 - DNA, 20 bp, Homo sapiens
gcaagtgagaggggagggag

SEQ ID NO: 3055626 - DNA, 14 bp, Homo sapiens
gcaagtgctgtttg

SEQ ID NO: 3055627 - DNA, 11 bp, Homo sapiens
gattattttgg

SEQ ID NO: 3055628 - DNA, 22 bp, Homo sapiens
gattcaaaatatttaaaaatgt

SEQ ID NO: 3055629 - DNA, 19 bp, Homo sapiens
gattcaaaggttctaggtt

SEQ ID NO: 3055630 - DNA, 15 bp, Homo sapiens
gattcacatctcatt

SEQ ID NO: 3055631 - DNA, 16 bp, Homo sapiens
gattcacatctcattt

SEQ ID NO: 3055632 - DNA, 14 bp, Homo sapiens
gattcacctgagca

SEQ ID NO: 3055633 - DNA, 21 bp, Homo sapiens
gattcagagaaaggcaaggga

SEQ ID NO: 3055634 - DNA, 13 bp, Homo sapiens
gattcaggaatgt

SEQ ID NO: 3055635 - DNA, 14 bp, Homo sapiens
gattcaggggaagg

SEQ ID NO: 3055636 - DNA, 15 bp, Homo sapiens
gattcaggggaaggg

SEQ ID NO: 3055637 - DNA, 20 bp, Homo sapiens
gattcagtgttaaatgtgat

SEQ ID NO: 3055638 - DNA, 16 bp, Homo sapiens
gattcatagtaacttc

SEQ ID NO: 3055639 - DNA, 19 bp, Homo sapiens
gattcatagtaacttctta

SEQ ID NO: 3055640 - DNA, 17 bp, Homo sapiens
gattcatgatttataaa

SEQ ID NO: 3055641 - DNA, 18 bp, Homo sapiens
gattccaaagagtagaat

SEQ ID NO: 3055642 - DNA, 13 bp, Homo sapiens
gattccaaagcat

SEQ ID NO: 3055643 - DNA, 18 bp, Homo sapiens
gattccaaagcattttca

SEQ ID NO: 3055644 - DNA, 22 bp, Homo sapiens
gattccaacaggcgtgggatca

SEQ ID NO: 3055645 - DNA, 17 bp, Homo sapiens
gattccaggtggcatca

SEQ ID NO: 3055646 - DNA, 18 bp, Homo sapiens
gattccattggtccaaga

SEQ ID NO: 3055647 - DNA, 14 bp, Homo sapiens
gattcccaactcct

SEQ ID NO: 3055648 - DNA, 13 bp, Homo sapiens
gattcccaggcca

SEQ ID NO: 3055649 - DNA, 17 bp, Homo sapiens
gattccccctgccctgt

SEQ ID NO: 3055650 - DNA, 18 bp, Homo sapiens
gattccggatcctaagca

SEQ ID NO: 3055651 - DNA, 17 bp, Homo sapiens
gattcctgtaaatgtga

SEQ ID NO: 3055652 - DNA, 16 bp, Homo sapiens
gattccttttttcaaa

SEQ ID NO: 3055653 - DNA, 20 bp, Homo sapiens
gattcgtctgcgattttatc

SEQ ID NO: 3055654 - DNA, 12 bp, Homo sapiens
gattctaaagat

SEQ ID NO: 3055655 - DNA, 17 bp, Homo sapiens
gattctaaagattctat

SEQ ID NO: 3055656 - DNA, 15 bp, Homo sapiens
gattctaaaggtcca

SEQ ID NO: 3055657 - DNA, 18 bp, Homo sapiens
gattctagatcagatgct

SEQ ID NO: 3055658 - DNA, 19 bp, Homo sapiens
gattctagatcagatgctc

SEQ ID NO: 3055659 - DNA, 20 bp, Homo sapiens
gattctatttatatgtacat

SEQ ID NO: 3055660 - DNA, 15 bp, Homo sapiens
gattctcctgcctca

SEQ ID NO: 3055661 - DNA, 17 bp, Homo sapiens
gattctcctgcctcagc

SEQ ID NO: 3055662 - DNA, 21 bp, Homo sapiens
gattctcctgcctcagcctcc

SEQ ID NO: 3055663 - DNA, 16 bp, Homo sapiens
gattctcgactgcttt

SEQ ID NO: 3055664 - DNA, 12 bp, Homo sapiens
gattctctgtgg

SEQ ID NO: 3055665 - DNA, 15 bp, Homo sapiens
gattctctgtgtcta

SEQ ID NO: 3055666 - DNA, 23 bp, Homo sapiens
gattctctgtgtctaagattcta

SEQ ID NO: 3055667 - DNA, 20 bp, Homo sapiens
gattctcttagctactgtat

SEQ ID NO: 3055668 - DNA, 16 bp, Homo sapiens
gattctgaaaccacag

SEQ ID NO: 3055669 - DNA, 20 bp, Homo sapiens
gattctgaagcttatgtttc

SEQ ID NO: 3055670 - DNA, 21 bp, Homo sapiens
gattctgaagcttatgtttct

SEQ ID NO: 3055671 - DNA, 15 bp, Homo sapiens
gattctgcagtaaat

SEQ ID NO: 3055672 - DNA, 21 bp, Homo sapiens
gattctgcagtaaatctttta

SEQ ID NO: 3055673 - DNA, 13 bp, Homo sapiens
gattcttccagat

SEQ ID NO: 3055674 - DNA, 15 bp, Homo sapiens
gattgaaaacttttc

SEQ ID NO: 3055675 - DNA, 15 bp, Homo sapiens
gattgaaaagtaaac

SEQ ID NO: 3055676 - DNA, 17 bp, Homo sapiens
gattgacagctttgctg

SEQ ID NO: 3055677 - DNA, 17 bp, Homo sapiens
gattgatttgaagaaca

SEQ ID NO: 3055678 - DNA, 17 bp, Homo sapiens
gattgcatgtgactctg

SEQ ID NO: 3055679 - DNA, 14 bp, Homo sapiens
gattgctaaatgta

SEQ ID NO: 3055680 - DNA, 20 bp, Homo sapiens
gattgctaaatgtaacagtc

SEQ ID NO: 3055681 - DNA, 13 bp, Homo sapiens
gattgctaattgc

SEQ ID NO: 3055682 - DNA, 16 bp, Homo sapiens
gattgctgccccatca

SEQ ID NO: 3055683 - DNA, 20 bp, Homo sapiens
gattgctgccccatcagtgc

SEQ ID NO: 3055684 - DNA, 19 bp, Homo sapiens
gattgctggaaaccaagtc

SEQ ID NO: 3055685 - DNA, 18 bp, Homo sapiens
gattgcttcaattaaaat

SEQ ID NO: 3055686 - DNA, 16 bp, Homo sapiens
gattgcttgagctcag

SEQ ID NO: 3055687 - DNA, 18 bp, Homo sapiens
gattgcttgagctcagga

SEQ ID NO: 3055688 - DNA, 22 bp, Homo sapiens
gattgcttttattacattagtt

SEQ ID NO: 3055689 - DNA, 13 bp, Homo sapiens
gattggaaagaca

SEQ ID NO: 3055690 - DNA, 20 bp, Homo sapiens
gattggaaagacaggaagac

SEQ ID NO: 3055691 - DNA, 18 bp, Homo sapiens
gattggaaggagacacag

SEQ ID NO: 3055692 - DNA, 20 bp, Homo sapiens
gattggaaggagacacagat

SEQ ID NO: 3055693 - DNA, 19 bp, Homo sapiens
gattggccctgcccctccc

SEQ ID NO: 3055694 - DNA, 15 bp, Homo sapiens
gattgggaataaata

SEQ ID NO: 3055695 - DNA, 23 bp, Homo sapiens
gattgggaataaatatgcctctc

SEQ ID NO: 3055696 - DNA, 15 bp, Homo sapiens
gattgggcccctgcc

SEQ ID NO: 3055697 - DNA, 15 bp, Homo sapiens
gattggggaattaaa

SEQ ID NO: 3055698 - DNA, 23 bp, Homo sapiens
gattggtctgggtggatgtgagc

SEQ ID NO: 3055699 - DNA, 22 bp, Homo sapiens
gattgtaaaccgctttggcctg

SEQ ID NO: 3055700 - DNA, 19 bp, Homo sapiens
gattgtacgtagccacagg

SEQ ID NO: 3055701 - DNA, 12 bp, Homo sapiens
gattgtagtatt

SEQ ID NO: 3055702 - DNA, 16 bp, Homo sapiens
gattgtattactttaa

SEQ ID NO: 3055703 - DNA, 19 bp, Homo sapiens
gattgtgcaatagtcagag

SEQ ID NO: 3055704 - DNA, 19 bp, Homo sapiens
gattgtgccagtgcactcc

SEQ ID NO: 3055705 - DNA, 18 bp, Homo sapiens
gattgttcttttgtttca

SEQ ID NO: 3055706 - DNA, 15 bp, Homo sapiens
gattgtttctataca

SEQ ID NO: 3055707 - DNA, 16 bp, Homo sapiens
gattgtttgcacagag

SEQ ID NO: 3055708 - DNA, 13 bp, Homo sapiens
gattgttttaaca

SEQ ID NO: 3055709 - DNA, 20 bp, Homo sapiens
gattgttttattttggaatt

SEQ ID NO: 3055710 - DNA, 15 bp, Homo sapiens
gattgttttgttcac

SEQ ID NO: 3055711 - DNA, 18 bp, Homo sapiens
gatttaaaagtgtatttt

SEQ ID NO: 3055712 - DNA, 14 bp, Homo sapiens
gatttaatagtgtt

SEQ ID NO: 3055713 - DNA, 15 bp, Homo sapiens
gatttagaagtgtca

SEQ ID NO: 3055714 - DNA, 15 bp, Homo sapiens
gatttagagtttttt

SEQ ID NO: 3055715 - DNA, 22 bp, Homo sapiens
gatttagtgaaagctagagata

SEQ ID NO: 3055716 - DNA, 22 bp, Homo sapiens
gatttagtgtttttacctctgt

SEQ ID NO: 3055717 - DNA, 14 bp, Homo sapiens
gatttataaacaga

SEQ ID NO: 3055718 - DNA, 14 bp, Homo sapiens
gatttatcaaatca

SEQ ID NO: 3055719 - DNA, 22 bp, Homo sapiens
gatttcccactgcactccagcc

SEQ ID NO: 3055720 - DNA, 18 bp, Homo sapiens
gatgaatctacatttgtt

SEQ ID NO: 3055721 - DNA, 14 bp, Homo sapiens
gatgaatgtattta

SEQ ID NO: 3055722 - DNA, 19 bp, Homo sapiens
gatgacaggcgcctgccat

SEQ ID NO: 3055723 - DNA, 20 bp, Homo sapiens
gatgacaggcgcctgccatc

SEQ ID NO: 3055724 - DNA, 15 bp, Homo sapiens
gatgacattgctaag

SEQ ID NO: 3055725 - DNA, 21 bp, Homo sapiens
gatgacattgctaagatgctc

SEQ ID NO: 3055726 - DNA, 22 bp, Homo sapiens
gatgaccaaagtcccttcctgc

SEQ ID NO: 3055727 - DNA, 16 bp, Homo sapiens
gatgaccatactcaga

SEQ ID NO: 3055728 - DNA, 11 bp, Homo sapiens
gatgaccccta

SEQ ID NO: 3055729 - DNA, 17 bp, Homo sapiens
gatgacctcattaaccg

SEQ ID NO: 3055730 - DNA, 14 bp, Homo sapiens
gatgactggcattt

SEQ ID NO: 3055731 - DNA, 17 bp, Homo sapiens
gatgactggcattttat

SEQ ID NO: 3055732 - DNA, 18 bp, Homo sapiens
gatgactggcattttata

SEQ ID NO: 3055733 - DNA, 16 bp, Homo sapiens
gatgacttgagccctg

SEQ ID NO: 3055734 - DNA, 18 bp, Homo sapiens
gatgactttgcagatgga

SEQ ID NO: 3055735 - DNA, 20 bp, Homo sapiens
gatgactttgcagatggaaa

SEQ ID NO: 3055736 - DNA, 17 bp, Homo sapiens
gatgagacagggttttt

SEQ ID NO: 3055737 - DNA, 20 bp, Homo sapiens
gatgagcactcctgattttt

SEQ ID NO: 3055738 - DNA, 15 bp, Homo sapiens
gatgagccctcagaa

SEQ ID NO: 3055739 - DNA, 22 bp, Homo sapiens
gatgagccctcagaacccttgg

SEQ ID NO: 3055740 - DNA, 14 bp, Homo sapiens
gatgagcttagggt

SEQ ID NO: 3055741 - DNA, 20 bp, Homo sapiens
gatgaggacagagggcacat

SEQ ID NO: 3055742 - DNA, 21 bp, Homo sapiens
gatgaggccgcggcctccccg

SEQ ID NO: 3055743 - DNA, 21 bp, Homo sapiens
gatgatacaagattagaagct

SEQ ID NO: 3055744 - DNA, 20 bp, Homo sapiens
gatgatacagtgttttttag

SEQ ID NO: 3055745 - DNA, 20 bp, Homo sapiens
gatgatcaattatagtttct

SEQ ID NO: 3055746 - DNA, 16 bp, Homo sapiens
gatgatcgctgtattt

SEQ ID NO: 3055747 - DNA, 19 bp, Homo sapiens
gatgattgcttgagctcag

SEQ ID NO: 3055748 - DNA, 20 bp, Homo sapiens
gatgattgcttgagctcagg

SEQ ID NO: 3055749 - DNA, 14 bp, Homo sapiens
gatgatttttgtca

SEQ ID NO: 3055750 - DNA, 23 bp, Homo sapiens
gatgattttttttcttttgagtt

SEQ ID NO: 3055751 - DNA, 17 bp, Homo sapiens
gatgcaaagaggcaaga

SEQ ID NO: 3055752 - DNA, 22 bp, Homo sapiens
gatgcaaccaaaagggaaaaaa

SEQ ID NO: 3055753 - DNA, 18 bp, Homo sapiens
gatgcaaggattacagaa

SEQ ID NO: 3055754 - DNA, 18 bp, Homo sapiens
gatgcaatgtgctactga

SEQ ID NO: 3055755 - DNA, 19 bp, Homo sapiens
gatgcacggtttctgttct

SEQ ID NO: 3055756 - DNA, 20 bp, Homo sapiens
gatgcacggtttctgttctg

SEQ ID NO: 3055757 - DNA, 21 bp, Homo sapiens
gatgcaggatttgttctctgt

SEQ ID NO: 3055758 - DNA, 20 bp, Homo sapiens
gatgcaggctcccctgagga

SEQ ID NO: 3055759 - DNA, 19 bp, Homo sapiens
gatgcaggtttgaccagga

SEQ ID NO: 3055760 - DNA, 16 bp, Homo sapiens
gatgcatgtcttttaa

SEQ ID NO: 3055761 - DNA, 17 bp, Homo sapiens
gatgcatgtcttttaaa

SEQ ID NO: 3055762 - DNA, 22 bp, Homo sapiens
gatgcatgtcttttaaaatgca

SEQ ID NO: 3055763 - DNA, 20 bp, Homo sapiens
gatgcatgttgattaaactc

SEQ ID NO: 3055764 - DNA, 19 bp, Homo sapiens
gatgccaatattaaatctg

SEQ ID NO: 3055765 - DNA, 13 bp, Homo sapiens
gatgccctgccct

SEQ ID NO: 3055766 - DNA, 12 bp, Homo sapiens
gatgccctggag

SEQ ID NO: 3055767 - DNA, 14 bp, Homo sapiens
gatgccctgggggc

SEQ ID NO: 3055768 - DNA, 15 bp, Homo sapiens
gatgcctaccgggtt

SEQ ID NO: 3055769 - DNA, 12 bp, Homo sapiens
gatgcctccacc

SEQ ID NO: 3055770 - DNA, 13 bp, Homo sapiens
gatgcctccaccg

SEQ ID NO: 3055771 - DNA, 20 bp, Homo sapiens
gatgcctccaccgctgccta

SEQ ID NO: 3055772 - DNA, 19 bp, Homo sapiens
gatgcgcagccccatctgt

SEQ ID NO: 3055773 - DNA, 15 bp, Homo sapiens
gatgcgtattctgtg

SEQ ID NO: 3055774 - DNA, 18 bp, Homo sapiens
gatgcgtattctgtggcc

SEQ ID NO: 3055775 - DNA, 19 bp, Homo sapiens
gatgcgtattctgtggccg

SEQ ID NO: 3055776 - DNA, 19 bp, Homo sapiens
gatgctcagttgctaaaca

SEQ ID NO: 3055777 - DNA, 17 bp, Homo sapiens
gatgctcatctgagcca

SEQ ID NO: 3055778 - DNA, 20 bp, Homo sapiens
gatgctcccaagcaaaggaa

SEQ ID NO: 3055779 - DNA, 15 bp, Homo sapiens
gatgctccgaggact

SEQ ID NO: 3055780 - DNA, 21 bp, Homo sapiens
gatgctccgaggactggactg

SEQ ID NO: 3055781 - DNA, 14 bp, Homo sapiens
gatgctccttgggc

SEQ ID NO: 3055782 - DNA, 13 bp, Homo sapiens
gatgctgaaataa

SEQ ID NO: 3055783 - DNA, 19 bp, Homo sapiens
gatgctgaaataaactagg

SEQ ID NO: 3055784 - DNA, 19 bp, Homo sapiens
gatgctgacctcacctggt

SEQ ID NO: 3055785 - DNA, 22 bp, Homo sapiens
gatgctgacctcacctggtcct

SEQ ID NO: 3055786 - DNA, 13 bp, Homo sapiens
gatgctgatgttc

SEQ ID NO: 3055787 - DNA, 19 bp, Homo sapiens
gatgctgatgttcagtgta

SEQ ID NO: 3055788 - DNA, 23 bp, Homo sapiens
gatgctgccagggcgccatcgcc

SEQ ID NO: 3055789 - DNA, 19 bp, Homo sapiens
gatgctgctggcctccctc

SEQ ID NO: 3055790 - DNA, 17 bp, Homo sapiens
gatgctggatgtctgcc

SEQ ID NO: 3055791 - DNA, 16 bp, Homo sapiens
gatgctggcccagggc

SEQ ID NO: 3055792 - DNA, 21 bp, Homo sapiens
gatgctggcctcttggcacct

SEQ ID NO: 3055793 - DNA, 15 bp, Homo sapiens
gatgcttctgggaga

SEQ ID NO: 3055794 - DNA, 18 bp, Homo sapiens
gatggaaccgcaggaagc

SEQ ID NO: 3055795 - DNA, 16 bp, Homo sapiens
gatggacagtttgttt

SEQ ID NO: 3055796 - DNA, 23 bp, Homo sapiens
gatggagaaagggcagaggaaga

SEQ ID NO: 3055797 - DNA, 13 bp, Homo sapiens
gatggagtttcta

SEQ ID NO: 3055798 - DNA, 17 bp, Homo sapiens
gatggagtttctaaggt

SEQ ID NO: 3055799 - DNA, 19 bp, Homo sapiens
gatggccactgctcttgtg

SEQ ID NO: 3055800 - DNA, 13 bp, Homo sapiens
gatggccaggctg

SEQ ID NO: 3055801 - DNA, 12 bp, Homo sapiens
gatggctcctct

SEQ ID NO: 3055802 - DNA, 21 bp, Homo sapiens
gatggctgggtccttgggcct

SEQ ID NO: 3055803 - DNA, 22 bp, Homo sapiens
gatggctgggtccttgggcctg

SEQ ID NO: 3055804 - DNA, 20 bp, Homo sapiens
gatgggatggtggagggcca

SEQ ID NO: 3055805 - DNA, 17 bp, Homo sapiens
gatgggattctggacag

SEQ ID NO: 3055806 - DNA, 16 bp, Homo sapiens
gatgggcagcccaaca

SEQ ID NO: 3055807 - DNA, 22 bp, Homo sapiens
gatgggcagcccaacagcactt

SEQ ID NO: 3055808 - DNA, 20 bp, Homo sapiens
gatgggcttttgttctgagg

SEQ ID NO: 3055809 - DNA, 21 bp, Homo sapiens
gatggggccctaattcagcca

SEQ ID NO: 3055810 - DNA, 12 bp, Homo sapiens
gatggggtgggg

SEQ ID NO: 3055811 - DNA, 11 bp, Homo sapiens
gatggtcccag

SEQ ID NO: 3055812 - DNA, 19 bp, Homo sapiens
gatggtcccaggaagcagg

SEQ ID NO: 3055813 - DNA, 20 bp, Homo sapiens
gatggtcccaggaagcaggg

SEQ ID NO: 3055814 - DNA, 17 bp, Homo sapiens
gatggtgacttttgaag

SEQ ID NO: 3055815 - DNA, 15 bp, Homo sapiens
gatggtgctgcccag

SEQ ID NO: 3055816 - DNA, 17 bp, Homo sapiens
gatggtgggatgtggtt

SEQ ID NO: 3055817 - DNA, 15 bp, Homo sapiens
gatggtgggcttcag

SEQ ID NO: 3055818 - DNA, 20 bp, Homo sapiens
gatggtgttactgcagttga

SEQ ID NO: 3055819 - DNA, 13 bp, Homo sapiens
gatggtgtttctt

SEQ ID NO: 3055820 - DNA, 17 bp, Homo sapiens
gatggtgttttggggat

SEQ ID NO: 3055821 - DNA, 23 bp, Homo sapiens
gatggttattttcttttctttca

SEQ ID NO: 3055822 - DNA, 19 bp, Homo sapiens
gatgtaaacagtgcctgct

SEQ ID NO: 3055823 - DNA, 15 bp, Homo sapiens
gatgtacatttccaa

SEQ ID NO: 3055824 - DNA, 13 bp, Homo sapiens
gatgtagaaacaa

SEQ ID NO: 3055825 - DNA, 21 bp, Homo sapiens
gatgtatgaatacagcagcaa

SEQ ID NO: 3055826 - DNA, 22 bp, Homo sapiens
gatgtcagctgctgttgaactt

SEQ ID NO: 3055827 - DNA, 23 bp, Homo sapiens
gatgtcagctgctgttgaacttt

SEQ ID NO: 3055828 - DNA, 12 bp, Homo sapiens
gatgtccagggc

SEQ ID NO: 3055829 - DNA, 19 bp, Homo sapiens
gatgtccttaaaatgtggt

SEQ ID NO: 3055830 - DNA, 19 bp, Homo sapiens
gatgtctgtttgctgatgg

SEQ ID NO: 3055831 - DNA, 13 bp, Homo sapiens
gatgtgaagccaa

SEQ ID NO: 3055832 - DNA, 23 bp, Homo sapiens
gatgtgaagccaattcagacagg

SEQ ID NO: 3055833 - DNA, 13 bp, Homo sapiens
gatgtgagcagaa

SEQ ID NO: 3055834 - DNA, 18 bp, Homo sapiens
gatgtgagggcaccacca

SEQ ID NO: 3055835 - DNA, 16 bp, Homo sapiens
gatgtgattgtggaat

SEQ ID NO: 3055836 - DNA, 24 bp, Homo sapiens
gatgtgatttaatagtgttaatca

SEQ ID NO: 3055837 - DNA, 14 bp, Homo sapiens
gatgtgcagcagat

SEQ ID NO: 3055838 - DNA, 14 bp, Homo sapiens
gatgtgcctgtaat

SEQ ID NO: 3055839 - DNA, 11 bp, Homo sapiens
gatgtggagcc

SEQ ID NO: 3055840 - DNA, 12 bp, Homo sapiens
gatgtggagcca

SEQ ID NO: 3055841 - DNA, 14 bp, Homo sapiens
gatgtggagccagg

SEQ ID NO: 3055842 - DNA, 20 bp, Homo sapiens
gatgtggccctggcctgctg

SEQ ID NO: 3055843 - DNA, 13 bp, Homo sapiens
gatgtggggctga

SEQ ID NO: 3055844 - DNA, 23 bp, Homo sapiens
gatgtgttggtttacagggtata

SEQ ID NO: 3055845 - DNA, 18 bp, Homo sapiens
gatgtgtttgctttctga

SEQ ID NO: 3055846 - DNA, 14 bp, Homo sapiens
gatgttcagtgtaa

SEQ ID NO: 3055847 - DNA, 20 bp, Homo sapiens
gatgttcagtgtaatttctt

SEQ ID NO: 3055848 - DNA, 18 bp, Homo sapiens
gatgttctaaggctctga

SEQ ID NO: 3055849 - DNA, 19 bp, Homo sapiens
gatgttctaaggctctgag

SEQ ID NO: 3055850 - DNA, 20 bp, Homo sapiens
gatgttctaaggctctgaga

SEQ ID NO: 3055851 - DNA, 13 bp, Homo sapiens
gatgttgataatt

SEQ ID NO: 3055852 - DNA, 15 bp, Homo sapiens
gatgttgataatttc

SEQ ID NO: 3055853 - DNA, 15 bp, Homo sapiens
gatgttgccatgtgt

SEQ ID NO: 3055854 - DNA, 19 bp, Homo sapiens
gatgttgccatgtgtttta

SEQ ID NO: 3055855 - DNA, 15 bp, Homo sapiens
gatgtttacctggtg

SEQ ID NO: 3055856 - DNA, 20 bp, Homo sapiens
gagggagctgaggcctccct

SEQ ID NO: 3055857 - DNA, 13 bp, Homo sapiens
gagggagggagcc

SEQ ID NO: 3055858 - DNA, 16 bp, Homo sapiens
gagggagggtttctct

SEQ ID NO: 3055859 - DNA, 21 bp, Homo sapiens
gagggagggtttctctcccaa

SEQ ID NO: 3055860 - DNA, 14 bp, Homo sapiens
gagggagtctcagg

SEQ ID NO: 3055861 - DNA, 16 bp, Homo sapiens
gagggatctaggtctt

SEQ ID NO: 3055862 - DNA, 13 bp, Homo sapiens
gagggatgggaga

SEQ ID NO: 3055863 - DNA, 22 bp, Homo sapiens
gagggattcggccgcggctccg

SEQ ID NO: 3055864 - DNA, 20 bp, Homo sapiens
gagggcaagtggatgggaat

SEQ ID NO: 3055865 - DNA, 19 bp, Homo sapiens
gagggcactggagctggga

SEQ ID NO: 3055866 - DNA, 16 bp, Homo sapiens
gagggcagaggctgga

SEQ ID NO: 3055867 - DNA, 19 bp, Homo sapiens
gagggcagcactgggaagc

SEQ ID NO: 3055868 - DNA, 21 bp, Homo sapiens
gagggcagcactgggaagctg

SEQ ID NO: 3055869 - DNA, 14 bp, Homo sapiens
gagggcagcagggc

SEQ ID NO: 3055870 - DNA, 15 bp, Homo sapiens
gagggccacggggag

SEQ ID NO: 3055871 - DNA, 20 bp, Homo sapiens
gagggccagggaggcagagc

SEQ ID NO: 3055872 - DNA, 22 bp, Homo sapiens
gagggcccaaagcttgtaaata

SEQ ID NO: 3055873 - DNA, 22 bp, Homo sapiens
gagggccctgtggagtccagct

SEQ ID NO: 3055874 - DNA, 14 bp, Homo sapiens
gagggccgcctgcc

SEQ ID NO: 3055875 - DNA, 16 bp, Homo sapiens
gagggccgcctgcctt

SEQ ID NO: 3055876 - DNA, 16 bp, Homo sapiens
gagggcctctgcctgg

SEQ ID NO: 3055877 - DNA, 13 bp, Homo sapiens
gagggcgcccagc

SEQ ID NO: 3055878 - DNA, 16 bp, Homo sapiens
gagggcgcccagcagc

SEQ ID NO: 3055879 - DNA, 17 bp, Homo sapiens
gagggcgcccagcagcc

SEQ ID NO: 3055880 - DNA, 18 bp, Homo sapiens
gagggcgcccagcagcct

SEQ ID NO: 3055881 - DNA, 14 bp, Homo sapiens
gagggcgctcctgt

SEQ ID NO: 3055882 - DNA, 11 bp, Homo sapiens
gagggctcaga

SEQ ID NO: 3055883 - DNA, 15 bp, Homo sapiens
gagggctcagaagag

SEQ ID NO: 3055884 - DNA, 14 bp, Homo sapiens
gagggctcagggca

SEQ ID NO: 3055885 - DNA, 17 bp, Homo sapiens
gagggctcagggcagtg

SEQ ID NO: 3055886 - DNA, 16 bp, Homo sapiens
gagggctgcctttgga

SEQ ID NO: 3055887 - DNA, 16 bp, Homo sapiens
gagggctggaggccca

SEQ ID NO: 3055888 - DNA, 20 bp, Homo sapiens
gagggctggaggcccaggct

SEQ ID NO: 3055889 - DNA, 10 bp, Homo sapiens
gagggctggc

SEQ ID NO: 3055890 - DNA, 13 bp, Homo sapiens
gagggctggctgg

SEQ ID NO: 3055891 - DNA, 17 bp, Homo sapiens
gaggggaaaaaaatgtt

SEQ ID NO: 3055892 - DNA, 15 bp, Homo sapiens
gaggggaaaggcctg

SEQ ID NO: 3055893 - DNA, 23 bp, Homo sapiens
gaggggaagaaacactttctctt

SEQ ID NO: 3055894 - DNA, 14 bp, Homo sapiens
gaggggacgcaggc

SEQ ID NO: 3055895 - DNA, 15 bp, Homo sapiens
gaggggacgcaggcc

SEQ ID NO: 3055896 - DNA, 15 bp, Homo sapiens
gaggggacgggacag

SEQ ID NO: 3055897 - DNA, 17 bp, Homo sapiens
gaggggacgggacagac

SEQ ID NO: 3055898 - DNA, 12 bp, Homo sapiens
gaggggagaagc

SEQ ID NO: 3055899 - DNA, 15 bp, Homo sapiens
gaggggaggaacagg

SEQ ID NO: 3055900 - DNA, 14 bp, Homo sapiens
gaggggagggaggg

SEQ ID NO: 3055901 - DNA, 13 bp, Homo sapiens
gaggggccctccg

SEQ ID NO: 3055902 - DNA, 21 bp, Homo sapiens
gaggggccggccctgtgtgca

SEQ ID NO: 3055903 - DNA, 19 bp, Homo sapiens
gaggggcctaggcctcagc

SEQ ID NO: 3055904 - DNA, 22 bp, Homo sapiens
gaggggcctaggcctcagccag

SEQ ID NO: 3055905 - DNA, 16 bp, Homo sapiens
gaggggcctgatgaga

SEQ ID NO: 3055906 - DNA, 22 bp, Homo sapiens
gaggggcctgatgagactccac

SEQ ID NO: 3055907 - DNA, 21 bp, Homo sapiens
gaggggctccccgggtctctc

SEQ ID NO: 3055908 - DNA, 12 bp, Homo sapiens
gaggggctgggg

SEQ ID NO: 3055909 - DNA, 16 bp, Homo sapiens
gaggggctggggaggg

SEQ ID NO: 3055910 - DNA, 23 bp, Homo sapiens
gagggggcggcagggctgggcct

SEQ ID NO: 3055911 - DNA, 13 bp, Homo sapiens
gaggggtagtggg

SEQ ID NO: 3055912 - DNA, 21 bp, Homo sapiens
gaggggtcgacttcgggctgg

SEQ ID NO: 3055913 - DNA, 11 bp, Homo sapiens
gaggggtgtcc

SEQ ID NO: 3055914 - DNA, 23 bp, Homo sapiens
gaggggtgtccgagaggctggtg

SEQ ID NO: 3055915 - DNA, 13 bp, Homo sapiens
gagggtgagctgg

SEQ ID NO: 3055916 - DNA, 14 bp, Homo sapiens
gagggtgagctggt

SEQ ID NO: 3055917 - DNA, 19 bp, Homo sapiens
gagggtgcccgagtgcggc

SEQ ID NO: 3055918 - DNA, 15 bp, Homo sapiens
gagggtttgtgccca

SEQ ID NO: 3055919 - DNA, 14 bp, Homo sapiens
gaggtaaaaaaaag

SEQ ID NO: 3055920 - DNA, 15 bp, Homo sapiens
gaggtaaaaaaaaga

SEQ ID NO: 3055921 - DNA, 21 bp, Homo sapiens
gaggtagctttgaggtggaag

SEQ ID NO: 3055922 - DNA, 23 bp, Homo sapiens
gaggtcaacagagaaggcaggaa

SEQ ID NO: 3055923 - DNA, 20 bp, Homo sapiens
gaggtcgaagcaatcagcaa

SEQ ID NO: 3055924 - DNA, 22 bp, Homo sapiens
gaggtctgaaaagaggagccag

SEQ ID NO: 3055925 - DNA, 21 bp, Homo sapiens
gaggtgattccagtgaagata

SEQ ID NO: 3055926 - DNA, 12 bp, Homo sapiens
gaggtgccttct

SEQ ID NO: 3055927 - DNA, 20 bp, Homo sapiens
gaggtgccttcttcagggcc

SEQ ID NO: 3055928 - DNA, 19 bp, Homo sapiens
gaggtggaggttgcattga

SEQ ID NO: 3055929 - DNA, 13 bp, Homo sapiens
gaggtggccaccg

SEQ ID NO: 3055930 - DNA, 21 bp, Homo sapiens
gaggtggccaccgggggtggc

SEQ ID NO: 3055931 - DNA, 20 bp, Homo sapiens
gaggtggctgagcccctgtc

SEQ ID NO: 3055932 - DNA, 14 bp, Homo sapiens
gaggtggctgcctg

SEQ ID NO: 3055933 - DNA, 16 bp, Homo sapiens
gaggtgggaggccagg

SEQ ID NO: 3055934 - DNA, 17 bp, Homo sapiens
gaggtgggaggccaggc

SEQ ID NO: 3055935 - DNA, 22 bp, Homo sapiens
gaggtgggggctggaggtgctg

SEQ ID NO: 3055936 - DNA, 21 bp, Homo sapiens
gaggtgggtggtgggcttctg

SEQ ID NO: 3055937 - DNA, 13 bp, Homo sapiens
gaggtgtctggcc

SEQ ID NO: 3055938 - DNA, 15 bp, Homo sapiens
gaggttaaggctgag

SEQ ID NO: 3055939 - DNA, 19 bp, Homo sapiens
gaggttgataactttgctt

SEQ ID NO: 3055940 - DNA, 13 bp, Homo sapiens
gaggttgcagtga

SEQ ID NO: 3055941 - DNA, 19 bp, Homo sapiens
gaggttgcagtgagctgag

SEQ ID NO: 3055942 - DNA, 17 bp, Homo sapiens
gaggttggggtgtacta

SEQ ID NO: 3055943 - DNA, 15 bp, Homo sapiens
gaggttgtggggagg

SEQ ID NO: 3055944 - DNA, 22 bp, Homo sapiens
gaggtttatagaaagatagata

SEQ ID NO: 3055945 - DNA, 19 bp, Homo sapiens
gaggtttcccaatggtgtt

SEQ ID NO: 3055946 - DNA, 10 bp, Homo sapiens
gagtaaagct

SEQ ID NO: 3055947 - DNA, 12 bp, Homo sapiens
gagtaaaggaaa

SEQ ID NO: 3055948 - DNA, 16 bp, Homo sapiens
gagtaaatcagatgtt

SEQ ID NO: 3055949 - DNA, 20 bp, Homo sapiens
gagtaaatcagatgttgaat

SEQ ID NO: 3055950 - DNA, 17 bp, Homo sapiens
gagtaatagtaaacaca

SEQ ID NO: 3055951 - DNA, 16 bp, Homo sapiens
gagtaatatgcctgct

SEQ ID NO: 3055952 - DNA, 22 bp, Homo sapiens
gagtaatctgtgtacaaagaaa

SEQ ID NO: 3055953 - DNA, 21 bp, Homo sapiens
gagtacaagctcttgtttctg

SEQ ID NO: 3055954 - DNA, 17 bp, Homo sapiens
gagtacactgtgtctct

SEQ ID NO: 3055955 - DNA, 19 bp, Homo sapiens
gagtacactgtgtctctat

SEQ ID NO: 3055956 - DNA, 20 bp, Homo sapiens
gagtacagatactgtgagct

SEQ ID NO: 3055957 - DNA, 22 bp, Homo sapiens
gagtactgtgggcaatttagaa

SEQ ID NO: 3055958 - DNA, 19 bp, Homo sapiens
gagtagaaactgcagggaa

SEQ ID NO: 3055959 - DNA, 14 bp, Homo sapiens
gagtagaattgcat

SEQ ID NO: 3055960 - DNA, 17 bp, Homo sapiens
gagtagaattgcattga

SEQ ID NO: 3055961 - DNA, 18 bp, Homo sapiens
gagtagccgagagcctgc

SEQ ID NO: 3055962 - DNA, 21 bp, Homo sapiens
gagtagccgagagcctgctcc

SEQ ID NO: 3055963 - DNA, 23 bp, Homo sapiens
gagtagttatataattgttgaac

SEQ ID NO: 3055964 - DNA, 20 bp, Homo sapiens
gagtagtttgttatgtgtct

SEQ ID NO: 3055965 - DNA, 14 bp, Homo sapiens
gagtcaccaggaat

SEQ ID NO: 3055966 - DNA, 17 bp, Homo sapiens
gagtcagcaccttggcc

SEQ ID NO: 3055967 - DNA, 22 bp, Homo sapiens
gagtcagcaccttggcccagga

SEQ ID NO: 3055968 - DNA, 16 bp, Homo sapiens
gagtcagccaggagct

SEQ ID NO: 3055969 - DNA, 21 bp, Homo sapiens
gagtcaggcaattgattgtga

SEQ ID NO: 3055970 - DNA, 18 bp, Homo sapiens
gagtcagggacccctgcc

SEQ ID NO: 3055971 - DNA, 16 bp, Homo sapiens
gagtcatgatctccct

SEQ ID NO: 3055972 - DNA, 18 bp, Homo sapiens
gagtcatgatctccctgc

SEQ ID NO: 3055973 - DNA, 19 bp, Homo sapiens
gagtcatgatctccctgcc

SEQ ID NO: 3055974 - DNA, 22 bp, Homo sapiens
gagtcatgtgcctctgtcctta

SEQ ID NO: 3055975 - DNA, 16 bp, Homo sapiens
gagtcattaccacgcc

SEQ ID NO: 3055976 - DNA, 13 bp, Homo sapiens
gagtcatttgagt

SEQ ID NO: 3055977 - DNA, 23 bp, Homo sapiens
gagtccaacagacacaatttata

SEQ ID NO: 3055978 - DNA, 14 bp, Homo sapiens
gagtccaagctggg

SEQ ID NO: 3055979 - DNA, 19 bp, Homo sapiens
gagtccaaggtttaaagag

SEQ ID NO: 3055980 - DNA, 12 bp, Homo sapiens
gagtcccagagc

SEQ ID NO: 3055981 - DNA, 21 bp, Homo sapiens
gagtcccaggggcagccacac

SEQ ID NO: 3055982 - DNA, 22 bp, Homo sapiens
gagtcccaggggcagccacacc

SEQ ID NO: 3055983 - DNA, 20 bp, Homo sapiens
gagtccccagactctgccta

SEQ ID NO: 3055984 - DNA, 22 bp, Homo sapiens
gagtccctcacgtttcttcccc

SEQ ID NO: 3055985 - DNA, 19 bp, Homo sapiens
gagtccctcgtctcttgtg

SEQ ID NO: 3055986 - DNA, 19 bp, Homo sapiens
gagtccctgcctggaccag

SEQ ID NO: 3055987 - DNA, 23 bp, Homo sapiens
gagtccctgcctggaccagcctc

SEQ ID NO: 3055988 - DNA, 22 bp, Homo sapiens
gagtccgcctgcgcctccatcc

SEQ ID NO: 3055989 - DNA, 16 bp, Homo sapiens
gagtcctccaccccat

SEQ ID NO: 3055990 - DNA, 22 bp, Homo sapiens
gagtctaaagatggagtttcta

SEQ ID NO: 3055991 - DNA, 20 bp, Homo sapiens
gagtctagaagttgtttgtc

SEQ ID NO: 3055992 - DNA, 22 bp, Homo sapiens
gagcttacattgaaaacagata

SEQ ID NO: 3055993 - DNA, 18 bp, Homo sapiens
gagcttctggggtcccca

SEQ ID NO: 3055994 - DNA, 12 bp, Homo sapiens
gagcttggggca

SEQ ID NO: 3055995 - DNA, 17 bp, Homo sapiens
gagctttcttgtttctt

SEQ ID NO: 3055996 - DNA, 21 bp, Homo sapiens
gagcttttcgaactgtgctcc

SEQ ID NO: 3055997 - DNA, 16 bp, Homo sapiens
gaggaaaaacaacaaa

SEQ ID NO: 3055998 - DNA, 21 bp, Homo sapiens
gaggaaaataatgtaattgta

SEQ ID NO: 3055999 - DNA, 17 bp, Homo sapiens
gaggaaagacaacacaa

SEQ ID NO: 3056000 - DNA, 13 bp, Homo sapiens
gaggaaaggccag

SEQ ID NO: 3056001 - DNA, 14 bp, Homo sapiens
gaggaaaggccagc

SEQ ID NO: 3056002 - DNA, 22 bp, Homo sapiens
gaggaaagggcctggccagtcc

SEQ ID NO: 3056003 - DNA, 21 bp, Homo sapiens
gaggaaataaagttaagtttg

SEQ ID NO: 3056004 - DNA, 21 bp, Homo sapiens
gaggaacagtggccttgcttc

SEQ ID NO: 3056005 - DNA, 23 bp, Homo sapiens
gaggaacagtgtggtttgggaaa

SEQ ID NO: 3056006 - DNA, 19 bp, Homo sapiens
gaggaagagacatgagaaa

SEQ ID NO: 3056007 - DNA, 12 bp, Homo sapiens
gaggaagtgagc

SEQ ID NO: 3056008 - DNA, 19 bp, Homo sapiens
gaggaatcactcttgtgga

SEQ ID NO: 3056009 - DNA, 22 bp, Homo sapiens
gaggaatcactcttgtggatgt

SEQ ID NO: 3056010 - DNA, 20 bp, Homo sapiens
gaggaatgtgtgccttgttc

SEQ ID NO: 3056011 - DNA, 20 bp, Homo sapiens
gaggacaattcatgaacttc

SEQ ID NO: 3056012 - DNA, 16 bp, Homo sapiens
gaggacagagggcaca

SEQ ID NO: 3056013 - DNA, 21 bp, Homo sapiens
gaggaccacaggtgtgagcca

SEQ ID NO: 3056014 - DNA, 19 bp, Homo sapiens
gaggaccagggtggagctg

SEQ ID NO: 3056015 - DNA, 22 bp, Homo sapiens
gaggaccgccccaccctggaat

SEQ ID NO: 3056016 - DNA, 18 bp, Homo sapiens
gaggactgtatttgtgac

SEQ ID NO: 3056017 - DNA, 9 bp, Homo sapiens
gaggagaaa

SEQ ID NO: 3056018 - DNA, 20 bp, Homo sapiens
gaggagaagaattttcagac

SEQ ID NO: 3056019 - DNA, 22 bp, Homo sapiens
gaggagaagaattttcagaccc

SEQ ID NO: 3056020 - DNA, 16 bp, Homo sapiens
gaggagagaaaatata

SEQ ID NO: 3056021 - DNA, 14 bp, Homo sapiens
gaggagagaagaat

SEQ ID NO: 3056022 - DNA, 17 bp, Homo sapiens
gaggagagccagagaag

SEQ ID NO: 3056023 - DNA, 23 bp, Homo sapiens
gaggagagccagagaagtgacag

SEQ ID NO: 3056024 - DNA, 13 bp, Homo sapiens
gaggagcccagcg

SEQ ID NO: 3056025 - DNA, 18 bp, Homo sapiens
gaggagcccagtgggctg

SEQ ID NO: 3056026 - DNA, 13 bp, Homo sapiens
gaggagccccatc

SEQ ID NO: 3056027 - DNA, 13 bp, Homo sapiens
gaggagccttttt

SEQ ID NO: 3056028 - DNA, 16 bp, Homo sapiens
gaggagcggactcact

SEQ ID NO: 3056029 - DNA, 15 bp, Homo sapiens
gaggagctgagggag

SEQ ID NO: 3056030 - DNA, 16 bp, Homo sapiens
gaggaggcgcggcctc

SEQ ID NO: 3056031 - DNA, 13 bp, Homo sapiens
gaggaggctgccc

SEQ ID NO: 3056032 - DNA, 14 bp, Homo sapiens
gaggaggctgccct

SEQ ID NO: 3056033 - DNA, 15 bp, Homo sapiens
gaggagggcaggcat

SEQ ID NO: 3056034 - DNA, 16 bp, Homo sapiens
gaggaggggccgctgc

SEQ ID NO: 3056035 - DNA, 18 bp, Homo sapiens
gaggaggggccgctgcca

SEQ ID NO: 3056036 - DNA, 15 bp, Homo sapiens
gaggaggtgggggct

SEQ ID NO: 3056037 - DNA, 18 bp, Homo sapiens
gaggataaaaaggaagga

SEQ ID NO: 3056038 - DNA, 22 bp, Homo sapiens
gaggataaaaaggaaggagaga

SEQ ID NO: 3056039 - DNA, 12 bp, Homo sapiens
gaggatcctgag

SEQ ID NO: 3056040 - DNA, 21 bp, Homo sapiens
gaggatgatttcagaaggaga

SEQ ID NO: 3056041 - DNA, 15 bp, Homo sapiens
gaggatgcattcgag

SEQ ID NO: 3056042 - DNA, 22 bp, Homo sapiens
gaggatttagaagtgtcatgtt

SEQ ID NO: 3056043 - DNA, 16 bp, Homo sapiens
gaggcaaatggcactg

SEQ ID NO: 3056044 - DNA, 13 bp, Homo sapiens
gaggcaagccctg

SEQ ID NO: 3056045 - DNA, 11 bp, Homo sapiens
gaggcacagca

SEQ ID NO: 3056046 - DNA, 21 bp, Homo sapiens
gaggcactagtcaccgacagc

SEQ ID NO: 3056047 - DNA, 17 bp, Homo sapiens
gaggcacttcctcccct

SEQ ID NO: 3056048 - DNA, 22 bp, Homo sapiens
gaggcacttcctcccctcgccc

SEQ ID NO: 3056049 - DNA, 14 bp, Homo sapiens
gaggcagagcggga

SEQ ID NO: 3056050 - DNA, 20 bp, Homo sapiens
gaggcagagcgggagggagt

SEQ ID NO: 3056051 - DNA, 12 bp, Homo sapiens
gaggcaggagaa

SEQ ID NO: 3056052 - DNA, 16 bp, Homo sapiens
gaggcaggcatggccc

SEQ ID NO: 3056053 - DNA, 14 bp, Homo sapiens
gaggcagggaagga

SEQ ID NO: 3056054 - DNA, 21 bp, Homo sapiens
gaggcagggccttgcccagag

SEQ ID NO: 3056055 - DNA, 22 bp, Homo sapiens
gaggcagggccttgcccagaga

SEQ ID NO: 3056056 - DNA, 14 bp, Homo sapiens
gaggcagtggctag

SEQ ID NO: 3056057 - DNA, 18 bp, Homo sapiens
gaggcatccagcagtctc

SEQ ID NO: 3056058 - DNA, 12 bp, Homo sapiens
gaggcatggaaa

SEQ ID NO: 3056059 - DNA, 13 bp, Homo sapiens
gaggcatggaaac

SEQ ID NO: 3056060 - DNA, 15 bp, Homo sapiens
gaggcatggggcatg

SEQ ID NO: 3056061 - DNA, 18 bp, Homo sapiens
gaggccaacactgtgggt

SEQ ID NO: 3056062 - DNA, 18 bp, Homo sapiens
gaggccacactcagcaca

SEQ ID NO: 3056063 - DNA, 15 bp, Homo sapiens
gaggccagggcagag

SEQ ID NO: 3056064 - DNA, 19 bp, Homo sapiens
gaggccagggcagagtgag

SEQ ID NO: 3056065 - DNA, 16 bp, Homo sapiens
gaggccagtgagccac

SEQ ID NO: 3056066 - DNA, 19 bp, Homo sapiens
gaggcccagatccaaggcc

SEQ ID NO: 3056067 - DNA, 15 bp, Homo sapiens
gaggcccaggctggg

SEQ ID NO: 3056068 - DNA, 18 bp, Homo sapiens
gaggcccagttcaccctg

SEQ ID NO: 3056069 - DNA, 14 bp, Homo sapiens
gaggccccactggg

SEQ ID NO: 3056070 - DNA, 12 bp, Homo sapiens
gaggccccagcc

SEQ ID NO: 3056071 - DNA, 22 bp, Homo sapiens
gaggccccagcctccctgaagc

SEQ ID NO: 3056072 - DNA, 23 bp, Homo sapiens
gaggccccagcctccctgaagcc

SEQ ID NO: 3056073 - DNA, 12 bp, Homo sapiens
gaggccccaggg

SEQ ID NO: 3056074 - DNA, 11 bp, Homo sapiens
gaggccctgca

SEQ ID NO: 3056075 - DNA, 13 bp, Homo sapiens
gaggccctgcatg

SEQ ID NO: 3056076 - DNA, 19 bp, Homo sapiens
gaggccctgcatgggccag

SEQ ID NO: 3056077 - DNA, 19 bp, Homo sapiens
gaggccctggtcctggcct

SEQ ID NO: 3056078 - DNA, 17 bp, Homo sapiens
gaggccggccctgcccc

SEQ ID NO: 3056079 - DNA, 23 bp, Homo sapiens
gaggcctcactactcgagcccac

SEQ ID NO: 3056080 - DNA, 21 bp, Homo sapiens
gaggcctcttttcctgaagaa

SEQ ID NO: 3056081 - DNA, 18 bp, Homo sapiens
gaggcctgagacccagga

SEQ ID NO: 3056082 - DNA, 20 bp, Homo sapiens
gaggcctgcgaccctggggg

SEQ ID NO: 3056083 - DNA, 19 bp, Homo sapiens
gaggcctgtctgtgacctg

SEQ ID NO: 3056084 - DNA, 21 bp, Homo sapiens
gaggccttatgagggtcctct

SEQ ID NO: 3056085 - DNA, 19 bp, Homo sapiens
gaggccttggggtgggggc

SEQ ID NO: 3056086 - DNA, 22 bp, Homo sapiens
gaggccttggggtgggggccag

SEQ ID NO: 3056087 - DNA, 13 bp, Homo sapiens
gaggcggcagctc

SEQ ID NO: 3056088 - DNA, 21 bp, Homo sapiens
gaggctcctgttagctcctca

SEQ ID NO: 3056089 - DNA, 13 bp, Homo sapiens
gaggctgagacag

SEQ ID NO: 3056090 - DNA, 13 bp, Homo sapiens
gaggctgaggcac

SEQ ID NO: 3056091 - DNA, 14 bp, Homo sapiens
gaggctgaggcaga

SEQ ID NO: 3056092 - DNA, 21 bp, Homo sapiens
gaggctgaggcaggagaatca

SEQ ID NO: 3056093 - DNA, 15 bp, Homo sapiens
gaggctgaggctggc

SEQ ID NO: 3056094 - DNA, 19 bp, Homo sapiens
gaggctgaggctggcacag

SEQ ID NO: 3056095 - DNA, 18 bp, Homo sapiens
gaggctgcaatgagccat

SEQ ID NO: 3056096 - DNA, 18 bp, Homo sapiens
gaggctgcactggagcca

SEQ ID NO: 3056097 - DNA, 20 bp, Homo sapiens
gaggctgcactggagccaca

SEQ ID NO: 3056098 - DNA, 23 bp, Homo sapiens
gaggctgcactggagccacaggc

SEQ ID NO: 3056099 - DNA, 11 bp, Homo sapiens
gaggctgcagc

SEQ ID NO: 3056100 - DNA, 12 bp, Homo sapiens
gaggctgcagcc

SEQ ID NO: 3056101 - DNA, 15 bp, Homo sapiens
gaggctgcagccagg

SEQ ID NO: 3056102 - DNA, 17 bp, Homo sapiens
gaggctgcagccaggcc

SEQ ID NO: 3056103 - DNA, 14 bp, Homo sapiens
gaggctgcagtcag

SEQ ID NO: 3056104 - DNA, 14 bp, Homo sapiens
gaggctgccccagg

SEQ ID NO: 3056105 - DNA, 16 bp, Homo sapiens
gaggctgccccaggcc

SEQ ID NO: 3056106 - DNA, 17 bp, Homo sapiens
gaggctgccccaggccg

SEQ ID NO: 3056107 - DNA, 18 bp, Homo sapiens
gaggctgccccaggccgg

SEQ ID NO: 3056108 - DNA, 23 bp, Homo sapiens
gaggctgccccaggccggagccc

SEQ ID NO: 3056109 - DNA, 18 bp, Homo sapiens
gaggctgccctgaggggc

SEQ ID NO: 3056110 - DNA, 15 bp, Homo sapiens
gaggctgcctccgca

SEQ ID NO: 3056111 - DNA, 14 bp, Homo sapiens
gaggctggaggcag

SEQ ID NO: 3056112 - DNA, 13 bp, Homo sapiens
gaggcttcacgcc

SEQ ID NO: 3056113 - DNA, 18 bp, Homo sapiens
gaggcttcacgccgggag

SEQ ID NO: 3056114 - DNA, 18 bp, Homo sapiens
gaggctttaagctccagc

SEQ ID NO: 3056115 - DNA, 20 bp, Homo sapiens
gaggctttaagctccagctt

SEQ ID NO: 3056116 - DNA, 17 bp, Homo sapiens
gaggctttgagcaacta

SEQ ID NO: 3056117 - DNA, 20 bp, Homo sapiens
gaggctttggatttgacatt

SEQ ID NO: 3056118 - DNA, 23 bp, Homo sapiens
gaggctttggggtcctagcccag

SEQ ID NO: 3056119 - DNA, 14 bp, Homo sapiens
gagggaaaccagag

SEQ ID NO: 3056120 - DNA, 17 bp, Homo sapiens
gagggaaactgtgaatg

SEQ ID NO: 3056121 - DNA, 23 bp, Homo sapiens
gagggaagatcttgatggtgttt

SEQ ID NO: 3056122 - DNA, 19 bp, Homo sapiens
gagggaagccaggattggg

SEQ ID NO: 3056123 - DNA, 18 bp, Homo sapiens
gagggaatgacaccatca

SEQ ID NO: 3056124 - DNA, 20 bp, Homo sapiens
gagggaccaaattgcttcta

SEQ ID NO: 3056125 - DNA, 17 bp, Homo sapiens
gagggacctctcccagg

SEQ ID NO: 3056126 - DNA, 23 bp, Homo sapiens
gagggacgcctgggggtgccagg

SEQ ID NO: 3056127 - DNA, 20 bp, Homo sapiens
gagggacggccaagaatgta

SEQ ID NO: 3056128 - DNA, 22 bp, Homo sapiens
gagggacgtcagacttggctca

SEQ ID NO: 3056129 - DNA, 15 bp, Homo sapiens
gagcatttatgtaga

SEQ ID NO: 3056130 - DNA, 16 bp, Homo sapiens
gagcatttatgtagac

SEQ ID NO: 3056131 - DNA, 22 bp, Homo sapiens
gagcatttatgtagacattgta

SEQ ID NO: 3056132 - DNA, 15 bp, Homo sapiens
gagccaagaaacact

SEQ ID NO: 3056133 - DNA, 17 bp, Homo sapiens
gagccaagggggcagag

SEQ ID NO: 3056134 - DNA, 15 bp, Homo sapiens
gagccaattagactt

SEQ ID NO: 3056135 - DNA, 16 bp, Homo sapiens
gagccaattagacttg

SEQ ID NO: 3056136 - DNA, 18 bp, Homo sapiens
gagccacacatgggcatc

SEQ ID NO: 3056137 - DNA, 20 bp, Homo sapiens
gagccacaggaacggccctg

SEQ ID NO: 3056138 - DNA, 13 bp, Homo sapiens
gagccacaggcag

SEQ ID NO: 3056139 - DNA, 14 bp, Homo sapiens
gagccaccacacct

SEQ ID NO: 3056140 - DNA, 14 bp, Homo sapiens
gagccagagaagtg

SEQ ID NO: 3056141 - DNA, 16 bp, Homo sapiens
gagccagagaagtgac

SEQ ID NO: 3056142 - DNA, 14 bp, Homo sapiens
gagccagccaggcc

SEQ ID NO: 3056143 - DNA, 13 bp, Homo sapiens
gagccagccctcc

SEQ ID NO: 3056144 - DNA, 14 bp, Homo sapiens
gagccagccctccc

SEQ ID NO: 3056145 - DNA, 16 bp, Homo sapiens
gagccagccctccctg

SEQ ID NO: 3056146 - DNA, 21 bp, Homo sapiens
gagccagccctccctgtcctc

SEQ ID NO: 3056147 - DNA, 17 bp, Homo sapiens
gagccagcggctccaac

SEQ ID NO: 3056148 - DNA, 19 bp, Homo sapiens
gagccagcggctccaactc

SEQ ID NO: 3056149 - DNA, 20 bp, Homo sapiens
gagccagcggctccaactcc

SEQ ID NO: 3056150 - DNA, 23 bp, Homo sapiens
gagccagggtagagcaaaggaga

SEQ ID NO: 3056151 - DNA, 20 bp, Homo sapiens
gagccatggaaggtgccaga

SEQ ID NO: 3056152 - DNA, 12 bp, Homo sapiens
gagccatgtttc

SEQ ID NO: 3056153 - DNA, 13 bp, Homo sapiens
gagccatttgaga

SEQ ID NO: 3056154 - DNA, 16 bp, Homo sapiens
gagcccagcccaggag

SEQ ID NO: 3056155 - DNA, 18 bp, Homo sapiens
gagcccagccctccccat

SEQ ID NO: 3056156 - DNA, 19 bp, Homo sapiens
gagcccagcggcccaagag

SEQ ID NO: 3056157 - DNA, 14 bp, Homo sapiens
gagcccagctcttg

SEQ ID NO: 3056158 - DNA, 19 bp, Homo sapiens
gagcccagctcttgctctc

SEQ ID NO: 3056159 - DNA, 19 bp, Homo sapiens
gagcccagctgggtcaggc

SEQ ID NO: 3056160 - DNA, 12 bp, Homo sapiens
gagcccagggga

SEQ ID NO: 3056161 - DNA, 12 bp, Homo sapiens
gagccccatctt

SEQ ID NO: 3056162 - DNA, 18 bp, Homo sapiens
gagccccatcttcaccca

SEQ ID NO: 3056163 - DNA, 18 bp, Homo sapiens
gagcccctcggctctgga

SEQ ID NO: 3056164 - DNA, 20 bp, Homo sapiens
gagcccctcggctctggagg

SEQ ID NO: 3056165 - DNA, 12 bp, Homo sapiens
gagcccctgagt

SEQ ID NO: 3056166 - DNA, 21 bp, Homo sapiens
gagcccctgtctagagaggga

SEQ ID NO: 3056167 - DNA, 22 bp, Homo sapiens
gagcccctgtctagagagggag

SEQ ID NO: 3056168 - DNA, 17 bp, Homo sapiens
gagcccgcactgtccca

SEQ ID NO: 3056169 - DNA, 14 bp, Homo sapiens
gagcccgcagccca

SEQ ID NO: 3056170 - DNA, 23 bp, Homo sapiens
gagccctccgccttcacattccc

SEQ ID NO: 3056171 - DNA, 21 bp, Homo sapiens
gagccctgtggatgagccctc

SEQ ID NO: 3056172 - DNA, 13 bp, Homo sapiens
gagcccttagcct

SEQ ID NO: 3056173 - DNA, 14 bp, Homo sapiens
gagcccttagcctt

SEQ ID NO: 3056174 - DNA, 22 bp, Homo sapiens
gagcccttagccttgctgtaga

SEQ ID NO: 3056175 - DNA, 19 bp, Homo sapiens
gagcccttatctgtgctca

SEQ ID NO: 3056176 - DNA, 16 bp, Homo sapiens
gagccgagggcgtcag

SEQ ID NO: 3056177 - DNA, 20 bp, Homo sapiens
gagccgagggcgtcagagag

SEQ ID NO: 3056178 - DNA, 21 bp, Homo sapiens
gagccgcatcttctccatctg

SEQ ID NO: 3056179 - DNA, 22 bp, Homo sapiens
gagccgcatcttctccatctgg

SEQ ID NO: 3056180 - DNA, 18 bp, Homo sapiens
gagccggacacttctcag

SEQ ID NO: 3056181 - DNA, 23 bp, Homo sapiens
gagccggacacttctcaggaaat

SEQ ID NO: 3056182 - DNA, 12 bp, Homo sapiens
gagccggagcct

SEQ ID NO: 3056183 - DNA, 22 bp, Homo sapiens
gagccgggaaagaagagccgga

SEQ ID NO: 3056184 - DNA, 21 bp, Homo sapiens
gagccgggtctgcctcttctg

SEQ ID NO: 3056185 - DNA, 22 bp, Homo sapiens
gagccgggtctgcctcttctgg

SEQ ID NO: 3056186 - DNA, 17 bp, Homo sapiens
gagccgtggtcctttgg

SEQ ID NO: 3056187 - DNA, 13 bp, Homo sapiens
gagcctcagaaga

SEQ ID NO: 3056188 - DNA, 16 bp, Homo sapiens
gagcctctgctcccca

SEQ ID NO: 3056189 - DNA, 13 bp, Homo sapiens
gagcctgaggcag

SEQ ID NO: 3056190 - DNA, 16 bp, Homo sapiens
gagcctgaggcaggag

SEQ ID NO: 3056191 - DNA, 12 bp, Homo sapiens
gagcctgaggga

SEQ ID NO: 3056192 - DNA, 15 bp, Homo sapiens
gagcctgagggatct

SEQ ID NO: 3056193 - DNA, 12 bp, Homo sapiens
gagcctgcagag

SEQ ID NO: 3056194 - DNA, 13 bp, Homo sapiens
gagcctgcaggga

SEQ ID NO: 3056195 - DNA, 13 bp, Homo sapiens
gagcctgctcccc

SEQ ID NO: 3056196 - DNA, 17 bp, Homo sapiens
gagcctgctcccccacc

SEQ ID NO: 3056197 - DNA, 16 bp, Homo sapiens
gagcctgtccccgcct

SEQ ID NO: 3056198 - DNA, 17 bp, Homo sapiens
gagcctgtgaccttggg

SEQ ID NO: 3056199 - DNA, 18 bp, Homo sapiens
gagccttttaactgtgca

SEQ ID NO: 3056200 - DNA, 19 bp, Homo sapiens
gagccttttaactgtgcaa

SEQ ID NO: 3056201 - DNA, 20 bp, Homo sapiens
gagcctttttaaaacacatg

SEQ ID NO: 3056202 - DNA, 13 bp, Homo sapiens
gagcgaggaaaaa

SEQ ID NO: 3056203 - DNA, 21 bp, Homo sapiens
gagcgaggagatgctccttgg

SEQ ID NO: 3056204 - DNA, 21 bp, Homo sapiens
gagcgcaagccacagcctgtc

SEQ ID NO: 3056205 - DNA, 13 bp, Homo sapiens
gagcgcctgcccc

SEQ ID NO: 3056206 - DNA, 14 bp, Homo sapiens
gagcgcggctggct

SEQ ID NO: 3056207 - DNA, 16 bp, Homo sapiens
gagcgcggctggctct

SEQ ID NO: 3056208 - DNA, 18 bp, Homo sapiens
gagcgctggtcccctccc

SEQ ID NO: 3056209 - DNA, 17 bp, Homo sapiens
gagcggaaagcagctca

SEQ ID NO: 3056210 - DNA, 18 bp, Homo sapiens
gagcggactcacttgatg

SEQ ID NO: 3056211 - DNA, 17 bp, Homo sapiens
gagcggaggaggaagtc

SEQ ID NO: 3056212 - DNA, 21 bp, Homo sapiens
gagcggctgctcgcccaggaa

SEQ ID NO: 3056213 - DNA, 13 bp, Homo sapiens
gagcgggagggag

SEQ ID NO: 3056214 - DNA, 13 bp, Homo sapiens
gagcggtggcccc

SEQ ID NO: 3056215 - DNA, 15 bp, Homo sapiens
gagcgtttgctgtgc

SEQ ID NO: 3056216 - DNA, 11 bp, Homo sapiens
gagctaaggct

SEQ ID NO: 3056217 - DNA, 15 bp, Homo sapiens
gagctagccagagga

SEQ ID NO: 3056218 - DNA, 19 bp, Homo sapiens
gagctagttctcagcttgc

SEQ ID NO: 3056219 - DNA, 19 bp, Homo sapiens
gagctcaagggacaaggac

SEQ ID NO: 3056220 - DNA, 18 bp, Homo sapiens
gagctcacctgtttgaaa

SEQ ID NO: 3056221 - DNA, 14 bp, Homo sapiens
gagctcagaccccc

SEQ ID NO: 3056222 - DNA, 22 bp, Homo sapiens
gagctcccaggtgcagccagag

SEQ ID NO: 3056223 - DNA, 20 bp, Homo sapiens
gagctcccctacggaccagg

SEQ ID NO: 3056224 - DNA, 14 bp, Homo sapiens
gagctcgcagcccc

SEQ ID NO: 3056225 - DNA, 16 bp, Homo sapiens
gagctcgcagcccccg

SEQ ID NO: 3056226 - DNA, 15 bp, Homo sapiens
gagctctacccaggg

SEQ ID NO: 3056227 - DNA, 23 bp, Homo sapiens
gagctctacccagggcctgcagg

SEQ ID NO: 3056228 - DNA, 12 bp, Homo sapiens
gagctctccagg

SEQ ID NO: 3056229 - DNA, 15 bp, Homo sapiens
gagctctccaggcca

SEQ ID NO: 3056230 - DNA, 16 bp, Homo sapiens
gagctctccaggccag

SEQ ID NO: 3056231 - DNA, 17 bp, Homo sapiens
gagctctgcgccaggca

SEQ ID NO: 3056232 - DNA, 23 bp, Homo sapiens
gagctctgcgccaggcagagctg

SEQ ID NO: 3056233 - DNA, 21 bp, Homo sapiens
gagctcttgggtcagagaaaa

SEQ ID NO: 3056234 - DNA, 23 bp, Homo sapiens
gagctgaaaaggatcgaggcatg

SEQ ID NO: 3056235 - DNA, 19 bp, Homo sapiens
gagctgagaagaggaggag

SEQ ID NO: 3056236 - DNA, 21 bp, Homo sapiens
gagctgagaagaggaggaggt

SEQ ID NO: 3056237 - DNA, 22 bp, Homo sapiens
gagctgagaagaggaggaggtg

SEQ ID NO: 3056238 - DNA, 22 bp, Homo sapiens
gagctgagatcgtgccactgca

SEQ ID NO: 3056239 - DNA, 23 bp, Homo sapiens
gagctgagccaggctagctggag

SEQ ID NO: 3056240 - DNA, 12 bp, Homo sapiens
gagctgagggag

SEQ ID NO: 3056241 - DNA, 15 bp, Homo sapiens
gagctgagggccctg

SEQ ID NO: 3056242 - DNA, 11 bp, Homo sapiens
gagctgccact

SEQ ID NO: 3056243 - DNA, 18 bp, Homo sapiens
gagctgcccggcgcctgc

SEQ ID NO: 3056244 - DNA, 19 bp, Homo sapiens
gagctgcccggcgcctgcc

SEQ ID NO: 3056245 - DNA, 12 bp, Homo sapiens
gagctgcctgca

SEQ ID NO: 3056246 - DNA, 17 bp, Homo sapiens
gagctgcgggctgaggg

SEQ ID NO: 3056247 - DNA, 15 bp, Homo sapiens
gagctgctaaaataa

SEQ ID NO: 3056248 - DNA, 21 bp, Homo sapiens
gagctgctatagcctggggtg

SEQ ID NO: 3056249 - DNA, 13 bp, Homo sapiens
gagctgctgagtg

SEQ ID NO: 3056250 - DNA, 20 bp, Homo sapiens
gagctggccaaagagccttt

SEQ ID NO: 3056251 - DNA, 22 bp, Homo sapiens
gagctggccaaagagcctttcc

SEQ ID NO: 3056252 - DNA, 14 bp, Homo sapiens
gagctggcccaggg

SEQ ID NO: 3056253 - DNA, 15 bp, Homo sapiens
gagctggcccagggg

SEQ ID NO: 3056254 - DNA, 20 bp, Homo sapiens
gagctggcccagggggcctg

SEQ ID NO: 3056255 - DNA, 21 bp, Homo sapiens
gagctggcccagggggcctgg

SEQ ID NO: 3056256 - DNA, 22 bp, Homo sapiens
gagctggcccagggggcctgga

SEQ ID NO: 3056257 - DNA, 21 bp, Homo sapiens
gagctgggacacttaacagat

SEQ ID NO: 3056258 - DNA, 16 bp, Homo sapiens
gagctgggaggaaaag

SEQ ID NO: 3056259 - DNA, 19 bp, Homo sapiens
gagctgggatcccacagcc

SEQ ID NO: 3056260 - DNA, 13 bp, Homo sapiens
gagctgggcccga

SEQ ID NO: 3056261 - DNA, 18 bp, Homo sapiens
gagctggggaggtgggag

SEQ ID NO: 3056262 - DNA, 20 bp, Homo sapiens
gagctggggaggtgggaggc

SEQ ID NO: 3056263 - DNA, 15 bp, Homo sapiens
gagctggtgacagcc

SEQ ID NO: 3056264 - DNA, 16 bp, Homo sapiens
gagctgtcaccaagga

SEQ ID NO: 3056265 - DNA, 20 bp, Homo sapiens
gagctgtgcatcagctagaa

SEQ ID NO: 3056266 - DNA, 20 bp, Homo sapiens
gagacaggaaaatcctctgg

SEQ ID NO: 3056267 - DNA, 21 bp, Homo sapiens
gagacaggaaaatcctctggc

SEQ ID NO: 3056268 - DNA, 13 bp, Homo sapiens
gagacaggaagcc

SEQ ID NO: 3056269 - DNA, 14 bp, Homo sapiens
gagacaggcagagc

SEQ ID NO: 3056270 - DNA, 19 bp, Homo sapiens
gagacaggcagagctgctc

SEQ ID NO: 3056271 - DNA, 19 bp, Homo sapiens
gagacagggtttcaccatg

SEQ ID NO: 3056272 - DNA, 14 bp, Homo sapiens
gagacagtgggaaa

SEQ ID NO: 3056273 - DNA, 15 bp, Homo sapiens
gagacagtgggaaat

SEQ ID NO: 3056274 - DNA, 17 bp, Homo sapiens
gagacagttgagagcgg

SEQ ID NO: 3056275 - DNA, 22 bp, Homo sapiens
gagacattaactcattagactg

SEQ ID NO: 3056276 - DNA, 14 bp, Homo sapiens
gagaccaacctgac

SEQ ID NO: 3056277 - DNA, 16 bp, Homo sapiens
gagaccaacctgacca

SEQ ID NO: 3056278 - DNA, 14 bp, Homo sapiens
gagaccagcctttc

SEQ ID NO: 3056279 - DNA, 18 bp, Homo sapiens
gacggtttccagggaggg

SEQ ID NO: 3056280 - DNA, 13 bp, Homo sapiens
gacgtgaaatact

SEQ ID NO: 3056281 - DNA, 19 bp, Homo sapiens
gacgtgaaatacttcgatg

SEQ ID NO: 3056282 - DNA, 14 bp, Homo sapiens
gacgtgcactgtga

SEQ ID NO: 3056283 - DNA, 13 bp, Homo sapiens
gacgtgctggcct

SEQ ID NO: 3056284 - DNA, 17 bp, Homo sapiens
gacgtgggccctgcagg

SEQ ID NO: 3056285 - DNA, 20 bp, Homo sapiens
gacgtgggctgggcccacaa

SEQ ID NO: 3056286 - DNA, 22 bp, Homo sapiens
gacgtgttacccactgccatgc

SEQ ID NO: 3056287 - DNA, 13 bp, Homo sapiens
gactaaaaatgca

SEQ ID NO: 3056288 - DNA, 15 bp, Homo sapiens
gactaaactacatta

SEQ ID NO: 3056289 - DNA, 16 bp, Homo sapiens
gactaagccaagctgt

SEQ ID NO: 3056290 - DNA, 22 bp, Homo sapiens
gactaattgtataacaggttat

SEQ ID NO: 3056291 - DNA, 15 bp, Homo sapiens
gactaattttacatg

SEQ ID NO: 3056292 - DNA, 18 bp, Homo sapiens
gactacagtcaggaaagg

SEQ ID NO: 3056293 - DNA, 22 bp, Homo sapiens
gactacattttgctctgtgaac

SEQ ID NO: 3056294 - DNA, 23 bp, Homo sapiens
gactagagggacctctcccaggg

SEQ ID NO: 3056295 - DNA, 22 bp, Homo sapiens
gactaggttctgtagagccaat

SEQ ID NO: 3056296 - DNA, 21 bp, Homo sapiens
gactagtgagtcagcaccttg

SEQ ID NO: 3056297 - DNA, 21 bp, Homo sapiens
gactatatttgggcctgctcc

SEQ ID NO: 3056298 - DNA, 17 bp, Homo sapiens
gactatgcagaggcctg

SEQ ID NO: 3056299 - DNA, 18 bp, Homo sapiens
gactatgccgtcttctgc

SEQ ID NO: 3056300 - DNA, 19 bp, Homo sapiens
gactatgccgtcttctgcc

SEQ ID NO: 3056301 - DNA, 20 bp, Homo sapiens
gactatggaatgtcagtgtt

SEQ ID NO: 3056302 - DNA, 20 bp, Homo sapiens
gactattatgttgttagaga

SEQ ID NO: 3056303 - DNA, 14 bp, Homo sapiens
gactcaaaaataag

SEQ ID NO: 3056304 - DNA, 19 bp, Homo sapiens
gactcaaatgttctaagtt

SEQ ID NO: 3056305 - DNA, 16 bp, Homo sapiens
gactcacacttgtaat

SEQ ID NO: 3056306 - DNA, 17 bp, Homo sapiens
gactcacacttgtaatc

SEQ ID NO: 3056307 - DNA, 13 bp, Homo sapiens
gactcaccctcca

SEQ ID NO: 3056308 - DNA, 18 bp, Homo sapiens
gactcaccctccacaaag

SEQ ID NO: 3056309 - DNA, 12 bp, Homo sapiens
gactcacctctg

SEQ ID NO: 3056310 - DNA, 13 bp, Homo sapiens
gactcaccttgtg

SEQ ID NO: 3056311 - DNA, 22 bp, Homo sapiens
gactcactggcagccccagcac

SEQ ID NO: 3056312 - DNA, 15 bp, Homo sapiens
gactcagaagcctct

SEQ ID NO: 3056313 - DNA, 16 bp, Homo sapiens
gactcagactccattt

SEQ ID NO: 3056314 - DNA, 11 bp, Homo sapiens
gactcagagct

SEQ ID NO: 3056315 - DNA, 14 bp, Homo sapiens
gactcagcagaggc

SEQ ID NO: 3056316 - DNA, 22 bp, Homo sapiens
gactcagcagaggcagtggcca

SEQ ID NO: 3056317 - DNA, 13 bp, Homo sapiens
gactcagcagcct

SEQ ID NO: 3056318 - DNA, 23 bp, Homo sapiens
gactcagctctgacattctgatt

SEQ ID NO: 3056319 - DNA, 12 bp, Homo sapiens
gactcagggcag

SEQ ID NO: 3056320 - DNA, 16 bp, Homo sapiens
gactcagggcagcgcc

SEQ ID NO: 3056321 - DNA, 14 bp, Homo sapiens
gactcagggctcct

SEQ ID NO: 3056322 - DNA, 22 bp, Homo sapiens
gactcaggtggtgtccttcttc

SEQ ID NO: 3056323 - DNA, 20 bp, Homo sapiens
gactcagtgcagatggagag

SEQ ID NO: 3056324 - DNA, 18 bp, Homo sapiens
gactcatgaggaggggcc

SEQ ID NO: 3056325 - DNA, 17 bp, Homo sapiens
gactcatgcctctgagc

SEQ ID NO: 3056326 - DNA, 18 bp, Homo sapiens
gactcatggtgtgttaca

SEQ ID NO: 3056327 - DNA, 15 bp, Homo sapiens
gactccaggccagct

SEQ ID NO: 3056328 - DNA, 12 bp, Homo sapiens
gactccatctca

SEQ ID NO: 3056329 - DNA, 23 bp, Homo sapiens
gactccattggggtgagaggtga

SEQ ID NO: 3056330 - DNA, 19 bp, Homo sapiens
gactccatttctttcttcc

SEQ ID NO: 3056331 - DNA, 23 bp, Homo sapiens
gactcccccaaccaaggaaggag

SEQ ID NO: 3056332 - DNA, 15 bp, Homo sapiens
gactcccgccccggg

SEQ ID NO: 3056333 - DNA, 22 bp, Homo sapiens
gactcccggggtccccgccctc

SEQ ID NO: 3056334 - DNA, 14 bp, Homo sapiens
gactccggccctcc

SEQ ID NO: 3056335 - DNA, 18 bp, Homo sapiens
gactcctgaggacagctg

SEQ ID NO: 3056336 - DNA, 19 bp, Homo sapiens
gactcctgaggacagctgt

SEQ ID NO: 3056337 - DNA, 18 bp, Homo sapiens
gactctagagtccaaggt

SEQ ID NO: 3056338 - DNA, 15 bp, Homo sapiens
gactctagcaaggct

SEQ ID NO: 3056339 - DNA, 19 bp, Homo sapiens
gactctaggtgcccttgga

SEQ ID NO: 3056340 - DNA, 14 bp, Homo sapiens
gactctcagtctct

SEQ ID NO: 3056341 - DNA, 20 bp, Homo sapiens
gactctctgagctggggagg

SEQ ID NO: 3056342 - DNA, 20 bp, Homo sapiens
gactctgcaagtgtctggag

SEQ ID NO: 3056343 - DNA, 22 bp, Homo sapiens
gactctgcaagtgtctggagcg

SEQ ID NO: 3056344 - DNA, 17 bp, Homo sapiens
gactctggcttggccta

SEQ ID NO: 3056345 - DNA, 12 bp, Homo sapiens
gactctgggcag

SEQ ID NO: 3056346 - DNA, 13 bp, Homo sapiens
gactctgggcagg

SEQ ID NO: 3056347 - DNA, 18 bp, Homo sapiens
gactctggtgcctccaga

SEQ ID NO: 3056348 - DNA, 22 bp, Homo sapiens
gactctgtaaccacctctctgt

SEQ ID NO: 3056349 - DNA, 23 bp, Homo sapiens
gactcttccaccagagcaggggc

SEQ ID NO: 3056350 - DNA, 14 bp, Homo sapiens
gactcttgggaggg

SEQ ID NO: 3056351 - DNA, 19 bp, Homo sapiens
gactcttgttttcagtttc

SEQ ID NO: 3056352 - DNA, 20 bp, Homo sapiens
gactctttagcaaaaaaaac

SEQ ID NO: 3056353 - DNA, 20 bp, Homo sapiens
gactgaaaacctctcctcat

SEQ ID NO: 3056354 - DNA, 21 bp, Homo sapiens
gactgaaagaagaacagctgt

SEQ ID NO: 3056355 - DNA, 19 bp, Homo sapiens
gactgaagcgaacatcttc

SEQ ID NO: 3056356 - DNA, 21 bp, Homo sapiens
gactgaagcgaacatcttcat

SEQ ID NO: 3056357 - DNA, 18 bp, Homo sapiens
gactgaattgtccccagt

SEQ ID NO: 3056358 - DNA, 15 bp, Homo sapiens
gactgacctggtcca

SEQ ID NO: 3056359 - DNA, 18 bp, Homo sapiens
gactgagatttcttaaat

SEQ ID NO: 3056360 - DNA, 21 bp, Homo sapiens
gactgagcgaggaaaaacaac

SEQ ID NO: 3056361 - DNA, 21 bp, Homo sapiens
gactgagcggccgcagagact

SEQ ID NO: 3056362 - DNA, 22 bp, Homo sapiens
gactgagcggccgcagagactg

SEQ ID NO: 3056363 - DNA, 23 bp, Homo sapiens
gactgagcggccgcagagactgg

SEQ ID NO: 3056364 - DNA, 17 bp, Homo sapiens
gactgagctctccaggc

SEQ ID NO: 3056365 - DNA, 19 bp, Homo sapiens
gactgagtgtgggagtgca

SEQ ID NO: 3056366 - DNA, 18 bp, Homo sapiens
gactgatgacaaacccag

SEQ ID NO: 3056367 - DNA, 19 bp, Homo sapiens
gactgcaccattgctgctc

SEQ ID NO: 3056368 - DNA, 17 bp, Homo sapiens
gactgcacccaggaggg

SEQ ID NO: 3056369 - DNA, 20 bp, Homo sapiens
gactgcagtcggcatgccag

SEQ ID NO: 3056370 - DNA, 12 bp, Homo sapiens
gactgcatttgt

SEQ ID NO: 3056371 - DNA, 14 bp, Homo sapiens
gactgcatttgtgt

SEQ ID NO: 3056372 - DNA, 17 bp, Homo sapiens
gactgcatttgtgtgtg

SEQ ID NO: 3056373 - DNA, 15 bp, Homo sapiens
gactgcccagccact

SEQ ID NO: 3056374 - DNA, 21 bp, Homo sapiens
gactgcccagccactccaagc

SEQ ID NO: 3056375 - DNA, 18 bp, Homo sapiens
gactgccccaactcctgg

SEQ ID NO: 3056376 - DNA, 16 bp, Homo sapiens
gactgccccagccaac

SEQ ID NO: 3056377 - DNA, 11 bp, Homo sapiens
gactgcctccc

SEQ ID NO: 3056378 - DNA, 14 bp, Homo sapiens
gactgcctccctct

SEQ ID NO: 3056379 - DNA, 13 bp, Homo sapiens
gactgcgctgctt

SEQ ID NO: 3056380 - DNA, 14 bp, Homo sapiens
gactgctaaataaa

SEQ ID NO: 3056381 - DNA, 14 bp, Homo sapiens
gactgctgctcccc

SEQ ID NO: 3056382 - DNA, 16 bp, Homo sapiens
gactgctgctccccac

SEQ ID NO: 3056383 - DNA, 11 bp, Homo sapiens
gactgctggct

SEQ ID NO: 3056384 - DNA, 15 bp, Homo sapiens
gactgctggctcacg

SEQ ID NO: 3056385 - DNA, 15 bp, Homo sapiens
gactgcttggccaga

SEQ ID NO: 3056386 - DNA, 16 bp, Homo sapiens
gactgcttggccagat

SEQ ID NO: 3056387 - DNA, 18 bp, Homo sapiens
gactgcttggccagatgc

SEQ ID NO: 3056388 - DNA, 23 bp, Homo sapiens
gactggaaaaatgaactgtatta

SEQ ID NO: 3056389 - DNA, 20 bp, Homo sapiens
gactggaagctaatttgcat

SEQ ID NO: 3056390 - DNA, 21 bp, Homo sapiens
gactggaagctaatttgcatt

SEQ ID NO: 3056391 - DNA, 14 bp, Homo sapiens
gactggacagcttg

SEQ ID NO: 3056392 - DNA, 15 bp, Homo sapiens
gactggactggacca

SEQ ID NO: 3056393 - DNA, 20 bp, Homo sapiens
gactggatttgcagaagttt

SEQ ID NO: 3056394 - DNA, 11 bp, Homo sapiens
gactggcaggc

SEQ ID NO: 3056395 - DNA, 12 bp, Homo sapiens
gactggcaggcg

SEQ ID NO: 3056396 - DNA, 15 bp, Homo sapiens
gactggcaggcgggg

SEQ ID NO: 3056397 - DNA, 14 bp, Homo sapiens
gactggccgggcag

SEQ ID NO: 3056398 - DNA, 15 bp, Homo sapiens
gactggccgggcagg

SEQ ID NO: 3056399 - DNA, 23 bp, Homo sapiens
gactggctgtgtaaccttgggtg

SEQ ID NO: 3056400 - DNA, 21 bp, Homo sapiens
gactggcttttattaatgcac

SEQ ID NO: 3056401 - DNA, 22 bp, Homo sapiens
gactggcttttattaatgcact

SEQ ID NO: 3056402 - DNA, 16 bp, Homo sapiens
gactgggctgagggag

SEQ ID NO: 3056403 - DNA, 12 bp, Homo sapiens
gactgggctggg

SEQ ID NO: 3056404 - DNA, 15 bp, Homo sapiens
gactgggtctgacct

SEQ ID NO: 3056405 - DNA, 18 bp, Homo sapiens
gactggtaggaggaggca

SEQ ID NO: 3056406 - DNA, 20 bp, Homo sapiens
gactggtaggaggaggcatg

SEQ ID NO: 3056407 - DNA, 23 bp, Homo sapiens
gactgtatttgtgactaattgta

SEQ ID NO: 3056408 - DNA, 14 bp, Homo sapiens
gactgtcagggagg

SEQ ID NO: 3056409 - DNA, 18 bp, Homo sapiens
gactgtctccatggccct

SEQ ID NO: 3056410 - DNA, 18 bp, Homo sapiens
gactgtcttccctctcta

SEQ ID NO: 3056411 - DNA, 20 bp, Homo sapiens
gactgtggagttccattctt

SEQ ID NO: 3056412 - DNA, 17 bp, Homo sapiens
gactgtggcacttgcct

SEQ ID NO: 3056413 - DNA, 11 bp, Homo sapiens
gactgttgatg

SEQ ID NO: 3056414 - DNA, 16 bp, Homo sapiens
gactgttgtgctccat

SEQ ID NO: 3056415 - DNA, 16 bp, Homo sapiens
gctcatcagaactgaa

SEQ ID NO: 3056416 - DNA, 20 bp, Homo sapiens
gctcatcattctctgtctca

SEQ ID NO: 3056417 - DNA, 16 bp, Homo sapiens
gctcatccttaatgta

SEQ ID NO: 3056418 - DNA, 20 bp, Homo sapiens
gctcatctgagccagcaccg

SEQ ID NO: 3056419 - DNA, 17 bp, Homo sapiens
gctcatgccccttgggg

SEQ ID NO: 3056420 - DNA, 21 bp, Homo sapiens
gctcatgtgtccctggcgctg

SEQ ID NO: 3056421 - DNA, 16 bp, Homo sapiens
gctcattccacactgt

SEQ ID NO: 3056422 - DNA, 20 bp, Homo sapiens
gctcatttacttgaaatgta

SEQ ID NO: 3056423 - DNA, 13 bp, Homo sapiens
gctccaaaccctc

SEQ ID NO: 3056424 - DNA, 18 bp, Homo sapiens
gctccaaaccctcgaggc

SEQ ID NO: 3056425 - DNA, 12 bp, Homo sapiens
gctccaacagaa

SEQ ID NO: 3056426 - DNA, 14 bp, Homo sapiens
gctccaagattcta

SEQ ID NO: 3056427 - DNA, 18 bp, Homo sapiens
gctccaagattctagatg

SEQ ID NO: 3056428 - DNA, 20 bp, Homo sapiens
gctccaaggggaatcagaac

SEQ ID NO: 3056429 - DNA, 18 bp, Homo sapiens
gctccaccagcatcacct

SEQ ID NO: 3056430 - DNA, 17 bp, Homo sapiens
gctccagaatgtgctgc

SEQ ID NO: 3056431 - DNA, 19 bp, Homo sapiens
gctccagaatgtgctgcct

SEQ ID NO: 3056432 - DNA, 12 bp, Homo sapiens
gctccagacctg

SEQ ID NO: 3056433 - DNA, 13 bp, Homo sapiens
gctccagacctga

SEQ ID NO: 3056434 - DNA, 21 bp, Homo sapiens
gctccagagggcactctgctt

SEQ ID NO: 3056435 - DNA, 19 bp, Homo sapiens
gctccagatgcagggcagt

SEQ ID NO: 3056436 - DNA, 21 bp, Homo sapiens
gctccagatgcagggcagtca

SEQ ID NO: 3056437 - DNA, 22 bp, Homo sapiens
gctccagatgcagggcagtcat

SEQ ID NO: 3056438 - DNA, 22 bp, Homo sapiens
gctccagcaacacagcctgggc

SEQ ID NO: 3056439 - DNA, 23 bp, Homo sapiens
gctccagcaacacagcctgggcc

SEQ ID NO: 3056440 - DNA, 23 bp, Homo sapiens
gctccagcaagcaaacagggtgg

SEQ ID NO: 3056441 - DNA, 18 bp, Homo sapiens
gctccagcccctttccaa

SEQ ID NO: 3056442 - DNA, 15 bp, Homo sapiens
gctccagctttaagg

SEQ ID NO: 3056443 - DNA, 23 bp, Homo sapiens
gctccaggatgcattctgatagg

SEQ ID NO: 3056444 - DNA, 22 bp, Homo sapiens
gctccagggtcaggcggagctg

SEQ ID NO: 3056445 - DNA, 21 bp, Homo sapiens
gctccaggtaccttgaccttt

SEQ ID NO: 3056446 - DNA, 17 bp, Homo sapiens
gctccatcccattcact

SEQ ID NO: 3056447 - DNA, 22 bp, Homo sapiens
gctccatctccgcctccacact

SEQ ID NO: 3056448 - DNA, 19 bp, Homo sapiens
gctccatgctttcacctac

SEQ ID NO: 3056449 - DNA, 17 bp, Homo sapiens
gctccatttacaaacta

SEQ ID NO: 3056450 - DNA, 18 bp, Homo sapiens
gctcccaaaacattttaa

SEQ ID NO: 3056451 - DNA, 18 bp, Homo sapiens
gctcccaactcccttctg

SEQ ID NO: 3056452 - DNA, 18 bp, Homo sapiens
gctcccacacttgtgcca

SEQ ID NO: 3056453 - DNA, 20 bp, Homo sapiens
gctcccacacttgtgccagc

SEQ ID NO: 3056454 - DNA, 13 bp, Homo sapiens
gctcccacctagt

SEQ ID NO: 3056455 - DNA, 14 bp, Homo sapiens
gctcccacggggac

SEQ ID NO: 3056456 - DNA, 14 bp, Homo sapiens
gctcccaggtgcag

SEQ ID NO: 3056457 - DNA, 19 bp, Homo sapiens
gctcccaggtgcagccaga

SEQ ID NO: 3056458 - DNA, 20 bp, Homo sapiens
gctcccaggtgcagccagag

SEQ ID NO: 3056459 - DNA, 20 bp, Homo sapiens
gctccccaggaagcccactg

SEQ ID NO: 3056460 - DNA, 14 bp, Homo sapiens
gctcccccaccccc

SEQ ID NO: 3056461 - DNA, 15 bp, Homo sapiens
gctcccccaccccct

SEQ ID NO: 3056462 - DNA, 20 bp, Homo sapiens
gctcccccaccccctcccca

SEQ ID NO: 3056463 - DNA, 15 bp, Homo sapiens
gctccccctctgctt

SEQ ID NO: 3056464 - DNA, 17 bp, Homo sapiens
gctccccgagggctcag

SEQ ID NO: 3056465 - DNA, 16 bp, Homo sapiens
gctcccctccatcccc

SEQ ID NO: 3056466 - DNA, 22 bp, Homo sapiens
gctcccctccatccccatcggc

SEQ ID NO: 3056467 - DNA, 18 bp, Homo sapiens
gctccccttgcccttcct

SEQ ID NO: 3056468 - DNA, 18 bp, Homo sapiens
gctccctcccatcctcca

SEQ ID NO: 3056469 - DNA, 11 bp, Homo sapiens
gctccctctct

SEQ ID NO: 3056470 - DNA, 13 bp, Homo sapiens
gctccctctctcc

SEQ ID NO: 3056471 - DNA, 16 bp, Homo sapiens
gctccctctctcctgg

SEQ ID NO: 3056472 - DNA, 19 bp, Homo sapiens
gctccctctctcctggact

SEQ ID NO: 3056473 - DNA, 21 bp, Homo sapiens
gctccctgtaacctcttcaga

SEQ ID NO: 3056474 - DNA, 20 bp, Homo sapiens
gctccgaaattccaaggccc

SEQ ID NO: 3056475 - DNA, 21 bp, Homo sapiens
gctccgacctctctcagcccc

SEQ ID NO: 3056476 - DNA, 14 bp, Homo sapiens
gctccgctgcctgg

SEQ ID NO: 3056477 - DNA, 16 bp, Homo sapiens
gctccgctgcctggaa

SEQ ID NO: 3056478 - DNA, 18 bp, Homo sapiens
gctccgctgcctggaaca

SEQ ID NO: 3056479 - DNA, 17 bp, Homo sapiens
gctccgtggactgcagt

SEQ ID NO: 3056480 - DNA, 16 bp, Homo sapiens
gctcctagagggaggg

SEQ ID NO: 3056481 - DNA, 18 bp, Homo sapiens
gctcctagagggaggggc

SEQ ID NO: 3056482 - DNA, 12 bp, Homo sapiens
gctcctcccctg

SEQ ID NO: 3056483 - DNA, 15 bp, Homo sapiens
gctcctcccctgccg

SEQ ID NO: 3056484 - DNA, 11 bp, Homo sapiens
gctcctccctc

SEQ ID NO: 3056485 - DNA, 17 bp, Homo sapiens
gctcctccctctgcctc

SEQ ID NO: 3056486 - DNA, 18 bp, Homo sapiens
gctcctccctctgcctca

SEQ ID NO: 3056487 - DNA, 15 bp, Homo sapiens
gctcctcctccctgc

SEQ ID NO: 3056488 - DNA, 14 bp, Homo sapiens
gctcctcctcctgg

SEQ ID NO: 3056489 - DNA, 19 bp, Homo sapiens
gctcctctccccagcccag

SEQ ID NO: 3056490 - DNA, 21 bp, Homo sapiens
gctcctctccccagcccagag

SEQ ID NO: 3056491 - DNA, 23 bp, Homo sapiens
gctcctctccccagcccagagac

SEQ ID NO: 3056492 - DNA, 12 bp, Homo sapiens
gctcctctttcc

SEQ ID NO: 3056493 - DNA, 18 bp, Homo sapiens
gctcctctttcccctcct

SEQ ID NO: 3056494 - DNA, 23 bp, Homo sapiens
gctcctgcaggccacagccacct

SEQ ID NO: 3056495 - DNA, 14 bp, Homo sapiens
gctcctgcccagcc

SEQ ID NO: 3056496 - DNA, 12 bp, Homo sapiens
gctcctggggag

SEQ ID NO: 3056497 - DNA, 16 bp, Homo sapiens
gctcctgtggcagctg

SEQ ID NO: 3056498 - DNA, 19 bp, Homo sapiens
gctcctgtggcagctgccc

SEQ ID NO: 3056499 - DNA, 18 bp, Homo sapiens
gctcctgttagctcctca

SEQ ID NO: 3056500 - DNA, 16 bp, Homo sapiens
gctccttagctgccaa

SEQ ID NO: 3056501 - DNA, 19 bp, Homo sapiens
gctccttagctgccaagcc

SEQ ID NO: 3056502 - DNA, 11 bp, Homo sapiens
gctccttgggc

SEQ ID NO: 3056503 - DNA, 14 bp, Homo sapiens
gctccttgggccct

SEQ ID NO: 3056504 - DNA, 23 bp, Homo sapiens
gctcgcagcccccgcgccctccc

SEQ ID NO: 3056505 - DNA, 16 bp, Homo sapiens
gctcgcatccagacag

SEQ ID NO: 3056506 - DNA, 17 bp, Homo sapiens
gctcgcatccagacagt

SEQ ID NO: 3056507 - DNA, 14 bp, Homo sapiens
gctcgcccaggaag

SEQ ID NO: 3056508 - DNA, 15 bp, Homo sapiens
gctcggcaggaagga

SEQ ID NO: 3056509 - DNA, 18 bp, Homo sapiens
gctcggcaggaaggagcg

SEQ ID NO: 3056510 - DNA, 13 bp, Homo sapiens
gctcggcccagca

SEQ ID NO: 3056511 - DNA, 17 bp, Homo sapiens
gctcggcccagcacccc

SEQ ID NO: 3056512 - DNA, 21 bp, Homo sapiens
gctctaagcagccaggaggga

SEQ ID NO: 3056513 - DNA, 12 bp, Homo sapiens
gctctaatacat

SEQ ID NO: 3056514 - DNA, 17 bp, Homo sapiens
gctctacacaacatgta

SEQ ID NO: 3056515 - DNA, 18 bp, Homo sapiens
gctctacccagggcctgc

SEQ ID NO: 3056516 - DNA, 13 bp, Homo sapiens
gctctacgggggc

SEQ ID NO: 3056517 - DNA, 19 bp, Homo sapiens
gctctacgtttaggcaccc

SEQ ID NO: 3056518 - DNA, 22 bp, Homo sapiens
gctctagatcataaggcttcaa

SEQ ID NO: 3056519 - DNA, 14 bp, Homo sapiens
gctctagatgagct

SEQ ID NO: 3056520 - DNA, 19 bp, Homo sapiens
gctctatcgcccaggctgg

SEQ ID NO: 3056521 - DNA, 21 bp, Homo sapiens
gctctatcttgctctgtaatc

SEQ ID NO: 3056522 - DNA, 13 bp, Homo sapiens
gctctatgagtct

SEQ ID NO: 3056523 - DNA, 15 bp, Homo sapiens
gctctatgtttacaa

SEQ ID NO: 3056524 - DNA, 22 bp, Homo sapiens
gctctcaaatgtgaccatgtga

SEQ ID NO: 3056525 - DNA, 18 bp, Homo sapiens
gctctcactagttgtcag

SEQ ID NO: 3056526 - DNA, 21 bp, Homo sapiens
gctctccacccccaccactct

SEQ ID NO: 3056527 - DNA, 15 bp, Homo sapiens
gctctccacctcagc

SEQ ID NO: 3056528 - DNA, 16 bp, Homo sapiens
gctctccacctcagcc

SEQ ID NO: 3056529 - DNA, 18 bp, Homo sapiens
gctctccacctcagcctt

SEQ ID NO: 3056530 - DNA, 19 bp, Homo sapiens
gctctccacctcagccttg

SEQ ID NO: 3056531 - DNA, 18 bp, Homo sapiens
gctctccagcctgggagg

SEQ ID NO: 3056532 - DNA, 14 bp, Homo sapiens
gctctccaggccag

SEQ ID NO: 3056533 - DNA, 16 bp, Homo sapiens
gctctccaggccaggt

SEQ ID NO: 3056534 - DNA, 19 bp, Homo sapiens
gctctccattcaatttcag

SEQ ID NO: 3056535 - DNA, 19 bp, Homo sapiens
gctctccctaccttgcctc

SEQ ID NO: 3056536 - DNA, 14 bp, Homo sapiens
gctctcctgccaca

SEQ ID NO: 3056537 - DNA, 19 bp, Homo sapiens
gctctctcattgtctgtgt

SEQ ID NO: 3056538 - DNA, 21 bp, Homo sapiens
gctctctgagtcctggcccaa

SEQ ID NO: 3056539 - DNA, 23 bp, Homo sapiens
gctctctttttctccagggtcag

SEQ ID NO: 3056540 - DNA, 14 bp, Homo sapiens
gctctgaaaggtaa

SEQ ID NO: 3056541 - DNA, 21 bp, Homo sapiens
gctctgacccacagcctccaa

SEQ ID NO: 3056542 - DNA, 15 bp, Homo sapiens
gctctgaccctgggc

SEQ ID NO: 3056543 - DNA, 13 bp, Homo sapiens
gctctgagagtct

SEQ ID NO: 3056544 - DNA, 18 bp, Homo sapiens
gctctgagagtctagatt

SEQ ID NO: 3056545 - DNA, 18 bp, Homo sapiens
gctctgaggactgcacca

SEQ ID NO: 3056546 - DNA, 13 bp, Homo sapiens
gctctgatccctc

SEQ ID NO: 3056547 - DNA, 20 bp, Homo sapiens
gctctgcaggcttaataaaa

SEQ ID NO: 3056548 - DNA, 17 bp, Homo sapiens
gctctgccgtctctgga

SEQ ID NO: 3056549 - DNA, 18 bp, Homo sapiens
gctctgcctcaactccac

SEQ ID NO: 3056550 - DNA, 15 bp, Homo sapiens
gctctgcctctaact

SEQ ID NO: 3056551 - DNA, 20 bp, Homo sapiens
gcggacaaaagggccaggtg

SEQ ID NO: 3056552 - DNA, 21 bp, Homo sapiens
gcggacaaaagggccaggtgc

SEQ ID NO: 3056553 - DNA, 18 bp, Homo sapiens
gcggacaccgtggcctgg

SEQ ID NO: 3056554 - DNA, 21 bp, Homo sapiens
gcggacaccgtggcctgggct

SEQ ID NO: 3056555 - DNA, 14 bp, Homo sapiens
gcggagctggcccc

SEQ ID NO: 3056556 - DNA, 18 bp, Homo sapiens
gcggattaatttgcatct

SEQ ID NO: 3056557 - DNA, 20 bp, Homo sapiens
gcggattaatttgcatctga

SEQ ID NO: 3056558 - DNA, 15 bp, Homo sapiens
gcggcactccaacct

SEQ ID NO: 3056559 - DNA, 12 bp, Homo sapiens
gcggcagacaca

SEQ ID NO: 3056560 - DNA, 19 bp, Homo sapiens
gcggccacctcaccctctc

SEQ ID NO: 3056561 - DNA, 21 bp, Homo sapiens
gcggccacctcaccctctccg

SEQ ID NO: 3056562 - DNA, 10 bp, Homo sapiens
gcggccaggg

SEQ ID NO: 3056563 - DNA, 20 bp, Homo sapiens
gcggccagggacccaaagca

SEQ ID NO: 3056564 - DNA, 17 bp, Homo sapiens
gcggccctgctgaagct

SEQ ID NO: 3056565 - DNA, 14 bp, Homo sapiens
gcggcctccccgag

SEQ ID NO: 3056566 - DNA, 20 bp, Homo sapiens
gcggcctcccgaggaggggc

SEQ ID NO: 3056567 - DNA, 14 bp, Homo sapiens
gcggcctgcaccga

SEQ ID NO: 3056568 - DNA, 21 bp, Homo sapiens
gcggcctgcaccgacccgagg

SEQ ID NO: 3056569 - DNA, 22 bp, Homo sapiens
gcggcctggggggaacggatgc

SEQ ID NO: 3056570 - DNA, 18 bp, Homo sapiens
gcggccttgaagacagag

SEQ ID NO: 3056571 - DNA, 15 bp, Homo sapiens
gcggcgccctggact

SEQ ID NO: 3056572 - DNA, 19 bp, Homo sapiens
gcggcgtggagactggcag

SEQ ID NO: 3056573 - DNA, 21 bp, Homo sapiens
gcggcgtggagactggcaggc

SEQ ID NO: 3056574 - DNA, 20 bp, Homo sapiens
gcggctactcagcagccctc

SEQ ID NO: 3056575 - DNA, 21 bp, Homo sapiens
gcggctctgcccacctctctt

SEQ ID NO: 3056576 - DNA, 13 bp, Homo sapiens
gcggctgggagga

SEQ ID NO: 3056577 - DNA, 17 bp, Homo sapiens
gcggctgggaggagggc

SEQ ID NO: 3056578 - DNA, 19 bp, Homo sapiens
gcggctgggaggagggcag

SEQ ID NO: 3056579 - DNA, 21 bp, Homo sapiens
gcgggacagagggtggctgga

SEQ ID NO: 3056580 - DNA, 12 bp, Homo sapiens
gcgggagggagt

SEQ ID NO: 3056581 - DNA, 17 bp, Homo sapiens
gcgggcacagccagccc

SEQ ID NO: 3056582 - DNA, 15 bp, Homo sapiens
gcgggcagagggctg

SEQ ID NO: 3056583 - DNA, 19 bp, Homo sapiens
gcgggcagagggctggagg

SEQ ID NO: 3056584 - DNA, 13 bp, Homo sapiens
gcgggcagccagg

SEQ ID NO: 3056585 - DNA, 16 bp, Homo sapiens
gcgggccacagggcaa

SEQ ID NO: 3056586 - DNA, 23 bp, Homo sapiens
gcgggcccctcacctggtacctg

SEQ ID NO: 3056587 - DNA, 13 bp, Homo sapiens
gcgggctcgccca

SEQ ID NO: 3056588 - DNA, 12 bp, Homo sapiens
gcgggctttgtt

SEQ ID NO: 3056589 - DNA, 21 bp, Homo sapiens
gcggggggggcgcctggagag

SEQ ID NO: 3056590 - DNA, 18 bp, Homo sapiens
gcgggtccacttgccagg

SEQ ID NO: 3056591 - DNA, 21 bp, Homo sapiens
gcgggtccacttgccagggct

SEQ ID NO: 3056592 - DNA, 17 bp, Homo sapiens
gcgggtcctcagctgct

SEQ ID NO: 3056593 - DNA, 22 bp, Homo sapiens
gcgggtcctcagctgctcccac

SEQ ID NO: 3056594 - DNA, 21 bp, Homo sapiens
gcgggtgctctgaggcctcac

SEQ ID NO: 3056595 - DNA, 19 bp, Homo sapiens
gcgggtggatcacctgagg

SEQ ID NO: 3056596 - DNA, 20 bp, Homo sapiens
gcggtatgtgcgtgtgcgtg

SEQ ID NO: 3056597 - DNA, 21 bp, Homo sapiens
gcggtgtcaggtcccagcgag

SEQ ID NO: 3056598 - DNA, 11 bp, Homo sapiens
gcgtattctgt

SEQ ID NO: 3056599 - DNA, 14 bp, Homo sapiens
gcgtattctgtggc

SEQ ID NO: 3056600 - DNA, 16 bp, Homo sapiens
gcgtcagacttttctt

SEQ ID NO: 3056601 - DNA, 18 bp, Homo sapiens
gcgtcaggggtgcacagt

SEQ ID NO: 3056602 - DNA, 13 bp, Homo sapiens
gcgtccaccaggc

SEQ ID NO: 3056603 - DNA, 17 bp, Homo sapiens
gcgtccaccaggcctca

SEQ ID NO: 3056604 - DNA, 18 bp, Homo sapiens
gcgtccaccaggcctcac

SEQ ID NO: 3056605 - DNA, 17 bp, Homo sapiens
gcgtcccaagatgttga

SEQ ID NO: 3056606 - DNA, 18 bp, Homo sapiens
gcgtccgtgggttgctaa

SEQ ID NO: 3056607 - DNA, 12 bp, Homo sapiens
gcgtcctgccct

SEQ ID NO: 3056608 - DNA, 15 bp, Homo sapiens
gcgtcctgccctgcc

SEQ ID NO: 3056609 - DNA, 21 bp, Homo sapiens
gcgtcctgtccacacccagct

SEQ ID NO: 3056610 - DNA, 24 bp, Homo sapiens
gcgtcctgtccacacccagctcag

SEQ ID NO: 3056611 - DNA, 17 bp, Homo sapiens
gcgtcgccctcccaggc

SEQ ID NO: 3056612 - DNA, 14 bp, Homo sapiens
gcgtctccatatgt

SEQ ID NO: 3056613 - DNA, 22 bp, Homo sapiens
gcgtctgactccctccccaccc

SEQ ID NO: 3056614 - DNA, 16 bp, Homo sapiens
gcgtctgttccccctt

SEQ ID NO: 3056615 - DNA, 16 bp, Homo sapiens
gcgtctttaagagact

SEQ ID NO: 3056616 - DNA, 13 bp, Homo sapiens
gcgtgaaggccga

SEQ ID NO: 3056617 - DNA, 15 bp, Homo sapiens
gcgtgaaggccgaga

SEQ ID NO: 3056618 - DNA, 13 bp, Homo sapiens
gcgtgacaataaa

SEQ ID NO: 3056619 - DNA, 19 bp, Homo sapiens
gcgtgacactctccttgca

SEQ ID NO: 3056620 - DNA, 13 bp, Homo sapiens
gcgtgactcaccc

SEQ ID NO: 3056621 - DNA, 16 bp, Homo sapiens
gcgtgactcagcagcc

SEQ ID NO: 3056622 - DNA, 17 bp, Homo sapiens
gcgtgactcagcagcct

SEQ ID NO: 3056623 - DNA, 15 bp, Homo sapiens
gcgtgagccactgcg

SEQ ID NO: 3056624 - DNA, 20 bp, Homo sapiens
gcgtgatcaaagccacactc

SEQ ID NO: 3056625 - DNA, 16 bp, Homo sapiens
gcgtgcccctgctgct

SEQ ID NO: 3056626 - DNA, 22 bp, Homo sapiens
gcgtgcgcatcttgcctccagg

SEQ ID NO: 3056627 - DNA, 20 bp, Homo sapiens
gcgtgctggcgacactcagg

SEQ ID NO: 3056628 - DNA, 12 bp, Homo sapiens
gcgtggaaaaag

SEQ ID NO: 3056629 - DNA, 16 bp, Homo sapiens
gcgtggaagtgttcct

SEQ ID NO: 3056630 - DNA, 15 bp, Homo sapiens
gcgtggagactggca

SEQ ID NO: 3056631 - DNA, 21 bp, Homo sapiens
gcgtggagactggcaggcggg

SEQ ID NO: 3056632 - DNA, 16 bp, Homo sapiens
gcgtggagggaggccc

SEQ ID NO: 3056633 - DNA, 13 bp, Homo sapiens
gcgtggattaaac

SEQ ID NO: 3056634 - DNA, 13 bp, Homo sapiens
gcgtggtgccatc

SEQ ID NO: 3056635 - DNA, 15 bp, Homo sapiens
gcgtggtgtggcccg

SEQ ID NO: 3056636 - DNA, 16 bp, Homo sapiens
gcgtgtatatgtgctt

SEQ ID NO: 3056637 - DNA, 20 bp, Homo sapiens
gcgtgtcaactttcatttga

SEQ ID NO: 3056638 - DNA, 20 bp, Homo sapiens
gcgtgtgcaggccgacagtc

SEQ ID NO: 3056639 - DNA, 16 bp, Homo sapiens
gcgtgtgcctgtgtgc

SEQ ID NO: 3056640 - DNA, 14 bp, Homo sapiens
gcgtgtggcagcca

SEQ ID NO: 3056641 - DNA, 17 bp, Homo sapiens
gcgtgtggcgtggcccg

SEQ ID NO: 3056642 - DNA, 19 bp, Homo sapiens
gcgttctaaatatgaatga

SEQ ID NO: 3056643 - DNA, 23 bp, Homo sapiens
gcgttctaccaggcaaattcact

SEQ ID NO: 3056644 - DNA, 16 bp, Homo sapiens
gcgttgcctgtcgctt

SEQ ID NO: 3056645 - DNA, 14 bp, Homo sapiens
gcgttgctttcact

SEQ ID NO: 3056646 - DNA, 21 bp, Homo sapiens
gcgtttgctgtgccaggaggc

SEQ ID NO: 3056647 - DNA, 13 bp, Homo sapiens
gctaaaattcaga

SEQ ID NO: 3056648 - DNA, 20 bp, Homo sapiens
gctaaacccagatggtttcc

SEQ ID NO: 3056649 - DNA, 17 bp, Homo sapiens
gctaaagcaatatgcat

SEQ ID NO: 3056650 - DNA, 16 bp, Homo sapiens
gctaaagcccagagac

SEQ ID NO: 3056651 - DNA, 14 bp, Homo sapiens
gctaaataactata

SEQ ID NO: 3056652 - DNA, 18 bp, Homo sapiens
gctaaataatcttactct

SEQ ID NO: 3056653 - DNA, 16 bp, Homo sapiens
gctaaattattattta

SEQ ID NO: 3056654 - DNA, 16 bp, Homo sapiens
gctaacaccagacaga

SEQ ID NO: 3056655 - DNA, 14 bp, Homo sapiens
gctaactccgagag

SEQ ID NO: 3056656 - DNA, 15 bp, Homo sapiens
gctaactccgagagc

SEQ ID NO: 3056657 - DNA, 15 bp, Homo sapiens
gctaactgaactttg

SEQ ID NO: 3056658 - DNA, 16 bp, Homo sapiens
gctaactgtaaatcat

SEQ ID NO: 3056659 - DNA, 17 bp, Homo sapiens
gctaagaacctggaact

SEQ ID NO: 3056660 - DNA, 16 bp, Homo sapiens
gctaagaatatttgaa

SEQ ID NO: 3056661 - DNA, 20 bp, Homo sapiens
gctaagagctagcgctgccg

SEQ ID NO: 3056662 - DNA, 17 bp, Homo sapiens
gctaaggacatttccca

SEQ ID NO: 3056663 - DNA, 20 bp, Homo sapiens
gctaaggacatttcccaggg

SEQ ID NO: 3056664 - DNA, 22 bp, Homo sapiens
gctaaggaggggaaaaaaatgt

SEQ ID NO: 3056665 - DNA, 16 bp, Homo sapiens
gctaaggttctaaggc

SEQ ID NO: 3056666 - DNA, 13 bp, Homo sapiens
gctaataaaaatt

SEQ ID NO: 3056667 - DNA, 23 bp, Homo sapiens
gctaataaactttgtgctgatct

SEQ ID NO: 3056668 - DNA, 20 bp, Homo sapiens
gctaattgctgttgaaagca

SEQ ID NO: 3056669 - DNA, 15 bp, Homo sapiens
gctaatttttgtaat

SEQ ID NO: 3056670 - DNA, 17 bp, Homo sapiens
gctaatttttgtaattt

SEQ ID NO: 3056671 - DNA, 11 bp, Homo sapiens
gcctgctcccc

SEQ ID NO: 3056672 - DNA, 16 bp, Homo sapiens
gcctgctcccccaccc

SEQ ID NO: 3056673 - DNA, 13 bp, Homo sapiens
gcctgctgggctc

SEQ ID NO: 3056674 - DNA, 19 bp, Homo sapiens
gcctgctgggctctccacc

SEQ ID NO: 3056675 - DNA, 23 bp, Homo sapiens
gcctgctgggctctccacctcag

SEQ ID NO: 3056676 - DNA, 12 bp, Homo sapiens
gcctgctgtgga

SEQ ID NO: 3056677 - DNA, 14 bp, Homo sapiens
gcctgctgtggagc

SEQ ID NO: 3056678 - DNA, 15 bp, Homo sapiens
gcctcccaaatgagc

SEQ ID NO: 3056679 - DNA, 19 bp, Homo sapiens
gcctcccagagtgctggga

SEQ ID NO: 3056680 - DNA, 15 bp, Homo sapiens
gcctcccatccaggg

SEQ ID NO: 3056681 - DNA, 17 bp, Homo sapiens
gcctccccacctccagg

SEQ ID NO: 3056682 - DNA, 21 bp, Homo sapiens
gcctccccgaggttgtgggga

SEQ ID NO: 3056683 - DNA, 15 bp, Homo sapiens
gcctcccctgaggat

SEQ ID NO: 3056684 - DNA, 17 bp, Homo sapiens
gcctcccgaggaggggc

SEQ ID NO: 3056685 - DNA, 14 bp, Homo sapiens
gcctcccgaggctt

SEQ ID NO: 3056686 - DNA, 20 bp, Homo sapiens
gcctcccgggaagcatcctc

SEQ ID NO: 3056687 - DNA, 21 bp, Homo sapiens
gcctcccgggaagcatcctcc

SEQ ID NO: 3056688 - DNA, 16 bp, Homo sapiens
gcctccctagccagca

SEQ ID NO: 3056689 - DNA, 22 bp, Homo sapiens
gcctccctagttagcatccagg

SEQ ID NO: 3056690 - DNA, 18 bp, Homo sapiens
gcctccctgaagcctttg

SEQ ID NO: 3056691 - DNA, 14 bp, Homo sapiens
gcctccctgcctca

SEQ ID NO: 3056692 - DNA, 13 bp, Homo sapiens
gcctcccttccca

SEQ ID NO: 3056693 - DNA, 22 bp, Homo sapiens
gcctcccttcccagtgggctgt

SEQ ID NO: 3056694 - DNA, 23 bp, Homo sapiens
gcctcccttgagtaggccctgct

SEQ ID NO: 3056695 - DNA, 22 bp, Homo sapiens
gccgccttggccttgcagctgg

SEQ ID NO: 3056696 - DNA, 17 bp, Homo sapiens
gccgcgcctggcctaga

SEQ ID NO: 3056697 - DNA, 18 bp, Homo sapiens
gccgcgcgtccagctgcc

SEQ ID NO: 3056698 - DNA, 13 bp, Homo sapiens
gccgcggcctccc

SEQ ID NO: 3056699 - DNA, 15 bp, Homo sapiens
gccgcggcctccccg

SEQ ID NO: 3056700 - DNA, 16 bp, Homo sapiens
gccgcggcctccccga

SEQ ID NO: 3056701 - DNA, 15 bp, Homo sapiens
gccgcgtgccgggcc

SEQ ID NO: 3056702 - DNA, 19 bp, Homo sapiens
gccgcgtgccgggccccca

SEQ ID NO: 3056703 - DNA, 20 bp, Homo sapiens
gccgcgtggtgccatcccca

SEQ ID NO: 3056704 - DNA, 14 bp, Homo sapiens
gccgcgtgtgcgtg

SEQ ID NO: 3056705 - DNA, 11 bp, Homo sapiens
gccgctacctc

SEQ ID NO: 3056706 - DNA, 15 bp, Homo sapiens
gccgctacctccctc

SEQ ID NO: 3056707 - DNA, 16 bp, Homo sapiens
gccgctacctccctcc

SEQ ID NO: 3056708 - DNA, 22 bp, Homo sapiens
gccgctgaccctgggcctggag

SEQ ID NO: 3056709 - DNA, 15 bp, Homo sapiens
gccgctgagcgagga

SEQ ID NO: 3056710 - DNA, 14 bp, Homo sapiens
gccgctgccctggg

SEQ ID NO: 3056711 - DNA, 23 bp, Homo sapiens
gccgctgccctgggtcctgcctg

SEQ ID NO: 3056712 - DNA, 15 bp, Homo sapiens
gccgctgttcaccca

SEQ ID NO: 3056713 - DNA, 16 bp, Homo sapiens
gccgctgttcacccac

SEQ ID NO: 3056714 - DNA, 15 bp, Homo sapiens
gccggacctgagccc

SEQ ID NO: 3056715 - DNA, 14 bp, Homo sapiens
gccggagaggaaga

SEQ ID NO: 3056716 - DNA, 14 bp, Homo sapiens
gccggagcccagat

SEQ ID NO: 3056717 - DNA, 19 bp, Homo sapiens
gccggagggcaccagggac

SEQ ID NO: 3056718 - DNA, 17 bp, Homo sapiens
gccggcatccttgcctg

SEQ ID NO: 3056719 - DNA, 12 bp, Homo sapiens
gccggccagccc

SEQ ID NO: 3056720 - DNA, 14 bp, Homo sapiens
gccggccagcccct

SEQ ID NO: 3056721 - DNA, 14 bp, Homo sapiens
gccggccctgcccc

SEQ ID NO: 3056722 - DNA, 16 bp, Homo sapiens
gccggccctgcccctc

SEQ ID NO: 3056723 - DNA, 22 bp, Homo sapiens
gccctcctctcccgtctcgcct

SEQ ID NO: 3056724 - DNA, 18 bp, Homo sapiens
gccctcctgggagctcat

SEQ ID NO: 3056725 - DNA, 21 bp, Homo sapiens
gccctcgcacggccccgaagg

SEQ ID NO: 3056726 - DNA, 19 bp, Homo sapiens
gccctctagggcagggtgg

SEQ ID NO: 3056727 - DNA, 24 bp, Homo sapiens
gccctctccctctaggctctgcct

SEQ ID NO: 3056728 - DNA, 16 bp, Homo sapiens
gccctctctgctctgc

SEQ ID NO: 3056729 - DNA, 16 bp, Homo sapiens
gccctctgaaataatg

SEQ ID NO: 3056730 - DNA, 14 bp, Homo sapiens
gccctctgcctcct

SEQ ID NO: 3056731 - DNA, 13 bp, Homo sapiens
gccctctgcctgc

SEQ ID NO: 3056732 - DNA, 13 bp, Homo sapiens
gccctctgctgct

SEQ ID NO: 3056733 - DNA, 14 bp, Homo sapiens
gccctctgctgctg

SEQ ID NO: 3056734 - DNA, 17 bp, Homo sapiens
gccctctgctgctgccc

SEQ ID NO: 3056735 - DNA, 18 bp, Homo sapiens
gccctctgctgctgcccg

SEQ ID NO: 3056736 - DNA, 20 bp, Homo sapiens
gccctctggagtggccacta

SEQ ID NO: 3056737 - DNA, 20 bp, Homo sapiens
gccctctttaatgctgtctt

SEQ ID NO: 3056738 - DNA, 19 bp, Homo sapiens
gccctctttcatctgtaag

SEQ ID NO: 3056739 - DNA, 15 bp, Homo sapiens
gccctgaaagggccc

SEQ ID NO: 3056740 - DNA, 19 bp, Homo sapiens
gccctgaaagggcccttcc

SEQ ID NO: 3056741 - DNA, 18 bp, Homo sapiens
gccctgaagaatggcgcc

SEQ ID NO: 3056742 - DNA, 23 bp, Homo sapiens
gccctgaatttcttcttttcctg

SEQ ID NO: 3056743 - DNA, 19 bp, Homo sapiens
gccctgactgtcagggagg

SEQ ID NO: 3056744 - DNA, 20 bp, Homo sapiens
gccctgactgtcagggaggg

SEQ ID NO: 3056745 - DNA, 22 bp, Homo sapiens
gccctgagacctctagagaaaa

SEQ ID NO: 3056746 - DNA, 22 bp, Homo sapiens
gccctgagagagaatagagctg

SEQ ID NO: 3056747 - DNA, 19 bp, Homo sapiens
gccctgaggggctggggag

SEQ ID NO: 3056748 - DNA, 17 bp, Homo sapiens
gccctgagtctgggcag

SEQ ID NO: 3056749 - DNA, 18 bp, Homo sapiens
gccctgcaaaaggactct

SEQ ID NO: 3056750 - DNA, 17 bp, Homo sapiens
gccctgcaggctgcagg

SEQ ID NO: 3056751 - DNA, 19 bp, Homo sapiens
gccctgcaggctgcaggag

SEQ ID NO: 3056752 - DNA, 21 bp, Homo sapiens
gccctgcatgggccagcccct

SEQ ID NO: 3056753 - DNA, 22 bp, Homo sapiens
gccctgcatgggccagcccctc

SEQ ID NO: 3056754 - DNA, 23 bp, Homo sapiens
gccctgcatgggccagcccctcc

SEQ ID NO: 3056755 - DNA, 14 bp, Homo sapiens
gccctgcatgtagt

SEQ ID NO: 3056756 - DNA, 14 bp, Homo sapiens
gccctgcccaagtg

SEQ ID NO: 3056757 - DNA, 19 bp, Homo sapiens
gccctgcccaagtgaccag

SEQ ID NO: 3056758 - DNA, 12 bp, Homo sapiens
gccctgcccctc

SEQ ID NO: 3056759 - DNA, 13 bp, Homo sapiens
gccctgcccctcc

SEQ ID NO: 3056760 - DNA, 18 bp, Homo sapiens
gccccctggcagctgccc

SEQ ID NO: 3056761 - DNA, 15 bp, Homo sapiens
gccccctggcctctg

SEQ ID NO: 3056762 - DNA, 17 bp, Homo sapiens
gccccctggcctctgtg

SEQ ID NO: 3056763 - DNA, 17 bp, Homo sapiens
gccccgaagggccccca

SEQ ID NO: 3056764 - DNA, 14 bp, Homo sapiens
gccccgcaggcctg

SEQ ID NO: 3056765 - DNA, 18 bp, Homo sapiens
gccccgctcccacctagt

SEQ ID NO: 3056766 - DNA, 15 bp, Homo sapiens
gccccgctgtgtcct

SEQ ID NO: 3056767 - DNA, 16 bp, Homo sapiens
gccccgcttgtccagc

SEQ ID NO: 3056768 - DNA, 13 bp, Homo sapiens
gccccgggctggc

SEQ ID NO: 3056769 - DNA, 19 bp, Homo sapiens
gccccgggctggccctgtg

SEQ ID NO: 3056770 - DNA, 20 bp, Homo sapiens
gcccctaaagatgggaggag

SEQ ID NO: 3056771 - DNA, 22 bp, Homo sapiens
gcccctaaagatgggaggagac

SEQ ID NO: 3056772 - DNA, 18 bp, Homo sapiens
gcccctaatcacatgtgc

SEQ ID NO: 3056773 - DNA, 12 bp, Homo sapiens
gcccctcaccct

SEQ ID NO: 3056774 - DNA, 15 bp, Homo sapiens
gcccctcaccctctg

SEQ ID NO: 3056775 - DNA, 16 bp, Homo sapiens
gcccctcaccctctgt

SEQ ID NO: 3056776 - DNA, 19 bp, Homo sapiens
gcccctcaccctctgtccc

SEQ ID NO: 3056777 - DNA, 20 bp, Homo sapiens
gcccctcaccctctgtcccc

SEQ ID NO: 3056778 - DNA, 21 bp, Homo sapiens
gcccctcaccctctgtcccca

SEQ ID NO: 3056779 - DNA, 14 bp, Homo sapiens
gcccctcaggggaa

SEQ ID NO: 3056780 - DNA, 21 bp, Homo sapiens
gcccctcaggggaagctgcta

SEQ ID NO: 3056781 - DNA, 22 bp, Homo sapiens
gcccctcaggggaagctgctag

SEQ ID NO: 3056782 - DNA, 18 bp, Homo sapiens
gcccctcccaagctggct

SEQ ID NO: 3056783 - DNA, 19 bp, Homo sapiens
gcccctcccaagctggctg

SEQ ID NO: 3056784 - DNA, 21 bp, Homo sapiens
gcccctcccacacccaaagct

SEQ ID NO: 3056785 - DNA, 22 bp, Homo sapiens
gcccctcccacacccaaagctg

SEQ ID NO: 3056786 - DNA, 16 bp, Homo sapiens
gcccctccccctaccg

SEQ ID NO: 3056787 - DNA, 16 bp, Homo sapiens
gcccctcccctcagag

SEQ ID NO: 3056788 - DNA, 20 bp, Homo sapiens
gcccctcccctcagagccca

SEQ ID NO: 3056789 - DNA, 21 bp, Homo sapiens
gcccctcccctcagagcccat

SEQ ID NO: 3056790 - DNA, 22 bp, Homo sapiens
gcccctcccctcagagcccatg

SEQ ID NO: 3056791 - DNA, 23 bp, Homo sapiens
gcccctccctagatccaggcttc

SEQ ID NO: 3056792 - DNA, 13 bp, Homo sapiens
gcccctccctgcc

SEQ ID NO: 3056793 - DNA, 17 bp, Homo sapiens
gcccctcctcccccggc

SEQ ID NO: 3056794 - DNA, 20 bp, Homo sapiens
gcccctcctcccccggctgg

SEQ ID NO: 3056795 - DNA, 21 bp, Homo sapiens
gcccctcctctgccacctccc

SEQ ID NO: 3056796 - DNA, 17 bp, Homo sapiens
gcccctcgaccctgtgc

SEQ ID NO: 3056797 - DNA, 12 bp, Homo sapiens
gcccctctccga

SEQ ID NO: 3056798 - DNA, 11 bp, Homo sapiens
gcccctctcct

SEQ ID NO: 3056799 - DNA, 13 bp, Homo sapiens
gcccctctcctcc

SEQ ID NO: 3056800 - DNA, 21 bp, Homo sapiens
gcccctctcctccgtggcaca

SEQ ID NO: 3056801 - DNA, 17 bp, Homo sapiens
gcccctctccttcttag

SEQ ID NO: 3056802 - DNA, 12 bp, Homo sapiens
gcccctctctgg

SEQ ID NO: 3056803 - DNA, 16 bp, Homo sapiens
gcccctgaaagcctca

SEQ ID NO: 3056804 - DNA, 16 bp, Homo sapiens
gcccctgagatctctg

SEQ ID NO: 3056805 - DNA, 16 bp, Homo sapiens
gcccctgaggcttcac

SEQ ID NO: 3056806 - DNA, 19 bp, Homo sapiens
gcccctgagtccgcctgcg

SEQ ID NO: 3056807 - DNA, 14 bp, Homo sapiens
gcccagagcccagc

SEQ ID NO: 3056808 - DNA, 18 bp, Homo sapiens
gcccagagcccagctcca

SEQ ID NO: 3056809 - DNA, 14 bp, Homo sapiens
gcccagagcccggt

SEQ ID NO: 3056810 - DNA, 22 bp, Homo sapiens
gcccagaggagcccagcggccc

SEQ ID NO: 3056811 - DNA, 21 bp, Homo sapiens
gcccagaggccaacactgtgg

SEQ ID NO: 3056812 - DNA, 15 bp, Homo sapiens
gcccagatccaaggc

SEQ ID NO: 3056813 - DNA, 16 bp, Homo sapiens
gcccagatccaaggcc

SEQ ID NO: 3056814 - DNA, 21 bp, Homo sapiens
gcccagcaccccctctcctgg

SEQ ID NO: 3056815 - DNA, 22 bp, Homo sapiens
gcccagcaccccctctcctgga

SEQ ID NO: 3056816 - DNA, 21 bp, Homo sapiens
gcccagcactgcttgaggaaa

SEQ ID NO: 3056817 - DNA, 20 bp, Homo sapiens
gcccagcagcctgccagcag

SEQ ID NO: 3056818 - DNA, 20 bp, Homo sapiens
gcccagcatggaatctgatg

SEQ ID NO: 3056819 - DNA, 23 bp, Homo sapiens
gcccagccactccaagccccctg

SEQ ID NO: 3056820 - DNA, 12 bp, Homo sapiens
gcccagccagcc

SEQ ID NO: 3056821 - DNA, 13 bp, Homo sapiens
gcccagccagcca

SEQ ID NO: 3056822 - DNA, 14 bp, Homo sapiens
gcccagccagccac

SEQ ID NO: 3056823 - DNA, 22 bp, Homo sapiens
gcccagccagccacccctgcca

SEQ ID NO: 3056824 - DNA, 15 bp, Homo sapiens
gcccagccaggcccc

SEQ ID NO: 3056825 - DNA, 14 bp, Homo sapiens
gcccagcccagctg

SEQ ID NO: 3056826 - DNA, 13 bp, Homo sapiens
gcccagcccagga

SEQ ID NO: 3056827 - DNA, 15 bp, Homo sapiens
gcccagccgggcaca

SEQ ID NO: 3056828 - DNA, 20 bp, Homo sapiens
gcccagcgctctcctggacg

SEQ ID NO: 3056829 - DNA, 20 bp, Homo sapiens
gcccagcggcccaagagccc

SEQ ID NO: 3056830 - DNA, 21 bp, Homo sapiens
gcccagcggcccaagagcccg

SEQ ID NO: 3056831 - DNA, 19 bp, Homo sapiens
gcccagctatacctgtgcc

SEQ ID NO: 3056832 - DNA, 16 bp, Homo sapiens
gcccagctcttgctct

SEQ ID NO: 3056833 - DNA, 17 bp, Homo sapiens
gcccagctcttgctctc

SEQ ID NO: 3056834 - DNA, 13 bp, Homo sapiens
gcccagctgggtc

SEQ ID NO: 3056835 - DNA, 15 bp, Homo sapiens
gcccagctgggtcag

SEQ ID NO: 3056836 - DNA, 17 bp, Homo sapiens
gcccagctggtgggaag

SEQ ID NO: 3056837 - DNA, 18 bp, Homo sapiens
gcccaggaaggcctaggc

SEQ ID NO: 3056838 - DNA, 15 bp, Homo sapiens
gcccaggagagccag

SEQ ID NO: 3056839 - DNA, 18 bp, Homo sapiens
gcccaggagctctgcgcc

SEQ ID NO: 3056840 - DNA, 19 bp, Homo sapiens
gcccaggagctctgcgcca

SEQ ID NO: 3056841 - DNA, 20 bp, Homo sapiens
gcccaggagtttgaggctgc

SEQ ID NO: 3056842 - DNA, 16 bp, Homo sapiens
gcccaggcaggtctgc

SEQ ID NO: 3056843 - DNA, 17 bp, Homo sapiens
gcccaggcaggtctgca

SEQ ID NO: 3056844 - DNA, 13 bp, Homo sapiens
gcccaggccatgt

SEQ ID NO: 3056845 - DNA, 15 bp, Homo sapiens
gcccaggccatgtgg

SEQ ID NO: 3056846 - DNA, 22 bp, Homo sapiens
gcccaggccatgtggcctgccc

SEQ ID NO: 3056847 - DNA, 14 bp, Homo sapiens
gcccaggccttgct

SEQ ID NO: 3056848 - DNA, 19 bp, Homo sapiens
gcccaggctggagggcagt

SEQ ID NO: 3056849 - DNA, 15 bp, Homo sapiens
gcccaggctggagtg

SEQ ID NO: 3056850 - DNA, 19 bp, Homo sapiens
gcccaggctggagtgcagt

SEQ ID NO: 3056851 - DNA, 15 bp, Homo sapiens
gcccagggcccagag

SEQ ID NO: 3056852 - DNA, 16 bp, Homo sapiens
gcccagggcccagagc

SEQ ID NO: 3056853 - DNA, 18 bp, Homo sapiens
gcccagggcccagagccc

SEQ ID NO: 3056854 - DNA, 20 bp, Homo sapiens
gcccagggcccagagcccag

SEQ ID NO: 3056855 - DNA, 21 bp, Homo sapiens
gcccagggcccagagcccagc

SEQ ID NO: 3056856 - DNA, 15 bp, Homo sapiens
gcccagggggcctgg

SEQ ID NO: 3056857 - DNA, 16 bp, Homo sapiens
gcccagggggcctgga

SEQ ID NO: 3056858 - DNA, 18 bp, Homo sapiens
gcccagggggcctggagc

SEQ ID NO: 3056859 - DNA, 14 bp, Homo sapiens
gcccagggtgcagt

SEQ ID NO: 3056860 - DNA, 21 bp, Homo sapiens
gcccaggtgagtcctagagct

SEQ ID NO: 3056861 - DNA, 22 bp, Homo sapiens
gcccaggtggggtttcctgcat

SEQ ID NO: 3056862 - DNA, 17 bp, Homo sapiens
gcccagtccttccacct

SEQ ID NO: 3056863 - DNA, 19 bp, Homo sapiens
gcccagtccttccacctcg

SEQ ID NO: 3056864 - DNA, 22 bp, Homo sapiens
gccacacgcaggcggccagggc

SEQ ID NO: 3056865 - DNA, 19 bp, Homo sapiens
gccacactcagcacaaggc

SEQ ID NO: 3056866 - DNA, 22 bp, Homo sapiens
gccacactctgggctccagagt

SEQ ID NO: 3056867 - DNA, 12 bp, Homo sapiens
gccacactgtga

SEQ ID NO: 3056868 - DNA, 17 bp, Homo sapiens
gccacaggaacggccct

SEQ ID NO: 3056869 - DNA, 20 bp, Homo sapiens
gccacaggaacggccctgca

SEQ ID NO: 3056870 - DNA, 20 bp, Homo sapiens
gccacaggagccctgctatg

SEQ ID NO: 3056871 - DNA, 18 bp, Homo sapiens
gccacagtagtcttgatg

SEQ ID NO: 3056872 - DNA, 15 bp, Homo sapiens
gccacatcaaagagg

SEQ ID NO: 3056873 - DNA, 15 bp, Homo sapiens
gccacatgccccagg

SEQ ID NO: 3056874 - DNA, 17 bp, Homo sapiens
gccacatgccccaggct

SEQ ID NO: 3056875 - DNA, 15 bp, Homo sapiens
gccacatgggaggct

SEQ ID NO: 3056876 - DNA, 14 bp, Homo sapiens
gccacattagaact

SEQ ID NO: 3056877 - DNA, 14 bp, Homo sapiens
gccacatttacata

SEQ ID NO: 3056878 - DNA, 19 bp, Homo sapiens
gccaccaagagggacgcct

SEQ ID NO: 3056879 - DNA, 22 bp, Homo sapiens
gccaccaagagggacgcctggg

SEQ ID NO: 3056880 - DNA, 20 bp, Homo sapiens
gccaccaggtgcctttcaaa

SEQ ID NO: 3056881 - DNA, 16 bp, Homo sapiens
gccacccacctccctg

SEQ ID NO: 3056882 - DNA, 16 bp, Homo sapiens
gccacccccgccccca

SEQ ID NO: 3056883 - DNA, 21 bp, Homo sapiens
gccacccccgcccccaccggg

SEQ ID NO: 3056884 - DNA, 14 bp, Homo sapiens
gccaccctgcccct

SEQ ID NO: 3056885 - DNA, 13 bp, Homo sapiens
gccacccttccct

SEQ ID NO: 3056886 - DNA, 21 bp, Homo sapiens
gccacccttccctgcctccag

SEQ ID NO: 3056887 - DNA, 22 bp, Homo sapiens
gccaccgactgcccagccactc

SEQ ID NO: 3056888 - DNA, 17 bp, Homo sapiens
gccaccgcagctgctgc

SEQ ID NO: 3056889 - DNA, 20 bp, Homo sapiens
gccaccgcagctgctgccac

SEQ ID NO: 3056890 - DNA, 15 bp, Homo sapiens
gccaccggggcaaga

SEQ ID NO: 3056891 - DNA, 16 bp, Homo sapiens
gccaccggggcaagag

SEQ ID NO: 3056892 - DNA, 13 bp, Homo sapiens
gccacctcaccct

SEQ ID NO: 3056893 - DNA, 11 bp, Homo sapiens
gccacctcccc

SEQ ID NO: 3056894 - DNA, 13 bp, Homo sapiens
gccacctccctct

SEQ ID NO: 3056895 - DNA, 16 bp, Homo sapiens
gccacctgaataaaga

SEQ ID NO: 3056896 - DNA, 21 bp, Homo sapiens
gccaccttgattttcttcttt

SEQ ID NO: 3056897 - DNA, 19 bp, Homo sapiens
gccacgaacagcccgccag

SEQ ID NO: 3056898 - DNA, 17 bp, Homo sapiens
gccacggcccagggagg

SEQ ID NO: 3056899 - DNA, 17 bp, Homo sapiens
gccacgtatagtcctag

SEQ ID NO: 3056900 - DNA, 16 bp, Homo sapiens
gccacgtgccaggccc

SEQ ID NO: 3056901 - DNA, 17 bp, Homo sapiens
gccacgtgccaggcccg

SEQ ID NO: 3056902 - DNA, 17 bp, Homo sapiens
gccacgttcagggaggg

SEQ ID NO: 3056903 - DNA, 21 bp, Homo sapiens
gccacgttccttactgcagaa

SEQ ID NO: 3056904 - DNA, 19 bp, Homo sapiens
gccactaagcagaggaggg

SEQ ID NO: 3056905 - DNA, 12 bp, Homo sapiens
gccactcaccct

SEQ ID NO: 3056906 - DNA, 13 bp, Homo sapiens
gccactcaccctt

SEQ ID NO: 3056907 - DNA, 22 bp, Homo sapiens
gccactcacccttcctggccca

SEQ ID NO: 3056908 - DNA, 22 bp, Homo sapiens
gccactcagagttctatactgt

SEQ ID NO: 3056909 - DNA, 17 bp, Homo sapiens
gccactccaagccccct

SEQ ID NO: 3056910 - DNA, 13 bp, Homo sapiens
gccactcctctga

SEQ ID NO: 3056911 - DNA, 15 bp, Homo sapiens
gccactgaaaagctt

SEQ ID NO: 3056912 - DNA, 17 bp, Homo sapiens
gccactgaaaagctttc

SEQ ID NO: 3056913 - DNA, 19 bp, Homo sapiens
gccactgcataccaacctg

SEQ ID NO: 3056914 - DNA, 19 bp, Homo sapiens
gccactgctctccagcctg

SEQ ID NO: 3056915 - DNA, 13 bp, Homo sapiens
gccactgctgctt

SEQ ID NO: 3056916 - DNA, 17 bp, Homo sapiens
gccactgggcacctgcg

SEQ ID NO: 3056917 - DNA, 14 bp, Homo sapiens
gccactgtgcttgg

SEQ ID NO: 3056918 - DNA, 15 bp, Homo sapiens
gccacttctgtccat

SEQ ID NO: 3056919 - DNA, 17 bp, Homo sapiens
gccactttccaccaact

SEQ ID NO: 3056920 - DNA, 20 bp, Homo sapiens
gccacttttagctactgcta

SEQ ID NO: 3056921 - DNA, 23 bp, Homo sapiens
gccagaagttgtggatttcagtt

SEQ ID NO: 3056922 - DNA, 20 bp, Homo sapiens
gccagacactgcgccccgcc

SEQ ID NO: 3056923 - DNA, 20 bp, Homo sapiens
gccagagatccaaaagaagc

SEQ ID NO: 3056924 - DNA, 21 bp, Homo sapiens
gccagagatccaaaagaagcc

SEQ ID NO: 3056925 - DNA, 22 bp, Homo sapiens
gccagagctacccgcagagttc

SEQ ID NO: 3056926 - DNA, 15 bp, Homo sapiens
gccagaggtgcttca

SEQ ID NO: 3056927 - DNA, 16 bp, Homo sapiens
gccagaggtgcttcac

SEQ ID NO: 3056928 - DNA, 11 bp, Homo sapiens
gccagatccag

SEQ ID NO: 3056929 - DNA, 11 bp, Homo sapiens
gccagatgctg

SEQ ID NO: 3056930 - DNA, 16 bp, Homo sapiens
gccagatgctgatgtt

SEQ ID NO: 3056931 - DNA, 20 bp, Homo sapiens
gccagatgctgatgttcagt

SEQ ID NO: 3056932 - DNA, 21 bp, Homo sapiens
gccagatgctgatgttcagtg

SEQ ID NO: 3056933 - DNA, 17 bp, Homo sapiens
gccagattggccaatta

SEQ ID NO: 3056934 - DNA, 13 bp, Homo sapiens
gccagcacacagg

SEQ ID NO: 3056935 - DNA, 15 bp, Homo sapiens
gccagcacacagggc

SEQ ID NO: 3056936 - DNA, 16 bp, Homo sapiens
gccagcacacagggca

SEQ ID NO: 3056937 - DNA, 22 bp, Homo sapiens
gccagcacacagggcagtgagg

SEQ ID NO: 3056938 - DNA, 18 bp, Homo sapiens
gccagcaccgccggcttt

SEQ ID NO: 3056939 - DNA, 16 bp, Homo sapiens
gccagcacctggttga

SEQ ID NO: 3056940 - DNA, 20 bp, Homo sapiens
gccagcacttgtccagctga

SEQ ID NO: 3056941 - DNA, 19 bp, Homo sapiens
gccagcagcccttgtttat

SEQ ID NO: 3056942 - DNA, 15 bp, Homo sapiens
gccagcagcctcgca

SEQ ID NO: 3056943 - DNA, 16 bp, Homo sapiens
gccagccacccctgcc

SEQ ID NO: 3056944 - DNA, 21 bp, Homo sapiens
gccagcccaaaccttgggccc

SEQ ID NO: 3056945 - DNA, 14 bp, Homo sapiens
gccagcccctggcc

SEQ ID NO: 3056946 - DNA, 18 bp, Homo sapiens
gccagcccggacctctgg

SEQ ID NO: 3056947 - DNA, 21 bp, Homo sapiens
gccagcccggaggggactggt

SEQ ID NO: 3056948 - DNA, 22 bp, Homo sapiens
gccagcccggccgctccaccag

SEQ ID NO: 3056949 - DNA, 22 bp, Homo sapiens
gccagcccggctcggcccagca

SEQ ID NO: 3056950 - DNA, 15 bp, Homo sapiens
gccagccctccctgt

SEQ ID NO: 3056951 - DNA, 22 bp, Homo sapiens
gccagccctccctgtcctcctc

SEQ ID NO: 3056952 - DNA, 13 bp, Homo sapiens
gccagcgccaggg

SEQ ID NO: 3056953 - DNA, 14 bp, Homo sapiens
gccagcgccagggc

SEQ ID NO: 3056954 - DNA, 16 bp, Homo sapiens
gccagcgccagggccc

SEQ ID NO: 3056955 - DNA, 22 bp, Homo sapiens
gccagcgccagggcccaggcca

SEQ ID NO: 3056956 - DNA, 23 bp, Homo sapiens
gccagcgccagggcccaggccat

SEQ ID NO: 3056957 - DNA, 13 bp, Homo sapiens
gccagcggctcca

SEQ ID NO: 3056958 - DNA, 13 bp, Homo sapiens
gccagctctgtca

SEQ ID NO: 3056959 - DNA, 15 bp, Homo sapiens
gccagctctgtcacc

SEQ ID NO: 3056960 - DNA, 21 bp, Homo sapiens
gccagctctgtcaccctggcc

SEQ ID NO: 3056961 - DNA, 23 bp, Homo sapiens
gccagctctgtcaccctggccac

SEQ ID NO: 3056962 - DNA, 14 bp, Homo sapiens
gccagctgcactga

SEQ ID NO: 3056963 - DNA, 17 bp, Homo sapiens
gccagctgccccagcca

SEQ ID NO: 3056964 - DNA, 17 bp, Homo sapiens
gccagctggcagcagag

SEQ ID NO: 3056965 - DNA, 18 bp, Homo sapiens
gccagctggcagcagagt

SEQ ID NO: 3056966 - DNA, 23 bp, Homo sapiens
gccaggaaggacagactggccgg

SEQ ID NO: 3056967 - DNA, 13 bp, Homo sapiens
gccaggaatattg

SEQ ID NO: 3056968 - DNA, 20 bp, Homo sapiens
gccaggaatttcccaggacc

SEQ ID NO: 3056969 - DNA, 21 bp, Homo sapiens
gccaggaatttcccaggaccc

SEQ ID NO: 3056970 - DNA, 23 bp, Homo sapiens
gccaggaatttcccaggaccctg

SEQ ID NO: 3056971 - DNA, 14 bp, Homo sapiens
gccaggacaggccc

SEQ ID NO: 3056972 - DNA, 17 bp, Homo sapiens
gccaggacccgccagcc

SEQ ID NO: 3056973 - DNA, 23 bp, Homo sapiens
gccaggagctgtcaccaaggaaa

SEQ ID NO: 3056974 - DNA, 17 bp, Homo sapiens
gccaggaggcggcagct

SEQ ID NO: 3056975 - DNA, 22 bp, Homo sapiens
gccaggatggaacacggccaca

SEQ ID NO: 3056976 - DNA, 19 bp, Homo sapiens
gccaggatttggttgttta

SEQ ID NO: 3056977 - DNA, 13 bp, Homo sapiens
gccaggcagagct

SEQ ID NO: 3056978 - DNA, 15 bp, Homo sapiens
gccaggcagagctga

SEQ ID NO: 3056979 - DNA, 14 bp, Homo sapiens
gccaggccccaggc

SEQ ID NO: 3056980 - DNA, 23 bp, Homo sapiens
gccaggcccccaagcctgcagtc

SEQ ID NO: 3056981 - DNA, 17 bp, Homo sapiens
gccaggcccccaccaca

SEQ ID NO: 3056982 - DNA, 19 bp, Homo sapiens
gccaggcccccaccacaca

SEQ ID NO: 3056983 - DNA, 16 bp, Homo sapiens
gccaggcccggggctg

SEQ ID NO: 3056984 - DNA, 12 bp, Homo sapiens
gccaggccctgg

SEQ ID NO: 3056985 - DNA, 15 bp, Homo sapiens
gccaggccctgggtc

SEQ ID NO: 3056986 - DNA, 15 bp, Homo sapiens
gccaggccgggcctg

SEQ ID NO: 3056987 - DNA, 21 bp, Homo sapiens
gccaggcctcgcctgccctcc

SEQ ID NO: 3056988 - DNA, 22 bp, Homo sapiens
gccaggcctcgcctgccctcct

SEQ ID NO: 3056989 - DNA, 14 bp, Homo sapiens
gccaggcgagcctg

SEQ ID NO: 3056990 - DNA, 18 bp, Homo sapiens
gccaggctgaccacagca

SEQ ID NO: 3056991 - DNA, 14 bp, Homo sapiens
gccaggctgggccg

SEQ ID NO: 3056992 - DNA, 17 bp, Homo sapiens
gccagggacccaaagca

SEQ ID NO: 3056993 - DNA, 20 bp, Homo sapiens
gccagggagaagctcctctc

SEQ ID NO: 3056994 - DNA, 18 bp, Homo sapiens
gccagggagacctggaca

SEQ ID NO: 3056995 - DNA, 23 bp, Homo sapiens
gccagggaggcagagcgggaggg

SEQ ID NO: 3056996 - DNA, 19 bp, Homo sapiens
gccagggccacgctccagc

SEQ ID NO: 3056997 - DNA, 16 bp, Homo sapiens
gccagggcccaggcca

SEQ ID NO: 3056998 - DNA, 14 bp, Homo sapiens
gccagggctcctgt

SEQ ID NO: 3056999 - DNA, 20 bp, Homo sapiens
gccagggctcctgtggcagc

SEQ ID NO: 3057000 - DNA, 14 bp, Homo sapiens
gcatggtggccaga

SEQ ID NO: 3057001 - DNA, 17 bp, Homo sapiens
gcatgtaaaatcttcag

SEQ ID NO: 3057002 - DNA, 19 bp, Homo sapiens
gcatgtaaaatcttcagct

SEQ ID NO: 3057003 - DNA, 23 bp, Homo sapiens
gcatgtagccagttaaggaaaga

SEQ ID NO: 3057004 - DNA, 22 bp, Homo sapiens
gcatgtagtgtgggaggctcct

SEQ ID NO: 3057005 - DNA, 13 bp, Homo sapiens
gcatgtcctttcc

SEQ ID NO: 3057006 - DNA, 19 bp, Homo sapiens
gcatgtcctttccatctgt

SEQ ID NO: 3057007 - DNA, 22 bp, Homo sapiens
gcatgtctaacctgatttacct

SEQ ID NO: 3057008 - DNA, 22 bp, Homo sapiens
gcatgtctaattcatttactca

SEQ ID NO: 3057009 - DNA, 23 bp, Homo sapiens
gcatgtctaattcatttactcac

SEQ ID NO: 3057010 - DNA, 13 bp, Homo sapiens
gcatgtctctgct

SEQ ID NO: 3057011 - DNA, 18 bp, Homo sapiens
gcatgtctgcctggagtg

SEQ ID NO: 3057012 - DNA, 17 bp, Homo sapiens
gcatgtcttttaaaatg

SEQ ID NO: 3057013 - DNA, 23 bp, Homo sapiens
gcatgtgactcctgaagggaagg

SEQ ID NO: 3057014 - DNA, 16 bp, Homo sapiens
gcatgtgcgtggaagt

SEQ ID NO: 3057015 - DNA, 19 bp, Homo sapiens
gcatgtgcgtggaagtgtt

SEQ ID NO: 3057016 - DNA, 13 bp, Homo sapiens
gcatgtggcttct

SEQ ID NO: 3057017 - DNA, 14 bp, Homo sapiens
gcatgtggcttctc

SEQ ID NO: 3057018 - DNA, 13 bp, Homo sapiens
gcatgtgggcttc

SEQ ID NO: 3057019 - DNA, 15 bp, Homo sapiens
gcatgtgtcatgcat

SEQ ID NO: 3057020 - DNA, 15 bp, Homo sapiens
gcatgtgtcccttcc

SEQ ID NO: 3057021 - DNA, 18 bp, Homo sapiens
gcatgttgaccatgtcta

SEQ ID NO: 3057022 - DNA, 12 bp, Homo sapiens
gcatgtttaatg

SEQ ID NO: 3057023 - DNA, 23 bp, Homo sapiens
gcatgtttaatgtgaactctccc

SEQ ID NO: 3057024 - DNA, 19 bp, Homo sapiens
gcatgtttaattgtgatat

SEQ ID NO: 3057025 - DNA, 23 bp, Homo sapiens
gcatgtttaattgtgatatttga

SEQ ID NO: 3057026 - DNA, 12 bp, Homo sapiens
gcatgtttgctg

SEQ ID NO: 3057027 - DNA, 14 bp, Homo sapiens
gcatgttttctgct

SEQ ID NO: 3057028 - DNA, 19 bp, Homo sapiens
gcattaaatataatatgca

SEQ ID NO: 3057029 - DNA, 20 bp, Homo sapiens
gcattagattcctttcctgt

SEQ ID NO: 3057030 - DNA, 21 bp, Homo sapiens
gcattagcctggatcctcagt

SEQ ID NO: 3057031 - DNA, 18 bp, Homo sapiens
gcattagggatgcctcct

SEQ ID NO: 3057032 - DNA, 22 bp, Homo sapiens
gcattatgtccactgtgtatag

SEQ ID NO: 3057033 - DNA, 21 bp, Homo sapiens
gcattattgacgaactggcta

SEQ ID NO: 3057034 - DNA, 23 bp, Homo sapiens
gcattcagtgcacctgcctcagc

SEQ ID NO: 3057035 - DNA, 12 bp, Homo sapiens
gcattcatgttt

SEQ ID NO: 3057036 - DNA, 15 bp, Homo sapiens
gcattcatgttttaa

SEQ ID NO: 3057037 - DNA, 23 bp, Homo sapiens
gcattcatgttttaaaagtttgt

SEQ ID NO: 3057038 - DNA, 14 bp, Homo sapiens
gcattccacaggat

SEQ ID NO: 3057039 - DNA, 20 bp, Homo sapiens
gcattccacaggatcatcat

SEQ ID NO: 3057040 - DNA, 13 bp, Homo sapiens
gcattccaggctc

SEQ ID NO: 3057041 - DNA, 14 bp, Homo sapiens
gcattccaggctcc

SEQ ID NO: 3057042 - DNA, 13 bp, Homo sapiens
gcattccctgagt

SEQ ID NO: 3057043 - DNA, 19 bp, Homo sapiens
gcattcctgatatgattta

SEQ ID NO: 3057044 - DNA, 22 bp, Homo sapiens
gcattcctgatatgatttaaaa

SEQ ID NO: 3057045 - DNA, 20 bp, Homo sapiens
gcattcctgtaacttttaat

SEQ ID NO: 3057046 - DNA, 14 bp, Homo sapiens
gcattctctgaaga

SEQ ID NO: 3057047 - DNA, 18 bp, Homo sapiens
gcattctgataggagggg

SEQ ID NO: 3057048 - DNA, 22 bp, Homo sapiens
gcattcttaacaaactcttcag

SEQ ID NO: 3057049 - DNA, 21 bp, Homo sapiens
gcattgaaagaagagatgaga

SEQ ID NO: 3057050 - DNA, 19 bp, Homo sapiens
gcattgaacacaaactgta

SEQ ID NO: 3057051 - DNA, 21 bp, Homo sapiens
gcattgaacacaaactgtaaa

SEQ ID NO: 3057052 - DNA, 22 bp, Homo sapiens
gcattgaagtgtttgctgcaga

SEQ ID NO: 3057053 - DNA, 21 bp, Homo sapiens
gcattgagaactgcatatgtt

SEQ ID NO: 3057054 - DNA, 15 bp, Homo sapiens
gcattgatattgtga

SEQ ID NO: 3057055 - DNA, 16 bp, Homo sapiens
gcattgatattgtgaa

SEQ ID NO: 3057056 - DNA, 18 bp, Homo sapiens
gcattgatggggaaggag

SEQ ID NO: 3057057 - DNA, 12 bp, Homo sapiens
gcattgctttcc

SEQ ID NO: 3057058 - DNA, 15 bp, Homo sapiens
gcattgctttccact

SEQ ID NO: 3057059 - DNA, 15 bp, Homo sapiens
gcattgtatcgatgt

SEQ ID NO: 3057060 - DNA, 13 bp, Homo sapiens
gcattgtctgcaa

SEQ ID NO: 3057061 - DNA, 17 bp, Homo sapiens
gcattgtgaactgacag

SEQ ID NO: 3057062 - DNA, 23 bp, Homo sapiens
gcattgtgagtaaatcagatgtt

SEQ ID NO: 3057063 - DNA, 16 bp, Homo sapiens
gcatttagctggccac

SEQ ID NO: 3057064 - DNA, 14 bp, Homo sapiens
gcatttatgtagac

SEQ ID NO: 3057065 - DNA, 18 bp, Homo sapiens
gcatttcaaagccctgcc

SEQ ID NO: 3057066 - DNA, 23 bp, Homo sapiens
gcatttcaaagccctgcctctgt

SEQ ID NO: 3057067 - DNA, 19 bp, Homo sapiens
gcatttcacaaaacagcct

SEQ ID NO: 3057068 - DNA, 18 bp, Homo sapiens
gcatttcacatgccttgc

SEQ ID NO: 3057069 - DNA, 22 bp, Homo sapiens
gcatttcactttcccggtgttc

SEQ ID NO: 3057070 - DNA, 18 bp, Homo sapiens
gcatttcccttccttcct

SEQ ID NO: 3057071 - DNA, 18 bp, Homo sapiens
gcatttggaaccaaagtc

SEQ ID NO: 3057072 - DNA, 22 bp, Homo sapiens
gcatttggaaccaaagtctaaa

SEQ ID NO: 3057073 - DNA, 16 bp, Homo sapiens
gcatttggattggggt

SEQ ID NO: 3057074 - DNA, 12 bp, Homo sapiens
gcattttgaatg

SEQ ID NO: 3057075 - DNA, 16 bp, Homo sapiens
gcattttgacaacatg

SEQ ID NO: 3057076 - DNA, 13 bp, Homo sapiens
gcattttgctaag

SEQ ID NO: 3057077 - DNA, 19 bp, Homo sapiens
gcattttgtttctgtatat

SEQ ID NO: 3057078 - DNA, 14 bp, Homo sapiens
gcatttttaaagga

SEQ ID NO: 3057079 - DNA, 13 bp, Homo sapiens
gccaaaaaggata

SEQ ID NO: 3057080 - DNA, 14 bp, Homo sapiens
gccaaaagctgctc

SEQ ID NO: 3057081 - DNA, 13 bp, Homo sapiens
gccaaacctctgt

SEQ ID NO: 3057082 - DNA, 15 bp, Homo sapiens
gccaaagagcctttc

SEQ ID NO: 3057083 - DNA, 22 bp, Homo sapiens
gccaaagcagattttcctaagg

SEQ ID NO: 3057084 - DNA, 17 bp, Homo sapiens
gccaaagccagagtggc

SEQ ID NO: 3057085 - DNA, 17 bp, Homo sapiens
gccaaatagccccagac

SEQ ID NO: 3057086 - DNA, 13 bp, Homo sapiens
gcagtaacattct

SEQ ID NO: 3057087 - DNA, 13 bp, Homo sapiens
gcagtagacattt

SEQ ID NO: 3057088 - DNA, 16 bp, Homo sapiens
gcagtagacattttaa

SEQ ID NO: 3057089 - DNA, 20 bp, Homo sapiens
gcagtagattttctttaaaa

SEQ ID NO: 3057090 - DNA, 20 bp, Homo sapiens
gcagtaggccggtgtgcctg

SEQ ID NO: 3057091 - DNA, 13 bp, Homo sapiens
gcagtaggggagg

SEQ ID NO: 3057092 - DNA, 21 bp, Homo sapiens
gcagtatcatgccctgtgcaa

SEQ ID NO: 3057093 - DNA, 14 bp, Homo sapiens
gcagtattttctgt

SEQ ID NO: 3057094 - DNA, 18 bp, Homo sapiens
gcagtcatcaacaatgat

SEQ ID NO: 3057095 - DNA, 22 bp, Homo sapiens
gcagtcatcttgaccaagcagg

SEQ ID NO: 3057096 - DNA, 19 bp, Homo sapiens
gcagtcattatccaggtaa

SEQ ID NO: 3057097 - DNA, 12 bp, Homo sapiens
gcagtccagagc

SEQ ID NO: 3057098 - DNA, 16 bp, Homo sapiens
gcagtccagagctttt

SEQ ID NO: 3057099 - DNA, 14 bp, Homo sapiens
gcagtccctgctta

SEQ ID NO: 3057100 - DNA, 19 bp, Homo sapiens
gcagtcctgatcagagccg

SEQ ID NO: 3057101 - DNA, 14 bp, Homo sapiens
gcagtcgctgcagg

SEQ ID NO: 3057102 - DNA, 16 bp, Homo sapiens
gcagtcgcttgccaaa

SEQ ID NO: 3057103 - DNA, 21 bp, Homo sapiens
gcagtcgcttgccaaagcaga

SEQ ID NO: 3057104 - DNA, 22 bp, Homo sapiens
gcagtcgcttgccaaagcagat

SEQ ID NO: 3057105 - DNA, 18 bp, Homo sapiens
gcagtcggcatgccagga

SEQ ID NO: 3057106 - DNA, 19 bp, Homo sapiens
gcagtcgtggctttggcag

SEQ ID NO: 3057107 - DNA, 15 bp, Homo sapiens
gcagtctacttctgt

SEQ ID NO: 3057108 - DNA, 20 bp, Homo sapiens
gcagtctacttctgtgtctg

SEQ ID NO: 3057109 - DNA, 16 bp, Homo sapiens
gcagtctttcccccag

SEQ ID NO: 3057110 - DNA, 18 bp, Homo sapiens
gcagtctttcccccagga

SEQ ID NO: 3057111 - DNA, 14 bp, Homo sapiens
gcagtgccagccaa

SEQ ID NO: 3057112 - DNA, 12 bp, Homo sapiens
gcagtggccacg

SEQ ID NO: 3057113 - DNA, 13 bp, Homo sapiens
gcagtggcctggc

SEQ ID NO: 3057114 - DNA, 14 bp, Homo sapiens
gcagtggcctggcc

SEQ ID NO: 3057115 - DNA, 21 bp, Homo sapiens
gcagtggcgcaatctcgcctt

SEQ ID NO: 3057116 - DNA, 19 bp, Homo sapiens
gcagtggcttagctgccat

SEQ ID NO: 3057117 - DNA, 16 bp, Homo sapiens
gcagtggcttctttcc

SEQ ID NO: 3057118 - DNA, 19 bp, Homo sapiens
gcagtgtcttaaggagact

SEQ ID NO: 3057119 - DNA, 17 bp, Homo sapiens
gcagtgtggccaggctg

SEQ ID NO: 3057120 - DNA, 13 bp, Homo sapiens
gcagtgtttgtat

SEQ ID NO: 3057121 - DNA, 17 bp, Homo sapiens
gcagtgttttggttcag

SEQ ID NO: 3057122 - DNA, 13 bp, Homo sapiens
gcagttacatgca

SEQ ID NO: 3057123 - DNA, 21 bp, Homo sapiens
gcagttacatgcatacttcaa

SEQ ID NO: 3057124 - DNA, 17 bp, Homo sapiens
gcagttactgaaatctt

SEQ ID NO: 3057125 - DNA, 13 bp, Homo sapiens
gcagttcacctgc

SEQ ID NO: 3057126 - DNA, 22 bp, Homo sapiens
gcagttgacaggtacttggagg

SEQ ID NO: 3057127 - DNA, 17 bp, Homo sapiens
gcagttgtggtgtgcca

SEQ ID NO: 3057128 - DNA, 14 bp, Homo sapiens
gcagtttatcattc

SEQ ID NO: 3057129 - DNA, 16 bp, Homo sapiens
gcagtttatcattcaa

SEQ ID NO: 3057130 - DNA, 22 bp, Homo sapiens
gcagtttccagtcctaacaaat

SEQ ID NO: 3057131 - DNA, 14 bp, Homo sapiens
gcagtttgaaattc

SEQ ID NO: 3057132 - DNA, 17 bp, Homo sapiens
gcagtttgaaattctga

SEQ ID NO: 3057133 - DNA, 18 bp, Homo sapiens
gcagtttgaaattctgaa

SEQ ID NO: 3057134 - DNA, 19 bp, Homo sapiens
gcagtttgaaattctgaat

SEQ ID NO: 3057135 - DNA, 21 bp, Homo sapiens
gcagtttgaaattctgaattt

SEQ ID NO: 3057136 - DNA, 21 bp, Homo sapiens
gcataaaagggtcaaacctgt

SEQ ID NO: 3057137 - DNA, 16 bp, Homo sapiens
gcataaatttaatgta

SEQ ID NO: 3057138 - DNA, 16 bp, Homo sapiens
gcataacaaattctga

SEQ ID NO: 3057139 - DNA, 13 bp, Homo sapiens
gcataagcttttt

SEQ ID NO: 3057140 - DNA, 19 bp, Homo sapiens
gcataatttgtttaaaatt

SEQ ID NO: 3057141 - DNA, 20 bp, Homo sapiens
gcataatttgtttaaaattc

SEQ ID NO: 3057142 - DNA, 23 bp, Homo sapiens
gcataatttgtttaaaattctct

SEQ ID NO: 3057143 - DNA, 13 bp, Homo sapiens
gcatacaatctga

SEQ ID NO: 3057144 - DNA, 22 bp, Homo sapiens
gcatacacacacacacacagcc

SEQ ID NO: 3057145 - DNA, 22 bp, Homo sapiens
gcatactccgtgaggctgctgc

SEQ ID NO: 3057146 - DNA, 14 bp, Homo sapiens
gcatacttcaaaag

SEQ ID NO: 3057147 - DNA, 13 bp, Homo sapiens
gcatacttttaat

SEQ ID NO: 3057148 - DNA, 15 bp, Homo sapiens
gcatagcgtcctgcc

SEQ ID NO: 3057149 - DNA, 17 bp, Homo sapiens
gcataggtttaataatt

SEQ ID NO: 3057150 - DNA, 15 bp, Homo sapiens
gcatatagaaaacaa

SEQ ID NO: 3057151 - DNA, 12 bp, Homo sapiens
gcatatgttgaa

SEQ ID NO: 3057152 - DNA, 18 bp, Homo sapiens
gcatatgttgaatacttt

SEQ ID NO: 3057153 - DNA, 19 bp, Homo sapiens
gcatatgttgaatactttt

SEQ ID NO: 3057154 - DNA, 21 bp, Homo sapiens
gcatatgttgaatacttttta

SEQ ID NO: 3057155 - DNA, 15 bp, Homo sapiens
gcatattagttaatc

SEQ ID NO: 3057156 - DNA, 17 bp, Homo sapiens
gcatattcaacacactg

SEQ ID NO: 3057157 - DNA, 12 bp, Homo sapiens
gcatattggaaa

SEQ ID NO: 3057158 - DNA, 12 bp, Homo sapiens
gcatattgtaca

SEQ ID NO: 3057159 - DNA, 16 bp, Homo sapiens
gcatattgtacacttt

SEQ ID NO: 3057160 - DNA, 19 bp, Homo sapiens
gcatattgtacactttttt

SEQ ID NO: 3057161 - DNA, 18 bp, Homo sapiens
gcatcaaaagacaattct

SEQ ID NO: 3057162 - DNA, 19 bp, Homo sapiens
gcatcaaaagacaattctt

SEQ ID NO: 3057163 - DNA, 12 bp, Homo sapiens
gcatcaaacatg

SEQ ID NO: 3057164 - DNA, 15 bp, Homo sapiens
gcatcaaacatgaaa

SEQ ID NO: 3057165 - DNA, 19 bp, Homo sapiens
gcatcaaacatgaaaacat

SEQ ID NO: 3057166 - DNA, 20 bp, Homo sapiens
gcatcaaacatgaaaacatt

SEQ ID NO: 3057167 - DNA, 16 bp, Homo sapiens
gcatcaagaactattg

SEQ ID NO: 3057168 - DNA, 16 bp, Homo sapiens
gcatcacctgcctgtt

SEQ ID NO: 3057169 - DNA, 17 bp, Homo sapiens
gcatcactagtgacaag

SEQ ID NO: 3057170 - DNA, 22 bp, Homo sapiens
gcatcagctgtctgtcatctgc

SEQ ID NO: 3057171 - DNA, 21 bp, Homo sapiens
gcatcaggatactcaaagtgg

SEQ ID NO: 3057172 - DNA, 13 bp, Homo sapiens
gcatcatgcatgt

SEQ ID NO: 3057173 - DNA, 12 bp, Homo sapiens
gcatccaaataa

SEQ ID NO: 3057174 - DNA, 14 bp, Homo sapiens
gcatccaaggcctt

SEQ ID NO: 3057175 - DNA, 22 bp, Homo sapiens
gcatccacttctttcagcagac

SEQ ID NO: 3057176 - DNA, 21 bp, Homo sapiens
gcatccagagtccctgcctgg

SEQ ID NO: 3057177 - DNA, 23 bp, Homo sapiens
gcatccagagtccctgcctggac

SEQ ID NO: 3057178 - DNA, 17 bp, Homo sapiens
gcatccaggccagggct

SEQ ID NO: 3057179 - DNA, 20 bp, Homo sapiens
gcatccaggccagggctcct

SEQ ID NO: 3057180 - DNA, 14 bp, Homo sapiens
gcatccaggctggc

SEQ ID NO: 3057181 - DNA, 16 bp, Homo sapiens
gcatcccggctgaccc

SEQ ID NO: 3057182 - DNA, 17 bp, Homo sapiens
gcatcccggctgaccct

SEQ ID NO: 3057183 - DNA, 17 bp, Homo sapiens
gcatccctaattcttca

SEQ ID NO: 3057184 - DNA, 15 bp, Homo sapiens
gcatccgcaggtgct

SEQ ID NO: 3057185 - DNA, 11 bp, Homo sapiens
gcatcctagtc

SEQ ID NO: 3057186 - DNA, 22 bp, Homo sapiens
gcatcctccccaccagagctgc

SEQ ID NO: 3057187 - DNA, 15 bp, Homo sapiens
gcatccttgcctgtc

SEQ ID NO: 3057188 - DNA, 16 bp, Homo sapiens
gcatccttgcctgtct

SEQ ID NO: 3057189 - DNA, 19 bp, Homo sapiens
gcatctaagttataagact

SEQ ID NO: 3057190 - DNA, 23 bp, Homo sapiens
gcatctactctggaccaaggagc

SEQ ID NO: 3057191 - DNA, 14 bp, Homo sapiens
gcatctcaaatgtt

SEQ ID NO: 3057192 - DNA, 15 bp, Homo sapiens
gcatctcaaatgttt

SEQ ID NO: 3057193 - DNA, 18 bp, Homo sapiens
gcatctcaaatgttttct

SEQ ID NO: 3057194 - DNA, 15 bp, Homo sapiens
gcatctgaccatctg

SEQ ID NO: 3057195 - DNA, 21 bp, Homo sapiens
gcatctggctactttttcatg

SEQ ID NO: 3057196 - DNA, 12 bp, Homo sapiens
gcatctgtgcgt

SEQ ID NO: 3057197 - DNA, 11 bp, Homo sapiens
gcatctgtgtg

SEQ ID NO: 3057198 - DNA, 12 bp, Homo sapiens
gcatctgtgtgc

SEQ ID NO: 3057199 - DNA, 15 bp, Homo sapiens
gcatcttactgaagg

SEQ ID NO: 3057200 - DNA, 23 bp, Homo sapiens
gcatcttactgaaggtaaaattg

SEQ ID NO: 3057201 - DNA, 13 bp, Homo sapiens
gcatcttccagaa

SEQ ID NO: 3057202 - DNA, 15 bp, Homo sapiens
gcatcttgcctccag

SEQ ID NO: 3057203 - DNA, 17 bp, Homo sapiens
gcatcttgcctccaggt

SEQ ID NO: 3057204 - DNA, 19 bp, Homo sapiens
gcatcttgcctccaggtgc

SEQ ID NO: 3057205 - DNA, 20 bp, Homo sapiens
gcatgaaaaaccatttttga

SEQ ID NO: 3057206 - DNA, 13 bp, Homo sapiens
tgtgtaccacacc

SEQ ID NO: 3057207 - DNA, 21 bp, Homo sapiens
tgtgtagacaaatatttggag

SEQ ID NO: 3057208 - DNA, 14 bp, Homo sapiens
tgtgtagcctgtgc

SEQ ID NO: 3057209 - DNA, 22 bp, Homo sapiens
tgtgtagggagatggagaaaat

SEQ ID NO: 3057210 - DNA, 23 bp, Homo sapiens
tgtgtagggagatggagaaaatg

SEQ ID NO: 3057211 - DNA, 19 bp, Homo sapiens
tgtgtatccattatcatgt

SEQ ID NO: 3057212 - DNA, 22 bp, Homo sapiens
tgtgtatccattatcatgtgta

SEQ ID NO: 3057213 - DNA, 24 bp, Homo sapiens
tgtgtatccattatcatgtgtaat

SEQ ID NO: 3057214 - DNA, 12 bp, Homo sapiens
tgtgtatgagaa

SEQ ID NO: 3057215 - DNA, 21 bp, Homo sapiens
tgtgtatgagaagtactttgt

SEQ ID NO: 3057216 - DNA, 23 bp, Homo sapiens
tgtgtatgagaagtactttgtgc

SEQ ID NO: 3057217 - DNA, 14 bp, Homo sapiens
tgtgtatgccaaga

SEQ ID NO: 3057218 - DNA, 14 bp, Homo sapiens
tgtgtatgggcaaa

SEQ ID NO: 3057219 - DNA, 19 bp, Homo sapiens
tgtgtattcatactgacat

SEQ ID NO: 3057220 - DNA, 18 bp, Homo sapiens
tgtgtatttaacagggag

SEQ ID NO: 3057221 - DNA, 20 bp, Homo sapiens
tgtgtatttaacagggaggg

SEQ ID NO: 3057222 - DNA, 14 bp, Homo sapiens
tgtgtatttctctg

SEQ ID NO: 3057223 - DNA, 18 bp, Homo sapiens
tgtgtatttctctgtgaa

SEQ ID NO: 3057224 - DNA, 15 bp, Homo sapiens
tgtgtattttttcat

SEQ ID NO: 3057225 - DNA, 16 bp, Homo sapiens
tgtgtattttttcata

SEQ ID NO: 3057226 - DNA, 18 bp, Homo sapiens
tgtgtattttttcatagt

SEQ ID NO: 3057227 - DNA, 17 bp, Homo sapiens
tgtgtcagagcccagcc

SEQ ID NO: 3057228 - DNA, 19 bp, Homo sapiens
tgtgtcagagcccagccca

SEQ ID NO: 3057229 - DNA, 16 bp, Homo sapiens
tgtgtcagagcccagg

SEQ ID NO: 3057230 - DNA, 17 bp, Homo sapiens
tgtgtcagagcccaggg

SEQ ID NO: 3057231 - DNA, 20 bp, Homo sapiens
tgtgtcaggccctctgcctg

SEQ ID NO: 3057232 - DNA, 22 bp, Homo sapiens
tgtgtcaggccctctgcctgca

SEQ ID NO: 3057233 - DNA, 19 bp, Homo sapiens
tgtgtcagtggggctctct

SEQ ID NO: 3057234 - DNA, 16 bp, Homo sapiens
tgtgtccaaaactgcc

SEQ ID NO: 3057235 - DNA, 13 bp, Homo sapiens
tgtgtccatcctg

SEQ ID NO: 3057236 - DNA, 14 bp, Homo sapiens
tgtgtcccaggcag

SEQ ID NO: 3057237 - DNA, 21 bp, Homo sapiens
tgtgtccccctctgtccaggc

SEQ ID NO: 3057238 - DNA, 20 bp, Homo sapiens
tgtgtcccctgacctgtcca

SEQ ID NO: 3057239 - DNA, 20 bp, Homo sapiens
tgtgtctaagattctagatc

SEQ ID NO: 3057240 - DNA, 13 bp, Homo sapiens
tgtgtctctatgt

SEQ ID NO: 3057241 - DNA, 13 bp, Homo sapiens
tgtgtctgtacac

SEQ ID NO: 3057242 - DNA, 16 bp, Homo sapiens
tgtgtctgttttactg

SEQ ID NO: 3057243 - DNA, 15 bp, Homo sapiens
tgtgtgaagaaagcc

SEQ ID NO: 3057244 - DNA, 12 bp, Homo sapiens
tgtgtgaatgaa

SEQ ID NO: 3057245 - DNA, 17 bp, Homo sapiens
tgtgtgaatgaacactc

SEQ ID NO: 3057246 - DNA, 14 bp, Homo sapiens
tgtgtgacaattct

SEQ ID NO: 3057247 - DNA, 19 bp, Homo sapiens
tgtgtgacccctcctgggg

SEQ ID NO: 3057248 - DNA, 23 bp, Homo sapiens
tgtgtgagaccaggggaccagag

SEQ ID NO: 3057249 - DNA, 17 bp, Homo sapiens
tgtgtgcgtgtatatgt

SEQ ID NO: 3057250 - DNA, 20 bp, Homo sapiens
tgtgtgcgtgtatatgtgct

SEQ ID NO: 3057251 - DNA, 13 bp, Homo sapiens
tgtgtgctctcca

SEQ ID NO: 3057252 - DNA, 16 bp, Homo sapiens
tgtgtggccacttctg

SEQ ID NO: 3057253 - DNA, 20 bp, Homo sapiens
tgtgtggccacttctgtcca

SEQ ID NO: 3057254 - DNA, 11 bp, Homo sapiens
tgtgtggcctg

SEQ ID NO: 3057255 - DNA, 23 bp, Homo sapiens
tgtgtggtcagcggtatgtgcgt

SEQ ID NO: 3057256 - DNA, 21 bp, Homo sapiens
tgtgtgtaccacaccctgcct

SEQ ID NO: 3057257 - DNA, 22 bp, Homo sapiens
tgtgtgtccacgactgtctcca

SEQ ID NO: 3057258 - DNA, 19 bp, Homo sapiens
tgtgtgtcccaggcaggga

SEQ ID NO: 3057259 - DNA, 13 bp, Homo sapiens
tgtgtgtctctga

SEQ ID NO: 3057260 - DNA, 16 bp, Homo sapiens
tgtgtgtgacaattct

SEQ ID NO: 3057261 - DNA, 18 bp, Homo sapiens
tgtgtgtgcgtgtatatg

SEQ ID NO: 3057262 - DNA, 13 bp, Homo sapiens
tgtgtgtgtgaga

SEQ ID NO: 3057263 - DNA, 11 bp, Homo sapiens
tgtgtgtgtgc

SEQ ID NO: 3057264 - DNA, 15 bp, Homo sapiens
tgtgtgtgtgcacat

SEQ ID NO: 3057265 - DNA, 11 bp, Homo sapiens
tgtgtgtgtgt

SEQ ID NO: 3057266 - DNA, 13 bp, Homo sapiens
tgtgtgtgtgtgc

SEQ ID NO: 3057267 - DNA, 13 bp, Homo sapiens
tgtgtgtgtgtgt

SEQ ID NO: 3057268 - DNA, 12 bp, Homo sapiens
tgtgtgttctaa

SEQ ID NO: 3057269 - DNA, 17 bp, Homo sapiens
tgtgtgttgtttccata

SEQ ID NO: 3057270 - DNA, 15 bp, Homo sapiens
tgtgtgtttgtatgt

SEQ ID NO: 3057271 - DNA, 15 bp, Homo sapiens
tgtgttacttgaagt

SEQ ID NO: 3057272 - DNA, 16 bp, Homo sapiens
tgtgttccttctgtga

SEQ ID NO: 3057273 - DNA, 18 bp, Homo sapiens
tgtgttccttctgtgaag

SEQ ID NO: 3057274 - DNA, 21 bp, Homo sapiens
tgtgttggacaaatgtgaaga

SEQ ID NO: 3057275 - DNA, 20 bp, Homo sapiens
tgtttgggtgggttaagtgg

SEQ ID NO: 3057276 - DNA, 22 bp, Homo sapiens
tgtttgggtggtttgtgagcct

SEQ ID NO: 3057277 - DNA, 22 bp, Homo sapiens
tgtttgtaaaagcttgatgaaa

SEQ ID NO: 3057278 - DNA, 21 bp, Homo sapiens
tgtttgtacacaacacctaaa

SEQ ID NO: 3057279 - DNA, 16 bp, Homo sapiens
tgtttgtagctttcct

SEQ ID NO: 3057280 - DNA, 19 bp, Homo sapiens
tgtttgtagctttcctgga

SEQ ID NO: 3057281 - DNA, 19 bp, Homo sapiens
tgtttgtagtcttgtctta

SEQ ID NO: 3057282 - DNA, 20 bp, Homo sapiens
tgtttgtataccatgatgca

SEQ ID NO: 3057283 - DNA, 19 bp, Homo sapiens
tgtttgtcagcatctgacc

SEQ ID NO: 3057284 - DNA, 23 bp, Homo sapiens
tgtttgtcagcatctgaccatct

SEQ ID NO: 3057285 - DNA, 22 bp, Homo sapiens
tgtttgtctcacttttcatctg

SEQ ID NO: 3057286 - DNA, 15 bp, Homo sapiens
tgtttgtgctgtggt

SEQ ID NO: 3057287 - DNA, 14 bp, Homo sapiens
tgtttgttctgttt

SEQ ID NO: 3057288 - DNA, 18 bp, Homo sapiens
tgttttaaaacgtgtaaa

SEQ ID NO: 3057289 - DNA, 14 bp, Homo sapiens
tgttttaaaacttt

SEQ ID NO: 3057290 - DNA, 13 bp, Homo sapiens
tgttttaaaatta

SEQ ID NO: 3057291 - DNA, 18 bp, Homo sapiens
tgttttaaaattatatag

SEQ ID NO: 3057292 - DNA, 14 bp, Homo sapiens
tgttttaaatgtac

SEQ ID NO: 3057293 - DNA, 15 bp, Homo sapiens
tgttttaaatgtaca

SEQ ID NO: 3057294 - DNA, 11 bp, Homo sapiens
tgttttaacaa

SEQ ID NO: 3057295 - DNA, 13 bp, Homo sapiens
tgttttaacagat

SEQ ID NO: 3057296 - DNA, 11 bp, Homo sapiens
tgttttaactt

SEQ ID NO: 3057297 - DNA, 12 bp, Homo sapiens
tgttttaactta

SEQ ID NO: 3057298 - DNA, 17 bp, Homo sapiens
tgttttaagcagctcta

SEQ ID NO: 3057299 - DNA, 16 bp, Homo sapiens
tgttttaattccatga

SEQ ID NO: 3057300 - DNA, 22 bp, Homo sapiens
tgttttacgcaaggaaggactt

SEQ ID NO: 3057301 - DNA, 23 bp, Homo sapiens
tgttttaggttaaaaaaaggcat

SEQ ID NO: 3057302 - DNA, 14 bp, Homo sapiens
tgttttatgagaaa

SEQ ID NO: 3057303 - DNA, 20 bp, Homo sapiens
tgttttatggcctaaattta

SEQ ID NO: 3057304 - DNA, 18 bp, Homo sapiens
tgttttatttcattggtt

SEQ ID NO: 3057305 - DNA, 21 bp, Homo sapiens
tgttttcaacctagaaacctt

SEQ ID NO: 3057306 - DNA, 14 bp, Homo sapiens
tgttttcatcattt

SEQ ID NO: 3057307 - DNA, 16 bp, Homo sapiens
tgttttcatcatttca

SEQ ID NO: 3057308 - DNA, 21 bp, Homo sapiens
tgttttccctggctaacagtc

SEQ ID NO: 3057309 - DNA, 14 bp, Homo sapiens
tgttttctgtgtaa

SEQ ID NO: 3057310 - DNA, 13 bp, Homo sapiens
tgttttgaaacta

SEQ ID NO: 3057311 - DNA, 17 bp, Homo sapiens
tgttttgaaggcaaaat

SEQ ID NO: 3057312 - DNA, 12 bp, Homo sapiens
tgttttgagaac

SEQ ID NO: 3057313 - DNA, 12 bp, Homo sapiens
tgttttgataaa

SEQ ID NO: 3057314 - DNA, 12 bp, Homo sapiens
tgttttgccagt

SEQ ID NO: 3057315 - DNA, 20 bp, Homo sapiens
tgttttggtggaaaaaacat

SEQ ID NO: 3057316 - DNA, 16 bp, Homo sapiens
tgttttgtaccagtga

SEQ ID NO: 3057317 - DNA, 18 bp, Homo sapiens
tgtttttaaaaagaaaat

SEQ ID NO: 3057318 - DNA, 16 bp, Homo sapiens
tgtttttaaaaccact

SEQ ID NO: 3057319 - DNA, 13 bp, Homo sapiens
tgtttttaatgct

SEQ ID NO: 3057320 - DNA, 11 bp, Homo sapiens
tgtttttcatt

SEQ ID NO: 3057321 - DNA, 17 bp, Homo sapiens
tgtttttccagttccag

SEQ ID NO: 3057322 - DNA, 18 bp, Homo sapiens
tgtttttgaggctttctg

SEQ ID NO: 3057323 - DNA, 19 bp, Homo sapiens
tgtttttgcactgtctgta

SEQ ID NO: 3057324 - DNA, 14 bp, Homo sapiens
tgtttttgctttct

SEQ ID NO: 3057325 - DNA, 18 bp, Homo sapiens
ttaacactgaaattgcct

SEQ ID NO: 3057326 - DNA, 19 bp, Homo sapiens
ttaacactgaaattgcctg

SEQ ID NO: 3057327 - DNA, 21 bp, Homo sapiens
ttaacactgaaattgcctgaa

SEQ ID NO: 3057328 - DNA, 14 bp, Homo sapiens
ttaacagagtctga

SEQ ID NO: 3057329 - DNA, 19 bp, Homo sapiens
ttaacagagtctgaaccta

SEQ ID NO: 3057330 - DNA, 19 bp, Homo sapiens
ttaacagcgtgtcaacttt

SEQ ID NO: 3057331 - DNA, 16 bp, Homo sapiens
ttaacaggtattttca

SEQ ID NO: 3057332 - DNA, 14 bp, Homo sapiens
ttaacagtacctgt

SEQ ID NO: 3057333 - DNA, 15 bp, Homo sapiens
ttaacagtacctgtg

SEQ ID NO: 3057334 - DNA, 19 bp, Homo sapiens
ttaacatcagaactgaaat

SEQ ID NO: 3057335 - DNA, 22 bp, Homo sapiens
ttaacatttgtgtaatatgaaa

SEQ ID NO: 3057336 - DNA, 17 bp, Homo sapiens
ttaaccaaacaattatt

SEQ ID NO: 3057337 - DNA, 21 bp, Homo sapiens
ttaaccaaacaattatttaaa

SEQ ID NO: 3057338 - DNA, 21 bp, Homo sapiens
ttaaccaagttgtttattcca

SEQ ID NO: 3057339 - DNA, 19 bp, Homo sapiens
ttaaccaatcgcaaagcaa

SEQ ID NO: 3057340 - DNA, 13 bp, Homo sapiens
ttaaccagatcta

SEQ ID NO: 3057341 - DNA, 16 bp, Homo sapiens
ttaaccagttgtggtg

SEQ ID NO: 3057342 - DNA, 14 bp, Homo sapiens
ttaaccttgcctta

SEQ ID NO: 3057343 - DNA, 14 bp, Homo sapiens
ttaacctttgctat

SEQ ID NO: 3057344 - DNA, 16 bp, Homo sapiens
ttaacgtatgtatttc

SEQ ID NO: 3057345 - DNA, 20 bp, Homo sapiens
ttaactatcttctttggact

SEQ ID NO: 3057346 - DNA, 15 bp, Homo sapiens
ttaactcattagact

SEQ ID NO: 3057347 - DNA, 20 bp, Homo sapiens
ttaactctgtaaaagtgtct

SEQ ID NO: 3057348 - DNA, 21 bp, Homo sapiens
ttaactcttagaagtgttgta

SEQ ID NO: 3057349 - DNA, 21 bp, Homo sapiens
ttaactgttgcacttttgaat

SEQ ID NO: 3057350 - DNA, 19 bp, Homo sapiens
ttaacttatttatatgaag

SEQ ID NO: 3057351 - DNA, 20 bp, Homo sapiens
ttaacttatttatatgaagc

SEQ ID NO: 3057352 - DNA, 23 bp, Homo sapiens
ttaagaaagcacttaaacagaag

SEQ ID NO: 3057353 - DNA, 12 bp, Homo sapiens
ttaagaaggcaa

SEQ ID NO: 3057354 - DNA, 18 bp, Homo sapiens
ttaagaaggcaaaaatgt

SEQ ID NO: 3057355 - DNA, 14 bp, Homo sapiens
ttaagaatgaacac

SEQ ID NO: 3057356 - DNA, 18 bp, Homo sapiens
ttaagacatgatttcctt

SEQ ID NO: 3057357 - DNA, 18 bp, Homo sapiens
ttaagacctactgttcta

SEQ ID NO: 3057358 - DNA, 13 bp, Homo sapiens
ttaagacgtgttt

SEQ ID NO: 3057359 - DNA, 16 bp, Homo sapiens
ttaagacgtgtttgtg

SEQ ID NO: 3057360 - DNA, 17 bp, Homo sapiens
ttaagacgtgtttgtgt

SEQ ID NO: 3057361 - DNA, 19 bp, Homo sapiens
ttaagagaacaaagagtga

SEQ ID NO: 3057362 - DNA, 23 bp, Homo sapiens
ttaagagcagaacagatctttta

SEQ ID NO: 3057363 - DNA, 20 bp, Homo sapiens
ttaagaggcagaaaattgca

SEQ ID NO: 3057364 - DNA, 13 bp, Homo sapiens
ttaagagtccaag

SEQ ID NO: 3057365 - DNA, 19 bp, Homo sapiens
ttaagagtccaagaatcca

SEQ ID NO: 3057366 - DNA, 19 bp, Homo sapiens
ttaagatagacttattctt

SEQ ID NO: 3057367 - DNA, 11 bp, Homo sapiens
ttaagatatcc

SEQ ID NO: 3057368 - DNA, 12 bp, Homo sapiens
ttaagattcagt

SEQ ID NO: 3057369 - DNA, 19 bp, Homo sapiens
ttaagattcagttttccca

SEQ ID NO: 3057370 - DNA, 14 bp, Homo sapiens
ttaagcaaatgcat

SEQ ID NO: 3057371 - DNA, 15 bp, Homo sapiens
ttaagcaaatgcatt

SEQ ID NO: 3057372 - DNA, 19 bp, Homo sapiens
ttaagcaacgttagtagaa

SEQ ID NO: 3057373 - DNA, 22 bp, Homo sapiens
ttaagcaaggtgtccctgcctt

SEQ ID NO: 3057374 - DNA, 21 bp, Homo sapiens
ttaagccacttaaaatgttca

SEQ ID NO: 3057375 - DNA, 16 bp, Homo sapiens
ttaagccatcttggta

SEQ ID NO: 3057376 - DNA, 18 bp, Homo sapiens
ttaagccatcttggtaaa

SEQ ID NO: 3057377 - DNA, 21 bp, Homo sapiens
ttaagctgtaaattacataag

SEQ ID NO: 3057378 - DNA, 21 bp, Homo sapiens
ttaagctgttcctgttcagta

SEQ ID NO: 3057379 - DNA, 22 bp, Homo sapiens
ttaagctttggacccaaggaaa

SEQ ID NO: 3057380 - DNA, 14 bp, Homo sapiens
ttaaggaaaattag

SEQ ID NO: 3057381 - DNA, 12 bp, Homo sapiens
ttaaggaaacaa

SEQ ID NO: 3057382 - DNA, 14 bp, Homo sapiens
ttaaggaaacaata

SEQ ID NO: 3057383 - DNA, 22 bp, Homo sapiens
ttaaggacaaagtgccaaagaa

SEQ ID NO: 3057384 - DNA, 19 bp, Homo sapiens
ttaaggctctgtgccttgg

SEQ ID NO: 3057385 - DNA, 21 bp, Homo sapiens
ttaaggtgaggcctgtctgtg

SEQ ID NO: 3057386 - DNA, 13 bp, Homo sapiens
ttaagtcagaaca

SEQ ID NO: 3057387 - DNA, 14 bp, Homo sapiens
ttaagttcccagat

SEQ ID NO: 3057388 - DNA, 19 bp, Homo sapiens
ttaagttggctagagcttc

SEQ ID NO: 3057389 - DNA, 21 bp, Homo sapiens
ttaagtttccttccagcccag

SEQ ID NO: 3057390 - DNA, 15 bp, Homo sapiens
ttaataaaaaggcac

SEQ ID NO: 3057391 - DNA, 15 bp, Homo sapiens
ttaataaaaatgaca

SEQ ID NO: 3057392 - DNA, 19 bp, Homo sapiens
ttaataaaaatgacagact

SEQ ID NO: 3057393 - DNA, 16 bp, Homo sapiens
ttaataaactgcaaat

SEQ ID NO: 3057394 - DNA, 18 bp, Homo sapiens
ttaataaactgcaaatgt

SEQ ID NO: 3057395 - DNA, 13 bp, Homo sapiens
ttaataaagacag

SEQ ID NO: 3057396 - DNA, 15 bp, Homo sapiens
ttaataaatagagca

SEQ ID NO: 3057397 - DNA, 13 bp, Homo sapiens
ttaataataatta

SEQ ID NO: 3057398 - DNA, 21 bp, Homo sapiens
ttaatactgaatttctttgat

SEQ ID NO: 3057399 - DNA, 20 bp, Homo sapiens
ttaatagaaataaattccta

SEQ ID NO: 3057400 - DNA, 16 bp, Homo sapiens
ttaatagaatgataaa

SEQ ID NO: 3057401 - DNA, 20 bp, Homo sapiens
ttaatagagaaggaaagctt

SEQ ID NO: 3057402 - DNA, 17 bp, Homo sapiens
ttaatagggaatatatc

SEQ ID NO: 3057403 - DNA, 14 bp, Homo sapiens
ttaatagtgttaat

SEQ ID NO: 3057404 - DNA, 15 bp, Homo sapiens
ttaatagtgttaatc

SEQ ID NO: 3057405 - DNA, 17 bp, Homo sapiens
ttaatagtgttaatcaa

SEQ ID NO: 3057406 - DNA, 16 bp, Homo sapiens
ttaatatatcaatatt

SEQ ID NO: 3057407 - DNA, 19 bp, Homo sapiens
ttaatattagcttgcttaa

SEQ ID NO: 3057408 - DNA, 20 bp, Homo sapiens
ttaatatttgtgctttgaaa

SEQ ID NO: 3057409 - DNA, 19 bp, Homo sapiens
ttaatattttttcttttcc

SEQ ID NO: 3057410 - DNA, 20 bp, Homo sapiens
ttaatcaatttaaacccatt

SEQ ID NO: 3057411 - DNA, 13 bp, Homo sapiens
ttaatcagctgtt

SEQ ID NO: 3057412 - DNA, 16 bp, Homo sapiens
ttaatcagctgttgca

SEQ ID NO: 3057413 - DNA, 20 bp, Homo sapiens
ttaatcagctgttgcaggca

SEQ ID NO: 3057414 - DNA, 22 bp, Homo sapiens
ttaatcagctgttgcaggcagt

SEQ ID NO: 3057415 - DNA, 12 bp, Homo sapiens
ttaatcagtgtt

SEQ ID NO: 3057416 - DNA, 13 bp, Homo sapiens
ttaatcagtgttg

SEQ ID NO: 3057417 - DNA, 22 bp, Homo sapiens
ttaatcatatttgaaaaccata

SEQ ID NO: 3057418 - DNA, 17 bp, Homo sapiens
tgtgcagaccttactca

SEQ ID NO: 3057419 - DNA, 13 bp, Homo sapiens
tgtgcagcagatt

SEQ ID NO: 3057420 - DNA, 12 bp, Homo sapiens
tgtgcagctttt

SEQ ID NO: 3057421 - DNA, 16 bp, Homo sapiens
tgtgcagtgtttttcc

SEQ ID NO: 3057422 - DNA, 20 bp, Homo sapiens
tgtgcatgtatgtcttggac

SEQ ID NO: 3057423 - DNA, 20 bp, Homo sapiens
tgtgcatgtgcgtggaagtg

SEQ ID NO: 3057424 - DNA, 20 bp, Homo sapiens
tgtgccacaacgcctggcta

SEQ ID NO: 3057425 - DNA, 22 bp, Homo sapiens
tgtgccaggaggcggcagctct

SEQ ID NO: 3057426 - DNA, 18 bp, Homo sapiens
tgtgcccatcatctctgc

SEQ ID NO: 3057427 - DNA, 16 bp, Homo sapiens
tgtgccccgcgggctt

SEQ ID NO: 3057428 - DNA, 14 bp, Homo sapiens
tgtgcccttgattt

SEQ ID NO: 3057429 - DNA, 13 bp, Homo sapiens
tgtgcctccctct

SEQ ID NO: 3057430 - DNA, 16 bp, Homo sapiens
tgtgcctccctctcct

SEQ ID NO: 3057431 - DNA, 18 bp, Homo sapiens
tgtgcctcccttcccagt

SEQ ID NO: 3057432 - DNA, 15 bp, Homo sapiens
tgtgcctctgtcctt

SEQ ID NO: 3057433 - DNA, 18 bp, Homo sapiens
tgtgcctgtaatcttttt

SEQ ID NO: 3057434 - DNA, 22 bp, Homo sapiens
tgtgcctgtaatctttttctcc

SEQ ID NO: 3057435 - DNA, 16 bp, Homo sapiens
tgtgcctgtctgtcca

SEQ ID NO: 3057436 - DNA, 16 bp, Homo sapiens
tgtgccttcttttgat

SEQ ID NO: 3057437 - DNA, 16 bp, Homo sapiens
tgtgccttggtctctc

SEQ ID NO: 3057438 - DNA, 17 bp, Homo sapiens
tgtgccttgtcacgcca

SEQ ID NO: 3057439 - DNA, 12 bp, Homo sapiens
tgtgccttgttc

SEQ ID NO: 3057440 - DNA, 14 bp, Homo sapiens
tgtgcctttcctat

SEQ ID NO: 3057441 - DNA, 15 bp, Homo sapiens
tgtgcgctgcctggc

SEQ ID NO: 3057442 - DNA, 22 bp, Homo sapiens
tgtgcgctgcctggccaggccc

SEQ ID NO: 3057443 - DNA, 16 bp, Homo sapiens
tgtgcgtggaagtgtt

SEQ ID NO: 3057444 - DNA, 21 bp, Homo sapiens
tgtgcgtggaagtgttcctgt

SEQ ID NO: 3057445 - DNA, 17 bp, Homo sapiens
tgtgcgtggtccgtgtg

SEQ ID NO: 3057446 - DNA, 17 bp, Homo sapiens
tgtgcgtgtatatgtgc

SEQ ID NO: 3057447 - DNA, 14 bp, Homo sapiens
tgtgcgttcccttc

SEQ ID NO: 3057448 - DNA, 20 bp, Homo sapiens
tgtgctacagaaaataatct

SEQ ID NO: 3057449 - DNA, 15 bp, Homo sapiens
tgtgctacagagaaa

SEQ ID NO: 3057450 - DNA, 20 bp, Homo sapiens
tgtgctacagagaaaatcaa

SEQ ID NO: 3057451 - DNA, 16 bp, Homo sapiens
tgtgctaccagagtta

SEQ ID NO: 3057452 - DNA, 21 bp, Homo sapiens
tgtgctaccagagttaaagca

SEQ ID NO: 3057453 - DNA, 19 bp, Homo sapiens
tgtgctacgtgtgaaatct

SEQ ID NO: 3057454 - DNA, 17 bp, Homo sapiens
tgtgctactgattgttt

SEQ ID NO: 3057455 - DNA, 17 bp, Homo sapiens
tgtgctatagtatttga

SEQ ID NO: 3057456 - DNA, 15 bp, Homo sapiens
tgtgctatgaatttt

SEQ ID NO: 3057457 - DNA, 17 bp, Homo sapiens
tgtgctcagtcgccctg

SEQ ID NO: 3057458 - DNA, 18 bp, Homo sapiens
tgtgctcagtcgccctgt

SEQ ID NO: 3057459 - DNA, 19 bp, Homo sapiens
tgtgctcagtcgccctgtt

SEQ ID NO: 3057460 - DNA, 16 bp, Homo sapiens
tgtgctcatgtttgga

SEQ ID NO: 3057461 - DNA, 17 bp, Homo sapiens
tgtgctccatagagcag

SEQ ID NO: 3057462 - DNA, 13 bp, Homo sapiens
tgtgctcccacgg

SEQ ID NO: 3057463 - DNA, 14 bp, Homo sapiens
tgtgctctccaagc

SEQ ID NO: 3057464 - DNA, 15 bp, Homo sapiens
tgtgctgaagacatg

SEQ ID NO: 3057465 - DNA, 12 bp, Homo sapiens
tgtgctgccctg

SEQ ID NO: 3057466 - DNA, 20 bp, Homo sapiens
tgtgctggagccctgttcct

SEQ ID NO: 3057467 - DNA, 12 bp, Homo sapiens
tgtgctgtaatt

SEQ ID NO: 3057468 - DNA, 14 bp, Homo sapiens
tgtgctgtgtaaag

SEQ ID NO: 3057469 - DNA, 15 bp, Homo sapiens
tgtgctgtgtaaagt

SEQ ID NO: 3057470 - DNA, 13 bp, Homo sapiens
tgtggaaaacaga

SEQ ID NO: 3057471 - DNA, 19 bp, Homo sapiens
tgtggaaaagccaagaggc

SEQ ID NO: 3057472 - DNA, 21 bp, Homo sapiens
tgtggaaaagccaagaggctg

SEQ ID NO: 3057473 - DNA, 23 bp, Homo sapiens
tgtggaaaagccaagaggctgca

SEQ ID NO: 3057474 - DNA, 22 bp, Homo sapiens
tgtggaaaagccatctcaggtt

SEQ ID NO: 3057475 - DNA, 14 bp, Homo sapiens
tgtggaaagtgtaa

SEQ ID NO: 3057476 - DNA, 19 bp, Homo sapiens
tgtggaaagtgtaaagcat

SEQ ID NO: 3057477 - DNA, 20 bp, Homo sapiens
tgtggaaagtgtaaagcatt

SEQ ID NO: 3057478 - DNA, 21 bp, Homo sapiens
tgtggaaagtgtaaagcattc

SEQ ID NO: 3057479 - DNA, 14 bp, Homo sapiens
tgtggacaggatga

SEQ ID NO: 3057480 - DNA, 17 bp, Homo sapiens
tgtggaccactgcatga

SEQ ID NO: 3057481 - DNA, 14 bp, Homo sapiens
tgtcttctctccac

SEQ ID NO: 3057482 - DNA, 22 bp, Homo sapiens
tgtcttctgtatataaatggga

SEQ ID NO: 3057483 - DNA, 12 bp, Homo sapiens
tgtcttgaaaaa

SEQ ID NO: 3057484 - DNA, 16 bp, Homo sapiens
tgtcttgaaaaaaaat

SEQ ID NO: 3057485 - DNA, 20 bp, Homo sapiens
tgtcttgaaaaaaaatagat

SEQ ID NO: 3057486 - DNA, 21 bp, Homo sapiens
tgtcttgaaaaaaaatagatg

SEQ ID NO: 3057487 - DNA, 19 bp, Homo sapiens
tgtcttgaaagattcaggt

SEQ ID NO: 3057488 - DNA, 20 bp, Homo sapiens
tgtcttgctgttgacatatt

SEQ ID NO: 3057489 - DNA, 19 bp, Homo sapiens
tgtcttggacactgtacaa

SEQ ID NO: 3057490 - DNA, 17 bp, Homo sapiens
tgtcttgtacatgtgta

SEQ ID NO: 3057491 - DNA, 20 bp, Homo sapiens
tgtcttgtacatgtgtagcc

SEQ ID NO: 3057492 - DNA, 14 bp, Homo sapiens
tgtcttgtgtattt

SEQ ID NO: 3057493 - DNA, 14 bp, Homo sapiens
tgtcttgttctgtc

SEQ ID NO: 3057494 - DNA, 15 bp, Homo sapiens
tgtcttgttctgtca

SEQ ID NO: 3057495 - DNA, 18 bp, Homo sapiens
tgtcttgttctgtcactc

SEQ ID NO: 3057496 - DNA, 15 bp, Homo sapiens
tgtctttctgagcac

SEQ ID NO: 3057497 - DNA, 14 bp, Homo sapiens
tgtctttctttgct

SEQ ID NO: 3057498 - DNA, 22 bp, Homo sapiens
tgtctttgcggggcctgtctca

SEQ ID NO: 3057499 - DNA, 13 bp, Homo sapiens
tgtctttgtggac

SEQ ID NO: 3057500 - DNA, 19 bp, Homo sapiens
tgtcttttaaaaaacaaaa

SEQ ID NO: 3057501 - DNA, 16 bp, Homo sapiens
tgtcttttaaaatgca

SEQ ID NO: 3057502 - DNA, 12 bp, Homo sapiens
tgtcttttgaca

SEQ ID NO: 3057503 - DNA, 12 bp, Homo sapiens
tgtctttttcat

SEQ ID NO: 3057504 - DNA, 22 bp, Homo sapiens
tgtctttttcatttttttctct

SEQ ID NO: 3057505 - DNA, 13 bp, Homo sapiens
tgtctttttcctt

SEQ ID NO: 3057506 - DNA, 19 bp, Homo sapiens
tgtctttttccttcctgag

SEQ ID NO: 3057507 - DNA, 15 bp, Homo sapiens
tgtctttttcttacc

SEQ ID NO: 3057508 - DNA, 15 bp, Homo sapiens
tgtctttttgttgta

SEQ ID NO: 3057509 - DNA, 16 bp, Homo sapiens
tgtcttttttttcatc

SEQ ID NO: 3057510 - DNA, 18 bp, Homo sapiens
tgtcttttttttcatcct

SEQ ID NO: 3057511 - DNA, 14 bp, Homo sapiens
tgtgaaaaaaataa

SEQ ID NO: 3057512 - DNA, 18 bp, Homo sapiens
tgtgaaaatatctgctca

SEQ ID NO: 3057513 - DNA, 22 bp, Homo sapiens
tgtgaaaatggtccaggagaag

SEQ ID NO: 3057514 - DNA, 21 bp, Homo sapiens
tgtgaaatagttcaaagccaa

SEQ ID NO: 3057515 - DNA, 10 bp, Homo sapiens
tgtgaaattt

SEQ ID NO: 3057516 - DNA, 20 bp, Homo sapiens
tgtgaacaaaagatgctctt

SEQ ID NO: 3057517 - DNA, 15 bp, Homo sapiens
tgtgaacagcggctg

SEQ ID NO: 3057518 - DNA, 16 bp, Homo sapiens
tgtgaaccaaccccca

SEQ ID NO: 3057519 - DNA, 16 bp, Homo sapiens
tgtgaactcagccaag

SEQ ID NO: 3057520 - DNA, 19 bp, Homo sapiens
tgtgaactcagccaagcac

SEQ ID NO: 3057521 - DNA, 20 bp, Homo sapiens
tgtgaactctcccctcccca

SEQ ID NO: 3057522 - DNA, 19 bp, Homo sapiens
tgtgaactgactttaagta

SEQ ID NO: 3057523 - DNA, 17 bp, Homo sapiens
tgtgaagaagccctgtt

SEQ ID NO: 3057524 - DNA, 18 bp, Homo sapiens
tgtgaagaagccctgttc

SEQ ID NO: 3057525 - DNA, 14 bp, Homo sapiens
tgtgaagacatttt

SEQ ID NO: 3057526 - DNA, 19 bp, Homo sapiens
tgtgaagacattttttgct

SEQ ID NO: 3057527 - DNA, 12 bp, Homo sapiens
tgtgaagcattc

SEQ ID NO: 3057528 - DNA, 20 bp, Homo sapiens
tgtgaagccaattcagacag

SEQ ID NO: 3057529 - DNA, 19 bp, Homo sapiens
tgtgaagccctttgcctgt

SEQ ID NO: 3057530 - DNA, 14 bp, Homo sapiens
tgtgaaggaccctt

SEQ ID NO: 3057531 - DNA, 23 bp, Homo sapiens
tgtgaaggcagagaaagggacaa

SEQ ID NO: 3057532 - DNA, 18 bp, Homo sapiens
tgtgaagtgttaatacta

SEQ ID NO: 3057533 - DNA, 20 bp, Homo sapiens
tgtgaagttacatgcataaa

SEQ ID NO: 3057534 - DNA, 21 bp, Homo sapiens
tgtgaagttacatgcataaaa

SEQ ID NO: 3057535 - DNA, 13 bp, Homo sapiens
tgtgaagttagaa

SEQ ID NO: 3057536 - DNA, 19 bp, Homo sapiens
tgtgaagtttggagataga

SEQ ID NO: 3057537 - DNA, 12 bp, Homo sapiens
tgtgaataaatt

SEQ ID NO: 3057538 - DNA, 18 bp, Homo sapiens
tgtcacatagtttttcct

SEQ ID NO: 3057539 - DNA, 15 bp, Homo sapiens
tgtcacatcaagcat

SEQ ID NO: 3057540 - DNA, 16 bp, Homo sapiens
tgtcaccaccttccca

SEQ ID NO: 3057541 - DNA, 18 bp, Homo sapiens
tgtcaccaccttcccagc

SEQ ID NO: 3057542 - DNA, 19 bp, Homo sapiens
tgtcaccaccttcccagct

SEQ ID NO: 3057543 - DNA, 21 bp, Homo sapiens
tgtcaccaccttcccagctct

SEQ ID NO: 3057544 - DNA, 14 bp, Homo sapiens
tgtcaccccagagc

SEQ ID NO: 3057545 - DNA, 16 bp, Homo sapiens
tgtcaccccagagcca

SEQ ID NO: 3057546 - DNA, 14 bp, Homo sapiens
tgtcacctgtgctt

SEQ ID NO: 3057547 - DNA, 14 bp, Homo sapiens
tgtcactcaaggcg

SEQ ID NO: 3057548 - DNA, 15 bp, Homo sapiens
tgtcactcattgctg

SEQ ID NO: 3057549 - DNA, 22 bp, Homo sapiens
tgtcactcattgctgagcctct

SEQ ID NO: 3057550 - DNA, 23 bp, Homo sapiens
tgtcactcattgctgagcctctg

SEQ ID NO: 3057551 - DNA, 18 bp, Homo sapiens
tgtcactgtccctcctgg

SEQ ID NO: 3057552 - DNA, 23 bp, Homo sapiens
tgtcacttggtggcggggtgggg

SEQ ID NO: 3057553 - DNA, 21 bp, Homo sapiens
tgtcagaactagaatttgatt

SEQ ID NO: 3057554 - DNA, 13 bp, Homo sapiens
tgtcagagcccag

SEQ ID NO: 3057555 - DNA, 16 bp, Homo sapiens
tgtcagatacaatgta

SEQ ID NO: 3057556 - DNA, 15 bp, Homo sapiens
tgtcagcaaatgtaa

SEQ ID NO: 3057557 - DNA, 12 bp, Homo sapiens
tgtcagcatcaa

SEQ ID NO: 3057558 - DNA, 11 bp, Homo sapiens
tgtcagcatct

SEQ ID NO: 3057559 - DNA, 15 bp, Homo sapiens
tgtcagcatctgacc

SEQ ID NO: 3057560 - DNA, 18 bp, Homo sapiens
tgtcagcatctgaccatc

SEQ ID NO: 3057561 - DNA, 20 bp, Homo sapiens
tgtcagcatctgaccatctg

SEQ ID NO: 3057562 - DNA, 16 bp, Homo sapiens
tgtcagcatgacaaaa

SEQ ID NO: 3057563 - DNA, 18 bp, Homo sapiens
tgtcagccacctccctct

SEQ ID NO: 3057564 - DNA, 23 bp, Homo sapiens
tgtcagcgttctaccaggcaaat

SEQ ID NO: 3057565 - DNA, 20 bp, Homo sapiens
tgtcagctctcatctgaggc

SEQ ID NO: 3057566 - DNA, 18 bp, Homo sapiens
tgtcagctgctgttgaac

SEQ ID NO: 3057567 - DNA, 20 bp, Homo sapiens
tgtcagctgctgttgaactt

SEQ ID NO: 3057568 - DNA, 21 bp, Homo sapiens
tgtcaggcccgtcggagctgc

SEQ ID NO: 3057569 - DNA, 22 bp, Homo sapiens
tgtcaggcccgtcggagctgcc

SEQ ID NO: 3057570 - DNA, 22 bp, Homo sapiens
tgtcaggccctctgcctgcact

SEQ ID NO: 3057571 - DNA, 21 bp, Homo sapiens
tgtcagggagggccagggagg

SEQ ID NO: 3057572 - DNA, 23 bp, Homo sapiens
tgtcagggagggccagggaggca

SEQ ID NO: 3057573 - DNA, 15 bp, Homo sapiens
tgtcaggtcccagcg

SEQ ID NO: 3057574 - DNA, 18 bp, Homo sapiens
tgtcaggtcccagcgagc

SEQ ID NO: 3057575 - DNA, 20 bp, Homo sapiens
tgtcagtaccttcaaactag

SEQ ID NO: 3057576 - DNA, 17 bp, Homo sapiens
tgtcagtactaaggtga

SEQ ID NO: 3057577 - DNA, 24 bp, Homo sapiens
tgtcagtactaaggtgactttctg

SEQ ID NO: 3057578 - DNA, 15 bp, Homo sapiens
tgtcagtcacagcca

SEQ ID NO: 3057579 - DNA, 17 bp, Homo sapiens
tgtcagtcacagccacc

SEQ ID NO: 3057580 - DNA, 18 bp, Homo sapiens
tgtcagtcacagccaccc

SEQ ID NO: 3057581 - DNA, 18 bp, Homo sapiens
tgtcagtggggctctctg

SEQ ID NO: 3057582 - DNA, 19 bp, Homo sapiens
tgtcagtggggctctctga

SEQ ID NO: 3057583 - DNA, 18 bp, Homo sapiens
tgtcatcagccaccatcc

SEQ ID NO: 3057584 - DNA, 13 bp, Homo sapiens
tgtcatctgctgc

SEQ ID NO: 3057585 - DNA, 13 bp, Homo sapiens
tgtcatgattggc

SEQ ID NO: 3057586 - DNA, 17 bp, Homo sapiens
tgtcatgtgtatgagaa

SEQ ID NO: 3057587 - DNA, 20 bp, Homo sapiens
tgtcatgtgtatgagaagta

SEQ ID NO: 3057588 - DNA, 14 bp, Homo sapiens
tgtcattattccat

SEQ ID NO: 3057589 - DNA, 16 bp, Homo sapiens
tgtcatttacacacgt

SEQ ID NO: 3057590 - DNA, 17 bp, Homo sapiens
tgtcatttatgtgtcag

SEQ ID NO: 3057591 - DNA, 16 bp, Homo sapiens
tgtcatttctcatgga

SEQ ID NO: 3057592 - DNA, 23 bp, Homo sapiens
tgtcattttggcatctgcaaagg

SEQ ID NO: 3057593 - DNA, 14 bp, Homo sapiens
tgtcatttttgaat

SEQ ID NO: 3057594 - DNA, 13 bp, Homo sapiens
tgtccaaacaggt

SEQ ID NO: 3057595 - DNA, 22 bp, Homo sapiens
tgtccaaacaggtgctggccca

SEQ ID NO: 3057596 - DNA, 15 bp, Homo sapiens
tgtccaaatttaatg

SEQ ID NO: 3057597 - DNA, 18 bp, Homo sapiens
tgtccaacccctccccca

SEQ ID NO: 3057598 - DNA, 19 bp, Homo sapiens
tgtccaacccctcccccac

SEQ ID NO: 3057599 - DNA, 20 bp, Homo sapiens
tgtccaacccctcccccacg

SEQ ID NO: 3057600 - DNA, 21 bp, Homo sapiens
tgtccaacccctcccccacgt

SEQ ID NO: 3057601 - DNA, 15 bp, Homo sapiens
tgtccaacctaaccc

SEQ ID NO: 3057602 - DNA, 22 bp, Homo sapiens
tgtccaactaaaaacaaaccct

SEQ ID NO: 3057603 - DNA, 19 bp, Homo sapiens
tgtccacatccccagagcc

SEQ ID NO: 3057604 - DNA, 11 bp, Homo sapiens
tgtccacctgg

SEQ ID NO: 3057605 - DNA, 12 bp, Homo sapiens
tgtccacctggc

SEQ ID NO: 3057606 - DNA, 18 bp, Homo sapiens
tgtccacgactgtctcca

SEQ ID NO: 3057607 - DNA, 12 bp, Homo sapiens
tgtccagcacct

SEQ ID NO: 3057608 - DNA, 19 bp, Homo sapiens
tgtccagcaccttgtgcct

SEQ ID NO: 3057609 - DNA, 22 bp, Homo sapiens
tgtccagcaccttgtgcctggg

SEQ ID NO: 3057610 - DNA, 15 bp, Homo sapiens
tgtccagcagtcact

SEQ ID NO: 3057611 - DNA, 20 bp, Homo sapiens
tgtccagcatggatgaaacc

SEQ ID NO: 3057612 - DNA, 14 bp, Homo sapiens
tgtccagcgcctag

SEQ ID NO: 3057613 - DNA, 11 bp, Homo sapiens
tgtccagctcc

SEQ ID NO: 3057614 - DNA, 16 bp, Homo sapiens
tgtccagctccaacct

SEQ ID NO: 3057615 - DNA, 22 bp, Homo sapiens
tgtccatcatattaaaaatata

SEQ ID NO: 3057616 - DNA, 17 bp, Homo sapiens
tgtccatcctgacctgc

SEQ ID NO: 3057617 - DNA, 13 bp, Homo sapiens
tgtccatctgccc

SEQ ID NO: 3057618 - DNA, 16 bp, Homo sapiens
tgtccatctgcccgcc

SEQ ID NO: 3057619 - DNA, 19 bp, Homo sapiens
tgtccatctgcccgcctgc

SEQ ID NO: 3057620 - DNA, 23 bp, Homo sapiens
tgtccatctgcccgcctgcccac

SEQ ID NO: 3057621 - DNA, 21 bp, Homo sapiens
tgtcccaaatccgccagtgtt

SEQ ID NO: 3057622 - DNA, 23 bp, Homo sapiens
tgtcccaagctcccaagagcttc

SEQ ID NO: 3057623 - DNA, 20 bp, Homo sapiens
tgtcccactcaagccaagca

SEQ ID NO: 3057624 - DNA, 22 bp, Homo sapiens
tgtcccacttctcatcttaaaa

SEQ ID NO: 3057625 - DNA, 17 bp, Homo sapiens
tgtcccagtagccaagg

SEQ ID NO: 3057626 - DNA, 17 bp, Homo sapiens
tgtcccccgtgcacggt

SEQ ID NO: 3057627 - DNA, 16 bp, Homo sapiens
tgtccccgccttccct

SEQ ID NO: 3057628 - DNA, 19 bp, Homo sapiens
tgtccccgccttccctcac

SEQ ID NO: 3057629 - DNA, 16 bp, Homo sapiens
tgtcccctcccagagc

SEQ ID NO: 3057630 - DNA, 20 bp, Homo sapiens
tgtcccctggggctggtgga

SEQ ID NO: 3057631 - DNA, 12 bp, Homo sapiens
tgtccctccggg

SEQ ID NO: 3057632 - DNA, 13 bp, Homo sapiens
tgtccctcctggt

SEQ ID NO: 3057633 - DNA, 16 bp, Homo sapiens
tgtccctcctggtgtc

SEQ ID NO: 3057634 - DNA, 21 bp, Homo sapiens
tgtccctctcagtgccttctc

SEQ ID NO: 3057635 - DNA, 12 bp, Homo sapiens
tgtccctgcctt

SEQ ID NO: 3057636 - DNA, 23 bp, Homo sapiens
tgtccctggggcactcccccagg

SEQ ID NO: 3057637 - DNA, 21 bp, Homo sapiens
tgtccctgtcaccaagctcac

SEQ ID NO: 3057638 - DNA, 18 bp, Homo sapiens
tgtccctttttgcagggg

SEQ ID NO: 3057639 - DNA, 14 bp, Homo sapiens
tgtccgtctgtctg

SEQ ID NO: 3057640 - DNA, 14 bp, Homo sapiens
tgtcctaattcttc

SEQ ID NO: 3057641 - DNA, 18 bp, Homo sapiens
tgtcctaattcttctgtc

SEQ ID NO: 3057642 - DNA, 20 bp, Homo sapiens
tgtcctaattcttctgtcct

SEQ ID NO: 3057643 - DNA, 13 bp, Homo sapiens
tgtcctatgaatg

SEQ ID NO: 3057644 - DNA, 21 bp, Homo sapiens
tgtcctatgaatgctttgcat

SEQ ID NO: 3057645 - DNA, 17 bp, Homo sapiens
tgtcctcaagaagaaag

SEQ ID NO: 3057646 - DNA, 20 bp, Homo sapiens
tgtcctcaccatgatggggc

SEQ ID NO: 3057647 - DNA, 19 bp, Homo sapiens
tgtcctcacgccccctgtg

SEQ ID NO: 3057648 - DNA, 23 bp, Homo sapiens
tgtcctcacgccccctgtgactt

SEQ ID NO: 3057649 - DNA, 12 bp, Homo sapiens
tgtcctcagcct

SEQ ID NO: 3057650 - DNA, 14 bp, Homo sapiens
tgtcctcaggtggc

SEQ ID NO: 3057651 - DNA, 16 bp, Homo sapiens
tgtcctcatttctcca

SEQ ID NO: 3057652 - DNA, 17 bp, Homo sapiens
tgtcctccaagccagcg

SEQ ID NO: 3057653 - DNA, 21 bp, Homo sapiens
tgtcctccctccctcccttcc

SEQ ID NO: 3057654 - DNA, 20 bp, Homo sapiens
tgtcctcggtttcccatttg

SEQ ID NO: 3057655 - DNA, 19 bp, Homo sapiens
tgtcctcttctgcatcttg

SEQ ID NO: 3057656 - DNA, 13 bp, Homo sapiens
tgtcctgaagctg

SEQ ID NO: 3057657 - DNA, 20 bp, Homo sapiens
tgtcctgaagctgctggagc

SEQ ID NO: 3057658 - DNA, 19 bp, Homo sapiens
tgtcctgaatggctttgtc

SEQ ID NO: 3057659 - DNA, 21 bp, Homo sapiens
tgtcctgaatggctttgtctt

SEQ ID NO: 3057660 - DNA, 24 bp, Homo sapiens
tgtcctgtagttgcgtggactctg

SEQ ID NO: 3057661 - DNA, 13 bp, Homo sapiens
tgtcctgtgaggt

SEQ ID NO: 3057662 - DNA, 21 bp, Homo sapiens
tgtcctgtgaggtttcccaat

SEQ ID NO: 3057663 - DNA, 23 bp, Homo sapiens
tgtcctgttaggccaactgcctc

SEQ ID NO: 3057664 - DNA, 15 bp, Homo sapiens
tgtccttaaaatgtg

SEQ ID NO: 3057665 - DNA, 23 bp, Homo sapiens
tgtccttcacggcactggatccc

SEQ ID NO: 3057666 - DNA, 13 bp, Homo sapiens
tgtccttgcacct

SEQ ID NO: 3057667 - DNA, 15 bp, Homo sapiens
tgtccttgcacctgc

SEQ ID NO: 3057668 - DNA, 16 bp, Homo sapiens
tgtcctttaaaaaaga

SEQ ID NO: 3057669 - DNA, 15 bp, Homo sapiens
tgtcctttccatctg

SEQ ID NO: 3057670 - DNA, 14 bp, Homo sapiens
tgtcctttctagag

SEQ ID NO: 3057671 - DNA, 18 bp, Homo sapiens
tgtcctttctagagcact

SEQ ID NO: 3057672 - DNA, 16 bp, Homo sapiens
tgtcctttttgttatt

SEQ ID NO: 3057673 - DNA, 17 bp, Homo sapiens
tgtcgagagctggccaa

SEQ ID NO: 3057674 - DNA, 12 bp, Homo sapiens
ttacttaggact

SEQ ID NO: 3057675 - DNA, 17 bp, Homo sapiens
ttacttcccccaccctg

SEQ ID NO: 3057676 - DNA, 16 bp, Homo sapiens
ttacttctaatcttaa

SEQ ID NO: 3057677 - DNA, 17 bp, Homo sapiens
ttacttctaatcttaaa

SEQ ID NO: 3057678 - DNA, 18 bp, Homo sapiens
ttacttctaatcttaaat

SEQ ID NO: 3057679 - DNA, 13 bp, Homo sapiens
ttacttgaaagat

SEQ ID NO: 3057680 - DNA, 12 bp, Homo sapiens
ttacttgaagta

SEQ ID NO: 3057681 - DNA, 13 bp, Homo sapiens
ttacttgaagtaa

SEQ ID NO: 3057682 - DNA, 15 bp, Homo sapiens
ttacttgcttctgct

SEQ ID NO: 3057683 - DNA, 18 bp, Homo sapiens
ttacttggtgtaattaat

SEQ ID NO: 3057684 - DNA, 18 bp, Homo sapiens
ttacttgtaaataaagtc

SEQ ID NO: 3057685 - DNA, 17 bp, Homo sapiens
ttacttgttcatttctg

SEQ ID NO: 3057686 - DNA, 13 bp, Homo sapiens
ttactttcagttt

SEQ ID NO: 3057687 - DNA, 15 bp, Homo sapiens
ttactttcttaatgt

SEQ ID NO: 3057688 - DNA, 11 bp, Homo sapiens
ttactttgaat

SEQ ID NO: 3057689 - DNA, 16 bp, Homo sapiens
ttactttgaatagtcc

SEQ ID NO: 3057690 - DNA, 22 bp, Homo sapiens
ttactttgttttaaaaagcatc

SEQ ID NO: 3057691 - DNA, 13 bp, Homo sapiens
ttacttttttaca

SEQ ID NO: 3057692 - DNA, 15 bp, Homo sapiens
ttacttttttacact

SEQ ID NO: 3057693 - DNA, 14 bp, Homo sapiens
ttagaaaaagaaca

SEQ ID NO: 3057694 - DNA, 18 bp, Homo sapiens
ttagaacaattttcttgt

SEQ ID NO: 3057695 - DNA, 20 bp, Homo sapiens
ttagaaccaccaaaattata

SEQ ID NO: 3057696 - DNA, 19 bp, Homo sapiens
ttagaacccttctgctttc

SEQ ID NO: 3057697 - DNA, 20 bp, Homo sapiens
ttagaacccttctgctttct

SEQ ID NO: 3057698 - DNA, 19 bp, Homo sapiens
ttagaacgagcctggaagc

SEQ ID NO: 3057699 - DNA, 20 bp, Homo sapiens
ttagaacgagcctggaagca

SEQ ID NO: 3057700 - DNA, 21 bp, Homo sapiens
ttagaactttgcatagcagct

SEQ ID NO: 3057701 - DNA, 17 bp, Homo sapiens
ttagaatagtgtcagtt

SEQ ID NO: 3057702 - DNA, 18 bp, Homo sapiens
ttagaattccttcagggt

SEQ ID NO: 3057703 - DNA, 15 bp, Homo sapiens
ttagacaaatactca

SEQ ID NO: 3057704 - DNA, 18 bp, Homo sapiens
ttagacaaatactcatgt

SEQ ID NO: 3057705 - DNA, 20 bp, Homo sapiens
ttagacaaatactcatgtgt

SEQ ID NO: 3057706 - DNA, 21 bp, Homo sapiens
ttagacaaatactcatgtgta

SEQ ID NO: 3057707 - DNA, 23 bp, Homo sapiens
ttagacaaatactcatgtgtatg

SEQ ID NO: 3057708 - DNA, 19 bp, Homo sapiens
ttagacactacaacatatg

SEQ ID NO: 3057709 - DNA, 13 bp, Homo sapiens
ttagacactttta

SEQ ID NO: 3057710 - DNA, 15 bp, Homo sapiens
ttagacctgtagata

SEQ ID NO: 3057711 - DNA, 18 bp, Homo sapiens
ttagactaaggccattat

SEQ ID NO: 3057712 - DNA, 21 bp, Homo sapiens
ttagactggaacttgaactga

SEQ ID NO: 3057713 - DNA, 12 bp, Homo sapiens
ttagagaaaata

SEQ ID NO: 3057714 - DNA, 16 bp, Homo sapiens
ttagagaatgagaaat

SEQ ID NO: 3057715 - DNA, 12 bp, Homo sapiens
ttagagcattaa

SEQ ID NO: 3057716 - DNA, 17 bp, Homo sapiens
ttagagcattaaaataa

SEQ ID NO: 3057717 - DNA, 15 bp, Homo sapiens
ttagaggaaaatgag

SEQ ID NO: 3057718 - DNA, 20 bp, Homo sapiens
ttagagtcctagttttccta

SEQ ID NO: 3057719 - DNA, 16 bp, Homo sapiens
ttagagtgtctttcca

SEQ ID NO: 3057720 - DNA, 19 bp, Homo sapiens
ttagataatcttttacatt

SEQ ID NO: 3057721 - DNA, 12 bp, Homo sapiens
ttagatattaaa

SEQ ID NO: 3057722 - DNA, 13 bp, Homo sapiens
ttagatattaaaa

SEQ ID NO: 3057723 - DNA, 15 bp, Homo sapiens
ttagatatttcatgt

SEQ ID NO: 3057724 - DNA, 16 bp, Homo sapiens
ttagatggattctcca

SEQ ID NO: 3057725 - DNA, 13 bp, Homo sapiens
ttagatgtgattt

SEQ ID NO: 3057726 - DNA, 20 bp, Homo sapiens
ttagatgtgatttaatagtg

SEQ ID NO: 3057727 - DNA, 13 bp, Homo sapiens
ttagatgttctaa

SEQ ID NO: 3057728 - DNA, 22 bp, Homo sapiens
ttagatgttgccatgtgtttta

SEQ ID NO: 3057729 - DNA, 18 bp, Homo sapiens
ttagatgtttatatcaaa

SEQ ID NO: 3057730 - DNA, 17 bp, Homo sapiens
ttagattggttctgttt

SEQ ID NO: 3057731 - DNA, 15 bp, Homo sapiens
ttagatttattagat

SEQ ID NO: 3057732 - DNA, 18 bp, Homo sapiens
ttagattttctggttcta

SEQ ID NO: 3057733 - DNA, 15 bp, Homo sapiens
ttagattttctgtaa

SEQ ID NO: 3057734 - DNA, 20 bp, Homo sapiens
ttagcaagaatcattttgtg

SEQ ID NO: 3057735 - DNA, 18 bp, Homo sapiens
ttagcaatgctgtgaata

SEQ ID NO: 3057736 - DNA, 12 bp, Homo sapiens
ttagcagacagg

SEQ ID NO: 3057737 - DNA, 20 bp, Homo sapiens
ttagcaggagaggagagcca

SEQ ID NO: 3057738 - DNA, 13 bp, Homo sapiens
ttagcataaattt

SEQ ID NO: 3057739 - DNA, 16 bp, Homo sapiens
ttagcatccaggctgg

SEQ ID NO: 3057740 - DNA, 17 bp, Homo sapiens
ttagccagatttgtctt

SEQ ID NO: 3057741 - DNA, 21 bp, Homo sapiens
ttagccgggcatgatggtgca

SEQ ID NO: 3057742 - DNA, 19 bp, Homo sapiens
ttagccgggcatggtggca

SEQ ID NO: 3057743 - DNA, 20 bp, Homo sapiens
ttagcctcaatttctgaaca

SEQ ID NO: 3057744 - DNA, 18 bp, Homo sapiens
ttagccttgctgtagaga

SEQ ID NO: 3057745 - DNA, 16 bp, Homo sapiens
ttagcgctctggacag

SEQ ID NO: 3057746 - DNA, 15 bp, Homo sapiens
ttagctactgtatgc

SEQ ID NO: 3057747 - DNA, 18 bp, Homo sapiens
ttagctactgtatgcaaa

SEQ ID NO: 3057748 - DNA, 20 bp, Homo sapiens
ttagctgaggctgagaaagc

SEQ ID NO: 3057749 - DNA, 13 bp, Homo sapiens
ttagcttcaggaa

SEQ ID NO: 3057750 - DNA, 19 bp, Homo sapiens
ttaggaagtcacagattct

SEQ ID NO: 3057751 - DNA, 16 bp, Homo sapiens
ttaggaatactgtttt

SEQ ID NO: 3057752 - DNA, 16 bp, Homo sapiens
ttaggagaagccagga

SEQ ID NO: 3057753 - DNA, 16 bp, Homo sapiens
ttaggagctaaggctc

SEQ ID NO: 3057754 - DNA, 15 bp, Homo sapiens
ttaggatggcaggac

SEQ ID NO: 3057755 - DNA, 14 bp, Homo sapiens
ttaggcaaaaataa

SEQ ID NO: 3057756 - DNA, 16 bp, Homo sapiens
ttaggcagactcttta

SEQ ID NO: 3057757 - DNA, 16 bp, Homo sapiens
ttaggcctttttcaac

SEQ ID NO: 3057758 - DNA, 13 bp, Homo sapiens
ttaggctgtaaag

SEQ ID NO: 3057759 - DNA, 14 bp, Homo sapiens
ttaggctttcagct

SEQ ID NO: 3057760 - DNA, 21 bp, Homo sapiens
ttagggatagtactaagcatt

SEQ ID NO: 3057761 - DNA, 16 bp, Homo sapiens
ttagggggtgggaggg

SEQ ID NO: 3057762 - DNA, 17 bp, Homo sapiens
ttagggttttgcaataa

SEQ ID NO: 3057763 - DNA, 16 bp, Homo sapiens
ttaggtctctgttgac

SEQ ID NO: 3057764 - DNA, 13 bp, Homo sapiens
ttaggtcttcctg

SEQ ID NO: 3057765 - DNA, 16 bp, Homo sapiens
ttaggtcttcctgtgg

SEQ ID NO: 3057766 - DNA, 12 bp, Homo sapiens
ttaggttataag

SEQ ID NO: 3057767 - DNA, 13 bp, Homo sapiens
ttagtaaatacat

SEQ ID NO: 3057768 - DNA, 20 bp, Homo sapiens
ttagtaaatacatcactgta

SEQ ID NO: 3057769 - DNA, 13 bp, Homo sapiens
ttagtaaatgtta

SEQ ID NO: 3057770 - DNA, 16 bp, Homo sapiens
ttagtaacatcatttt

SEQ ID NO: 3057771 - DNA, 23 bp, Homo sapiens
ttagtaacatgtgttaagtattt

SEQ ID NO: 3057772 - DNA, 20 bp, Homo sapiens
ttagtaacctttaaaaatgt

SEQ ID NO: 3057773 - DNA, 22 bp, Homo sapiens
ttagtaacctttaaaaatgtat

SEQ ID NO: 3057774 - DNA, 20 bp, Homo sapiens
ttagtaatgctacgtgtgat

SEQ ID NO: 3057775 - DNA, 22 bp, Homo sapiens
ttagtaatgctacgtgtgattt

SEQ ID NO: 3057776 - DNA, 17 bp, Homo sapiens
ttagtaatttctttttt

SEQ ID NO: 3057777 - DNA, 13 bp, Homo sapiens
ttagtagaactta

SEQ ID NO: 3057778 - DNA, 20 bp, Homo sapiens
ttagtataatatttcttaat

SEQ ID NO: 3057779 - DNA, 21 bp, Homo sapiens
ttagtataatatttcttaatt

SEQ ID NO: 3057780 - DNA, 23 bp, Homo sapiens
ttagtatatgaaatattttgaat

SEQ ID NO: 3057781 - DNA, 20 bp, Homo sapiens
ttagtcaaatatttattgga

SEQ ID NO: 3057782 - DNA, 16 bp, Homo sapiens
ttagtcaataaacttg

SEQ ID NO: 3057783 - DNA, 22 bp, Homo sapiens
ttagtcacctaaccctctgtca

SEQ ID NO: 3057784 - DNA, 23 bp, Homo sapiens
ttagtcacctaaccctctgtcac

SEQ ID NO: 3057785 - DNA, 13 bp, Homo sapiens
ttagtcacttttt

SEQ ID NO: 3057786 - DNA, 20 bp, Homo sapiens
ttagtcattattattacttt

SEQ ID NO: 3057787 - DNA, 19 bp, Homo sapiens
ttagtctactcttaagcca

SEQ ID NO: 3057788 - DNA, 21 bp, Homo sapiens
ttagtctactcttaagccatc

SEQ ID NO: 3057789 - DNA, 18 bp, Homo sapiens
ttagtctctaaagagttt

SEQ ID NO: 3057790 - DNA, 14 bp, Homo sapiens
ttagtctctttatt

SEQ ID NO: 3057791 - DNA, 17 bp, Homo sapiens
ttagtctctttattcct

SEQ ID NO: 3057792 - DNA, 15 bp, Homo sapiens
ttagtgacatttaat

SEQ ID NO: 3057793 - DNA, 16 bp, Homo sapiens
ttagtgatatttctct

SEQ ID NO: 3057794 - DNA, 19 bp, Homo sapiens
ttagtgatatttctctagt

SEQ ID NO: 3057795 - DNA, 15 bp, Homo sapiens
ttagtgattgctttt

SEQ ID NO: 3057796 - DNA, 14 bp, Homo sapiens
ttagtgcatctttg

SEQ ID NO: 3057797 - DNA, 20 bp, Homo sapiens
ttagtggacttgttttaatt

SEQ ID NO: 3057798 - DNA, 12 bp, Homo sapiens
ttagtgtatttt

SEQ ID NO: 3057799 - DNA, 17 bp, Homo sapiens
ttagtgtttctgtgcat

SEQ ID NO: 3057800 - DNA, 12 bp, Homo sapiens
ttagttaatctc

SEQ ID NO: 3057801 - DNA, 16 bp, Homo sapiens
ttagttagaattggaa

SEQ ID NO: 3057802 - DNA, 22 bp, Homo sapiens
ttagttgcttgctaatatttcc

SEQ ID NO: 3057803 - DNA, 14 bp, Homo sapiens
ttagtttagtgtgt

SEQ ID NO: 3057804 - DNA, 17 bp, Homo sapiens
ttagtttcaagagtcta

SEQ ID NO: 3057805 - DNA, 21 bp, Homo sapiens
ttagtttcaagagtctaaacc

SEQ ID NO: 3057806 - DNA, 15 bp, Homo sapiens
ttagtttctgttctg

SEQ ID NO: 3057807 - DNA, 17 bp, Homo sapiens
ttatgtatcagaagaga

SEQ ID NO: 3057808 - DNA, 20 bp, Homo sapiens
ttatgtatgtaaatagattt

SEQ ID NO: 3057809 - DNA, 16 bp, Homo sapiens
ttatgtggttttagat

SEQ ID NO: 3057810 - DNA, 18 bp, Homo sapiens
ttatgtggttttagattt

SEQ ID NO: 3057811 - DNA, 16 bp, Homo sapiens
ttatgtgtctggaaga

SEQ ID NO: 3057812 - DNA, 17 bp, Homo sapiens
ttatgttaaatcaataa

SEQ ID NO: 3057813 - DNA, 17 bp, Homo sapiens
ttattaaagttctgtaa

SEQ ID NO: 3057814 - DNA, 11 bp, Homo sapiens
ttattaaatag

SEQ ID NO: 3057815 - DNA, 18 bp, Homo sapiens
ttattaaatcgtttaatg

SEQ ID NO: 3057816 - DNA, 22 bp, Homo sapiens
ttattaaatcgtttaatgttta

SEQ ID NO: 3057817 - DNA, 13 bp, Homo sapiens
ttattaatagaat

SEQ ID NO: 3057818 - DNA, 14 bp, Homo sapiens
ttattaattgcttt

SEQ ID NO: 3057819 - DNA, 18 bp, Homo sapiens
ttattaatttttaaggat

SEQ ID NO: 3057820 - DNA, 15 bp, Homo sapiens
ttattacataactga

SEQ ID NO: 3057821 - DNA, 18 bp, Homo sapiens
ttattacatgtaatttga

SEQ ID NO: 3057822 - DNA, 13 bp, Homo sapiens
ttattacatttaa

SEQ ID NO: 3057823 - DNA, 22 bp, Homo sapiens
ttattaccccctccttcagaca

SEQ ID NO: 3057824 - DNA, 14 bp, Homo sapiens
ttattactttttaa

SEQ ID NO: 3057825 - DNA, 21 bp, Homo sapiens
ttattagagattacctcctga

SEQ ID NO: 3057826 - DNA, 17 bp, Homo sapiens
ttattagagtgtctttc

SEQ ID NO: 3057827 - DNA, 22 bp, Homo sapiens
ttattagccaggtaatgtgaat

SEQ ID NO: 3057828 - DNA, 22 bp, Homo sapiens
ttattagccagtgaaacacttg

SEQ ID NO: 3057829 - DNA, 13 bp, Homo sapiens
ttattataaatgt

SEQ ID NO: 3057830 - DNA, 14 bp, Homo sapiens
ttattataaatgtt

SEQ ID NO: 3057831 - DNA, 14 bp, Homo sapiens
ttattataaattct

SEQ ID NO: 3057832 - DNA, 14 bp, Homo sapiens
ttattatgaagaat

SEQ ID NO: 3057833 - DNA, 19 bp, Homo sapiens
ttattatgaagaattgcca

SEQ ID NO: 3057834 - DNA, 14 bp, Homo sapiens
ttattattgttaat

SEQ ID NO: 3057835 - DNA, 16 bp, Homo sapiens
ttattattttccttcc

SEQ ID NO: 3057836 - DNA, 12 bp, Homo sapiens
ttattcaaacta

SEQ ID NO: 3057837 - DNA, 23 bp, Homo sapiens
ttattcaaactacctatattcct

SEQ ID NO: 3057838 - DNA, 17 bp, Homo sapiens
ttattcaaagcagctgt

SEQ ID NO: 3057839 - DNA, 18 bp, Homo sapiens
ttattcaaagcagctgta

SEQ ID NO: 3057840 - DNA, 14 bp, Homo sapiens
ttattcaaatgaag

SEQ ID NO: 3057841 - DNA, 23 bp, Homo sapiens
ttattcaagaatgccagtagaaa

SEQ ID NO: 3057842 - DNA, 18 bp, Homo sapiens
ttattccaaagagtgtgg

SEQ ID NO: 3057843 - DNA, 20 bp, Homo sapiens
ttattccagaatgctgtaca

SEQ ID NO: 3057844 - DNA, 15 bp, Homo sapiens
ttattcctgtatgtt

SEQ ID NO: 3057845 - DNA, 15 bp, Homo sapiens
ttattctctgtttgc

SEQ ID NO: 3057846 - DNA, 13 bp, Homo sapiens
ttattcttctaga

SEQ ID NO: 3057847 - DNA, 14 bp, Homo sapiens
ttattgacacagaa

SEQ ID NO: 3057848 - DNA, 18 bp, Homo sapiens
ttattgatctttgcccat

SEQ ID NO: 3057849 - DNA, 16 bp, Homo sapiens
ttattgcagtttatca

SEQ ID NO: 3057850 - DNA, 18 bp, Homo sapiens
ttattgcagtttatcatt

SEQ ID NO: 3057851 - DNA, 17 bp, Homo sapiens
ttattgccctaagtgat

SEQ ID NO: 3057852 - DNA, 18 bp, Homo sapiens
ttattgcctgggcagtgc

SEQ ID NO: 3057853 - DNA, 12 bp, Homo sapiens
ttattgccttct

SEQ ID NO: 3057854 - DNA, 14 bp, Homo sapiens
ttattggaaatgtg

SEQ ID NO: 3057855 - DNA, 20 bp, Homo sapiens
ttattggatgatacagtgtt

SEQ ID NO: 3057856 - DNA, 13 bp, Homo sapiens
ttattgtatattg

SEQ ID NO: 3057857 - DNA, 20 bp, Homo sapiens
ttattgtggataacaaagat

SEQ ID NO: 3057858 - DNA, 17 bp, Homo sapiens
ttattgtgtgcgctgcc

SEQ ID NO: 3057859 - DNA, 14 bp, Homo sapiens
ttatttaaaagatt

SEQ ID NO: 3057860 - DNA, 15 bp, Homo sapiens
ttatttaaaagattc

SEQ ID NO: 3057861 - DNA, 16 bp, Homo sapiens
ttatttaaaagattca

SEQ ID NO: 3057862 - DNA, 19 bp, Homo sapiens
ttatttaaagaaagtgaaa

SEQ ID NO: 3057863 - DNA, 11 bp, Homo sapiens
ttatttaaatg

SEQ ID NO: 3057864 - DNA, 12 bp, Homo sapiens
ttatttaactct

SEQ ID NO: 3057865 - DNA, 15 bp, Homo sapiens
ttatttacagatgaa

SEQ ID NO: 3057866 - DNA, 13 bp, Homo sapiens
ttatttagaaaaa

SEQ ID NO: 3057867 - DNA, 17 bp, Homo sapiens
ttatttagactcatctt

SEQ ID NO: 3057868 - DNA, 18 bp, Homo sapiens
ttatttagggaactgctt

SEQ ID NO: 3057869 - DNA, 20 bp, Homo sapiens
ttatttatatgaagcaagct

SEQ ID NO: 3057870 - DNA, 18 bp, Homo sapiens
ttatttatatgtactgtt

SEQ ID NO: 3057871 - DNA, 16 bp, Homo sapiens
ttatttatgtactttt

SEQ ID NO: 3057872 - DNA, 18 bp, Homo sapiens
ttatttcacaaataatag

SEQ ID NO: 3057873 - DNA, 13 bp, Homo sapiens
ttatttcattcat

SEQ ID NO: 3057874 - DNA, 19 bp, Homo sapiens
ttatttcccagtaattatt

SEQ ID NO: 3057875 - DNA, 18 bp, Homo sapiens
ttatttccccagccacag

SEQ ID NO: 3057876 - DNA, 15 bp, Homo sapiens
ttatttcctgattac

SEQ ID NO: 3057877 - DNA, 19 bp, Homo sapiens
ttatttctaggaagaattt

SEQ ID NO: 3057878 - DNA, 22 bp, Homo sapiens
ttatttctcagactttggaaaa

SEQ ID NO: 3057879 - DNA, 18 bp, Homo sapiens
ttatttctgagcaaagca

SEQ ID NO: 3057880 - DNA, 20 bp, Homo sapiens
ttatttctgcatatgttgaa

SEQ ID NO: 3057881 - DNA, 11 bp, Homo sapiens
ttatttgaaaa

SEQ ID NO: 3057882 - DNA, 14 bp, Homo sapiens
ttatttgaaaaaag

SEQ ID NO: 3057883 - DNA, 22 bp, Homo sapiens
ttatttgaaaacatataaagca

SEQ ID NO: 3057884 - DNA, 20 bp, Homo sapiens
ttatttgaatgaacactatg

SEQ ID NO: 3057885 - DNA, 12 bp, Homo sapiens
ttatttgtttga

SEQ ID NO: 3057886 - DNA, 13 bp, Homo sapiens
ttattttaaaaga

SEQ ID NO: 3057887 - DNA, 20 bp, Homo sapiens
ttattttaagcattgtgagt

SEQ ID NO: 3057888 - DNA, 16 bp, Homo sapiens
ttattttacacagaaa

SEQ ID NO: 3057889 - DNA, 15 bp, Homo sapiens
ttattttatatttga

SEQ ID NO: 3057890 - DNA, 12 bp, Homo sapiens
ttattttcaaga

SEQ ID NO: 3057891 - DNA, 13 bp, Homo sapiens
ttattttcaagag

SEQ ID NO: 3057892 - DNA, 15 bp, Homo sapiens
ttattttcagtgata

SEQ ID NO: 3057893 - DNA, 14 bp, Homo sapiens
ttattttccttcca

SEQ ID NO: 3057894 - DNA, 11 bp, Homo sapiens
ttattttgatg

SEQ ID NO: 3057895 - DNA, 15 bp, Homo sapiens
ttattttgctcttgt

SEQ ID NO: 3057896 - DNA, 17 bp, Homo sapiens
ttatttttaatttaaaa

SEQ ID NO: 3057897 - DNA, 18 bp, Homo sapiens
ttatttttatatacgttt

SEQ ID NO: 3057898 - DNA, 13 bp, Homo sapiens
ttatttttgcaaa

SEQ ID NO: 3057899 - DNA, 14 bp, Homo sapiens
ttatttttgcaaaa

SEQ ID NO: 3057900 - DNA, 21 bp, Homo sapiens
ttatttttgcaaaataagttt

SEQ ID NO: 3057901 - DNA, 17 bp, Homo sapiens
ttatttttttgatggct

SEQ ID NO: 3057902 - DNA, 11 bp, Homo sapiens
ttcaaaaactt

SEQ ID NO: 3057903 - DNA, 21 bp, Homo sapiens
ttcaaaaattacactacaagt

SEQ ID NO: 3057904 - DNA, 19 bp, Homo sapiens
ttcaaaacagttacttaag

SEQ ID NO: 3057905 - DNA, 22 bp, Homo sapiens
ttcaaaacagttacttaagatt

SEQ ID NO: 3057906 - DNA, 18 bp, Homo sapiens
ttcaaaacattgtgccat

SEQ ID NO: 3057907 - DNA, 16 bp, Homo sapiens
ttcaaaagtaatgcct

SEQ ID NO: 3057908 - DNA, 22 bp, Homo sapiens
ttcaaaagtaatgcctctgtct

SEQ ID NO: 3057909 - DNA, 12 bp, Homo sapiens
ttcaaaagttcc

SEQ ID NO: 3057910 - DNA, 14 bp, Homo sapiens
ttcaaaataaaaac

SEQ ID NO: 3057911 - DNA, 15 bp, Homo sapiens
ttcaaaatatttaaa

SEQ ID NO: 3057912 - DNA, 17 bp, Homo sapiens
ttcaaaatgctttttat

SEQ ID NO: 3057913 - DNA, 12 bp, Homo sapiens
ttcaaaattaat

SEQ ID NO: 3057914 - DNA, 18 bp, Homo sapiens
ttcaaaattctaaatgta

SEQ ID NO: 3057915 - DNA, 14 bp, Homo sapiens
ttcaaacacaaatg

SEQ ID NO: 3057916 - DNA, 15 bp, Homo sapiens
ttcaaacacaaatgc

SEQ ID NO: 3057917 - DNA, 17 bp, Homo sapiens
ttcaaacacaaatgcag

SEQ ID NO: 3057918 - DNA, 22 bp, Homo sapiens
ttcaaactacctatattccttg

SEQ ID NO: 3057919 - DNA, 20 bp, Homo sapiens
ttcaaactgctggaaatctc

SEQ ID NO: 3057920 - DNA, 22 bp, Homo sapiens
ttcaaacttttattagccagtg

SEQ ID NO: 3057921 - DNA, 17 bp, Homo sapiens
ttcaaagacaatcactg

SEQ ID NO: 3057922 - DNA, 17 bp, Homo sapiens
ttcaaagactgccacgt

SEQ ID NO: 3057923 - DNA, 21 bp, Homo sapiens
ttcaaagatgataatttagtg

SEQ ID NO: 3057924 - DNA, 23 bp, Homo sapiens
ttcaaagccaagtttatatacaa

SEQ ID NO: 3057925 - DNA, 18 bp, Homo sapiens
ttcaaagccatatggaca

SEQ ID NO: 3057926 - DNA, 13 bp, Homo sapiens
ttcaaagccctgc

SEQ ID NO: 3057927 - DNA, 21 bp, Homo sapiens
ttcaaagccctgcctctgtgt

SEQ ID NO: 3057928 - DNA, 22 bp, Homo sapiens
ttcaaagggacggtcagtttgg

SEQ ID NO: 3057929 - DNA, 21 bp, Homo sapiens
ttcaaaggttctaggtttcaa

SEQ ID NO: 3057930 - DNA, 21 bp, Homo sapiens
ttcaaatctgtaatcagcaat

SEQ ID NO: 3057931 - DNA, 13 bp, Homo sapiens
ttcaaattaaagt

SEQ ID NO: 3057932 - DNA, 21 bp, Homo sapiens
ttcaaattaaagtgctgttta

SEQ ID NO: 3057933 - DNA, 22 bp, Homo sapiens
ttcaaattcctatttttaaata

SEQ ID NO: 3057934 - DNA, 12 bp, Homo sapiens
ttcaaattctct

SEQ ID NO: 3057935 - DNA, 11 bp, Homo sapiens
ttcaaatttag

SEQ ID NO: 3057936 - DNA, 14 bp, Homo sapiens
ttcaacaaacagtg

SEQ ID NO: 3057937 - DNA, 23 bp, Homo sapiens
ttcaacagaccccctctagaaat

SEQ ID NO: 3057938 - DNA, 21 bp, Homo sapiens
ttcaactgccaaaatgctcta

SEQ ID NO: 3057939 - DNA, 19 bp, Homo sapiens
ttcaacttattaacaatta

SEQ ID NO: 3057940 - DNA, 18 bp, Homo sapiens
ttcaacttggaaaaagaa

SEQ ID NO: 3057941 - DNA, 19 bp, Homo sapiens
ttcagtcttaatactttat

SEQ ID NO: 3057942 - DNA, 22 bp, Homo sapiens
ttcagtgaatgtacccctttaa

SEQ ID NO: 3057943 - DNA, 14 bp, Homo sapiens
ttcagtgataactc

SEQ ID NO: 3057944 - DNA, 21 bp, Homo sapiens
ttcagtgataactcctaagag

SEQ ID NO: 3057945 - DNA, 10 bp, Homo sapiens
ttcagtgccc

SEQ ID NO: 3057946 - DNA, 13 bp, Homo sapiens
ttcagtgtaattt

SEQ ID NO: 3057947 - DNA, 16 bp, Homo sapiens
ttcagtgtaatttctt

SEQ ID NO: 3057948 - DNA, 21 bp, Homo sapiens
ttcagtgtaatttctttgcct

SEQ ID NO: 3057949 - DNA, 18 bp, Homo sapiens
ttcagtgtccttcacggc

SEQ ID NO: 3057950 - DNA, 14 bp, Homo sapiens
ttcagttacagaaa

SEQ ID NO: 3057951 - DNA, 16 bp, Homo sapiens
ttcagttacagaaagt

SEQ ID NO: 3057952 - DNA, 17 bp, Homo sapiens
ttcagttacagaaagtg

SEQ ID NO: 3057953 - DNA, 23 bp, Homo sapiens
ttcagttattatatttacaaatg

SEQ ID NO: 3057954 - DNA, 17 bp, Homo sapiens
ttcagttccagcttttg

SEQ ID NO: 3057955 - DNA, 21 bp, Homo sapiens
ttcagttccgtcagaaagtgt

SEQ ID NO: 3057956 - DNA, 19 bp, Homo sapiens
ttcagttggctgacttcca

SEQ ID NO: 3057957 - DNA, 17 bp, Homo sapiens
ttcagttgtgtttgttg

SEQ ID NO: 3057958 - DNA, 22 bp, Homo sapiens
ttcagttgtgtttgttgctggc

SEQ ID NO: 3057959 - DNA, 22 bp, Homo sapiens
ttcagtttatttgaaccaataa

SEQ ID NO: 3057960 - DNA, 19 bp, Homo sapiens
ttcataactaggagactga

SEQ ID NO: 3057961 - DNA, 21 bp, Homo sapiens
ttcatacaagccaactggtat

SEQ ID NO: 3057962 - DNA, 19 bp, Homo sapiens
ttcataccgcctcgtgcca

SEQ ID NO: 3057963 - DNA, 21 bp, Homo sapiens
ttcataccgcctcgtgccagc

SEQ ID NO: 3057964 - DNA, 19 bp, Homo sapiens
ttcatactctgttgcctcc

SEQ ID NO: 3057965 - DNA, 20 bp, Homo sapiens
ttcatactctgttgcctcct

SEQ ID NO: 3057966 - DNA, 15 bp, Homo sapiens
ttcatagatattgga

SEQ ID NO: 3057967 - DNA, 23 bp, Homo sapiens
ttcatagatattggaagagagaa

SEQ ID NO: 3057968 - DNA, 16 bp, Homo sapiens
ttcatagggaccttta

SEQ ID NO: 3057969 - DNA, 23 bp, Homo sapiens
ttcatagtaagtgcgaagactga

SEQ ID NO: 3057970 - DNA, 22 bp, Homo sapiens
ttcatagtcccaccttggagca

SEQ ID NO: 3057971 - DNA, 17 bp, Homo sapiens
ttcatagtgcctttttc

SEQ ID NO: 3057972 - DNA, 22 bp, Homo sapiens
ttcatatcatcaatgtgacatt

SEQ ID NO: 3057973 - DNA, 20 bp, Homo sapiens
ttcatatctatttattaaat

SEQ ID NO: 3057974 - DNA, 13 bp, Homo sapiens
ttcatatctctcc

SEQ ID NO: 3057975 - DNA, 19 bp, Homo sapiens
ttcatattaatataagttt

SEQ ID NO: 3057976 - DNA, 13 bp, Homo sapiens
ttcatattctttt

SEQ ID NO: 3057977 - DNA, 23 bp, Homo sapiens
ttcatattgtaatctatgtttat

SEQ ID NO: 3057978 - DNA, 21 bp, Homo sapiens
ttcatcaggctctgttcctca

SEQ ID NO: 3057979 - DNA, 15 bp, Homo sapiens
ttcatcatccctccc

SEQ ID NO: 3057980 - DNA, 19 bp, Homo sapiens
ttcatcatgaggaaagcag

SEQ ID NO: 3057981 - DNA, 16 bp, Homo sapiens
ttcatcatttcagcca

SEQ ID NO: 3057982 - DNA, 17 bp, Homo sapiens
ttcatcatttcagccaa

SEQ ID NO: 3057983 - DNA, 15 bp, Homo sapiens
ttcatcatttgcaca

SEQ ID NO: 3057984 - DNA, 16 bp, Homo sapiens
ttcatccaactctaaa

SEQ ID NO: 3057985 - DNA, 23 bp, Homo sapiens
ttcatccagctacttagctggcc

SEQ ID NO: 3057986 - DNA, 15 bp, Homo sapiens
ttcatccccttaccc

SEQ ID NO: 3057987 - DNA, 12 bp, Homo sapiens
ttcatcctgtgt

SEQ ID NO: 3057988 - DNA, 13 bp, Homo sapiens
ttcatcctgtgtc

SEQ ID NO: 3057989 - DNA, 18 bp, Homo sapiens
ttcatcctgttggctgct

SEQ ID NO: 3057990 - DNA, 17 bp, Homo sapiens
ttcatccttttttctct

SEQ ID NO: 3057991 - DNA, 23 bp, Homo sapiens
ttcatccttttttctcttctgtc

SEQ ID NO: 3057992 - DNA, 16 bp, Homo sapiens
ttcatctctttgtcct

SEQ ID NO: 3057993 - DNA, 19 bp, Homo sapiens
ttcatctctttgtcctgaa

SEQ ID NO: 3057994 - DNA, 14 bp, Homo sapiens
ttcatctgggaaag

SEQ ID NO: 3057995 - DNA, 21 bp, Homo sapiens
ttcatctggttgaatggcttt

SEQ ID NO: 3057996 - DNA, 16 bp, Homo sapiens
ttcatctgtgtagctg

SEQ ID NO: 3057997 - DNA, 16 bp, Homo sapiens
ttcatcttttaaagaa

SEQ ID NO: 3057998 - DNA, 15 bp, Homo sapiens
ttcatcttttaatca

SEQ ID NO: 3057999 - DNA, 22 bp, Homo sapiens
ttcatgaacttcgcatcaaaag

SEQ ID NO: 3058000 - DNA, 23 bp, Homo sapiens
ttcatgaagtgaattaatgatga

SEQ ID NO: 3058001 - DNA, 16 bp, Homo sapiens
ttcatgagtttttccc

SEQ ID NO: 3058002 - DNA, 17 bp, Homo sapiens
ttcatgtaaactgtgca

SEQ ID NO: 3058003 - DNA, 16 bp, Homo sapiens
ttcatgtaaagaaaaa

SEQ ID NO: 3058004 - DNA, 22 bp, Homo sapiens
ttcatgtctttccacttctctg

SEQ ID NO: 3058005 - DNA, 23 bp, Homo sapiens
ttcatgtgctatagacattagag

SEQ ID NO: 3058006 - DNA, 14 bp, Homo sapiens
ttcatgttcatgtg

SEQ ID NO: 3058007 - DNA, 21 bp, Homo sapiens
ttcatgttggatctgtcatta

SEQ ID NO: 3058008 - DNA, 13 bp, Homo sapiens
ttcatgtttctta

SEQ ID NO: 3058009 - DNA, 15 bp, Homo sapiens
ttcatgttttaacaa

SEQ ID NO: 3058010 - DNA, 17 bp, Homo sapiens
ttcatgttttaacaaaa

SEQ ID NO: 3058011 - DNA, 20 bp, Homo sapiens
ttcattaaacttgaagcagt

SEQ ID NO: 3058012 - DNA, 14 bp, Homo sapiens
ttcattatgtaaaa

SEQ ID NO: 3058013 - DNA, 17 bp, Homo sapiens
ttcattatgtaaaatgt

SEQ ID NO: 3058014 - DNA, 12 bp, Homo sapiens
ttcattattctc

SEQ ID NO: 3058015 - DNA, 14 bp, Homo sapiens
ttcattattctcat

SEQ ID NO: 3058016 - DNA, 17 bp, Homo sapiens
ttcattcattttgtgta

SEQ ID NO: 3058017 - DNA, 15 bp, Homo sapiens
ttcattccacaggac

SEQ ID NO: 3058018 - DNA, 17 bp, Homo sapiens
ttcattctcctcctcct

SEQ ID NO: 3058019 - DNA, 13 bp, Homo sapiens
ttcattctgcaag

SEQ ID NO: 3058020 - DNA, 19 bp, Homo sapiens
ttcattctgtatgtgacta

SEQ ID NO: 3058021 - DNA, 22 bp, Homo sapiens
ttcattgagagttttgtcttga

SEQ ID NO: 3058022 - DNA, 18 bp, Homo sapiens
ttcattgatttcctgtgt

SEQ ID NO: 3058023 - DNA, 19 bp, Homo sapiens
ttcattgctgtgtcacact

SEQ ID NO: 3058024 - DNA, 22 bp, Homo sapiens
ttcattggctatataaaatgtg

SEQ ID NO: 3058025 - DNA, 16 bp, Homo sapiens
ttcattgttttgcaaa

SEQ ID NO: 3058026 - DNA, 17 bp, Homo sapiens
ttcattgttttgcaaaa

SEQ ID NO: 3058027 - DNA, 16 bp, Homo sapiens
ttcatttactcaccat

SEQ ID NO: 3058028 - DNA, 14 bp, Homo sapiens
ttcatttctgtctc

SEQ ID NO: 3058029 - DNA, 19 bp, Homo sapiens
ttcattttatattgaaaaa

SEQ ID NO: 3058030 - DNA, 22 bp, Homo sapiens
ttcattttatattgaaaaaaat

SEQ ID NO: 3058031 - DNA, 14 bp, Homo sapiens
ttcattttcagagt

SEQ ID NO: 3058032 - DNA, 15 bp, Homo sapiens
ttcattttcagagtg

SEQ ID NO: 3058033 - DNA, 16 bp, Homo sapiens
ttcattttcagagtga

SEQ ID NO: 3058034 - DNA, 14 bp, Homo sapiens
ttcatttttaaatg

SEQ ID NO: 3058035 - DNA, 18 bp, Homo sapiens
ttcatttttttctctctg

SEQ ID NO: 3058036 - DNA, 15 bp, Homo sapiens
ttccaaaaaaatact

SEQ ID NO: 3058037 - DNA, 16 bp, Homo sapiens
ttccaaaagtggcctc

SEQ ID NO: 3058038 - DNA, 21 bp, Homo sapiens
ttccaaaagtggcctctttgt

SEQ ID NO: 3058039 - DNA, 16 bp, Homo sapiens
ttccaaagtctctaat

SEQ ID NO: 3058040 - DNA, 14 bp, Homo sapiens
ttccaaagttaaca

SEQ ID NO: 3058041 - DNA, 17 bp, Homo sapiens
ttccaaatgaatgttgt

SEQ ID NO: 3058042 - DNA, 21 bp, Homo sapiens
ttccaaatgaatgttgtctgt

SEQ ID NO: 3058043 - DNA, 23 bp, Homo sapiens
ttccaaattcacaagttgtgttt

SEQ ID NO: 3058044 - DNA, 14 bp, Homo sapiens
ttccaacaaagggt

SEQ ID NO: 3058045 - DNA, 22 bp, Homo sapiens
ttccaacaaagggttttaatgt

SEQ ID NO: 3058046 - DNA, 22 bp, Homo sapiens
ttccaacgtttggaagatcctg

SEQ ID NO: 3058047 - DNA, 23 bp, Homo sapiens
ttccaagaatagcatctgtacaa

SEQ ID NO: 3058048 - DNA, 12 bp, Homo sapiens
ttccaagacagt

SEQ ID NO: 3058049 - DNA, 14 bp, Homo sapiens
ttccaagacagtat

SEQ ID NO: 3058050 - DNA, 22 bp, Homo sapiens
ttccaagacagtatacagtcct

SEQ ID NO: 3058051 - DNA, 15 bp, Homo sapiens
ttccaagactctaga

SEQ ID NO: 3058052 - DNA, 22 bp, Homo sapiens
ttccaagactctagagtccaag

SEQ ID NO: 3058053 - DNA, 13 bp, Homo sapiens
ttccaagagcctg

SEQ ID NO: 3058054 - DNA, 19 bp, Homo sapiens
ttccaaggagcagagaggt

SEQ ID NO: 3058055 - DNA, 20 bp, Homo sapiens
ttccaagtcatttttgtttt

SEQ ID NO: 3058056 - DNA, 12 bp, Homo sapiens
ttccaagtgtgc

SEQ ID NO: 3058057 - DNA, 22 bp, Homo sapiens
ttccaagtgtgcatattgtaca

SEQ ID NO: 3058058 - DNA, 17 bp, Homo sapiens
ttccacaaagcagtggc

SEQ ID NO: 3058059 - DNA, 20 bp, Homo sapiens
ttccacaagattcccagaga

SEQ ID NO: 3058060 - DNA, 21 bp, Homo sapiens
ttccacaagattcccagagac

SEQ ID NO: 3058061 - DNA, 19 bp, Homo sapiens
ttccacacctagcatctca

SEQ ID NO: 3058062 - DNA, 20 bp, Homo sapiens
ttccacagatatctttttca

SEQ ID NO: 3058063 - DNA, 21 bp, Homo sapiens
ttctgaggacattccaagaca

SEQ ID NO: 3058064 - DNA, 16 bp, Homo sapiens
ttctgaggctttatga

SEQ ID NO: 3058065 - DNA, 13 bp, Homo sapiens
ttctgagtacaga

SEQ ID NO: 3058066 - DNA, 15 bp, Homo sapiens
ttctgatcaaggcct

SEQ ID NO: 3058067 - DNA, 17 bp, Homo sapiens
ttctgattcatttgaat

SEQ ID NO: 3058068 - DNA, 16 bp, Homo sapiens
ttctgcactccagata

SEQ ID NO: 3058069 - DNA, 13 bp, Homo sapiens
ttctgcagaaaaa

SEQ ID NO: 3058070 - DNA, 12 bp, Homo sapiens
ttctgcagaaga

SEQ ID NO: 3058071 - DNA, 21 bp, Homo sapiens
ttctgcagacgtctgccttgg

SEQ ID NO: 3058072 - DNA, 15 bp, Homo sapiens
ttctgcagtaaatct

SEQ ID NO: 3058073 - DNA, 23 bp, Homo sapiens
ttctgcatatgttgaatactttt

SEQ ID NO: 3058074 - DNA, 17 bp, Homo sapiens
ttctgcctctctaggac

SEQ ID NO: 3058075 - DNA, 18 bp, Homo sapiens
ttctgcctctctaggacc

SEQ ID NO: 3058076 - DNA, 17 bp, Homo sapiens
ttctgcctgccagctgc

SEQ ID NO: 3058077 - DNA, 22 bp, Homo sapiens
ttctgcctgtcctagtctcctt

SEQ ID NO: 3058078 - DNA, 21 bp, Homo sapiens
ttctgccttagcctaccatgt

SEQ ID NO: 3058079 - DNA, 19 bp, Homo sapiens
ttctgcggggcctgaggca

SEQ ID NO: 3058080 - DNA, 13 bp, Homo sapiens
ttctgcgtccacc

SEQ ID NO: 3058081 - DNA, 24 bp, Homo sapiens
ttctgcgtccaccaggcctcactg

SEQ ID NO: 3058082 - DNA, 19 bp, Homo sapiens
ttctgctactggcaaaagg

SEQ ID NO: 3058083 - DNA, 23 bp, Homo sapiens
ttctgctagagcagacaggcctg

SEQ ID NO: 3058084 - DNA, 20 bp, Homo sapiens
ttctgctcagctctgggcca

SEQ ID NO: 3058085 - DNA, 21 bp, Homo sapiens
ttctgctcatcattctctgtc

SEQ ID NO: 3058086 - DNA, 18 bp, Homo sapiens
ttctgctggaaacagact

SEQ ID NO: 3058087 - DNA, 12 bp, Homo sapiens
ttctgctttaaa

SEQ ID NO: 3058088 - DNA, 15 bp, Homo sapiens
ttctgctttcatctt

SEQ ID NO: 3058089 - DNA, 18 bp, Homo sapiens
ttctgcttttaagttttt

SEQ ID NO: 3058090 - DNA, 14 bp, Homo sapiens
ttctggagacagaa

SEQ ID NO: 3058091 - DNA, 11 bp, Homo sapiens
ttctggcaccg

SEQ ID NO: 3058092 - DNA, 23 bp, Homo sapiens
ttctggcagttttgacatcagcc

SEQ ID NO: 3058093 - DNA, 14 bp, Homo sapiens
ttctggcctcccac

SEQ ID NO: 3058094 - DNA, 15 bp, Homo sapiens
ttctggcctcccaca

SEQ ID NO: 3058095 - DNA, 20 bp, Homo sapiens
ttctggggaaagacactgcc

SEQ ID NO: 3058096 - DNA, 21 bp, Homo sapiens
ttctggggaaagacactgcct

SEQ ID NO: 3058097 - DNA, 20 bp, Homo sapiens
ttctgggggaaaaagccata

SEQ ID NO: 3058098 - DNA, 20 bp, Homo sapiens
ttctggggggacccagtgca

SEQ ID NO: 3058099 - DNA, 21 bp, Homo sapiens
ttctggggggacccagtgcag

SEQ ID NO: 3058100 - DNA, 14 bp, Homo sapiens
ttctgggtagaagc

SEQ ID NO: 3058101 - DNA, 16 bp, Homo sapiens
ttctgggtagaagcca

SEQ ID NO: 3058102 - DNA, 15 bp, Homo sapiens
ttctgggtgatttct

SEQ ID NO: 3058103 - DNA, 18 bp, Homo sapiens
ttctggtcccctgtggtg

SEQ ID NO: 3058104 - DNA, 21 bp, Homo sapiens
ttctggtcctgttttctaaaa

SEQ ID NO: 3058105 - DNA, 12 bp, Homo sapiens
ttctggttctaa

SEQ ID NO: 3058106 - DNA, 13 bp, Homo sapiens
ttctgtaaacaga

SEQ ID NO: 3058107 - DNA, 17 bp, Homo sapiens
ttctgtagagccaatta

SEQ ID NO: 3058108 - DNA, 13 bp, Homo sapiens
ttctgtagattct

SEQ ID NO: 3058109 - DNA, 16 bp, Homo sapiens
ttctgtatataaatgg

SEQ ID NO: 3058110 - DNA, 15 bp, Homo sapiens
ttctgtatatacttt

SEQ ID NO: 3058111 - DNA, 21 bp, Homo sapiens
ttctgtatatgattctctgtg

SEQ ID NO: 3058112 - DNA, 22 bp, Homo sapiens
ttctgtatatgattctctgtgg

SEQ ID NO: 3058113 - DNA, 19 bp, Homo sapiens
ttctgtcactcaggctgga

SEQ ID NO: 3058114 - DNA, 14 bp, Homo sapiens
ttctgtcactgtag

SEQ ID NO: 3058115 - DNA, 22 bp, Homo sapiens
ttctgtcattcccctcttttgt

SEQ ID NO: 3058116 - DNA, 14 bp, Homo sapiens
ttctgtccatcagt

SEQ ID NO: 3058117 - DNA, 15 bp, Homo sapiens
ttctgtcctgtgagg

SEQ ID NO: 3058118 - DNA, 23 bp, Homo sapiens
ttctgtcctgtgaggtttcccaa

SEQ ID NO: 3058119 - DNA, 19 bp, Homo sapiens
ttctgtctagactggccta

SEQ ID NO: 3058120 - DNA, 22 bp, Homo sapiens
ttctgtgaagaagccctgttct

SEQ ID NO: 3058121 - DNA, 23 bp, Homo sapiens
ttctgtgaagaagccctgttctc

SEQ ID NO: 3058122 - DNA, 21 bp, Homo sapiens
ttctgtgaagccctttgcctg

SEQ ID NO: 3058123 - DNA, 16 bp, Homo sapiens
ttctgtggaaagtgta

SEQ ID NO: 3058124 - DNA, 19 bp, Homo sapiens
ttctgtggaaagtgtaaag

SEQ ID NO: 3058125 - DNA, 21 bp, Homo sapiens
ttctgtggaaagtgtaaagca

SEQ ID NO: 3058126 - DNA, 19 bp, Homo sapiens
ttctgtggccgccatctgc

SEQ ID NO: 3058127 - DNA, 22 bp, Homo sapiens
ttctgtgggagaattcttacat

SEQ ID NO: 3058128 - DNA, 15 bp, Homo sapiens
ttctgtgtaaccatt

SEQ ID NO: 3058129 - DNA, 19 bp, Homo sapiens
ttctgtgtcagagcccagc

SEQ ID NO: 3058130 - DNA, 23 bp, Homo sapiens
ttctgtgtcagagcccagcccag

SEQ ID NO: 3058131 - DNA, 15 bp, Homo sapiens
ttctgtgtctgtcac

SEQ ID NO: 3058132 - DNA, 21 bp, Homo sapiens
ttctgttcatctctttgtcct

SEQ ID NO: 3058133 - DNA, 9 bp, Homo sapiens
ttctgttcc

SEQ ID NO: 3058134 - DNA, 13 bp, Homo sapiens
ttctgttccccag

SEQ ID NO: 3058135 - DNA, 18 bp, Homo sapiens
ttctgttcgaagttcatt

SEQ ID NO: 3058136 - DNA, 12 bp, Homo sapiens
ttctgttctgcc

SEQ ID NO: 3058137 - DNA, 13 bp, Homo sapiens
ttctgttctgtgg

SEQ ID NO: 3058138 - DNA, 20 bp, Homo sapiens
ttctgttctgtggaaagtgt

SEQ ID NO: 3058139 - DNA, 22 bp, Homo sapiens
ttctgttttcgtaccttcccac

SEQ ID NO: 3058140 - DNA, 21 bp, Homo sapiens
ttctgttttctaaaggagcag

SEQ ID NO: 3058141 - DNA, 20 bp, Homo sapiens
ttcttaaatctttcttcaaa

SEQ ID NO: 3058142 - DNA, 16 bp, Homo sapiens
ttcttaacaaactctt

SEQ ID NO: 3058143 - DNA, 17 bp, Homo sapiens
ttcttaacaaactcttc

SEQ ID NO: 3058144 - DNA, 13 bp, Homo sapiens
ttcttaacctttg

SEQ ID NO: 3058145 - DNA, 22 bp, Homo sapiens
ttcttacagcacatcacctctt

SEQ ID NO: 3058146 - DNA, 16 bp, Homo sapiens
ttcttacgcaatgctt

SEQ ID NO: 3058147 - DNA, 12 bp, Homo sapiens
ttcttactctgg

SEQ ID NO: 3058148 - DNA, 14 bp, Homo sapiens
ttcttactgcttaa

SEQ ID NO: 3058149 - DNA, 22 bp, Homo sapiens
ttcttataaatatgaagctcac

SEQ ID NO: 3058150 - DNA, 17 bp, Homo sapiens
ttcttatacgcttttct

SEQ ID NO: 3058151 - DNA, 20 bp, Homo sapiens
ttcttatagaataaaagctg

SEQ ID NO: 3058152 - DNA, 14 bp, Homo sapiens
ttcttatagatttt

SEQ ID NO: 3058153 - DNA, 21 bp, Homo sapiens
ttcttatatctgaagattgaa

SEQ ID NO: 3058154 - DNA, 15 bp, Homo sapiens
ttcttatggaattga

SEQ ID NO: 3058155 - DNA, 14 bp, Homo sapiens
ttcttattcacttt

SEQ ID NO: 3058156 - DNA, 15 bp, Homo sapiens
ttcttattctctgtt

SEQ ID NO: 3058157 - DNA, 14 bp, Homo sapiens
ttcttcaaacacaa

SEQ ID NO: 3058158 - DNA, 17 bp, Homo sapiens
ttcttcagatcagtgct

SEQ ID NO: 3058159 - DNA, 14 bp, Homo sapiens
ttcttcagccacct

SEQ ID NO: 3058160 - DNA, 18 bp, Homo sapiens
ttcttcagctgccagtgt

SEQ ID NO: 3058161 - DNA, 19 bp, Homo sapiens
ttcttccattccttcatgt

SEQ ID NO: 3058162 - DNA, 13 bp, Homo sapiens
ttcttccgccaac

SEQ ID NO: 3058163 - DNA, 13 bp, Homo sapiens
ttcttcctgttct

SEQ ID NO: 3058164 - DNA, 14 bp, Homo sapiens
ttcttcctttggta

SEQ ID NO: 3058165 - DNA, 23 bp, Homo sapiens
ttcttcgaggtggatcacagagg

SEQ ID NO: 3058166 - DNA, 14 bp, Homo sapiens
ttcttctaaatgag

SEQ ID NO: 3058167 - DNA, 21 bp, Homo sapiens
ttcttcttgtgtctccttatg

SEQ ID NO: 3058168 - DNA, 23 bp, Homo sapiens
ttcttcttgtgtctccttatggt

SEQ ID NO: 3058169 - DNA, 21 bp, Homo sapiens
ttcttgaaaaaaaaaatatgt

SEQ ID NO: 3058170 - DNA, 21 bp, Homo sapiens
ttcttgaggtctcttttctct

SEQ ID NO: 3058171 - DNA, 17 bp, Homo sapiens
ttcttgatcttaaagat

SEQ ID NO: 3058172 - DNA, 16 bp, Homo sapiens
ttcttgcaaatacctc

SEQ ID NO: 3058173 - DNA, 15 bp, Homo sapiens
ttcttgctaagctcc

SEQ ID NO: 3058174 - DNA, 13 bp, Homo sapiens
ttcttggcatcta

SEQ ID NO: 3058175 - DNA, 18 bp, Homo sapiens
ttcttgtaaatgtgttgg

SEQ ID NO: 3058176 - DNA, 18 bp, Homo sapiens
ttcttgtcaatggaagaa

SEQ ID NO: 3058177 - DNA, 22 bp, Homo sapiens
ttcttgtcatcagtaagtataa

SEQ ID NO: 3058178 - DNA, 12 bp, Homo sapiens
ttcttgttgctt

SEQ ID NO: 3058179 - DNA, 19 bp, Homo sapiens
ttcttgttgtacccttgtt

SEQ ID NO: 3058180 - DNA, 13 bp, Homo sapiens
ttcttgttgttta

SEQ ID NO: 3058181 - DNA, 15 bp, Homo sapiens
ttcttgttgtttata

SEQ ID NO: 3058182 - DNA, 14 bp, Homo sapiens
ttcttgtttgtcag

SEQ ID NO: 3058183 - DNA, 15 bp, Homo sapiens
ttcttgtttgtcagc

SEQ ID NO: 3058184 - DNA, 16 bp, Homo sapiens
ttcttgtttgtcagca

SEQ ID NO: 3058185 - DNA, 16 bp, Homo sapiens
ttgccaaaaccaagat

SEQ ID NO: 3058186 - DNA, 13 bp, Homo sapiens
ttgccaaagcaga

SEQ ID NO: 3058187 - DNA, 20 bp, Homo sapiens
ttgccaaagcagattttcct

SEQ ID NO: 3058188 - DNA, 18 bp, Homo sapiens
ttgccaacttgccatgtt

SEQ ID NO: 3058189 - DNA, 15 bp, Homo sapiens
ttgccaagaaaatga

SEQ ID NO: 3058190 - DNA, 14 bp, Homo sapiens
ttgccaagaaatcg

SEQ ID NO: 3058191 - DNA, 14 bp, Homo sapiens
ttgccaattttcct

SEQ ID NO: 3058192 - DNA, 14 bp, Homo sapiens
ttgccactgatatt

SEQ ID NO: 3058193 - DNA, 18 bp, Homo sapiens
ttgccactgatattcaga

SEQ ID NO: 3058194 - DNA, 18 bp, Homo sapiens
ttgccagatgctgcagag

SEQ ID NO: 3058195 - DNA, 16 bp, Homo sapiens
ttgccaggaatgtttc

SEQ ID NO: 3058196 - DNA, 15 bp, Homo sapiens
ttgccagggctctgg

SEQ ID NO: 3058197 - DNA, 19 bp, Homo sapiens
ttgccagtgagaacggtga

SEQ ID NO: 3058198 - DNA, 23 bp, Homo sapiens
ttgccagtgataagagcagtggg

SEQ ID NO: 3058199 - DNA, 20 bp, Homo sapiens
ttgccataactttatgaagt

SEQ ID NO: 3058200 - DNA, 19 bp, Homo sapiens
ttgccatattttcaccatt

SEQ ID NO: 3058201 - DNA, 17 bp, Homo sapiens
ttgccatgtagcagaca

SEQ ID NO: 3058202 - DNA, 14 bp, Homo sapiens
ttgccatgtgtttt

SEQ ID NO: 3058203 - DNA, 21 bp, Homo sapiens
ttgccattatagcgcctgtat

SEQ ID NO: 3058204 - DNA, 15 bp, Homo sapiens
ttgccattggtttct

SEQ ID NO: 3058205 - DNA, 17 bp, Homo sapiens
ttgcccacacacactcc

SEQ ID NO: 3058206 - DNA, 21 bp, Homo sapiens
ttgcccacacacactccttcc

SEQ ID NO: 3058207 - DNA, 22 bp, Homo sapiens
ttgcccacacacactccttccc

SEQ ID NO: 3058208 - DNA, 14 bp, Homo sapiens
ttcctcctgggccc

SEQ ID NO: 3058209 - DNA, 23 bp, Homo sapiens
ttcctcctgggccctctctgctc

SEQ ID NO: 3058210 - DNA, 13 bp, Homo sapiens
ttcctcctttctc

SEQ ID NO: 3058211 - DNA, 15 bp, Homo sapiens
ttcctcgttttgaaa

SEQ ID NO: 3058212 - DNA, 20 bp, Homo sapiens
ttcctcgttttgaaagcagt

SEQ ID NO: 3058213 - DNA, 14 bp, Homo sapiens
ttcctctctccaga

SEQ ID NO: 3058214 - DNA, 11 bp, Homo sapiens
ttcctctctct

SEQ ID NO: 3058215 - DNA, 12 bp, Homo sapiens
ttcctctctctc

SEQ ID NO: 3058216 - DNA, 19 bp, Homo sapiens
ttcctctctgtctgtctct

SEQ ID NO: 3058217 - DNA, 22 bp, Homo sapiens
ttcctctctgtctgtctctccc

SEQ ID NO: 3058218 - DNA, 19 bp, Homo sapiens
ttcctcttccgggcagaaa

SEQ ID NO: 3058219 - DNA, 19 bp, Homo sapiens
ttcctctttgctccctcca

SEQ ID NO: 3058220 - DNA, 17 bp, Homo sapiens
ttcctgaaataaatgtt

SEQ ID NO: 3058221 - DNA, 15 bp, Homo sapiens
ttcctgaactataac

SEQ ID NO: 3058222 - DNA, 16 bp, Homo sapiens
ttcctgaagaaccagt

SEQ ID NO: 3058223 - DNA, 15 bp, Homo sapiens
ttcctgacattgtct

SEQ ID NO: 3058224 - DNA, 21 bp, Homo sapiens
ttcctgacccggattggccct

SEQ ID NO: 3058225 - DNA, 22 bp, Homo sapiens
ttcctgacccggattggccctg

SEQ ID NO: 3058226 - DNA, 23 bp, Homo sapiens
ttcctgacttgagtgttcctttt

SEQ ID NO: 3058227 - DNA, 21 bp, Homo sapiens
ttcctgagaaacgtccatctc

SEQ ID NO: 3058228 - DNA, 22 bp, Homo sapiens
ttcctgagaaacgtccatctct

SEQ ID NO: 3058229 - DNA, 19 bp, Homo sapiens
ttcctgagaaagcccacct

SEQ ID NO: 3058230 - DNA, 22 bp, Homo sapiens
ttcctgagaaagcccacctggg

SEQ ID NO: 3058231 - DNA, 21 bp, Homo sapiens
ttcctgcgggcttttccccgg

SEQ ID NO: 3058232 - DNA, 13 bp, Homo sapiens
ttcctgctgcctg

SEQ ID NO: 3058233 - DNA, 23 bp, Homo sapiens
ttcctgctgcctgggtaggcccc

SEQ ID NO: 3058234 - DNA, 12 bp, Homo sapiens
ttcctgctgctt

SEQ ID NO: 3058235 - DNA, 11 bp, Homo sapiens
ttcctgctgtc

SEQ ID NO: 3058236 - DNA, 19 bp, Homo sapiens
ttcctgctgtcctggtggc

SEQ ID NO: 3058237 - DNA, 19 bp, Homo sapiens
ttcctgcttaaacttgacc

SEQ ID NO: 3058238 - DNA, 14 bp, Homo sapiens
ttcctgctttctct

SEQ ID NO: 3058239 - DNA, 13 bp, Homo sapiens
ttcctggaagcag

SEQ ID NO: 3058240 - DNA, 23 bp, Homo sapiens
ttcctggaagtcaaataaatgtt

SEQ ID NO: 3058241 - DNA, 15 bp, Homo sapiens
ttcctggatgtctga

SEQ ID NO: 3058242 - DNA, 11 bp, Homo sapiens
ttcctggccca

SEQ ID NO: 3058243 - DNA, 12 bp, Homo sapiens
ttcctggcccag

SEQ ID NO: 3058244 - DNA, 15 bp, Homo sapiens
ttcctggcccaggcc

SEQ ID NO: 3058245 - DNA, 19 bp, Homo sapiens
ttcctgggccttctcagct

SEQ ID NO: 3058246 - DNA, 21 bp, Homo sapiens
ttcctgggccttctcagctct

SEQ ID NO: 3058247 - DNA, 22 bp, Homo sapiens
ttcctgggccttctcagctctc

SEQ ID NO: 3058248 - DNA, 23 bp, Homo sapiens
ttcctgggccttctcagctctcc

SEQ ID NO: 3058249 - DNA, 16 bp, Homo sapiens
ttcctgtaaatgtgac

SEQ ID NO: 3058250 - DNA, 17 bp, Homo sapiens
ttcctgtaacttttaat

SEQ ID NO: 3058251 - DNA, 20 bp, Homo sapiens
ttcctgtcctcccagctcct

SEQ ID NO: 3058252 - DNA, 18 bp, Homo sapiens
ttcctgtgcctttcctat

SEQ ID NO: 3058253 - DNA, 21 bp, Homo sapiens
ttcctgtggctccctctctcc

SEQ ID NO: 3058254 - DNA, 11 bp, Homo sapiens
ttcctgtgtca

SEQ ID NO: 3058255 - DNA, 20 bp, Homo sapiens
ttcctgtttatttttaaatt

SEQ ID NO: 3058256 - DNA, 16 bp, Homo sapiens
ttcctgtttctgaaaa

SEQ ID NO: 3058257 - DNA, 18 bp, Homo sapiens
ttcctgtttctgaaaaga

SEQ ID NO: 3058258 - DNA, 20 bp, Homo sapiens
ttcctgtttctgaaaagaaa

SEQ ID NO: 3058259 - DNA, 19 bp, Homo sapiens
ttcctgttttaagcagctc

SEQ ID NO: 3058260 - DNA, 20 bp, Homo sapiens
ttccttaagtcagaacagca

SEQ ID NO: 3058261 - DNA, 16 bp, Homo sapiens
ttccttacctttaccc

SEQ ID NO: 3058262 - DNA, 16 bp, Homo sapiens
ttccttactgcagaat

SEQ ID NO: 3058263 - DNA, 22 bp, Homo sapiens
ttccttatagggaaaaatgcaa

SEQ ID NO: 3058264 - DNA, 21 bp, Homo sapiens
ttccttattttaagcattgtg

SEQ ID NO: 3058265 - DNA, 22 bp, Homo sapiens
ttccttcagtgcatctgggaag

SEQ ID NO: 3058266 - DNA, 12 bp, Homo sapiens
ttccttccctgg

SEQ ID NO: 3058267 - DNA, 12 bp, Homo sapiens
ttccttcctgag

SEQ ID NO: 3058268 - DNA, 12 bp, Homo sapiens
ttccttctgtga

SEQ ID NO: 3058269 - DNA, 14 bp, Homo sapiens
ttccttctgtgaag

SEQ ID NO: 3058270 - DNA, 16 bp, Homo sapiens
ttccttctgtgaagaa

SEQ ID NO: 3058271 - DNA, 18 bp, Homo sapiens
ttccttctgtgaagaagc

SEQ ID NO: 3058272 - DNA, 19 bp, Homo sapiens
ttccttgcttttatagttg

SEQ ID NO: 3058273 - DNA, 14 bp, Homo sapiens
ttccttggggcagg

SEQ ID NO: 3058274 - DNA, 18 bp, Homo sapiens
ttccttggggcaggcagt

SEQ ID NO: 3058275 - DNA, 20 bp, Homo sapiens
ttccttgttacccatgaaaa

SEQ ID NO: 3058276 - DNA, 15 bp, Homo sapiens
ttcctttaaatactc

SEQ ID NO: 3058277 - DNA, 16 bp, Homo sapiens
ttcctttacagctgtt

SEQ ID NO: 3058278 - DNA, 22 bp, Homo sapiens
ttcctttccaacgtttggaaga

SEQ ID NO: 3058279 - DNA, 14 bp, Homo sapiens
ttcctttgaagata

SEQ ID NO: 3058280 - DNA, 14 bp, Homo sapiens
ttcctttgtcattt

SEQ ID NO: 3058281 - DNA, 17 bp, Homo sapiens
ttcctttgttgtctaca

SEQ ID NO: 3058282 - DNA, 21 bp, Homo sapiens
ttccttttaagtaaggtccaa

SEQ ID NO: 3058283 - DNA, 23 bp, Homo sapiens
ttccttttctttctccctaacca

SEQ ID NO: 3058284 - DNA, 23 bp, Homo sapiens
ttccttttgaacgccccccccca

SEQ ID NO: 3058285 - DNA, 14 bp, Homo sapiens
ttccttttgtaaaa

SEQ ID NO: 3058286 - DNA, 16 bp, Homo sapiens
ttcctttttaaatgtg

SEQ ID NO: 3058287 - DNA, 21 bp, Homo sapiens
ttccttttttaaaaatgcaaa

SEQ ID NO: 3058288 - DNA, 17 bp, Homo sapiens
ttcctttttttaaattt

SEQ ID NO: 3058289 - DNA, 22 bp, Homo sapiens
ttcctttttttaaattttctcc

SEQ ID NO: 3058290 - DNA, 23 bp, Homo sapiens
ttcctttttttaaattttctcca

SEQ ID NO: 3058291 - DNA, 13 bp, Homo sapiens
ttcgaagtcatta

SEQ ID NO: 3058292 - DNA, 15 bp, Homo sapiens
ttcgaagtcattaaa

SEQ ID NO: 3058293 - DNA, 16 bp, Homo sapiens
ttcgagaccagcctgg

SEQ ID NO: 3058294 - DNA, 20 bp, Homo sapiens
ttcgatggtacgtgaccctc

SEQ ID NO: 3058295 - DNA, 22 bp, Homo sapiens
ttcgatgtacagtctcaatttt

SEQ ID NO: 3058296 - DNA, 22 bp, Homo sapiens
ttcgcagctctggcctcctaat

SEQ ID NO: 3058297 - DNA, 17 bp, Homo sapiens
ttcgcagctgaagtgga

SEQ ID NO: 3058298 - DNA, 18 bp, Homo sapiens
ttcgcatcaaaagacaat

SEQ ID NO: 3058299 - DNA, 18 bp, Homo sapiens
ttcgcatggtcacacact

SEQ ID NO: 3058300 - DNA, 21 bp, Homo sapiens
ttcgcatggtcacacactgat

SEQ ID NO: 3058301 - DNA, 14 bp, Homo sapiens
ttcgcatgtttaat

SEQ ID NO: 3058302 - DNA, 17 bp, Homo sapiens
ttcgcccccatgtgact

SEQ ID NO: 3058303 - DNA, 20 bp, Homo sapiens
ttcggcagatactgtctctt

SEQ ID NO: 3058304 - DNA, 18 bp, Homo sapiens
ttcgggcgtctgtgtgcg

SEQ ID NO: 3058305 - DNA, 11 bp, Homo sapiens
ttcggggaggg

SEQ ID NO: 3058306 - DNA, 21 bp, Homo sapiens
ttcgtaacttcatattaatat

SEQ ID NO: 3058307 - DNA, 14 bp, Homo sapiens
ttcgtaccttccca

SEQ ID NO: 3058308 - DNA, 16 bp, Homo sapiens
ttcgtaccttcccact

SEQ ID NO: 3058309 - DNA, 15 bp, Homo sapiens
ttcgtagcatgagtt

SEQ ID NO: 3058310 - DNA, 16 bp, Homo sapiens
ttcgtcatcttccctg

SEQ ID NO: 3058311 - DNA, 16 bp, Homo sapiens
ttcgtccacagcttcc

SEQ ID NO: 3058312 - DNA, 17 bp, Homo sapiens
ttcgtccacagcttcct

SEQ ID NO: 3058313 - DNA, 19 bp, Homo sapiens
ttcgtccacagcttcctgt

SEQ ID NO: 3058314 - DNA, 14 bp, Homo sapiens
ttcgtcttcactct

SEQ ID NO: 3058315 - DNA, 18 bp, Homo sapiens
ttcgtgaagtatactgta

SEQ ID NO: 3058316 - DNA, 21 bp, Homo sapiens
ttcgtgaagtatactgtattt

SEQ ID NO: 3058317 - DNA, 15 bp, Homo sapiens
ttcgtgagccccatc

SEQ ID NO: 3058318 - DNA, 20 bp, Homo sapiens
ttcgtgagccccatcttcac

SEQ ID NO: 3058319 - DNA, 13 bp, Homo sapiens
ttcgtgcattttt

SEQ ID NO: 3058320 - DNA, 18 bp, Homo sapiens
ttcgtgtaatattctctg

SEQ ID NO: 3058321 - DNA, 17 bp, Homo sapiens
ttcgttctgtactgtta

SEQ ID NO: 3058322 - DNA, 14 bp, Homo sapiens
ttcgttctttttaa

SEQ ID NO: 3058323 - DNA, 16 bp, Homo sapiens
ttcgtttctgtataca

SEQ ID NO: 3058324 - DNA, 15 bp, Homo sapiens
ttcgtttggtcttag

SEQ ID NO: 3058325 - DNA, 19 bp, Homo sapiens
ttctaaaaaaaaaaactgt

SEQ ID NO: 3058326 - DNA, 20 bp, Homo sapiens
ttctaaaatcttatagttct

SEQ ID NO: 3058327 - DNA, 11 bp, Homo sapiens
ttctaaacaga

SEQ ID NO: 3058328 - DNA, 23 bp, Homo sapiens
ttctaaacccaatccaaatggcg

SEQ ID NO: 3058329 - DNA, 15 bp, Homo sapiens
ttctaaacctgtgcc

SEQ ID NO: 3058330 - DNA, 17 bp, Homo sapiens
ttctaaacctgtgcctc

SEQ ID NO: 3058331 - DNA, 19 bp, Homo sapiens
ttctaaactgaagctgctg

SEQ ID NO: 3058332 - DNA, 13 bp, Homo sapiens
ttctaaagattct

SEQ ID NO: 3058333 - DNA, 14 bp, Homo sapiens
ttctaaagattcta

SEQ ID NO: 3058334 - DNA, 16 bp, Homo sapiens
ttctaaagattctata

SEQ ID NO: 3058335 - DNA, 12 bp, Homo sapiens
ttctaaagttct

SEQ ID NO: 3058336 - DNA, 20 bp, Homo sapiens
ttctaaagttctaagattct

SEQ ID NO: 3058337 - DNA, 14 bp, Homo sapiens
ttctaaatgaagtg

SEQ ID NO: 3058338 - DNA, 22 bp, Homo sapiens
ttctaaatgttattacttgtaa

SEQ ID NO: 3058339 - DNA, 23 bp, Homo sapiens
ttctaaatgttattacttgtaaa

SEQ ID NO: 3058340 - DNA, 14 bp, Homo sapiens
tggctcttcacctg

SEQ ID NO: 3058341 - DNA, 22 bp, Homo sapiens
tggctcttgaactgagcttgga

SEQ ID NO: 3058342 - DNA, 20 bp, Homo sapiens
tggctgaacagtgctctgcc

SEQ ID NO: 3058343 - DNA, 22 bp, Homo sapiens
tggctgaacagtgctctgcctc

SEQ ID NO: 3058344 - DNA, 16 bp, Homo sapiens
tggctgacccagtccc

SEQ ID NO: 3058345 - DNA, 19 bp, Homo sapiens
tggctgacccagtccctgg

SEQ ID NO: 3058346 - DNA, 18 bp, Homo sapiens
tggctgcaagcccacctc

SEQ ID NO: 3058347 - DNA, 16 bp, Homo sapiens
tggctgcagcctccgg

SEQ ID NO: 3058348 - DNA, 17 bp, Homo sapiens
tggctgcagcctccggg

SEQ ID NO: 3058349 - DNA, 20 bp, Homo sapiens
tggctgcagcggcaggaccg

SEQ ID NO: 3058350 - DNA, 16 bp, Homo sapiens
tggctgcaggaatctt

SEQ ID NO: 3058351 - DNA, 14 bp, Homo sapiens
tggctgcctggagc

SEQ ID NO: 3058352 - DNA, 15 bp, Homo sapiens
tggctgcctggagcc

SEQ ID NO: 3058353 - DNA, 20 bp, Homo sapiens
tggctgcctttgatcacagg

SEQ ID NO: 3058354 - DNA, 19 bp, Homo sapiens
tggctgcgctaacccccag

SEQ ID NO: 3058355 - DNA, 13 bp, Homo sapiens
tggctgctgccac

SEQ ID NO: 3058356 - DNA, 14 bp, Homo sapiens
tggctgctgcttct

SEQ ID NO: 3058357 - DNA, 19 bp, Homo sapiens
tggctgcttgcagccagga

SEQ ID NO: 3058358 - DNA, 23 bp, Homo sapiens
tggctgggacgtggctcagccag

SEQ ID NO: 3058359 - DNA, 11 bp, Homo sapiens
tggctggggga

SEQ ID NO: 3058360 - DNA, 16 bp, Homo sapiens
tggctgggggagggac

SEQ ID NO: 3058361 - DNA, 18 bp, Homo sapiens
tggctggggtggcctgtg

SEQ ID NO: 3058362 - DNA, 19 bp, Homo sapiens
tggctggggtggcctgtgt

SEQ ID NO: 3058363 - DNA, 21 bp, Homo sapiens
tggctggggtggcctgtgtgg

SEQ ID NO: 3058364 - DNA, 22 bp, Homo sapiens
tggctggggtggcctgtgtggc

SEQ ID NO: 3058365 - DNA, 22 bp, Homo sapiens
tggctgggtccttgggcctggc

SEQ ID NO: 3058366 - DNA, 19 bp, Homo sapiens
tggctgtaaggctctagat

SEQ ID NO: 3058367 - DNA, 20 bp, Homo sapiens
tggctgtacctgttcctccc

SEQ ID NO: 3058368 - DNA, 18 bp, Homo sapiens
tggctgtatccatgtaat

SEQ ID NO: 3058369 - DNA, 15 bp, Homo sapiens
tggcttaatcatttt

SEQ ID NO: 3058370 - DNA, 13 bp, Homo sapiens
tggcttcagctcc

SEQ ID NO: 3058371 - DNA, 14 bp, Homo sapiens
tggcttcagctcca

SEQ ID NO: 3058372 - DNA, 16 bp, Homo sapiens
tggcttcagctccagc

SEQ ID NO: 3058373 - DNA, 19 bp, Homo sapiens
tggcttcagctccagcccc

SEQ ID NO: 3058374 - DNA, 18 bp, Homo sapiens
tggcttctagtttgcaac

SEQ ID NO: 3058375 - DNA, 13 bp, Homo sapiens
tggcttctctgtc

SEQ ID NO: 3058376 - DNA, 17 bp, Homo sapiens
tggcttctggccaggaa

SEQ ID NO: 3058377 - DNA, 18 bp, Homo sapiens
tggcttggcatctgtgtg

SEQ ID NO: 3058378 - DNA, 12 bp, Homo sapiens
tggcttgtacat

SEQ ID NO: 3058379 - DNA, 18 bp, Homo sapiens
tggcttgttgtaaagcaa

SEQ ID NO: 3058380 - DNA, 15 bp, Homo sapiens
tggctttcagagttt

SEQ ID NO: 3058381 - DNA, 17 bp, Homo sapiens
tggctttgaggccgaag

SEQ ID NO: 3058382 - DNA, 18 bp, Homo sapiens
tggctttgaggccgaagc

SEQ ID NO: 3058383 - DNA, 19 bp, Homo sapiens
tggctttgcggaggctgct

SEQ ID NO: 3058384 - DNA, 17 bp, Homo sapiens
tggctttggcagtgttt

SEQ ID NO: 3058385 - DNA, 18 bp, Homo sapiens
tggctttggcagtgtttt

SEQ ID NO: 3058386 - DNA, 15 bp, Homo sapiens
tggctttgtcttgaa

SEQ ID NO: 3058387 - DNA, 16 bp, Homo sapiens
tggctttgtcttgaaa

SEQ ID NO: 3058388 - DNA, 20 bp, Homo sapiens
tggctttgtcttgaaaaaaa

SEQ ID NO: 3058389 - DNA, 18 bp, Homo sapiens
tggcttttctgtttcctg

SEQ ID NO: 3058390 - DNA, 14 bp, Homo sapiens
tgggaaaaaagaaa

SEQ ID NO: 3058391 - DNA, 15 bp, Homo sapiens
tgggaaaaaagaaaa

SEQ ID NO: 3058392 - DNA, 18 bp, Homo sapiens
tgggaaacaaaaggataa

SEQ ID NO: 3058393 - DNA, 21 bp, Homo sapiens
tgggaaacgtgggttcaattt

SEQ ID NO: 3058394 - DNA, 15 bp, Homo sapiens
tgggaaacttgtcac

SEQ ID NO: 3058395 - DNA, 21 bp, Homo sapiens
tgggaaacttgtcacttgcat

SEQ ID NO: 3058396 - DNA, 15 bp, Homo sapiens
tgggaaatgagcagg

SEQ ID NO: 3058397 - DNA, 17 bp, Homo sapiens
tgggaacactggcagac

SEQ ID NO: 3058398 - DNA, 17 bp, Homo sapiens
tgggaactggagggtga

SEQ ID NO: 3058399 - DNA, 21 bp, Homo sapiens
tgggaagcctttactgaccct

SEQ ID NO: 3058400 - DNA, 17 bp, Homo sapiens
tgggaagctatttcctt

SEQ ID NO: 3058401 - DNA, 15 bp, Homo sapiens
tgggaaggccagctg

SEQ ID NO: 3058402 - DNA, 12 bp, Homo sapiens
tgggaaggggct

SEQ ID NO: 3058403 - DNA, 20 bp, Homo sapiens
tgggaaggtttttaagggcc

SEQ ID NO: 3058404 - DNA, 21 bp, Homo sapiens
tgggaaggtttttaagggccg

SEQ ID NO: 3058405 - DNA, 16 bp, Homo sapiens
tgggaataaaatttct

SEQ ID NO: 3058406 - DNA, 22 bp, Homo sapiens
tgggaatacaaaaggtttgaga

SEQ ID NO: 3058407 - DNA, 12 bp, Homo sapiens
tgggaatgaagc

SEQ ID NO: 3058408 - DNA, 15 bp, Homo sapiens
tgggaccaaaggggg

SEQ ID NO: 3058409 - DNA, 19 bp, Homo sapiens
tgggaccctgctttagagc

SEQ ID NO: 3058410 - DNA, 17 bp, Homo sapiens
tgggactgctaaataaa

SEQ ID NO: 3058411 - DNA, 20 bp, Homo sapiens
tgggacttcttttcacattc

SEQ ID NO: 3058412 - DNA, 12 bp, Homo sapiens
tgggagaaagca

SEQ ID NO: 3058413 - DNA, 23 bp, Homo sapiens
tgggagagacttggatgaggagt

SEQ ID NO: 3058414 - DNA, 21 bp, Homo sapiens
tgggagagtgtcaaccagaca

SEQ ID NO: 3058415 - DNA, 15 bp, Homo sapiens
tgggagatgaaaacc

SEQ ID NO: 3058416 - DNA, 22 bp, Homo sapiens
tgggagatgaaaacctgcattt

SEQ ID NO: 3058417 - DNA, 19 bp, Homo sapiens
tgggagcaagttgcagtct

SEQ ID NO: 3058418 - DNA, 21 bp, Homo sapiens
tgggagcaagttgcagtcttt

SEQ ID NO: 3058419 - DNA, 20 bp, Homo sapiens
tgggagccgggaccctcagg

SEQ ID NO: 3058420 - DNA, 21 bp, Homo sapiens
tgggagccgggaccctcaggt

SEQ ID NO: 3058421 - DNA, 18 bp, Homo sapiens
tgggagccgggtctgcct

SEQ ID NO: 3058422 - DNA, 23 bp, Homo sapiens
tgggagccgggtctgcctcttct

SEQ ID NO: 3058423 - DNA, 16 bp, Homo sapiens
tgggagctgaggccac

SEQ ID NO: 3058424 - DNA, 20 bp, Homo sapiens
tgggagctgaggccacactc

SEQ ID NO: 3058425 - DNA, 22 bp, Homo sapiens
tgggagctgaggccacactcag

SEQ ID NO: 3058426 - DNA, 20 bp, Homo sapiens
tgggagcttcccacacctgc

SEQ ID NO: 3058427 - DNA, 12 bp, Homo sapiens
tgggaggaaaag

SEQ ID NO: 3058428 - DNA, 13 bp, Homo sapiens
tgggaggaaagta

SEQ ID NO: 3058429 - DNA, 15 bp, Homo sapiens
tgggaggaaatttga

SEQ ID NO: 3058430 - DNA, 14 bp, Homo sapiens
tgggaggagggcag

SEQ ID NO: 3058431 - DNA, 17 bp, Homo sapiens
tgggaggagggcaggca

SEQ ID NO: 3058432 - DNA, 20 bp, Homo sapiens
tgggaggccaaggtgggcgg

SEQ ID NO: 3058433 - DNA, 13 bp, Homo sapiens
tgggaggccaggc

SEQ ID NO: 3058434 - DNA, 14 bp, Homo sapiens
tgggaggccaggcg

SEQ ID NO: 3058435 - DNA, 15 bp, Homo sapiens
tgggaggccaggcga

SEQ ID NO: 3058436 - DNA, 21 bp, Homo sapiens
tgggaggccaggcgagcctga

SEQ ID NO: 3058437 - DNA, 14 bp, Homo sapiens
tgggaggctcctgt

SEQ ID NO: 3058438 - DNA, 14 bp, Homo sapiens
tgggaggctgcagc

SEQ ID NO: 3058439 - DNA, 21 bp, Homo sapiens
tgggaggctgcagccaggcct

SEQ ID NO: 3058440 - DNA, 18 bp, Homo sapiens
tgggagggcagcagggct

SEQ ID NO: 3058441 - DNA, 13 bp, Homo sapiens
tgggaggtcgagg

SEQ ID NO: 3058442 - DNA, 15 bp, Homo sapiens
tgggaggtgtctgtg

SEQ ID NO: 3058443 - DNA, 17 bp, Homo sapiens
tgggagtatacggaaac

SEQ ID NO: 3058444 - DNA, 23 bp, Homo sapiens
tgggagtcacacagtgttggagg

SEQ ID NO: 3058445 - DNA, 15 bp, Homo sapiens
tgggatcccacagcc

SEQ ID NO: 3058446 - DNA, 16 bp, Homo sapiens
tgggatcccacagccc

SEQ ID NO: 3058447 - DNA, 22 bp, Homo sapiens
tgggatccctgtctttcctaag

SEQ ID NO: 3058448 - DNA, 23 bp, Homo sapiens
tgggatctgtaaggaactggaac

SEQ ID NO: 3058449 - DNA, 21 bp, Homo sapiens
tgggatgctatttcagccaat

SEQ ID NO: 3058450 - DNA, 22 bp, Homo sapiens
tgggatgctatttcagccaatc

SEQ ID NO: 3058451 - DNA, 13 bp, Homo sapiens
tgggatggaggag

SEQ ID NO: 3058452 - DNA, 20 bp, Homo sapiens
tgggatggtgggcttcaggg

SEQ ID NO: 3058453 - DNA, 23 bp, Homo sapiens
tgggatgtatgaatacagcagca

SEQ ID NO: 3058454 - DNA, 21 bp, Homo sapiens
tgggattctggacaggatgtg

SEQ ID NO: 3058455 - DNA, 18 bp, Homo sapiens
tgggattttaaactagat

SEQ ID NO: 3058456 - DNA, 19 bp, Homo sapiens
tgggattttatctgtggat

SEQ ID NO: 3058457 - DNA, 14 bp, Homo sapiens
tgggattttctagt

SEQ ID NO: 3058458 - DNA, 15 bp, Homo sapiens
tgggattttctagtt

SEQ ID NO: 3058459 - DNA, 15 bp, Homo sapiens
tgggcaaaaaactcg

SEQ ID NO: 3058460 - DNA, 15 bp, Homo sapiens
tgggcaacaaagtga

SEQ ID NO: 3058461 - DNA, 20 bp, Homo sapiens
tgggcacaaagggcccagat

SEQ ID NO: 3058462 - DNA, 19 bp, Homo sapiens
tggtccccaacaatgtgag

SEQ ID NO: 3058463 - DNA, 14 bp, Homo sapiens
tggtccccaagacc

SEQ ID NO: 3058464 - DNA, 21 bp, Homo sapiens
tggtcccgtggatgctctttc

SEQ ID NO: 3058465 - DNA, 21 bp, Homo sapiens
tggtccctaaatttgcatgaa

SEQ ID NO: 3058466 - DNA, 17 bp, Homo sapiens
tggtccgagctgaggac

SEQ ID NO: 3058467 - DNA, 18 bp, Homo sapiens
tggtccgagctgaggact

SEQ ID NO: 3058468 - DNA, 17 bp, Homo sapiens
tggtcctccgcctactg

SEQ ID NO: 3058469 - DNA, 22 bp, Homo sapiens
tggtcctccgcctactgtccct

SEQ ID NO: 3058470 - DNA, 14 bp, Homo sapiens
tggtcctctctctg

SEQ ID NO: 3058471 - DNA, 19 bp, Homo sapiens
tggtcctggctgcactctt

SEQ ID NO: 3058472 - DNA, 17 bp, Homo sapiens
tggtcctgtctgtcctt

SEQ ID NO: 3058473 - DNA, 17 bp, Homo sapiens
tggtccttcactggcgc

SEQ ID NO: 3058474 - DNA, 20 bp, Homo sapiens
tggtccttcactggcgcctt

SEQ ID NO: 3058475 - DNA, 21 bp, Homo sapiens
tggtccttcactggcgccttc

SEQ ID NO: 3058476 - DNA, 12 bp, Homo sapiens
tggtcctttggg

SEQ ID NO: 3058477 - DNA, 12 bp, Homo sapiens
tggtctaaaact

SEQ ID NO: 3058478 - DNA, 16 bp, Homo sapiens
tggtctcctctcagct

SEQ ID NO: 3058479 - DNA, 22 bp, Homo sapiens
tggtctccttggaaatccgtct

SEQ ID NO: 3058480 - DNA, 16 bp, Homo sapiens
tggtctcgatgctgct

SEQ ID NO: 3058481 - DNA, 17 bp, Homo sapiens
tggtctcgatgctgctg

SEQ ID NO: 3058482 - DNA, 18 bp, Homo sapiens
tggtctcgatgctgctgg

SEQ ID NO: 3058483 - DNA, 17 bp, Homo sapiens
tggtctgagctgtccca

SEQ ID NO: 3058484 - DNA, 15 bp, Homo sapiens
tggtctgcaggcagg

SEQ ID NO: 3058485 - DNA, 12 bp, Homo sapiens
tggtctgccaat

SEQ ID NO: 3058486 - DNA, 15 bp, Homo sapiens
tggtctgccaggccc

SEQ ID NO: 3058487 - DNA, 23 bp, Homo sapiens
tggtctgctcaggaattgaagat

SEQ ID NO: 3058488 - DNA, 16 bp, Homo sapiens
tggtctgggactctct

SEQ ID NO: 3058489 - DNA, 23 bp, Homo sapiens
tggtctgggtggatgtgagcaga

SEQ ID NO: 3058490 - DNA, 23 bp, Homo sapiens
tggtctgtgtgtgtgtgtgtgcg

SEQ ID NO: 3058491 - DNA, 15 bp, Homo sapiens
tggtcttaggtcttc

SEQ ID NO: 3058492 - DNA, 21 bp, Homo sapiens
tggtcttaggtcttcctgtgg

SEQ ID NO: 3058493 - DNA, 23 bp, Homo sapiens
tggtcttaggtcttcctgtggct

SEQ ID NO: 3058494 - DNA, 14 bp, Homo sapiens
tggtcttcagcctc

SEQ ID NO: 3058495 - DNA, 15 bp, Homo sapiens
tggtcttcagcctct

SEQ ID NO: 3058496 - DNA, 19 bp, Homo sapiens
tggtcttgaagtcctggct

SEQ ID NO: 3058497 - DNA, 14 bp, Homo sapiens
tggtgagaaacctg

SEQ ID NO: 3058498 - DNA, 17 bp, Homo sapiens
tggtgaggccggccctg

SEQ ID NO: 3058499 - DNA, 20 bp, Homo sapiens
tggtgaggccggccctgccc

SEQ ID NO: 3058500 - DNA, 15 bp, Homo sapiens
tggtgatatagaatt

SEQ ID NO: 3058501 - DNA, 16 bp, Homo sapiens
tggtgatggaaaaagc

SEQ ID NO: 3058502 - DNA, 16 bp, Homo sapiens
tggtgatttcttgcta

SEQ ID NO: 3058503 - DNA, 16 bp, Homo sapiens
tggtgcaatcacagct

SEQ ID NO: 3058504 - DNA, 19 bp, Homo sapiens
tggtgcactttgtaaattc

SEQ ID NO: 3058505 - DNA, 17 bp, Homo sapiens
tggtgcatagcagatgg

SEQ ID NO: 3058506 - DNA, 19 bp, Homo sapiens
tggtgccaaatagccccag

SEQ ID NO: 3058507 - DNA, 20 bp, Homo sapiens
tggtgccaaatagccccaga

SEQ ID NO: 3058508 - DNA, 14 bp, Homo sapiens
tggtgccatcccca

SEQ ID NO: 3058509 - DNA, 16 bp, Homo sapiens
tggtgccatccccagg

SEQ ID NO: 3058510 - DNA, 13 bp, Homo sapiens
tggtgccccagga

SEQ ID NO: 3058511 - DNA, 14 bp, Homo sapiens
tggtgccccaggac

SEQ ID NO: 3058512 - DNA, 17 bp, Homo sapiens
tggtgccccaggaccag

SEQ ID NO: 3058513 - DNA, 19 bp, Homo sapiens
tggtgccccaggaccagct

SEQ ID NO: 3058514 - DNA, 12 bp, Homo sapiens
tggtgcccccag

SEQ ID NO: 3058515 - DNA, 13 bp, Homo sapiens
tggtgcctggcct

SEQ ID NO: 3058516 - DNA, 14 bp, Homo sapiens
tggtgcctggcctg

SEQ ID NO: 3058517 - DNA, 19 bp, Homo sapiens
tggtgcctggcctggcaca

SEQ ID NO: 3058518 - DNA, 17 bp, Homo sapiens
tggtgctaatattttat

SEQ ID NO: 3058519 - DNA, 11 bp, Homo sapiens
tggtgctcagt

SEQ ID NO: 3058520 - DNA, 15 bp, Homo sapiens
tggtgctcagttgta

SEQ ID NO: 3058521 - DNA, 15 bp, Homo sapiens
tggtgctcctgccca

SEQ ID NO: 3058522 - DNA, 18 bp, Homo sapiens
tggtgctcctgcccagcc

SEQ ID NO: 3058523 - DNA, 20 bp, Homo sapiens
tggtgctcctgcccagccac

SEQ ID NO: 3058524 - DNA, 14 bp, Homo sapiens
tggtgctcttgctt

SEQ ID NO: 3058525 - DNA, 15 bp, Homo sapiens
tggtgctgcccaggc

SEQ ID NO: 3058526 - DNA, 18 bp, Homo sapiens
tggtgctgcccaggcctc

SEQ ID NO: 3058527 - DNA, 12 bp, Homo sapiens
tggtgctggttt

SEQ ID NO: 3058528 - DNA, 13 bp, Homo sapiens
tggtggaggagct

SEQ ID NO: 3058529 - DNA, 14 bp, Homo sapiens
tggtggaggagctg

SEQ ID NO: 3058530 - DNA, 18 bp, Homo sapiens
tggtggaggagctgaggg

SEQ ID NO: 3058531 - DNA, 14 bp, Homo sapiens
tggtggatggtgac

SEQ ID NO: 3058532 - DNA, 15 bp, Homo sapiens
tggtggcctggtccc

SEQ ID NO: 3058533 - DNA, 16 bp, Homo sapiens
tggtggcgcaagcctg

SEQ ID NO: 3058534 - DNA, 19 bp, Homo sapiens
tggtgggatgtggttttct

SEQ ID NO: 3058535 - DNA, 20 bp, Homo sapiens
tggtgggccaacaaagaaca

SEQ ID NO: 3058536 - DNA, 13 bp, Homo sapiens
tggtgggcttctg

SEQ ID NO: 3058537 - DNA, 16 bp, Homo sapiens
tggtgggtccatgggc

SEQ ID NO: 3058538 - DNA, 17 bp, Homo sapiens
tggtgggtccatgggca

SEQ ID NO: 3058539 - DNA, 18 bp, Homo sapiens
tggtgggtccatgggcag

SEQ ID NO: 3058540 - DNA, 16 bp, Homo sapiens
tggtggtaaccctggt

SEQ ID NO: 3058541 - DNA, 17 bp, Homo sapiens
tggtggtaaccctggtg

SEQ ID NO: 3058542 - DNA, 14 bp, Homo sapiens
tggtggtattctgt

SEQ ID NO: 3058543 - DNA, 15 bp, Homo sapiens
tggtggtattctgtc

SEQ ID NO: 3058544 - DNA, 17 bp, Homo sapiens
tggtggtattctgtcat

SEQ ID NO: 3058545 - DNA, 16 bp, Homo sapiens
tggtggttcattccac

SEQ ID NO: 3058546 - DNA, 17 bp, Homo sapiens
tggtggttcattccaca

SEQ ID NO: 3058547 - DNA, 18 bp, Homo sapiens
tggtggttcattccacag

SEQ ID NO: 3058548 - DNA, 14 bp, Homo sapiens
tggtggttgctgtt

SEQ ID NO: 3058549 - DNA, 18 bp, Homo sapiens
tggtgtagccctcccact

SEQ ID NO: 3058550 - DNA, 15 bp, Homo sapiens
tggtgtatatcatga

SEQ ID NO: 3058551 - DNA, 22 bp, Homo sapiens
tggtgtatatcatgaagccttg

SEQ ID NO: 3058552 - DNA, 20 bp, Homo sapiens
tggtgtcactgtccctcctg

SEQ ID NO: 3058553 - DNA, 18 bp, Homo sapiens
tggtgtcattattccatc

SEQ ID NO: 3058554 - DNA, 19 bp, Homo sapiens
tggtgtcattattccatct

SEQ ID NO: 3058555 - DNA, 20 bp, Homo sapiens
tggtgtccagcatggatgaa

SEQ ID NO: 3058556 - DNA, 16 bp, Homo sapiens
tggtgtccttcttcct

SEQ ID NO: 3058557 - DNA, 23 bp, Homo sapiens
tggtgtctcttctttagaacagg

SEQ ID NO: 3058558 - DNA, 22 bp, Homo sapiens
tggtgtgaacccgggaggcaga

SEQ ID NO: 3058559 - DNA, 18 bp, Homo sapiens
tggtgtgcatctgtgtgt

SEQ ID NO: 3058560 - DNA, 17 bp, Homo sapiens
tggtgtggcccgtggcc

SEQ ID NO: 3058561 - DNA, 15 bp, Homo sapiens
tggtgtggtgaatgt

SEQ ID NO: 3058562 - DNA, 16 bp, Homo sapiens
tggtgtggtgaatgtg

SEQ ID NO: 3058563 - DNA, 16 bp, Homo sapiens
tggtgtgttggacaga

SEQ ID NO: 3058564 - DNA, 13 bp, Homo sapiens
tggtgtgtttccc

SEQ ID NO: 3058565 - DNA, 22 bp, Homo sapiens
tggtgttcaaaaaacttgtaaa

SEQ ID NO: 3058566 - DNA, 21 bp, Homo sapiens
tggtgttgtcacaaactgtgg

SEQ ID NO: 3058567 - DNA, 14 bp, Homo sapiens
tggttaagagtcca

SEQ ID NO: 3058568 - DNA, 16 bp, Homo sapiens
tggttaagagtccaag

SEQ ID NO: 3058569 - DNA, 17 bp, Homo sapiens
tggttaagagtccaaga

SEQ ID NO: 3058570 - DNA, 17 bp, Homo sapiens
tggttagaaccagcaga

SEQ ID NO: 3058571 - DNA, 14 bp, Homo sapiens
tggttagaagaaaa

SEQ ID NO: 3058572 - DNA, 19 bp, Homo sapiens
tggttagagaagtaagcag

SEQ ID NO: 3058573 - DNA, 18 bp, Homo sapiens
tggttatacaagttcttg

SEQ ID NO: 3058574 - DNA, 18 bp, Homo sapiens
tggttatcctgtgctaca

SEQ ID NO: 3058575 - DNA, 21 bp, Homo sapiens
tggttatcctgtgctacagag

SEQ ID NO: 3058576 - DNA, 13 bp, Homo sapiens
tggttatttaacg

SEQ ID NO: 3058577 - DNA, 12 bp, Homo sapiens
tggttcagtcta

SEQ ID NO: 3058578 - DNA, 23 bp, Homo sapiens
tggttcatccatcatctgctgca

SEQ ID NO: 3058579 - DNA, 16 bp, Homo sapiens
tggttcattaattcta

SEQ ID NO: 3058580 - DNA, 15 bp, Homo sapiens
tggttcattccacag

SEQ ID NO: 3058581 - DNA, 21 bp, Homo sapiens
tggttcctctctcccacccta

SEQ ID NO: 3058582 - DNA, 12 bp, Homo sapiens
tggttctggcca

SEQ ID NO: 3058583 - DNA, 21 bp, Homo sapiens
tggttctgtctagactggcct

SEQ ID NO: 3058584 - DNA, 16 bp, Homo sapiens
tggttctgttttctaa

SEQ ID NO: 3058585 - DNA, 23 bp, Homo sapiens
tggttgaactctggtggcacagg

SEQ ID NO: 3058586 - DNA, 15 bp, Homo sapiens
tggttgaggtggaag

SEQ ID NO: 3058587 - DNA, 22 bp, Homo sapiens
tggttgagttcaggtagctgcc

SEQ ID NO: 3058588 - DNA, 23 bp, Homo sapiens
tggttgattggggtttgatttgc

SEQ ID NO: 3058589 - DNA, 16 bp, Homo sapiens
tggttgcagtctttcc

SEQ ID NO: 3058590 - DNA, 19 bp, Homo sapiens
tggttgctgttttcctccc

SEQ ID NO: 3058591 - DNA, 18 bp, Homo sapiens
tggttggacctattgcca

SEQ ID NO: 3058592 - DNA, 17 bp, Homo sapiens
tgtagctgagctgtgac

SEQ ID NO: 3058593 - DNA, 14 bp, Homo sapiens
tgtagctttcctgg

SEQ ID NO: 3058594 - DNA, 15 bp, Homo sapiens
tgtagctttcctgga

SEQ ID NO: 3058595 - DNA, 16 bp, Homo sapiens
tgtagctttcctggaa

SEQ ID NO: 3058596 - DNA, 18 bp, Homo sapiens
tgtagctttcctggaagt

SEQ ID NO: 3058597 - DNA, 13 bp, Homo sapiens
tgtagcttttcac

SEQ ID NO: 3058598 - DNA, 20 bp, Homo sapiens
tgtaggaattcttttgggga

SEQ ID NO: 3058599 - DNA, 21 bp, Homo sapiens
tgtaggaattcttttggggaa

SEQ ID NO: 3058600 - DNA, 19 bp, Homo sapiens
tgtaggacttttaaacaaa

SEQ ID NO: 3058601 - DNA, 22 bp, Homo sapiens
tgtaggagctgccttggctcag

SEQ ID NO: 3058602 - DNA, 17 bp, Homo sapiens
tgtaggataattagcag

SEQ ID NO: 3058603 - DNA, 16 bp, Homo sapiens
tgtaggcagaggctgc

SEQ ID NO: 3058604 - DNA, 18 bp, Homo sapiens
tgtaggcatcatgcatgt

SEQ ID NO: 3058605 - DNA, 21 bp, Homo sapiens
tgtagggttctgcttttaagt

SEQ ID NO: 3058606 - DNA, 16 bp, Homo sapiens
tgtaggtatagaagat

SEQ ID NO: 3058607 - DNA, 19 bp, Homo sapiens
tgtagtaaactatttatct

SEQ ID NO: 3058608 - DNA, 20 bp, Homo sapiens
tgtagtaaagccgttgttta

SEQ ID NO: 3058609 - DNA, 20 bp, Homo sapiens
tgtagtagtcaaggtgctca

SEQ ID NO: 3058610 - DNA, 18 bp, Homo sapiens
tgtagtagtgcatagaat

SEQ ID NO: 3058611 - DNA, 12 bp, Homo sapiens
tgtagtcccagc

SEQ ID NO: 3058612 - DNA, 17 bp, Homo sapiens
tgtagtgagatagcatt

SEQ ID NO: 3058613 - DNA, 13 bp, Homo sapiens
tgtagttctaaga

SEQ ID NO: 3058614 - DNA, 16 bp, Homo sapiens
tgtagttctttgttcc

SEQ ID NO: 3058615 - DNA, 17 bp, Homo sapiens
tgtagttctttgttcct

SEQ ID NO: 3058616 - DNA, 16 bp, Homo sapiens
tgtagtttacagaaaa

SEQ ID NO: 3058617 - DNA, 13 bp, Homo sapiens
tgtataaatgaca

SEQ ID NO: 3058618 - DNA, 22 bp, Homo sapiens
tgtataaatgtctattattatg

SEQ ID NO: 3058619 - DNA, 15 bp, Homo sapiens
tgtataacaggttat

SEQ ID NO: 3058620 - DNA, 21 bp, Homo sapiens
tgtataacaggttattttagt

SEQ ID NO: 3058621 - DNA, 18 bp, Homo sapiens
tgtataaccctgttacaa

SEQ ID NO: 3058622 - DNA, 17 bp, Homo sapiens
tgtataagatcctagat

SEQ ID NO: 3058623 - DNA, 13 bp, Homo sapiens
tgtataagtagat

SEQ ID NO: 3058624 - DNA, 15 bp, Homo sapiens
tgtataatgactttt

SEQ ID NO: 3058625 - DNA, 19 bp, Homo sapiens
tgtatataaacgtgtcccg

SEQ ID NO: 3058626 - DNA, 14 bp, Homo sapiens
tgtatataaatgtg

SEQ ID NO: 3058627 - DNA, 21 bp, Homo sapiens
tgtatataccttttgttacca

SEQ ID NO: 3058628 - DNA, 21 bp, Homo sapiens
tgtatatacgcatctataaat

SEQ ID NO: 3058629 - DNA, 12 bp, Homo sapiens
tgtatatacttt

SEQ ID NO: 3058630 - DNA, 13 bp, Homo sapiens
tgtatatactttt

SEQ ID NO: 3058631 - DNA, 22 bp, Homo sapiens
tgtatatagctctacacaacat

SEQ ID NO: 3058632 - DNA, 21 bp, Homo sapiens
tgtatataggacaaaatgtta

SEQ ID NO: 3058633 - DNA, 19 bp, Homo sapiens
tgtatatatgtatttctat

SEQ ID NO: 3058634 - DNA, 17 bp, Homo sapiens
tgtatatcatgaagcct

SEQ ID NO: 3058635 - DNA, 18 bp, Homo sapiens
tgtatatcatgaagcctt

SEQ ID NO: 3058636 - DNA, 13 bp, Homo sapiens
tgtatatgactgc

SEQ ID NO: 3058637 - DNA, 19 bp, Homo sapiens
tgtatatggtatatataca

SEQ ID NO: 3058638 - DNA, 20 bp, Homo sapiens
tgtatatgtgcttgtgctca

SEQ ID NO: 3058639 - DNA, 16 bp, Homo sapiens
tgtatattatttctag

SEQ ID NO: 3058640 - DNA, 13 bp, Homo sapiens
tgtatattccttt

SEQ ID NO: 3058641 - DNA, 17 bp, Homo sapiens
tgtatattgggctcaga

SEQ ID NO: 3058642 - DNA, 15 bp, Homo sapiens
tgtatcattaatgta

SEQ ID NO: 3058643 - DNA, 14 bp, Homo sapiens
tgtatccagaggaa

SEQ ID NO: 3058644 - DNA, 20 bp, Homo sapiens
tgtatccatgtaatgatctt

SEQ ID NO: 3058645 - DNA, 13 bp, Homo sapiens
tgtatccattatc

SEQ ID NO: 3058646 - DNA, 22 bp, Homo sapiens
tgtatccattatcatgtgtaat

SEQ ID NO: 3058647 - DNA, 22 bp, Homo sapiens
tgtatcctccctggcagacaca

SEQ ID NO: 3058648 - DNA, 22 bp, Homo sapiens
tgtatcctttatttctgataag

SEQ ID NO: 3058649 - DNA, 16 bp, Homo sapiens
tgtatcgcatattagt

SEQ ID NO: 3058650 - DNA, 16 bp, Homo sapiens
tgtatcgtatagctgt

SEQ ID NO: 3058651 - DNA, 17 bp, Homo sapiens
tgtatcgtatagctgta

SEQ ID NO: 3058652 - DNA, 19 bp, Homo sapiens
tgtatcgtatagctgtatt

SEQ ID NO: 3058653 - DNA, 21 bp, Homo sapiens
tgtatctgtctactttctctt

SEQ ID NO: 3058654 - DNA, 14 bp, Homo sapiens
tgtatctttctatg

SEQ ID NO: 3058655 - DNA, 17 bp, Homo sapiens
tgtatctttttgaaaat

SEQ ID NO: 3058656 - DNA, 18 bp, Homo sapiens
tgtatgaaattataatct

SEQ ID NO: 3058657 - DNA, 19 bp, Homo sapiens
tgtatgaatacagcagcaa

SEQ ID NO: 3058658 - DNA, 15 bp, Homo sapiens
tgtatgaatatttta

SEQ ID NO: 3058659 - DNA, 19 bp, Homo sapiens
tgtatgaatattttatatt

SEQ ID NO: 3058660 - DNA, 19 bp, Homo sapiens
tgtatgatttgttttgaat

SEQ ID NO: 3058661 - DNA, 18 bp, Homo sapiens
tgtatgccaagtgagaag

SEQ ID NO: 3058662 - DNA, 20 bp, Homo sapiens
tgtatgccaagtgagaagat

SEQ ID NO: 3058663 - DNA, 22 bp, Homo sapiens
tgtatgcgtgtccgtctgtctg

SEQ ID NO: 3058664 - DNA, 16 bp, Homo sapiens
tgtatgcttcatacag

SEQ ID NO: 3058665 - DNA, 14 bp, Homo sapiens
tgtatgggcaaaaa

SEQ ID NO: 3058666 - DNA, 21 bp, Homo sapiens
tgtatgggggagattgaactt

SEQ ID NO: 3058667 - DNA, 16 bp, Homo sapiens
tgtatgtatggaaaca

SEQ ID NO: 3058668 - DNA, 14 bp, Homo sapiens
tgtatgtcttggac

SEQ ID NO: 3058669 - DNA, 17 bp, Homo sapiens
tgtatgtggatacagtc

SEQ ID NO: 3058670 - DNA, 22 bp, Homo sapiens
tgtatgtggatacagtcattat

SEQ ID NO: 3058671 - DNA, 17 bp, Homo sapiens
tgtatgttttttttctg

SEQ ID NO: 3058672 - DNA, 13 bp, Homo sapiens
tgtattaacttgt

SEQ ID NO: 3058673 - DNA, 16 bp, Homo sapiens
tgtattaataaataga

SEQ ID NO: 3058674 - DNA, 14 bp, Homo sapiens
tgtattactttaat

SEQ ID NO: 3058675 - DNA, 14 bp, Homo sapiens
tgtattagccagtc

SEQ ID NO: 3058676 - DNA, 13 bp, Homo sapiens
tgtattatttcat

SEQ ID NO: 3058677 - DNA, 16 bp, Homo sapiens
tgtattcatactgaca

SEQ ID NO: 3058678 - DNA, 20 bp, Homo sapiens
tgtattcatgttcatgtgat

SEQ ID NO: 3058679 - DNA, 17 bp, Homo sapiens
tgtattcccagttactt

SEQ ID NO: 3058680 - DNA, 15 bp, Homo sapiens
tgtattcccttcctc

SEQ ID NO: 3058681 - DNA, 19 bp, Homo sapiens
tgtattctttgatgttaac

SEQ ID NO: 3058682 - DNA, 23 bp, Homo sapiens
tgtattctttgatgttaacacat

SEQ ID NO: 3058683 - DNA, 15 bp, Homo sapiens
tgtattgaatcatgt

SEQ ID NO: 3058684 - DNA, 20 bp, Homo sapiens
tgtattgaatcatgtagtat

SEQ ID NO: 3058685 - DNA, 22 bp, Homo sapiens
tgtattgccatcgggtgccaaa

SEQ ID NO: 3058686 - DNA, 22 bp, Homo sapiens
tgtatttaaggaatcaaatctt

SEQ ID NO: 3058687 - DNA, 22 bp, Homo sapiens
tgtatttaatacacaatgcatc

SEQ ID NO: 3058688 - DNA, 11 bp, Homo sapiens
tgtatttaatt

SEQ ID NO: 3058689 - DNA, 12 bp, Homo sapiens
tgtatttatgta

SEQ ID NO: 3058690 - DNA, 15 bp, Homo sapiens
tgtatttatttaaaa

SEQ ID NO: 3058691 - DNA, 16 bp, Homo sapiens
tgtatttatttaaaag

SEQ ID NO: 3058692 - DNA, 20 bp, Homo sapiens
tgtatttatttaaaagattc

SEQ ID NO: 3058693 - DNA, 19 bp, Homo sapiens
tgtatttcctgaaataaat

SEQ ID NO: 3058694 - DNA, 14 bp, Homo sapiens
tgtatttctatata

SEQ ID NO: 3058695 - DNA, 14 bp, Homo sapiens
tgtatttctctgtg

SEQ ID NO: 3058696 - DNA, 16 bp, Homo sapiens
tgtatttctctgtgaa

SEQ ID NO: 3058697 - DNA, 17 bp, Homo sapiens
tgtatttctctgtgaat

SEQ ID NO: 3058698 - DNA, 18 bp, Homo sapiens
tgtatttcttatacgctt

SEQ ID NO: 3058699 - DNA, 13 bp, Homo sapiens
tgtatttgtgact

SEQ ID NO: 3058700 - DNA, 14 bp, Homo sapiens
tgtatttgtgacta

SEQ ID NO: 3058701 - DNA, 16 bp, Homo sapiens
tgtattttaaaataga

SEQ ID NO: 3058702 - DNA, 10 bp, Homo sapiens
tgtattttcc

SEQ ID NO: 3058703 - DNA, 21 bp, Homo sapiens
tgtattttccaagtgtgcata

SEQ ID NO: 3058704 - DNA, 22 bp, Homo sapiens
tgtattttccaagtgtgcatat

SEQ ID NO: 3058705 - DNA, 13 bp, Homo sapiens
tgtattttccacc

SEQ ID NO: 3058706 - DNA, 14 bp, Homo sapiens
tgtattttccacct

SEQ ID NO: 3058707 - DNA, 20 bp, Homo sapiens
tgtattttctgtcactgtag

SEQ ID NO: 3058708 - DNA, 14 bp, Homo sapiens
tgtattttgatgag

SEQ ID NO: 3058709 - DNA, 19 bp, Homo sapiens
tgtattttggaagacatat

SEQ ID NO: 3058710 - DNA, 16 bp, Homo sapiens
tgtatttttatataat

SEQ ID NO: 3058711 - DNA, 18 bp, Homo sapiens
tgtatttttctaaactcc

SEQ ID NO: 3058712 - DNA, 18 bp, Homo sapiens
tgtattttttcatagtcc

SEQ ID NO: 3058713 - DNA, 20 bp, Homo sapiens
tgtattttttcttgcattga

SEQ ID NO: 3058714 - DNA, 21 bp, Homo sapiens
tgtattttttcttgcattgac

SEQ ID NO: 3058715 - DNA, 21 bp, Homo sapiens
tgtcaaacaaagccagaagct

SEQ ID NO: 3058716 - DNA, 15 bp, Homo sapiens
tgtcaaactttgtca

SEQ ID NO: 3058717 - DNA, 14 bp, Homo sapiens
tgtcaacattgtga

SEQ ID NO: 3058718 - DNA, 14 bp, Homo sapiens
tgtcaaccagacag

SEQ ID NO: 3058719 - DNA, 23 bp, Homo sapiens
tgtcaaccagacagagggtcaca

SEQ ID NO: 3058720 - DNA, 19 bp, Homo sapiens
tgtcaagcatattggaaag

SEQ ID NO: 3058721 - DNA, 18 bp, Homo sapiens
tgtcaagcctgtgcaaaa

SEQ ID NO: 3058722 - DNA, 17 bp, Homo sapiens
tgtcaagtataaagtca

SEQ ID NO: 3058723 - DNA, 19 bp, Homo sapiens
tgtcaagtataaagtcagg

SEQ ID NO: 3058724 - DNA, 17 bp, Homo sapiens
tgtcaatggaagaaacc

SEQ ID NO: 3058725 - DNA, 14 bp, Homo sapiens
tgtcacactggcta

SEQ ID NO: 3058726 - DNA, 15 bp, Homo sapiens
tgtcacactggctat

SEQ ID NO: 3058727 - DNA, 15 bp, Homo sapiens
tgtcacagctcttgt

SEQ ID NO: 3058728 - DNA, 16 bp, Homo sapiens
tgtcacagctcttgtt

SEQ ID NO: 3058729 - DNA, 21 bp, Homo sapiens
tgtaaagaaagagagaaaata

SEQ ID NO: 3058730 - DNA, 23 bp, Homo sapiens
tgtaaagaaagagagaaaataaa

SEQ ID NO: 3058731 - DNA, 19 bp, Homo sapiens
tgtaaagatctacatgaat

SEQ ID NO: 3058732 - DNA, 11 bp, Homo sapiens
tgtaaagcaaa

SEQ ID NO: 3058733 - DNA, 17 bp, Homo sapiens
tgtaaagcattccaaca

SEQ ID NO: 3058734 - DNA, 13 bp, Homo sapiens
tgtaaagcttgtc

SEQ ID NO: 3058735 - DNA, 16 bp, Homo sapiens
tgtaaaggagtcaaaa

SEQ ID NO: 3058736 - DNA, 19 bp, Homo sapiens
tgtaaaggagtcaaaacta

SEQ ID NO: 3058737 - DNA, 17 bp, Homo sapiens
tgtaaataaaggaacca

SEQ ID NO: 3058738 - DNA, 13 bp, Homo sapiens
tgtaaataaagtc

SEQ ID NO: 3058739 - DNA, 17 bp, Homo sapiens
tgtaaatactgttggtg

SEQ ID NO: 3058740 - DNA, 14 bp, Homo sapiens
tgtaaatattgtgt

SEQ ID NO: 3058741 - DNA, 15 bp, Homo sapiens
tgtaaatatttttcc

SEQ ID NO: 3058742 - DNA, 16 bp, Homo sapiens
tgtaaatcacatcctt

SEQ ID NO: 3058743 - DNA, 22 bp, Homo sapiens
tgtaaatcgggaaggatgggaa

SEQ ID NO: 3058744 - DNA, 17 bp, Homo sapiens
tgtaaatgaagatcttt

SEQ ID NO: 3058745 - DNA, 20 bp, Homo sapiens
tgtaaatgaagatctttata

SEQ ID NO: 3058746 - DNA, 22 bp, Homo sapiens
tgtaaatgagggcagaaacctt

SEQ ID NO: 3058747 - DNA, 22 bp, Homo sapiens
tgtaaatgtgttggacaaatgt

SEQ ID NO: 3058748 - DNA, 22 bp, Homo sapiens
tgtaaatgttagtttcttggta

SEQ ID NO: 3058749 - DNA, 22 bp, Homo sapiens
tgtaaatgtttgttaaaaataa

SEQ ID NO: 3058750 - DNA, 15 bp, Homo sapiens
tgtaaatttggattt

SEQ ID NO: 3058751 - DNA, 16 bp, Homo sapiens
tgtaaatttggattta

SEQ ID NO: 3058752 - DNA, 14 bp, Homo sapiens
tgtaacaagccaga

SEQ ID NO: 3058753 - DNA, 13 bp, Homo sapiens
tgtaacagaaagg

SEQ ID NO: 3058754 - DNA, 17 bp, Homo sapiens
tgtaacatagtccagag

SEQ ID NO: 3058755 - DNA, 16 bp, Homo sapiens
tgtaacatgatttccc

SEQ ID NO: 3058756 - DNA, 13 bp, Homo sapiens
tgtaaccatttta

SEQ ID NO: 3058757 - DNA, 12 bp, Homo sapiens
tgtaactccacc

SEQ ID NO: 3058758 - DNA, 21 bp, Homo sapiens
tgtaactggcagttttccatt

SEQ ID NO: 3058759 - DNA, 15 bp, Homo sapiens
tgtaacttttaatcc

SEQ ID NO: 3058760 - DNA, 22 bp, Homo sapiens
tgtaagaactaaagaagatctg

SEQ ID NO: 3058761 - DNA, 20 bp, Homo sapiens
tgtaagatcgttctctgcct

SEQ ID NO: 3058762 - DNA, 14 bp, Homo sapiens
tgtaagatgtctgt

SEQ ID NO: 3058763 - DNA, 22 bp, Homo sapiens
tgtaagattatagattctaaag

SEQ ID NO: 3058764 - DNA, 19 bp, Homo sapiens
tgtaagcaacttgcttcta

SEQ ID NO: 3058765 - DNA, 20 bp, Homo sapiens
tgtaagcatactttgtaaat

SEQ ID NO: 3058766 - DNA, 22 bp, Homo sapiens
tgtaagcatactttgtaaatag

SEQ ID NO: 3058767 - DNA, 16 bp, Homo sapiens
tgtaagccctctttaa

SEQ ID NO: 3058768 - DNA, 14 bp, Homo sapiens
tgtaaggctctaga

SEQ ID NO: 3058769 - DNA, 17 bp, Homo sapiens
tgtaaggtctttgtaaa

SEQ ID NO: 3058770 - DNA, 14 bp, Homo sapiens
tgtaagtgggccca

SEQ ID NO: 3058771 - DNA, 18 bp, Homo sapiens
tgtaataatcattttaga

SEQ ID NO: 3058772 - DNA, 17 bp, Homo sapiens
tgtaataatgtaacatg

SEQ ID NO: 3058773 - DNA, 18 bp, Homo sapiens
tgtaatacagacaaactt

SEQ ID NO: 3058774 - DNA, 18 bp, Homo sapiens
tgtaatattctctgatgt

SEQ ID NO: 3058775 - DNA, 20 bp, Homo sapiens
tgtaatattctctgatgttt

SEQ ID NO: 3058776 - DNA, 15 bp, Homo sapiens
tgtaatcaataaacg

SEQ ID NO: 3058777 - DNA, 18 bp, Homo sapiens
tgtaatcaataaacgatt

SEQ ID NO: 3058778 - DNA, 15 bp, Homo sapiens
tgtaatcccagaact

SEQ ID NO: 3058779 - DNA, 14 bp, Homo sapiens
tgtaatcccagcac

SEQ ID NO: 3058780 - DNA, 15 bp, Homo sapiens
tgtaatcccagcact

SEQ ID NO: 3058781 - DNA, 21 bp, Homo sapiens
tgtaatcccagctactcagga

SEQ ID NO: 3058782 - DNA, 23 bp, Homo sapiens
tgtaatcccagctactcaggagg

SEQ ID NO: 3058783 - DNA, 16 bp, Homo sapiens
tgtaatccgaatctct

SEQ ID NO: 3058784 - DNA, 13 bp, Homo sapiens
tgtaatctcaatg

SEQ ID NO: 3058785 - DNA, 20 bp, Homo sapiens
tgtaatggtatcttaaagtg

SEQ ID NO: 3058786 - DNA, 13 bp, Homo sapiens
tgtaatgtcacca

SEQ ID NO: 3058787 - DNA, 16 bp, Homo sapiens
tgtaatgtcaccacct

SEQ ID NO: 3058788 - DNA, 20 bp, Homo sapiens
tgtaatgtcaccaccttccc

SEQ ID NO: 3058789 - DNA, 21 bp, Homo sapiens
tgtaatgttttctttgcaaag

SEQ ID NO: 3058790 - DNA, 16 bp, Homo sapiens
tgtaattatgtaaata

SEQ ID NO: 3058791 - DNA, 13 bp, Homo sapiens
tgtaattcagtgt

SEQ ID NO: 3058792 - DNA, 18 bp, Homo sapiens
tgtaattgtaattttgaa

SEQ ID NO: 3058793 - DNA, 22 bp, Homo sapiens
tgtaattgtgtaaaaaatggaa

SEQ ID NO: 3058794 - DNA, 17 bp, Homo sapiens
tgtaattttagtattaa

SEQ ID NO: 3058795 - DNA, 15 bp, Homo sapiens
tgtaattttgttcct

SEQ ID NO: 3058796 - DNA, 19 bp, Homo sapiens
tgtaattttgttcctgttt

SEQ ID NO: 3058797 - DNA, 20 bp, Homo sapiens
tgtacaaaaattatgcaatt

SEQ ID NO: 3058798 - DNA, 14 bp, Homo sapiens
tgtacaaaggggaa

SEQ ID NO: 3058799 - DNA, 13 bp, Homo sapiens
tgtacaaggtatg

SEQ ID NO: 3058800 - DNA, 16 bp, Homo sapiens
tgtacaagttgctttg

SEQ ID NO: 3058801 - DNA, 16 bp, Homo sapiens
tgtacaataaaaacat

SEQ ID NO: 3058802 - DNA, 20 bp, Homo sapiens
tgtacaataaaaacattgcc

SEQ ID NO: 3058803 - DNA, 18 bp, Homo sapiens
tgtacaatatgaaaagga

SEQ ID NO: 3058804 - DNA, 16 bp, Homo sapiens
tgtacacgtgtcctgt

SEQ ID NO: 3058805 - DNA, 22 bp, Homo sapiens
tgtacagacatatttaactggt

SEQ ID NO: 3058806 - DNA, 22 bp, Homo sapiens
tgtacagagaagaagtgcttgg

SEQ ID NO: 3058807 - DNA, 17 bp, Homo sapiens
tgtacagcgttttaaaa

SEQ ID NO: 3058808 - DNA, 18 bp, Homo sapiens
tgtacagtatttttcaga

SEQ ID NO: 3058809 - DNA, 19 bp, Homo sapiens
tgtacagtatttttcagat

SEQ ID NO: 3058810 - DNA, 12 bp, Homo sapiens
tgtacagtctgt

SEQ ID NO: 3058811 - DNA, 15 bp, Homo sapiens
tgtacagtctgtctt

SEQ ID NO: 3058812 - DNA, 17 bp, Homo sapiens
tgtacagttatctaagt

SEQ ID NO: 3058813 - DNA, 21 bp, Homo sapiens
tgtacagttatctaagttaat

SEQ ID NO: 3058814 - DNA, 17 bp, Homo sapiens
tgtacatagaccctctt

SEQ ID NO: 3058815 - DNA, 12 bp, Homo sapiens
tgtacatgaaat

SEQ ID NO: 3058816 - DNA, 22 bp, Homo sapiens
tgtacatgggactgattctgtt

SEQ ID NO: 3058817 - DNA, 16 bp, Homo sapiens
tgtacatgtacatagt

SEQ ID NO: 3058818 - DNA, 20 bp, Homo sapiens
tgtacatgtgtagcctgtgc

SEQ ID NO: 3058819 - DNA, 17 bp, Homo sapiens
tgtacatttctataaat

SEQ ID NO: 3058820 - DNA, 18 bp, Homo sapiens
tgtacatttctataaata

SEQ ID NO: 3058821 - DNA, 15 bp, Homo sapiens
tgtaccaagaatctt

SEQ ID NO: 3058822 - DNA, 17 bp, Homo sapiens
tgtaccagcccagatgt

SEQ ID NO: 3058823 - DNA, 20 bp, Homo sapiens
tgtaccagcccagatgtttt

SEQ ID NO: 3058824 - DNA, 19 bp, Homo sapiens
tgtaccagtgaatttttgc

SEQ ID NO: 3058825 - DNA, 18 bp, Homo sapiens
tgtaccccctttcccttc

SEQ ID NO: 3058826 - DNA, 14 bp, Homo sapiens
tgtacgctagagca

SEQ ID NO: 3058827 - DNA, 22 bp, Homo sapiens
tggattccccatctcaggccag

SEQ ID NO: 3058828 - DNA, 23 bp, Homo sapiens
tggattcctaaatattttcaaga

SEQ ID NO: 3058829 - DNA, 17 bp, Homo sapiens
tggattcttatgtagca

SEQ ID NO: 3058830 - DNA, 19 bp, Homo sapiens
tggccccgcctgcctgcca

SEQ ID NO: 3058831 - DNA, 14 bp, Homo sapiens
tggcccctgagatc

SEQ ID NO: 3058832 - DNA, 20 bp, Homo sapiens
tggcccctgctgtctctctg

SEQ ID NO: 3058833 - DNA, 13 bp, Homo sapiens
tggcccctggaac

SEQ ID NO: 3058834 - DNA, 19 bp, Homo sapiens
tggcccctggaacctttcc

SEQ ID NO: 3058835 - DNA, 16 bp, Homo sapiens
tggcccctttgggccc

SEQ ID NO: 3058836 - DNA, 19 bp, Homo sapiens
tggcccctttgggccctgc

SEQ ID NO: 3058837 - DNA, 14 bp, Homo sapiens
tggcccgtggcctg

SEQ ID NO: 3058838 - DNA, 11 bp, Homo sapiens
tggccctgccc

SEQ ID NO: 3058839 - DNA, 16 bp, Homo sapiens
tggccctgccttcttc

SEQ ID NO: 3058840 - DNA, 13 bp, Homo sapiens
tggccctggcctg

SEQ ID NO: 3058841 - DNA, 14 bp, Homo sapiens
tggccctggcctgc

SEQ ID NO: 3058842 - DNA, 18 bp, Homo sapiens
tggccctggcctgctggg

SEQ ID NO: 3058843 - DNA, 20 bp, Homo sapiens
tggccctggcgggtggctgc

SEQ ID NO: 3058844 - DNA, 21 bp, Homo sapiens
tggccctggcgggtggctgca

SEQ ID NO: 3058845 - DNA, 23 bp, Homo sapiens
tggccctggcgggtggctgcaag

SEQ ID NO: 3058846 - DNA, 12 bp, Homo sapiens
tggccctgggcg

SEQ ID NO: 3058847 - DNA, 13 bp, Homo sapiens
tggccctgtgcag

SEQ ID NO: 3058848 - DNA, 15 bp, Homo sapiens
tggccctgtgcagac

SEQ ID NO: 3058849 - DNA, 21 bp, Homo sapiens
tggccctgtgcagaccttact

SEQ ID NO: 3058850 - DNA, 14 bp, Homo sapiens
tggcccttccagtg

SEQ ID NO: 3058851 - DNA, 18 bp, Homo sapiens
tggcccttcctcctccac

SEQ ID NO: 3058852 - DNA, 13 bp, Homo sapiens
tggcccttttata

SEQ ID NO: 3058853 - DNA, 17 bp, Homo sapiens
tggccgagtccaagctg

SEQ ID NO: 3058854 - DNA, 19 bp, Homo sapiens
tggccgagtccaagctggg

SEQ ID NO: 3058855 - DNA, 19 bp, Homo sapiens
tggccgcacgcctctccct

SEQ ID NO: 3058856 - DNA, 21 bp, Homo sapiens
tggccgcacgcctctccctgc

SEQ ID NO: 3058857 - DNA, 14 bp, Homo sapiens
tggccggccagcca

SEQ ID NO: 3058858 - DNA, 23 bp, Homo sapiens
tggccggccagccagccactcta

SEQ ID NO: 3058859 - DNA, 13 bp, Homo sapiens
tggccggctgtgc

SEQ ID NO: 3058860 - DNA, 20 bp, Homo sapiens
tggccggctgtgctcagaga

SEQ ID NO: 3058861 - DNA, 16 bp, Homo sapiens
tggccgggcacagtgg

SEQ ID NO: 3058862 - DNA, 23 bp, Homo sapiens
tggccgggcacagtggctcacgc

SEQ ID NO: 3058863 - DNA, 17 bp, Homo sapiens
tggccgttcagcctgtc

SEQ ID NO: 3058864 - DNA, 16 bp, Homo sapiens
tggcctaacctgccga

SEQ ID NO: 3058865 - DNA, 22 bp, Homo sapiens
tggcctaccttgtgagggagag

SEQ ID NO: 3058866 - DNA, 16 bp, Homo sapiens
tggcctagacttgtgt

SEQ ID NO: 3058867 - DNA, 13 bp, Homo sapiens
tggcctatctcct

SEQ ID NO: 3058868 - DNA, 15 bp, Homo sapiens
tggcctatgcacata

SEQ ID NO: 3058869 - DNA, 17 bp, Homo sapiens
tggcctatgcacatatg

SEQ ID NO: 3058870 - DNA, 13 bp, Homo sapiens
tggcctcaagatc

SEQ ID NO: 3058871 - DNA, 21 bp, Homo sapiens
tggcctcaagatcaatgaaat

SEQ ID NO: 3058872 - DNA, 20 bp, Homo sapiens
tggcctcagactgcacccag

SEQ ID NO: 3058873 - DNA, 23 bp, Homo sapiens
tggcctcagactgcacccaggag

SEQ ID NO: 3058874 - DNA, 13 bp, Homo sapiens
tggcctcagggcc

SEQ ID NO: 3058875 - DNA, 18 bp, Homo sapiens
tggcctcagggccaggaa

SEQ ID NO: 3058876 - DNA, 19 bp, Homo sapiens
tggcctcagggccaggaag

SEQ ID NO: 3058877 - DNA, 22 bp, Homo sapiens
tggcctccaggcccgtctgtcc

SEQ ID NO: 3058878 - DNA, 18 bp, Homo sapiens
tggcctcccaaagtgctg

SEQ ID NO: 3058879 - DNA, 16 bp, Homo sapiens
tggcctccctccgtcc

SEQ ID NO: 3058880 - DNA, 19 bp, Homo sapiens
tggcctccgatgcctggcc

SEQ ID NO: 3058881 - DNA, 20 bp, Homo sapiens
tggcctccgatgcctggcct

SEQ ID NO: 3058882 - DNA, 12 bp, Homo sapiens
tggcctctgctg

SEQ ID NO: 3058883 - DNA, 18 bp, Homo sapiens
tggcctctgctggtctct

SEQ ID NO: 3058884 - DNA, 23 bp, Homo sapiens
tggcctcttggataccagctcag

SEQ ID NO: 3058885 - DNA, 19 bp, Homo sapiens
tggcctcttggcacctgcc

SEQ ID NO: 3058886 - DNA, 22 bp, Homo sapiens
tggcctcttggcacctgcctag

SEQ ID NO: 3058887 - DNA, 14 bp, Homo sapiens
tggcctctttgtct

SEQ ID NO: 3058888 - DNA, 22 bp, Homo sapiens
tggcctgatcagaccacggctc

SEQ ID NO: 3058889 - DNA, 11 bp, Homo sapiens
tggcctgccca

SEQ ID NO: 3058890 - DNA, 12 bp, Homo sapiens
tggcctgcccag

SEQ ID NO: 3058891 - DNA, 15 bp, Homo sapiens
tggcctgcccagcct

SEQ ID NO: 3058892 - DNA, 21 bp, Homo sapiens
tggcctgctgggctctccacc

SEQ ID NO: 3058893 - DNA, 22 bp, Homo sapiens
tggcctgctgggctctccacct

SEQ ID NO: 3058894 - DNA, 14 bp, Homo sapiens
tggcctggaggctc

SEQ ID NO: 3058895 - DNA, 21 bp, Homo sapiens
tggcctggaggctcagcccac

SEQ ID NO: 3058896 - DNA, 18 bp, Homo sapiens
tggcctggcatctgtgtg

SEQ ID NO: 3058897 - DNA, 16 bp, Homo sapiens
tggcctgggcttggcc

SEQ ID NO: 3058898 - DNA, 16 bp, Homo sapiens
tggcctggtccctggt

SEQ ID NO: 3058899 - DNA, 23 bp, Homo sapiens
tggcctgtagaatagcctgtggc

SEQ ID NO: 3058900 - DNA, 15 bp, Homo sapiens
tggcctgtgagtctc

SEQ ID NO: 3058901 - DNA, 12 bp, Homo sapiens
tggcctgtgtgg

SEQ ID NO: 3058902 - DNA, 20 bp, Homo sapiens
tggccttgcagctggcccac

SEQ ID NO: 3058903 - DNA, 22 bp, Homo sapiens
tggccttgcccgtcgtgtgctg

SEQ ID NO: 3058904 - DNA, 18 bp, Homo sapiens
tggccttggtatgtgcca

SEQ ID NO: 3058905 - DNA, 21 bp, Homo sapiens
tggccttggtatgtgccaggc

SEQ ID NO: 3058906 - DNA, 20 bp, Homo sapiens
tggccttgtcctcagccagt

SEQ ID NO: 3058907 - DNA, 23 bp, Homo sapiens
tggccttttgctacgtgcctccc

SEQ ID NO: 3058908 - DNA, 17 bp, Homo sapiens
tggcgacactcagggca

SEQ ID NO: 3058909 - DNA, 22 bp, Homo sapiens
tggcgaggcctctctcaggagc

SEQ ID NO: 3058910 - DNA, 16 bp, Homo sapiens
tggcgcaatctcgcct

SEQ ID NO: 3058911 - DNA, 17 bp, Homo sapiens
tggcgccaccagctctg

SEQ ID NO: 3058912 - DNA, 14 bp, Homo sapiens
tggcgcgcctgcct

SEQ ID NO: 3058913 - DNA, 16 bp, Homo sapiens
tggcgcgcctgccttt

SEQ ID NO: 3058914 - DNA, 21 bp, Homo sapiens
tggcgctgtgctagctttcct

SEQ ID NO: 3058915 - DNA, 14 bp, Homo sapiens
tggcggagagtttt

SEQ ID NO: 3058916 - DNA, 20 bp, Homo sapiens
tggcggcagggccaggctgg

SEQ ID NO: 3058917 - DNA, 20 bp, Homo sapiens
tggcgggtccacttgccagg

SEQ ID NO: 3058918 - DNA, 23 bp, Homo sapiens
tggcgggtccacttgccagggct

SEQ ID NO: 3058919 - DNA, 15 bp, Homo sapiens
tggcggtggccacag

SEQ ID NO: 3058920 - DNA, 16 bp, Homo sapiens
tggcgtggattaaact

SEQ ID NO: 3058921 - DNA, 11 bp, Homo sapiens
tggcgtggccc

SEQ ID NO: 3058922 - DNA, 17 bp, Homo sapiens
tggcgttgtgggcaggc

SEQ ID NO: 3058923 - DNA, 14 bp, Homo sapiens
tggctacagtacca

SEQ ID NO: 3058924 - DNA, 18 bp, Homo sapiens
tggctagtcaagctcctc

SEQ ID NO: 3058925 - DNA, 23 bp, Homo sapiens
tggctagtcaagctcctcctccc

SEQ ID NO: 3058926 - DNA, 16 bp, Homo sapiens
tggctagtcagagaga

SEQ ID NO: 3058927 - DNA, 19 bp, Homo sapiens
tggctagtggggtgaacag

SEQ ID NO: 3058928 - DNA, 22 bp, Homo sapiens
tggctatcaaagaataagaaaa

SEQ ID NO: 3058929 - DNA, 16 bp, Homo sapiens
tggctatgagggcctt

SEQ ID NO: 3058930 - DNA, 15 bp, Homo sapiens
tggctatttaaaact

SEQ ID NO: 3058931 - DNA, 20 bp, Homo sapiens
tggctcacagtggggccagc

SEQ ID NO: 3058932 - DNA, 21 bp, Homo sapiens
tggctcacgccccgctgtgtc

SEQ ID NO: 3058933 - DNA, 17 bp, Homo sapiens
tggctcacgcctgtaat

SEQ ID NO: 3058934 - DNA, 22 bp, Homo sapiens
tggctcacgtctgtaatcccag

SEQ ID NO: 3058935 - DNA, 16 bp, Homo sapiens
tggctcagccagcact

SEQ ID NO: 3058936 - DNA, 24 bp, Homo sapiens
tggctcagctcggggagccttagc

SEQ ID NO: 3058937 - DNA, 15 bp, Homo sapiens
tggctcagctgtggt

SEQ ID NO: 3058938 - DNA, 23 bp, Homo sapiens
tggctcagctgtggtcccaccca

SEQ ID NO: 3058939 - DNA, 14 bp, Homo sapiens
tggctcagggtggt

SEQ ID NO: 3058940 - DNA, 18 bp, Homo sapiens
tggctccaaaccctcgag

SEQ ID NO: 3058941 - DNA, 22 bp, Homo sapiens
tggctccagaatgtgctgcctt

SEQ ID NO: 3058942 - DNA, 21 bp, Homo sapiens
tggctccagatgcagggcagt

SEQ ID NO: 3058943 - DNA, 23 bp, Homo sapiens
tggctccagatgcagggcagtca

SEQ ID NO: 3058944 - DNA, 13 bp, Homo sapiens
tggctccagcacc

SEQ ID NO: 3058945 - DNA, 17 bp, Homo sapiens
tggctccccctctgctt

SEQ ID NO: 3058946 - DNA, 19 bp, Homo sapiens
tggctccccctctgcttct

SEQ ID NO: 3058947 - DNA, 19 bp, Homo sapiens
tggctccccgagggctcag

SEQ ID NO: 3058948 - DNA, 20 bp, Homo sapiens
tggctccccgagggctcaga

SEQ ID NO: 3058949 - DNA, 22 bp, Homo sapiens
tggctccccgagggctcagaag

SEQ ID NO: 3058950 - DNA, 14 bp, Homo sapiens
tggctccctctctc

SEQ ID NO: 3058951 - DNA, 15 bp, Homo sapiens
tggctccctctctcc

SEQ ID NO: 3058952 - DNA, 19 bp, Homo sapiens
tggctccctctctcctgga

SEQ ID NO: 3058953 - DNA, 20 bp, Homo sapiens
tggctccctctctcctggac

SEQ ID NO: 3058954 - DNA, 21 bp, Homo sapiens
tggctccctctctcctggact

SEQ ID NO: 3058955 - DNA, 15 bp, Homo sapiens
tggctccggcctctg

SEQ ID NO: 3058956 - DNA, 23 bp, Homo sapiens
tggctccgtggccccgccctcag

SEQ ID NO: 3058957 - DNA, 13 bp, Homo sapiens
tggctcctctcag

SEQ ID NO: 3058958 - DNA, 12 bp, Homo sapiens
tgccccctcagg

SEQ ID NO: 3058959 - DNA, 15 bp, Homo sapiens
tgccccgcgggcttt

SEQ ID NO: 3058960 - DNA, 22 bp, Homo sapiens
tgccccgcgggctttgttgctg

SEQ ID NO: 3058961 - DNA, 13 bp, Homo sapiens
tgccccggagctg

SEQ ID NO: 3058962 - DNA, 14 bp, Homo sapiens
tgccccgtctctgt

SEQ ID NO: 3058963 - DNA, 19 bp, Homo sapiens
tgcccctaaagatgggagg

SEQ ID NO: 3058964 - DNA, 16 bp, Homo sapiens
tgcccctcagagactg

SEQ ID NO: 3058965 - DNA, 18 bp, Homo sapiens
tgcccctccagagacagg

SEQ ID NO: 3058966 - DNA, 17 bp, Homo sapiens
tgcccctccctagatcc

SEQ ID NO: 3058967 - DNA, 15 bp, Homo sapiens
tgcccctctccttct

SEQ ID NO: 3058968 - DNA, 12 bp, Homo sapiens
tgcccctctctg

SEQ ID NO: 3058969 - DNA, 13 bp, Homo sapiens
tgcccctctctgg

SEQ ID NO: 3058970 - DNA, 14 bp, Homo sapiens
tgcccctctctggg

SEQ ID NO: 3058971 - DNA, 19 bp, Homo sapiens
tgcccctgctgctgtcacc

SEQ ID NO: 3058972 - DNA, 14 bp, Homo sapiens
tgcccctggctctg

SEQ ID NO: 3058973 - DNA, 16 bp, Homo sapiens
tgcccctgttcatgtt

SEQ ID NO: 3058974 - DNA, 22 bp, Homo sapiens
tgccccttcattgatttcctgt

SEQ ID NO: 3058975 - DNA, 20 bp, Homo sapiens
tgccccttgacaactggcag

SEQ ID NO: 3058976 - DNA, 19 bp, Homo sapiens
tgccccttggggggcttga

SEQ ID NO: 3058977 - DNA, 18 bp, Homo sapiens
tgcccgcaccctggcctg

SEQ ID NO: 3058978 - DNA, 19 bp, Homo sapiens
tgcccgcaccctggcctgg

SEQ ID NO: 3058979 - DNA, 20 bp, Homo sapiens
tgcccgcaccctggcctggt

SEQ ID NO: 3058980 - DNA, 21 bp, Homo sapiens
tgcccgcaccctggcctggtc

SEQ ID NO: 3058981 - DNA, 18 bp, Homo sapiens
tgcccgcagacctctgga

SEQ ID NO: 3058982 - DNA, 23 bp, Homo sapiens
tgcccgccacatggtgtggccat

SEQ ID NO: 3058983 - DNA, 18 bp, Homo sapiens
tgcccgcctgcccacctg

SEQ ID NO: 3058984 - DNA, 18 bp, Homo sapiens
tgcccggcgcctgccctg

SEQ ID NO: 3058985 - DNA, 17 bp, Homo sapiens
tgcccgggagctcagga

SEQ ID NO: 3058986 - DNA, 18 bp, Homo sapiens
tgcccgggagctcaggaa

SEQ ID NO: 3058987 - DNA, 23 bp, Homo sapiens
tgcccggggtggggtgcactcgc

SEQ ID NO: 3058988 - DNA, 21 bp, Homo sapiens
tgcccggtccccttcccaggg

SEQ ID NO: 3058989 - DNA, 14 bp, Homo sapiens
tgcccgtgtacata

SEQ ID NO: 3058990 - DNA, 14 bp, Homo sapiens
tgcccgttcttgaa

SEQ ID NO: 3058991 - DNA, 17 bp, Homo sapiens
tgcccgttcttgaaatg

SEQ ID NO: 3058992 - DNA, 22 bp, Homo sapiens
tgccctaagtgatttccacagg

SEQ ID NO: 3058993 - DNA, 22 bp, Homo sapiens
tgccctcctctcccgtctcgcc

SEQ ID NO: 3058994 - DNA, 18 bp, Homo sapiens
tgccctcctgagcctccg

SEQ ID NO: 3058995 - DNA, 17 bp, Homo sapiens
tgccctctgctgctgcc

SEQ ID NO: 3058996 - DNA, 18 bp, Homo sapiens
tgccctctgctgctgccc

SEQ ID NO: 3058997 - DNA, 17 bp, Homo sapiens
tgccctgaaagggccct

SEQ ID NO: 3058998 - DNA, 12 bp, Homo sapiens
tgccctgagggg

SEQ ID NO: 3058999 - DNA, 21 bp, Homo sapiens
tgccctgctatttcaggccct

SEQ ID NO: 3059000 - DNA, 15 bp, Homo sapiens
tgccctgctcctaag

SEQ ID NO: 3059001 - DNA, 17 bp, Homo sapiens
tgccctgggggccgtgc

SEQ ID NO: 3059002 - DNA, 12 bp, Homo sapiens
tgccctgtgcaa

SEQ ID NO: 3059003 - DNA, 16 bp, Homo sapiens
tgccctgtggacagga

SEQ ID NO: 3059004 - DNA, 19 bp, Homo sapiens
tgccctgtgggaccccagg

SEQ ID NO: 3059005 - DNA, 22 bp, Homo sapiens
tgccctgtgggaccccaggccc

SEQ ID NO: 3059006 - DNA, 19 bp, Homo sapiens
tgccctgtttcctgctgct

SEQ ID NO: 3059007 - DNA, 15 bp, Homo sapiens
tgcccttcctgaccc

SEQ ID NO: 3059008 - DNA, 19 bp, Homo sapiens
tgcccttggaggccagcca

SEQ ID NO: 3059009 - DNA, 18 bp, Homo sapiens
tgcccttggtttctgggg

SEQ ID NO: 3059010 - DNA, 16 bp, Homo sapiens
tgcccttgtcccactc

SEQ ID NO: 3059011 - DNA, 17 bp, Homo sapiens
tgcccttgtcccactca

SEQ ID NO: 3059012 - DNA, 22 bp, Homo sapiens
tgcccttttcctgggccttctc

SEQ ID NO: 3059013 - DNA, 17 bp, Homo sapiens
tgccgacctcgtcctcc

SEQ ID NO: 3059014 - DNA, 20 bp, Homo sapiens
tgccgagacagaccctctgc

SEQ ID NO: 3059015 - DNA, 22 bp, Homo sapiens
tgccgagagtccatcagcctcc

SEQ ID NO: 3059016 - DNA, 15 bp, Homo sapiens
tgccgcaaattgtac

SEQ ID NO: 3059017 - DNA, 13 bp, Homo sapiens
tgccgcaccccag

SEQ ID NO: 3059018 - DNA, 15 bp, Homo sapiens
tgccgcactctggcg

SEQ ID NO: 3059019 - DNA, 17 bp, Homo sapiens
tgccgcagcggtgggaa

SEQ ID NO: 3059020 - DNA, 21 bp, Homo sapiens
tgccgcaggcgcggcggctct

SEQ ID NO: 3059021 - DNA, 23 bp, Homo sapiens
tgccgcccgaggtggctgcctgg

SEQ ID NO: 3059022 - DNA, 21 bp, Homo sapiens
tgccgccgcccgctggggacc

SEQ ID NO: 3059023 - DNA, 16 bp, Homo sapiens
tgccgcctcaatgtgg

SEQ ID NO: 3059024 - DNA, 12 bp, Homo sapiens
tgccgcttctgg

SEQ ID NO: 3059025 - DNA, 21 bp, Homo sapiens
tgccggagaggaagagacact

SEQ ID NO: 3059026 - DNA, 13 bp, Homo sapiens
tgccggaggcctt

SEQ ID NO: 3059027 - DNA, 15 bp, Homo sapiens
tgccggccctggggc

SEQ ID NO: 3059028 - DNA, 13 bp, Homo sapiens
tgccgggccccca

SEQ ID NO: 3059029 - DNA, 19 bp, Homo sapiens
tgccgtcagtgctgtgctg

SEQ ID NO: 3059030 - DNA, 13 bp, Homo sapiens
tgccgtctctgga

SEQ ID NO: 3059031 - DNA, 21 bp, Homo sapiens
tgccgtgtgtctcgtctcctg

SEQ ID NO: 3059032 - DNA, 16 bp, Homo sapiens
tgccgttactctccaa

SEQ ID NO: 3059033 - DNA, 22 bp, Homo sapiens
tgcctacatgttctcatgcatg

SEQ ID NO: 3059034 - DNA, 22 bp, Homo sapiens
tgcctaccgggttctcctgatt

SEQ ID NO: 3059035 - DNA, 16 bp, Homo sapiens
tgcctagaatctttat

SEQ ID NO: 3059036 - DNA, 16 bp, Homo sapiens
tgcctagctcttgggc

SEQ ID NO: 3059037 - DNA, 17 bp, Homo sapiens
tgcctagctcttgggcc

SEQ ID NO: 3059038 - DNA, 18 bp, Homo sapiens
tgcctagctcttgggcct

SEQ ID NO: 3059039 - DNA, 19 bp, Homo sapiens
tgcctagctcttgggcctg

SEQ ID NO: 3059040 - DNA, 20 bp, Homo sapiens
tgcctagctcttgggcctga

SEQ ID NO: 3059041 - DNA, 22 bp, Homo sapiens
tgcctagctcttgggcctgacc

SEQ ID NO: 3059042 - DNA, 16 bp, Homo sapiens
tgcctagtgatgtaga

SEQ ID NO: 3059043 - DNA, 17 bp, Homo sapiens
tcttctgtatataaatg

SEQ ID NO: 3059044 - DNA, 12 bp, Homo sapiens
tcttctgtccat

SEQ ID NO: 3059045 - DNA, 16 bp, Homo sapiens
tcttctgtccatcagt

SEQ ID NO: 3059046 - DNA, 20 bp, Homo sapiens
tcttctgtgccctggctcca

SEQ ID NO: 3059047 - DNA, 13 bp, Homo sapiens
tcttcttcaccat

SEQ ID NO: 3059048 - DNA, 15 bp, Homo sapiens
tcttctttttctttt

SEQ ID NO: 3059049 - DNA, 22 bp, Homo sapiens
tcttgaaaaaaaaaatatgtat

SEQ ID NO: 3059050 - DNA, 15 bp, Homo sapiens
tcttgaaaaaaaata

SEQ ID NO: 3059051 - DNA, 19 bp, Homo sapiens
tcttgaaaaaaaatagatg

SEQ ID NO: 3059052 - DNA, 13 bp, Homo sapiens
tcttgaaacatgt

SEQ ID NO: 3059053 - DNA, 23 bp, Homo sapiens
tcttgaaagattcaggtatgttg

SEQ ID NO: 3059054 - DNA, 21 bp, Homo sapiens
tcttgaaaggtccaaatgttt

SEQ ID NO: 3059055 - DNA, 15 bp, Homo sapiens
tcttgaactgagctt

SEQ ID NO: 3059056 - DNA, 18 bp, Homo sapiens
tcttgaagtccaggactg

SEQ ID NO: 3059057 - DNA, 18 bp, Homo sapiens
tcttgaagtcctggcttc

SEQ ID NO: 3059058 - DNA, 22 bp, Homo sapiens
tcttgaagtcctggcttcaggc

SEQ ID NO: 3059059 - DNA, 23 bp, Homo sapiens
tcttgaatttaataatctgtagg

SEQ ID NO: 3059060 - DNA, 15 bp, Homo sapiens
tcttgaatttctgac

SEQ ID NO: 3059061 - DNA, 14 bp, Homo sapiens
tcttgacagtctga

SEQ ID NO: 3059062 - DNA, 18 bp, Homo sapiens
tcttgacctgaactctgc

SEQ ID NO: 3059063 - DNA, 22 bp, Homo sapiens
tcttgaggtggtagtaaaacac

SEQ ID NO: 3059064 - DNA, 21 bp, Homo sapiens
tcttgagttttgttttaaaat

SEQ ID NO: 3059065 - DNA, 13 bp, Homo sapiens
tcttgatctcctg

SEQ ID NO: 3059066 - DNA, 13 bp, Homo sapiens
tcttgatcttaaa

SEQ ID NO: 3059067 - DNA, 15 bp, Homo sapiens
tcttgatcttaaaga

SEQ ID NO: 3059068 - DNA, 13 bp, Homo sapiens
tcttgatgcatgc

SEQ ID NO: 3059069 - DNA, 17 bp, Homo sapiens
tcttgattataaatgtt

SEQ ID NO: 3059070 - DNA, 19 bp, Homo sapiens
tcttgattataaatgtttg

SEQ ID NO: 3059071 - DNA, 14 bp, Homo sapiens
tcttgattatccat

SEQ ID NO: 3059072 - DNA, 17 bp, Homo sapiens
tcttgcaagcatgcttg

SEQ ID NO: 3059073 - DNA, 13 bp, Homo sapiens
tcttgcaggctga

SEQ ID NO: 3059074 - DNA, 21 bp, Homo sapiens
tcttgcatggcattaattgtt

SEQ ID NO: 3059075 - DNA, 22 bp, Homo sapiens
tcttgcattgaatttagtcatt

SEQ ID NO: 3059076 - DNA, 14 bp, Homo sapiens
tcttgccctgggga

SEQ ID NO: 3059077 - DNA, 18 bp, Homo sapiens
tcttgcccttcctactcc

SEQ ID NO: 3059078 - DNA, 21 bp, Homo sapiens
tcttgcccttcctactcctca

SEQ ID NO: 3059079 - DNA, 19 bp, Homo sapiens
tcttgcctccaggtgcaga

SEQ ID NO: 3059080 - DNA, 14 bp, Homo sapiens
tcttgccttcccct

SEQ ID NO: 3059081 - DNA, 20 bp, Homo sapiens
tcttgctatcggggaagcca

SEQ ID NO: 3059082 - DNA, 21 bp, Homo sapiens
tcttgctccaataaaggaaca

SEQ ID NO: 3059083 - DNA, 12 bp, Homo sapiens
tcttgctctcac

SEQ ID NO: 3059084 - DNA, 13 bp, Homo sapiens
tcttgctctgtaa

SEQ ID NO: 3059085 - DNA, 14 bp, Homo sapiens
tcttgctgttgaca

SEQ ID NO: 3059086 - DNA, 19 bp, Homo sapiens
tcttgctgttgacatattt

SEQ ID NO: 3059087 - DNA, 19 bp, Homo sapiens
tcttgcttaccttgactgt

SEQ ID NO: 3059088 - DNA, 17 bp, Homo sapiens
tcttgcttccaagacca

SEQ ID NO: 3059089 - DNA, 17 bp, Homo sapiens
tcttgcttttctttgga

SEQ ID NO: 3059090 - DNA, 14 bp, Homo sapiens
tcttggaaaaacag

SEQ ID NO: 3059091 - DNA, 16 bp, Homo sapiens
tcttggaaagaaacaa

SEQ ID NO: 3059092 - DNA, 17 bp, Homo sapiens
tcttggacactgtacaa

SEQ ID NO: 3059093 - DNA, 13 bp, Homo sapiens
tcttggagcctgc

SEQ ID NO: 3059094 - DNA, 15 bp, Homo sapiens
tcttggagcctgcag

SEQ ID NO: 3059095 - DNA, 15 bp, Homo sapiens
tcttggattagcctt

SEQ ID NO: 3059096 - DNA, 17 bp, Homo sapiens
tcttggcacctgcctag

SEQ ID NO: 3059097 - DNA, 18 bp, Homo sapiens
tcttggcagcacctgtct

SEQ ID NO: 3059098 - DNA, 17 bp, Homo sapiens
tcttggcttggtgagga

SEQ ID NO: 3059099 - DNA, 15 bp, Homo sapiens
tcttggctttcatgt

SEQ ID NO: 3059100 - DNA, 12 bp, Homo sapiens
tcttgggaaata

SEQ ID NO: 3059101 - DNA, 20 bp, Homo sapiens
tcttgggaaatatgaatgcc

SEQ ID NO: 3059102 - DNA, 21 bp, Homo sapiens
tcttggggacatctctttgaa

SEQ ID NO: 3059103 - DNA, 18 bp, Homo sapiens
tcttggggcccagtgcat

SEQ ID NO: 3059104 - DNA, 16 bp, Homo sapiens
tcttgggtctatgcct

SEQ ID NO: 3059105 - DNA, 15 bp, Homo sapiens
tcttgggttattatt

SEQ ID NO: 3059106 - DNA, 20 bp, Homo sapiens
tcttggtaaagtccttttct

SEQ ID NO: 3059107 - DNA, 18 bp, Homo sapiens
tcttggttagagaagtaa

SEQ ID NO: 3059108 - DNA, 14 bp, Homo sapiens
tcttggtttccaaa

SEQ ID NO: 3059109 - DNA, 13 bp, Homo sapiens
tcttgtaaataaa

SEQ ID NO: 3059110 - DNA, 17 bp, Homo sapiens
tcttgtaaataaagccc

SEQ ID NO: 3059111 - DNA, 17 bp, Homo sapiens
tcttgtacatgtgtagc

SEQ ID NO: 3059112 - DNA, 17 bp, Homo sapiens
tcttgtagcccaggctg

SEQ ID NO: 3059113 - DNA, 20 bp, Homo sapiens
tcttgtataagatcctagat

SEQ ID NO: 3059114 - DNA, 16 bp, Homo sapiens
tcttgtattgctccat

SEQ ID NO: 3059115 - DNA, 23 bp, Homo sapiens
tcttgtcaggtggaccctgtaaa

SEQ ID NO: 3059116 - DNA, 15 bp, Homo sapiens
tcttgtcctcctgtt

SEQ ID NO: 3059117 - DNA, 13 bp, Homo sapiens
tcttgtctgtgtg

SEQ ID NO: 3059118 - DNA, 12 bp, Homo sapiens
tcttgtctgtta

SEQ ID NO: 3059119 - DNA, 23 bp, Homo sapiens
tcttgtcttttcccctcattgca

SEQ ID NO: 3059120 - DNA, 10 bp, Homo sapiens
tcttgtgaag

SEQ ID NO: 3059121 - DNA, 18 bp, Homo sapiens
tcttgtgaagttgttttt

SEQ ID NO: 3059122 - DNA, 17 bp, Homo sapiens
tcttgtgacgtgcactg

SEQ ID NO: 3059123 - DNA, 13 bp, Homo sapiens
tcttgtgatgttt

SEQ ID NO: 3059124 - DNA, 22 bp, Homo sapiens
tcttgtggaagtgcatctactt

SEQ ID NO: 3059125 - DNA, 23 bp, Homo sapiens
tcttgtggaagtgcatctacttg

SEQ ID NO: 3059126 - DNA, 11 bp, Homo sapiens
tcttgtgtatt

SEQ ID NO: 3059127 - DNA, 20 bp, Homo sapiens
tcttgtgtatttctctgtga

SEQ ID NO: 3059128 - DNA, 15 bp, Homo sapiens
tcttgtgtcctggct

SEQ ID NO: 3059129 - DNA, 13 bp, Homo sapiens
tcttgttattatt

SEQ ID NO: 3059130 - DNA, 13 bp, Homo sapiens
tcttgttctgtca

SEQ ID NO: 3059131 - DNA, 23 bp, Homo sapiens
tcttgttgtttatatgaaaacac

SEQ ID NO: 3059132 - DNA, 17 bp, Homo sapiens
tcttgtttaaaaaaaga

SEQ ID NO: 3059133 - DNA, 16 bp, Homo sapiens
tcttgtttctgtttag

SEQ ID NO: 3059134 - DNA, 21 bp, Homo sapiens
tcttgtttctgtttagtccgt

SEQ ID NO: 3059135 - DNA, 22 bp, Homo sapiens
tcttgtttcttttcacatagct

SEQ ID NO: 3059136 - DNA, 21 bp, Homo sapiens
tcttgtttggagggatcattt

SEQ ID NO: 3059137 - DNA, 15 bp, Homo sapiens
tcttgtttgtcagca

SEQ ID NO: 3059138 - DNA, 18 bp, Homo sapiens
tcttgtttgtcagcatct

SEQ ID NO: 3059139 - DNA, 23 bp, Homo sapiens
tcttgtttgtcagcatctgacca

SEQ ID NO: 3059140 - DNA, 22 bp, Homo sapiens
tcttgttttcaaagggactttt

SEQ ID NO: 3059141 - DNA, 13 bp, Homo sapiens
tcttgtttttcca

SEQ ID NO: 3059142 - DNA, 18 bp, Homo sapiens
tctttaaaaaagaaatta

SEQ ID NO: 3059143 - DNA, 15 bp, Homo sapiens
tctttaaaattacaa

SEQ ID NO: 3059144 - DNA, 10 bp, Homo sapiens
tctttaagag

SEQ ID NO: 3059145 - DNA, 11 bp, Homo sapiens
tctttaagaga

SEQ ID NO: 3059146 - DNA, 13 bp, Homo sapiens
tctttaatctgtt

SEQ ID NO: 3059147 - DNA, 15 bp, Homo sapiens
tctttaatctgttgt

SEQ ID NO: 3059148 - DNA, 16 bp, Homo sapiens
tctttaatgctgtctt

SEQ ID NO: 3059149 - DNA, 19 bp, Homo sapiens
tctttaatgctgtctttgt

SEQ ID NO: 3059150 - DNA, 14 bp, Homo sapiens
tctttaccttcatt

SEQ ID NO: 3059151 - DNA, 18 bp, Homo sapiens
tctttaccttcatttcat

SEQ ID NO: 3059152 - DNA, 20 bp, Homo sapiens
tctttaccttcatttcatcc

SEQ ID NO: 3059153 - DNA, 15 bp, Homo sapiens
tctttactagactga

SEQ ID NO: 3059154 - DNA, 23 bp, Homo sapiens
tctttactcctcacacttactgt

SEQ ID NO: 3059155 - DNA, 11 bp, Homo sapiens
tctttagaaca

SEQ ID NO: 3059156 - DNA, 16 bp, Homo sapiens
tctttagagaactgaa

SEQ ID NO: 3059157 - DNA, 20 bp, Homo sapiens
tctttagagaactgaaaaga

SEQ ID NO: 3059158 - DNA, 16 bp, Homo sapiens
tctttaggtctttgta

SEQ ID NO: 3059159 - DNA, 18 bp, Homo sapiens
tctttagttgaattccaa

SEQ ID NO: 3059160 - DNA, 20 bp, Homo sapiens
tctttatacaacagtgctaa

SEQ ID NO: 3059161 - DNA, 18 bp, Homo sapiens
tctttatactctcttccc

SEQ ID NO: 3059162 - DNA, 21 bp, Homo sapiens
tctttatactctcttcccttt

SEQ ID NO: 3059163 - DNA, 21 bp, Homo sapiens
tctttatacttaaacagcttt

SEQ ID NO: 3059164 - DNA, 15 bp, Homo sapiens
tctttatagttgtag

SEQ ID NO: 3059165 - DNA, 12 bp, Homo sapiens
tctttatataag

SEQ ID NO: 3059166 - DNA, 23 bp, Homo sapiens
tctttatatacaataatggaaaa

SEQ ID NO: 3059167 - DNA, 19 bp, Homo sapiens
tctttatcctaaaaatctg

SEQ ID NO: 3059168 - DNA, 23 bp, Homo sapiens
tctttatgagctaaaaatatgca

SEQ ID NO: 3059169 - DNA, 14 bp, Homo sapiens
tctttattcctagt

SEQ ID NO: 3059170 - DNA, 20 bp, Homo sapiens
tctttcaaaaccttttgaaa

SEQ ID NO: 3059171 - DNA, 23 bp, Homo sapiens
tctttcaaaaccttttgaaatta

SEQ ID NO: 3059172 - DNA, 15 bp, Homo sapiens
tctttcacaaggtat

SEQ ID NO: 3059173 - DNA, 17 bp, Homo sapiens
tctttcacatttaaata

SEQ ID NO: 3059174 - DNA, 14 bp, Homo sapiens
tctttcacttgaaa

SEQ ID NO: 3059175 - DNA, 19 bp, Homo sapiens
tgaaaattgtataaattac

SEQ ID NO: 3059176 - DNA, 23 bp, Homo sapiens
tgaaacaatactcataatgtgaa

SEQ ID NO: 3059177 - DNA, 21 bp, Homo sapiens
tgaaacaccaagatgtctgtc

SEQ ID NO: 3059178 - DNA, 13 bp, Homo sapiens
tgaaacagaaaaa

SEQ ID NO: 3059179 - DNA, 14 bp, Homo sapiens
tgaaacagaaaaat

SEQ ID NO: 3059180 - DNA, 23 bp, Homo sapiens
tgaaacagaaaaatatgtaccaa

SEQ ID NO: 3059181 - DNA, 9 bp, Homo sapiens
tgaaacagc

SEQ ID NO: 3059182 - DNA, 14 bp, Homo sapiens
tgaaacagctgcct

SEQ ID NO: 3059183 - DNA, 15 bp, Homo sapiens
tgaaacagctgcctt

SEQ ID NO: 3059184 - DNA, 16 bp, Homo sapiens
tgaaacagctgcctta

SEQ ID NO: 3059185 - DNA, 19 bp, Homo sapiens
tgaaacagctgccttagct

SEQ ID NO: 3059186 - DNA, 19 bp, Homo sapiens
tgaaacaggtctttgccat

SEQ ID NO: 3059187 - DNA, 12 bp, Homo sapiens
tgaaacattatt

SEQ ID NO: 3059188 - DNA, 22 bp, Homo sapiens
tgactatcacacactttctctt

SEQ ID NO: 3059189 - DNA, 23 bp, Homo sapiens
tgactatcacacactttctcttc

SEQ ID NO: 3059190 - DNA, 22 bp, Homo sapiens
tgactatgccgtcttctgccct

SEQ ID NO: 3059191 - DNA, 12 bp, Homo sapiens
tgactattatgt

SEQ ID NO: 3059192 - DNA, 16 bp, Homo sapiens
tgactattatgttgtt

SEQ ID NO: 3059193 - DNA, 12 bp, Homo sapiens
tgactcaagttt

SEQ ID NO: 3059194 - DNA, 14 bp, Homo sapiens
tgactcacccaagc

SEQ ID NO: 3059195 - DNA, 15 bp, Homo sapiens
tgactcacccaagca

SEQ ID NO: 3059196 - DNA, 20 bp, Homo sapiens
tgactcagcagaggcagtgg

SEQ ID NO: 3059197 - DNA, 13 bp, Homo sapiens
tgactcagggctc

SEQ ID NO: 3059198 - DNA, 22 bp, Homo sapiens
tgactcaggtggtgtccttctt

SEQ ID NO: 3059199 - DNA, 17 bp, Homo sapiens
tgactcccattttggtg

SEQ ID NO: 3059200 - DNA, 23 bp, Homo sapiens
tgactcccattttggtgtgcatc

SEQ ID NO: 3059201 - DNA, 17 bp, Homo sapiens
tgactccctccccaccc

SEQ ID NO: 3059202 - DNA, 17 bp, Homo sapiens
tgactctagcaaggctc

SEQ ID NO: 3059203 - DNA, 13 bp, Homo sapiens
tgactctcctgcc

SEQ ID NO: 3059204 - DNA, 15 bp, Homo sapiens
tgactctctgagctg

SEQ ID NO: 3059205 - DNA, 19 bp, Homo sapiens
tgactctctgagctgggga

SEQ ID NO: 3059206 - DNA, 14 bp, Homo sapiens
tgactctgggcagg

SEQ ID NO: 3059207 - DNA, 15 bp, Homo sapiens
tgactctgggcaggg

SEQ ID NO: 3059208 - DNA, 24 bp, Homo sapiens
tgactctgttgatctacccgtgcc

SEQ ID NO: 3059209 - DNA, 22 bp, Homo sapiens
tgactgaaagaagaacagctgt

SEQ ID NO: 3059210 - DNA, 19 bp, Homo sapiens
tgactgaagcgaacatctt

SEQ ID NO: 3059211 - DNA, 20 bp, Homo sapiens
tgactgaagcgaacatcttc

SEQ ID NO: 3059212 - DNA, 21 bp, Homo sapiens
tgactgaagcgaacatcttca

SEQ ID NO: 3059213 - DNA, 23 bp, Homo sapiens
tgactgaagcgaacatcttcata

SEQ ID NO: 3059214 - DNA, 21 bp, Homo sapiens
tgactgagtctggcaaacatg

SEQ ID NO: 3059215 - DNA, 14 bp, Homo sapiens
tgactgcccagcat

SEQ ID NO: 3059216 - DNA, 21 bp, Homo sapiens
tgactgcccagcatttgggta

SEQ ID NO: 3059217 - DNA, 16 bp, Homo sapiens
tgactgccccaactcc

SEQ ID NO: 3059218 - DNA, 19 bp, Homo sapiens
tgactgccccaactcctgg

SEQ ID NO: 3059219 - DNA, 14 bp, Homo sapiens
tgactgctgctccc

SEQ ID NO: 3059220 - DNA, 16 bp, Homo sapiens
tgactgctgctcccca

SEQ ID NO: 3059221 - DNA, 15 bp, Homo sapiens
tgactgggctgggtt

SEQ ID NO: 3059222 - DNA, 17 bp, Homo sapiens
tgactgggctgggtttg

SEQ ID NO: 3059223 - DNA, 16 bp, Homo sapiens
tgactggttatcacac

SEQ ID NO: 3059224 - DNA, 12 bp, Homo sapiens
tgactgtatttt

SEQ ID NO: 3059225 - DNA, 14 bp, Homo sapiens
tgactgtcagcaag

SEQ ID NO: 3059226 - DNA, 23 bp, Homo sapiens
tgactgtggagttccattcttgg

SEQ ID NO: 3059227 - DNA, 13 bp, Homo sapiens
tgacttagatatt

SEQ ID NO: 3059228 - DNA, 23 bp, Homo sapiens
tgacttagatattaaaatttggt

SEQ ID NO: 3059229 - DNA, 17 bp, Homo sapiens
tgacttaggtttcagga

SEQ ID NO: 3059230 - DNA, 20 bp, Homo sapiens
tgacttaggtttcaggaagt

SEQ ID NO: 3059231 - DNA, 12 bp, Homo sapiens
tgacttcaggtg

SEQ ID NO: 3059232 - DNA, 20 bp, Homo sapiens
tgacttcaggtggagagcac

SEQ ID NO: 3059233 - DNA, 24 bp, Homo sapiens
tgacttcaggtggagagcactaga

SEQ ID NO: 3059234 - DNA, 14 bp, Homo sapiens
tgacttccacacct

SEQ ID NO: 3059235 - DNA, 23 bp, Homo sapiens
tgacttggatcccaaagcaagga

SEQ ID NO: 3059236 - DNA, 14 bp, Homo sapiens
tgactttaaagatg

SEQ ID NO: 3059237 - DNA, 20 bp, Homo sapiens
tgactttaagtaatcaggat

SEQ ID NO: 3059238 - DNA, 15 bp, Homo sapiens
tgacttttaaaattt

SEQ ID NO: 3059239 - DNA, 17 bp, Homo sapiens
tgacttttgaagaacaa

SEQ ID NO: 3059240 - DNA, 19 bp, Homo sapiens
tgagaaaaaaaaaaaagac

SEQ ID NO: 3059241 - DNA, 15 bp, Homo sapiens
tgagaaacactattt

SEQ ID NO: 3059242 - DNA, 20 bp, Homo sapiens
tgagaaacactatttgtgac

SEQ ID NO: 3059243 - DNA, 23 bp, Homo sapiens
tgagaaacactatttgtgacttt

SEQ ID NO: 3059244 - DNA, 18 bp, Homo sapiens
tgagaaacctgtatcttt

SEQ ID NO: 3059245 - DNA, 12 bp, Homo sapiens
tgagaaactcta

SEQ ID NO: 3059246 - DNA, 12 bp, Homo sapiens
tgagaaagaaag

SEQ ID NO: 3059247 - DNA, 14 bp, Homo sapiens
tgagaaagaaagta

SEQ ID NO: 3059248 - DNA, 17 bp, Homo sapiens
tgagaaagcccacctgg

SEQ ID NO: 3059249 - DNA, 18 bp, Homo sapiens
tgagaaagcccacctggg

SEQ ID NO: 3059250 - DNA, 14 bp, Homo sapiens
tgagaaagccttct

SEQ ID NO: 3059251 - DNA, 16 bp, Homo sapiens
tgagaaagccttcttt

SEQ ID NO: 3059252 - DNA, 18 bp, Homo sapiens
tgagaaagctaaagtttg

SEQ ID NO: 3059253 - DNA, 13 bp, Homo sapiens
tgagaaaggacag

SEQ ID NO: 3059254 - DNA, 19 bp, Homo sapiens
tgagaaaggacagagccag

SEQ ID NO: 3059255 - DNA, 13 bp, Homo sapiens
tgagaaatgatga

SEQ ID NO: 3059256 - DNA, 21 bp, Homo sapiens
tgagaacatggtgtgtgtctc

SEQ ID NO: 3059257 - DNA, 22 bp, Homo sapiens
tgagaacggtgaccgcctcctg

SEQ ID NO: 3059258 - DNA, 15 bp, Homo sapiens
tgagaactccagctg

SEQ ID NO: 3059259 - DNA, 22 bp, Homo sapiens
tgagaactccagctggtgcccc

SEQ ID NO: 3059260 - DNA, 16 bp, Homo sapiens
tgagaactgaggagcg

SEQ ID NO: 3059261 - DNA, 17 bp, Homo sapiens
tgagaactggttcttgc

SEQ ID NO: 3059262 - DNA, 18 bp, Homo sapiens
tgagaactggttcttgcc

SEQ ID NO: 3059263 - DNA, 20 bp, Homo sapiens
tgagaagaaaatggaaccag

SEQ ID NO: 3059264 - DNA, 21 bp, Homo sapiens
tgagaagtactttgtgctgat

SEQ ID NO: 3059265 - DNA, 13 bp, Homo sapiens
tgagaatcccaaa

SEQ ID NO: 3059266 - DNA, 14 bp, Homo sapiens
tgagacaaaagaaa

SEQ ID NO: 3059267 - DNA, 22 bp, Homo sapiens
tgagacacggagcccagccctc

SEQ ID NO: 3059268 - DNA, 21 bp, Homo sapiens
tgagacaggaggattgcctga

SEQ ID NO: 3059269 - DNA, 16 bp, Homo sapiens
tgagacagggtttttt

SEQ ID NO: 3059270 - DNA, 18 bp, Homo sapiens
tgagacagggttttttca

SEQ ID NO: 3059271 - DNA, 19 bp, Homo sapiens
tgagacagggttttttcat

SEQ ID NO: 3059272 - DNA, 22 bp, Homo sapiens
tgagacagggttttttcatttt

SEQ ID NO: 3059273 - DNA, 23 bp, Homo sapiens
tgagacagggttttttcattttt

SEQ ID NO: 3059274 - DNA, 17 bp, Homo sapiens
tgagacagtgcacatga

SEQ ID NO: 3059275 - DNA, 16 bp, Homo sapiens
tgagacagtgggaaat

SEQ ID NO: 3059276 - DNA, 17 bp, Homo sapiens
tgagacagtgggaaata

SEQ ID NO: 3059277 - DNA, 22 bp, Homo sapiens
tgagacagtttactttgccaac

SEQ ID NO: 3059278 - DNA, 13 bp, Homo sapiens
tgagaccacagag

SEQ ID NO: 3059279 - DNA, 21 bp, Homo sapiens
tgagaccacagagagagggga

SEQ ID NO: 3059280 - DNA, 18 bp, Homo sapiens
tgagaccaggctgggcat

SEQ ID NO: 3059281 - DNA, 16 bp, Homo sapiens
tgagacccaggagccg

SEQ ID NO: 3059282 - DNA, 13 bp, Homo sapiens
tgagacctcagcc

SEQ ID NO: 3059283 - DNA, 16 bp, Homo sapiens
tgagacctcagccatg

SEQ ID NO: 3059284 - DNA, 19 bp, Homo sapiens
tgagacctcagccatgagg

SEQ ID NO: 3059285 - DNA, 15 bp, Homo sapiens
tgagaccttgatgag

SEQ ID NO: 3059286 - DNA, 15 bp, Homo sapiens
tgagaccttgtctct

SEQ ID NO: 3059287 - DNA, 22 bp, Homo sapiens
tgagacggtgtctcgctgcatc

SEQ ID NO: 3059288 - DNA, 21 bp, Homo sapiens
tgagactcaaaggtgatgtaa

SEQ ID NO: 3059289 - DNA, 21 bp, Homo sapiens
tgagacttaattttgtctttc

SEQ ID NO: 3059290 - DNA, 16 bp, Homo sapiens
tgagagacagtaacac

SEQ ID NO: 3059291 - DNA, 21 bp, Homo sapiens
tgagagacccaaggaggaaaa

SEQ ID NO: 3059292 - DNA, 19 bp, Homo sapiens
tgagagagaaatgctgttc

SEQ ID NO: 3059293 - DNA, 16 bp, Homo sapiens
tgagagctttctgcct

SEQ ID NO: 3059294 - DNA, 14 bp, Homo sapiens
tgagaggctgcctc

SEQ ID NO: 3059295 - DNA, 11 bp, Homo sapiens
tgagaggggag

SEQ ID NO: 3059296 - DNA, 12 bp, Homo sapiens
tgagaggggagg

SEQ ID NO: 3059297 - DNA, 13 bp, Homo sapiens
tgagaggggaggg

SEQ ID NO: 3059298 - DNA, 17 bp, Homo sapiens
tgagaggggagggaggg

SEQ ID NO: 3059299 - DNA, 14 bp, Homo sapiens
tgagaggtttgact

SEQ ID NO: 3059300 - DNA, 14 bp, Homo sapiens
tgagagtctagatt

SEQ ID NO: 3059301 - DNA, 24 bp, Homo sapiens
tgagagtgtcttcacggcaggaca

SEQ ID NO: 3059302 - DNA, 18 bp, Homo sapiens
tgagagttcgtgaagagg

SEQ ID NO: 3059303 - DNA, 21 bp, Homo sapiens
tgagagttttgtcttgaatgt

SEQ ID NO: 3059304 - DNA, 15 bp, Homo sapiens
tgagatacatacaga

SEQ ID NO: 3059305 - DNA, 21 bp, Homo sapiens
tgagataccagcgaggaggct

SEQ ID NO: 3059306 - DNA, 19 bp, Homo sapiens
tgagatatatctttatact

SEQ ID NO: 3059307 - DNA, 21 bp, Homo sapiens
tgagatatatctttatactta

SEQ ID NO: 3059308 - DNA, 22 bp, Homo sapiens
tgagatatatctttatacttaa

SEQ ID NO: 3059309 - DNA, 14 bp, Homo sapiens
tgagatattaaatt

SEQ ID NO: 3059310 - DNA, 18 bp, Homo sapiens
tgagatattaaattctca

SEQ ID NO: 3059311 - DNA, 16 bp, Homo sapiens
tgagatgattaaaatg

SEQ ID NO: 3059312 - DNA, 20 bp, Homo sapiens
tgagatggagtttctctctt

SEQ ID NO: 3059313 - DNA, 20 bp, Homo sapiens
tgagatgtgtggactgtggc

SEQ ID NO: 3059314 - DNA, 14 bp, Homo sapiens
tgagattctgaagt

SEQ ID NO: 3059315 - DNA, 12 bp, Homo sapiens
tgagattgtcct

SEQ ID NO: 3059316 - DNA, 22 bp, Homo sapiens
tgagattgtcctcatttctcca

SEQ ID NO: 3059317 - DNA, 23 bp, Homo sapiens
tgagattgttttctttttctacc

SEQ ID NO: 3059318 - DNA, 20 bp, Homo sapiens
tgagatttaagttcctgctg

SEQ ID NO: 3059319 - DNA, 13 bp, Homo sapiens
tgagatttcttaa

SEQ ID NO: 3059320 - DNA, 15 bp, Homo sapiens
tgatgaaaatattta

SEQ ID NO: 3059321 - DNA, 21 bp, Homo sapiens
tgatgaagccgaccttagatt

SEQ ID NO: 3059322 - DNA, 16 bp, Homo sapiens
tgatgaatctacattt

SEQ ID NO: 3059323 - DNA, 15 bp, Homo sapiens
tgatgaatgaggaac

SEQ ID NO: 3059324 - DNA, 18 bp, Homo sapiens
tgatgacaaaaaatgttt

SEQ ID NO: 3059325 - DNA, 13 bp, Homo sapiens
tgatgacaatcaa

SEQ ID NO: 3059326 - DNA, 14 bp, Homo sapiens
tgatgaccaaagtc

SEQ ID NO: 3059327 - DNA, 21 bp, Homo sapiens
tgatgagatattaaattctca

SEQ ID NO: 3059328 - DNA, 16 bp, Homo sapiens
tgatgagctcctcttc

SEQ ID NO: 3059329 - DNA, 17 bp, Homo sapiens
tgatgaggctgatcatt

SEQ ID NO: 3059330 - DNA, 22 bp, Homo sapiens
tgatgaggtattttttcctttt

SEQ ID NO: 3059331 - DNA, 15 bp, Homo sapiens
tgatgataataataa

SEQ ID NO: 3059332 - DNA, 13 bp, Homo sapiens
tgatgcaaggatt

SEQ ID NO: 3059333 - DNA, 23 bp, Homo sapiens
tgatgcatgcactgttccccctg

SEQ ID NO: 3059334 - DNA, 19 bp, Homo sapiens
tgatgccaggttctatttg

SEQ ID NO: 3059335 - DNA, 14 bp, Homo sapiens
tgatgccctgccct

SEQ ID NO: 3059336 - DNA, 12 bp, Homo sapiens
tgatgcctgccc

SEQ ID NO: 3059337 - DNA, 22 bp, Homo sapiens
tgatgcctgcccgcaccctggc

SEQ ID NO: 3059338 - DNA, 16 bp, Homo sapiens
tgatgctcccaagcaa

SEQ ID NO: 3059339 - DNA, 14 bp, Homo sapiens
tgatgctttggaag

SEQ ID NO: 3059340 - DNA, 23 bp, Homo sapiens
tgatgctttggaagatgcagaag

SEQ ID NO: 3059341 - DNA, 20 bp, Homo sapiens
tgatgcttttctctcagcat

SEQ ID NO: 3059342 - DNA, 19 bp, Homo sapiens
tgatggaagaaaatggaat

SEQ ID NO: 3059343 - DNA, 20 bp, Homo sapiens
tgatggattccaaaccagga

SEQ ID NO: 3059344 - DNA, 16 bp, Homo sapiens
tgatggcaacagatct

SEQ ID NO: 3059345 - DNA, 23 bp, Homo sapiens
tgatggcaacagatctggaacct

SEQ ID NO: 3059346 - DNA, 13 bp, Homo sapiens
tgatgggaaaata

SEQ ID NO: 3059347 - DNA, 20 bp, Homo sapiens
tgatgggaaaatatttcctg

SEQ ID NO: 3059348 - DNA, 18 bp, Homo sapiens
tgatgggccaccggggca

SEQ ID NO: 3059349 - DNA, 17 bp, Homo sapiens
tgatgggctccccagga

SEQ ID NO: 3059350 - DNA, 12 bp, Homo sapiens
tgatgggctttt

SEQ ID NO: 3059351 - DNA, 22 bp, Homo sapiens
tgatggggccctaattcagcca

SEQ ID NO: 3059352 - DNA, 16 bp, Homo sapiens
tgatggtcacttaaaa

SEQ ID NO: 3059353 - DNA, 15 bp, Homo sapiens
tgatggtctggtcta

SEQ ID NO: 3059354 - DNA, 19 bp, Homo sapiens
tgatgtaagtttacctatg

SEQ ID NO: 3059355 - DNA, 19 bp, Homo sapiens
tgatgtactgattgagaag

SEQ ID NO: 3059356 - DNA, 21 bp, Homo sapiens
tgatgtactgattgagaagtt

SEQ ID NO: 3059357 - DNA, 21 bp, Homo sapiens
tgatgtattagtagagcaacc

SEQ ID NO: 3059358 - DNA, 18 bp, Homo sapiens
tgatgtccttaaaatgtg

SEQ ID NO: 3059359 - DNA, 17 bp, Homo sapiens
tgatgtgagtgtgtgtg

SEQ ID NO: 3059360 - DNA, 16 bp, Homo sapiens
tgatgtggactgtctt

SEQ ID NO: 3059361 - DNA, 13 bp, Homo sapiens
tgatgtgtacatc

SEQ ID NO: 3059362 - DNA, 13 bp, Homo sapiens
tgatgttatctta

SEQ ID NO: 3059363 - DNA, 20 bp, Homo sapiens
tgatgttcagtgtaatttct

SEQ ID NO: 3059364 - DNA, 16 bp, Homo sapiens
tgatgttgccttaata

SEQ ID NO: 3059365 - DNA, 18 bp, Homo sapiens
tgattaaataagattcta

SEQ ID NO: 3059366 - DNA, 22 bp, Homo sapiens
tgattaaataagattctaacgg

SEQ ID NO: 3059367 - DNA, 22 bp, Homo sapiens
tgattaacaatgtattttaata

SEQ ID NO: 3059368 - DNA, 21 bp, Homo sapiens
tgattaactgtgaataataaa

SEQ ID NO: 3059369 - DNA, 12 bp, Homo sapiens
tgattaaggcag

SEQ ID NO: 3059370 - DNA, 16 bp, Homo sapiens
tgattactctttgctt

SEQ ID NO: 3059371 - DNA, 14 bp, Homo sapiens
tgattactgcaatc

SEQ ID NO: 3059372 - DNA, 18 bp, Homo sapiens
tgattactgcaatcactg

SEQ ID NO: 3059373 - DNA, 17 bp, Homo sapiens
tgattagtataatattt

SEQ ID NO: 3059374 - DNA, 19 bp, Homo sapiens
tgattagttttcttgttgc

SEQ ID NO: 3059375 - DNA, 20 bp, Homo sapiens
tgattatagcaatgtgattt

SEQ ID NO: 3059376 - DNA, 22 bp, Homo sapiens
tgattatagcaatgtgattttg

SEQ ID NO: 3059377 - DNA, 17 bp, Homo sapiens
tgattatggacatcgat

SEQ ID NO: 3059378 - DNA, 22 bp, Homo sapiens
tgattatggacatcgatatgaa

SEQ ID NO: 3059379 - DNA, 13 bp, Homo sapiens
tgattcaaaatat

SEQ ID NO: 3059380 - DNA, 14 bp, Homo sapiens
tgattcaaaatatt

SEQ ID NO: 3059381 - DNA, 17 bp, Homo sapiens
tgattcaaaatatttaa

SEQ ID NO: 3059382 - DNA, 23 bp, Homo sapiens
tgattcaactaaaaaaaaaaaag

SEQ ID NO: 3059383 - DNA, 24 bp, Homo sapiens
tgattcagtgttaaatgtgatgaa

SEQ ID NO: 3059384 - DNA, 15 bp, Homo sapiens
tgattcccaactcct

SEQ ID NO: 3059385 - DNA, 20 bp, Homo sapiens
tgattcccaactcctttctg

SEQ ID NO: 3059386 - DNA, 14 bp, Homo sapiens
tgattcccttttct

SEQ ID NO: 3059387 - DNA, 18 bp, Homo sapiens
tgattcgaatgacactgt

SEQ ID NO: 3059388 - DNA, 22 bp, Homo sapiens
tgattctatttatatgtacatg

SEQ ID NO: 3059389 - DNA, 19 bp, Homo sapiens
tgattctgaagcttatgtt

SEQ ID NO: 3059390 - DNA, 21 bp, Homo sapiens
tgattctgaagcttatgtttc

SEQ ID NO: 3059391 - DNA, 23 bp, Homo sapiens
tgattctgaagcttatgtttctt

SEQ ID NO: 3059392 - DNA, 17 bp, Homo sapiens
tgattctgcttgagaat

SEQ ID NO: 3059393 - DNA, 13 bp, Homo sapiens
tgattctgttcta

SEQ ID NO: 3059394 - DNA, 13 bp, Homo sapiens
tgattgacagctt

SEQ ID NO: 3059395 - DNA, 13 bp, Homo sapiens
tgattgagaagtt

SEQ ID NO: 3059396 - DNA, 15 bp, Homo sapiens
tgattgctaaatgta

SEQ ID NO: 3059397 - DNA, 16 bp, Homo sapiens
tgattgctaaatgtaa

SEQ ID NO: 3059398 - DNA, 18 bp, Homo sapiens
tgattgcttgagctcagg

SEQ ID NO: 3059399 - DNA, 12 bp, Homo sapiens
tgattgctttta

SEQ ID NO: 3059400 - DNA, 17 bp, Homo sapiens
tgattgggaataaatat

SEQ ID NO: 3059401 - DNA, 20 bp, Homo sapiens
tgattgggaataaatatgcc

SEQ ID NO: 3059402 - DNA, 14 bp, Homo sapiens
tgattgtcagccac

SEQ ID NO: 3059403 - DNA, 18 bp, Homo sapiens
tgattgtgaattccttaa

SEQ ID NO: 3059404 - DNA, 21 bp, Homo sapiens
tgattgtggaatggagattca

SEQ ID NO: 3059405 - DNA, 15 bp, Homo sapiens
tgattgttcttttgt

SEQ ID NO: 3059406 - DNA, 14 bp, Homo sapiens
tgattgttggcaca

SEQ ID NO: 3059407 - DNA, 23 bp, Homo sapiens
tgattgttttaacacagtaccta

SEQ ID NO: 3059408 - DNA, 13 bp, Homo sapiens
tgatttaatagtg

SEQ ID NO: 3059409 - DNA, 17 bp, Homo sapiens
tgatttaatagtgttaa

SEQ ID NO: 3059410 - DNA, 21 bp, Homo sapiens
tgatttaatagtgttaatcaa

SEQ ID NO: 3059411 - DNA, 16 bp, Homo sapiens
tgatttaatgttttca

SEQ ID NO: 3059412 - DNA, 17 bp, Homo sapiens
tgatttagcaatgctgt

SEQ ID NO: 3059413 - DNA, 16 bp, Homo sapiens
tgatttaggagaagcc

SEQ ID NO: 3059414 - DNA, 21 bp, Homo sapiens
tgatttaggagaagccaggaa

SEQ ID NO: 3059415 - DNA, 22 bp, Homo sapiens
tgatttaggagaagccaggaat

SEQ ID NO: 3059416 - DNA, 22 bp, Homo sapiens
tgatttagtgtttttacctctg

SEQ ID NO: 3059417 - DNA, 15 bp, Homo sapiens
tgatttataaacaga

SEQ ID NO: 3059418 - DNA, 17 bp, Homo sapiens
tgatttataaacagaca

SEQ ID NO: 3059419 - DNA, 15 bp, Homo sapiens
tgatttattgaaatt

SEQ ID NO: 3059420 - DNA, 11 bp, Homo sapiens
tgatttcagaa

SEQ ID NO: 3059421 - DNA, 20 bp, Homo sapiens
tgatttcccactgcactcca

SEQ ID NO: 3059422 - DNA, 19 bp, Homo sapiens
tgatttccctccagagaaa

SEQ ID NO: 3059423 - DNA, 21 bp, Homo sapiens
tgatttccctccagagaaagc

SEQ ID NO: 3059424 - DNA, 13 bp, Homo sapiens
tgatttccttgaa

SEQ ID NO: 3059425 - DNA, 23 bp, Homo sapiens
tgatttccttgaatgtggcttga

SEQ ID NO: 3059426 - DNA, 20 bp, Homo sapiens
tgatttcttttcttcctggc

SEQ ID NO: 3059427 - DNA, 15 bp, Homo sapiens
tgatttgcaggattt

SEQ ID NO: 3059428 - DNA, 18 bp, Homo sapiens
tgatttgcattgaacaca

SEQ ID NO: 3059429 - DNA, 21 bp, Homo sapiens
tgatttgccactgatattcag

SEQ ID NO: 3059430 - DNA, 22 bp, Homo sapiens
tgatttgccactgatattcaga

SEQ ID NO: 3059431 - DNA, 14 bp, Homo sapiens
tgattttaactctg

SEQ ID NO: 3059432 - DNA, 15 bp, Homo sapiens
tgattttaactctgt

SEQ ID NO: 3059433 - DNA, 18 bp, Homo sapiens
tgattttacaaattaata

SEQ ID NO: 3059434 - DNA, 22 bp, Homo sapiens
tgattttaggagctaaggctct

SEQ ID NO: 3059435 - DNA, 12 bp, Homo sapiens
tgattttatgat

SEQ ID NO: 3059436 - DNA, 18 bp, Homo sapiens
tgattttatttttgcaaa

SEQ ID NO: 3059437 - DNA, 13 bp, Homo sapiens
tgattttctggat

SEQ ID NO: 3059438 - DNA, 13 bp, Homo sapiens
tgatttttatcta

SEQ ID NO: 3059439 - DNA, 16 bp, Homo sapiens
tgatttttatctccaa

SEQ ID NO: 3059440 - DNA, 19 bp, Homo sapiens
tgatttttctggaggttga

SEQ ID NO: 3059441 - DNA, 12 bp, Homo sapiens
tgatttttgtgt

SEQ ID NO: 3059442 - DNA, 15 bp, Homo sapiens
tgatttttgtgtatc

SEQ ID NO: 3059443 - DNA, 21 bp, Homo sapiens
tgatttttgtgtatccagtat

SEQ ID NO: 3059444 - DNA, 15 bp, Homo sapiens
tgcaaaaaggactgg

SEQ ID NO: 3059445 - DNA, 19 bp, Homo sapiens
tgcaaaaggactctcagga

SEQ ID NO: 3059446 - DNA, 22 bp, Homo sapiens
tgcaaaaggactctcaggacca

SEQ ID NO: 3059447 - DNA, 13 bp, Homo sapiens
tgcaaaagtgggg

SEQ ID NO: 3059448 - DNA, 16 bp, Homo sapiens
tgcaaaagtggggcta

SEQ ID NO: 3059449 - DNA, 22 bp, Homo sapiens
tgcaaaagtggggctaaatgaa

SEQ ID NO: 3059450 - DNA, 22 bp, Homo sapiens
tgcaaaataagtttttctttaa

SEQ ID NO: 3059451 - DNA, 20 bp, Homo sapiens
tgcaaaatgcgtatttgcat

SEQ ID NO: 3059452 - DNA, 23 bp, Homo sapiens
tgcaatatatctaaattgaataa

SEQ ID NO: 3059453 - DNA, 18 bp, Homo sapiens
tgcaatatgggcgggcag

SEQ ID NO: 3059454 - DNA, 19 bp, Homo sapiens
tgcaatcctgtctttctga

SEQ ID NO: 3059455 - DNA, 11 bp, Homo sapiens
tgcaatgaaca

SEQ ID NO: 3059456 - DNA, 16 bp, Homo sapiens
tgcaatgactcaggac

SEQ ID NO: 3059457 - DNA, 13 bp, Homo sapiens
tgcaatgactgtg

SEQ ID NO: 3059458 - DNA, 16 bp, Homo sapiens
tgcaatggtgactgat

SEQ ID NO: 3059459 - DNA, 22 bp, Homo sapiens
tgcaatggtgactgatttcaaa

SEQ ID NO: 3059460 - DNA, 22 bp, Homo sapiens
tgcaatgtagaggggaaaagag

SEQ ID NO: 3059461 - DNA, 21 bp, Homo sapiens
tgcaattactgcctgcagaga

SEQ ID NO: 3059462 - DNA, 21 bp, Homo sapiens
tgcaattcaaaagttccaaga

SEQ ID NO: 3059463 - DNA, 19 bp, Homo sapiens
tgcaattcagtctgctctc

SEQ ID NO: 3059464 - DNA, 14 bp, Homo sapiens
tgcaattcagtgtt

SEQ ID NO: 3059465 - DNA, 12 bp, Homo sapiens
tgcaatttcaag

SEQ ID NO: 3059466 - DNA, 20 bp, Homo sapiens
tgcacaataaaaccaagcct

SEQ ID NO: 3059467 - DNA, 18 bp, Homo sapiens
tgcacacagcggctgcct

SEQ ID NO: 3059468 - DNA, 17 bp, Homo sapiens
tgcacacatcaccaggt

SEQ ID NO: 3059469 - DNA, 16 bp, Homo sapiens
tgcacacccactcagc

SEQ ID NO: 3059470 - DNA, 22 bp, Homo sapiens
tgcacacggctggtcactctgc

SEQ ID NO: 3059471 - DNA, 22 bp, Homo sapiens
tgcacactagtttatgctacct

SEQ ID NO: 3059472 - DNA, 16 bp, Homo sapiens
tgcacactatttccct

SEQ ID NO: 3059473 - DNA, 14 bp, Homo sapiens
tgcacactttgcca

SEQ ID NO: 3059474 - DNA, 22 bp, Homo sapiens
tgcacactttgccatattttca

SEQ ID NO: 3059475 - DNA, 14 bp, Homo sapiens
tgcacagaagcaca

SEQ ID NO: 3059476 - DNA, 15 bp, Homo sapiens
tgcacagaagtcctg

SEQ ID NO: 3059477 - DNA, 21 bp, Homo sapiens
tgcacagaagtcctgtatgtc

SEQ ID NO: 3059478 - DNA, 21 bp, Homo sapiens
tgcacagattcccaggccagg

SEQ ID NO: 3059479 - DNA, 21 bp, Homo sapiens
tgcacagcagcaattgtttta

SEQ ID NO: 3059480 - DNA, 20 bp, Homo sapiens
tgcacagccactccccggca

SEQ ID NO: 3059481 - DNA, 17 bp, Homo sapiens
tgcacagcgtcctgtcc

SEQ ID NO: 3059482 - DNA, 21 bp, Homo sapiens
tgcacagggtttggcccaagt

SEQ ID NO: 3059483 - DNA, 22 bp, Homo sapiens
tgcacaggtggctgtttcttgt

SEQ ID NO: 3059484 - DNA, 12 bp, Homo sapiens
tgcacagtcaga

SEQ ID NO: 3059485 - DNA, 20 bp, Homo sapiens
tgcacagtcagaaggacggc

SEQ ID NO: 3059486 - DNA, 22 bp, Homo sapiens
tgcacagtccacagctgaagag

SEQ ID NO: 3059487 - DNA, 17 bp, Homo sapiens
tgcacatatcaagaagt

SEQ ID NO: 3059488 - DNA, 14 bp, Homo sapiens
tgcacatatggact

SEQ ID NO: 3059489 - DNA, 17 bp, Homo sapiens
tgcacatatggactctg

SEQ ID NO: 3059490 - DNA, 19 bp, Homo sapiens
tgcacatatggactctgca

SEQ ID NO: 3059491 - DNA, 12 bp, Homo sapiens
tgcacatccctg

SEQ ID NO: 3059492 - DNA, 21 bp, Homo sapiens
tgcacatccgcgtgtgcctgt

SEQ ID NO: 3059493 - DNA, 15 bp, Homo sapiens
tgcacatctgtgtct

SEQ ID NO: 3059494 - DNA, 16 bp, Homo sapiens
tgcacatctgtgtctt

SEQ ID NO: 3059495 - DNA, 14 bp, Homo sapiens
tgcacatgaactgt

SEQ ID NO: 3059496 - DNA, 15 bp, Homo sapiens
tgcacatgaagaaat

SEQ ID NO: 3059497 - DNA, 15 bp, Homo sapiens
tgcacatgtcttgta

SEQ ID NO: 3059498 - DNA, 22 bp, Homo sapiens
tgcacatgtcttgtacatgtgt

SEQ ID NO: 3059499 - DNA, 23 bp, Homo sapiens
tgcacatgtcttgtacatgtgta

SEQ ID NO: 3059500 - DNA, 15 bp, Homo sapiens
tgcaccaccatgccc

SEQ ID NO: 3059501 - DNA, 22 bp, Homo sapiens
tgcacccaggaggggaacactg

SEQ ID NO: 3059502 - DNA, 16 bp, Homo sapiens
tgcaccccatgctgtt

SEQ ID NO: 3059503 - DNA, 15 bp, Homo sapiens
tgcacccccctgggc

SEQ ID NO: 3059504 - DNA, 19 bp, Homo sapiens
tgcaccgacccgaggccca

SEQ ID NO: 3059505 - DNA, 13 bp, Homo sapiens
tgcaccgcctgcc

SEQ ID NO: 3059506 - DNA, 16 bp, Homo sapiens
tgcaccgcctgccctc

SEQ ID NO: 3059507 - DNA, 15 bp, Homo sapiens
tgcaccttgtgtctg

SEQ ID NO: 3059508 - DNA, 15 bp, Homo sapiens
tgcacgctcccctcc

SEQ ID NO: 3059509 - DNA, 15 bp, Homo sapiens
tgcacgggcatgcac

SEQ ID NO: 3059510 - DNA, 20 bp, Homo sapiens
tgcacgggcatgcacacggc

SEQ ID NO: 3059511 - DNA, 22 bp, Homo sapiens
tgcacggtttctgttctgcccc

SEQ ID NO: 3059512 - DNA, 15 bp, Homo sapiens
tgcactaaggggccc

SEQ ID NO: 3059513 - DNA, 14 bp, Homo sapiens
tgcactcaagttgt

SEQ ID NO: 3059514 - DNA, 17 bp, Homo sapiens
tgcactcaagttgttta

SEQ ID NO: 3059515 - DNA, 14 bp, Homo sapiens
tgcactcagctctt

SEQ ID NO: 3059516 - DNA, 21 bp, Homo sapiens
tgcactccctggccttgcccg

SEQ ID NO: 3059517 - DNA, 15 bp, Homo sapiens
tgcactccggcctgg

SEQ ID NO: 3059518 - DNA, 19 bp, Homo sapiens
tgcactcttgaactgggcg

SEQ ID NO: 3059519 - DNA, 13 bp, Homo sapiens
tgcactgaaaacc

SEQ ID NO: 3059520 - DNA, 14 bp, Homo sapiens
tgcactgaagtttt

SEQ ID NO: 3059521 - DNA, 15 bp, Homo sapiens
tgcactgaagttttt

SEQ ID NO: 3059522 - DNA, 16 bp, Homo sapiens
tgcactgatgctgccc

SEQ ID NO: 3059523 - DNA, 21 bp, Homo sapiens
tgcactgcccatggacaggct

SEQ ID NO: 3059524 - DNA, 14 bp, Homo sapiens
tgcactggagccac

SEQ ID NO: 3059525 - DNA, 15 bp, Homo sapiens
tgcactggagccaca

SEQ ID NO: 3059526 - DNA, 21 bp, Homo sapiens
tgcactgttccccctgtgcag

SEQ ID NO: 3059527 - DNA, 16 bp, Homo sapiens
tgcacttaaggcactc

SEQ ID NO: 3059528 - DNA, 21 bp, Homo sapiens
tgcacttataaggtgttttct

SEQ ID NO: 3059529 - DNA, 14 bp, Homo sapiens
tgcacttcatatct

SEQ ID NO: 3059530 - DNA, 15 bp, Homo sapiens
tgcacttcatatcta

SEQ ID NO: 3059531 - DNA, 16 bp, Homo sapiens
tgcacttcatatctag

SEQ ID NO: 3059532 - DNA, 22 bp, Homo sapiens
tgcacttcatatctagatttct

SEQ ID NO: 3059533 - DNA, 21 bp, Homo sapiens
tgcactttagtgtattttctg

SEQ ID NO: 3059534 - DNA, 19 bp, Homo sapiens
tgcactttgggtttttaac

SEQ ID NO: 3059535 - DNA, 21 bp, Homo sapiens
tgcactttgggtttttaactc

SEQ ID NO: 3059536 - DNA, 15 bp, Homo sapiens
tgcactttgtaaatt

SEQ ID NO: 3059537 - DNA, 17 bp, Homo sapiens
tgcactttgtaaattcc

SEQ ID NO: 3059538 - DNA, 19 bp, Homo sapiens
tgcacttttgaatgtccaa

SEQ ID NO: 3059539 - DNA, 20 bp, Homo sapiens
tgcacttttgaatgtccaaa

SEQ ID NO: 3059540 - DNA, 22 bp, Homo sapiens
tgcagaaaaagaaaaaaactat

SEQ ID NO: 3059541 - DNA, 19 bp, Homo sapiens
tgcagaaaagcacctgccg

SEQ ID NO: 3059542 - DNA, 15 bp, Homo sapiens
tgcagaacacctggc

SEQ ID NO: 3059543 - DNA, 20 bp, Homo sapiens
tgcagaaccagtgacaatct

SEQ ID NO: 3059544 - DNA, 15 bp, Homo sapiens
tgcagaagcaataat

SEQ ID NO: 3059545 - DNA, 14 bp, Homo sapiens
tgcagaagtattct

SEQ ID NO: 3059546 - DNA, 12 bp, Homo sapiens
tgcagacagtgt

SEQ ID NO: 3059547 - DNA, 14 bp, Homo sapiens
tgcagacgtctggc

SEQ ID NO: 3059548 - DNA, 16 bp, Homo sapiens
tgcagacgtctggccc

SEQ ID NO: 3059549 - DNA, 21 bp, Homo sapiens
tgcagacgtctggccctggcg

SEQ ID NO: 3059550 - DNA, 14 bp, Homo sapiens
tgcagactggcagt

SEQ ID NO: 3059551 - DNA, 18 bp, Homo sapiens
tgcagactggcagtcgca

SEQ ID NO: 3059552 - DNA, 15 bp, Homo sapiens
tgcagacttcccagc

SEQ ID NO: 3059553 - DNA, 22 bp, Homo sapiens
tgcagacttcccagctaggaag

SEQ ID NO: 3059554 - DNA, 10 bp, Homo sapiens
tgcagagcct

SEQ ID NO: 3059555 - DNA, 19 bp, Homo sapiens
tgcagagccttttacccct

SEQ ID NO: 3059556 - DNA, 15 bp, Homo sapiens
tgcagaggtaccctg

SEQ ID NO: 3059557 - DNA, 19 bp, Homo sapiens
tgcagaggtaccctgggtg

SEQ ID NO: 3059558 - DNA, 17 bp, Homo sapiens
tgcagaggttgagagga

SEQ ID NO: 3059559 - DNA, 23 bp, Homo sapiens
tgcagagtgccccatcggtcacc

SEQ ID NO: 3059560 - DNA, 22 bp, Homo sapiens
tgcagataaacagaaatgctct

SEQ ID NO: 3059561 - DNA, 16 bp, Homo sapiens
tgcagatcatctgggg

SEQ ID NO: 3059562 - DNA, 22 bp, Homo sapiens
tgcagattgcagttctgattca

SEQ ID NO: 3059563 - DNA, 16 bp, Homo sapiens
tgcagcaatctttgaa

SEQ ID NO: 3059564 - DNA, 17 bp, Homo sapiens
tgcagcaatctttgaaa

SEQ ID NO: 3059565 - DNA, 14 bp, Homo sapiens
tgcagcactgctgc

SEQ ID NO: 3059566 - DNA, 15 bp, Homo sapiens
tgcagcactgctgcc

SEQ ID NO: 3059567 - DNA, 16 bp, Homo sapiens
tgcagcactgctgcct

SEQ ID NO: 3059568 - DNA, 19 bp, Homo sapiens
tgcagcactgctgcctcag

SEQ ID NO: 3059569 - DNA, 20 bp, Homo sapiens
tgcagcactgctgcctcagc

SEQ ID NO: 3059570 - DNA, 21 bp, Homo sapiens
tgcagcactgctgcctcagct

SEQ ID NO: 3059571 - DNA, 14 bp, Homo sapiens
tgcagcagggatgc

SEQ ID NO: 3059572 - DNA, 22 bp, Homo sapiens
tgcagcagggatgccctggagg

SEQ ID NO: 3059573 - DNA, 22 bp, Homo sapiens
tgcagcaggtggtaatgataaa

SEQ ID NO: 3059574 - DNA, 14 bp, Homo sapiens
tgcagccagaggca

SEQ ID NO: 3059575 - DNA, 14 bp, Homo sapiens
tgcagccagcccag

SEQ ID NO: 3059576 - DNA, 14 bp, Homo sapiens
tgcagccaggcctc

SEQ ID NO: 3059577 - DNA, 22 bp, Homo sapiens
tgcagccaggcctcgcctgccc

SEQ ID NO: 3059578 - DNA, 23 bp, Homo sapiens
tgcagccaggcctcgcctgccct

SEQ ID NO: 3059579 - DNA, 12 bp, Homo sapiens
tgcagcccacca

SEQ ID NO: 3059580 - DNA, 14 bp, Homo sapiens
tgcagcccatttct

SEQ ID NO: 3059581 - DNA, 20 bp, Homo sapiens
tgcagcccatttctccagaa

SEQ ID NO: 3059582 - DNA, 21 bp, Homo sapiens
tgcagcccatttctccagaac

SEQ ID NO: 3059583 - DNA, 22 bp, Homo sapiens
tgcagcccatttctccagaacc

SEQ ID NO: 3059584 - DNA, 19 bp, Homo sapiens
tgcagccctgagaaagccc

SEQ ID NO: 3059585 - DNA, 21 bp, Homo sapiens
tgcagccctgagaaagccctg

SEQ ID NO: 3059586 - DNA, 14 bp, Homo sapiens
tgcagccgctgagc

SEQ ID NO: 3059587 - DNA, 18 bp, Homo sapiens
tgcagcctcaacctcctg

SEQ ID NO: 3059588 - DNA, 20 bp, Homo sapiens
tgcagcctcaacctcctggg

SEQ ID NO: 3059589 - DNA, 13 bp, Homo sapiens
tgcagcctccggg

SEQ ID NO: 3059590 - DNA, 14 bp, Homo sapiens
tgcagcctgcgcca

SEQ ID NO: 3059591 - DNA, 16 bp, Homo sapiens
tgcagcgccacccagt

SEQ ID NO: 3059592 - DNA, 22 bp, Homo sapiens
tgcagcggtgtggaccgaggaa

SEQ ID NO: 3059593 - DNA, 16 bp, Homo sapiens
tgcagctaacatgagt

SEQ ID NO: 3059594 - DNA, 14 bp, Homo sapiens
tgcagctatctggt

SEQ ID NO: 3059595 - DNA, 15 bp, Homo sapiens
tgcagctcctcagcg

SEQ ID NO: 3059596 - DNA, 20 bp, Homo sapiens
tgcagctcctcagcggctcc

SEQ ID NO: 3059597 - DNA, 14 bp, Homo sapiens
tgcagcttttggtc

SEQ ID NO: 3059598 - DNA, 13 bp, Homo sapiens
tgcaggaaggaaa

SEQ ID NO: 3059599 - DNA, 17 bp, Homo sapiens
tgcaggaaggaaaacta

SEQ ID NO: 3059600 - DNA, 17 bp, Homo sapiens
tgcaggacctgcctgta

SEQ ID NO: 3059601 - DNA, 16 bp, Homo sapiens
tgcaggcggccctcag

SEQ ID NO: 3059602 - DNA, 15 bp, Homo sapiens
tgcaggctgcaggag

SEQ ID NO: 3059603 - DNA, 17 bp, Homo sapiens
tgcaggctgcaggaggg

SEQ ID NO: 3059604 - DNA, 18 bp, Homo sapiens
tgcaggctgcaggagggc

SEQ ID NO: 3059605 - DNA, 16 bp, Homo sapiens
tgcaggctggccagcc

SEQ ID NO: 3059606 - DNA, 18 bp, Homo sapiens
tgcaggctggccagccgc

SEQ ID NO: 3059607 - DNA, 22 bp, Homo sapiens
tgcaggctggccagccgctctc

SEQ ID NO: 3059608 - DNA, 21 bp, Homo sapiens
tgcagggagcaccacggccag

SEQ ID NO: 3059609 - DNA, 22 bp, Homo sapiens
tgcagggagcaccacggccaga

SEQ ID NO: 3059610 - DNA, 19 bp, Homo sapiens
tgcagggattgctgccact

SEQ ID NO: 3059611 - DNA, 14 bp, Homo sapiens
tgcagggcagtcat

SEQ ID NO: 3059612 - DNA, 15 bp, Homo sapiens
tgcagggccatggct

SEQ ID NO: 3059613 - DNA, 14 bp, Homo sapiens
tgcagggctggttt

SEQ ID NO: 3059614 - DNA, 18 bp, Homo sapiens
tgcagggctggtttgttc

SEQ ID NO: 3059615 - DNA, 19 bp, Homo sapiens
tgcagggctggtttgttct

SEQ ID NO: 3059616 - DNA, 13 bp, Homo sapiens
tgcaggggactgg

SEQ ID NO: 3059617 - DNA, 16 bp, Homo sapiens
tgcaggggactgggcc

SEQ ID NO: 3059618 - DNA, 18 bp, Homo sapiens
tgcaggggactgggccat

SEQ ID NO: 3059619 - DNA, 19 bp, Homo sapiens
tgcaggggatggggtgggg

SEQ ID NO: 3059620 - DNA, 21 bp, Homo sapiens
tgcaggggatggggtgggggg

SEQ ID NO: 3059621 - DNA, 22 bp, Homo sapiens
tgcagggtcctcttctgggcct

SEQ ID NO: 3059622 - DNA, 11 bp, Homo sapiens
tgcaggtgctg

SEQ ID NO: 3059623 - DNA, 17 bp, Homo sapiens
tgcaggtgctgctgatg

SEQ ID NO: 3059624 - DNA, 13 bp, Homo sapiens
tgcaggtggggag

SEQ ID NO: 3059625 - DNA, 23 bp, Homo sapiens
tgcaggtggggtgatggccagag

SEQ ID NO: 3059626 - DNA, 15 bp, Homo sapiens
tgcagtaaatctttt

SEQ ID NO: 3059627 - DNA, 16 bp, Homo sapiens
tgcagtagattttctt

SEQ ID NO: 3059628 - DNA, 16 bp, Homo sapiens
tgcagtatggtacatt

SEQ ID NO: 3059629 - DNA, 22 bp, Homo sapiens
tgcagtcatcaacaatgattaa

SEQ ID NO: 3059630 - DNA, 16 bp, Homo sapiens
tgcagtcggcatgcca

SEQ ID NO: 3059631 - DNA, 17 bp, Homo sapiens
tgcagtcggcatgccag

SEQ ID NO: 3059632 - DNA, 19 bp, Homo sapiens
tgcagtctgtattttccac

SEQ ID NO: 3059633 - DNA, 19 bp, Homo sapiens
tgcagtctgtccaggctcg

SEQ ID NO: 3059634 - DNA, 14 bp, Homo sapiens
tgcagtctttcccc

SEQ ID NO: 3059635 - DNA, 15 bp, Homo sapiens
tgcagtctttccccc

SEQ ID NO: 3059636 - DNA, 20 bp, Homo sapiens
tgcagtctttcccccaggaa

SEQ ID NO: 3059637 - DNA, 14 bp, Homo sapiens
tgcagtggcctggc

SEQ ID NO: 3059638 - DNA, 21 bp, Homo sapiens
tgcagtggcgcattctaggct

SEQ ID NO: 3059639 - DNA, 21 bp, Homo sapiens
tgcagtggggtttcgcagcct

SEQ ID NO: 3059640 - DNA, 17 bp, Homo sapiens
tgcagtgtccagaagcg

SEQ ID NO: 3059641 - DNA, 18 bp, Homo sapiens
tgcagttctgattcattt

SEQ ID NO: 3059642 - DNA, 16 bp, Homo sapiens
tgcagttgaagagcct

SEQ ID NO: 3059643 - DNA, 17 bp, Homo sapiens
tgcagttgaagagcctg

SEQ ID NO: 3059644 - DNA, 18 bp, Homo sapiens
tgcagtttaagagcagaa

SEQ ID NO: 3059645 - DNA, 12 bp, Homo sapiens
tgcagtttgaaa

SEQ ID NO: 3059646 - DNA, 13 bp, Homo sapiens
tgcagtttgaaat

SEQ ID NO: 3059647 - DNA, 17 bp, Homo sapiens
tgcagtttgaaattctg

SEQ ID NO: 3059648 - DNA, 18 bp, Homo sapiens
tgcagtttgaaattctga

SEQ ID NO: 3059649 - DNA, 20 bp, Homo sapiens
tgcagtttgaaattctgaat

SEQ ID NO: 3059650 - DNA, 21 bp, Homo sapiens
tgcagtttgaaattctgaatt

SEQ ID NO: 3059651 - DNA, 12 bp, Homo sapiens
tgcagttttcct

SEQ ID NO: 3059652 - DNA, 21 bp, Homo sapiens
tgcataaaagggtcaaacctg

SEQ ID NO: 3059653 - DNA, 18 bp, Homo sapiens
tgcataaacaatccaaat

SEQ ID NO: 3059654 - DNA, 23 bp, Homo sapiens
tgcataaacaatccaaatgcatt

SEQ ID NO: 3059655 - DNA, 22 bp, Homo sapiens
tgcataagctttttaatgctgt

SEQ ID NO: 3059656 - DNA, 9 bp, Homo sapiens
tgcatacac

SEQ ID NO: 3059657 - DNA, 10 bp, Homo sapiens
tgcatacaca

SEQ ID NO: 3059658 - DNA, 11 bp, Homo sapiens
tgcatacacac

SEQ ID NO: 3059659 - DNA, 14 bp, Homo sapiens
tgcatacacacaca

SEQ ID NO: 3059660 - DNA, 15 bp, Homo sapiens
tgcatacacacacac

SEQ ID NO: 3059661 - DNA, 12 bp, Homo sapiens
tgcataccaacc

SEQ ID NO: 3059662 - DNA, 17 bp, Homo sapiens
tgcatacttcaaaagta

SEQ ID NO: 3059663 - DNA, 13 bp, Homo sapiens
tgcatagaattct

SEQ ID NO: 3059664 - DNA, 19 bp, Homo sapiens
tgcatagaattctagcttt

SEQ ID NO: 3059665 - DNA, 19 bp, Homo sapiens
tgcatagcgtcctgccctg

SEQ ID NO: 3059666 - DNA, 21 bp, Homo sapiens
tgcatagcgtcctgccctgcc

SEQ ID NO: 3059667 - DNA, 22 bp, Homo sapiens
tgcatatctctagtccctgtgt

SEQ ID NO: 3059668 - DNA, 14 bp, Homo sapiens
tgcatattgtacac

SEQ ID NO: 3059669 - DNA, 15 bp, Homo sapiens
tgcatattgtacact

SEQ ID NO: 3059670 - DNA, 15 bp, Homo sapiens
tgcatatttatccaa

SEQ ID NO: 3059671 - DNA, 20 bp, Homo sapiens
tgcatcacatgatgaaaaat

SEQ ID NO: 3059672 - DNA, 17 bp, Homo sapiens
tgcatcagttcactgct

SEQ ID NO: 3059673 - DNA, 16 bp, Homo sapiens
tgcatccattcctcag

SEQ ID NO: 3059674 - DNA, 17 bp, Homo sapiens
tgcatccattcctcagg

SEQ ID NO: 3059675 - DNA, 18 bp, Homo sapiens
tgcatccattcctcaggg

SEQ ID NO: 3059676 - DNA, 20 bp, Homo sapiens
tgcatccattcctcagggac

SEQ ID NO: 3059677 - DNA, 21 bp, Homo sapiens
tgcatccattcctcagggaca

SEQ ID NO: 3059678 - DNA, 23 bp, Homo sapiens
tgcatccccacgacccctgcctc

SEQ ID NO: 3059679 - DNA, 15 bp, Homo sapiens
tgcatcccccccacc

SEQ ID NO: 3059680 - DNA, 14 bp, Homo sapiens
tgcatcgtcccctc

SEQ ID NO: 3059681 - DNA, 13 bp, Homo sapiens
tgcatctcccaga

SEQ ID NO: 3059682 - DNA, 22 bp, Homo sapiens
tgcatctgaaataggaaacaag

SEQ ID NO: 3059683 - DNA, 19 bp, Homo sapiens
tgcatctgtgtgtgtgtgc

SEQ ID NO: 3059684 - DNA, 22 bp, Homo sapiens
tgcatcttactgaaggtaaaat

SEQ ID NO: 3059685 - DNA, 15 bp, Homo sapiens
tgcatgaaaaaccat

SEQ ID NO: 3059686 - DNA, 15 bp, Homo sapiens
tgcatgaaagcacaa

SEQ ID NO: 3059687 - DNA, 15 bp, Homo sapiens
tgcatgagcttttat

SEQ ID NO: 3059688 - DNA, 19 bp, Homo sapiens
tgcatgctaaattattatt

SEQ ID NO: 3059689 - DNA, 16 bp, Homo sapiens
tgcatgctctctgcag

SEQ ID NO: 3059690 - DNA, 16 bp, Homo sapiens
tgcatggaagttgggg

SEQ ID NO: 3059691 - DNA, 19 bp, Homo sapiens
tgcatggaagttggggcac

SEQ ID NO: 3059692 - DNA, 21 bp, Homo sapiens
tgcatgggccagcccctccat

SEQ ID NO: 3059693 - DNA, 17 bp, Homo sapiens
tgcatggtgccccagga

SEQ ID NO: 3059694 - DNA, 21 bp, Homo sapiens
tgcatggtgccccaggaccag

SEQ ID NO: 3059695 - DNA, 22 bp, Homo sapiens
tgcatggtgccccaggaccagc

SEQ ID NO: 3059696 - DNA, 14 bp, Homo sapiens
tgcatggtggccag

SEQ ID NO: 3059697 - DNA, 17 bp, Homo sapiens
tgcatgtaaaatcttca

SEQ ID NO: 3059698 - DNA, 18 bp, Homo sapiens
tgcatgtaaaatcttcag

SEQ ID NO: 3059699 - DNA, 20 bp, Homo sapiens
tgcatgtaaaatcttcagct

SEQ ID NO: 3059700 - DNA, 15 bp, Homo sapiens
tgcatgtatgtcttg

SEQ ID NO: 3059701 - DNA, 23 bp, Homo sapiens
tgcatgtctactcagcatttgat

SEQ ID NO: 3059702 - DNA, 12 bp, Homo sapiens
tgcatgtgaaga

SEQ ID NO: 3059703 - DNA, 15 bp, Homo sapiens
tgcatgtgactctga

SEQ ID NO: 3059704 - DNA, 16 bp, Homo sapiens
tgcatgtgactctgaa

SEQ ID NO: 3059705 - DNA, 17 bp, Homo sapiens
tgcatgtggcttctctg

SEQ ID NO: 3059706 - DNA, 11 bp, Homo sapiens
tgcatgtgtat

SEQ ID NO: 3059707 - DNA, 21 bp, Homo sapiens
tgcatgtgtatatatgtcaaa

SEQ ID NO: 3059708 - DNA, 14 bp, Homo sapiens
tgcatgttaagcgt

SEQ ID NO: 3059709 - DNA, 22 bp, Homo sapiens
tgcattagcctggatcctcagt

SEQ ID NO: 3059710 - DNA, 19 bp, Homo sapiens
tgcattcaccttagtgcaa

SEQ ID NO: 3059711 - DNA, 22 bp, Homo sapiens
tgcattcatgttttaaaagttt

SEQ ID NO: 3059712 - DNA, 14 bp, Homo sapiens
tgcattctatcgtt

SEQ ID NO: 3059713 - DNA, 20 bp, Homo sapiens
tgcattctgataggaggggg

SEQ ID NO: 3059714 - DNA, 20 bp, Homo sapiens
tgcattctgcctctctagga

SEQ ID NO: 3059715 - DNA, 15 bp, Homo sapiens
tgcattctggagaca

SEQ ID NO: 3059716 - DNA, 14 bp, Homo sapiens
tgcattcttaacaa

SEQ ID NO: 3059717 - DNA, 14 bp, Homo sapiens
tgcattgaacacaa

SEQ ID NO: 3059718 - DNA, 17 bp, Homo sapiens
tgcattgaacacaaact

SEQ ID NO: 3059719 - DNA, 21 bp, Homo sapiens
tgcattgaacacaaactgtaa

SEQ ID NO: 3059720 - DNA, 22 bp, Homo sapiens
tgcattgaccgcgactaatttc

SEQ ID NO: 3059721 - DNA, 15 bp, Homo sapiens
tgcattgagaactgc

SEQ ID NO: 3059722 - DNA, 13 bp, Homo sapiens
tgcattgatattg

SEQ ID NO: 3059723 - DNA, 18 bp, Homo sapiens
tgcattgatattgtgaac

SEQ ID NO: 3059724 - DNA, 20 bp, Homo sapiens
tgcattgcccagtctttcat

SEQ ID NO: 3059725 - DNA, 13 bp, Homo sapiens
tgcattgtctgca

SEQ ID NO: 3059726 - DNA, 20 bp, Homo sapiens
tgcattgtctgcaatggtga

SEQ ID NO: 3059727 - DNA, 18 bp, Homo sapiens
tgcattgtttctgtgggc

SEQ ID NO: 3059728 - DNA, 16 bp, Homo sapiens
tgcatttattgcagtt

SEQ ID NO: 3059729 - DNA, 23 bp, Homo sapiens
tgcatttctatgccatttttagt

SEQ ID NO: 3059730 - DNA, 21 bp, Homo sapiens
tgcatttggaatttttgcttg

SEQ ID NO: 3059731 - DNA, 14 bp, Homo sapiens
tgcattttgatatt

SEQ ID NO: 3059732 - DNA, 17 bp, Homo sapiens
tgcattttgatattgct

SEQ ID NO: 3059733 - DNA, 19 bp, Homo sapiens
tgcattttgtttctgtata

SEQ ID NO: 3059734 - DNA, 20 bp, Homo sapiens
tgcattttgtttctgtatat

SEQ ID NO: 3059735 - DNA, 13 bp, Homo sapiens
tgcatttttctgc

SEQ ID NO: 3059736 - DNA, 15 bp, Homo sapiens
tgcatttttctgcag

SEQ ID NO: 3059737 - DNA, 16 bp, Homo sapiens
tgcatttttttagttt

SEQ ID NO: 3059738 - DNA, 21 bp, Homo sapiens
tgccaaaaaggatacataatg

SEQ ID NO: 3059739 - DNA, 18 bp, Homo sapiens
tgccaaaatgctctagtg

SEQ ID NO: 3059740 - DNA, 17 bp, Homo sapiens
tgccaaaattcatttct

SEQ ID NO: 3059741 - DNA, 19 bp, Homo sapiens
tgccaaaattcatttctaa

SEQ ID NO: 3059742 - DNA, 21 bp, Homo sapiens
tgccaaagcagattttcctaa

SEQ ID NO: 3059743 - DNA, 18 bp, Homo sapiens
tgccaaataaaaaacaga

SEQ ID NO: 3059744 - DNA, 16 bp, Homo sapiens
tgccaaatagccccag

SEQ ID NO: 3059745 - DNA, 17 bp, Homo sapiens
tgccaaatagccccaga

SEQ ID NO: 3059746 - DNA, 19 bp, Homo sapiens
tgccaaatataaataaaaa

SEQ ID NO: 3059747 - DNA, 22 bp, Homo sapiens
tgccaaatataaataaaaataa

SEQ ID NO: 3059748 - DNA, 15 bp, Homo sapiens
tgccaacaagaatgc

SEQ ID NO: 3059749 - DNA, 19 bp, Homo sapiens
tgccaacaagaatgcattg

SEQ ID NO: 3059750 - DNA, 23 bp, Homo sapiens
tgccaacaagaatgcattgatat

SEQ ID NO: 3059751 - DNA, 15 bp, Homo sapiens
tgccaacaatcctag

SEQ ID NO: 3059752 - DNA, 20 bp, Homo sapiens
tgccaacaatcctagtgctt

SEQ ID NO: 3059753 - DNA, 20 bp, Homo sapiens
tgccaaccccacccagctcc

SEQ ID NO: 3059754 - DNA, 23 bp, Homo sapiens
tgccaactcaggttcacagcagc

SEQ ID NO: 3059755 - DNA, 16 bp, Homo sapiens
tgccaacttgccatgt

SEQ ID NO: 3059756 - DNA, 20 bp, Homo sapiens
tgccaagcaaggaaaactta

SEQ ID NO: 3059757 - DNA, 16 bp, Homo sapiens
tgccaagtcctgcctt

SEQ ID NO: 3059758 - DNA, 20 bp, Homo sapiens
tgccaatctgtacaaaatgg

SEQ ID NO: 3059759 - DNA, 20 bp, Homo sapiens
tgccaatgtgaaatgtaaat

SEQ ID NO: 3059760 - DNA, 15 bp, Homo sapiens
tgccaatgttgtgtg

SEQ ID NO: 3059761 - DNA, 17 bp, Homo sapiens
tgccaatgttgtgtgtt

SEQ ID NO: 3059762 - DNA, 20 bp, Homo sapiens
tgccaatgttgtgtgttgca

SEQ ID NO: 3059763 - DNA, 16 bp, Homo sapiens
tgccaattacggtgta

SEQ ID NO: 3059764 - DNA, 17 bp, Homo sapiens
tgccaattacggtgtac

SEQ ID NO: 3059765 - DNA, 20 bp, Homo sapiens
tgccaattacggtgtacagt

SEQ ID NO: 3059766 - DNA, 21 bp, Homo sapiens
tgccaattttgtcacagctct

SEQ ID NO: 3059767 - DNA, 18 bp, Homo sapiens
tgccaatttttgccttca

SEQ ID NO: 3059768 - DNA, 19 bp, Homo sapiens
tgccaatttttgccttcat

SEQ ID NO: 3059769 - DNA, 22 bp, Homo sapiens
tgccacagagtgtagccaggtc

SEQ ID NO: 3059770 - DNA, 17 bp, Homo sapiens
tgccacagcctcccctg

SEQ ID NO: 3059771 - DNA, 21 bp, Homo sapiens
tgccacagcctcccctgccag

SEQ ID NO: 3059772 - DNA, 22 bp, Homo sapiens
tgccacatttatttttatatct

SEQ ID NO: 3059773 - DNA, 18 bp, Homo sapiens
tgccaccaaatctgtcta

SEQ ID NO: 3059774 - DNA, 23 bp, Homo sapiens
tgccaccacagcttatggcatct

SEQ ID NO: 3059775 - DNA, 22 bp, Homo sapiens
tgccaccactataaaatgtctt

SEQ ID NO: 3059776 - DNA, 13 bp, Homo sapiens
tgccacccacctc

SEQ ID NO: 3059777 - DNA, 18 bp, Homo sapiens
tgccaccgactgcccagc

SEQ ID NO: 3059778 - DNA, 21 bp, Homo sapiens
tgccaccgactgcccagccac

SEQ ID NO: 3059779 - DNA, 22 bp, Homo sapiens
tgccaccgactgcccagccact

SEQ ID NO: 3059780 - DNA, 13 bp, Homo sapiens
tgccacctcccct

SEQ ID NO: 3059781 - DNA, 19 bp, Homo sapiens
tgccacgtgccttaggaat

SEQ ID NO: 3059782 - DNA, 14 bp, Homo sapiens
tgccactcaccctt

SEQ ID NO: 3059783 - DNA, 20 bp, Homo sapiens
tgccactcacccttcctggc

SEQ ID NO: 3059784 - DNA, 23 bp, Homo sapiens
tgccactcacccttcctggccca

SEQ ID NO: 3059785 - DNA, 14 bp, Homo sapiens
tgccactctgctgc

SEQ ID NO: 3059786 - DNA, 15 bp, Homo sapiens
tgccactctgctgcc

SEQ ID NO: 3059787 - DNA, 16 bp, Homo sapiens
tgccactctgctgcct

SEQ ID NO: 3059788 - DNA, 13 bp, Homo sapiens
tgccactgggcac

SEQ ID NO: 3059789 - DNA, 15 bp, Homo sapiens
tgccactgggcacct

SEQ ID NO: 3059790 - DNA, 17 bp, Homo sapiens
tgccactgggcacctgc

SEQ ID NO: 3059791 - DNA, 18 bp, Homo sapiens
tgccactgggcacctgcg

SEQ ID NO: 3059792 - DNA, 18 bp, Homo sapiens
tgccactttccaccaact

SEQ ID NO: 3059793 - DNA, 12 bp, Homo sapiens
tgccacttttta

SEQ ID NO: 3059794 - DNA, 15 bp, Homo sapiens
tgccagaaggaaggt

SEQ ID NO: 3059795 - DNA, 22 bp, Homo sapiens
tgccagaagttgtggatttcag

SEQ ID NO: 3059796 - DNA, 14 bp, Homo sapiens
tgccagagatccaa

SEQ ID NO: 3059797 - DNA, 16 bp, Homo sapiens
tgccagatcctcttct

SEQ ID NO: 3059798 - DNA, 11 bp, Homo sapiens
tgccagatgct

SEQ ID NO: 3059799 - DNA, 16 bp, Homo sapiens
tgccagatgctgatgt

SEQ ID NO: 3059800 - DNA, 12 bp, Homo sapiens
tgccagcagccc

SEQ ID NO: 3059801 - DNA, 12 bp, Homo sapiens
tgccagcagcct

SEQ ID NO: 3059802 - DNA, 20 bp, Homo sapiens
tgccagcagttactgtgaat

SEQ ID NO: 3059803 - DNA, 21 bp, Homo sapiens
tgccagccaatccctggccat

SEQ ID NO: 3059804 - DNA, 24 bp, Homo sapiens
tgccagcccctgctggctggtgcc

SEQ ID NO: 3059805 - DNA, 13 bp, Homo sapiens
tgccagctccctc

SEQ ID NO: 3059806 - DNA, 14 bp, Homo sapiens
tgccagctctgtca

SEQ ID NO: 3059807 - DNA, 18 bp, Homo sapiens
tgccagctctgtcaccct

SEQ ID NO: 3059808 - DNA, 20 bp, Homo sapiens
tgccaggaaactcttgctat

SEQ ID NO: 3059809 - DNA, 23 bp, Homo sapiens
tgccaggaaggggtgagcacaga

SEQ ID NO: 3059810 - DNA, 16 bp, Homo sapiens
tgccaggattttgtat

SEQ ID NO: 3059811 - DNA, 20 bp, Homo sapiens
tgccaggcccccaccacaca

SEQ ID NO: 3059812 - DNA, 11 bp, Homo sapiens
tgccaggcccg

SEQ ID NO: 3059813 - DNA, 14 bp, Homo sapiens
tgccaggcccgggg

SEQ ID NO: 3059814 - DNA, 15 bp, Homo sapiens
tgccaggctcaacaa

SEQ ID NO: 3059815 - DNA, 14 bp, Homo sapiens
tgccaggcttgcct

SEQ ID NO: 3059816 - DNA, 15 bp, Homo sapiens
tgccaggcttgcctg

SEQ ID NO: 3059817 - DNA, 18 bp, Homo sapiens
tgccaggcttgcctgggc

SEQ ID NO: 3059818 - DNA, 15 bp, Homo sapiens
tgccagggatgggca

SEQ ID NO: 3059819 - DNA, 11 bp, Homo sapiens
tgccagggcag

SEQ ID NO: 3059820 - DNA, 14 bp, Homo sapiens
tgccagggctctgg

SEQ ID NO: 3059821 - DNA, 19 bp, Homo sapiens
tgccagggctctgggggca

SEQ ID NO: 3059822 - DNA, 21 bp, Homo sapiens
tgccagggctctgggggcaga

SEQ ID NO: 3059823 - DNA, 13 bp, Homo sapiens
tgccagggcttcc

SEQ ID NO: 3059824 - DNA, 18 bp, Homo sapiens
tgccaggtactatgcaga

SEQ ID NO: 3059825 - DNA, 18 bp, Homo sapiens
tgccaggttaggaaggca

SEQ ID NO: 3059826 - DNA, 19 bp, Homo sapiens
tgccagtagtaccttgttt

SEQ ID NO: 3059827 - DNA, 14 bp, Homo sapiens
tgccagtgcactcc

SEQ ID NO: 3059828 - DNA, 17 bp, Homo sapiens
tgccagtgcactccggc

SEQ ID NO: 3059829 - DNA, 20 bp, Homo sapiens
tgccagtgcactccggcctg

SEQ ID NO: 3059830 - DNA, 20 bp, Homo sapiens
tgccagtgccttacctcctg

SEQ ID NO: 3059831 - DNA, 19 bp, Homo sapiens
tgccataacataccaccta

SEQ ID NO: 3059832 - DNA, 17 bp, Homo sapiens
tgccataactttatgaa

SEQ ID NO: 3059833 - DNA, 16 bp, Homo sapiens
tgccatagtcacatgg

SEQ ID NO: 3059834 - DNA, 19 bp, Homo sapiens
tgccatagtcacatggcct

SEQ ID NO: 3059835 - DNA, 13 bp, Homo sapiens
tgccatattttca

SEQ ID NO: 3059836 - DNA, 14 bp, Homo sapiens
tgccatattttcac

SEQ ID NO: 3059837 - DNA, 22 bp, Homo sapiens
tgccatcattgctgtctgcagc

SEQ ID NO: 3059838 - DNA, 12 bp, Homo sapiens
tgccatcttctc

SEQ ID NO: 3059839 - DNA, 14 bp, Homo sapiens
tgccatcttctccc

SEQ ID NO: 3059840 - DNA, 14 bp, Homo sapiens
tgccatgcatacat

SEQ ID NO: 3059841 - DNA, 15 bp, Homo sapiens
tgccatgcatacatg

SEQ ID NO: 3059842 - DNA, 20 bp, Homo sapiens
tgccatggatttccactgct

SEQ ID NO: 3059843 - DNA, 15 bp, Homo sapiens
tgccatgggaaacaa

SEQ ID NO: 3059844 - DNA, 16 bp, Homo sapiens
tgccattatagcgcct

SEQ ID NO: 3059845 - DNA, 22 bp, Homo sapiens
tgccattatagcgcctgtataa

SEQ ID NO: 3059846 - DNA, 15 bp, Homo sapiens
tgccattgcactcca

SEQ ID NO: 3059847 - DNA, 19 bp, Homo sapiens
tgccattggtccacccttt

SEQ ID NO: 3059848 - DNA, 22 bp, Homo sapiens
tgccattgtactccagcctggg

SEQ ID NO: 3059849 - DNA, 19 bp, Homo sapiens
tgcccaaaaatatggttga

SEQ ID NO: 3059850 - DNA, 19 bp, Homo sapiens
tgcccaaagttttattttt

SEQ ID NO: 3059851 - DNA, 20 bp, Homo sapiens
tgcccaacccttccctcacc

SEQ ID NO: 3059852 - DNA, 22 bp, Homo sapiens
tgcccaacccttccctcacctt

SEQ ID NO: 3059853 - DNA, 14 bp, Homo sapiens
tgcccaactgttat

SEQ ID NO: 3059854 - DNA, 18 bp, Homo sapiens
tgcccaactttcattggt

SEQ ID NO: 3059855 - DNA, 18 bp, Homo sapiens
tgcccaagtgaccaggga

SEQ ID NO: 3059856 - DNA, 20 bp, Homo sapiens
tgcccacaacttgtcaccca

SEQ ID NO: 3059857 - DNA, 18 bp, Homo sapiens
tgcccacacacactcctt

SEQ ID NO: 3059858 - DNA, 23 bp, Homo sapiens
tgcccacacacactccttcccct

SEQ ID NO: 3059859 - DNA, 16 bp, Homo sapiens
tgcccacatttagtct

SEQ ID NO: 3059860 - DNA, 14 bp, Homo sapiens
tgcccacccccggg

SEQ ID NO: 3059861 - DNA, 15 bp, Homo sapiens
tgaaaccacagtttc

SEQ ID NO: 3059862 - DNA, 16 bp, Homo sapiens
tgaaacccatttactt

SEQ ID NO: 3059863 - DNA, 18 bp, Homo sapiens
tgaaacccccacacacac

SEQ ID NO: 3059864 - DNA, 21 bp, Homo sapiens
tgaaaccctggaccagtggtc

SEQ ID NO: 3059865 - DNA, 15 bp, Homo sapiens
tgaaaccgtccctga

SEQ ID NO: 3059866 - DNA, 15 bp, Homo sapiens
tgaaacctgatgtca

SEQ ID NO: 3059867 - DNA, 22 bp, Homo sapiens
tgaaacctgtataaccctgtta

SEQ ID NO: 3059868 - DNA, 21 bp, Homo sapiens
tgaaactagaaatctgtcctg

SEQ ID NO: 3059869 - DNA, 20 bp, Homo sapiens
tgaaactatttacaatgtgt

SEQ ID NO: 3059870 - DNA, 18 bp, Homo sapiens
tgaaactcccttgtgttc

SEQ ID NO: 3059871 - DNA, 15 bp, Homo sapiens
tgaaacttctcagtc

SEQ ID NO: 3059872 - DNA, 12 bp, Homo sapiens
tgaaacttgaac

SEQ ID NO: 3059873 - DNA, 12 bp, Homo sapiens
tgaaacttggat

SEQ ID NO: 3059874 - DNA, 13 bp, Homo sapiens
tgaaagaaaataa

SEQ ID NO: 3059875 - DNA, 19 bp, Homo sapiens
tgaaagaagaacagctgtt

SEQ ID NO: 3059876 - DNA, 13 bp, Homo sapiens
tgaaagacatttc

SEQ ID NO: 3059877 - DNA, 14 bp, Homo sapiens
tgaaagacatttca

SEQ ID NO: 3059878 - DNA, 21 bp, Homo sapiens
tgaaagacttccaaagaatgt

SEQ ID NO: 3059879 - DNA, 22 bp, Homo sapiens
tgaaagaggacgtgttacccac

SEQ ID NO: 3059880 - DNA, 20 bp, Homo sapiens
tgaaagagtaaaggaaatga

SEQ ID NO: 3059881 - DNA, 11 bp, Homo sapiens
tgaaagatgat

SEQ ID NO: 3059882 - DNA, 22 bp, Homo sapiens
tgaaagatgatttgcaatggga

SEQ ID NO: 3059883 - DNA, 15 bp, Homo sapiens
tgaaagattatttaa

SEQ ID NO: 3059884 - DNA, 18 bp, Homo sapiens
tgaaagattatttaaatg

SEQ ID NO: 3059885 - DNA, 20 bp, Homo sapiens
tgaaagattatttaaatgct

SEQ ID NO: 3059886 - DNA, 15 bp, Homo sapiens
tgaaagcaaaaatgc

SEQ ID NO: 3059887 - DNA, 16 bp, Homo sapiens
tgaaagcaaaaatgct

SEQ ID NO: 3059888 - DNA, 20 bp, Homo sapiens
tgaaagcaaaaatgctaata

SEQ ID NO: 3059889 - DNA, 14 bp, Homo sapiens
tgaaagcataacat

SEQ ID NO: 3059890 - DNA, 16 bp, Homo sapiens
tgaaaggaacattttt

SEQ ID NO: 3059891 - DNA, 20 bp, Homo sapiens
tgaaaggacagttaagtatt

SEQ ID NO: 3059892 - DNA, 18 bp, Homo sapiens
tgaaaggagacaatggtt

SEQ ID NO: 3059893 - DNA, 21 bp, Homo sapiens
tgaaaggatgtagaaacaata

SEQ ID NO: 3059894 - DNA, 21 bp, Homo sapiens
tgaaagggaaggacagctgtg

SEQ ID NO: 3059895 - DNA, 23 bp, Homo sapiens
tgaaaggggaaacgtctcccaga

SEQ ID NO: 3059896 - DNA, 19 bp, Homo sapiens
tgaaaggttaccctgtaac

SEQ ID NO: 3059897 - DNA, 16 bp, Homo sapiens
tgaaagtattcacatc

SEQ ID NO: 3059898 - DNA, 19 bp, Homo sapiens
tgaaagtattcacatcatt

SEQ ID NO: 3059899 - DNA, 18 bp, Homo sapiens
tgaaagtccagaaactgt

SEQ ID NO: 3059900 - DNA, 15 bp, Homo sapiens
tgaaagttaatccac

SEQ ID NO: 3059901 - DNA, 18 bp, Homo sapiens
tgaaagttgtacatgaaa

SEQ ID NO: 3059902 - DNA, 21 bp, Homo sapiens
tgaaagtttttaattcatatt

SEQ ID NO: 3059903 - DNA, 17 bp, Homo sapiens
tgaaataaaactggctt

SEQ ID NO: 3059904 - DNA, 19 bp, Homo sapiens
tgaaataaaactggctttg

SEQ ID NO: 3059905 - DNA, 19 bp, Homo sapiens
tgaaataaatgtttcaaat

SEQ ID NO: 3059906 - DNA, 14 bp, Homo sapiens
tgaaataactggaa

SEQ ID NO: 3059907 - DNA, 12 bp, Homo sapiens
tgaaataatcag

SEQ ID NO: 3059908 - DNA, 21 bp, Homo sapiens
tgaaataccaacctgaagaca

SEQ ID NO: 3059909 - DNA, 18 bp, Homo sapiens
tgaaatacctttgtagtt

SEQ ID NO: 3059910 - DNA, 21 bp, Homo sapiens
tgaaatacctttgtagttact

SEQ ID NO: 3059911 - DNA, 17 bp, Homo sapiens
tgaaataggaaacaagt

SEQ ID NO: 3059912 - DNA, 19 bp, Homo sapiens
tgaaatagttcaaagccaa

SEQ ID NO: 3059913 - DNA, 16 bp, Homo sapiens
tgaaatatgagaagat

SEQ ID NO: 3059914 - DNA, 20 bp, Homo sapiens
tgaaatatgagaagatcctg

SEQ ID NO: 3059915 - DNA, 12 bp, Homo sapiens
tgaaatattttg

SEQ ID NO: 3059916 - DNA, 21 bp, Homo sapiens
tgaaatctgtcaagagtagtt

SEQ ID NO: 3059917 - DNA, 14 bp, Homo sapiens
tgaaatgatagatt

SEQ ID NO: 3059918 - DNA, 17 bp, Homo sapiens
tgaaatgatagatttga

SEQ ID NO: 3059919 - DNA, 22 bp, Homo sapiens
tgaaatgatagatttgacctcc

SEQ ID NO: 3059920 - DNA, 19 bp, Homo sapiens
tgaaatggacttttgtaca

SEQ ID NO: 3059921 - DNA, 21 bp, Homo sapiens
tgaaatgtttggattctctta

SEQ ID NO: 3059922 - DNA, 14 bp, Homo sapiens
tgaaattaacctct

SEQ ID NO: 3059923 - DNA, 21 bp, Homo sapiens
tgaaattaagaaggcaaaaat

SEQ ID NO: 3059924 - DNA, 23 bp, Homo sapiens
tgaaattaagaaggcaaaaatgt

SEQ ID NO: 3059925 - DNA, 20 bp, Homo sapiens
tgaaattacgggtacctgaa

SEQ ID NO: 3059926 - DNA, 22 bp, Homo sapiens
tgaaattacttatcatccacat

SEQ ID NO: 3059927 - DNA, 13 bp, Homo sapiens
tgaaattcacaga

SEQ ID NO: 3059928 - DNA, 21 bp, Homo sapiens
tgaaattcacagaagcctagg

SEQ ID NO: 3059929 - DNA, 19 bp, Homo sapiens
tgaaattctgaatttgcaa

SEQ ID NO: 3059930 - DNA, 15 bp, Homo sapiens
tgaaattgtattaca

SEQ ID NO: 3059931 - DNA, 13 bp, Homo sapiens
tgaaatttttcca

SEQ ID NO: 3059932 - DNA, 19 bp, Homo sapiens
tgaaatttttctctttaaa

SEQ ID NO: 3059933 - DNA, 15 bp, Homo sapiens
tgaacacacaccagt

SEQ ID NO: 3059934 - DNA, 14 bp, Homo sapiens
tgaacacttaaatt

SEQ ID NO: 3059935 - DNA, 15 bp, Homo sapiens
tgaacacttggtgct

SEQ ID NO: 3059936 - DNA, 16 bp, Homo sapiens
tgaacacttggtgctg

SEQ ID NO: 3059937 - DNA, 19 bp, Homo sapiens
tgaacacttggtgctggga

SEQ ID NO: 3059938 - DNA, 14 bp, Homo sapiens
tgaacagatgtaaa

SEQ ID NO: 3059939 - DNA, 17 bp, Homo sapiens
tgaacagccaaaagcta

SEQ ID NO: 3059940 - DNA, 15 bp, Homo sapiens
tgaacagcggctgga

SEQ ID NO: 3059941 - DNA, 22 bp, Homo sapiens
tgaacagcggctggacttggag

SEQ ID NO: 3059942 - DNA, 16 bp, Homo sapiens
tgaacagctggtgcca

SEQ ID NO: 3059943 - DNA, 14 bp, Homo sapiens
tgaacagggcccag

SEQ ID NO: 3059944 - DNA, 15 bp, Homo sapiens
tgaacagtgctctgc

SEQ ID NO: 3059945 - DNA, 18 bp, Homo sapiens
tgaacagtgctctgcctc

SEQ ID NO: 3059946 - DNA, 23 bp, Homo sapiens
tgaacataacttctcatgtatat

SEQ ID NO: 3059947 - DNA, 16 bp, Homo sapiens
tgaacatttgtgatat

SEQ ID NO: 3059948 - DNA, 11 bp, Homo sapiens
tgaaccaaatt

SEQ ID NO: 3059949 - DNA, 15 bp, Homo sapiens
tgaaccaaattgcac

SEQ ID NO: 3059950 - DNA, 16 bp, Homo sapiens
tgaacccgggggacag

SEQ ID NO: 3059951 - DNA, 20 bp, Homo sapiens
tgaacctcaccccgaggccc

SEQ ID NO: 3059952 - DNA, 14 bp, Homo sapiens
tgaacctcattaaa

SEQ ID NO: 3059953 - DNA, 21 bp, Homo sapiens
tgaacctgaaaagggtcagaa

SEQ ID NO: 3059954 - DNA, 12 bp, Homo sapiens
tgaacctgcaag

SEQ ID NO: 3059955 - DNA, 12 bp, Homo sapiens
tgaacctgggaa

SEQ ID NO: 3059956 - DNA, 17 bp, Homo sapiens
tgaaccttgagcaaatt

SEQ ID NO: 3059957 - DNA, 13 bp, Homo sapiens
tgaacctttactc

SEQ ID NO: 3059958 - DNA, 17 bp, Homo sapiens
tgaactaagttattgtt

SEQ ID NO: 3059959 - DNA, 15 bp, Homo sapiens
tgaactcagccaagc

SEQ ID NO: 3059960 - DNA, 17 bp, Homo sapiens
tgaactcagccaagcac

SEQ ID NO: 3059961 - DNA, 17 bp, Homo sapiens
tgaactccttccccact

SEQ ID NO: 3059962 - DNA, 13 bp, Homo sapiens
tgaactctcccct

SEQ ID NO: 3059963 - DNA, 23 bp, Homo sapiens
tgaactctcccctccccatctgt

SEQ ID NO: 3059964 - DNA, 18 bp, Homo sapiens
tgaactgaaattaaaact

SEQ ID NO: 3059965 - DNA, 13 bp, Homo sapiens
tgaactgacaggc

SEQ ID NO: 3059966 - DNA, 23 bp, Homo sapiens
tgaactgacaggcagcctggaca

SEQ ID NO: 3059967 - DNA, 16 bp, Homo sapiens
tgaactgagcttggaa

SEQ ID NO: 3059968 - DNA, 16 bp, Homo sapiens
tgaactgaggccttgt

SEQ ID NO: 3059969 - DNA, 20 bp, Homo sapiens
tgaactgattcacatctcat

SEQ ID NO: 3059970 - DNA, 16 bp, Homo sapiens
tgaactggcttgtaca

SEQ ID NO: 3059971 - DNA, 18 bp, Homo sapiens
tgaactggcttgtacatt

SEQ ID NO: 3059972 - DNA, 19 bp, Homo sapiens
tgaactggcttgtacattt

SEQ ID NO: 3059973 - DNA, 12 bp, Homo sapiens
tgaactgggctc

SEQ ID NO: 3059974 - DNA, 18 bp, Homo sapiens
tgaactgtattattgcaa

SEQ ID NO: 3059975 - DNA, 22 bp, Homo sapiens
tgaactgtgtgtaattgttcct

SEQ ID NO: 3059976 - DNA, 16 bp, Homo sapiens
tgaacttattctgtag

SEQ ID NO: 3059977 - DNA, 14 bp, Homo sapiens
tgaacttcgcatca

SEQ ID NO: 3059978 - DNA, 18 bp, Homo sapiens
tgaacttcgcatcaaaag

SEQ ID NO: 3059979 - DNA, 19 bp, Homo sapiens
tgaatattaagaaacaatt

SEQ ID NO: 3059980 - DNA, 13 bp, Homo sapiens
tgaatatttgtaa

SEQ ID NO: 3059981 - DNA, 20 bp, Homo sapiens
tgaatatttgtaaaaataat

SEQ ID NO: 3059982 - DNA, 15 bp, Homo sapiens
tgaatcaaaagtgcc

SEQ ID NO: 3059983 - DNA, 16 bp, Homo sapiens
tgaatcaaaagtgcct

SEQ ID NO: 3059984 - DNA, 17 bp, Homo sapiens
tgaatcaataatatatt

SEQ ID NO: 3059985 - DNA, 19 bp, Homo sapiens
tgaatcaataatatatttt

SEQ ID NO: 3059986 - DNA, 22 bp, Homo sapiens
tgaatcactgtttttagacacc

SEQ ID NO: 3059987 - DNA, 16 bp, Homo sapiens
tgaatcagaccctacc

SEQ ID NO: 3059988 - DNA, 23 bp, Homo sapiens
tgaatcagtttccaattatttga

SEQ ID NO: 3059989 - DNA, 21 bp, Homo sapiens
tgaatcatgtagtatcaaata

SEQ ID NO: 3059990 - DNA, 20 bp, Homo sapiens
tgaatccaaatctgtcctct

SEQ ID NO: 3059991 - DNA, 21 bp, Homo sapiens
tgaatccaaatctgtcctctg

SEQ ID NO: 3059992 - DNA, 23 bp, Homo sapiens
tgaatccaaatctgtcctctgta

SEQ ID NO: 3059993 - DNA, 21 bp, Homo sapiens
tgaatccatgggtctggctag

SEQ ID NO: 3059994 - DNA, 20 bp, Homo sapiens
tgaatcccacccacatgtga

SEQ ID NO: 3059995 - DNA, 14 bp, Homo sapiens
tgaatctacatttg

SEQ ID NO: 3059996 - DNA, 16 bp, Homo sapiens
tgaatcttatgcaaaa

SEQ ID NO: 3059997 - DNA, 18 bp, Homo sapiens
tgaatgaaacccccacac

SEQ ID NO: 3059998 - DNA, 20 bp, Homo sapiens
tgaatgaaacccccacacac

SEQ ID NO: 3059999 - DNA, 18 bp, Homo sapiens
tgaatgagtctgttgtgt

SEQ ID NO: 3060000 - DNA, 16 bp, Homo sapiens
tgaatgattcagtgtt

SEQ ID NO: 3060001 - DNA, 22 bp, Homo sapiens
tgaatgcagtctgtccaggctc

SEQ ID NO: 3060002 - DNA, 15 bp, Homo sapiens
tgaatgccaaagcca

SEQ ID NO: 3060003 - DNA, 18 bp, Homo sapiens
tgaatgcccccagctggc

SEQ ID NO: 3060004 - DNA, 20 bp, Homo sapiens
tgaatgcccccagctggccc

SEQ ID NO: 3060005 - DNA, 12 bp, Homo sapiens
tgaatgctgctt

SEQ ID NO: 3060006 - DNA, 14 bp, Homo sapiens
tctgtatataaata

SEQ ID NO: 3060007 - DNA, 22 bp, Homo sapiens
tctgtatataaatatattttct

SEQ ID NO: 3060008 - DNA, 17 bp, Homo sapiens
tctgtatataaatggga

SEQ ID NO: 3060009 - DNA, 20 bp, Homo sapiens
tctgtatatagctctacaca

SEQ ID NO: 3060010 - DNA, 21 bp, Homo sapiens
tctgtatatgattctctgtgg

SEQ ID NO: 3060011 - DNA, 16 bp, Homo sapiens
tctgtatcctgggcct

SEQ ID NO: 3060012 - DNA, 14 bp, Homo sapiens
tctgtatcttttct

SEQ ID NO: 3060013 - DNA, 14 bp, Homo sapiens
tctgtattttcaaa

SEQ ID NO: 3060014 - DNA, 16 bp, Homo sapiens
tctgtattttcaaaga

SEQ ID NO: 3060015 - DNA, 15 bp, Homo sapiens
tctgtatttttctaa

SEQ ID NO: 3060016 - DNA, 21 bp, Homo sapiens
tctgtattttttcttgcattg

SEQ ID NO: 3060017 - DNA, 22 bp, Homo sapiens
tctgtattttttcttgcattga

SEQ ID NO: 3060018 - DNA, 22 bp, Homo sapiens
tctgtcaagagtagttatataa

SEQ ID NO: 3060019 - DNA, 18 bp, Homo sapiens
tctgtcacccagtctgtt

SEQ ID NO: 3060020 - DNA, 16 bp, Homo sapiens
tctgtcaccctggcca

SEQ ID NO: 3060021 - DNA, 21 bp, Homo sapiens
tctgtcaccctggccaccacc

SEQ ID NO: 3060022 - DNA, 22 bp, Homo sapiens
tctgtcactgtaggtatagaag

SEQ ID NO: 3060023 - DNA, 18 bp, Homo sapiens
tctgtcaggtttggtttt

SEQ ID NO: 3060024 - DNA, 19 bp, Homo sapiens
tctgtcagtcacagccacc

SEQ ID NO: 3060025 - DNA, 15 bp, Homo sapiens
tctgtcagtgtgaaa

SEQ ID NO: 3060026 - DNA, 20 bp, Homo sapiens
tctgtccaacccctccccca

SEQ ID NO: 3060027 - DNA, 19 bp, Homo sapiens
tctgtccacatccccagag

SEQ ID NO: 3060028 - DNA, 15 bp, Homo sapiens
tctgtccatcctcct

SEQ ID NO: 3060029 - DNA, 17 bp, Homo sapiens
tctgtccatcctcctct

SEQ ID NO: 3060030 - DNA, 19 bp, Homo sapiens
tctgtccatcctcctctcc

SEQ ID NO: 3060031 - DNA, 13 bp, Homo sapiens
tctgtccccaggc

SEQ ID NO: 3060032 - DNA, 15 bp, Homo sapiens
tctgtccccaggcct

SEQ ID NO: 3060033 - DNA, 19 bp, Homo sapiens
tctgtccccaggcctggct

SEQ ID NO: 3060034 - DNA, 14 bp, Homo sapiens
tctgtccctcacag

SEQ ID NO: 3060035 - DNA, 20 bp, Homo sapiens
tctgtcccttctgtccctca

SEQ ID NO: 3060036 - DNA, 15 bp, Homo sapiens
tctgtcccttgctgt

SEQ ID NO: 3060037 - DNA, 17 bp, Homo sapiens
tctgtcccttgctgtat

SEQ ID NO: 3060038 - DNA, 17 bp, Homo sapiens
tctgtccgtccagagcc

SEQ ID NO: 3060039 - DNA, 15 bp, Homo sapiens
tctgtcctcagcctt

SEQ ID NO: 3060040 - DNA, 19 bp, Homo sapiens
tctgtcctcagccttgcca

SEQ ID NO: 3060041 - DNA, 23 bp, Homo sapiens
tctgtcctcagccttgccagaga

SEQ ID NO: 3060042 - DNA, 21 bp, Homo sapiens
tctgtcctgtgaggtttccca

SEQ ID NO: 3060043 - DNA, 14 bp, Homo sapiens
tctgtccttctgaa

SEQ ID NO: 3060044 - DNA, 16 bp, Homo sapiens
tctgtcgcccaggctg

SEQ ID NO: 3060045 - DNA, 17 bp, Homo sapiens
tctgtctagaatcctgc

SEQ ID NO: 3060046 - DNA, 21 bp, Homo sapiens
tctgtctagaatcctgcttta

SEQ ID NO: 3060047 - DNA, 14 bp, Homo sapiens
tctgtctctgtgga

SEQ ID NO: 3060048 - DNA, 15 bp, Homo sapiens
tctgtcttcacctga

SEQ ID NO: 3060049 - DNA, 22 bp, Homo sapiens
tctgtcttcaggctctgcccag

SEQ ID NO: 3060050 - DNA, 16 bp, Homo sapiens
tctgtcttctctccac

SEQ ID NO: 3060051 - DNA, 17 bp, Homo sapiens
tctgtcttctctccact

SEQ ID NO: 3060052 - DNA, 15 bp, Homo sapiens
tctgtcttctgtata

SEQ ID NO: 3060053 - DNA, 19 bp, Homo sapiens
tctgtcttggctttcatgt

SEQ ID NO: 3060054 - DNA, 20 bp, Homo sapiens
tctgtctttgcggggcctgt

SEQ ID NO: 3060055 - DNA, 23 bp, Homo sapiens
tctgtctttgcggggcctgtctc

SEQ ID NO: 3060056 - DNA, 17 bp, Homo sapiens
tctgtctttttccttcc

SEQ ID NO: 3060057 - DNA, 14 bp, Homo sapiens
tctgtgaagaagcc

SEQ ID NO: 3060058 - DNA, 21 bp, Homo sapiens
tctgtgaagaagccctgttct

SEQ ID NO: 3060059 - DNA, 22 bp, Homo sapiens
tctgtgaagaagccctgttctc

SEQ ID NO: 3060060 - DNA, 19 bp, Homo sapiens
tctgtgaagaggaacagtg

SEQ ID NO: 3060061 - DNA, 19 bp, Homo sapiens
tctgtgaagccctttgcct

SEQ ID NO: 3060062 - DNA, 20 bp, Homo sapiens
tctgtgaagccctttgcctg

SEQ ID NO: 3060063 - DNA, 14 bp, Homo sapiens
tctgtgactataaa

SEQ ID NO: 3060064 - DNA, 18 bp, Homo sapiens
tctgtgactataaagctg

SEQ ID NO: 3060065 - DNA, 14 bp, Homo sapiens
tctgtgcagggctg

SEQ ID NO: 3060066 - DNA, 19 bp, Homo sapiens
tctgtgcatggtggcacca

SEQ ID NO: 3060067 - DNA, 21 bp, Homo sapiens
tctgtgccgccacctctacct

SEQ ID NO: 3060068 - DNA, 20 bp, Homo sapiens
tctgtgcctacatgttctca

SEQ ID NO: 3060069 - DNA, 18 bp, Homo sapiens
tctgtgccttcttttgat

SEQ ID NO: 3060070 - DNA, 15 bp, Homo sapiens
tctgtgcgtgtggcg

SEQ ID NO: 3060071 - DNA, 19 bp, Homo sapiens
tctgtgctgtgtggaacca

SEQ ID NO: 3060072 - DNA, 20 bp, Homo sapiens
tctgtggaaagtgtaaagca

SEQ ID NO: 3060073 - DNA, 22 bp, Homo sapiens
tctgtggaaagtgtaaagcatt

SEQ ID NO: 3060074 - DNA, 18 bp, Homo sapiens
tctgtggagttcctgctc

SEQ ID NO: 3060075 - DNA, 20 bp, Homo sapiens
tctgtggattcagcttctgt

SEQ ID NO: 3060076 - DNA, 21 bp, Homo sapiens
tctgtggattcagcttctgtt

SEQ ID NO: 3060077 - DNA, 18 bp, Homo sapiens
tctgtgggaaaaaagaaa

SEQ ID NO: 3060078 - DNA, 20 bp, Homo sapiens
tctgtgggcgggcccagcac

SEQ ID NO: 3060079 - DNA, 22 bp, Homo sapiens
tctgtgggggtcatcagggagg

SEQ ID NO: 3060080 - DNA, 16 bp, Homo sapiens
tctgtgggtctctgga

SEQ ID NO: 3060081 - DNA, 20 bp, Homo sapiens
tctgtgtaaccagctcagtg

SEQ ID NO: 3060082 - DNA, 14 bp, Homo sapiens
tctgtgtacaaaga

SEQ ID NO: 3060083 - DNA, 16 bp, Homo sapiens
tctgtgtacaaagaaa

SEQ ID NO: 3060084 - DNA, 20 bp, Homo sapiens
tctgtgtagccgccctgaga

SEQ ID NO: 3060085 - DNA, 22 bp, Homo sapiens
tctgtgtctaagattctagatc

SEQ ID NO: 3060086 - DNA, 23 bp, Homo sapiens
tctgtgtgtgacccctcctgggg

SEQ ID NO: 3060087 - DNA, 15 bp, Homo sapiens
tctgtgtgtgtggcg

SEQ ID NO: 3060088 - DNA, 20 bp, Homo sapiens
tctgttatcgaacacattca

SEQ ID NO: 3060089 - DNA, 17 bp, Homo sapiens
tctgttcagtgtaaata

SEQ ID NO: 3060090 - DNA, 12 bp, Homo sapiens
tctgttcatctc

SEQ ID NO: 3060091 - DNA, 21 bp, Homo sapiens
tctgttcatctctttgtcctg

SEQ ID NO: 3060092 - DNA, 23 bp, Homo sapiens
tctgttcatctctttgtcctgaa

SEQ ID NO: 3060093 - DNA, 15 bp, Homo sapiens
tctgttccttcacat

SEQ ID NO: 3060094 - DNA, 15 bp, Homo sapiens
tctgttctaacatgt

SEQ ID NO: 3060095 - DNA, 19 bp, Homo sapiens
tctgttctactcttaatga

SEQ ID NO: 3060096 - DNA, 12 bp, Homo sapiens
tctgttctgtgg

SEQ ID NO: 3060097 - DNA, 13 bp, Homo sapiens
tctgttgcctcct

SEQ ID NO: 3060098 - DNA, 21 bp, Homo sapiens
tctgttgcctcctctctccct

SEQ ID NO: 3060099 - DNA, 22 bp, Homo sapiens
tctgttggaagcttgttttcca

SEQ ID NO: 3060100 - DNA, 23 bp, Homo sapiens
tctgttggtgggcgtgcccctga

SEQ ID NO: 3060101 - DNA, 16 bp, Homo sapiens
tctgttgtctagagct

SEQ ID NO: 3060102 - DNA, 13 bp, Homo sapiens
tctgttgtgttca

SEQ ID NO: 3060103 - DNA, 14 bp, Homo sapiens
tctgtttacagtgt

SEQ ID NO: 3060104 - DNA, 20 bp, Homo sapiens
tctgtttcctgacattgtct

SEQ ID NO: 3060105 - DNA, 16 bp, Homo sapiens
tctgtttgcttttgaa

SEQ ID NO: 3060106 - DNA, 20 bp, Homo sapiens
tctgttttatatagaaacac

SEQ ID NO: 3060107 - DNA, 21 bp, Homo sapiens
tctgttttcgtaccttcccac

SEQ ID NO: 3060108 - DNA, 17 bp, Homo sapiens
tctgttttctgtgcact

SEQ ID NO: 3060109 - DNA, 17 bp, Homo sapiens
tctgttttgaaggcaaa

SEQ ID NO: 3060110 - DNA, 19 bp, Homo sapiens
tctgtttttaatgctattt

SEQ ID NO: 3060111 - DNA, 18 bp, Homo sapiens
tctgtttttatgttttat

SEQ ID NO: 3060112 - DNA, 15 bp, Homo sapiens
tctgtttttcacact

SEQ ID NO: 3060113 - DNA, 22 bp, Homo sapiens
tctgtttttcacactaaacata

SEQ ID NO: 3060114 - DNA, 19 bp, Homo sapiens
tcttaaaaagttgttcaac

SEQ ID NO: 3060115 - DNA, 15 bp, Homo sapiens
tcttaaaaatattgt

SEQ ID NO: 3060116 - DNA, 20 bp, Homo sapiens
tcttaaaaatgttttttcat

SEQ ID NO: 3060117 - DNA, 19 bp, Homo sapiens
tcttaaatcagaataaatt

SEQ ID NO: 3060118 - DNA, 22 bp, Homo sapiens
tcttaaatcagaataaattaat

SEQ ID NO: 3060119 - DNA, 14 bp, Homo sapiens
tcttaaatcagttt

SEQ ID NO: 3060120 - DNA, 14 bp, Homo sapiens
tcttaaatctttct

SEQ ID NO: 3060121 - DNA, 18 bp, Homo sapiens
tcttaaatctttcttcaa

SEQ ID NO: 3060122 - DNA, 20 bp, Homo sapiens
tcttaacaaaccaacatctt

SEQ ID NO: 3060123 - DNA, 21 bp, Homo sapiens
tcttaacaaaccaacatcttt

SEQ ID NO: 3060124 - DNA, 14 bp, Homo sapiens
tcttaagaaatgta

SEQ ID NO: 3060125 - DNA, 16 bp, Homo sapiens
tcttaagaggctgaca

SEQ ID NO: 3060126 - DNA, 23 bp, Homo sapiens
tcttaagcagagataaataaaag

SEQ ID NO: 3060127 - DNA, 19 bp, Homo sapiens
tcttaagccatcttggtaa

SEQ ID NO: 3060128 - DNA, 22 bp, Homo sapiens
tcttaagccatcttggtaaatt

SEQ ID NO: 3060129 - DNA, 18 bp, Homo sapiens
tctcagtccagcagtttc

SEQ ID NO: 3060130 - DNA, 15 bp, Homo sapiens
tctcagtctctgagc

SEQ ID NO: 3060131 - DNA, 13 bp, Homo sapiens
tctcagtcttttc

SEQ ID NO: 3060132 - DNA, 18 bp, Homo sapiens
tctcagtgattcgctttt

SEQ ID NO: 3060133 - DNA, 23 bp, Homo sapiens
tctcagtgccttctctcagctcc

SEQ ID NO: 3060134 - DNA, 20 bp, Homo sapiens
tctcatagcaggaaatgtag

SEQ ID NO: 3060135 - DNA, 21 bp, Homo sapiens
tctcatatatagacagctttg

SEQ ID NO: 3060136 - DNA, 16 bp, Homo sapiens
tctcatatcactgaag

SEQ ID NO: 3060137 - DNA, 18 bp, Homo sapiens
tctcatcaacttaaaagt

SEQ ID NO: 3060138 - DNA, 14 bp, Homo sapiens
tctcatcacacaca

SEQ ID NO: 3060139 - DNA, 15 bp, Homo sapiens
tctcatcacacacat

SEQ ID NO: 3060140 - DNA, 14 bp, Homo sapiens
tctcatccatcatc

SEQ ID NO: 3060141 - DNA, 13 bp, Homo sapiens
tctcatctgtgat

SEQ ID NO: 3060142 - DNA, 13 bp, Homo sapiens
tctcatcttaaaa

SEQ ID NO: 3060143 - DNA, 16 bp, Homo sapiens
tctcatcttaaaaata

SEQ ID NO: 3060144 - DNA, 17 bp, Homo sapiens
tctcatcttaaaaatat

SEQ ID NO: 3060145 - DNA, 16 bp, Homo sapiens
tctcatgggaagggga

SEQ ID NO: 3060146 - DNA, 18 bp, Homo sapiens
tctcatgttttcaactgc

SEQ ID NO: 3060147 - DNA, 19 bp, Homo sapiens
tctcatgttttcaactgcc

SEQ ID NO: 3060148 - DNA, 13 bp, Homo sapiens
tctcattccccag

SEQ ID NO: 3060149 - DNA, 14 bp, Homo sapiens
tctcattccccagg

SEQ ID NO: 3060150 - DNA, 16 bp, Homo sapiens
tctcattgaggacaaa

SEQ ID NO: 3060151 - DNA, 15 bp, Homo sapiens
tctcattgctgcccg

SEQ ID NO: 3060152 - DNA, 19 bp, Homo sapiens
tctcattggacccttccat

SEQ ID NO: 3060153 - DNA, 23 bp, Homo sapiens
tctcatttggtttgattttccct

SEQ ID NO: 3060154 - DNA, 20 bp, Homo sapiens
tctcattttgtccatgtccc

SEQ ID NO: 3060155 - DNA, 21 bp, Homo sapiens
tctcatttttccgtaaaaatg

SEQ ID NO: 3060156 - DNA, 21 bp, Homo sapiens
tctccaactgcctaaggccct

SEQ ID NO: 3060157 - DNA, 17 bp, Homo sapiens
tctccaagaatggaagc

SEQ ID NO: 3060158 - DNA, 19 bp, Homo sapiens
tctccaagaatggaagcct

SEQ ID NO: 3060159 - DNA, 14 bp, Homo sapiens
tctccacagcaacc

SEQ ID NO: 3060160 - DNA, 19 bp, Homo sapiens
tctccacagcaaccccagg

SEQ ID NO: 3060161 - DNA, 13 bp, Homo sapiens
tctccacctcagc

SEQ ID NO: 3060162 - DNA, 15 bp, Homo sapiens
tctccacctcagcct

SEQ ID NO: 3060163 - DNA, 18 bp, Homo sapiens
tctccacctcagccttgg

SEQ ID NO: 3060164 - DNA, 19 bp, Homo sapiens
tctccacctcagccttgga

SEQ ID NO: 3060165 - DNA, 17 bp, Homo sapiens
tctccactcagttgcaa

SEQ ID NO: 3060166 - DNA, 17 bp, Homo sapiens
tctccacttctggtccc

SEQ ID NO: 3060167 - DNA, 23 bp, Homo sapiens
tctccacttctggtcccctgtgg

SEQ ID NO: 3060168 - DNA, 15 bp, Homo sapiens
tctccagaagaaaat

SEQ ID NO: 3060169 - DNA, 15 bp, Homo sapiens
tctccagatgtttcc

SEQ ID NO: 3060170 - DNA, 18 bp, Homo sapiens
tctccagatgtttccaga

SEQ ID NO: 3060171 - DNA, 11 bp, Homo sapiens
tctccagcctc

SEQ ID NO: 3060172 - DNA, 21 bp, Homo sapiens
tctccagcctgggaggcacag

SEQ ID NO: 3060173 - DNA, 12 bp, Homo sapiens
tctccaggccag

SEQ ID NO: 3060174 - DNA, 16 bp, Homo sapiens
tctccaggccaggtgg

SEQ ID NO: 3060175 - DNA, 21 bp, Homo sapiens
tctccaggcgacgcggttttt

SEQ ID NO: 3060176 - DNA, 21 bp, Homo sapiens
tctccagggtcagaaacagga

SEQ ID NO: 3060177 - DNA, 17 bp, Homo sapiens
tctccagtatcctgctg

SEQ ID NO: 3060178 - DNA, 12 bp, Homo sapiens
tctccagtccct

SEQ ID NO: 3060179 - DNA, 15 bp, Homo sapiens
tctccagtccctggg

SEQ ID NO: 3060180 - DNA, 13 bp, Homo sapiens
tctccatccacat

SEQ ID NO: 3060181 - DNA, 21 bp, Homo sapiens
tctccatgaggtactggtccc

SEQ ID NO: 3060182 - DNA, 15 bp, Homo sapiens
tctccatgcaagtgc

SEQ ID NO: 3060183 - DNA, 16 bp, Homo sapiens
tctccatgcaagtgct

SEQ ID NO: 3060184 - DNA, 15 bp, Homo sapiens
tctccatggccacct

SEQ ID NO: 3060185 - DNA, 20 bp, Homo sapiens
tctccatggccaccttttca

SEQ ID NO: 3060186 - DNA, 15 bp, Homo sapiens
tctccatggccctgc

SEQ ID NO: 3060187 - DNA, 22 bp, Homo sapiens
tctccatgtagaataaatgaag

SEQ ID NO: 3060188 - DNA, 20 bp, Homo sapiens
tctcccaaagggcacacccc

SEQ ID NO: 3060189 - DNA, 18 bp, Homo sapiens
tctcccaacgctgaagcg

SEQ ID NO: 3060190 - DNA, 18 bp, Homo sapiens
tctcccacatcccactgg

SEQ ID NO: 3060191 - DNA, 20 bp, Homo sapiens
tctcccaccctaagggcagc

SEQ ID NO: 3060192 - DNA, 14 bp, Homo sapiens
tctcccacctagca

SEQ ID NO: 3060193 - DNA, 15 bp, Homo sapiens
tctcccagacttgtt

SEQ ID NO: 3060194 - DNA, 17 bp, Homo sapiens
tctcccagacttgtttc

SEQ ID NO: 3060195 - DNA, 16 bp, Homo sapiens
tctcccagataatgtg

SEQ ID NO: 3060196 - DNA, 23 bp, Homo sapiens
tctcccagataatgtgaaaatgg

SEQ ID NO: 3060197 - DNA, 22 bp, Homo sapiens
tctcccagatcgctcccttggc

SEQ ID NO: 3060198 - DNA, 22 bp, Homo sapiens
tctcccatttcaggaatttaaa

SEQ ID NO: 3060199 - DNA, 14 bp, Homo sapiens
tctccccagcccag

SEQ ID NO: 3060200 - DNA, 15 bp, Homo sapiens
tctccccagcccaga

SEQ ID NO: 3060201 - DNA, 16 bp, Homo sapiens
tctccccagcccagag

SEQ ID NO: 3060202 - DNA, 22 bp, Homo sapiens
tctcccccaacaccccgcctgc

SEQ ID NO: 3060203 - DNA, 14 bp, Homo sapiens
tctccccctcctga

SEQ ID NO: 3060204 - DNA, 13 bp, Homo sapiens
tctccccctctgt

SEQ ID NO: 3060205 - DNA, 16 bp, Homo sapiens
tctccccctctgtctt

SEQ ID NO: 3060206 - DNA, 18 bp, Homo sapiens
tctcccccttaccccaca

SEQ ID NO: 3060207 - DNA, 20 bp, Homo sapiens
tctccccgaggctgccccag

SEQ ID NO: 3060208 - DNA, 13 bp, Homo sapiens
tctcccctcagag

SEQ ID NO: 3060209 - DNA, 15 bp, Homo sapiens
tctcccctccccatc

SEQ ID NO: 3060210 - DNA, 17 bp, Homo sapiens
tctcccctccccatctg

SEQ ID NO: 3060211 - DNA, 14 bp, Homo sapiens
tctcccgtctcgcc

SEQ ID NO: 3060212 - DNA, 18 bp, Homo sapiens
tctccctcctctgcccgg

SEQ ID NO: 3060213 - DNA, 22 bp, Homo sapiens
tctccctctaggctctgccttc

SEQ ID NO: 3060214 - DNA, 14 bp, Homo sapiens
tctccctctcctgc

SEQ ID NO: 3060215 - DNA, 17 bp, Homo sapiens
tctccctctcctgccta

SEQ ID NO: 3060216 - DNA, 15 bp, Homo sapiens
tctccctctggccct

SEQ ID NO: 3060217 - DNA, 16 bp, Homo sapiens
tctccctctttctagc

SEQ ID NO: 3060218 - DNA, 18 bp, Homo sapiens
tctccctctttctagcct

SEQ ID NO: 3060219 - DNA, 15 bp, Homo sapiens
tctccctgaccctgt

SEQ ID NO: 3060220 - DNA, 14 bp, Homo sapiens
tctccctgccatcc

SEQ ID NO: 3060221 - DNA, 19 bp, Homo sapiens
tctccctgccatccccctc

SEQ ID NO: 3060222 - DNA, 13 bp, Homo sapiens
tctccctgcctca

SEQ ID NO: 3060223 - DNA, 21 bp, Homo sapiens
tctccctgcctcacatctccc

SEQ ID NO: 3060224 - DNA, 20 bp, Homo sapiens
tctcccttactattcccact

SEQ ID NO: 3060225 - DNA, 14 bp, Homo sapiens
tctcccttccacct

SEQ ID NO: 3060226 - DNA, 16 bp, Homo sapiens
tctcccttccacctca

SEQ ID NO: 3060227 - DNA, 23 bp, Homo sapiens
tctcccttcccttccctcacccc

SEQ ID NO: 3060228 - DNA, 22 bp, Homo sapiens
tctccgcacacctctggctgtc

SEQ ID NO: 3060229 - DNA, 17 bp, Homo sapiens
tctccgtatgatgtgat

SEQ ID NO: 3060230 - DNA, 18 bp, Homo sapiens
tctcctaatgctctgaaa

SEQ ID NO: 3060231 - DNA, 18 bp, Homo sapiens
tctcctaggggcttggtc

SEQ ID NO: 3060232 - DNA, 23 bp, Homo sapiens
tctcctatcttttatttcattca

SEQ ID NO: 3060233 - DNA, 21 bp, Homo sapiens
tctcctcagacagtaaccatg

SEQ ID NO: 3060234 - DNA, 16 bp, Homo sapiens
tctcctccccttgaat

SEQ ID NO: 3060235 - DNA, 15 bp, Homo sapiens
tctcctcctcctccc

SEQ ID NO: 3060236 - DNA, 21 bp, Homo sapiens
tctcctcctcctccctcctca

SEQ ID NO: 3060237 - DNA, 14 bp, Homo sapiens
tctcctcctgccca

SEQ ID NO: 3060238 - DNA, 17 bp, Homo sapiens
tctcctccttgggcagg

SEQ ID NO: 3060239 - DNA, 20 bp, Homo sapiens
tctcctcgttggttcatgtg

SEQ ID NO: 3060240 - DNA, 15 bp, Homo sapiens
tctcctctcagcttc

SEQ ID NO: 3060241 - DNA, 14 bp, Homo sapiens
tctcctctcttggc

SEQ ID NO: 3060242 - DNA, 13 bp, Homo sapiens
tctcctcttgtaa

SEQ ID NO: 3060243 - DNA, 14 bp, Homo sapiens
tctcctcttgtaaa

SEQ ID NO: 3060244 - DNA, 23 bp, Homo sapiens
tctcctcttgtaaataaagccct

SEQ ID NO: 3060245 - DNA, 16 bp, Homo sapiens
tctcctgacctcatga

SEQ ID NO: 3060246 - DNA, 14 bp, Homo sapiens
tctcctgactttta

SEQ ID NO: 3060247 - DNA, 19 bp, Homo sapiens
tctcctgccacattagaac

SEQ ID NO: 3060248 - DNA, 22 bp, Homo sapiens
tctcctgccacattagaacttc

SEQ ID NO: 3060249 - DNA, 23 bp, Homo sapiens
tctcctgcctcagcctccccagt

SEQ ID NO: 3060250 - DNA, 15 bp, Homo sapiens
tctcctgcctcagct

SEQ ID NO: 3060251 - DNA, 16 bp, Homo sapiens
tctcctgccttcctcc

SEQ ID NO: 3060252 - DNA, 18 bp, Homo sapiens
tctcctgccttcctcctg

SEQ ID NO: 3060253 - DNA, 13 bp, Homo sapiens
tctcctgcctttg

SEQ ID NO: 3060254 - DNA, 14 bp, Homo sapiens
tctcctgcttgtac

SEQ ID NO: 3060255 - DNA, 18 bp, Homo sapiens
tctcctggagggcgccca

SEQ ID NO: 3060256 - DNA, 19 bp, Homo sapiens
tctcctggagggcgcccag

SEQ ID NO: 3060257 - DNA, 13 bp, Homo sapiens
tctccttctcttc

SEQ ID NO: 3060258 - DNA, 18 bp, Homo sapiens
tctccttctcttctcttc

SEQ ID NO: 3060259 - DNA, 17 bp, Homo sapiens
tctcttttcctctctct

SEQ ID NO: 3060260 - DNA, 16 bp, Homo sapiens
tctcttttcctctctg

SEQ ID NO: 3060261 - DNA, 17 bp, Homo sapiens
tctcttttcctctctgt

SEQ ID NO: 3060262 - DNA, 13 bp, Homo sapiens
tctcttttctcta

SEQ ID NO: 3060263 - DNA, 17 bp, Homo sapiens
tctcttttgaaacaata

SEQ ID NO: 3060264 - DNA, 20 bp, Homo sapiens
tctcttttgaaacaatactc

SEQ ID NO: 3060265 - DNA, 13 bp, Homo sapiens
tctctttttgaaa

SEQ ID NO: 3060266 - DNA, 12 bp, Homo sapiens
tctgaaaagaaa

SEQ ID NO: 3060267 - DNA, 16 bp, Homo sapiens
tctgaaaatacatttc

SEQ ID NO: 3060268 - DNA, 14 bp, Homo sapiens
tctgaaaatataac

SEQ ID NO: 3060269 - DNA, 17 bp, Homo sapiens
tctgaaaatatttacat

SEQ ID NO: 3060270 - DNA, 10 bp, Homo sapiens
tctgaaacag

SEQ ID NO: 3060271 - DNA, 18 bp, Homo sapiens
tctgaaacagctgcctta

SEQ ID NO: 3060272 - DNA, 16 bp, Homo sapiens
tctgaaaccacagttt

SEQ ID NO: 3060273 - DNA, 12 bp, Homo sapiens
tctgaaagccac

SEQ ID NO: 3060274 - DNA, 21 bp, Homo sapiens
tctgaaagttgtacatgaaat

SEQ ID NO: 3060275 - DNA, 18 bp, Homo sapiens
tctgaaataggaaacaag

SEQ ID NO: 3060276 - DNA, 14 bp, Homo sapiens
tctgaaatgtgata

SEQ ID NO: 3060277 - DNA, 13 bp, Homo sapiens
tctgaagaagcaa

SEQ ID NO: 3060278 - DNA, 23 bp, Homo sapiens
tctgaagagaccactcaatccat

SEQ ID NO: 3060279 - DNA, 17 bp, Homo sapiens
tctgaagattgaaaaaa

SEQ ID NO: 3060280 - DNA, 13 bp, Homo sapiens
tctgaagcaaggc

SEQ ID NO: 3060281 - DNA, 13 bp, Homo sapiens
tctgaagcctcac

SEQ ID NO: 3060282 - DNA, 20 bp, Homo sapiens
tctgaagctgacgaacttcc

SEQ ID NO: 3060283 - DNA, 20 bp, Homo sapiens
tctgaagcttatgtttctta

SEQ ID NO: 3060284 - DNA, 21 bp, Homo sapiens
tctgaaggagccccattcctg

SEQ ID NO: 3060285 - DNA, 19 bp, Homo sapiens
tctgaagtatgaagtctga

SEQ ID NO: 3060286 - DNA, 18 bp, Homo sapiens
tctgaagtggttcagtct

SEQ ID NO: 3060287 - DNA, 17 bp, Homo sapiens
tctgaatattaagaaac

SEQ ID NO: 3060288 - DNA, 15 bp, Homo sapiens
tctgaatgtttgtgt

SEQ ID NO: 3060289 - DNA, 18 bp, Homo sapiens
tctgaatgtttgtgtctg

SEQ ID NO: 3060290 - DNA, 19 bp, Homo sapiens
tctgaatttgcaaagtact

SEQ ID NO: 3060291 - DNA, 21 bp, Homo sapiens
tctgaatttgcaaagtactgt

SEQ ID NO: 3060292 - DNA, 13 bp, Homo sapiens
tctgacaaagtgt

SEQ ID NO: 3060293 - DNA, 13 bp, Homo sapiens
tctgacaaattca

SEQ ID NO: 3060294 - DNA, 23 bp, Homo sapiens
tctgacagcagcctgtgagggag

SEQ ID NO: 3060295 - DNA, 13 bp, Homo sapiens
tctgacagttgtg

SEQ ID NO: 3060296 - DNA, 17 bp, Homo sapiens
tctgacagtttttctgt

SEQ ID NO: 3060297 - DNA, 13 bp, Homo sapiens
tctgacataatcc

SEQ ID NO: 3060298 - DNA, 23 bp, Homo sapiens
tctgacattatgtggttttagat

SEQ ID NO: 3060299 - DNA, 14 bp, Homo sapiens
tctgaccatctgtg

SEQ ID NO: 3060300 - DNA, 16 bp, Homo sapiens
tctgaccatctgtgac

SEQ ID NO: 3060301 - DNA, 21 bp, Homo sapiens
tctgaccatgaggtgggggtt

SEQ ID NO: 3060302 - DNA, 13 bp, Homo sapiens
tctgacccagtgc

SEQ ID NO: 3060303 - DNA, 17 bp, Homo sapiens
tctgaccctgggctttc

SEQ ID NO: 3060304 - DNA, 21 bp, Homo sapiens
tctgacctgcaaaaatgctgg

SEQ ID NO: 3060305 - DNA, 12 bp, Homo sapiens
tctgacctggtg

SEQ ID NO: 3060306 - DNA, 13 bp, Homo sapiens
tctgactcagggc

SEQ ID NO: 3060307 - DNA, 20 bp, Homo sapiens
tctgactccctccccaccca

SEQ ID NO: 3060308 - DNA, 18 bp, Homo sapiens
tctgactttacactcggc

SEQ ID NO: 3060309 - DNA, 20 bp, Homo sapiens
tctgagaaacctgttgaaga

SEQ ID NO: 3060310 - DNA, 21 bp, Homo sapiens
tctgagaaacctgttgaagat

SEQ ID NO: 3060311 - DNA, 14 bp, Homo sapiens
tctgagaaactcta

SEQ ID NO: 3060312 - DNA, 16 bp, Homo sapiens
tctgagacaaaagaaa

SEQ ID NO: 3060313 - DNA, 19 bp, Homo sapiens
tctgagacaaaagaaaaaa

SEQ ID NO: 3060314 - DNA, 17 bp, Homo sapiens
tctgagagaccatctcc

SEQ ID NO: 3060315 - DNA, 20 bp, Homo sapiens
tctgagagaggccattcttt

SEQ ID NO: 3060316 - DNA, 17 bp, Homo sapiens
tctgagagtctagattc

SEQ ID NO: 3060317 - DNA, 22 bp, Homo sapiens
tctgagcaaggagtttaaatga

SEQ ID NO: 3060318 - DNA, 19 bp, Homo sapiens
tctgagcagtgaatgattc

SEQ ID NO: 3060319 - DNA, 20 bp, Homo sapiens
tctgagcgtttaaagtactg

SEQ ID NO: 3060320 - DNA, 15 bp, Homo sapiens
tctgagctgagccag

SEQ ID NO: 3060321 - DNA, 17 bp, Homo sapiens
tctgagctggggaggtg

SEQ ID NO: 3060322 - DNA, 18 bp, Homo sapiens
tctgagctttgttactga

SEQ ID NO: 3060323 - DNA, 12 bp, Homo sapiens
tctgaggacatt

SEQ ID NO: 3060324 - DNA, 20 bp, Homo sapiens
tctgaggacattccaagaca

SEQ ID NO: 3060325 - DNA, 23 bp, Homo sapiens
tctgaggggtgtccgagaggctg

SEQ ID NO: 3060326 - DNA, 23 bp, Homo sapiens
tctgagtcagctgaccccctccc

SEQ ID NO: 3060327 - DNA, 12 bp, Homo sapiens
tctgagtggtgt

SEQ ID NO: 3060328 - DNA, 15 bp, Homo sapiens
tctgagtgtctctgc

SEQ ID NO: 3060329 - DNA, 20 bp, Homo sapiens
tctgagtgtctctgcctgga

SEQ ID NO: 3060330 - DNA, 23 bp, Homo sapiens
tctgagtgttttatgagaaagcc

SEQ ID NO: 3060331 - DNA, 19 bp, Homo sapiens
tctgataagagaatcaaca

SEQ ID NO: 3060332 - DNA, 17 bp, Homo sapiens
tctgataccttcattta

SEQ ID NO: 3060333 - DNA, 19 bp, Homo sapiens
tctgatcacccccctgctt

SEQ ID NO: 3060334 - DNA, 20 bp, Homo sapiens
tctgatcgtgacgctgaata

SEQ ID NO: 3060335 - DNA, 13 bp, Homo sapiens
tctgatctataca

SEQ ID NO: 3060336 - DNA, 20 bp, Homo sapiens
tctgatcttggaaaaacagc

SEQ ID NO: 3060337 - DNA, 19 bp, Homo sapiens
tctgatgggaggaaagtag

SEQ ID NO: 3060338 - DNA, 16 bp, Homo sapiens
tctgatggtgagcagt

SEQ ID NO: 3060339 - DNA, 17 bp, Homo sapiens
tctgattagaaaggaaa

SEQ ID NO: 3060340 - DNA, 22 bp, Homo sapiens
tctgattcgaatgacactgttc

SEQ ID NO: 3060341 - DNA, 14 bp, Homo sapiens
tctgatttagcaat

SEQ ID NO: 3060342 - DNA, 14 bp, Homo sapiens
tctgatttgcagga

SEQ ID NO: 3060343 - DNA, 17 bp, Homo sapiens
tctgatttgcaggattt

SEQ ID NO: 3060344 - DNA, 18 bp, Homo sapiens
tctgatttgcaggatttt

SEQ ID NO: 3060345 - DNA, 15 bp, Homo sapiens
tctgattttctccac

SEQ ID NO: 3060346 - DNA, 19 bp, Homo sapiens
tctgcaacatggattccaa

SEQ ID NO: 3060347 - DNA, 14 bp, Homo sapiens
tctgcaactgctca

SEQ ID NO: 3060348 - DNA, 17 bp, Homo sapiens
tctgcaactgctcagct

SEQ ID NO: 3060349 - DNA, 15 bp, Homo sapiens
tctgcaactggagag

SEQ ID NO: 3060350 - DNA, 21 bp, Homo sapiens
tctgcaagattctgaaacatt

SEQ ID NO: 3060351 - DNA, 14 bp, Homo sapiens
tctgcaagggccca

SEQ ID NO: 3060352 - DNA, 17 bp, Homo sapiens
tctgcaagggcccagag

SEQ ID NO: 3060353 - DNA, 18 bp, Homo sapiens
tctgcaagggcccagagt

SEQ ID NO: 3060354 - DNA, 17 bp, Homo sapiens
tctgcaagtgtctggag

SEQ ID NO: 3060355 - DNA, 18 bp, Homo sapiens
tctgcaagtgtctggagc

SEQ ID NO: 3060356 - DNA, 13 bp, Homo sapiens
tctgcaatggtga

SEQ ID NO: 3060357 - DNA, 16 bp, Homo sapiens
tctgcaattcaaaagt

SEQ ID NO: 3060358 - DNA, 21 bp, Homo sapiens
tctgcaattcaaaagttccaa

SEQ ID NO: 3060359 - DNA, 17 bp, Homo sapiens
tctgcacaggtctctgt

SEQ ID NO: 3060360 - DNA, 18 bp, Homo sapiens
tctgcacaggtctctgtt

SEQ ID NO: 3060361 - DNA, 12 bp, Homo sapiens
tctgcacatgaa

SEQ ID NO: 3060362 - DNA, 19 bp, Homo sapiens
tctgcacatgtcttgtaca

SEQ ID NO: 3060363 - DNA, 21 bp, Homo sapiens
tctgcacatgtcttgtacatg

SEQ ID NO: 3060364 - DNA, 17 bp, Homo sapiens
tctgcaccaccatgccc

SEQ ID NO: 3060365 - DNA, 18 bp, Homo sapiens
tctgcaccaccatgccca

SEQ ID NO: 3060366 - DNA, 20 bp, Homo sapiens
tctgcaccaccatgcccagc

SEQ ID NO: 3060367 - DNA, 17 bp, Homo sapiens
tctgcacccccctgggc

SEQ ID NO: 3060368 - DNA, 22 bp, Homo sapiens
tctgcactccagatatgtgcca

SEQ ID NO: 3060369 - DNA, 22 bp, Homo sapiens
tctgcagacgtctgccttggca

SEQ ID NO: 3060370 - DNA, 19 bp, Homo sapiens
tctgcagatagaaagcatt

SEQ ID NO: 3060371 - DNA, 16 bp, Homo sapiens
tctgcagccagcccag

SEQ ID NO: 3060372 - DNA, 18 bp, Homo sapiens
tctgcagccagcccagcc

SEQ ID NO: 3060373 - DNA, 14 bp, Homo sapiens
tctaattggtcatt

SEQ ID NO: 3060374 - DNA, 22 bp, Homo sapiens
tctaattttgtgctctttcctg

SEQ ID NO: 3060375 - DNA, 20 bp, Homo sapiens
tctacaaaaaggtataaata

SEQ ID NO: 3060376 - DNA, 15 bp, Homo sapiens
tctacaaggtgttca

SEQ ID NO: 3060377 - DNA, 16 bp, Homo sapiens
tctacacaatttaatt

SEQ ID NO: 3060378 - DNA, 14 bp, Homo sapiens
tctacacagagcag

SEQ ID NO: 3060379 - DNA, 21 bp, Homo sapiens
tctacaccttgcttttttact

SEQ ID NO: 3060380 - DNA, 20 bp, Homo sapiens
tctacagaaagaaaaatgca

SEQ ID NO: 3060381 - DNA, 15 bp, Homo sapiens
tctacatattcttta

SEQ ID NO: 3060382 - DNA, 22 bp, Homo sapiens
tctacatcttttttcacaaatt

SEQ ID NO: 3060383 - DNA, 21 bp, Homo sapiens
tctacatgaggaactgtagat

SEQ ID NO: 3060384 - DNA, 21 bp, Homo sapiens
tctacatgtaactatttcttc

SEQ ID NO: 3060385 - DNA, 11 bp, Homo sapiens
tctacatttaa

SEQ ID NO: 3060386 - DNA, 19 bp, Homo sapiens
tctacatttaaacaagtat

SEQ ID NO: 3060387 - DNA, 11 bp, Homo sapiens
tctacatttgt

SEQ ID NO: 3060388 - DNA, 17 bp, Homo sapiens
tctaccaggcaaattca

SEQ ID NO: 3060389 - DNA, 16 bp, Homo sapiens
tctacccagggcctgc

SEQ ID NO: 3060390 - DNA, 14 bp, Homo sapiens
tctacccctttctg

SEQ ID NO: 3060391 - DNA, 16 bp, Homo sapiens
tctacccgtgcctggg

SEQ ID NO: 3060392 - DNA, 19 bp, Homo sapiens
tctacccgtgcctgggccc

SEQ ID NO: 3060393 - DNA, 21 bp, Homo sapiens
tctacccgtgcctgggcccct

SEQ ID NO: 3060394 - DNA, 22 bp, Homo sapiens
tctacccgtgcctgggcccctc

SEQ ID NO: 3060395 - DNA, 12 bp, Homo sapiens
tctacctctctc

SEQ ID NO: 3060396 - DNA, 14 bp, Homo sapiens
tctacctctctcct

SEQ ID NO: 3060397 - DNA, 22 bp, Homo sapiens
tctacctgagcattcaggcagc

SEQ ID NO: 3060398 - DNA, 16 bp, Homo sapiens
tctacctgcaacacaa

SEQ ID NO: 3060399 - DNA, 15 bp, Homo sapiens
tctacgcaattgaca

SEQ ID NO: 3060400 - DNA, 16 bp, Homo sapiens
tctacgctctcctttc

SEQ ID NO: 3060401 - DNA, 16 bp, Homo sapiens
tctactaaaattcaaa

SEQ ID NO: 3060402 - DNA, 18 bp, Homo sapiens
tctactctggaccaagga

SEQ ID NO: 3060403 - DNA, 20 bp, Homo sapiens
tctacttgatatttccttca

SEQ ID NO: 3060404 - DNA, 15 bp, Homo sapiens
tctactttctcttgt

SEQ ID NO: 3060405 - DNA, 19 bp, Homo sapiens
tctactttctcttgtttaa

SEQ ID NO: 3060406 - DNA, 16 bp, Homo sapiens
tctactttgattctga

SEQ ID NO: 3060407 - DNA, 17 bp, Homo sapiens
tctactttgattctgat

SEQ ID NO: 3060408 - DNA, 14 bp, Homo sapiens
tctacttttaaata

SEQ ID NO: 3060409 - DNA, 18 bp, Homo sapiens
tctactttttttttaatt

SEQ ID NO: 3060410 - DNA, 17 bp, Homo sapiens
tctagaaaagcttccta

SEQ ID NO: 3060411 - DNA, 21 bp, Homo sapiens
tctagaacatccctgccagct

SEQ ID NO: 3060412 - DNA, 20 bp, Homo sapiens
tctagaagttgtttgtcatc

SEQ ID NO: 3060413 - DNA, 23 bp, Homo sapiens
tctagaatctgcaattcaaaagt

SEQ ID NO: 3060414 - DNA, 22 bp, Homo sapiens
tctagacatggaggttctaagg

SEQ ID NO: 3060415 - DNA, 20 bp, Homo sapiens
tctagagtccaaggtttaaa

SEQ ID NO: 3060416 - DNA, 18 bp, Homo sapiens
tctagagttcagagtcct

SEQ ID NO: 3060417 - DNA, 20 bp, Homo sapiens
tctagagtttatacagtgta

SEQ ID NO: 3060418 - DNA, 17 bp, Homo sapiens
tctagatacctaaaaca

SEQ ID NO: 3060419 - DNA, 19 bp, Homo sapiens
tctagatacctaaaacata

SEQ ID NO: 3060420 - DNA, 19 bp, Homo sapiens
tctagatgaagttttacat

SEQ ID NO: 3060421 - DNA, 20 bp, Homo sapiens
tctagatgaagttttacatt

SEQ ID NO: 3060422 - DNA, 22 bp, Homo sapiens
tctagatgattaaataagattc

SEQ ID NO: 3060423 - DNA, 20 bp, Homo sapiens
tctagatggctcctctcagt

SEQ ID NO: 3060424 - DNA, 21 bp, Homo sapiens
tctagatgtttattcttctag

SEQ ID NO: 3060425 - DNA, 21 bp, Homo sapiens
tctagattctctggctgtaag

SEQ ID NO: 3060426 - DNA, 14 bp, Homo sapiens
tctagccgctgccc

SEQ ID NO: 3060427 - DNA, 21 bp, Homo sapiens
tctagccgctgccctgggtcc

SEQ ID NO: 3060428 - DNA, 20 bp, Homo sapiens
tctagcctggggcttgaatt

SEQ ID NO: 3060429 - DNA, 21 bp, Homo sapiens
tctagctgggggtgggccagg

SEQ ID NO: 3060430 - DNA, 17 bp, Homo sapiens
tctagctgtatgatttg

SEQ ID NO: 3060431 - DNA, 18 bp, Homo sapiens
tctagctgtatgatttgt

SEQ ID NO: 3060432 - DNA, 23 bp, Homo sapiens
tctaggaccatggttaagagtcc

SEQ ID NO: 3060433 - DNA, 18 bp, Homo sapiens
tctaggagctgggaggaa

SEQ ID NO: 3060434 - DNA, 20 bp, Homo sapiens
tctaggagctgggaggaaaa

SEQ ID NO: 3060435 - DNA, 21 bp, Homo sapiens
tctaggagctgggaggaaaag

SEQ ID NO: 3060436 - DNA, 23 bp, Homo sapiens
tctaggatagctaactgtaaatc

SEQ ID NO: 3060437 - DNA, 22 bp, Homo sapiens
tctaggcactgtagttctaaga

SEQ ID NO: 3060438 - DNA, 12 bp, Homo sapiens
tctaggctctgc

SEQ ID NO: 3060439 - DNA, 15 bp, Homo sapiens
tctaggctctgcctt

SEQ ID NO: 3060440 - DNA, 15 bp, Homo sapiens
tctaggtcttggtta

SEQ ID NO: 3060441 - DNA, 23 bp, Homo sapiens
tctaggtgcccttggaggccagc

SEQ ID NO: 3060442 - DNA, 17 bp, Homo sapiens
tctaggtttcaaagatg

SEQ ID NO: 3060443 - DNA, 19 bp, Homo sapiens
tctaggtttcaaagatgct

SEQ ID NO: 3060444 - DNA, 14 bp, Homo sapiens
tctagtatgtcttg

SEQ ID NO: 3060445 - DNA, 14 bp, Homo sapiens
tctagtgccttcta

SEQ ID NO: 3060446 - DNA, 17 bp, Homo sapiens
tctagttctgccaggag

SEQ ID NO: 3060447 - DNA, 13 bp, Homo sapiens
tctagtttcctgc

SEQ ID NO: 3060448 - DNA, 15 bp, Homo sapiens
tctagtttgcattcc

SEQ ID NO: 3060449 - DNA, 13 bp, Homo sapiens
tctagttttgtca

SEQ ID NO: 3060450 - DNA, 12 bp, Homo sapiens
tctataaagtat

SEQ ID NO: 3060451 - DNA, 16 bp, Homo sapiens
tctataacagaaagtt

SEQ ID NO: 3060452 - DNA, 15 bp, Homo sapiens
tctataacatgcatt

SEQ ID NO: 3060453 - DNA, 13 bp, Homo sapiens
tctataagaaaaa

SEQ ID NO: 3060454 - DNA, 14 bp, Homo sapiens
tctataaggccata

SEQ ID NO: 3060455 - DNA, 15 bp, Homo sapiens
tctataatgtgcctg

SEQ ID NO: 3060456 - DNA, 16 bp, Homo sapiens
tctatacaaatataaa

SEQ ID NO: 3060457 - DNA, 21 bp, Homo sapiens
tctatacaaatataaatctta

SEQ ID NO: 3060458 - DNA, 19 bp, Homo sapiens
tctatatatgtgtatgtac

SEQ ID NO: 3060459 - DNA, 20 bp, Homo sapiens
tctatatgtacttgtcaaag

SEQ ID NO: 3060460 - DNA, 21 bp, Homo sapiens
tctatatgtacttgtcaaaga

SEQ ID NO: 3060461 - DNA, 23 bp, Homo sapiens
tctatatgtacttgtcaaagaag

SEQ ID NO: 3060462 - DNA, 20 bp, Homo sapiens
tctatcagacgtgctccctc

SEQ ID NO: 3060463 - DNA, 13 bp, Homo sapiens
tctatcctctctc

SEQ ID NO: 3060464 - DNA, 14 bp, Homo sapiens
tctatcctctgtaa

SEQ ID NO: 3060465 - DNA, 14 bp, Homo sapiens
tctatcttccaaac

SEQ ID NO: 3060466 - DNA, 19 bp, Homo sapiens
tctatcttgctctgtaatc

SEQ ID NO: 3060467 - DNA, 22 bp, Homo sapiens
tctatcttgttccaaggccagg

SEQ ID NO: 3060468 - DNA, 12 bp, Homo sapiens
tctatgaaaacc

SEQ ID NO: 3060469 - DNA, 14 bp, Homo sapiens
tctatgagtctaga

SEQ ID NO: 3060470 - DNA, 16 bp, Homo sapiens
tctatgagtctagatg

SEQ ID NO: 3060471 - DNA, 16 bp, Homo sapiens
tctatgccatttttag

SEQ ID NO: 3060472 - DNA, 21 bp, Homo sapiens
tctatgtcgtgttttcaagga

SEQ ID NO: 3060473 - DNA, 21 bp, Homo sapiens
tctatgttgcatgataaacat

SEQ ID NO: 3060474 - DNA, 23 bp, Homo sapiens
tctattaaagtgctaaggttcta

SEQ ID NO: 3060475 - DNA, 13 bp, Homo sapiens
tctattaagggat

SEQ ID NO: 3060476 - DNA, 14 bp, Homo sapiens
tctattacccctca

SEQ ID NO: 3060477 - DNA, 18 bp, Homo sapiens
tctattacccctcattta

SEQ ID NO: 3060478 - DNA, 21 bp, Homo sapiens
tctattatactttatcaaaga

SEQ ID NO: 3060479 - DNA, 20 bp, Homo sapiens
tctattatgttatcatcctc

SEQ ID NO: 3060480 - DNA, 12 bp, Homo sapiens
tctattattatg

SEQ ID NO: 3060481 - DNA, 18 bp, Homo sapiens
tctattccagctcattca

SEQ ID NO: 3060482 - DNA, 23 bp, Homo sapiens
tctattccagctcattcatttta

SEQ ID NO: 3060483 - DNA, 14 bp, Homo sapiens
tctattctttgcct

SEQ ID NO: 3060484 - DNA, 21 bp, Homo sapiens
tctattggatttgtccaaaca

SEQ ID NO: 3060485 - DNA, 21 bp, Homo sapiens
tctattgtaattttgttcctg

SEQ ID NO: 3060486 - DNA, 18 bp, Homo sapiens
tctatttaattaggaaaa

SEQ ID NO: 3060487 - DNA, 18 bp, Homo sapiens
tctatttatatgtacatg

SEQ ID NO: 3060488 - DNA, 14 bp, Homo sapiens
tctatttctcctcc

SEQ ID NO: 3060489 - DNA, 13 bp, Homo sapiens
tctatttctctgt

SEQ ID NO: 3060490 - DNA, 12 bp, Homo sapiens
tctatttcttta

SEQ ID NO: 3060491 - DNA, 16 bp, Homo sapiens
tctatttggaatttat

SEQ ID NO: 3060492 - DNA, 20 bp, Homo sapiens
tctatttttatcatgaattc

SEQ ID NO: 3060493 - DNA, 14 bp, Homo sapiens
tctatttttatgat

SEQ ID NO: 3060494 - DNA, 18 bp, Homo sapiens
tctatttttatgatgaca

SEQ ID NO: 3060495 - DNA, 15 bp, Homo sapiens
tctcaaaactgtact

SEQ ID NO: 3060496 - DNA, 14 bp, Homo sapiens
tctcaaaagaactt

SEQ ID NO: 3060497 - DNA, 18 bp, Homo sapiens
tctcaaaagaacttaccc

SEQ ID NO: 3060498 - DNA, 23 bp, Homo sapiens
tctcaaactcccgacctcaggtg

SEQ ID NO: 3060499 - DNA, 14 bp, Homo sapiens
tctcaaactcctga

SEQ ID NO: 3060500 - DNA, 14 bp, Homo sapiens
tctcaaatgttttc

SEQ ID NO: 3060501 - DNA, 15 bp, Homo sapiens
tctcaaatgttttct

SEQ ID NO: 3060502 - DNA, 13 bp, Homo sapiens
tctcaaccatccc

SEQ ID NO: 3060503 - DNA, 14 bp, Homo sapiens
tctcaagggtggca

SEQ ID NO: 3060504 - DNA, 18 bp, Homo sapiens
tctcaagttctaagattc

SEQ ID NO: 3060505 - DNA, 21 bp, Homo sapiens
tctcaagttctaagattctaa

SEQ ID NO: 3060506 - DNA, 19 bp, Homo sapiens
tctcaatcctgcagtgggg

SEQ ID NO: 3060507 - DNA, 12 bp, Homo sapiens
tctcaatgaaaa

SEQ ID NO: 3060508 - DNA, 16 bp, Homo sapiens
tctcaatttatttggg

SEQ ID NO: 3060509 - DNA, 12 bp, Homo sapiens
tcggaggaagcc

SEQ ID NO: 3060510 - DNA, 13 bp, Homo sapiens
tcggaggaagccc

SEQ ID NO: 3060511 - DNA, 15 bp, Homo sapiens
tcggaggctcctccc

SEQ ID NO: 3060512 - DNA, 21 bp, Homo sapiens
tcggaggctcctccctctgcc

SEQ ID NO: 3060513 - DNA, 16 bp, Homo sapiens
tcggcagatactgtct

SEQ ID NO: 3060514 - DNA, 22 bp, Homo sapiens
tcggcagatgatgctttggaag

SEQ ID NO: 3060515 - DNA, 19 bp, Homo sapiens
tcggcaggaaggagcggcg

SEQ ID NO: 3060516 - DNA, 23 bp, Homo sapiens
tcggcccacagctcccaccccac

SEQ ID NO: 3060517 - DNA, 14 bp, Homo sapiens
tcggcccagggccg

SEQ ID NO: 3060518 - DNA, 17 bp, Homo sapiens
tcggccgagctggtttc

SEQ ID NO: 3060519 - DNA, 14 bp, Homo sapiens
tcggcctttgggtg

SEQ ID NO: 3060520 - DNA, 13 bp, Homo sapiens
tcggctctggagg

SEQ ID NO: 3060521 - DNA, 12 bp, Homo sapiens
tcgggaaggatg

SEQ ID NO: 3060522 - DNA, 12 bp, Homo sapiens
tcgggaccagaa

SEQ ID NO: 3060523 - DNA, 19 bp, Homo sapiens
tcgggacttgaaaaccact

SEQ ID NO: 3060524 - DNA, 13 bp, Homo sapiens
tcgggcccaggga

SEQ ID NO: 3060525 - DNA, 14 bp, Homo sapiens
tcgggcccagggac

SEQ ID NO: 3060526 - DNA, 13 bp, Homo sapiens
tcggggagcctta

SEQ ID NO: 3060527 - DNA, 14 bp, Homo sapiens
tcggtcatgtgtgt

SEQ ID NO: 3060528 - DNA, 17 bp, Homo sapiens
tcggtgaccccatcact

SEQ ID NO: 3060529 - DNA, 15 bp, Homo sapiens
tcggtgctatgtgtt

SEQ ID NO: 3060530 - DNA, 13 bp, Homo sapiens
tcggtgctccatc

SEQ ID NO: 3060531 - DNA, 22 bp, Homo sapiens
tcggtggccctgactgtcaggg

SEQ ID NO: 3060532 - DNA, 13 bp, Homo sapiens
tcggtggctgcct

SEQ ID NO: 3060533 - DNA, 14 bp, Homo sapiens
tcggtggctgcctt

SEQ ID NO: 3060534 - DNA, 15 bp, Homo sapiens
tcgtaacttcatatt

SEQ ID NO: 3060535 - DNA, 14 bp, Homo sapiens
tcgtatatttctca

SEQ ID NO: 3060536 - DNA, 15 bp, Homo sapiens
tcgtcaggctgccag

SEQ ID NO: 3060537 - DNA, 17 bp, Homo sapiens
tcgtcataggcttctgc

SEQ ID NO: 3060538 - DNA, 13 bp, Homo sapiens
tcgtcatcttccc

SEQ ID NO: 3060539 - DNA, 15 bp, Homo sapiens
tcgtcatcttccctg

SEQ ID NO: 3060540 - DNA, 17 bp, Homo sapiens
tcgtccacagcttcctg

SEQ ID NO: 3060541 - DNA, 16 bp, Homo sapiens
tcgtcctccccctgcc

SEQ ID NO: 3060542 - DNA, 23 bp, Homo sapiens
tcgtctctcccaccccctcccca

SEQ ID NO: 3060543 - DNA, 15 bp, Homo sapiens
tcgtcttcaaattaa

SEQ ID NO: 3060544 - DNA, 15 bp, Homo sapiens
tcgtcttgttgttat

SEQ ID NO: 3060545 - DNA, 21 bp, Homo sapiens
tcgtgacgctgaataaatgtc

SEQ ID NO: 3060546 - DNA, 22 bp, Homo sapiens
tcgtgacgctgaataaatgtct

SEQ ID NO: 3060547 - DNA, 11 bp, Homo sapiens
tcgtgccagca

SEQ ID NO: 3060548 - DNA, 18 bp, Homo sapiens
tcgtgcctgggggagaga

SEQ ID NO: 3060549 - DNA, 18 bp, Homo sapiens
tcgtgcggaatcagcttc

SEQ ID NO: 3060550 - DNA, 15 bp, Homo sapiens
tcgtggcagcacggc

SEQ ID NO: 3060551 - DNA, 21 bp, Homo sapiens
tcgtgtctagtagaacaatgt

SEQ ID NO: 3060552 - DNA, 21 bp, Homo sapiens
tcgtgtgtgttatttccccag

SEQ ID NO: 3060553 - DNA, 22 bp, Homo sapiens
tcgtgtgtgttatttccccagc

SEQ ID NO: 3060554 - DNA, 16 bp, Homo sapiens
tcgttaaaaagttgtt

SEQ ID NO: 3060555 - DNA, 17 bp, Homo sapiens
tcgttaaaaagttgttt

SEQ ID NO: 3060556 - DNA, 15 bp, Homo sapiens
tcgttattataaatg

SEQ ID NO: 3060557 - DNA, 16 bp, Homo sapiens
tcgttcaaaagtggag

SEQ ID NO: 3060558 - DNA, 19 bp, Homo sapiens
tcgttcccatagatttgaa

SEQ ID NO: 3060559 - DNA, 20 bp, Homo sapiens
tcgttcccatagatttgaag

SEQ ID NO: 3060560 - DNA, 11 bp, Homo sapiens
tcgttctgtgg

SEQ ID NO: 3060561 - DNA, 14 bp, Homo sapiens
tcgttctttttaag

SEQ ID NO: 3060562 - DNA, 19 bp, Homo sapiens
tcgttgccctaattcatct

SEQ ID NO: 3060563 - DNA, 22 bp, Homo sapiens
tcgttggttatacaagttcttg

SEQ ID NO: 3060564 - DNA, 19 bp, Homo sapiens
tcgttggttgtttctctga

SEQ ID NO: 3060565 - DNA, 15 bp, Homo sapiens
tcgtttaatgtttat

SEQ ID NO: 3060566 - DNA, 17 bp, Homo sapiens
tcgtttagtgccaatgt

SEQ ID NO: 3060567 - DNA, 23 bp, Homo sapiens
tcgtttatatttttttaactgtg

SEQ ID NO: 3060568 - DNA, 16 bp, Homo sapiens
tcgtttcaaaaacaca

SEQ ID NO: 3060569 - DNA, 23 bp, Homo sapiens
tcgtttgatagtgcttcttgtaa

SEQ ID NO: 3060570 - DNA, 16 bp, Homo sapiens
tcgtttgggctcaagg

SEQ ID NO: 3060571 - DNA, 11 bp, Homo sapiens
tctaaaacaat

SEQ ID NO: 3060572 - DNA, 17 bp, Homo sapiens
tctaaaagaatttaaat

SEQ ID NO: 3060573 - DNA, 13 bp, Homo sapiens
tctaaaagacttc

SEQ ID NO: 3060574 - DNA, 15 bp, Homo sapiens
tctaaaatcttatag

SEQ ID NO: 3060575 - DNA, 22 bp, Homo sapiens
tctaaaatcttatagttctagg

SEQ ID NO: 3060576 - DNA, 14 bp, Homo sapiens
tctaaaatgaaata

SEQ ID NO: 3060577 - DNA, 21 bp, Homo sapiens
tctaaaatgtgatgttctaag

SEQ ID NO: 3060578 - DNA, 20 bp, Homo sapiens
tctaaacaatgctgatttgg

SEQ ID NO: 3060579 - DNA, 18 bp, Homo sapiens
tctaaacctgtgcctccc

SEQ ID NO: 3060580 - DNA, 23 bp, Homo sapiens
tctaaactccctggctgttctga

SEQ ID NO: 3060581 - DNA, 24 bp, Homo sapiens
tctaaagatagagtcattgctgta

SEQ ID NO: 3060582 - DNA, 19 bp, Homo sapiens
tctaaagatggagtttcta

SEQ ID NO: 3060583 - DNA, 21 bp, Homo sapiens
tctaaagatggagtttctaag

SEQ ID NO: 3060584 - DNA, 13 bp, Homo sapiens
tctaaagattcta

SEQ ID NO: 3060585 - DNA, 22 bp, Homo sapiens
tctaaagattctatagttctag

SEQ ID NO: 3060586 - DNA, 23 bp, Homo sapiens
tctaaagattctatagttctaga

SEQ ID NO: 3060587 - DNA, 22 bp, Homo sapiens
tctaaagccttaactaagactc

SEQ ID NO: 3060588 - DNA, 14 bp, Homo sapiens
tctaaagctctgac

SEQ ID NO: 3060589 - DNA, 15 bp, Homo sapiens
tctaaaggatggaaa

SEQ ID NO: 3060590 - DNA, 17 bp, Homo sapiens
tctaaaggatggaaaaa

SEQ ID NO: 3060591 - DNA, 15 bp, Homo sapiens
tctaaaggtccacag

SEQ ID NO: 3060592 - DNA, 22 bp, Homo sapiens
tctaaaggtccacaggtctaga

SEQ ID NO: 3060593 - DNA, 17 bp, Homo sapiens
tctaaagttatatttca

SEQ ID NO: 3060594 - DNA, 15 bp, Homo sapiens
tctaaagttctaaga

SEQ ID NO: 3060595 - DNA, 18 bp, Homo sapiens
tctaaagttctaagattc

SEQ ID NO: 3060596 - DNA, 21 bp, Homo sapiens
tctaaagttctaagattctga

SEQ ID NO: 3060597 - DNA, 21 bp, Homo sapiens
tctaaataaagagaactccag

SEQ ID NO: 3060598 - DNA, 18 bp, Homo sapiens
tctaaataggatcctgga

SEQ ID NO: 3060599 - DNA, 16 bp, Homo sapiens
tctaaatccttgttaa

SEQ ID NO: 3060600 - DNA, 13 bp, Homo sapiens
tctaaatgaagtg

SEQ ID NO: 3060601 - DNA, 13 bp, Homo sapiens
tctaaatgcccag

SEQ ID NO: 3060602 - DNA, 21 bp, Homo sapiens
tctaaatttcttcctatttct

SEQ ID NO: 3060603 - DNA, 13 bp, Homo sapiens
tctaacaatgaca

SEQ ID NO: 3060604 - DNA, 22 bp, Homo sapiens
tctaaccaaagagtctctggct

SEQ ID NO: 3060605 - DNA, 14 bp, Homo sapiens
tctaactccctcct

SEQ ID NO: 3060606 - DNA, 15 bp, Homo sapiens
tctaactccctcctc

SEQ ID NO: 3060607 - DNA, 16 bp, Homo sapiens
tctaactccctcctca

SEQ ID NO: 3060608 - DNA, 13 bp, Homo sapiens
tctaacttattta

SEQ ID NO: 3060609 - DNA, 16 bp, Homo sapiens
tctaagaatacagctt

SEQ ID NO: 3060610 - DNA, 16 bp, Homo sapiens
tctaagactcaaatgt

SEQ ID NO: 3060611 - DNA, 12 bp, Homo sapiens
tctaagatctta

SEQ ID NO: 3060612 - DNA, 12 bp, Homo sapiens
tctaagatgtga

SEQ ID NO: 3060613 - DNA, 21 bp, Homo sapiens
tctaagatgtgatattctaag

SEQ ID NO: 3060614 - DNA, 24 bp, Homo sapiens
tctaagatgtgatattctaagact

SEQ ID NO: 3060615 - DNA, 15 bp, Homo sapiens
tctaagattctaaag

SEQ ID NO: 3060616 - DNA, 18 bp, Homo sapiens
tctaagattctaaaggtc

SEQ ID NO: 3060617 - DNA, 14 bp, Homo sapiens
tctaagattctaat

SEQ ID NO: 3060618 - DNA, 20 bp, Homo sapiens
tctaagattctaatgatgat

SEQ ID NO: 3060619 - DNA, 16 bp, Homo sapiens
tctaagattctagatc

SEQ ID NO: 3060620 - DNA, 24 bp, Homo sapiens
tctaagcaagtgagtctggtggag

SEQ ID NO: 3060621 - DNA, 14 bp, Homo sapiens
tctaagcagccagg

SEQ ID NO: 3060622 - DNA, 23 bp, Homo sapiens
tctaaggacctgaaattccaaag

SEQ ID NO: 3060623 - DNA, 19 bp, Homo sapiens
tctaaggataatgaaataa

SEQ ID NO: 3060624 - DNA, 19 bp, Homo sapiens
tctaaggccctttttccta

SEQ ID NO: 3060625 - DNA, 18 bp, Homo sapiens
tctaaggcctaggattct

SEQ ID NO: 3060626 - DNA, 20 bp, Homo sapiens
tctaaggcctaggattctaa

SEQ ID NO: 3060627 - DNA, 22 bp, Homo sapiens
tctaaggcctaggattctaaaa

SEQ ID NO: 3060628 - DNA, 16 bp, Homo sapiens
tctaaggctgtttgct

SEQ ID NO: 3060629 - DNA, 20 bp, Homo sapiens
tctaaggtccggtgttctaa

SEQ ID NO: 3060630 - DNA, 13 bp, Homo sapiens
tctaagtctttcc

SEQ ID NO: 3060631 - DNA, 14 bp, Homo sapiens
tctaagtctttcca

SEQ ID NO: 3060632 - DNA, 18 bp, Homo sapiens
tctaagttaatttaaagt

SEQ ID NO: 3060633 - DNA, 15 bp, Homo sapiens
tctaataatttctaa

SEQ ID NO: 3060634 - DNA, 16 bp, Homo sapiens
tctaataatttctaat

SEQ ID NO: 3060635 - DNA, 18 bp, Homo sapiens
tctaataatttctaatgt

SEQ ID NO: 3060636 - DNA, 14 bp, Homo sapiens
tctaatacctctgt

SEQ ID NO: 3060637 - DNA, 20 bp, Homo sapiens
tctaatacctctgtgtgctc

SEQ ID NO: 3060638 - DNA, 14 bp, Homo sapiens
tctaatatggccac

SEQ ID NO: 3060639 - DNA, 22 bp, Homo sapiens
tctaatgaggagagaaaatata

SEQ ID NO: 3060640 - DNA, 24 bp, Homo sapiens
tctaatgaggagagaaaatatatg

SEQ ID NO: 3060641 - DNA, 15 bp, Homo sapiens
tctaattcatttact

SEQ ID NO: 3060642 - DNA, 16 bp, Homo sapiens
tctaattcatttactc

SEQ ID NO: 3060643 - DNA, 18 bp, Homo sapiens
tctaattcatttactcac

SEQ ID NO: 3060644 - DNA, 21 bp, Homo sapiens
tctaattctattaaagtgcta

SEQ ID NO: 3060645 - DNA, 16 bp, Homo sapiens
tctaattgctgtgtgt

SEQ ID NO: 3060646 - DNA, 18 bp, Homo sapiens
tcgaaacacagaaacctt

SEQ ID NO: 3060647 - DNA, 11 bp, Homo sapiens
tcgaaagtgtc

SEQ ID NO: 3060648 - DNA, 13 bp, Homo sapiens
tcgaaagtgtcat

SEQ ID NO: 3060649 - DNA, 14 bp, Homo sapiens
tcgaagcaatcagc

SEQ ID NO: 3060650 - DNA, 18 bp, Homo sapiens
tcgaagtcattaaactgg

SEQ ID NO: 3060651 - DNA, 15 bp, Homo sapiens
tcgaagttcattttt

SEQ ID NO: 3060652 - DNA, 19 bp, Homo sapiens
tcgaagttcatttttatcc

SEQ ID NO: 3060653 - DNA, 17 bp, Homo sapiens
tcgaatagggaagtaaa

SEQ ID NO: 3060654 - DNA, 23 bp, Homo sapiens
tcgaatagggaagtaaaaaaaca

SEQ ID NO: 3060655 - DNA, 19 bp, Homo sapiens
tcgaattttatctgtggag

SEQ ID NO: 3060656 - DNA, 12 bp, Homo sapiens
tcgacacagagt

SEQ ID NO: 3060657 - DNA, 18 bp, Homo sapiens
tcgacatcactgttcatg

SEQ ID NO: 3060658 - DNA, 20 bp, Homo sapiens
tcgaccctgtgcaggagcta

SEQ ID NO: 3060659 - DNA, 18 bp, Homo sapiens
tcgacgccccgaacctca

SEQ ID NO: 3060660 - DNA, 17 bp, Homo sapiens
tcgacttcgggctggcc

SEQ ID NO: 3060661 - DNA, 15 bp, Homo sapiens
tcgagagctggccaa

SEQ ID NO: 3060662 - DNA, 17 bp, Homo sapiens
tcgagatcccaacactg

SEQ ID NO: 3060663 - DNA, 18 bp, Homo sapiens
tcgagatcccaacactgc

SEQ ID NO: 3060664 - DNA, 21 bp, Homo sapiens
tcgagatcccaacactgccag

SEQ ID NO: 3060665 - DNA, 22 bp, Homo sapiens
tcgagatcccaacactgccagc

SEQ ID NO: 3060666 - DNA, 21 bp, Homo sapiens
tcgagcatgcggagccagcag

SEQ ID NO: 3060667 - DNA, 17 bp, Homo sapiens
tcgagcccacccagcat

SEQ ID NO: 3060668 - DNA, 17 bp, Homo sapiens
tcgagggccgcctgcct

SEQ ID NO: 3060669 - DNA, 20 bp, Homo sapiens
tcgagtactgtgggcaattt

SEQ ID NO: 3060670 - DNA, 23 bp, Homo sapiens
tcgagtactgtgggcaatttaga

SEQ ID NO: 3060671 - DNA, 18 bp, Homo sapiens
tcgatgcctttgctgttt

SEQ ID NO: 3060672 - DNA, 15 bp, Homo sapiens
tcgatgctgctggcc

SEQ ID NO: 3060673 - DNA, 22 bp, Homo sapiens
tcgatgctgctggcctccctcc

SEQ ID NO: 3060674 - DNA, 12 bp, Homo sapiens
tcgattagactg

SEQ ID NO: 3060675 - DNA, 15 bp, Homo sapiens
tcgattcatattgaa

SEQ ID NO: 3060676 - DNA, 15 bp, Homo sapiens
tcgatttctccagga

SEQ ID NO: 3060677 - DNA, 22 bp, Homo sapiens
tcgcaacccctcaccccacaat

SEQ ID NO: 3060678 - DNA, 13 bp, Homo sapiens
tcgcaagctgggt

SEQ ID NO: 3060679 - DNA, 13 bp, Homo sapiens
tcgcacaggccct

SEQ ID NO: 3060680 - DNA, 16 bp, Homo sapiens
tcgcacaggccctagc

SEQ ID NO: 3060681 - DNA, 17 bp, Homo sapiens
tcgcacaggccctagct

SEQ ID NO: 3060682 - DNA, 20 bp, Homo sapiens
tcgcaccactgcactccagc

SEQ ID NO: 3060683 - DNA, 21 bp, Homo sapiens
tcgcaccactgcactccagcc

SEQ ID NO: 3060684 - DNA, 23 bp, Homo sapiens
tcgcacttgcagaggagcccagt

SEQ ID NO: 3060685 - DNA, 23 bp, Homo sapiens
tcgcagcccccgcgccctccctc

SEQ ID NO: 3060686 - DNA, 14 bp, Homo sapiens
tcgcagcctgagtc

SEQ ID NO: 3060687 - DNA, 15 bp, Homo sapiens
tcgcatcaaaagaca

SEQ ID NO: 3060688 - DNA, 17 bp, Homo sapiens
tcgcatcaaaagacaat

SEQ ID NO: 3060689 - DNA, 20 bp, Homo sapiens
tcgcatcaaaagacaattct

SEQ ID NO: 3060690 - DNA, 13 bp, Homo sapiens
tcgcatcattgca

SEQ ID NO: 3060691 - DNA, 15 bp, Homo sapiens
tcgcatcattgcaga

SEQ ID NO: 3060692 - DNA, 22 bp, Homo sapiens
tcgcatcccggctgaccctgtg

SEQ ID NO: 3060693 - DNA, 13 bp, Homo sapiens
tcgcatggcagaa

SEQ ID NO: 3060694 - DNA, 20 bp, Homo sapiens
tcgcatggtcacacactgat

SEQ ID NO: 3060695 - DNA, 16 bp, Homo sapiens
tcgcatgtttaatgtg

SEQ ID NO: 3060696 - DNA, 16 bp, Homo sapiens
tcgccaacatggtgaa

SEQ ID NO: 3060697 - DNA, 20 bp, Homo sapiens
tcgccagaagactcctaggc

SEQ ID NO: 3060698 - DNA, 13 bp, Homo sapiens
tcgccataggcca

SEQ ID NO: 3060699 - DNA, 13 bp, Homo sapiens
tcgcccaggaagg

SEQ ID NO: 3060700 - DNA, 13 bp, Homo sapiens
tcgcccccacttt

SEQ ID NO: 3060701 - DNA, 14 bp, Homo sapiens
tcgccctcccaggc

SEQ ID NO: 3060702 - DNA, 17 bp, Homo sapiens
tcgcctaggatttcagc

SEQ ID NO: 3060703 - DNA, 12 bp, Homo sapiens
tcgcctgccctc

SEQ ID NO: 3060704 - DNA, 13 bp, Homo sapiens
tcgcctgccctcc

SEQ ID NO: 3060705 - DNA, 18 bp, Homo sapiens
tcgcctgccctcctctcc

SEQ ID NO: 3060706 - DNA, 13 bp, Homo sapiens
tcgcctggagccc

SEQ ID NO: 3060707 - DNA, 22 bp, Homo sapiens
tcgccttagcactaccactcct

SEQ ID NO: 3060708 - DNA, 15 bp, Homo sapiens
tcgccttcctgcagt

SEQ ID NO: 3060709 - DNA, 15 bp, Homo sapiens
tcgccttgaacaaaa

SEQ ID NO: 3060710 - DNA, 20 bp, Homo sapiens
tcgcggcggagctggccccg

SEQ ID NO: 3060711 - DNA, 21 bp, Homo sapiens
tcgctactggcatagtttcat

SEQ ID NO: 3060712 - DNA, 19 bp, Homo sapiens
tcgctctgttacccagggt

SEQ ID NO: 3060713 - DNA, 22 bp, Homo sapiens
tcgctgatatatgtgtttttca

SEQ ID NO: 3060714 - DNA, 22 bp, Homo sapiens
tcgctgccctgtggacaggatg

SEQ ID NO: 3060715 - DNA, 20 bp, Homo sapiens
tcgctggactctcagtctct

SEQ ID NO: 3060716 - DNA, 22 bp, Homo sapiens
tcgctggcccctttgggccctg

SEQ ID NO: 3060717 - DNA, 20 bp, Homo sapiens
tcgctgtaccctttaagata

SEQ ID NO: 3060718 - DNA, 17 bp, Homo sapiens
tcgcttgaacctgggaa

SEQ ID NO: 3060719 - DNA, 15 bp, Homo sapiens
tcgcttgccaaagca

SEQ ID NO: 3060720 - DNA, 13 bp, Homo sapiens
tcggaaacactga

SEQ ID NO: 3060721 - DNA, 13 bp, Homo sapiens
tcggaagcctgtc

SEQ ID NO: 3060722 - DNA, 12 bp, Homo sapiens
tcggagctgcct

SEQ ID NO: 3060723 - DNA, 16 bp, Homo sapiens
tcggagctgcctgcag

SEQ ID NO: 3060724 - DNA, 15 bp, Homo sapiens
tcggagctggcccag

SEQ ID NO: 3060725 - DNA, 17 bp, Homo sapiens
tcggagctggcccaggg

SEQ ID NO: 3060726 - DNA, 14 bp, Homo sapiens
tcagcctggccaga

SEQ ID NO: 3060727 - DNA, 19 bp, Homo sapiens
tcagcctggccagacacag

SEQ ID NO: 3060728 - DNA, 18 bp, Homo sapiens
tcagccttcaagaatcag

SEQ ID NO: 3060729 - DNA, 22 bp, Homo sapiens
tcagccttggataatgctgttg

SEQ ID NO: 3060730 - DNA, 23 bp, Homo sapiens
tcagcgcccccaggcctgccctg

SEQ ID NO: 3060731 - DNA, 22 bp, Homo sapiens
tcagctatttaaaaaaaaaaga

SEQ ID NO: 3060732 - DNA, 23 bp, Homo sapiens
tcagctatttaaaaaaaaaagag

SEQ ID NO: 3060733 - DNA, 20 bp, Homo sapiens
tcagctatttagtgatatat

SEQ ID NO: 3060734 - DNA, 14 bp, Homo sapiens
tcagctcccaggcc

SEQ ID NO: 3060735 - DNA, 15 bp, Homo sapiens
tcagctcccaggcca

SEQ ID NO: 3060736 - DNA, 14 bp, Homo sapiens
tcagctccttcctg

SEQ ID NO: 3060737 - DNA, 19 bp, Homo sapiens
tcagctcgttacttcagcc

SEQ ID NO: 3060738 - DNA, 17 bp, Homo sapiens
tcagctctgaaaggtaa

SEQ ID NO: 3060739 - DNA, 17 bp, Homo sapiens
tcagctctggtccaggc

SEQ ID NO: 3060740 - DNA, 12 bp, Homo sapiens
tcagctctgtcc

SEQ ID NO: 3060741 - DNA, 20 bp, Homo sapiens
tcagctctgtcctgttaggc

SEQ ID NO: 3060742 - DNA, 17 bp, Homo sapiens
tcagctgaccccctccc

SEQ ID NO: 3060743 - DNA, 19 bp, Homo sapiens
tcagctgaccccctccccc

SEQ ID NO: 3060744 - DNA, 20 bp, Homo sapiens
tcagctgaccccctcccccc

SEQ ID NO: 3060745 - DNA, 17 bp, Homo sapiens
tcagctgcatctgataa

SEQ ID NO: 3060746 - DNA, 16 bp, Homo sapiens
tcagctgcgtcatggg

SEQ ID NO: 3060747 - DNA, 18 bp, Homo sapiens
tcagctgctgttgaactt

SEQ ID NO: 3060748 - DNA, 22 bp, Homo sapiens
tcagctggtggatggtgacttt

SEQ ID NO: 3060749 - DNA, 23 bp, Homo sapiens
tcagctgtcgggggccactgtgt

SEQ ID NO: 3060750 - DNA, 17 bp, Homo sapiens
tcagctgtggtcccacc

SEQ ID NO: 3060751 - DNA, 18 bp, Homo sapiens
tcagctgtggtcccaccc

SEQ ID NO: 3060752 - DNA, 20 bp, Homo sapiens
tcagctgtggtcccacccag

SEQ ID NO: 3060753 - DNA, 21 bp, Homo sapiens
tcagctgtggtcccacccagg

SEQ ID NO: 3060754 - DNA, 22 bp, Homo sapiens
tcagctgtggtcccacccagga

SEQ ID NO: 3060755 - DNA, 23 bp, Homo sapiens
tcagcttctaattttgtgctctt

SEQ ID NO: 3060756 - DNA, 12 bp, Homo sapiens
tcagcttctgtt

SEQ ID NO: 3060757 - DNA, 16 bp, Homo sapiens
tcagcttgtgcacaat

SEQ ID NO: 3060758 - DNA, 17 bp, Homo sapiens
tcagctttcaaagcatt

SEQ ID NO: 3060759 - DNA, 18 bp, Homo sapiens
tcagctttgcttcatgtt

SEQ ID NO: 3060760 - DNA, 20 bp, Homo sapiens
tcagctttttgtcttttctg

SEQ ID NO: 3060761 - DNA, 20 bp, Homo sapiens
tcaggaacctcgagtactgt

SEQ ID NO: 3060762 - DNA, 22 bp, Homo sapiens
tcaggaagaacaccctctaaat

SEQ ID NO: 3060763 - DNA, 15 bp, Homo sapiens
tcaggaattgaagat

SEQ ID NO: 3060764 - DNA, 14 bp, Homo sapiens
tcaggacagatgcc

SEQ ID NO: 3060765 - DNA, 21 bp, Homo sapiens
tcaggaccaggacccagggag

SEQ ID NO: 3060766 - DNA, 19 bp, Homo sapiens
tcaggacccagaggaaggg

SEQ ID NO: 3060767 - DNA, 16 bp, Homo sapiens
tcaggacctggcttgg

SEQ ID NO: 3060768 - DNA, 19 bp, Homo sapiens
tcaggagactgggctctgg

SEQ ID NO: 3060769 - DNA, 12 bp, Homo sapiens
tcaggagcaggg

SEQ ID NO: 3060770 - DNA, 14 bp, Homo sapiens
tcaggaggaggctg

SEQ ID NO: 3060771 - DNA, 15 bp, Homo sapiens
tcaggaggaggctgc

SEQ ID NO: 3060772 - DNA, 16 bp, Homo sapiens
tcaggaggagtcatgt

SEQ ID NO: 3060773 - DNA, 17 bp, Homo sapiens
tcaggaggcaggacctt

SEQ ID NO: 3060774 - DNA, 12 bp, Homo sapiens
tcaggaggctga

SEQ ID NO: 3060775 - DNA, 22 bp, Homo sapiens
tcaggaggctgaggcagaagaa

SEQ ID NO: 3060776 - DNA, 21 bp, Homo sapiens
tcaggagttcaagaccagcct

SEQ ID NO: 3060777 - DNA, 16 bp, Homo sapiens
tcaggagttcaagact

SEQ ID NO: 3060778 - DNA, 23 bp, Homo sapiens
tcaggagtttgagaccaggctgg

SEQ ID NO: 3060779 - DNA, 18 bp, Homo sapiens
tcaggatactcaaagtgg

SEQ ID NO: 3060780 - DNA, 19 bp, Homo sapiens
tcaggatgcacggtttctg

SEQ ID NO: 3060781 - DNA, 14 bp, Homo sapiens
tcaggcaattgatt

SEQ ID NO: 3060782 - DNA, 14 bp, Homo sapiens
tcaggcacacagct

SEQ ID NO: 3060783 - DNA, 12 bp, Homo sapiens
tcaggcaccagt

SEQ ID NO: 3060784 - DNA, 18 bp, Homo sapiens
tcaggcaccagtccctgt

SEQ ID NO: 3060785 - DNA, 21 bp, Homo sapiens
tcaggcagaagaatctttctt

SEQ ID NO: 3060786 - DNA, 14 bp, Homo sapiens
tcaggcagcactga

SEQ ID NO: 3060787 - DNA, 13 bp, Homo sapiens
tcaggccaggtgg

SEQ ID NO: 3060788 - DNA, 15 bp, Homo sapiens
tcaggccaggtgggc

SEQ ID NO: 3060789 - DNA, 14 bp, Homo sapiens
tcaggcccaaagcc

SEQ ID NO: 3060790 - DNA, 21 bp, Homo sapiens
tcaggcccggcagggcgggca

SEQ ID NO: 3060791 - DNA, 21 bp, Homo sapiens
tcaggcccgtcggagctgcct

SEQ ID NO: 3060792 - DNA, 14 bp, Homo sapiens
tcaggccctcagct

SEQ ID NO: 3060793 - DNA, 16 bp, Homo sapiens
tcaggccctctgcctg

SEQ ID NO: 3060794 - DNA, 17 bp, Homo sapiens
tcaggccctctgcctgc

SEQ ID NO: 3060795 - DNA, 18 bp, Homo sapiens
tcaggccctctgcctgca

SEQ ID NO: 3060796 - DNA, 19 bp, Homo sapiens
tcaggccctctgcctgcac

SEQ ID NO: 3060797 - DNA, 16 bp, Homo sapiens
tcaggctctgttcctc

SEQ ID NO: 3060798 - DNA, 12 bp, Homo sapiens
tcaggctgccag

SEQ ID NO: 3060799 - DNA, 12 bp, Homo sapiens
tcaggctggctc

SEQ ID NO: 3060800 - DNA, 21 bp, Homo sapiens
tcaggctgtcccaagctccca

SEQ ID NO: 3060801 - DNA, 13 bp, Homo sapiens
tcaggcttcctgg

SEQ ID NO: 3060802 - DNA, 18 bp, Homo sapiens
tcagggaaaagcagctct

SEQ ID NO: 3060803 - DNA, 19 bp, Homo sapiens
tcagggaaaagcagctctc

SEQ ID NO: 3060804 - DNA, 17 bp, Homo sapiens
tcagggaaattaatcaa

SEQ ID NO: 3060805 - DNA, 21 bp, Homo sapiens
tcagggaactgcttgcccagg

SEQ ID NO: 3060806 - DNA, 18 bp, Homo sapiens
tcagggacagagacacct

SEQ ID NO: 3060807 - DNA, 14 bp, Homo sapiens
tcagggacccctgc

SEQ ID NO: 3060808 - DNA, 16 bp, Homo sapiens
tcagggacccctgccc

SEQ ID NO: 3060809 - DNA, 15 bp, Homo sapiens
tcagggagggccagg

SEQ ID NO: 3060810 - DNA, 16 bp, Homo sapiens
tcagggagggccaggg

SEQ ID NO: 3060811 - DNA, 22 bp, Homo sapiens
tcagggagggccagggaggcag

SEQ ID NO: 3060812 - DNA, 21 bp, Homo sapiens
tcagggatgtgggaatctccc

SEQ ID NO: 3060813 - DNA, 19 bp, Homo sapiens
tcagggcagcgccaggctg

SEQ ID NO: 3060814 - DNA, 16 bp, Homo sapiens
tcagggcagctgcctg

SEQ ID NO: 3060815 - DNA, 17 bp, Homo sapiens
tcagggcagctgcctgg

SEQ ID NO: 3060816 - DNA, 18 bp, Homo sapiens
tcagggcagctgcctggc

SEQ ID NO: 3060817 - DNA, 21 bp, Homo sapiens
tcagggcagctgcctggccat

SEQ ID NO: 3060818 - DNA, 16 bp, Homo sapiens
tcagggccaggaagga

SEQ ID NO: 3060819 - DNA, 15 bp, Homo sapiens
tcagggcctggttga

SEQ ID NO: 3060820 - DNA, 12 bp, Homo sapiens
tcaggggaaggg

SEQ ID NO: 3060821 - DNA, 18 bp, Homo sapiens
tcaggggacactggcccc

SEQ ID NO: 3060822 - DNA, 17 bp, Homo sapiens
tcaggggtgacacagac

SEQ ID NO: 3060823 - DNA, 20 bp, Homo sapiens
tcaggggtgacacagactca

SEQ ID NO: 3060824 - DNA, 23 bp, Homo sapiens
tcagggtggtctcttcttggggc

SEQ ID NO: 3060825 - DNA, 13 bp, Homo sapiens
tcaggtaaatctt

SEQ ID NO: 3060826 - DNA, 19 bp, Homo sapiens
tcaggtgcacacatcacca

SEQ ID NO: 3060827 - DNA, 13 bp, Homo sapiens
tcaggtggccatg

SEQ ID NO: 3060828 - DNA, 19 bp, Homo sapiens
tcaggtggtgtccttcttc

SEQ ID NO: 3060829 - DNA, 22 bp, Homo sapiens
tcaggtggtgtccttcttcctc

SEQ ID NO: 3060830 - DNA, 15 bp, Homo sapiens
tcaggtgtcaggccc

SEQ ID NO: 3060831 - DNA, 16 bp, Homo sapiens
tcaggtgtcaggcccg

SEQ ID NO: 3060832 - DNA, 21 bp, Homo sapiens
tcaggtttggtttttttgtac

SEQ ID NO: 3060833 - DNA, 15 bp, Homo sapiens
tcagtaagctgtgtg

SEQ ID NO: 3060834 - DNA, 16 bp, Homo sapiens
tcagtaagtataacaa

SEQ ID NO: 3060835 - DNA, 17 bp, Homo sapiens
tcagtactaaggtgact

SEQ ID NO: 3060836 - DNA, 21 bp, Homo sapiens
tcagtactaaggtgactttct

SEQ ID NO: 3060837 - DNA, 14 bp, Homo sapiens
tcagtactgcagcg

SEQ ID NO: 3060838 - DNA, 21 bp, Homo sapiens
tcagtacttcagcaagagaga

SEQ ID NO: 3060839 - DNA, 23 bp, Homo sapiens
tcagtacttttttaaatattttc

SEQ ID NO: 3060840 - DNA, 14 bp, Homo sapiens
tcagtagcttaagg

SEQ ID NO: 3060841 - DNA, 21 bp, Homo sapiens
tcagtatgatttatcctcaca

SEQ ID NO: 3060842 - DNA, 17 bp, Homo sapiens
tcagtatgttttacact

SEQ ID NO: 3060843 - DNA, 13 bp, Homo sapiens
tcagtattaaact

SEQ ID NO: 3060844 - DNA, 15 bp, Homo sapiens
tcagtcacagccacc

SEQ ID NO: 3060845 - DNA, 15 bp, Homo sapiens
tcagtcattttgggt

SEQ ID NO: 3060846 - DNA, 21 bp, Homo sapiens
tcagtccagcagtttccagtc

SEQ ID NO: 3060847 - DNA, 22 bp, Homo sapiens
tcagtctgctctcccttgtgga

SEQ ID NO: 3060848 - DNA, 18 bp, Homo sapiens
tcagtcttaatactttat

SEQ ID NO: 3060849 - DNA, 19 bp, Homo sapiens
tcagtgattcgcttttggt

SEQ ID NO: 3060850 - DNA, 15 bp, Homo sapiens
tcagtgcaaaatgtc

SEQ ID NO: 3060851 - DNA, 16 bp, Homo sapiens
tcagtgcaaaatgtct

SEQ ID NO: 3060852 - DNA, 14 bp, Homo sapiens
tcagtgcacctgcc

SEQ ID NO: 3060853 - DNA, 16 bp, Homo sapiens
tcatgatctccctgcc

SEQ ID NO: 3060854 - DNA, 18 bp, Homo sapiens
tcatgatctccctgccgc

SEQ ID NO: 3060855 - DNA, 15 bp, Homo sapiens
tcatgatgctagcca

SEQ ID NO: 3060856 - DNA, 13 bp, Homo sapiens
tcatgattagcaa

SEQ ID NO: 3060857 - DNA, 13 bp, Homo sapiens
tcatgatttataa

SEQ ID NO: 3060858 - DNA, 14 bp, Homo sapiens
tcatgcctctgagc

SEQ ID NO: 3060859 - DNA, 18 bp, Homo sapiens
tcatggaaaagccttctt

SEQ ID NO: 3060860 - DNA, 19 bp, Homo sapiens
tcatggaacacaaacacat

SEQ ID NO: 3060861 - DNA, 16 bp, Homo sapiens
tcatggacattcatgc

SEQ ID NO: 3060862 - DNA, 22 bp, Homo sapiens
tcatggcagaaggcaaacccat

SEQ ID NO: 3060863 - DNA, 12 bp, Homo sapiens
tcatggccacac

SEQ ID NO: 3060864 - DNA, 17 bp, Homo sapiens
tcatggccacactgtga

SEQ ID NO: 3060865 - DNA, 19 bp, Homo sapiens
tcatggccacactgtgaca

SEQ ID NO: 3060866 - DNA, 15 bp, Homo sapiens
tcatggccttgtcta

SEQ ID NO: 3060867 - DNA, 17 bp, Homo sapiens
tcatgggaacgcagcct

SEQ ID NO: 3060868 - DNA, 19 bp, Homo sapiens
tcatggggatcaattttca

SEQ ID NO: 3060869 - DNA, 21 bp, Homo sapiens
tcatggggatcaattttcatt

SEQ ID NO: 3060870 - DNA, 18 bp, Homo sapiens
tcatgtaaatactgttgg

SEQ ID NO: 3060871 - DNA, 17 bp, Homo sapiens
tcatgtacaagatgaag

SEQ ID NO: 3060872 - DNA, 18 bp, Homo sapiens
tcatgtacaagatgaagg

SEQ ID NO: 3060873 - DNA, 17 bp, Homo sapiens
tcatgtaccaagtgctt

SEQ ID NO: 3060874 - DNA, 19 bp, Homo sapiens
tcatgtagtatcaaatatt

SEQ ID NO: 3060875 - DNA, 20 bp, Homo sapiens
tcatgtatgtatgagacaga

SEQ ID NO: 3060876 - DNA, 22 bp, Homo sapiens
tcatgtcaaagtgaaagacatt

SEQ ID NO: 3060877 - DNA, 22 bp, Homo sapiens
tcatgtcctctatacctgtgtc

SEQ ID NO: 3060878 - DNA, 23 bp, Homo sapiens
tcatgtctttccacttctctggg

SEQ ID NO: 3060879 - DNA, 19 bp, Homo sapiens
tcatgtgactctttccaac

SEQ ID NO: 3060880 - DNA, 17 bp, Homo sapiens
tcatgtgcctctgtcct

SEQ ID NO: 3060881 - DNA, 11 bp, Homo sapiens
tcatgtgtgta

SEQ ID NO: 3060882 - DNA, 12 bp, Homo sapiens
tcatgtgtgtcc

SEQ ID NO: 3060883 - DNA, 16 bp, Homo sapiens
tcatgttcatgtgatt

SEQ ID NO: 3060884 - DNA, 21 bp, Homo sapiens
tcatgttcgagcttacctact

SEQ ID NO: 3060885 - DNA, 13 bp, Homo sapiens
tcatgttctgtgg

SEQ ID NO: 3060886 - DNA, 22 bp, Homo sapiens
tcatgttgcacacccactcagc

SEQ ID NO: 3060887 - DNA, 18 bp, Homo sapiens
tcatgttttaacaaaaac

SEQ ID NO: 3060888 - DNA, 17 bp, Homo sapiens
tcatgtttttgttttaa

SEQ ID NO: 3060889 - DNA, 24 bp, Homo sapiens
tcattaaatggtgatttcttgcta

SEQ ID NO: 3060890 - DNA, 16 bp, Homo sapiens
tcattaaatgtttgtt

SEQ ID NO: 3060891 - DNA, 22 bp, Homo sapiens
tcattaaatgtttgttgaataa

SEQ ID NO: 3060892 - DNA, 20 bp, Homo sapiens
tcattaaccatctttaatca

SEQ ID NO: 3060893 - DNA, 21 bp, Homo sapiens
tcattaaccatctttaatcaa

SEQ ID NO: 3060894 - DNA, 22 bp, Homo sapiens
tcattaaggtcattactctcaa

SEQ ID NO: 3060895 - DNA, 14 bp, Homo sapiens
tcattaatgtaata

SEQ ID NO: 3060896 - DNA, 20 bp, Homo sapiens
tcattaccttttttgataaa

SEQ ID NO: 3060897 - DNA, 10 bp, Homo sapiens
tcattagaac

SEQ ID NO: 3060898 - DNA, 13 bp, Homo sapiens
tcattatgtaaaa

SEQ ID NO: 3060899 - DNA, 20 bp, Homo sapiens
tcattatgtaaaatgtttta

SEQ ID NO: 3060900 - DNA, 20 bp, Homo sapiens
tcattattctcataatcctt

SEQ ID NO: 3060901 - DNA, 18 bp, Homo sapiens
tcattatttgataacatt

SEQ ID NO: 3060902 - DNA, 23 bp, Homo sapiens
tcattcaactctccaatgttcta

SEQ ID NO: 3060903 - DNA, 22 bp, Homo sapiens
tcattcaagtgtaaaatatttt

SEQ ID NO: 3060904 - DNA, 13 bp, Homo sapiens
tcattcaataaat

SEQ ID NO: 3060905 - DNA, 21 bp, Homo sapiens
tcattcataaaagtttgcatg

SEQ ID NO: 3060906 - DNA, 19 bp, Homo sapiens
tcattcattttatattgaa

SEQ ID NO: 3060907 - DNA, 14 bp, Homo sapiens
tcattccacactgt

SEQ ID NO: 3060908 - DNA, 17 bp, Homo sapiens
tcattccctctcatctc

SEQ ID NO: 3060909 - DNA, 16 bp, Homo sapiens
tcattccgttgtctgt

SEQ ID NO: 3060910 - DNA, 17 bp, Homo sapiens
tcattccgttgtctgtg

SEQ ID NO: 3060911 - DNA, 13 bp, Homo sapiens
tcattcctttcca

SEQ ID NO: 3060912 - DNA, 15 bp, Homo sapiens
tcattcgttctgtgg

SEQ ID NO: 3060913 - DNA, 18 bp, Homo sapiens
tcattctactaatgtgat

SEQ ID NO: 3060914 - DNA, 13 bp, Homo sapiens
tcattctcctcct

SEQ ID NO: 3060915 - DNA, 18 bp, Homo sapiens
tcattctctgtctcatcc

SEQ ID NO: 3060916 - DNA, 21 bp, Homo sapiens
tcattgaaatttactgtgaga

SEQ ID NO: 3060917 - DNA, 14 bp, Homo sapiens
tcattgaggacaaa

SEQ ID NO: 3060918 - DNA, 18 bp, Homo sapiens
tcattgagggaccaaaaa

SEQ ID NO: 3060919 - DNA, 19 bp, Homo sapiens
tcattgcacctatctcagc

SEQ ID NO: 3060920 - DNA, 16 bp, Homo sapiens
tcattgctaaactgat

SEQ ID NO: 3060921 - DNA, 17 bp, Homo sapiens
tcattgctaaactgatg

SEQ ID NO: 3060922 - DNA, 14 bp, Homo sapiens
tcattgctgtagga

SEQ ID NO: 3060923 - DNA, 14 bp, Homo sapiens
tcattgctgtgtca

SEQ ID NO: 3060924 - DNA, 19 bp, Homo sapiens
tcattggcattctttgcaa

SEQ ID NO: 3060925 - DNA, 16 bp, Homo sapiens
tcattggctatataaa

SEQ ID NO: 3060926 - DNA, 23 bp, Homo sapiens
tcattggttaaaatattactgat

SEQ ID NO: 3060927 - DNA, 13 bp, Homo sapiens
tcattgtaatcac

SEQ ID NO: 3060928 - DNA, 18 bp, Homo sapiens
tcattgtccccatgcaac

SEQ ID NO: 3060929 - DNA, 19 bp, Homo sapiens
tcatttaaaaaaaaagaat

SEQ ID NO: 3060930 - DNA, 18 bp, Homo sapiens
tcatttaaaatgtaaact

SEQ ID NO: 3060931 - DNA, 15 bp, Homo sapiens
tcatttatccctcaa

SEQ ID NO: 3060932 - DNA, 14 bp, Homo sapiens
tcatttcagccaaa

SEQ ID NO: 3060933 - DNA, 16 bp, Homo sapiens
tcatttcagccaaagt

SEQ ID NO: 3060934 - DNA, 14 bp, Homo sapiens
tcatttctactgaa

SEQ ID NO: 3060935 - DNA, 13 bp, Homo sapiens
tcatttctatttc

SEQ ID NO: 3060936 - DNA, 17 bp, Homo sapiens
tcatttctatttctcct

SEQ ID NO: 3060937 - DNA, 21 bp, Homo sapiens
tcatttctatttctcctccat

SEQ ID NO: 3060938 - DNA, 16 bp, Homo sapiens
tcatttctgtctcccc

SEQ ID NO: 3060939 - DNA, 22 bp, Homo sapiens
tcatttgaataaaaaggaactt

SEQ ID NO: 3060940 - DNA, 14 bp, Homo sapiens
tcatttgctgtgaa

SEQ ID NO: 3060941 - DNA, 18 bp, Homo sapiens
tcatttgcttcaggagtt

SEQ ID NO: 3060942 - DNA, 22 bp, Homo sapiens
tcatttggaggaaaaaaagcat

SEQ ID NO: 3060943 - DNA, 23 bp, Homo sapiens
tcatttgtggtgatatagaatta

SEQ ID NO: 3060944 - DNA, 12 bp, Homo sapiens
tcatttgtttac

SEQ ID NO: 3060945 - DNA, 18 bp, Homo sapiens
tcatttgtttacatttga

SEQ ID NO: 3060946 - DNA, 15 bp, Homo sapiens
tcatttgtttttctc

SEQ ID NO: 3060947 - DNA, 22 bp, Homo sapiens
tcattttacaagcattagattc

SEQ ID NO: 3060948 - DNA, 15 bp, Homo sapiens
tcattttcactttta

SEQ ID NO: 3060949 - DNA, 15 bp, Homo sapiens
tcattttctccacct

SEQ ID NO: 3060950 - DNA, 17 bp, Homo sapiens
tcattttgtccatgtcc

SEQ ID NO: 3060951 - DNA, 13 bp, Homo sapiens
tcattttgtgtaa

SEQ ID NO: 3060952 - DNA, 14 bp, Homo sapiens
tcatttttaaatgt

SEQ ID NO: 3060953 - DNA, 15 bp, Homo sapiens
tcatttttaaatgtg

SEQ ID NO: 3060954 - DNA, 19 bp, Homo sapiens
tcatttttaatcatgaaat

SEQ ID NO: 3060955 - DNA, 17 bp, Homo sapiens
tcatttttttctctctg

SEQ ID NO: 3060956 - DNA, 18 bp, Homo sapiens
tcatttttttctctctgg

SEQ ID NO: 3060957 - DNA, 13 bp, Homo sapiens
tccaaaaaaagga

SEQ ID NO: 3060958 - DNA, 14 bp, Homo sapiens
tccaaaaaaaggaa

SEQ ID NO: 3060959 - DNA, 16 bp, Homo sapiens
tccaaaaaaaggaaaa

SEQ ID NO: 3060960 - DNA, 19 bp, Homo sapiens
tccaaaaaagcaaacacaa

SEQ ID NO: 3060961 - DNA, 15 bp, Homo sapiens
tccaaaagaagcccc

SEQ ID NO: 3060962 - DNA, 19 bp, Homo sapiens
tccaaaatgtgtatttctt

SEQ ID NO: 3060963 - DNA, 14 bp, Homo sapiens
tccaaaatttttca

SEQ ID NO: 3060964 - DNA, 15 bp, Homo sapiens
tccaaaatttttcaa

SEQ ID NO: 3060965 - DNA, 16 bp, Homo sapiens
tccaaactgctgtctc

SEQ ID NO: 3060966 - DNA, 18 bp, Homo sapiens
tccaaactgctgtctctt

SEQ ID NO: 3060967 - DNA, 20 bp, Homo sapiens
tccaaagaatgttagagcac

SEQ ID NO: 3060968 - DNA, 23 bp, Homo sapiens
tccaaagaatgttagagcacagt

SEQ ID NO: 3060969 - DNA, 22 bp, Homo sapiens
tccaaagagagttaaaagcagc

SEQ ID NO: 3060970 - DNA, 18 bp, Homo sapiens
tccaaagagtgtggaatt

SEQ ID NO: 3060971 - DNA, 18 bp, Homo sapiens
tccaaagcgatcatgtca

SEQ ID NO: 3060972 - DNA, 14 bp, Homo sapiens
tccaaaggctctgt

SEQ ID NO: 3060973 - DNA, 13 bp, Homo sapiens
tccaaagtctcta

SEQ ID NO: 3060974 - DNA, 13 bp, Homo sapiens
tccaaatccagga

SEQ ID NO: 3060975 - DNA, 23 bp, Homo sapiens
tccaaatctgtcctctgtagtat

SEQ ID NO: 3060976 - DNA, 13 bp, Homo sapiens
tccaaatgcattc

SEQ ID NO: 3060977 - DNA, 18 bp, Homo sapiens
tccaaatgcattcatgtt

SEQ ID NO: 3060978 - DNA, 23 bp, Homo sapiens
tccaaatgctgtgcaaacagtgt

SEQ ID NO: 3060979 - DNA, 20 bp, Homo sapiens
tccaaatggcgtctggaagt

SEQ ID NO: 3060980 - DNA, 19 bp, Homo sapiens
tccaacaaagaaaggtgcc

SEQ ID NO: 3060981 - DNA, 23 bp, Homo sapiens
tccaacactgaagtgcttgcaga

SEQ ID NO: 3060982 - DNA, 21 bp, Homo sapiens
tccaacagacctggtgctcta

SEQ ID NO: 3060983 - DNA, 20 bp, Homo sapiens
tccaacaggcgtgggatcag

SEQ ID NO: 3060984 - DNA, 22 bp, Homo sapiens
tccaacccatgatgagctcctc

SEQ ID NO: 3060985 - DNA, 18 bp, Homo sapiens
tccaacctaacccctttc

SEQ ID NO: 3060986 - DNA, 14 bp, Homo sapiens
tccaacctaacctg

SEQ ID NO: 3060987 - DNA, 17 bp, Homo sapiens
tccaacctaacctgtgt

SEQ ID NO: 3060988 - DNA, 20 bp, Homo sapiens
tccaacctctcggccccatc

SEQ ID NO: 3060989 - DNA, 19 bp, Homo sapiens
tcagtgccaactgtggctg

SEQ ID NO: 3060990 - DNA, 21 bp, Homo sapiens
tcagtgccaactgtggctggt

SEQ ID NO: 3060991 - DNA, 22 bp, Homo sapiens
tcagtgccagcccctgctggct

SEQ ID NO: 3060992 - DNA, 20 bp, Homo sapiens
tcagtgccggaggccttggg

SEQ ID NO: 3060993 - DNA, 13 bp, Homo sapiens
tcagtgccttctc

SEQ ID NO: 3060994 - DNA, 16 bp, Homo sapiens
tcagtgccttctctca

SEQ ID NO: 3060995 - DNA, 14 bp, Homo sapiens
tcagtgctgtgctg

SEQ ID NO: 3060996 - DNA, 22 bp, Homo sapiens
tcagtgctgtgctgtgctatgg

SEQ ID NO: 3060997 - DNA, 23 bp, Homo sapiens
tcagtggaacacaaatgaaaatg

SEQ ID NO: 3060998 - DNA, 17 bp, Homo sapiens
tcagtggcgagaaataa

SEQ ID NO: 3060999 - DNA, 15 bp, Homo sapiens
tcagtggctctgggt

SEQ ID NO: 3061000 - DNA, 12 bp, Homo sapiens
tcagtgggagaa

SEQ ID NO: 3061001 - DNA, 13 bp, Homo sapiens
tcagtgggagaaa

SEQ ID NO: 3061002 - DNA, 20 bp, Homo sapiens
tcagtggttatttagggaac

SEQ ID NO: 3061003 - DNA, 15 bp, Homo sapiens
tcagtgtaatttctt

SEQ ID NO: 3061004 - DNA, 18 bp, Homo sapiens
tcagtgtaccatttgcct

SEQ ID NO: 3061005 - DNA, 19 bp, Homo sapiens
tcagtgtaccatttgcctc

SEQ ID NO: 3061006 - DNA, 12 bp, Homo sapiens
tcagtgtatcta

SEQ ID NO: 3061007 - DNA, 17 bp, Homo sapiens
tcagtgtatttcagttc

SEQ ID NO: 3061008 - DNA, 21 bp, Homo sapiens
tcagtgttaaatgtgatgaat

SEQ ID NO: 3061009 - DNA, 20 bp, Homo sapiens
tcagtgttcagccaaacagt

SEQ ID NO: 3061010 - DNA, 16 bp, Homo sapiens
tcagtgtttaaataaa

SEQ ID NO: 3061011 - DNA, 15 bp, Homo sapiens
tcagtgttttggact

SEQ ID NO: 3061012 - DNA, 14 bp, Homo sapiens
tcagtgtttttcct

SEQ ID NO: 3061013 - DNA, 14 bp, Homo sapiens
tcagttacagaaag

SEQ ID NO: 3061014 - DNA, 15 bp, Homo sapiens
tcagttactcagccc

SEQ ID NO: 3061015 - DNA, 17 bp, Homo sapiens
tcagttactctgaaggg

SEQ ID NO: 3061016 - DNA, 17 bp, Homo sapiens
tcagttagcagacagaa

SEQ ID NO: 3061017 - DNA, 12 bp, Homo sapiens
tcagttccagct

SEQ ID NO: 3061018 - DNA, 15 bp, Homo sapiens
tcagttccagctttt

SEQ ID NO: 3061019 - DNA, 12 bp, Homo sapiens
tcagttctcaaa

SEQ ID NO: 3061020 - DNA, 16 bp, Homo sapiens
tcagttgattaagtta

SEQ ID NO: 3061021 - DNA, 22 bp, Homo sapiens
tcagttgctaaacactgcgctt

SEQ ID NO: 3061022 - DNA, 14 bp, Homo sapiens
tcagttggctgact

SEQ ID NO: 3061023 - DNA, 23 bp, Homo sapiens
tcagttgggtttcacgagtgttc

SEQ ID NO: 3061024 - DNA, 18 bp, Homo sapiens
tcagtttataccttgcct

SEQ ID NO: 3061025 - DNA, 20 bp, Homo sapiens
tcagtttgaaaatattttgt

SEQ ID NO: 3061026 - DNA, 12 bp, Homo sapiens
tcagttttcatt

SEQ ID NO: 3061027 - DNA, 14 bp, Homo sapiens
tcagttttcccact

SEQ ID NO: 3061028 - DNA, 22 bp, Homo sapiens
tcagttttcccactttttggta

SEQ ID NO: 3061029 - DNA, 15 bp, Homo sapiens
tcataaattaatgat

SEQ ID NO: 3061030 - DNA, 18 bp, Homo sapiens
tcataaattaatgattct

SEQ ID NO: 3061031 - DNA, 18 bp, Homo sapiens
tcataagcattactttat

SEQ ID NO: 3061032 - DNA, 15 bp, Homo sapiens
tcataagtatttcaa

SEQ ID NO: 3061033 - DNA, 20 bp, Homo sapiens
tcataagtatttcaaattgg

SEQ ID NO: 3061034 - DNA, 16 bp, Homo sapiens
tcataataagttgcat

SEQ ID NO: 3061035 - DNA, 17 bp, Homo sapiens
tcataatgtgaagtgtt

SEQ ID NO: 3061036 - DNA, 22 bp, Homo sapiens
tcataattgttgtggtttaaat

SEQ ID NO: 3061037 - DNA, 13 bp, Homo sapiens
tcatacacagaaa

SEQ ID NO: 3061038 - DNA, 15 bp, Homo sapiens
tcataccaatgaaaa

SEQ ID NO: 3061039 - DNA, 21 bp, Homo sapiens
tcataccgcctcgtgccagca

SEQ ID NO: 3061040 - DNA, 23 bp, Homo sapiens
tcataccgcctcgtgccagcagc

SEQ ID NO: 3061041 - DNA, 20 bp, Homo sapiens
tcatacctgctcctcatctg

SEQ ID NO: 3061042 - DNA, 20 bp, Homo sapiens
tcatactctgttgcctcctc

SEQ ID NO: 3061043 - DNA, 17 bp, Homo sapiens
tcatagaaattctttat

SEQ ID NO: 3061044 - DNA, 14 bp, Homo sapiens
tcatagaacagaaa

SEQ ID NO: 3061045 - DNA, 19 bp, Homo sapiens
tcatagggacctttaaaaa

SEQ ID NO: 3061046 - DNA, 13 bp, Homo sapiens
tcataggggcagg

SEQ ID NO: 3061047 - DNA, 22 bp, Homo sapiens
tcatagtactctttgtagcaaa

SEQ ID NO: 3061048 - DNA, 22 bp, Homo sapiens
tcatagtcccaccttggagcat

SEQ ID NO: 3061049 - DNA, 15 bp, Homo sapiens
tcatagtgccttttt

SEQ ID NO: 3061050 - DNA, 12 bp, Homo sapiens
tcatagtgtcat

SEQ ID NO: 3061051 - DNA, 13 bp, Homo sapiens
tcatagttgcaaa

SEQ ID NO: 3061052 - DNA, 20 bp, Homo sapiens
tcatataaaagctatggtga

SEQ ID NO: 3061053 - DNA, 20 bp, Homo sapiens
tcatataaactttttaaaga

SEQ ID NO: 3061054 - DNA, 21 bp, Homo sapiens
tcatatcactgaaggatattt

SEQ ID NO: 3061055 - DNA, 20 bp, Homo sapiens
tcatatgaattgctgtctag

SEQ ID NO: 3061056 - DNA, 22 bp, Homo sapiens
tcatattaatataagtttcttt

SEQ ID NO: 3061057 - DNA, 13 bp, Homo sapiens
tcatatttttcct

SEQ ID NO: 3061058 - DNA, 19 bp, Homo sapiens
tcatcaacttaaaagtcag

SEQ ID NO: 3061059 - DNA, 21 bp, Homo sapiens
tcatcaagggtgcgtctggga

SEQ ID NO: 3061060 - DNA, 19 bp, Homo sapiens
tcatcaatgggattttcta

SEQ ID NO: 3061061 - DNA, 14 bp, Homo sapiens
tcatcacacacatg

SEQ ID NO: 3061062 - DNA, 14 bp, Homo sapiens
tcatcactgtggct

SEQ ID NO: 3061063 - DNA, 17 bp, Homo sapiens
tcatcactgtggctgtc

SEQ ID NO: 3061064 - DNA, 22 bp, Homo sapiens
tcatcagactagtatcaagtgt

SEQ ID NO: 3061065 - DNA, 17 bp, Homo sapiens
tcatcatccctccctgc

SEQ ID NO: 3061066 - DNA, 13 bp, Homo sapiens
tcatcatctcttg

SEQ ID NO: 3061067 - DNA, 17 bp, Homo sapiens
tcatcatctcttgataa

SEQ ID NO: 3061068 - DNA, 23 bp, Homo sapiens
tcatcatgaactggcttgtacat

SEQ ID NO: 3061069 - DNA, 20 bp, Homo sapiens
tcatcatttaaaaaaaaaga

SEQ ID NO: 3061070 - DNA, 12 bp, Homo sapiens
tcatcatttcag

SEQ ID NO: 3061071 - DNA, 14 bp, Homo sapiens
tcatccacattgtt

SEQ ID NO: 3061072 - DNA, 15 bp, Homo sapiens
tcatccacattgttt

SEQ ID NO: 3061073 - DNA, 18 bp, Homo sapiens
tcatccaggaggttcaaa

SEQ ID NO: 3061074 - DNA, 11 bp, Homo sapiens
tcatccatcat

SEQ ID NO: 3061075 - DNA, 17 bp, Homo sapiens
tcatccatcatcatgtg

SEQ ID NO: 3061076 - DNA, 17 bp, Homo sapiens
tcatcccctcacttgcc

SEQ ID NO: 3061077 - DNA, 15 bp, Homo sapiens
tcatccctccctgcc

SEQ ID NO: 3061078 - DNA, 22 bp, Homo sapiens
tcatccctccctgcctaaggaa

SEQ ID NO: 3061079 - DNA, 15 bp, Homo sapiens
tcatccgtctgtgtg

SEQ ID NO: 3061080 - DNA, 11 bp, Homo sapiens
tcatcctggct

SEQ ID NO: 3061081 - DNA, 18 bp, Homo sapiens
tcatcctgtgtcccctga

SEQ ID NO: 3061082 - DNA, 21 bp, Homo sapiens
tcatcctgttggctgctgcca

SEQ ID NO: 3061083 - DNA, 23 bp, Homo sapiens
tcatcctgttggctgctgccacc

SEQ ID NO: 3061084 - DNA, 20 bp, Homo sapiens
tcatccttgcccatcgggac

SEQ ID NO: 3061085 - DNA, 15 bp, Homo sapiens
tcatccttggtgctc

SEQ ID NO: 3061086 - DNA, 15 bp, Homo sapiens
tcatccttttttctc

SEQ ID NO: 3061087 - DNA, 21 bp, Homo sapiens
tcatcgaatctactaattcca

SEQ ID NO: 3061088 - DNA, 20 bp, Homo sapiens
tcatcgacttagcctgagtc

SEQ ID NO: 3061089 - DNA, 17 bp, Homo sapiens
tcatcgggcccagggac

SEQ ID NO: 3061090 - DNA, 15 bp, Homo sapiens
tcatcgttccccacc

SEQ ID NO: 3061091 - DNA, 19 bp, Homo sapiens
tcatctccctgccatcccc

SEQ ID NO: 3061092 - DNA, 18 bp, Homo sapiens
tcatctcctgccttcctc

SEQ ID NO: 3061093 - DNA, 21 bp, Homo sapiens
tcatctcctgccttcctcctg

SEQ ID NO: 3061094 - DNA, 14 bp, Homo sapiens
tcatctctctgccc

SEQ ID NO: 3061095 - DNA, 13 bp, Homo sapiens
tcatctctgcctt

SEQ ID NO: 3061096 - DNA, 15 bp, Homo sapiens
tcatctctgcctttg

SEQ ID NO: 3061097 - DNA, 16 bp, Homo sapiens
tcatctcttgataaag

SEQ ID NO: 3061098 - DNA, 16 bp, Homo sapiens
tcatctctttgtcctg

SEQ ID NO: 3061099 - DNA, 18 bp, Homo sapiens
tcatctctttgtcctgaa

SEQ ID NO: 3061100 - DNA, 21 bp, Homo sapiens
tcatctgaatttgccctggga

SEQ ID NO: 3061101 - DNA, 23 bp, Homo sapiens
tcatctgaatttgccctgggaaa

SEQ ID NO: 3061102 - DNA, 16 bp, Homo sapiens
tcatctgcctggaaag

SEQ ID NO: 3061103 - DNA, 16 bp, Homo sapiens
tcatctgctgcacata

SEQ ID NO: 3061104 - DNA, 23 bp, Homo sapiens
tcatctggaagtattttcctcca

SEQ ID NO: 3061105 - DNA, 13 bp, Homo sapiens
tcatctgggaaag

SEQ ID NO: 3061106 - DNA, 16 bp, Homo sapiens
tcatctgggaaagaca

SEQ ID NO: 3061107 - DNA, 23 bp, Homo sapiens
tcatctggttgaactctggtggc

SEQ ID NO: 3061108 - DNA, 17 bp, Homo sapiens
tcatctgtccctccggg

SEQ ID NO: 3061109 - DNA, 16 bp, Homo sapiens
tcatctgtgcctgtct

SEQ ID NO: 3061110 - DNA, 14 bp, Homo sapiens
tcatcttaaaaata

SEQ ID NO: 3061111 - DNA, 12 bp, Homo sapiens
tcatcttccctg

SEQ ID NO: 3061112 - DNA, 13 bp, Homo sapiens
tcatcttccctgc

SEQ ID NO: 3061113 - DNA, 14 bp, Homo sapiens
tcatcttccctgcc

SEQ ID NO: 3061114 - DNA, 15 bp, Homo sapiens
tcatcttccctgccc

SEQ ID NO: 3061115 - DNA, 16 bp, Homo sapiens
tcatcttccctgcccc

SEQ ID NO: 3061116 - DNA, 16 bp, Homo sapiens
tcatcttgaccaagca

SEQ ID NO: 3061117 - DNA, 18 bp, Homo sapiens
tcatctttatcctaaaaa

SEQ ID NO: 3061118 - DNA, 17 bp, Homo sapiens
tcatctttcttccaaac

SEQ ID NO: 3061119 - DNA, 17 bp, Homo sapiens
tcatcttttaatcatga

SEQ ID NO: 3061120 - DNA, 21 bp, Homo sapiens
tcatgaactggcttgtacatt

SEQ ID NO: 3061121 - DNA, 22 bp, Homo sapiens
tcatgaactggcttgtacattt

SEQ ID NO: 3061122 - DNA, 13 bp, Homo sapiens
tcatgaagccttg

SEQ ID NO: 3061123 - DNA, 18 bp, Homo sapiens
tcatgaagccttgctgaa

SEQ ID NO: 3061124 - DNA, 21 bp, Homo sapiens
tcatgatccacccacctcagc

SEQ ID NO: 3061125 - DNA, 22 bp, Homo sapiens
tcatgatccacccacctcagcc

SEQ ID NO: 3061126 - DNA, 18 bp, Homo sapiens
tcacttttctgagttctt

SEQ ID NO: 3061127 - DNA, 18 bp, Homo sapiens
tcacttttgcaaggttcc

SEQ ID NO: 3061128 - DNA, 21 bp, Homo sapiens
tcacttttgcaaggttccaca

SEQ ID NO: 3061129 - DNA, 16 bp, Homo sapiens
tcactttttttgttct

SEQ ID NO: 3061130 - DNA, 17 bp, Homo sapiens
tcactttttttttccaa

SEQ ID NO: 3061131 - DNA, 19 bp, Homo sapiens
tcactttttttttccaaaa

SEQ ID NO: 3061132 - DNA, 17 bp, Homo sapiens
tcagaaacttgtgaagt

SEQ ID NO: 3061133 - DNA, 14 bp, Homo sapiens
tcagaaagagcaag

SEQ ID NO: 3061134 - DNA, 23 bp, Homo sapiens
tcagaaagagcaagtctggatct

SEQ ID NO: 3061135 - DNA, 15 bp, Homo sapiens
tcagaaagtgtaaat

SEQ ID NO: 3061136 - DNA, 15 bp, Homo sapiens
tcagaaatagaatca

SEQ ID NO: 3061137 - DNA, 17 bp, Homo sapiens
tcagaaatggacaaaga

SEQ ID NO: 3061138 - DNA, 20 bp, Homo sapiens
tcagaaatggacaaagaaaa

SEQ ID NO: 3061139 - DNA, 18 bp, Homo sapiens
tcagaacccttggcttgc

SEQ ID NO: 3061140 - DNA, 15 bp, Homo sapiens
tcagaactagaattt

SEQ ID NO: 3061141 - DNA, 22 bp, Homo sapiens
tcagaagaaaacaaagttctat

SEQ ID NO: 3061142 - DNA, 23 bp, Homo sapiens
tcagaagaaaacaaagttctatt

SEQ ID NO: 3061143 - DNA, 17 bp, Homo sapiens
tcagaagagaggggaag

SEQ ID NO: 3061144 - DNA, 19 bp, Homo sapiens
tcagaaggagaaggaagga

SEQ ID NO: 3061145 - DNA, 23 bp, Homo sapiens
tcagaaggagaaggaaggagact

SEQ ID NO: 3061146 - DNA, 16 bp, Homo sapiens
tcagaagtaactccca

SEQ ID NO: 3061147 - DNA, 18 bp, Homo sapiens
tcagaagtaactcccact

SEQ ID NO: 3061148 - DNA, 22 bp, Homo sapiens
tcagaatagccacatttggaat

SEQ ID NO: 3061149 - DNA, 23 bp, Homo sapiens
tcagaatagccacatttggaata

SEQ ID NO: 3061150 - DNA, 16 bp, Homo sapiens
tcagaatctttgttaa

SEQ ID NO: 3061151 - DNA, 17 bp, Homo sapiens
tcagaattgaaacactt

SEQ ID NO: 3061152 - DNA, 18 bp, Homo sapiens
tcagaatttttaactgta

SEQ ID NO: 3061153 - DNA, 16 bp, Homo sapiens
tcagacattataagta

SEQ ID NO: 3061154 - DNA, 14 bp, Homo sapiens
tcagaccagctctt

SEQ ID NO: 3061155 - DNA, 13 bp, Homo sapiens
tcagaccccagcg

SEQ ID NO: 3061156 - DNA, 12 bp, Homo sapiens
tcagacccccac

SEQ ID NO: 3061157 - DNA, 18 bp, Homo sapiens
tcagacccccactctcat

SEQ ID NO: 3061158 - DNA, 17 bp, Homo sapiens
tcagacgcctgaggaac

SEQ ID NO: 3061159 - DNA, 19 bp, Homo sapiens
tcagacgtgtgacctccat

SEQ ID NO: 3061160 - DNA, 23 bp, Homo sapiens
tcagacgtgtgacctccatactg

SEQ ID NO: 3061161 - DNA, 15 bp, Homo sapiens
tcagactgcacccag

SEQ ID NO: 3061162 - DNA, 16 bp, Homo sapiens
tcagactgcacccagg

SEQ ID NO: 3061163 - DNA, 17 bp, Homo sapiens
tcagactgcacccagga

SEQ ID NO: 3061164 - DNA, 12 bp, Homo sapiens
tcagactggagg

SEQ ID NO: 3061165 - DNA, 16 bp, Homo sapiens
tcagactggtctcgaa

SEQ ID NO: 3061166 - DNA, 15 bp, Homo sapiens
tcagactttggaaaa

SEQ ID NO: 3061167 - DNA, 16 bp, Homo sapiens
tcagagaaaacacttt

SEQ ID NO: 3061168 - DNA, 20 bp, Homo sapiens
tcagagaaaatgagaaagga

SEQ ID NO: 3061169 - DNA, 23 bp, Homo sapiens
tcagagaaaatgagaaaggacag

SEQ ID NO: 3061170 - DNA, 14 bp, Homo sapiens
tcagagaaggccag

SEQ ID NO: 3061171 - DNA, 16 bp, Homo sapiens
tcagagaccaggccct

SEQ ID NO: 3061172 - DNA, 21 bp, Homo sapiens
tcagagaccaggccctggcta

SEQ ID NO: 3061173 - DNA, 23 bp, Homo sapiens
tcagagagtacactgtgtctcta

SEQ ID NO: 3061174 - DNA, 18 bp, Homo sapiens
tcagagccaagggggcag

SEQ ID NO: 3061175 - DNA, 19 bp, Homo sapiens
tcagagccaagggggcaga

SEQ ID NO: 3061176 - DNA, 13 bp, Homo sapiens
tcagagcccagcc

SEQ ID NO: 3061177 - DNA, 17 bp, Homo sapiens
tcagagcccagcccagg

SEQ ID NO: 3061178 - DNA, 18 bp, Homo sapiens
tcagagcccagcccagga

SEQ ID NO: 3061179 - DNA, 14 bp, Homo sapiens
tcagagcccagggg

SEQ ID NO: 3061180 - DNA, 16 bp, Homo sapiens
tcagagcccaggggag

SEQ ID NO: 3061181 - DNA, 16 bp, Homo sapiens
tcagagccgtggtcct

SEQ ID NO: 3061182 - DNA, 20 bp, Homo sapiens
tcagagccgtggtcctttgg

SEQ ID NO: 3061183 - DNA, 12 bp, Homo sapiens
tcagagctgcgg

SEQ ID NO: 3061184 - DNA, 23 bp, Homo sapiens
tcagagcttttcgaactgtgctc

SEQ ID NO: 3061185 - DNA, 18 bp, Homo sapiens
tcagaggagcatcagctg

SEQ ID NO: 3061186 - DNA, 21 bp, Homo sapiens
tcagaggccctcgctgccagc

SEQ ID NO: 3061187 - DNA, 16 bp, Homo sapiens
tcagagggctgatgga

SEQ ID NO: 3061188 - DNA, 21 bp, Homo sapiens
tcagaggtgaattaatggaca

SEQ ID NO: 3061189 - DNA, 23 bp, Homo sapiens
tcagagtgtccctttttgcaggg

SEQ ID NO: 3061190 - DNA, 19 bp, Homo sapiens
tcagagtttcagctttctt

SEQ ID NO: 3061191 - DNA, 22 bp, Homo sapiens
tcagagtttcagctttcttcag

SEQ ID NO: 3061192 - DNA, 14 bp, Homo sapiens
tcagatacaatgta

SEQ ID NO: 3061193 - DNA, 16 bp, Homo sapiens
tcagatatcaaaattc

SEQ ID NO: 3061194 - DNA, 23 bp, Homo sapiens
tcagatcagtgtaccatttgcct

SEQ ID NO: 3061195 - DNA, 18 bp, Homo sapiens
tcagatgcgttcgcctct

SEQ ID NO: 3061196 - DNA, 12 bp, Homo sapiens
tcagatgctcaa

SEQ ID NO: 3061197 - DNA, 20 bp, Homo sapiens
tcagatgctccaagattcta

SEQ ID NO: 3061198 - DNA, 18 bp, Homo sapiens
tcagatgtggagccaggc

SEQ ID NO: 3061199 - DNA, 18 bp, Homo sapiens
tcagatgttgaattcttt

SEQ ID NO: 3061200 - DNA, 17 bp, Homo sapiens
tcagatgttttggtcaa

SEQ ID NO: 3061201 - DNA, 16 bp, Homo sapiens
tcagattgcatgtgac

SEQ ID NO: 3061202 - DNA, 21 bp, Homo sapiens
tcagatttaccataatgttcc

SEQ ID NO: 3061203 - DNA, 19 bp, Homo sapiens
tcagatttatttgtttgat

SEQ ID NO: 3061204 - DNA, 21 bp, Homo sapiens
tcagatttatttgtttgattt

SEQ ID NO: 3061205 - DNA, 20 bp, Homo sapiens
tcagatttggtgatggaaaa

SEQ ID NO: 3061206 - DNA, 20 bp, Homo sapiens
tcagcaacaaccatctcatc

SEQ ID NO: 3061207 - DNA, 23 bp, Homo sapiens
tcagcaacaaccatctcatccta

SEQ ID NO: 3061208 - DNA, 14 bp, Homo sapiens
tcagcaagagagaa

SEQ ID NO: 3061209 - DNA, 15 bp, Homo sapiens
tcagcaagagagaac

SEQ ID NO: 3061210 - DNA, 19 bp, Homo sapiens
tcagcacaaggccatctgg

SEQ ID NO: 3061211 - DNA, 18 bp, Homo sapiens
tcagcaccttggcccagg

SEQ ID NO: 3061212 - DNA, 15 bp, Homo sapiens
tcagcagaacctgta

SEQ ID NO: 3061213 - DNA, 16 bp, Homo sapiens
tcagcagaacctgtag

SEQ ID NO: 3061214 - DNA, 13 bp, Homo sapiens
tcagcagactgat

SEQ ID NO: 3061215 - DNA, 16 bp, Homo sapiens
tcagcagaggcagtgg

SEQ ID NO: 3061216 - DNA, 17 bp, Homo sapiens
tcagcagcagagagccc

SEQ ID NO: 3061217 - DNA, 19 bp, Homo sapiens
tcagcagcagagagccctg

SEQ ID NO: 3061218 - DNA, 13 bp, Homo sapiens
tcagcagcagctc

SEQ ID NO: 3061219 - DNA, 15 bp, Homo sapiens
tcagcagccctcctc

SEQ ID NO: 3061220 - DNA, 20 bp, Homo sapiens
tcagcataggtatgcttact

SEQ ID NO: 3061221 - DNA, 13 bp, Homo sapiens
tcagcatctgacc

SEQ ID NO: 3061222 - DNA, 16 bp, Homo sapiens
tcagcatctgaccatc

SEQ ID NO: 3061223 - DNA, 21 bp, Homo sapiens
tcagcatctgaccatctgtga

SEQ ID NO: 3061224 - DNA, 19 bp, Homo sapiens
tcagcatttccacaccaag

SEQ ID NO: 3061225 - DNA, 12 bp, Homo sapiens
tcagccaagcac

SEQ ID NO: 3061226 - DNA, 16 bp, Homo sapiens
tcagccaatttgtctc

SEQ ID NO: 3061227 - DNA, 18 bp, Homo sapiens
tcagccacatgccccagg

SEQ ID NO: 3061228 - DNA, 19 bp, Homo sapiens
tcagccacatgccccaggc

SEQ ID NO: 3061229 - DNA, 22 bp, Homo sapiens
tcagccacatgccccaggctct

SEQ ID NO: 3061230 - DNA, 17 bp, Homo sapiens
tcagccacctccctctg

SEQ ID NO: 3061231 - DNA, 23 bp, Homo sapiens
tcagccagcacttgtccagctga

SEQ ID NO: 3061232 - DNA, 22 bp, Homo sapiens
tcagccagctgccctaaataac

SEQ ID NO: 3061233 - DNA, 15 bp, Homo sapiens
tcagccatcagccat

SEQ ID NO: 3061234 - DNA, 16 bp, Homo sapiens
tcagccatcagccatg

SEQ ID NO: 3061235 - DNA, 20 bp, Homo sapiens
tcagccatccgcagactgct

SEQ ID NO: 3061236 - DNA, 23 bp, Homo sapiens
tcagccatccgcagactgcttgg

SEQ ID NO: 3061237 - DNA, 23 bp, Homo sapiens
tcagccatgcgcgcgctctctct

SEQ ID NO: 3061238 - DNA, 14 bp, Homo sapiens
tcagcccaccctcc

SEQ ID NO: 3061239 - DNA, 19 bp, Homo sapiens
tcagcccctacccctgccc

SEQ ID NO: 3061240 - DNA, 20 bp, Homo sapiens
tcagcccctacccctgccct

SEQ ID NO: 3061241 - DNA, 14 bp, Homo sapiens
tcagcccctcctct

SEQ ID NO: 3061242 - DNA, 20 bp, Homo sapiens
tcagcccctcctctgccacc

SEQ ID NO: 3061243 - DNA, 24 bp, Homo sapiens
tcaaatcagtcagtgcaaatgtca

SEQ ID NO: 3061244 - DNA, 16 bp, Homo sapiens
tcaaatccctctccaa

SEQ ID NO: 3061245 - DNA, 22 bp, Homo sapiens
tcaaatcgaatagggaagtaaa

SEQ ID NO: 3061246 - DNA, 19 bp, Homo sapiens
tcaaatctcttccttccct

SEQ ID NO: 3061247 - DNA, 15 bp, Homo sapiens
tcaaatctcttgctt

SEQ ID NO: 3061248 - DNA, 14 bp, Homo sapiens
tcaaatgctcagac

SEQ ID NO: 3061249 - DNA, 19 bp, Homo sapiens
tcaaatgctcagaccagct

SEQ ID NO: 3061250 - DNA, 21 bp, Homo sapiens
tcaaatgctcagaccagctct

SEQ ID NO: 3061251 - DNA, 18 bp, Homo sapiens
tcaaatggggccagatcc

SEQ ID NO: 3061252 - DNA, 20 bp, Homo sapiens
tcaaatggtaggcatttcct

SEQ ID NO: 3061253 - DNA, 21 bp, Homo sapiens
tcaaatggtaggcatttccta

SEQ ID NO: 3061254 - DNA, 13 bp, Homo sapiens
tcaaatgttctaa

SEQ ID NO: 3061255 - DNA, 14 bp, Homo sapiens
tcaaatgttctaag

SEQ ID NO: 3061256 - DNA, 15 bp, Homo sapiens
tcaaatgttctaagt

SEQ ID NO: 3061257 - DNA, 20 bp, Homo sapiens
tcaaatgttctaagtttcta

SEQ ID NO: 3061258 - DNA, 23 bp, Homo sapiens
tcaaatgttctaagtttctaaga

SEQ ID NO: 3061259 - DNA, 22 bp, Homo sapiens
tcaaatgttttctgcagaaaaa

SEQ ID NO: 3061260 - DNA, 20 bp, Homo sapiens
tcaaattaagattctctgcc

SEQ ID NO: 3061261 - DNA, 21 bp, Homo sapiens
tcaaattcctatttttaaata

SEQ ID NO: 3061262 - DNA, 14 bp, Homo sapiens
tcaaattctcttct

SEQ ID NO: 3061263 - DNA, 21 bp, Homo sapiens
tcaaattgtcagcatgacaaa

SEQ ID NO: 3061264 - DNA, 22 bp, Homo sapiens
tcaaatttagaaactaattgac

SEQ ID NO: 3061265 - DNA, 23 bp, Homo sapiens
tcaaatttagaaactaattgact

SEQ ID NO: 3061266 - DNA, 15 bp, Homo sapiens
tcaacaaaaattgtc

SEQ ID NO: 3061267 - DNA, 13 bp, Homo sapiens
tcaacaagcctga

SEQ ID NO: 3061268 - DNA, 18 bp, Homo sapiens
tcaacaataaaatttttt

SEQ ID NO: 3061269 - DNA, 17 bp, Homo sapiens
tcaacaataaagactga

SEQ ID NO: 3061270 - DNA, 18 bp, Homo sapiens
tcaacaatgattaatcag

SEQ ID NO: 3061271 - DNA, 14 bp, Homo sapiens
tcaacaatttgggc

SEQ ID NO: 3061272 - DNA, 16 bp, Homo sapiens
tcaacacactgcctta

SEQ ID NO: 3061273 - DNA, 21 bp, Homo sapiens
tcaacaccaccgagctctgtg

SEQ ID NO: 3061274 - DNA, 22 bp, Homo sapiens
tcaacaccaccgagctctgtgg

SEQ ID NO: 3061275 - DNA, 19 bp, Homo sapiens
tcaacagaatgaaaaatga

SEQ ID NO: 3061276 - DNA, 22 bp, Homo sapiens
tcaacagaatgaaaaatgaaag

SEQ ID NO: 3061277 - DNA, 19 bp, Homo sapiens
tcaacagagaaggcaggaa

SEQ ID NO: 3061278 - DNA, 22 bp, Homo sapiens
tcaacagagaaggcaggaatgt

SEQ ID NO: 3061279 - DNA, 23 bp, Homo sapiens
tcaacagagaggaccaacatcca

SEQ ID NO: 3061280 - DNA, 18 bp, Homo sapiens
tcaacagtgaagacagaa

SEQ ID NO: 3061281 - DNA, 14 bp, Homo sapiens
tcaacagttttcct

SEQ ID NO: 3061282 - DNA, 22 bp, Homo sapiens
tcaacagttttcctatgctttg

SEQ ID NO: 3061283 - DNA, 14 bp, Homo sapiens
tcaacatgaaacac

SEQ ID NO: 3061284 - DNA, 17 bp, Homo sapiens
tcaacattcttgtgtct

SEQ ID NO: 3061285 - DNA, 19 bp, Homo sapiens
tcaacattcttgtgtctgt

SEQ ID NO: 3061286 - DNA, 14 bp, Homo sapiens
tcaacatttccaaa

SEQ ID NO: 3061287 - DNA, 15 bp, Homo sapiens
tcaacatttccaaaa

SEQ ID NO: 3061288 - DNA, 14 bp, Homo sapiens
tcaaccagacagag

SEQ ID NO: 3061289 - DNA, 14 bp, Homo sapiens
tcaaccagatttag

SEQ ID NO: 3061290 - DNA, 18 bp, Homo sapiens
tcaaccccaccctgtttg

SEQ ID NO: 3061291 - DNA, 23 bp, Homo sapiens
tcaaccttaagacctactgttct

SEQ ID NO: 3061292 - DNA, 15 bp, Homo sapiens
tcaacgtattgtttc

SEQ ID NO: 3061293 - DNA, 20 bp, Homo sapiens
tcaacgttgtactgtatgtg

SEQ ID NO: 3061294 - DNA, 12 bp, Homo sapiens
tcaactatttta

SEQ ID NO: 3061295 - DNA, 20 bp, Homo sapiens
tcaactgccaaaatgctcta

SEQ ID NO: 3061296 - DNA, 21 bp, Homo sapiens
tcaactgtaggttatttaaaa

SEQ ID NO: 3061297 - DNA, 17 bp, Homo sapiens
tcaacttggaaaaagaa

SEQ ID NO: 3061298 - DNA, 19 bp, Homo sapiens
tcaacttggaaaaagaaag

SEQ ID NO: 3061299 - DNA, 17 bp, Homo sapiens
tcaactttcatttgaaa

SEQ ID NO: 3061300 - DNA, 12 bp, Homo sapiens
tcaactttgaat

SEQ ID NO: 3061301 - DNA, 21 bp, Homo sapiens
tcaactttttattgccttctc

SEQ ID NO: 3061302 - DNA, 22 bp, Homo sapiens
tcaagaaataaaaggaagccaa

SEQ ID NO: 3061303 - DNA, 15 bp, Homo sapiens
tcaagaaattctgct

SEQ ID NO: 3061304 - DNA, 22 bp, Homo sapiens
tcaagaagaaagtgttcaaatt

SEQ ID NO: 3061305 - DNA, 14 bp, Homo sapiens
tcaagaccagcctg

SEQ ID NO: 3061306 - DNA, 13 bp, Homo sapiens
tcaagacttgata

SEQ ID NO: 3061307 - DNA, 22 bp, Homo sapiens
tcaagaggcaggttagaagaac

SEQ ID NO: 3061308 - DNA, 15 bp, Homo sapiens
tcaagagtctctcca

SEQ ID NO: 3061309 - DNA, 19 bp, Homo sapiens
tcaagagtctctccagcct

SEQ ID NO: 3061310 - DNA, 23 bp, Homo sapiens
tcaagatccaaatgctgtgcaaa

SEQ ID NO: 3061311 - DNA, 19 bp, Homo sapiens
tcaagcaatcctcctacct

SEQ ID NO: 3061312 - DNA, 15 bp, Homo sapiens
tcaagcacttcccag

SEQ ID NO: 3061313 - DNA, 19 bp, Homo sapiens
tcaagcacttcccaggatc

SEQ ID NO: 3061314 - DNA, 13 bp, Homo sapiens
tcaagcagcaaaa

SEQ ID NO: 3061315 - DNA, 15 bp, Homo sapiens
tcaagcatattggaa

SEQ ID NO: 3061316 - DNA, 17 bp, Homo sapiens
tcaagccaagcagccaa

SEQ ID NO: 3061317 - DNA, 20 bp, Homo sapiens
tcaagccaagcagccaagct

SEQ ID NO: 3061318 - DNA, 16 bp, Homo sapiens
tcaagcgattctcctg

SEQ ID NO: 3061319 - DNA, 22 bp, Homo sapiens
tcaagcgattctcctgcctcag

SEQ ID NO: 3061320 - DNA, 16 bp, Homo sapiens
tcaagctcctcctccc

SEQ ID NO: 3061321 - DNA, 16 bp, Homo sapiens
tcaagctgagctggct

SEQ ID NO: 3061322 - DNA, 21 bp, Homo sapiens
tcaagctggtggcctctgcag

SEQ ID NO: 3061323 - DNA, 22 bp, Homo sapiens
tcaaggaacttgaaaaatactt

SEQ ID NO: 3061324 - DNA, 19 bp, Homo sapiens
tcaaggagaccatgtatgt

SEQ ID NO: 3061325 - DNA, 14 bp, Homo sapiens
tcaaggcactctag

SEQ ID NO: 3061326 - DNA, 18 bp, Homo sapiens
tcaaggcactctagattc

SEQ ID NO: 3061327 - DNA, 17 bp, Homo sapiens
tcaaggctcagaaggaa

SEQ ID NO: 3061328 - DNA, 14 bp, Homo sapiens
tcaaggcttcagtc

SEQ ID NO: 3061329 - DNA, 21 bp, Homo sapiens
tcaagggaattaaataaataa

SEQ ID NO: 3061330 - DNA, 16 bp, Homo sapiens
tcaagggtgcgtctgg

SEQ ID NO: 3061331 - DNA, 14 bp, Homo sapiens
tcaccacatcttgt

SEQ ID NO: 3061332 - DNA, 19 bp, Homo sapiens
tcaccacatcttgtctttt

SEQ ID NO: 3061333 - DNA, 20 bp, Homo sapiens
tcaccacatcttgtcttttc

SEQ ID NO: 3061334 - DNA, 21 bp, Homo sapiens
tcaccacctcatgtcatttct

SEQ ID NO: 3061335 - DNA, 16 bp, Homo sapiens
tcaccaccttcccagc

SEQ ID NO: 3061336 - DNA, 18 bp, Homo sapiens
tcaccaccttcccagctc

SEQ ID NO: 3061337 - DNA, 17 bp, Homo sapiens
tcaccagacttttctct

SEQ ID NO: 3061338 - DNA, 12 bp, Homo sapiens
tcaccagctgca

SEQ ID NO: 3061339 - DNA, 14 bp, Homo sapiens
tcaccagctgcaaa

SEQ ID NO: 3061340 - DNA, 22 bp, Homo sapiens
tcaccaggaatgttaaagtcag

SEQ ID NO: 3061341 - DNA, 15 bp, Homo sapiens
tcaccaggtgcatct

SEQ ID NO: 3061342 - DNA, 17 bp, Homo sapiens
tcaccaggtgcatctgc

SEQ ID NO: 3061343 - DNA, 21 bp, Homo sapiens
tcaccaggtgcatctgcaggc

SEQ ID NO: 3061344 - DNA, 13 bp, Homo sapiens
tcaccatgcaagg

SEQ ID NO: 3061345 - DNA, 21 bp, Homo sapiens
tcaccatgttggccaggctgg

SEQ ID NO: 3061346 - DNA, 22 bp, Homo sapiens
tcaccatttgattatgtagcaa

SEQ ID NO: 3061347 - DNA, 23 bp, Homo sapiens
tcacccaaagcctgtcccaggac

SEQ ID NO: 3061348 - DNA, 20 bp, Homo sapiens
tcacccacaaccctctggaa

SEQ ID NO: 3061349 - DNA, 14 bp, Homo sapiens
tcacccacccctgc

SEQ ID NO: 3061350 - DNA, 19 bp, Homo sapiens
tcacccaggctggagtgca

SEQ ID NO: 3061351 - DNA, 19 bp, Homo sapiens
tcacccatgcaagcagagg

SEQ ID NO: 3061352 - DNA, 14 bp, Homo sapiens
tcaccccagagcca

SEQ ID NO: 3061353 - DNA, 12 bp, Homo sapiens
tcaccccagctc

SEQ ID NO: 3061354 - DNA, 13 bp, Homo sapiens
tcaccccagggcc

SEQ ID NO: 3061355 - DNA, 19 bp, Homo sapiens
tcaccccagggcctgagcc

SEQ ID NO: 3061356 - DNA, 18 bp, Homo sapiens
tcacccccttctccatcc

SEQ ID NO: 3061357 - DNA, 16 bp, Homo sapiens
tcaccccgaggccctg

SEQ ID NO: 3061358 - DNA, 19 bp, Homo sapiens
tcaccccgaggccctgcat

SEQ ID NO: 3061359 - DNA, 20 bp, Homo sapiens
tcaccccgaggccctgcatg

SEQ ID NO: 3061360 - DNA, 12 bp, Homo sapiens
tcaccctctgtc

SEQ ID NO: 3061361 - DNA, 15 bp, Homo sapiens
tcaccctctgtcccc

SEQ ID NO: 3061362 - DNA, 20 bp, Homo sapiens
tcaccctgtgaccctctcac

SEQ ID NO: 3061363 - DNA, 13 bp, Homo sapiens
tcacccttcctgg

SEQ ID NO: 3061364 - DNA, 18 bp, Homo sapiens
tcacccttcctggcccag

SEQ ID NO: 3061365 - DNA, 21 bp, Homo sapiens
tcacccttcctggcccaggcc

SEQ ID NO: 3061366 - DNA, 22 bp, Homo sapiens
tcacccttcctggcccaggcct

SEQ ID NO: 3061367 - DNA, 16 bp, Homo sapiens
tcaccgacagcggcct

SEQ ID NO: 3061368 - DNA, 19 bp, Homo sapiens
tcaccgacagcggccttga

SEQ ID NO: 3061369 - DNA, 23 bp, Homo sapiens
tcaccgagagtagccgagagcct

SEQ ID NO: 3061370 - DNA, 20 bp, Homo sapiens
tcaccgcggacgtgctggcc

SEQ ID NO: 3061371 - DNA, 15 bp, Homo sapiens
tcaccggatcctggg

SEQ ID NO: 3061372 - DNA, 17 bp, Homo sapiens
tcaccgtgggctccctg

SEQ ID NO: 3061373 - DNA, 18 bp, Homo sapiens
tcaccgtgggctccctga

SEQ ID NO: 3061374 - DNA, 18 bp, Homo sapiens
tcacctaaccctctgtca

SEQ ID NO: 3061375 - DNA, 20 bp, Homo sapiens
tcacctatttccattcaaca

SEQ ID NO: 3061376 - DNA, 17 bp, Homo sapiens
tcacctccatatcagaa

SEQ ID NO: 3061377 - DNA, 12 bp, Homo sapiens
tcacctctgcct

SEQ ID NO: 3061378 - DNA, 15 bp, Homo sapiens
tcacctctgcctcaa

SEQ ID NO: 3061379 - DNA, 20 bp, Homo sapiens
tcacctgaaccccagaggca

SEQ ID NO: 3061380 - DNA, 22 bp, Homo sapiens
tcacctgaaccccagaggcaga

SEQ ID NO: 3061381 - DNA, 18 bp, Homo sapiens
tcacctgattcaactaaa

SEQ ID NO: 3061382 - DNA, 12 bp, Homo sapiens
tcacctgcctgt

SEQ ID NO: 3061383 - DNA, 18 bp, Homo sapiens
tcacctggcttgtttatt

SEQ ID NO: 3061384 - DNA, 19 bp, Homo sapiens
tcacctggggtgtgggagg

SEQ ID NO: 3061385 - DNA, 13 bp, Homo sapiens
tcacctggtcctc

SEQ ID NO: 3061386 - DNA, 20 bp, Homo sapiens
tcacctgttgcttacaattt

SEQ ID NO: 3061387 - DNA, 21 bp, Homo sapiens
tcacctgttgcttacaatttt

SEQ ID NO: 3061388 - DNA, 18 bp, Homo sapiens
tcaccttaggcagggaag

SEQ ID NO: 3061389 - DNA, 21 bp, Homo sapiens
tcaccttcgtttactatgcct

SEQ ID NO: 3061390 - DNA, 15 bp, Homo sapiens
tcacctttactttag

SEQ ID NO: 3061391 - DNA, 14 bp, Homo sapiens
tcacctttcccact

SEQ ID NO: 3061392 - DNA, 19 bp, Homo sapiens
tcacctttcttcttgtgtc

SEQ ID NO: 3061393 - DNA, 12 bp, Homo sapiens
tcacctttgtag

SEQ ID NO: 3061394 - DNA, 15 bp, Homo sapiens
tcacctttgtagcac

SEQ ID NO: 3061395 - DNA, 14 bp, Homo sapiens
tcaccttttcttgc

SEQ ID NO: 3061396 - DNA, 17 bp, Homo sapiens
tcaccttttcttgcctg

SEQ ID NO: 3061397 - DNA, 16 bp, Homo sapiens
tcacgaagtgttgcat

SEQ ID NO: 3061398 - DNA, 13 bp, Homo sapiens
tcacgagtgttcc

SEQ ID NO: 3061399 - DNA, 16 bp, Homo sapiens
tcacgattatgactaa

SEQ ID NO: 3061400 - DNA, 22 bp, Homo sapiens
tcacgcagcaacgtttttaata

SEQ ID NO: 3061401 - DNA, 17 bp, Homo sapiens
tcacgccacccccgccc

SEQ ID NO: 3061402 - DNA, 18 bp, Homo sapiens
tcacgccacccccgcccc

SEQ ID NO: 3061403 - DNA, 19 bp, Homo sapiens
tcacgccattctcctgcct

SEQ ID NO: 3061404 - DNA, 22 bp, Homo sapiens
tcacgccattgtactccagcct

SEQ ID NO: 3061405 - DNA, 17 bp, Homo sapiens
tcacgccccgctgtgtc

SEQ ID NO: 3061406 - DNA, 23 bp, Homo sapiens
tcacgccccgctgtgtcctccct

SEQ ID NO: 3061407 - DNA, 22 bp, Homo sapiens
tcacgcctgtaatcccagcact

SEQ ID NO: 3061408 - DNA, 23 bp, Homo sapiens
tcacggcaggacaacgaggaagc

SEQ ID NO: 3061409 - DNA, 19 bp, Homo sapiens
tcacgtatttcacagagca

SEQ ID NO: 3061410 - DNA, 20 bp, Homo sapiens
tcacgtatttcacagagcac

SEQ ID NO: 3061411 - DNA, 18 bp, Homo sapiens
tcacgtgcaggacagctc

SEQ ID NO: 3061412 - DNA, 22 bp, Homo sapiens
tcacgtgcaggacagctcttga

SEQ ID NO: 3061413 - DNA, 23 bp, Homo sapiens
tcacgtgcaggacagctcttgat

SEQ ID NO: 3061414 - DNA, 17 bp, Homo sapiens
tcacgtgtagtgtccat

SEQ ID NO: 3061415 - DNA, 22 bp, Homo sapiens
tcacgtttcatgtaatcctcaa

SEQ ID NO: 3061416 - DNA, 13 bp, Homo sapiens
tcactaaaagtgt

SEQ ID NO: 3061417 - DNA, 21 bp, Homo sapiens
tcactacctgccatgcataca

SEQ ID NO: 3061418 - DNA, 20 bp, Homo sapiens
tcactactcgagcccaccca

SEQ ID NO: 3061419 - DNA, 21 bp, Homo sapiens
tcactatctgaaaatacattt

SEQ ID NO: 3061420 - DNA, 13 bp, Homo sapiens
tcactatgtttct

SEQ ID NO: 3061421 - DNA, 17 bp, Homo sapiens
tcactatgtttctcaga

SEQ ID NO: 3061422 - DNA, 14 bp, Homo sapiens
tcactcagatggaa

SEQ ID NO: 3061423 - DNA, 18 bp, Homo sapiens
tcactccaaccctgcccc

SEQ ID NO: 3061424 - DNA, 14 bp, Homo sapiens
tcactccaccaccc

SEQ ID NO: 3061425 - DNA, 15 bp, Homo sapiens
tcactccaccaccca

SEQ ID NO: 3061426 - DNA, 13 bp, Homo sapiens
tcactccctaggc

SEQ ID NO: 3061427 - DNA, 22 bp, Homo sapiens
tcactcgcaggaccaagggggc

SEQ ID NO: 3061428 - DNA, 17 bp, Homo sapiens
tcactctcctatgcctt

SEQ ID NO: 3061429 - DNA, 17 bp, Homo sapiens
tcactctgagtgtttta

SEQ ID NO: 3061430 - DNA, 20 bp, Homo sapiens
tcactctgagtgttttatga

SEQ ID NO: 3061431 - DNA, 23 bp, Homo sapiens
tcactctgccctctgctgctgcc

SEQ ID NO: 3061432 - DNA, 19 bp, Homo sapiens
tcactcttgaagtccagga

SEQ ID NO: 3061433 - DNA, 16 bp, Homo sapiens
tcactcttggagcctg

SEQ ID NO: 3061434 - DNA, 18 bp, Homo sapiens
tcactgaaaacatctgga

SEQ ID NO: 3061435 - DNA, 21 bp, Homo sapiens
tcactgaaacctttaagaaaa

SEQ ID NO: 3061436 - DNA, 19 bp, Homo sapiens
tcactgacacaaaaagtag

SEQ ID NO: 3061437 - DNA, 18 bp, Homo sapiens
tcactgacacatcagcat

SEQ ID NO: 3061438 - DNA, 22 bp, Homo sapiens
tcactgaggcctgagacccagg

SEQ ID NO: 3061439 - DNA, 16 bp, Homo sapiens
tcactgatgggaaaac

SEQ ID NO: 3061440 - DNA, 14 bp, Homo sapiens
tcactgcaacctcc

SEQ ID NO: 3061441 - DNA, 18 bp, Homo sapiens
tcactgcaacctccgcct

SEQ ID NO: 3061442 - DNA, 17 bp, Homo sapiens
tcactgcaacctctgcc

SEQ ID NO: 3061443 - DNA, 21 bp, Homo sapiens
tcactgcaacctctgcctccc

SEQ ID NO: 3061444 - DNA, 16 bp, Homo sapiens
tcactgcaaccttcac

SEQ ID NO: 3061445 - DNA, 15 bp, Homo sapiens
tcactgcagcctcaa

SEQ ID NO: 3061446 - DNA, 20 bp, Homo sapiens
tcactgcagcctcaacctcc

SEQ ID NO: 3061447 - DNA, 12 bp, Homo sapiens
tcactgccaaag

SEQ ID NO: 3061448 - DNA, 14 bp, Homo sapiens
tcactgccttcgtt

SEQ ID NO: 3061449 - DNA, 19 bp, Homo sapiens
tcactgccttcgtttatat

SEQ ID NO: 3061450 - DNA, 19 bp, Homo sapiens
tcactgctaagaatatttg

SEQ ID NO: 3061451 - DNA, 16 bp, Homo sapiens
tcactgctgctactgc

SEQ ID NO: 3061452 - DNA, 17 bp, Homo sapiens
tcactgctgctactgcc

SEQ ID NO: 3061453 - DNA, 16 bp, Homo sapiens
tcactgcttttggcct

SEQ ID NO: 3061454 - DNA, 14 bp, Homo sapiens
tcactggaaaggaa

SEQ ID NO: 3061455 - DNA, 16 bp, Homo sapiens
tcactggattggtcat

SEQ ID NO: 3061456 - DNA, 19 bp, Homo sapiens
tcactggcagccccagcac

SEQ ID NO: 3061457 - DNA, 22 bp, Homo sapiens
tcactggcgaggtgcggccacc

SEQ ID NO: 3061458 - DNA, 14 bp, Homo sapiens
tcactggcgccttc

SEQ ID NO: 3061459 - DNA, 17 bp, Homo sapiens
tcactggctcatgcccc

SEQ ID NO: 3061460 - DNA, 18 bp, Homo sapiens
tcactggctcatgcccct

SEQ ID NO: 3061461 - DNA, 17 bp, Homo sapiens
tcactggggcctacagc

SEQ ID NO: 3061462 - DNA, 23 bp, Homo sapiens
tcactggttttacttacaaaaat

SEQ ID NO: 3061463 - DNA, 22 bp, Homo sapiens
tcactgtccaggtaggaaacaa

SEQ ID NO: 3061464 - DNA, 19 bp, Homo sapiens
tcactgtccctcctggtgt

SEQ ID NO: 3061465 - DNA, 12 bp, Homo sapiens
tcactgtggctg

SEQ ID NO: 3061466 - DNA, 15 bp, Homo sapiens
tcactgtggctgtct

SEQ ID NO: 3061467 - DNA, 21 bp, Homo sapiens
tattgagggatagattgtatc

SEQ ID NO: 3061468 - DNA, 14 bp, Homo sapiens
tattgagtcaaatg

SEQ ID NO: 3061469 - DNA, 14 bp, Homo sapiens
tattgatctttgcc

SEQ ID NO: 3061470 - DNA, 20 bp, Homo sapiens
tattgcagcaattaaaaatt

SEQ ID NO: 3061471 - DNA, 11 bp, Homo sapiens
tattgcagttt

SEQ ID NO: 3061472 - DNA, 18 bp, Homo sapiens
tattgccaggaatgtttc

SEQ ID NO: 3061473 - DNA, 20 bp, Homo sapiens
tattgccattatagcgcctg

SEQ ID NO: 3061474 - DNA, 21 bp, Homo sapiens
tattgccattatagcgcctgt

SEQ ID NO: 3061475 - DNA, 20 bp, Homo sapiens
tattgctgctgtgcgtggaa

SEQ ID NO: 3061476 - DNA, 18 bp, Homo sapiens
tattggatctgcttgctg

SEQ ID NO: 3061477 - DNA, 22 bp, Homo sapiens
tattggtccagcttgctcttca

SEQ ID NO: 3061478 - DNA, 14 bp, Homo sapiens
tattgtaaatgcta

SEQ ID NO: 3061479 - DNA, 19 bp, Homo sapiens
tattgtaatctatgtttat

SEQ ID NO: 3061480 - DNA, 20 bp, Homo sapiens
tattgtacacttttttgggg

SEQ ID NO: 3061481 - DNA, 13 bp, Homo sapiens
tattgtacctttt

SEQ ID NO: 3061482 - DNA, 13 bp, Homo sapiens
tattgtataaaaa

SEQ ID NO: 3061483 - DNA, 13 bp, Homo sapiens
tattgtatattga

SEQ ID NO: 3061484 - DNA, 18 bp, Homo sapiens
tattgtattgctgctgtg

SEQ ID NO: 3061485 - DNA, 13 bp, Homo sapiens
tattgtctgtaaa

SEQ ID NO: 3061486 - DNA, 14 bp, Homo sapiens
tattgtctgtaaaa

SEQ ID NO: 3061487 - DNA, 16 bp, Homo sapiens
tattgtgagatgattt

SEQ ID NO: 3061488 - DNA, 18 bp, Homo sapiens
tattgtgagatgatttgt

SEQ ID NO: 3061489 - DNA, 17 bp, Homo sapiens
tattgtgtgcgctgcct

SEQ ID NO: 3061490 - DNA, 19 bp, Homo sapiens
tattgtgtgcgctgcctgg

SEQ ID NO: 3061491 - DNA, 20 bp, Homo sapiens
tattgttaataataattatt

SEQ ID NO: 3061492 - DNA, 12 bp, Homo sapiens
tattgtttacat

SEQ ID NO: 3061493 - DNA, 13 bp, Homo sapiens
tattgtttacatt

SEQ ID NO: 3061494 - DNA, 11 bp, Homo sapiens
tattgtttcta

SEQ ID NO: 3061495 - DNA, 13 bp, Homo sapiens
tattgtttcttta

SEQ ID NO: 3061496 - DNA, 18 bp, Homo sapiens
tatttaaaaatagaaaca

SEQ ID NO: 3061497 - DNA, 15 bp, Homo sapiens
tatttaaaaatattt

SEQ ID NO: 3061498 - DNA, 16 bp, Homo sapiens
tatttaaaaatatttc

SEQ ID NO: 3061499 - DNA, 19 bp, Homo sapiens
tatttaaaaatatttcaga

SEQ ID NO: 3061500 - DNA, 20 bp, Homo sapiens
tatttaaaaatatttcagat

SEQ ID NO: 3061501 - DNA, 15 bp, Homo sapiens
tatttaaaaatgtct

SEQ ID NO: 3061502 - DNA, 12 bp, Homo sapiens
tatttaaaactt

SEQ ID NO: 3061503 - DNA, 12 bp, Homo sapiens
tatttaaaagat

SEQ ID NO: 3061504 - DNA, 16 bp, Homo sapiens
tatttaaaataaattc

SEQ ID NO: 3061505 - DNA, 19 bp, Homo sapiens
tatttaaagaaagtgaaaa

SEQ ID NO: 3061506 - DNA, 13 bp, Homo sapiens
tatttaaagacaa

SEQ ID NO: 3061507 - DNA, 18 bp, Homo sapiens
tatttaaagacaaagaca

SEQ ID NO: 3061508 - DNA, 14 bp, Homo sapiens
tatttaaagcacat

SEQ ID NO: 3061509 - DNA, 13 bp, Homo sapiens
tatttaaatgtac

SEQ ID NO: 3061510 - DNA, 14 bp, Homo sapiens
tatttaaattacaa

SEQ ID NO: 3061511 - DNA, 12 bp, Homo sapiens
tatttaacatgt

SEQ ID NO: 3061512 - DNA, 16 bp, Homo sapiens
tatttaagaagaatga

SEQ ID NO: 3061513 - DNA, 17 bp, Homo sapiens
tatttaagcaacatctt

SEQ ID NO: 3061514 - DNA, 18 bp, Homo sapiens
tatttaagcaacatcttt

SEQ ID NO: 3061515 - DNA, 20 bp, Homo sapiens
tatttaatgatttttgtgta

SEQ ID NO: 3061516 - DNA, 24 bp, Homo sapiens
tatttacaatgtgtatcaaaacta

SEQ ID NO: 3061517 - DNA, 15 bp, Homo sapiens
tatttacgctttgat

SEQ ID NO: 3061518 - DNA, 19 bp, Homo sapiens
tatttacttctaatcttaa

SEQ ID NO: 3061519 - DNA, 20 bp, Homo sapiens
tatttacttctaatcttaaa

SEQ ID NO: 3061520 - DNA, 20 bp, Homo sapiens
tatttagtatatgaaatatt

SEQ ID NO: 3061521 - DNA, 16 bp, Homo sapiens
tatttagtgatatatt

SEQ ID NO: 3061522 - DNA, 14 bp, Homo sapiens
tatttagttattta

SEQ ID NO: 3061523 - DNA, 16 bp, Homo sapiens
tatttagttatttaag

SEQ ID NO: 3061524 - DNA, 14 bp, Homo sapiens
tatttatatgaagc

SEQ ID NO: 3061525 - DNA, 22 bp, Homo sapiens
tatttatatgaagcaagctgtg

SEQ ID NO: 3061526 - DNA, 15 bp, Homo sapiens
tatttatctgattaa

SEQ ID NO: 3061527 - DNA, 17 bp, Homo sapiens
tatttatgctataaatt

SEQ ID NO: 3061528 - DNA, 22 bp, Homo sapiens
tatttatgggcccctggcactc

SEQ ID NO: 3061529 - DNA, 15 bp, Homo sapiens
tatttatgtactttt

SEQ ID NO: 3061530 - DNA, 16 bp, Homo sapiens
tatttatttaaaagat

SEQ ID NO: 3061531 - DNA, 13 bp, Homo sapiens
tatttatttaatt

SEQ ID NO: 3061532 - DNA, 18 bp, Homo sapiens
tatttcaaattggagctt

SEQ ID NO: 3061533 - DNA, 20 bp, Homo sapiens
tatttcaaccagcacattcg

SEQ ID NO: 3061534 - DNA, 19 bp, Homo sapiens
tatttcaagggttgcttct

SEQ ID NO: 3061535 - DNA, 16 bp, Homo sapiens
tatttcaatgttagcc

SEQ ID NO: 3061536 - DNA, 17 bp, Homo sapiens
tatgttgctattgtaag

SEQ ID NO: 3061537 - DNA, 16 bp, Homo sapiens
tatgttgtttacctga

SEQ ID NO: 3061538 - DNA, 19 bp, Homo sapiens
tatgtttatgtaacatagt

SEQ ID NO: 3061539 - DNA, 12 bp, Homo sapiens
tatgtttgtaca

SEQ ID NO: 3061540 - DNA, 11 bp, Homo sapiens
tatgttttatt

SEQ ID NO: 3061541 - DNA, 15 bp, Homo sapiens
tatgttttttttctg

SEQ ID NO: 3061542 - DNA, 22 bp, Homo sapiens
tattaaaaaacaattaactgcc

SEQ ID NO: 3061543 - DNA, 20 bp, Homo sapiens
tattaaaaaggtttacagaa

SEQ ID NO: 3061544 - DNA, 14 bp, Homo sapiens
tattaaaatttggt

SEQ ID NO: 3061545 - DNA, 22 bp, Homo sapiens
tattaaacgtatgcatgtgaag

SEQ ID NO: 3061546 - DNA, 15 bp, Homo sapiens
tattaaactctcctt

SEQ ID NO: 3061547 - DNA, 14 bp, Homo sapiens
tattaaagtgctaa

SEQ ID NO: 3061548 - DNA, 23 bp, Homo sapiens
tattaaataaaatgcacaaaact

SEQ ID NO: 3061549 - DNA, 15 bp, Homo sapiens
tattaaataacatgt

SEQ ID NO: 3061550 - DNA, 23 bp, Homo sapiens
tattaaataacatgtttctctat

SEQ ID NO: 3061551 - DNA, 21 bp, Homo sapiens
tattaaatcgtttaatgttta

SEQ ID NO: 3061552 - DNA, 15 bp, Homo sapiens
tattaaatctgaatt

SEQ ID NO: 3061553 - DNA, 14 bp, Homo sapiens
tattaacctcttaa

SEQ ID NO: 3061554 - DNA, 20 bp, Homo sapiens
tattaaccttgccttagaaa

SEQ ID NO: 3061555 - DNA, 18 bp, Homo sapiens
tattaactatcttctttg

SEQ ID NO: 3061556 - DNA, 20 bp, Homo sapiens
tattaagccaggaaacatga

SEQ ID NO: 3061557 - DNA, 21 bp, Homo sapiens
tattaagccaggaaacatgaa

SEQ ID NO: 3061558 - DNA, 18 bp, Homo sapiens
tattaaggatgtagcttt

SEQ ID NO: 3061559 - DNA, 14 bp, Homo sapiens
tattaataaataga

SEQ ID NO: 3061560 - DNA, 17 bp, Homo sapiens
tattaataaatagagca

SEQ ID NO: 3061561 - DNA, 17 bp, Homo sapiens
tattacatatatcatta

SEQ ID NO: 3061562 - DNA, 22 bp, Homo sapiens
tattaccttaagatttttcttt

SEQ ID NO: 3061563 - DNA, 13 bp, Homo sapiens
tattacgttgttt

SEQ ID NO: 3061564 - DNA, 17 bp, Homo sapiens
tattacgttgtttctta

SEQ ID NO: 3061565 - DNA, 19 bp, Homo sapiens
tattactgctgctgtgctt

SEQ ID NO: 3061566 - DNA, 19 bp, Homo sapiens
tattactggcgtggattaa

SEQ ID NO: 3061567 - DNA, 13 bp, Homo sapiens
tattacttttcat

SEQ ID NO: 3061568 - DNA, 16 bp, Homo sapiens
tattacttttcatcta

SEQ ID NO: 3061569 - DNA, 15 bp, Homo sapiens
tattagagtgtcttt

SEQ ID NO: 3061570 - DNA, 11 bp, Homo sapiens
tattagatgaa

SEQ ID NO: 3061571 - DNA, 14 bp, Homo sapiens
tattagatgtgatt

SEQ ID NO: 3061572 - DNA, 21 bp, Homo sapiens
tattagccaggtaatgtgaat

SEQ ID NO: 3061573 - DNA, 23 bp, Homo sapiens
tattagctgtattatccattttt

SEQ ID NO: 3061574 - DNA, 14 bp, Homo sapiens
tattagctttactg

SEQ ID NO: 3061575 - DNA, 16 bp, Homo sapiens
tattagctttactgtt

SEQ ID NO: 3061576 - DNA, 21 bp, Homo sapiens
tattaggtgaatatggaagta

SEQ ID NO: 3061577 - DNA, 18 bp, Homo sapiens
tattagtgatatttctct

SEQ ID NO: 3061578 - DNA, 20 bp, Homo sapiens
tattagtgatatttctctag

SEQ ID NO: 3061579 - DNA, 22 bp, Homo sapiens
tattagtggtttatcagcaaaa

SEQ ID NO: 3061580 - DNA, 13 bp, Homo sapiens
tattataaattct

SEQ ID NO: 3061581 - DNA, 23 bp, Homo sapiens
tattataaattctactaagttat

SEQ ID NO: 3061582 - DNA, 20 bp, Homo sapiens
tattatactttatcaaagat

SEQ ID NO: 3061583 - DNA, 20 bp, Homo sapiens
tattatagagagttatgaac

SEQ ID NO: 3061584 - DNA, 15 bp, Homo sapiens
tattatataaacttt

SEQ ID NO: 3061585 - DNA, 12 bp, Homo sapiens
tattatatatag

SEQ ID NO: 3061586 - DNA, 14 bp, Homo sapiens
tattatatatagaa

SEQ ID NO: 3061587 - DNA, 23 bp, Homo sapiens
tattatcctagattatatcaaag

SEQ ID NO: 3061588 - DNA, 15 bp, Homo sapiens
tattatctacctgtt

SEQ ID NO: 3061589 - DNA, 17 bp, Homo sapiens
tattatctacctgttct

SEQ ID NO: 3061590 - DNA, 18 bp, Homo sapiens
tattatcttcttaacagt

SEQ ID NO: 3061591 - DNA, 14 bp, Homo sapiens
tattattattttcc

SEQ ID NO: 3061592 - DNA, 21 bp, Homo sapiens
tattattccgtattacatttt

SEQ ID NO: 3061593 - DNA, 14 bp, Homo sapiens
tattattgttaata

SEQ ID NO: 3061594 - DNA, 15 bp, Homo sapiens
tattatttaactctt

SEQ ID NO: 3061595 - DNA, 18 bp, Homo sapiens
tatcaataaattccatgt

SEQ ID NO: 3061596 - DNA, 15 bp, Homo sapiens
tatcacctcattctg

SEQ ID NO: 3061597 - DNA, 17 bp, Homo sapiens
tatcacctcattctgaa

SEQ ID NO: 3061598 - DNA, 12 bp, Homo sapiens
tatcacctggct

SEQ ID NO: 3061599 - DNA, 19 bp, Homo sapiens
tatcacctggcttgtttat

SEQ ID NO: 3061600 - DNA, 18 bp, Homo sapiens
tatcactgacacaaaaag

SEQ ID NO: 3061601 - DNA, 14 bp, Homo sapiens
tatcaggcagaaga

SEQ ID NO: 3061602 - DNA, 17 bp, Homo sapiens
tatcagttactcagccc

SEQ ID NO: 3061603 - DNA, 19 bp, Homo sapiens
tatcagttactcagccctg

SEQ ID NO: 3061604 - DNA, 20 bp, Homo sapiens
tatcagttactcagccctgg

SEQ ID NO: 3061605 - DNA, 21 bp, Homo sapiens
tatcagttgagcttcatatac

SEQ ID NO: 3061606 - DNA, 12 bp, Homo sapiens
tatcatgctaaa

SEQ ID NO: 3061607 - DNA, 15 bp, Homo sapiens
tatcatgctaaaatt

SEQ ID NO: 3061608 - DNA, 17 bp, Homo sapiens
tatcatgctttgaaaaa

SEQ ID NO: 3061609 - DNA, 14 bp, Homo sapiens
tatcatgtatctct

SEQ ID NO: 3061610 - DNA, 19 bp, Homo sapiens
tatcattgcttcctcctcc

SEQ ID NO: 3061611 - DNA, 23 bp, Homo sapiens
tatccaaaatgtgtatttcttat

SEQ ID NO: 3061612 - DNA, 18 bp, Homo sapiens
tatccacatgaaaataaa

SEQ ID NO: 3061613 - DNA, 13 bp, Homo sapiens
tatccacccagcc

SEQ ID NO: 3061614 - DNA, 20 bp, Homo sapiens
tatccacccagcccattctc

SEQ ID NO: 3061615 - DNA, 16 bp, Homo sapiens
tatccagaccttgaaa

SEQ ID NO: 3061616 - DNA, 21 bp, Homo sapiens
tatccaggtaatccaagatat

SEQ ID NO: 3061617 - DNA, 17 bp, Homo sapiens
tatccatatagaaatct

SEQ ID NO: 3061618 - DNA, 15 bp, Homo sapiens
tatccatattacgtt

SEQ ID NO: 3061619 - DNA, 17 bp, Homo sapiens
tatccattatcatgtgt

SEQ ID NO: 3061620 - DNA, 19 bp, Homo sapiens
tatccattatcatgtgtaa

SEQ ID NO: 3061621 - DNA, 22 bp, Homo sapiens
tatccatttaaactaacctttt

SEQ ID NO: 3061622 - DNA, 21 bp, Homo sapiens
tatcccagctttaaaaagaaa

SEQ ID NO: 3061623 - DNA, 21 bp, Homo sapiens
tatccccagggacagaaacca

SEQ ID NO: 3061624 - DNA, 15 bp, Homo sapiens
tatcccttcctgtct

SEQ ID NO: 3061625 - DNA, 17 bp, Homo sapiens
tatcctagcacatgctt

SEQ ID NO: 3061626 - DNA, 13 bp, Homo sapiens
tatcctcacataa

SEQ ID NO: 3061627 - DNA, 20 bp, Homo sapiens
tatcctccctggcagacaca

SEQ ID NO: 3061628 - DNA, 16 bp, Homo sapiens
tatcctcgctcccggg

SEQ ID NO: 3061629 - DNA, 12 bp, Homo sapiens
tatcctctgtaa

SEQ ID NO: 3061630 - DNA, 22 bp, Homo sapiens
tatcctgcttctgatatgcagt

SEQ ID NO: 3061631 - DNA, 19 bp, Homo sapiens
tatcctggttagaagaaaa

SEQ ID NO: 3061632 - DNA, 13 bp, Homo sapiens
tatccttcatctt

SEQ ID NO: 3061633 - DNA, 16 bp, Homo sapiens
tatccttcatctttta

SEQ ID NO: 3061634 - DNA, 20 bp, Homo sapiens
tatccttcatcttttaaaga

SEQ ID NO: 3061635 - DNA, 16 bp, Homo sapiens
tatccttcctctcctt

SEQ ID NO: 3061636 - DNA, 15 bp, Homo sapiens
tatccttctggctgt

SEQ ID NO: 3061637 - DNA, 18 bp, Homo sapiens
tatccttttcttctatgt

SEQ ID NO: 3061638 - DNA, 17 bp, Homo sapiens
tatcggggaagccagac

SEQ ID NO: 3061639 - DNA, 18 bp, Homo sapiens
tatcggggaagccagacg

SEQ ID NO: 3061640 - DNA, 18 bp, Homo sapiens
tatctaaagttatatttc

SEQ ID NO: 3061641 - DNA, 14 bp, Homo sapiens
tatctaaattgaat

SEQ ID NO: 3061642 - DNA, 13 bp, Homo sapiens
tatctaagaatac

SEQ ID NO: 3061643 - DNA, 19 bp, Homo sapiens
tatctaagaatacagcttt

SEQ ID NO: 3061644 - DNA, 20 bp, Homo sapiens
tatctaagaatacagctttc

SEQ ID NO: 3061645 - DNA, 21 bp, Homo sapiens
tatctacatcttttttcacaa

SEQ ID NO: 3061646 - DNA, 15 bp, Homo sapiens
tatctacctgttctg

SEQ ID NO: 3061647 - DNA, 14 bp, Homo sapiens
tatctactaagttt

SEQ ID NO: 3061648 - DNA, 18 bp, Homo sapiens
tatctactaagtttcctt

SEQ ID NO: 3061649 - DNA, 20 bp, Homo sapiens
tatctactaagtttcctttt

SEQ ID NO: 3061650 - DNA, 16 bp, Homo sapiens
tatctatagcaactca

SEQ ID NO: 3061651 - DNA, 13 bp, Homo sapiens
tatctatatatgt

SEQ ID NO: 3061652 - DNA, 17 bp, Homo sapiens
tatctatatatgtgtat

SEQ ID NO: 3061653 - DNA, 14 bp, Homo sapiens
tatctatgaaaacc

SEQ ID NO: 3061654 - DNA, 23 bp, Homo sapiens
tatctatgttgcatgataaacat

SEQ ID NO: 3061655 - DNA, 18 bp, Homo sapiens
tatctattctgagaaaac

SEQ ID NO: 3061656 - DNA, 12 bp, Homo sapiens
tatctcagccat

SEQ ID NO: 3061657 - DNA, 13 bp, Homo sapiens
tatctcagccata

SEQ ID NO: 3061658 - DNA, 14 bp, Homo sapiens
tatctcagccatcc

SEQ ID NO: 3061659 - DNA, 18 bp, Homo sapiens
tatctccatactttggat

SEQ ID NO: 3061660 - DNA, 18 bp, Homo sapiens
tatctccctgcttcatat

SEQ ID NO: 3061661 - DNA, 16 bp, Homo sapiens
tatctcctagggctat

SEQ ID NO: 3061662 - DNA, 18 bp, Homo sapiens
tatctcctcgcaagctgg

SEQ ID NO: 3061663 - DNA, 16 bp, Homo sapiens
tatctcttttatattt

SEQ ID NO: 3061664 - DNA, 13 bp, Homo sapiens
tatctgaatgttc

SEQ ID NO: 3061665 - DNA, 23 bp, Homo sapiens
tatctgcttttggttataatgtg

SEQ ID NO: 3061666 - DNA, 22 bp, Homo sapiens
tatctggccccaggtagaaact

SEQ ID NO: 3061667 - DNA, 19 bp, Homo sapiens
tatctggtatctgcatgta

SEQ ID NO: 3061668 - DNA, 23 bp, Homo sapiens
tatctgtagtgagatagcattgt

SEQ ID NO: 3061669 - DNA, 20 bp, Homo sapiens
tatctgtctactttctcttg

SEQ ID NO: 3061670 - DNA, 21 bp, Homo sapiens
tatctgtctactttctcttgt

SEQ ID NO: 3061671 - DNA, 20 bp, Homo sapiens
tatcttaattttggttgtat

SEQ ID NO: 3061672 - DNA, 20 bp, Homo sapiens
tatcttctcaagttctaaga

SEQ ID NO: 3061673 - DNA, 22 bp, Homo sapiens
tatcttctcaagttctaagatt

SEQ ID NO: 3061674 - DNA, 14 bp, Homo sapiens
tatcttctgatttg

SEQ ID NO: 3061675 - DNA, 15 bp, Homo sapiens
tatcttcttaacagt

SEQ ID NO: 3061676 - DNA, 17 bp, Homo sapiens
tatcttcttaacagttt

SEQ ID NO: 3061677 - DNA, 23 bp, Homo sapiens
tatcttgatgttcagacatttat

SEQ ID NO: 3061678 - DNA, 13 bp, Homo sapiens
tatcttgtgaagt

SEQ ID NO: 3061679 - DNA, 14 bp, Homo sapiens
tatcttgtttttcc

SEQ ID NO: 3061680 - DNA, 18 bp, Homo sapiens
tatcttgtttttccacta

SEQ ID NO: 3061681 - DNA, 22 bp, Homo sapiens
tatcttgtttttccactactgc

SEQ ID NO: 3061682 - DNA, 12 bp, Homo sapiens
tatctttatact

SEQ ID NO: 3061683 - DNA, 22 bp, Homo sapiens
tatctttatacttaaacagctt

SEQ ID NO: 3061684 - DNA, 23 bp, Homo sapiens
tatctttcgtgataaactttgct

SEQ ID NO: 3061685 - DNA, 22 bp, Homo sapiens
tatcttttctttagagaactga

SEQ ID NO: 3061686 - DNA, 16 bp, Homo sapiens
tatgaaagctgggggt

SEQ ID NO: 3061687 - DNA, 18 bp, Homo sapiens
tatgaaatattttgaata

SEQ ID NO: 3061688 - DNA, 19 bp, Homo sapiens
tatgaagaattgccaatct

SEQ ID NO: 3061689 - DNA, 14 bp, Homo sapiens
tatgaagacataaa

SEQ ID NO: 3061690 - DNA, 15 bp, Homo sapiens
tatgaagcaagctgt

SEQ ID NO: 3061691 - DNA, 18 bp, Homo sapiens
tatgaagcaagctgtgtt

SEQ ID NO: 3061692 - DNA, 19 bp, Homo sapiens
tatgaagcaagctgtgtta

SEQ ID NO: 3061693 - DNA, 21 bp, Homo sapiens
tatgaagcaagctgtgttact

SEQ ID NO: 3061694 - DNA, 14 bp, Homo sapiens
tatgaagtactttt

SEQ ID NO: 3061695 - DNA, 23 bp, Homo sapiens
tatgaatctgctcactttaaacc

SEQ ID NO: 3061696 - DNA, 20 bp, Homo sapiens
tatgaatgcagcactgctgc

SEQ ID NO: 3061697 - DNA, 21 bp, Homo sapiens
tatgaatgcccccagctggcc

SEQ ID NO: 3061698 - DNA, 19 bp, Homo sapiens
tatgaatggtctagaaaca

SEQ ID NO: 3061699 - DNA, 15 bp, Homo sapiens
tatgaattgctgtct

SEQ ID NO: 3061700 - DNA, 21 bp, Homo sapiens
tatgacatgaaaagttattta

SEQ ID NO: 3061701 - DNA, 15 bp, Homo sapiens
tatgaccagagcaaa

SEQ ID NO: 3061702 - DNA, 13 bp, Homo sapiens
tatgagaaatgta

SEQ ID NO: 3061703 - DNA, 14 bp, Homo sapiens
tatgagaacatggt

SEQ ID NO: 3061704 - DNA, 20 bp, Homo sapiens
tatgagaacatggtgtgtgt

SEQ ID NO: 3061705 - DNA, 15 bp, Homo sapiens
tatgagaagatcctg

SEQ ID NO: 3061706 - DNA, 17 bp, Homo sapiens
tatgagaagtactttgt

SEQ ID NO: 3061707 - DNA, 18 bp, Homo sapiens
tatgagttgttttcagac

SEQ ID NO: 3061708 - DNA, 15 bp, Homo sapiens
tatgataaaacactg

SEQ ID NO: 3061709 - DNA, 19 bp, Homo sapiens
tatgatatttcttgctttc

SEQ ID NO: 3061710 - DNA, 15 bp, Homo sapiens
tatgatctatgttgt

SEQ ID NO: 3061711 - DNA, 18 bp, Homo sapiens
tatgatctccgtatgatg

SEQ ID NO: 3061712 - DNA, 22 bp, Homo sapiens
tatgatgatacaagattagaag

SEQ ID NO: 3061713 - DNA, 21 bp, Homo sapiens
tatgatggaagacaggaaagt

SEQ ID NO: 3061714 - DNA, 14 bp, Homo sapiens
tatgatgtattagt

SEQ ID NO: 3061715 - DNA, 17 bp, Homo sapiens
tatgattgtttgcacag

SEQ ID NO: 3061716 - DNA, 14 bp, Homo sapiens
tatgatttaaaaca

SEQ ID NO: 3061717 - DNA, 18 bp, Homo sapiens
tatgatttaaaacatgta

SEQ ID NO: 3061718 - DNA, 20 bp, Homo sapiens
tatgatttataaacagacaa

SEQ ID NO: 3061719 - DNA, 19 bp, Homo sapiens
tatgatttgttttgaattt

SEQ ID NO: 3061720 - DNA, 15 bp, Homo sapiens
tatgcaaagaactca

SEQ ID NO: 3061721 - DNA, 13 bp, Homo sapiens
tatgcaagtggga

SEQ ID NO: 3061722 - DNA, 19 bp, Homo sapiens
tatgcaccttgtgtctgta

SEQ ID NO: 3061723 - DNA, 15 bp, Homo sapiens
tatgcacgttaacag

SEQ ID NO: 3061724 - DNA, 15 bp, Homo sapiens
tatgcagaacaggca

SEQ ID NO: 3061725 - DNA, 21 bp, Homo sapiens
tatgcagaacaggcagaaata

SEQ ID NO: 3061726 - DNA, 14 bp, Homo sapiens
tatgcataaagtca

SEQ ID NO: 3061727 - DNA, 20 bp, Homo sapiens
tatgcatggtgccccaggac

SEQ ID NO: 3061728 - DNA, 15 bp, Homo sapiens
tatgcatgtgaagaa

SEQ ID NO: 3061729 - DNA, 15 bp, Homo sapiens
tatgcattcttataa

SEQ ID NO: 3061730 - DNA, 21 bp, Homo sapiens
tatgcattcttataacataac

SEQ ID NO: 3061731 - DNA, 12 bp, Homo sapiens
tagtatttgatt

SEQ ID NO: 3061732 - DNA, 17 bp, Homo sapiens
tagtatttgattcaaaa

SEQ ID NO: 3061733 - DNA, 15 bp, Homo sapiens
tagtcaatcaagtct

SEQ ID NO: 3061734 - DNA, 21 bp, Homo sapiens
tagtcaatcaagtctgtttac

SEQ ID NO: 3061735 - DNA, 19 bp, Homo sapiens
tagtcaatttctacttctg

SEQ ID NO: 3061736 - DNA, 23 bp, Homo sapiens
tagtcacatggcctatgcacata

SEQ ID NO: 3061737 - DNA, 21 bp, Homo sapiens
tagtcacctaaccctctgtca

SEQ ID NO: 3061738 - DNA, 18 bp, Homo sapiens
tagtcactggcagcctgc

SEQ ID NO: 3061739 - DNA, 19 bp, Homo sapiens
tagtcagctagatcatttg

SEQ ID NO: 3061740 - DNA, 21 bp, Homo sapiens
tagtccaaaaagctcctgggg

SEQ ID NO: 3061741 - DNA, 19 bp, Homo sapiens
tagtccagagaactgacat

SEQ ID NO: 3061742 - DNA, 18 bp, Homo sapiens
tagtcccccaaagggcct

SEQ ID NO: 3061743 - DNA, 22 bp, Homo sapiens
tagtccccccagctctaagcag

SEQ ID NO: 3061744 - DNA, 18 bp, Homo sapiens
tagtcgggcagggcccct

SEQ ID NO: 3061745 - DNA, 22 bp, Homo sapiens
tagtctactcttaagccatctt

SEQ ID NO: 3061746 - DNA, 19 bp, Homo sapiens
tagtctagatggctcctct

SEQ ID NO: 3061747 - DNA, 13 bp, Homo sapiens
tagtctagtgtag

SEQ ID NO: 3061748 - DNA, 18 bp, Homo sapiens
tagtctctgggtttacaa

SEQ ID NO: 3061749 - DNA, 16 bp, Homo sapiens
tagtctctgttcttca

SEQ ID NO: 3061750 - DNA, 15 bp, Homo sapiens
tagtctctttattcc

SEQ ID NO: 3061751 - DNA, 17 bp, Homo sapiens
tagtctgggtcagaccc

SEQ ID NO: 3061752 - DNA, 18 bp, Homo sapiens
tagtctgggtcagaccca

SEQ ID NO: 3061753 - DNA, 15 bp, Homo sapiens
tagtcttgaatttct

SEQ ID NO: 3061754 - DNA, 19 bp, Homo sapiens
tagtgaaggcttctctctg

SEQ ID NO: 3061755 - DNA, 21 bp, Homo sapiens
tagtgaaggcttctctctgtg

SEQ ID NO: 3061756 - DNA, 11 bp, Homo sapiens
tagtgacattt

SEQ ID NO: 3061757 - DNA, 19 bp, Homo sapiens
tagtgacatttaatgccat

SEQ ID NO: 3061758 - DNA, 15 bp, Homo sapiens
tagtgagcgagtgga

SEQ ID NO: 3061759 - DNA, 20 bp, Homo sapiens
tagtgagcgagtggatgctg

SEQ ID NO: 3061760 - DNA, 16 bp, Homo sapiens
tagtgatatattttat

SEQ ID NO: 3061761 - DNA, 19 bp, Homo sapiens
tagtgatgtagaaagatac

SEQ ID NO: 3061762 - DNA, 22 bp, Homo sapiens
tagtgatttttatgccacctga

SEQ ID NO: 3061763 - DNA, 15 bp, Homo sapiens
tagtgcaacttagat

SEQ ID NO: 3061764 - DNA, 16 bp, Homo sapiens
tagtgcatctttgcct

SEQ ID NO: 3061765 - DNA, 23 bp, Homo sapiens
tagtgccaatgttgtgtgttgca

SEQ ID NO: 3061766 - DNA, 17 bp, Homo sapiens
tagtgccttgcccacag

SEQ ID NO: 3061767 - DNA, 18 bp, Homo sapiens
tagtgccttgcccacagg

SEQ ID NO: 3061768 - DNA, 11 bp, Homo sapiens
tagtgcctttt

SEQ ID NO: 3061769 - DNA, 17 bp, Homo sapiens
tagtgctttaagaatga

SEQ ID NO: 3061770 - DNA, 18 bp, Homo sapiens
tagtgctttaagaatgaa

SEQ ID NO: 3061771 - DNA, 14 bp, Homo sapiens
tagtggacttgttt

SEQ ID NO: 3061772 - DNA, 21 bp, Homo sapiens
tagtggagggttggagaagga

SEQ ID NO: 3061773 - DNA, 16 bp, Homo sapiens
tagtggatctcagttt

SEQ ID NO: 3061774 - DNA, 16 bp, Homo sapiens
tagtggcttgtcctca

SEQ ID NO: 3061775 - DNA, 17 bp, Homo sapiens
tagtgggccttcattaa

SEQ ID NO: 3061776 - DNA, 22 bp, Homo sapiens
tagtggtctctactgtggcaaa

SEQ ID NO: 3061777 - DNA, 19 bp, Homo sapiens
tagtgtagtattcttccct

SEQ ID NO: 3061778 - DNA, 15 bp, Homo sapiens
tagtgtcacctttct

SEQ ID NO: 3061779 - DNA, 22 bp, Homo sapiens
tagtgtgggaggctcctgttag

SEQ ID NO: 3061780 - DNA, 23 bp, Homo sapiens
tagtgtgtgtgcagagtccattt

SEQ ID NO: 3061781 - DNA, 20 bp, Homo sapiens
tagtgtgtgttgcaaatcac

SEQ ID NO: 3061782 - DNA, 15 bp, Homo sapiens
tagtgttaatcaatt

SEQ ID NO: 3061783 - DNA, 13 bp, Homo sapiens
tagtgtttggaat

SEQ ID NO: 3061784 - DNA, 23 bp, Homo sapiens
tagttaagacatgatttccttga

SEQ ID NO: 3061785 - DNA, 22 bp, Homo sapiens
tagttaatgaaggtgtgctaca

SEQ ID NO: 3061786 - DNA, 21 bp, Homo sapiens
tagttactgttgtgacctgaa

SEQ ID NO: 3061787 - DNA, 16 bp, Homo sapiens
tagttagcatccaggc

SEQ ID NO: 3061788 - DNA, 20 bp, Homo sapiens
tagttagccatctaatgctt

SEQ ID NO: 3061789 - DNA, 14 bp, Homo sapiens
tagttattggatca

SEQ ID NO: 3061790 - DNA, 23 bp, Homo sapiens
tagttattggatcagtgaaaaac

SEQ ID NO: 3061791 - DNA, 15 bp, Homo sapiens
tagttatttctgcct

SEQ ID NO: 3061792 - DNA, 16 bp, Homo sapiens
tagttccagagggttg

SEQ ID NO: 3061793 - DNA, 14 bp, Homo sapiens
tagttctaagactc

SEQ ID NO: 3061794 - DNA, 12 bp, Homo sapiens
tagttctagaca

SEQ ID NO: 3061795 - DNA, 23 bp, Homo sapiens
tagttctagacatggaggttcta

SEQ ID NO: 3061796 - DNA, 15 bp, Homo sapiens
tagttctaggcactg

SEQ ID NO: 3061797 - DNA, 15 bp, Homo sapiens
tagttctcagcttgc

SEQ ID NO: 3061798 - DNA, 22 bp, Homo sapiens
tagttctcttggtgttaaaaca

SEQ ID NO: 3061799 - DNA, 18 bp, Homo sapiens
tagttctgagctgccagt

SEQ ID NO: 3061800 - DNA, 13 bp, Homo sapiens
tagttctgccagg

SEQ ID NO: 3061801 - DNA, 16 bp, Homo sapiens
tagttctgtatataaa

SEQ ID NO: 3061802 - DNA, 15 bp, Homo sapiens
tagttctttgttcct

SEQ ID NO: 3061803 - DNA, 22 bp, Homo sapiens
tagttctttgttcctgctttct

SEQ ID NO: 3061804 - DNA, 19 bp, Homo sapiens
tagttgaaaaaagaagttt

SEQ ID NO: 3061805 - DNA, 15 bp, Homo sapiens
tagttgaattccaag

SEQ ID NO: 3061806 - DNA, 13 bp, Homo sapiens
tagttgtattttg

SEQ ID NO: 3061807 - DNA, 17 bp, Homo sapiens
tagttgtgggtgggaga

SEQ ID NO: 3061808 - DNA, 18 bp, Homo sapiens
tagtttaagacttagtta

SEQ ID NO: 3061809 - DNA, 19 bp, Homo sapiens
tagtttaagacttagttat

SEQ ID NO: 3061810 - DNA, 16 bp, Homo sapiens
tagtttcctgccttca

SEQ ID NO: 3061811 - DNA, 18 bp, Homo sapiens
tagtttctgttctgtgga

SEQ ID NO: 3061812 - DNA, 17 bp, Homo sapiens
tagtttgcattcctgat

SEQ ID NO: 3061813 - DNA, 18 bp, Homo sapiens
tagtttgcattcctgata

SEQ ID NO: 3061814 - DNA, 19 bp, Homo sapiens
tagtttgctttgctttgta

SEQ ID NO: 3061815 - DNA, 15 bp, Homo sapiens
tagtttgtttttgtt

SEQ ID NO: 3061816 - DNA, 14 bp, Homo sapiens
tagttttagaggca

SEQ ID NO: 3061817 - DNA, 18 bp, Homo sapiens
tagttttctagatgacat

SEQ ID NO: 3061818 - DNA, 13 bp, Homo sapiens
tagttttcttgtt

SEQ ID NO: 3061819 - DNA, 13 bp, Homo sapiens
tagttttgtcaaa

SEQ ID NO: 3061820 - DNA, 20 bp, Homo sapiens
tataaaacttgataaatgga

SEQ ID NO: 3061821 - DNA, 18 bp, Homo sapiens
tataaaagctatggtgag

SEQ ID NO: 3061822 - DNA, 19 bp, Homo sapiens
tataaaaggcaaatgtgta

SEQ ID NO: 3061823 - DNA, 12 bp, Homo sapiens
tataaaataatg

SEQ ID NO: 3061824 - DNA, 18 bp, Homo sapiens
tataaaatataaacaaag

SEQ ID NO: 3061825 - DNA, 20 bp, Homo sapiens
tataaacagacaatatgtga

SEQ ID NO: 3061826 - DNA, 23 bp, Homo sapiens
tataaacagcagggtttgagcac

SEQ ID NO: 3061827 - DNA, 14 bp, Homo sapiens
tataaacagtttta

SEQ ID NO: 3061828 - DNA, 20 bp, Homo sapiens
tataaacagttttacttgtg

SEQ ID NO: 3061829 - DNA, 17 bp, Homo sapiens
tataaaccgtgtgtcat

SEQ ID NO: 3061830 - DNA, 17 bp, Homo sapiens
tataaagctctcaaatg

SEQ ID NO: 3061831 - DNA, 20 bp, Homo sapiens
tataaagctgttattcttgt

SEQ ID NO: 3061832 - DNA, 22 bp, Homo sapiens
tataaagctgttattcttgtta

SEQ ID NO: 3061833 - DNA, 21 bp, Homo sapiens
tataaagtttttttatttctt

SEQ ID NO: 3061834 - DNA, 13 bp, Homo sapiens
tataaataataat

SEQ ID NO: 3061835 - DNA, 22 bp, Homo sapiens
tataaatacacttcctgcttaa

SEQ ID NO: 3061836 - DNA, 20 bp, Homo sapiens
tataaatactgacaatgtat

SEQ ID NO: 3061837 - DNA, 21 bp, Homo sapiens
tataaatactgacaatgtatt

SEQ ID NO: 3061838 - DNA, 17 bp, Homo sapiens
tataaatatattttctt

SEQ ID NO: 3061839 - DNA, 21 bp, Homo sapiens
tataaatgacaaagtgttgaa

SEQ ID NO: 3061840 - DNA, 18 bp, Homo sapiens
tataaatgccaaagtctt

SEQ ID NO: 3061841 - DNA, 14 bp, Homo sapiens
tataaatgttagtt

SEQ ID NO: 3061842 - DNA, 22 bp, Homo sapiens
tataaatgtttggaaaggttct

SEQ ID NO: 3061843 - DNA, 16 bp, Homo sapiens
tataaattaagaagag

SEQ ID NO: 3061844 - DNA, 17 bp, Homo sapiens
tataaattaatttgtta

SEQ ID NO: 3061845 - DNA, 18 bp, Homo sapiens
tataaattctactaagtt

SEQ ID NO: 3061846 - DNA, 16 bp, Homo sapiens
tataacaaaaaaagaa

SEQ ID NO: 3061847 - DNA, 19 bp, Homo sapiens
tataacagaaagtttgtaa

SEQ ID NO: 3061848 - DNA, 12 bp, Homo sapiens
tataacaggtta

SEQ ID NO: 3061849 - DNA, 11 bp, Homo sapiens
tataacatgaa

SEQ ID NO: 3061850 - DNA, 19 bp, Homo sapiens
tataaccctgttacaaagc

SEQ ID NO: 3061851 - DNA, 11 bp, Homo sapiens
tataagaaaaa

SEQ ID NO: 3061852 - DNA, 13 bp, Homo sapiens
tataagaaagaca

SEQ ID NO: 3061853 - DNA, 14 bp, Homo sapiens
tataagaaagacat

SEQ ID NO: 3061854 - DNA, 17 bp, Homo sapiens
tataagaaagacatctt

SEQ ID NO: 3061855 - DNA, 21 bp, Homo sapiens
tataagcccaaatggctctgt

SEQ ID NO: 3061856 - DNA, 23 bp, Homo sapiens
tataagcccaaatggctctgtga

SEQ ID NO: 3061857 - DNA, 17 bp, Homo sapiens
tataagggagagctgag

SEQ ID NO: 3061858 - DNA, 20 bp, Homo sapiens
tataagggagagctgagcca

SEQ ID NO: 3061859 - DNA, 22 bp, Homo sapiens
tataaggtgttttctgtgtaac

SEQ ID NO: 3061860 - DNA, 15 bp, Homo sapiens
tataagtacttggtc

SEQ ID NO: 3061861 - DNA, 12 bp, Homo sapiens
tataatactact

SEQ ID NO: 3061862 - DNA, 19 bp, Homo sapiens
tataatgacttttaaaatt

SEQ ID NO: 3061863 - DNA, 20 bp, Homo sapiens
tataatgacttttaaaattt

SEQ ID NO: 3061864 - DNA, 20 bp, Homo sapiens
tataattgggtcatagaaat

SEQ ID NO: 3061865 - DNA, 12 bp, Homo sapiens
tataattgtatc

SEQ ID NO: 3061866 - DNA, 23 bp, Homo sapiens
tataatttgatagatgtttgact

SEQ ID NO: 3061867 - DNA, 12 bp, Homo sapiens
tagtaaatacat

SEQ ID NO: 3061868 - DNA, 16 bp, Homo sapiens
tagtaacctttaaaaa

SEQ ID NO: 3061869 - DNA, 17 bp, Homo sapiens
tagtaaggagttcattt

SEQ ID NO: 3061870 - DNA, 14 bp, Homo sapiens
tagtaatcacagtt

SEQ ID NO: 3061871 - DNA, 20 bp, Homo sapiens
tagtaatgctacgtgtgatt

SEQ ID NO: 3061872 - DNA, 15 bp, Homo sapiens
tagtaatgttttata

SEQ ID NO: 3061873 - DNA, 20 bp, Homo sapiens
tagtaatttctttttttcct

SEQ ID NO: 3061874 - DNA, 16 bp, Homo sapiens
tagtacctgaaaagta

SEQ ID NO: 3061875 - DNA, 13 bp, Homo sapiens
tagtaccttgttt

SEQ ID NO: 3061876 - DNA, 19 bp, Homo sapiens
tagtagcggatctcactca

SEQ ID NO: 3061877 - DNA, 16 bp, Homo sapiens
tagtagcttataagag

SEQ ID NO: 3061878 - DNA, 14 bp, Homo sapiens
tagtagtacctttc

SEQ ID NO: 3061879 - DNA, 18 bp, Homo sapiens
tagtagtatgatgataca

SEQ ID NO: 3061880 - DNA, 17 bp, Homo sapiens
tagtagtgcatagaatt

SEQ ID NO: 3061881 - DNA, 14 bp, Homo sapiens
tagtatatgaaata

SEQ ID NO: 3061882 - DNA, 20 bp, Homo sapiens
tagtatatgaaatattttga

SEQ ID NO: 3061883 - DNA, 14 bp, Homo sapiens
tagtattcaggcac

SEQ ID NO: 3061884 - DNA, 19 bp, Homo sapiens
tagtattcaggcactgaga

SEQ ID NO: 3061885 - DNA, 14 bp, Homo sapiens
tagtatttaattgt

SEQ ID NO: 3061886 - DNA, 19 bp, Homo sapiens
tagtatttagtatatgaaa

SEQ ID NO: 3061887 - DNA, 19 bp, Homo sapiens
taccagtgcaggctggcca

SEQ ID NO: 3061888 - DNA, 21 bp, Homo sapiens
taccagtgcaggctggccagc

SEQ ID NO: 3061889 - DNA, 23 bp, Homo sapiens
taccagtgcaggctggccagccg

SEQ ID NO: 3061890 - DNA, 21 bp, Homo sapiens
taccataaaatgtcagcaaat

SEQ ID NO: 3061891 - DNA, 20 bp, Homo sapiens
taccatcactgagttttcca

SEQ ID NO: 3061892 - DNA, 15 bp, Homo sapiens
taccatgatgcatgg

SEQ ID NO: 3061893 - DNA, 23 bp, Homo sapiens
taccatttcctcagcttatctct

SEQ ID NO: 3061894 - DNA, 17 bp, Homo sapiens
taccatttttctggatt

SEQ ID NO: 3061895 - DNA, 21 bp, Homo sapiens
taccattttttaaggaaacaa

SEQ ID NO: 3061896 - DNA, 17 bp, Homo sapiens
tacccaaaacaagcctg

SEQ ID NO: 3061897 - DNA, 14 bp, Homo sapiens
tacccactgccatg

SEQ ID NO: 3061898 - DNA, 20 bp, Homo sapiens
tacccaggctggagtgcagt

SEQ ID NO: 3061899 - DNA, 13 bp, Homo sapiens
tacccatcttgct

SEQ ID NO: 3061900 - DNA, 16 bp, Homo sapiens
tacccatcttgcttcc

SEQ ID NO: 3061901 - DNA, 18 bp, Homo sapiens
tacccatcttgcttccaa

SEQ ID NO: 3061902 - DNA, 17 bp, Homo sapiens
taccccctccttcagac

SEQ ID NO: 3061903 - DNA, 13 bp, Homo sapiens
taccccctttccc

SEQ ID NO: 3061904 - DNA, 17 bp, Homo sapiens
taccccctttcccttct

SEQ ID NO: 3061905 - DNA, 12 bp, Homo sapiens
tacccctgccct

SEQ ID NO: 3061906 - DNA, 14 bp, Homo sapiens
tacccctgccctgc

SEQ ID NO: 3061907 - DNA, 22 bp, Homo sapiens
tacccgtgcctgggcccctccc

SEQ ID NO: 3061908 - DNA, 15 bp, Homo sapiens
taccctagttctctt

SEQ ID NO: 3061909 - DNA, 18 bp, Homo sapiens
taccctcctctatttctt

SEQ ID NO: 3061910 - DNA, 20 bp, Homo sapiens
tagctgacgccaataataaa

SEQ ID NO: 3061911 - DNA, 16 bp, Homo sapiens
tagctgaggctgagaa

SEQ ID NO: 3061912 - DNA, 21 bp, Homo sapiens
tagctgaggctgagaaagcta

SEQ ID NO: 3061913 - DNA, 21 bp, Homo sapiens
tagctgatgaacttattctgt

SEQ ID NO: 3061914 - DNA, 23 bp, Homo sapiens
tagctgatgaacttattctgtag

SEQ ID NO: 3061915 - DNA, 16 bp, Homo sapiens
tagctgccaagcccca

SEQ ID NO: 3061916 - DNA, 21 bp, Homo sapiens
tagctgccaagccccatcctg

SEQ ID NO: 3061917 - DNA, 15 bp, Homo sapiens
tagctgcccatttcg

SEQ ID NO: 3061918 - DNA, 12 bp, Homo sapiens
tagctgctacaa

SEQ ID NO: 3061919 - DNA, 17 bp, Homo sapiens
tacagatactgtgagct

SEQ ID NO: 3061920 - DNA, 18 bp, Homo sapiens
tacagatatttttctcca

SEQ ID NO: 3061921 - DNA, 23 bp, Homo sapiens
tacagatctgcaccaccatgccc

SEQ ID NO: 3061922 - DNA, 17 bp, Homo sapiens
tacagcacatcacctct

SEQ ID NO: 3061923 - DNA, 14 bp, Homo sapiens
tacagcagtagaca

SEQ ID NO: 3061924 - DNA, 16 bp, Homo sapiens
tacagcagtagacatt

SEQ ID NO: 3061925 - DNA, 20 bp, Homo sapiens
tacagcagtagacattttaa

SEQ ID NO: 3061926 - DNA, 20 bp, Homo sapiens
tacagcctgaataaaccaag

SEQ ID NO: 3061927 - DNA, 13 bp, Homo sapiens
tacagccttattt

SEQ ID NO: 3061928 - DNA, 16 bp, Homo sapiens
tacagctatgaagaaa

SEQ ID NO: 3061929 - DNA, 13 bp, Homo sapiens
tacagctctgact

SEQ ID NO: 3061930 - DNA, 14 bp, Homo sapiens
tacagctgtatata

SEQ ID NO: 3061931 - DNA, 15 bp, Homo sapiens
tacagcttatttttt

SEQ ID NO: 3061932 - DNA, 12 bp, Homo sapiens
tacagctttctg

SEQ ID NO: 3061933 - DNA, 23 bp, Homo sapiens
tacagctttctgaccttcagctc

SEQ ID NO: 3061934 - DNA, 19 bp, Homo sapiens
tacagctttgatccctgac

SEQ ID NO: 3061935 - DNA, 15 bp, Homo sapiens
tacagctttgggtca

SEQ ID NO: 3061936 - DNA, 19 bp, Homo sapiens
tacaggagacccaacaatg

SEQ ID NO: 3061937 - DNA, 17 bp, Homo sapiens
tacagggatggtgttca

SEQ ID NO: 3061938 - DNA, 23 bp, Homo sapiens
tacaggggggtcggaagcctgtc

SEQ ID NO: 3061939 - DNA, 21 bp, Homo sapiens
tacaggttacaacagatttgt

SEQ ID NO: 3061940 - DNA, 18 bp, Homo sapiens
tacagtaactttatgtgt

SEQ ID NO: 3061941 - DNA, 18 bp, Homo sapiens
tacagtacacagatacct

SEQ ID NO: 3061942 - DNA, 22 bp, Homo sapiens
tacagtaggagcccagctctga

SEQ ID NO: 3061943 - DNA, 21 bp, Homo sapiens
tacagtatattcttgtaaata

SEQ ID NO: 3061944 - DNA, 22 bp, Homo sapiens
tacagtatttttcagatataaa

SEQ ID NO: 3061945 - DNA, 13 bp, Homo sapiens
tacagtcattatt

SEQ ID NO: 3061946 - DNA, 17 bp, Homo sapiens
tacagtctcaattttgt

SEQ ID NO: 3061947 - DNA, 19 bp, Homo sapiens
tacagtctcaattttgtat

SEQ ID NO: 3061948 - DNA, 20 bp, Homo sapiens
tacagtctcaattttgtatt

SEQ ID NO: 3061949 - DNA, 12 bp, Homo sapiens
tacagtctgtct

SEQ ID NO: 3061950 - DNA, 19 bp, Homo sapiens
tacagtctgtcttctgtat

SEQ ID NO: 3061951 - DNA, 20 bp, Homo sapiens
tacagtcttccatttgcaag

SEQ ID NO: 3061952 - DNA, 13 bp, Homo sapiens
tacagtgatatgg

SEQ ID NO: 3061953 - DNA, 22 bp, Homo sapiens
tacagtggtgccatcattgctg

SEQ ID NO: 3061954 - DNA, 13 bp, Homo sapiens
tacagtgtacatg

SEQ ID NO: 3061955 - DNA, 15 bp, Homo sapiens
tacagtgtacatgta

SEQ ID NO: 3061956 - DNA, 22 bp, Homo sapiens
tacagttagggttttgcaataa

SEQ ID NO: 3061957 - DNA, 18 bp, Homo sapiens
tacagttatcctgcaagg

SEQ ID NO: 3061958 - DNA, 17 bp, Homo sapiens
tacagttgaaataactg

SEQ ID NO: 3061959 - DNA, 17 bp, Homo sapiens
tacagttgcaggagcgt

SEQ ID NO: 3061960 - DNA, 19 bp, Homo sapiens
tacagttgcaggagcgtga

SEQ ID NO: 3061961 - DNA, 17 bp, Homo sapiens
tacagtttataaagcca

SEQ ID NO: 3061962 - DNA, 23 bp, Homo sapiens
tacagtttgtgctctactgttac

SEQ ID NO: 3061963 - DNA, 18 bp, Homo sapiens
tacagttttgtggactga

SEQ ID NO: 3061964 - DNA, 19 bp, Homo sapiens
tacagttttgtggactgag

SEQ ID NO: 3061965 - DNA, 18 bp, Homo sapiens
tacataaactgtctcatt

SEQ ID NO: 3061966 - DNA, 19 bp, Homo sapiens
tacataactgatctattta

SEQ ID NO: 3061967 - DNA, 22 bp, Homo sapiens
tacataagagaaagaggccaga

SEQ ID NO: 3061968 - DNA, 12 bp, Homo sapiens
tacataatctgt

SEQ ID NO: 3061969 - DNA, 16 bp, Homo sapiens
tacataattcactctg

SEQ ID NO: 3061970 - DNA, 14 bp, Homo sapiens
tacataattgatta

SEQ ID NO: 3061971 - DNA, 15 bp, Homo sapiens
tacataattgattaa

SEQ ID NO: 3061972 - DNA, 18 bp, Homo sapiens
tacataattgattaaaat

SEQ ID NO: 3061973 - DNA, 16 bp, Homo sapiens
tacataattgtgacca

SEQ ID NO: 3061974 - DNA, 15 bp, Homo sapiens
tacatacaccagcat

SEQ ID NO: 3061975 - DNA, 20 bp, Homo sapiens
tacatacagaattactgtaa

SEQ ID NO: 3061976 - DNA, 19 bp, Homo sapiens
tacatacagagattgtagt

SEQ ID NO: 3061977 - DNA, 23 bp, Homo sapiens
tacatagcatgacatttctttgt

SEQ ID NO: 3061978 - DNA, 21 bp, Homo sapiens
tacatatgtagaaacatttag

SEQ ID NO: 3061979 - DNA, 14 bp, Homo sapiens
tacatattctttaa

SEQ ID NO: 3061980 - DNA, 21 bp, Homo sapiens
tacatattgcaggagacattt

SEQ ID NO: 3061981 - DNA, 23 bp, Homo sapiens
tacatattgcaggagacattttc

SEQ ID NO: 3061982 - DNA, 19 bp, Homo sapiens
tacatccaaagcagacagc

SEQ ID NO: 3061983 - DNA, 19 bp, Homo sapiens
tacatctattttggattgt

SEQ ID NO: 3061984 - DNA, 22 bp, Homo sapiens
tacatctattttggattgtata

SEQ ID NO: 3061985 - DNA, 19 bp, Homo sapiens
tacatctgcaatatgaatt

SEQ ID NO: 3061986 - DNA, 20 bp, Homo sapiens
tacatctgtgcagggctggt

SEQ ID NO: 3061987 - DNA, 15 bp, Homo sapiens
tacatctttcacatt

SEQ ID NO: 3061988 - DNA, 20 bp, Homo sapiens
tacatctttcacattggcta

SEQ ID NO: 3061989 - DNA, 18 bp, Homo sapiens
tacatgaaatttttgtaa

SEQ ID NO: 3061990 - DNA, 20 bp, Homo sapiens
tacatgaaatttttgtaaat

SEQ ID NO: 3061991 - DNA, 19 bp, Homo sapiens
tacatgacatcaaaatgag

SEQ ID NO: 3061992 - DNA, 21 bp, Homo sapiens
tacatgacatttatttttcat

SEQ ID NO: 3061993 - DNA, 19 bp, Homo sapiens
tacatgaggaactgtagat

SEQ ID NO: 3061994 - DNA, 21 bp, Homo sapiens
tacatgcatacttcaaaagta

SEQ ID NO: 3061995 - DNA, 22 bp, Homo sapiens
tacatgcattgagctctctcat

SEQ ID NO: 3061996 - DNA, 15 bp, Homo sapiens
tacatgctgcgcatg

SEQ ID NO: 3061997 - DNA, 16 bp, Homo sapiens
tacatggacagaattt

SEQ ID NO: 3061998 - DNA, 19 bp, Homo sapiens
tacatggcagagtttgtgt

SEQ ID NO: 3061999 - DNA, 20 bp, Homo sapiens
tacatgtaactatttcttca

SEQ ID NO: 3062000 - DNA, 19 bp, Homo sapiens
tacatgttattgttttcaa

SEQ ID NO: 3062001 - DNA, 15 bp, Homo sapiens
tacatgttcccaaaa

SEQ ID NO: 3062002 - DNA, 13 bp, Homo sapiens
tacatgtttataa

SEQ ID NO: 3062003 - DNA, 15 bp, Homo sapiens
tacatgtttataaat

SEQ ID NO: 3062004 - DNA, 13 bp, Homo sapiens
tacatgtttgcac

SEQ ID NO: 3062005 - DNA, 13 bp, Homo sapiens
tacattaaaaagc

SEQ ID NO: 3062006 - DNA, 21 bp, Homo sapiens
tacattaaaaagccttacagt

SEQ ID NO: 3062007 - DNA, 15 bp, Homo sapiens
tacattaaggagcag

SEQ ID NO: 3062008 - DNA, 15 bp, Homo sapiens
tacattaatgcccag

SEQ ID NO: 3062009 - DNA, 21 bp, Homo sapiens
tacattaatgcccagccagcc

SEQ ID NO: 3062010 - DNA, 15 bp, Homo sapiens
tacattcatttagct

SEQ ID NO: 3062011 - DNA, 14 bp, Homo sapiens
tacattccaactcg

SEQ ID NO: 3062012 - DNA, 12 bp, Homo sapiens
tacattgaaaac

SEQ ID NO: 3062013 - DNA, 16 bp, Homo sapiens
tacattgtgaaacttc

SEQ ID NO: 3062014 - DNA, 13 bp, Homo sapiens
tacattgttgagc

SEQ ID NO: 3062015 - DNA, 23 bp, Homo sapiens
tacattgttgagctattgctgtt

SEQ ID NO: 3062016 - DNA, 13 bp, Homo sapiens
tacatttaaacaa

SEQ ID NO: 3062017 - DNA, 22 bp, Homo sapiens
tacatttcttagactacattta

SEQ ID NO: 3062018 - DNA, 19 bp, Homo sapiens
tacatttgatgcatgtctt

SEQ ID NO: 3062019 - DNA, 14 bp, Homo sapiens
tacatttggaacta

SEQ ID NO: 3062020 - DNA, 15 bp, Homo sapiens
tacatttgtttgtat

SEQ ID NO: 3062021 - DNA, 17 bp, Homo sapiens
tacatttgtttgtattc

SEQ ID NO: 3062022 - DNA, 18 bp, Homo sapiens
tacatttgtttgtattca

SEQ ID NO: 3062023 - DNA, 22 bp, Homo sapiens
tacatttgtttgtattcatgtt

SEQ ID NO: 3062024 - DNA, 18 bp, Homo sapiens
tacattttggatttcttt

SEQ ID NO: 3062025 - DNA, 20 bp, Homo sapiens
tacattttggatttctttat

SEQ ID NO: 3062026 - DNA, 19 bp, Homo sapiens
tacatttttcaactttgaa

SEQ ID NO: 3062027 - DNA, 14 bp, Homo sapiens
taccaaacagcaaa

SEQ ID NO: 3062028 - DNA, 20 bp, Homo sapiens
taccaaagtgtcttttgaca

SEQ ID NO: 3062029 - DNA, 16 bp, Homo sapiens
taccaaatacacattt

SEQ ID NO: 3062030 - DNA, 21 bp, Homo sapiens
taccaaatacacatttcacat

SEQ ID NO: 3062031 - DNA, 22 bp, Homo sapiens
taccaaatacacatttcacatt

SEQ ID NO: 3062032 - DNA, 15 bp, Homo sapiens
taccaacatgtatct

SEQ ID NO: 3062033 - DNA, 13 bp, Homo sapiens
taccaagccaccg

SEQ ID NO: 3062034 - DNA, 14 bp, Homo sapiens
taccaagccaccgc

SEQ ID NO: 3062035 - DNA, 17 bp, Homo sapiens
taccacaccctgcctgc

SEQ ID NO: 3062036 - DNA, 23 bp, Homo sapiens
taccacagagttttttaaacaaa

SEQ ID NO: 3062037 - DNA, 13 bp, Homo sapiens
taccacagtttct

SEQ ID NO: 3062038 - DNA, 18 bp, Homo sapiens
taccacagtttcttctgt

SEQ ID NO: 3062039 - DNA, 10 bp, Homo sapiens
taccacctcc

SEQ ID NO: 3062040 - DNA, 16 bp, Homo sapiens
taccacgccttgacct

SEQ ID NO: 3062041 - DNA, 13 bp, Homo sapiens
taccactcctgcc

SEQ ID NO: 3062042 - DNA, 21 bp, Homo sapiens
taccacttttcattgcaaagt

SEQ ID NO: 3062043 - DNA, 18 bp, Homo sapiens
taccagagttaaagcata

SEQ ID NO: 3062044 - DNA, 15 bp, Homo sapiens
taccagataaaatta

SEQ ID NO: 3062045 - DNA, 23 bp, Homo sapiens
taccagatagctcaatactctct

SEQ ID NO: 3062046 - DNA, 12 bp, Homo sapiens
taccagatgcag

SEQ ID NO: 3062047 - DNA, 22 bp, Homo sapiens
taccagcaaagagaatgtattt

SEQ ID NO: 3062048 - DNA, 20 bp, Homo sapiens
taccagcgaggaggctccag

SEQ ID NO: 3062049 - DNA, 15 bp, Homo sapiens
taccaggataaagcc

SEQ ID NO: 3062050 - DNA, 19 bp, Homo sapiens
taccaggcacatggctggg

SEQ ID NO: 3062051 - DNA, 20 bp, Homo sapiens
taccaggcacatggctgggg

SEQ ID NO: 3062052 - DNA, 13 bp, Homo sapiens
taccagtgaattt

SEQ ID NO: 3062053 - DNA, 20 bp, Homo sapiens
taccagtgaatttttgcaat

SEQ ID NO: 3062054 - DNA, 18 bp, Homo sapiens
taccagtgcaggctggcc

SEQ ID NO: 3062055 - DNA, 11 bp, Homo sapiens
taattgtacaa

SEQ ID NO: 3062056 - DNA, 23 bp, Homo sapiens
taattgtactaaagccaaacata

SEQ ID NO: 3062057 - DNA, 16 bp, Homo sapiens
taattgtataacaggt

SEQ ID NO: 3062058 - DNA, 13 bp, Homo sapiens
taattgtatcgta

SEQ ID NO: 3062059 - DNA, 15 bp, Homo sapiens
taattgtatcgtata

SEQ ID NO: 3062060 - DNA, 23 bp, Homo sapiens
taattgtatcgtatagctgtatt

SEQ ID NO: 3062061 - DNA, 21 bp, Homo sapiens
taattgtgaaaaagttaaaca

SEQ ID NO: 3062062 - DNA, 20 bp, Homo sapiens
taattgtgaccaatacattt

SEQ ID NO: 3062063 - DNA, 13 bp, Homo sapiens
taattgtgtaaaa

SEQ ID NO: 3062064 - DNA, 14 bp, Homo sapiens
taattgttccttgc

SEQ ID NO: 3062065 - DNA, 16 bp, Homo sapiens
taattgtttcaaaaaa

SEQ ID NO: 3062066 - DNA, 19 bp, Homo sapiens
taatttaaaacttttgttt

SEQ ID NO: 3062067 - DNA, 21 bp, Homo sapiens
taatttacaaaaatataaaat

SEQ ID NO: 3062068 - DNA, 22 bp, Homo sapiens
taatttacaaaaatataaaata

SEQ ID NO: 3062069 - DNA, 21 bp, Homo sapiens
taatttagaatggttgagtta

SEQ ID NO: 3062070 - DNA, 19 bp, Homo sapiens
taatttagtcccttaaaaa

SEQ ID NO: 3062071 - DNA, 12 bp, Homo sapiens
taatttatagta

SEQ ID NO: 3062072 - DNA, 22 bp, Homo sapiens
taatttatagtaatgagtttaa

SEQ ID NO: 3062073 - DNA, 14 bp, Homo sapiens
taatttatcagtac

SEQ ID NO: 3062074 - DNA, 14 bp, Homo sapiens
taatttatgcagaa

SEQ ID NO: 3062075 - DNA, 18 bp, Homo sapiens
taatttattaattgcttt

SEQ ID NO: 3062076 - DNA, 19 bp, Homo sapiens
taatttattaattgctttg

SEQ ID NO: 3062077 - DNA, 20 bp, Homo sapiens
taatttattaattgctttga

SEQ ID NO: 3062078 - DNA, 15 bp, Homo sapiens
taatttattttgctc

SEQ ID NO: 3062079 - DNA, 17 bp, Homo sapiens
taatttcaaatctgtaa

SEQ ID NO: 3062080 - DNA, 14 bp, Homo sapiens
taatttcagttcta

SEQ ID NO: 3062081 - DNA, 17 bp, Homo sapiens
taatttctttgcctgtt

SEQ ID NO: 3062082 - DNA, 13 bp, Homo sapiens
taatttgaacttt

SEQ ID NO: 3062083 - DNA, 22 bp, Homo sapiens
taatttgagatcgtccactgtc

SEQ ID NO: 3062084 - DNA, 23 bp, Homo sapiens
taatttgagatcgtccactgtca

SEQ ID NO: 3062085 - DNA, 16 bp, Homo sapiens
taatttgatagatgtt

SEQ ID NO: 3062086 - DNA, 17 bp, Homo sapiens
taatttgatgaggtatt

SEQ ID NO: 3062087 - DNA, 17 bp, Homo sapiens
taatttgcattaaattc

SEQ ID NO: 3062088 - DNA, 15 bp, Homo sapiens
taatttggataataa

SEQ ID NO: 3062089 - DNA, 17 bp, Homo sapiens
taatttgtttaaaattc

SEQ ID NO: 3062090 - DNA, 19 bp, Homo sapiens
taatttgtttaaaattctc

SEQ ID NO: 3062091 - DNA, 15 bp, Homo sapiens
taattttaaaaatgg

SEQ ID NO: 3062092 - DNA, 17 bp, Homo sapiens
taattttcctaataaag

SEQ ID NO: 3062093 - DNA, 21 bp, Homo sapiens
taattttggttgtattctttg

SEQ ID NO: 3062094 - DNA, 22 bp, Homo sapiens
taattttggttgtattctttga

SEQ ID NO: 3062095 - DNA, 20 bp, Homo sapiens
taattttgtgctctttcctg

SEQ ID NO: 3062096 - DNA, 17 bp, Homo sapiens
taatttttaaaagactt

SEQ ID NO: 3062097 - DNA, 18 bp, Homo sapiens
taatttttaaaagacttt

SEQ ID NO: 3062098 - DNA, 21 bp, Homo sapiens
taatttttaaaagactttgat

SEQ ID NO: 3062099 - DNA, 13 bp, Homo sapiens
taatttttccttc

SEQ ID NO: 3062100 - DNA, 14 bp, Homo sapiens
taattttttaatta

SEQ ID NO: 3062101 - DNA, 15 bp, Homo sapiens
taattttttggtaca

SEQ ID NO: 3062102 - DNA, 17 bp, Homo sapiens
taattttttggtacaaa

SEQ ID NO: 3062103 - DNA, 16 bp, Homo sapiens
taatttttttaagttc

SEQ ID NO: 3062104 - DNA, 14 bp, Homo sapiens
taatttttttaatt

SEQ ID NO: 3062105 - DNA, 16 bp, Homo sapiens
taattttttttagtat

SEQ ID NO: 3062106 - DNA, 16 bp, Homo sapiens
tacaaaaaataaaata

SEQ ID NO: 3062107 - DNA, 18 bp, Homo sapiens
tacaaaaaggtataaata

SEQ ID NO: 3062108 - DNA, 23 bp, Homo sapiens
tacaaaaaggtataaataataat

SEQ ID NO: 3062109 - DNA, 14 bp, Homo sapiens
tacaaaaataaatt

SEQ ID NO: 3062110 - DNA, 15 bp, Homo sapiens
tacaaaaataaattt

SEQ ID NO: 3062111 - DNA, 16 bp, Homo sapiens
tacaaaaatcagccag

SEQ ID NO: 3062112 - DNA, 19 bp, Homo sapiens
tacaaaaatcagccagaca

SEQ ID NO: 3062113 - DNA, 22 bp, Homo sapiens
tacaaaaatttgccaggcgtgg

SEQ ID NO: 3062114 - DNA, 19 bp, Homo sapiens
tacaaaataaagctgttct

SEQ ID NO: 3062115 - DNA, 21 bp, Homo sapiens
tacaaaatgagattcagtgaa

SEQ ID NO: 3062116 - DNA, 20 bp, Homo sapiens
tacaaacgtatggaatgctt

SEQ ID NO: 3062117 - DNA, 21 bp, Homo sapiens
tacaaacgtatggaatgcttc

SEQ ID NO: 3062118 - DNA, 16 bp, Homo sapiens
tacaaactaaggtgct

SEQ ID NO: 3062119 - DNA, 14 bp, Homo sapiens
tacaaagaaaataa

SEQ ID NO: 3062120 - DNA, 18 bp, Homo sapiens
tacaaagaagacatgttt

SEQ ID NO: 3062121 - DNA, 19 bp, Homo sapiens
tacaaagaagacatgtttt

SEQ ID NO: 3062122 - DNA, 19 bp, Homo sapiens
tacaaagagatgcttggag

SEQ ID NO: 3062123 - DNA, 18 bp, Homo sapiens
tacaaaggggaaagaaca

SEQ ID NO: 3062124 - DNA, 23 bp, Homo sapiens
tacaaaggggaaagaacataaag

SEQ ID NO: 3062125 - DNA, 16 bp, Homo sapiens
tacaaatcaagtattt

SEQ ID NO: 3062126 - DNA, 16 bp, Homo sapiens
tacaaatctgtataaa

SEQ ID NO: 3062127 - DNA, 21 bp, Homo sapiens
tacaaattaatatttgtgctt

SEQ ID NO: 3062128 - DNA, 14 bp, Homo sapiens
tacaaattttcact

SEQ ID NO: 3062129 - DNA, 15 bp, Homo sapiens
tacaaattttcactg

SEQ ID NO: 3062130 - DNA, 14 bp, Homo sapiens
tacaacaaacactg

SEQ ID NO: 3062131 - DNA, 14 bp, Homo sapiens
tacaacagatttgt

SEQ ID NO: 3062132 - DNA, 17 bp, Homo sapiens
tacaacagatttgtgaa

SEQ ID NO: 3062133 - DNA, 20 bp, Homo sapiens
tacaacagatttgtgaactc

SEQ ID NO: 3062134 - DNA, 14 bp, Homo sapiens
tacaacagtgctaa

SEQ ID NO: 3062135 - DNA, 16 bp, Homo sapiens
tacaacttaatggaaa

SEQ ID NO: 3062136 - DNA, 14 bp, Homo sapiens
tacaagcaacagca

SEQ ID NO: 3062137 - DNA, 15 bp, Homo sapiens
tacaagccccccctt

SEQ ID NO: 3062138 - DNA, 19 bp, Homo sapiens
tacaagcccccccttccac

SEQ ID NO: 3062139 - DNA, 17 bp, Homo sapiens
tacaagctcttgtttct

SEQ ID NO: 3062140 - DNA, 19 bp, Homo sapiens
tacaaggcaggcctttcct

SEQ ID NO: 3062141 - DNA, 20 bp, Homo sapiens
tacaaggcaggcctttccta

SEQ ID NO: 3062142 - DNA, 18 bp, Homo sapiens
tacaagggtctagggaga

SEQ ID NO: 3062143 - DNA, 14 bp, Homo sapiens
tacaagtaactcag

SEQ ID NO: 3062144 - DNA, 19 bp, Homo sapiens
tacaagttaaggtatctgg

SEQ ID NO: 3062145 - DNA, 16 bp, Homo sapiens
tacaagttctttttaa

SEQ ID NO: 3062146 - DNA, 13 bp, Homo sapiens
tacaataaactgg

SEQ ID NO: 3062147 - DNA, 15 bp, Homo sapiens
tacaataaactggta

SEQ ID NO: 3062148 - DNA, 14 bp, Homo sapiens
tacaataatggaaa

SEQ ID NO: 3062149 - DNA, 16 bp, Homo sapiens
tacaatattttattct

SEQ ID NO: 3062150 - DNA, 23 bp, Homo sapiens
tacaatctttattatgcattctt

SEQ ID NO: 3062151 - DNA, 16 bp, Homo sapiens
tacaatgggaaaagag

SEQ ID NO: 3062152 - DNA, 18 bp, Homo sapiens
tacaatgtatttatttaa

SEQ ID NO: 3062153 - DNA, 15 bp, Homo sapiens
tacaattatatcagt

SEQ ID NO: 3062154 - DNA, 22 bp, Homo sapiens
tacaattatttttacagttctc

SEQ ID NO: 3062155 - DNA, 22 bp, Homo sapiens
tacaattcattgttttgcaaaa

SEQ ID NO: 3062156 - DNA, 16 bp, Homo sapiens
tacaattgaaatgact

SEQ ID NO: 3062157 - DNA, 16 bp, Homo sapiens
tacacaacatgtatgt

SEQ ID NO: 3062158 - DNA, 21 bp, Homo sapiens
tacacaacatgtatgtggata

SEQ ID NO: 3062159 - DNA, 12 bp, Homo sapiens
tacacacacaca

SEQ ID NO: 3062160 - DNA, 14 bp, Homo sapiens
tacacacacacaca

SEQ ID NO: 3062161 - DNA, 22 bp, Homo sapiens
tacacacatgtatattcttcct

SEQ ID NO: 3062162 - DNA, 17 bp, Homo sapiens
tacacacctaagggaca

SEQ ID NO: 3062163 - DNA, 15 bp, Homo sapiens
tacacagaaacactg

SEQ ID NO: 3062164 - DNA, 14 bp, Homo sapiens
tacaccacacacaa

SEQ ID NO: 3062165 - DNA, 16 bp, Homo sapiens
tacaccacacacaaca

SEQ ID NO: 3062166 - DNA, 20 bp, Homo sapiens
tacaccagagataatatgag

SEQ ID NO: 3062167 - DNA, 20 bp, Homo sapiens
tacaccagcattccttttga

SEQ ID NO: 3062168 - DNA, 15 bp, Homo sapiens
tacacccttttccag

SEQ ID NO: 3062169 - DNA, 17 bp, Homo sapiens
tacacgtatctcttggt

SEQ ID NO: 3062170 - DNA, 14 bp, Homo sapiens
tacactcattgaaa

SEQ ID NO: 3062171 - DNA, 22 bp, Homo sapiens
tacactggaggagagaagaatg

SEQ ID NO: 3062172 - DNA, 15 bp, Homo sapiens
tacactgtgtctcta

SEQ ID NO: 3062173 - DNA, 19 bp, Homo sapiens
tacactgtgtctctatgtg

SEQ ID NO: 3062174 - DNA, 20 bp, Homo sapiens
tacactgtgtctctatgtga

SEQ ID NO: 3062175 - DNA, 22 bp, Homo sapiens
tacactgtgtctctatgtgaat

SEQ ID NO: 3062176 - DNA, 16 bp, Homo sapiens
tacacttcctgcttaa

SEQ ID NO: 3062177 - DNA, 22 bp, Homo sapiens
tacacttgtgtttaagcaccat

SEQ ID NO: 3062178 - DNA, 14 bp, Homo sapiens
tacagaaactgatg

SEQ ID NO: 3062179 - DNA, 15 bp, Homo sapiens
tacagaaactgatgc

SEQ ID NO: 3062180 - DNA, 16 bp, Homo sapiens
tacagaaactgatgcc

SEQ ID NO: 3062181 - DNA, 10 bp, Homo sapiens
tacagaaagt

SEQ ID NO: 3062182 - DNA, 24 bp, Homo sapiens
tacagaaagtggtgctcagttgta

SEQ ID NO: 3062183 - DNA, 16 bp, Homo sapiens
tacagaactctttcaa

SEQ ID NO: 3062184 - DNA, 17 bp, Homo sapiens
tacagaactctttcaaa

SEQ ID NO: 3062185 - DNA, 19 bp, Homo sapiens
tacagacaaggcaggcctg

SEQ ID NO: 3062186 - DNA, 17 bp, Homo sapiens
tacagacagacatacat

SEQ ID NO: 3062187 - DNA, 23 bp, Homo sapiens
tacagacagacatacatagacat

SEQ ID NO: 3062188 - DNA, 13 bp, Homo sapiens
tacagacatattt

SEQ ID NO: 3062189 - DNA, 18 bp, Homo sapiens
tacagacatatttaactg

SEQ ID NO: 3062190 - DNA, 13 bp, Homo sapiens
tacagaggggaca

SEQ ID NO: 3062191 - DNA, 22 bp, Homo sapiens
tacagataagtgttcttcagtg

SEQ ID NO: 3062192 - DNA, 19 bp, Homo sapiens
taatagctttagtgaatta

SEQ ID NO: 3062193 - DNA, 16 bp, Homo sapiens
taatagcttttgatta

SEQ ID NO: 3062194 - DNA, 15 bp, Homo sapiens
taatagggaatatat

SEQ ID NO: 3062195 - DNA, 15 bp, Homo sapiens
taatagtgttaatca

SEQ ID NO: 3062196 - DNA, 10 bp, Homo sapiens
taatatatat

SEQ ID NO: 3062197 - DNA, 14 bp, Homo sapiens
taatatatatattt

SEQ ID NO: 3062198 - DNA, 20 bp, Homo sapiens
taatatatcctgaaagcatt

SEQ ID NO: 3062199 - DNA, 24 bp, Homo sapiens
taatatccaggtcaacagaatgaa

SEQ ID NO: 3062200 - DNA, 21 bp, Homo sapiens
taatatgattctagtacataa

SEQ ID NO: 3062201 - DNA, 15 bp, Homo sapiens
taatatgttgacttt

SEQ ID NO: 3062202 - DNA, 17 bp, Homo sapiens
taatattaaaagtcaca

SEQ ID NO: 3062203 - DNA, 16 bp, Homo sapiens
taatattagcttgctt

SEQ ID NO: 3062204 - DNA, 23 bp, Homo sapiens
taatattattactgttgataatt

SEQ ID NO: 3062205 - DNA, 14 bp, Homo sapiens
taatattctctgat

SEQ ID NO: 3062206 - DNA, 17 bp, Homo sapiens
taatatttccaatgtga

SEQ ID NO: 3062207 - DNA, 23 bp, Homo sapiens
taatatttccaatgtgaaagatt

SEQ ID NO: 3062208 - DNA, 18 bp, Homo sapiens
taatatttcttcaagtga

SEQ ID NO: 3062209 - DNA, 22 bp, Homo sapiens
taatcaactgtaggttatttaa

SEQ ID NO: 3062210 - DNA, 10 bp, Homo sapiens
taatcaagat

SEQ ID NO: 3062211 - DNA, 21 bp, Homo sapiens
taatcaagtagaacaaaaact

SEQ ID NO: 3062212 - DNA, 15 bp, Homo sapiens
taatcagcaataaaa

SEQ ID NO: 3062213 - DNA, 16 bp, Homo sapiens
taatcagctgttgcag

SEQ ID NO: 3062214 - DNA, 22 bp, Homo sapiens
taatcagctgttgcaggcagtg

SEQ ID NO: 3062215 - DNA, 14 bp, Homo sapiens
taatcagtgactga

SEQ ID NO: 3062216 - DNA, 13 bp, Homo sapiens
taatcagtgttga

SEQ ID NO: 3062217 - DNA, 15 bp, Homo sapiens
taatcatatttgaaa

SEQ ID NO: 3062218 - DNA, 17 bp, Homo sapiens
taatcatgaaattactt

SEQ ID NO: 3062219 - DNA, 18 bp, Homo sapiens
taatcatgaaattactta

SEQ ID NO: 3062220 - DNA, 21 bp, Homo sapiens
taatcatgaaattacttatca

SEQ ID NO: 3062221 - DNA, 13 bp, Homo sapiens
taatcatgtgaaa

SEQ ID NO: 3062222 - DNA, 18 bp, Homo sapiens
taatcatgtgaaatgttt

SEQ ID NO: 3062223 - DNA, 19 bp, Homo sapiens
taatcatttgatttaaaca

SEQ ID NO: 3062224 - DNA, 20 bp, Homo sapiens
taatcatttgatttaaacaa

SEQ ID NO: 3062225 - DNA, 13 bp, Homo sapiens
taatcatttgttt

SEQ ID NO: 3062226 - DNA, 14 bp, Homo sapiens
taatcatttgttta

SEQ ID NO: 3062227 - DNA, 23 bp, Homo sapiens
taatcattttagaattaaaattt

SEQ ID NO: 3062228 - DNA, 12 bp, Homo sapiens
taatcattttca

SEQ ID NO: 3062229 - DNA, 19 bp, Homo sapiens
taatccaatacctcttgga

SEQ ID NO: 3062230 - DNA, 19 bp, Homo sapiens
taatccaggcagatccagg

SEQ ID NO: 3062231 - DNA, 23 bp, Homo sapiens
taatccaggcagatccaggacta

SEQ ID NO: 3062232 - DNA, 13 bp, Homo sapiens
taatcccagcact

SEQ ID NO: 3062233 - DNA, 15 bp, Homo sapiens
taatcccagctactg

SEQ ID NO: 3062234 - DNA, 14 bp, Homo sapiens
taatccctgggcat

SEQ ID NO: 3062235 - DNA, 22 bp, Homo sapiens
taatccctgggcattgctttcc

SEQ ID NO: 3062236 - DNA, 19 bp, Homo sapiens
taatccgaatctctttttg

SEQ ID NO: 3062237 - DNA, 21 bp, Homo sapiens
taatccgaatctctttttgct

SEQ ID NO: 3062238 - DNA, 23 bp, Homo sapiens
taatctatatgattaaagaaaat

SEQ ID NO: 3062239 - DNA, 15 bp, Homo sapiens
taatctcgtttcaaa

SEQ ID NO: 3062240 - DNA, 16 bp, Homo sapiens
taatctcgtttcaaaa

SEQ ID NO: 3062241 - DNA, 19 bp, Homo sapiens
taatctcgtttcaaaaaca

SEQ ID NO: 3062242 - DNA, 20 bp, Homo sapiens
taatctgaggatgagacagg

SEQ ID NO: 3062243 - DNA, 14 bp, Homo sapiens
taatctgtgtacaa

SEQ ID NO: 3062244 - DNA, 12 bp, Homo sapiens
taatctgttgtt

SEQ ID NO: 3062245 - DNA, 15 bp, Homo sapiens
taatcttgctctgct

SEQ ID NO: 3062246 - DNA, 22 bp, Homo sapiens
taatctttcacttgaaagattt

SEQ ID NO: 3062247 - DNA, 13 bp, Homo sapiens
taatcttttacat

SEQ ID NO: 3062248 - DNA, 15 bp, Homo sapiens
taatcttttacattg

SEQ ID NO: 3062249 - DNA, 14 bp, Homo sapiens
taatgaaacttgga

SEQ ID NO: 3062250 - DNA, 14 bp, Homo sapiens
taatgaaataatca

SEQ ID NO: 3062251 - DNA, 20 bp, Homo sapiens
taatgaaggtgtgctacaga

SEQ ID NO: 3062252 - DNA, 15 bp, Homo sapiens
taatgacacttgtcc

SEQ ID NO: 3062253 - DNA, 14 bp, Homo sapiens
taatgacttttaaa

SEQ ID NO: 3062254 - DNA, 17 bp, Homo sapiens
taatgacttttaaaatt

SEQ ID NO: 3062255 - DNA, 23 bp, Homo sapiens
taatgacttttaaaatttgtaga

SEQ ID NO: 3062256 - DNA, 22 bp, Homo sapiens
taatgagatatatctttatact

SEQ ID NO: 3062257 - DNA, 13 bp, Homo sapiens
taatgagtttaaa

SEQ ID NO: 3062258 - DNA, 21 bp, Homo sapiens
taatgatcagcaaaaagactg

SEQ ID NO: 3062259 - DNA, 20 bp, Homo sapiens
taatgatgttatcttaacac

SEQ ID NO: 3062260 - DNA, 19 bp, Homo sapiens
taatgatgttgataatttc

SEQ ID NO: 3062261 - DNA, 20 bp, Homo sapiens
taatgatgttgataatttca

SEQ ID NO: 3062262 - DNA, 16 bp, Homo sapiens
taatgatttttgtgta

SEQ ID NO: 3062263 - DNA, 14 bp, Homo sapiens
taatgcaaagaatc

SEQ ID NO: 3062264 - DNA, 16 bp, Homo sapiens
taatgcagaagtattc

SEQ ID NO: 3062265 - DNA, 18 bp, Homo sapiens
taatgcagaagtattctt

SEQ ID NO: 3062266 - DNA, 17 bp, Homo sapiens
taatgcagtatggtaca

SEQ ID NO: 3062267 - DNA, 20 bp, Homo sapiens
taatgcagtatggtacattt

SEQ ID NO: 3062268 - DNA, 21 bp, Homo sapiens
taatgcagtatggtacatttt

SEQ ID NO: 3062269 - DNA, 17 bp, Homo sapiens
taatgcatttgagcatg

SEQ ID NO: 3062270 - DNA, 12 bp, Homo sapiens
taatgccaagtt

SEQ ID NO: 3062271 - DNA, 20 bp, Homo sapiens
taatgcccagccagccaccc

SEQ ID NO: 3062272 - DNA, 14 bp, Homo sapiens
taatgcgattttat

SEQ ID NO: 3062273 - DNA, 18 bp, Homo sapiens
taatgcgattttattact

SEQ ID NO: 3062274 - DNA, 20 bp, Homo sapiens
taatgctcacctttatcacc

SEQ ID NO: 3062275 - DNA, 16 bp, Homo sapiens
taatgcttaagaggga

SEQ ID NO: 3062276 - DNA, 15 bp, Homo sapiens
taatgcttatgtgtt

SEQ ID NO: 3062277 - DNA, 21 bp, Homo sapiens
taatggaaaaaaaaaaaagag

SEQ ID NO: 3062278 - DNA, 19 bp, Homo sapiens
taatggacacttttcacct

SEQ ID NO: 3062279 - DNA, 16 bp, Homo sapiens
taatggactcagctct

SEQ ID NO: 3062280 - DNA, 17 bp, Homo sapiens
taatggtaccagataaa

SEQ ID NO: 3062281 - DNA, 18 bp, Homo sapiens
taatggtccacacccaat

SEQ ID NO: 3062282 - DNA, 13 bp, Homo sapiens
taatgtaacatga

SEQ ID NO: 3062283 - DNA, 21 bp, Homo sapiens
taatgtagacattatcttttg

SEQ ID NO: 3062284 - DNA, 22 bp, Homo sapiens
taatgtcaccaccttcccagct

SEQ ID NO: 3062285 - DNA, 22 bp, Homo sapiens
taatgtgacctagcaataggca

SEQ ID NO: 3062286 - DNA, 21 bp, Homo sapiens
taatgtgagtgtgaagctttg

SEQ ID NO: 3062287 - DNA, 12 bp, Homo sapiens
taatgtgcctgg

SEQ ID NO: 3062288 - DNA, 15 bp, Homo sapiens
taatgtgctgtgtaa

SEQ ID NO: 3062289 - DNA, 16 bp, Homo sapiens
taatgtgctgtgtaaa

SEQ ID NO: 3062290 - DNA, 17 bp, Homo sapiens
taatgttacatagtaaa

SEQ ID NO: 3062291 - DNA, 18 bp, Homo sapiens
taatgttacatagtaaat

SEQ ID NO: 3062292 - DNA, 15 bp, Homo sapiens
taatgttctgtgata

SEQ ID NO: 3062293 - DNA, 15 bp, Homo sapiens
taatgtttaaaacat

SEQ ID NO: 3062294 - DNA, 11 bp, Homo sapiens
taatgtttcct

SEQ ID NO: 3062295 - DNA, 15 bp, Homo sapiens
taattaaaacacttt

SEQ ID NO: 3062296 - DNA, 16 bp, Homo sapiens
taattaaatatttctt

SEQ ID NO: 3062297 - DNA, 19 bp, Homo sapiens
taattaaccttactaatta

SEQ ID NO: 3062298 - DNA, 21 bp, Homo sapiens
taattaccatacataaactgt

SEQ ID NO: 3062299 - DNA, 15 bp, Homo sapiens
taattataaacagca

SEQ ID NO: 3062300 - DNA, 17 bp, Homo sapiens
taattataggaagttct

SEQ ID NO: 3062301 - DNA, 15 bp, Homo sapiens
taattatcagttggt

SEQ ID NO: 3062302 - DNA, 21 bp, Homo sapiens
taattatgccttttttgatca

SEQ ID NO: 3062303 - DNA, 13 bp, Homo sapiens
taattatgtaaat

SEQ ID NO: 3062304 - DNA, 17 bp, Homo sapiens
taattattatttaactc

SEQ ID NO: 3062305 - DNA, 16 bp, Homo sapiens
taattatttaaatgta

SEQ ID NO: 3062306 - DNA, 18 bp, Homo sapiens
taattatttaaatgtact

SEQ ID NO: 3062307 - DNA, 18 bp, Homo sapiens
taattattttaaaatatt

SEQ ID NO: 3062308 - DNA, 17 bp, Homo sapiens
taattattttcttcctt

SEQ ID NO: 3062309 - DNA, 17 bp, Homo sapiens
taattcaaggagaatat

SEQ ID NO: 3062310 - DNA, 20 bp, Homo sapiens
taattcaaggagaatatgat

SEQ ID NO: 3062311 - DNA, 17 bp, Homo sapiens
taattcagatgttttac

SEQ ID NO: 3062312 - DNA, 11 bp, Homo sapiens
taattcatctt

SEQ ID NO: 3062313 - DNA, 22 bp, Homo sapiens
taattcatcttttaatcatgag

SEQ ID NO: 3062314 - DNA, 15 bp, Homo sapiens
taattcatgtttctt

SEQ ID NO: 3062315 - DNA, 22 bp, Homo sapiens
taattccgtaggttattttcag

SEQ ID NO: 3062316 - DNA, 19 bp, Homo sapiens
taattcctcaacgtattgt

SEQ ID NO: 3062317 - DNA, 23 bp, Homo sapiens
taattctattaaagtgctaaggt

SEQ ID NO: 3062318 - DNA, 20 bp, Homo sapiens
taattcttcaccttaggaat

SEQ ID NO: 3062319 - DNA, 15 bp, Homo sapiens
taattgattaaaatc

SEQ ID NO: 3062320 - DNA, 18 bp, Homo sapiens
taattgattaaaatctct

SEQ ID NO: 3062321 - DNA, 20 bp, Homo sapiens
taattgcatttaaaaatata

SEQ ID NO: 3062322 - DNA, 14 bp, Homo sapiens
taattgctgtgtgt

SEQ ID NO: 3062323 - DNA, 22 bp, Homo sapiens
taattgctgtgtgtcccaggca

SEQ ID NO: 3062324 - DNA, 20 bp, Homo sapiens
taattgctgttgaaagcaaa

SEQ ID NO: 3062325 - DNA, 21 bp, Homo sapiens
taattgctgttgaaagcaaaa

SEQ ID NO: 3062326 - DNA, 12 bp, Homo sapiens
taattgctttga

SEQ ID NO: 3062327 - DNA, 18 bp, Homo sapiens
taattgggtcatagaaat

SEQ ID NO: 3062328 - DNA, 16 bp, Homo sapiens
taattggtttaaagtc

SEQ ID NO: 3062329 - DNA, 24 bp, Homo sapiens
taagatgctctatcttgctctgta

SEQ ID NO: 3062330 - DNA, 19 bp, Homo sapiens
taagattatagattctaaa

SEQ ID NO: 3062331 - DNA, 21 bp, Homo sapiens
taagattatagattctaaaga

SEQ ID NO: 3062332 - DNA, 22 bp, Homo sapiens
taagattatagattctaaagat

SEQ ID NO: 3062333 - DNA, 11 bp, Homo sapiens
taagattctaa

SEQ ID NO: 3062334 - DNA, 12 bp, Homo sapiens
taagattctaac

SEQ ID NO: 3062335 - DNA, 17 bp, Homo sapiens
taagattctaacggtct

SEQ ID NO: 3062336 - DNA, 12 bp, Homo sapiens
taagattctaat

SEQ ID NO: 3062337 - DNA, 19 bp, Homo sapiens
taagattctctgcccagcc

SEQ ID NO: 3062338 - DNA, 12 bp, Homo sapiens
taagcaaatgca

SEQ ID NO: 3062339 - DNA, 14 bp, Homo sapiens
taagcaaatgcatt

SEQ ID NO: 3062340 - DNA, 23 bp, Homo sapiens
taagcaacatctagcaaatgtta

SEQ ID NO: 3062341 - DNA, 14 bp, Homo sapiens
taagcaacatcttt

SEQ ID NO: 3062342 - DNA, 16 bp, Homo sapiens
taagcagaggaggggc

SEQ ID NO: 3062343 - DNA, 17 bp, Homo sapiens
taagcagaggaggggcc

SEQ ID NO: 3062344 - DNA, 16 bp, Homo sapiens
taagcagagttctttg

SEQ ID NO: 3062345 - DNA, 20 bp, Homo sapiens
taagcagttttgtaaatgta

SEQ ID NO: 3062346 - DNA, 16 bp, Homo sapiens
taagcataagaccaat

SEQ ID NO: 3062347 - DNA, 17 bp, Homo sapiens
taagcatactttgtaaa

SEQ ID NO: 3062348 - DNA, 14 bp, Homo sapiens
taagcatgagtggc

SEQ ID NO: 3062349 - DNA, 19 bp, Homo sapiens
taagccaagctgtgttcat

SEQ ID NO: 3062350 - DNA, 19 bp, Homo sapiens
taagccacttaaaatgttc

SEQ ID NO: 3062351 - DNA, 20 bp, Homo sapiens
taagccacttaaaatgttca

SEQ ID NO: 3062352 - DNA, 17 bp, Homo sapiens
taagccaggaaacatga

SEQ ID NO: 3062353 - DNA, 18 bp, Homo sapiens
taagccgatggtcactat

SEQ ID NO: 3062354 - DNA, 12 bp, Homo sapiens
taagcctgtggc

SEQ ID NO: 3062355 - DNA, 18 bp, Homo sapiens
taagcctgtggctgtgga

SEQ ID NO: 3062356 - DNA, 20 bp, Homo sapiens
taagcctgtggctgtggaga

SEQ ID NO: 3062357 - DNA, 13 bp, Homo sapiens
taagcggaataaa

SEQ ID NO: 3062358 - DNA, 18 bp, Homo sapiens
taagctagaagaagtgag

SEQ ID NO: 3062359 - DNA, 19 bp, Homo sapiens
taagctccagttttcgtat

SEQ ID NO: 3062360 - DNA, 15 bp, Homo sapiens
taagctcctctgtaa

SEQ ID NO: 3062361 - DNA, 22 bp, Homo sapiens
taagctgttcctgttcagtaat

SEQ ID NO: 3062362 - DNA, 21 bp, Homo sapiens
taagctttggacccaaggaaa

SEQ ID NO: 3062363 - DNA, 21 bp, Homo sapiens
taaggaaagcaataaatgaat

SEQ ID NO: 3062364 - DNA, 19 bp, Homo sapiens
taaggaaatcaacttgctt

SEQ ID NO: 3062365 - DNA, 18 bp, Homo sapiens
taaggaaccctggaaact

SEQ ID NO: 3062366 - DNA, 15 bp, Homo sapiens
taaggaactggaaca

SEQ ID NO: 3062367 - DNA, 23 bp, Homo sapiens
taaggaactggaacacacatgtc

SEQ ID NO: 3062368 - DNA, 19 bp, Homo sapiens
taaggaagtatcagcacta

SEQ ID NO: 3062369 - DNA, 15 bp, Homo sapiens
taaggacaaagtgcc

SEQ ID NO: 3062370 - DNA, 13 bp, Homo sapiens
taaggagggagaa

SEQ ID NO: 3062371 - DNA, 15 bp, Homo sapiens
taaggagggagaaag

SEQ ID NO: 3062372 - DNA, 21 bp, Homo sapiens
taaggatgtagcttttcacct

SEQ ID NO: 3062373 - DNA, 17 bp, Homo sapiens
taaggattctgaagttt

SEQ ID NO: 3062374 - DNA, 18 bp, Homo sapiens
taaggcatacttttaatc

SEQ ID NO: 3062375 - DNA, 21 bp, Homo sapiens
taaggccacgtatagtcctag

SEQ ID NO: 3062376 - DNA, 21 bp, Homo sapiens
taaggccactgttttaaaaga

SEQ ID NO: 3062377 - DNA, 19 bp, Homo sapiens
taaggccattattgtactt

SEQ ID NO: 3062378 - DNA, 16 bp, Homo sapiens
taaggccctttttcct

SEQ ID NO: 3062379 - DNA, 19 bp, Homo sapiens
taaggcctaggattctaaa

SEQ ID NO: 3062380 - DNA, 20 bp, Homo sapiens
taaggcctaggattctaaaa

SEQ ID NO: 3062381 - DNA, 14 bp, Homo sapiens
taaggctctagatc

SEQ ID NO: 3062382 - DNA, 22 bp, Homo sapiens
taaggctctatgagtctagatg

SEQ ID NO: 3062383 - DNA, 17 bp, Homo sapiens
taaggctctgtgccttg

SEQ ID NO: 3062384 - DNA, 20 bp, Homo sapiens
taagggacatgttttgataa

SEQ ID NO: 3062385 - DNA, 14 bp, Homo sapiens
taagggatttctta

SEQ ID NO: 3062386 - DNA, 13 bp, Homo sapiens
taagggcagccct

SEQ ID NO: 3062387 - DNA, 21 bp, Homo sapiens
taagggccggggatggatctt

SEQ ID NO: 3062388 - DNA, 20 bp, Homo sapiens
taagggtctttggtgttttt

SEQ ID NO: 3062389 - DNA, 15 bp, Homo sapiens
taaggtagccctctc

SEQ ID NO: 3062390 - DNA, 14 bp, Homo sapiens
taaggtctttgtaa

SEQ ID NO: 3062391 - DNA, 18 bp, Homo sapiens
taaggtctttgtaaaatc

SEQ ID NO: 3062392 - DNA, 21 bp, Homo sapiens
taaggtctttgtaaaatcttg

SEQ ID NO: 3062393 - DNA, 19 bp, Homo sapiens
taaggtgactttctgaaac

SEQ ID NO: 3062394 - DNA, 15 bp, Homo sapiens
taaggtgctaaatct

SEQ ID NO: 3062395 - DNA, 19 bp, Homo sapiens
taaggtgtgcagtgttttt

SEQ ID NO: 3062396 - DNA, 17 bp, Homo sapiens
taaggtgttttctgtgt

SEQ ID NO: 3062397 - DNA, 18 bp, Homo sapiens
taaggtgttttctgtgta

SEQ ID NO: 3062398 - DNA, 14 bp, Homo sapiens
taaggttcagactt

SEQ ID NO: 3062399 - DNA, 20 bp, Homo sapiens
taaggtttcgtttctgtata

SEQ ID NO: 3062400 - DNA, 17 bp, Homo sapiens
taagtacctcagcattt

SEQ ID NO: 3062401 - DNA, 18 bp, Homo sapiens
taagtacctcagcattta

SEQ ID NO: 3062402 - DNA, 16 bp, Homo sapiens
taagtagaacaaaaaa

SEQ ID NO: 3062403 - DNA, 16 bp, Homo sapiens
taagtagatctgcttt

SEQ ID NO: 3062404 - DNA, 20 bp, Homo sapiens
taagtagatctgctttctgt

SEQ ID NO: 3062405 - DNA, 19 bp, Homo sapiens
taagtataacaaactatgt

SEQ ID NO: 3062406 - DNA, 14 bp, Homo sapiens
taagtatgttattt

SEQ ID NO: 3062407 - DNA, 15 bp, Homo sapiens
taagtcaacctgcct

SEQ ID NO: 3062408 - DNA, 22 bp, Homo sapiens
taagtcaccctagccctctccc

SEQ ID NO: 3062409 - DNA, 15 bp, Homo sapiens
taagtcctttatgtg

SEQ ID NO: 3062410 - DNA, 19 bp, Homo sapiens
taagtgatattcatttaaa

SEQ ID NO: 3062411 - DNA, 17 bp, Homo sapiens
taagtgatgtcatttga

SEQ ID NO: 3062412 - DNA, 17 bp, Homo sapiens
taagtggcgtgtgcata

SEQ ID NO: 3062413 - DNA, 15 bp, Homo sapiens
taagtgggcccaccc

SEQ ID NO: 3062414 - DNA, 20 bp, Homo sapiens
taagttaaaggcagtccaga

SEQ ID NO: 3062415 - DNA, 15 bp, Homo sapiens
taagttacaatgttt

SEQ ID NO: 3062416 - DNA, 16 bp, Homo sapiens
taagttatgtgtgtgg

SEQ ID NO: 3062417 - DNA, 20 bp, Homo sapiens
taagttattgcagtttatca

SEQ ID NO: 3062418 - DNA, 13 bp, Homo sapiens
taagttattgtta

SEQ ID NO: 3062419 - DNA, 15 bp, Homo sapiens
taagttattttatga

SEQ ID NO: 3062420 - DNA, 15 bp, Homo sapiens
taagttcactttttt

SEQ ID NO: 3062421 - DNA, 13 bp, Homo sapiens
taagttcctgctg

SEQ ID NO: 3062422 - DNA, 22 bp, Homo sapiens
taagttcgaacatgtttcactt

SEQ ID NO: 3062423 - DNA, 13 bp, Homo sapiens
taagttgtaaaat

SEQ ID NO: 3062424 - DNA, 13 bp, Homo sapiens
taagttgtttgca

SEQ ID NO: 3062425 - DNA, 15 bp, Homo sapiens
taagttgtttgcatg

SEQ ID NO: 3062426 - DNA, 19 bp, Homo sapiens
taagtttacctatgtaaca

SEQ ID NO: 3062427 - DNA, 21 bp, Homo sapiens
taagtttccttccagcccaga

SEQ ID NO: 3062428 - DNA, 16 bp, Homo sapiens
taagtttctttagaaa

SEQ ID NO: 3062429 - DNA, 18 bp, Homo sapiens
taagtttgaaggaaacag

SEQ ID NO: 3062430 - DNA, 18 bp, Homo sapiens
taagtttgtgaatgtgac

SEQ ID NO: 3062431 - DNA, 19 bp, Homo sapiens
taagttttgtgtgtatata

SEQ ID NO: 3062432 - DNA, 21 bp, Homo sapiens
taagtttttattcaaagcagc

SEQ ID NO: 3062433 - DNA, 19 bp, Homo sapiens
taagtttttctttaatatg

SEQ ID NO: 3062434 - DNA, 13 bp, Homo sapiens
taataaaaaacaa

SEQ ID NO: 3062435 - DNA, 17 bp, Homo sapiens
taataaaaaacaagaaa

SEQ ID NO: 3062436 - DNA, 19 bp, Homo sapiens
taataaaaagaaagatact

SEQ ID NO: 3062437 - DNA, 14 bp, Homo sapiens
taataaaaaggcac

SEQ ID NO: 3062438 - DNA, 14 bp, Homo sapiens
taataaaaatgaca

SEQ ID NO: 3062439 - DNA, 14 bp, Homo sapiens
taataaaatacttt

SEQ ID NO: 3062440 - DNA, 20 bp, Homo sapiens
taataaacgagatgtttgcc

SEQ ID NO: 3062441 - DNA, 18 bp, Homo sapiens
taataaactttgtgctga

SEQ ID NO: 3062442 - DNA, 17 bp, Homo sapiens
taataaattaagtacag

SEQ ID NO: 3062443 - DNA, 15 bp, Homo sapiens
taataacatatctaa

SEQ ID NO: 3062444 - DNA, 13 bp, Homo sapiens
taataactttgct

SEQ ID NO: 3062445 - DNA, 19 bp, Homo sapiens
taataagcataagaccaat

SEQ ID NO: 3062446 - DNA, 15 bp, Homo sapiens
taataagttgatgtt

SEQ ID NO: 3062447 - DNA, 23 bp, Homo sapiens
taataatcattggattctgagag

SEQ ID NO: 3062448 - DNA, 17 bp, Homo sapiens
taataatcattttagaa

SEQ ID NO: 3062449 - DNA, 14 bp, Homo sapiens
taataattgaagaa

SEQ ID NO: 3062450 - DNA, 22 bp, Homo sapiens
taataattggccttcgatttta

SEQ ID NO: 3062451 - DNA, 14 bp, Homo sapiens
taataatttctaat

SEQ ID NO: 3062452 - DNA, 18 bp, Homo sapiens
taatacaaaaggctccat

SEQ ID NO: 3062453 - DNA, 18 bp, Homo sapiens
taatacaaagaaaaagcc

SEQ ID NO: 3062454 - DNA, 16 bp, Homo sapiens
taatacacttgccctg

SEQ ID NO: 3062455 - DNA, 15 bp, Homo sapiens
taatacctctgtgtg

SEQ ID NO: 3062456 - DNA, 18 bp, Homo sapiens
taatacctctgtgtgctc

SEQ ID NO: 3062457 - DNA, 15 bp, Homo sapiens
taatactactactgt

SEQ ID NO: 3062458 - DNA, 22 bp, Homo sapiens
taatactagttgtgaccttagt

SEQ ID NO: 3062459 - DNA, 12 bp, Homo sapiens
taatactgaatt

SEQ ID NO: 3062460 - DNA, 19 bp, Homo sapiens
taatactgctgagatacat

SEQ ID NO: 3062461 - DNA, 21 bp, Homo sapiens
taatactttcggagaaattct

SEQ ID NO: 3062462 - DNA, 22 bp, Homo sapiens
taatagaacacagagtgtgttt

SEQ ID NO: 3062463 - DNA, 22 bp, Homo sapiens
taatagattttttcagacttgt

SEQ ID NO: 3062464 - DNA, 23 bp, Homo sapiens
taatagattttttcagacttgtc

SEQ ID NO: 3062465 - DNA, 18 bp, Homo sapiens
taacattctacttgctta

SEQ ID NO: 3062466 - DNA, 15 bp, Homo sapiens
taacatttaggagaa

SEQ ID NO: 3062467 - DNA, 20 bp, Homo sapiens
taaccaaagagtctctggct

SEQ ID NO: 3062468 - DNA, 15 bp, Homo sapiens
taaccaaccttgttt

SEQ ID NO: 3062469 - DNA, 17 bp, Homo sapiens
taaccaaggctgtgttt

SEQ ID NO: 3062470 - DNA, 16 bp, Homo sapiens
taaccaagttgtttat

SEQ ID NO: 3062471 - DNA, 22 bp, Homo sapiens
taaccaagttgtttattccaaa

SEQ ID NO: 3062472 - DNA, 14 bp, Homo sapiens
taaccacattttag

SEQ ID NO: 3062473 - DNA, 17 bp, Homo sapiens
taaccacattttaggat

SEQ ID NO: 3062474 - DNA, 20 bp, Homo sapiens
taaccactaatgttagaatt

SEQ ID NO: 3062475 - DNA, 22 bp, Homo sapiens
taaccagatctagtcaatcaag

SEQ ID NO: 3062476 - DNA, 20 bp, Homo sapiens
taaccagctcagtgttttgg

SEQ ID NO: 3062477 - DNA, 22 bp, Homo sapiens
taaccagttgtggtgtgagtat

SEQ ID NO: 3062478 - DNA, 22 bp, Homo sapiens
taaccatagttatttacttgaa

SEQ ID NO: 3062479 - DNA, 14 bp, Homo sapiens
taaccatttgcact

SEQ ID NO: 3062480 - DNA, 20 bp, Homo sapiens
taacccccagcccacagagc

SEQ ID NO: 3062481 - DNA, 13 bp, Homo sapiens
taaccccttgaaa

SEQ ID NO: 3062482 - DNA, 14 bp, Homo sapiens
taaccccttgaaac

SEQ ID NO: 3062483 - DNA, 20 bp, Homo sapiens
taaccctggtggttgctgtt

SEQ ID NO: 3062484 - DNA, 15 bp, Homo sapiens
taaccgatgctttac

SEQ ID NO: 3062485 - DNA, 14 bp, Homo sapiens
taaccgctccaggt

SEQ ID NO: 3062486 - DNA, 15 bp, Homo sapiens
taaccgtttttcaag

SEQ ID NO: 3062487 - DNA, 17 bp, Homo sapiens
taaccgtttttcaagaa

SEQ ID NO: 3062488 - DNA, 19 bp, Homo sapiens
taacctcaagtgatcctcc

SEQ ID NO: 3062489 - DNA, 15 bp, Homo sapiens
taacctcgtgtctag

SEQ ID NO: 3062490 - DNA, 17 bp, Homo sapiens
taacctcttcagaggcc

SEQ ID NO: 3062491 - DNA, 12 bp, Homo sapiens
taacctgtgtct

SEQ ID NO: 3062492 - DNA, 23 bp, Homo sapiens
taacctgtgtctgcgaagtccta

SEQ ID NO: 3062493 - DNA, 20 bp, Homo sapiens
taacctttaaaaatgtataa

SEQ ID NO: 3062494 - DNA, 23 bp, Homo sapiens
taacggtctgttctgtttcaagg

SEQ ID NO: 3062495 - DNA, 15 bp, Homo sapiens
taacgttttttcttc

SEQ ID NO: 3062496 - DNA, 20 bp, Homo sapiens
taacgttttttcttctttta

SEQ ID NO: 3062497 - DNA, 15 bp, Homo sapiens
taactaagactcccg

SEQ ID NO: 3062498 - DNA, 17 bp, Homo sapiens
taactaagactcccgcc

SEQ ID NO: 3062499 - DNA, 19 bp, Homo sapiens
taactaatgaattgaaatt

SEQ ID NO: 3062500 - DNA, 18 bp, Homo sapiens
taactagacaccaaagtt

SEQ ID NO: 3062501 - DNA, 15 bp, Homo sapiens
taactataacaaaaa

SEQ ID NO: 3062502 - DNA, 17 bp, Homo sapiens
taactatataagacatt

SEQ ID NO: 3062503 - DNA, 14 bp, Homo sapiens
taactatcaggcag

SEQ ID NO: 3062504 - DNA, 16 bp, Homo sapiens
taactatcaggcagaa

SEQ ID NO: 3062505 - DNA, 20 bp, Homo sapiens
taactatcaggcagaagaat

SEQ ID NO: 3062506 - DNA, 16 bp, Homo sapiens
taactattagaatata

SEQ ID NO: 3062507 - DNA, 12 bp, Homo sapiens
taactattcagt

SEQ ID NO: 3062508 - DNA, 14 bp, Homo sapiens
taactattcagttg

SEQ ID NO: 3062509 - DNA, 16 bp, Homo sapiens
taactcattagactgg

SEQ ID NO: 3062510 - DNA, 16 bp, Homo sapiens
taactcccctgtttca

SEQ ID NO: 3062511 - DNA, 11 bp, Homo sapiens
taactccctcc

SEQ ID NO: 3062512 - DNA, 14 bp, Homo sapiens
taactctgtcttca

SEQ ID NO: 3062513 - DNA, 24 bp, Homo sapiens
taactcttagaagtgttgtaaaag

SEQ ID NO: 3062514 - DNA, 14 bp, Homo sapiens
taactgaaccaaat

SEQ ID NO: 3062515 - DNA, 18 bp, Homo sapiens
taactgaaccaaattgca

SEQ ID NO: 3062516 - DNA, 20 bp, Homo sapiens
taactgaaccaaattgcact

SEQ ID NO: 3062517 - DNA, 17 bp, Homo sapiens
taactgaagaaagagaa

SEQ ID NO: 3062518 - DNA, 17 bp, Homo sapiens
taactgaagatgttgag

SEQ ID NO: 3062519 - DNA, 15 bp, Homo sapiens
taactgaaggagaag

SEQ ID NO: 3062520 - DNA, 20 bp, Homo sapiens
taactgagtagctctcctga

SEQ ID NO: 3062521 - DNA, 16 bp, Homo sapiens
taactgatctatttat

SEQ ID NO: 3062522 - DNA, 17 bp, Homo sapiens
taactgatctcaagtat

SEQ ID NO: 3062523 - DNA, 20 bp, Homo sapiens
taactgatctcaagtatatg

SEQ ID NO: 3062524 - DNA, 16 bp, Homo sapiens
taactgcatttttaga

SEQ ID NO: 3062525 - DNA, 15 bp, Homo sapiens
taactgccaatcctt

SEQ ID NO: 3062526 - DNA, 22 bp, Homo sapiens
taactgctacttgctctgctct

SEQ ID NO: 3062527 - DNA, 12 bp, Homo sapiens
taactgctgtcg

SEQ ID NO: 3062528 - DNA, 23 bp, Homo sapiens
taactggcagttttccattggtt

SEQ ID NO: 3062529 - DNA, 18 bp, Homo sapiens
taactggtagtgttcagt

SEQ ID NO: 3062530 - DNA, 12 bp, Homo sapiens
taactgtaaatc

SEQ ID NO: 3062531 - DNA, 13 bp, Homo sapiens
taactgtaaatca

SEQ ID NO: 3062532 - DNA, 11 bp, Homo sapiens
taactgtatct

SEQ ID NO: 3062533 - DNA, 18 bp, Homo sapiens
taactgtccctgctttct

SEQ ID NO: 3062534 - DNA, 24 bp, Homo sapiens
taacttagaaggatggcatctcca

SEQ ID NO: 3062535 - DNA, 21 bp, Homo sapiens
taacttattgcctgggcagtg

SEQ ID NO: 3062536 - DNA, 16 bp, Homo sapiens
taacttatttatatga

SEQ ID NO: 3062537 - DNA, 14 bp, Homo sapiens
taacttattttgta

SEQ ID NO: 3062538 - DNA, 21 bp, Homo sapiens
taacttattttgtactagtgt

SEQ ID NO: 3062539 - DNA, 16 bp, Homo sapiens
taacttctcatgtata

SEQ ID NO: 3062540 - DNA, 22 bp, Homo sapiens
taacttgaatttggtctgtata

SEQ ID NO: 3062541 - DNA, 23 bp, Homo sapiens
taacttgatagggtctaccaata

SEQ ID NO: 3062542 - DNA, 16 bp, Homo sapiens
taactttatgaagtgc

SEQ ID NO: 3062543 - DNA, 16 bp, Homo sapiens
taactttatgtgtaaa

SEQ ID NO: 3062544 - DNA, 15 bp, Homo sapiens
taactttattcttga

SEQ ID NO: 3062545 - DNA, 24 bp, Homo sapiens
taactttgcccttcactgttgctt

SEQ ID NO: 3062546 - DNA, 22 bp, Homo sapiens
taactttgcttgcagtagattt

SEQ ID NO: 3062547 - DNA, 24 bp, Homo sapiens
taactttgcttgcagtagattttc

SEQ ID NO: 3062548 - DNA, 16 bp, Homo sapiens
taagaaaacatcactg

SEQ ID NO: 3062549 - DNA, 21 bp, Homo sapiens
taagaaaaccaccccttagat

SEQ ID NO: 3062550 - DNA, 20 bp, Homo sapiens
taagaaacacactgaggcag

SEQ ID NO: 3062551 - DNA, 23 bp, Homo sapiens
taagaaacctactgcccaggcac

SEQ ID NO: 3062552 - DNA, 16 bp, Homo sapiens
taagaaagacatcttt

SEQ ID NO: 3062553 - DNA, 18 bp, Homo sapiens
taagaaagcacttaaaca

SEQ ID NO: 3062554 - DNA, 18 bp, Homo sapiens
taagaaagtgaagcaaat

SEQ ID NO: 3062555 - DNA, 22 bp, Homo sapiens
taagaaagtgaagcaaatcaga

SEQ ID NO: 3062556 - DNA, 19 bp, Homo sapiens
taagaaagtgtctctgttt

SEQ ID NO: 3062557 - DNA, 21 bp, Homo sapiens
taagaaatctcccatgtgcat

SEQ ID NO: 3062558 - DNA, 18 bp, Homo sapiens
taagaaatgtataaactt

SEQ ID NO: 3062559 - DNA, 15 bp, Homo sapiens
taagaacgaggattt

SEQ ID NO: 3062560 - DNA, 17 bp, Homo sapiens
taagaaggcaaaaatgt

SEQ ID NO: 3062561 - DNA, 13 bp, Homo sapiens
taagaataattta

SEQ ID NO: 3062562 - DNA, 22 bp, Homo sapiens
taagaataatttttaattgctt

SEQ ID NO: 3062563 - DNA, 14 bp, Homo sapiens
taagaatacagctt

SEQ ID NO: 3062564 - DNA, 12 bp, Homo sapiens
taagaatagtct

SEQ ID NO: 3062565 - DNA, 21 bp, Homo sapiens
taagaatagtctctgggttta

SEQ ID NO: 3062566 - DNA, 13 bp, Homo sapiens
taagaatatttga

SEQ ID NO: 3062567 - DNA, 13 bp, Homo sapiens
taagaatgaacac

SEQ ID NO: 3062568 - DNA, 14 bp, Homo sapiens
taagaatgaacaca

SEQ ID NO: 3062569 - DNA, 14 bp, Homo sapiens
taagaatggaaaag

SEQ ID NO: 3062570 - DNA, 17 bp, Homo sapiens
taagacatgatttcctt

SEQ ID NO: 3062571 - DNA, 19 bp, Homo sapiens
taagacatgatttccttga

SEQ ID NO: 3062572 - DNA, 20 bp, Homo sapiens
taagacatgatttccttgaa

SEQ ID NO: 3062573 - DNA, 21 bp, Homo sapiens
taagacatgatttccttgaat

SEQ ID NO: 3062574 - DNA, 12 bp, Homo sapiens
taagacattaag

SEQ ID NO: 3062575 - DNA, 16 bp, Homo sapiens
taagacatttcctttt

SEQ ID NO: 3062576 - DNA, 18 bp, Homo sapiens
taagacctactgttctaa

SEQ ID NO: 3062577 - DNA, 20 bp, Homo sapiens
taagacctactgttctaaag

SEQ ID NO: 3062578 - DNA, 21 bp, Homo sapiens
taagacctactgttctaaagc

SEQ ID NO: 3062579 - DNA, 13 bp, Homo sapiens
taagacctggcag

SEQ ID NO: 3062580 - DNA, 17 bp, Homo sapiens
taagacctggcagctct

SEQ ID NO: 3062581 - DNA, 18 bp, Homo sapiens
taagactcaaatgttcta

SEQ ID NO: 3062582 - DNA, 18 bp, Homo sapiens
taagactcccgccccggg

SEQ ID NO: 3062583 - DNA, 16 bp, Homo sapiens
taagactctcacactc

SEQ ID NO: 3062584 - DNA, 15 bp, Homo sapiens
taagacttagttatt

SEQ ID NO: 3062585 - DNA, 12 bp, Homo sapiens
taagactttttt

SEQ ID NO: 3062586 - DNA, 19 bp, Homo sapiens
taagagaacaaagagtgaa

SEQ ID NO: 3062587 - DNA, 23 bp, Homo sapiens
taagagactcactggttttactt

SEQ ID NO: 3062588 - DNA, 22 bp, Homo sapiens
taagagcagtccatttctacca

SEQ ID NO: 3062589 - DNA, 20 bp, Homo sapiens
taagagctagcgctgccgca

SEQ ID NO: 3062590 - DNA, 14 bp, Homo sapiens
taagagtctccttc

SEQ ID NO: 3062591 - DNA, 18 bp, Homo sapiens
taagatactcaagcaggt

SEQ ID NO: 3062592 - DNA, 20 bp, Homo sapiens
taagatactcaagcaggttt

SEQ ID NO: 3062593 - DNA, 19 bp, Homo sapiens
taagatagacttattcttt

SEQ ID NO: 3062594 - DNA, 16 bp, Homo sapiens
taagatatccatcttt

SEQ ID NO: 3062595 - DNA, 18 bp, Homo sapiens
taagatcactgccagaga

SEQ ID NO: 3062596 - DNA, 21 bp, Homo sapiens
taagatcactgccagagataa

SEQ ID NO: 3062597 - DNA, 19 bp, Homo sapiens
taagatctcagtggttaag

SEQ ID NO: 3062598 - DNA, 15 bp, Homo sapiens
taagatgacattgct

SEQ ID NO: 3062599 - DNA, 16 bp, Homo sapiens
taagatgacattgcta

SEQ ID NO: 3062600 - DNA, 17 bp, Homo sapiens
taagatgacattgctaa

SEQ ID NO: 3062601 - DNA, 16 bp, Homo sapiens
taaagttagtctactc

SEQ ID NO: 3062602 - DNA, 13 bp, Homo sapiens
taaagttatattt

SEQ ID NO: 3062603 - DNA, 16 bp, Homo sapiens
taaagttatatttcag

SEQ ID NO: 3062604 - DNA, 14 bp, Homo sapiens
taaagttctaagat

SEQ ID NO: 3062605 - DNA, 18 bp, Homo sapiens
taaagttctaagattctg

SEQ ID NO: 3062606 - DNA, 22 bp, Homo sapiens
taaagttctaagattctgattt

SEQ ID NO: 3062607 - DNA, 18 bp, Homo sapiens
taaagtttgcttgtttct

SEQ ID NO: 3062608 - DNA, 21 bp, Homo sapiens
taaagtttgcttgtttcttgg

SEQ ID NO: 3062609 - DNA, 21 bp, Homo sapiens
taaagtttgtaagaaaatgtt

SEQ ID NO: 3062610 - DNA, 16 bp, Homo sapiens
taaataaaagatagca

SEQ ID NO: 3062611 - DNA, 17 bp, Homo sapiens
taaataaaagatagcaa

SEQ ID NO: 3062612 - DNA, 22 bp, Homo sapiens
taaataaaatgcacaaaacttt

SEQ ID NO: 3062613 - DNA, 17 bp, Homo sapiens
taaataaaattcatttc

SEQ ID NO: 3062614 - DNA, 14 bp, Homo sapiens
taaataaataatcg

SEQ ID NO: 3062615 - DNA, 13 bp, Homo sapiens
taaataacatgtt

SEQ ID NO: 3062616 - DNA, 22 bp, Homo sapiens
taaataactatataagacatta

SEQ ID NO: 3062617 - DNA, 16 bp, Homo sapiens
taaataagatgattta

SEQ ID NO: 3062618 - DNA, 18 bp, Homo sapiens
taaataagattctaacgg

SEQ ID NO: 3062619 - DNA, 14 bp, Homo sapiens
taaataataatata

SEQ ID NO: 3062620 - DNA, 13 bp, Homo sapiens
taaatacaaatct

SEQ ID NO: 3062621 - DNA, 13 bp, Homo sapiens
taaatacagtctt

SEQ ID NO: 3062622 - DNA, 14 bp, Homo sapiens
taaatacatcactg

SEQ ID NO: 3062623 - DNA, 18 bp, Homo sapiens
taaataccaattatggaa

SEQ ID NO: 3062624 - DNA, 21 bp, Homo sapiens
taaatactaactgctgatttt

SEQ ID NO: 3062625 - DNA, 20 bp, Homo sapiens
taaatactgacaatgtattt

SEQ ID NO: 3062626 - DNA, 11 bp, Homo sapiens
taaatagagca

SEQ ID NO: 3062627 - DNA, 12 bp, Homo sapiens
taaatagagcaa

SEQ ID NO: 3062628 - DNA, 19 bp, Homo sapiens
taaatagagcaattacaag

SEQ ID NO: 3062629 - DNA, 17 bp, Homo sapiens
taaataggatcctggag

SEQ ID NO: 3062630 - DNA, 23 bp, Homo sapiens
taaatagtgagacataaatagag

SEQ ID NO: 3062631 - DNA, 22 bp, Homo sapiens
taaatatagttgtctttctttg

SEQ ID NO: 3062632 - DNA, 18 bp, Homo sapiens
taaatatatataaattga

SEQ ID NO: 3062633 - DNA, 17 bp, Homo sapiens
taaatatcttctgattt

SEQ ID NO: 3062634 - DNA, 14 bp, Homo sapiens
taaatatgaatgaa

SEQ ID NO: 3062635 - DNA, 20 bp, Homo sapiens
taaatatggggatagtctgg

SEQ ID NO: 3062636 - DNA, 22 bp, Homo sapiens
taaatattggtttgttattctt

SEQ ID NO: 3062637 - DNA, 15 bp, Homo sapiens
taaatatttgttctt

SEQ ID NO: 3062638 - DNA, 14 bp, Homo sapiens
taaatatttttccc

SEQ ID NO: 3062639 - DNA, 17 bp, Homo sapiens
taaatatttttccctcc

SEQ ID NO: 3062640 - DNA, 18 bp, Homo sapiens
taaatatttttccctccg

SEQ ID NO: 3062641 - DNA, 14 bp, Homo sapiens
taaatcacatcctt

SEQ ID NO: 3062642 - DNA, 16 bp, Homo sapiens
taaatcagaataaatt

SEQ ID NO: 3062643 - DNA, 11 bp, Homo sapiens
taaatcagtgg

SEQ ID NO: 3062644 - DNA, 14 bp, Homo sapiens
taaatccacaggct

SEQ ID NO: 3062645 - DNA, 16 bp, Homo sapiens
taaatcgtttaatgtt

SEQ ID NO: 3062646 - DNA, 21 bp, Homo sapiens
taaatctagagtttatacagt

SEQ ID NO: 3062647 - DNA, 23 bp, Homo sapiens
taaatctagagtttatacagtgt

SEQ ID NO: 3062648 - DNA, 15 bp, Homo sapiens
taaatctcttaaact

SEQ ID NO: 3062649 - DNA, 17 bp, Homo sapiens
taaatctcttaaactct

SEQ ID NO: 3062650 - DNA, 17 bp, Homo sapiens
taaatctgcagcacatt

SEQ ID NO: 3062651 - DNA, 14 bp, Homo sapiens
taaatctttcttca

SEQ ID NO: 3062652 - DNA, 16 bp, Homo sapiens
taaatctttcttcaaa

SEQ ID NO: 3062653 - DNA, 14 bp, Homo sapiens
taaatcttttacaa

SEQ ID NO: 3062654 - DNA, 20 bp, Homo sapiens
taaatgaagggtcatttctc

SEQ ID NO: 3062655 - DNA, 15 bp, Homo sapiens
taaatgacaaagtgt

SEQ ID NO: 3062656 - DNA, 19 bp, Homo sapiens
taaatgcagcccatttctc

SEQ ID NO: 3062657 - DNA, 11 bp, Homo sapiens
taaatgccaca

SEQ ID NO: 3062658 - DNA, 15 bp, Homo sapiens
taaatgccacacacc

SEQ ID NO: 3062659 - DNA, 14 bp, Homo sapiens
taaatgcccagttc

SEQ ID NO: 3062660 - DNA, 13 bp, Homo sapiens
taaatgtaacagt

SEQ ID NO: 3062661 - DNA, 17 bp, Homo sapiens
taaatgtactggtaatt

SEQ ID NO: 3062662 - DNA, 22 bp, Homo sapiens
taaatgtactggtaattgtaca

SEQ ID NO: 3062663 - DNA, 12 bp, Homo sapiens
taaatgtcctga

SEQ ID NO: 3062664 - DNA, 15 bp, Homo sapiens
taaatgtctattatt

SEQ ID NO: 3062665 - DNA, 22 bp, Homo sapiens
taaatgtcttttttttaatgtg

SEQ ID NO: 3062666 - DNA, 23 bp, Homo sapiens
taaatgtcttttttttaatgtgc

SEQ ID NO: 3062667 - DNA, 11 bp, Homo sapiens
taaatgtgaat

SEQ ID NO: 3062668 - DNA, 21 bp, Homo sapiens
taaatgtgaatttttatttct

SEQ ID NO: 3062669 - DNA, 12 bp, Homo sapiens
taaatgtgtaca

SEQ ID NO: 3062670 - DNA, 21 bp, Homo sapiens
taaatgtgttttgtttattaa

SEQ ID NO: 3062671 - DNA, 16 bp, Homo sapiens
taaatgttagttctag

SEQ ID NO: 3062672 - DNA, 21 bp, Homo sapiens
taaatgttagtttcttggtaa

SEQ ID NO: 3062673 - DNA, 11 bp, Homo sapiens
taaatgtttac

SEQ ID NO: 3062674 - DNA, 14 bp, Homo sapiens
taaatgtttccccc

SEQ ID NO: 3062675 - DNA, 18 bp, Homo sapiens
taaatgtttcccccactc

SEQ ID NO: 3062676 - DNA, 20 bp, Homo sapiens
taaatgttttgccagccact

SEQ ID NO: 3062677 - DNA, 22 bp, Homo sapiens
taaattaatttgttaattaaat

SEQ ID NO: 3062678 - DNA, 14 bp, Homo sapiens
taaattacaatttt

SEQ ID NO: 3062679 - DNA, 16 bp, Homo sapiens
taaattacaattttat

SEQ ID NO: 3062680 - DNA, 18 bp, Homo sapiens
taaattacactttattct

SEQ ID NO: 3062681 - DNA, 20 bp, Homo sapiens
taaattaccataaaatgtca

SEQ ID NO: 3062682 - DNA, 21 bp, Homo sapiens
taaattacgtaggtttaagac

SEQ ID NO: 3062683 - DNA, 23 bp, Homo sapiens
taaattagtgtacctattaaaag

SEQ ID NO: 3062684 - DNA, 17 bp, Homo sapiens
taaattatatttgtgct

SEQ ID NO: 3062685 - DNA, 21 bp, Homo sapiens
taaattatatttgtgctatag

SEQ ID NO: 3062686 - DNA, 21 bp, Homo sapiens
taaattatgaatattaaaggt

SEQ ID NO: 3062687 - DNA, 20 bp, Homo sapiens
taaattatgggaatcaagat

SEQ ID NO: 3062688 - DNA, 22 bp, Homo sapiens
taaattccccatatttgtgttc

SEQ ID NO: 3062689 - DNA, 17 bp, Homo sapiens
taaattcctctttgctt

SEQ ID NO: 3062690 - DNA, 18 bp, Homo sapiens
taaattcctctttgcttt

SEQ ID NO: 3062691 - DNA, 16 bp, Homo sapiens
taaattctactaagtt

SEQ ID NO: 3062692 - DNA, 19 bp, Homo sapiens
taaattctactaagttatt

SEQ ID NO: 3062693 - DNA, 14 bp, Homo sapiens
taaattctctctaa

SEQ ID NO: 3062694 - DNA, 14 bp, Homo sapiens
taaattcttactct

SEQ ID NO: 3062695 - DNA, 17 bp, Homo sapiens
taaattgaataatggta

SEQ ID NO: 3062696 - DNA, 18 bp, Homo sapiens
taaattgttataacttca

SEQ ID NO: 3062697 - DNA, 21 bp, Homo sapiens
taaattgttataacttcataa

SEQ ID NO: 3062698 - DNA, 22 bp, Homo sapiens
taaatttactctgttgaatatt

SEQ ID NO: 3062699 - DNA, 18 bp, Homo sapiens
taaatttccatatccttc

SEQ ID NO: 3062700 - DNA, 17 bp, Homo sapiens
taaatttccccaacagt

SEQ ID NO: 3062701 - DNA, 13 bp, Homo sapiens
taaatttggattt

SEQ ID NO: 3062702 - DNA, 15 bp, Homo sapiens
taaatttgttgtcat

SEQ ID NO: 3062703 - DNA, 22 bp, Homo sapiens
taaatttgttgtcatgtgtatg

SEQ ID NO: 3062704 - DNA, 23 bp, Homo sapiens
taaatttgttgtcatgtgtatga

SEQ ID NO: 3062705 - DNA, 11 bp, Homo sapiens
taaattttctc

SEQ ID NO: 3062706 - DNA, 14 bp, Homo sapiens
taaattttttgaaa

SEQ ID NO: 3062707 - DNA, 16 bp, Homo sapiens
taaattttttgaaaca

SEQ ID NO: 3062708 - DNA, 18 bp, Homo sapiens
taacaaaaactacacata

SEQ ID NO: 3062709 - DNA, 22 bp, Homo sapiens
taacaagcaaggatatcagagc

SEQ ID NO: 3062710 - DNA, 15 bp, Homo sapiens
taacaagccagattt

SEQ ID NO: 3062711 - DNA, 22 bp, Homo sapiens
taacaagggttttaatgtaatt

SEQ ID NO: 3062712 - DNA, 15 bp, Homo sapiens
taacaagtataatta

SEQ ID NO: 3062713 - DNA, 20 bp, Homo sapiens
taacaagtcgatgaactatt

SEQ ID NO: 3062714 - DNA, 14 bp, Homo sapiens
taacacattttgta

SEQ ID NO: 3062715 - DNA, 18 bp, Homo sapiens
taacacattttgtataat

SEQ ID NO: 3062716 - DNA, 23 bp, Homo sapiens
taacacattttgtataattgtat

SEQ ID NO: 3062717 - DNA, 16 bp, Homo sapiens
taacacctgatgtgta

SEQ ID NO: 3062718 - DNA, 20 bp, Homo sapiens
taacactgaaattgcctgaa

SEQ ID NO: 3062719 - DNA, 21 bp, Homo sapiens
taacactgaaattgcctgaaa

SEQ ID NO: 3062720 - DNA, 13 bp, Homo sapiens
taacactgtttat

SEQ ID NO: 3062721 - DNA, 23 bp, Homo sapiens
taacagaaagggcaacaataaaa

SEQ ID NO: 3062722 - DNA, 22 bp, Homo sapiens
taacagaaatgtttctgtgtca

SEQ ID NO: 3062723 - DNA, 12 bp, Homo sapiens
taacagatgcaa

SEQ ID NO: 3062724 - DNA, 15 bp, Homo sapiens
taacagatgcaatgt

SEQ ID NO: 3062725 - DNA, 21 bp, Homo sapiens
taacagatgcaatgtgctact

SEQ ID NO: 3062726 - DNA, 15 bp, Homo sapiens
taacagattatgtat

SEQ ID NO: 3062727 - DNA, 22 bp, Homo sapiens
taacagattttggggttgtgtt

SEQ ID NO: 3062728 - DNA, 22 bp, Homo sapiens
taacaggttattttagtttctg

SEQ ID NO: 3062729 - DNA, 15 bp, Homo sapiens
taacataataaatta

SEQ ID NO: 3062730 - DNA, 16 bp, Homo sapiens
taacatatctaaagtc

SEQ ID NO: 3062731 - DNA, 17 bp, Homo sapiens
taacatcagccattttt

SEQ ID NO: 3062732 - DNA, 13 bp, Homo sapiens
taacatgaaatga

SEQ ID NO: 3062733 - DNA, 18 bp, Homo sapiens
taacatgtggaagaaaac

SEQ ID NO: 3062734 - DNA, 22 bp, Homo sapiens
taacatgtgttaagtattttca

SEQ ID NO: 3062735 - DNA, 22 bp, Homo sapiens
taacatgtttctctataaagta

SEQ ID NO: 3062736 - DNA, 22 bp, Homo sapiens
taacattccaagactctagagt

SEQ ID NO: 3062737 - DNA, 18 bp, Homo sapiens
taaaatggctgtaatcat

SEQ ID NO: 3062738 - DNA, 17 bp, Homo sapiens
taaaatgtgatgttcta

SEQ ID NO: 3062739 - DNA, 15 bp, Homo sapiens
taaaatgtttactgt

SEQ ID NO: 3062740 - DNA, 18 bp, Homo sapiens
taaaatgtttactgtaaa

SEQ ID NO: 3062741 - DNA, 21 bp, Homo sapiens
taaaatgtttactgtaaattt

SEQ ID NO: 3062742 - DNA, 16 bp, Homo sapiens
taaaattacaaaagag

SEQ ID NO: 3062743 - DNA, 17 bp, Homo sapiens
taaaattacaaaagaga

SEQ ID NO: 3062744 - DNA, 17 bp, Homo sapiens
taaaattacaactaagt

SEQ ID NO: 3062745 - DNA, 19 bp, Homo sapiens
taaaattacaactaagtga

SEQ ID NO: 3062746 - DNA, 12 bp, Homo sapiens
taaaattactaa

SEQ ID NO: 3062747 - DNA, 17 bp, Homo sapiens
taaaattatatagcaaa

SEQ ID NO: 3062748 - DNA, 21 bp, Homo sapiens
taaaattatatagcaaagata

SEQ ID NO: 3062749 - DNA, 16 bp, Homo sapiens
taaaattccttctata

SEQ ID NO: 3062750 - DNA, 22 bp, Homo sapiens
taaaattcgttgaaacgatttc

SEQ ID NO: 3062751 - DNA, 13 bp, Homo sapiens
taaaattgaaagg

SEQ ID NO: 3062752 - DNA, 17 bp, Homo sapiens
taaaattgctaacgttt

SEQ ID NO: 3062753 - DNA, 16 bp, Homo sapiens
taaaatttacatttaa

SEQ ID NO: 3062754 - DNA, 23 bp, Homo sapiens
taaaatttacatttaatacagat

SEQ ID NO: 3062755 - DNA, 15 bp, Homo sapiens
taaaatttagctgcc

SEQ ID NO: 3062756 - DNA, 14 bp, Homo sapiens
taaaatttatattg

SEQ ID NO: 3062757 - DNA, 15 bp, Homo sapiens
taaaattttatgaca

SEQ ID NO: 3062758 - DNA, 22 bp, Homo sapiens
taaaattttttataaactaaag

SEQ ID NO: 3062759 - DNA, 17 bp, Homo sapiens
taaaattttttttcatg

SEQ ID NO: 3062760 - DNA, 23 bp, Homo sapiens
taaaattttttttcatgttttaa

SEQ ID NO: 3062761 - DNA, 14 bp, Homo sapiens
taaacaaaccagaa

SEQ ID NO: 3062762 - DNA, 18 bp, Homo sapiens
taaacaaagattcatgat

SEQ ID NO: 3062763 - DNA, 13 bp, Homo sapiens
taaacaaatgagt

SEQ ID NO: 3062764 - DNA, 18 bp, Homo sapiens
taaacaatatcagacttt

SEQ ID NO: 3062765 - DNA, 23 bp, Homo sapiens
taaacaatgaaatattgctgtat

SEQ ID NO: 3062766 - DNA, 22 bp, Homo sapiens
taaacaatgccaagtcactctt

SEQ ID NO: 3062767 - DNA, 21 bp, Homo sapiens
taaacaatgctgatttggtga

SEQ ID NO: 3062768 - DNA, 14 bp, Homo sapiens
taaacacactagtt

SEQ ID NO: 3062769 - DNA, 22 bp, Homo sapiens
taaacacattaaaagacaaata

SEQ ID NO: 3062770 - DNA, 13 bp, Homo sapiens
taaacagacaata

SEQ ID NO: 3062771 - DNA, 13 bp, Homo sapiens
taaacagatattc

SEQ ID NO: 3062772 - DNA, 12 bp, Homo sapiens
taaacagtgcct

SEQ ID NO: 3062773 - DNA, 20 bp, Homo sapiens
taaacatgaatgaattcttg

SEQ ID NO: 3062774 - DNA, 16 bp, Homo sapiens
taaacattaattggag

SEQ ID NO: 3062775 - DNA, 12 bp, Homo sapiens
taaaccaatttt

SEQ ID NO: 3062776 - DNA, 21 bp, Homo sapiens
taaaccacaaggctgttgcat

SEQ ID NO: 3062777 - DNA, 20 bp, Homo sapiens
taaacccgaatcattgtttt

SEQ ID NO: 3062778 - DNA, 18 bp, Homo sapiens
taaaccctatctgtgatt

SEQ ID NO: 3062779 - DNA, 15 bp, Homo sapiens
taaacctgtgcctcc

SEQ ID NO: 3062780 - DNA, 17 bp, Homo sapiens
taaaccttgtttctttc

SEQ ID NO: 3062781 - DNA, 18 bp, Homo sapiens
taaaccttgtttctttct

SEQ ID NO: 3062782 - DNA, 19 bp, Homo sapiens
taaaccttgtttctttctg

SEQ ID NO: 3062783 - DNA, 17 bp, Homo sapiens
taaacctttttcttgat

SEQ ID NO: 3062784 - DNA, 23 bp, Homo sapiens
taaacctttttcttgatcttaaa

SEQ ID NO: 3062785 - DNA, 19 bp, Homo sapiens
taaacgattagtgatgtcc

SEQ ID NO: 3062786 - DNA, 20 bp, Homo sapiens
taaacggttcagtttcttct

SEQ ID NO: 3062787 - DNA, 19 bp, Homo sapiens
taaacgttaaaagtgtaca

SEQ ID NO: 3062788 - DNA, 20 bp, Homo sapiens
taaacgttaaaagtgtacaa

SEQ ID NO: 3062789 - DNA, 14 bp, Homo sapiens
taaactaaagttgt

SEQ ID NO: 3062790 - DNA, 17 bp, Homo sapiens
taaactactatttttct

SEQ ID NO: 3062791 - DNA, 19 bp, Homo sapiens
taaactactatttttcttt

SEQ ID NO: 3062792 - DNA, 14 bp, Homo sapiens
taaactagagaagg

SEQ ID NO: 3062793 - DNA, 17 bp, Homo sapiens
taaactagatgacctca

SEQ ID NO: 3062794 - DNA, 13 bp, Homo sapiens
taaactcacatag

SEQ ID NO: 3062795 - DNA, 14 bp, Homo sapiens
taaactcatttata

SEQ ID NO: 3062796 - DNA, 24 bp, Homo sapiens
taaactcctactgcttcctctgaa

SEQ ID NO: 3062797 - DNA, 17 bp, Homo sapiens
taaactgaagctgctgt

SEQ ID NO: 3062798 - DNA, 12 bp, Homo sapiens
taaactgcaaat

SEQ ID NO: 3062799 - DNA, 17 bp, Homo sapiens
taaacttagaggaaaat

SEQ ID NO: 3062800 - DNA, 18 bp, Homo sapiens
taaacttagaggaaaatg

SEQ ID NO: 3062801 - DNA, 19 bp, Homo sapiens
taaacttagaggaaaatga

SEQ ID NO: 3062802 - DNA, 21 bp, Homo sapiens
taaacttagaggaaaatgagt

SEQ ID NO: 3062803 - DNA, 12 bp, Homo sapiens
taaacttatgaa

SEQ ID NO: 3062804 - DNA, 13 bp, Homo sapiens
taaacttatgaat

SEQ ID NO: 3062805 - DNA, 15 bp, Homo sapiens
taaacttatgaatgt

SEQ ID NO: 3062806 - DNA, 19 bp, Homo sapiens
taaacttatgaatgtttcc

SEQ ID NO: 3062807 - DNA, 16 bp, Homo sapiens
taaacttgaagcagtc

SEQ ID NO: 3062808 - DNA, 22 bp, Homo sapiens
taaactttcaaattgaaatgac

SEQ ID NO: 3062809 - DNA, 22 bp, Homo sapiens
taaagaaaaatgcacctaaaat

SEQ ID NO: 3062810 - DNA, 23 bp, Homo sapiens
taaagaaaatgtgtctgcaacat

SEQ ID NO: 3062811 - DNA, 9 bp, Homo sapiens
taaagaaag

SEQ ID NO: 3062812 - DNA, 12 bp, Homo sapiens
taaagaaagaga

SEQ ID NO: 3062813 - DNA, 16 bp, Homo sapiens
taaagaaagagagaaa

SEQ ID NO: 3062814 - DNA, 17 bp, Homo sapiens
taaagaaagagagaaaa

SEQ ID NO: 3062815 - DNA, 19 bp, Homo sapiens
taaagaaagagagaaaata

SEQ ID NO: 3062816 - DNA, 23 bp, Homo sapiens
taaagaaagagagaaaataaaaa

SEQ ID NO: 3062817 - DNA, 15 bp, Homo sapiens
taaagaaagtgaaaa

SEQ ID NO: 3062818 - DNA, 19 bp, Homo sapiens
taaagaactgcacatgaag

SEQ ID NO: 3062819 - DNA, 23 bp, Homo sapiens
taaagaactgcacatgaagaaat

SEQ ID NO: 3062820 - DNA, 12 bp, Homo sapiens
taaagaatactt

SEQ ID NO: 3062821 - DNA, 14 bp, Homo sapiens
taaagaatacttga

SEQ ID NO: 3062822 - DNA, 23 bp, Homo sapiens
taaagaatttaagctgtaaatta

SEQ ID NO: 3062823 - DNA, 15 bp, Homo sapiens
taaagacaaagacaa

SEQ ID NO: 3062824 - DNA, 19 bp, Homo sapiens
taaagacaaagacaaattc

SEQ ID NO: 3062825 - DNA, 18 bp, Homo sapiens
taaagactacctgggacc

SEQ ID NO: 3062826 - DNA, 15 bp, Homo sapiens
taaagactgagaccc

SEQ ID NO: 3062827 - DNA, 19 bp, Homo sapiens
taaagaggcgttgctttca

SEQ ID NO: 3062828 - DNA, 18 bp, Homo sapiens
taaagagtctagattcaa

SEQ ID NO: 3062829 - DNA, 12 bp, Homo sapiens
taaagagttatt

SEQ ID NO: 3062830 - DNA, 17 bp, Homo sapiens
taaagatctacatgaat

SEQ ID NO: 3062831 - DNA, 23 bp, Homo sapiens
taaagatgattgttcttttgttt

SEQ ID NO: 3062832 - DNA, 19 bp, Homo sapiens
taaagatggagtttctaag

SEQ ID NO: 3062833 - DNA, 14 bp, Homo sapiens
taaagatgtgaaaa

SEQ ID NO: 3062834 - DNA, 15 bp, Homo sapiens
taaagattattacct

SEQ ID NO: 3062835 - DNA, 18 bp, Homo sapiens
taaagcaaaccagcctca

SEQ ID NO: 3062836 - DNA, 18 bp, Homo sapiens
taaagcactattgtttag

SEQ ID NO: 3062837 - DNA, 21 bp, Homo sapiens
taaagccagtcatcatctctt

SEQ ID NO: 3062838 - DNA, 18 bp, Homo sapiens
taaagcctgaatttggga

SEQ ID NO: 3062839 - DNA, 16 bp, Homo sapiens
taaagcctgcttttta

SEQ ID NO: 3062840 - DNA, 21 bp, Homo sapiens
taaagcctgctttttaagtgt

SEQ ID NO: 3062841 - DNA, 20 bp, Homo sapiens
taaagccttaactaagactc

SEQ ID NO: 3062842 - DNA, 19 bp, Homo sapiens
taaagctgttattcttgtt

SEQ ID NO: 3062843 - DNA, 20 bp, Homo sapiens
taaagctttgaatatctgca

SEQ ID NO: 3062844 - DNA, 14 bp, Homo sapiens
taaaggaaaagcac

SEQ ID NO: 3062845 - DNA, 22 bp, Homo sapiens
taaaggaaaagcacaagaaact

SEQ ID NO: 3062846 - DNA, 13 bp, Homo sapiens
taaaggaaatgat

SEQ ID NO: 3062847 - DNA, 14 bp, Homo sapiens
taaaggaacataaa

SEQ ID NO: 3062848 - DNA, 14 bp, Homo sapiens
taaaggacaaacag

SEQ ID NO: 3062849 - DNA, 19 bp, Homo sapiens
taaaggacaaacagtgaat

SEQ ID NO: 3062850 - DNA, 21 bp, Homo sapiens
taaaggacaaacagtgaattt

SEQ ID NO: 3062851 - DNA, 22 bp, Homo sapiens
taaaggagaggttaaagcaaac

SEQ ID NO: 3062852 - DNA, 16 bp, Homo sapiens
taaaggatggaaaaat

SEQ ID NO: 3062853 - DNA, 19 bp, Homo sapiens
taaaggatggaaaaataaa

SEQ ID NO: 3062854 - DNA, 17 bp, Homo sapiens
taaaggatgttggtgtt

SEQ ID NO: 3062855 - DNA, 18 bp, Homo sapiens
taaaggcagtccagagct

SEQ ID NO: 3062856 - DNA, 21 bp, Homo sapiens
taaaggccctatctgtttaca

SEQ ID NO: 3062857 - DNA, 20 bp, Homo sapiens
taaaggtccacaggtctaga

SEQ ID NO: 3062858 - DNA, 19 bp, Homo sapiens
taaaggtggccacaaattc

SEQ ID NO: 3062859 - DNA, 21 bp, Homo sapiens
taaaggtggtgaggcaataaa

SEQ ID NO: 3062860 - DNA, 15 bp, Homo sapiens
taaagtaaatctctt

SEQ ID NO: 3062861 - DNA, 18 bp, Homo sapiens
taaagtaaatctcttttt

SEQ ID NO: 3062862 - DNA, 19 bp, Homo sapiens
taaagtagtaaaaattaaa

SEQ ID NO: 3062863 - DNA, 13 bp, Homo sapiens
taaagtattcttc

SEQ ID NO: 3062864 - DNA, 18 bp, Homo sapiens
taaagtcatcatgaactg

SEQ ID NO: 3062865 - DNA, 21 bp, Homo sapiens
taaagtcatcatgaactggct

SEQ ID NO: 3062866 - DNA, 23 bp, Homo sapiens
taaagtccctttataaagagtgc

SEQ ID NO: 3062867 - DNA, 19 bp, Homo sapiens
taaagtgactaatggcatg

SEQ ID NO: 3062868 - DNA, 18 bp, Homo sapiens
taaagtgagtactgttaa

SEQ ID NO: 3062869 - DNA, 16 bp, Homo sapiens
taaagtgctaaggttc

SEQ ID NO: 3062870 - DNA, 11 bp, Homo sapiens
taaagtgcttg

SEQ ID NO: 3062871 - DNA, 17 bp, Homo sapiens
taaagtggacttctgaa

SEQ ID NO: 3062872 - DNA, 18 bp, Homo sapiens
taaagtggacttctgaaa

SEQ ID NO: 3062873 - DNA, 14 bp, Homo sapiens
gttttgataaagta

SEQ ID NO: 3062874 - DNA, 21 bp, Homo sapiens
gttttgataggaataattttc

SEQ ID NO: 3062875 - DNA, 20 bp, Homo sapiens
gttttgatttaatgttttca

SEQ ID NO: 3062876 - DNA, 18 bp, Homo sapiens
gttttgctcttgtagccc

SEQ ID NO: 3062877 - DNA, 11 bp, Homo sapiens
gttttgctgct

SEQ ID NO: 3062878 - DNA, 10 bp, Homo sapiens
gttttggaaa

SEQ ID NO: 3062879 - DNA, 12 bp, Homo sapiens
gttttgtaaatg

SEQ ID NO: 3062880 - DNA, 15 bp, Homo sapiens
gttttgtaagccctc

SEQ ID NO: 3062881 - DNA, 18 bp, Homo sapiens
gttttgtaagccctcttt

SEQ ID NO: 3062882 - DNA, 18 bp, Homo sapiens
gttttgtcccataatatg

SEQ ID NO: 3062883 - DNA, 22 bp, Homo sapiens
gttttgtggactgagcgaggaa

SEQ ID NO: 3062884 - DNA, 13 bp, Homo sapiens
gttttgtgtgtat

SEQ ID NO: 3062885 - DNA, 15 bp, Homo sapiens
gtttttaaaaagcaa

SEQ ID NO: 3062886 - DNA, 23 bp, Homo sapiens
gtttttaaatagagtttgctatt

SEQ ID NO: 3062887 - DNA, 20 bp, Homo sapiens
gtttttaaattttgtaatga

SEQ ID NO: 3062888 - DNA, 14 bp, Homo sapiens
gtttttaagggccg

SEQ ID NO: 3062889 - DNA, 17 bp, Homo sapiens
gtttttaataaagacag

SEQ ID NO: 3062890 - DNA, 19 bp, Homo sapiens
gtttttaatcgtttttgtt

SEQ ID NO: 3062891 - DNA, 17 bp, Homo sapiens
gtttttacaagatgtat

SEQ ID NO: 3062892 - DNA, 13 bp, Homo sapiens
gtttttacagtta

SEQ ID NO: 3062893 - DNA, 17 bp, Homo sapiens
gtttttacctctgtctt

SEQ ID NO: 3062894 - DNA, 21 bp, Homo sapiens
gtttttagacaccttcatttt

SEQ ID NO: 3062895 - DNA, 16 bp, Homo sapiens
gtttttatggggctga

SEQ ID NO: 3062896 - DNA, 13 bp, Homo sapiens
gtttttattacaa

SEQ ID NO: 3062897 - DNA, 23 bp, Homo sapiens
gtttttattacaaattttcactg

SEQ ID NO: 3062898 - DNA, 11 bp, Homo sapiens
gtttttcaaga

SEQ ID NO: 3062899 - DNA, 15 bp, Homo sapiens
gtttttccactactg

SEQ ID NO: 3062900 - DNA, 16 bp, Homo sapiens
gtttttccactactgc

SEQ ID NO: 3062901 - DNA, 15 bp, Homo sapiens
gtttttccagttcca

SEQ ID NO: 3062902 - DNA, 20 bp, Homo sapiens
gtttttccatgtgttttgct

SEQ ID NO: 3062903 - DNA, 16 bp, Homo sapiens
gtttttcggacagttt

SEQ ID NO: 3062904 - DNA, 17 bp, Homo sapiens
gtttttctgcttttgaa

SEQ ID NO: 3062905 - DNA, 13 bp, Homo sapiens
gtttttgaaatac

SEQ ID NO: 3062906 - DNA, 12 bp, Homo sapiens
gtttttgcccat

SEQ ID NO: 3062907 - DNA, 23 bp, Homo sapiens
gtttttgctttctgaaattcaca

SEQ ID NO: 3062908 - DNA, 18 bp, Homo sapiens
gtttttggtttttaaaac

SEQ ID NO: 3062909 - DNA, 15 bp, Homo sapiens
gtttttgttcaaagc

SEQ ID NO: 3062910 - DNA, 16 bp, Homo sapiens
gtttttgttttaagga

SEQ ID NO: 3062911 - DNA, 17 bp, Homo sapiens
gttttttaaacaaatga

SEQ ID NO: 3062912 - DNA, 16 bp, Homo sapiens
gttttttgtttgagtt

SEQ ID NO: 3062913 - DNA, 22 bp, Homo sapiens
gtttttttccctccataagttt

SEQ ID NO: 3062914 - DNA, 12 bp, Homo sapiens
gtttttttgaga

SEQ ID NO: 3062915 - DNA, 20 bp, Homo sapiens
gtttttttgtcaacattgtg

SEQ ID NO: 3062916 - DNA, 14 bp, Homo sapiens
gttttttttttgtt

SEQ ID NO: 3062917 - DNA, 22 bp, Homo sapiens
taaaaaaaaaaaaaggaaaaaa

SEQ ID NO: 3062918 - DNA, 16 bp, Homo sapiens
taaaaaaaaaaaagta

SEQ ID NO: 3062919 - DNA, 18 bp, Homo sapiens
taaaaaaaaaaaagttat

SEQ ID NO: 3062920 - DNA, 20 bp, Homo sapiens
taaaaaaaaaatcagtgttt

SEQ ID NO: 3062921 - DNA, 13 bp, Homo sapiens
taaaaaaaatgtg

SEQ ID NO: 3062922 - DNA, 15 bp, Homo sapiens
taaaaaaaatgtgaa

SEQ ID NO: 3062923 - DNA, 19 bp, Homo sapiens
taaaaaaaatgtgaaattt

SEQ ID NO: 3062924 - DNA, 12 bp, Homo sapiens
taaaaaaagaaa

SEQ ID NO: 3062925 - DNA, 14 bp, Homo sapiens
taaaaaaagaaaaa

SEQ ID NO: 3062926 - DNA, 19 bp, Homo sapiens
taaaaaaatttttgcaaat

SEQ ID NO: 3062927 - DNA, 13 bp, Homo sapiens
taaaaaacaagaa

SEQ ID NO: 3062928 - DNA, 17 bp, Homo sapiens
taaaaaacaattaactg

SEQ ID NO: 3062929 - DNA, 18 bp, Homo sapiens
taaaaaagaaattatctt

SEQ ID NO: 3062930 - DNA, 14 bp, Homo sapiens
taaaaaagaagcac

SEQ ID NO: 3062931 - DNA, 17 bp, Homo sapiens
taaaaaagcaaatggaa

SEQ ID NO: 3062932 - DNA, 13 bp, Homo sapiens
taaaaaatatttt

SEQ ID NO: 3062933 - DNA, 14 bp, Homo sapiens
taaaaaatattttc

SEQ ID NO: 3062934 - DNA, 13 bp, Homo sapiens
taaaaaatggaaa

SEQ ID NO: 3062935 - DNA, 15 bp, Homo sapiens
taaaaaatggaaaaa

SEQ ID NO: 3062936 - DNA, 16 bp, Homo sapiens
taaaaaatggaaaaaa

SEQ ID NO: 3062937 - DNA, 15 bp, Homo sapiens
taaaaaatgtatgct

SEQ ID NO: 3062938 - DNA, 17 bp, Homo sapiens
taaaaacagcattgctt

SEQ ID NO: 3062939 - DNA, 18 bp, Homo sapiens
taaaaacagcattgcttt

SEQ ID NO: 3062940 - DNA, 22 bp, Homo sapiens
taaaaacagcattgctttctga

SEQ ID NO: 3062941 - DNA, 18 bp, Homo sapiens
taaaaacgaaaacctgac

SEQ ID NO: 3062942 - DNA, 16 bp, Homo sapiens
taaaaagaaaatcagt

SEQ ID NO: 3062943 - DNA, 12 bp, Homo sapiens
taaaaagaaaga

SEQ ID NO: 3062944 - DNA, 22 bp, Homo sapiens
taaaaagaggatgatttcagaa

SEQ ID NO: 3062945 - DNA, 23 bp, Homo sapiens
taaaaagcagaattttaatgtga

SEQ ID NO: 3062946 - DNA, 20 bp, Homo sapiens
taaaaagcttccatgattct

SEQ ID NO: 3062947 - DNA, 12 bp, Homo sapiens
taaaaaggaagg

SEQ ID NO: 3062948 - DNA, 15 bp, Homo sapiens
taaaaaggaaggaga

SEQ ID NO: 3062949 - DNA, 19 bp, Homo sapiens
taaaaaggcacctataaaa

SEQ ID NO: 3062950 - DNA, 21 bp, Homo sapiens
taaaaagggcagccctcctta

SEQ ID NO: 3062951 - DNA, 17 bp, Homo sapiens
taaaaagtgagaaagaa

SEQ ID NO: 3062952 - DNA, 9 bp, Homo sapiens
taaaaagtt

SEQ ID NO: 3062953 - DNA, 15 bp, Homo sapiens
taaaaagttgttcaa

SEQ ID NO: 3062954 - DNA, 23 bp, Homo sapiens
taaaaatacaattattgtatatt

SEQ ID NO: 3062955 - DNA, 15 bp, Homo sapiens
taaaaatatatgttg

SEQ ID NO: 3062956 - DNA, 13 bp, Homo sapiens
taaaaatatttca

SEQ ID NO: 3062957 - DNA, 17 bp, Homo sapiens
taaaaatatttcagata

SEQ ID NO: 3062958 - DNA, 14 bp, Homo sapiens
taaaaatcaacttt

SEQ ID NO: 3062959 - DNA, 15 bp, Homo sapiens
taaaaatcaactttt

SEQ ID NO: 3062960 - DNA, 14 bp, Homo sapiens
taaaaatcacactg

SEQ ID NO: 3062961 - DNA, 12 bp, Homo sapiens
taaaaatgtata

SEQ ID NO: 3062962 - DNA, 20 bp, Homo sapiens
taaaacaaaacaaaacaaca

SEQ ID NO: 3062963 - DNA, 21 bp, Homo sapiens
taaaacaaaacaaaacaacat

SEQ ID NO: 3062964 - DNA, 17 bp, Homo sapiens
taaaacaatccttacta

SEQ ID NO: 3062965 - DNA, 18 bp, Homo sapiens
taaaacacttctgtcctg

SEQ ID NO: 3062966 - DNA, 17 bp, Homo sapiens
taaaacactttcaaaac

SEQ ID NO: 3062967 - DNA, 14 bp, Homo sapiens
taaaacagaagcct

SEQ ID NO: 3062968 - DNA, 16 bp, Homo sapiens
taaaacatagactgaa

SEQ ID NO: 3062969 - DNA, 21 bp, Homo sapiens
taaaaccatgtagaaaatttg

SEQ ID NO: 3062970 - DNA, 11 bp, Homo sapiens
taaaactaaga

SEQ ID NO: 3062971 - DNA, 18 bp, Homo sapiens
taaaactggacctgtata

SEQ ID NO: 3062972 - DNA, 18 bp, Homo sapiens
taaaactggctttggctt

SEQ ID NO: 3062973 - DNA, 14 bp, Homo sapiens
taaaactgtattta

SEQ ID NO: 3062974 - DNA, 14 bp, Homo sapiens
taaaagaaaaaaac

SEQ ID NO: 3062975 - DNA, 17 bp, Homo sapiens
taaaagaaaatctatta

SEQ ID NO: 3062976 - DNA, 16 bp, Homo sapiens
taaaagacaaatatgt

SEQ ID NO: 3062977 - DNA, 17 bp, Homo sapiens
taaaagacaaatatgta

SEQ ID NO: 3062978 - DNA, 21 bp, Homo sapiens
taaaagacagtgtatgtagaa

SEQ ID NO: 3062979 - DNA, 21 bp, Homo sapiens
taaaagacttccctaacactt

SEQ ID NO: 3062980 - DNA, 17 bp, Homo sapiens
taaaagataaatattat

SEQ ID NO: 3062981 - DNA, 19 bp, Homo sapiens
taaaagatcttcaaaagta

SEQ ID NO: 3062982 - DNA, 16 bp, Homo sapiens
taaaagatgcaatgta

SEQ ID NO: 3062983 - DNA, 14 bp, Homo sapiens
taaaagatgctttt

SEQ ID NO: 3062984 - DNA, 14 bp, Homo sapiens
taaaagattcattt

SEQ ID NO: 3062985 - DNA, 14 bp, Homo sapiens
taaaagctgtggaa

SEQ ID NO: 3062986 - DNA, 15 bp, Homo sapiens
taaaagctgtggaat

SEQ ID NO: 3062987 - DNA, 19 bp, Homo sapiens
taaaaggaagccaaagagt

SEQ ID NO: 3062988 - DNA, 18 bp, Homo sapiens
taaaaggccaaacctctg

SEQ ID NO: 3062989 - DNA, 19 bp, Homo sapiens
taaaagggattacccaagc

SEQ ID NO: 3062990 - DNA, 23 bp, Homo sapiens
taaaagtgggcttgattctgcag

SEQ ID NO: 3062991 - DNA, 14 bp, Homo sapiens
taaaagttctcaat

SEQ ID NO: 3062992 - DNA, 14 bp, Homo sapiens
taaaagttgcaaag

SEQ ID NO: 3062993 - DNA, 15 bp, Homo sapiens
taaaagtttgtcctt

SEQ ID NO: 3062994 - DNA, 18 bp, Homo sapiens
taaaagtttgtcctttaa

SEQ ID NO: 3062995 - DNA, 19 bp, Homo sapiens
taaaataaaaaccaaatta

SEQ ID NO: 3062996 - DNA, 13 bp, Homo sapiens
taaaataaaccaa

SEQ ID NO: 3062997 - DNA, 15 bp, Homo sapiens
taaaataaaccaaat

SEQ ID NO: 3062998 - DNA, 17 bp, Homo sapiens
taaaataatatgtaaat

SEQ ID NO: 3062999 - DNA, 23 bp, Homo sapiens
taaaatagaggctttgagcaact

SEQ ID NO: 3063000 - DNA, 14 bp, Homo sapiens
taaaatataaacaa

SEQ ID NO: 3063001 - DNA, 23 bp, Homo sapiens
taaaatatttaaacctttttctt

SEQ ID NO: 3063002 - DNA, 15 bp, Homo sapiens
taaaatatttatctg

SEQ ID NO: 3063003 - DNA, 15 bp, Homo sapiens
taaaatcccaccaga

SEQ ID NO: 3063004 - DNA, 16 bp, Homo sapiens
taaaatctcttgatta

SEQ ID NO: 3063005 - DNA, 20 bp, Homo sapiens
taaaatcttcagctggtgga

SEQ ID NO: 3063006 - DNA, 13 bp, Homo sapiens
taaaatctttctt

SEQ ID NO: 3063007 - DNA, 15 bp, Homo sapiens
taaaatctttctttg

SEQ ID NO: 3063008 - DNA, 23 bp, Homo sapiens
taaaatctttctttggggaaaaa

SEQ ID NO: 3063009 - DNA, 12 bp, Homo sapiens
taaaatgaatct

SEQ ID NO: 3063010 - DNA, 16 bp, Homo sapiens
taaaatgatgttatac

SEQ ID NO: 3063011 - DNA, 22 bp, Homo sapiens
taaaatggatgccttgaataat

SEQ ID NO: 3063012 - DNA, 16 bp, Homo sapiens
gtttcaaaataaaaac

SEQ ID NO: 3063013 - DNA, 19 bp, Homo sapiens
gtttcaaaataaaaaccaa

SEQ ID NO: 3063014 - DNA, 18 bp, Homo sapiens
gtttcaaacacaaatgca

SEQ ID NO: 3063015 - DNA, 15 bp, Homo sapiens
gtttcaaatctgtaa

SEQ ID NO: 3063016 - DNA, 23 bp, Homo sapiens
gtttcaaggcactctagattcca

SEQ ID NO: 3063017 - DNA, 15 bp, Homo sapiens
gtttcaattcagtgc

SEQ ID NO: 3063018 - DNA, 19 bp, Homo sapiens
gtttcacaaggtctttaaa

SEQ ID NO: 3063019 - DNA, 22 bp, Homo sapiens
gtttcacaggtcaataaactta

SEQ ID NO: 3063020 - DNA, 16 bp, Homo sapiens
gtttcaccatgttagc

SEQ ID NO: 3063021 - DNA, 20 bp, Homo sapiens
gtttcacgagtgttcctgtg

SEQ ID NO: 3063022 - DNA, 21 bp, Homo sapiens
gtttcactgaaatgtttggat

SEQ ID NO: 3063023 - DNA, 16 bp, Homo sapiens
gtttcagctggaaact

SEQ ID NO: 3063024 - DNA, 18 bp, Homo sapiens
gtttcatgtaatcctcaa

SEQ ID NO: 3063025 - DNA, 22 bp, Homo sapiens
gtttcattaagttgtaaaatgt

SEQ ID NO: 3063026 - DNA, 14 bp, Homo sapiens
gtttcattttggtt

SEQ ID NO: 3063027 - DNA, 20 bp, Homo sapiens
gtttccaaatccctttcatg

SEQ ID NO: 3063028 - DNA, 19 bp, Homo sapiens
gtttccagacttccttgag

SEQ ID NO: 3063029 - DNA, 20 bp, Homo sapiens
gtttccagacttccttgaga

SEQ ID NO: 3063030 - DNA, 23 bp, Homo sapiens
gtttccatagctcttcacttcct

SEQ ID NO: 3063031 - DNA, 22 bp, Homo sapiens
gtttcctgaaacaacttggaaa

SEQ ID NO: 3063032 - DNA, 13 bp, Homo sapiens
gtttcctggaagc

SEQ ID NO: 3063033 - DNA, 14 bp, Homo sapiens
gtttccttcagtgc

SEQ ID NO: 3063034 - DNA, 15 bp, Homo sapiens
gtttcgttatattaa

SEQ ID NO: 3063035 - DNA, 15 bp, Homo sapiens
gtttctagggaaatg

SEQ ID NO: 3063036 - DNA, 15 bp, Homo sapiens
gtttctatacaaata

SEQ ID NO: 3063037 - DNA, 23 bp, Homo sapiens
gtttctatacaaatataaatctt

SEQ ID NO: 3063038 - DNA, 20 bp, Homo sapiens
gtttctatgagtggaaaaag

SEQ ID NO: 3063039 - DNA, 12 bp, Homo sapiens
gtttctcagact

SEQ ID NO: 3063040 - DNA, 14 bp, Homo sapiens
gtttctcatttgtt

SEQ ID NO: 3063041 - DNA, 15 bp, Homo sapiens
gtttctcctgagcta

SEQ ID NO: 3063042 - DNA, 22 bp, Homo sapiens
gtttctctcccaacgctgaagc

SEQ ID NO: 3063043 - DNA, 22 bp, Homo sapiens
gtttctctcttgttgtccaggc

SEQ ID NO: 3063044 - DNA, 18 bp, Homo sapiens
gtttctcttgtcttaaaa

SEQ ID NO: 3063045 - DNA, 15 bp, Homo sapiens
gtttctgaatgtttg

SEQ ID NO: 3063046 - DNA, 20 bp, Homo sapiens
gtttctgaatgtttgtgtct

SEQ ID NO: 3063047 - DNA, 22 bp, Homo sapiens
gtttctgtatatgattctctgt

SEQ ID NO: 3063048 - DNA, 13 bp, Homo sapiens
gtttctgtgcatg

SEQ ID NO: 3063049 - DNA, 14 bp, Homo sapiens
gtttctgtgctcca

SEQ ID NO: 3063050 - DNA, 14 bp, Homo sapiens
gtttctgttctgcc

SEQ ID NO: 3063051 - DNA, 20 bp, Homo sapiens
gtttcttctgcgcctcaggc

SEQ ID NO: 3063052 - DNA, 23 bp, Homo sapiens
gtttcttcttcatgcttttgctt

SEQ ID NO: 3063053 - DNA, 17 bp, Homo sapiens
gtttcttgcaagcatgc

SEQ ID NO: 3063054 - DNA, 16 bp, Homo sapiens
gtttctttagcagttt

SEQ ID NO: 3063055 - DNA, 16 bp, Homo sapiens
gtttctttgtgtttgc

SEQ ID NO: 3063056 - DNA, 17 bp, Homo sapiens
gtttctttgtgtttgct

SEQ ID NO: 3063057 - DNA, 14 bp, Homo sapiens
gtttcttttgcaat

SEQ ID NO: 3063058 - DNA, 18 bp, Homo sapiens
gtttgaaattctgaattt

SEQ ID NO: 3063059 - DNA, 15 bp, Homo sapiens
gtttgaaggaaacag

SEQ ID NO: 3063060 - DNA, 19 bp, Homo sapiens
gtttgacagtttttgacat

SEQ ID NO: 3063061 - DNA, 14 bp, Homo sapiens
gtttgactttaaag

SEQ ID NO: 3063062 - DNA, 21 bp, Homo sapiens
gtttgagaccaggctgggcat

SEQ ID NO: 3063063 - DNA, 16 bp, Homo sapiens
gtttgagctcagaccc

SEQ ID NO: 3063064 - DNA, 20 bp, Homo sapiens
gtttgatagtgcttcttgta

SEQ ID NO: 3063065 - DNA, 15 bp, Homo sapiens
gtttgatcagacagc

SEQ ID NO: 3063066 - DNA, 21 bp, Homo sapiens
gtttgattttagctgcagaac

SEQ ID NO: 3063067 - DNA, 21 bp, Homo sapiens
gtttgcagaaaagcacctgcc

SEQ ID NO: 3063068 - DNA, 22 bp, Homo sapiens
gtttgccatactttgtctgaaa

SEQ ID NO: 3063069 - DNA, 15 bp, Homo sapiens
gtttgccttccagaa

SEQ ID NO: 3063070 - DNA, 18 bp, Homo sapiens
gtttgctaaatactgtag

SEQ ID NO: 3063071 - DNA, 14 bp, Homo sapiens
gtttgctgttttaa

SEQ ID NO: 3063072 - DNA, 19 bp, Homo sapiens
gtttgctttgctttgtagg

SEQ ID NO: 3063073 - DNA, 13 bp, Homo sapiens
gtttgcttttgaa

SEQ ID NO: 3063074 - DNA, 21 bp, Homo sapiens
gtttggatctccaattgcctc

SEQ ID NO: 3063075 - DNA, 21 bp, Homo sapiens
gtttggatttcctttatactg

SEQ ID NO: 3063076 - DNA, 15 bp, Homo sapiens
gtttggcaaggaaag

SEQ ID NO: 3063077 - DNA, 21 bp, Homo sapiens
gtttggcccaagactgggctg

SEQ ID NO: 3063078 - DNA, 20 bp, Homo sapiens
gtttgggtattgtgtgagtg

SEQ ID NO: 3063079 - DNA, 17 bp, Homo sapiens
gtttggtcttaggtctt

SEQ ID NO: 3063080 - DNA, 14 bp, Homo sapiens
gtttggtttataat

SEQ ID NO: 3063081 - DNA, 17 bp, Homo sapiens
gtttgtagctttcctgg

SEQ ID NO: 3063082 - DNA, 22 bp, Homo sapiens
gtttgtataccatgatgcatgg

SEQ ID NO: 3063083 - DNA, 12 bp, Homo sapiens
gtttgtcagcat

SEQ ID NO: 3063084 - DNA, 14 bp, Homo sapiens
gtttgtcagcatct

SEQ ID NO: 3063085 - DNA, 16 bp, Homo sapiens
gtttgtcagcatctga

SEQ ID NO: 3063086 - DNA, 16 bp, Homo sapiens
gtttgtcctttaacta

SEQ ID NO: 3063087 - DNA, 15 bp, Homo sapiens
gtttgtctcactttt

SEQ ID NO: 3063088 - DNA, 14 bp, Homo sapiens
gtttgtgagccttg

SEQ ID NO: 3063089 - DNA, 23 bp, Homo sapiens
gtttgtgcctttttatttttgtt

SEQ ID NO: 3063090 - DNA, 13 bp, Homo sapiens
gtttgttactttg

SEQ ID NO: 3063091 - DNA, 21 bp, Homo sapiens
gtttgttatgtgtctggaaga

SEQ ID NO: 3063092 - DNA, 15 bp, Homo sapiens
gtttgttcacactcc

SEQ ID NO: 3063093 - DNA, 23 bp, Homo sapiens
gtttgttcccattggatgcattt

SEQ ID NO: 3063094 - DNA, 16 bp, Homo sapiens
gtttgttgctggcttg

SEQ ID NO: 3063095 - DNA, 12 bp, Homo sapiens
gtttgtttcctg

SEQ ID NO: 3063096 - DNA, 15 bp, Homo sapiens
gttttaaaaagcatc

SEQ ID NO: 3063097 - DNA, 20 bp, Homo sapiens
gttttaaaaaggaactgcag

SEQ ID NO: 3063098 - DNA, 22 bp, Homo sapiens
gttttaaaaaggaactgcagca

SEQ ID NO: 3063099 - DNA, 21 bp, Homo sapiens
gttttaaaacgtgtaaatgaa

SEQ ID NO: 3063100 - DNA, 21 bp, Homo sapiens
gttttaaaactggacctgtat

SEQ ID NO: 3063101 - DNA, 13 bp, Homo sapiens
gttttaaaataat

SEQ ID NO: 3063102 - DNA, 14 bp, Homo sapiens
gttttaaaataata

SEQ ID NO: 3063103 - DNA, 17 bp, Homo sapiens
gttttaaaattatatag

SEQ ID NO: 3063104 - DNA, 15 bp, Homo sapiens
gttttaaagaagtct

SEQ ID NO: 3063105 - DNA, 13 bp, Homo sapiens
gttttaaatgtac

SEQ ID NO: 3063106 - DNA, 16 bp, Homo sapiens
gttttaaatgtacagt

SEQ ID NO: 3063107 - DNA, 21 bp, Homo sapiens
gttttaacaaatgctattaaa

SEQ ID NO: 3063108 - DNA, 21 bp, Homo sapiens
gttttaacttatttatatgaa

SEQ ID NO: 3063109 - DNA, 23 bp, Homo sapiens
gttttaagctaaagcctgaattt

SEQ ID NO: 3063110 - DNA, 17 bp, Homo sapiens
gttttaagttgtttgca

SEQ ID NO: 3063111 - DNA, 18 bp, Homo sapiens
gttttaagttgtttgcat

SEQ ID NO: 3063112 - DNA, 15 bp, Homo sapiens
gttttaatgtaattt

SEQ ID NO: 3063113 - DNA, 13 bp, Homo sapiens
gttttaattccat

SEQ ID NO: 3063114 - DNA, 11 bp, Homo sapiens
gttttacactg

SEQ ID NO: 3063115 - DNA, 17 bp, Homo sapiens
gttttacgcaaggaagg

SEQ ID NO: 3063116 - DNA, 21 bp, Homo sapiens
gttttactacccaaatctaaa

SEQ ID NO: 3063117 - DNA, 21 bp, Homo sapiens
gttttacttacaaaaatggga

SEQ ID NO: 3063118 - DNA, 23 bp, Homo sapiens
gttttagacaaatactcatgtgt

SEQ ID NO: 3063119 - DNA, 20 bp, Homo sapiens
gttttagattttctggttct

SEQ ID NO: 3063120 - DNA, 15 bp, Homo sapiens
gttttaggttctaaa

SEQ ID NO: 3063121 - DNA, 16 bp, Homo sapiens
gttttaggttctaaag

SEQ ID NO: 3063122 - DNA, 17 bp, Homo sapiens
gttttagtgccaggctg

SEQ ID NO: 3063123 - DNA, 22 bp, Homo sapiens
gttttatctccatactttggat

SEQ ID NO: 3063124 - DNA, 14 bp, Homo sapiens
gttttattcctgta

SEQ ID NO: 3063125 - DNA, 20 bp, Homo sapiens
gttttattcctgtatgttgt

SEQ ID NO: 3063126 - DNA, 16 bp, Homo sapiens
gttttattttaaatta

SEQ ID NO: 3063127 - DNA, 17 bp, Homo sapiens
gttttattttggaattg

SEQ ID NO: 3063128 - DNA, 13 bp, Homo sapiens
gttttcaaatcat

SEQ ID NO: 3063129 - DNA, 16 bp, Homo sapiens
gttttcaacctagaaa

SEQ ID NO: 3063130 - DNA, 23 bp, Homo sapiens
gttttcacataaatgcagcccat

SEQ ID NO: 3063131 - DNA, 16 bp, Homo sapiens
gttttcatttggttca

SEQ ID NO: 3063132 - DNA, 17 bp, Homo sapiens
gttttcatttggttcat

SEQ ID NO: 3063133 - DNA, 15 bp, Homo sapiens
gttttccccatgaca

SEQ ID NO: 3063134 - DNA, 20 bp, Homo sapiens
gttttcccttgaggaaacaa

SEQ ID NO: 3063135 - DNA, 17 bp, Homo sapiens
gttttcctatgctttga

SEQ ID NO: 3063136 - DNA, 20 bp, Homo sapiens
gttttccttttattcacata

SEQ ID NO: 3063137 - DNA, 18 bp, Homo sapiens
gttttcgtaccttcccac

SEQ ID NO: 3063138 - DNA, 14 bp, Homo sapiens
gttttcgtcatctt

SEQ ID NO: 3063139 - DNA, 21 bp, Homo sapiens
gttttcgtcatcttccctgcc

SEQ ID NO: 3063140 - DNA, 22 bp, Homo sapiens
gttttctaaaggatgctgctgt

SEQ ID NO: 3063141 - DNA, 17 bp, Homo sapiens
gttttctgctttaaatt

SEQ ID NO: 3063142 - DNA, 19 bp, Homo sapiens
gttttctgggggaaaaagc

SEQ ID NO: 3063143 - DNA, 18 bp, Homo sapiens
gttttctgtgcactgtag

SEQ ID NO: 3063144 - DNA, 12 bp, Homo sapiens
gttttcttccca

SEQ ID NO: 3063145 - DNA, 19 bp, Homo sapiens
gttttcttgttgctttgtt

SEQ ID NO: 3063146 - DNA, 21 bp, Homo sapiens
gttttgaattttgtttttatt

SEQ ID NO: 3063147 - DNA, 18 bp, Homo sapiens
gttttgacatcagccagc

SEQ ID NO: 3063148 - DNA, 18 bp, Homo sapiens
gttgagactcggccgcag

SEQ ID NO: 3063149 - DNA, 16 bp, Homo sapiens
gttgagaggaggactt

SEQ ID NO: 3063150 - DNA, 18 bp, Homo sapiens
gttgagaggaggacttgg

SEQ ID NO: 3063151 - DNA, 21 bp, Homo sapiens
gttgagcttcatataccagca

SEQ ID NO: 3063152 - DNA, 17 bp, Homo sapiens
gttgagggaacagacag

SEQ ID NO: 3063153 - DNA, 19 bp, Homo sapiens
gttgagggaacagacagga

SEQ ID NO: 3063154 - DNA, 22 bp, Homo sapiens
gttgagttacattaaaataaac

SEQ ID NO: 3063155 - DNA, 13 bp, Homo sapiens
gttgataactttg

SEQ ID NO: 3063156 - DNA, 22 bp, Homo sapiens
gttgatagcaagtgaatttttc

SEQ ID NO: 3063157 - DNA, 14 bp, Homo sapiens
gttgatatttctat

SEQ ID NO: 3063158 - DNA, 20 bp, Homo sapiens
gttgatctacccgtgcctgg

SEQ ID NO: 3063159 - DNA, 17 bp, Homo sapiens
gttgatctggaacccag

SEQ ID NO: 3063160 - DNA, 13 bp, Homo sapiens
gttgattaaactc

SEQ ID NO: 3063161 - DNA, 14 bp, Homo sapiens
gttgattgctaaat

SEQ ID NO: 3063162 - DNA, 15 bp, Homo sapiens
gttgattgctaaatg

SEQ ID NO: 3063163 - DNA, 16 bp, Homo sapiens
gttgattgctaaatgt

SEQ ID NO: 3063164 - DNA, 17 bp, Homo sapiens
gttgattgctaaatgta

SEQ ID NO: 3063165 - DNA, 18 bp, Homo sapiens
gttgattgctaaatgtaa

SEQ ID NO: 3063166 - DNA, 22 bp, Homo sapiens
gttgattgctaaatgtaacagt

SEQ ID NO: 3063167 - DNA, 17 bp, Homo sapiens
gttgatttttactgtgt

SEQ ID NO: 3063168 - DNA, 16 bp, Homo sapiens
gttgcaaggccgctgt

SEQ ID NO: 3063169 - DNA, 17 bp, Homo sapiens
gttgcaaggccgctgtt

SEQ ID NO: 3063170 - DNA, 17 bp, Homo sapiens
gttgcactcaagttgtt

SEQ ID NO: 3063171 - DNA, 20 bp, Homo sapiens
gttgcactcaagttgtttaa

SEQ ID NO: 3063172 - DNA, 16 bp, Homo sapiens
gttgcacttttgaatg

SEQ ID NO: 3063173 - DNA, 14 bp, Homo sapiens
gttgcagacaggaa

SEQ ID NO: 3063174 - DNA, 15 bp, Homo sapiens
gttgcagacaggaat

SEQ ID NO: 3063175 - DNA, 20 bp, Homo sapiens
gttgcagacaggaatcttaa

SEQ ID NO: 3063176 - DNA, 12 bp, Homo sapiens
gttgcaggcagt

SEQ ID NO: 3063177 - DNA, 19 bp, Homo sapiens
gttgcaggcagtgtcttaa

SEQ ID NO: 3063178 - DNA, 17 bp, Homo sapiens
gttgcagtctttccccc

SEQ ID NO: 3063179 - DNA, 13 bp, Homo sapiens
gttgcagtgagct

SEQ ID NO: 3063180 - DNA, 21 bp, Homo sapiens
gttgcccctcctccgcatgcc

SEQ ID NO: 3063181 - DNA, 17 bp, Homo sapiens
gttgccctaattcatct

SEQ ID NO: 3063182 - DNA, 18 bp, Homo sapiens
gttgccctaattcatctt

SEQ ID NO: 3063183 - DNA, 23 bp, Homo sapiens
gttgccgcagcggtgggaaggaa

SEQ ID NO: 3063184 - DNA, 11 bp, Homo sapiens
gttgcctcctc

SEQ ID NO: 3063185 - DNA, 13 bp, Homo sapiens
gttgcctcctctc

SEQ ID NO: 3063186 - DNA, 20 bp, Homo sapiens
gttgcctcctctctccctgc

SEQ ID NO: 3063187 - DNA, 20 bp, Homo sapiens
gttgcctctgattttctcca

SEQ ID NO: 3063188 - DNA, 23 bp, Homo sapiens
gttgccttttttatcatttctac

SEQ ID NO: 3063189 - DNA, 13 bp, Homo sapiens
gttgctaaacact

SEQ ID NO: 3063190 - DNA, 15 bp, Homo sapiens
gttgctaaacactgc

SEQ ID NO: 3063191 - DNA, 22 bp, Homo sapiens
gttgctattgtaaggtctttgt

SEQ ID NO: 3063192 - DNA, 23 bp, Homo sapiens
gttgctattgtaaggtctttgta

SEQ ID NO: 3063193 - DNA, 15 bp, Homo sapiens
gttgctcgaagactg

SEQ ID NO: 3063194 - DNA, 20 bp, Homo sapiens
gttgctctaggaagacattt

SEQ ID NO: 3063195 - DNA, 23 bp, Homo sapiens
gttgctctttggctgaaattctt

SEQ ID NO: 3063196 - DNA, 11 bp, Homo sapiens
gttgctgctgc

SEQ ID NO: 3063197 - DNA, 14 bp, Homo sapiens
gttgcttacaattt

SEQ ID NO: 3063198 - DNA, 16 bp, Homo sapiens
gttgcttacaattttt

SEQ ID NO: 3063199 - DNA, 17 bp, Homo sapiens
gttgcttcttgtgaagg

SEQ ID NO: 3063200 - DNA, 14 bp, Homo sapiens
gttgctttgttgca

SEQ ID NO: 3063201 - DNA, 13 bp, Homo sapiens
gttggaagaaata

SEQ ID NO: 3063202 - DNA, 21 bp, Homo sapiens
gttggaattccacgcccggga

SEQ ID NO: 3063203 - DNA, 21 bp, Homo sapiens
gttggacacctttaggttctt

SEQ ID NO: 3063204 - DNA, 16 bp, Homo sapiens
gttggactgtgcctgg

SEQ ID NO: 3063205 - DNA, 20 bp, Homo sapiens
gttggcatttgctggcctgg

SEQ ID NO: 3063206 - DNA, 23 bp, Homo sapiens
gttggcatttgctggcctggcag

SEQ ID NO: 3063207 - DNA, 16 bp, Homo sapiens
gttggcccttccagtg

SEQ ID NO: 3063208 - DNA, 14 bp, Homo sapiens
gttggccctttaat

SEQ ID NO: 3063209 - DNA, 23 bp, Homo sapiens
gttggccctttaatatttccaat

SEQ ID NO: 3063210 - DNA, 19 bp, Homo sapiens
gttggcctcagggccagga

SEQ ID NO: 3063211 - DNA, 15 bp, Homo sapiens
gttggcgctgaggtg

SEQ ID NO: 3063212 - DNA, 16 bp, Homo sapiens
gttgggctgtgcctgg

SEQ ID NO: 3063213 - DNA, 14 bp, Homo sapiens
gttggggaaggcaa

SEQ ID NO: 3063214 - DNA, 16 bp, Homo sapiens
gttggggtctggcagc

SEQ ID NO: 3063215 - DNA, 14 bp, Homo sapiens
gttggtcacatgga

SEQ ID NO: 3063216 - DNA, 14 bp, Homo sapiens
gttggtcaggctgg

SEQ ID NO: 3063217 - DNA, 18 bp, Homo sapiens
gttggtgaccagtttctt

SEQ ID NO: 3063218 - DNA, 17 bp, Homo sapiens
gttgtaaagcaataaaa

SEQ ID NO: 3063219 - DNA, 14 bp, Homo sapiens
gttgtacatgaaat

SEQ ID NO: 3063220 - DNA, 16 bp, Homo sapiens
gttgtacatgaaattt

SEQ ID NO: 3063221 - DNA, 16 bp, Homo sapiens
gttgtagactatggaa

SEQ ID NO: 3063222 - DNA, 15 bp, Homo sapiens
gttgtagtgtccccc

SEQ ID NO: 3063223 - DNA, 15 bp, Homo sapiens
gttgtatataaagtt

SEQ ID NO: 3063224 - DNA, 16 bp, Homo sapiens
gttgtatataaagttt

SEQ ID NO: 3063225 - DNA, 20 bp, Homo sapiens
gttgtattctttgatgttaa

SEQ ID NO: 3063226 - DNA, 16 bp, Homo sapiens
gttgtcacaaactgtg

SEQ ID NO: 3063227 - DNA, 21 bp, Homo sapiens
gttgtcactgcttttggcctg

SEQ ID NO: 3063228 - DNA, 22 bp, Homo sapiens
gttgtcactgcttttggcctgg

SEQ ID NO: 3063229 - DNA, 22 bp, Homo sapiens
gttgtccaattgttgacagttc

SEQ ID NO: 3063230 - DNA, 14 bp, Homo sapiens
gttgtccaggaagt

SEQ ID NO: 3063231 - DNA, 12 bp, Homo sapiens
gttgtctttctt

SEQ ID NO: 3063232 - DNA, 22 bp, Homo sapiens
gttgtctttctttgctgctgtg

SEQ ID NO: 3063233 - DNA, 10 bp, Homo sapiens
gttgtgcagc

SEQ ID NO: 3063234 - DNA, 21 bp, Homo sapiens
gttgtgccacagagtgtagcc

SEQ ID NO: 3063235 - DNA, 22 bp, Homo sapiens
gttgtgccacagagtgtagcca

SEQ ID NO: 3063236 - DNA, 12 bp, Homo sapiens
gttgtgttgtca

SEQ ID NO: 3063237 - DNA, 14 bp, Homo sapiens
gttgtgttgtcacc

SEQ ID NO: 3063238 - DNA, 14 bp, Homo sapiens
gttgttagagaaaa

SEQ ID NO: 3063239 - DNA, 17 bp, Homo sapiens
gttgtttaactgtgcat

SEQ ID NO: 3063240 - DNA, 18 bp, Homo sapiens
gttgtttatatgaaaaca

SEQ ID NO: 3063241 - DNA, 14 bp, Homo sapiens
gttgttttttcata

SEQ ID NO: 3063242 - DNA, 18 bp, Homo sapiens
gttgttttttcatagtgc

SEQ ID NO: 3063243 - DNA, 16 bp, Homo sapiens
gtttaaaaatcaactt

SEQ ID NO: 3063244 - DNA, 22 bp, Homo sapiens
gtttaaaataggggagcctgtg

SEQ ID NO: 3063245 - DNA, 14 bp, Homo sapiens
gtttaaagagtcta

SEQ ID NO: 3063246 - DNA, 12 bp, Homo sapiens
gtttaaagcatt

SEQ ID NO: 3063247 - DNA, 15 bp, Homo sapiens
gtttaaataaagacc

SEQ ID NO: 3063248 - DNA, 18 bp, Homo sapiens
gtttaacttttttcttta

SEQ ID NO: 3063249 - DNA, 14 bp, Homo sapiens
gtttaatcccagca

SEQ ID NO: 3063250 - DNA, 16 bp, Homo sapiens
gtttaatgtgaactct

SEQ ID NO: 3063251 - DNA, 12 bp, Homo sapiens
gtttaatgttta

SEQ ID NO: 3063252 - DNA, 16 bp, Homo sapiens
gtttaatgtttataca

SEQ ID NO: 3063253 - DNA, 22 bp, Homo sapiens
gtttacaagcccccccttccac

SEQ ID NO: 3063254 - DNA, 11 bp, Homo sapiens
gtttacagaat

SEQ ID NO: 3063255 - DNA, 17 bp, Homo sapiens
gtttacaggaaagatgc

SEQ ID NO: 3063256 - DNA, 13 bp, Homo sapiens
gtttacagtgttc

SEQ ID NO: 3063257 - DNA, 15 bp, Homo sapiens
gtttacagtgttccg

SEQ ID NO: 3063258 - DNA, 23 bp, Homo sapiens
gtttaccgtagcgtatacatttg

SEQ ID NO: 3063259 - DNA, 15 bp, Homo sapiens
gtttacctggtgctc

SEQ ID NO: 3063260 - DNA, 22 bp, Homo sapiens
gtttactagggatccctcatct

SEQ ID NO: 3063261 - DNA, 16 bp, Homo sapiens
gtttactatgcctgtg

SEQ ID NO: 3063262 - DNA, 20 bp, Homo sapiens
gtttactatgcctgtgtctt

SEQ ID NO: 3063263 - DNA, 13 bp, Homo sapiens
gtttactgtaaat

SEQ ID NO: 3063264 - DNA, 14 bp, Homo sapiens
gtttactgtaaatt

SEQ ID NO: 3063265 - DNA, 14 bp, Homo sapiens
gtttacttaaagat

SEQ ID NO: 3063266 - DNA, 13 bp, Homo sapiens
gtttactttcaaa

SEQ ID NO: 3063267 - DNA, 20 bp, Homo sapiens
gtttagattgtattaactat

SEQ ID NO: 3063268 - DNA, 15 bp, Homo sapiens
gtttagcttcctcca

SEQ ID NO: 3063269 - DNA, 21 bp, Homo sapiens
gtttaggctggtggcccagga

SEQ ID NO: 3063270 - DNA, 21 bp, Homo sapiens
gtttagtaaatacatcactgt

SEQ ID NO: 3063271 - DNA, 13 bp, Homo sapiens
gtttagtaagttt

SEQ ID NO: 3063272 - DNA, 22 bp, Homo sapiens
gtttagttgcttgctaatattt

SEQ ID NO: 3063273 - DNA, 14 bp, Homo sapiens
gtttataaagccaa

SEQ ID NO: 3063274 - DNA, 15 bp, Homo sapiens
gtttataaagccaag

SEQ ID NO: 3063275 - DNA, 16 bp, Homo sapiens
gtttataaagccaaga

SEQ ID NO: 3063276 - DNA, 11 bp, Homo sapiens
gtttatatttt

SEQ ID NO: 3063277 - DNA, 22 bp, Homo sapiens
gtttatatttttttaactgtga

SEQ ID NO: 3063278 - DNA, 15 bp, Homo sapiens
gtttatcagcaaaaa

SEQ ID NO: 3063279 - DNA, 14 bp, Homo sapiens
gtttatggcagaag

SEQ ID NO: 3063280 - DNA, 21 bp, Homo sapiens
gtttatgttcttatagaataa

SEQ ID NO: 3063281 - DNA, 22 bp, Homo sapiens
gtttatgttcttatagaataaa

SEQ ID NO: 3063282 - DNA, 14 bp, Homo sapiens
gtttattagatgaa

SEQ ID NO: 3063283 - DNA, 16 bp, Homo sapiens
gtttattccaaagagt

SEQ ID NO: 3063284 - DNA, 13 bp, Homo sapiens
gtttattttaaga

SEQ ID NO: 3063285 - DNA, 19 bp, Homo sapiens
gtttcaaaaacacagtgtt

SEQ ID NO: 3063286 - DNA, 14 bp, Homo sapiens
gttcaaaaagtcta

SEQ ID NO: 3063287 - DNA, 14 bp, Homo sapiens
gttcaaaattctaa

SEQ ID NO: 3063288 - DNA, 13 bp, Homo sapiens
gttcaaagccagc

SEQ ID NO: 3063289 - DNA, 13 bp, Homo sapiens
gttcaactacatg

SEQ ID NO: 3063290 - DNA, 15 bp, Homo sapiens
gttcaagaggcgtgt

SEQ ID NO: 3063291 - DNA, 21 bp, Homo sapiens
gttcaagcgattctcctgcct

SEQ ID NO: 3063292 - DNA, 19 bp, Homo sapiens
gttcaaggccatccttccc

SEQ ID NO: 3063293 - DNA, 15 bp, Homo sapiens
gttcacacagcccag

SEQ ID NO: 3063294 - DNA, 13 bp, Homo sapiens
gttcacagaaaaa

SEQ ID NO: 3063295 - DNA, 15 bp, Homo sapiens
gttcacagcagcttt

SEQ ID NO: 3063296 - DNA, 20 bp, Homo sapiens
gttcacatatgattctctta

SEQ ID NO: 3063297 - DNA, 22 bp, Homo sapiens
gttcaccagagaaagcttgagg

SEQ ID NO: 3063298 - DNA, 16 bp, Homo sapiens
gttcacccacagggct

SEQ ID NO: 3063299 - DNA, 19 bp, Homo sapiens
gttcacgccattctcctgc

SEQ ID NO: 3063300 - DNA, 21 bp, Homo sapiens
gttcacttaaaagctggcttt

SEQ ID NO: 3063301 - DNA, 11 bp, Homo sapiens
gttcacttttt

SEQ ID NO: 3063302 - DNA, 12 bp, Homo sapiens
gttcactttttt

SEQ ID NO: 3063303 - DNA, 23 bp, Homo sapiens
gttcagccaaacagtatgatgga

SEQ ID NO: 3063304 - DNA, 21 bp, Homo sapiens
gttcagcccctcctctgccac

SEQ ID NO: 3063305 - DNA, 22 bp, Homo sapiens
gttcagccggcactgagaagaa

SEQ ID NO: 3063306 - DNA, 15 bp, Homo sapiens
gttcagcctgtctcc

SEQ ID NO: 3063307 - DNA, 13 bp, Homo sapiens
gttcagctactcc

SEQ ID NO: 3063308 - DNA, 23 bp, Homo sapiens
gttcagggaactgcttgcccagg

SEQ ID NO: 3063309 - DNA, 16 bp, Homo sapiens
gttcagggcttttctt

SEQ ID NO: 3063310 - DNA, 13 bp, Homo sapiens
gttcaggtagctg

SEQ ID NO: 3063311 - DNA, 13 bp, Homo sapiens
gttcagtgtaatt

SEQ ID NO: 3063312 - DNA, 15 bp, Homo sapiens
gttcagttccagctt

SEQ ID NO: 3063313 - DNA, 19 bp, Homo sapiens
gttcataactgctacttgc

SEQ ID NO: 3063314 - DNA, 14 bp, Homo sapiens
gttcatcatccctc

SEQ ID NO: 3063315 - DNA, 20 bp, Homo sapiens
gttcatctggaagtattttc

SEQ ID NO: 3063316 - DNA, 13 bp, Homo sapiens
gttcattccacag

SEQ ID NO: 3063317 - DNA, 16 bp, Homo sapiens
gttcattccacaggac

SEQ ID NO: 3063318 - DNA, 21 bp, Homo sapiens
gttcattggcattctttgcaa

SEQ ID NO: 3063319 - DNA, 12 bp, Homo sapiens
gttcatttctgt

SEQ ID NO: 3063320 - DNA, 13 bp, Homo sapiens
gttcatttctgtc

SEQ ID NO: 3063321 - DNA, 13 bp, Homo sapiens
gttcattttgtca

SEQ ID NO: 3063322 - DNA, 19 bp, Homo sapiens
gttcatttttatcccttcc

SEQ ID NO: 3063323 - DNA, 14 bp, Homo sapiens
gttccacaaagcag

SEQ ID NO: 3063324 - DNA, 14 bp, Homo sapiens
gttccagcaccaca

SEQ ID NO: 3063325 - DNA, 12 bp, Homo sapiens
gttccagtgctg

SEQ ID NO: 3063326 - DNA, 15 bp, Homo sapiens
gttcccacaagcctg

SEQ ID NO: 3063327 - DNA, 13 bp, Homo sapiens
gttccccacccct

SEQ ID NO: 3063328 - DNA, 12 bp, Homo sapiens
gttccccagaga

SEQ ID NO: 3063329 - DNA, 13 bp, Homo sapiens
gttccccagagaa

SEQ ID NO: 3063330 - DNA, 15 bp, Homo sapiens
gttccccttccactg

SEQ ID NO: 3063331 - DNA, 22 bp, Homo sapiens
gttccccttccactgagggcag

SEQ ID NO: 3063332 - DNA, 14 bp, Homo sapiens
gttcccttgaccat

SEQ ID NO: 3063333 - DNA, 20 bp, Homo sapiens
gttcccttgaccattggctg

SEQ ID NO: 3063334 - DNA, 18 bp, Homo sapiens
gttcctagaggagacagc

SEQ ID NO: 3063335 - DNA, 16 bp, Homo sapiens
gttcctagccaccgcc

SEQ ID NO: 3063336 - DNA, 14 bp, Homo sapiens
gttcctctctccca

SEQ ID NO: 3063337 - DNA, 22 bp, Homo sapiens
gttcctctttggtgtacagact

SEQ ID NO: 3063338 - DNA, 14 bp, Homo sapiens
gttcctgctccgtg

SEQ ID NO: 3063339 - DNA, 15 bp, Homo sapiens
gttcctgctgcctgg

SEQ ID NO: 3063340 - DNA, 17 bp, Homo sapiens
gttcctgctgcctgggt

SEQ ID NO: 3063341 - DNA, 19 bp, Homo sapiens
gttcctgctgtcctggtgg

SEQ ID NO: 3063342 - DNA, 20 bp, Homo sapiens
gttcctgtttatttttaaat

SEQ ID NO: 3063343 - DNA, 14 bp, Homo sapiens
gttccttctgtgaa

SEQ ID NO: 3063344 - DNA, 18 bp, Homo sapiens
gttccttctgtgaagaag

SEQ ID NO: 3063345 - DNA, 12 bp, Homo sapiens
gttccttgcttt

SEQ ID NO: 3063346 - DNA, 18 bp, Homo sapiens
gttccttgcttttatagt

SEQ ID NO: 3063347 - DNA, 21 bp, Homo sapiens
gttcctttccaacgtttggaa

SEQ ID NO: 3063348 - DNA, 23 bp, Homo sapiens
gttcctttttaaatgtgaatttt

SEQ ID NO: 3063349 - DNA, 19 bp, Homo sapiens
gttcgagaccaacctgacc

SEQ ID NO: 3063350 - DNA, 15 bp, Homo sapiens
gttcgagaccagcct

SEQ ID NO: 3063351 - DNA, 14 bp, Homo sapiens
gttcgcatggtcac

SEQ ID NO: 3063352 - DNA, 15 bp, Homo sapiens
gttcgcctctggccc

SEQ ID NO: 3063353 - DNA, 15 bp, Homo sapiens
gttcgcctggagccc

SEQ ID NO: 3063354 - DNA, 17 bp, Homo sapiens
gttcggtttttttcctg

SEQ ID NO: 3063355 - DNA, 19 bp, Homo sapiens
gttcggtttttttcctgtt

SEQ ID NO: 3063356 - DNA, 18 bp, Homo sapiens
gttcgttcaaaagtggag

SEQ ID NO: 3063357 - DNA, 14 bp, Homo sapiens
gttcgttggttata

SEQ ID NO: 3063358 - DNA, 14 bp, Homo sapiens
gttctaaagatgga

SEQ ID NO: 3063359 - DNA, 17 bp, Homo sapiens
gttctaaagatggaaaa

SEQ ID NO: 3063360 - DNA, 20 bp, Homo sapiens
gttctaaagatggaaaaacc

SEQ ID NO: 3063361 - DNA, 14 bp, Homo sapiens
gttctaaagttcta

SEQ ID NO: 3063362 - DNA, 17 bp, Homo sapiens
gttctaaagttctaaga

SEQ ID NO: 3063363 - DNA, 13 bp, Homo sapiens
gttctaacttatt

SEQ ID NO: 3063364 - DNA, 15 bp, Homo sapiens
gttctaagactcaaa

SEQ ID NO: 3063365 - DNA, 13 bp, Homo sapiens
gttctaagatgtg

SEQ ID NO: 3063366 - DNA, 15 bp, Homo sapiens
gttctaagattctga

SEQ ID NO: 3063367 - DNA, 22 bp, Homo sapiens
gttctaaggcctaggattctaa

SEQ ID NO: 3063368 - DNA, 11 bp, Homo sapiens
gttctaaggct

SEQ ID NO: 3063369 - DNA, 14 bp, Homo sapiens
gttctaaggctctg

SEQ ID NO: 3063370 - DNA, 16 bp, Homo sapiens
gttctaagtttctaag

SEQ ID NO: 3063371 - DNA, 17 bp, Homo sapiens
gttctaagtttctaaga

SEQ ID NO: 3063372 - DNA, 20 bp, Homo sapiens
gttctagacatggaggttct

SEQ ID NO: 3063373 - DNA, 23 bp, Homo sapiens
gttctagcacttcatctggctgc

SEQ ID NO: 3063374 - DNA, 22 bp, Homo sapiens
gttctaggcactgtagttctaa

SEQ ID NO: 3063375 - DNA, 23 bp, Homo sapiens
gttctaggcactgtagttctaag

SEQ ID NO: 3063376 - DNA, 19 bp, Homo sapiens
gttctaggtttcaaagatg

SEQ ID NO: 3063377 - DNA, 15 bp, Homo sapiens
gttctagtttgcatt

SEQ ID NO: 3063378 - DNA, 13 bp, Homo sapiens
gttctcagagcac

SEQ ID NO: 3063379 - DNA, 18 bp, Homo sapiens
gttctcagcttgcagctg

SEQ ID NO: 3063380 - DNA, 17 bp, Homo sapiens
gttctccactaatactg

SEQ ID NO: 3063381 - DNA, 21 bp, Homo sapiens
gttctccttttgaacttgtca

SEQ ID NO: 3063382 - DNA, 21 bp, Homo sapiens
gttctcgttgccctaattcat

SEQ ID NO: 3063383 - DNA, 17 bp, Homo sapiens
gttctgagagaaaaaga

SEQ ID NO: 3063384 - DNA, 13 bp, Homo sapiens
gttctgcctgcca

SEQ ID NO: 3063385 - DNA, 18 bp, Homo sapiens
gttctgctagagcagaca

SEQ ID NO: 3063386 - DNA, 15 bp, Homo sapiens
gttctgctcatcatt

SEQ ID NO: 3063387 - DNA, 14 bp, Homo sapiens
gttctgctttctcc

SEQ ID NO: 3063388 - DNA, 16 bp, Homo sapiens
gttctgcttttaagtt

SEQ ID NO: 3063389 - DNA, 12 bp, Homo sapiens
gttctggccaga

SEQ ID NO: 3063390 - DNA, 13 bp, Homo sapiens
gttctggccagaa

SEQ ID NO: 3063391 - DNA, 16 bp, Homo sapiens
gttctggggggaccca

SEQ ID NO: 3063392 - DNA, 10 bp, Homo sapiens
gttctgggtg

SEQ ID NO: 3063393 - DNA, 18 bp, Homo sapiens
gttctgtagagccaatta

SEQ ID NO: 3063394 - DNA, 18 bp, Homo sapiens
gttctgtagctttctgga

SEQ ID NO: 3063395 - DNA, 12 bp, Homo sapiens
gttctgtgaaga

SEQ ID NO: 3063396 - DNA, 15 bp, Homo sapiens
gttctgtgaagagga

SEQ ID NO: 3063397 - DNA, 10 bp, Homo sapiens
gttctgtgac

SEQ ID NO: 3063398 - DNA, 11 bp, Homo sapiens
gttctgtgcac

SEQ ID NO: 3063399 - DNA, 12 bp, Homo sapiens
gttctgtggaaa

SEQ ID NO: 3063400 - DNA, 14 bp, Homo sapiens
gttctgtggaaagt

SEQ ID NO: 3063401 - DNA, 16 bp, Homo sapiens
gttctgtggaaagtgt

SEQ ID NO: 3063402 - DNA, 17 bp, Homo sapiens
gttctgtggaaagtgta

SEQ ID NO: 3063403 - DNA, 20 bp, Homo sapiens
gttctgtggaaagtgtaaag

SEQ ID NO: 3063404 - DNA, 16 bp, Homo sapiens
gttcttatagaataaa

SEQ ID NO: 3063405 - DNA, 22 bp, Homo sapiens
gttcttattaccctgattgaat

SEQ ID NO: 3063406 - DNA, 18 bp, Homo sapiens
gttcttcctgtctccttt

SEQ ID NO: 3063407 - DNA, 14 bp, Homo sapiens
gttcttcgaggtgg

SEQ ID NO: 3063408 - DNA, 13 bp, Homo sapiens
gttctttatatac

SEQ ID NO: 3063409 - DNA, 14 bp, Homo sapiens
gttctttgccagag

SEQ ID NO: 3063410 - DNA, 23 bp, Homo sapiens
gttctttgctgcattctgcctct

SEQ ID NO: 3063411 - DNA, 16 bp, Homo sapiens
gttctttgttcctgct

SEQ ID NO: 3063412 - DNA, 18 bp, Homo sapiens
gttctttgttcctgcttt

SEQ ID NO: 3063413 - DNA, 17 bp, Homo sapiens
gttctttttaagttaat

SEQ ID NO: 3063414 - DNA, 16 bp, Homo sapiens
gttgaaagcaaaaatg

SEQ ID NO: 3063415 - DNA, 16 bp, Homo sapiens
gttgaagactttgttt

SEQ ID NO: 3063416 - DNA, 22 bp, Homo sapiens
gttgaaggttaaaggaaaagca

SEQ ID NO: 3063417 - DNA, 15 bp, Homo sapiens
gttgacacaggtctt

SEQ ID NO: 3063418 - DNA, 19 bp, Homo sapiens
gttgacaggtacttggagg

SEQ ID NO: 3063419 - DNA, 19 bp, Homo sapiens
gttgacatatttaatgttt

SEQ ID NO: 3063420 - DNA, 17 bp, Homo sapiens
gttgaccactccagaga

SEQ ID NO: 3063421 - DNA, 22 bp, Homo sapiens
gttgaccatgtctatgattcgt

SEQ ID NO: 3063422 - DNA, 22 bp, Homo sapiens
gttgacccaaaaatgttccctt

SEQ ID NO: 3063423 - DNA, 21 bp, Homo sapiens
gttgactcaagtttttacaaa

SEQ ID NO: 3063424 - DNA, 15 bp, Homo sapiens
gttgactgctgctcc

SEQ ID NO: 3063425 - DNA, 21 bp, Homo sapiens
gtgttcaccagagaaagcttg

SEQ ID NO: 3063426 - DNA, 16 bp, Homo sapiens
gtgttcactgaagacg

SEQ ID NO: 3063427 - DNA, 22 bp, Homo sapiens
gtgttcagccaaacagtatgat

SEQ ID NO: 3063428 - DNA, 22 bp, Homo sapiens
gtgttccccttccactgagggc

SEQ ID NO: 3063429 - DNA, 13 bp, Homo sapiens
gtgttcctgagac

SEQ ID NO: 3063430 - DNA, 17 bp, Homo sapiens
gtgttccttctgtgaag

SEQ ID NO: 3063431 - DNA, 18 bp, Homo sapiens
gtgttccttctgtgaaga

SEQ ID NO: 3063432 - DNA, 19 bp, Homo sapiens
gtgttccttctgtgaagaa

SEQ ID NO: 3063433 - DNA, 21 bp, Homo sapiens
gtgttcctttttaaatgtgaa

SEQ ID NO: 3063434 - DNA, 14 bp, Homo sapiens
gtgttgaccggctg

SEQ ID NO: 3063435 - DNA, 21 bp, Homo sapiens
gtgttgaccggctgccgtttg

SEQ ID NO: 3063436 - DNA, 14 bp, Homo sapiens
gtgttgactgctgc

SEQ ID NO: 3063437 - DNA, 20 bp, Homo sapiens
gtgttgcaaatcactctgca

SEQ ID NO: 3063438 - DNA, 14 bp, Homo sapiens
gtgttggacagaga

SEQ ID NO: 3063439 - DNA, 16 bp, Homo sapiens
gtgttgtccaggaagt

SEQ ID NO: 3063440 - DNA, 14 bp, Homo sapiens
gtgttgtcccttct

SEQ ID NO: 3063441 - DNA, 18 bp, Homo sapiens
gtgttgtcttgaaagatt

SEQ ID NO: 3063442 - DNA, 21 bp, Homo sapiens
gtgttgttgcttcttgtgaag

SEQ ID NO: 3063443 - DNA, 12 bp, Homo sapiens
gtgttgtttcca

SEQ ID NO: 3063444 - DNA, 17 bp, Homo sapiens
gtgtttaaataaagacc

SEQ ID NO: 3063445 - DNA, 20 bp, Homo sapiens
gtgtttccctagactctgta

SEQ ID NO: 3063446 - DNA, 15 bp, Homo sapiens
gtgtttctagaatca

SEQ ID NO: 3063447 - DNA, 11 bp, Homo sapiens
gtgtttctagg

SEQ ID NO: 3063448 - DNA, 12 bp, Homo sapiens
gtgtttctatga

SEQ ID NO: 3063449 - DNA, 13 bp, Homo sapiens
gtgtttctccctc

SEQ ID NO: 3063450 - DNA, 16 bp, Homo sapiens
gtgtttctgtgctcca

SEQ ID NO: 3063451 - DNA, 14 bp, Homo sapiens
gtgtttgcttggtg

SEQ ID NO: 3063452 - DNA, 13 bp, Homo sapiens
gtgtttgctttct

SEQ ID NO: 3063453 - DNA, 15 bp, Homo sapiens
gtgttttataaaata

SEQ ID NO: 3063454 - DNA, 14 bp, Homo sapiens
gtgttttcaaggaa

SEQ ID NO: 3063455 - DNA, 21 bp, Homo sapiens
gtgttttcaaggaagaaaacg

SEQ ID NO: 3063456 - DNA, 19 bp, Homo sapiens
gtgttttcatcatttcagc

SEQ ID NO: 3063457 - DNA, 14 bp, Homo sapiens
gtgttttctgtgta

SEQ ID NO: 3063458 - DNA, 16 bp, Homo sapiens
gtgttttctgtgtaac

SEQ ID NO: 3063459 - DNA, 19 bp, Homo sapiens
gtgttttttaggaaaagca

SEQ ID NO: 3063460 - DNA, 22 bp, Homo sapiens
gtgttttttaggaaaagcatct

SEQ ID NO: 3063461 - DNA, 15 bp, Homo sapiens
gttaaaaaaatggca

SEQ ID NO: 3063462 - DNA, 14 bp, Homo sapiens
gttaaaatgtttac

SEQ ID NO: 3063463 - DNA, 18 bp, Homo sapiens
gttaaaatgtttactgta

SEQ ID NO: 3063464 - DNA, 15 bp, Homo sapiens
gttaaactgattagt

SEQ ID NO: 3063465 - DNA, 12 bp, Homo sapiens
gttaaagatgca

SEQ ID NO: 3063466 - DNA, 16 bp, Homo sapiens
gttaaaggcagtccag

SEQ ID NO: 3063467 - DNA, 22 bp, Homo sapiens
gttaaaggcagtccagagcttt

SEQ ID NO: 3063468 - DNA, 20 bp, Homo sapiens
gttaaagtcacacatttcta

SEQ ID NO: 3063469 - DNA, 20 bp, Homo sapiens
gttaaagtcagtgggaacgt

SEQ ID NO: 3063470 - DNA, 11 bp, Homo sapiens
gttaaatgtat

SEQ ID NO: 3063471 - DNA, 12 bp, Homo sapiens
gttaacacattt

SEQ ID NO: 3063472 - DNA, 12 bp, Homo sapiens
gttaacagagca

SEQ ID NO: 3063473 - DNA, 13 bp, Homo sapiens
gttaacagagcaa

SEQ ID NO: 3063474 - DNA, 19 bp, Homo sapiens
gttaacgtgatgtgccact

SEQ ID NO: 3063475 - DNA, 17 bp, Homo sapiens
gttaactgatttgcaat

SEQ ID NO: 3063476 - DNA, 16 bp, Homo sapiens
gttaagaaagcactta

SEQ ID NO: 3063477 - DNA, 21 bp, Homo sapiens
gttaagaataataaaatactt

SEQ ID NO: 3063478 - DNA, 17 bp, Homo sapiens
gttaagacatgatttcc

SEQ ID NO: 3063479 - DNA, 14 bp, Homo sapiens
gttaagacctggca

SEQ ID NO: 3063480 - DNA, 14 bp, Homo sapiens
gttaaggaaagaaa

SEQ ID NO: 3063481 - DNA, 14 bp, Homo sapiens
gttaaggaatataa

SEQ ID NO: 3063482 - DNA, 16 bp, Homo sapiens
gttaaggctgaggaaa

SEQ ID NO: 3063483 - DNA, 20 bp, Homo sapiens
gttaagtgggcattttgaca

SEQ ID NO: 3063484 - DNA, 17 bp, Homo sapiens
gttaatcatatttgaaa

SEQ ID NO: 3063485 - DNA, 23 bp, Homo sapiens
gttaatccaatcaatttaaatgt

SEQ ID NO: 3063486 - DNA, 23 bp, Homo sapiens
gttaatgttatatcatatgtata

SEQ ID NO: 3063487 - DNA, 15 bp, Homo sapiens
gttaattagcattct

SEQ ID NO: 3063488 - DNA, 20 bp, Homo sapiens
gttaattataaacagcaggg

SEQ ID NO: 3063489 - DNA, 16 bp, Homo sapiens
gttaattatgtacaac

SEQ ID NO: 3063490 - DNA, 15 bp, Homo sapiens
gttaatttttacatg

SEQ ID NO: 3063491 - DNA, 18 bp, Homo sapiens
gttaatttttccttcctc

SEQ ID NO: 3063492 - DNA, 20 bp, Homo sapiens
gttacaacagatttgtgaac

SEQ ID NO: 3063493 - DNA, 21 bp, Homo sapiens
gttacaacagatttgtgaact

SEQ ID NO: 3063494 - DNA, 20 bp, Homo sapiens
gttacaataaaactaaatgt

SEQ ID NO: 3063495 - DNA, 12 bp, Homo sapiens
gttacagaaagt

SEQ ID NO: 3063496 - DNA, 22 bp, Homo sapiens
gttacagaaagtggtgctcagt

SEQ ID NO: 3063497 - DNA, 13 bp, Homo sapiens
gttacagagacct

SEQ ID NO: 3063498 - DNA, 16 bp, Homo sapiens
gttacatctgtgcagg

SEQ ID NO: 3063499 - DNA, 19 bp, Homo sapiens
gttacatgcatacttcaaa

SEQ ID NO: 3063500 - DNA, 23 bp, Homo sapiens
gttacatgcatacttcaaaagta

SEQ ID NO: 3063501 - DNA, 19 bp, Homo sapiens
gttaccaaatacacatttc

SEQ ID NO: 3063502 - DNA, 16 bp, Homo sapiens
gttacccactgccatg

SEQ ID NO: 3063503 - DNA, 17 bp, Homo sapiens
gttacccactgccatgc

SEQ ID NO: 3063504 - DNA, 20 bp, Homo sapiens
gttacccagggtggagtgca

SEQ ID NO: 3063505 - DNA, 14 bp, Homo sapiens
gttacccatgaaaa

SEQ ID NO: 3063506 - DNA, 21 bp, Homo sapiens
gttacctgatcaatgacagag

SEQ ID NO: 3063507 - DNA, 14 bp, Homo sapiens
gttactatctgctt

SEQ ID NO: 3063508 - DNA, 17 bp, Homo sapiens
gttactcagccctgggc

SEQ ID NO: 3063509 - DNA, 16 bp, Homo sapiens
gttactccagtgccaa

SEQ ID NO: 3063510 - DNA, 19 bp, Homo sapiens
gttactccctacactgatg

SEQ ID NO: 3063511 - DNA, 14 bp, Homo sapiens
gttactctccaacc

SEQ ID NO: 3063512 - DNA, 11 bp, Homo sapiens
gttactctgaa

SEQ ID NO: 3063513 - DNA, 14 bp, Homo sapiens
gttactgggccctg

SEQ ID NO: 3063514 - DNA, 16 bp, Homo sapiens
gttactgttgtgacct

SEQ ID NO: 3063515 - DNA, 12 bp, Homo sapiens
gttacttaaaca

SEQ ID NO: 3063516 - DNA, 12 bp, Homo sapiens
gttacttaagat

SEQ ID NO: 3063517 - DNA, 14 bp, Homo sapiens
gttacttgaagtaa

SEQ ID NO: 3063518 - DNA, 21 bp, Homo sapiens
gttactttaaaaatcagtttt

SEQ ID NO: 3063519 - DNA, 18 bp, Homo sapiens
gttactttcttaatgtga

SEQ ID NO: 3063520 - DNA, 16 bp, Homo sapiens
gttactttgaatagtc

SEQ ID NO: 3063521 - DNA, 20 bp, Homo sapiens
gttagaattccttcagggtg

SEQ ID NO: 3063522 - DNA, 20 bp, Homo sapiens
gttagatgggaggatgaatt

SEQ ID NO: 3063523 - DNA, 18 bp, Homo sapiens
gttagcagacaggccccg

SEQ ID NO: 3063524 - DNA, 15 bp, Homo sapiens
gttagcatccaggct

SEQ ID NO: 3063525 - DNA, 21 bp, Homo sapiens
gttagcatccaggctggccag

SEQ ID NO: 3063526 - DNA, 21 bp, Homo sapiens
gttagcatttaccaacatgta

SEQ ID NO: 3063527 - DNA, 18 bp, Homo sapiens
gttaggccaactgcctcc

SEQ ID NO: 3063528 - DNA, 21 bp, Homo sapiens
gttagtctactcttaagccat

SEQ ID NO: 3063529 - DNA, 14 bp, Homo sapiens
gttagtgacattta

SEQ ID NO: 3063530 - DNA, 17 bp, Homo sapiens
gttagttatagatgtct

SEQ ID NO: 3063531 - DNA, 19 bp, Homo sapiens
gttagttatagatgtctag

SEQ ID NO: 3063532 - DNA, 22 bp, Homo sapiens
gttagtttagtgtgtgtgcaga

SEQ ID NO: 3063533 - DNA, 14 bp, Homo sapiens
gttataaaagtgat

SEQ ID NO: 3063534 - DNA, 17 bp, Homo sapiens
gttataacttcataaaa

SEQ ID NO: 3063535 - DNA, 13 bp, Homo sapiens
gttataagactct

SEQ ID NO: 3063536 - DNA, 15 bp, Homo sapiens
gttatatttcagatg

SEQ ID NO: 3063537 - DNA, 21 bp, Homo sapiens
gttatatttcagatgtaatgt

SEQ ID NO: 3063538 - DNA, 13 bp, Homo sapiens
gttatcatcctcc

SEQ ID NO: 3063539 - DNA, 22 bp, Homo sapiens
gttatccagaagtattgtttac

SEQ ID NO: 3063540 - DNA, 23 bp, Homo sapiens
gttatccagaagtattgtttaca

SEQ ID NO: 3063541 - DNA, 15 bp, Homo sapiens
gttatctaagttaat

SEQ ID NO: 3063542 - DNA, 15 bp, Homo sapiens
gttatcttaacactg

SEQ ID NO: 3063543 - DNA, 19 bp, Homo sapiens
gttatcttctcaagttcta

SEQ ID NO: 3063544 - DNA, 17 bp, Homo sapiens
gttatgatggaaaggaa

SEQ ID NO: 3063545 - DNA, 15 bp, Homo sapiens
gttatggtgtttctc

SEQ ID NO: 3063546 - DNA, 12 bp, Homo sapiens
gttatgtatttc

SEQ ID NO: 3063547 - DNA, 22 bp, Homo sapiens
gttatgtcagaggaacagtcct

SEQ ID NO: 3063548 - DNA, 17 bp, Homo sapiens
gttattataaatgttag

SEQ ID NO: 3063549 - DNA, 17 bp, Homo sapiens
gttattatatttacaaa

SEQ ID NO: 3063550 - DNA, 20 bp, Homo sapiens
gttattatatttacaaatgg

SEQ ID NO: 3063551 - DNA, 18 bp, Homo sapiens
gttattatatttgacatg

SEQ ID NO: 3063552 - DNA, 15 bp, Homo sapiens
gttattattgttaat

SEQ ID NO: 3063553 - DNA, 20 bp, Homo sapiens
gttattcttcaaacacaagt

SEQ ID NO: 3063554 - DNA, 22 bp, Homo sapiens
gttattcttttccagaaagaaa

SEQ ID NO: 3063555 - DNA, 18 bp, Homo sapiens
gttattggatcagtgaaa

SEQ ID NO: 3063556 - DNA, 11 bp, Homo sapiens
gttatttaaat

SEQ ID NO: 3063557 - DNA, 15 bp, Homo sapiens
gttatttacttgaaa

SEQ ID NO: 3063558 - DNA, 12 bp, Homo sapiens
gttatttagact

SEQ ID NO: 3063559 - DNA, 18 bp, Homo sapiens
gttatttccccagccaca

SEQ ID NO: 3063560 - DNA, 19 bp, Homo sapiens
gttatttccccagccacag

SEQ ID NO: 3063561 - DNA, 16 bp, Homo sapiens
gttatttctgcctata

SEQ ID NO: 3063562 - DNA, 15 bp, Homo sapiens
gttattttagtttct

SEQ ID NO: 3063563 - DNA, 14 bp, Homo sapiens
gtgtacaagttgct

SEQ ID NO: 3063564 - DNA, 16 bp, Homo sapiens
gtgtacaagttgcttt

SEQ ID NO: 3063565 - DNA, 13 bp, Homo sapiens
gtgtacagtttaa

SEQ ID NO: 3063566 - DNA, 18 bp, Homo sapiens
gtgtaccacaccctgcct

SEQ ID NO: 3063567 - DNA, 21 bp, Homo sapiens
gtgtaccacaccctgcctgct

SEQ ID NO: 3063568 - DNA, 17 bp, Homo sapiens
gtgtaccatttgcctcc

SEQ ID NO: 3063569 - DNA, 20 bp, Homo sapiens
gtgtactagtttatggttct

SEQ ID NO: 3063570 - DNA, 15 bp, Homo sapiens
gtgtagccgccctga

SEQ ID NO: 3063571 - DNA, 14 bp, Homo sapiens
gtgtagctgagctg

SEQ ID NO: 3063572 - DNA, 15 bp, Homo sapiens
gtgtagctgagctgt

SEQ ID NO: 3063573 - DNA, 18 bp, Homo sapiens
gtgtagggagatggagaa

SEQ ID NO: 3063574 - DNA, 17 bp, Homo sapiens
gtgtagttgaactgata

SEQ ID NO: 3063575 - DNA, 12 bp, Homo sapiens
gtgtatatcatg

SEQ ID NO: 3063576 - DNA, 18 bp, Homo sapiens
gtgtatatcatgaagcct

SEQ ID NO: 3063577 - DNA, 19 bp, Homo sapiens
gtgtatctaaaggatggaa

SEQ ID NO: 3063578 - DNA, 15 bp, Homo sapiens
gtgtatctaattccc

SEQ ID NO: 3063579 - DNA, 20 bp, Homo sapiens
gtgtatgtatggaaacacat

SEQ ID NO: 3063580 - DNA, 14 bp, Homo sapiens
gtgtattaaacctt

SEQ ID NO: 3063581 - DNA, 14 bp, Homo sapiens
gtgtatttatataa

SEQ ID NO: 3063582 - DNA, 16 bp, Homo sapiens
gtgtatttctctgtga

SEQ ID NO: 3063583 - DNA, 18 bp, Homo sapiens
gtgtatttctctgtgaat

SEQ ID NO: 3063584 - DNA, 19 bp, Homo sapiens
gtgtatttctctgtgaatc

SEQ ID NO: 3063585 - DNA, 16 bp, Homo sapiens
gtgtattttattcagt

SEQ ID NO: 3063586 - DNA, 15 bp, Homo sapiens
gtgtcaaccagacag

SEQ ID NO: 3063587 - DNA, 19 bp, Homo sapiens
gtgtcaaccagacagaggg

SEQ ID NO: 3063588 - DNA, 15 bp, Homo sapiens
gtgtcaactttcatt

SEQ ID NO: 3063589 - DNA, 16 bp, Homo sapiens
gtgtcaactttcattt

SEQ ID NO: 3063590 - DNA, 15 bp, Homo sapiens
gtgtcaccccagagc

SEQ ID NO: 3063591 - DNA, 19 bp, Homo sapiens
gtgtcaccccagagccaca

SEQ ID NO: 3063592 - DNA, 21 bp, Homo sapiens
gtgtcaccccagagccacaca

SEQ ID NO: 3063593 - DNA, 18 bp, Homo sapiens
gtgtcaccttttcttgcc

SEQ ID NO: 3063594 - DNA, 21 bp, Homo sapiens
gtgtcactcaaggcggtgctt

SEQ ID NO: 3063595 - DNA, 14 bp, Homo sapiens
gtgtcactgtccct

SEQ ID NO: 3063596 - DNA, 23 bp, Homo sapiens
gtgtcagcgcctggcctacccag

SEQ ID NO: 3063597 - DNA, 16 bp, Homo sapiens
gtgtcaggccctctgc

SEQ ID NO: 3063598 - DNA, 18 bp, Homo sapiens
gtgtcaggccctctgcct

SEQ ID NO: 3063599 - DNA, 15 bp, Homo sapiens
gtgtcatttttgaat

SEQ ID NO: 3063600 - DNA, 18 bp, Homo sapiens
gtgtccacgactgtctcc

SEQ ID NO: 3063601 - DNA, 22 bp, Homo sapiens
gtgtccatgtgtatgcgtgtcc

SEQ ID NO: 3063602 - DNA, 17 bp, Homo sapiens
gtgtccattttgtgaag

SEQ ID NO: 3063603 - DNA, 21 bp, Homo sapiens
gtgtccattttgtgaagccct

SEQ ID NO: 3063604 - DNA, 14 bp, Homo sapiens
gtgtcccaggcagg

SEQ ID NO: 3063605 - DNA, 14 bp, Homo sapiens
gtgtccccctctgt

SEQ ID NO: 3063606 - DNA, 17 bp, Homo sapiens
gtgtccccggggcccag

SEQ ID NO: 3063607 - DNA, 19 bp, Homo sapiens
gtgtccccggggcccaggg

SEQ ID NO: 3063608 - DNA, 13 bp, Homo sapiens
gtgtcccctgacc

SEQ ID NO: 3063609 - DNA, 20 bp, Homo sapiens
gtgtcccctgacctgtccag

SEQ ID NO: 3063610 - DNA, 22 bp, Homo sapiens
gtgtccctgctggggtctcagg

SEQ ID NO: 3063611 - DNA, 20 bp, Homo sapiens
gtgtccctttttgcagggga

SEQ ID NO: 3063612 - DNA, 12 bp, Homo sapiens
gtgtccgagagg

SEQ ID NO: 3063613 - DNA, 14 bp, Homo sapiens
gtgtcctgaagctg

SEQ ID NO: 3063614 - DNA, 23 bp, Homo sapiens
gtgtccttcacggcactggatcc

SEQ ID NO: 3063615 - DNA, 15 bp, Homo sapiens
gtgtctaagattcta

SEQ ID NO: 3063616 - DNA, 18 bp, Homo sapiens
gtgtctaagattctagat

SEQ ID NO: 3063617 - DNA, 16 bp, Homo sapiens
gtgtctcaaaaataat

SEQ ID NO: 3063618 - DNA, 14 bp, Homo sapiens
gtgtctcgctgcat

SEQ ID NO: 3063619 - DNA, 12 bp, Homo sapiens
gtgtctctgcct

SEQ ID NO: 3063620 - DNA, 18 bp, Homo sapiens
gtgtctctgcctggagca

SEQ ID NO: 3063621 - DNA, 14 bp, Homo sapiens
gtgtctgcaacatg

SEQ ID NO: 3063622 - DNA, 15 bp, Homo sapiens
gtgtctgccacttct

SEQ ID NO: 3063623 - DNA, 17 bp, Homo sapiens
gtgtctgcgaagtccta

SEQ ID NO: 3063624 - DNA, 12 bp, Homo sapiens
gtgtctggaaga

SEQ ID NO: 3063625 - DNA, 15 bp, Homo sapiens
gtgtctggcctgagg

SEQ ID NO: 3063626 - DNA, 18 bp, Homo sapiens
gtgtctggcctgaggtca

SEQ ID NO: 3063627 - DNA, 12 bp, Homo sapiens
gtgtctgtacac

SEQ ID NO: 3063628 - DNA, 13 bp, Homo sapiens
gtgtctgtacacg

SEQ ID NO: 3063629 - DNA, 16 bp, Homo sapiens
gtgtctgtacacgtgt

SEQ ID NO: 3063630 - DNA, 22 bp, Homo sapiens
gtgtctgtacacgtgtcctgta

SEQ ID NO: 3063631 - DNA, 18 bp, Homo sapiens
gtgtctgtcaccacatct

SEQ ID NO: 3063632 - DNA, 22 bp, Homo sapiens
gtgtcttacaaggcaggccttt

SEQ ID NO: 3063633 - DNA, 14 bp, Homo sapiens
gtgtcttgttctgt

SEQ ID NO: 3063634 - DNA, 17 bp, Homo sapiens
gtgtctttccactcctc

SEQ ID NO: 3063635 - DNA, 16 bp, Homo sapiens
gtgtcttttataaaaa

SEQ ID NO: 3063636 - DNA, 14 bp, Homo sapiens
gtgtgaaacatact

SEQ ID NO: 3063637 - DNA, 15 bp, Homo sapiens
gtgtgaaatctgtct

SEQ ID NO: 3063638 - DNA, 16 bp, Homo sapiens
gtgtgaaatctgtctt

SEQ ID NO: 3063639 - DNA, 19 bp, Homo sapiens
gtgtgaaggtaactaagaa

SEQ ID NO: 3063640 - DNA, 12 bp, Homo sapiens
gtgtgaagttag

SEQ ID NO: 3063641 - DNA, 16 bp, Homo sapiens
gtgtgaagtttggaga

SEQ ID NO: 3063642 - DNA, 18 bp, Homo sapiens
gtgtgaagtttggagata

SEQ ID NO: 3063643 - DNA, 14 bp, Homo sapiens
gtgtgaatgaacac

SEQ ID NO: 3063644 - DNA, 22 bp, Homo sapiens
gtgtgacaattctgtttttaat

SEQ ID NO: 3063645 - DNA, 14 bp, Homo sapiens
gtgtgacccctcct

SEQ ID NO: 3063646 - DNA, 20 bp, Homo sapiens
gtgtgactctagcaaggctc

SEQ ID NO: 3063647 - DNA, 17 bp, Homo sapiens
gtgtgaggccagggcag

SEQ ID NO: 3063648 - DNA, 12 bp, Homo sapiens
gtgtgagggcag

SEQ ID NO: 3063649 - DNA, 14 bp, Homo sapiens
gtgtgagggcagca

SEQ ID NO: 3063650 - DNA, 15 bp, Homo sapiens
gtgtgatcccagctc

SEQ ID NO: 3063651 - DNA, 16 bp, Homo sapiens
gtgtgattgacagctt

SEQ ID NO: 3063652 - DNA, 14 bp, Homo sapiens
gtgtgatttttctg

SEQ ID NO: 3063653 - DNA, 23 bp, Homo sapiens
gtgtgcacatccgcgtgtgcctg

SEQ ID NO: 3063654 - DNA, 17 bp, Homo sapiens
gtgtgcactaaggggcc

SEQ ID NO: 3063655 - DNA, 23 bp, Homo sapiens
gtgtgcactaaggggcccggcca

SEQ ID NO: 3063656 - DNA, 20 bp, Homo sapiens
gtgtgcatagcgtcctgccc

SEQ ID NO: 3063657 - DNA, 21 bp, Homo sapiens
gtgtgcatagcgtcctgccct

SEQ ID NO: 3063658 - DNA, 14 bp, Homo sapiens
gtgtgcatattgta

SEQ ID NO: 3063659 - DNA, 15 bp, Homo sapiens
gtgtgcatattgtac

SEQ ID NO: 3063660 - DNA, 21 bp, Homo sapiens
gtgtgcatattgtacactttt

SEQ ID NO: 3063661 - DNA, 19 bp, Homo sapiens
gtgtgccgttgctccggcc

SEQ ID NO: 3063662 - DNA, 19 bp, Homo sapiens
gtgtgcgctgcctggccag

SEQ ID NO: 3063663 - DNA, 19 bp, Homo sapiens
gtgtgcggagtctcctctc

SEQ ID NO: 3063664 - DNA, 13 bp, Homo sapiens
gtgtggaccgagg

SEQ ID NO: 3063665 - DNA, 21 bp, Homo sapiens
gtgtggactgtggcacttgcc

SEQ ID NO: 3063666 - DNA, 14 bp, Homo sapiens
gtgtggcagcaggc

SEQ ID NO: 3063667 - DNA, 20 bp, Homo sapiens
gtgtggcagccaggatgact

SEQ ID NO: 3063668 - DNA, 22 bp, Homo sapiens
gtgtggccatcactcagcccct

SEQ ID NO: 3063669 - DNA, 15 bp, Homo sapiens
gtgtggcgtggcccg

SEQ ID NO: 3063670 - DNA, 21 bp, Homo sapiens
gtgtggtgttagggtgcagcc

SEQ ID NO: 3063671 - DNA, 15 bp, Homo sapiens
gtgtggttatgaact

SEQ ID NO: 3063672 - DNA, 17 bp, Homo sapiens
gtgtgtagacaaatatt

SEQ ID NO: 3063673 - DNA, 14 bp, Homo sapiens
gtgtgtcaggccct

SEQ ID NO: 3063674 - DNA, 17 bp, Homo sapiens
gtgtgtcaggccctctg

SEQ ID NO: 3063675 - DNA, 21 bp, Homo sapiens
gtgtgtcaggccctctgcctg

SEQ ID NO: 3063676 - DNA, 18 bp, Homo sapiens
gtgtgtccaaaactgcct

SEQ ID NO: 3063677 - DNA, 17 bp, Homo sapiens
gtgtgtccccctctgtc

SEQ ID NO: 3063678 - DNA, 21 bp, Homo sapiens
gtgtgtgcagagtccatttcc

SEQ ID NO: 3063679 - DNA, 17 bp, Homo sapiens
gtgtgtggcgtggcccg

SEQ ID NO: 3063680 - DNA, 15 bp, Homo sapiens
gtgtgtgtatatata

SEQ ID NO: 3063681 - DNA, 9 bp, Homo sapiens
gtgtgtgtg

SEQ ID NO: 3063682 - DNA, 15 bp, Homo sapiens
gtgtgtgtgtgtgca

SEQ ID NO: 3063683 - DNA, 14 bp, Homo sapiens
gtgtgtgtgtgtgt

SEQ ID NO: 3063684 - DNA, 21 bp, Homo sapiens
gtgtgttctcacagtgacacc

SEQ ID NO: 3063685 - DNA, 13 bp, Homo sapiens
gtgtgtttagaag

SEQ ID NO: 3063686 - DNA, 20 bp, Homo sapiens
gtgtgttttgagagtatatt

SEQ ID NO: 3063687 - DNA, 14 bp, Homo sapiens
gtgttaacattcca

SEQ ID NO: 3063688 - DNA, 17 bp, Homo sapiens
gtgttaacattccaaga

SEQ ID NO: 3063689 - DNA, 19 bp, Homo sapiens
gtgttaatactagttgtga

SEQ ID NO: 3063690 - DNA, 15 bp, Homo sapiens
gtgttaatcaattta

SEQ ID NO: 3063691 - DNA, 18 bp, Homo sapiens
gtgttaatcaatttaaac

SEQ ID NO: 3063692 - DNA, 23 bp, Homo sapiens
gtgttaattataaacagcagggt

SEQ ID NO: 3063693 - DNA, 21 bp, Homo sapiens
gtgttacaatcagtgtgaatg

SEQ ID NO: 3063694 - DNA, 14 bp, Homo sapiens
gtgttactcatctt

SEQ ID NO: 3063695 - DNA, 23 bp, Homo sapiens
gtgttagggaagggcctgccaca

SEQ ID NO: 3063696 - DNA, 14 bp, Homo sapiens
gtgttagtggcacc

SEQ ID NO: 3063697 - DNA, 21 bp, Homo sapiens
gtgttatttccccagccacag

SEQ ID NO: 3063698 - DNA, 19 bp, Homo sapiens
gtgttcaaattaaaaaagc

SEQ ID NO: 3063699 - DNA, 23 bp, Homo sapiens
gtgttcaaggccatccttccctg

SEQ ID NO: 3063700 - DNA, 13 bp, Homo sapiens
gtggatttcagtt

SEQ ID NO: 3063701 - DNA, 18 bp, Homo sapiens
gtggattttgtttaaaaa

SEQ ID NO: 3063702 - DNA, 18 bp, Homo sapiens
gtggcacatctgtcctga

SEQ ID NO: 3063703 - DNA, 23 bp, Homo sapiens
gtggcacgcacctgtagtcccag

SEQ ID NO: 3063704 - DNA, 16 bp, Homo sapiens
gtggcactcaacatga

SEQ ID NO: 3063705 - DNA, 17 bp, Homo sapiens
gtggcacttgcctgggt

SEQ ID NO: 3063706 - DNA, 19 bp, Homo sapiens
gtggcacttgcctgggtca

SEQ ID NO: 3063707 - DNA, 20 bp, Homo sapiens
gtggcagcaggcatggcttc

SEQ ID NO: 3063708 - DNA, 15 bp, Homo sapiens
gtggcagctgcccct

SEQ ID NO: 3063709 - DNA, 23 bp, Homo sapiens
gtggcagggcctagctgctacaa

SEQ ID NO: 3063710 - DNA, 22 bp, Homo sapiens
gtggcaggtcactgtcactgcc

SEQ ID NO: 3063711 - DNA, 19 bp, Homo sapiens
gtggccaaggagctgctat

SEQ ID NO: 3063712 - DNA, 21 bp, Homo sapiens
gtggccaccgggggtggctct

SEQ ID NO: 3063713 - DNA, 17 bp, Homo sapiens
gtggccacggcccaggg

SEQ ID NO: 3063714 - DNA, 18 bp, Homo sapiens
gtggccacggcccaggga

SEQ ID NO: 3063715 - DNA, 19 bp, Homo sapiens
gtggccacggcccagggag

SEQ ID NO: 3063716 - DNA, 22 bp, Homo sapiens
gtggccacgttcagggaggggc

SEQ ID NO: 3063717 - DNA, 16 bp, Homo sapiens
gtggccagcgccaggg

SEQ ID NO: 3063718 - DNA, 16 bp, Homo sapiens
gtggccatcactcagc

SEQ ID NO: 3063719 - DNA, 17 bp, Homo sapiens
gtggccatcactcagcc

SEQ ID NO: 3063720 - DNA, 16 bp, Homo sapiens
gtggccatggcctctg

SEQ ID NO: 3063721 - DNA, 19 bp, Homo sapiens
gtggccatggcctctgcaa

SEQ ID NO: 3063722 - DNA, 22 bp, Homo sapiens
gtggcccctgctgtctctctgg

SEQ ID NO: 3063723 - DNA, 22 bp, Homo sapiens
gtggccctgactgtcagggagg

SEQ ID NO: 3063724 - DNA, 13 bp, Homo sapiens
gtggccctggcct

SEQ ID NO: 3063725 - DNA, 19 bp, Homo sapiens
gtggccctgtcctgccatg

SEQ ID NO: 3063726 - DNA, 13 bp, Homo sapiens
gtggccgccatct

SEQ ID NO: 3063727 - DNA, 15 bp, Homo sapiens
gtggcctctgctggt

SEQ ID NO: 3063728 - DNA, 16 bp, Homo sapiens
gtggcctctttgtcta

SEQ ID NO: 3063729 - DNA, 20 bp, Homo sapiens
gtggcctggcatctgtgtgc

SEQ ID NO: 3063730 - DNA, 15 bp, Homo sapiens
gtggcctgggcttgg

SEQ ID NO: 3063731 - DNA, 21 bp, Homo sapiens
gtggccttggccggctgtgct

SEQ ID NO: 3063732 - DNA, 15 bp, Homo sapiens
gtggcgcgcctgcct

SEQ ID NO: 3063733 - DNA, 16 bp, Homo sapiens
gtggcgcgcctgcctt

SEQ ID NO: 3063734 - DNA, 17 bp, Homo sapiens
gtggcgcgcctgccttt

SEQ ID NO: 3063735 - DNA, 13 bp, Homo sapiens
gtggcggcagggc

SEQ ID NO: 3063736 - DNA, 14 bp, Homo sapiens
gtggcggcagggcc

SEQ ID NO: 3063737 - DNA, 17 bp, Homo sapiens
gtggcggtgcctgggtg

SEQ ID NO: 3063738 - DNA, 19 bp, Homo sapiens
gtggcgtgagctgcccggc

SEQ ID NO: 3063739 - DNA, 22 bp, Homo sapiens
gtggcgtgtgcatagcgtcctg

SEQ ID NO: 3063740 - DNA, 22 bp, Homo sapiens
gtggctccagaatgtgctgcct

SEQ ID NO: 3063741 - DNA, 17 bp, Homo sapiens
gtggctccccctctgct

SEQ ID NO: 3063742 - DNA, 18 bp, Homo sapiens
gtggctccccctctgctt

SEQ ID NO: 3063743 - DNA, 20 bp, Homo sapiens
gtggctccctctctcctgga

SEQ ID NO: 3063744 - DNA, 15 bp, Homo sapiens
gtggctgacccagtc

SEQ ID NO: 3063745 - DNA, 20 bp, Homo sapiens
gtggctgcctcatttagaga

SEQ ID NO: 3063746 - DNA, 23 bp, Homo sapiens
gtggctgcctttgatcacaggag

SEQ ID NO: 3063747 - DNA, 20 bp, Homo sapiens
gtggctgcgtgcccctgctg

SEQ ID NO: 3063748 - DNA, 13 bp, Homo sapiens
gtggctgtctgga

SEQ ID NO: 3063749 - DNA, 23 bp, Homo sapiens
gtggctgtggagacaatgtctgc

SEQ ID NO: 3063750 - DNA, 16 bp, Homo sapiens
gtggcttagctgccat

SEQ ID NO: 3063751 - DNA, 17 bp, Homo sapiens
gtggcttccctgtccca

SEQ ID NO: 3063752 - DNA, 16 bp, Homo sapiens
gtggctttggcagtgt

SEQ ID NO: 3063753 - DNA, 15 bp, Homo sapiens
gtgggaaaaaagaaa

SEQ ID NO: 3063754 - DNA, 18 bp, Homo sapiens
gtgggaaaaaagaaaaac

SEQ ID NO: 3063755 - DNA, 17 bp, Homo sapiens
gtgggaacgtgactgcc

SEQ ID NO: 3063756 - DNA, 14 bp, Homo sapiens
gtgggaaggccagc

SEQ ID NO: 3063757 - DNA, 17 bp, Homo sapiens
gtgggaccaggtctgtg

SEQ ID NO: 3063758 - DNA, 13 bp, Homo sapiens
gtgggaccccagg

SEQ ID NO: 3063759 - DNA, 21 bp, Homo sapiens
gtgggagcttcccacacctgc

SEQ ID NO: 3063760 - DNA, 20 bp, Homo sapiens
gtgggaggaaagggcctggc

SEQ ID NO: 3063761 - DNA, 22 bp, Homo sapiens
gtgggagggggcgttggattta

SEQ ID NO: 3063762 - DNA, 15 bp, Homo sapiens
gtgggcaatttagaa

SEQ ID NO: 3063763 - DNA, 16 bp, Homo sapiens
gtgggcacccaccctg

SEQ ID NO: 3063764 - DNA, 20 bp, Homo sapiens
gtgggcagcagcatcccagc

SEQ ID NO: 3063765 - DNA, 21 bp, Homo sapiens
gtgggcagcagcatcccagcc

SEQ ID NO: 3063766 - DNA, 20 bp, Homo sapiens
gtgggcattgatggggaagg

SEQ ID NO: 3063767 - DNA, 20 bp, Homo sapiens
gtgggcatttcttgcgagcc

SEQ ID NO: 3063768 - DNA, 12 bp, Homo sapiens
gtgggcccaccc

SEQ ID NO: 3063769 - DNA, 14 bp, Homo sapiens
gtgggccctgcagg

SEQ ID NO: 3063770 - DNA, 23 bp, Homo sapiens
gtgggcggacaaaagggccaggt

SEQ ID NO: 3063771 - DNA, 17 bp, Homo sapiens
gtgggctgcacgctccc

SEQ ID NO: 3063772 - DNA, 19 bp, Homo sapiens
gtgggctgcacgctcccct

SEQ ID NO: 3063773 - DNA, 16 bp, Homo sapiens
gtgggcttctgcgtcc

SEQ ID NO: 3063774 - DNA, 15 bp, Homo sapiens
gtggggaaggggtgc

SEQ ID NO: 3063775 - DNA, 16 bp, Homo sapiens
gtggggaaggggtgca

SEQ ID NO: 3063776 - DNA, 18 bp, Homo sapiens
gtggggacctcagcctgc

SEQ ID NO: 3063777 - DNA, 19 bp, Homo sapiens
gtggggacctcagcctgca

SEQ ID NO: 3063778 - DNA, 22 bp, Homo sapiens
gtggggagccgagggcgtcaga

SEQ ID NO: 3063779 - DNA, 22 bp, Homo sapiens
gtggggaggctgcactggagcc

SEQ ID NO: 3063780 - DNA, 15 bp, Homo sapiens
gtggggcagggagct

SEQ ID NO: 3063781 - DNA, 17 bp, Homo sapiens
gtggggctgagctgggg

SEQ ID NO: 3063782 - DNA, 17 bp, Homo sapiens
gtgggggcagagggcag

SEQ ID NO: 3063783 - DNA, 19 bp, Homo sapiens
gtgggggtcatcagggagg

SEQ ID NO: 3063784 - DNA, 20 bp, Homo sapiens
gtgggggttttggggtgggc

SEQ ID NO: 3063785 - DNA, 17 bp, Homo sapiens
gtggggtctccctctcc

SEQ ID NO: 3063786 - DNA, 19 bp, Homo sapiens
gtggggtctccctctcctg

SEQ ID NO: 3063787 - DNA, 21 bp, Homo sapiens
gtgggtaggttggactggaaa

SEQ ID NO: 3063788 - DNA, 17 bp, Homo sapiens
gtgggtatgcgagacca

SEQ ID NO: 3063789 - DNA, 18 bp, Homo sapiens
gtgggtccatgggcagag

SEQ ID NO: 3063790 - DNA, 22 bp, Homo sapiens
gtgggtccatgggcagagccca

SEQ ID NO: 3063791 - DNA, 24 bp, Homo sapiens
gtgggtctgtaagaccttggtagg

SEQ ID NO: 3063792 - DNA, 14 bp, Homo sapiens
gtgggtggggctgc

SEQ ID NO: 3063793 - DNA, 16 bp, Homo sapiens
gtgggttaagtgggca

SEQ ID NO: 3063794 - DNA, 13 bp, Homo sapiens
gtggtagctccag

SEQ ID NO: 3063795 - DNA, 15 bp, Homo sapiens
gtggtagctccagcg

SEQ ID NO: 3063796 - DNA, 16 bp, Homo sapiens
gtggtagctccagcga

SEQ ID NO: 3063797 - DNA, 13 bp, Homo sapiens
gtggtattctgtc

SEQ ID NO: 3063798 - DNA, 23 bp, Homo sapiens
gtggtatttgctgtcacatagtt

SEQ ID NO: 3063799 - DNA, 17 bp, Homo sapiens
gtggtctccttggaaat

SEQ ID NO: 3063800 - DNA, 19 bp, Homo sapiens
gtggtctcgatgctgctgg

SEQ ID NO: 3063801 - DNA, 20 bp, Homo sapiens
gtggtctcttcttggggccc

SEQ ID NO: 3063802 - DNA, 23 bp, Homo sapiens
gtggtctcttcttggggcccagt

SEQ ID NO: 3063803 - DNA, 19 bp, Homo sapiens
gtggtctgagctgtcccaa

SEQ ID NO: 3063804 - DNA, 20 bp, Homo sapiens
gtggtctgagctgtcccaag

SEQ ID NO: 3063805 - DNA, 14 bp, Homo sapiens
gtggtctgcaggca

SEQ ID NO: 3063806 - DNA, 19 bp, Homo sapiens
gtggtctgccaatctgtac

SEQ ID NO: 3063807 - DNA, 21 bp, Homo sapiens
gtggtctgccaatctgtacaa

SEQ ID NO: 3063808 - DNA, 19 bp, Homo sapiens
gtggtgaatgtgtgagaaa

SEQ ID NO: 3063809 - DNA, 18 bp, Homo sapiens
gtggtgccatcattgctg

SEQ ID NO: 3063810 - DNA, 19 bp, Homo sapiens
gtggtggctccccctctgc

SEQ ID NO: 3063811 - DNA, 16 bp, Homo sapiens
gtggtgggcgctgggg

SEQ ID NO: 3063812 - DNA, 19 bp, Homo sapiens
gtggtgggcttctgcgtcc

SEQ ID NO: 3063813 - DNA, 22 bp, Homo sapiens
gtggtgtcactgtccctcctgg

SEQ ID NO: 3063814 - DNA, 23 bp, Homo sapiens
gtggtgtgtccccctctgtccag

SEQ ID NO: 3063815 - DNA, 14 bp, Homo sapiens
gtggtgtgtgaagt

SEQ ID NO: 3063816 - DNA, 20 bp, Homo sapiens
gtggtgtttcctgcaggcca

SEQ ID NO: 3063817 - DNA, 22 bp, Homo sapiens
gtggttaatccaatcaatttaa

SEQ ID NO: 3063818 - DNA, 20 bp, Homo sapiens
gtggttcactcttggagcct

SEQ ID NO: 3063819 - DNA, 22 bp, Homo sapiens
gtggttcactcttggagcctgc

SEQ ID NO: 3063820 - DNA, 17 bp, Homo sapiens
gtggttcattccacagg

SEQ ID NO: 3063821 - DNA, 19 bp, Homo sapiens
gtggttcattccacaggac

SEQ ID NO: 3063822 - DNA, 17 bp, Homo sapiens
gtggttgcctgccctcc

SEQ ID NO: 3063823 - DNA, 20 bp, Homo sapiens
gtggttgctgttttcctccc

SEQ ID NO: 3063824 - DNA, 14 bp, Homo sapiens
gtggtttggtttta

SEQ ID NO: 3063825 - DNA, 12 bp, Homo sapiens
gtggttttctta

SEQ ID NO: 3063826 - DNA, 12 bp, Homo sapiens
gtggtttttatt

SEQ ID NO: 3063827 - DNA, 17 bp, Homo sapiens
gtgtaaaaaatggaaaa

SEQ ID NO: 3063828 - DNA, 19 bp, Homo sapiens
gtgtaaaaaatggaaaaaa

SEQ ID NO: 3063829 - DNA, 20 bp, Homo sapiens
gtgtaaaagtagtgagttaa

SEQ ID NO: 3063830 - DNA, 12 bp, Homo sapiens
gtgtaaagcatt

SEQ ID NO: 3063831 - DNA, 20 bp, Homo sapiens
gtgtaaatatttttccctcc

SEQ ID NO: 3063832 - DNA, 16 bp, Homo sapiens
gtgtaatctcaatgca

SEQ ID NO: 3063833 - DNA, 15 bp, Homo sapiens
gtgtaatttctttgc

SEQ ID NO: 3063834 - DNA, 13 bp, Homo sapiens
gtgtacaaagaaa

SEQ ID NO: 3063835 - DNA, 17 bp, Homo sapiens
gtgcccccagcccagag

SEQ ID NO: 3063836 - DNA, 12 bp, Homo sapiens
gtgcccctgctg

SEQ ID NO: 3063837 - DNA, 22 bp, Homo sapiens
gtgcccggctaatttttttgta

SEQ ID NO: 3063838 - DNA, 19 bp, Homo sapiens
gtgcccgtaatcccagcta

SEQ ID NO: 3063839 - DNA, 14 bp, Homo sapiens
gtgccgcactctgg

SEQ ID NO: 3063840 - DNA, 15 bp, Homo sapiens
gtgccgttactctcc

SEQ ID NO: 3063841 - DNA, 19 bp, Homo sapiens
gtgcctagtgatgtagaaa

SEQ ID NO: 3063842 - DNA, 22 bp, Homo sapiens
gtgcctcaagaggaatgaaaaa

SEQ ID NO: 3063843 - DNA, 13 bp, Homo sapiens
gtgcctcccttcc

SEQ ID NO: 3063844 - DNA, 17 bp, Homo sapiens
gtgcctcccttcccagt

SEQ ID NO: 3063845 - DNA, 23 bp, Homo sapiens
gtgcctcccttcccagtgggctg

SEQ ID NO: 3063846 - DNA, 19 bp, Homo sapiens
gtgcctctgtcctagactc

SEQ ID NO: 3063847 - DNA, 16 bp, Homo sapiens
gtgcctgactgcccag

SEQ ID NO: 3063848 - DNA, 15 bp, Homo sapiens
gtgcctgagcccctc

SEQ ID NO: 3063849 - DNA, 13 bp, Homo sapiens
gtgcctgctttga

SEQ ID NO: 3063850 - DNA, 22 bp, Homo sapiens
gtgcctgctttgacgggccagg

SEQ ID NO: 3063851 - DNA, 23 bp, Homo sapiens
gtgcctgctttgacgggccaggc

SEQ ID NO: 3063852 - DNA, 18 bp, Homo sapiens
gtgcctgggtggggctgc

SEQ ID NO: 3063853 - DNA, 17 bp, Homo sapiens
gtgcctgtgaggcaggg

SEQ ID NO: 3063854 - DNA, 17 bp, Homo sapiens
gtgccttacctcctgcc

SEQ ID NO: 3063855 - DNA, 21 bp, Homo sapiens
gtgccttacctcctgcccagg

SEQ ID NO: 3063856 - DNA, 16 bp, Homo sapiens
gtgccttaggaatact

SEQ ID NO: 3063857 - DNA, 17 bp, Homo sapiens
gtgccttaggaatactg

SEQ ID NO: 3063858 - DNA, 12 bp, Homo sapiens
gtgccttctctc

SEQ ID NO: 3063859 - DNA, 18 bp, Homo sapiens
gtgccttctctcagctcc

SEQ ID NO: 3063860 - DNA, 13 bp, Homo sapiens
gtgccttgcccac

SEQ ID NO: 3063861 - DNA, 15 bp, Homo sapiens
gtgccttgcccacag

SEQ ID NO: 3063862 - DNA, 18 bp, Homo sapiens
gtgccttggtctctcctt

SEQ ID NO: 3063863 - DNA, 23 bp, Homo sapiens
gtgccttggtctctccttcctct

SEQ ID NO: 3063864 - DNA, 17 bp, Homo sapiens
gtgcctttatctcagcc

SEQ ID NO: 3063865 - DNA, 18 bp, Homo sapiens
gtgcctttatctcagcca

SEQ ID NO: 3063866 - DNA, 12 bp, Homo sapiens
gtgcctttcaaa

SEQ ID NO: 3063867 - DNA, 11 bp, Homo sapiens
gtgcctttcct

SEQ ID NO: 3063868 - DNA, 23 bp, Homo sapiens
gtgccttttgcagaagagggtgt

SEQ ID NO: 3063869 - DNA, 18 bp, Homo sapiens
gtgcgatctcggctcagt

SEQ ID NO: 3063870 - DNA, 24 bp, Homo sapiens
gtgcgcatcttgcctccaggtgca

SEQ ID NO: 3063871 - DNA, 19 bp, Homo sapiens
gtgcgcgtggcgtggcccg

SEQ ID NO: 3063872 - DNA, 15 bp, Homo sapiens
gtgcgctctgtggat

SEQ ID NO: 3063873 - DNA, 22 bp, Homo sapiens
gtgcgctctgtggatgccaggg

SEQ ID NO: 3063874 - DNA, 11 bp, Homo sapiens
gtgcgctgcct

SEQ ID NO: 3063875 - DNA, 12 bp, Homo sapiens
gtgcgctgcctg

SEQ ID NO: 3063876 - DNA, 19 bp, Homo sapiens
gtgcgctgggcacttccct

SEQ ID NO: 3063877 - DNA, 22 bp, Homo sapiens
gtgcgctgggcacttccctgct

SEQ ID NO: 3063878 - DNA, 12 bp, Homo sapiens
gtgcggcctggg

SEQ ID NO: 3063879 - DNA, 18 bp, Homo sapiens
gtgcggcgtggagactgg

SEQ ID NO: 3063880 - DNA, 19 bp, Homo sapiens
gtgcggcgtggagactggc

SEQ ID NO: 3063881 - DNA, 22 bp, Homo sapiens
gtgcggcgtggagactggcagg

SEQ ID NO: 3063882 - DNA, 15 bp, Homo sapiens
gtgcgtggaaaaaga

SEQ ID NO: 3063883 - DNA, 16 bp, Homo sapiens
gtgcgtggaaaaagac

SEQ ID NO: 3063884 - DNA, 23 bp, Homo sapiens
gtgcgtggaagtgttcctgtctc

SEQ ID NO: 3063885 - DNA, 17 bp, Homo sapiens
gtgcgtggcgtggcccg

SEQ ID NO: 3063886 - DNA, 17 bp, Homo sapiens
gtgcgtggtgtggcccg

SEQ ID NO: 3063887 - DNA, 14 bp, Homo sapiens
gtgctaaggttcta

SEQ ID NO: 3063888 - DNA, 20 bp, Homo sapiens
gtgctaatattttatttgaa

SEQ ID NO: 3063889 - DNA, 18 bp, Homo sapiens
gtgctagtcactggcagc

SEQ ID NO: 3063890 - DNA, 13 bp, Homo sapiens
gtgctatagtatt

SEQ ID NO: 3063891 - DNA, 14 bp, Homo sapiens
gtgctatagtattt

SEQ ID NO: 3063892 - DNA, 15 bp, Homo sapiens
gtgctatagtatttg

SEQ ID NO: 3063893 - DNA, 20 bp, Homo sapiens
gtgctcaagcagcaaaatcc

SEQ ID NO: 3063894 - DNA, 21 bp, Homo sapiens
gtgctcaagcagcaaaatcct

SEQ ID NO: 3063895 - DNA, 22 bp, Homo sapiens
gtgctcagttgtagaatgtatt

SEQ ID NO: 3063896 - DNA, 13 bp, Homo sapiens
gtgctccatctcc

SEQ ID NO: 3063897 - DNA, 18 bp, Homo sapiens
gtgctccctaccacctcc

SEQ ID NO: 3063898 - DNA, 13 bp, Homo sapiens
gtgctccctccca

SEQ ID NO: 3063899 - DNA, 14 bp, Homo sapiens
gtgctcctgcccag

SEQ ID NO: 3063900 - DNA, 16 bp, Homo sapiens
gtgctcctgcccagcc

SEQ ID NO: 3063901 - DNA, 19 bp, Homo sapiens
gtgctcctgcccagccacc

SEQ ID NO: 3063902 - DNA, 16 bp, Homo sapiens
gtgctcgccccagcag

SEQ ID NO: 3063903 - DNA, 15 bp, Homo sapiens
gtgctgacagctgct

SEQ ID NO: 3063904 - DNA, 17 bp, Homo sapiens
gtgctgacagctgctcc

SEQ ID NO: 3063905 - DNA, 14 bp, Homo sapiens
gtgctgagattaca

SEQ ID NO: 3063906 - DNA, 20 bp, Homo sapiens
gtgctgagtagatgcgcagc

SEQ ID NO: 3063907 - DNA, 14 bp, Homo sapiens
gtgctgcagcaccg

SEQ ID NO: 3063908 - DNA, 14 bp, Homo sapiens
gtgctgcccaggcc

SEQ ID NO: 3063909 - DNA, 19 bp, Homo sapiens
gtgctggaaggacaaataa

SEQ ID NO: 3063910 - DNA, 15 bp, Homo sapiens
gtgctggagccctgt

SEQ ID NO: 3063911 - DNA, 14 bp, Homo sapiens
gtgctggcccagca

SEQ ID NO: 3063912 - DNA, 17 bp, Homo sapiens
gtgctggcccagcatgg

SEQ ID NO: 3063913 - DNA, 20 bp, Homo sapiens
gtgctggcgacactcagggc

SEQ ID NO: 3063914 - DNA, 20 bp, Homo sapiens
gtgctgggaacctcagggta

SEQ ID NO: 3063915 - DNA, 20 bp, Homo sapiens
gtgctgggtaataaaatcat

SEQ ID NO: 3063916 - DNA, 14 bp, Homo sapiens
gtgctgtgtaaagt

SEQ ID NO: 3063917 - DNA, 14 bp, Homo sapiens
gtgcttcgggccct

SEQ ID NO: 3063918 - DNA, 14 bp, Homo sapiens
gtgcttgtgtaatt

SEQ ID NO: 3063919 - DNA, 12 bp, Homo sapiens
gtgctttgaaaa

SEQ ID NO: 3063920 - DNA, 13 bp, Homo sapiens
gtgctttgcattt

SEQ ID NO: 3063921 - DNA, 19 bp, Homo sapiens
gtgcttttagtaaaaacat

SEQ ID NO: 3063922 - DNA, 13 bp, Homo sapiens
gtggaaagtgtaa

SEQ ID NO: 3063923 - DNA, 16 bp, Homo sapiens
gtggaaagtgtaaagc

SEQ ID NO: 3063924 - DNA, 18 bp, Homo sapiens
gtggaaagtgtaaagcat

SEQ ID NO: 3063925 - DNA, 23 bp, Homo sapiens
gtggaaagtgtaaagcattccaa

SEQ ID NO: 3063926 - DNA, 18 bp, Homo sapiens
gtggaaatgcgcatgagt

SEQ ID NO: 3063927 - DNA, 19 bp, Homo sapiens
gtggaacacaaatgaaaat

SEQ ID NO: 3063928 - DNA, 14 bp, Homo sapiens
gtggaagagggctg

SEQ ID NO: 3063929 - DNA, 15 bp, Homo sapiens
gtggaagccactgga

SEQ ID NO: 3063930 - DNA, 18 bp, Homo sapiens
gtggaagccctccttcca

SEQ ID NO: 3063931 - DNA, 15 bp, Homo sapiens
gtggaattattttaa

SEQ ID NO: 3063932 - DNA, 18 bp, Homo sapiens
gtggaattattttaaaag

SEQ ID NO: 3063933 - DNA, 21 bp, Homo sapiens
gtggacaccactgagctctgc

SEQ ID NO: 3063934 - DNA, 23 bp, Homo sapiens
gtggacaccactgagctctgcct

SEQ ID NO: 3063935 - DNA, 22 bp, Homo sapiens
gtggaccatcgctgtcatgagt

SEQ ID NO: 3063936 - DNA, 18 bp, Homo sapiens
gtggaccctgtaaataca

SEQ ID NO: 3063937 - DNA, 21 bp, Homo sapiens
gtggaccttaggccttcctct

SEQ ID NO: 3063938 - DNA, 13 bp, Homo sapiens
gtggacgctgtgc

SEQ ID NO: 3063939 - DNA, 17 bp, Homo sapiens
gtggacggcgctgcctc

SEQ ID NO: 3063940 - DNA, 21 bp, Homo sapiens
gtggacggcgctgcctcaggc

SEQ ID NO: 3063941 - DNA, 14 bp, Homo sapiens
gtggactctgcaca

SEQ ID NO: 3063942 - DNA, 23 bp, Homo sapiens
gtggactgcagtcggcatgccag

SEQ ID NO: 3063943 - DNA, 15 bp, Homo sapiens
gtggacttgaacttt

SEQ ID NO: 3063944 - DNA, 16 bp, Homo sapiens
gtggagaactcctagg

SEQ ID NO: 3063945 - DNA, 13 bp, Homo sapiens
gtggagaagccat

SEQ ID NO: 3063946 - DNA, 14 bp, Homo sapiens
gtggagaagccatt

SEQ ID NO: 3063947 - DNA, 18 bp, Homo sapiens
gtggagaagccattgtct

SEQ ID NO: 3063948 - DNA, 14 bp, Homo sapiens
gtggagactggcag

SEQ ID NO: 3063949 - DNA, 15 bp, Homo sapiens
gtggagactggcagg

SEQ ID NO: 3063950 - DNA, 16 bp, Homo sapiens
gtggagactggcaggc

SEQ ID NO: 3063951 - DNA, 17 bp, Homo sapiens
gtggagactggcaggcg

SEQ ID NO: 3063952 - DNA, 15 bp, Homo sapiens
gtggagctgagaaga

SEQ ID NO: 3063953 - DNA, 20 bp, Homo sapiens
gtggagctgagaagaggagg

SEQ ID NO: 3063954 - DNA, 16 bp, Homo sapiens
gtggaggagctgaggg

SEQ ID NO: 3063955 - DNA, 11 bp, Homo sapiens
gtggaggcagt

SEQ ID NO: 3063956 - DNA, 15 bp, Homo sapiens
gtggaggggccctcc

SEQ ID NO: 3063957 - DNA, 21 bp, Homo sapiens
gtggaggttaaggctgaggaa

SEQ ID NO: 3063958 - DNA, 19 bp, Homo sapiens
gtggaggttgagtgagccg

SEQ ID NO: 3063959 - DNA, 20 bp, Homo sapiens
gtggaggttgagtgagccgg

SEQ ID NO: 3063960 - DNA, 19 bp, Homo sapiens
gtggagtgcagtggtgcga

SEQ ID NO: 3063961 - DNA, 14 bp, Homo sapiens
gtggatacagtcat

SEQ ID NO: 3063962 - DNA, 13 bp, Homo sapiens
gtggatcacagag

SEQ ID NO: 3063963 - DNA, 19 bp, Homo sapiens
gtggatcacctgaggtcag

SEQ ID NO: 3063964 - DNA, 14 bp, Homo sapiens
gtggatgctgtgct

SEQ ID NO: 3063965 - DNA, 17 bp, Homo sapiens
gtggatggattcatcat

SEQ ID NO: 3063966 - DNA, 16 bp, Homo sapiens
gtggatgggaatttgt

SEQ ID NO: 3063967 - DNA, 22 bp, Homo sapiens
gtggatgggaatttgtcagcgt

SEQ ID NO: 3063968 - DNA, 22 bp, Homo sapiens
gtggatggtgacttttgaagaa

SEQ ID NO: 3063969 - DNA, 14 bp, Homo sapiens
gtggatgtgagcag

SEQ ID NO: 3063970 - DNA, 17 bp, Homo sapiens
gtggatgtgagcagaag

SEQ ID NO: 3063971 - DNA, 22 bp, Homo sapiens
gtggattgggcagaatcctggg

SEQ ID NO: 3063972 - DNA, 13 bp, Homo sapiens
gtgagctgcccgg

SEQ ID NO: 3063973 - DNA, 18 bp, Homo sapiens
gtgaggatgtcactcaga

SEQ ID NO: 3063974 - DNA, 16 bp, Homo sapiens
gtgaggccggccctgc

SEQ ID NO: 3063975 - DNA, 16 bp, Homo sapiens
gtgaggcgttctcctg

SEQ ID NO: 3063976 - DNA, 19 bp, Homo sapiens
gtgaggcgttctcctgctt

SEQ ID NO: 3063977 - DNA, 20 bp, Homo sapiens
gtgaggcgttctcctgcttg

SEQ ID NO: 3063978 - DNA, 12 bp, Homo sapiens
gtgagggagtgc

SEQ ID NO: 3063979 - DNA, 19 bp, Homo sapiens
gtgagggcaccaccaagaa

SEQ ID NO: 3063980 - DNA, 14 bp, Homo sapiens
gtgaggtttcccaa

SEQ ID NO: 3063981 - DNA, 21 bp, Homo sapiens
gtgagtactgttaagaataat

SEQ ID NO: 3063982 - DNA, 16 bp, Homo sapiens
gtgagtatcagaattg

SEQ ID NO: 3063983 - DNA, 12 bp, Homo sapiens
gtgagtcagcac

SEQ ID NO: 3063984 - DNA, 13 bp, Homo sapiens
gtgagtcagcacc

SEQ ID NO: 3063985 - DNA, 23 bp, Homo sapiens
gtgagtcagcaccttggcccagg

SEQ ID NO: 3063986 - DNA, 16 bp, Homo sapiens
gtgagtcagtgatgag

SEQ ID NO: 3063987 - DNA, 17 bp, Homo sapiens
gtgagtctggtggagga

SEQ ID NO: 3063988 - DNA, 18 bp, Homo sapiens
gtgagtctggtggaggag

SEQ ID NO: 3063989 - DNA, 17 bp, Homo sapiens
gtgagtctttggttcta

SEQ ID NO: 3063990 - DNA, 19 bp, Homo sapiens
gtgagtctttggttctaag

SEQ ID NO: 3063991 - DNA, 20 bp, Homo sapiens
gtgagttcagcctttaagat

SEQ ID NO: 3063992 - DNA, 14 bp, Homo sapiens
gtgagttttgttca

SEQ ID NO: 3063993 - DNA, 14 bp, Homo sapiens
gtgataaactttgc

SEQ ID NO: 3063994 - DNA, 12 bp, Homo sapiens
gtgataaggaca

SEQ ID NO: 3063995 - DNA, 21 bp, Homo sapiens
gtgataaggacatgatgcttt

SEQ ID NO: 3063996 - DNA, 21 bp, Homo sapiens
gtgataatcgtcttcaaatta

SEQ ID NO: 3063997 - DNA, 16 bp, Homo sapiens
gtgatatatgtattaa

SEQ ID NO: 3063998 - DNA, 19 bp, Homo sapiens
gtgatattgaccatgtgat

SEQ ID NO: 3063999 - DNA, 13 bp, Homo sapiens
gtgatatttctct

SEQ ID NO: 3064000 - DNA, 13 bp, Homo sapiens
gtgatatttgaca

SEQ ID NO: 3064001 - DNA, 15 bp, Homo sapiens
gtgatcatctttgct

SEQ ID NO: 3064002 - DNA, 22 bp, Homo sapiens
gtgatcgatgattcaggtgcag

SEQ ID NO: 3064003 - DNA, 14 bp, Homo sapiens
gtgatctcagatca

SEQ ID NO: 3064004 - DNA, 15 bp, Homo sapiens
gtgatctcagatcag

SEQ ID NO: 3064005 - DNA, 19 bp, Homo sapiens
gtgatcttatttttctaaa

SEQ ID NO: 3064006 - DNA, 16 bp, Homo sapiens
gtgatgatgcatggag

SEQ ID NO: 3064007 - DNA, 14 bp, Homo sapiens
gtgatgggatctgt

SEQ ID NO: 3064008 - DNA, 16 bp, Homo sapiens
gtgatggtgtagccct

SEQ ID NO: 3064009 - DNA, 14 bp, Homo sapiens
gtgatgtcatttga

SEQ ID NO: 3064010 - DNA, 21 bp, Homo sapiens
gtgatgtgaactgactttaag

SEQ ID NO: 3064011 - DNA, 15 bp, Homo sapiens
gtgatgtgaagccaa

SEQ ID NO: 3064012 - DNA, 14 bp, Homo sapiens
gtgatgtgccacta

SEQ ID NO: 3064013 - DNA, 16 bp, Homo sapiens
gtgatgttctaaggct

SEQ ID NO: 3064014 - DNA, 19 bp, Homo sapiens
gtgatgttctaaggctctg

SEQ ID NO: 3064015 - DNA, 18 bp, Homo sapiens
gtgattaactgtgaataa

SEQ ID NO: 3064016 - DNA, 17 bp, Homo sapiens
gtgattacataatctgt

SEQ ID NO: 3064017 - DNA, 23 bp, Homo sapiens
gtgattactctttgctttgtagt

SEQ ID NO: 3064018 - DNA, 12 bp, Homo sapiens
gtgattgaaagt

SEQ ID NO: 3064019 - DNA, 21 bp, Homo sapiens
gtgattgacagctttgctgct

SEQ ID NO: 3064020 - DNA, 23 bp, Homo sapiens
gtgattgacagctttgctgctga

SEQ ID NO: 3064021 - DNA, 17 bp, Homo sapiens
gtgattgggaataaata

SEQ ID NO: 3064022 - DNA, 20 bp, Homo sapiens
gtgattgggaataaatatgc

SEQ ID NO: 3064023 - DNA, 23 bp, Homo sapiens
gtgattgtggaatggagattcag

SEQ ID NO: 3064024 - DNA, 18 bp, Homo sapiens
gtgatttaatagtgttaa

SEQ ID NO: 3064025 - DNA, 13 bp, Homo sapiens
gtgatttcttgct

SEQ ID NO: 3064026 - DNA, 18 bp, Homo sapiens
gtgattttaactctgtct

SEQ ID NO: 3064027 - DNA, 16 bp, Homo sapiens
gtgatttttatgccac

SEQ ID NO: 3064028 - DNA, 17 bp, Homo sapiens
gtgatttttatgccacc

SEQ ID NO: 3064029 - DNA, 19 bp, Homo sapiens
gtgatttttatgccacctg

SEQ ID NO: 3064030 - DNA, 21 bp, Homo sapiens
gtgcaaaatgtcttgtgtatt

SEQ ID NO: 3064031 - DNA, 20 bp, Homo sapiens
gtgcaaacagtgtaagctta

SEQ ID NO: 3064032 - DNA, 23 bp, Homo sapiens
gtgcaaatgtcagatacaatgta

SEQ ID NO: 3064033 - DNA, 13 bp, Homo sapiens
gtgcaacctctgc

SEQ ID NO: 3064034 - DNA, 21 bp, Homo sapiens
gtgcaacctctgcttcccagg

SEQ ID NO: 3064035 - DNA, 19 bp, Homo sapiens
gtgcaagactgaattaatg

SEQ ID NO: 3064036 - DNA, 19 bp, Homo sapiens
gtgcaattcagtctgctct

SEQ ID NO: 3064037 - DNA, 18 bp, Homo sapiens
gtgcacacatcaccaggt

SEQ ID NO: 3064038 - DNA, 13 bp, Homo sapiens
gtgcacagcccct

SEQ ID NO: 3064039 - DNA, 16 bp, Homo sapiens
gtgcacagtccacagc

SEQ ID NO: 3064040 - DNA, 18 bp, Homo sapiens
gtgcacatctgtgtcttg

SEQ ID NO: 3064041 - DNA, 19 bp, Homo sapiens
gtgcactgcccatggacag

SEQ ID NO: 3064042 - DNA, 20 bp, Homo sapiens
gtgcactgcccatggacagg

SEQ ID NO: 3064043 - DNA, 20 bp, Homo sapiens
gtgcactgtgaatcctggca

SEQ ID NO: 3064044 - DNA, 12 bp, Homo sapiens
gtgcagaggaag

SEQ ID NO: 3064045 - DNA, 15 bp, Homo sapiens
gtgcagaggtaccct

SEQ ID NO: 3064046 - DNA, 15 bp, Homo sapiens
gtgcagatggagaga

SEQ ID NO: 3064047 - DNA, 21 bp, Homo sapiens
gtgcagcagattggaaggaga

SEQ ID NO: 3064048 - DNA, 18 bp, Homo sapiens
gtgcagccgctgagcgag

SEQ ID NO: 3064049 - DNA, 22 bp, Homo sapiens
gtgcagctcaaggaaaggcctg

SEQ ID NO: 3064050 - DNA, 23 bp, Homo sapiens
gtgcagctcaaggaaaggcctga

SEQ ID NO: 3064051 - DNA, 14 bp, Homo sapiens
gtgcagctcctcag

SEQ ID NO: 3064052 - DNA, 14 bp, Homo sapiens
gtgcaggctggcca

SEQ ID NO: 3064053 - DNA, 16 bp, Homo sapiens
gtgcagggctggtttg

SEQ ID NO: 3064054 - DNA, 15 bp, Homo sapiens
gtgcagtaatagcac

SEQ ID NO: 3064055 - DNA, 17 bp, Homo sapiens
gtgcagtgtttttcctg

SEQ ID NO: 3064056 - DNA, 16 bp, Homo sapiens
gtgcatagaattctag

SEQ ID NO: 3064057 - DNA, 20 bp, Homo sapiens
gtgcatagaattctagcttt

SEQ ID NO: 3064058 - DNA, 16 bp, Homo sapiens
gtgcatagcgtcctgc

SEQ ID NO: 3064059 - DNA, 18 bp, Homo sapiens
gtgcatagcgtcctgccc

SEQ ID NO: 3064060 - DNA, 20 bp, Homo sapiens
gtgcatagcgtcctgccctg

SEQ ID NO: 3064061 - DNA, 16 bp, Homo sapiens
gtgcatatagaaaaca

SEQ ID NO: 3064062 - DNA, 22 bp, Homo sapiens
gtgcatatagaaaacaaaggag

SEQ ID NO: 3064063 - DNA, 14 bp, Homo sapiens
gtgcatattgtaca

SEQ ID NO: 3064064 - DNA, 15 bp, Homo sapiens
gtgcatattgtacac

SEQ ID NO: 3064065 - DNA, 13 bp, Homo sapiens
gtgcatctgcagg

SEQ ID NO: 3064066 - DNA, 23 bp, Homo sapiens
gtgcatctgcaggcaccgggctg

SEQ ID NO: 3064067 - DNA, 18 bp, Homo sapiens
gtgcatgatcttgagcaa

SEQ ID NO: 3064068 - DNA, 15 bp, Homo sapiens
gtgcatgcaggtctc

SEQ ID NO: 3064069 - DNA, 22 bp, Homo sapiens
gtgcatgcctgtagtctcagct

SEQ ID NO: 3064070 - DNA, 21 bp, Homo sapiens
gtgcatgctctctgcagccag

SEQ ID NO: 3064071 - DNA, 17 bp, Homo sapiens
gtgcatggaagttgggg

SEQ ID NO: 3064072 - DNA, 16 bp, Homo sapiens
gtgcatggtggccaga

SEQ ID NO: 3064073 - DNA, 21 bp, Homo sapiens
gtgcatgtgcgtggaagtgtt

SEQ ID NO: 3064074 - DNA, 16 bp, Homo sapiens
gtgcattataattttt

SEQ ID NO: 3064075 - DNA, 14 bp, Homo sapiens
gtgcattctccagc

SEQ ID NO: 3064076 - DNA, 19 bp, Homo sapiens
gtgcattgtttctgtgggc

SEQ ID NO: 3064077 - DNA, 19 bp, Homo sapiens
gtgccaaatagccccagac

SEQ ID NO: 3064078 - DNA, 20 bp, Homo sapiens
gtgccaaccccacccagctc

SEQ ID NO: 3064079 - DNA, 16 bp, Homo sapiens
gtgccaactgtggctg

SEQ ID NO: 3064080 - DNA, 18 bp, Homo sapiens
gtgccaactgtggctggt

SEQ ID NO: 3064081 - DNA, 16 bp, Homo sapiens
gtgccaccatgcctca

SEQ ID NO: 3064082 - DNA, 20 bp, Homo sapiens
gtgccacccccagccctggc

SEQ ID NO: 3064083 - DNA, 15 bp, Homo sapiens
gtgccagatcctctt

SEQ ID NO: 3064084 - DNA, 22 bp, Homo sapiens
gtgccagcagcctcgcacaggc

SEQ ID NO: 3064085 - DNA, 12 bp, Homo sapiens
gtgccagccaat

SEQ ID NO: 3064086 - DNA, 21 bp, Homo sapiens
gtgccagccaatccctggcca

SEQ ID NO: 3064087 - DNA, 17 bp, Homo sapiens
gtgccagcccctgctgg

SEQ ID NO: 3064088 - DNA, 16 bp, Homo sapiens
gtgccaggaccagtca

SEQ ID NO: 3064089 - DNA, 13 bp, Homo sapiens
gtgccaggcccgg

SEQ ID NO: 3064090 - DNA, 20 bp, Homo sapiens
gtgccaggcccggggctggc

SEQ ID NO: 3064091 - DNA, 15 bp, Homo sapiens
gtgccaggcttgcct

SEQ ID NO: 3064092 - DNA, 17 bp, Homo sapiens
gtgccaggcttgcctgg

SEQ ID NO: 3064093 - DNA, 19 bp, Homo sapiens
gtgccaggcttgcctgggc

SEQ ID NO: 3064094 - DNA, 20 bp, Homo sapiens
gtgccaggcttgcctgggct

SEQ ID NO: 3064095 - DNA, 21 bp, Homo sapiens
gtgccaggcttgcctgggctg

SEQ ID NO: 3064096 - DNA, 16 bp, Homo sapiens
gtgccaggtctgggtg

SEQ ID NO: 3064097 - DNA, 16 bp, Homo sapiens
gtgccatcattgctgt

SEQ ID NO: 3064098 - DNA, 22 bp, Homo sapiens
gtgccatcattgctgtctgcag

SEQ ID NO: 3064099 - DNA, 19 bp, Homo sapiens
gtgccatgtcaaacaaata

SEQ ID NO: 3064100 - DNA, 23 bp, Homo sapiens
gtgccattgtactccagcctggg

SEQ ID NO: 3064101 - DNA, 13 bp, Homo sapiens
gtgcccacaggcc

SEQ ID NO: 3064102 - DNA, 21 bp, Homo sapiens
gtgcccacaggccgccctgcg

SEQ ID NO: 3064103 - DNA, 20 bp, Homo sapiens
gtgcccagctatacctgtgc

SEQ ID NO: 3064104 - DNA, 12 bp, Homo sapiens
gtgccccagact

SEQ ID NO: 3064105 - DNA, 18 bp, Homo sapiens
gtgccccagactgagctc

SEQ ID NO: 3064106 - DNA, 23 bp, Homo sapiens
gtgccccagactgagctctccag

SEQ ID NO: 3064107 - DNA, 19 bp, Homo sapiens
gtgccccaggaccagctca

SEQ ID NO: 3064108 - DNA, 23 bp, Homo sapiens
gtcttgtgtatttctctgtgaat

SEQ ID NO: 3064109 - DNA, 13 bp, Homo sapiens
gtcttgttctgtc

SEQ ID NO: 3064110 - DNA, 21 bp, Homo sapiens
gtcttgttctgtcactcaggc

SEQ ID NO: 3064111 - DNA, 23 bp, Homo sapiens
gtcttgttctgtcactcaggctg

SEQ ID NO: 3064112 - DNA, 20 bp, Homo sapiens
gtcttgttgttattgatgtt

SEQ ID NO: 3064113 - DNA, 21 bp, Homo sapiens
gtctttactccatgaagggtc

SEQ ID NO: 3064114 - DNA, 18 bp, Homo sapiens
gtctttaggtctttgtaa

SEQ ID NO: 3064115 - DNA, 22 bp, Homo sapiens
gtctttcagtacttttttaaat

SEQ ID NO: 3064116 - DNA, 21 bp, Homo sapiens
gtctttctttgctgctgtgga

SEQ ID NO: 3064117 - DNA, 22 bp, Homo sapiens
gtctttctttgctgctgtggaa

SEQ ID NO: 3064118 - DNA, 21 bp, Homo sapiens
gtctttgtaatgtcaccacct

SEQ ID NO: 3064119 - DNA, 22 bp, Homo sapiens
gtctttgtaatgtcaccacctt

SEQ ID NO: 3064120 - DNA, 22 bp, Homo sapiens
gtcttttagttccaacaaagaa

SEQ ID NO: 3064121 - DNA, 16 bp, Homo sapiens
gtctttttccttcctg

SEQ ID NO: 3064122 - DNA, 18 bp, Homo sapiens
gtctttttccttcctgag

SEQ ID NO: 3064123 - DNA, 11 bp, Homo sapiens
gtctttttgta

SEQ ID NO: 3064124 - DNA, 17 bp, Homo sapiens
gtcttttttttcatcct

SEQ ID NO: 3064125 - DNA, 18 bp, Homo sapiens
gtcttttttttcatcctt

SEQ ID NO: 3064126 - DNA, 24 bp, Homo sapiens
gtgaaacccagtcactgtgagctc

SEQ ID NO: 3064127 - DNA, 17 bp, Homo sapiens
gtgaaagcatatgggtt

SEQ ID NO: 3064128 - DNA, 17 bp, Homo sapiens
gtgaaatagttcaaagc

SEQ ID NO: 3064129 - DNA, 21 bp, Homo sapiens
gtgaaatagttcaaagccaag

SEQ ID NO: 3064130 - DNA, 15 bp, Homo sapiens
gtgaaatattgtaaa

SEQ ID NO: 3064131 - DNA, 16 bp, Homo sapiens
gtgaaatattgtaaat

SEQ ID NO: 3064132 - DNA, 16 bp, Homo sapiens
gtgaaatctgtctttg

SEQ ID NO: 3064133 - DNA, 19 bp, Homo sapiens
gtgaacaaaagatgctctt

SEQ ID NO: 3064134 - DNA, 17 bp, Homo sapiens
gtgaacaaagcagccac

SEQ ID NO: 3064135 - DNA, 12 bp, Homo sapiens
gtgaacagccaa

SEQ ID NO: 3064136 - DNA, 15 bp, Homo sapiens
gtgaacagctggtgc

SEQ ID NO: 3064137 - DNA, 16 bp, Homo sapiens
gtgaacagctggtgcc

SEQ ID NO: 3064138 - DNA, 14 bp, Homo sapiens
gtgaactcagccaa

SEQ ID NO: 3064139 - DNA, 21 bp, Homo sapiens
gtgaactcagccaagcacagt

SEQ ID NO: 3064140 - DNA, 22 bp, Homo sapiens
gtgaactcagccaagcacagtg

SEQ ID NO: 3064141 - DNA, 23 bp, Homo sapiens
gtgaactcagccaagcacagtgg

SEQ ID NO: 3064142 - DNA, 23 bp, Homo sapiens
gtgaagaatccttttgtagaatg

SEQ ID NO: 3064143 - DNA, 18 bp, Homo sapiens
gtgaagagggacataaga

SEQ ID NO: 3064144 - DNA, 13 bp, Homo sapiens
gtgaaggaccctt

SEQ ID NO: 3064145 - DNA, 14 bp, Homo sapiens
gtgaaggcttctct

SEQ ID NO: 3064146 - DNA, 15 bp, Homo sapiens
gtgaagggagaaagg

SEQ ID NO: 3064147 - DNA, 17 bp, Homo sapiens
gtgaaggtcctgctatt

SEQ ID NO: 3064148 - DNA, 19 bp, Homo sapiens
gtgaagtaagctgtaactt

SEQ ID NO: 3064149 - DNA, 13 bp, Homo sapiens
gtgaagtgaggac

SEQ ID NO: 3064150 - DNA, 18 bp, Homo sapiens
gtgaagttagaattcctt

SEQ ID NO: 3064151 - DNA, 14 bp, Homo sapiens
gtgaagtttggaga

SEQ ID NO: 3064152 - DNA, 24 bp, Homo sapiens
gtgaataataaatacacaatgaat

SEQ ID NO: 3064153 - DNA, 23 bp, Homo sapiens
gtgaataatcatgtgaaatgttt

SEQ ID NO: 3064154 - DNA, 18 bp, Homo sapiens
gtgaatatgcctgtaatt

SEQ ID NO: 3064155 - DNA, 18 bp, Homo sapiens
gtgaatccatgggtctgg

SEQ ID NO: 3064156 - DNA, 15 bp, Homo sapiens
gtgaatcctggcaag

SEQ ID NO: 3064157 - DNA, 21 bp, Homo sapiens
gtgaatctaaggataatgaaa

SEQ ID NO: 3064158 - DNA, 13 bp, Homo sapiens
gtgaatgaacact

SEQ ID NO: 3064159 - DNA, 22 bp, Homo sapiens
gtgaatgcttctgatttagcaa

SEQ ID NO: 3064160 - DNA, 20 bp, Homo sapiens
gtgaatgtcttccttttctt

SEQ ID NO: 3064161 - DNA, 16 bp, Homo sapiens
gtgaatttaagcatga

SEQ ID NO: 3064162 - DNA, 17 bp, Homo sapiens
gtgaatttaagcatgag

SEQ ID NO: 3064163 - DNA, 12 bp, Homo sapiens
gtgaatttttat

SEQ ID NO: 3064164 - DNA, 13 bp, Homo sapiens
gtgaatttttatt

SEQ ID NO: 3064165 - DNA, 15 bp, Homo sapiens
gtgaatttttctcta

SEQ ID NO: 3064166 - DNA, 13 bp, Homo sapiens
gtgaatttttgca

SEQ ID NO: 3064167 - DNA, 14 bp, Homo sapiens
gtgaatttttgcaa

SEQ ID NO: 3064168 - DNA, 23 bp, Homo sapiens
gtgaatttttgcaataatgcagt

SEQ ID NO: 3064169 - DNA, 14 bp, Homo sapiens
gtgacacaaacaca

SEQ ID NO: 3064170 - DNA, 18 bp, Homo sapiens
gtgacacaaacacacaca

SEQ ID NO: 3064171 - DNA, 21 bp, Homo sapiens
gtgacacaaacacacacaaaa

SEQ ID NO: 3064172 - DNA, 23 bp, Homo sapiens
gtgacacactacaccacacacaa

SEQ ID NO: 3064173 - DNA, 20 bp, Homo sapiens
gtgacacccaagagggctgc

SEQ ID NO: 3064174 - DNA, 19 bp, Homo sapiens
gtgacactctccttgcagt

SEQ ID NO: 3064175 - DNA, 20 bp, Homo sapiens
gtgacactctccttgcagtt

SEQ ID NO: 3064176 - DNA, 22 bp, Homo sapiens
gtgacagactcctgaggacagc

SEQ ID NO: 3064177 - DNA, 18 bp, Homo sapiens
gtgacagagcgagactcc

SEQ ID NO: 3064178 - DNA, 12 bp, Homo sapiens
gtgacagagtga

SEQ ID NO: 3064179 - DNA, 13 bp, Homo sapiens
gtgacagccttgg

SEQ ID NO: 3064180 - DNA, 16 bp, Homo sapiens
gtgacagccttgggcc

SEQ ID NO: 3064181 - DNA, 22 bp, Homo sapiens
gtgacagctctttttgtgaagt

SEQ ID NO: 3064182 - DNA, 23 bp, Homo sapiens
gtgacagctttcctcaaaaagca

SEQ ID NO: 3064183 - DNA, 14 bp, Homo sapiens
gtgacaggaaagat

SEQ ID NO: 3064184 - DNA, 15 bp, Homo sapiens
gtgacaggaaagatt

SEQ ID NO: 3064185 - DNA, 20 bp, Homo sapiens
gtgacagggaagctacaggt

SEQ ID NO: 3064186 - DNA, 12 bp, Homo sapiens
gtgacagtggct

SEQ ID NO: 3064187 - DNA, 22 bp, Homo sapiens
gtgacagttgcagcccttgtga

SEQ ID NO: 3064188 - DNA, 18 bp, Homo sapiens
gtgacatcgacaaccacg

SEQ ID NO: 3064189 - DNA, 19 bp, Homo sapiens
gtgacatgcccaaggccac

SEQ ID NO: 3064190 - DNA, 15 bp, Homo sapiens
gtgaccaatgtcttg

SEQ ID NO: 3064191 - DNA, 14 bp, Homo sapiens
gtgaccagtttctt

SEQ ID NO: 3064192 - DNA, 18 bp, Homo sapiens
gtgacccacttctcatca

SEQ ID NO: 3064193 - DNA, 14 bp, Homo sapiens
gtgaccctctcact

SEQ ID NO: 3064194 - DNA, 19 bp, Homo sapiens
gtgaccgcccagctctccc

SEQ ID NO: 3064195 - DNA, 20 bp, Homo sapiens
gtgaccgcctcctgctctgc

SEQ ID NO: 3064196 - DNA, 23 bp, Homo sapiens
gtgaccgcctcctgctctgcacg

SEQ ID NO: 3064197 - DNA, 14 bp, Homo sapiens
gtgacctccatact

SEQ ID NO: 3064198 - DNA, 15 bp, Homo sapiens
gtgacctccatactg

SEQ ID NO: 3064199 - DNA, 14 bp, Homo sapiens
gtgacctgaagttc

SEQ ID NO: 3064200 - DNA, 18 bp, Homo sapiens
gtgaccttgggaccaaag

SEQ ID NO: 3064201 - DNA, 16 bp, Homo sapiens
gtgacgtgactcagag

SEQ ID NO: 3064202 - DNA, 23 bp, Homo sapiens
gtgactaactagacaccaaagtt

SEQ ID NO: 3064203 - DNA, 17 bp, Homo sapiens
gtgactaatggcatgag

SEQ ID NO: 3064204 - DNA, 15 bp, Homo sapiens
gtgactaattgtata

SEQ ID NO: 3064205 - DNA, 20 bp, Homo sapiens
gtgactaattgtataacagg

SEQ ID NO: 3064206 - DNA, 21 bp, Homo sapiens
gtgactaattgtataacaggt

SEQ ID NO: 3064207 - DNA, 22 bp, Homo sapiens
gtgactaattgtataacaggtt

SEQ ID NO: 3064208 - DNA, 14 bp, Homo sapiens
gtgactataaagct

SEQ ID NO: 3064209 - DNA, 17 bp, Homo sapiens
gtgactataaagctgtt

SEQ ID NO: 3064210 - DNA, 15 bp, Homo sapiens
gtgactcacccaagc

SEQ ID NO: 3064211 - DNA, 13 bp, Homo sapiens
gtgactcagagct

SEQ ID NO: 3064212 - DNA, 17 bp, Homo sapiens
gtgactcagcagaggca

SEQ ID NO: 3064213 - DNA, 14 bp, Homo sapiens
gtgactcagcagcc

SEQ ID NO: 3064214 - DNA, 19 bp, Homo sapiens
gtgactctagcaaggctca

SEQ ID NO: 3064215 - DNA, 21 bp, Homo sapiens
gtgactctcctgcctcagcct

SEQ ID NO: 3064216 - DNA, 14 bp, Homo sapiens
gtgactctgaagct

SEQ ID NO: 3064217 - DNA, 15 bp, Homo sapiens
gtgactctgggcagg

SEQ ID NO: 3064218 - DNA, 12 bp, Homo sapiens
gtgactctttcc

SEQ ID NO: 3064219 - DNA, 10 bp, Homo sapiens
gtgactgaaa

SEQ ID NO: 3064220 - DNA, 14 bp, Homo sapiens
gtgactgatttcaa

SEQ ID NO: 3064221 - DNA, 20 bp, Homo sapiens
gtgactgccccaactcctgg

SEQ ID NO: 3064222 - DNA, 21 bp, Homo sapiens
gtgactgccccaactcctgga

SEQ ID NO: 3064223 - DNA, 23 bp, Homo sapiens
gtgactgccccaactcctggaag

SEQ ID NO: 3064224 - DNA, 12 bp, Homo sapiens
gtgagaaagaaa

SEQ ID NO: 3064225 - DNA, 23 bp, Homo sapiens
gtgagaaagaaagtaaaaaaggt

SEQ ID NO: 3064226 - DNA, 22 bp, Homo sapiens
gtgagaacctgggttgcagaca

SEQ ID NO: 3064227 - DNA, 23 bp, Homo sapiens
gtgagaacggtgaccgcctcctg

SEQ ID NO: 3064228 - DNA, 14 bp, Homo sapiens
gtgagaactgagga

SEQ ID NO: 3064229 - DNA, 18 bp, Homo sapiens
gtgagaccaggggaccag

SEQ ID NO: 3064230 - DNA, 15 bp, Homo sapiens
gtgagacccaggagc

SEQ ID NO: 3064231 - DNA, 15 bp, Homo sapiens
gtgagaggaagggtg

SEQ ID NO: 3064232 - DNA, 12 bp, Homo sapiens
gtgagaggggag

SEQ ID NO: 3064233 - DNA, 17 bp, Homo sapiens
gtgagaggggagggagg

SEQ ID NO: 3064234 - DNA, 23 bp, Homo sapiens
gtgagataacttccttcacatct

SEQ ID NO: 3064235 - DNA, 16 bp, Homo sapiens
gtgagatgcagctgga

SEQ ID NO: 3064236 - DNA, 18 bp, Homo sapiens
gtgagatgcagctggaaa

SEQ ID NO: 3064237 - DNA, 15 bp, Homo sapiens
gtgagcagtaactgt

SEQ ID NO: 3064238 - DNA, 15 bp, Homo sapiens
gtgagcatcagaggg

SEQ ID NO: 3064239 - DNA, 16 bp, Homo sapiens
gtgagcatcagagggc

SEQ ID NO: 3064240 - DNA, 12 bp, Homo sapiens
gtgagccccatc

SEQ ID NO: 3064241 - DNA, 16 bp, Homo sapiens
gtgagccttgctgcca

SEQ ID NO: 3064242 - DNA, 14 bp, Homo sapiens
gtgagctacaaatg

SEQ ID NO: 3064243 - DNA, 22 bp, Homo sapiens
gtgagctcccaggtgcagccag

SEQ ID NO: 3064244 - DNA, 19 bp, Homo sapiens
gtctcccttggcccagaga

SEQ ID NO: 3064245 - DNA, 14 bp, Homo sapiens
gtctcctactctgt

SEQ ID NO: 3064246 - DNA, 17 bp, Homo sapiens
gtctcctctcagcttct

SEQ ID NO: 3064247 - DNA, 15 bp, Homo sapiens
gtctccttctcttct

SEQ ID NO: 3064248 - DNA, 21 bp, Homo sapiens
gtctccttctcttctcttctt

SEQ ID NO: 3064249 - DNA, 18 bp, Homo sapiens
gtctcctttcaccccagg

SEQ ID NO: 3064250 - DNA, 15 bp, Homo sapiens
gtctcgaactcctga

SEQ ID NO: 3064251 - DNA, 17 bp, Homo sapiens
gtctcgaactcctgacc

SEQ ID NO: 3064252 - DNA, 14 bp, Homo sapiens
gtctcgatgctgct

SEQ ID NO: 3064253 - DNA, 16 bp, Homo sapiens
gtctcgatgctgctgg

SEQ ID NO: 3064254 - DNA, 19 bp, Homo sapiens
gtctcgatgctgctggcct

SEQ ID NO: 3064255 - DNA, 20 bp, Homo sapiens
gtctcgatgctgctggcctc

SEQ ID NO: 3064256 - DNA, 21 bp, Homo sapiens
gtctcgatgctgctggcctcc

SEQ ID NO: 3064257 - DNA, 20 bp, Homo sapiens
gtctcgctgcatcacccagg

SEQ ID NO: 3064258 - DNA, 22 bp, Homo sapiens
gtctcggggcttgccccactct

SEQ ID NO: 3064259 - DNA, 16 bp, Homo sapiens
gtctctaaaaagaagc

SEQ ID NO: 3064260 - DNA, 18 bp, Homo sapiens
gtctctacccctttctgt

SEQ ID NO: 3064261 - DNA, 17 bp, Homo sapiens
gtctctatcattaaagt

SEQ ID NO: 3064262 - DNA, 18 bp, Homo sapiens
gtctctatcattaaagtt

SEQ ID NO: 3064263 - DNA, 12 bp, Homo sapiens
gtctctcagaat

SEQ ID NO: 3064264 - DNA, 24 bp, Homo sapiens
gtctctccagcctcacagatgctg

SEQ ID NO: 3064265 - DNA, 22 bp, Homo sapiens
gtctctccccctctgtcttctc

SEQ ID NO: 3064266 - DNA, 13 bp, Homo sapiens
gtctctctgcctg

SEQ ID NO: 3064267 - DNA, 18 bp, Homo sapiens
gtctctctgcctgctggg

SEQ ID NO: 3064268 - DNA, 15 bp, Homo sapiens
gtctctctgggctgc

SEQ ID NO: 3064269 - DNA, 21 bp, Homo sapiens
gtctctcttggaattagatgt

SEQ ID NO: 3064270 - DNA, 19 bp, Homo sapiens
gtctctcttgtcacatgga

SEQ ID NO: 3064271 - DNA, 18 bp, Homo sapiens
gtctctgcctggagcagg

SEQ ID NO: 3064272 - DNA, 12 bp, Homo sapiens
gtctctgctcca

SEQ ID NO: 3064273 - DNA, 21 bp, Homo sapiens
gtctctgctccacctttcagc

SEQ ID NO: 3064274 - DNA, 15 bp, Homo sapiens
gtctctgcttccatg

SEQ ID NO: 3064275 - DNA, 16 bp, Homo sapiens
gtctctggaacccagg

SEQ ID NO: 3064276 - DNA, 15 bp, Homo sapiens
gtctctgtgtaacca

SEQ ID NO: 3064277 - DNA, 20 bp, Homo sapiens
gtctctgttgactggctgtg

SEQ ID NO: 3064278 - DNA, 21 bp, Homo sapiens
gtctctgtttagtaaatacat

SEQ ID NO: 3064279 - DNA, 16 bp, Homo sapiens
gtctctttattcctag

SEQ ID NO: 3064280 - DNA, 22 bp, Homo sapiens
gtctctttcatgagtttttccc

SEQ ID NO: 3064281 - DNA, 17 bp, Homo sapiens
gtctctttccactttgt

SEQ ID NO: 3064282 - DNA, 12 bp, Homo sapiens
gtctcttttctc

SEQ ID NO: 3064283 - DNA, 13 bp, Homo sapiens
gtctcttttctct

SEQ ID NO: 3064284 - DNA, 16 bp, Homo sapiens
gtctgaactttgggaa

SEQ ID NO: 3064285 - DNA, 17 bp, Homo sapiens
gtctgaagctcgcatcc

SEQ ID NO: 3064286 - DNA, 22 bp, Homo sapiens
gtctgaagctcgcatccagaca

SEQ ID NO: 3064287 - DNA, 19 bp, Homo sapiens
gtctgacctggtgggagca

SEQ ID NO: 3064288 - DNA, 14 bp, Homo sapiens
gtctgactccctcc

SEQ ID NO: 3064289 - DNA, 18 bp, Homo sapiens
gtctgactccctccccac

SEQ ID NO: 3064290 - DNA, 19 bp, Homo sapiens
gtctgagagaccatctcct

SEQ ID NO: 3064291 - DNA, 20 bp, Homo sapiens
gtctgagagcaaagtgacct

SEQ ID NO: 3064292 - DNA, 19 bp, Homo sapiens
gtctgatcgtgacgctgaa

SEQ ID NO: 3064293 - DNA, 15 bp, Homo sapiens
gtctgatggtgagca

SEQ ID NO: 3064294 - DNA, 12 bp, Homo sapiens
gtctgatttgca

SEQ ID NO: 3064295 - DNA, 15 bp, Homo sapiens
gtctgatttgcagga

SEQ ID NO: 3064296 - DNA, 16 bp, Homo sapiens
gtctgatttgcaggat

SEQ ID NO: 3064297 - DNA, 18 bp, Homo sapiens
gtctgcaagggcccagag

SEQ ID NO: 3064298 - DNA, 19 bp, Homo sapiens
gtctgcaagggcccagagt

SEQ ID NO: 3064299 - DNA, 19 bp, Homo sapiens
gtctgcagatagaaagcat

SEQ ID NO: 3064300 - DNA, 12 bp, Homo sapiens
gtctgcagccct

SEQ ID NO: 3064301 - DNA, 20 bp, Homo sapiens
gtctgcatttcggtggctag

SEQ ID NO: 3064302 - DNA, 15 bp, Homo sapiens
gtctgccaatctgta

SEQ ID NO: 3064303 - DNA, 12 bp, Homo sapiens
gtctgccagggc

SEQ ID NO: 3064304 - DNA, 15 bp, Homo sapiens
gtctgccccacatgt

SEQ ID NO: 3064305 - DNA, 20 bp, Homo sapiens
gtctgcctggagtgctgtgc

SEQ ID NO: 3064306 - DNA, 17 bp, Homo sapiens
gtctgcgattttatctg

SEQ ID NO: 3064307 - DNA, 23 bp, Homo sapiens
gtctgcggcagttgccgcttctg

SEQ ID NO: 3064308 - DNA, 18 bp, Homo sapiens
gtctgctcaggaattgaa

SEQ ID NO: 3064309 - DNA, 21 bp, Homo sapiens
gtctgctcaggaattgaagat

SEQ ID NO: 3064310 - DNA, 17 bp, Homo sapiens
gtctgctcctttcccct

SEQ ID NO: 3064311 - DNA, 15 bp, Homo sapiens
gtctgctgatgcagc

SEQ ID NO: 3064312 - DNA, 19 bp, Homo sapiens
gtctggaagaaagataaaa

SEQ ID NO: 3064313 - DNA, 17 bp, Homo sapiens
gtctggcacagcctggc

SEQ ID NO: 3064314 - DNA, 15 bp, Homo sapiens
gtctggccctggcgg

SEQ ID NO: 3064315 - DNA, 21 bp, Homo sapiens
gtctggccctggcgggtggct

SEQ ID NO: 3064316 - DNA, 12 bp, Homo sapiens
gtctggcctgag

SEQ ID NO: 3064317 - DNA, 14 bp, Homo sapiens
gtctggcctgaggt

SEQ ID NO: 3064318 - DNA, 15 bp, Homo sapiens
gtctggcctgaggtc

SEQ ID NO: 3064319 - DNA, 15 bp, Homo sapiens
gtctggcgagccctt

SEQ ID NO: 3064320 - DNA, 16 bp, Homo sapiens
gtctggcgagccctta

SEQ ID NO: 3064321 - DNA, 18 bp, Homo sapiens
gtctgggaaatgagcagg

SEQ ID NO: 3064322 - DNA, 21 bp, Homo sapiens
gtctgggagaaattgacagat

SEQ ID NO: 3064323 - DNA, 16 bp, Homo sapiens
gtctggggttcagccc

SEQ ID NO: 3064324 - DNA, 18 bp, Homo sapiens
gtctggggttcagcccct

SEQ ID NO: 3064325 - DNA, 16 bp, Homo sapiens
gtctgggtcagaccca

SEQ ID NO: 3064326 - DNA, 21 bp, Homo sapiens
gtctgggtggatgtgagcaga

SEQ ID NO: 3064327 - DNA, 19 bp, Homo sapiens
gtctgggtttggcccaaga

SEQ ID NO: 3064328 - DNA, 14 bp, Homo sapiens
gtctggtctatgtt

SEQ ID NO: 3064329 - DNA, 19 bp, Homo sapiens
gtctggttagtcgtgacta

SEQ ID NO: 3064330 - DNA, 22 bp, Homo sapiens
gtctgtagtgtcactcaaggcg

SEQ ID NO: 3064331 - DNA, 14 bp, Homo sapiens
gtctgtcatctgct

SEQ ID NO: 3064332 - DNA, 13 bp, Homo sapiens
gtctgtccaaccc

SEQ ID NO: 3064333 - DNA, 22 bp, Homo sapiens
gtctgtccaacccctcccccac

SEQ ID NO: 3064334 - DNA, 21 bp, Homo sapiens
gtctgtcctcacgccccctgt

SEQ ID NO: 3064335 - DNA, 18 bp, Homo sapiens
gtctgtctagtgtctggg

SEQ ID NO: 3064336 - DNA, 23 bp, Homo sapiens
gtctgtcttctgtatataaatgg

SEQ ID NO: 3064337 - DNA, 22 bp, Homo sapiens
gtctgtgtgtgacccctcctgg

SEQ ID NO: 3064338 - DNA, 21 bp, Homo sapiens
gtctgtgtgtgtgtgtgtgcg

SEQ ID NO: 3064339 - DNA, 20 bp, Homo sapiens
gtctgtgtttttttggcagt

SEQ ID NO: 3064340 - DNA, 22 bp, Homo sapiens
gtctgttgtgtgtcatgccagt

SEQ ID NO: 3064341 - DNA, 21 bp, Homo sapiens
gtctgtttggactgcagaagc

SEQ ID NO: 3064342 - DNA, 16 bp, Homo sapiens
gtcttaatttatttct

SEQ ID NO: 3064343 - DNA, 20 bp, Homo sapiens
gtcttactacagaaatgagg

SEQ ID NO: 3064344 - DNA, 19 bp, Homo sapiens
gtcttagaagtggaccagg

SEQ ID NO: 3064345 - DNA, 21 bp, Homo sapiens
gtcttagctctggacgtgaaa

SEQ ID NO: 3064346 - DNA, 15 bp, Homo sapiens
gtcttagctctttct

SEQ ID NO: 3064347 - DNA, 23 bp, Homo sapiens
gtcttaggtcttcctgtggctcc

SEQ ID NO: 3064348 - DNA, 13 bp, Homo sapiens
gtcttcaaattaa

SEQ ID NO: 3064349 - DNA, 14 bp, Homo sapiens
gtcttcaaattaaa

SEQ ID NO: 3064350 - DNA, 20 bp, Homo sapiens
gtcttcacctgattcaacta

SEQ ID NO: 3064351 - DNA, 14 bp, Homo sapiens
gtcttcagcctctt

SEQ ID NO: 3064352 - DNA, 22 bp, Homo sapiens
gtcttcagcctctttctgtccc

SEQ ID NO: 3064353 - DNA, 23 bp, Homo sapiens
gtcttcagcctctttctgtccct

SEQ ID NO: 3064354 - DNA, 17 bp, Homo sapiens
gtcttcatctccctgcc

SEQ ID NO: 3064355 - DNA, 22 bp, Homo sapiens
gtcttcctcttagcctctggat

SEQ ID NO: 3064356 - DNA, 19 bp, Homo sapiens
gtcttcctgtggctccctc

SEQ ID NO: 3064357 - DNA, 21 bp, Homo sapiens
gtcttcctgtggctccctctc

SEQ ID NO: 3064358 - DNA, 22 bp, Homo sapiens
gtcttcctgtggctccctctct

SEQ ID NO: 3064359 - DNA, 23 bp, Homo sapiens
gtcttcctgtggctccctctctc

SEQ ID NO: 3064360 - DNA, 24 bp, Homo sapiens
gtcttcctgtggctccctctctcc

SEQ ID NO: 3064361 - DNA, 22 bp, Homo sapiens
gtcttccttctcattgctgccc

SEQ ID NO: 3064362 - DNA, 21 bp, Homo sapiens
gtcttcggccgagctggtttc

SEQ ID NO: 3064363 - DNA, 17 bp, Homo sapiens
gtcttctctatcctctc

SEQ ID NO: 3064364 - DNA, 18 bp, Homo sapiens
gtcttctctatcctctct

SEQ ID NO: 3064365 - DNA, 13 bp, Homo sapiens
gtcttctctccac

SEQ ID NO: 3064366 - DNA, 22 bp, Homo sapiens
gtcttgaaaaaaaatagatgtt

SEQ ID NO: 3064367 - DNA, 22 bp, Homo sapiens
gtcttgaaacatgttcatctgg

SEQ ID NO: 3064368 - DNA, 12 bp, Homo sapiens
gtcttgaaagat

SEQ ID NO: 3064369 - DNA, 18 bp, Homo sapiens
gtcttgacctgaactctg

SEQ ID NO: 3064370 - DNA, 21 bp, Homo sapiens
gtcttgacctgaactctgcaa

SEQ ID NO: 3064371 - DNA, 23 bp, Homo sapiens
gtcttgctatattgcccaggctg

SEQ ID NO: 3064372 - DNA, 19 bp, Homo sapiens
gtcttgctgttgacatatt

SEQ ID NO: 3064373 - DNA, 22 bp, Homo sapiens
gtcttggaattccatttgagga

SEQ ID NO: 3064374 - DNA, 14 bp, Homo sapiens
gtcttggacactgt

SEQ ID NO: 3064375 - DNA, 20 bp, Homo sapiens
gtcttggcagcacctgtctc

SEQ ID NO: 3064376 - DNA, 20 bp, Homo sapiens
gtcttggctttcatgttatt

SEQ ID NO: 3064377 - DNA, 17 bp, Homo sapiens
gtcttggttccagcctg

SEQ ID NO: 3064378 - DNA, 15 bp, Homo sapiens
gtcttgtacatgtgt

SEQ ID NO: 3064379 - DNA, 17 bp, Homo sapiens
gtcctaacaaatgctcc

SEQ ID NO: 3064380 - DNA, 15 bp, Homo sapiens
gtcctaagaagtggg

SEQ ID NO: 3064381 - DNA, 15 bp, Homo sapiens
gtcctaagtgtcaag

SEQ ID NO: 3064382 - DNA, 16 bp, Homo sapiens
gtcctacccatccccg

SEQ ID NO: 3064383 - DNA, 21 bp, Homo sapiens
gtcctagctcctcctcctggg

SEQ ID NO: 3064384 - DNA, 19 bp, Homo sapiens
gtcctaggagtatcctcat

SEQ ID NO: 3064385 - DNA, 19 bp, Homo sapiens
gtcctatggacaacttatt

SEQ ID NO: 3064386 - DNA, 20 bp, Homo sapiens
gtcctcaaagaagtggttct

SEQ ID NO: 3064387 - DNA, 23 bp, Homo sapiens
gtcctcacttctagatctcagcc

SEQ ID NO: 3064388 - DNA, 13 bp, Homo sapiens
gtcctcagccagt

SEQ ID NO: 3064389 - DNA, 12 bp, Homo sapiens
gtcctcagcccc

SEQ ID NO: 3064390 - DNA, 14 bp, Homo sapiens
gtcctcaggtggcc

SEQ ID NO: 3064391 - DNA, 17 bp, Homo sapiens
gtcctcattcaaaggga

SEQ ID NO: 3064392 - DNA, 18 bp, Homo sapiens
gtcctccacacaagggaa

SEQ ID NO: 3064393 - DNA, 21 bp, Homo sapiens
gtcctcccaatttcagactcc

SEQ ID NO: 3064394 - DNA, 15 bp, Homo sapiens
gtcctccccctgcca

SEQ ID NO: 3064395 - DNA, 16 bp, Homo sapiens
gtcctccccctgccag

SEQ ID NO: 3064396 - DNA, 20 bp, Homo sapiens
gtcctccccctgccagtgcc

SEQ ID NO: 3064397 - DNA, 21 bp, Homo sapiens
gtcctccccctgccagtgcct

SEQ ID NO: 3064398 - DNA, 22 bp, Homo sapiens
gtcctccccctgccagtgcctt

SEQ ID NO: 3064399 - DNA, 16 bp, Homo sapiens
gtcctccgcctactgt

SEQ ID NO: 3064400 - DNA, 22 bp, Homo sapiens
gtcctcctcggatcaccgagag

SEQ ID NO: 3064401 - DNA, 11 bp, Homo sapiens
gtcctcctcta

SEQ ID NO: 3064402 - DNA, 14 bp, Homo sapiens
gtcctcctgttact

SEQ ID NO: 3064403 - DNA, 23 bp, Homo sapiens
gtcctcctgttccgtgtgggctt

SEQ ID NO: 3064404 - DNA, 22 bp, Homo sapiens
gtcctcgatgggagggatggcc

SEQ ID NO: 3064405 - DNA, 20 bp, Homo sapiens
gtcctcggagctggttcctc

SEQ ID NO: 3064406 - DNA, 14 bp, Homo sapiens
gtcctcggcccatc

SEQ ID NO: 3064407 - DNA, 21 bp, Homo sapiens
gtcctctctctgtggggctga

SEQ ID NO: 3064408 - DNA, 17 bp, Homo sapiens
gtcctctgaatgaacct

SEQ ID NO: 3064409 - DNA, 12 bp, Homo sapiens
gtcctctgcctc

SEQ ID NO: 3064410 - DNA, 12 bp, Homo sapiens
gtcctctgtagt

SEQ ID NO: 3064411 - DNA, 23 bp, Homo sapiens
gtcctctgtcagtcacagccacc

SEQ ID NO: 3064412 - DNA, 13 bp, Homo sapiens
gtcctcttctgca

SEQ ID NO: 3064413 - DNA, 13 bp, Homo sapiens
gtcctgaatggct

SEQ ID NO: 3064414 - DNA, 17 bp, Homo sapiens
gtcctgacagcactcct

SEQ ID NO: 3064415 - DNA, 16 bp, Homo sapiens
gtcctgactgggctgg

SEQ ID NO: 3064416 - DNA, 17 bp, Homo sapiens
gtcctgactgggctggg

SEQ ID NO: 3064417 - DNA, 17 bp, Homo sapiens
gtcctgatcagagccgt

SEQ ID NO: 3064418 - DNA, 24 bp, Homo sapiens
gtcctgcacagattcccaggccag

SEQ ID NO: 3064419 - DNA, 20 bp, Homo sapiens
gtcctgcaccggggcctggg

SEQ ID NO: 3064420 - DNA, 15 bp, Homo sapiens
gtcctgccctgcccc

SEQ ID NO: 3064421 - DNA, 16 bp, Homo sapiens
gtcctgccggagagga

SEQ ID NO: 3064422 - DNA, 14 bp, Homo sapiens
gtcctgcctttggg

SEQ ID NO: 3064423 - DNA, 18 bp, Homo sapiens
gtcctgctccgctgcctg

SEQ ID NO: 3064424 - DNA, 19 bp, Homo sapiens
gtcctgctccgctgcctgg

SEQ ID NO: 3064425 - DNA, 20 bp, Homo sapiens
gtcctgctccgctgcctgga

SEQ ID NO: 3064426 - DNA, 21 bp, Homo sapiens
gtcctgctccgctgcctggaa

SEQ ID NO: 3064427 - DNA, 12 bp, Homo sapiens
gtcctgctggcc

SEQ ID NO: 3064428 - DNA, 16 bp, Homo sapiens
gtcctgctggcctgct

SEQ ID NO: 3064429 - DNA, 16 bp, Homo sapiens
gtcctgggaggctgca

SEQ ID NO: 3064430 - DNA, 18 bp, Homo sapiens
gtcctgggaggctgcagc

SEQ ID NO: 3064431 - DNA, 11 bp, Homo sapiens
gtcctgggcag

SEQ ID NO: 3064432 - DNA, 14 bp, Homo sapiens
gtcctgggcaggtg

SEQ ID NO: 3064433 - DNA, 21 bp, Homo sapiens
gtcctgggcaggtgggagctg

SEQ ID NO: 3064434 - DNA, 14 bp, Homo sapiens
gtcctggtcctggc

SEQ ID NO: 3064435 - DNA, 18 bp, Homo sapiens
gtcctggtctgctcagga

SEQ ID NO: 3064436 - DNA, 21 bp, Homo sapiens
gtcctggtctgctcaggaatt

SEQ ID NO: 3064437 - DNA, 18 bp, Homo sapiens
gtcctggtggctgggccc

SEQ ID NO: 3064438 - DNA, 21 bp, Homo sapiens
gtcctgtagttgcgtggactc

SEQ ID NO: 3064439 - DNA, 15 bp, Homo sapiens
gtcctgtctgtcctt

SEQ ID NO: 3064440 - DNA, 20 bp, Homo sapiens
gtcctgtgatcttatttttc

SEQ ID NO: 3064441 - DNA, 22 bp, Homo sapiens
gtcctgtgatcttatttttcta

SEQ ID NO: 3064442 - DNA, 20 bp, Homo sapiens
gtcctgtgtaaattagtgta

SEQ ID NO: 3064443 - DNA, 13 bp, Homo sapiens
gtccttaaaatgt

SEQ ID NO: 3064444 - DNA, 20 bp, Homo sapiens
gtccttactcagagctgcgg

SEQ ID NO: 3064445 - DNA, 15 bp, Homo sapiens
gtccttcacctcact

SEQ ID NO: 3064446 - DNA, 17 bp, Homo sapiens
gtccttcacctttccca

SEQ ID NO: 3064447 - DNA, 18 bp, Homo sapiens
gtccttcactggcgcctt

SEQ ID NO: 3064448 - DNA, 20 bp, Homo sapiens
gtccttcactggcgccttct

SEQ ID NO: 3064449 - DNA, 21 bp, Homo sapiens
gtccttcactggcgccttctc

SEQ ID NO: 3064450 - DNA, 22 bp, Homo sapiens
gtccttcactggcgccttctcg

SEQ ID NO: 3064451 - DNA, 12 bp, Homo sapiens
gtccttgaaaca

SEQ ID NO: 3064452 - DNA, 14 bp, Homo sapiens
gtccttgcacctgc

SEQ ID NO: 3064453 - DNA, 18 bp, Homo sapiens
gtccttgcacctgcatcc

SEQ ID NO: 3064454 - DNA, 15 bp, Homo sapiens
gtccttggcaacttt

SEQ ID NO: 3064455 - DNA, 21 bp, Homo sapiens
gtcctttaactcgttgcagtc

SEQ ID NO: 3064456 - DNA, 20 bp, Homo sapiens
gtcctttccaaggcttctcc

SEQ ID NO: 3064457 - DNA, 22 bp, Homo sapiens
gtcctttccaaggcttctccaa

SEQ ID NO: 3064458 - DNA, 18 bp, Homo sapiens
gtccttttcactacacca

SEQ ID NO: 3064459 - DNA, 15 bp, Homo sapiens
gtcgaaaggtgcagc

SEQ ID NO: 3064460 - DNA, 18 bp, Homo sapiens
gtcgaagcaatcagcaaa

SEQ ID NO: 3064461 - DNA, 15 bp, Homo sapiens
gtcgacactaagaat

SEQ ID NO: 3064462 - DNA, 18 bp, Homo sapiens
gtcgacttcgggctggcc

SEQ ID NO: 3064463 - DNA, 14 bp, Homo sapiens
gtcgatagagctgt

SEQ ID NO: 3064464 - DNA, 23 bp, Homo sapiens
gtcgcacacacatttggaatgca

SEQ ID NO: 3064465 - DNA, 23 bp, Homo sapiens
gtcgctgcagggagcaccacggc

SEQ ID NO: 3064466 - DNA, 13 bp, Homo sapiens
gtcgcttgccaaa

SEQ ID NO: 3064467 - DNA, 13 bp, Homo sapiens
gtcggaaaagcgt

SEQ ID NO: 3064468 - DNA, 16 bp, Homo sapiens
gtcggaaaagcgtctt

SEQ ID NO: 3064469 - DNA, 15 bp, Homo sapiens
gtcggaagcctgtcc

SEQ ID NO: 3064470 - DNA, 16 bp, Homo sapiens
gtcggaagcctgtcct

SEQ ID NO: 3064471 - DNA, 16 bp, Homo sapiens
gtcggagctgcctgca

SEQ ID NO: 3064472 - DNA, 15 bp, Homo sapiens
gtcggcatgccagga

SEQ ID NO: 3064473 - DNA, 20 bp, Homo sapiens
gtcgggagaggggacgcagg

SEQ ID NO: 3064474 - DNA, 22 bp, Homo sapiens
gtcgggagaggggacgcaggcc

SEQ ID NO: 3064475 - DNA, 19 bp, Homo sapiens
gtcgtgttttcaaggaaga

SEQ ID NO: 3064476 - DNA, 19 bp, Homo sapiens
gtcgttgagggaatgacac

SEQ ID NO: 3064477 - DNA, 22 bp, Homo sapiens
gtcgtttcattcattttgtgta

SEQ ID NO: 3064478 - DNA, 14 bp, Homo sapiens
gtctaaaacaataa

SEQ ID NO: 3064479 - DNA, 11 bp, Homo sapiens
gtctaaaactc

SEQ ID NO: 3064480 - DNA, 16 bp, Homo sapiens
gtctaaacaatgctga

SEQ ID NO: 3064481 - DNA, 20 bp, Homo sapiens
gtctaaagatggagtttcta

SEQ ID NO: 3064482 - DNA, 23 bp, Homo sapiens
gtctaaagatggagtttctaagg

SEQ ID NO: 3064483 - DNA, 16 bp, Homo sapiens
gtctaaagccttaact

SEQ ID NO: 3064484 - DNA, 23 bp, Homo sapiens
gtctaaagccttaactaagactc

SEQ ID NO: 3064485 - DNA, 14 bp, Homo sapiens
gtctaagattctag

SEQ ID NO: 3064486 - DNA, 15 bp, Homo sapiens
gtctaagattctaga

SEQ ID NO: 3064487 - DNA, 23 bp, Homo sapiens
gtctaagcagttttgtaaatgta

SEQ ID NO: 3064488 - DNA, 20 bp, Homo sapiens
gtctaattcatttactcacc

SEQ ID NO: 3064489 - DNA, 22 bp, Homo sapiens
gtctaattcatttactcaccat

SEQ ID NO: 3064490 - DNA, 18 bp, Homo sapiens
gtctacgtatgcatgcta

SEQ ID NO: 3064491 - DNA, 20 bp, Homo sapiens
gtctactttctcttgtttaa

SEQ ID NO: 3064492 - DNA, 20 bp, Homo sapiens
gtctagaatcctgctttaca

SEQ ID NO: 3064493 - DNA, 13 bp, Homo sapiens
gtctagagaggga

SEQ ID NO: 3064494 - DNA, 16 bp, Homo sapiens
gtctagagagggaggc

SEQ ID NO: 3064495 - DNA, 22 bp, Homo sapiens
gtctagattcaaaggttctagg

SEQ ID NO: 3064496 - DNA, 12 bp, Homo sapiens
gtctagattctc

SEQ ID NO: 3064497 - DNA, 13 bp, Homo sapiens
gtctaggagctgg

SEQ ID NO: 3064498 - DNA, 14 bp, Homo sapiens
gtctagggagagac

SEQ ID NO: 3064499 - DNA, 21 bp, Homo sapiens
gtctatcaaccccagacactg

SEQ ID NO: 3064500 - DNA, 15 bp, Homo sapiens
gtctatgttccgaat

SEQ ID NO: 3064501 - DNA, 23 bp, Homo sapiens
gtctcaactgctcttttatactg

SEQ ID NO: 3064502 - DNA, 23 bp, Homo sapiens
gtctcaatagctccaagctgtta

SEQ ID NO: 3064503 - DNA, 16 bp, Homo sapiens
gtctcacactcctcct

SEQ ID NO: 3064504 - DNA, 17 bp, Homo sapiens
gtctcacactcctcctg

SEQ ID NO: 3064505 - DNA, 15 bp, Homo sapiens
gtctcactgaaacat

SEQ ID NO: 3064506 - DNA, 14 bp, Homo sapiens
gtctcaggaggagg

SEQ ID NO: 3064507 - DNA, 14 bp, Homo sapiens
gtctcaggtccagc

SEQ ID NO: 3064508 - DNA, 15 bp, Homo sapiens
gtctcatccatcatc

SEQ ID NO: 3064509 - DNA, 16 bp, Homo sapiens
gtctcatccatcatca

SEQ ID NO: 3064510 - DNA, 11 bp, Homo sapiens
gtctcccagat

SEQ ID NO: 3064511 - DNA, 16 bp, Homo sapiens
gtctccctcctctgcc

SEQ ID NO: 3064512 - DNA, 16 bp, Homo sapiens
gtctccctctcctgcc

SEQ ID NO: 3064513 - DNA, 17 bp, Homo sapiens
gtctccctctcctgcct

SEQ ID NO: 3064514 - DNA, 22 bp, Homo sapiens
gtctccctctcctgcctactca

SEQ ID NO: 3064515 - DNA, 22 bp, Homo sapiens
gtcattgatgtaatttaaaact

SEQ ID NO: 3064516 - DNA, 11 bp, Homo sapiens
gtcattgctgt

SEQ ID NO: 3064517 - DNA, 22 bp, Homo sapiens
gtcatttcctttgttgtctaca

SEQ ID NO: 3064518 - DNA, 16 bp, Homo sapiens
gtcatttgctctgcct

SEQ ID NO: 3064519 - DNA, 20 bp, Homo sapiens
gtcattttacaagcattaga

SEQ ID NO: 3064520 - DNA, 17 bp, Homo sapiens
gtcattttggcatctgc

SEQ ID NO: 3064521 - DNA, 21 bp, Homo sapiens
gtcattttggcatctgcaaag

SEQ ID NO: 3064522 - DNA, 22 bp, Homo sapiens
gtcattttggcatctgcaaagg

SEQ ID NO: 3064523 - DNA, 15 bp, Homo sapiens
gtccaaaaaaaggaa

SEQ ID NO: 3064524 - DNA, 17 bp, Homo sapiens
gtccaaaaaaaggaaaa

SEQ ID NO: 3064525 - DNA, 21 bp, Homo sapiens
gtccaaaatttatattttaga

SEQ ID NO: 3064526 - DNA, 18 bp, Homo sapiens
gtccaaacaggtgctggc

SEQ ID NO: 3064527 - DNA, 14 bp, Homo sapiens
gtccaacccctccc

SEQ ID NO: 3064528 - DNA, 14 bp, Homo sapiens
gtccaacctaaccc

SEQ ID NO: 3064529 - DNA, 15 bp, Homo sapiens
gtccaactgcaactc

SEQ ID NO: 3064530 - DNA, 16 bp, Homo sapiens
gtccaagattccggat

SEQ ID NO: 3064531 - DNA, 15 bp, Homo sapiens
gtccaagttcacagt

SEQ ID NO: 3064532 - DNA, 12 bp, Homo sapiens
gtccaatcctat

SEQ ID NO: 3064533 - DNA, 18 bp, Homo sapiens
gtccacagctgaagagca

SEQ ID NO: 3064534 - DNA, 16 bp, Homo sapiens
gtccacatccccagag

SEQ ID NO: 3064535 - DNA, 20 bp, Homo sapiens
gtccacatccccagagccca

SEQ ID NO: 3064536 - DNA, 21 bp, Homo sapiens
gtccacatccccagagcccag

SEQ ID NO: 3064537 - DNA, 21 bp, Homo sapiens
gtccaccaggcctcactggct

SEQ ID NO: 3064538 - DNA, 16 bp, Homo sapiens
gtccacgactgtctcc

SEQ ID NO: 3064539 - DNA, 15 bp, Homo sapiens
gtccacttgccaggg

SEQ ID NO: 3064540 - DNA, 17 bp, Homo sapiens
gtccacttgtgggtcct

SEQ ID NO: 3064541 - DNA, 18 bp, Homo sapiens
gtccacttgtgggtcctg

SEQ ID NO: 3064542 - DNA, 16 bp, Homo sapiens
gtccagaaggagacag

SEQ ID NO: 3064543 - DNA, 17 bp, Homo sapiens
gtccagaaggagacagg

SEQ ID NO: 3064544 - DNA, 19 bp, Homo sapiens
gtccagaaggagacaggca

SEQ ID NO: 3064545 - DNA, 16 bp, Homo sapiens
gtccagagcttttcag

SEQ ID NO: 3064546 - DNA, 13 bp, Homo sapiens
gtccagctctact

SEQ ID NO: 3064547 - DNA, 22 bp, Homo sapiens
gtccagctgcccttccgcagtg

SEQ ID NO: 3064548 - DNA, 24 bp, Homo sapiens
gtccagctttactgtggctgtctg

SEQ ID NO: 3064549 - DNA, 12 bp, Homo sapiens
gtccagctttct

SEQ ID NO: 3064550 - DNA, 18 bp, Homo sapiens
gtccaggactgggtctga

SEQ ID NO: 3064551 - DNA, 21 bp, Homo sapiens
gtccaggactgggtctgacct

SEQ ID NO: 3064552 - DNA, 22 bp, Homo sapiens
gtccaggactgggtctgacctg

SEQ ID NO: 3064553 - DNA, 15 bp, Homo sapiens
gtccaggccctgtgg

SEQ ID NO: 3064554 - DNA, 21 bp, Homo sapiens
gtccagggagcattttcctcc

SEQ ID NO: 3064555 - DNA, 11 bp, Homo sapiens
gtccaggggat

SEQ ID NO: 3064556 - DNA, 17 bp, Homo sapiens
gtccaggtaggaaacaa

SEQ ID NO: 3064557 - DNA, 20 bp, Homo sapiens
gtccaggtgagtgtgagggc

SEQ ID NO: 3064558 - DNA, 20 bp, Homo sapiens
gtccagtgcattttgtttct

SEQ ID NO: 3064559 - DNA, 22 bp, Homo sapiens
gtccagtgcattttgtttctgt

SEQ ID NO: 3064560 - DNA, 16 bp, Homo sapiens
gtccatcagtgcatga

SEQ ID NO: 3064561 - DNA, 13 bp, Homo sapiens
gtccatcctcctc

SEQ ID NO: 3064562 - DNA, 14 bp, Homo sapiens
gtccatcctcctct

SEQ ID NO: 3064563 - DNA, 19 bp, Homo sapiens
gtccatcctcctctccatg

SEQ ID NO: 3064564 - DNA, 13 bp, Homo sapiens
gtccatctctctc

SEQ ID NO: 3064565 - DNA, 18 bp, Homo sapiens
gtccatctctctccctta

SEQ ID NO: 3064566 - DNA, 13 bp, Homo sapiens
gtccatctgcccg

SEQ ID NO: 3064567 - DNA, 15 bp, Homo sapiens
gtccatgctccaggg

SEQ ID NO: 3064568 - DNA, 16 bp, Homo sapiens
gtccatgggcagagcc

SEQ ID NO: 3064569 - DNA, 23 bp, Homo sapiens
gtccatgggcagagcccaaggga

SEQ ID NO: 3064570 - DNA, 18 bp, Homo sapiens
gtccatgggtctggcctg

SEQ ID NO: 3064571 - DNA, 16 bp, Homo sapiens
gtccattgtccaatcc

SEQ ID NO: 3064572 - DNA, 13 bp, Homo sapiens
gtccatttcctaa

SEQ ID NO: 3064573 - DNA, 16 bp, Homo sapiens
gtccattttgtgaagc

SEQ ID NO: 3064574 - DNA, 17 bp, Homo sapiens
gtccattttgtgaagcc

SEQ ID NO: 3064575 - DNA, 21 bp, Homo sapiens
gtccattttgtgaagccctgt

SEQ ID NO: 3064576 - DNA, 13 bp, Homo sapiens
gtcccaaatccgc

SEQ ID NO: 3064577 - DNA, 19 bp, Homo sapiens
gtcccaaatccttcccaag

SEQ ID NO: 3064578 - DNA, 21 bp, Homo sapiens
gtcccaacaggaggacaattc

SEQ ID NO: 3064579 - DNA, 17 bp, Homo sapiens
gtcccaagctcccaaga

SEQ ID NO: 3064580 - DNA, 14 bp, Homo sapiens
gtcccacccaggaa

SEQ ID NO: 3064581 - DNA, 17 bp, Homo sapiens
gtcccactatctgggtg

SEQ ID NO: 3064582 - DNA, 12 bp, Homo sapiens
gtcccactcaag

SEQ ID NO: 3064583 - DNA, 14 bp, Homo sapiens
gtcccagcgagcca

SEQ ID NO: 3064584 - DNA, 17 bp, Homo sapiens
gtcccagcggcctcagg

SEQ ID NO: 3064585 - DNA, 23 bp, Homo sapiens
gtcccagctacttgggagcctga

SEQ ID NO: 3064586 - DNA, 14 bp, Homo sapiens
gtccccacagactg

SEQ ID NO: 3064587 - DNA, 15 bp, Homo sapiens
gtccccacagactgc

SEQ ID NO: 3064588 - DNA, 22 bp, Homo sapiens
gtccccacagactgccccagcc

SEQ ID NO: 3064589 - DNA, 24 bp, Homo sapiens
gtccccacagactgccccagccaa

SEQ ID NO: 3064590 - DNA, 23 bp, Homo sapiens
gtccccacgaggggacccatggg

SEQ ID NO: 3064591 - DNA, 14 bp, Homo sapiens
gtccccagaagcag

SEQ ID NO: 3064592 - DNA, 14 bp, Homo sapiens
gtccccaggcctgg

SEQ ID NO: 3064593 - DNA, 18 bp, Homo sapiens
gtccccagtttgcagaaa

SEQ ID NO: 3064594 - DNA, 12 bp, Homo sapiens
gtccccccaccc

SEQ ID NO: 3064595 - DNA, 22 bp, Homo sapiens
gtccccccaccctcattctact

SEQ ID NO: 3064596 - DNA, 19 bp, Homo sapiens
gtccccccccaggccctcc

SEQ ID NO: 3064597 - DNA, 17 bp, Homo sapiens
gtcccccgactgcctgt

SEQ ID NO: 3064598 - DNA, 18 bp, Homo sapiens
gtcccccgactgcctgtc

SEQ ID NO: 3064599 - DNA, 20 bp, Homo sapiens
gtcccccgactgcctgtctc

SEQ ID NO: 3064600 - DNA, 12 bp, Homo sapiens
gtccccctgcag

SEQ ID NO: 3064601 - DNA, 15 bp, Homo sapiens
gtccccgccttccct

SEQ ID NO: 3064602 - DNA, 14 bp, Homo sapiens
gtccccgctgctgt

SEQ ID NO: 3064603 - DNA, 16 bp, Homo sapiens
gtcccctcacagactc

SEQ ID NO: 3064604 - DNA, 20 bp, Homo sapiens
gtcccctcacagactcttcc

SEQ ID NO: 3064605 - DNA, 22 bp, Homo sapiens
gtcccctcccccacccctgctg

SEQ ID NO: 3064606 - DNA, 13 bp, Homo sapiens
gtcccctgccacc

SEQ ID NO: 3064607 - DNA, 11 bp, Homo sapiens
gtcccctgctt

SEQ ID NO: 3064608 - DNA, 13 bp, Homo sapiens
gtcccctggagtg

SEQ ID NO: 3064609 - DNA, 19 bp, Homo sapiens
gtcccctgtggtgatgtgc

SEQ ID NO: 3064610 - DNA, 21 bp, Homo sapiens
gtcccctgtggtgatgtgcct

SEQ ID NO: 3064611 - DNA, 21 bp, Homo sapiens
gtcccggggccagcacttcca

SEQ ID NO: 3064612 - DNA, 17 bp, Homo sapiens
gtcccgtggatgctctt

SEQ ID NO: 3064613 - DNA, 15 bp, Homo sapiens
gtccctatgcatatc

SEQ ID NO: 3064614 - DNA, 20 bp, Homo sapiens
gtccctcacgtttcttcccc

SEQ ID NO: 3064615 - DNA, 21 bp, Homo sapiens
gtccctcacgtttcttcccca

SEQ ID NO: 3064616 - DNA, 17 bp, Homo sapiens
gtccctctcagtgcctt

SEQ ID NO: 3064617 - DNA, 19 bp, Homo sapiens
gtccctctcagtgccttct

SEQ ID NO: 3064618 - DNA, 21 bp, Homo sapiens
gtccctctcagtgccttctct

SEQ ID NO: 3064619 - DNA, 21 bp, Homo sapiens
gtccctctgccccatcctcca

SEQ ID NO: 3064620 - DNA, 20 bp, Homo sapiens
gtccctctgtccacttgtgg

SEQ ID NO: 3064621 - DNA, 18 bp, Homo sapiens
gtccctgaagtcttgcat

SEQ ID NO: 3064622 - DNA, 15 bp, Homo sapiens
gtccctgcactgtgc

SEQ ID NO: 3064623 - DNA, 16 bp, Homo sapiens
gtccctgcccttcttc

SEQ ID NO: 3064624 - DNA, 20 bp, Homo sapiens
gtccctgcctggaccagcct

SEQ ID NO: 3064625 - DNA, 22 bp, Homo sapiens
gtccctgcctggaccagcctct

SEQ ID NO: 3064626 - DNA, 23 bp, Homo sapiens
gtccctgctgctgccagggcttc

SEQ ID NO: 3064627 - DNA, 20 bp, Homo sapiens
gtccctgctttctggtataa

SEQ ID NO: 3064628 - DNA, 13 bp, Homo sapiens
gtccctggcaaga

SEQ ID NO: 3064629 - DNA, 14 bp, Homo sapiens
gtccctggcgctgt

SEQ ID NO: 3064630 - DNA, 23 bp, Homo sapiens
gtccctgggggaagccctggatt

SEQ ID NO: 3064631 - DNA, 17 bp, Homo sapiens
gtcccttccaagctgtg

SEQ ID NO: 3064632 - DNA, 16 bp, Homo sapiens
gtcccttgagacctca

SEQ ID NO: 3064633 - DNA, 18 bp, Homo sapiens
gtcccttgagacctcagc

SEQ ID NO: 3064634 - DNA, 20 bp, Homo sapiens
gtcccttgagacctcagcca

SEQ ID NO: 3064635 - DNA, 22 bp, Homo sapiens
gtcccttgagacctcagccatg

SEQ ID NO: 3064636 - DNA, 11 bp, Homo sapiens
gtcccttgctg

SEQ ID NO: 3064637 - DNA, 16 bp, Homo sapiens
gtcccttgctgtatgc

SEQ ID NO: 3064638 - DNA, 20 bp, Homo sapiens
gtcccttgcttgcctgcagg

SEQ ID NO: 3064639 - DNA, 19 bp, Homo sapiens
gtcccttttcattctcctc

SEQ ID NO: 3064640 - DNA, 22 bp, Homo sapiens
gtccctttttgcaggggactgg

SEQ ID NO: 3064641 - DNA, 12 bp, Homo sapiens
gtccgagaggct

SEQ ID NO: 3064642 - DNA, 15 bp, Homo sapiens
gtccgcataagaaaa

SEQ ID NO: 3064643 - DNA, 15 bp, Homo sapiens
gtccgcatccctgct

SEQ ID NO: 3064644 - DNA, 12 bp, Homo sapiens
gtccgcggcctg

SEQ ID NO: 3064645 - DNA, 15 bp, Homo sapiens
gtccgcggcctgcac

SEQ ID NO: 3064646 - DNA, 13 bp, Homo sapiens
gtccggaagggtg

SEQ ID NO: 3064647 - DNA, 16 bp, Homo sapiens
gtccggaatgccaccc

SEQ ID NO: 3064648 - DNA, 13 bp, Homo sapiens
gtccgtctgtctg

SEQ ID NO: 3064649 - DNA, 20 bp, Homo sapiens
gtccgtgctgacagctgctc

SEQ ID NO: 3064650 - DNA, 21 bp, Homo sapiens
gtccgtgctgacagctgctcc

SEQ ID NO: 3064651 - DNA, 20 bp, Homo sapiens
gtccgtgggttgctaactga

SEQ ID NO: 3064652 - DNA, 22 bp, Homo sapiens
gtcaaaaggaacaaaaattaca

SEQ ID NO: 3064653 - DNA, 20 bp, Homo sapiens
gtcaaacaaactctctgaac

SEQ ID NO: 3064654 - DNA, 16 bp, Homo sapiens
gtcaaataaatgtttc

SEQ ID NO: 3064655 - DNA, 20 bp, Homo sapiens
gtcaaataaatgtttccccc

SEQ ID NO: 3064656 - DNA, 16 bp, Homo sapiens
gtcaaatctgggctca

SEQ ID NO: 3064657 - DNA, 15 bp, Homo sapiens
gtcaacagaatgaaa

SEQ ID NO: 3064658 - DNA, 19 bp, Homo sapiens
gtcaacagagaaggcagga

SEQ ID NO: 3064659 - DNA, 23 bp, Homo sapiens
gtcaacagagaaggcaggaatgt

SEQ ID NO: 3064660 - DNA, 21 bp, Homo sapiens
gtcaacagttttcctatgctt

SEQ ID NO: 3064661 - DNA, 22 bp, Homo sapiens
gtcaacagttttcctatgcttt

SEQ ID NO: 3064662 - DNA, 12 bp, Homo sapiens
gtcaaccagaca

SEQ ID NO: 3064663 - DNA, 13 bp, Homo sapiens
gtcaaccagacag

SEQ ID NO: 3064664 - DNA, 15 bp, Homo sapiens
gtcaacccttctgga

SEQ ID NO: 3064665 - DNA, 14 bp, Homo sapiens
gtcaacctcctgga

SEQ ID NO: 3064666 - DNA, 18 bp, Homo sapiens
gtcaactggctggccagt

SEQ ID NO: 3064667 - DNA, 16 bp, Homo sapiens
gtcaactttcatttga

SEQ ID NO: 3064668 - DNA, 20 bp, Homo sapiens
gtcaagaaattctgctgtta

SEQ ID NO: 3064669 - DNA, 19 bp, Homo sapiens
gtcaagctcctcctccctg

SEQ ID NO: 3064670 - DNA, 14 bp, Homo sapiens
gtcaaggtgctcaa

SEQ ID NO: 3064671 - DNA, 13 bp, Homo sapiens
gtcaagtcaacca

SEQ ID NO: 3064672 - DNA, 19 bp, Homo sapiens
gtcaataaaaataaatcta

SEQ ID NO: 3064673 - DNA, 22 bp, Homo sapiens
gtcaataaacttagaggaaaat

SEQ ID NO: 3064674 - DNA, 14 bp, Homo sapiens
gtcaataaacttgt

SEQ ID NO: 3064675 - DNA, 16 bp, Homo sapiens
gtcaatacaaatgtta

SEQ ID NO: 3064676 - DNA, 15 bp, Homo sapiens
gtcaatccatcagca

SEQ ID NO: 3064677 - DNA, 16 bp, Homo sapiens
gtcacaaactgtggtt

SEQ ID NO: 3064678 - DNA, 21 bp, Homo sapiens
gtcacaacaaaaggaagactg

SEQ ID NO: 3064679 - DNA, 18 bp, Homo sapiens
gtcacaatgttctttata

SEQ ID NO: 3064680 - DNA, 20 bp, Homo sapiens
gtcacacagtgttggaggtt

SEQ ID NO: 3064681 - DNA, 12 bp, Homo sapiens
gtcacagagtga

SEQ ID NO: 3064682 - DNA, 15 bp, Homo sapiens
gtcacaggaaggaaa

SEQ ID NO: 3064683 - DNA, 14 bp, Homo sapiens
gtcacataaaactt

SEQ ID NO: 3064684 - DNA, 14 bp, Homo sapiens
gtcacatggagctc

SEQ ID NO: 3064685 - DNA, 13 bp, Homo sapiens
gtcaccaaggaaa

SEQ ID NO: 3064686 - DNA, 15 bp, Homo sapiens
gtcaccaccttccca

SEQ ID NO: 3064687 - DNA, 17 bp, Homo sapiens
gtcaccaccttcccagc

SEQ ID NO: 3064688 - DNA, 20 bp, Homo sapiens
gtcaccaccttcccagctct

SEQ ID NO: 3064689 - DNA, 22 bp, Homo sapiens
gtcaccaccttcccagctctcc

SEQ ID NO: 3064690 - DNA, 16 bp, Homo sapiens
gtcaccacgactggcc

SEQ ID NO: 3064691 - DNA, 18 bp, Homo sapiens
gtcaccaggaatgttaaa

SEQ ID NO: 3064692 - DNA, 23 bp, Homo sapiens
gtcaccaggaatgttaaagtcag

SEQ ID NO: 3064693 - DNA, 12 bp, Homo sapiens
gtcaccagtggc

SEQ ID NO: 3064694 - DNA, 23 bp, Homo sapiens
gtcacccaaagcctgtcccagga

SEQ ID NO: 3064695 - DNA, 12 bp, Homo sapiens
gtcacccagact

SEQ ID NO: 3064696 - DNA, 13 bp, Homo sapiens
gtcaccccagagc

SEQ ID NO: 3064697 - DNA, 18 bp, Homo sapiens
gtcaccccagagccacac

SEQ ID NO: 3064698 - DNA, 20 bp, Homo sapiens
gtcacccctccaggaatgat

SEQ ID NO: 3064699 - DNA, 14 bp, Homo sapiens
gtcaccctggccac

SEQ ID NO: 3064700 - DNA, 15 bp, Homo sapiens
gtcaccctggccacc

SEQ ID NO: 3064701 - DNA, 20 bp, Homo sapiens
gtcacccttggtagagttta

SEQ ID NO: 3064702 - DNA, 19 bp, Homo sapiens
gtcaccggatcctgggtgg

SEQ ID NO: 3064703 - DNA, 23 bp, Homo sapiens
gtcaccggatcctgggtggtctg

SEQ ID NO: 3064704 - DNA, 20 bp, Homo sapiens
gtcacctaaccctctgtcac

SEQ ID NO: 3064705 - DNA, 14 bp, Homo sapiens
gtcactaatacaca

SEQ ID NO: 3064706 - DNA, 15 bp, Homo sapiens
gtcactcaggctgga

SEQ ID NO: 3064707 - DNA, 21 bp, Homo sapiens
gtcactccaaggatcagaagt

SEQ ID NO: 3064708 - DNA, 12 bp, Homo sapiens
gtcactctgccc

SEQ ID NO: 3064709 - DNA, 16 bp, Homo sapiens
gtcactctgccctctg

SEQ ID NO: 3064710 - DNA, 22 bp, Homo sapiens
gtcactctgccctctgctgctg

SEQ ID NO: 3064711 - DNA, 23 bp, Homo sapiens
gtcactgaggcctgagacccagg

SEQ ID NO: 3064712 - DNA, 21 bp, Homo sapiens
gtcactgccgacatccctccc

SEQ ID NO: 3064713 - DNA, 18 bp, Homo sapiens
gtcactgctgctactgcc

SEQ ID NO: 3064714 - DNA, 17 bp, Homo sapiens
gtcactgcttttggcct

SEQ ID NO: 3064715 - DNA, 18 bp, Homo sapiens
gtcacttaaaatgtgcag

SEQ ID NO: 3064716 - DNA, 23 bp, Homo sapiens
gtcacttggtggcggggtggggt

SEQ ID NO: 3064717 - DNA, 13 bp, Homo sapiens
gtcagaaagtgta

SEQ ID NO: 3064718 - DNA, 18 bp, Homo sapiens
gtcagaaagtgtaaatgt

SEQ ID NO: 3064719 - DNA, 16 bp, Homo sapiens
gtcagaacagcagact

SEQ ID NO: 3064720 - DNA, 19 bp, Homo sapiens
gtcagaacagcagactcag

SEQ ID NO: 3064721 - DNA, 17 bp, Homo sapiens
gtcagaatttttaactg

SEQ ID NO: 3064722 - DNA, 18 bp, Homo sapiens
gtcagacccatctctccc

SEQ ID NO: 3064723 - DNA, 15 bp, Homo sapiens
gtcagactggaggtc

SEQ ID NO: 3064724 - DNA, 20 bp, Homo sapiens
gtcagactggaggtcgaagc

SEQ ID NO: 3064725 - DNA, 14 bp, Homo sapiens
gtcagagaaaacac

SEQ ID NO: 3064726 - DNA, 17 bp, Homo sapiens
gtcagagcccagcccag

SEQ ID NO: 3064727 - DNA, 16 bp, Homo sapiens
gtcagaggagagatag

SEQ ID NO: 3064728 - DNA, 23 bp, Homo sapiens
gtcagaggagagatagcctgtgg

SEQ ID NO: 3064729 - DNA, 20 bp, Homo sapiens
gtcagcaccttggcccagga

SEQ ID NO: 3064730 - DNA, 20 bp, Homo sapiens
gtcagccatgtctgtgctgt

SEQ ID NO: 3064731 - DNA, 13 bp, Homo sapiens
gtcagccctaggg

SEQ ID NO: 3064732 - DNA, 22 bp, Homo sapiens
gtcagccctagggtggagagcc

SEQ ID NO: 3064733 - DNA, 14 bp, Homo sapiens
gtcagcgagaagga

SEQ ID NO: 3064734 - DNA, 23 bp, Homo sapiens
gtcagctagatcatttgttctgg

SEQ ID NO: 3064735 - DNA, 16 bp, Homo sapiens
gtcagctgaccccctc

SEQ ID NO: 3064736 - DNA, 20 bp, Homo sapiens
gtcagctgaccccctccccc

SEQ ID NO: 3064737 - DNA, 18 bp, Homo sapiens
gtcaggagtccaagacca

SEQ ID NO: 3064738 - DNA, 19 bp, Homo sapiens
gtcaggagtccaagaccag

SEQ ID NO: 3064739 - DNA, 15 bp, Homo sapiens
gtcaggcaattgatt

SEQ ID NO: 3064740 - DNA, 12 bp, Homo sapiens
gtcaggccaggt

SEQ ID NO: 3064741 - DNA, 13 bp, Homo sapiens
gtcaggccaggtg

SEQ ID NO: 3064742 - DNA, 14 bp, Homo sapiens
gtcaggccaggtgg

SEQ ID NO: 3064743 - DNA, 19 bp, Homo sapiens
gtcaggcccgtcggagctg

SEQ ID NO: 3064744 - DNA, 21 bp, Homo sapiens
gtcaggcccgtcggagctgcc

SEQ ID NO: 3064745 - DNA, 20 bp, Homo sapiens
gtcaggccctctgcctgcac

SEQ ID NO: 3064746 - DNA, 14 bp, Homo sapiens
gtcagggacccctg

SEQ ID NO: 3064747 - DNA, 12 bp, Homo sapiens
gtcagggagggc

SEQ ID NO: 3064748 - DNA, 17 bp, Homo sapiens
gtcaggggtgacacaga

SEQ ID NO: 3064749 - DNA, 18 bp, Homo sapiens
gtcaggggtgacacagac

SEQ ID NO: 3064750 - DNA, 20 bp, Homo sapiens
gtcaggggtgacacagactc

SEQ ID NO: 3064751 - DNA, 19 bp, Homo sapiens
gtcaggtcccagcgagcca

SEQ ID NO: 3064752 - DNA, 15 bp, Homo sapiens
gtcaggtggaccctg

SEQ ID NO: 3064753 - DNA, 14 bp, Homo sapiens
gtcagtatgacatt

SEQ ID NO: 3064754 - DNA, 23 bp, Homo sapiens
gtcagtgctgtgctgtgctatgg

SEQ ID NO: 3064755 - DNA, 22 bp, Homo sapiens
gtcagtggtccacatcccggga

SEQ ID NO: 3064756 - DNA, 21 bp, Homo sapiens
gtcataacggttaagaaagca

SEQ ID NO: 3064757 - DNA, 22 bp, Homo sapiens
gtcataagctccagttttcgta

SEQ ID NO: 3064758 - DNA, 19 bp, Homo sapiens
gtcataggcttctgcacgt

SEQ ID NO: 3064759 - DNA, 18 bp, Homo sapiens
gtcatcaacattcttgtg

SEQ ID NO: 3064760 - DNA, 15 bp, Homo sapiens
gtcatcagtaagtat

SEQ ID NO: 3064761 - DNA, 19 bp, Homo sapiens
gtcatcatctcttgataaa

SEQ ID NO: 3064762 - DNA, 17 bp, Homo sapiens
gtcatcatctttttgtg

SEQ ID NO: 3064763 - DNA, 17 bp, Homo sapiens
gtcatcatgaactggct

SEQ ID NO: 3064764 - DNA, 18 bp, Homo sapiens
gtcatcatgaactggctt

SEQ ID NO: 3064765 - DNA, 23 bp, Homo sapiens
gtcatctgaatttgccctgggaa

SEQ ID NO: 3064766 - DNA, 18 bp, Homo sapiens
gtcatcttgaccaagcag

SEQ ID NO: 3064767 - DNA, 19 bp, Homo sapiens
gtcatgacaagatgggaca

SEQ ID NO: 3064768 - DNA, 14 bp, Homo sapiens
gtcatgatctccct

SEQ ID NO: 3064769 - DNA, 15 bp, Homo sapiens
gtcatgatctccctg

SEQ ID NO: 3064770 - DNA, 16 bp, Homo sapiens
gtcatgccctcctctc

SEQ ID NO: 3064771 - DNA, 18 bp, Homo sapiens
gtcatgccctcctctccc

SEQ ID NO: 3064772 - DNA, 15 bp, Homo sapiens
gtcatggacattcat

SEQ ID NO: 3064773 - DNA, 13 bp, Homo sapiens
gtcatggccacac

SEQ ID NO: 3064774 - DNA, 17 bp, Homo sapiens
gtcatggccacactgtg

SEQ ID NO: 3064775 - DNA, 19 bp, Homo sapiens
gtcatgggaacgcagcctc

SEQ ID NO: 3064776 - DNA, 21 bp, Homo sapiens
gtcatgggaacgcagcctcca

SEQ ID NO: 3064777 - DNA, 23 bp, Homo sapiens
gtcatgggaacgcagcctccagt

SEQ ID NO: 3064778 - DNA, 22 bp, Homo sapiens
gtcatgggccccccatgcatac

SEQ ID NO: 3064779 - DNA, 15 bp, Homo sapiens
gtcatgtgcctctgt

SEQ ID NO: 3064780 - DNA, 15 bp, Homo sapiens
gtcatgtgtgtattt

SEQ ID NO: 3064781 - DNA, 14 bp, Homo sapiens
gtcatgtttattct

SEQ ID NO: 3064782 - DNA, 13 bp, Homo sapiens
gtcattaaactgg

SEQ ID NO: 3064783 - DNA, 17 bp, Homo sapiens
gtcattatcaaaagtga

SEQ ID NO: 3064784 - DNA, 21 bp, Homo sapiens
gtcattatgagaggcaatgat

SEQ ID NO: 3064785 - DNA, 16 bp, Homo sapiens
gtcattatttaaagca

SEQ ID NO: 3064786 - DNA, 19 bp, Homo sapiens
gtcattatttgataacatt

SEQ ID NO: 3064787 - DNA, 14 bp, Homo sapiens
gtcattcagaaaaa

SEQ ID NO: 3064788 - DNA, 16 bp, Homo sapiens
gtagctgggattttaa

SEQ ID NO: 3064789 - DNA, 17 bp, Homo sapiens
gtagctgggattttaaa

SEQ ID NO: 3064790 - DNA, 13 bp, Homo sapiens
gtagctttcctgg

SEQ ID NO: 3064791 - DNA, 21 bp, Homo sapiens
gtagctttggaaaggtgccct

SEQ ID NO: 3064792 - DNA, 21 bp, Homo sapiens
gtaggaacggtaaatttctgt

SEQ ID NO: 3064793 - DNA, 15 bp, Homo sapiens
gtaggaatctgcctt

SEQ ID NO: 3064794 - DNA, 16 bp, Homo sapiens
gtaggaatctgccttc

SEQ ID NO: 3064795 - DNA, 19 bp, Homo sapiens
gtaggactttcctaaatgt

SEQ ID NO: 3064796 - DNA, 22 bp, Homo sapiens
gtaggactttggtggtttaaaa

SEQ ID NO: 3064797 - DNA, 14 bp, Homo sapiens
gtaggacttttaaa

SEQ ID NO: 3064798 - DNA, 14 bp, Homo sapiens
gtaggagctgcctt

SEQ ID NO: 3064799 - DNA, 15 bp, Homo sapiens
gtaggatgaaaagat

SEQ ID NO: 3064800 - DNA, 19 bp, Homo sapiens
gtaggccccacaaggcctg

SEQ ID NO: 3064801 - DNA, 21 bp, Homo sapiens
gtaggccccacaaggcctggt

SEQ ID NO: 3064802 - DNA, 16 bp, Homo sapiens
gtagggaggaccacag

SEQ ID NO: 3064803 - DNA, 17 bp, Homo sapiens
gtagggtagaaggaaag

SEQ ID NO: 3064804 - DNA, 20 bp, Homo sapiens
gtaggtaaaagtagaagcat

SEQ ID NO: 3064805 - DNA, 18 bp, Homo sapiens
gtaggttattttatattt

SEQ ID NO: 3064806 - DNA, 20 bp, Homo sapiens
gtaggttattttatatttga

SEQ ID NO: 3064807 - DNA, 14 bp, Homo sapiens
gtagtatcaaatat

SEQ ID NO: 3064808 - DNA, 15 bp, Homo sapiens
gtagtattcttccct

SEQ ID NO: 3064809 - DNA, 16 bp, Homo sapiens
gtagtcacctctgggc

SEQ ID NO: 3064810 - DNA, 20 bp, Homo sapiens
gtagtcccagctactcggga

SEQ ID NO: 3064811 - DNA, 13 bp, Homo sapiens
gtagtctcagcta

SEQ ID NO: 3064812 - DNA, 12 bp, Homo sapiens
gtagtcttgatg

SEQ ID NO: 3064813 - DNA, 22 bp, Homo sapiens
gtagtcttgtcttagctctgga

SEQ ID NO: 3064814 - DNA, 23 bp, Homo sapiens
gtagtgtcagtactaaggtgact

SEQ ID NO: 3064815 - DNA, 23 bp, Homo sapiens
gtagtgtccattttgtgaagccc

SEQ ID NO: 3064816 - DNA, 21 bp, Homo sapiens
gtagttacattaatgcccagc

SEQ ID NO: 3064817 - DNA, 20 bp, Homo sapiens
gtagttctcttggtgttaaa

SEQ ID NO: 3064818 - DNA, 19 bp, Homo sapiens
gtagtttatggcagaaggg

SEQ ID NO: 3064819 - DNA, 13 bp, Homo sapiens
gtagttttgttta

SEQ ID NO: 3064820 - DNA, 22 bp, Homo sapiens
gtataagatcctagatcctaag

SEQ ID NO: 3064821 - DNA, 21 bp, Homo sapiens
gtataagtagatctgctttct

SEQ ID NO: 3064822 - DNA, 16 bp, Homo sapiens
gtataatatttcttaa

SEQ ID NO: 3064823 - DNA, 16 bp, Homo sapiens
gtataatgacttttaa

SEQ ID NO: 3064824 - DNA, 20 bp, Homo sapiens
gtataatgacttttaaaatt

SEQ ID NO: 3064825 - DNA, 16 bp, Homo sapiens
gtataatttagtccct

SEQ ID NO: 3064826 - DNA, 22 bp, Homo sapiens
gtataccgtgccactttccacc

SEQ ID NO: 3064827 - DNA, 18 bp, Homo sapiens
gtatagcatgcatctgtt

SEQ ID NO: 3064828 - DNA, 20 bp, Homo sapiens
gtatagcatgcatctgttta

SEQ ID NO: 3064829 - DNA, 21 bp, Homo sapiens
gtatagcctatggcagaaaaa

SEQ ID NO: 3064830 - DNA, 19 bp, Homo sapiens
gtatagttgatgtaacatt

SEQ ID NO: 3064831 - DNA, 17 bp, Homo sapiens
gtatagtttttagtctg

SEQ ID NO: 3064832 - DNA, 16 bp, Homo sapiens
gtatatacgcatctat

SEQ ID NO: 3064833 - DNA, 14 bp, Homo sapiens
gtatatacttttaa

SEQ ID NO: 3064834 - DNA, 18 bp, Homo sapiens
gtatatacttttaaatta

SEQ ID NO: 3064835 - DNA, 19 bp, Homo sapiens
gtatatataagaaagacat

SEQ ID NO: 3064836 - DNA, 18 bp, Homo sapiens
gtatatatacatatatat

SEQ ID NO: 3064837 - DNA, 19 bp, Homo sapiens
gtatatgactgcatttgtg

SEQ ID NO: 3064838 - DNA, 16 bp, Homo sapiens
gtatatgattctctgt

SEQ ID NO: 3064839 - DNA, 17 bp, Homo sapiens
gtatatgattctctgtg

SEQ ID NO: 3064840 - DNA, 23 bp, Homo sapiens
gtatatgggcttttacctgtgca

SEQ ID NO: 3064841 - DNA, 19 bp, Homo sapiens
gtatatggtatatatacat

SEQ ID NO: 3064842 - DNA, 14 bp, Homo sapiens
gtatatgtcattta

SEQ ID NO: 3064843 - DNA, 11 bp, Homo sapiens
gtatattattt

SEQ ID NO: 3064844 - DNA, 14 bp, Homo sapiens
gtatattgtattta

SEQ ID NO: 3064845 - DNA, 20 bp, Homo sapiens
gtatatttatgaccagagca

SEQ ID NO: 3064846 - DNA, 19 bp, Homo sapiens
gtatcaaatattagatgtg

SEQ ID NO: 3064847 - DNA, 21 bp, Homo sapiens
gtatcactgccttcgtttata

SEQ ID NO: 3064848 - DNA, 20 bp, Homo sapiens
gtatcagaattgaaacactt

SEQ ID NO: 3064849 - DNA, 12 bp, Homo sapiens
gtatcagcacta

SEQ ID NO: 3064850 - DNA, 18 bp, Homo sapiens
gtatcaggacccagagga

SEQ ID NO: 3064851 - DNA, 21 bp, Homo sapiens
gtatcaggacccagaggaagg

SEQ ID NO: 3064852 - DNA, 13 bp, Homo sapiens
gtatccagaggaa

SEQ ID NO: 3064853 - DNA, 17 bp, Homo sapiens
gtatcctccctggcaga

SEQ ID NO: 3064854 - DNA, 19 bp, Homo sapiens
gtatcctccctggcagaca

SEQ ID NO: 3064855 - DNA, 15 bp, Homo sapiens
gtatcgatgttatgt

SEQ ID NO: 3064856 - DNA, 16 bp, Homo sapiens
gtatctaaaagtgtca

SEQ ID NO: 3064857 - DNA, 22 bp, Homo sapiens
gtatctaatcctttaatgatct

SEQ ID NO: 3064858 - DNA, 20 bp, Homo sapiens
gtatctcttggtatgcatct

SEQ ID NO: 3064859 - DNA, 12 bp, Homo sapiens
gtatctgaagac

SEQ ID NO: 3064860 - DNA, 15 bp, Homo sapiens
gtatctgcatgtaaa

SEQ ID NO: 3064861 - DNA, 20 bp, Homo sapiens
gtatctgcatgtaaaatctt

SEQ ID NO: 3064862 - DNA, 17 bp, Homo sapiens
gtatctgtctactttct

SEQ ID NO: 3064863 - DNA, 17 bp, Homo sapiens
gtatcttctatttttat

SEQ ID NO: 3064864 - DNA, 23 bp, Homo sapiens
gtatcttgtttttccactactgc

SEQ ID NO: 3064865 - DNA, 12 bp, Homo sapiens
gtatgaaacaaa

SEQ ID NO: 3064866 - DNA, 13 bp, Homo sapiens
gtatgaagtactt

SEQ ID NO: 3064867 - DNA, 18 bp, Homo sapiens
gtatgaagtacttttaac

SEQ ID NO: 3064868 - DNA, 21 bp, Homo sapiens
gtatgagtgtgagtgtgtgtg

SEQ ID NO: 3064869 - DNA, 18 bp, Homo sapiens
gtatgatttgttttgaat

SEQ ID NO: 3064870 - DNA, 22 bp, Homo sapiens
gtatgcaagtgggagatgaaaa

SEQ ID NO: 3064871 - DNA, 12 bp, Homo sapiens
gtatgcatgtga

SEQ ID NO: 3064872 - DNA, 14 bp, Homo sapiens
gtatgcttcataca

SEQ ID NO: 3064873 - DNA, 14 bp, Homo sapiens
gtatgggcaaaaaa

SEQ ID NO: 3064874 - DNA, 18 bp, Homo sapiens
gtatggtgctaatatttt

SEQ ID NO: 3064875 - DNA, 16 bp, Homo sapiens
gtatgtaacaattgtt

SEQ ID NO: 3064876 - DNA, 13 bp, Homo sapiens
gtatgtattagtg

SEQ ID NO: 3064877 - DNA, 15 bp, Homo sapiens
gtatgtgccaatttt

SEQ ID NO: 3064878 - DNA, 13 bp, Homo sapiens
gtatgtgccaggc

SEQ ID NO: 3064879 - DNA, 14 bp, Homo sapiens
gtatgtgccaggct

SEQ ID NO: 3064880 - DNA, 20 bp, Homo sapiens
gtatgtgcgtgtgcgtgttc

SEQ ID NO: 3064881 - DNA, 16 bp, Homo sapiens
gtatgtgctgtaattt

SEQ ID NO: 3064882 - DNA, 13 bp, Homo sapiens
gtatgtgtgtaga

SEQ ID NO: 3064883 - DNA, 16 bp, Homo sapiens
gtatgtgtttgtgtgt

SEQ ID NO: 3064884 - DNA, 11 bp, Homo sapiens
gtatgttgtcc

SEQ ID NO: 3064885 - DNA, 21 bp, Homo sapiens
gtatgttgtccaattgttgac

SEQ ID NO: 3064886 - DNA, 22 bp, Homo sapiens
gtatgttttaattgcatttaaa

SEQ ID NO: 3064887 - DNA, 23 bp, Homo sapiens
gtattaaaaaacaattaactgcc

SEQ ID NO: 3064888 - DNA, 17 bp, Homo sapiens
gtattaaactctccttt

SEQ ID NO: 3064889 - DNA, 15 bp, Homo sapiens
gtattaagggattta

SEQ ID NO: 3064890 - DNA, 18 bp, Homo sapiens
gtattaagtcaagaatat

SEQ ID NO: 3064891 - DNA, 18 bp, Homo sapiens
gtattaataaatagagca

SEQ ID NO: 3064892 - DNA, 12 bp, Homo sapiens
gtattacatttt

SEQ ID NO: 3064893 - DNA, 14 bp, Homo sapiens
gtattaccattact

SEQ ID NO: 3064894 - DNA, 20 bp, Homo sapiens
gtattactgctgctgtgctt

SEQ ID NO: 3064895 - DNA, 13 bp, Homo sapiens
gtattcacatcat

SEQ ID NO: 3064896 - DNA, 15 bp, Homo sapiens
gtattcaggcactga

SEQ ID NO: 3064897 - DNA, 11 bp, Homo sapiens
gtattctctga

SEQ ID NO: 3064898 - DNA, 19 bp, Homo sapiens
gtattctctgagctgtgca

SEQ ID NO: 3064899 - DNA, 16 bp, Homo sapiens
gtattctttgatgtta

SEQ ID NO: 3064900 - DNA, 12 bp, Homo sapiens
gtattgaatcat

SEQ ID NO: 3064901 - DNA, 22 bp, Homo sapiens
gtattgccatcgggtgccaaat

SEQ ID NO: 3064902 - DNA, 14 bp, Homo sapiens
gtattgcttgccac

SEQ ID NO: 3064903 - DNA, 15 bp, Homo sapiens
gtattgtttacatta

SEQ ID NO: 3064904 - DNA, 9 bp, Homo sapiens
gtatttaac

SEQ ID NO: 3064905 - DNA, 21 bp, Homo sapiens
gtatttaaggaatcaaatctt

SEQ ID NO: 3064906 - DNA, 13 bp, Homo sapiens
gtatttacagaca

SEQ ID NO: 3064907 - DNA, 19 bp, Homo sapiens
gtatttacgctttgattca

SEQ ID NO: 3064908 - DNA, 13 bp, Homo sapiens
gtatttatttaaa

SEQ ID NO: 3064909 - DNA, 18 bp, Homo sapiens
gtatttatttaaaagatt

SEQ ID NO: 3064910 - DNA, 14 bp, Homo sapiens
gtatttatttatgt

SEQ ID NO: 3064911 - DNA, 13 bp, Homo sapiens
gtatttctctgtg

SEQ ID NO: 3064912 - DNA, 16 bp, Homo sapiens
gtatttctcttgtcct

SEQ ID NO: 3064913 - DNA, 15 bp, Homo sapiens
gtatttctgattttg

SEQ ID NO: 3064914 - DNA, 22 bp, Homo sapiens
gtatttgagagagagaaccttt

SEQ ID NO: 3064915 - DNA, 18 bp, Homo sapiens
gtatttgattcaaaatat

SEQ ID NO: 3064916 - DNA, 15 bp, Homo sapiens
gtatttggaaaaaga

SEQ ID NO: 3064917 - DNA, 22 bp, Homo sapiens
gtatttgggaaacttgtcactt

SEQ ID NO: 3064918 - DNA, 18 bp, Homo sapiens
gtatttgtgactaattgt

SEQ ID NO: 3064919 - DNA, 17 bp, Homo sapiens
gtatttgtttgtagctt

SEQ ID NO: 3064920 - DNA, 20 bp, Homo sapiens
gtattttaagtgatgtcatt

SEQ ID NO: 3064921 - DNA, 15 bp, Homo sapiens
gtattttctgtcact

SEQ ID NO: 3064922 - DNA, 14 bp, Homo sapiens
gtatttttatataa

SEQ ID NO: 3064923 - DNA, 23 bp, Homo sapiens
gtatttttgattaacaatgtatt

SEQ ID NO: 3064924 - DNA, 20 bp, Homo sapiens
gtattttttcttgcattgac

SEQ ID NO: 3064925 - DNA, 23 bp, Homo sapiens
gtaatttctgcacaggtctctgt

SEQ ID NO: 3064926 - DNA, 13 bp, Homo sapiens
gtaatttctttgc

SEQ ID NO: 3064927 - DNA, 13 bp, Homo sapiens
gtaattttctgat

SEQ ID NO: 3064928 - DNA, 18 bp, Homo sapiens
gtacaaaaataaatttat

SEQ ID NO: 3064929 - DNA, 14 bp, Homo sapiens
gtacaacggaggcc

SEQ ID NO: 3064930 - DNA, 15 bp, Homo sapiens
gtacaacggaggcct

SEQ ID NO: 3064931 - DNA, 22 bp, Homo sapiens
gtacaagctcttgtttctgttt

SEQ ID NO: 3064932 - DNA, 17 bp, Homo sapiens
gtacaatatgaaaagga

SEQ ID NO: 3064933 - DNA, 22 bp, Homo sapiens
gtacaattcattgttttgcaaa

SEQ ID NO: 3064934 - DNA, 21 bp, Homo sapiens
gtacacaactagttttgttta

SEQ ID NO: 3064935 - DNA, 16 bp, Homo sapiens
gtacacagcaccagaa

SEQ ID NO: 3064936 - DNA, 11 bp, Homo sapiens
gtacactgtgt

SEQ ID NO: 3064937 - DNA, 13 bp, Homo sapiens
gtacactgtgtct

SEQ ID NO: 3064938 - DNA, 23 bp, Homo sapiens
gtacagacagagaatatgtctgc

SEQ ID NO: 3064939 - DNA, 19 bp, Homo sapiens
gtacagacgtctcaagact

SEQ ID NO: 3064940 - DNA, 12 bp, Homo sapiens
gtacagcccaga

SEQ ID NO: 3064941 - DNA, 16 bp, Homo sapiens
gtacagcccagaggcc

SEQ ID NO: 3064942 - DNA, 23 bp, Homo sapiens
gtacagcccagaggccaacactg

SEQ ID NO: 3064943 - DNA, 24 bp, Homo sapiens
gtacaggagtcagccatgtctgtg

SEQ ID NO: 3064944 - DNA, 20 bp, Homo sapiens
gtacagtatattcttgtaaa

SEQ ID NO: 3064945 - DNA, 13 bp, Homo sapiens
gtacagtattttt

SEQ ID NO: 3064946 - DNA, 18 bp, Homo sapiens
gtacagtatttttcagat

SEQ ID NO: 3064947 - DNA, 22 bp, Homo sapiens
gtacagtatttttcagatataa

SEQ ID NO: 3064948 - DNA, 17 bp, Homo sapiens
gtacagtctcaattttg

SEQ ID NO: 3064949 - DNA, 14 bp, Homo sapiens
gtacagtctgtctt

SEQ ID NO: 3064950 - DNA, 20 bp, Homo sapiens
gtacagtggtgccatcattg

SEQ ID NO: 3064951 - DNA, 15 bp, Homo sapiens
gtacagttgcaggag

SEQ ID NO: 3064952 - DNA, 22 bp, Homo sapiens
gtacataatacacttgccctgc

SEQ ID NO: 3064953 - DNA, 14 bp, Homo sapiens
gtacataattgatt

SEQ ID NO: 3064954 - DNA, 22 bp, Homo sapiens
gtacataattgattaaaatctc

SEQ ID NO: 3064955 - DNA, 24 bp, Homo sapiens
gtacatagccctggtgctcctgcc

SEQ ID NO: 3064956 - DNA, 12 bp, Homo sapiens
gtacatagtaaa

SEQ ID NO: 3064957 - DNA, 20 bp, Homo sapiens
gtacatctattttggattgt

SEQ ID NO: 3064958 - DNA, 11 bp, Homo sapiens
gtacatgagaa

SEQ ID NO: 3064959 - DNA, 16 bp, Homo sapiens
gtacatggcagagttt

SEQ ID NO: 3064960 - DNA, 23 bp, Homo sapiens
gtacatgtacatagtaaagtatt

SEQ ID NO: 3064961 - DNA, 20 bp, Homo sapiens
gtacatgtgtagcctgtgca

SEQ ID NO: 3064962 - DNA, 15 bp, Homo sapiens
gtacattgtgccctt

SEQ ID NO: 3064963 - DNA, 14 bp, Homo sapiens
gtacatttctataa

SEQ ID NO: 3064964 - DNA, 16 bp, Homo sapiens
gtacatttttcaactt

SEQ ID NO: 3064965 - DNA, 20 bp, Homo sapiens
gtacatttttcaactttgaa

SEQ ID NO: 3064966 - DNA, 21 bp, Homo sapiens
gtacatttttcaactttgaat

SEQ ID NO: 3064967 - DNA, 19 bp, Homo sapiens
gtaccaagccaccgcagct

SEQ ID NO: 3064968 - DNA, 21 bp, Homo sapiens
gtaccaagccaccgcagctgc

SEQ ID NO: 3064969 - DNA, 22 bp, Homo sapiens
gtaccacaccctgcctgctgtg

SEQ ID NO: 3064970 - DNA, 23 bp, Homo sapiens
gtaccaggcacatggctggggga

SEQ ID NO: 3064971 - DNA, 22 bp, Homo sapiens
gtaccccctcaaaccctgccct

SEQ ID NO: 3064972 - DNA, 17 bp, Homo sapiens
gtacccttgttttgaaa

SEQ ID NO: 3064973 - DNA, 20 bp, Homo sapiens
gtaccctttaagatatccat

SEQ ID NO: 3064974 - DNA, 15 bp, Homo sapiens
gtacctgcaagcaga

SEQ ID NO: 3064975 - DNA, 19 bp, Homo sapiens
gtacctgcaagcagaactt

SEQ ID NO: 3064976 - DNA, 19 bp, Homo sapiens
gtacctgcaagtatccaga

SEQ ID NO: 3064977 - DNA, 18 bp, Homo sapiens
gtaccttgacctttgtac

SEQ ID NO: 3064978 - DNA, 19 bp, Homo sapiens
gtaccttgacctttgtaca

SEQ ID NO: 3064979 - DNA, 20 bp, Homo sapiens
gtaccttgacctttgtacag

SEQ ID NO: 3064980 - DNA, 23 bp, Homo sapiens
gtaccttttttgttttttcaaaa

SEQ ID NO: 3064981 - DNA, 15 bp, Homo sapiens
gtacgcacagacagg

SEQ ID NO: 3064982 - DNA, 14 bp, Homo sapiens
gtacgtagccacag

SEQ ID NO: 3064983 - DNA, 12 bp, Homo sapiens
gtacgtcccagc

SEQ ID NO: 3064984 - DNA, 13 bp, Homo sapiens
gtacgtgaccctc

SEQ ID NO: 3064985 - DNA, 14 bp, Homo sapiens
gtacgtttgtatgt

SEQ ID NO: 3064986 - DNA, 14 bp, Homo sapiens
gtactaaggagaat

SEQ ID NO: 3064987 - DNA, 16 bp, Homo sapiens
gtactaaggagcatga

SEQ ID NO: 3064988 - DNA, 14 bp, Homo sapiens
gtactcattaaaaa

SEQ ID NO: 3064989 - DNA, 17 bp, Homo sapiens
gtactccagcctgggca

SEQ ID NO: 3064990 - DNA, 17 bp, Homo sapiens
gtactccagcctgggtg

SEQ ID NO: 3064991 - DNA, 15 bp, Homo sapiens
gtactccctctcagg

SEQ ID NO: 3064992 - DNA, 17 bp, Homo sapiens
gtactggtaattgtaca

SEQ ID NO: 3064993 - DNA, 15 bp, Homo sapiens
gtactgtatgtgatg

SEQ ID NO: 3064994 - DNA, 17 bp, Homo sapiens
gtactgtgggcaattta

SEQ ID NO: 3064995 - DNA, 18 bp, Homo sapiens
gtactgttactgggccct

SEQ ID NO: 3064996 - DNA, 16 bp, Homo sapiens
gtacttcagcaagaga

SEQ ID NO: 3064997 - DNA, 23 bp, Homo sapiens
gtacttcagcaagagagaaccta

SEQ ID NO: 3064998 - DNA, 18 bp, Homo sapiens
gtacttggagggctcagg

SEQ ID NO: 3064999 - DNA, 19 bp, Homo sapiens
gtacttggtccaactgcaa

SEQ ID NO: 3065000 - DNA, 15 bp, Homo sapiens
gtacttgtcaaagaa

SEQ ID NO: 3065001 - DNA, 16 bp, Homo sapiens
gtacttgtcaaagaag

SEQ ID NO: 3065002 - DNA, 21 bp, Homo sapiens
gtactttagggaaacctttgc

SEQ ID NO: 3065003 - DNA, 21 bp, Homo sapiens
gtactttatttttctgataga

SEQ ID NO: 3065004 - DNA, 18 bp, Homo sapiens
gtactttctaagagaaag

SEQ ID NO: 3065005 - DNA, 10 bp, Homo sapiens
gtactttgtg

SEQ ID NO: 3065006 - DNA, 21 bp, Homo sapiens
gtacttttcattctcttttaa

SEQ ID NO: 3065007 - DNA, 14 bp, Homo sapiens
gtactttttgtgaa

SEQ ID NO: 3065008 - DNA, 15 bp, Homo sapiens
gtactttttgtgaag

SEQ ID NO: 3065009 - DNA, 20 bp, Homo sapiens
gtacttttttaaatattttc

SEQ ID NO: 3065010 - DNA, 21 bp, Homo sapiens
gtagaaattcttaatttggat

SEQ ID NO: 3065011 - DNA, 19 bp, Homo sapiens
gtagaactgattttacaaa

SEQ ID NO: 3065012 - DNA, 19 bp, Homo sapiens
gtagaagccacccttccct

SEQ ID NO: 3065013 - DNA, 19 bp, Homo sapiens
gtagaaggttgacacagtt

SEQ ID NO: 3065014 - DNA, 17 bp, Homo sapiens
gtagaataaatgaagaa

SEQ ID NO: 3065015 - DNA, 19 bp, Homo sapiens
gtagaataaatgaagaaag

SEQ ID NO: 3065016 - DNA, 14 bp, Homo sapiens
gtagaatgtattgt

SEQ ID NO: 3065017 - DNA, 23 bp, Homo sapiens
gtagaatgtattgtaccttttaa

SEQ ID NO: 3065018 - DNA, 14 bp, Homo sapiens
gtagaattgcattg

SEQ ID NO: 3065019 - DNA, 12 bp, Homo sapiens
gtagaattgtta

SEQ ID NO: 3065020 - DNA, 19 bp, Homo sapiens
gtagacacgctcttctatt

SEQ ID NO: 3065021 - DNA, 14 bp, Homo sapiens
gtagacattttaac

SEQ ID NO: 3065022 - DNA, 21 bp, Homo sapiens
gtagacattttaacaagaaga

SEQ ID NO: 3065023 - DNA, 20 bp, Homo sapiens
gtagagccaattagacttga

SEQ ID NO: 3065024 - DNA, 20 bp, Homo sapiens
gtagaggaagacgagacagg

SEQ ID NO: 3065025 - DNA, 21 bp, Homo sapiens
gtagagtagggtagaaggaaa

SEQ ID NO: 3065026 - DNA, 15 bp, Homo sapiens
gtagataaataatgt

SEQ ID NO: 3065027 - DNA, 22 bp, Homo sapiens
gtagatattggacaaagaacct

SEQ ID NO: 3065028 - DNA, 18 bp, Homo sapiens
gtagatctgctttctgtt

SEQ ID NO: 3065029 - DNA, 21 bp, Homo sapiens
gtagatctgctttctgttcat

SEQ ID NO: 3065030 - DNA, 17 bp, Homo sapiens
gtagatgggagggaggc

SEQ ID NO: 3065031 - DNA, 21 bp, Homo sapiens
gtagatgggagggaggctcag

SEQ ID NO: 3065032 - DNA, 16 bp, Homo sapiens
gtagattctgtggaac

SEQ ID NO: 3065033 - DNA, 17 bp, Homo sapiens
gtagattgttttgttca

SEQ ID NO: 3065034 - DNA, 20 bp, Homo sapiens
gtagattgttttgttcacat

SEQ ID NO: 3065035 - DNA, 13 bp, Homo sapiens
gtagattttcttt

SEQ ID NO: 3065036 - DNA, 16 bp, Homo sapiens
gtagattttctttaaa

SEQ ID NO: 3065037 - DNA, 23 bp, Homo sapiens
gtagcacccacaagtggcagaca

SEQ ID NO: 3065038 - DNA, 14 bp, Homo sapiens
gtagcactcaggct

SEQ ID NO: 3065039 - DNA, 13 bp, Homo sapiens
gtagcagaaacca

SEQ ID NO: 3065040 - DNA, 13 bp, Homo sapiens
gtagcagcaaata

SEQ ID NO: 3065041 - DNA, 18 bp, Homo sapiens
gtagcaggtaccactgat

SEQ ID NO: 3065042 - DNA, 15 bp, Homo sapiens
gtagccacaccagga

SEQ ID NO: 3065043 - DNA, 16 bp, Homo sapiens
gtagccacaccaggat

SEQ ID NO: 3065044 - DNA, 14 bp, Homo sapiens
gtagccacaggagc

SEQ ID NO: 3065045 - DNA, 15 bp, Homo sapiens
gtagccacaggagcc

SEQ ID NO: 3065046 - DNA, 19 bp, Homo sapiens
gtagccacaggagccctgc

SEQ ID NO: 3065047 - DNA, 18 bp, Homo sapiens
gtagccagcacacagggc

SEQ ID NO: 3065048 - DNA, 17 bp, Homo sapiens
gtagccagttaaggaaa

SEQ ID NO: 3065049 - DNA, 20 bp, Homo sapiens
gtagcccactctgctcgcct

SEQ ID NO: 3065050 - DNA, 14 bp, Homo sapiens
gtagcccaggctgg

SEQ ID NO: 3065051 - DNA, 23 bp, Homo sapiens
gtagccccagtcagaagttctgg

SEQ ID NO: 3065052 - DNA, 19 bp, Homo sapiens
gtagccccagtgacagcta

SEQ ID NO: 3065053 - DNA, 15 bp, Homo sapiens
gtagccgccctgaga

SEQ ID NO: 3065054 - DNA, 16 bp, Homo sapiens
gtagccgccctgagag

SEQ ID NO: 3065055 - DNA, 18 bp, Homo sapiens
gtagcggatgattcttca

SEQ ID NO: 3065056 - DNA, 14 bp, Homo sapiens
gtagctagaggaac

SEQ ID NO: 3065057 - DNA, 17 bp, Homo sapiens
gtagctagaggaaccaa

SEQ ID NO: 3065058 - DNA, 17 bp, Homo sapiens
gtagctgagctgtgaca

SEQ ID NO: 3065059 - DNA, 13 bp, Homo sapiens
gtagctgagggga

SEQ ID NO: 3065060 - DNA, 10 bp, Homo sapiens
gtagctgcta

SEQ ID NO: 3065061 - DNA, 23 bp, Homo sapiens
gctgagcccctgtctagagaggg

SEQ ID NO: 3065062 - DNA, 19 bp, Homo sapiens
gctgagcctctgctcccca

SEQ ID NO: 3065063 - DNA, 20 bp, Homo sapiens
gctgagcctctgctccccag

SEQ ID NO: 3065064 - DNA, 20 bp, Homo sapiens
gctgagcctgcagggaagcc

SEQ ID NO: 3065065 - DNA, 13 bp, Homo sapiens
gctgagctggctt

SEQ ID NO: 3065066 - DNA, 13 bp, Homo sapiens
gctgagctgggga

SEQ ID NO: 3065067 - DNA, 13 bp, Homo sapiens
gctgagctgtgac

SEQ ID NO: 3065068 - DNA, 23 bp, Homo sapiens
gctgaggaaaggccagctggcag

SEQ ID NO: 3065069 - DNA, 13 bp, Homo sapiens
gctgaggcagaag

SEQ ID NO: 3065070 - DNA, 13 bp, Homo sapiens
gctgaggcaggag

SEQ ID NO: 3065071 - DNA, 15 bp, Homo sapiens
gctgaggcctccctt

SEQ ID NO: 3065072 - DNA, 13 bp, Homo sapiens
gctgaggctggca

SEQ ID NO: 3065073 - DNA, 23 bp, Homo sapiens
gctgagggaccgagcccagcaga

SEQ ID NO: 3065074 - DNA, 14 bp, Homo sapiens
gctgagggagcctg

SEQ ID NO: 3065075 - DNA, 15 bp, Homo sapiens
gctgagggagggagc

SEQ ID NO: 3065076 - DNA, 19 bp, Homo sapiens
gctgagggagggagccatg

SEQ ID NO: 3065077 - DNA, 15 bp, Homo sapiens
gctgagggccctgtg

SEQ ID NO: 3065078 - DNA, 17 bp, Homo sapiens
gctgaggtggctaaggg

SEQ ID NO: 3065079 - DNA, 22 bp, Homo sapiens
gctgaggtggtaggatcacctg

SEQ ID NO: 3065080 - DNA, 14 bp, Homo sapiens
gctgaggtgtctgg

SEQ ID NO: 3065081 - DNA, 21 bp, Homo sapiens
gctgaggtgtctggcctgagg

SEQ ID NO: 3065082 - DNA, 20 bp, Homo sapiens
gctgagtagatgcgcagccc

SEQ ID NO: 3065083 - DNA, 15 bp, Homo sapiens
gctgagtctccaggg

SEQ ID NO: 3065084 - DNA, 13 bp, Homo sapiens
gctgagtgagtga

SEQ ID NO: 3065085 - DNA, 15 bp, Homo sapiens
gctgagtttcccttc

SEQ ID NO: 3065086 - DNA, 17 bp, Homo sapiens
gctgataccatatgaat

SEQ ID NO: 3065087 - DNA, 20 bp, Homo sapiens
gctgatatatgtgtttttca

SEQ ID NO: 3065088 - DNA, 20 bp, Homo sapiens
gctgatcatcgccagaggtg

SEQ ID NO: 3065089 - DNA, 21 bp, Homo sapiens
gctgatgaatcactgttttta

SEQ ID NO: 3065090 - DNA, 23 bp, Homo sapiens
gctgatgcagccgtccatagcag

SEQ ID NO: 3065091 - DNA, 13 bp, Homo sapiens
gctgatggtctgg

SEQ ID NO: 3065092 - DNA, 15 bp, Homo sapiens
gctgatgtagtgacc

SEQ ID NO: 3065093 - DNA, 16 bp, Homo sapiens
gctgatgtgagtgtgt

SEQ ID NO: 3065094 - DNA, 15 bp, Homo sapiens
gctgatgttcagtgt

SEQ ID NO: 3065095 - DNA, 17 bp, Homo sapiens
gctgatttggtgaccaa

SEQ ID NO: 3065096 - DNA, 20 bp, Homo sapiens
gctgcaagcccacctcggcc

SEQ ID NO: 3065097 - DNA, 23 bp, Homo sapiens
gctgcacagggtttggcccaagt

SEQ ID NO: 3065098 - DNA, 14 bp, Homo sapiens
gctgcacatagcag

SEQ ID NO: 3065099 - DNA, 16 bp, Homo sapiens
gctgcacgctcccctc

SEQ ID NO: 3065100 - DNA, 12 bp, Homo sapiens
gctgcactcttg

SEQ ID NO: 3065101 - DNA, 14 bp, Homo sapiens
gctgcactcttgaa

SEQ ID NO: 3065102 - DNA, 18 bp, Homo sapiens
gctgcactggagccacag

SEQ ID NO: 3065103 - DNA, 19 bp, Homo sapiens
gctgcactggagccacagg

SEQ ID NO: 3065104 - DNA, 23 bp, Homo sapiens
gctgcactggagccacaggcagg

SEQ ID NO: 3065105 - DNA, 15 bp, Homo sapiens
gctgcagagtcacaa

SEQ ID NO: 3065106 - DNA, 13 bp, Homo sapiens
gctgcagccaggc

SEQ ID NO: 3065107 - DNA, 14 bp, Homo sapiens
gctgcagccaggcc

SEQ ID NO: 3065108 - DNA, 21 bp, Homo sapiens
gctgcagccaggcctcgcctg

SEQ ID NO: 3065109 - DNA, 16 bp, Homo sapiens
gctgcagcctgcgcca

SEQ ID NO: 3065110 - DNA, 12 bp, Homo sapiens
gctgcaggaggg

SEQ ID NO: 3065111 - DNA, 15 bp, Homo sapiens
gctgcaggagggcac

SEQ ID NO: 3065112 - DNA, 15 bp, Homo sapiens
gctgcagggagcacc

SEQ ID NO: 3065113 - DNA, 22 bp, Homo sapiens
gctgcatcccccccacctctcc

SEQ ID NO: 3065114 - DNA, 16 bp, Homo sapiens
gctacctttcaaagct

SEQ ID NO: 3065115 - DNA, 17 bp, Homo sapiens
gctacgtgcctcccgag

SEQ ID NO: 3065116 - DNA, 14 bp, Homo sapiens
gctacgtgtgaaat

SEQ ID NO: 3065117 - DNA, 23 bp, Homo sapiens
gctacgtgtgaaatctgtctttg

SEQ ID NO: 3065118 - DNA, 20 bp, Homo sapiens
gctacgtgtgatttttctgg

SEQ ID NO: 3065119 - DNA, 14 bp, Homo sapiens
gctactagctcttt

SEQ ID NO: 3065120 - DNA, 11 bp, Homo sapiens
gctactcagca

SEQ ID NO: 3065121 - DNA, 22 bp, Homo sapiens
gctactcagcagccctcctcac

SEQ ID NO: 3065122 - DNA, 24 bp, Homo sapiens
gctactcagcagccctcctcaccc

SEQ ID NO: 3065123 - DNA, 12 bp, Homo sapiens
gctactcaggag

SEQ ID NO: 3065124 - DNA, 15 bp, Homo sapiens
gctactcaggaggct

SEQ ID NO: 3065125 - DNA, 17 bp, Homo sapiens
gctactcaggaggctga

SEQ ID NO: 3065126 - DNA, 18 bp, Homo sapiens
gctactcaggaggctgag

SEQ ID NO: 3065127 - DNA, 22 bp, Homo sapiens
gctactcaggaggctgagacag

SEQ ID NO: 3065128 - DNA, 19 bp, Homo sapiens
gctactcgggaggctgagg

SEQ ID NO: 3065129 - DNA, 17 bp, Homo sapiens
gctactctgttccttca

SEQ ID NO: 3065130 - DNA, 18 bp, Homo sapiens
gctactctgttccttcac

SEQ ID NO: 3065131 - DNA, 15 bp, Homo sapiens
gctactgcccctctc

SEQ ID NO: 3065132 - DNA, 16 bp, Homo sapiens
gctactgcccctctcc

SEQ ID NO: 3065133 - DNA, 17 bp, Homo sapiens
gctactgcccctctccg

SEQ ID NO: 3065134 - DNA, 20 bp, Homo sapiens
gctactggcatagtttcata

SEQ ID NO: 3065135 - DNA, 17 bp, Homo sapiens
gctactggggaggctga

SEQ ID NO: 3065136 - DNA, 20 bp, Homo sapiens
gctactggggaggctgaggc

SEQ ID NO: 3065137 - DNA, 14 bp, Homo sapiens
gctacttagctggc

SEQ ID NO: 3065138 - DNA, 17 bp, Homo sapiens
gctacttcccactgtat

SEQ ID NO: 3065139 - DNA, 20 bp, Homo sapiens
gctacttcttattcactttt

SEQ ID NO: 3065140 - DNA, 21 bp, Homo sapiens
gctacttcttattcacttttg

SEQ ID NO: 3065141 - DNA, 17 bp, Homo sapiens
gctacttttacttgttc

SEQ ID NO: 3065142 - DNA, 16 bp, Homo sapiens
gctagaaaaaaagaat

SEQ ID NO: 3065143 - DNA, 20 bp, Homo sapiens
gctagaagtgggccaggaca

SEQ ID NO: 3065144 - DNA, 20 bp, Homo sapiens
gctagagagaaaaagaaaga

SEQ ID NO: 3065145 - DNA, 20 bp, Homo sapiens
gctagagatatggcagcgaa

SEQ ID NO: 3065146 - DNA, 15 bp, Homo sapiens
gctagagggcccaaa

SEQ ID NO: 3065147 - DNA, 14 bp, Homo sapiens
gctagattaaaata

SEQ ID NO: 3065148 - DNA, 21 bp, Homo sapiens
gctagattaaaatatcctttc

SEQ ID NO: 3065149 - DNA, 19 bp, Homo sapiens
gctagcaaatggcagaacc

SEQ ID NO: 3065150 - DNA, 12 bp, Homo sapiens
gctagccagagg

SEQ ID NO: 3065151 - DNA, 15 bp, Homo sapiens
gctagccagaggact

SEQ ID NO: 3065152 - DNA, 20 bp, Homo sapiens
gctagcgctgccgcacccca

SEQ ID NO: 3065153 - DNA, 15 bp, Homo sapiens
gctagctagccagcc

SEQ ID NO: 3065154 - DNA, 16 bp, Homo sapiens
gctagctagccagcca

SEQ ID NO: 3065155 - DNA, 14 bp, Homo sapiens
gctagctggagcct

SEQ ID NO: 3065156 - DNA, 23 bp, Homo sapiens
gctagctttcctttacagctgtt

SEQ ID NO: 3065157 - DNA, 13 bp, Homo sapiens
gctaggaagagtc

SEQ ID NO: 3065158 - DNA, 18 bp, Homo sapiens
gctaggacgttggcctca

SEQ ID NO: 3065159 - DNA, 14 bp, Homo sapiens
gctagggaggacca

SEQ ID NO: 3065160 - DNA, 17 bp, Homo sapiens
gctagggtggggagaga

SEQ ID NO: 3065161 - DNA, 16 bp, Homo sapiens
gctagtcactggcagc

SEQ ID NO: 3065162 - DNA, 22 bp, Homo sapiens
gctagtcactggcagcctgcac

SEQ ID NO: 3065163 - DNA, 14 bp, Homo sapiens
gctagtcagagaga

SEQ ID NO: 3065164 - DNA, 15 bp, Homo sapiens
gctagtcctagtgaa

SEQ ID NO: 3065165 - DNA, 15 bp, Homo sapiens
gctagtgaagtggcc

SEQ ID NO: 3065166 - DNA, 20 bp, Homo sapiens
gctagtgccttgcccacagg

SEQ ID NO: 3065167 - DNA, 15 bp, Homo sapiens
gctagttctcagctt

SEQ ID NO: 3065168 - DNA, 19 bp, Homo sapiens
gctagttggggagctaagg

SEQ ID NO: 3065169 - DNA, 23 bp, Homo sapiens
gctataaattcctctttgctttg

SEQ ID NO: 3065170 - DNA, 22 bp, Homo sapiens
gctataaattttttgaaacaca

SEQ ID NO: 3065171 - DNA, 11 bp, Homo sapiens
gctataatcat

SEQ ID NO: 3065172 - DNA, 13 bp, Homo sapiens
gctataatcatta

SEQ ID NO: 3065173 - DNA, 18 bp, Homo sapiens
gctataatcattagtttt

SEQ ID NO: 3065174 - DNA, 22 bp, Homo sapiens
gctataatcattagttttagag

SEQ ID NO: 3065175 - DNA, 17 bp, Homo sapiens
gctatacctgtgcctcg

SEQ ID NO: 3065176 - DNA, 14 bp, Homo sapiens
gctatagtatttga

SEQ ID NO: 3065177 - DNA, 20 bp, Homo sapiens
gctatagtatttgattcaaa

SEQ ID NO: 3065178 - DNA, 15 bp, Homo sapiens
gctatataaaatgtg

SEQ ID NO: 3065179 - DNA, 16 bp, Homo sapiens
gctatataaaatgtgg

SEQ ID NO: 3065180 - DNA, 18 bp, Homo sapiens
gctatcggcagatgatgc

SEQ ID NO: 3065181 - DNA, 12 bp, Homo sapiens
gctatctactaa

SEQ ID NO: 3065182 - DNA, 16 bp, Homo sapiens
gctatctactaagttt

SEQ ID NO: 3065183 - DNA, 20 bp, Homo sapiens
gctatctactaagtttcctt

SEQ ID NO: 3065184 - DNA, 16 bp, Homo sapiens
gctatgaaaggaataa

SEQ ID NO: 3065185 - DNA, 21 bp, Homo sapiens
gctatgataagattgaaattc

SEQ ID NO: 3065186 - DNA, 18 bp, Homo sapiens
gctatggtgctctgtcta

SEQ ID NO: 3065187 - DNA, 14 bp, Homo sapiens
gctatggtgggaga

SEQ ID NO: 3065188 - DNA, 14 bp, Homo sapiens
gctatgtaagggtc

SEQ ID NO: 3065189 - DNA, 23 bp, Homo sapiens
gctattactaaggagtaatctgt

SEQ ID NO: 3065190 - DNA, 19 bp, Homo sapiens
gctattatactgttatcca

SEQ ID NO: 3065191 - DNA, 13 bp, Homo sapiens
gctatttaaaact

SEQ ID NO: 3065192 - DNA, 16 bp, Homo sapiens
gctatttatgggcccc

SEQ ID NO: 3065193 - DNA, 19 bp, Homo sapiens
gctatttcaggccctcagc

SEQ ID NO: 3065194 - DNA, 14 bp, Homo sapiens
gctatttctatgta

SEQ ID NO: 3065195 - DNA, 22 bp, Homo sapiens
gctatttctatgtatgtgccaa

SEQ ID NO: 3065196 - DNA, 14 bp, Homo sapiens
gctatttgaagtgt

SEQ ID NO: 3065197 - DNA, 14 bp, Homo sapiens
gctcaaaggcacag

SEQ ID NO: 3065198 - DNA, 14 bp, Homo sapiens
gctcaagcagcaaa

SEQ ID NO: 3065199 - DNA, 22 bp, Homo sapiens
gctcaagccctgaatttcttct

SEQ ID NO: 3065200 - DNA, 18 bp, Homo sapiens
gctcaagcgattctcctg

SEQ ID NO: 3065201 - DNA, 19 bp, Homo sapiens
gctcaaggaaaggcctgaa

SEQ ID NO: 3065202 - DNA, 15 bp, Homo sapiens
gctcaagggacaagg

SEQ ID NO: 3065203 - DNA, 17 bp, Homo sapiens
gctcaagtgatcctcac

SEQ ID NO: 3065204 - DNA, 15 bp, Homo sapiens
gctcaataggaccag

SEQ ID NO: 3065205 - DNA, 14 bp, Homo sapiens
gctcaatttcagca

SEQ ID NO: 3065206 - DNA, 19 bp, Homo sapiens
gctcacaccctaccttccc

SEQ ID NO: 3065207 - DNA, 22 bp, Homo sapiens
gctcacaccctaccttccccag

SEQ ID NO: 3065208 - DNA, 19 bp, Homo sapiens
gctcacagttcctcgccct

SEQ ID NO: 3065209 - DNA, 18 bp, Homo sapiens
gctcacccccttctccat

SEQ ID NO: 3065210 - DNA, 20 bp, Homo sapiens
gctcacccccttctccatcc

SEQ ID NO: 3065211 - DNA, 22 bp, Homo sapiens
gctcacccccttctccatccac

SEQ ID NO: 3065212 - DNA, 15 bp, Homo sapiens
gctcacctgttgctt

SEQ ID NO: 3065213 - DNA, 18 bp, Homo sapiens
gctcacgccccgctgtgt

SEQ ID NO: 3065214 - DNA, 19 bp, Homo sapiens
gctcacgccccgctgtgtc

SEQ ID NO: 3065215 - DNA, 21 bp, Homo sapiens
gctcacgccccgctgtgtcct

SEQ ID NO: 3065216 - DNA, 22 bp, Homo sapiens
gctcacgcctgtaatcccagca

SEQ ID NO: 3065217 - DNA, 23 bp, Homo sapiens
gctcacgcctgtaatcccagcac

SEQ ID NO: 3065218 - DNA, 19 bp, Homo sapiens
gctcactgcaacctctgcc

SEQ ID NO: 3065219 - DNA, 16 bp, Homo sapiens
gctcagacatgttttc

SEQ ID NO: 3065220 - DNA, 16 bp, Homo sapiens
gctcagaccagctctt

SEQ ID NO: 3065221 - DNA, 19 bp, Homo sapiens
gctcagacccccactctca

SEQ ID NO: 3065222 - DNA, 18 bp, Homo sapiens
gctcagagagtacactgt

SEQ ID NO: 3065223 - DNA, 20 bp, Homo sapiens
gctcagagagtacactgtgt

SEQ ID NO: 3065224 - DNA, 22 bp, Homo sapiens
gctcagagagtacactgtgtct

SEQ ID NO: 3065225 - DNA, 19 bp, Homo sapiens
gctcagaggcgcactgtga

SEQ ID NO: 3065226 - DNA, 20 bp, Homo sapiens
gctcagaggcgcactgtgac

SEQ ID NO: 3065227 - DNA, 15 bp, Homo sapiens
gctcagatagaatga

SEQ ID NO: 3065228 - DNA, 19 bp, Homo sapiens
gctcagatagaatgacagt

SEQ ID NO: 3065229 - DNA, 18 bp, Homo sapiens
gctcagatggcctgagcc

SEQ ID NO: 3065230 - DNA, 17 bp, Homo sapiens
gctcagcagtgactgtg

SEQ ID NO: 3065231 - DNA, 15 bp, Homo sapiens
gctcagccagcactt

SEQ ID NO: 3065232 - DNA, 19 bp, Homo sapiens
gctcagctagacattgcaa

SEQ ID NO: 3065233 - DNA, 19 bp, Homo sapiens
gctcagctcggggagcctt

SEQ ID NO: 3065234 - DNA, 17 bp, Homo sapiens
gctcagctctgggccat

SEQ ID NO: 3065235 - DNA, 14 bp, Homo sapiens
gctcagctctggtc

SEQ ID NO: 3065236 - DNA, 21 bp, Homo sapiens
gctcagctgtggtcccaccca

SEQ ID NO: 3065237 - DNA, 12 bp, Homo sapiens
gctcagcttctc

SEQ ID NO: 3065238 - DNA, 19 bp, Homo sapiens
gctcaggaaccgaggcagg

SEQ ID NO: 3065239 - DNA, 21 bp, Homo sapiens
gctcaggaattgaagatgtaa

SEQ ID NO: 3065240 - DNA, 20 bp, Homo sapiens
gctcaggacagatgccacac

SEQ ID NO: 3065241 - DNA, 14 bp, Homo sapiens
gctcaggcccagct

SEQ ID NO: 3065242 - DNA, 23 bp, Homo sapiens
gctcagggcagtggcttctttcc

SEQ ID NO: 3065243 - DNA, 18 bp, Homo sapiens
gctcaggggacactggcc

SEQ ID NO: 3065244 - DNA, 16 bp, Homo sapiens
gctcagtcgccctgtt

SEQ ID NO: 3065245 - DNA, 17 bp, Homo sapiens
gctcagtcgccctgttc

SEQ ID NO: 3065246 - DNA, 21 bp, Homo sapiens
gctcagtgcaacctctgcttc

SEQ ID NO: 3065247 - DNA, 16 bp, Homo sapiens
gctcagttctgcctta

SEQ ID NO: 3065248 - DNA, 19 bp, Homo sapiens
gctcagttgctaaacactg

SEQ ID NO: 3065249 - DNA, 17 bp, Homo sapiens
gctcagttgtagaatgt

SEQ ID NO: 3065250 - DNA, 22 bp, Homo sapiens
cagacagagaatatgtctgctc

SEQ ID NO: 3065251 - DNA, 19 bp, Homo sapiens
cagacagaggatgagctct

SEQ ID NO: 3065252 - DNA, 13 bp, Homo sapiens
ccagacttccttg

SEQ ID NO: 3065253 - DNA, 18 bp, Homo sapiens
ccagagaaaaagggaggg

SEQ ID NO: 3065254 - DNA, 16 bp, Homo sapiens
ccagagaaaggggagc

SEQ ID NO: 3065255 - DNA, 20 bp, Homo sapiens
ccagagaaaggggagcccac

SEQ ID NO: 3065256 - DNA, 13 bp, Homo sapiens
ccagagacatgtg

SEQ ID NO: 3065257 - DNA, 13 bp, Homo sapiens
ccagagatccaaa

SEQ ID NO: 3065258 - DNA, 16 bp, Homo sapiens
ccagagatgcctccac

SEQ ID NO: 3065259 - DNA, 16 bp, Homo sapiens
ccagagcaggggctgc

SEQ ID NO: 3065260 - DNA, 20 bp, Homo sapiens
ccagagcaggggctgctggg

SEQ ID NO: 3065261 - DNA, 13 bp, Homo sapiens
ccagagccacaca

SEQ ID NO: 3065262 - DNA, 16 bp, Homo sapiens
ccagagcccagctctt

SEQ ID NO: 3065263 - DNA, 17 bp, Homo sapiens
ccagagcccagctcttg

SEQ ID NO: 3065264 - DNA, 19 bp, Homo sapiens
ccagagcccagctcttgct

SEQ ID NO: 3065265 - DNA, 17 bp, Homo sapiens
ccagagctctgacccac

SEQ ID NO: 3065266 - DNA, 22 bp, Homo sapiens
ccagagctctgacccacagcct

SEQ ID NO: 3065267 - DNA, 23 bp, Homo sapiens
ccagagctgaagagttgccccgt

SEQ ID NO: 3065268 - DNA, 15 bp, Homo sapiens
ccagagctgcacagg

SEQ ID NO: 3065269 - DNA, 13 bp, Homo sapiens
ccagagctgcctc

SEQ ID NO: 3065270 - DNA, 14 bp, Homo sapiens
ccagagctgcctcc

SEQ ID NO: 3065271 - DNA, 16 bp, Homo sapiens
ccagagctgcctcccc

SEQ ID NO: 3065272 - DNA, 23 bp, Homo sapiens
ccagagctgcctccccaatccat

SEQ ID NO: 3065273 - DNA, 19 bp, Homo sapiens
ccagagctgcttctgtctg

SEQ ID NO: 3065274 - DNA, 20 bp, Homo sapiens
ccagagctgcttctgtctgg

SEQ ID NO: 3065275 - DNA, 22 bp, Homo sapiens
ccagagctggtggacccaggga

SEQ ID NO: 3065276 - DNA, 16 bp, Homo sapiens
ccagaggagcccagcg

SEQ ID NO: 3065277 - DNA, 22 bp, Homo sapiens
ccagaggcctcttttcctgaag

SEQ ID NO: 3065278 - DNA, 17 bp, Homo sapiens
ccagaggcgtcccgcac

SEQ ID NO: 3065279 - DNA, 12 bp, Homo sapiens
ccagagggtggg

SEQ ID NO: 3065280 - DNA, 19 bp, Homo sapiens
ccagataaaattatagatg

SEQ ID NO: 3065281 - DNA, 21 bp, Homo sapiens
ccagatacacccaaagtatca

SEQ ID NO: 3065282 - DNA, 21 bp, Homo sapiens
ccagatacgggggctgtgact

SEQ ID NO: 3065283 - DNA, 14 bp, Homo sapiens
ccagatccagcctg

SEQ ID NO: 3065284 - DNA, 15 bp, Homo sapiens
ccagatcctcttctc

SEQ ID NO: 3065285 - DNA, 18 bp, Homo sapiens
ccagatgcacatccctgg

SEQ ID NO: 3065286 - DNA, 13 bp, Homo sapiens
ccagatgcgggga

SEQ ID NO: 3065287 - DNA, 21 bp, Homo sapiens
ccagatgctgatgttcagtgt

SEQ ID NO: 3065288 - DNA, 16 bp, Homo sapiens
ccagatggactccagc

SEQ ID NO: 3065289 - DNA, 14 bp, Homo sapiens
ccagatggtgggat

SEQ ID NO: 3065290 - DNA, 16 bp, Homo sapiens
ccagatggtgggatgt

SEQ ID NO: 3065291 - DNA, 12 bp, Homo sapiens
ccagatggtttc

SEQ ID NO: 3065292 - DNA, 15 bp, Homo sapiens
ccagatggtttccta

SEQ ID NO: 3065293 - DNA, 17 bp, Homo sapiens
ccagatgtttccagact

SEQ ID NO: 3065294 - DNA, 19 bp, Homo sapiens
ccagatgttttacgtctgg

SEQ ID NO: 3065295 - DNA, 14 bp, Homo sapiens
ccagattggccaat

SEQ ID NO: 3065296 - DNA, 20 bp, Homo sapiens
ccagattggggctagtttaa

SEQ ID NO: 3065297 - DNA, 22 bp, Homo sapiens
ccagattgtatcatgtgctaga

SEQ ID NO: 3065298 - DNA, 15 bp, Homo sapiens
ccagatttgtctttt

SEQ ID NO: 3065299 - DNA, 16 bp, Homo sapiens
ccagcaaaatccaaac

SEQ ID NO: 3065300 - DNA, 18 bp, Homo sapiens
ccagcaaaatccaaactg

SEQ ID NO: 3065301 - DNA, 21 bp, Homo sapiens
ccagcaaaatccaaactgctg

SEQ ID NO: 3065302 - DNA, 23 bp, Homo sapiens
ccagcaaaatccaaactgctgtc

SEQ ID NO: 3065303 - DNA, 15 bp, Homo sapiens
ccagcaaacaaaatg

SEQ ID NO: 3065304 - DNA, 14 bp, Homo sapiens
ccagcaacacagcc

SEQ ID NO: 3065305 - DNA, 16 bp, Homo sapiens
ccagcaacacagcctg

SEQ ID NO: 3065306 - DNA, 22 bp, Homo sapiens
ccagcaacacagcctgggcccc

SEQ ID NO: 3065307 - DNA, 12 bp, Homo sapiens
ccagcacaaaca

SEQ ID NO: 3065308 - DNA, 12 bp, Homo sapiens
ccagcacagctc

SEQ ID NO: 3065309 - DNA, 14 bp, Homo sapiens
ccagcacagctcct

SEQ ID NO: 3065310 - DNA, 19 bp, Homo sapiens
ccagcacagctcctcccct

SEQ ID NO: 3065311 - DNA, 22 bp, Homo sapiens
ccagcacagctcctcccctgcc

SEQ ID NO: 3065312 - DNA, 18 bp, Homo sapiens
ccagcaccaccaggtctc

SEQ ID NO: 3065313 - DNA, 13 bp, Homo sapiens
ccagcaccccctc

SEQ ID NO: 3065314 - DNA, 21 bp, Homo sapiens
ccagcaccccctctcctggag

SEQ ID NO: 3065315 - DNA, 18 bp, Homo sapiens
ccagcacctcagcctgca

SEQ ID NO: 3065316 - DNA, 18 bp, Homo sapiens
ccagcactgcttgaggaa

SEQ ID NO: 3065317 - DNA, 19 bp, Homo sapiens
ccagcacttgtccagctga

SEQ ID NO: 3065318 - DNA, 19 bp, Homo sapiens
ccagcactttgggagacca

SEQ ID NO: 3065319 - DNA, 17 bp, Homo sapiens
ccagcactttgggaggc

SEQ ID NO: 3065320 - DNA, 20 bp, Homo sapiens
ccagcagcctcgcacaggcc

SEQ ID NO: 3065321 - DNA, 22 bp, Homo sapiens
ccagcagcctcgcacaggccct

SEQ ID NO: 3065322 - DNA, 12 bp, Homo sapiens
ccagcagcctgc

SEQ ID NO: 3065323 - DNA, 16 bp, Homo sapiens
ccagcagcctgccagc

SEQ ID NO: 3065324 - DNA, 18 bp, Homo sapiens
ccagcagcctgccagcag

SEQ ID NO: 3065325 - DNA, 12 bp, Homo sapiens
ccagcagcgcct

SEQ ID NO: 3065326 - DNA, 17 bp, Homo sapiens
ccagcagcgcgcaggcc

SEQ ID NO: 3065327 - DNA, 15 bp, Homo sapiens
ccagcaggaatttct

SEQ ID NO: 3065328 - DNA, 16 bp, Homo sapiens
ccagcaggcagcgcct

SEQ ID NO: 3065329 - DNA, 21 bp, Homo sapiens
ccagcaggcagcgcctgtccc

SEQ ID NO: 3065330 - DNA, 17 bp, Homo sapiens
ccagcaggcctccctga

SEQ ID NO: 3065331 - DNA, 14 bp, Homo sapiens
ccagcagtcacttc

SEQ ID NO: 3065332 - DNA, 16 bp, Homo sapiens
ccagcagtctctgcct

SEQ ID NO: 3065333 - DNA, 16 bp, Homo sapiens
ccccgaagggccccca

SEQ ID NO: 3065334 - DNA, 18 bp, Homo sapiens
ccccgacccccgcagagg

SEQ ID NO: 3065335 - DNA, 13 bp, Homo sapiens
ccccgactgcctg

SEQ ID NO: 3065336 - DNA, 15 bp, Homo sapiens
ccccgactgcctgtc

SEQ ID NO: 3065337 - DNA, 16 bp, Homo sapiens
ccccgaggccctgcat

SEQ ID NO: 3065338 - DNA, 19 bp, Homo sapiens
ccccgaggttgtggggagg

SEQ ID NO: 3065339 - DNA, 23 bp, Homo sapiens
ccccgcacctgtacagtggaacc

SEQ ID NO: 3065340 - DNA, 21 bp, Homo sapiens
ccccgcaggcctgccttctca

SEQ ID NO: 3065341 - DNA, 18 bp, Homo sapiens
ccccgccccctgccctcc

SEQ ID NO: 3065342 - DNA, 15 bp, Homo sapiens
ccccgccctctctca

SEQ ID NO: 3065343 - DNA, 13 bp, Homo sapiens
ccccgcctgcctc

SEQ ID NO: 3065344 - DNA, 16 bp, Homo sapiens
ccccgcgatgccctgg

SEQ ID NO: 3065345 - DNA, 20 bp, Homo sapiens
ccccgcgggctttgttgctg

SEQ ID NO: 3065346 - DNA, 12 bp, Homo sapiens
ccccgctcccac

SEQ ID NO: 3065347 - DNA, 12 bp, Homo sapiens
ccccgctccgtc

SEQ ID NO: 3065348 - DNA, 13 bp, Homo sapiens
ccccgctccgtct

SEQ ID NO: 3065349 - DNA, 13 bp, Homo sapiens
ccccgctgctgtg

SEQ ID NO: 3065350 - DNA, 15 bp, Homo sapiens
ccccgcttgtccagc

SEQ ID NO: 3065351 - DNA, 17 bp, Homo sapiens
ccccgcttgtccagcgc

SEQ ID NO: 3065352 - DNA, 18 bp, Homo sapiens
ccccgcttgtccagcgcc

SEQ ID NO: 3065353 - DNA, 19 bp, Homo sapiens
ccccgcttgtccagcgcct

SEQ ID NO: 3065354 - DNA, 19 bp, Homo sapiens
ccccgggatcctgccccca

SEQ ID NO: 3065355 - DNA, 15 bp, Homo sapiens
ccccgggctggccct

SEQ ID NO: 3065356 - DNA, 16 bp, Homo sapiens
ccccgggctggccctg

SEQ ID NO: 3065357 - DNA, 14 bp, Homo sapiens
ccccggggcccagg

SEQ ID NO: 3065358 - DNA, 15 bp, Homo sapiens
ccccggtcccttgag

SEQ ID NO: 3065359 - DNA, 16 bp, Homo sapiens
ccccggtcccttgaga

SEQ ID NO: 3065360 - DNA, 18 bp, Homo sapiens
ccccggtggcggccccag

SEQ ID NO: 3065361 - DNA, 21 bp, Homo sapiens
ccccgtctggggttcagcccc

SEQ ID NO: 3065362 - DNA, 13 bp, Homo sapiens
ccccgtggggcag

SEQ ID NO: 3065363 - DNA, 17 bp, Homo sapiens
cccctaaagatgggagg

SEQ ID NO: 3065364 - DNA, 15 bp, Homo sapiens
cccctaccccctcat

SEQ ID NO: 3065365 - DNA, 21 bp, Homo sapiens
cccctaccgcatggcagctgg

SEQ ID NO: 3065366 - DNA, 22 bp, Homo sapiens
cccctaccgcatggcagctggg

SEQ ID NO: 3065367 - DNA, 22 bp, Homo sapiens
cccctaggattccccctgccct

SEQ ID NO: 3065368 - DNA, 19 bp, Homo sapiens
cccctatccacccagccca

SEQ ID NO: 3065369 - DNA, 21 bp, Homo sapiens
cccctatccacccagcccatt

SEQ ID NO: 3065370 - DNA, 19 bp, Homo sapiens
cccctatggaatttataat

SEQ ID NO: 3065371 - DNA, 20 bp, Homo sapiens
cccctcacagactcttccac

SEQ ID NO: 3065372 - DNA, 23 bp, Homo sapiens
cccctcacagactcttccaccag

SEQ ID NO: 3065373 - DNA, 12 bp, Homo sapiens
cccctcaccacc

SEQ ID NO: 3065374 - DNA, 12 bp, Homo sapiens
cccctcaccctc

SEQ ID NO: 3065375 - DNA, 16 bp, Homo sapiens
cccctcagagcccatg

SEQ ID NO: 3065376 - DNA, 16 bp, Homo sapiens
cccctcagctctgtcc

SEQ ID NO: 3065377 - DNA, 16 bp, Homo sapiens
cccctcaggggaagct

SEQ ID NO: 3065378 - DNA, 12 bp, Homo sapiens
cccctccatccc

SEQ ID NO: 3065379 - DNA, 14 bp, Homo sapiens
cccctcccagaggc

SEQ ID NO: 3065380 - DNA, 13 bp, Homo sapiens
cccctccccaaag

SEQ ID NO: 3065381 - DNA, 18 bp, Homo sapiens
cccctccccatctgtgtt

SEQ ID NO: 3065382 - DNA, 15 bp, Homo sapiens
cccctcccccacgtc

SEQ ID NO: 3065383 - DNA, 17 bp, Homo sapiens
cccctcccccactcctc

SEQ ID NO: 3065384 - DNA, 16 bp, Homo sapiens
cccctcccctcagagc

SEQ ID NO: 3065385 - DNA, 17 bp, Homo sapiens
cccctccctcttctgcc

SEQ ID NO: 3065386 - DNA, 13 bp, Homo sapiens
cccctccctgcct

SEQ ID NO: 3065387 - DNA, 22 bp, Homo sapiens
cccctcctctgaaacagctgcc

SEQ ID NO: 3065388 - DNA, 23 bp, Homo sapiens
cccctcctctgaaacagctgcct

SEQ ID NO: 3065389 - DNA, 15 bp, Homo sapiens
cccctcctggggcca

SEQ ID NO: 3065390 - DNA, 13 bp, Homo sapiens
cccctctcacgcc

SEQ ID NO: 3065391 - DNA, 17 bp, Homo sapiens
cccctctcacgccaccc

SEQ ID NO: 3065392 - DNA, 17 bp, Homo sapiens
cccctctcaggagccat

SEQ ID NO: 3065393 - DNA, 14 bp, Homo sapiens
cccctctccttcct

SEQ ID NO: 3065394 - DNA, 19 bp, Homo sapiens
cccctctccttcctgtgtg

SEQ ID NO: 3065395 - DNA, 12 bp, Homo sapiens
cccctctctcct

SEQ ID NO: 3065396 - DNA, 11 bp, Homo sapiens
cccctctctgg

SEQ ID NO: 3065397 - DNA, 11 bp, Homo sapiens
cccctctgtct

SEQ ID NO: 3065398 - DNA, 14 bp, Homo sapiens
cccctcttctgagc

SEQ ID NO: 3065399 - DNA, 16 bp, Homo sapiens
cccctgacctgtccag

SEQ ID NO: 3065400 - DNA, 15 bp, Homo sapiens
cccctgacctgtgag

SEQ ID NO: 3065401 - DNA, 21 bp, Homo sapiens
cccctgaggatcccctgtccc

SEQ ID NO: 3065402 - DNA, 21 bp, Homo sapiens
cccctgcagacgtctggccct

SEQ ID NO: 3065403 - DNA, 18 bp, Homo sapiens
cccctgccaccgactgcc

SEQ ID NO: 3065404 - DNA, 22 bp, Homo sapiens
cccctgccaccgactgcccagc

SEQ ID NO: 3065405 - DNA, 22 bp, Homo sapiens
cccctgccactcacccttcctg

SEQ ID NO: 3065406 - DNA, 10 bp, Homo sapiens
cccctgccag

SEQ ID NO: 3065407 - DNA, 15 bp, Homo sapiens
cccctgccagggcag

SEQ ID NO: 3065408 - DNA, 19 bp, Homo sapiens
cccctgccagggcagggcc

SEQ ID NO: 3065409 - DNA, 23 bp, Homo sapiens
cccctgccagggcagggccccag

SEQ ID NO: 3065410 - DNA, 15 bp, Homo sapiens
cccctgccagtgcct

SEQ ID NO: 3065411 - DNA, 17 bp, Homo sapiens
cccctgccagtgcctta

SEQ ID NO: 3065412 - DNA, 12 bp, Homo sapiens
cccctgccctgt

SEQ ID NO: 3065413 - DNA, 14 bp, Homo sapiens
cccctgccctgtgc

SEQ ID NO: 3065414 - DNA, 15 bp, Homo sapiens
cccctgccctgtgcc

SEQ ID NO: 3065415 - DNA, 20 bp, Homo sapiens
cccctgctgctgtcacctct

SEQ ID NO: 3065416 - DNA, 21 bp, Homo sapiens
cccctgctgctgtcacctctc

SEQ ID NO: 3065417 - DNA, 14 bp, Homo sapiens
cccctgctggctgg

SEQ ID NO: 3065418 - DNA, 14 bp, Homo sapiens
cccctgctgtctct

SEQ ID NO: 3065419 - DNA, 23 bp, Homo sapiens
cccctgcttcagatgtggagcca

SEQ ID NO: 3065420 - DNA, 14 bp, Homo sapiens
cccctggaaccagc

SEQ ID NO: 3065421 - DNA, 17 bp, Homo sapiens
cccctggaaccagcaag

SEQ ID NO: 3065422 - DNA, 22 bp, Homo sapiens
cccctggaaccagcaagtccca

SEQ ID NO: 3065423 - DNA, 22 bp, Homo sapiens
cccctggaacctttcccttgtg

SEQ ID NO: 3065424 - DNA, 20 bp, Homo sapiens
cccctggagtgtgtcagagc

SEQ ID NO: 3065425 - DNA, 21 bp, Homo sapiens
cccctggagtgtgtcagagcc

SEQ ID NO: 3065426 - DNA, 23 bp, Homo sapiens
cccctggagtgtgtcagagccca

SEQ ID NO: 3065427 - DNA, 19 bp, Homo sapiens
cccctggcagctgcccctc

SEQ ID NO: 3065428 - DNA, 13 bp, Homo sapiens
cccctggcctgcc

SEQ ID NO: 3065429 - DNA, 15 bp, Homo sapiens
cccctggctctgggc

SEQ ID NO: 3065430 - DNA, 23 bp, Homo sapiens
cccctggctgaacagtgctctgc

SEQ ID NO: 3065431 - DNA, 23 bp, Homo sapiens
cccctggctgggacgtggctcag

SEQ ID NO: 3065432 - DNA, 23 bp, Homo sapiens
cccctggggctgagtctccaggg

SEQ ID NO: 3065433 - DNA, 23 bp, Homo sapiens
cccctggtggttcactcttggag

SEQ ID NO: 3065434 - DNA, 18 bp, Homo sapiens
cccctgtcccctggggct

SEQ ID NO: 3065435 - DNA, 14 bp, Homo sapiens
cccctgtctagaga

SEQ ID NO: 3065436 - DNA, 19 bp, Homo sapiens
cccctgtgcagccgctgag

SEQ ID NO: 3065437 - DNA, 20 bp, Homo sapiens
cccctgtgcagccgctgagc

SEQ ID NO: 3065438 - DNA, 16 bp, Homo sapiens
cccctgtgcctctgtc

SEQ ID NO: 3065439 - DNA, 10 bp, Homo sapiens
ccccttagat

SEQ ID NO: 3065440 - DNA, 14 bp, Homo sapiens
ccccttcagtgccc

SEQ ID NO: 3065441 - DNA, 21 bp, Homo sapiens
ccccttctacatttcttagac

SEQ ID NO: 3065442 - DNA, 15 bp, Homo sapiens
ccccttctctgtgac

SEQ ID NO: 3065443 - DNA, 18 bp, Homo sapiens
ccccttgacaactggcag

SEQ ID NO: 3065444 - DNA, 13 bp, Homo sapiens
ccccttgcagcct

SEQ ID NO: 3065445 - DNA, 16 bp, Homo sapiens
ccccttgcccttcctg

SEQ ID NO: 3065446 - DNA, 20 bp, Homo sapiens
ccccttgcccttcctgaccc

SEQ ID NO: 3065447 - DNA, 18 bp, Homo sapiens
ccccttgtccctggggca

SEQ ID NO: 3065448 - DNA, 16 bp, Homo sapiens
cccctttgggccctgc

SEQ ID NO: 3065449 - DNA, 18 bp, Homo sapiens
cccctttgggccctgcat

SEQ ID NO: 3065450 - DNA, 14 bp, Homo sapiens
cccgacggctgtga

SEQ ID NO: 3065451 - DNA, 12 bp, Homo sapiens
cccgactgcctg

SEQ ID NO: 3065452 - DNA, 18 bp, Homo sapiens
cccgagaaatttgtcttt

SEQ ID NO: 3065453 - DNA, 15 bp, Homo sapiens
cccgagccaccccag

SEQ ID NO: 3065454 - DNA, 20 bp, Homo sapiens
cccgaggaactcgcctcagc

SEQ ID NO: 3065455 - DNA, 13 bp, Homo sapiens
cccgaggcccaga

SEQ ID NO: 3065456 - DNA, 15 bp, Homo sapiens
cccgaggccctgcat

SEQ ID NO: 3065457 - DNA, 19 bp, Homo sapiens
cccgaggctgccccaggcc

SEQ ID NO: 3065458 - DNA, 20 bp, Homo sapiens
cccgaggctgccccaggccg

SEQ ID NO: 3065459 - DNA, 21 bp, Homo sapiens
cccgaggctgccccaggccgg

SEQ ID NO: 3065460 - DNA, 17 bp, Homo sapiens
cccgaggtggctgcctg

SEQ ID NO: 3065461 - DNA, 21 bp, Homo sapiens
cccgagtcattcgttctgtgg

SEQ ID NO: 3065462 - DNA, 23 bp, Homo sapiens
cccgagtcattcgttctgtggag

SEQ ID NO: 3065463 - DNA, 19 bp, Homo sapiens
cccgagtgcggcgtggaga

SEQ ID NO: 3065464 - DNA, 21 bp, Homo sapiens
cccgagtgcggcgtggagact

SEQ ID NO: 3065465 - DNA, 18 bp, Homo sapiens
cccgcacaaagcggctct

SEQ ID NO: 3065466 - DNA, 19 bp, Homo sapiens
cccgcacaaagcggctcta

SEQ ID NO: 3065467 - DNA, 12 bp, Homo sapiens
cccgcacacctg

SEQ ID NO: 3065468 - DNA, 15 bp, Homo sapiens
cccgcacctgtacag

SEQ ID NO: 3065469 - DNA, 18 bp, Homo sapiens
cccgcaccttcctcctcc

SEQ ID NO: 3065470 - DNA, 14 bp, Homo sapiens
ccatcaagcacttc

SEQ ID NO: 3065471 - DNA, 15 bp, Homo sapiens
ccatcaagcacttcc

SEQ ID NO: 3065472 - DNA, 18 bp, Homo sapiens
ccatcaagcacttcccag

SEQ ID NO: 3065473 - DNA, 17 bp, Homo sapiens
ccatcactcgcaggacc

SEQ ID NO: 3065474 - DNA, 18 bp, Homo sapiens
ccatcactgagttttcca

SEQ ID NO: 3065475 - DNA, 18 bp, Homo sapiens
ccatcactggagcaccag

SEQ ID NO: 3065476 - DNA, 21 bp, Homo sapiens
ccatcagcttaggggctgctg

SEQ ID NO: 3065477 - DNA, 14 bp, Homo sapiens
ccatcagtgccagc

SEQ ID NO: 3065478 - DNA, 19 bp, Homo sapiens
ccatcagtgccagcccctg

SEQ ID NO: 3065479 - DNA, 16 bp, Homo sapiens
ccatccagcttgccag

SEQ ID NO: 3065480 - DNA, 14 bp, Homo sapiens
ccatccattctgga

SEQ ID NO: 3065481 - DNA, 18 bp, Homo sapiens
ccatcccaagcccagtga

SEQ ID NO: 3065482 - DNA, 14 bp, Homo sapiens
ccatccccatcggc

SEQ ID NO: 3065483 - DNA, 22 bp, Homo sapiens
ccatccccatcggccctgtccc

SEQ ID NO: 3065484 - DNA, 17 bp, Homo sapiens
ccatccccgcagtgtgc

SEQ ID NO: 3065485 - DNA, 15 bp, Homo sapiens
ccatccgccagggcc

SEQ ID NO: 3065486 - DNA, 16 bp, Homo sapiens
ccatccgccagggccc

SEQ ID NO: 3065487 - DNA, 16 bp, Homo sapiens
ccatcctccagcaggg

SEQ ID NO: 3065488 - DNA, 17 bp, Homo sapiens
ccatcctccagcaggga

SEQ ID NO: 3065489 - DNA, 14 bp, Homo sapiens
ccatcctcctctcc

SEQ ID NO: 3065490 - DNA, 18 bp, Homo sapiens
ccatcctcctctccatgc

SEQ ID NO: 3065491 - DNA, 23 bp, Homo sapiens
ccatcctcctctccatgcaagtg

SEQ ID NO: 3065492 - DNA, 13 bp, Homo sapiens
ccatcctgtgtcc

SEQ ID NO: 3065493 - DNA, 19 bp, Homo sapiens
ccatccttcccaagaagag

SEQ ID NO: 3065494 - DNA, 13 bp, Homo sapiens
ccatcgccccacc

SEQ ID NO: 3065495 - DNA, 13 bp, Homo sapiens
ccatcggccctgt

SEQ ID NO: 3065496 - DNA, 16 bp, Homo sapiens
ccatcggccctgtccc

SEQ ID NO: 3065497 - DNA, 16 bp, Homo sapiens
ccatctatgcagaaca

SEQ ID NO: 3065498 - DNA, 14 bp, Homo sapiens
ccatctcaggccag

SEQ ID NO: 3065499 - DNA, 18 bp, Homo sapiens
ccatctcaggccagagcc

SEQ ID NO: 3065500 - DNA, 13 bp, Homo sapiens
ccatctcatccta

SEQ ID NO: 3065501 - DNA, 18 bp, Homo sapiens
ccatctcgctccctccca

SEQ ID NO: 3065502 - DNA, 16 bp, Homo sapiens
ccatctcggggctgct

SEQ ID NO: 3065503 - DNA, 14 bp, Homo sapiens
ccatctctactaaa

SEQ ID NO: 3065504 - DNA, 19 bp, Homo sapiens
ccatctgcacccccctggg

SEQ ID NO: 3065505 - DNA, 17 bp, Homo sapiens
ccatctgcccgcctgcc

SEQ ID NO: 3065506 - DNA, 20 bp, Homo sapiens
ccatctgcccgcctgcccac

SEQ ID NO: 3065507 - DNA, 22 bp, Homo sapiens
ccatctgcccgcctgcccacct

SEQ ID NO: 3065508 - DNA, 17 bp, Homo sapiens
ccatctgcgcagggtgg

SEQ ID NO: 3065509 - DNA, 22 bp, Homo sapiens
ccatctgcgtgacaataaaaca

SEQ ID NO: 3065510 - DNA, 16 bp, Homo sapiens
ccatctggcagggtgg

SEQ ID NO: 3065511 - DNA, 16 bp, Homo sapiens
ccatctgggctcctcc

SEQ ID NO: 3065512 - DNA, 16 bp, Homo sapiens
ccatctgtacttggtc

SEQ ID NO: 3065513 - DNA, 12 bp, Homo sapiens
ccatctgtccat

SEQ ID NO: 3065514 - DNA, 21 bp, Homo sapiens
ccatctgtccgtccagagccg

SEQ ID NO: 3065515 - DNA, 14 bp, Homo sapiens
ccatctgtgttcta

SEQ ID NO: 3065516 - DNA, 22 bp, Homo sapiens
ccatcttccacctcacctcttt

SEQ ID NO: 3065517 - DNA, 19 bp, Homo sapiens
ccatcttcccgcctcagcc

SEQ ID NO: 3065518 - DNA, 20 bp, Homo sapiens
ccatcttcgggaccaggatt

SEQ ID NO: 3065519 - DNA, 23 bp, Homo sapiens
ccatgaaaatggcatccagggct

SEQ ID NO: 3065520 - DNA, 16 bp, Homo sapiens
ccatgaacagaaaaca

SEQ ID NO: 3065521 - DNA, 22 bp, Homo sapiens
ccatgaacagaaaacattctga

SEQ ID NO: 3065522 - DNA, 15 bp, Homo sapiens
ccatgaaccaagacc

SEQ ID NO: 3065523 - DNA, 18 bp, Homo sapiens
ccatgaagccacagccca

SEQ ID NO: 3065524 - DNA, 15 bp, Homo sapiens
ccatgaatcgcttct

SEQ ID NO: 3065525 - DNA, 14 bp, Homo sapiens
ccatgacatttttc

SEQ ID NO: 3065526 - DNA, 16 bp, Homo sapiens
ccatgacatttttcct

SEQ ID NO: 3065527 - DNA, 23 bp, Homo sapiens
ccatgagatgatacatccaaagc

SEQ ID NO: 3065528 - DNA, 22 bp, Homo sapiens
ccatgaggagaaaaaaagcatg

SEQ ID NO: 3065529 - DNA, 14 bp, Homo sapiens
ccatgaggtactgg

SEQ ID NO: 3065530 - DNA, 17 bp, Homo sapiens
ccatgaggtactggtcc

SEQ ID NO: 3065531 - DNA, 22 bp, Homo sapiens
ccatgaggtactggtcccttcc

SEQ ID NO: 3065532 - DNA, 22 bp, Homo sapiens
ccatgagttggggtctggcagc

SEQ ID NO: 3065533 - DNA, 20 bp, Homo sapiens
ccatgatgcctctgtcttct

SEQ ID NO: 3065534 - DNA, 16 bp, Homo sapiens
ccatgatggcaacaga

SEQ ID NO: 3065535 - DNA, 13 bp, Homo sapiens
ccatgatggccag

SEQ ID NO: 3065536 - DNA, 18 bp, Homo sapiens
ccatgatggccaggctga

SEQ ID NO: 3065537 - DNA, 23 bp, Homo sapiens
ccatgattctatttatatgtaca

SEQ ID NO: 3065538 - DNA, 20 bp, Homo sapiens
ccatgatttcccactgcact

SEQ ID NO: 3065539 - DNA, 22 bp, Homo sapiens
ccatgcaagaactcatcactgt

SEQ ID NO: 3065540 - DNA, 16 bp, Homo sapiens
ccatgcaagcagagga

SEQ ID NO: 3065541 - DNA, 19 bp, Homo sapiens
ccatgcaagcagaggacca

SEQ ID NO: 3065542 - DNA, 23 bp, Homo sapiens
ccatgcaagcagaggaccagggc

SEQ ID NO: 3065543 - DNA, 21 bp, Homo sapiens
ccatgcaccaggactggctgt

SEQ ID NO: 3065544 - DNA, 17 bp, Homo sapiens
ccatgcacccctgatgt

SEQ ID NO: 3065545 - DNA, 15 bp, Homo sapiens
ccatgcactgtgaag

SEQ ID NO: 3065546 - DNA, 21 bp, Homo sapiens
ccatgcactgtgaaggaccct

SEQ ID NO: 3065547 - DNA, 21 bp, Homo sapiens
ccatgcctcagccctgaccct

SEQ ID NO: 3065548 - DNA, 13 bp, Homo sapiens
ccatgcctgtggc

SEQ ID NO: 3065549 - DNA, 16 bp, Homo sapiens
ccatgcgacactggga

SEQ ID NO: 3065550 - DNA, 18 bp, Homo sapiens
ccatgctatgtgcacagc

SEQ ID NO: 3065551 - DNA, 19 bp, Homo sapiens
ccatgctcccaactccctt

SEQ ID NO: 3065552 - DNA, 17 bp, Homo sapiens
ccatgctgtccctgcac

SEQ ID NO: 3065553 - DNA, 21 bp, Homo sapiens
ccatgctgtccctgcactgtg

SEQ ID NO: 3065554 - DNA, 22 bp, Homo sapiens
ccatgctgtccctgcactgtgc

SEQ ID NO: 3065555 - DNA, 22 bp, Homo sapiens
ccatgctgtgtgagaccagggg

SEQ ID NO: 3065556 - DNA, 14 bp, Homo sapiens
ccatggagccagct

SEQ ID NO: 3065557 - DNA, 22 bp, Homo sapiens
ccatggagccagctccctctat

SEQ ID NO: 3065558 - DNA, 16 bp, Homo sapiens
ccatggaggagacagg

SEQ ID NO: 3065559 - DNA, 17 bp, Homo sapiens
ccatggctcagggtggt

SEQ ID NO: 3065560 - DNA, 17 bp, Homo sapiens
ccatggcttcctgagaa

SEQ ID NO: 3065561 - DNA, 17 bp, Homo sapiens
ccatggctttcatcctg

SEQ ID NO: 3065562 - DNA, 21 bp, Homo sapiens
ccatggctttcatcctgtgtc

SEQ ID NO: 3065563 - DNA, 15 bp, Homo sapiens
ccatgggaccacaac

SEQ ID NO: 3065564 - DNA, 21 bp, Homo sapiens
ccatgggcacaaagggcccag

SEQ ID NO: 3065565 - DNA, 16 bp, Homo sapiens
ccatgggcagagccca

SEQ ID NO: 3065566 - DNA, 15 bp, Homo sapiens
ccatggggaggtggc

SEQ ID NO: 3065567 - DNA, 21 bp, Homo sapiens
ccatgggtcctcggcccatct

SEQ ID NO: 3065568 - DNA, 16 bp, Homo sapiens
ccatgggtctggcctg

SEQ ID NO: 3065569 - DNA, 23 bp, Homo sapiens
ccatgggtctggctagagggccc

SEQ ID NO: 3065570 - DNA, 16 bp, Homo sapiens
ccatggtcctgtctgt

SEQ ID NO: 3065571 - DNA, 20 bp, Homo sapiens
ccatggtcctgtctgtcctt

SEQ ID NO: 3065572 - DNA, 16 bp, Homo sapiens
ccatggtgatggtgta

SEQ ID NO: 3065573 - DNA, 20 bp, Homo sapiens
ccatggttaagagtccaaga

SEQ ID NO: 3065574 - DNA, 19 bp, Homo sapiens
ccatgtaatgatcttggac

SEQ ID NO: 3065575 - DNA, 16 bp, Homo sapiens
ccatgtagaaaatttg

SEQ ID NO: 3065576 - DNA, 17 bp, Homo sapiens
ccatgtgactctggctt

SEQ ID NO: 3065577 - DNA, 20 bp, Homo sapiens
ccatgtggcctgcccagcct

SEQ ID NO: 3065578 - DNA, 21 bp, Homo sapiens
ccatgtggcctgcccagcctc

SEQ ID NO: 3065579 - DNA, 22 bp, Homo sapiens
ccatgtggcctgcccagcctca

SEQ ID NO: 3065580 - DNA, 17 bp, Homo sapiens
ccatgtggtgatgatgt

SEQ ID NO: 3065581 - DNA, 23 bp, Homo sapiens
ccatgttggccaggctggtctca

SEQ ID NO: 3065582 - DNA, 13 bp, Homo sapiens
ccatgttggcctc

SEQ ID NO: 3065583 - DNA, 18 bp, Homo sapiens
ccatgtttccaccaaatg

SEQ ID NO: 3065584 - DNA, 12 bp, Homo sapiens
ccatgttttaaa

SEQ ID NO: 3065585 - DNA, 21 bp, Homo sapiens
ccatgttttaaaattatatag

SEQ ID NO: 3065586 - DNA, 22 bp, Homo sapiens
ccattaaccagatctagtcaat

SEQ ID NO: 3065587 - DNA, 16 bp, Homo sapiens
ccattaactagtttat

SEQ ID NO: 3065588 - DNA, 18 bp, Homo sapiens
ccattacttgtataaata

SEQ ID NO: 3065589 - DNA, 16 bp, Homo sapiens
ccattatagcgcctgt

SEQ ID NO: 3065590 - DNA, 21 bp, Homo sapiens
ccattatagcgcctgtataag

SEQ ID NO: 3065591 - DNA, 15 bp, Homo sapiens
ccattatcatgtgta

SEQ ID NO: 3065592 - DNA, 22 bp, Homo sapiens
ccattccagtcaaatctgggct

SEQ ID NO: 3065593 - DNA, 13 bp, Homo sapiens
ccattcctgaaga

SEQ ID NO: 3065594 - DNA, 13 bp, Homo sapiens
ccattcctgctct

SEQ ID NO: 3065595 - DNA, 22 bp, Homo sapiens
ccattcctgggaaatattccct

SEQ ID NO: 3065596 - DNA, 11 bp, Homo sapiens
ccattccttca

SEQ ID NO: 3065597 - DNA, 18 bp, Homo sapiens
ccattcgcgctctgctca

SEQ ID NO: 3065598 - DNA, 14 bp, Homo sapiens
ccattctacacaga

SEQ ID NO: 3065599 - DNA, 16 bp, Homo sapiens
ccattctccacagcaa

SEQ ID NO: 3065600 - DNA, 18 bp, Homo sapiens
ccattctccacagcaacc

SEQ ID NO: 3065601 - DNA, 19 bp, Homo sapiens
ccattctcctgcctcagcc

SEQ ID NO: 3065602 - DNA, 14 bp, Homo sapiens
ccattctttcccaa

SEQ ID NO: 3065603 - DNA, 20 bp, Homo sapiens
ccattctttcccaacacctc

SEQ ID NO: 3065604 - DNA, 19 bp, Homo sapiens
ccattctttcttcctccag

SEQ ID NO: 3065605 - DNA, 18 bp, Homo sapiens
ccattcttttgtaattta

SEQ ID NO: 3065606 - DNA, 23 bp, Homo sapiens
ccattgctgctccttagctgcca

SEQ ID NO: 3065607 - DNA, 19 bp, Homo sapiens
ccattggacagatttcagt

SEQ ID NO: 3065608 - DNA, 20 bp, Homo sapiens
ccattggctatttaaaactt

SEQ ID NO: 3065609 - DNA, 16 bp, Homo sapiens
ccattggtccaccctt

SEQ ID NO: 3065610 - DNA, 15 bp, Homo sapiens
ccattgtccctctgc

SEQ ID NO: 3065611 - DNA, 19 bp, Homo sapiens
ccattgtccctctgcccca

SEQ ID NO: 3065612 - DNA, 22 bp, Homo sapiens
ccattgtccctctgccccatcc

SEQ ID NO: 3065613 - DNA, 10 bp, Homo sapiens
ccattgtctt

SEQ ID NO: 3065614 - DNA, 20 bp, Homo sapiens
ccattgttggcgctgaggtg

SEQ ID NO: 3065615 - DNA, 18 bp, Homo sapiens
ccatttaaactaaccttt

SEQ ID NO: 3065616 - DNA, 15 bp, Homo sapiens
ccatttacttaggac

SEQ ID NO: 3065617 - DNA, 12 bp, Homo sapiens
ccatttatttat

SEQ ID NO: 3065618 - DNA, 17 bp, Homo sapiens
ccatttcaggaatttaa

SEQ ID NO: 3065619 - DNA, 19 bp, Homo sapiens
ccatttcatattctttcaa

SEQ ID NO: 3065620 - DNA, 22 bp, Homo sapiens
ccatttccatgtcccctcccag

SEQ ID NO: 3065621 - DNA, 15 bp, Homo sapiens
ccatttcccacatct

SEQ ID NO: 3065622 - DNA, 17 bp, Homo sapiens
ccatttcccacatcttt

SEQ ID NO: 3065623 - DNA, 13 bp, Homo sapiens
ccatttcctgaga

SEQ ID NO: 3065624 - DNA, 22 bp, Homo sapiens
ccatttcgtgagccccatcttc

SEQ ID NO: 3065625 - DNA, 12 bp, Homo sapiens
ccatttctcatg

SEQ ID NO: 3065626 - DNA, 15 bp, Homo sapiens
ccatttgaaagaaag

SEQ ID NO: 3065627 - DNA, 20 bp, Homo sapiens
ccatttgaggatttagaagt

SEQ ID NO: 3065628 - DNA, 20 bp, Homo sapiens
ccatttgctgagtttccctt

SEQ ID NO: 3065629 - DNA, 16 bp, Homo sapiens
ccatttggcagaactg

SEQ ID NO: 3065630 - DNA, 21 bp, Homo sapiens
ccatttggcagaactgctggg

SEQ ID NO: 3065631 - DNA, 23 bp, Homo sapiens
ccatttggcagaactgctggggc

SEQ ID NO: 3065632 - DNA, 18 bp, Homo sapiens
ccatttgtccttttctgc

SEQ ID NO: 3065633 - DNA, 19 bp, Homo sapiens
ccattttctataagaaaaa

SEQ ID NO: 3065634 - DNA, 20 bp, Homo sapiens
ccattttctataagaaaaag

SEQ ID NO: 3065635 - DNA, 13 bp, Homo sapiens
ccattttctgtgg

SEQ ID NO: 3065636 - DNA, 16 bp, Homo sapiens
ccattttgcccttcca

SEQ ID NO: 3065637 - DNA, 12 bp, Homo sapiens
ccattttggaaa

SEQ ID NO: 3065638 - DNA, 17 bp, Homo sapiens
ccattttggtgtgcatc

SEQ ID NO: 3065639 - DNA, 19 bp, Homo sapiens
ccattttgtgaagccctgt

SEQ ID NO: 3065640 - DNA, 19 bp, Homo sapiens
ccattttttaaggaaacaa

SEQ ID NO: 3065641 - DNA, 19 bp, Homo sapiens
cccaaaacaccgggttcca

SEQ ID NO: 3065642 - DNA, 11 bp, Homo sapiens
cccaaaagcac

SEQ ID NO: 3065643 - DNA, 23 bp, Homo sapiens
cccaaacgccctttcctcctcag

SEQ ID NO: 3065644 - DNA, 17 bp, Homo sapiens
cccaaagccactggaag

SEQ ID NO: 3065645 - DNA, 18 bp, Homo sapiens
cccaaagctgagcctgca

SEQ ID NO: 3065646 - DNA, 14 bp, Homo sapiens
cccaaagggcacac

SEQ ID NO: 3065647 - DNA, 15 bp, Homo sapiens
cccaaagtgctgaga

SEQ ID NO: 3065648 - DNA, 19 bp, Homo sapiens
cccaaatttgattgatttg

SEQ ID NO: 3065649 - DNA, 13 bp, Homo sapiens
cccaacaagcaag

SEQ ID NO: 3065650 - DNA, 20 bp, Homo sapiens
cccaacaccccgcctgcctc

SEQ ID NO: 3065651 - DNA, 11 bp, Homo sapiens
cccaacagcac

SEQ ID NO: 3065652 - DNA, 17 bp, Homo sapiens
cccaacaggaggacaat

SEQ ID NO: 3065653 - DNA, 18 bp, Homo sapiens
cccaacaggaggacaatt

SEQ ID NO: 3065654 - DNA, 19 bp, Homo sapiens
cccaacaggaggacaattc

SEQ ID NO: 3065655 - DNA, 19 bp, Homo sapiens
cccaacagtgtgaagttag

SEQ ID NO: 3065656 - DNA, 15 bp, Homo sapiens
cccaaccaaggaagg

SEQ ID NO: 3065657 - DNA, 17 bp, Homo sapiens
cccaaccaaggaaggag

SEQ ID NO: 3065658 - DNA, 13 bp, Homo sapiens
cccaacctgtcct

SEQ ID NO: 3065659 - DNA, 23 bp, Homo sapiens
cccaacctgtccttactcagagc

SEQ ID NO: 3065660 - DNA, 15 bp, Homo sapiens
cccaacgctgaagcg

SEQ ID NO: 3065661 - DNA, 17 bp, Homo sapiens
cccaactcccttctgct

SEQ ID NO: 3065662 - DNA, 13 bp, Homo sapiens
cccaactcctgga

SEQ ID NO: 3065663 - DNA, 16 bp, Homo sapiens
cccaactctagctggg

SEQ ID NO: 3065664 - DNA, 20 bp, Homo sapiens
cccaactctcccctgacctg

SEQ ID NO: 3065665 - DNA, 19 bp, Homo sapiens
cccaactgtggtagctcca

SEQ ID NO: 3065666 - DNA, 14 bp, Homo sapiens
cccaacttccctgt

SEQ ID NO: 3065667 - DNA, 17 bp, Homo sapiens
cccaacttccctgttct

SEQ ID NO: 3065668 - DNA, 13 bp, Homo sapiens
cccaagagggctg

SEQ ID NO: 3065669 - DNA, 13 bp, Homo sapiens
cccaagcggcctt

SEQ ID NO: 3065670 - DNA, 17 bp, Homo sapiens
cccaaggaaaactgcat

SEQ ID NO: 3065671 - DNA, 19 bp, Homo sapiens
cccaaggctcccggaattc

SEQ ID NO: 3065672 - DNA, 13 bp, Homo sapiens
cccaagggatctg

SEQ ID NO: 3065673 - DNA, 23 bp, Homo sapiens
cccaaggtgaaatgaagcaacag

SEQ ID NO: 3065674 - DNA, 23 bp, Homo sapiens
cccaaggttactcagcagcagag

SEQ ID NO: 3065675 - DNA, 12 bp, Homo sapiens
cccaagtcctcc

SEQ ID NO: 3065676 - DNA, 19 bp, Homo sapiens
cccaagtgccaagacacag

SEQ ID NO: 3065677 - DNA, 23 bp, Homo sapiens
cccaagtgggggcagagggcaga

SEQ ID NO: 3065678 - DNA, 23 bp, Homo sapiens
cccaatccaggtacgcacagaca

SEQ ID NO: 3065679 - DNA, 17 bp, Homo sapiens
cccaatgagacttgcct

SEQ ID NO: 3065680 - DNA, 15 bp, Homo sapiens
cccacaaaggcaaag

SEQ ID NO: 3065681 - DNA, 17 bp, Homo sapiens
cccacaaccctctggaa

SEQ ID NO: 3065682 - DNA, 14 bp, Homo sapiens
cccacaagcctgcc

SEQ ID NO: 3065683 - DNA, 16 bp, Homo sapiens
cccacaagcctgcctc

SEQ ID NO: 3065684 - DNA, 21 bp, Homo sapiens
cccacaagcctgcctcgcctt

SEQ ID NO: 3065685 - DNA, 16 bp, Homo sapiens
cccacaagctgcctct

SEQ ID NO: 3065686 - DNA, 13 bp, Homo sapiens
cccacaatttctt

SEQ ID NO: 3065687 - DNA, 13 bp, Homo sapiens
cccacacacacac

SEQ ID NO: 3065688 - DNA, 13 bp, Homo sapiens
cccacacacactc

SEQ ID NO: 3065689 - DNA, 19 bp, Homo sapiens
cccacacacactccttccc

SEQ ID NO: 3065690 - DNA, 12 bp, Homo sapiens
cccacacacagg

SEQ ID NO: 3065691 - DNA, 13 bp, Homo sapiens
cccacactcgcca

SEQ ID NO: 3065692 - DNA, 17 bp, Homo sapiens
cccacagactgccccag

SEQ ID NO: 3065693 - DNA, 19 bp, Homo sapiens
cccacagctcccaccccac

SEQ ID NO: 3065694 - DNA, 20 bp, Homo sapiens
cccacagctcccaccccacc

SEQ ID NO: 3065695 - DNA, 20 bp, Homo sapiens
cccacaggcacattaactgt

SEQ ID NO: 3065696 - DNA, 22 bp, Homo sapiens
cccacaggtgcgggaccatctg

SEQ ID NO: 3065697 - DNA, 14 bp, Homo sapiens
cccacatcccactg

SEQ ID NO: 3065698 - DNA, 19 bp, Homo sapiens
cccacatgtgacacatatg

SEQ ID NO: 3065699 - DNA, 19 bp, Homo sapiens
cccaccaaggtctcacact

SEQ ID NO: 3065700 - DNA, 20 bp, Homo sapiens
cccaccaaggtctcacactc

SEQ ID NO: 3065701 - DNA, 18 bp, Homo sapiens
cccaccacacatcccagc

SEQ ID NO: 3065702 - DNA, 19 bp, Homo sapiens
cccaccacctaggccactc

SEQ ID NO: 3065703 - DNA, 20 bp, Homo sapiens
cccaccacctaggccactcc

SEQ ID NO: 3065704 - DNA, 13 bp, Homo sapiens
cccaccagagctg

SEQ ID NO: 3065705 - DNA, 13 bp, Homo sapiens
cccaccaggagca

SEQ ID NO: 3065706 - DNA, 12 bp, Homo sapiens
cccacccaagag

SEQ ID NO: 3065707 - DNA, 20 bp, Homo sapiens
cccacccagtccatgctcca

SEQ ID NO: 3065708 - DNA, 15 bp, Homo sapiens
cccaccccaccccct

SEQ ID NO: 3065709 - DNA, 21 bp, Homo sapiens
cccaccccagcacagctcctc

SEQ ID NO: 3065710 - DNA, 20 bp, Homo sapiens
cccacccccgggatcctgcc

SEQ ID NO: 3065711 - DNA, 21 bp, Homo sapiens
cccacccccgggatcctgccc

SEQ ID NO: 3065712 - DNA, 12 bp, Homo sapiens
cccaccccctcc

SEQ ID NO: 3065713 - DNA, 19 bp, Homo sapiens
cccaccccctccccaaagc

SEQ ID NO: 3065714 - DNA, 11 bp, Homo sapiens
cccacccctca

SEQ ID NO: 3065715 - DNA, 12 bp, Homo sapiens
cccacccctgca

SEQ ID NO: 3065716 - DNA, 15 bp, Homo sapiens
cccacccctgcacag

SEQ ID NO: 3065717 - DNA, 22 bp, Homo sapiens
cccacccggtggttcttcctgt

SEQ ID NO: 3065718 - DNA, 18 bp, Homo sapiens
cccaccctaagggcagcc

SEQ ID NO: 3065719 - DNA, 15 bp, Homo sapiens
cccaccctgctgctg

SEQ ID NO: 3065720 - DNA, 17 bp, Homo sapiens
cccaccctgctgctggt

SEQ ID NO: 3065721 - DNA, 12 bp, Homo sapiens
cccaccctgggt

SEQ ID NO: 3065722 - DNA, 18 bp, Homo sapiens
cccaccctggtgggccaa

SEQ ID NO: 3065723 - DNA, 13 bp, Homo sapiens
cccaccctgtggc

SEQ ID NO: 3065724 - DNA, 24 bp, Homo sapiens
cccaccgccggggtcctgggaggc

SEQ ID NO: 3065725 - DNA, 19 bp, Homo sapiens
cccaccggatgctgtgcct

SEQ ID NO: 3065726 - DNA, 15 bp, Homo sapiens
cccaccgtgggcagg

SEQ ID NO: 3065727 - DNA, 20 bp, Homo sapiens
cccacctagtgccccagact

SEQ ID NO: 3065728 - DNA, 13 bp, Homo sapiens
cccacctcagcct

SEQ ID NO: 3065729 - DNA, 16 bp, Homo sapiens
cccacctccctgcctc

SEQ ID NO: 3065730 - DNA, 20 bp, Homo sapiens
cccacctctcttttcctctc

SEQ ID NO: 3065731 - DNA, 22 bp, Homo sapiens
cccacctctcttttcctctctg

SEQ ID NO: 3065732 - DNA, 23 bp, Homo sapiens
cccacctctcttttcctctctgt

SEQ ID NO: 3065733 - DNA, 21 bp, Homo sapiens
cccacctgaaagcctgtctct

SEQ ID NO: 3065734 - DNA, 21 bp, Homo sapiens
cccacctgcctggccggccag

SEQ ID NO: 3065735 - DNA, 12 bp, Homo sapiens
cccacctgctga

SEQ ID NO: 3065736 - DNA, 13 bp, Homo sapiens
cccacctgctgag

SEQ ID NO: 3065737 - DNA, 14 bp, Homo sapiens
cccacctgggctgg

SEQ ID NO: 3065738 - DNA, 15 bp, Homo sapiens
cccacctgggctggg

SEQ ID NO: 3065739 - DNA, 18 bp, Homo sapiens
aagcatttacaagtgctg

SEQ ID NO: 3065740 - DNA, 21 bp, Homo sapiens
aagcatttcaaagccctgcct

SEQ ID NO: 3065741 - DNA, 19 bp, Homo sapiens
aagcatttgtttctacttt

SEQ ID NO: 3065742 - DNA, 14 bp, Homo sapiens
aagccaaccagcct

SEQ ID NO: 3065743 - DNA, 15 bp, Homo sapiens
aagccaaccagcctt

SEQ ID NO: 3065744 - DNA, 18 bp, Homo sapiens
aagccaagaggctgcagc

SEQ ID NO: 3065745 - DNA, 22 bp, Homo sapiens
aagccaagaggctgcagccagg

SEQ ID NO: 3065746 - DNA, 14 bp, Homo sapiens
aagccaagcagcca

SEQ ID NO: 3065747 - DNA, 15 bp, Homo sapiens
aagccaagctgtgtt

SEQ ID NO: 3065748 - DNA, 17 bp, Homo sapiens
aagccaagctgtgttca

SEQ ID NO: 3065749 - DNA, 11 bp, Homo sapiens
aagccacagcc

SEQ ID NO: 3065750 - DNA, 19 bp, Homo sapiens
aagccaccctcccagctct

SEQ ID NO: 3065751 - DNA, 21 bp, Homo sapiens
aagccaccctcccagctctga

SEQ ID NO: 3065752 - DNA, 12 bp, Homo sapiens
aagccacccttc

SEQ ID NO: 3065753 - DNA, 15 bp, Homo sapiens
aagccacccttccct

SEQ ID NO: 3065754 - DNA, 16 bp, Homo sapiens
aagccacccttccctg

SEQ ID NO: 3065755 - DNA, 17 bp, Homo sapiens
aagccacccttccctgc

SEQ ID NO: 3065756 - DNA, 19 bp, Homo sapiens
aagccacccttccctgcct

SEQ ID NO: 3065757 - DNA, 20 bp, Homo sapiens
aagccacccttccctgcctc

SEQ ID NO: 3065758 - DNA, 13 bp, Homo sapiens
aagccaccgcagc

SEQ ID NO: 3065759 - DNA, 17 bp, Homo sapiens
aagccaccgcagctgct

SEQ ID NO: 3065760 - DNA, 19 bp, Homo sapiens
aagccaccgcagctgctgc

SEQ ID NO: 3065761 - DNA, 17 bp, Homo sapiens
aagccactggaaggagc

SEQ ID NO: 3065762 - DNA, 18 bp, Homo sapiens
aagccactggaaggagca

SEQ ID NO: 3065763 - DNA, 19 bp, Homo sapiens
aagccactggaaggagcac

SEQ ID NO: 3065764 - DNA, 12 bp, Homo sapiens
aagccagaagct

SEQ ID NO: 3065765 - DNA, 13 bp, Homo sapiens
aagccagaagctg

SEQ ID NO: 3065766 - DNA, 14 bp, Homo sapiens
aagccagagggtgg

SEQ ID NO: 3065767 - DNA, 18 bp, Homo sapiens
aagccagagggtgggagg

SEQ ID NO: 3065768 - DNA, 20 bp, Homo sapiens
aagccagagtggccacggcc

SEQ ID NO: 3065769 - DNA, 20 bp, Homo sapiens
aagccagcgtcctcctctgt

SEQ ID NO: 3065770 - DNA, 17 bp, Homo sapiens
aagccaggaaacatgaa

SEQ ID NO: 3065771 - DNA, 16 bp, Homo sapiens
aagccagtcatcatct

SEQ ID NO: 3065772 - DNA, 19 bp, Homo sapiens
aagccagtcatcatctctt

SEQ ID NO: 3065773 - DNA, 17 bp, Homo sapiens
aagccagttgcttcttc

SEQ ID NO: 3065774 - DNA, 16 bp, Homo sapiens
aagccatatggacact

SEQ ID NO: 3065775 - DNA, 17 bp, Homo sapiens
aagccatatggacactg

SEQ ID NO: 3065776 - DNA, 18 bp, Homo sapiens
aagccatatggacactgt

SEQ ID NO: 3065777 - DNA, 22 bp, Homo sapiens
aagccatatggacactgtgaca

SEQ ID NO: 3065778 - DNA, 15 bp, Homo sapiens
aagccatcttcccgc

SEQ ID NO: 3065779 - DNA, 22 bp, Homo sapiens
aagccatcttcccgcctcagcc

SEQ ID NO: 3065780 - DNA, 16 bp, Homo sapiens
cccctggccccgcctg

SEQ ID NO: 3065781 - DNA, 12 bp, Homo sapiens
cccctggcctct

SEQ ID NO: 3065782 - DNA, 14 bp, Homo sapiens
cccctggcctctgt

SEQ ID NO: 3065783 - DNA, 11 bp, Homo sapiens
cccctggctct

SEQ ID NO: 3065784 - DNA, 20 bp, Homo sapiens
cccctggggctgagtctcca

SEQ ID NO: 3065785 - DNA, 16 bp, Homo sapiens
cccctggggctggtgg

SEQ ID NO: 3065786 - DNA, 17 bp, Homo sapiens
cccctggggctggtgga

SEQ ID NO: 3065787 - DNA, 23 bp, Homo sapiens
cccctggggctggtggattgggc

SEQ ID NO: 3065788 - DNA, 15 bp, Homo sapiens
cccctgggtttcttt

SEQ ID NO: 3065789 - DNA, 13 bp, Homo sapiens
cccctgtcccctg

SEQ ID NO: 3065790 - DNA, 14 bp, Homo sapiens
cccctgtcccctgg

SEQ ID NO: 3065791 - DNA, 17 bp, Homo sapiens
cccctgtcccctggggc

SEQ ID NO: 3065792 - DNA, 11 bp, Homo sapiens
cccctgtgcag

SEQ ID NO: 3065793 - DNA, 24 bp, Homo sapiens
cccctgtgcctctgtcctagactc

SEQ ID NO: 3065794 - DNA, 14 bp, Homo sapiens
cccctgtgccttgt

SEQ ID NO: 3065795 - DNA, 19 bp, Homo sapiens
cccctgtggtaactttgca

SEQ ID NO: 3065796 - DNA, 11 bp, Homo sapiens
cccctgtgtag

SEQ ID NO: 3065797 - DNA, 13 bp, Homo sapiens
ccccttcagtgcc

SEQ ID NO: 3065798 - DNA, 17 bp, Homo sapiens
ccccttcctactcccag

SEQ ID NO: 3065799 - DNA, 13 bp, Homo sapiens
ccccttcctttta

SEQ ID NO: 3065800 - DNA, 19 bp, Homo sapiens
ccccttcgacatgctgcca

SEQ ID NO: 3065801 - DNA, 20 bp, Homo sapiens
ccccttctgctcagctctgg

SEQ ID NO: 3065802 - DNA, 21 bp, Homo sapiens
ccccttctgctcagctctggg

SEQ ID NO: 3065803 - DNA, 22 bp, Homo sapiens
ccccttcttgtgtcctggctgg

SEQ ID NO: 3065804 - DNA, 11 bp, Homo sapiens
ccccttgccct

SEQ ID NO: 3065805 - DNA, 16 bp, Homo sapiens
cccctttccccagcct

SEQ ID NO: 3065806 - DNA, 23 bp, Homo sapiens
cccctttccccagcctctcctcc

SEQ ID NO: 3065807 - DNA, 14 bp, Homo sapiens
cccctttgggccct

SEQ ID NO: 3065808 - DNA, 17 bp, Homo sapiens
cccctttgggccctgca

SEQ ID NO: 3065809 - DNA, 20 bp, Homo sapiens
cccctttgggccctgcatgt

SEQ ID NO: 3065810 - DNA, 14 bp, Homo sapiens
ccccttttctatgt

SEQ ID NO: 3065811 - DNA, 19 bp, Homo sapiens
ccccttttctatgttgcta

SEQ ID NO: 3065812 - DNA, 19 bp, Homo sapiens
cccgaaactccacccgttc

SEQ ID NO: 3065813 - DNA, 15 bp, Homo sapiens
cccgacaccagccct

SEQ ID NO: 3065814 - DNA, 15 bp, Homo sapiens
cccgacagagggaag

SEQ ID NO: 3065815 - DNA, 13 bp, Homo sapiens
cccgacggctgtg

SEQ ID NO: 3065816 - DNA, 15 bp, Homo sapiens
cccgacggctgtgac

SEQ ID NO: 3065817 - DNA, 13 bp, Homo sapiens
cccgagcctggct

SEQ ID NO: 3065818 - DNA, 15 bp, Homo sapiens
cccgagcctggctcc

SEQ ID NO: 3065819 - DNA, 17 bp, Homo sapiens
cccgaggaggggcccgg

SEQ ID NO: 3065820 - DNA, 13 bp, Homo sapiens
cccgaggccctgc

SEQ ID NO: 3065821 - DNA, 15 bp, Homo sapiens
cccgaggctgcccca

SEQ ID NO: 3065822 - DNA, 16 bp, Homo sapiens
cccgaggctgccccag

SEQ ID NO: 3065823 - DNA, 17 bp, Homo sapiens
cccgaggctgccccagg

SEQ ID NO: 3065824 - DNA, 15 bp, Homo sapiens
cccgcaccctggcct

SEQ ID NO: 3065825 - DNA, 21 bp, Homo sapiens
cccgcagacctctggattagg

SEQ ID NO: 3065826 - DNA, 16 bp, Homo sapiens
cccgcagccctggcag

SEQ ID NO: 3065827 - DNA, 22 bp, Homo sapiens
cccgcagcctggcatctgtgcg

SEQ ID NO: 3065828 - DNA, 23 bp, Homo sapiens
cccgcagcctggcatctgtgcgt

SEQ ID NO: 3065829 - DNA, 15 bp, Homo sapiens
cccgcattccaggct

SEQ ID NO: 3065830 - DNA, 21 bp, Homo sapiens
cccgcccagaggagcccagcg

SEQ ID NO: 3065831 - DNA, 14 bp, Homo sapiens
cccgccccctccct

SEQ ID NO: 3065832 - DNA, 21 bp, Homo sapiens
cccgccccgggctggccctgt

SEQ ID NO: 3065833 - DNA, 15 bp, Homo sapiens
cccgccctctctcat

SEQ ID NO: 3065834 - DNA, 18 bp, Homo sapiens
cccgccgcctggtactca

SEQ ID NO: 3065835 - DNA, 14 bp, Homo sapiens
cccgcctcagcctc

SEQ ID NO: 3065836 - DNA, 14 bp, Homo sapiens
cccgcctgcctcct

SEQ ID NO: 3065837 - DNA, 15 bp, Homo sapiens
cccgcctgcctcctg

SEQ ID NO: 3065838 - DNA, 18 bp, Homo sapiens
cccgcgcccccaccccag

SEQ ID NO: 3065839 - DNA, 14 bp, Homo sapiens
cccgcgccctccct

SEQ ID NO: 3065840 - DNA, 16 bp, Homo sapiens
cccgcggcctgcaccg

SEQ ID NO: 3065841 - DNA, 12 bp, Homo sapiens
cccgcggcctgg

SEQ ID NO: 3065842 - DNA, 13 bp, Homo sapiens
cccgcggcctgga

SEQ ID NO: 3065843 - DNA, 17 bp, Homo sapiens
cccgcgggcacagccag

SEQ ID NO: 3065844 - DNA, 18 bp, Homo sapiens
cccgcgggcacagccagc

SEQ ID NO: 3065845 - DNA, 21 bp, Homo sapiens
cccgcggggacattgggaagg

SEQ ID NO: 3065846 - DNA, 21 bp, Homo sapiens
cccgcgtgtccccggggccca

SEQ ID NO: 3065847 - DNA, 23 bp, Homo sapiens
cccgctctgccgccgcccgctgg

SEQ ID NO: 3065848 - DNA, 16 bp, Homo sapiens
cccgctgtgtcctccc

SEQ ID NO: 3065849 - DNA, 17 bp, Homo sapiens
cccgctgtgtcctccct

SEQ ID NO: 3065850 - DNA, 18 bp, Homo sapiens
cccgctgtgtcctccctc

SEQ ID NO: 3065851 - DNA, 14 bp, Homo sapiens
cccggagctggagg

SEQ ID NO: 3065852 - DNA, 17 bp, Homo sapiens
cccggagggaaactgtg

SEQ ID NO: 3065853 - DNA, 19 bp, Homo sapiens
cccggattggccctgcccc

SEQ ID NO: 3065854 - DNA, 21 bp, Homo sapiens
cccggattggccctgcccctc

SEQ ID NO: 3065855 - DNA, 14 bp, Homo sapiens
cccggcagggcggg

SEQ ID NO: 3065856 - DNA, 11 bp, Homo sapiens
cccggccagcc

SEQ ID NO: 3065857 - DNA, 13 bp, Homo sapiens
cccggcccctcac

SEQ ID NO: 3065858 - DNA, 16 bp, Homo sapiens
cccggcgcctgccctg

SEQ ID NO: 3065859 - DNA, 23 bp, Homo sapiens
cccggcgcctgccctgcccaagt

SEQ ID NO: 3065860 - DNA, 20 bp, Homo sapiens
cccggcgcctggcctccagg

SEQ ID NO: 3065861 - DNA, 17 bp, Homo sapiens
cccggctcggcccagca

SEQ ID NO: 3065862 - DNA, 20 bp, Homo sapiens
cccggctctacgggggccgc

SEQ ID NO: 3065863 - DNA, 16 bp, Homo sapiens
cccggctgaccctgtg

SEQ ID NO: 3065864 - DNA, 17 bp, Homo sapiens
cccggctgaccctgtgc

SEQ ID NO: 3065865 - DNA, 20 bp, Homo sapiens
cccggcttcctttcccaagc

SEQ ID NO: 3065866 - DNA, 12 bp, Homo sapiens
cccgggaaggaa

SEQ ID NO: 3065867 - DNA, 16 bp, Homo sapiens
cccgggacaccgtggg

SEQ ID NO: 3065868 - DNA, 24 bp, Homo sapiens
cccgggactcactggcagccccag

SEQ ID NO: 3065869 - DNA, 13 bp, Homo sapiens
cccgggaggcaga

SEQ ID NO: 3065870 - DNA, 15 bp, Homo sapiens
cccgggatcctgccc

SEQ ID NO: 3065871 - DNA, 15 bp, Homo sapiens
cccgggatgggtgga

SEQ ID NO: 3065872 - DNA, 16 bp, Homo sapiens
cccgggccgaccctgc

SEQ ID NO: 3065873 - DNA, 14 bp, Homo sapiens
cccgggccggacct

SEQ ID NO: 3065874 - DNA, 12 bp, Homo sapiens
cccgggctggcc

SEQ ID NO: 3065875 - DNA, 13 bp, Homo sapiens
cccgggctggccc

SEQ ID NO: 3065876 - DNA, 14 bp, Homo sapiens
cccgggctggccct

SEQ ID NO: 3065877 - DNA, 18 bp, Homo sapiens
cccgggctggccctgtgc

SEQ ID NO: 3065878 - DNA, 14 bp, Homo sapiens
cccggggccagcac

SEQ ID NO: 3065879 - DNA, 16 bp, Homo sapiens
cccggggccagcactt

SEQ ID NO: 3065880 - DNA, 15 bp, Homo sapiens
cccggggcccagggg

SEQ ID NO: 3065881 - DNA, 14 bp, Homo sapiens
cccggggtctcctg

SEQ ID NO: 3065882 - DNA, 15 bp, Homo sapiens
cccggggtctcctgg

SEQ ID NO: 3065883 - DNA, 21 bp, Homo sapiens
cccggggtgcccacaggccgc

SEQ ID NO: 3065884 - DNA, 17 bp, Homo sapiens
cccggtggcggcagggc

SEQ ID NO: 3065885 - DNA, 12 bp, Homo sapiens
cccgtcggagct

SEQ ID NO: 3065886 - DNA, 15 bp, Homo sapiens
cccgtcggagctgcc

SEQ ID NO: 3065887 - DNA, 18 bp, Homo sapiens
cccgtcggagctgcctgc

SEQ ID NO: 3065888 - DNA, 19 bp, Homo sapiens
cccgtcggagctgcctgca

SEQ ID NO: 3065889 - DNA, 20 bp, Homo sapiens
cccgtcggagctgcctgcag

SEQ ID NO: 3065890 - DNA, 14 bp, Homo sapiens
cccgtctctactaa

SEQ ID NO: 3065891 - DNA, 20 bp, Homo sapiens
cccgtctggggttcagcccc

SEQ ID NO: 3065892 - DNA, 21 bp, Homo sapiens
cccgtctggggttcagcccct

SEQ ID NO: 3065893 - DNA, 11 bp, Homo sapiens
cccgtctgtcc

SEQ ID NO: 3065894 - DNA, 16 bp, Homo sapiens
cccgtgacagtggctg

SEQ ID NO: 3065895 - DNA, 16 bp, Homo sapiens
cccgtgacgaggctca

SEQ ID NO: 3065896 - DNA, 17 bp, Homo sapiens
cccgtgacgaggctcaa

SEQ ID NO: 3065897 - DNA, 21 bp, Homo sapiens
cccgtgaggatgtcactcaga

SEQ ID NO: 3065898 - DNA, 11 bp, Homo sapiens
cccgtgcctgg

SEQ ID NO: 3065899 - DNA, 19 bp, Homo sapiens
cccgtgcctgggcccctcc

SEQ ID NO: 3065900 - DNA, 11 bp, Homo sapiens
cccgtggcctg

SEQ ID NO: 3065901 - DNA, 17 bp, Homo sapiens
cccgtggcctggcatct

SEQ ID NO: 3065902 - DNA, 19 bp, Homo sapiens
cccgtggcttggcatctgt

SEQ ID NO: 3065903 - DNA, 14 bp, Homo sapiens
cccgtgggctcccg

SEQ ID NO: 3065904 - DNA, 20 bp, Homo sapiens
ccctaacttcgtattttttg

SEQ ID NO: 3065905 - DNA, 13 bp, Homo sapiens
ccctaagggcagc

SEQ ID NO: 3065906 - DNA, 15 bp, Homo sapiens
ccctaagggcagccc

SEQ ID NO: 3065907 - DNA, 16 bp, Homo sapiens
ccctaattcagccatg

SEQ ID NO: 3065908 - DNA, 17 bp, Homo sapiens
ccctaattcatctttta

SEQ ID NO: 3065909 - DNA, 20 bp, Homo sapiens
ccctaccacacatctgtgga

SEQ ID NO: 3065910 - DNA, 18 bp, Homo sapiens
ccctaccccctcatcccc

SEQ ID NO: 3065911 - DNA, 23 bp, Homo sapiens
ccctaccgcatggcagctgggcc

SEQ ID NO: 3065912 - DNA, 14 bp, Homo sapiens
ccctacggaccagg

SEQ ID NO: 3065913 - DNA, 23 bp, Homo sapiens
ccctactattcagtggcgagaaa

SEQ ID NO: 3065914 - DNA, 14 bp, Homo sapiens
cccttcctcctcca

SEQ ID NO: 3065915 - DNA, 19 bp, Homo sapiens
cccttcctcctccaccacc

SEQ ID NO: 3065916 - DNA, 16 bp, Homo sapiens
cccttccttgggcaga

SEQ ID NO: 3065917 - DNA, 17 bp, Homo sapiens
cccttcgctctgctgga

SEQ ID NO: 3065918 - DNA, 23 bp, Homo sapiens
cccttctagggttattgcatttg

SEQ ID NO: 3065919 - DNA, 20 bp, Homo sapiens
cccttctcctcttgtaaata

SEQ ID NO: 3065920 - DNA, 13 bp, Homo sapiens
cccttctctgtga

SEQ ID NO: 3065921 - DNA, 19 bp, Homo sapiens
cccttctctgtgacccact

SEQ ID NO: 3065922 - DNA, 18 bp, Homo sapiens
cccttctgctttctatta

SEQ ID NO: 3065923 - DNA, 16 bp, Homo sapiens
cccttctgtccctcac

SEQ ID NO: 3065924 - DNA, 17 bp, Homo sapiens
cccttcttgtgtcctgg

SEQ ID NO: 3065925 - DNA, 15 bp, Homo sapiens
cccttgaccattggc

SEQ ID NO: 3065926 - DNA, 13 bp, Homo sapiens
cccttgagacctc

SEQ ID NO: 3065927 - DNA, 14 bp, Homo sapiens
cccttgagacctca

SEQ ID NO: 3065928 - DNA, 17 bp, Homo sapiens
cccttgagacctcagcc

SEQ ID NO: 3065929 - DNA, 14 bp, Homo sapiens
cccttgagccctcc

SEQ ID NO: 3065930 - DNA, 22 bp, Homo sapiens
cccttgaggaaacaacagcttt

SEQ ID NO: 3065931 - DNA, 20 bp, Homo sapiens
cccttgagtaggccctgctt

SEQ ID NO: 3065932 - DNA, 21 bp, Homo sapiens
cccttgagtaggccctgcttt

SEQ ID NO: 3065933 - DNA, 13 bp, Homo sapiens
cccttgcagcctg

SEQ ID NO: 3065934 - DNA, 21 bp, Homo sapiens
cccttgccatcccaagcccag

SEQ ID NO: 3065935 - DNA, 14 bp, Homo sapiens
cccttgcccttcct

SEQ ID NO: 3065936 - DNA, 18 bp, Homo sapiens
cccttgcccttcctgacc

SEQ ID NO: 3065937 - DNA, 19 bp, Homo sapiens
cccttgcccttcctgaccc

SEQ ID NO: 3065938 - DNA, 18 bp, Homo sapiens
cccttgcttgcctgcagg

SEQ ID NO: 3065939 - DNA, 19 bp, Homo sapiens
cccttgcttgcctgcaggg

SEQ ID NO: 3065940 - DNA, 13 bp, Homo sapiens
cccttggaggcca

SEQ ID NO: 3065941 - DNA, 15 bp, Homo sapiens
cccttggaggccagc

SEQ ID NO: 3065942 - DNA, 19 bp, Homo sapiens
cccttggggtggcgcgcct

SEQ ID NO: 3065943 - DNA, 22 bp, Homo sapiens
cccttggggtggcgcgcctgcc

SEQ ID NO: 3065944 - DNA, 18 bp, Homo sapiens
cccttggtagagtttatt

SEQ ID NO: 3065945 - DNA, 19 bp, Homo sapiens
cccttgtgtgtaccacacc

SEQ ID NO: 3065946 - DNA, 23 bp, Homo sapiens
cccttgtgtgtaccacaccctgc

SEQ ID NO: 3065947 - DNA, 15 bp, Homo sapiens
cccttgtgttccttc

SEQ ID NO: 3065948 - DNA, 21 bp, Homo sapiens
cccttgtgttccttctgtgaa

SEQ ID NO: 3065949 - DNA, 21 bp, Homo sapiens
cccttgttttgaaactagaaa

SEQ ID NO: 3065950 - DNA, 18 bp, Homo sapiens
ccctttccttccttccct

SEQ ID NO: 3065951 - DNA, 12 bp, Homo sapiens
ccctttgagtgc

SEQ ID NO: 3065952 - DNA, 14 bp, Homo sapiens
ccctttgccttcat

SEQ ID NO: 3065953 - DNA, 13 bp, Homo sapiens
ccctttgggccct

SEQ ID NO: 3065954 - DNA, 18 bp, Homo sapiens
ccctttgggccctgcatg

SEQ ID NO: 3065955 - DNA, 20 bp, Homo sapiens
ccctttgggccctgcatgta

SEQ ID NO: 3065956 - DNA, 16 bp, Homo sapiens
ccctttggttttacta

SEQ ID NO: 3065957 - DNA, 16 bp, Homo sapiens
ccgaacctcctctgtg

SEQ ID NO: 3065958 - DNA, 15 bp, Homo sapiens
ccgaactccaggctg

SEQ ID NO: 3065959 - DNA, 13 bp, Homo sapiens
ccgaagtcttttg

SEQ ID NO: 3065960 - DNA, 16 bp, Homo sapiens
ccgaattgagcacaaa

SEQ ID NO: 3065961 - DNA, 18 bp, Homo sapiens
ccgacaccactcctgcca

SEQ ID NO: 3065962 - DNA, 21 bp, Homo sapiens
ccgacaccactcctgccagcc

SEQ ID NO: 3065963 - DNA, 22 bp, Homo sapiens
ccgacaccactcctgccagccc

SEQ ID NO: 3065964 - DNA, 14 bp, Homo sapiens
ccgacactgttctc

SEQ ID NO: 3065965 - DNA, 13 bp, Homo sapiens
ccgacagagggaa

SEQ ID NO: 3065966 - DNA, 13 bp, Homo sapiens
ccgacatggctcc

SEQ ID NO: 3065967 - DNA, 20 bp, Homo sapiens
ccgacccccgcagaggcaga

SEQ ID NO: 3065968 - DNA, 16 bp, Homo sapiens
ccgaccccgggccgga

SEQ ID NO: 3065969 - DNA, 15 bp, Homo sapiens
ccgacccgaggccca

SEQ ID NO: 3065970 - DNA, 17 bp, Homo sapiens
ccgacccgaggcccaga

SEQ ID NO: 3065971 - DNA, 13 bp, Homo sapiens
ccgacctctctcg

SEQ ID NO: 3065972 - DNA, 21 bp, Homo sapiens
ccgactcccccaaccaaggaa

SEQ ID NO: 3065973 - DNA, 23 bp, Homo sapiens
ccgactcccccaaccaaggaagg

SEQ ID NO: 3065974 - DNA, 12 bp, Homo sapiens
ccgactgcctgt

SEQ ID NO: 3065975 - DNA, 13 bp, Homo sapiens
ccgactgcctgtc

SEQ ID NO: 3065976 - DNA, 14 bp, Homo sapiens
ccgactgcctgtct

SEQ ID NO: 3065977 - DNA, 19 bp, Homo sapiens
ccgactgcctgtctccatg

SEQ ID NO: 3065978 - DNA, 22 bp, Homo sapiens
ccgactgcgctgctttttcaaa

SEQ ID NO: 3065979 - DNA, 19 bp, Homo sapiens
ccgagaagcaagaaagaaa

SEQ ID NO: 3065980 - DNA, 13 bp, Homo sapiens
ccgagaaggttta

SEQ ID NO: 3065981 - DNA, 20 bp, Homo sapiens
ccgagacagaccctctgccg

SEQ ID NO: 3065982 - DNA, 20 bp, Homo sapiens
ccgagagcctgctcccccac

SEQ ID NO: 3065983 - DNA, 20 bp, Homo sapiens
ccgagagtagccgagagcct

SEQ ID NO: 3065984 - DNA, 22 bp, Homo sapiens
ccgagagtagccgagagcctgc

SEQ ID NO: 3065985 - DNA, 21 bp, Homo sapiens
ccgagagtccatcagcctcca

SEQ ID NO: 3065986 - DNA, 14 bp, Homo sapiens
ccgagccaccccag

SEQ ID NO: 3065987 - DNA, 23 bp, Homo sapiens
ccgagctctgtgggaaaaaagaa

SEQ ID NO: 3065988 - DNA, 17 bp, Homo sapiens
ccgagctgaggactctg

SEQ ID NO: 3065989 - DNA, 14 bp, Homo sapiens
ccgaggaaactcag

SEQ ID NO: 3065990 - DNA, 19 bp, Homo sapiens
ccgaggaactcgcctcagc

SEQ ID NO: 3065991 - DNA, 15 bp, Homo sapiens
ccgaggcagggaagg

SEQ ID NO: 3065992 - DNA, 21 bp, Homo sapiens
ccgaggcccagatccaaggcc

SEQ ID NO: 3065993 - DNA, 11 bp, Homo sapiens
ccgaggccctg

SEQ ID NO: 3065994 - DNA, 13 bp, Homo sapiens
ccgaggccctgca

SEQ ID NO: 3065995 - DNA, 15 bp, Homo sapiens
ccgaggctgccccag

SEQ ID NO: 3065996 - DNA, 18 bp, Homo sapiens
ccgaggctgccccaggcc

SEQ ID NO: 3065997 - DNA, 19 bp, Homo sapiens
ccgaggctgccccaggccg

SEQ ID NO: 3065998 - DNA, 19 bp, Homo sapiens
ccgagggctcagaagagca

SEQ ID NO: 3065999 - DNA, 21 bp, Homo sapiens
ccgagggttgattaaggcagt

SEQ ID NO: 3066000 - DNA, 22 bp, Homo sapiens
ccgagggttgattaaggcagta

SEQ ID NO: 3066001 - DNA, 16 bp, Homo sapiens
ccgaggtggctgcctg

SEQ ID NO: 3066002 - DNA, 17 bp, Homo sapiens
ccgaggttgtggggagg

SEQ ID NO: 3066003 - DNA, 21 bp, Homo sapiens
ccgagtacaaggacagacagc

SEQ ID NO: 3066004 - DNA, 19 bp, Homo sapiens
ccgagtagctgggattaca

SEQ ID NO: 3066005 - DNA, 23 bp, Homo sapiens
ccgagtgcggcgtggagactggc

SEQ ID NO: 3066006 - DNA, 22 bp, Homo sapiens
ccgagtggtctcctctcagctt

SEQ ID NO: 3066007 - DNA, 21 bp, Homo sapiens
ccgatgctgacctcacctggt

SEQ ID NO: 3066008 - DNA, 22 bp, Homo sapiens
ccgatgctttaccaaacagcaa

SEQ ID NO: 3066009 - DNA, 16 bp, Homo sapiens
ccgattcacctgagca

SEQ ID NO: 3066010 - DNA, 13 bp, Homo sapiens
ccgcaagggcctg

SEQ ID NO: 3066011 - DNA, 14 bp, Homo sapiens
ccgcaagggcctgg

SEQ ID NO: 3066012 - DNA, 16 bp, Homo sapiens
ccgcaagggcctggac

SEQ ID NO: 3066013 - DNA, 17 bp, Homo sapiens
ccgcacacctctggctg

SEQ ID NO: 3066014 - DNA, 14 bp, Homo sapiens
ccgcacatgaaaca

SEQ ID NO: 3066015 - DNA, 11 bp, Homo sapiens
ccgcaccccag

SEQ ID NO: 3066016 - DNA, 17 bp, Homo sapiens
ccgcaccccagagtgtg

SEQ ID NO: 3066017 - DNA, 14 bp, Homo sapiens
ccgcaccctggcct

SEQ ID NO: 3066018 - DNA, 18 bp, Homo sapiens
ccgcaccctggcctggtc

SEQ ID NO: 3066019 - DNA, 14 bp, Homo sapiens
ccgcaccttcctcc

SEQ ID NO: 3066020 - DNA, 20 bp, Homo sapiens
ccgcaccttcctcctccccg

SEQ ID NO: 3066021 - DNA, 15 bp, Homo sapiens
ccgcacttggaaagg

SEQ ID NO: 3066022 - DNA, 14 bp, Homo sapiens
ccgcagactgcttg

SEQ ID NO: 3066023 - DNA, 20 bp, Homo sapiens
ccgcagactgcttggccaga

SEQ ID NO: 3066024 - DNA, 21 bp, Homo sapiens
ccgcagactgcttggccagat

SEQ ID NO: 3066025 - DNA, 18 bp, Homo sapiens
ccgcagcggtgggaagga

SEQ ID NO: 3066026 - DNA, 15 bp, Homo sapiens
ccgcagctgctgcca

SEQ ID NO: 3066027 - DNA, 16 bp, Homo sapiens
ccgcagctgctgccac

SEQ ID NO: 3066028 - DNA, 17 bp, Homo sapiens
ccgcagctgctgccact

SEQ ID NO: 3066029 - DNA, 19 bp, Homo sapiens
ccgcagctgctgccactct

SEQ ID NO: 3066030 - DNA, 22 bp, Homo sapiens
ccgcagctgctgccactctgct

SEQ ID NO: 3066031 - DNA, 12 bp, Homo sapiens
ccgcaggaagct

SEQ ID NO: 3066032 - DNA, 14 bp, Homo sapiens
ccgcaggaagctgc

SEQ ID NO: 3066033 - DNA, 20 bp, Homo sapiens
ccgcaggcctgccttctcag

SEQ ID NO: 3066034 - DNA, 22 bp, Homo sapiens
ccgcaggcctgccttctcaggg

SEQ ID NO: 3066035 - DNA, 24 bp, Homo sapiens
ccgcaggcgcggcggctctgccca

SEQ ID NO: 3066036 - DNA, 14 bp, Homo sapiens
ccgcataagaaaaa

SEQ ID NO: 3066037 - DNA, 18 bp, Homo sapiens
ccgcataagaaaaagaat

SEQ ID NO: 3066038 - DNA, 22 bp, Homo sapiens
ccgcatccctgcttctggcgcc

SEQ ID NO: 3066039 - DNA, 20 bp, Homo sapiens
ccgcatggcagctgggccca

SEQ ID NO: 3066040 - DNA, 23 bp, Homo sapiens
ccgcattcagtgcacctgcctca

SEQ ID NO: 3066041 - DNA, 20 bp, Homo sapiens
ccgccagcagcgcgcaggcc

SEQ ID NO: 3066042 - DNA, 19 bp, Homo sapiens
ccgccagccccgctcccac

SEQ ID NO: 3066043 - DNA, 14 bp, Homo sapiens
ccgccagtgtttct

SEQ ID NO: 3066044 - DNA, 20 bp, Homo sapiens
ccgcccagaggagcccagcg

SEQ ID NO: 3066045 - DNA, 14 bp, Homo sapiens
ccgcccatgcactg

SEQ ID NO: 3066046 - DNA, 19 bp, Homo sapiens
cctagctcctcctcctggg

SEQ ID NO: 3066047 - DNA, 20 bp, Homo sapiens
cctagctcctcctcctgggc

SEQ ID NO: 3066048 - DNA, 18 bp, Homo sapiens
cctagctcttgggcctga

SEQ ID NO: 3066049 - DNA, 21 bp, Homo sapiens
cctagctcttgggcctgacct

SEQ ID NO: 3066050 - DNA, 14 bp, Homo sapiens
cctagctgctacaa

SEQ ID NO: 3066051 - DNA, 20 bp, Homo sapiens
cctagcttatctccctgctt

SEQ ID NO: 3066052 - DNA, 15 bp, Homo sapiens
cctaggaggactggg

SEQ ID NO: 3066053 - DNA, 17 bp, Homo sapiens
cctaggattccccctgc

SEQ ID NO: 3066054 - DNA, 21 bp, Homo sapiens
cctaggattccccctgccctg

SEQ ID NO: 3066055 - DNA, 23 bp, Homo sapiens
cctaggattccccctgccctgtg

SEQ ID NO: 3066056 - DNA, 14 bp, Homo sapiens
cctaggccactcct

SEQ ID NO: 3066057 - DNA, 17 bp, Homo sapiens
cctaggccactcctcca

SEQ ID NO: 3066058 - DNA, 11 bp, Homo sapiens
cctaggccctt

SEQ ID NO: 3066059 - DNA, 14 bp, Homo sapiens
cctaggcctcagcc

SEQ ID NO: 3066060 - DNA, 18 bp, Homo sapiens
cctagggaacagaaattg

SEQ ID NO: 3066061 - DNA, 16 bp, Homo sapiens
cctaggggccagggct

SEQ ID NO: 3066062 - DNA, 17 bp, Homo sapiens
cctaggggcttggtcct

SEQ ID NO: 3066063 - DNA, 19 bp, Homo sapiens
cctaggtgcagctcctcag

SEQ ID NO: 3066064 - DNA, 14 bp, Homo sapiens
cctaggttttgaga

SEQ ID NO: 3066065 - DNA, 21 bp, Homo sapiens
cctaggttttgagatttagag

SEQ ID NO: 3066066 - DNA, 16 bp, Homo sapiens
cctagtaactgctgtc

SEQ ID NO: 3066067 - DNA, 17 bp, Homo sapiens
cctagtatgaaagctgg

SEQ ID NO: 3066068 - DNA, 20 bp, Homo sapiens
cctagtatgaaagctggggg

SEQ ID NO: 3066069 - DNA, 13 bp, Homo sapiens
cctagtcgacact

SEQ ID NO: 3066070 - DNA, 21 bp, Homo sapiens
cctagtctctatcattaaagt

SEQ ID NO: 3066071 - DNA, 18 bp, Homo sapiens
cctagtgaaggcttctct

SEQ ID NO: 3066072 - DNA, 15 bp, Homo sapiens
cctagtgatgtagaa

SEQ ID NO: 3066073 - DNA, 12 bp, Homo sapiens
cctagtgcccca

SEQ ID NO: 3066074 - DNA, 16 bp, Homo sapiens
cctagtgccccagact

SEQ ID NO: 3066075 - DNA, 24 bp, Homo sapiens
cctagtgccccagactgagctctc

SEQ ID NO: 3066076 - DNA, 15 bp, Homo sapiens
cctagtggcttgtcc

SEQ ID NO: 3066077 - DNA, 17 bp, Homo sapiens
cctagtggggtctccct

SEQ ID NO: 3066078 - DNA, 22 bp, Homo sapiens
cctagtggtgtcatttttgaat

SEQ ID NO: 3066079 - DNA, 16 bp, Homo sapiens
cctagttagcatccag

SEQ ID NO: 3066080 - DNA, 14 bp, Homo sapiens
cctagttctcttat

SEQ ID NO: 3066081 - DNA, 23 bp, Homo sapiens
cctataaaacaggtcaatacagt

SEQ ID NO: 3066082 - DNA, 16 bp, Homo sapiens
cctataaaatgcccat

SEQ ID NO: 3066083 - DNA, 11 bp, Homo sapiens
cctataaattt

SEQ ID NO: 3066084 - DNA, 22 bp, Homo sapiens
cctatacgcagcgtgctttaaa

SEQ ID NO: 3066085 - DNA, 14 bp, Homo sapiens
cctatattccttgt

SEQ ID NO: 3066086 - DNA, 17 bp, Homo sapiens
cctatcacctatttcca

SEQ ID NO: 3066087 - DNA, 13 bp, Homo sapiens
cctatcccacctc

SEQ ID NO: 3066088 - DNA, 21 bp, Homo sapiens
cctatcctggttagaagaaaa

SEQ ID NO: 3066089 - DNA, 19 bp, Homo sapiens
cctatctgtgattccccca

SEQ ID NO: 3066090 - DNA, 15 bp, Homo sapiens
cctatcttgtgaagt

SEQ ID NO: 3066091 - DNA, 14 bp, Homo sapiens
cctatgcacatatg

SEQ ID NO: 3066092 - DNA, 23 bp, Homo sapiens
cctatggcagaaaaaatgtctgt

SEQ ID NO: 3066093 - DNA, 22 bp, Homo sapiens
cctatgtaagaattcagaagac

SEQ ID NO: 3066094 - DNA, 17 bp, Homo sapiens
cctatgtgattttaact

SEQ ID NO: 3066095 - DNA, 22 bp, Homo sapiens
cctatgtgattttaactctgtc

SEQ ID NO: 3066096 - DNA, 23 bp, Homo sapiens
cctatgtgattttaactctgtct

SEQ ID NO: 3066097 - DNA, 22 bp, Homo sapiens
cctatgttgatccatccagctt

SEQ ID NO: 3066098 - DNA, 22 bp, Homo sapiens
cctatgtttttgttcaaagcca

SEQ ID NO: 3066099 - DNA, 19 bp, Homo sapiens
cctattaaaagttgcaaag

SEQ ID NO: 3066100 - DNA, 15 bp, Homo sapiens
cctatttcagtactt

SEQ ID NO: 3066101 - DNA, 20 bp, Homo sapiens
cctatttcagtacttcagca

SEQ ID NO: 3066102 - DNA, 15 bp, Homo sapiens
cctatttttaaataa

SEQ ID NO: 3066103 - DNA, 16 bp, Homo sapiens
cctcaactaaccctta

SEQ ID NO: 3066104 - DNA, 18 bp, Homo sapiens
cctcaagccatcttcccg

SEQ ID NO: 3066105 - DNA, 23 bp, Homo sapiens
cctcaaggttttaggttctaaag

SEQ ID NO: 3066106 - DNA, 16 bp, Homo sapiens
cctcaagtagcactga

SEQ ID NO: 3066107 - DNA, 15 bp, Homo sapiens
cctcaagtcttgaca

SEQ ID NO: 3066108 - DNA, 13 bp, Homo sapiens
cctcaatccagct

SEQ ID NO: 3066109 - DNA, 18 bp, Homo sapiens
cctcaatctcaatcctgc

SEQ ID NO: 3066110 - DNA, 13 bp, Homo sapiens
cctcacaactcct

SEQ ID NO: 3066111 - DNA, 20 bp, Homo sapiens
cctcacaactccttccatcc

SEQ ID NO: 3066112 - DNA, 11 bp, Homo sapiens
cctcacacagc

SEQ ID NO: 3066113 - DNA, 13 bp, Homo sapiens
cctcacagactct

SEQ ID NO: 3066114 - DNA, 17 bp, Homo sapiens
cctcacagactcttcca

SEQ ID NO: 3066115 - DNA, 24 bp, Homo sapiens
cctcacagactcttccaccagagc

SEQ ID NO: 3066116 - DNA, 15 bp, Homo sapiens
cctcacagatgctgg

SEQ ID NO: 3066117 - DNA, 16 bp, Homo sapiens
cctcacagatgctggc

SEQ ID NO: 3066118 - DNA, 17 bp, Homo sapiens
cctcacagatgctggcc

SEQ ID NO: 3066119 - DNA, 21 bp, Homo sapiens
cctcacagatgctggcctctt

SEQ ID NO: 3066120 - DNA, 22 bp, Homo sapiens
cctcacagatgctggcctcttg

SEQ ID NO: 3066121 - DNA, 16 bp, Homo sapiens
cctcacatctcccttc

SEQ ID NO: 3066122 - DNA, 13 bp, Homo sapiens
cctcaccccagct

SEQ ID NO: 3066123 - DNA, 18 bp, Homo sapiens
cctcaccccgaggccctg

SEQ ID NO: 3066124 - DNA, 22 bp, Homo sapiens
cctcaccccgaggccctgcatg

SEQ ID NO: 3066125 - DNA, 13 bp, Homo sapiens
cctcaccctctgt

SEQ ID NO: 3066126 - DNA, 17 bp, Homo sapiens
cctcaccctctgtcccc

SEQ ID NO: 3066127 - DNA, 14 bp, Homo sapiens
cctcacctctttgt

SEQ ID NO: 3066128 - DNA, 16 bp, Homo sapiens
cctcacctggtacctg

SEQ ID NO: 3066129 - DNA, 14 bp, Homo sapiens
cctcacctggtcct

SEQ ID NO: 3066130 - DNA, 21 bp, Homo sapiens
cctcaccttggcaccagacac

SEQ ID NO: 3066131 - DNA, 17 bp, Homo sapiens
cctcacgcacctcccat

SEQ ID NO: 3066132 - DNA, 13 bp, Homo sapiens
cctcacgtgcagg

SEQ ID NO: 3066133 - DNA, 16 bp, Homo sapiens
cctcacgtgcaggaca

SEQ ID NO: 3066134 - DNA, 23 bp, Homo sapiens
cctcacgtgcaggacagctcttg

SEQ ID NO: 3066135 - DNA, 20 bp, Homo sapiens
cctcactactcgagcccacc

SEQ ID NO: 3066136 - DNA, 23 bp, Homo sapiens
cctcactccctaggcccaagtct

SEQ ID NO: 3066137 - DNA, 20 bp, Homo sapiens
cctcactcttcctcatcctg

SEQ ID NO: 3066138 - DNA, 12 bp, Homo sapiens
cctcactcttga

SEQ ID NO: 3066139 - DNA, 12 bp, Homo sapiens
cctcactggctc

SEQ ID NO: 3066140 - DNA, 21 bp, Homo sapiens
cctcacttggtctgccaggcc

SEQ ID NO: 3066141 - DNA, 13 bp, Homo sapiens
cctcagaagaaaa

SEQ ID NO: 3066142 - DNA, 14 bp, Homo sapiens
cctcagaagaaaac

SEQ ID NO: 3066143 - DNA, 19 bp, Homo sapiens
cctcagaagaaaacaaagt

SEQ ID NO: 3066144 - DNA, 14 bp, Homo sapiens
cctcagagcccatg

SEQ ID NO: 3066145 - DNA, 16 bp, Homo sapiens
cctcagagcccatggt

SEQ ID NO: 3066146 - DNA, 14 bp, Homo sapiens
cctcagagtgcaag

SEQ ID NO: 3066147 - DNA, 22 bp, Homo sapiens
cctcagatgcgttcgcctctgg

SEQ ID NO: 3066148 - DNA, 15 bp, Homo sapiens
cctcagattttatat

SEQ ID NO: 3066149 - DNA, 16 bp, Homo sapiens
cctcagccagagaagc

SEQ ID NO: 3066150 - DNA, 17 bp, Homo sapiens
cctcagccagagaagct

SEQ ID NO: 3066151 - DNA, 16 bp, Homo sapiens
cctcagccatgaggag

SEQ ID NO: 3066152 - DNA, 17 bp, Homo sapiens
cctcagccctgaccctg

SEQ ID NO: 3066153 - DNA, 19 bp, Homo sapiens
cctcagccgtcagccatca

SEQ ID NO: 3066154 - DNA, 19 bp, Homo sapiens
cctcagcctcccaaagtgc

SEQ ID NO: 3066155 - DNA, 16 bp, Homo sapiens
cctcagcctggccaga

SEQ ID NO: 3066156 - DNA, 19 bp, Homo sapiens
cctcagcctggccagacac

SEQ ID NO: 3066157 - DNA, 20 bp, Homo sapiens
cctcagccttgccagagatc

SEQ ID NO: 3066158 - DNA, 21 bp, Homo sapiens
cctcagccttgccagagatcc

SEQ ID NO: 3066159 - DNA, 16 bp, Homo sapiens
cctcagcggaccactc

SEQ ID NO: 3066160 - DNA, 20 bp, Homo sapiens
cctcagcgggggccttgaag

SEQ ID NO: 3066161 - DNA, 13 bp, Homo sapiens
cctcagctgctcc

SEQ ID NO: 3066162 - DNA, 19 bp, Homo sapiens
cctcagctgctcccacact

SEQ ID NO: 3066163 - DNA, 17 bp, Homo sapiens
cctcagctgtcgggggc

SEQ ID NO: 3066164 - DNA, 16 bp, Homo sapiens
cctcaggcacacagct

SEQ ID NO: 3066165 - DNA, 17 bp, Homo sapiens
cctcaggcacacagcta

SEQ ID NO: 3066166 - DNA, 11 bp, Homo sapiens
cctcagggaca

SEQ ID NO: 3066167 - DNA, 23 bp, Homo sapiens
cctcagggacagagacacctgca

SEQ ID NO: 3066168 - DNA, 11 bp, Homo sapiens
cctcagggcac

SEQ ID NO: 3066169 - DNA, 19 bp, Homo sapiens
cctcaggggaagctgctag

SEQ ID NO: 3066170 - DNA, 20 bp, Homo sapiens
cctcaggggaagctgctagg

SEQ ID NO: 3066171 - DNA, 11 bp, Homo sapiens
cctcaggtggc

SEQ ID NO: 3066172 - DNA, 18 bp, Homo sapiens
cctcaggtggccatgcct

SEQ ID NO: 3066173 - DNA, 21 bp, Homo sapiens
cctcaggtggccatgcctcag

SEQ ID NO: 3066174 - DNA, 18 bp, Homo sapiens
cctcaggtgtagctgagc

SEQ ID NO: 3066175 - DNA, 20 bp, Homo sapiens
cctcagtgcaaaatgtcttg

SEQ ID NO: 3066176 - DNA, 21 bp, Homo sapiens
cctcagtgcaaaatgtcttgt

SEQ ID NO: 3066177 - DNA, 20 bp, Homo sapiens
cctcagttctcaaatgtgtg

SEQ ID NO: 3066178 - DNA, 23 bp, Homo sapiens
cccacgacaaaaacaagactgcc

SEQ ID NO: 3066179 - DNA, 13 bp, Homo sapiens
cccacgacccctg

SEQ ID NO: 3066180 - DNA, 17 bp, Homo sapiens
cccacgagaccccggct

SEQ ID NO: 3066181 - DNA, 16 bp, Homo sapiens
cccacgaggggaccca

SEQ ID NO: 3066182 - DNA, 19 bp, Homo sapiens
cccacgtctctctgcctgc

SEQ ID NO: 3066183 - DNA, 17 bp, Homo sapiens
cccactaatgcaaactg

SEQ ID NO: 3066184 - DNA, 16 bp, Homo sapiens
cccactcaagccaagc

SEQ ID NO: 3066185 - DNA, 18 bp, Homo sapiens
cccactcagctccgtgaa

SEQ ID NO: 3066186 - DNA, 12 bp, Homo sapiens
cccactcctaat

SEQ ID NO: 3066187 - DNA, 16 bp, Homo sapiens
cccactctgcctgcct

SEQ ID NO: 3066188 - DNA, 17 bp, Homo sapiens
cccactctgcctgcctg

SEQ ID NO: 3066189 - DNA, 14 bp, Homo sapiens
cccactgaccagaa

SEQ ID NO: 3066190 - DNA, 15 bp, Homo sapiens
cccactgcaatcctg

SEQ ID NO: 3066191 - DNA, 18 bp, Homo sapiens
cccactgcaatcctgtct

SEQ ID NO: 3066192 - DNA, 19 bp, Homo sapiens
cccactgcaggccccgctt

SEQ ID NO: 3066193 - DNA, 23 bp, Homo sapiens
cccactgcaggccccgcttgtcc

SEQ ID NO: 3066194 - DNA, 12 bp, Homo sapiens
cccactgcctcc

SEQ ID NO: 3066195 - DNA, 23 bp, Homo sapiens
cccactgcctcctccctggctgc

SEQ ID NO: 3066196 - DNA, 14 bp, Homo sapiens
cccactgctggctg

SEQ ID NO: 3066197 - DNA, 16 bp, Homo sapiens
cccactgctggctgca

SEQ ID NO: 3066198 - DNA, 17 bp, Homo sapiens
cccactggatctggctt

SEQ ID NO: 3066199 - DNA, 21 bp, Homo sapiens
cccactggggaaataacagct

SEQ ID NO: 3066200 - DNA, 21 bp, Homo sapiens
cccactggggtccagggagca

SEQ ID NO: 3066201 - DNA, 22 bp, Homo sapiens
cccactgtcctgggcctgcaga

SEQ ID NO: 3066202 - DNA, 20 bp, Homo sapiens
cccacttctcatcacacaca

SEQ ID NO: 3066203 - DNA, 16 bp, Homo sapiens
cccacttctgtgccac

SEQ ID NO: 3066204 - DNA, 16 bp, Homo sapiens
cccactttcttctacc

SEQ ID NO: 3066205 - DNA, 21 bp, Homo sapiens
cccactttgctgttccttact

SEQ ID NO: 3066206 - DNA, 15 bp, Homo sapiens
cccagacagctgctc

SEQ ID NO: 3066207 - DNA, 16 bp, Homo sapiens
cccagacccccagtgt

SEQ ID NO: 3066208 - DNA, 16 bp, Homo sapiens
cccagactgagctctc

SEQ ID NO: 3066209 - DNA, 18 bp, Homo sapiens
cccagactgagctctcca

SEQ ID NO: 3066210 - DNA, 22 bp, Homo sapiens
cccagactgggcccaggcaggt

SEQ ID NO: 3066211 - DNA, 15 bp, Homo sapiens
cccagacttgcactg

SEQ ID NO: 3066212 - DNA, 13 bp, Homo sapiens
cccagagacagga

SEQ ID NO: 3066213 - DNA, 14 bp, Homo sapiens
cccagagacaggaa

SEQ ID NO: 3066214 - DNA, 21 bp, Homo sapiens
cccagagacatacttgaaggg

SEQ ID NO: 3066215 - DNA, 23 bp, Homo sapiens
cccagagacatacttgaagggcc

SEQ ID NO: 3066216 - DNA, 21 bp, Homo sapiens
cccagagacctttgcccacac

SEQ ID NO: 3066217 - DNA, 21 bp, Homo sapiens
cccagagacggagtgtgggag

SEQ ID NO: 3066218 - DNA, 19 bp, Homo sapiens
cccagagcccagctcttgc

SEQ ID NO: 3066219 - DNA, 21 bp, Homo sapiens
cccagagcccagctcttgctc

SEQ ID NO: 3066220 - DNA, 16 bp, Homo sapiens
cccagagtgtgggaag

SEQ ID NO: 3066221 - DNA, 21 bp, Homo sapiens
cccagatcgctcccttggctt

SEQ ID NO: 3066222 - DNA, 22 bp, Homo sapiens
cccagatgttttacgtctggga

SEQ ID NO: 3066223 - DNA, 14 bp, Homo sapiens
cccagcacagctcc

SEQ ID NO: 3066224 - DNA, 19 bp, Homo sapiens
cccagcacagctcctcccc

SEQ ID NO: 3066225 - DNA, 20 bp, Homo sapiens
cccagcacagctcctcccct

SEQ ID NO: 3066226 - DNA, 22 bp, Homo sapiens
cccagcacagctcctcccctgc

SEQ ID NO: 3066227 - DNA, 20 bp, Homo sapiens
cccagcactttgagaggctg

SEQ ID NO: 3066228 - DNA, 17 bp, Homo sapiens
cccagcactttgggagg

SEQ ID NO: 3066229 - DNA, 21 bp, Homo sapiens
cccagcactttgggaggcagg

SEQ ID NO: 3066230 - DNA, 20 bp, Homo sapiens
cccagcactttgggaggcca

SEQ ID NO: 3066231 - DNA, 20 bp, Homo sapiens
cccagcagaatggaggcagg

SEQ ID NO: 3066232 - DNA, 14 bp, Homo sapiens
cccagcagcctgcc

SEQ ID NO: 3066233 - DNA, 17 bp, Homo sapiens
cccagcagcctgccagc

SEQ ID NO: 3066234 - DNA, 13 bp, Homo sapiens
cccagcaggggcc

SEQ ID NO: 3066235 - DNA, 20 bp, Homo sapiens
cccagcaggggccctcactc

SEQ ID NO: 3066236 - DNA, 15 bp, Homo sapiens
cccagcattctcagg

SEQ ID NO: 3066237 - DNA, 15 bp, Homo sapiens
cccagccacaggcca

SEQ ID NO: 3066238 - DNA, 14 bp, Homo sapiens
cccagccacccctc

SEQ ID NO: 3066239 - DNA, 15 bp, Homo sapiens
cccagccacccctca

SEQ ID NO: 3066240 - DNA, 22 bp, Homo sapiens
cccagccagatggactccagcc

SEQ ID NO: 3066241 - DNA, 23 bp, Homo sapiens
cccagccagccacccctgccact

SEQ ID NO: 3066242 - DNA, 19 bp, Homo sapiens
cccagcccaatccaggtac

SEQ ID NO: 3066243 - DNA, 14 bp, Homo sapiens
cccagcccacagag

SEQ ID NO: 3066244 - DNA, 20 bp, Homo sapiens
cccagcccgcggcctggacc

SEQ ID NO: 3066245 - DNA, 21 bp, Homo sapiens
cccagcccgcggcctggaccc

SEQ ID NO: 3066246 - DNA, 13 bp, Homo sapiens
cccagccgcagga

SEQ ID NO: 3066247 - DNA, 18 bp, Homo sapiens
cccagcctccctgaagcc

SEQ ID NO: 3066248 - DNA, 13 bp, Homo sapiens
cccagcgagccac

SEQ ID NO: 3066249 - DNA, 17 bp, Homo sapiens
cccagcgagccacagga

SEQ ID NO: 3066250 - DNA, 15 bp, Homo sapiens
cccagcgtggcctcc

SEQ ID NO: 3066251 - DNA, 14 bp, Homo sapiens
cccagctactcagg

SEQ ID NO: 3066252 - DNA, 22 bp, Homo sapiens
cccagctactcaggaggctgag

SEQ ID NO: 3066253 - DNA, 17 bp, Homo sapiens
cccagctactggggagg

SEQ ID NO: 3066254 - DNA, 15 bp, Homo sapiens
cccagctacttggga

SEQ ID NO: 3066255 - DNA, 21 bp, Homo sapiens
cccagctacttgggagcctga

SEQ ID NO: 3066256 - DNA, 22 bp, Homo sapiens
cccagctacttgggagcctgag

SEQ ID NO: 3066257 - DNA, 23 bp, Homo sapiens
cccagctaggaagagcaggactc

SEQ ID NO: 3066258 - DNA, 20 bp, Homo sapiens
cccagctccgacctctctca

SEQ ID NO: 3066259 - DNA, 16 bp, Homo sapiens
cccagctcgcgggacc

SEQ ID NO: 3066260 - DNA, 23 bp, Homo sapiens
cccagctctaagcagccaggagg

SEQ ID NO: 3066261 - DNA, 13 bp, Homo sapiens
cccagctctccca

SEQ ID NO: 3066262 - DNA, 16 bp, Homo sapiens
cccagctctccctctg

SEQ ID NO: 3066263 - DNA, 23 bp, Homo sapiens
cccagctctccctctggccctgc

SEQ ID NO: 3066264 - DNA, 12 bp, Homo sapiens
cccagctctgaa

SEQ ID NO: 3066265 - DNA, 18 bp, Homo sapiens
cccagctctgaggactgc

SEQ ID NO: 3066266 - DNA, 14 bp, Homo sapiens
cccagctcttgctc

SEQ ID NO: 3066267 - DNA, 17 bp, Homo sapiens
cccagctcttgctctct

SEQ ID NO: 3066268 - DNA, 20 bp, Homo sapiens
cccagctcttgctctcttgt

SEQ ID NO: 3066269 - DNA, 17 bp, Homo sapiens
cccagctttaaaaagaa

SEQ ID NO: 3066270 - DNA, 19 bp, Homo sapiens
cccagctttaaaaagaaaa

SEQ ID NO: 3066271 - DNA, 23 bp, Homo sapiens
cccaggaactcgcacctgtgctg

SEQ ID NO: 3066272 - DNA, 15 bp, Homo sapiens
cccaggaagcaggga

SEQ ID NO: 3066273 - DNA, 11 bp, Homo sapiens
cccaggaaggc

SEQ ID NO: 3066274 - DNA, 13 bp, Homo sapiens
cccaggaaggcct

SEQ ID NO: 3066275 - DNA, 15 bp, Homo sapiens
cccaggaccagctca

SEQ ID NO: 3066276 - DNA, 21 bp, Homo sapiens
cccaggaccagctcaggacag

SEQ ID NO: 3066277 - DNA, 16 bp, Homo sapiens
cccaggacctggctgc

SEQ ID NO: 3066278 - DNA, 18 bp, Homo sapiens
cccaggacctggctgcca

SEQ ID NO: 3066279 - DNA, 16 bp, Homo sapiens
cccaggactcaccctc

SEQ ID NO: 3066280 - DNA, 18 bp, Homo sapiens
cccaggagagccagccct

SEQ ID NO: 3066281 - DNA, 19 bp, Homo sapiens
cccaggagagccagccctc

SEQ ID NO: 3066282 - DNA, 13 bp, Homo sapiens
cccaggagctctg

SEQ ID NO: 3066283 - DNA, 14 bp, Homo sapiens
cccaggagctctgc

SEQ ID NO: 3066284 - DNA, 17 bp, Homo sapiens
cccaggagctctgcgcc

SEQ ID NO: 3066285 - DNA, 20 bp, Homo sapiens
cccaggagctctgcgccagg

SEQ ID NO: 3066286 - DNA, 23 bp, Homo sapiens
cccaggagctctgcgccaggcag

SEQ ID NO: 3066287 - DNA, 21 bp, Homo sapiens
cccaggaggaggattgtgctg

SEQ ID NO: 3066288 - DNA, 20 bp, Homo sapiens
cccaggaggggaacactgcc

SEQ ID NO: 3066289 - DNA, 23 bp, Homo sapiens
cccaggaggtggaggttgcagtg

SEQ ID NO: 3066290 - DNA, 19 bp, Homo sapiens
cccaggagtttgaggctgc

SEQ ID NO: 3066291 - DNA, 14 bp, Homo sapiens
aagggaattgctca

SEQ ID NO: 3066292 - DNA, 14 bp, Homo sapiens
aagggacaggaagg

SEQ ID NO: 3066293 - DNA, 15 bp, Homo sapiens
aagggacaggaaggt

SEQ ID NO: 3066294 - DNA, 23 bp, Homo sapiens
aagggagaagacaacagaaagag

SEQ ID NO: 3066295 - DNA, 23 bp, Homo sapiens
aagggagacattgtttggatttc

SEQ ID NO: 3066296 - DNA, 17 bp, Homo sapiens
aagggagaggaagagaa

SEQ ID NO: 3066297 - DNA, 16 bp, Homo sapiens
aagggaggcagtggct

SEQ ID NO: 3066298 - DNA, 19 bp, Homo sapiens
aagggaggcccagccgcag

SEQ ID NO: 3066299 - DNA, 15 bp, Homo sapiens
aagggagggagctga

SEQ ID NO: 3066300 - DNA, 20 bp, Homo sapiens
aagggagggagctgaggcct

SEQ ID NO: 3066301 - DNA, 16 bp, Homo sapiens
aagggatgcaggctcc

SEQ ID NO: 3066302 - DNA, 15 bp, Homo sapiens
aagggatggtattga

SEQ ID NO: 3066303 - DNA, 16 bp, Homo sapiens
aagggattagtatttt

SEQ ID NO: 3066304 - DNA, 23 bp, Homo sapiens
aagggatttagtaacatcatttt

SEQ ID NO: 3066305 - DNA, 15 bp, Homo sapiens
aagggatttcttagg

SEQ ID NO: 3066306 - DNA, 21 bp, Homo sapiens
aagggcatgagcattggatac

SEQ ID NO: 3066307 - DNA, 19 bp, Homo sapiens
aagggcatgcacgggcatg

SEQ ID NO: 3066308 - DNA, 21 bp, Homo sapiens
aagggcatgggtcgggagagg

SEQ ID NO: 3066309 - DNA, 22 bp, Homo sapiens
aagggcatgggtcgggagaggg

SEQ ID NO: 3066310 - DNA, 11 bp, Homo sapiens
aagggccaggt

SEQ ID NO: 3066311 - DNA, 20 bp, Homo sapiens
aagggccaggtgcggcctgg

SEQ ID NO: 3066312 - DNA, 20 bp, Homo sapiens
aagggccggggatggatctt

SEQ ID NO: 3066313 - DNA, 21 bp, Homo sapiens
aagggcctcctcacccaccct

SEQ ID NO: 3066314 - DNA, 11 bp, Homo sapiens
aagggcctgga

SEQ ID NO: 3066315 - DNA, 21 bp, Homo sapiens
aagggcgcaaagggcatgggt

SEQ ID NO: 3066316 - DNA, 19 bp, Homo sapiens
aaggggaaacgtctcccag

SEQ ID NO: 3066317 - DNA, 22 bp, Homo sapiens
aaggggaaacgtctcccagatc

SEQ ID NO: 3066318 - DNA, 20 bp, Homo sapiens
aaggggacccccgccccctg

SEQ ID NO: 3066319 - DNA, 15 bp, Homo sapiens
agcccattctctctc

SEQ ID NO: 3066320 - DNA, 20 bp, Homo sapiens
agcccattctctctcctgtc

SEQ ID NO: 3066321 - DNA, 22 bp, Homo sapiens
agcccattctctctcctgtcca

SEQ ID NO: 3066322 - DNA, 15 bp, Homo sapiens
agcccatttctccag

SEQ ID NO: 3066323 - DNA, 17 bp, Homo sapiens
agcccatttctccagaa

SEQ ID NO: 3066324 - DNA, 21 bp, Homo sapiens
agcccatttctccagaaccca

SEQ ID NO: 3066325 - DNA, 19 bp, Homo sapiens
agccccagactgggcccag

SEQ ID NO: 3066326 - DNA, 21 bp, Homo sapiens
agccccagactgggcccaggc

SEQ ID NO: 3066327 - DNA, 15 bp, Homo sapiens
agccccatcctgccg

SEQ ID NO: 3066328 - DNA, 19 bp, Homo sapiens
agccccatcgccccaactc

SEQ ID NO: 3066329 - DNA, 12 bp, Homo sapiens
agccccatctgt

SEQ ID NO: 3066330 - DNA, 14 bp, Homo sapiens
agccccatcttcac

SEQ ID NO: 3066331 - DNA, 16 bp, Homo sapiens
agccccattcctggga

SEQ ID NO: 3066332 - DNA, 11 bp, Homo sapiens
agcccccaccc

SEQ ID NO: 3066333 - DNA, 20 bp, Homo sapiens
agcccccaccccagcacagc

SEQ ID NO: 3066334 - DNA, 19 bp, Homo sapiens
agcccccaccgtgggcagg

SEQ ID NO: 3066335 - DNA, 12 bp, Homo sapiens
agcccccagcta

SEQ ID NO: 3066336 - DNA, 19 bp, Homo sapiens
agcccccagctaagaacct

SEQ ID NO: 3066337 - DNA, 15 bp, Homo sapiens
agcccccgggacacc

SEQ ID NO: 3066338 - DNA, 16 bp, Homo sapiens
agccccctgccccgca

SEQ ID NO: 3066339 - DNA, 15 bp, Homo sapiens
agccccctggcagct

SEQ ID NO: 3066340 - DNA, 18 bp, Homo sapiens
agccccctggcagctgcc

SEQ ID NO: 3066341 - DNA, 23 bp, Homo sapiens
agccccctggcagctgcccctcc

SEQ ID NO: 3066342 - DNA, 14 bp, Homo sapiens
agccccctggcctc

SEQ ID NO: 3066343 - DNA, 15 bp, Homo sapiens
agccccctggcctct

SEQ ID NO: 3066344 - DNA, 17 bp, Homo sapiens
agccccgctcccaccta

SEQ ID NO: 3066345 - DNA, 15 bp, Homo sapiens
agcccctacccctgc

SEQ ID NO: 3066346 - DNA, 16 bp, Homo sapiens
agcccctacccctgcc

SEQ ID NO: 3066347 - DNA, 19 bp, Homo sapiens
agcccctacccctgccctg

SEQ ID NO: 3066348 - DNA, 12 bp, Homo sapiens
agcccctcagac

SEQ ID NO: 3066349 - DNA, 16 bp, Homo sapiens
agcccctcccaagctg

SEQ ID NO: 3066350 - DNA, 21 bp, Homo sapiens
agcccctcccaagctggctgg

SEQ ID NO: 3066351 - DNA, 22 bp, Homo sapiens
agcccctcccaagctggctggg

SEQ ID NO: 3066352 - DNA, 14 bp, Homo sapiens
agcccctcctcccc

SEQ ID NO: 3066353 - DNA, 13 bp, Homo sapiens
agcccctcctctg

SEQ ID NO: 3066354 - DNA, 15 bp, Homo sapiens
agcccctcctctgcc

SEQ ID NO: 3066355 - DNA, 18 bp, Homo sapiens
agcccctcctctgccacc

SEQ ID NO: 3066356 - DNA, 19 bp, Homo sapiens
agcccctcctctgccacct

SEQ ID NO: 3066357 - DNA, 20 bp, Homo sapiens
agcccctcctctgccacctc

SEQ ID NO: 3066358 - DNA, 14 bp, Homo sapiens
agcccctcggctct

SEQ ID NO: 3066359 - DNA, 11 bp, Homo sapiens
agcccctgagt

SEQ ID NO: 3066360 - DNA, 21 bp, Homo sapiens
agcccctgagtccgcctgcgc

SEQ ID NO: 3066361 - DNA, 17 bp, Homo sapiens
agcccctgcagacgtct

SEQ ID NO: 3066362 - DNA, 23 bp, Homo sapiens
agcccctgcagacgtctggccct

SEQ ID NO: 3066363 - DNA, 16 bp, Homo sapiens
agcccctgctggctgg

SEQ ID NO: 3066364 - DNA, 20 bp, Homo sapiens
agcccctgtctagagaggga

SEQ ID NO: 3066365 - DNA, 22 bp, Homo sapiens
agccccttggattactttgttt

SEQ ID NO: 3066366 - DNA, 16 bp, Homo sapiens
agcccctttccaaaat

SEQ ID NO: 3066367 - DNA, 18 bp, Homo sapiens
agcccgagtggtctcctc

SEQ ID NO: 3066368 - DNA, 17 bp, Homo sapiens
agcccgcactgtcccag

SEQ ID NO: 3066369 - DNA, 13 bp, Homo sapiens
agcccgcggcctg

SEQ ID NO: 3066370 - DNA, 17 bp, Homo sapiens
agcccgcggcctggacc

SEQ ID NO: 3066371 - DNA, 20 bp, Homo sapiens
agcccgcggggacattggga

SEQ ID NO: 3066372 - DNA, 21 bp, Homo sapiens
agcccggaggggactggtccc

SEQ ID NO: 3066373 - DNA, 17 bp, Homo sapiens
agcccgtgccaccccca

SEQ ID NO: 3066374 - DNA, 16 bp, Homo sapiens
agccctcatcccgagc

SEQ ID NO: 3066375 - DNA, 17 bp, Homo sapiens
agccctccatggtcctg

SEQ ID NO: 3066376 - DNA, 19 bp, Homo sapiens
agccctccccatggagcca

SEQ ID NO: 3066377 - DNA, 11 bp, Homo sapiens
agccctccttc

SEQ ID NO: 3066378 - DNA, 12 bp, Homo sapiens
agccctccttcc

SEQ ID NO: 3066379 - DNA, 13 bp, Homo sapiens
agccctccttcca

SEQ ID NO: 3066380 - DNA, 14 bp, Homo sapiens
agccctctagggca

SEQ ID NO: 3066381 - DNA, 23 bp, Homo sapiens
agccctctcatcgtcttttagtt

SEQ ID NO: 3066382 - DNA, 16 bp, Homo sapiens
agccctctgcctcctc

SEQ ID NO: 3066383 - DNA, 20 bp, Homo sapiens
agccctctgcctcctcccca

SEQ ID NO: 3066384 - DNA, 20 bp, Homo sapiens
agccctctttaatgctgtct

SEQ ID NO: 3066385 - DNA, 19 bp, Homo sapiens
agccctgaatttcttcttt

SEQ ID NO: 3066386 - DNA, 18 bp, Homo sapiens
agccctgagttcctagcc

SEQ ID NO: 3066387 - DNA, 16 bp, Homo sapiens
agccctgattgtgcca

SEQ ID NO: 3066388 - DNA, 12 bp, Homo sapiens
agccctgcccac

SEQ ID NO: 3066389 - DNA, 12 bp, Homo sapiens
agccctgcctct

SEQ ID NO: 3066390 - DNA, 14 bp, Homo sapiens
agccctgcctctgt

SEQ ID NO: 3066391 - DNA, 16 bp, Homo sapiens
agccctgcctctgtgt

SEQ ID NO: 3066392 - DNA, 12 bp, Homo sapiens
agccctgctgct

SEQ ID NO: 3066393 - DNA, 17 bp, Homo sapiens
agccctgctgcttccta

SEQ ID NO: 3066394 - DNA, 18 bp, Homo sapiens
agccctgctgcttcctaa

SEQ ID NO: 3066395 - DNA, 20 bp, Homo sapiens
agccctgctgcttcctaact

SEQ ID NO: 3066396 - DNA, 17 bp, Homo sapiens
agccctggcccctccaa

SEQ ID NO: 3066397 - DNA, 16 bp, Homo sapiens
agccctgggatcactg

SEQ ID NO: 3066398 - DNA, 21 bp, Homo sapiens
agccctgggtgacttcaggtg

SEQ ID NO: 3066399 - DNA, 22 bp, Homo sapiens
agccctgtggatgagccctcag

SEQ ID NO: 3066400 - DNA, 17 bp, Homo sapiens
agccctgttcctccctc

SEQ ID NO: 3066401 - DNA, 21 bp, Homo sapiens
agccctgttcctccctcccac

SEQ ID NO: 3066402 - DNA, 19 bp, Homo sapiens
agccctgttgtgccacaga

SEQ ID NO: 3066403 - DNA, 15 bp, Homo sapiens
agccctttgcctgta

SEQ ID NO: 3066404 - DNA, 14 bp, Homo sapiens
agccgaactccagg

SEQ ID NO: 3066405 - DNA, 16 bp, Homo sapiens
agccgagagcctgctc

SEQ ID NO: 3066406 - DNA, 18 bp, Homo sapiens
agccgagagcctgctccc

SEQ ID NO: 3066407 - DNA, 21 bp, Homo sapiens
agccgagagcctgctccccca

SEQ ID NO: 3066408 - DNA, 19 bp, Homo sapiens
agccgagggcgtcagagag

SEQ ID NO: 3066409 - DNA, 13 bp, Homo sapiens
agccgctctcctg

SEQ ID NO: 3066410 - DNA, 13 bp, Homo sapiens
agccgctgccctg

SEQ ID NO: 3066411 - DNA, 19 bp, Homo sapiens
agccgctgccctgggtcct

SEQ ID NO: 3066412 - DNA, 16 bp, Homo sapiens
agccggaaggccgagg

SEQ ID NO: 3066413 - DNA, 16 bp, Homo sapiens
agccggacacttctca

SEQ ID NO: 3066414 - DNA, 20 bp, Homo sapiens
agccggacacttctcaggaa

SEQ ID NO: 3066415 - DNA, 21 bp, Homo sapiens
agccggagcctccagctgccc

SEQ ID NO: 3066416 - DNA, 19 bp, Homo sapiens
agccggagggcaccaggga

SEQ ID NO: 3066417 - DNA, 19 bp, Homo sapiens
agccggcactgagaagaac

SEQ ID NO: 3066418 - DNA, 19 bp, Homo sapiens
agccggcatccttgcctgt

SEQ ID NO: 3066419 - DNA, 20 bp, Homo sapiens
agccgggaaagaagagccgg

SEQ ID NO: 3066420 - DNA, 13 bp, Homo sapiens
agccgggaccctc

SEQ ID NO: 3066421 - DNA, 16 bp, Homo sapiens
agccgggaccctcagg

SEQ ID NO: 3066422 - DNA, 17 bp, Homo sapiens
agccgggaccctcaggt

SEQ ID NO: 3066423 - DNA, 23 bp, Homo sapiens
agccggggaagagatccaaagac

SEQ ID NO: 3066424 - DNA, 20 bp, Homo sapiens
agccgggtctgcctcttctg

SEQ ID NO: 3066425 - DNA, 22 bp, Homo sapiens
agccggttctgctagagcagac

SEQ ID NO: 3066426 - DNA, 16 bp, Homo sapiens
agccgtggtcctttgg

SEQ ID NO: 3066427 - DNA, 18 bp, Homo sapiens
agcctaattataagaatt

SEQ ID NO: 3066428 - DNA, 16 bp, Homo sapiens
agcctaccatgtgaaa

SEQ ID NO: 3066429 - DNA, 14 bp, Homo sapiens
agcctactatttaa

SEQ ID NO: 3066430 - DNA, 23 bp, Homo sapiens
agcctactgtactatttaaaatg

SEQ ID NO: 3066431 - DNA, 22 bp, Homo sapiens
taagttaataagttgatgtttt

SEQ ID NO: 3066432 - DNA, 13 bp, Homo sapiens
taagttattttat

SEQ ID NO: 3066433 - DNA, 23 bp, Homo sapiens
taagttattttatgacatgaaaa

SEQ ID NO: 3066434 - DNA, 14 bp, Homo sapiens
taagttcctgctgc

SEQ ID NO: 3066435 - DNA, 15 bp, Homo sapiens
taagttcctgctgcc

SEQ ID NO: 3066436 - DNA, 22 bp, Homo sapiens
taagttcctgctgcctgggtag

SEQ ID NO: 3066437 - DNA, 17 bp, Homo sapiens
taagttcgaacatgttt

SEQ ID NO: 3066438 - DNA, 19 bp, Homo sapiens
taagttcgaacatgtttca

SEQ ID NO: 3066439 - DNA, 15 bp, Homo sapiens
taagttgatgttttc

SEQ ID NO: 3066440 - DNA, 12 bp, Homo sapiens
taagtttctaag

SEQ ID NO: 3066441 - DNA, 13 bp, Homo sapiens
taagtttctaaga

SEQ ID NO: 3066442 - DNA, 14 bp, Homo sapiens
taagtttctaagat

SEQ ID NO: 3066443 - DNA, 15 bp, Homo sapiens
taagtttctaagatt

SEQ ID NO: 3066444 - DNA, 17 bp, Homo sapiens
taagtttctaagattct

SEQ ID NO: 3066445 - DNA, 14 bp, Homo sapiens
taagtttctttaga

SEQ ID NO: 3066446 - DNA, 17 bp, Homo sapiens
taagttttatttaactt

SEQ ID NO: 3066447 - DNA, 16 bp, Homo sapiens
taagttttgtgtgtat

SEQ ID NO: 3066448 - DNA, 24 bp, Homo sapiens
taagttttgtttgttcacactcct

SEQ ID NO: 3066449 - DNA, 22 bp, Homo sapiens
taagtttttattcaaagcagct

SEQ ID NO: 3066450 - DNA, 23 bp, Homo sapiens
taagtttttctctttttcagaca

SEQ ID NO: 3066451 - DNA, 14 bp, Homo sapiens
taagtttttcttta

SEQ ID NO: 3066452 - DNA, 16 bp, Homo sapiens
taataaaaagaaagat

SEQ ID NO: 3066453 - DNA, 14 bp, Homo sapiens
taataaaaatttat

SEQ ID NO: 3066454 - DNA, 16 bp, Homo sapiens
taataaaataattatg

SEQ ID NO: 3066455 - DNA, 21 bp, Homo sapiens
taataaacagactgttttcta

SEQ ID NO: 3066456 - DNA, 15 bp, Homo sapiens
taataaactgcaaat

SEQ ID NO: 3066457 - DNA, 20 bp, Homo sapiens
taataaactgcaaatgtgca

SEQ ID NO: 3066458 - DNA, 13 bp, Homo sapiens
taataaagatgtg

SEQ ID NO: 3066459 - DNA, 15 bp, Homo sapiens
taataaagatgtgaa

SEQ ID NO: 3066460 - DNA, 16 bp, Homo sapiens
taataaagatgtgaaa

SEQ ID NO: 3066461 - DNA, 19 bp, Homo sapiens
taataaagatgtgaaaact

SEQ ID NO: 3066462 - DNA, 14 bp, Homo sapiens
taataaatacacaa

SEQ ID NO: 3066463 - DNA, 15 bp, Homo sapiens
taataaatagagcaa

SEQ ID NO: 3066464 - DNA, 19 bp, Homo sapiens
taataaatgacaaatgtat

SEQ ID NO: 3066465 - DNA, 11 bp, Homo sapiens
taataagaaaa

SEQ ID NO: 3066466 - DNA, 18 bp, Homo sapiens
taataagcataagaccaa

SEQ ID NO: 3066467 - DNA, 20 bp, Homo sapiens
taataagttgatgttttcta

SEQ ID NO: 3066468 - DNA, 12 bp, Homo sapiens
taataatataat

SEQ ID NO: 3066469 - DNA, 16 bp, Homo sapiens
taataatttctaatgt

SEQ ID NO: 3066470 - DNA, 22 bp, Homo sapiens
taatacaggagacccaacaatg

SEQ ID NO: 3066471 - DNA, 20 bp, Homo sapiens
taatacattccaactcgtat

SEQ ID NO: 3066472 - DNA, 22 bp, Homo sapiens
taataccattttttaaggaaac

SEQ ID NO: 3066473 - DNA, 20 bp, Homo sapiens
taatacctgggtgattacat

SEQ ID NO: 3066474 - DNA, 15 bp, Homo sapiens
taatactagttgtga

SEQ ID NO: 3066475 - DNA, 18 bp, Homo sapiens
taatactagttgtgacct

SEQ ID NO: 3066476 - DNA, 21 bp, Homo sapiens
taatactgaatttctttgatt

SEQ ID NO: 3066477 - DNA, 23 bp, Homo sapiens
taatactgctgagatacatacag

SEQ ID NO: 3066478 - DNA, 15 bp, Homo sapiens
taatagaatgataaa

SEQ ID NO: 3066479 - DNA, 16 bp, Homo sapiens
taatagaatgataaat

SEQ ID NO: 3066480 - DNA, 19 bp, Homo sapiens
taatagaatttcctaatga

SEQ ID NO: 3066481 - DNA, 12 bp, Homo sapiens
taatagaggagc

SEQ ID NO: 3066482 - DNA, 15 bp, Homo sapiens
taatagataactgct

SEQ ID NO: 3066483 - DNA, 21 bp, Homo sapiens
taatagcttttgattagtata

SEQ ID NO: 3066484 - DNA, 16 bp, Homo sapiens
taatagggaatatatc

SEQ ID NO: 3066485 - DNA, 17 bp, Homo sapiens
taatagtgttaatcaat

SEQ ID NO: 3066486 - DNA, 21 bp, Homo sapiens
taatagtgttaatcaatttaa

SEQ ID NO: 3066487 - DNA, 21 bp, Homo sapiens
taatataaaaagcttccatga

SEQ ID NO: 3066488 - DNA, 21 bp, Homo sapiens
taatataagtttctttagaaa

SEQ ID NO: 3066489 - DNA, 16 bp, Homo sapiens
taatatagctgagact

SEQ ID NO: 3066490 - DNA, 20 bp, Homo sapiens
taatatatttgtgtatttaa

SEQ ID NO: 3066491 - DNA, 13 bp, Homo sapiens
taatatattttct

SEQ ID NO: 3066492 - DNA, 21 bp, Homo sapiens
taatatattttctgttttctt

SEQ ID NO: 3066493 - DNA, 21 bp, Homo sapiens
taatatcaaatgcagtatatt

SEQ ID NO: 3066494 - DNA, 15 bp, Homo sapiens
taatatcaatagaag

SEQ ID NO: 3066495 - DNA, 22 bp, Homo sapiens
taatatccaacacaactatcaa

SEQ ID NO: 3066496 - DNA, 23 bp, Homo sapiens
taatatccaacacaactatcaaa

SEQ ID NO: 3066497 - DNA, 19 bp, Homo sapiens
taatatccaggtcaacaga

SEQ ID NO: 3066498 - DNA, 20 bp, Homo sapiens
taatatccaggtcaacagaa

SEQ ID NO: 3066499 - DNA, 13 bp, Homo sapiens
taatatgaagtat

SEQ ID NO: 3066500 - DNA, 16 bp, Homo sapiens
taatatgctttttact

SEQ ID NO: 3066501 - DNA, 17 bp, Homo sapiens
taatatgttgactttat

SEQ ID NO: 3066502 - DNA, 18 bp, Homo sapiens
taatattaaaagtcacaa

SEQ ID NO: 3066503 - DNA, 17 bp, Homo sapiens
taatattagcttgctta

SEQ ID NO: 3066504 - DNA, 12 bp, Homo sapiens
taatattctctg

SEQ ID NO: 3066505 - DNA, 17 bp, Homo sapiens
taatattctctgatgtt

SEQ ID NO: 3066506 - DNA, 14 bp, Homo sapiens
taatattctgctat

SEQ ID NO: 3066507 - DNA, 14 bp, Homo sapiens
taatattgagaaag

SEQ ID NO: 3066508 - DNA, 22 bp, Homo sapiens
tacaccacacacaacagccaac

SEQ ID NO: 3066509 - DNA, 23 bp, Homo sapiens
tacaccacacacaacagccaaca

SEQ ID NO: 3066510 - DNA, 16 bp, Homo sapiens
tacaccacactttcaa

SEQ ID NO: 3066511 - DNA, 17 bp, Homo sapiens
tacaccagcattccttt

SEQ ID NO: 3066512 - DNA, 18 bp, Homo sapiens
tacaccagcattcctttt

SEQ ID NO: 3066513 - DNA, 20 bp, Homo sapiens
tacaccccctcttctgagca

SEQ ID NO: 3066514 - DNA, 22 bp, Homo sapiens
tacaccccctcttctgagcaca

SEQ ID NO: 3066515 - DNA, 16 bp, Homo sapiens
tacacccttttccagc

SEQ ID NO: 3066516 - DNA, 12 bp, Homo sapiens
tacacctggacc

SEQ ID NO: 3066517 - DNA, 14 bp, Homo sapiens
tacaccttgctttt

SEQ ID NO: 3066518 - DNA, 18 bp, Homo sapiens
tacacctttctcctttgt

SEQ ID NO: 3066519 - DNA, 18 bp, Homo sapiens
tacacgggacagttgctg

SEQ ID NO: 3066520 - DNA, 15 bp, Homo sapiens
tacactgacttggtg

SEQ ID NO: 3066521 - DNA, 15 bp, Homo sapiens
tacactgagtttcta

SEQ ID NO: 3066522 - DNA, 14 bp, Homo sapiens
tacactgtgtctct

SEQ ID NO: 3066523 - DNA, 14 bp, Homo sapiens
tacacttgccctgc

SEQ ID NO: 3066524 - DNA, 21 bp, Homo sapiens
tacacttgccctgctccctct

SEQ ID NO: 3066525 - DNA, 13 bp, Homo sapiens
tacagaaactgat

SEQ ID NO: 3066526 - DNA, 21 bp, Homo sapiens
tacagaaagaaaaatgcatta

SEQ ID NO: 3066527 - DNA, 22 bp, Homo sapiens
tacagaaagtggtgctcagttg

SEQ ID NO: 3066528 - DNA, 21 bp, Homo sapiens
tacagacaaacttgatttctt

SEQ ID NO: 3066529 - DNA, 22 bp, Homo sapiens
tacagacagagaatatgtctgc

SEQ ID NO: 3066530 - DNA, 19 bp, Homo sapiens
tacagacatatttaactgg

SEQ ID NO: 3066531 - DNA, 22 bp, Homo sapiens
tacagacttgttgtgactttga

SEQ ID NO: 3066532 - DNA, 16 bp, Homo sapiens
tacagagcttccctga

SEQ ID NO: 3066533 - DNA, 19 bp, Homo sapiens
tacagagtgtggactctgg

SEQ ID NO: 3066534 - DNA, 20 bp, Homo sapiens
tacagataagtgttcttcag

SEQ ID NO: 3066535 - DNA, 19 bp, Homo sapiens
tacagatagagagttgttg

SEQ ID NO: 3066536 - DNA, 18 bp, Homo sapiens
tacagatgaatgtattta

SEQ ID NO: 3066537 - DNA, 21 bp, Homo sapiens
tacagcacatcacctctttgc

SEQ ID NO: 3066538 - DNA, 16 bp, Homo sapiens
tacagcagcaagaaaa

SEQ ID NO: 3066539 - DNA, 23 bp, Homo sapiens
tacagcagcaagaaaaaaaaatg

SEQ ID NO: 3066540 - DNA, 17 bp, Homo sapiens
tacagcagttgactcag

SEQ ID NO: 3066541 - DNA, 18 bp, Homo sapiens
tacagcctgaataaacca

SEQ ID NO: 3066542 - DNA, 22 bp, Homo sapiens
tacagcctgaataaaccaagac

SEQ ID NO: 3066543 - DNA, 23 bp, Homo sapiens
tacagcctgaataaaccaagaca

SEQ ID NO: 3066544 - DNA, 23 bp, Homo sapiens
tacagccttattttgttggtgct

SEQ ID NO: 3066545 - DNA, 13 bp, Homo sapiens
tacaggaaagatg

SEQ ID NO: 3066546 - DNA, 18 bp, Homo sapiens
tacaggagtcagccatgt

SEQ ID NO: 3066547 - DNA, 14 bp, Homo sapiens
tacaggatttgaaa

SEQ ID NO: 3066548 - DNA, 15 bp, Homo sapiens
tacaggcagcacaga

SEQ ID NO: 3066549 - DNA, 15 bp, Homo sapiens
tacaggcgtgagcca

SEQ ID NO: 3066550 - DNA, 22 bp, Homo sapiens
tacaggggagaaggaaatgcag

SEQ ID NO: 3066551 - DNA, 16 bp, Homo sapiens
tacaggtgtgagcata

SEQ ID NO: 3066552 - DNA, 17 bp, Homo sapiens
tacaggttactaccctc

SEQ ID NO: 3066553 - DNA, 16 bp, Homo sapiens
tacagtaactttatgt

SEQ ID NO: 3066554 - DNA, 15 bp, Homo sapiens
tacagtacaggcagc

SEQ ID NO: 3066555 - DNA, 17 bp, Homo sapiens
tacagtatattcttgta

SEQ ID NO: 3066556 - DNA, 12 bp, Homo sapiens
tacagtattttt

SEQ ID NO: 3066557 - DNA, 20 bp, Homo sapiens
tacagtatttttcagatata

SEQ ID NO: 3066558 - DNA, 21 bp, Homo sapiens
tacagtatttttcagatataa

SEQ ID NO: 3066559 - DNA, 21 bp, Homo sapiens
tacagtatttttctgtgacca

SEQ ID NO: 3066560 - DNA, 14 bp, Homo sapiens
tacagtctcaattt

SEQ ID NO: 3066561 - DNA, 17 bp, Homo sapiens
tacagtctgtcttctgt

SEQ ID NO: 3066562 - DNA, 18 bp, Homo sapiens
tacagtcttccatttgca

SEQ ID NO: 3066563 - DNA, 19 bp, Homo sapiens
tacagtcttccatttgcaa

SEQ ID NO: 3066564 - DNA, 23 bp, Homo sapiens
tacagtggaaccgttgccaaccg

SEQ ID NO: 3066565 - DNA, 18 bp, Homo sapiens
tacagtggtgccatcatt

SEQ ID NO: 3066566 - DNA, 21 bp, Homo sapiens
tacagtgttttttaggaaaag

SEQ ID NO: 3066567 - DNA, 18 bp, Homo sapiens
tacagttaaggaatataa

SEQ ID NO: 3066568 - DNA, 19 bp, Homo sapiens
tacagttagggttttgcaa

SEQ ID NO: 3066569 - DNA, 19 bp, Homo sapiens
tacagttatctaagttaat

SEQ ID NO: 3066570 - DNA, 17 bp, Homo sapiens
tacagttcataaatttg

SEQ ID NO: 3066571 - DNA, 13 bp, Homo sapiens
tacagttgcagga

SEQ ID NO: 3066572 - DNA, 15 bp, Homo sapiens
tacagtttaacagag

SEQ ID NO: 3066573 - DNA, 16 bp, Homo sapiens
tacagtttaacagagt

SEQ ID NO: 3066574 - DNA, 19 bp, Homo sapiens
tacagtttaacagagtttt

SEQ ID NO: 3066575 - DNA, 22 bp, Homo sapiens
tacagtttggggcaagtcatgt

SEQ ID NO: 3066576 - DNA, 20 bp, Homo sapiens
tacagtttgtgctctactgt

SEQ ID NO: 3066577 - DNA, 15 bp, Homo sapiens
tacagttttgtggac

SEQ ID NO: 3066578 - DNA, 22 bp, Homo sapiens
tacagttttgtggactgagcga

SEQ ID NO: 3066579 - DNA, 15 bp, Homo sapiens
tacataactgatcta

SEQ ID NO: 3066580 - DNA, 16 bp, Homo sapiens
tacataactgatctat

SEQ ID NO: 3066581 - DNA, 15 bp, Homo sapiens
tacataatctgtaca

SEQ ID NO: 3066582 - DNA, 16 bp, Homo sapiens
taccaacatgtatctg

SEQ ID NO: 3066583 - DNA, 17 bp, Homo sapiens
taccaacatgtatctgt

SEQ ID NO: 3066584 - DNA, 11 bp, Homo sapiens
taccaagagaa

SEQ ID NO: 3066585 - DNA, 14 bp, Homo sapiens
taccaatacaaaat

SEQ ID NO: 3066586 - DNA, 15 bp, Homo sapiens
taccaattatggaaa

SEQ ID NO: 3066587 - DNA, 13 bp, Homo sapiens
taccacaccctgc

SEQ ID NO: 3066588 - DNA, 14 bp, Homo sapiens
taccacaccctgcc

SEQ ID NO: 3066589 - DNA, 15 bp, Homo sapiens
taccacaccctgcct

SEQ ID NO: 3066590 - DNA, 16 bp, Homo sapiens
taccacaccctgcctg

SEQ ID NO: 3066591 - DNA, 18 bp, Homo sapiens
taccacaccctgcctgct

SEQ ID NO: 3066592 - DNA, 22 bp, Homo sapiens
taccacaccctgcctgctgtgg

SEQ ID NO: 3066593 - DNA, 23 bp, Homo sapiens
taccacaccctgcctgctgtgga

SEQ ID NO: 3066594 - DNA, 14 bp, Homo sapiens
taccacagagtttt

SEQ ID NO: 3066595 - DNA, 15 bp, Homo sapiens
taccactttcttatt

SEQ ID NO: 3066596 - DNA, 20 bp, Homo sapiens
taccacttttcattgcaaag

SEQ ID NO: 3066597 - DNA, 20 bp, Homo sapiens
taccagcaaagagaatgtat

SEQ ID NO: 3066598 - DNA, 23 bp, Homo sapiens
taccagcaaagagaatgtatttc

SEQ ID NO: 3066599 - DNA, 13 bp, Homo sapiens
taccagctcaggg

SEQ ID NO: 3066600 - DNA, 21 bp, Homo sapiens
taccaggcacatggctggggg

SEQ ID NO: 3066601 - DNA, 14 bp, Homo sapiens
taccagtgaatttt

SEQ ID NO: 3066602 - DNA, 18 bp, Homo sapiens
taccagtgaatttttgca

SEQ ID NO: 3066603 - DNA, 21 bp, Homo sapiens
taccagtgaatttttgcaata

SEQ ID NO: 3066604 - DNA, 14 bp, Homo sapiens
taccagtgcaggct

SEQ ID NO: 3066605 - DNA, 14 bp, Homo sapiens
taccagtgggcatg

SEQ ID NO: 3066606 - DNA, 16 bp, Homo sapiens
taccagtgtaaattca

SEQ ID NO: 3066607 - DNA, 15 bp, Homo sapiens
taccatatgaatgaa

SEQ ID NO: 3066608 - DNA, 19 bp, Homo sapiens
taccatatgaatgaaacat

SEQ ID NO: 3066609 - DNA, 23 bp, Homo sapiens
taccatctactcttttgaagtgt

SEQ ID NO: 3066610 - DNA, 18 bp, Homo sapiens
taccattacttgtataaa

SEQ ID NO: 3066611 - DNA, 22 bp, Homo sapiens
taccattacttgtataaataca

SEQ ID NO: 3066612 - DNA, 21 bp, Homo sapiens
taccatttcaaatatttacag

SEQ ID NO: 3066613 - DNA, 20 bp, Homo sapiens
taccattttttaaggaaaca

SEQ ID NO: 3066614 - DNA, 19 bp, Homo sapiens
tacccaaccccagatgccc

SEQ ID NO: 3066615 - DNA, 12 bp, Homo sapiens
tacccaagcaaa

SEQ ID NO: 3066616 - DNA, 13 bp, Homo sapiens
tacccactgccat

SEQ ID NO: 3066617 - DNA, 16 bp, Homo sapiens
tacccagggcctgcag

SEQ ID NO: 3066618 - DNA, 18 bp, Homo sapiens
tacccagggtggagtgca

SEQ ID NO: 3066619 - DNA, 16 bp, Homo sapiens
tacccagtattactgc

SEQ ID NO: 3066620 - DNA, 20 bp, Homo sapiens
tacccagtattactgctgct

SEQ ID NO: 3066621 - DNA, 21 bp, Homo sapiens
tacccagtattactgctgctg

SEQ ID NO: 3066622 - DNA, 16 bp, Homo sapiens
tacccatacaccccct

SEQ ID NO: 3066623 - DNA, 23 bp, Homo sapiens
tacccatcttgcttccaagacca

SEQ ID NO: 3066624 - DNA, 17 bp, Homo sapiens
tacccatgggacaaaat

SEQ ID NO: 3066625 - DNA, 16 bp, Homo sapiens
taccccagttttttga

SEQ ID NO: 3066626 - DNA, 13 bp, Homo sapiens
taccccatccctg

SEQ ID NO: 3066627 - DNA, 16 bp, Homo sapiens
tacccccagctgtgct

SEQ ID NO: 3066628 - DNA, 20 bp, Homo sapiens
taccccctcaaaccctgccc

SEQ ID NO: 3066629 - DNA, 16 bp, Homo sapiens
taccccctcatccccc

SEQ ID NO: 3066630 - DNA, 21 bp, Homo sapiens
tacccctgcctttgggagcag

SEQ ID NO: 3066631 - DNA, 22 bp, Homo sapiens
tacccctgcctttgggagcagg

SEQ ID NO: 3066632 - DNA, 14 bp, Homo sapiens
tacccgtgcctggg

SEQ ID NO: 3066633 - DNA, 16 bp, Homo sapiens
taccctgagctgaggc

SEQ ID NO: 3066634 - DNA, 18 bp, Homo sapiens
taccctgagctgaggcag

SEQ ID NO: 3066635 - DNA, 12 bp, Homo sapiens
taccctgggtgt

SEQ ID NO: 3066636 - DNA, 18 bp, Homo sapiens
taccctgtgctaagcacg

SEQ ID NO: 3066637 - DNA, 19 bp, Homo sapiens
tacccttcctcatctgtgc

SEQ ID NO: 3066638 - DNA, 21 bp, Homo sapiens
tacccttcctcatctgtgcct

SEQ ID NO: 3066639 - DNA, 15 bp, Homo sapiens
tacccttgttttgaa

SEQ ID NO: 3066640 - DNA, 23 bp, Homo sapiens
taccctttaagatatccatcttt

SEQ ID NO: 3066641 - DNA, 20 bp, Homo sapiens
taccctttagactgtagcct

SEQ ID NO: 3066642 - DNA, 15 bp, Homo sapiens
tacccttttctgggg

SEQ ID NO: 3066643 - DNA, 13 bp, Homo sapiens
taccgatggtccc

SEQ ID NO: 3066644 - DNA, 12 bp, Homo sapiens
taccgcatggca

SEQ ID NO: 3066645 - DNA, 17 bp, Homo sapiens
taccgcatggcagctgg

SEQ ID NO: 3066646 - DNA, 22 bp, Homo sapiens
taccgccctgcgggccacaggg

SEQ ID NO: 3066647 - DNA, 17 bp, Homo sapiens
taccgcctcgtgccagc

SEQ ID NO: 3066648 - DNA, 20 bp, Homo sapiens
taccgcctcgtgccagcagc

SEQ ID NO: 3066649 - DNA, 21 bp, Homo sapiens
taccgcctcgtgccagcagcc

SEQ ID NO: 3066650 - DNA, 18 bp, Homo sapiens
taccgggttctcctgatt

SEQ ID NO: 3066651 - DNA, 18 bp, Homo sapiens
taccgtgccactttccac

SEQ ID NO: 3066652 - DNA, 18 bp, Homo sapiens
tacctacaaaatgagatt

SEQ ID NO: 3066653 - DNA, 23 bp, Homo sapiens
tacctacaaaatgagattcagtg

SEQ ID NO: 3066654 - DNA, 14 bp, Homo sapiens
tacctatattcctt

SEQ ID NO: 3066655 - DNA, 13 bp, Homo sapiens
tacctatgtaaca

SEQ ID NO: 3066656 - DNA, 18 bp, Homo sapiens
tacctccccttttctatg

SEQ ID NO: 3066657 - DNA, 20 bp, Homo sapiens
tacctccccttttctatgtt

SEQ ID NO: 3066658 - DNA, 12 bp, Homo sapiens
tacctccctccc

SEQ ID NO: 3066659 - DNA, 19 bp, Homo sapiens
tacctcctctcagtgtttt

SEQ ID NO: 3066660 - DNA, 16 bp, Homo sapiens
tacctcctgcccagga

SEQ ID NO: 3066661 - DNA, 20 bp, Homo sapiens
tacctctctgtcccttgctg

SEQ ID NO: 3066662 - DNA, 20 bp, Homo sapiens
tacctgaaaacactgtgcac

SEQ ID NO: 3066663 - DNA, 21 bp, Homo sapiens
tacctgaaaacactgtgcaca

SEQ ID NO: 3066664 - DNA, 12 bp, Homo sapiens
tacctgaacatt

SEQ ID NO: 3066665 - DNA, 14 bp, Homo sapiens
agcccagctcttgc

SEQ ID NO: 3066666 - DNA, 21 bp, Homo sapiens
agcccagctgggtcaggcagg

SEQ ID NO: 3066667 - DNA, 13 bp, Homo sapiens
agcccaggctgga

SEQ ID NO: 3066668 - DNA, 20 bp, Homo sapiens
agcccaggctggagtgcaat

SEQ ID NO: 3066669 - DNA, 12 bp, Homo sapiens
agcccagtgacc

SEQ ID NO: 3066670 - DNA, 19 bp, Homo sapiens
agcccagtgggctgcacgc

SEQ ID NO: 3066671 - DNA, 21 bp, Homo sapiens
agcccagtgggctgcacgctc

SEQ ID NO: 3066672 - DNA, 18 bp, Homo sapiens
agcccagttcagcttggg

SEQ ID NO: 3066673 - DNA, 19 bp, Homo sapiens
agcccatccatagtaactg

SEQ ID NO: 3066674 - DNA, 17 bp, Homo sapiens
aaaagcagctctcccct

SEQ ID NO: 3066675 - DNA, 23 bp, Homo sapiens
aaaagcaggcttgtgctttatac

SEQ ID NO: 3066676 - DNA, 19 bp, Homo sapiens
aaaagcatctgccacaaaa

SEQ ID NO: 3066677 - DNA, 17 bp, Homo sapiens
aaaagcatgatgggaaa

SEQ ID NO: 3066678 - DNA, 15 bp, Homo sapiens
aaaagccatatcatg

SEQ ID NO: 3066679 - DNA, 20 bp, Homo sapiens
aaaagccttcttatatctga

SEQ ID NO: 3066680 - DNA, 15 bp, Homo sapiens
aaaagcgtctttaag

SEQ ID NO: 3066681 - DNA, 19 bp, Homo sapiens
aaaagcgtctttaagagac

SEQ ID NO: 3066682 - DNA, 22 bp, Homo sapiens
aaaagcgtctttaagagactca

SEQ ID NO: 3066683 - DNA, 22 bp, Homo sapiens
aaaagctccatttttagtgaaa

SEQ ID NO: 3066684 - DNA, 17 bp, Homo sapiens
aaaagctgtaagaaaat

SEQ ID NO: 3066685 - DNA, 16 bp, Homo sapiens
aaaagctgtgtctctg

SEQ ID NO: 3066686 - DNA, 11 bp, Homo sapiens
aaaaggaaaaa

SEQ ID NO: 3066687 - DNA, 13 bp, Homo sapiens
aaaaggaaaaaaa

SEQ ID NO: 3066688 - DNA, 21 bp, Homo sapiens
aaaaggaaaaaaagactcttt

SEQ ID NO: 3066689 - DNA, 19 bp, Homo sapiens
aaaaggaacaaaaattaca

SEQ ID NO: 3066690 - DNA, 12 bp, Homo sapiens
aaaaggaagact

SEQ ID NO: 3066691 - DNA, 18 bp, Homo sapiens
aaaaggaagccaaagagt

SEQ ID NO: 3066692 - DNA, 11 bp, Homo sapiens
aaaaggaagga

SEQ ID NO: 3066693 - DNA, 17 bp, Homo sapiens
aaaaggacgtaaaattt

SEQ ID NO: 3066694 - DNA, 18 bp, Homo sapiens
aaaaggacgtaaaattta

SEQ ID NO: 3066695 - DNA, 18 bp, Homo sapiens
aaaaggactggaaaaatg

SEQ ID NO: 3066696 - DNA, 20 bp, Homo sapiens
aaaaggactggaaaaatgaa

SEQ ID NO: 3066697 - DNA, 14 bp, Homo sapiens
aaaaggagagatta

SEQ ID NO: 3066698 - DNA, 18 bp, Homo sapiens
aaaaggagagattattaa

SEQ ID NO: 3066699 - DNA, 21 bp, Homo sapiens
aaaaggatattatctacctgt

SEQ ID NO: 3066700 - DNA, 22 bp, Homo sapiens
aaaaggccaaacctctgttcag

SEQ ID NO: 3066701 - DNA, 23 bp, Homo sapiens
aaaaggccaaacctctgttcagt

SEQ ID NO: 3066702 - DNA, 14 bp, Homo sapiens
aaaagggaaaaaat

SEQ ID NO: 3066703 - DNA, 18 bp, Homo sapiens
aaaagggtcaaacctgta

SEQ ID NO: 3066704 - DNA, 17 bp, Homo sapiens
aaaagggtcagaaggat

SEQ ID NO: 3066705 - DNA, 15 bp, Homo sapiens
aaaaggtataaataa

SEQ ID NO: 3066706 - DNA, 20 bp, Homo sapiens
aaaaggtgcctgtgaggcag

SEQ ID NO: 3066707 - DNA, 22 bp, Homo sapiens
aaaaggtgcctgtgaggcaggg

SEQ ID NO: 3066708 - DNA, 16 bp, Homo sapiens
aaaaggtttacagaat

SEQ ID NO: 3066709 - DNA, 18 bp, Homo sapiens
aaaaggtttacagaattt

SEQ ID NO: 3066710 - DNA, 13 bp, Homo sapiens
aaaagtaatgcct

SEQ ID NO: 3066711 - DNA, 16 bp, Homo sapiens
aaaagtaatgcctctg

SEQ ID NO: 3066712 - DNA, 18 bp, Homo sapiens
aaaagtacaattcattgt

SEQ ID NO: 3066713 - DNA, 12 bp, Homo sapiens
aaaagtattttc

SEQ ID NO: 3066714 - DNA, 14 bp, Homo sapiens
aaaagtcacaatgt

SEQ ID NO: 3066715 - DNA, 21 bp, Homo sapiens
aaaagtcagtatcatattatt

SEQ ID NO: 3066716 - DNA, 13 bp, Homo sapiens
aaaagtccaattt

SEQ ID NO: 3066717 - DNA, 22 bp, Homo sapiens
aaaagtgatcagcaatgaagaa

SEQ ID NO: 3066718 - DNA, 14 bp, Homo sapiens
aaaagtgcctcaag

SEQ ID NO: 3066719 - DNA, 16 bp, Homo sapiens
aaaagtggaagtgaca

SEQ ID NO: 3066720 - DNA, 18 bp, Homo sapiens
aaaagtgggcttgattct

SEQ ID NO: 3066721 - DNA, 21 bp, Homo sapiens
aaaagtgtacctgtaaatgtc

SEQ ID NO: 3066722 - DNA, 21 bp, Homo sapiens
aaaagtgtattttattcagta

SEQ ID NO: 3066723 - DNA, 18 bp, Homo sapiens
aaaagttaatgcttaaga

SEQ ID NO: 3066724 - DNA, 18 bp, Homo sapiens
aaaagttacatgtttgca

SEQ ID NO: 3066725 - DNA, 14 bp, Homo sapiens
aaaagttatttatg

SEQ ID NO: 3066726 - DNA, 22 bp, Homo sapiens
aaaagttccaagagtctaaaga

SEQ ID NO: 3066727 - DNA, 19 bp, Homo sapiens
aaaagttcctctcccttcc

SEQ ID NO: 3066728 - DNA, 18 bp, Homo sapiens
aaaagttgttcaactatt

SEQ ID NO: 3066729 - DNA, 22 bp, Homo sapiens
aaaagtttctatttagttattt

SEQ ID NO: 3066730 - DNA, 23 bp, Homo sapiens
aaaagtttctatttagttattta

SEQ ID NO: 3066731 - DNA, 16 bp, Homo sapiens
aaaagtttgccagaag

SEQ ID NO: 3066732 - DNA, 17 bp, Homo sapiens
aaaagtttgttactttg

SEQ ID NO: 3066733 - DNA, 22 bp, Homo sapiens
aaaagttttttttttgtttgtt

SEQ ID NO: 3066734 - DNA, 15 bp, Homo sapiens
aaaataaaaaatgtg

SEQ ID NO: 3066735 - DNA, 12 bp, Homo sapiens
aaaataaaaagt

SEQ ID NO: 3066736 - DNA, 13 bp, Homo sapiens
aaaataaaaagtt

SEQ ID NO: 3066737 - DNA, 19 bp, Homo sapiens
aaaataaaaagttaaaaag

SEQ ID NO: 3066738 - DNA, 14 bp, Homo sapiens
aaaataaaacaaag

SEQ ID NO: 3066739 - DNA, 15 bp, Homo sapiens
aaaataaaagaaaat

SEQ ID NO: 3066740 - DNA, 14 bp, Homo sapiens
aaaataaaccaaat

SEQ ID NO: 3066741 - DNA, 13 bp, Homo sapiens
aaaataaacctgt

SEQ ID NO: 3066742 - DNA, 15 bp, Homo sapiens
aaaataaataaaagc

SEQ ID NO: 3066743 - DNA, 17 bp, Homo sapiens
aaaataaataaaagcct

SEQ ID NO: 3066744 - DNA, 22 bp, Homo sapiens
aaaataaataccaattatggaa

SEQ ID NO: 3066745 - DNA, 15 bp, Homo sapiens
aaaataaattctctc

SEQ ID NO: 3066746 - DNA, 13 bp, Homo sapiens
aaaataataataa

SEQ ID NO: 3066747 - DNA, 20 bp, Homo sapiens
aaaataatttattttgctct

SEQ ID NO: 3066748 - DNA, 18 bp, Homo sapiens
aaaataattttaaaaatg

SEQ ID NO: 3066749 - DNA, 19 bp, Homo sapiens
aaaataattttaaaaatgg

SEQ ID NO: 3066750 - DNA, 15 bp, Homo sapiens
aaaatacaattattg

SEQ ID NO: 3066751 - DNA, 20 bp, Homo sapiens
aaaatacaattattgtatat

SEQ ID NO: 3066752 - DNA, 22 bp, Homo sapiens
aaaatactacctataggaaagt

SEQ ID NO: 3066753 - DNA, 18 bp, Homo sapiens
aaaatactgccagatgct

SEQ ID NO: 3066754 - DNA, 20 bp, Homo sapiens
aaaatactgccagatgctga

SEQ ID NO: 3066755 - DNA, 13 bp, Homo sapiens
aaaatagacactc

SEQ ID NO: 3066756 - DNA, 16 bp, Homo sapiens
aaaatagagcttttaa

SEQ ID NO: 3066757 - DNA, 16 bp, Homo sapiens
aaaatagaggctttga

SEQ ID NO: 3066758 - DNA, 22 bp, Homo sapiens
aaaataggattgcttcaattaa

SEQ ID NO: 3066759 - DNA, 12 bp, Homo sapiens
aaaataggcagg

SEQ ID NO: 3066760 - DNA, 13 bp, Homo sapiens
aaaatagtgaatt

SEQ ID NO: 3066761 - DNA, 15 bp, Homo sapiens
aaaatataaacaaag

SEQ ID NO: 3066762 - DNA, 10 bp, Homo sapiens
aaaatataac

SEQ ID NO: 3066763 - DNA, 14 bp, Homo sapiens
aaaatatactgtaa

SEQ ID NO: 3066764 - DNA, 18 bp, Homo sapiens
aaaatatactgtaaagaa

SEQ ID NO: 3066765 - DNA, 14 bp, Homo sapiens
aaaatatatgtatt

SEQ ID NO: 3066766 - DNA, 15 bp, Homo sapiens
aaaatatatgtattt

SEQ ID NO: 3066767 - DNA, 13 bp, Homo sapiens
aaaatatatgttg

SEQ ID NO: 3066768 - DNA, 13 bp, Homo sapiens
aaaatatcaagta

SEQ ID NO: 3066769 - DNA, 22 bp, Homo sapiens
aaaatatccaattcatttcttc

SEQ ID NO: 3066770 - DNA, 11 bp, Homo sapiens
aaaatatttaa

SEQ ID NO: 3066771 - DNA, 11 bp, Homo sapiens
aaaatatttcc

SEQ ID NO: 3066772 - DNA, 15 bp, Homo sapiens
aaaatatttcctgac

SEQ ID NO: 3066773 - DNA, 23 bp, Homo sapiens
aaaatattttctctgtacttttc

SEQ ID NO: 3066774 - DNA, 20 bp, Homo sapiens
aaaatattttttatatatac

SEQ ID NO: 3066775 - DNA, 13 bp, Homo sapiens
aaaatcactgttt

SEQ ID NO: 3066776 - DNA, 15 bp, Homo sapiens
aaaatcactgtttgt

SEQ ID NO: 3066777 - DNA, 18 bp, Homo sapiens
aaaatcatcacaattagg

SEQ ID NO: 3066778 - DNA, 19 bp, Homo sapiens
aaaatcatggaatggttat

SEQ ID NO: 3066779 - DNA, 15 bp, Homo sapiens
aaaatccaaaaagaa

SEQ ID NO: 3066780 - DNA, 12 bp, Homo sapiens
aaaatccaaact

SEQ ID NO: 3066781 - DNA, 14 bp, Homo sapiens
aaaatccaaactgc

SEQ ID NO: 3066782 - DNA, 15 bp, Homo sapiens
aaaatctcttgatta

SEQ ID NO: 3066783 - DNA, 22 bp, Homo sapiens
aaaatctgagaaactctacatg

SEQ ID NO: 3066784 - DNA, 18 bp, Homo sapiens
aaaatcttatagttctag

SEQ ID NO: 3066785 - DNA, 19 bp, Homo sapiens
aaaatcttatagttctagg

SEQ ID NO: 3066786 - DNA, 12 bp, Homo sapiens
aaaatcttcagc

SEQ ID NO: 3066787 - DNA, 13 bp, Homo sapiens
aaaatcttcagct

SEQ ID NO: 3066788 - DNA, 19 bp, Homo sapiens
aaaatcttgcagttttgta

SEQ ID NO: 3066789 - DNA, 20 bp, Homo sapiens
aaaatcttgcagttttgtaa

SEQ ID NO: 3066790 - DNA, 13 bp, Homo sapiens
aaaatgaaagatg

SEQ ID NO: 3066791 - DNA, 20 bp, Homo sapiens
aaaatgaacctgcaagcctt

SEQ ID NO: 3066792 - DNA, 18 bp, Homo sapiens
aaaatgaagaaggaagct

SEQ ID NO: 3066793 - DNA, 13 bp, Homo sapiens
aaaatgaagggat

SEQ ID NO: 3066794 - DNA, 16 bp, Homo sapiens
aaaatgaatcctacac

SEQ ID NO: 3066795 - DNA, 22 bp, Homo sapiens
aaaatgagctacttcttattca

SEQ ID NO: 3066796 - DNA, 23 bp, Homo sapiens
aaaatgagtttttatggggctga

SEQ ID NO: 3066797 - DNA, 18 bp, Homo sapiens
aaaatgatgcaaccaaaa

SEQ ID NO: 3066798 - DNA, 18 bp, Homo sapiens
aaaatgcaaatcctatgt

SEQ ID NO: 3066799 - DNA, 22 bp, Homo sapiens
aaaatgcaaatcctatgtgatt

SEQ ID NO: 3066800 - DNA, 15 bp, Homo sapiens
aaaatgcaccaaata

SEQ ID NO: 3066801 - DNA, 14 bp, Homo sapiens
aaaatgcattgtat

SEQ ID NO: 3066802 - DNA, 18 bp, Homo sapiens
aaaatgccataatacaaa

SEQ ID NO: 3066803 - DNA, 16 bp, Homo sapiens
aaaatgctaatattaa

SEQ ID NO: 3066804 - DNA, 16 bp, Homo sapiens
aaaatggaaaaaaaca

SEQ ID NO: 3066805 - DNA, 18 bp, Homo sapiens
aaaatggaaaaaaacata

SEQ ID NO: 3066806 - DNA, 19 bp, Homo sapiens
aaaatggaattactccaaa

SEQ ID NO: 3066807 - DNA, 12 bp, Homo sapiens
aagattcagttt

SEQ ID NO: 3066808 - DNA, 21 bp, Homo sapiens
aagattcagttttcccacttt

SEQ ID NO: 3066809 - DNA, 21 bp, Homo sapiens
aagattccacagagatgttta

SEQ ID NO: 3066810 - DNA, 15 bp, Homo sapiens
aagattcccagagac

SEQ ID NO: 3066811 - DNA, 18 bp, Homo sapiens
aagattcccagagacagg

SEQ ID NO: 3066812 - DNA, 13 bp, Homo sapiens
aagattctaaagg

SEQ ID NO: 3066813 - DNA, 16 bp, Homo sapiens
aagattctaatgatga

SEQ ID NO: 3066814 - DNA, 11 bp, Homo sapiens
aagattctaga

SEQ ID NO: 3066815 - DNA, 13 bp, Homo sapiens
aagattctagatg

SEQ ID NO: 3066816 - DNA, 15 bp, Homo sapiens
aagattctagatgat

SEQ ID NO: 3066817 - DNA, 23 bp, Homo sapiens
aagattctgtgtcagagcccagc

SEQ ID NO: 3066818 - DNA, 22 bp, Homo sapiens
aagatttgtgtttttctttttc

SEQ ID NO: 3066819 - DNA, 14 bp, Homo sapiens
aagattttagggct

SEQ ID NO: 3066820 - DNA, 22 bp, Homo sapiens
aagattttagggcttttatttt

SEQ ID NO: 3066821 - DNA, 15 bp, Homo sapiens
aagattttgaaggaa

SEQ ID NO: 3066822 - DNA, 18 bp, Homo sapiens
aagatttttaaaatgaat

SEQ ID NO: 3066823 - DNA, 14 bp, Homo sapiens
aagcaaaaatgcta

SEQ ID NO: 3066824 - DNA, 17 bp, Homo sapiens
aagcaaaatcttttttc

SEQ ID NO: 3066825 - DNA, 12 bp, Homo sapiens
aagcaaaccagc

SEQ ID NO: 3066826 - DNA, 15 bp, Homo sapiens
aagcaaaggatgtgt

SEQ ID NO: 3066827 - DNA, 23 bp, Homo sapiens
aagcaaatctttctgtaaacaga

SEQ ID NO: 3066828 - DNA, 15 bp, Homo sapiens
aagcaaatgcattct

SEQ ID NO: 3066829 - DNA, 19 bp, Homo sapiens
aagcaaatggaaaatgtat

SEQ ID NO: 3066830 - DNA, 23 bp, Homo sapiens
aagcaacgtgttaattataaaca

SEQ ID NO: 3066831 - DNA, 20 bp, Homo sapiens
aagcaagtgagtctggtgga

SEQ ID NO: 3066832 - DNA, 16 bp, Homo sapiens
aagcaataaatgaatg

SEQ ID NO: 3066833 - DNA, 20 bp, Homo sapiens
aagcaataatcctattgtac

SEQ ID NO: 3066834 - DNA, 22 bp, Homo sapiens
aagcaatcctctcacctcagcc

SEQ ID NO: 3066835 - DNA, 22 bp, Homo sapiens
aagcaatgctgatgaatcactg

SEQ ID NO: 3066836 - DNA, 17 bp, Homo sapiens
aagcaatggatatttgt

SEQ ID NO: 3066837 - DNA, 20 bp, Homo sapiens
aagcaattatttaaagaaag

SEQ ID NO: 3066838 - DNA, 19 bp, Homo sapiens
aagcacaatttaaaacaat

SEQ ID NO: 3066839 - DNA, 19 bp, Homo sapiens
aagcacactcatcccctca

SEQ ID NO: 3066840 - DNA, 18 bp, Homo sapiens
aagcacagtggtggcagg

SEQ ID NO: 3066841 - DNA, 19 bp, Homo sapiens
aagcacagtggtggcaggg

SEQ ID NO: 3066842 - DNA, 24 bp, Homo sapiens
aagcacagtggtggcagggcctag

SEQ ID NO: 3066843 - DNA, 14 bp, Homo sapiens
aagcacagtttgaa

SEQ ID NO: 3066844 - DNA, 17 bp, Homo sapiens
aagcacagtttgaacaa

SEQ ID NO: 3066845 - DNA, 13 bp, Homo sapiens
aagcacctgccga

SEQ ID NO: 3066846 - DNA, 20 bp, Homo sapiens
aagcacctgccgacctcgtc

SEQ ID NO: 3066847 - DNA, 16 bp, Homo sapiens
aagcactaaacaaaga

SEQ ID NO: 3066848 - DNA, 23 bp, Homo sapiens
aagcactacagagcatcccacag

SEQ ID NO: 3066849 - DNA, 15 bp, Homo sapiens
aagcacttcccagga

SEQ ID NO: 3066850 - DNA, 13 bp, Homo sapiens
aagcactttgatt

SEQ ID NO: 3066851 - DNA, 20 bp, Homo sapiens
aagcagaaaataaaggaagc

SEQ ID NO: 3066852 - DNA, 11 bp, Homo sapiens
aagcagaagga

SEQ ID NO: 3066853 - DNA, 14 bp, Homo sapiens
aagcagacagctcc

SEQ ID NO: 3066854 - DNA, 14 bp, Homo sapiens
aagcagagcaaaat

SEQ ID NO: 3066855 - DNA, 19 bp, Homo sapiens
aagcagaggaccagggcct

SEQ ID NO: 3066856 - DNA, 20 bp, Homo sapiens
aagcagaggaggggccgctg

SEQ ID NO: 3066857 - DNA, 14 bp, Homo sapiens
aagcagagggaaat

SEQ ID NO: 3066858 - DNA, 15 bp, Homo sapiens
aagcagagttctttg

SEQ ID NO: 3066859 - DNA, 14 bp, Homo sapiens
aagcagatgcaaag

SEQ ID NO: 3066860 - DNA, 23 bp, Homo sapiens
aagcagatgcaaagaggcaagag

SEQ ID NO: 3066861 - DNA, 17 bp, Homo sapiens
aagcagattttcctaag

SEQ ID NO: 3066862 - DNA, 14 bp, Homo sapiens
aagcagcaaaatcc

SEQ ID NO: 3066863 - DNA, 12 bp, Homo sapiens
aagcagcaacag

SEQ ID NO: 3066864 - DNA, 14 bp, Homo sapiens
aagcagccaagctc

SEQ ID NO: 3066865 - DNA, 21 bp, Homo sapiens
aagcagccaagctccttggga

SEQ ID NO: 3066866 - DNA, 16 bp, Homo sapiens
aagcagccaggaggga

SEQ ID NO: 3066867 - DNA, 17 bp, Homo sapiens
aagcagccaggagggac

SEQ ID NO: 3066868 - DNA, 19 bp, Homo sapiens
aagcagcgctagtggaggg

SEQ ID NO: 3066869 - DNA, 22 bp, Homo sapiens
aagcagcggtcagcagacaagg

SEQ ID NO: 3066870 - DNA, 16 bp, Homo sapiens
aagcagctcaaaggca

SEQ ID NO: 3066871 - DNA, 17 bp, Homo sapiens
aagcagctctaaaacat

SEQ ID NO: 3066872 - DNA, 13 bp, Homo sapiens
aagcagctctccc

SEQ ID NO: 3066873 - DNA, 14 bp, Homo sapiens
aagcagctctcccc

SEQ ID NO: 3066874 - DNA, 17 bp, Homo sapiens
aagcagctctgccttct

SEQ ID NO: 3066875 - DNA, 11 bp, Homo sapiens
aagcagctctt

SEQ ID NO: 3066876 - DNA, 18 bp, Homo sapiens
aagcaggcgctgtgctat

SEQ ID NO: 3066877 - DNA, 18 bp, Homo sapiens
aagcaggttcccaagctc

SEQ ID NO: 3066878 - DNA, 14 bp, Homo sapiens
aagcagtcttgctc

SEQ ID NO: 3066879 - DNA, 21 bp, Homo sapiens
aagcagtggcttagctgccat

SEQ ID NO: 3066880 - DNA, 14 bp, Homo sapiens
aagcagttttgtaa

SEQ ID NO: 3066881 - DNA, 17 bp, Homo sapiens
aagcagttttgtaaatg

SEQ ID NO: 3066882 - DNA, 23 bp, Homo sapiens
aagcagttttgtaaatgtactgg

SEQ ID NO: 3066883 - DNA, 21 bp, Homo sapiens
aagcatatgggttagatgttg

SEQ ID NO: 3066884 - DNA, 15 bp, Homo sapiens
aagcatcctccccac

SEQ ID NO: 3066885 - DNA, 23 bp, Homo sapiens
aagcatcctccccaccagagctg

SEQ ID NO: 3066886 - DNA, 23 bp, Homo sapiens
aagcatcggtcatgtgtgtattt

SEQ ID NO: 3066887 - DNA, 13 bp, Homo sapiens
aagcatctaagtt

SEQ ID NO: 3066888 - DNA, 18 bp, Homo sapiens
aagcatctaagttataag

SEQ ID NO: 3066889 - DNA, 18 bp, Homo sapiens
aagcatctgccacaaaaa

SEQ ID NO: 3066890 - DNA, 23 bp, Homo sapiens
aagcatctgccacaaaaatgttc

SEQ ID NO: 3066891 - DNA, 19 bp, Homo sapiens
aagcatgagtggccttaat

SEQ ID NO: 3066892 - DNA, 18 bp, Homo sapiens
aagcatggccctgctgcc

SEQ ID NO: 3066893 - DNA, 23 bp, Homo sapiens
aagcatgtagccagttaaggaaa

SEQ ID NO: 3066894 - DNA, 13 bp, Homo sapiens
aagcatgtgtcat

SEQ ID NO: 3066895 - DNA, 20 bp, Homo sapiens
aagcatgtttattctgttcc

SEQ ID NO: 3066896 - DNA, 12 bp, Homo sapiens
aagcattcacaa

SEQ ID NO: 3066897 - DNA, 13 bp, Homo sapiens
aagcattcacaac

SEQ ID NO: 3066898 - DNA, 14 bp, Homo sapiens
aagcattccaacaa

SEQ ID NO: 3066899 - DNA, 15 bp, Homo sapiens
aagcattctgtttat

SEQ ID NO: 3066900 - DNA, 17 bp, Homo sapiens
aagcatttccagcctat

SEQ ID NO: 3066901 - DNA, 22 bp, Homo sapiens
aagcatttgtactaagctcctc

SEQ ID NO: 3066902 - DNA, 23 bp, Homo sapiens
aagcatttgtttctactttgata

SEQ ID NO: 3066903 - DNA, 13 bp, Homo sapiens
aagccaagcagcc

SEQ ID NO: 3066904 - DNA, 21 bp, Homo sapiens
aagccaagctgtgttcatcca

SEQ ID NO: 3066905 - DNA, 21 bp, Homo sapiens
aagccaaggtgtcatttatgt

SEQ ID NO: 3066906 - DNA, 14 bp, Homo sapiens
aagccacagcccag

SEQ ID NO: 3066907 - DNA, 18 bp, Homo sapiens
aagccacagcccaggcct

SEQ ID NO: 3066908 - DNA, 24 bp, Homo sapiens
aagccacagcccaggcctccagct

SEQ ID NO: 3066909 - DNA, 12 bp, Homo sapiens
aagccacagcct

SEQ ID NO: 3066910 - DNA, 15 bp, Homo sapiens
aagccaccctcccag

SEQ ID NO: 3066911 - DNA, 18 bp, Homo sapiens
aagccaccctcccagctc

SEQ ID NO: 3066912 - DNA, 14 bp, Homo sapiens
aagccacccttccc

SEQ ID NO: 3066913 - DNA, 18 bp, Homo sapiens
aagccacccttccctgcc

SEQ ID NO: 3066914 - DNA, 12 bp, Homo sapiens
aagccaccgcag

SEQ ID NO: 3066915 - DNA, 16 bp, Homo sapiens
aagccaccgcagctgc

SEQ ID NO: 3066916 - DNA, 20 bp, Homo sapiens
aagccaccgcagctgctgcc

SEQ ID NO: 3066917 - DNA, 23 bp, Homo sapiens
aagccaccgcagctgctgccact

SEQ ID NO: 3066918 - DNA, 20 bp, Homo sapiens
aagccagaagctgagcacca

SEQ ID NO: 3066919 - DNA, 15 bp, Homo sapiens
aagccagagggtggg

SEQ ID NO: 3066920 - DNA, 21 bp, Homo sapiens
aagccagagtggccacggccc

SEQ ID NO: 3066921 - DNA, 23 bp, Homo sapiens
aagccagattttttaaaatttat

SEQ ID NO: 3066922 - DNA, 17 bp, Homo sapiens
aagccagcgtcctcctc

SEQ ID NO: 3066923 - DNA, 19 bp, Homo sapiens
aagccagcgtcctcctctg

SEQ ID NO: 3066924 - DNA, 21 bp, Homo sapiens
aagccaggaatttcccaggac

SEQ ID NO: 3066925 - DNA, 22 bp, Homo sapiens
aagccaggaggctttaagctcc

SEQ ID NO: 3066926 - DNA, 19 bp, Homo sapiens
aagccatatggacactgtg

SEQ ID NO: 3066927 - DNA, 23 bp, Homo sapiens
aagccatatggacactgtgacaa

SEQ ID NO: 3066928 - DNA, 15 bp, Homo sapiens
aagccatcttggtaa

SEQ ID NO: 3066929 - DNA, 14 bp, Homo sapiens
aagccatggagtga

SEQ ID NO: 3066930 - DNA, 23 bp, Homo sapiens
aagcccacctcggccctccctgc

SEQ ID NO: 3066931 - DNA, 12 bp, Homo sapiens
aagcccacctgg

SEQ ID NO: 3066932 - DNA, 14 bp, Homo sapiens
aagcccacctgggc

SEQ ID NO: 3066933 - DNA, 16 bp, Homo sapiens
aagcccactgcctcct

SEQ ID NO: 3066934 - DNA, 17 bp, Homo sapiens
aagcccactgcctcctc

SEQ ID NO: 3066935 - DNA, 21 bp, Homo sapiens
aagcccactgcctcctccctg

SEQ ID NO: 3066936 - DNA, 14 bp, Homo sapiens
aagcccagacctcc

SEQ ID NO: 3066937 - DNA, 19 bp, Homo sapiens
aagcccagttcagcttggg

SEQ ID NO: 3066938 - DNA, 16 bp, Homo sapiens
aagccccacatgtcca

SEQ ID NO: 3066939 - DNA, 21 bp, Homo sapiens
aagtcctttttttccatcttt

SEQ ID NO: 3066940 - DNA, 19 bp, Homo sapiens
aagtctaggagctgggagg

SEQ ID NO: 3066941 - DNA, 17 bp, Homo sapiens
aagtctccagaagaaaa

SEQ ID NO: 3066942 - DNA, 18 bp, Homo sapiens
aagtctccagaagaaaat

SEQ ID NO: 3066943 - DNA, 15 bp, Homo sapiens
aagtctctaattcta

SEQ ID NO: 3066944 - DNA, 15 bp, Homo sapiens
aagtctcttaattct

SEQ ID NO: 3066945 - DNA, 16 bp, Homo sapiens
aagtctttcacattta

SEQ ID NO: 3066946 - DNA, 18 bp, Homo sapiens
aagtcttttgttcgcatg

SEQ ID NO: 3066947 - DNA, 13 bp, Homo sapiens
aagtgaaaatctt

SEQ ID NO: 3066948 - DNA, 18 bp, Homo sapiens
aagtgaaagacatttcaa

SEQ ID NO: 3066949 - DNA, 23 bp, Homo sapiens
aagtgaagaatccttttgtagaa

SEQ ID NO: 3066950 - DNA, 16 bp, Homo sapiens
aagtgaagactggaag

SEQ ID NO: 3066951 - DNA, 16 bp, Homo sapiens
aagtgaagcatggcat

SEQ ID NO: 3066952 - DNA, 17 bp, Homo sapiens
aagtgaatttttctcta

SEQ ID NO: 3066953 - DNA, 22 bp, Homo sapiens
aagtgacagatcctccattttt

SEQ ID NO: 3066954 - DNA, 12 bp, Homo sapiens
aagtgacaggga

SEQ ID NO: 3066955 - DNA, 16 bp, Homo sapiens
aagtgacagggaagct

SEQ ID NO: 3066956 - DNA, 19 bp, Homo sapiens
aagtgacagggaagctaca

SEQ ID NO: 3066957 - DNA, 22 bp, Homo sapiens
aagtgacagggaagctacaggt

SEQ ID NO: 3066958 - DNA, 18 bp, Homo sapiens
aagtgaccacagaagcag

SEQ ID NO: 3066959 - DNA, 13 bp, Homo sapiens
aagtgaccaggga

SEQ ID NO: 3066960 - DNA, 12 bp, Homo sapiens
aagtgagagggg

SEQ ID NO: 3066961 - DNA, 15 bp, Homo sapiens
aagtgagaggggagg

SEQ ID NO: 3066962 - DNA, 19 bp, Homo sapiens
aagtgagaggggagggagg

SEQ ID NO: 3066963 - DNA, 11 bp, Homo sapiens
aagtgaggaag

SEQ ID NO: 3066964 - DNA, 18 bp, Homo sapiens
aagtgagtactgttaaga

SEQ ID NO: 3066965 - DNA, 19 bp, Homo sapiens
aagtgagtgtgctgctgta

SEQ ID NO: 3066966 - DNA, 18 bp, Homo sapiens
aagtgagtgtttctatga

SEQ ID NO: 3066967 - DNA, 16 bp, Homo sapiens
aagtgatgtcatttga

SEQ ID NO: 3066968 - DNA, 19 bp, Homo sapiens
aagtgatgtcatttgagca

SEQ ID NO: 3066969 - DNA, 21 bp, Homo sapiens
aagtgattctcctgcctcagc

SEQ ID NO: 3066970 - DNA, 17 bp, Homo sapiens
aagtgatttccacaggt

SEQ ID NO: 3066971 - DNA, 22 bp, Homo sapiens
aagtgattttatttttgcaaaa

SEQ ID NO: 3066972 - DNA, 23 bp, Homo sapiens
aagtgcaataaatctgacccagt

SEQ ID NO: 3066973 - DNA, 19 bp, Homo sapiens
aagtgccaaagaaagtggt

SEQ ID NO: 3066974 - DNA, 18 bp, Homo sapiens
aagtgctaaagttttctt

SEQ ID NO: 3066975 - DNA, 22 bp, Homo sapiens
aagtgctaaagttttcttccca

SEQ ID NO: 3066976 - DNA, 15 bp, Homo sapiens
aagtgctaaggttct

SEQ ID NO: 3066977 - DNA, 18 bp, Homo sapiens
aagtgctaaggttctaag

SEQ ID NO: 3066978 - DNA, 17 bp, Homo sapiens
aagtgctacagaaagca

SEQ ID NO: 3066979 - DNA, 19 bp, Homo sapiens
aagtgctacagaaagcaca

SEQ ID NO: 3066980 - DNA, 20 bp, Homo sapiens
aagtgctacagaaagcacaa

SEQ ID NO: 3066981 - DNA, 20 bp, Homo sapiens
aagtgctcaagcagcaaaat

SEQ ID NO: 3066982 - DNA, 11 bp, Homo sapiens
aagtgctggga

SEQ ID NO: 3066983 - DNA, 18 bp, Homo sapiens
aagtggaattaaaggaat

SEQ ID NO: 3066984 - DNA, 16 bp, Homo sapiens
aagtggaccaggacag

SEQ ID NO: 3066985 - DNA, 18 bp, Homo sapiens
aagtggacttctgaaaaa

SEQ ID NO: 3066986 - DNA, 23 bp, Homo sapiens
aagtggacttctgaaaaatgaat

SEQ ID NO: 3066987 - DNA, 14 bp, Homo sapiens
aagtggagaaatga

SEQ ID NO: 3066988 - DNA, 20 bp, Homo sapiens
aagtggcagtttttaaaatt

SEQ ID NO: 3066989 - DNA, 13 bp, Homo sapiens
aagtggcctcttg

SEQ ID NO: 3066990 - DNA, 17 bp, Homo sapiens
aagtggcctctttgtct

SEQ ID NO: 3066991 - DNA, 18 bp, Homo sapiens
aagtgggagatgaaaacc

SEQ ID NO: 3066992 - DNA, 11 bp, Homo sapiens
aagtgggccca

SEQ ID NO: 3066993 - DNA, 12 bp, Homo sapiens
aagtgggctggt

SEQ ID NO: 3066994 - DNA, 22 bp, Homo sapiens
aagtgggcttgattctgcagta

SEQ ID NO: 3066995 - DNA, 23 bp, Homo sapiens
aagtggggaccccacccctcatc

SEQ ID NO: 3066996 - DNA, 18 bp, Homo sapiens
aagtggggctaaatgaag

SEQ ID NO: 3066997 - DNA, 19 bp, Homo sapiens
aagtgggggcagagggcag

SEQ ID NO: 3066998 - DNA, 18 bp, Homo sapiens
aagtggtggtaaccctgg

SEQ ID NO: 3066999 - DNA, 14 bp, Homo sapiens
aagtggttcagtct

SEQ ID NO: 3067000 - DNA, 21 bp, Homo sapiens
aagtgtaaagcattccaacaa

SEQ ID NO: 3067001 - DNA, 14 bp, Homo sapiens
aagtgtaattgaga

SEQ ID NO: 3067002 - DNA, 16 bp, Homo sapiens
aagtgtacaagttgct

SEQ ID NO: 3067003 - DNA, 19 bp, Homo sapiens
aagtgtattttaaaataga

SEQ ID NO: 3067004 - DNA, 20 bp, Homo sapiens
aagtgtattttaaaatagag

SEQ ID NO: 3067005 - DNA, 16 bp, Homo sapiens
aagtgtcaccttttct

SEQ ID NO: 3067006 - DNA, 23 bp, Homo sapiens
aagtgtcaccttttcttgcctga

SEQ ID NO: 3067007 - DNA, 13 bp, Homo sapiens
aagtgtcatcaat

SEQ ID NO: 3067008 - DNA, 17 bp, Homo sapiens
aagtgtcttttgacatt

SEQ ID NO: 3067009 - DNA, 19 bp, Homo sapiens
aagtgtcttttgacatttt

SEQ ID NO: 3067010 - DNA, 13 bp, Homo sapiens
aagtgtgagcaaa

SEQ ID NO: 3067011 - DNA, 11 bp, Homo sapiens
aagtgtgattg

SEQ ID NO: 3067012 - DNA, 20 bp, Homo sapiens
aagtgtgattgggaataaat

SEQ ID NO: 3067013 - DNA, 22 bp, Homo sapiens
aagtgtgattgggaataaatat

SEQ ID NO: 3067014 - DNA, 19 bp, Homo sapiens
aagtgtggtcccaacagga

SEQ ID NO: 3067015 - DNA, 21 bp, Homo sapiens
aagtgtgtccatcctgacctg

SEQ ID NO: 3067016 - DNA, 13 bp, Homo sapiens
aagtgttcctgtc

SEQ ID NO: 3067017 - DNA, 15 bp, Homo sapiens
aagtgttcctgtctc

SEQ ID NO: 3067018 - DNA, 17 bp, Homo sapiens
aagtgttcctgtctcaa

SEQ ID NO: 3067019 - DNA, 15 bp, Homo sapiens
aagtgttgaaaaata

SEQ ID NO: 3067020 - DNA, 16 bp, Homo sapiens
aagtgttgaaaaatat

SEQ ID NO: 3067021 - DNA, 16 bp, Homo sapiens
aagtgttgaaaatgta

SEQ ID NO: 3067022 - DNA, 22 bp, Homo sapiens
aagtgttgaaaatgtatttcct

SEQ ID NO: 3067023 - DNA, 23 bp, Homo sapiens
aagtgttgaaaatgtatttcctg

SEQ ID NO: 3067024 - DNA, 18 bp, Homo sapiens
aagtgttttgtaccagtg

SEQ ID NO: 3067025 - DNA, 19 bp, Homo sapiens
aagttaaaaaacagctgca

SEQ ID NO: 3067026 - DNA, 18 bp, Homo sapiens
aagttaaacattgaagta

SEQ ID NO: 3067027 - DNA, 22 bp, Homo sapiens
aagttaaagtcacacatttcta

SEQ ID NO: 3067028 - DNA, 14 bp, Homo sapiens
aagttaataagcaa

SEQ ID NO: 3067029 - DNA, 15 bp, Homo sapiens
aagttaataagttga

SEQ ID NO: 3067030 - DNA, 19 bp, Homo sapiens
aagttaatccactgtgact

SEQ ID NO: 3067031 - DNA, 17 bp, Homo sapiens
aagttaatgaatatgcc

SEQ ID NO: 3067032 - DNA, 21 bp, Homo sapiens
aagttaatgcttaagagggaa

SEQ ID NO: 3067033 - DNA, 16 bp, Homo sapiens
aagttaatttaaagtt

SEQ ID NO: 3067034 - DNA, 17 bp, Homo sapiens
aagttaatttaaagttg

SEQ ID NO: 3067035 - DNA, 23 bp, Homo sapiens
aagttacatgcataaaagggtca

SEQ ID NO: 3067036 - DNA, 16 bp, Homo sapiens
aagttacatgtttgca

SEQ ID NO: 3067037 - DNA, 20 bp, Homo sapiens
aagttaggttataagaaaca

SEQ ID NO: 3067038 - DNA, 23 bp, Homo sapiens
aagttagtctactcttaagccat

SEQ ID NO: 3067039 - DNA, 15 bp, Homo sapiens
aagttataagactct

SEQ ID NO: 3067040 - DNA, 23 bp, Homo sapiens
aagttatataggttttgtttgct

SEQ ID NO: 3067041 - DNA, 20 bp, Homo sapiens
aagttattagtggtttatca

SEQ ID NO: 3067042 - DNA, 17 bp, Homo sapiens
aagttattgcagtttat

SEQ ID NO: 3067043 - DNA, 23 bp, Homo sapiens
aagttattgcagtttatcattca

SEQ ID NO: 3067044 - DNA, 13 bp, Homo sapiens
aagttcacagtag

SEQ ID NO: 3067045 - DNA, 16 bp, Homo sapiens
aagttcatttttatcc

SEQ ID NO: 3067046 - DNA, 15 bp, Homo sapiens
aagttccaagagtct

SEQ ID NO: 3067047 - DNA, 16 bp, Homo sapiens
aagttccaagagtcta

SEQ ID NO: 3067048 - DNA, 19 bp, Homo sapiens
aagttccatatagacacca

SEQ ID NO: 3067049 - DNA, 17 bp, Homo sapiens
aagttcctctcccttcc

SEQ ID NO: 3067050 - DNA, 15 bp, Homo sapiens
aagttcctgctgcct

SEQ ID NO: 3067051 - DNA, 16 bp, Homo sapiens
aagttcctgctgcctg

SEQ ID NO: 3067052 - DNA, 23 bp, Homo sapiens
aagttcgaacatgtttcacttaa

SEQ ID NO: 3067053 - DNA, 11 bp, Homo sapiens
aagttctaaga

SEQ ID NO: 3067054 - DNA, 14 bp, Homo sapiens
aagttctaagattc

SEQ ID NO: 3067055 - DNA, 15 bp, Homo sapiens
aagttctaagattct

SEQ ID NO: 3067056 - DNA, 16 bp, Homo sapiens
aagttctaagattctg

SEQ ID NO: 3067057 - DNA, 19 bp, Homo sapiens
aagttctaataatttctaa

SEQ ID NO: 3067058 - DNA, 13 bp, Homo sapiens
aagttctcattgt

SEQ ID NO: 3067059 - DNA, 19 bp, Homo sapiens
aagttctgctttctcccca

SEQ ID NO: 3067060 - DNA, 12 bp, Homo sapiens
aagttctgggtg

SEQ ID NO: 3067061 - DNA, 19 bp, Homo sapiens
aagttgcaaagtggaatta

SEQ ID NO: 3067062 - DNA, 17 bp, Homo sapiens
aagttgcagtctttttt

SEQ ID NO: 3067063 - DNA, 22 bp, Homo sapiens
aagttggggcccagtccttggc

SEQ ID NO: 3067064 - DNA, 23 bp, Homo sapiens
aagttggtcttactttgtgcaaa

SEQ ID NO: 3067065 - DNA, 17 bp, Homo sapiens
aagttgtaaaatgtcaa

SEQ ID NO: 3067066 - DNA, 12 bp, Homo sapiens
aagttgtacatg

SEQ ID NO: 3067067 - DNA, 14 bp, Homo sapiens
aagttgttcaacta

SEQ ID NO: 3067068 - DNA, 13 bp, Homo sapiens
aagttgtttgcat

SEQ ID NO: 3067069 - DNA, 17 bp, Homo sapiens
aagttgtttgtcatctt

SEQ ID NO: 3067070 - DNA, 21 bp, Homo sapiens
aagtttaactttaaaactgta

SEQ ID NO: 3067071 - DNA, 13 bp, Homo sapiens
aatctgtacaatg

SEQ ID NO: 3067072 - DNA, 15 bp, Homo sapiens
aatctgtataaatgt

SEQ ID NO: 3067073 - DNA, 16 bp, Homo sapiens
aatctgtataaatgtc

SEQ ID NO: 3067074 - DNA, 17 bp, Homo sapiens
aatctgtataaatgtct

SEQ ID NO: 3067075 - DNA, 21 bp, Homo sapiens
aatctgtataaatgtctatta

SEQ ID NO: 3067076 - DNA, 20 bp, Homo sapiens
aatctgtatctgtagtgaga

SEQ ID NO: 3067077 - DNA, 12 bp, Homo sapiens
aatctgtcataa

SEQ ID NO: 3067078 - DNA, 14 bp, Homo sapiens
aatctgtcctctgt

SEQ ID NO: 3067079 - DNA, 20 bp, Homo sapiens
aatctgtgtacaaagaaata

SEQ ID NO: 3067080 - DNA, 12 bp, Homo sapiens
aatctgttctac

SEQ ID NO: 3067081 - DNA, 19 bp, Homo sapiens
aatctgttgtttgaagaac

SEQ ID NO: 3067082 - DNA, 15 bp, Homo sapiens
aatctgtttttctaa

SEQ ID NO: 3067083 - DNA, 17 bp, Homo sapiens
aatcttaaaaagttgtt

SEQ ID NO: 3067084 - DNA, 21 bp, Homo sapiens
aatcttaaaaagttgttcaac

SEQ ID NO: 3067085 - DNA, 13 bp, Homo sapiens
aatcttacaaaat

SEQ ID NO: 3067086 - DNA, 18 bp, Homo sapiens
aatcttatagttctaggc

SEQ ID NO: 3067087 - DNA, 11 bp, Homo sapiens
aatcttcagct

SEQ ID NO: 3067088 - DNA, 13 bp, Homo sapiens
aatcttcagctgg

SEQ ID NO: 3067089 - DNA, 23 bp, Homo sapiens
aatcttgttttaagcaaatgcat

SEQ ID NO: 3067090 - DNA, 20 bp, Homo sapiens
aatctttcacttgaaagatt

SEQ ID NO: 3067091 - DNA, 13 bp, Homo sapiens
aatctttctgcag

SEQ ID NO: 3067092 - DNA, 18 bp, Homo sapiens
aatctttctgtaaacaga

SEQ ID NO: 3067093 - DNA, 20 bp, Homo sapiens
aatctttctgtaaacagaat

SEQ ID NO: 3067094 - DNA, 14 bp, Homo sapiens
aatctttgaaagac

SEQ ID NO: 3067095 - DNA, 12 bp, Homo sapiens
aatcttttacaa

SEQ ID NO: 3067096 - DNA, 21 bp, Homo sapiens
aatcttttacaactgcctcga

SEQ ID NO: 3067097 - DNA, 23 bp, Homo sapiens
aatcttttacaactgcctcgaaa

SEQ ID NO: 3067098 - DNA, 13 bp, Homo sapiens
aatgaaaaatgaa

SEQ ID NO: 3067099 - DNA, 14 bp, Homo sapiens
aatgaaaaatgaaa

SEQ ID NO: 3067100 - DNA, 14 bp, Homo sapiens
aatgaaaataagaa

SEQ ID NO: 3067101 - DNA, 20 bp, Homo sapiens
aatgaaacccccacacacac

SEQ ID NO: 3067102 - DNA, 16 bp, Homo sapiens
aatgaaataatcagtg

SEQ ID NO: 3067103 - DNA, 16 bp, Homo sapiens
aatgaaatgtatgtgc

SEQ ID NO: 3067104 - DNA, 17 bp, Homo sapiens
aatgaaatgtatgtgct

SEQ ID NO: 3067105 - DNA, 18 bp, Homo sapiens
aatgaacactcttttgct

SEQ ID NO: 3067106 - DNA, 21 bp, Homo sapiens
aatgaacactcttttgcttta

SEQ ID NO: 3067107 - DNA, 18 bp, Homo sapiens
aatgaactgatttttatt

SEQ ID NO: 3067108 - DNA, 11 bp, Homo sapiens
aatgaactttg

SEQ ID NO: 3067109 - DNA, 15 bp, Homo sapiens
aatgaagaaggaagc

SEQ ID NO: 3067110 - DNA, 14 bp, Homo sapiens
aatgaagcttgtgt

SEQ ID NO: 3067111 - DNA, 17 bp, Homo sapiens
aatgaagcttgtgtatc

SEQ ID NO: 3067112 - DNA, 12 bp, Homo sapiens
aatgaatatgcc

SEQ ID NO: 3067113 - DNA, 14 bp, Homo sapiens
aatgaatgtaaaag

SEQ ID NO: 3067114 - DNA, 14 bp, Homo sapiens
aatgaattgaaatt

SEQ ID NO: 3067115 - DNA, 17 bp, Homo sapiens
aatgaatttgactggtt

SEQ ID NO: 3067116 - DNA, 15 bp, Homo sapiens
aatgacacatttgtt

SEQ ID NO: 3067117 - DNA, 11 bp, Homo sapiens
aatgacactgt

SEQ ID NO: 3067118 - DNA, 11 bp, Homo sapiens
aatgacagagc

SEQ ID NO: 3067119 - DNA, 13 bp, Homo sapiens
aatgactgaaaga

SEQ ID NO: 3067120 - DNA, 15 bp, Homo sapiens
aatgactgaaagaag

SEQ ID NO: 3067121 - DNA, 21 bp, Homo sapiens
aatgactgaaagaagaacagc

SEQ ID NO: 3067122 - DNA, 21 bp, Homo sapiens
aatgactgccctgtttctgtt

SEQ ID NO: 3067123 - DNA, 13 bp, Homo sapiens
aatgacttagaaa

SEQ ID NO: 3067124 - DNA, 15 bp, Homo sapiens
aatgacttagaaaca

SEQ ID NO: 3067125 - DNA, 12 bp, Homo sapiens
aatgagaaagga

SEQ ID NO: 3067126 - DNA, 13 bp, Homo sapiens
aatgagaaatgga

SEQ ID NO: 3067127 - DNA, 21 bp, Homo sapiens
aatgagaaggccaatagtttt

SEQ ID NO: 3067128 - DNA, 13 bp, Homo sapiens
aatgagaatctac

SEQ ID NO: 3067129 - DNA, 17 bp, Homo sapiens
aatgagacttgccttcc

SEQ ID NO: 3067130 - DNA, 15 bp, Homo sapiens
aatgagattcagtga

SEQ ID NO: 3067131 - DNA, 20 bp, Homo sapiens
aatgagcatctcaaatgttt

SEQ ID NO: 3067132 - DNA, 18 bp, Homo sapiens
aatgagccatgatttccc

SEQ ID NO: 3067133 - DNA, 21 bp, Homo sapiens
aatgagcctacgctgaagatg

SEQ ID NO: 3067134 - DNA, 17 bp, Homo sapiens
aatgagctacttcttat

SEQ ID NO: 3067135 - DNA, 20 bp, Homo sapiens
aatgagctacttcttattca

SEQ ID NO: 3067136 - DNA, 16 bp, Homo sapiens
aatgaggagagaaaat

SEQ ID NO: 3067137 - DNA, 21 bp, Homo sapiens
aatgaggcagggatactctgt

SEQ ID NO: 3067138 - DNA, 14 bp, Homo sapiens
aatgagtctgttgt

SEQ ID NO: 3067139 - DNA, 15 bp, Homo sapiens
aatgagtggccagcg

SEQ ID NO: 3067140 - DNA, 14 bp, Homo sapiens
aatgagtgtgaagg

SEQ ID NO: 3067141 - DNA, 15 bp, Homo sapiens
aatgatagaactgta

SEQ ID NO: 3067142 - DNA, 13 bp, Homo sapiens
aatgatatgcatt

SEQ ID NO: 3067143 - DNA, 17 bp, Homo sapiens
aatgatcagcaaaaaga

SEQ ID NO: 3067144 - DNA, 23 bp, Homo sapiens
aatgatcctgtattcagacagat

SEQ ID NO: 3067145 - DNA, 19 bp, Homo sapiens
aatgatgacaaaaaatgtt

SEQ ID NO: 3067146 - DNA, 15 bp, Homo sapiens
aatgatgacttgagc

SEQ ID NO: 3067147 - DNA, 15 bp, Homo sapiens
aatgatgattatgga

SEQ ID NO: 3067148 - DNA, 13 bp, Homo sapiens
aatgatgtcttta

SEQ ID NO: 3067149 - DNA, 20 bp, Homo sapiens
aatgatgttgataatttcag

SEQ ID NO: 3067150 - DNA, 12 bp, Homo sapiens
aatgattaatca

SEQ ID NO: 3067151 - DNA, 14 bp, Homo sapiens
aatgattcagtgtt

SEQ ID NO: 3067152 - DNA, 21 bp, Homo sapiens
aatgattcagtgttaaatgtg

SEQ ID NO: 3067153 - DNA, 15 bp, Homo sapiens
aatgatttttgtgta

SEQ ID NO: 3067154 - DNA, 13 bp, Homo sapiens
aatgcaagctctg

SEQ ID NO: 3067155 - DNA, 16 bp, Homo sapiens
aatgcacacagcggct

SEQ ID NO: 3067156 - DNA, 21 bp, Homo sapiens
aatgcacacagcggctgcctc

SEQ ID NO: 3067157 - DNA, 22 bp, Homo sapiens
aatgcacacagcggctgcctcc

SEQ ID NO: 3067158 - DNA, 11 bp, Homo sapiens
aatgcactttc

SEQ ID NO: 3067159 - DNA, 13 bp, Homo sapiens
aatgcactttcta

SEQ ID NO: 3067160 - DNA, 12 bp, Homo sapiens
aatgcagcactg

SEQ ID NO: 3067161 - DNA, 14 bp, Homo sapiens
aatgcagcactgct

SEQ ID NO: 3067162 - DNA, 12 bp, Homo sapiens
aatgcagcccat

SEQ ID NO: 3067163 - DNA, 22 bp, Homo sapiens
aatgcagggattgctgccactt

SEQ ID NO: 3067164 - DNA, 23 bp, Homo sapiens
aatgcagggattgctgccacttt

SEQ ID NO: 3067165 - DNA, 15 bp, Homo sapiens
aatgcagtatatttc

SEQ ID NO: 3067166 - DNA, 20 bp, Homo sapiens
aatgcagtctgtccaggctc

SEQ ID NO: 3067167 - DNA, 20 bp, Homo sapiens
aatgcagttgtggtgtgcca

SEQ ID NO: 3067168 - DNA, 13 bp, Homo sapiens
aatgcattattga

SEQ ID NO: 3067169 - DNA, 14 bp, Homo sapiens
aatgcattctggag

SEQ ID NO: 3067170 - DNA, 15 bp, Homo sapiens
aatgcattctggaga

SEQ ID NO: 3067171 - DNA, 14 bp, Homo sapiens
aatgcattgatatt

SEQ ID NO: 3067172 - DNA, 20 bp, Homo sapiens
aatgcattgatattgtgaac

SEQ ID NO: 3067173 - DNA, 21 bp, Homo sapiens
aatgcattgatattgtgaaca

SEQ ID NO: 3067174 - DNA, 21 bp, Homo sapiens
aatgcattgtatcgatgttat

SEQ ID NO: 3067175 - DNA, 21 bp, Homo sapiens
aatgcatttggaaccaaagtc

SEQ ID NO: 3067176 - DNA, 15 bp, Homo sapiens
aatgccaagtgcctg

SEQ ID NO: 3067177 - DNA, 16 bp, Homo sapiens
aatgccaagtgcctgc

SEQ ID NO: 3067178 - DNA, 12 bp, Homo sapiens
aatgccaatgtc

SEQ ID NO: 3067179 - DNA, 15 bp, Homo sapiens
aatgccactttttca

SEQ ID NO: 3067180 - DNA, 18 bp, Homo sapiens
aatgccataatacaaaag

SEQ ID NO: 3067181 - DNA, 22 bp, Homo sapiens
aatgccatgatgcctctgtctt

SEQ ID NO: 3067182 - DNA, 19 bp, Homo sapiens
aatgccatttatttattga

SEQ ID NO: 3067183 - DNA, 18 bp, Homo sapiens
aatgccattttaaggaaa

SEQ ID NO: 3067184 - DNA, 22 bp, Homo sapiens
aatgccattttaaggaaaacta

SEQ ID NO: 3067185 - DNA, 22 bp, Homo sapiens
aatgcccagccagccacccctg

SEQ ID NO: 3067186 - DNA, 18 bp, Homo sapiens
aatgcccccagctggccc

SEQ ID NO: 3067187 - DNA, 22 bp, Homo sapiens
aatgcctgactagggagccatg

SEQ ID NO: 3067188 - DNA, 13 bp, Homo sapiens
aatgcgattttat

SEQ ID NO: 3067189 - DNA, 16 bp, Homo sapiens
aatgcgattttattac

SEQ ID NO: 3067190 - DNA, 14 bp, Homo sapiens
aatgctaaatgtgt

SEQ ID NO: 3067191 - DNA, 16 bp, Homo sapiens
aatgctaaatgtgtaa

SEQ ID NO: 3067192 - DNA, 17 bp, Homo sapiens
aatgctaatattaaaag

SEQ ID NO: 3067193 - DNA, 22 bp, Homo sapiens
aatgctaccggggaccgggacc

SEQ ID NO: 3067194 - DNA, 17 bp, Homo sapiens
aatgctacgtgtgattt

SEQ ID NO: 3067195 - DNA, 14 bp, Homo sapiens
aatgctagaagaaa

SEQ ID NO: 3067196 - DNA, 17 bp, Homo sapiens
aatgctatactggaaat

SEQ ID NO: 3067197 - DNA, 14 bp, Homo sapiens
aatgctattatact

SEQ ID NO: 3067198 - DNA, 14 bp, Homo sapiens
aatgctctcctttc

SEQ ID NO: 3067199 - DNA, 13 bp, Homo sapiens
aatgctctgatta

SEQ ID NO: 3067200 - DNA, 13 bp, Homo sapiens
aatgctcttgtcc

SEQ ID NO: 3067201 - DNA, 15 bp, Homo sapiens
aatgctgaggttatg

SEQ ID NO: 3067202 - DNA, 13 bp, Homo sapiens
aatgctgtacatc

SEQ ID NO: 3067203 - DNA, 15 bp, Homo sapiens
aatgctgtacatcta

SEQ ID NO: 3067204 - DNA, 23 bp, Homo sapiens
aatgctgtacatctattttggat

SEQ ID NO: 3067205 - DNA, 14 bp, Homo sapiens
acacaggtctttcc

SEQ ID NO: 3067206 - DNA, 20 bp, Homo sapiens
acacaggtggtgtcactgtc

SEQ ID NO: 3067207 - DNA, 22 bp, Homo sapiens
acacagtgctgaccagacagcc

SEQ ID NO: 3067208 - DNA, 13 bp, Homo sapiens
acacatatgaggg

SEQ ID NO: 3067209 - DNA, 12 bp, Homo sapiens
acacatcagcat

SEQ ID NO: 3067210 - DNA, 19 bp, Homo sapiens
acacatcagcatgttttct

SEQ ID NO: 3067211 - DNA, 15 bp, Homo sapiens
acacatcccagccca

SEQ ID NO: 3067212 - DNA, 18 bp, Homo sapiens
acacatcgttgccgcagc

SEQ ID NO: 3067213 - DNA, 19 bp, Homo sapiens
acacatctctgtcagtgtg

SEQ ID NO: 3067214 - DNA, 17 bp, Homo sapiens
acacatctgggtgccct

SEQ ID NO: 3067215 - DNA, 18 bp, Homo sapiens
acacatctgggtgccctg

SEQ ID NO: 3067216 - DNA, 22 bp, Homo sapiens
acacatctgggtgccctgaaag

SEQ ID NO: 3067217 - DNA, 17 bp, Homo sapiens
acacatctgtggagatg

SEQ ID NO: 3067218 - DNA, 18 bp, Homo sapiens
acacatgcatacacacac

SEQ ID NO: 3067219 - DNA, 17 bp, Homo sapiens
acacatggtgagcctag

SEQ ID NO: 3067220 - DNA, 18 bp, Homo sapiens
acacatgtcctatccaaa

SEQ ID NO: 3067221 - DNA, 20 bp, Homo sapiens
acacatgtcctatccaaagg

SEQ ID NO: 3067222 - DNA, 19 bp, Homo sapiens
acacattaaaagacaaata

SEQ ID NO: 3067223 - DNA, 19 bp, Homo sapiens
acacatttctattttgcaa

SEQ ID NO: 3067224 - DNA, 13 bp, Homo sapiens
acacattttgtat

SEQ ID NO: 3067225 - DNA, 15 bp, Homo sapiens
acaccaaagttctaa

SEQ ID NO: 3067226 - DNA, 20 bp, Homo sapiens
acaccaaatataacaagtat

SEQ ID NO: 3067227 - DNA, 14 bp, Homo sapiens
acaccaagcacagc

SEQ ID NO: 3067228 - DNA, 16 bp, Homo sapiens
acaccaagcacagcag

SEQ ID NO: 3067229 - DNA, 13 bp, Homo sapiens
acaccaagcagca

SEQ ID NO: 3067230 - DNA, 11 bp, Homo sapiens
acaccacacac

SEQ ID NO: 3067231 - DNA, 19 bp, Homo sapiens
acaccacacacaacagcca

SEQ ID NO: 3067232 - DNA, 18 bp, Homo sapiens
acaccaccgagctctgtg

SEQ ID NO: 3067233 - DNA, 16 bp, Homo sapiens
acaccactcctgccag

SEQ ID NO: 3067234 - DNA, 16 bp, Homo sapiens
acaccagcagcactgg

SEQ ID NO: 3067235 - DNA, 13 bp, Homo sapiens
acaccagccctgc

SEQ ID NO: 3067236 - DNA, 19 bp, Homo sapiens
acaccagccctgctgcttc

SEQ ID NO: 3067237 - DNA, 13 bp, Homo sapiens
acaccagcctcct

SEQ ID NO: 3067238 - DNA, 19 bp, Homo sapiens
acaccatcgctggcccctt

SEQ ID NO: 3067239 - DNA, 13 bp, Homo sapiens
acacccaaagctg

SEQ ID NO: 3067240 - DNA, 14 bp, Homo sapiens
acacccaaagctga

SEQ ID NO: 3067241 - DNA, 15 bp, Homo sapiens
acacccactcagctc

SEQ ID NO: 3067242 - DNA, 12 bp, Homo sapiens
acacccagcccc

SEQ ID NO: 3067243 - DNA, 22 bp, Homo sapiens
acacccagggtctagccgctgc

SEQ ID NO: 3067244 - DNA, 21 bp, Homo sapiens
acacccctcagttgtgcagct

SEQ ID NO: 3067245 - DNA, 16 bp, Homo sapiens
acaccctgcctgctgt

SEQ ID NO: 3067246 - DNA, 19 bp, Homo sapiens
acaccctgcctgctgtgga

SEQ ID NO: 3067247 - DNA, 21 bp, Homo sapiens
acaccctgcctgctgtggagc

SEQ ID NO: 3067248 - DNA, 13 bp, Homo sapiens
acacccttttaac

SEQ ID NO: 3067249 - DNA, 14 bp, Homo sapiens
acaccgccagcagc

SEQ ID NO: 3067250 - DNA, 16 bp, Homo sapiens
acaccgtggcctgggc

SEQ ID NO: 3067251 - DNA, 18 bp, Homo sapiens
acaccgttcattcaggca

SEQ ID NO: 3067252 - DNA, 19 bp, Homo sapiens
acacctgagaaacatctag

SEQ ID NO: 3067253 - DNA, 12 bp, Homo sapiens
acacctgatgtg

SEQ ID NO: 3067254 - DNA, 18 bp, Homo sapiens
acacctgatgtgtacatc

SEQ ID NO: 3067255 - DNA, 15 bp, Homo sapiens
acacctgcacctccc

SEQ ID NO: 3067256 - DNA, 16 bp, Homo sapiens
acacctggtctgtttt

SEQ ID NO: 3067257 - DNA, 22 bp, Homo sapiens
acacctgttcacagaaaaagca

SEQ ID NO: 3067258 - DNA, 14 bp, Homo sapiens
acacgcaggagcac

SEQ ID NO: 3067259 - DNA, 18 bp, Homo sapiens
acacgcaggcggccaggg

SEQ ID NO: 3067260 - DNA, 22 bp, Homo sapiens
acacggagcccagccctcccca

SEQ ID NO: 3067261 - DNA, 20 bp, Homo sapiens
acacggctggtcactctgcc

SEQ ID NO: 3067262 - DNA, 22 bp, Homo sapiens
acacggctggtcactctgccct

SEQ ID NO: 3067263 - DNA, 19 bp, Homo sapiens
acacgtcgttctaattaaa

SEQ ID NO: 3067264 - DNA, 17 bp, Homo sapiens
acacgtttaatcccagc

SEQ ID NO: 3067265 - DNA, 21 bp, Homo sapiens
acacgtttaatcccagcactt

SEQ ID NO: 3067266 - DNA, 17 bp, Homo sapiens
acactacaagtttataa

SEQ ID NO: 3067267 - DNA, 19 bp, Homo sapiens
acactacaagtttataagc

SEQ ID NO: 3067268 - DNA, 22 bp, Homo sapiens
acactagctaatatcaatagaa

SEQ ID NO: 3067269 - DNA, 15 bp, Homo sapiens
acactatgtgtgttg

SEQ ID NO: 3067270 - DNA, 22 bp, Homo sapiens
acactatgtgtgttgtttccat

SEQ ID NO: 3067271 - DNA, 14 bp, Homo sapiens
acactatttgtgac

SEQ ID NO: 3067272 - DNA, 13 bp, Homo sapiens
acactcaaaatga

SEQ ID NO: 3067273 - DNA, 13 bp, Homo sapiens
acactcagcacaa

SEQ ID NO: 3067274 - DNA, 11 bp, Homo sapiens
acactcagggc

SEQ ID NO: 3067275 - DNA, 21 bp, Homo sapiens
acactcagggcagctgcctgg

SEQ ID NO: 3067276 - DNA, 14 bp, Homo sapiens
acactcccttgggc

SEQ ID NO: 3067277 - DNA, 19 bp, Homo sapiens
acactcctcctgccagctc

SEQ ID NO: 3067278 - DNA, 22 bp, Homo sapiens
acactccttccccttgtccctg

SEQ ID NO: 3067279 - DNA, 17 bp, Homo sapiens
acactcgccatctcctg

SEQ ID NO: 3067280 - DNA, 15 bp, Homo sapiens
acactctccttgcag

SEQ ID NO: 3067281 - DNA, 18 bp, Homo sapiens
acactctccttgcagttc

SEQ ID NO: 3067282 - DNA, 23 bp, Homo sapiens
acactctccttgcagttcttgag

SEQ ID NO: 3067283 - DNA, 21 bp, Homo sapiens
acactcttttgctttattcca

SEQ ID NO: 3067284 - DNA, 15 bp, Homo sapiens
acactgaaaaaatac

SEQ ID NO: 3067285 - DNA, 15 bp, Homo sapiens
acactgaaattgcct

SEQ ID NO: 3067286 - DNA, 18 bp, Homo sapiens
acactgaaattgcctgaa

SEQ ID NO: 3067287 - DNA, 20 bp, Homo sapiens
acactgaccaagtgctggcc

SEQ ID NO: 3067288 - DNA, 23 bp, Homo sapiens
acactgacttaggtttcaggaag

SEQ ID NO: 3067289 - DNA, 16 bp, Homo sapiens
acactgaggcagggaa

SEQ ID NO: 3067290 - DNA, 17 bp, Homo sapiens
acactgaggcagggaag

SEQ ID NO: 3067291 - DNA, 23 bp, Homo sapiens
acactgatgcaaggattacagaa

SEQ ID NO: 3067292 - DNA, 11 bp, Homo sapiens
acactgccagc

SEQ ID NO: 3067293 - DNA, 16 bp, Homo sapiens
acactgccccaggact

SEQ ID NO: 3067294 - DNA, 15 bp, Homo sapiens
acactgccctcgcac

SEQ ID NO: 3067295 - DNA, 12 bp, Homo sapiens
acactgcctgcc

SEQ ID NO: 3067296 - DNA, 15 bp, Homo sapiens
acactgcctgggctg

SEQ ID NO: 3067297 - DNA, 22 bp, Homo sapiens
acactggaccaggtcctgctcc

SEQ ID NO: 3067298 - DNA, 16 bp, Homo sapiens
acactggactccggcc

SEQ ID NO: 3067299 - DNA, 19 bp, Homo sapiens
acactggaggagagaagaa

SEQ ID NO: 3067300 - DNA, 20 bp, Homo sapiens
acactggaggagagaagaat

SEQ ID NO: 3067301 - DNA, 22 bp, Homo sapiens
acactggaggagagaagaatga

SEQ ID NO: 3067302 - DNA, 16 bp, Homo sapiens
acactggccccacagg

SEQ ID NO: 3067303 - DNA, 17 bp, Homo sapiens
acactggccccacagga

SEQ ID NO: 3067304 - DNA, 19 bp, Homo sapiens
acactggccccacaggagt

SEQ ID NO: 3067305 - DNA, 22 bp, Homo sapiens
acactgggaggccgaggcaggg

SEQ ID NO: 3067306 - DNA, 15 bp, Homo sapiens
acactggttctcaat

SEQ ID NO: 3067307 - DNA, 21 bp, Homo sapiens
acactggttctcaatgaaaaa

SEQ ID NO: 3067308 - DNA, 21 bp, Homo sapiens
acactggttgtagtcagtttt

SEQ ID NO: 3067309 - DNA, 14 bp, Homo sapiens
acactgtgtctcta

SEQ ID NO: 3067310 - DNA, 14 bp, Homo sapiens
acacttaatactac

SEQ ID NO: 3067311 - DNA, 18 bp, Homo sapiens
acacttactgtaagacat

SEQ ID NO: 3067312 - DNA, 23 bp, Homo sapiens
acacttccaaagactccctccat

SEQ ID NO: 3067313 - DNA, 19 bp, Homo sapiens
acacttcttacgcaatgct

SEQ ID NO: 3067314 - DNA, 21 bp, Homo sapiens
acacttgccctgctccctctc

SEQ ID NO: 3067315 - DNA, 14 bp, Homo sapiens
acacttggtaattg

SEQ ID NO: 3067316 - DNA, 18 bp, Homo sapiens
acacttggtgctgggaac

SEQ ID NO: 3067317 - DNA, 18 bp, Homo sapiens
acacttgtgccagcccgg

SEQ ID NO: 3067318 - DNA, 16 bp, Homo sapiens
acacttttaaaataaa

SEQ ID NO: 3067319 - DNA, 12 bp, Homo sapiens
acagaaaatata

SEQ ID NO: 3067320 - DNA, 13 bp, Homo sapiens
acagaaaatatac

SEQ ID NO: 3067321 - DNA, 13 bp, Homo sapiens
acagaaacactgc

SEQ ID NO: 3067322 - DNA, 18 bp, Homo sapiens
acagaaacactgcctttt

SEQ ID NO: 3067323 - DNA, 12 bp, Homo sapiens
acagaaactgat

SEQ ID NO: 3067324 - DNA, 22 bp, Homo sapiens
acagaaagaaaaatgcattatt

SEQ ID NO: 3067325 - DNA, 18 bp, Homo sapiens
acagaaagtggtgctcag

SEQ ID NO: 3067326 - DNA, 17 bp, Homo sapiens
acagaaagtttgtaaaa

SEQ ID NO: 3067327 - DNA, 13 bp, Homo sapiens
acagaaatgagga

SEQ ID NO: 3067328 - DNA, 14 bp, Homo sapiens
acagaaatgtttct

SEQ ID NO: 3067329 - DNA, 16 bp, Homo sapiens
acagaaatgtttctgt

SEQ ID NO: 3067330 - DNA, 19 bp, Homo sapiens
acagaaccagcagaacagc

SEQ ID NO: 3067331 - DNA, 23 bp, Homo sapiens
acagaaccttgttatttctcaga

SEQ ID NO: 3067332 - DNA, 20 bp, Homo sapiens
acagaactctttcaaaacct

SEQ ID NO: 3067333 - DNA, 14 bp, Homo sapiens
acagaagcacatgc

SEQ ID NO: 3067334 - DNA, 13 bp, Homo sapiens
acagaagcagctc

SEQ ID NO: 3067335 - DNA, 22 bp, Homo sapiens
acagaaggtgaactttgtgctt

SEQ ID NO: 3067336 - DNA, 23 bp, Homo sapiens
acagaataaaagttcctctccct

SEQ ID NO: 3067337 - DNA, 18 bp, Homo sapiens
acagaatgaaaaatgaaa

SEQ ID NO: 3067338 - DNA, 19 bp, Homo sapiens
acagtttgtgctctactgt

SEQ ID NO: 3067339 - DNA, 13 bp, Homo sapiens
acagtttgtttcc

SEQ ID NO: 3067340 - DNA, 15 bp, Homo sapiens
acagtttgtttcctg

SEQ ID NO: 3067341 - DNA, 16 bp, Homo sapiens
acagtttgtttcctgt

SEQ ID NO: 3067342 - DNA, 14 bp, Homo sapiens
acagttttccttct

SEQ ID NO: 3067343 - DNA, 19 bp, Homo sapiens
acagttttgtggactgagc

SEQ ID NO: 3067344 - DNA, 20 bp, Homo sapiens
acataaaaagcagaatttta

SEQ ID NO: 3067345 - DNA, 23 bp, Homo sapiens
acataaaaagcagaattttaatg

SEQ ID NO: 3067346 - DNA, 18 bp, Homo sapiens
acataaatagtagaaaaa

SEQ ID NO: 3067347 - DNA, 21 bp, Homo sapiens
acataacaacctttcccattt

SEQ ID NO: 3067348 - DNA, 18 bp, Homo sapiens
acataacctcagagtatc

SEQ ID NO: 3067349 - DNA, 22 bp, Homo sapiens
acataacctcagagtatcttta

SEQ ID NO: 3067350 - DNA, 18 bp, Homo sapiens
acataactgatctattta

SEQ ID NO: 3067351 - DNA, 23 bp, Homo sapiens
acataagatcactgccagagata

SEQ ID NO: 3067352 - DNA, 22 bp, Homo sapiens
acataagcggcgtaagtttaaa

SEQ ID NO: 3067353 - DNA, 14 bp, Homo sapiens
acataatagaattt

SEQ ID NO: 3067354 - DNA, 16 bp, Homo sapiens
acataatagaatttcc

SEQ ID NO: 3067355 - DNA, 16 bp, Homo sapiens
acataattcactctga

SEQ ID NO: 3067356 - DNA, 17 bp, Homo sapiens
acataattcactctgag

SEQ ID NO: 3067357 - DNA, 12 bp, Homo sapiens
acataattgatt

SEQ ID NO: 3067358 - DNA, 14 bp, Homo sapiens
acataattgtgacc

SEQ ID NO: 3067359 - DNA, 23 bp, Homo sapiens
acataattgtgaccaatacattt

SEQ ID NO: 3067360 - DNA, 13 bp, Homo sapiens
acatacaccagca

SEQ ID NO: 3067361 - DNA, 14 bp, Homo sapiens
acatacaccagcat

SEQ ID NO: 3067362 - DNA, 18 bp, Homo sapiens
acatacagaattactgta

SEQ ID NO: 3067363 - DNA, 16 bp, Homo sapiens
acatacagtgatatgg

SEQ ID NO: 3067364 - DNA, 17 bp, Homo sapiens
acatactaggtgccttt

SEQ ID NO: 3067365 - DNA, 24 bp, Homo sapiens
acatactccttccatcaaatagaa

SEQ ID NO: 3067366 - DNA, 12 bp, Homo sapiens
acatactgctgt

SEQ ID NO: 3067367 - DNA, 18 bp, Homo sapiens
acatacttgaagggccag

SEQ ID NO: 3067368 - DNA, 21 bp, Homo sapiens
acatacttgaagggccagagc

SEQ ID NO: 3067369 - DNA, 20 bp, Homo sapiens
acatacttttgctttcagta

SEQ ID NO: 3067370 - DNA, 13 bp, Homo sapiens
acatagaaaaatg

SEQ ID NO: 3067371 - DNA, 14 bp, Homo sapiens
acatagaaaaatga

SEQ ID NO: 3067372 - DNA, 12 bp, Homo sapiens
acatagaaatgg

SEQ ID NO: 3067373 - DNA, 12 bp, Homo sapiens
acatagacattt

SEQ ID NO: 3067374 - DNA, 16 bp, Homo sapiens
acatagacatttcaaa

SEQ ID NO: 3067375 - DNA, 17 bp, Homo sapiens
acatagacatttcaaaa

SEQ ID NO: 3067376 - DNA, 20 bp, Homo sapiens
acatagacatttcaaaatta

SEQ ID NO: 3067377 - DNA, 13 bp, Homo sapiens
acatagaccctct

SEQ ID NO: 3067378 - DNA, 14 bp, Homo sapiens
acatagcagactag

SEQ ID NO: 3067379 - DNA, 18 bp, Homo sapiens
acatagcatgacatttct

SEQ ID NO: 3067380 - DNA, 21 bp, Homo sapiens
acatagcatgacatttctttg

SEQ ID NO: 3067381 - DNA, 18 bp, Homo sapiens
acatagccaactctccca

SEQ ID NO: 3067382 - DNA, 20 bp, Homo sapiens
acatagccctggtgctcctg

SEQ ID NO: 3067383 - DNA, 19 bp, Homo sapiens
acatagtgggccttcatta

SEQ ID NO: 3067384 - DNA, 15 bp, Homo sapiens
acatagtttttcctg

SEQ ID NO: 3067385 - DNA, 17 bp, Homo sapiens
acatatatatatataac

SEQ ID NO: 3067386 - DNA, 14 bp, Homo sapiens
acatatatattaca

SEQ ID NO: 3067387 - DNA, 16 bp, Homo sapiens
acatatattatatata

SEQ ID NO: 3067388 - DNA, 20 bp, Homo sapiens
acatatattatatatagaaa

SEQ ID NO: 3067389 - DNA, 15 bp, Homo sapiens
acatatctaaagtca

SEQ ID NO: 3067390 - DNA, 16 bp, Homo sapiens
acatatgatactgatg

SEQ ID NO: 3067391 - DNA, 15 bp, Homo sapiens
acatatgcaccttgt

SEQ ID NO: 3067392 - DNA, 16 bp, Homo sapiens
acatatgcaccttgtg

SEQ ID NO: 3067393 - DNA, 17 bp, Homo sapiens
acatatgcaccttgtgt

SEQ ID NO: 3067394 - DNA, 18 bp, Homo sapiens
acatatgcaccttgtgtc

SEQ ID NO: 3067395 - DNA, 19 bp, Homo sapiens
acatatgcaccttgtgtct

SEQ ID NO: 3067396 - DNA, 22 bp, Homo sapiens
acatattaagaatagtctctgg

SEQ ID NO: 3067397 - DNA, 21 bp, Homo sapiens
acatattgcaggagacatttt

SEQ ID NO: 3067398 - DNA, 13 bp, Homo sapiens
acatatttaactg

SEQ ID NO: 3067399 - DNA, 16 bp, Homo sapiens
acatatttaatgtttt

SEQ ID NO: 3067400 - DNA, 21 bp, Homo sapiens
acatatttaatgttttaaatg

SEQ ID NO: 3067401 - DNA, 18 bp, Homo sapiens
acatcaacccgagtcatt

SEQ ID NO: 3067402 - DNA, 17 bp, Homo sapiens
acatcacacagtatact

SEQ ID NO: 3067403 - DNA, 19 bp, Homo sapiens
acatcacagggtgggcctc

SEQ ID NO: 3067404 - DNA, 22 bp, Homo sapiens
acatcagaagtaactcccactc

SEQ ID NO: 3067405 - DNA, 19 bp, Homo sapiens
acatcagcactttaccaga

SEQ ID NO: 3067406 - DNA, 18 bp, Homo sapiens
acatcagcatgttttctg

SEQ ID NO: 3067407 - DNA, 12 bp, Homo sapiens
acatcagccagc

SEQ ID NO: 3067408 - DNA, 14 bp, Homo sapiens
acatcagccatttt

SEQ ID NO: 3067409 - DNA, 22 bp, Homo sapiens
acatcagctggtcaaacaaact

SEQ ID NO: 3067410 - DNA, 18 bp, Homo sapiens
acatcaggagactgggct

SEQ ID NO: 3067411 - DNA, 23 bp, Homo sapiens
acatcaggagactgggctctggc

SEQ ID NO: 3067412 - DNA, 18 bp, Homo sapiens
acatcagttactctgaag

SEQ ID NO: 3067413 - DNA, 15 bp, Homo sapiens
acatcatattggaga

SEQ ID NO: 3067414 - DNA, 17 bp, Homo sapiens
acatcattttgttttcc

SEQ ID NO: 3067415 - DNA, 19 bp, Homo sapiens
acatccaaagcagacagct

SEQ ID NO: 3067416 - DNA, 13 bp, Homo sapiens
acatccataaaga

SEQ ID NO: 3067417 - DNA, 15 bp, Homo sapiens
acatccataaagaag

SEQ ID NO: 3067418 - DNA, 18 bp, Homo sapiens
acatcccactggatctgg

SEQ ID NO: 3067419 - DNA, 23 bp, Homo sapiens
acatcccagcccaatccaggtac

SEQ ID NO: 3067420 - DNA, 21 bp, Homo sapiens
acatcccagtagtgtttggaa

SEQ ID NO: 3067421 - DNA, 22 bp, Homo sapiens
acatcccagtagtgtttggaat

SEQ ID NO: 3067422 - DNA, 17 bp, Homo sapiens
acatccccagagcccag

SEQ ID NO: 3067423 - DNA, 18 bp, Homo sapiens
acatccccagagcccagc

SEQ ID NO: 3067424 - DNA, 23 bp, Homo sapiens
acatccccagagcccagctcttg

SEQ ID NO: 3067425 - DNA, 18 bp, Homo sapiens
acatcccgggacgcagca

SEQ ID NO: 3067426 - DNA, 16 bp, Homo sapiens
acatccctgccagctc

SEQ ID NO: 3067427 - DNA, 16 bp, Homo sapiens
acatccgcgtgtgcct

SEQ ID NO: 3067428 - DNA, 23 bp, Homo sapiens
acatccgcgtgtgcctgtgtgcg

SEQ ID NO: 3067429 - DNA, 14 bp, Homo sapiens
acatcctgtgtttc

SEQ ID NO: 3067430 - DNA, 15 bp, Homo sapiens
acatcctttttctgc

SEQ ID NO: 3067431 - DNA, 21 bp, Homo sapiens
acatcgacaaccacgtaccaa

SEQ ID NO: 3067432 - DNA, 18 bp, Homo sapiens
acatcgttgttttgctgg

SEQ ID NO: 3067433 - DNA, 21 bp, Homo sapiens
acatctaaattgatcattcat

SEQ ID NO: 3067434 - DNA, 22 bp, Homo sapiens
acatctaaattgatcattcata

SEQ ID NO: 3067435 - DNA, 14 bp, Homo sapiens
acatctattctctc

SEQ ID NO: 3067436 - DNA, 23 bp, Homo sapiens
acatctattttggattgtatatt

SEQ ID NO: 3067437 - DNA, 23 bp, Homo sapiens
acatctctttgaattttctgtgt

SEQ ID NO: 3067438 - DNA, 16 bp, Homo sapiens
acatctgacccagagg

SEQ ID NO: 3067439 - DNA, 20 bp, Homo sapiens
acatctgcaatatgaattca

SEQ ID NO: 3067440 - DNA, 22 bp, Homo sapiens
acatctgtgcagggctggtttg

SEQ ID NO: 3067441 - DNA, 16 bp, Homo sapiens
acatctgtgtcttgtt

SEQ ID NO: 3067442 - DNA, 24 bp, Homo sapiens
acatcttgtcttttcccctcattg

SEQ ID NO: 3067443 - DNA, 12 bp, Homo sapiens
acatctttcaca

SEQ ID NO: 3067444 - DNA, 13 bp, Homo sapiens
acatctttcacat

SEQ ID NO: 3067445 - DNA, 18 bp, Homo sapiens
acatctttcctcaagtat

SEQ ID NO: 3067446 - DNA, 18 bp, Homo sapiens
acatcttttaagacaaat

SEQ ID NO: 3067447 - DNA, 19 bp, Homo sapiens
acatcttttttcacaaatt

SEQ ID NO: 3067448 - DNA, 14 bp, Homo sapiens
acatgaaaacattg

SEQ ID NO: 3067449 - DNA, 18 bp, Homo sapiens
acatgaaacctacacact

SEQ ID NO: 3067450 - DNA, 12 bp, Homo sapiens
acatgaaatgat

SEQ ID NO: 3067451 - DNA, 13 bp, Homo sapiens
acatgaaatgata

SEQ ID NO: 3067452 - DNA, 18 bp, Homo sapiens
acatgaaatttttgtaaa

SEQ ID NO: 3067453 - DNA, 14 bp, Homo sapiens
acatgaacagcttg

SEQ ID NO: 3067454 - DNA, 13 bp, Homo sapiens
acatgaagaaata

SEQ ID NO: 3067455 - DNA, 17 bp, Homo sapiens
acatgacatcaaaatga

SEQ ID NO: 3067456 - DNA, 16 bp, Homo sapiens
acatgagaaagggaga

SEQ ID NO: 3067457 - DNA, 18 bp, Homo sapiens
acatgaggaactgtagat

SEQ ID NO: 3067458 - DNA, 12 bp, Homo sapiens
acatgatgcttt

SEQ ID NO: 3067459 - DNA, 16 bp, Homo sapiens
acatgatttccttgaa

SEQ ID NO: 3067460 - DNA, 21 bp, Homo sapiens
acatgatttccttgaatgtgg

SEQ ID NO: 3067461 - DNA, 17 bp, Homo sapiens
acatgcactcagctctt

SEQ ID NO: 3067462 - DNA, 21 bp, Homo sapiens
acatgcagtagcactttggta

SEQ ID NO: 3067463 - DNA, 16 bp, Homo sapiens
acatgcagtttgaaat

SEQ ID NO: 3067464 - DNA, 17 bp, Homo sapiens
acatgcagtttgaaatt

SEQ ID NO: 3067465 - DNA, 19 bp, Homo sapiens
acatgcataaaagggtcaa

SEQ ID NO: 3067466 - DNA, 13 bp, Homo sapiens
acatgcatacaca

SEQ ID NO: 3067467 - DNA, 17 bp, Homo sapiens
acatgcatacacacaca

SEQ ID NO: 3067468 - DNA, 24 bp, Homo sapiens
acatgcatacacacacacacacag

SEQ ID NO: 3067469 - DNA, 16 bp, Homo sapiens
acatgcatacttcaaa

SEQ ID NO: 3067470 - DNA, 19 bp, Homo sapiens
accccagagccacacatgg

SEQ ID NO: 3067471 - DNA, 22 bp, Homo sapiens
accccagcacagctcctcccct

SEQ ID NO: 3067472 - DNA, 22 bp, Homo sapiens
accccagcattctcaggcacca

SEQ ID NO: 3067473 - DNA, 11 bp, Homo sapiens
accccagctcc

SEQ ID NO: 3067474 - DNA, 13 bp, Homo sapiens
accccaggcccac

SEQ ID NO: 3067475 - DNA, 18 bp, Homo sapiens
accccaggcccactcagg

SEQ ID NO: 3067476 - DNA, 10 bp, Homo sapiens
accccagggc

SEQ ID NO: 3067477 - DNA, 13 bp, Homo sapiens
accccagggcctg

SEQ ID NO: 3067478 - DNA, 15 bp, Homo sapiens
accccagggcctgag

SEQ ID NO: 3067479 - DNA, 17 bp, Homo sapiens
accccagggcctgagcc

SEQ ID NO: 3067480 - DNA, 20 bp, Homo sapiens
accccatcactcgcaggacc

SEQ ID NO: 3067481 - DNA, 16 bp, Homo sapiens
accccatgctgttgat

SEQ ID NO: 3067482 - DNA, 19 bp, Homo sapiens
accccatggctgcacagtt

SEQ ID NO: 3067483 - DNA, 23 bp, Homo sapiens
accccatgtcaccggatcctggg

SEQ ID NO: 3067484 - DNA, 16 bp, Homo sapiens
acccccaaattttctt

SEQ ID NO: 3067485 - DNA, 15 bp, Homo sapiens
acccccactccagct

SEQ ID NO: 3067486 - DNA, 12 bp, Homo sapiens
acccccagcact

SEQ ID NO: 3067487 - DNA, 15 bp, Homo sapiens
acccccagcccccac

SEQ ID NO: 3067488 - DNA, 22 bp, Homo sapiens
acccccagccctggcccctcca

SEQ ID NO: 3067489 - DNA, 22 bp, Homo sapiens
acccccagtgtattttgtccaa

SEQ ID NO: 3067490 - DNA, 21 bp, Homo sapiens
accccccccattagaatgtga

SEQ ID NO: 3067491 - DNA, 20 bp, Homo sapiens
acccccctccccaactccct

SEQ ID NO: 3067492 - DNA, 18 bp, Homo sapiens
acccccgccccctgccct

SEQ ID NO: 3067493 - DNA, 21 bp, Homo sapiens
acccccgggatcctgccccca

SEQ ID NO: 3067494 - DNA, 20 bp, Homo sapiens
acccccgtggggcagggagc

SEQ ID NO: 3067495 - DNA, 18 bp, Homo sapiens
accccctcatcccccagt

SEQ ID NO: 3067496 - DNA, 13 bp, Homo sapiens
accccctccccag

SEQ ID NO: 3067497 - DNA, 14 bp, Homo sapiens
accccctccccagg

SEQ ID NO: 3067498 - DNA, 15 bp, Homo sapiens
accccctccttcaga

SEQ ID NO: 3067499 - DNA, 17 bp, Homo sapiens
accccctccttcagaca

SEQ ID NO: 3067500 - DNA, 16 bp, Homo sapiens
accccctcgcctccta

SEQ ID NO: 3067501 - DNA, 19 bp, Homo sapiens
accccctctcctggagggc

SEQ ID NO: 3067502 - DNA, 22 bp, Homo sapiens
accccctcttctgagcacagat

SEQ ID NO: 3067503 - DNA, 19 bp, Homo sapiens
acccccttcctactcccag

SEQ ID NO: 3067504 - DNA, 16 bp, Homo sapiens
accccctttcccttct

SEQ ID NO: 3067505 - DNA, 17 bp, Homo sapiens
accccgaggccctgcat

SEQ ID NO: 3067506 - DNA, 22 bp, Homo sapiens
accccgcctgcctcctggctca

SEQ ID NO: 3067507 - DNA, 17 bp, Homo sapiens
accccgcggcccagacc

SEQ ID NO: 3067508 - DNA, 20 bp, Homo sapiens
accccgcggcccagacccag

SEQ ID NO: 3067509 - DNA, 13 bp, Homo sapiens
accccgggccgga

SEQ ID NO: 3067510 - DNA, 19 bp, Homo sapiens
accccggtggcggccccag

SEQ ID NO: 3067511 - DNA, 15 bp, Homo sapiens
accccgtctctacta

SEQ ID NO: 3067512 - DNA, 11 bp, Homo sapiens
acccctcacca

SEQ ID NO: 3067513 - DNA, 20 bp, Homo sapiens
acccctcaccacccccactg

SEQ ID NO: 3067514 - DNA, 12 bp, Homo sapiens
acccctccagga

SEQ ID NO: 3067515 - DNA, 21 bp, Homo sapiens
acccctcccccacgtctctct

SEQ ID NO: 3067516 - DNA, 22 bp, Homo sapiens
acccctcccccacgtctctctg

SEQ ID NO: 3067517 - DNA, 20 bp, Homo sapiens
acccctcctggggccaggcc

SEQ ID NO: 3067518 - DNA, 21 bp, Homo sapiens
acccctcctggggccaggccg

SEQ ID NO: 3067519 - DNA, 13 bp, Homo sapiens
acccctgccactc

SEQ ID NO: 3067520 - DNA, 14 bp, Homo sapiens
acccctgccactca

SEQ ID NO: 3067521 - DNA, 16 bp, Homo sapiens
acccctgccactcacc

SEQ ID NO: 3067522 - DNA, 18 bp, Homo sapiens
acccctgccctgctccta

SEQ ID NO: 3067523 - DNA, 13 bp, Homo sapiens
acccctgcctcga

SEQ ID NO: 3067524 - DNA, 14 bp, Homo sapiens
acccctgcctcgag

SEQ ID NO: 3067525 - DNA, 11 bp, Homo sapiens
acccctggctg

SEQ ID NO: 3067526 - DNA, 22 bp, Homo sapiens
acccctggctgaacagtgctct

SEQ ID NO: 3067527 - DNA, 18 bp, Homo sapiens
accccttcgacatgctgc

SEQ ID NO: 3067528 - DNA, 20 bp, Homo sapiens
accccttcgacatgctgcca

SEQ ID NO: 3067529 - DNA, 22 bp, Homo sapiens
accccttcgacatgctgccagg

SEQ ID NO: 3067530 - DNA, 16 bp, Homo sapiens
accccttctctgtgac

SEQ ID NO: 3067531 - DNA, 15 bp, Homo sapiens
acccctttccccagc

SEQ ID NO: 3067532 - DNA, 19 bp, Homo sapiens
acccgacaccagccctgct

SEQ ID NO: 3067533 - DNA, 23 bp, Homo sapiens
acccgaccccccgtgggctcccg

SEQ ID NO: 3067534 - DNA, 13 bp, Homo sapiens
acccgaggcccag

SEQ ID NO: 3067535 - DNA, 23 bp, Homo sapiens
acccgaggcccagatccaaggcc

SEQ ID NO: 3067536 - DNA, 15 bp, Homo sapiens
acccgccttcagcct

SEQ ID NO: 3067537 - DNA, 21 bp, Homo sapiens
acccggattggccctgcccct

SEQ ID NO: 3067538 - DNA, 23 bp, Homo sapiens
acccggattggccctgcccctcc

SEQ ID NO: 3067539 - DNA, 15 bp, Homo sapiens
acccggcggccctgc

SEQ ID NO: 3067540 - DNA, 13 bp, Homo sapiens
acccggctaattt

SEQ ID NO: 3067541 - DNA, 20 bp, Homo sapiens
acccgggaaggaaggctctc

SEQ ID NO: 3067542 - DNA, 16 bp, Homo sapiens
acccgtgacagtggct

SEQ ID NO: 3067543 - DNA, 13 bp, Homo sapiens
acccgtgcctggg

SEQ ID NO: 3067544 - DNA, 16 bp, Homo sapiens
acccgtgcctgggccc

SEQ ID NO: 3067545 - DNA, 15 bp, Homo sapiens
accctaaagcgacat

SEQ ID NO: 3067546 - DNA, 14 bp, Homo sapiens
accctaagggcagc

SEQ ID NO: 3067547 - DNA, 15 bp, Homo sapiens
accctaagggcagcc

SEQ ID NO: 3067548 - DNA, 15 bp, Homo sapiens
accctaccccaccac

SEQ ID NO: 3067549 - DNA, 13 bp, Homo sapiens
accctaccttccc

SEQ ID NO: 3067550 - DNA, 16 bp, Homo sapiens
accctaccttccccag

SEQ ID NO: 3067551 - DNA, 18 bp, Homo sapiens
accctagcctccaccatc

SEQ ID NO: 3067552 - DNA, 21 bp, Homo sapiens
accctagcctccaccatcccc

SEQ ID NO: 3067553 - DNA, 22 bp, Homo sapiens
accctagttctcttatctttga

SEQ ID NO: 3067554 - DNA, 19 bp, Homo sapiens
accctatttaaatgaaagg

SEQ ID NO: 3067555 - DNA, 19 bp, Homo sapiens
accctcaccacccaacagt

SEQ ID NO: 3067556 - DNA, 15 bp, Homo sapiens
accctcccagctctg

SEQ ID NO: 3067557 - DNA, 16 bp, Homo sapiens
accctcccagctctga

SEQ ID NO: 3067558 - DNA, 21 bp, Homo sapiens
accctccctccactcctctca

SEQ ID NO: 3067559 - DNA, 23 bp, Homo sapiens
accctccctctactgggagccta

SEQ ID NO: 3067560 - DNA, 19 bp, Homo sapiens
accctcctctatttcttta

SEQ ID NO: 3067561 - DNA, 11 bp, Homo sapiens
accctctggaa

SEQ ID NO: 3067562 - DNA, 13 bp, Homo sapiens
accctctgtcccc

SEQ ID NO: 3067563 - DNA, 17 bp, Homo sapiens
accctctgtccccacga

SEQ ID NO: 3067564 - DNA, 18 bp, Homo sapiens
accctctgtccccaggcc

SEQ ID NO: 3067565 - DNA, 13 bp, Homo sapiens
accctcttcatgg

SEQ ID NO: 3067566 - DNA, 18 bp, Homo sapiens
accctcttctcctctggc

SEQ ID NO: 3067567 - DNA, 19 bp, Homo sapiens
accctctttcttgtttgtc

SEQ ID NO: 3067568 - DNA, 22 bp, Homo sapiens
accctctttcttgtttgtcagc

SEQ ID NO: 3067569 - DNA, 21 bp, Homo sapiens
accctgaagcagaggccttta

SEQ ID NO: 3067570 - DNA, 17 bp, Homo sapiens
accctgaaggggccatg

SEQ ID NO: 3067571 - DNA, 22 bp, Homo sapiens
accctgagatctgcacagtcag

SEQ ID NO: 3067572 - DNA, 22 bp, Homo sapiens
accctgagctgaggcagcagtg

SEQ ID NO: 3067573 - DNA, 10 bp, Homo sapiens
accctgcccc

SEQ ID NO: 3067574 - DNA, 21 bp, Homo sapiens
accctgccctcatgggacctg

SEQ ID NO: 3067575 - DNA, 17 bp, Homo sapiens
accctgcctgctgtgga

SEQ ID NO: 3067576 - DNA, 24 bp, Homo sapiens
accctggaaactaccagtgggcat

SEQ ID NO: 3067577 - DNA, 15 bp, Homo sapiens
accctggcattatgt

SEQ ID NO: 3067578 - DNA, 21 bp, Homo sapiens
accctggccgagtccaagctg

SEQ ID NO: 3067579 - DNA, 14 bp, Homo sapiens
accctggcctggtc

SEQ ID NO: 3067580 - DNA, 21 bp, Homo sapiens
accctggggctggcttttctg

SEQ ID NO: 3067581 - DNA, 14 bp, Homo sapiens
accctgggggcaca

SEQ ID NO: 3067582 - DNA, 19 bp, Homo sapiens
accctgggtttggcccctg

SEQ ID NO: 3067583 - DNA, 20 bp, Homo sapiens
accctgggtttggcccctgg

SEQ ID NO: 3067584 - DNA, 21 bp, Homo sapiens
accctgggtttggcccctgga

SEQ ID NO: 3067585 - DNA, 15 bp, Homo sapiens
accctgtatatagcc

SEQ ID NO: 3067586 - DNA, 20 bp, Homo sapiens
accctgtatatagcccagcc

SEQ ID NO: 3067587 - DNA, 17 bp, Homo sapiens
accctgtgcaggagcta

SEQ ID NO: 3067588 - DNA, 16 bp, Homo sapiens
accctgttcaggctgg

SEQ ID NO: 3067589 - DNA, 18 bp, Homo sapiens
accctgtttggattttta

SEQ ID NO: 3067590 - DNA, 15 bp, Homo sapiens
acccttaggcctttt

SEQ ID NO: 3067591 - DNA, 11 bp, Homo sapiens
acccttcctca

SEQ ID NO: 3067592 - DNA, 20 bp, Homo sapiens
acccttcctcatctgtgcct

SEQ ID NO: 3067593 - DNA, 21 bp, Homo sapiens
acccttcctcatctgtgcctg

SEQ ID NO: 3067594 - DNA, 14 bp, Homo sapiens
acccttcctggccc

SEQ ID NO: 3067595 - DNA, 16 bp, Homo sapiens
acccttcctggcccag

SEQ ID NO: 3067596 - DNA, 19 bp, Homo sapiens
acccttcctggcccaggcc

SEQ ID NO: 3067597 - DNA, 17 bp, Homo sapiens
acccttctcctcttgta

SEQ ID NO: 3067598 - DNA, 13 bp, Homo sapiens
acccttgagccct

SEQ ID NO: 3067599 - DNA, 15 bp, Homo sapiens
acccttgagccctcc

SEQ ID NO: 3067600 - DNA, 15 bp, Homo sapiens
acccttggtagagtt

SEQ ID NO: 3067601 - DNA, 16 bp, Homo sapiens
acccttggtagagttt

SEQ ID NO: 3067602 - DNA, 19 bp, Homo sapiens
accttgacctttgtacagc

SEQ ID NO: 3067603 - DNA, 16 bp, Homo sapiens
accttgactgttgatg

SEQ ID NO: 3067604 - DNA, 18 bp, Homo sapiens
accttgagcagaatacaa

SEQ ID NO: 3067605 - DNA, 19 bp, Homo sapiens
accttgagcagaatacaat

SEQ ID NO: 3067606 - DNA, 23 bp, Homo sapiens
accttgagcagaatacaatggga

SEQ ID NO: 3067607 - DNA, 21 bp, Homo sapiens
accttgattttcttctttgtg

SEQ ID NO: 3067608 - DNA, 13 bp, Homo sapiens
accttgcagtatt

SEQ ID NO: 3067609 - DNA, 13 bp, Homo sapiens
accttgcctcctt

SEQ ID NO: 3067610 - DNA, 22 bp, Homo sapiens
accttgcctccttttttcttaa

SEQ ID NO: 3067611 - DNA, 12 bp, Homo sapiens
accttgcttctt

SEQ ID NO: 3067612 - DNA, 19 bp, Homo sapiens
accttggagcatttatgta

SEQ ID NO: 3067613 - DNA, 23 bp, Homo sapiens
accttggagcatttatgtagaca

SEQ ID NO: 3067614 - DNA, 16 bp, Homo sapiens
accttggcccaggagc

SEQ ID NO: 3067615 - DNA, 17 bp, Homo sapiens
accttggcccaggagct

SEQ ID NO: 3067616 - DNA, 18 bp, Homo sapiens
accttggcccaggagctc

SEQ ID NO: 3067617 - DNA, 16 bp, Homo sapiens
accttgggaccaaagg

SEQ ID NO: 3067618 - DNA, 23 bp, Homo sapiens
accttggtgtagttgaactgata

SEQ ID NO: 3067619 - DNA, 12 bp, Homo sapiens
accttgtaaaag

SEQ ID NO: 3067620 - DNA, 14 bp, Homo sapiens
accttgtgcctggg

SEQ ID NO: 3067621 - DNA, 16 bp, Homo sapiens
accttgtgcctggggt

SEQ ID NO: 3067622 - DNA, 22 bp, Homo sapiens
accttgtggtctcgatgctgct

SEQ ID NO: 3067623 - DNA, 21 bp, Homo sapiens
accttgtgtctgtacacgtgt

SEQ ID NO: 3067624 - DNA, 17 bp, Homo sapiens
accttgttatttctcag

SEQ ID NO: 3067625 - DNA, 13 bp, Homo sapiens
accttgtttgttt

SEQ ID NO: 3067626 - DNA, 19 bp, Homo sapiens
accttgtttgttttattca

SEQ ID NO: 3067627 - DNA, 16 bp, Homo sapiens
acctttatccctgctt

SEQ ID NO: 3067628 - DNA, 14 bp, Homo sapiens
acctttcaaagctt

SEQ ID NO: 3067629 - DNA, 15 bp, Homo sapiens
acctttcagaactca

SEQ ID NO: 3067630 - DNA, 19 bp, Homo sapiens
acctttcataatctttgct

SEQ ID NO: 3067631 - DNA, 14 bp, Homo sapiens
acctttccactccc

SEQ ID NO: 3067632 - DNA, 11 bp, Homo sapiens
acctttctagt

SEQ ID NO: 3067633 - DNA, 17 bp, Homo sapiens
acctttctccactgggt

SEQ ID NO: 3067634 - DNA, 15 bp, Homo sapiens
acctttctcctttgt

SEQ ID NO: 3067635 - DNA, 19 bp, Homo sapiens
acctttctcctttgtactt

SEQ ID NO: 3067636 - DNA, 16 bp, Homo sapiens
acctttcttcttgtgt

SEQ ID NO: 3067637 - DNA, 22 bp, Homo sapiens
acctttgcccacacacactcct

SEQ ID NO: 3067638 - DNA, 16 bp, Homo sapiens
acctttgctatgtaag

SEQ ID NO: 3067639 - DNA, 22 bp, Homo sapiens
acctttgtacagcccagaggcc

SEQ ID NO: 3067640 - DNA, 13 bp, Homo sapiens
acctttgtagtta

SEQ ID NO: 3067641 - DNA, 15 bp, Homo sapiens
acctttgtagttact

SEQ ID NO: 3067642 - DNA, 21 bp, Homo sapiens
accttttaacacctgatgtgt

SEQ ID NO: 3067643 - DNA, 20 bp, Homo sapiens
accttttatgtagtaattga

SEQ ID NO: 3067644 - DNA, 21 bp, Homo sapiens
accttttgataaaatgttcct

SEQ ID NO: 3067645 - DNA, 19 bp, Homo sapiens
acctttttaatagagtatg

SEQ ID NO: 3067646 - DNA, 19 bp, Homo sapiens
acctttttatattttatac

SEQ ID NO: 3067647 - DNA, 17 bp, Homo sapiens
acctttttcttgatctt

SEQ ID NO: 3067648 - DNA, 19 bp, Homo sapiens
acctttttcttgatcttaa

SEQ ID NO: 3067649 - DNA, 17 bp, Homo sapiens
acgaaaccaaaaagttg

SEQ ID NO: 3067650 - DNA, 16 bp, Homo sapiens
acgaacacaagaaaaa

SEQ ID NO: 3067651 - DNA, 13 bp, Homo sapiens
acgaacagcccgc

SEQ ID NO: 3067652 - DNA, 14 bp, Homo sapiens
acgaacccacctgc

SEQ ID NO: 3067653 - DNA, 15 bp, Homo sapiens
acgaacccacctgct

SEQ ID NO: 3067654 - DNA, 18 bp, Homo sapiens
acgaacctcggggtgggg

SEQ ID NO: 3067655 - DNA, 17 bp, Homo sapiens
acgaactggctacagta

SEQ ID NO: 3067656 - DNA, 14 bp, Homo sapiens
acgaatacttttgc

SEQ ID NO: 3067657 - DNA, 13 bp, Homo sapiens
acgaatcctgctc

SEQ ID NO: 3067658 - DNA, 22 bp, Homo sapiens
acgaatgcatattcaacacact

SEQ ID NO: 3067659 - DNA, 18 bp, Homo sapiens
acgaatgccattggaacc

SEQ ID NO: 3067660 - DNA, 20 bp, Homo sapiens
acgacaaaaacaagactgcc

SEQ ID NO: 3067661 - DNA, 12 bp, Homo sapiens
acgactgaagaa

SEQ ID NO: 3067662 - DNA, 18 bp, Homo sapiens
acgactgaagaaggacat

SEQ ID NO: 3067663 - DNA, 14 bp, Homo sapiens
acgagaccccggct

SEQ ID NO: 3067664 - DNA, 14 bp, Homo sapiens
acgagcctggaagc

SEQ ID NO: 3067665 - DNA, 16 bp, Homo sapiens
acgagcctggaagcac

SEQ ID NO: 3067666 - DNA, 19 bp, Homo sapiens
acgagctgtttactaggga

SEQ ID NO: 3067667 - DNA, 12 bp, Homo sapiens
acgaggaagccc

SEQ ID NO: 3067668 - DNA, 22 bp, Homo sapiens
acgaggaatctgtgggtctggg

SEQ ID NO: 3067669 - DNA, 16 bp, Homo sapiens
acgagggctggctggc

SEQ ID NO: 3067670 - DNA, 17 bp, Homo sapiens
acgagtgttcctgtgct

SEQ ID NO: 3067671 - DNA, 23 bp, Homo sapiens
acgataaggaagaaacagaagag

SEQ ID NO: 3067672 - DNA, 14 bp, Homo sapiens
acgatgtggccctg

SEQ ID NO: 3067673 - DNA, 17 bp, Homo sapiens
acgatgtggccctggcc

SEQ ID NO: 3067674 - DNA, 22 bp, Homo sapiens
acgatgtggccctggcctgctg

SEQ ID NO: 3067675 - DNA, 15 bp, Homo sapiens
acgatttaattctct

SEQ ID NO: 3067676 - DNA, 19 bp, Homo sapiens
acgatttaattctcttgaa

SEQ ID NO: 3067677 - DNA, 21 bp, Homo sapiens
acgcaaaccaacctttctgac

SEQ ID NO: 3067678 - DNA, 14 bp, Homo sapiens
acgcacagacaggt

SEQ ID NO: 3067679 - DNA, 13 bp, Homo sapiens
acgcacctccacg

SEQ ID NO: 3067680 - DNA, 17 bp, Homo sapiens
acgcacctgcctcagga

SEQ ID NO: 3067681 - DNA, 18 bp, Homo sapiens
acgcacctgtagtcccag

SEQ ID NO: 3067682 - DNA, 19 bp, Homo sapiens
acgcacctgtagtcccagc

SEQ ID NO: 3067683 - DNA, 14 bp, Homo sapiens
acgcaccttgctgc

SEQ ID NO: 3067684 - DNA, 19 bp, Homo sapiens
acgcaccttgctgcagtgt

SEQ ID NO: 3067685 - DNA, 19 bp, Homo sapiens
acgcactttgcaggatgac

SEQ ID NO: 3067686 - DNA, 23 bp, Homo sapiens
acgcagccggagggaggcactag

SEQ ID NO: 3067687 - DNA, 11 bp, Homo sapiens
acgcagcctcc

SEQ ID NO: 3067688 - DNA, 11 bp, Homo sapiens
acgcaggcccc

SEQ ID NO: 3067689 - DNA, 17 bp, Homo sapiens
acgcaggcccctctcct

SEQ ID NO: 3067690 - DNA, 18 bp, Homo sapiens
acgcaggcccctctcctc

SEQ ID NO: 3067691 - DNA, 14 bp, Homo sapiens
acgcaggcctccct

SEQ ID NO: 3067692 - DNA, 11 bp, Homo sapiens
acgcaggtgct

SEQ ID NO: 3067693 - DNA, 14 bp, Homo sapiens
acgcaggtgctgcg

SEQ ID NO: 3067694 - DNA, 21 bp, Homo sapiens
acgccaccctgcccacccccg

SEQ ID NO: 3067695 - DNA, 14 bp, Homo sapiens
acgccagtgtgttt

SEQ ID NO: 3067696 - DNA, 18 bp, Homo sapiens
acgccattgtactccagc

SEQ ID NO: 3067697 - DNA, 21 bp, Homo sapiens
acgccattgtactccagcctg

SEQ ID NO: 3067698 - DNA, 22 bp, Homo sapiens
acgccattgtactccagcctgg

SEQ ID NO: 3067699 - DNA, 16 bp, Homo sapiens
acgccccgctgtgtcc

SEQ ID NO: 3067700 - DNA, 21 bp, Homo sapiens
acgccccggggcgcctagagc

SEQ ID NO: 3067701 - DNA, 17 bp, Homo sapiens
acgccctttcctcctca

SEQ ID NO: 3067702 - DNA, 18 bp, Homo sapiens
acgccctttcctcctcag

SEQ ID NO: 3067703 - DNA, 21 bp, Homo sapiens
acgccctttcctcctcaggca

SEQ ID NO: 3067704 - DNA, 14 bp, Homo sapiens
acgccgccttggcc

SEQ ID NO: 3067705 - DNA, 21 bp, Homo sapiens
acgccgccttggccttgcagc

SEQ ID NO: 3067706 - DNA, 20 bp, Homo sapiens
acgccgggagaagccacctt

SEQ ID NO: 3067707 - DNA, 21 bp, Homo sapiens
acgccgggagaagccaccttc

SEQ ID NO: 3067708 - DNA, 15 bp, Homo sapiens
acgccgtctgtcctc

SEQ ID NO: 3067709 - DNA, 21 bp, Homo sapiens
acgcctgaggaacccttacag

SEQ ID NO: 3067710 - DNA, 17 bp, Homo sapiens
acgcctgcaaacgctgc

SEQ ID NO: 3067711 - DNA, 18 bp, Homo sapiens
acgcctgggggtgccagg

SEQ ID NO: 3067712 - DNA, 20 bp, Homo sapiens
acgcctgtaatcccagcact

SEQ ID NO: 3067713 - DNA, 21 bp, Homo sapiens
acgcctgtaatcccagcactt

SEQ ID NO: 3067714 - DNA, 20 bp, Homo sapiens
acgcgaaaccaattcctcat

SEQ ID NO: 3067715 - DNA, 19 bp, Homo sapiens
acgcgaggggaaaggcctg

SEQ ID NO: 3067716 - DNA, 21 bp, Homo sapiens
acgcgaggggaaaggcctgtg

SEQ ID NO: 3067717 - DNA, 21 bp, Homo sapiens
acgcgcagatgtgcagcagat

SEQ ID NO: 3067718 - DNA, 22 bp, Homo sapiens
acgcgcagatgtgcagcagatt

SEQ ID NO: 3067719 - DNA, 18 bp, Homo sapiens
acgcgcccccctcccaga

SEQ ID NO: 3067720 - DNA, 19 bp, Homo sapiens
acgcggttttttcacttcc

SEQ ID NO: 3067721 - DNA, 17 bp, Homo sapiens
acgctagagcatgctgc

SEQ ID NO: 3067722 - DNA, 19 bp, Homo sapiens
acgctccagctgccccggc

SEQ ID NO: 3067723 - DNA, 12 bp, Homo sapiens
acgctcccctcc

SEQ ID NO: 3067724 - DNA, 13 bp, Homo sapiens
acgctccgctgcc

SEQ ID NO: 3067725 - DNA, 22 bp, Homo sapiens
acgctctcctttctttctaact

SEQ ID NO: 3067726 - DNA, 20 bp, Homo sapiens
acgctgaagcggtcagactg

SEQ ID NO: 3067727 - DNA, 13 bp, Homo sapiens
acgctgaataaat

SEQ ID NO: 3067728 - DNA, 18 bp, Homo sapiens
acgctgaataaatgtctt

SEQ ID NO: 3067729 - DNA, 23 bp, Homo sapiens
acgctgtccctagtaaaaataca

SEQ ID NO: 3067730 - DNA, 12 bp, Homo sapiens
acgctttgattc

SEQ ID NO: 3067731 - DNA, 20 bp, Homo sapiens
acggaataagagacctgttt

SEQ ID NO: 3067732 - DNA, 19 bp, Homo sapiens
acggacttacaaccttgtc

SEQ ID NO: 3067733 - DNA, 21 bp, Homo sapiens
acggagccactcctctgactc

SEQ ID NO: 3067734 - DNA, 22 bp, Homo sapiens
actcttggagcctgcagagctg

SEQ ID NO: 3067735 - DNA, 18 bp, Homo sapiens
actcttgtggatgtttta

SEQ ID NO: 3067736 - DNA, 18 bp, Homo sapiens
actctttatgcttgcaaa

SEQ ID NO: 3067737 - DNA, 14 bp, Homo sapiens
actctttctgtata

SEQ ID NO: 3067738 - DNA, 22 bp, Homo sapiens
actctttctgtatatacttttt

SEQ ID NO: 3067739 - DNA, 16 bp, Homo sapiens
actctttgagaaacaa

SEQ ID NO: 3067740 - DNA, 23 bp, Homo sapiens
actctttgctttgtagtttgctt

SEQ ID NO: 3067741 - DNA, 12 bp, Homo sapiens
actcttttgctt

SEQ ID NO: 3067742 - DNA, 11 bp, Homo sapiens
actctttttgg

SEQ ID NO: 3067743 - DNA, 16 bp, Homo sapiens
actctttttgggtcca

SEQ ID NO: 3067744 - DNA, 18 bp, Homo sapiens
actgaaaaaatactacct

SEQ ID NO: 3067745 - DNA, 15 bp, Homo sapiens
actgaaaacatctgg

SEQ ID NO: 3067746 - DNA, 17 bp, Homo sapiens
actgaaaacctctcctc

SEQ ID NO: 3067747 - DNA, 17 bp, Homo sapiens
actgaaaagagagcaga

SEQ ID NO: 3067748 - DNA, 17 bp, Homo sapiens
actgaaacaaaaattgt

SEQ ID NO: 3067749 - DNA, 18 bp, Homo sapiens
actgaaacaaaaattgtc

SEQ ID NO: 3067750 - DNA, 20 bp, Homo sapiens
actgaaacaaaaattgtctt

SEQ ID NO: 3067751 - DNA, 19 bp, Homo sapiens
actgaaacctttaagaaaa

SEQ ID NO: 3067752 - DNA, 22 bp, Homo sapiens
actgaaactatttacaatgtgt

SEQ ID NO: 3067753 - DNA, 13 bp, Homo sapiens
actgaaataaaaa

SEQ ID NO: 3067754 - DNA, 17 bp, Homo sapiens
actgaaatcttgtaagt

SEQ ID NO: 3067755 - DNA, 18 bp, Homo sapiens
actgaaattgcctgaaac

SEQ ID NO: 3067756 - DNA, 13 bp, Homo sapiens
actgaaccaaatt

SEQ ID NO: 3067757 - DNA, 16 bp, Homo sapiens
actgaaccaaattgca

SEQ ID NO: 3067758 - DNA, 15 bp, Homo sapiens
actgaactttgaaga

SEQ ID NO: 3067759 - DNA, 16 bp, Homo sapiens
actgaactttgaagac

SEQ ID NO: 3067760 - DNA, 19 bp, Homo sapiens
actgaactttgaagacccg

SEQ ID NO: 3067761 - DNA, 16 bp, Homo sapiens
actgaagatattccaa

SEQ ID NO: 3067762 - DNA, 16 bp, Homo sapiens
actgaagatgttgaga

SEQ ID NO: 3067763 - DNA, 20 bp, Homo sapiens
actgaagatttatttttaat

SEQ ID NO: 3067764 - DNA, 20 bp, Homo sapiens
actgaagcgaacatcttcat

SEQ ID NO: 3067765 - DNA, 22 bp, Homo sapiens
actgaaggatattttcaacaat

SEQ ID NO: 3067766 - DNA, 17 bp, Homo sapiens
actgaaggtaaaattga

SEQ ID NO: 3067767 - DNA, 23 bp, Homo sapiens
actgaagtcttactacagaaatg

SEQ ID NO: 3067768 - DNA, 16 bp, Homo sapiens
actgaagtttttgaaa

SEQ ID NO: 3067769 - DNA, 23 bp, Homo sapiens
actgaagtttttgaaataccttt

SEQ ID NO: 3067770 - DNA, 16 bp, Homo sapiens
actgaatgaaaccccc

SEQ ID NO: 3067771 - DNA, 23 bp, Homo sapiens
actgaatgaaacccccacacaca

SEQ ID NO: 3067772 - DNA, 21 bp, Homo sapiens
actgaatgggatcatgaaagt

SEQ ID NO: 3067773 - DNA, 23 bp, Homo sapiens
actgacacaaaaagtagattaag

SEQ ID NO: 3067774 - DNA, 23 bp, Homo sapiens
actgacacatcagcatgttttct

SEQ ID NO: 3067775 - DNA, 20 bp, Homo sapiens
actgacaggcagcctggaca

SEQ ID NO: 3067776 - DNA, 21 bp, Homo sapiens
actgacaggcagcctggacat

SEQ ID NO: 3067777 - DNA, 14 bp, Homo sapiens
actgaccagaacta

SEQ ID NO: 3067778 - DNA, 21 bp, Homo sapiens
actgaccccccccattagaat

SEQ ID NO: 3067779 - DNA, 17 bp, Homo sapiens
actgacctgccagccgg

SEQ ID NO: 3067780 - DNA, 20 bp, Homo sapiens
actgaccttgtaaaagacag

SEQ ID NO: 3067781 - DNA, 14 bp, Homo sapiens
actgactaaccatt

SEQ ID NO: 3067782 - DNA, 23 bp, Homo sapiens
actgactcccattttggtgtgca

SEQ ID NO: 3067783 - DNA, 17 bp, Homo sapiens
actgactttaagtaatc

SEQ ID NO: 3067784 - DNA, 18 bp, Homo sapiens
actgagataccagcgagg

SEQ ID NO: 3067785 - DNA, 21 bp, Homo sapiens
actgagcatcactagtgacaa

SEQ ID NO: 3067786 - DNA, 14 bp, Homo sapiens
actgagcgaggaaa

SEQ ID NO: 3067787 - DNA, 19 bp, Homo sapiens
actgagcgaggaaaaacaa

SEQ ID NO: 3067788 - DNA, 21 bp, Homo sapiens
actgagcgaggaaaaacaaca

SEQ ID NO: 3067789 - DNA, 22 bp, Homo sapiens
actgagcgaggaaaaacaacaa

SEQ ID NO: 3067790 - DNA, 18 bp, Homo sapiens
actgagcgcaagccacag

SEQ ID NO: 3067791 - DNA, 20 bp, Homo sapiens
actgagcgcaagccacagcc

SEQ ID NO: 3067792 - DNA, 23 bp, Homo sapiens
actgagcgcaagccacagcctgt

SEQ ID NO: 3067793 - DNA, 20 bp, Homo sapiens
actgagcggccgcagagact

SEQ ID NO: 3067794 - DNA, 16 bp, Homo sapiens
actgagctcgcagccc

SEQ ID NO: 3067795 - DNA, 18 bp, Homo sapiens
actgagctcgcagccccc

SEQ ID NO: 3067796 - DNA, 17 bp, Homo sapiens
actgagctctccaggcc

SEQ ID NO: 3067797 - DNA, 21 bp, Homo sapiens
actgagctctccaggccaggt

SEQ ID NO: 3067798 - DNA, 15 bp, Homo sapiens
actgagctctgcctc

SEQ ID NO: 3067799 - DNA, 16 bp, Homo sapiens
actgagctctgcctca

SEQ ID NO: 3067800 - DNA, 21 bp, Homo sapiens
actgagctgctaaaataaacc

SEQ ID NO: 3067801 - DNA, 12 bp, Homo sapiens
actgagcttgga

SEQ ID NO: 3067802 - DNA, 13 bp, Homo sapiens
actgagcttggaa

SEQ ID NO: 3067803 - DNA, 16 bp, Homo sapiens
actgagcttggaagct

SEQ ID NO: 3067804 - DNA, 23 bp, Homo sapiens
actgagctttagacagcagagca

SEQ ID NO: 3067805 - DNA, 14 bp, Homo sapiens
actgaggcagggaa

SEQ ID NO: 3067806 - DNA, 20 bp, Homo sapiens
actgaggcctgagacccagg

SEQ ID NO: 3067807 - DNA, 21 bp, Homo sapiens
actgagtctggcaaacatgtg

SEQ ID NO: 3067808 - DNA, 20 bp, Homo sapiens
actgatagttactgttgtga

SEQ ID NO: 3067809 - DNA, 15 bp, Homo sapiens
actgatattcagaat

SEQ ID NO: 3067810 - DNA, 16 bp, Homo sapiens
actgatattcagaatt

SEQ ID NO: 3067811 - DNA, 17 bp, Homo sapiens
actgatcatctgctgtg

SEQ ID NO: 3067812 - DNA, 21 bp, Homo sapiens
actgatctcaagtatatgtca

SEQ ID NO: 3067813 - DNA, 20 bp, Homo sapiens
actgatcttacctttatgag

SEQ ID NO: 3067814 - DNA, 14 bp, Homo sapiens
actgatctttgcaa

SEQ ID NO: 3067815 - DNA, 11 bp, Homo sapiens
actgatgctgc

SEQ ID NO: 3067816 - DNA, 19 bp, Homo sapiens
actgatgctgcccctcatc

SEQ ID NO: 3067817 - DNA, 20 bp, Homo sapiens
actgatgctgcccctcatct

SEQ ID NO: 3067818 - DNA, 15 bp, Homo sapiens
actgatgcttagatg

SEQ ID NO: 3067819 - DNA, 17 bp, Homo sapiens
actgatggaagcacaca

SEQ ID NO: 3067820 - DNA, 20 bp, Homo sapiens
actgattcataataaatatc

SEQ ID NO: 3067821 - DNA, 14 bp, Homo sapiens
actgattctgttgt

SEQ ID NO: 3067822 - DNA, 15 bp, Homo sapiens
actgattgagaagtt

SEQ ID NO: 3067823 - DNA, 13 bp, Homo sapiens
actgatttaattt

SEQ ID NO: 3067824 - DNA, 19 bp, Homo sapiens
actgcaacctccgccttcc

SEQ ID NO: 3067825 - DNA, 18 bp, Homo sapiens
actgcaacctctgcctcc

SEQ ID NO: 3067826 - DNA, 20 bp, Homo sapiens
actgcaacttaacttaaaat

SEQ ID NO: 3067827 - DNA, 16 bp, Homo sapiens
actgcaagagccttgg

SEQ ID NO: 3067828 - DNA, 17 bp, Homo sapiens
actgcaagagccttggt

SEQ ID NO: 3067829 - DNA, 19 bp, Homo sapiens
actgcaagtccttttgtaa

SEQ ID NO: 3067830 - DNA, 20 bp, Homo sapiens
actgcaagtccttttgtaaa

SEQ ID NO: 3067831 - DNA, 20 bp, Homo sapiens
actgcaatcctgtctttctg

SEQ ID NO: 3067832 - DNA, 21 bp, Homo sapiens
actgcaatcctgtctttctga

SEQ ID NO: 3067833 - DNA, 21 bp, Homo sapiens
actgcacaataaaaccaagcc

SEQ ID NO: 3067834 - DNA, 16 bp, Homo sapiens
actgcacatgaagaaa

SEQ ID NO: 3067835 - DNA, 18 bp, Homo sapiens
actgcacatgaagaaata

SEQ ID NO: 3067836 - DNA, 12 bp, Homo sapiens
actgcacccagg

SEQ ID NO: 3067837 - DNA, 13 bp, Homo sapiens
actgcactccagc

SEQ ID NO: 3067838 - DNA, 17 bp, Homo sapiens
actgcactccagcctga

SEQ ID NO: 3067839 - DNA, 20 bp, Homo sapiens
actgcactccagcctgagtg

SEQ ID NO: 3067840 - DNA, 17 bp, Homo sapiens
actgcagcctcaacctc

SEQ ID NO: 3067841 - DNA, 16 bp, Homo sapiens
actgcagtcatcaaca

SEQ ID NO: 3067842 - DNA, 20 bp, Homo sapiens
actgcagtcatcaacaatga

SEQ ID NO: 3067843 - DNA, 14 bp, Homo sapiens
actgcatctggatt

SEQ ID NO: 3067844 - DNA, 16 bp, Homo sapiens
actgcatgtttgctgt

SEQ ID NO: 3067845 - DNA, 15 bp, Homo sapiens
actgcattgagaact

SEQ ID NO: 3067846 - DNA, 23 bp, Homo sapiens
actgccaatatagaaaaataaaa

SEQ ID NO: 3067847 - DNA, 16 bp, Homo sapiens
actgccacgtgcctta

SEQ ID NO: 3067848 - DNA, 24 bp, Homo sapiens
actgccacgtgccttaggaatact

SEQ ID NO: 3067849 - DNA, 15 bp, Homo sapiens
actgccagatgctga

SEQ ID NO: 3067850 - DNA, 17 bp, Homo sapiens
actgccagatgctgatg

SEQ ID NO: 3067851 - DNA, 16 bp, Homo sapiens
actgccagtctcactg

SEQ ID NO: 3067852 - DNA, 15 bp, Homo sapiens
actgcccagccactc

SEQ ID NO: 3067853 - DNA, 17 bp, Homo sapiens
actgcccaggcactgca

SEQ ID NO: 3067854 - DNA, 16 bp, Homo sapiens
actgcccatggacagg

SEQ ID NO: 3067855 - DNA, 18 bp, Homo sapiens
actgccccaactcctgga

SEQ ID NO: 3067856 - DNA, 18 bp, Homo sapiens
actgccgtcagtgctgtg

SEQ ID NO: 3067857 - DNA, 17 bp, Homo sapiens
actgcctccctctcttc

SEQ ID NO: 3067858 - DNA, 20 bp, Homo sapiens
actgcctcctccctggctgc

SEQ ID NO: 3067859 - DNA, 17 bp, Homo sapiens
actgcctccttgccagc

SEQ ID NO: 3067860 - DNA, 19 bp, Homo sapiens
actgcctttggcagagttc

SEQ ID NO: 3067861 - DNA, 20 bp, Homo sapiens
actgcctttttatttatatg

SEQ ID NO: 3067862 - DNA, 19 bp, Homo sapiens
actgcgccccgcctgacct

SEQ ID NO: 3067863 - DNA, 17 bp, Homo sapiens
actgcgcccgggcaaga

SEQ ID NO: 3067864 - DNA, 14 bp, Homo sapiens
actgctaaataaaa

SEQ ID NO: 3067865 - DNA, 21 bp, Homo sapiens
actgtgcacatctgtgtcttg

SEQ ID NO: 3067866 - DNA, 12 bp, Homo sapiens
actgtgcagagt

SEQ ID NO: 3067867 - DNA, 14 bp, Homo sapiens
actgtgcttggcca

SEQ ID NO: 3067868 - DNA, 22 bp, Homo sapiens
actgtggcacttgcctgggtca

SEQ ID NO: 3067869 - DNA, 21 bp, Homo sapiens
actgtggccatggtccccaag

SEQ ID NO: 3067870 - DNA, 12 bp, Homo sapiens
actgtggccctg

SEQ ID NO: 3067871 - DNA, 23 bp, Homo sapiens
actgtggccgttatctggaagta

SEQ ID NO: 3067872 - DNA, 12 bp, Homo sapiens
actgtggctgtc

SEQ ID NO: 3067873 - DNA, 14 bp, Homo sapiens
actgtggctgtctg

SEQ ID NO: 3067874 - DNA, 14 bp, Homo sapiens
actgtgggcaattt

SEQ ID NO: 3067875 - DNA, 18 bp, Homo sapiens
actgtggtaaatgccaca

SEQ ID NO: 3067876 - DNA, 19 bp, Homo sapiens
actgtgtaaaatgtaatgc

SEQ ID NO: 3067877 - DNA, 12 bp, Homo sapiens
actgtgtataga

SEQ ID NO: 3067878 - DNA, 18 bp, Homo sapiens
actgtgtcacatcacgaa

SEQ ID NO: 3067879 - DNA, 16 bp, Homo sapiens
actgtgtctctatgtg

SEQ ID NO: 3067880 - DNA, 17 bp, Homo sapiens
actgtgtctctatgtga

SEQ ID NO: 3067881 - DNA, 16 bp, Homo sapiens
actgtgtgtgtgaatg

SEQ ID NO: 3067882 - DNA, 19 bp, Homo sapiens
actgtgtttctgtgctcca

SEQ ID NO: 3067883 - DNA, 15 bp, Homo sapiens
actgttactgggccc

SEQ ID NO: 3067884 - DNA, 15 bp, Homo sapiens
actgttatttaattg

SEQ ID NO: 3067885 - DNA, 18 bp, Homo sapiens
actgttccccctgtgcag

SEQ ID NO: 3067886 - DNA, 18 bp, Homo sapiens
actgttctaaagctctga

SEQ ID NO: 3067887 - DNA, 18 bp, Homo sapiens
actgttctcccttcggtg

SEQ ID NO: 3067888 - DNA, 13 bp, Homo sapiens
actgttcttgaat

SEQ ID NO: 3067889 - DNA, 14 bp, Homo sapiens
actgttgataattc

SEQ ID NO: 3067890 - DNA, 17 bp, Homo sapiens
actgttgcacttttgaa

SEQ ID NO: 3067891 - DNA, 20 bp, Homo sapiens
actgttgcacttttgaatgt

SEQ ID NO: 3067892 - DNA, 20 bp, Homo sapiens
actgttgcagtggcctggcc

SEQ ID NO: 3067893 - DNA, 18 bp, Homo sapiens
actgttgcttaattgtga

SEQ ID NO: 3067894 - DNA, 23 bp, Homo sapiens
actgttgtagaaattcttaattt

SEQ ID NO: 3067895 - DNA, 16 bp, Homo sapiens
actgttgttaagcaac

SEQ ID NO: 3067896 - DNA, 18 bp, Homo sapiens
actgtttaatgttctgtg

SEQ ID NO: 3067897 - DNA, 20 bp, Homo sapiens
actgtttcactgaaatgttt

SEQ ID NO: 3067898 - DNA, 22 bp, Homo sapiens
actgtttgtttttatttaaatt

SEQ ID NO: 3067899 - DNA, 13 bp, Homo sapiens
actgttttatctc

SEQ ID NO: 3067900 - DNA, 21 bp, Homo sapiens
actgttttatctccatacttt

SEQ ID NO: 3067901 - DNA, 14 bp, Homo sapiens
actgttttatctgg

SEQ ID NO: 3067902 - DNA, 20 bp, Homo sapiens
actgttttctttatgtcttt

SEQ ID NO: 3067903 - DNA, 19 bp, Homo sapiens
actgtttttagacaccttc

SEQ ID NO: 3067904 - DNA, 23 bp, Homo sapiens
actgttttttttttttttaattt

SEQ ID NO: 3067905 - DNA, 14 bp, Homo sapiens
acttaaaatgtgca

SEQ ID NO: 3067906 - DNA, 18 bp, Homo sapiens
acttaaaatgtgcagtaa

SEQ ID NO: 3067907 - DNA, 13 bp, Homo sapiens
acttaaacagctt

SEQ ID NO: 3067908 - DNA, 13 bp, Homo sapiens
acttaaacatcat

SEQ ID NO: 3067909 - DNA, 13 bp, Homo sapiens
acttaaagattta

SEQ ID NO: 3067910 - DNA, 23 bp, Homo sapiens
acttaacggacttacaaccttgt

SEQ ID NO: 3067911 - DNA, 15 bp, Homo sapiens
acttaactttttaac

SEQ ID NO: 3067912 - DNA, 15 bp, Homo sapiens
acttaagattcagtt

SEQ ID NO: 3067913 - DNA, 13 bp, Homo sapiens
acttaataatgtg

SEQ ID NO: 3067914 - DNA, 17 bp, Homo sapiens
acttaataatgtgtaca

SEQ ID NO: 3067915 - DNA, 18 bp, Homo sapiens
acttaatactgaatttct

SEQ ID NO: 3067916 - DNA, 14 bp, Homo sapiens
acttacaaaaatgg

SEQ ID NO: 3067917 - DNA, 12 bp, Homo sapiens
acttacaagaaa

SEQ ID NO: 3067918 - DNA, 23 bp, Homo sapiens
acttacatgttcccaaaacaatg

SEQ ID NO: 3067919 - DNA, 16 bp, Homo sapiens
acttagaaacaatgtt

SEQ ID NO: 3067920 - DNA, 16 bp, Homo sapiens
acttagatattaaaat

SEQ ID NO: 3067921 - DNA, 20 bp, Homo sapiens
acttagatattaaaatttgg

SEQ ID NO: 3067922 - DNA, 15 bp, Homo sapiens
acttagatatttcat

SEQ ID NO: 3067923 - DNA, 17 bp, Homo sapiens
acttagatatttcatgt

SEQ ID NO: 3067924 - DNA, 14 bp, Homo sapiens
acttagccgactgc

SEQ ID NO: 3067925 - DNA, 20 bp, Homo sapiens
acttagccgactgcgctgct

SEQ ID NO: 3067926 - DNA, 12 bp, Homo sapiens
acttagctggcc

SEQ ID NO: 3067927 - DNA, 13 bp, Homo sapiens
acttagctggcca

SEQ ID NO: 3067928 - DNA, 17 bp, Homo sapiens
acttagctggccaagga

SEQ ID NO: 3067929 - DNA, 19 bp, Homo sapiens
acttaggtttcaggaagtt

SEQ ID NO: 3067930 - DNA, 16 bp, Homo sapiens
acttagtaacttttta

SEQ ID NO: 3067931 - DNA, 15 bp, Homo sapiens
acttagtagattaaa

SEQ ID NO: 3067932 - DNA, 15 bp, Homo sapiens
acttagttatttctg

SEQ ID NO: 3067933 - DNA, 22 bp, Homo sapiens
acttataaggtgttttctgtgt

SEQ ID NO: 3067934 - DNA, 15 bp, Homo sapiens
acttatactcttgag

SEQ ID NO: 3067935 - DNA, 18 bp, Homo sapiens
acttatatggaaattctg

SEQ ID NO: 3067936 - DNA, 14 bp, Homo sapiens
acttatcagtgtat

SEQ ID NO: 3067937 - DNA, 20 bp, Homo sapiens
acttatcatccacattgttt

SEQ ID NO: 3067938 - DNA, 16 bp, Homo sapiens
acttatccctgcccat

SEQ ID NO: 3067939 - DNA, 12 bp, Homo sapiens
acttatgaatgt

SEQ ID NO: 3067940 - DNA, 13 bp, Homo sapiens
acttatgaatgtt

SEQ ID NO: 3067941 - DNA, 16 bp, Homo sapiens
acttatgatttcatgt

SEQ ID NO: 3067942 - DNA, 12 bp, Homo sapiens
acttattaacaa

SEQ ID NO: 3067943 - DNA, 21 bp, Homo sapiens
acttattaagttcgaacatgt

SEQ ID NO: 3067944 - DNA, 16 bp, Homo sapiens
acttattctcaagaag

SEQ ID NO: 3067945 - DNA, 14 bp, Homo sapiens
acttattcttttat

SEQ ID NO: 3067946 - DNA, 22 bp, Homo sapiens
acttattgcctgggcagtgccc

SEQ ID NO: 3067947 - DNA, 13 bp, Homo sapiens
acttatttaatgc

SEQ ID NO: 3067948 - DNA, 20 bp, Homo sapiens
acttatttacctataaaatg

SEQ ID NO: 3067949 - DNA, 22 bp, Homo sapiens
acttatttatatgaagcaagct

SEQ ID NO: 3067950 - DNA, 15 bp, Homo sapiens
acttattttacacag

SEQ ID NO: 3067951 - DNA, 15 bp, Homo sapiens
acttcaaaagtattt

SEQ ID NO: 3067952 - DNA, 16 bp, Homo sapiens
acttcaaaagtatttt

SEQ ID NO: 3067953 - DNA, 19 bp, Homo sapiens
acttcaacatttacatgta

SEQ ID NO: 3067954 - DNA, 16 bp, Homo sapiens
acttcaaggtgacaga

SEQ ID NO: 3067955 - DNA, 19 bp, Homo sapiens
acttcaataattgtccatg

SEQ ID NO: 3067956 - DNA, 15 bp, Homo sapiens
acttcaatgatagta

SEQ ID NO: 3067957 - DNA, 14 bp, Homo sapiens
acttcacactgcaa

SEQ ID NO: 3067958 - DNA, 19 bp, Homo sapiens
acttcacactgcaagagcc

SEQ ID NO: 3067959 - DNA, 19 bp, Homo sapiens
acttcagcaagagagaacc

SEQ ID NO: 3067960 - DNA, 21 bp, Homo sapiens
acttcagcaagagagaaccta

SEQ ID NO: 3067961 - DNA, 16 bp, Homo sapiens
acttcagcattgtaat

SEQ ID NO: 3067962 - DNA, 15 bp, Homo sapiens
acttcagctttgtgt

SEQ ID NO: 3067963 - DNA, 17 bp, Homo sapiens
acttcaggccaacaagg

SEQ ID NO: 3067964 - DNA, 16 bp, Homo sapiens
acttcatctggctgcc

SEQ ID NO: 3067965 - DNA, 21 bp, Homo sapiens
acttcatctggctgcctttgc

SEQ ID NO: 3067966 - DNA, 23 bp, Homo sapiens
acttccaaagaatgttagagcac

SEQ ID NO: 3067967 - DNA, 20 bp, Homo sapiens
acttccaaagactccctcca

SEQ ID NO: 3067968 - DNA, 13 bp, Homo sapiens
acttccacatttt

SEQ ID NO: 3067969 - DNA, 14 bp, Homo sapiens
acttccacattttt

SEQ ID NO: 3067970 - DNA, 18 bp, Homo sapiens
acttccacatttttgcac

SEQ ID NO: 3067971 - DNA, 13 bp, Homo sapiens
acttccagcaaaa

SEQ ID NO: 3067972 - DNA, 14 bp, Homo sapiens
acttccagcaaaat

SEQ ID NO: 3067973 - DNA, 18 bp, Homo sapiens
acttccagcaaaatccaa

SEQ ID NO: 3067974 - DNA, 15 bp, Homo sapiens
acttccattctttct

SEQ ID NO: 3067975 - DNA, 17 bp, Homo sapiens
acttccattctttcttc

SEQ ID NO: 3067976 - DNA, 22 bp, Homo sapiens
acttccattctttcttcctcca

SEQ ID NO: 3067977 - DNA, 17 bp, Homo sapiens
acttcccaccctgcccc

SEQ ID NO: 3067978 - DNA, 20 bp, Homo sapiens
acttcccaggatctgctcca

SEQ ID NO: 3067979 - DNA, 24 bp, Homo sapiens
acttcccaggatctgctccaacag

SEQ ID NO: 3067980 - DNA, 17 bp, Homo sapiens
acttcccccaccctggg

SEQ ID NO: 3067981 - DNA, 14 bp, Homo sapiens
acttccgtcaccct

SEQ ID NO: 3067982 - DNA, 20 bp, Homo sapiens
acttcctaaatattatgaga

SEQ ID NO: 3067983 - DNA, 16 bp, Homo sapiens
acttcctccagaagcc

SEQ ID NO: 3067984 - DNA, 17 bp, Homo sapiens
acttcctccagaagcct

SEQ ID NO: 3067985 - DNA, 20 bp, Homo sapiens
acttcctgtgcctttcctat

SEQ ID NO: 3067986 - DNA, 21 bp, Homo sapiens
acttcctgtgcctttcctatc

SEQ ID NO: 3067987 - DNA, 16 bp, Homo sapiens
acttccttcacatctc

SEQ ID NO: 3067988 - DNA, 23 bp, Homo sapiens
acttcgcatcaaaagacaattct

SEQ ID NO: 3067989 - DNA, 22 bp, Homo sapiens
acttcggcagatactgtctctt

SEQ ID NO: 3067990 - DNA, 14 bp, Homo sapiens
acttcgggctggcc

SEQ ID NO: 3067991 - DNA, 23 bp, Homo sapiens
acttcgttggtgaccagtttctt

SEQ ID NO: 3067992 - DNA, 16 bp, Homo sapiens
acttctaaatgaagtg

SEQ ID NO: 3067993 - DNA, 16 bp, Homo sapiens
acttctaatcttaaat

SEQ ID NO: 3067994 - DNA, 21 bp, Homo sapiens
acttctagagggagaagactg

SEQ ID NO: 3067995 - DNA, 22 bp, Homo sapiens
acttctagagggagaagactgt

SEQ ID NO: 3067996 - DNA, 17 bp, Homo sapiens
acttctagatctcagcc

SEQ ID NO: 3067997 - DNA, 20 bp, Homo sapiens
acttctcaggaaatggcttt

SEQ ID NO: 3067998 - DNA, 14 bp, Homo sapiens
agaagttctgggtg

SEQ ID NO: 3067999 - DNA, 20 bp, Homo sapiens
agaagttgtggatttcagtt

SEQ ID NO: 3068000 - DNA, 21 bp, Homo sapiens
agaagttgtggatttcagttt

SEQ ID NO: 3068001 - DNA, 19 bp, Homo sapiens
agaagtttcgaggggtcct

SEQ ID NO: 3068002 - DNA, 16 bp, Homo sapiens
agaagtttgcactatc

SEQ ID NO: 3068003 - DNA, 21 bp, Homo sapiens
agaagtttgcactatctttca

SEQ ID NO: 3068004 - DNA, 16 bp, Homo sapiens
agaataaaagctgtgg

SEQ ID NO: 3068005 - DNA, 22 bp, Homo sapiens
agaataaatccttgggagtcat

SEQ ID NO: 3068006 - DNA, 13 bp, Homo sapiens
agaataaatgaag

SEQ ID NO: 3068007 - DNA, 14 bp, Homo sapiens
agaataaatgaaga

SEQ ID NO: 3068008 - DNA, 20 bp, Homo sapiens
agaataaattaatattgtat

SEQ ID NO: 3068009 - DNA, 16 bp, Homo sapiens
agaataagttattgca

SEQ ID NO: 3068010 - DNA, 19 bp, Homo sapiens
agaataagttattgcagtt

SEQ ID NO: 3068011 - DNA, 20 bp, Homo sapiens
agaataagttattgcagttt

SEQ ID NO: 3068012 - DNA, 16 bp, Homo sapiens
agaataataattaacc

SEQ ID NO: 3068013 - DNA, 16 bp, Homo sapiens
agaatactgcttgctt

SEQ ID NO: 3068014 - DNA, 17 bp, Homo sapiens
agaatagagctgccact

SEQ ID NO: 3068015 - DNA, 22 bp, Homo sapiens
agaatagcatctgtacaaaggg

SEQ ID NO: 3068016 - DNA, 17 bp, Homo sapiens
agaatagccacatttgg

SEQ ID NO: 3068017 - DNA, 19 bp, Homo sapiens
agaatagccacatttggaa

SEQ ID NO: 3068018 - DNA, 14 bp, Homo sapiens
agaatataacatga

SEQ ID NO: 3068019 - DNA, 21 bp, Homo sapiens
agaatataacatgaaatgata

SEQ ID NO: 3068020 - DNA, 21 bp, Homo sapiens
agaatattagctttactgttt

SEQ ID NO: 3068021 - DNA, 21 bp, Homo sapiens
agaatattgaagtacttgcca

SEQ ID NO: 3068022 - DNA, 22 bp, Homo sapiens
agaatattgaagtacttgccag

SEQ ID NO: 3068023 - DNA, 21 bp, Homo sapiens
agaatcaacatttctcaataa

SEQ ID NO: 3068024 - DNA, 23 bp, Homo sapiens
agaatcaacatttctcaataatt

SEQ ID NO: 3068025 - DNA, 17 bp, Homo sapiens
agaatcagatcatttca

SEQ ID NO: 3068026 - DNA, 20 bp, Homo sapiens
agaatccacatttctaaaat

SEQ ID NO: 3068027 - DNA, 15 bp, Homo sapiens
agaatcccaaatttg

SEQ ID NO: 3068028 - DNA, 16 bp, Homo sapiens
agaatccctctacatg

SEQ ID NO: 3068029 - DNA, 16 bp, Homo sapiens
agaatccttttgtaga

SEQ ID NO: 3068030 - DNA, 17 bp, Homo sapiens
agaatccttttgtagaa

SEQ ID NO: 3068031 - DNA, 19 bp, Homo sapiens
agaatcggcagtattttct

SEQ ID NO: 3068032 - DNA, 21 bp, Homo sapiens
agaatctctatgtatattcta

SEQ ID NO: 3068033 - DNA, 19 bp, Homo sapiens
agaatcttggtttgccttc

SEQ ID NO: 3068034 - DNA, 22 bp, Homo sapiens
agaatctttattcaaactttta

SEQ ID NO: 3068035 - DNA, 20 bp, Homo sapiens
agaatctttcttctcgccta

SEQ ID NO: 3068036 - DNA, 18 bp, Homo sapiens
agaatgaaaaatgaaaga

SEQ ID NO: 3068037 - DNA, 17 bp, Homo sapiens
agaatgaaatgtatgtg

SEQ ID NO: 3068038 - DNA, 12 bp, Homo sapiens
agaatgaacaca

SEQ ID NO: 3068039 - DNA, 18 bp, Homo sapiens
agaatgaattcgatgcgt

SEQ ID NO: 3068040 - DNA, 20 bp, Homo sapiens
agaatgaggctgctttccaa

SEQ ID NO: 3068041 - DNA, 20 bp, Homo sapiens
agaatgcagcccaccaggag

SEQ ID NO: 3068042 - DNA, 22 bp, Homo sapiens
agaatgcattgatattgtgaac

SEQ ID NO: 3068043 - DNA, 21 bp, Homo sapiens
agaatgctacaagtaactcag

SEQ ID NO: 3068044 - DNA, 22 bp, Homo sapiens
agaatgctgcaggacttgagaa

SEQ ID NO: 3068045 - DNA, 13 bp, Homo sapiens
agaatgctgtaca

SEQ ID NO: 3068046 - DNA, 14 bp, Homo sapiens
agaatgctgtacat

SEQ ID NO: 3068047 - DNA, 15 bp, Homo sapiens
agaatggaagcctga

SEQ ID NO: 3068048 - DNA, 15 bp, Homo sapiens
agaatgtaatatact

SEQ ID NO: 3068049 - DNA, 13 bp, Homo sapiens
agaatgtatttcc

SEQ ID NO: 3068050 - DNA, 13 bp, Homo sapiens
agaatgtgctgcc

SEQ ID NO: 3068051 - DNA, 14 bp, Homo sapiens
agaatgtgctgcct

SEQ ID NO: 3068052 - DNA, 18 bp, Homo sapiens
agaatgtgtttcaaactg

SEQ ID NO: 3068053 - DNA, 15 bp, Homo sapiens
agaatgttagagcac

SEQ ID NO: 3068054 - DNA, 18 bp, Homo sapiens
agaatgttagagcacagt

SEQ ID NO: 3068055 - DNA, 15 bp, Homo sapiens
agaattaaaataaca

SEQ ID NO: 3068056 - DNA, 15 bp, Homo sapiens
agaattaaaatttat

SEQ ID NO: 3068057 - DNA, 16 bp, Homo sapiens
agaattacccttcctc

SEQ ID NO: 3068058 - DNA, 15 bp, Homo sapiens
agaattagctttttc

SEQ ID NO: 3068059 - DNA, 16 bp, Homo sapiens
agaattagctttttca

SEQ ID NO: 3068060 - DNA, 16 bp, Homo sapiens
agaattatgcatctgc

SEQ ID NO: 3068061 - DNA, 21 bp, Homo sapiens
agaattatttcacaaataata

SEQ ID NO: 3068062 - DNA, 14 bp, Homo sapiens
agaattcacaatgc

SEQ ID NO: 3068063 - DNA, 22 bp, Homo sapiens
agaattcacaatgcatttttca

SEQ ID NO: 3068064 - DNA, 18 bp, Homo sapiens
agaattcagaagacccct

SEQ ID NO: 3068065 - DNA, 22 bp, Homo sapiens
agaattctcttgttctttggca

SEQ ID NO: 3068066 - DNA, 23 bp, Homo sapiens
agaattctggtcctgttttctaa

SEQ ID NO: 3068067 - DNA, 19 bp, Homo sapiens
agaattcttacatgttttc

SEQ ID NO: 3068068 - DNA, 14 bp, Homo sapiens
agaattgaaacact

SEQ ID NO: 3068069 - DNA, 23 bp, Homo sapiens
agaattgcttgagcttgggaagt

SEQ ID NO: 3068070 - DNA, 13 bp, Homo sapiens
agaattgggcggc

SEQ ID NO: 3068071 - DNA, 20 bp, Homo sapiens
agaattgttagatggcaata

SEQ ID NO: 3068072 - DNA, 18 bp, Homo sapiens
agaatttaatttttaaaa

SEQ ID NO: 3068073 - DNA, 15 bp, Homo sapiens
agaatttcactgtct

SEQ ID NO: 3068074 - DNA, 21 bp, Homo sapiens
agaatttcactgtcttttaaa

SEQ ID NO: 3068075 - DNA, 16 bp, Homo sapiens
agaatttcctaatgag

SEQ ID NO: 3068076 - DNA, 21 bp, Homo sapiens
agaattttaaaaatgaatcct

SEQ ID NO: 3068077 - DNA, 17 bp, Homo sapiens
agaattttaatgtgaag

SEQ ID NO: 3068078 - DNA, 18 bp, Homo sapiens
agaattttaatgtgaaga

SEQ ID NO: 3068079 - DNA, 22 bp, Homo sapiens
agaatttttaactgtactgaat

SEQ ID NO: 3068080 - DNA, 16 bp, Homo sapiens
agacaaaaacagcctc

SEQ ID NO: 3068081 - DNA, 22 bp, Homo sapiens
agacaaaaacagcctcacagaa

SEQ ID NO: 3068082 - DNA, 14 bp, Homo sapiens
agacaaaagaaaaa

SEQ ID NO: 3068083 - DNA, 13 bp, Homo sapiens
agacaaatactca

SEQ ID NO: 3068084 - DNA, 13 bp, Homo sapiens
agacaaatatgta

SEQ ID NO: 3068085 - DNA, 18 bp, Homo sapiens
agacaaattcatattctt

SEQ ID NO: 3068086 - DNA, 19 bp, Homo sapiens
agacaaattctgtttcttg

SEQ ID NO: 3068087 - DNA, 21 bp, Homo sapiens
agacaaattctgtttcttgag

SEQ ID NO: 3068088 - DNA, 17 bp, Homo sapiens
agacaacatcttaaatc

SEQ ID NO: 3068089 - DNA, 15 bp, Homo sapiens
agacaagccagaact

SEQ ID NO: 3068090 - DNA, 19 bp, Homo sapiens
agacaagtaatcactaacc

SEQ ID NO: 3068091 - DNA, 17 bp, Homo sapiens
agacaatacgtttgata

SEQ ID NO: 3068092 - DNA, 13 bp, Homo sapiens
agacaattcttta

SEQ ID NO: 3068093 - DNA, 22 bp, Homo sapiens
agacaattctttatacaacagt

SEQ ID NO: 3068094 - DNA, 14 bp, Homo sapiens
agacacagatgttc

SEQ ID NO: 3068095 - DNA, 14 bp, Homo sapiens
agacacatatgagg

SEQ ID NO: 3068096 - DNA, 14 bp, Homo sapiens
agacaccaaagttc

SEQ ID NO: 3068097 - DNA, 18 bp, Homo sapiens
agacaccaaagttctaat

SEQ ID NO: 3068098 - DNA, 14 bp, Homo sapiens
agacaccaaatata

SEQ ID NO: 3068099 - DNA, 20 bp, Homo sapiens
agacacctgcacctcccccc

SEQ ID NO: 3068100 - DNA, 21 bp, Homo sapiens
agacacggagcccagccctcc

SEQ ID NO: 3068101 - DNA, 20 bp, Homo sapiens
agacactccccgaagtcttt

SEQ ID NO: 3068102 - DNA, 13 bp, Homo sapiens
agacactgcctgg

SEQ ID NO: 3068103 - DNA, 14 bp, Homo sapiens
agacactgcctggg

SEQ ID NO: 3068104 - DNA, 16 bp, Homo sapiens
agacactgcctgggct

SEQ ID NO: 3068105 - DNA, 17 bp, Homo sapiens
agacactggtgtatctc

SEQ ID NO: 3068106 - DNA, 21 bp, Homo sapiens
agacactggtgtatctcagaa

SEQ ID NO: 3068107 - DNA, 12 bp, Homo sapiens
agacactggttt

SEQ ID NO: 3068108 - DNA, 20 bp, Homo sapiens
agacagaattaatggtcatt

SEQ ID NO: 3068109 - DNA, 17 bp, Homo sapiens
agacagagggtcacagt

SEQ ID NO: 3068110 - DNA, 14 bp, Homo sapiens
agacagcagacaaa

SEQ ID NO: 3068111 - DNA, 15 bp, Homo sapiens
agacagccccctgcc

SEQ ID NO: 3068112 - DNA, 13 bp, Homo sapiens
agacagcctgtct

SEQ ID NO: 3068113 - DNA, 12 bp, Homo sapiens
agacagctcttc

SEQ ID NO: 3068114 - DNA, 18 bp, Homo sapiens
agacagctgctcagagcc

SEQ ID NO: 3068115 - DNA, 19 bp, Homo sapiens
agacagctgctcagagcca

SEQ ID NO: 3068116 - DNA, 17 bp, Homo sapiens
agacagcttactgcagc

SEQ ID NO: 3068117 - DNA, 17 bp, Homo sapiens
agacaggaagaccaagg

SEQ ID NO: 3068118 - DNA, 14 bp, Homo sapiens
agacaggagaaatg

SEQ ID NO: 3068119 - DNA, 19 bp, Homo sapiens
agacagggtttcaccatgt

SEQ ID NO: 3068120 - DNA, 21 bp, Homo sapiens
agacaggttttcacataaatg

SEQ ID NO: 3068121 - DNA, 14 bp, Homo sapiens
agacagtatacagt

SEQ ID NO: 3068122 - DNA, 21 bp, Homo sapiens
agacagtatacagtcctgtgg

SEQ ID NO: 3068123 - DNA, 15 bp, Homo sapiens
agacagtgcacatga

SEQ ID NO: 3068124 - DNA, 15 bp, Homo sapiens
agacagtgggaaata

SEQ ID NO: 3068125 - DNA, 17 bp, Homo sapiens
agacagtgtatgtagaa

SEQ ID NO: 3068126 - DNA, 23 bp, Homo sapiens
agacagtgtatgtagaagcatga

SEQ ID NO: 3068127 - DNA, 20 bp, Homo sapiens
agacagtttactttgccaac

SEQ ID NO: 3068128 - DNA, 20 bp, Homo sapiens
agacagttttgagaacgtaa

SEQ ID NO: 3068129 - DNA, 20 bp, Homo sapiens
agacatacatagacatttca

SEQ ID NO: 3068130 - DNA, 18 bp, Homo sapiens
agaggtgaaaatgaagaa

SEQ ID NO: 3068131 - DNA, 19 bp, Homo sapiens
agaggtgaaaatgaagaag

SEQ ID NO: 3068132 - DNA, 16 bp, Homo sapiens
agaggtgaaagcataa

SEQ ID NO: 3068133 - DNA, 16 bp, Homo sapiens
agaggtgcttcaccct

SEQ ID NO: 3068134 - DNA, 22 bp, Homo sapiens
agaggtgtttttataatatcca

SEQ ID NO: 3068135 - DNA, 15 bp, Homo sapiens
agaggttgcagtgag

SEQ ID NO: 3068136 - DNA, 20 bp, Homo sapiens
agagtaagaaatttcaggtt

SEQ ID NO: 3068137 - DNA, 15 bp, Homo sapiens
agagtaattatagga

SEQ ID NO: 3068138 - DNA, 22 bp, Homo sapiens
agagtaattataggaagttctt

SEQ ID NO: 3068139 - DNA, 20 bp, Homo sapiens
agagtactcacttttcactt

SEQ ID NO: 3068140 - DNA, 18 bp, Homo sapiens
agagtagaaagcttgaaa

SEQ ID NO: 3068141 - DNA, 17 bp, Homo sapiens
agagtagaattgcattg

SEQ ID NO: 3068142 - DNA, 19 bp, Homo sapiens
agagtagccgagagcctgc

SEQ ID NO: 3068143 - DNA, 19 bp, Homo sapiens
agagtagtaagacgtgaaa

SEQ ID NO: 3068144 - DNA, 23 bp, Homo sapiens
agagtagttatataattgttgaa

SEQ ID NO: 3068145 - DNA, 14 bp, Homo sapiens
agagtatgaacacc

SEQ ID NO: 3068146 - DNA, 22 bp, Homo sapiens
agagtatgtgccaggaaactct

SEQ ID NO: 3068147 - DNA, 19 bp, Homo sapiens
agagtatttggaaaaagaa

SEQ ID NO: 3068148 - DNA, 21 bp, Homo sapiens
agagtccaaggtttaaagagt

SEQ ID NO: 3068149 - DNA, 21 bp, Homo sapiens
agagtccaggaggccctggtc

SEQ ID NO: 3068150 - DNA, 18 bp, Homo sapiens
agagtccccagactctgc

SEQ ID NO: 3068151 - DNA, 14 bp, Homo sapiens
agagtccctgcctg

SEQ ID NO: 3068152 - DNA, 17 bp, Homo sapiens
agagtccctgcctggac

SEQ ID NO: 3068153 - DNA, 14 bp, Homo sapiens
agagtcctctgaat

SEQ ID NO: 3068154 - DNA, 22 bp, Homo sapiens
agagtcggaacggagaaaggtg

SEQ ID NO: 3068155 - DNA, 22 bp, Homo sapiens
agagtctaaagatggagtttct

SEQ ID NO: 3068156 - DNA, 13 bp, Homo sapiens
agagtctagattc

SEQ ID NO: 3068157 - DNA, 15 bp, Homo sapiens
agagtctagattcaa

SEQ ID NO: 3068158 - DNA, 17 bp, Homo sapiens
agagtctagattcaaag

SEQ ID NO: 3068159 - DNA, 17 bp, Homo sapiens
agagtctccagttactg

SEQ ID NO: 3068160 - DNA, 13 bp, Homo sapiens
agagtctccttct

SEQ ID NO: 3068161 - DNA, 17 bp, Homo sapiens
agagtctccttctcttc

SEQ ID NO: 3068162 - DNA, 14 bp, Homo sapiens
agagtctctccagc

SEQ ID NO: 3068163 - DNA, 16 bp, Homo sapiens
agagtctctccagcct

SEQ ID NO: 3068164 - DNA, 14 bp, Homo sapiens
agagtctctggctc

SEQ ID NO: 3068165 - DNA, 18 bp, Homo sapiens
agagtctctggctcagct

SEQ ID NO: 3068166 - DNA, 14 bp, Homo sapiens
agagtgagaccctg

SEQ ID NO: 3068167 - DNA, 12 bp, Homo sapiens
agagtgagactc

SEQ ID NO: 3068168 - DNA, 22 bp, Homo sapiens
agagtgagagacattaactcat

SEQ ID NO: 3068169 - DNA, 12 bp, Homo sapiens
agagtgctctga

SEQ ID NO: 3068170 - DNA, 12 bp, Homo sapiens
agagtgctggga

SEQ ID NO: 3068171 - DNA, 15 bp, Homo sapiens
agagtggaggcgggc

SEQ ID NO: 3068172 - DNA, 21 bp, Homo sapiens
agagtggccacggcccaggga

SEQ ID NO: 3068173 - DNA, 16 bp, Homo sapiens
agagtggcctagagca

SEQ ID NO: 3068174 - DNA, 19 bp, Homo sapiens
agagtggcctagagcactc

SEQ ID NO: 3068175 - DNA, 15 bp, Homo sapiens
agagtggcgtgagct

SEQ ID NO: 3068176 - DNA, 16 bp, Homo sapiens
agagtgggtttcacaa

SEQ ID NO: 3068177 - DNA, 20 bp, Homo sapiens
agagtgtagtttacagaaaa

SEQ ID NO: 3068178 - DNA, 19 bp, Homo sapiens
agagtgtcaaccagacaga

SEQ ID NO: 3068179 - DNA, 20 bp, Homo sapiens
agagtgtcaaccagacagag

SEQ ID NO: 3068180 - DNA, 22 bp, Homo sapiens
agagtgtcaaccagacagaggg

SEQ ID NO: 3068181 - DNA, 21 bp, Homo sapiens
agagtgtccctttttgcaggg

SEQ ID NO: 3068182 - DNA, 15 bp, Homo sapiens
agagtgtctttccac

SEQ ID NO: 3068183 - DNA, 14 bp, Homo sapiens
agagtgtgaccaaa

SEQ ID NO: 3068184 - DNA, 21 bp, Homo sapiens
agagtgtgaccaaaagttaca

SEQ ID NO: 3068185 - DNA, 20 bp, Homo sapiens
agagtgtgtttttgcactgt

SEQ ID NO: 3068186 - DNA, 22 bp, Homo sapiens
agagtgtgtttttgcactgtct

SEQ ID NO: 3068187 - DNA, 18 bp, Homo sapiens
agagttaaaagcagcagc

SEQ ID NO: 3068188 - DNA, 16 bp, Homo sapiens
agagttaaaatgttta

SEQ ID NO: 3068189 - DNA, 12 bp, Homo sapiens
agagttattcaa

SEQ ID NO: 3068190 - DNA, 15 bp, Homo sapiens
agagttattcaaatg

SEQ ID NO: 3068191 - DNA, 15 bp, Homo sapiens
agagttcgtgaagag

SEQ ID NO: 3068192 - DNA, 19 bp, Homo sapiens
agagttcgtgaagagggaa

SEQ ID NO: 3068193 - DNA, 20 bp, Homo sapiens
agagtttatacagtgtacat

SEQ ID NO: 3068194 - DNA, 23 bp, Homo sapiens
agagtttatacagtgtacatgta

SEQ ID NO: 3068195 - DNA, 19 bp, Homo sapiens
agagtttatttttttgatg

SEQ ID NO: 3068196 - DNA, 13 bp, Homo sapiens
agagtttcagctt

SEQ ID NO: 3068197 - DNA, 19 bp, Homo sapiens
agagtttctgcagttccat

SEQ ID NO: 3068198 - DNA, 13 bp, Homo sapiens
agagttttgtctt

SEQ ID NO: 3068199 - DNA, 22 bp, Homo sapiens
agagttttttaaacaaatgagt

SEQ ID NO: 3068200 - DNA, 14 bp, Homo sapiens
agataaaatgatgt

SEQ ID NO: 3068201 - DNA, 21 bp, Homo sapiens
agataaaattatagatgggaa

SEQ ID NO: 3068202 - DNA, 20 bp, Homo sapiens
agataaacagaaatgctctg

SEQ ID NO: 3068203 - DNA, 15 bp, Homo sapiens
agataaaggaaacat

SEQ ID NO: 3068204 - DNA, 20 bp, Homo sapiens
agataaataaaagatagcaa

SEQ ID NO: 3068205 - DNA, 13 bp, Homo sapiens
agataacagcaag

SEQ ID NO: 3068206 - DNA, 12 bp, Homo sapiens
agataacatttt

SEQ ID NO: 3068207 - DNA, 21 bp, Homo sapiens
agataactgctcttttactaa

SEQ ID NO: 3068208 - DNA, 13 bp, Homo sapiens
agataactgctgt

SEQ ID NO: 3068209 - DNA, 15 bp, Homo sapiens
agataatatgagaat

SEQ ID NO: 3068210 - DNA, 18 bp, Homo sapiens
agataatcttttacattg

SEQ ID NO: 3068211 - DNA, 12 bp, Homo sapiens
agataatgtgaa

SEQ ID NO: 3068212 - DNA, 22 bp, Homo sapiens
agataattaaaaagatggttgc

SEQ ID NO: 3068213 - DNA, 15 bp, Homo sapiens
agatacaatgtattt

SEQ ID NO: 3068214 - DNA, 16 bp, Homo sapiens
agatacaatgtattta

SEQ ID NO: 3068215 - DNA, 14 bp, Homo sapiens
agatacatacagaa

SEQ ID NO: 3068216 - DNA, 16 bp, Homo sapiens
agatacatacagaatt

SEQ ID NO: 3068217 - DNA, 21 bp, Homo sapiens
agataccagcgaggaggctcc

SEQ ID NO: 3068218 - DNA, 19 bp, Homo sapiens
agataccttgaaaggaaga

SEQ ID NO: 3068219 - DNA, 16 bp, Homo sapiens
agatactgctgatgct

SEQ ID NO: 3068220 - DNA, 23 bp, Homo sapiens
agatacttctgaaataaatgttc

SEQ ID NO: 3068221 - DNA, 15 bp, Homo sapiens
agatagaatgacagt

SEQ ID NO: 3068222 - DNA, 16 bp, Homo sapiens
agatagaatgacagtc

SEQ ID NO: 3068223 - DNA, 16 bp, Homo sapiens
agatagacttattctt

SEQ ID NO: 3068224 - DNA, 18 bp, Homo sapiens
agatagagagttgttgtg

SEQ ID NO: 3068225 - DNA, 16 bp, Homo sapiens
agatagcattgtgaac

SEQ ID NO: 3068226 - DNA, 18 bp, Homo sapiens
agatagcattgtgaactg

SEQ ID NO: 3068227 - DNA, 19 bp, Homo sapiens
agatagcattgtgaactga

SEQ ID NO: 3068228 - DNA, 18 bp, Homo sapiens
agatagcctgtggccctg

SEQ ID NO: 3068229 - DNA, 21 bp, Homo sapiens
agataggtcagtgcaaatact

SEQ ID NO: 3068230 - DNA, 14 bp, Homo sapiens
agatataaatactg

SEQ ID NO: 3068231 - DNA, 19 bp, Homo sapiens
agatatatcagtgttgtct

SEQ ID NO: 3068232 - DNA, 22 bp, Homo sapiens
agatatatcagtgttgtctcat

SEQ ID NO: 3068233 - DNA, 15 bp, Homo sapiens
agatatcaaaattct

SEQ ID NO: 3068234 - DNA, 13 bp, Homo sapiens
agatatcttttct

SEQ ID NO: 3068235 - DNA, 17 bp, Homo sapiens
agatatcttttctttag

SEQ ID NO: 3068236 - DNA, 18 bp, Homo sapiens
agatatcttttctttaga

SEQ ID NO: 3068237 - DNA, 23 bp, Homo sapiens
agatatcttttctttagagaact

SEQ ID NO: 3068238 - DNA, 17 bp, Homo sapiens
agatatggcagcgaaag

SEQ ID NO: 3068239 - DNA, 16 bp, Homo sapiens
agatatgggaacactg

SEQ ID NO: 3068240 - DNA, 13 bp, Homo sapiens
agatattaaaatt

SEQ ID NO: 3068241 - DNA, 13 bp, Homo sapiens
agatattaaattc

SEQ ID NO: 3068242 - DNA, 16 bp, Homo sapiens
agatatttaaaagaca

SEQ ID NO: 3068243 - DNA, 16 bp, Homo sapiens
agatatttcttcagga

SEQ ID NO: 3068244 - DNA, 16 bp, Homo sapiens
agatatttttattcaa

SEQ ID NO: 3068245 - DNA, 22 bp, Homo sapiens
agatatttttattcaaactacc

SEQ ID NO: 3068246 - DNA, 22 bp, Homo sapiens
agatcaagaggcaggttagaag

SEQ ID NO: 3068247 - DNA, 17 bp, Homo sapiens
agatcactgaattggaa

SEQ ID NO: 3068248 - DNA, 22 bp, Homo sapiens
agatcactgaattggaactttt

SEQ ID NO: 3068249 - DNA, 23 bp, Homo sapiens
agatcagatgctccaagattcta

SEQ ID NO: 3068250 - DNA, 16 bp, Homo sapiens
agatcataaggcttca

SEQ ID NO: 3068251 - DNA, 16 bp, Homo sapiens
agatcatatacgtgaa

SEQ ID NO: 3068252 - DNA, 19 bp, Homo sapiens
agatcatggaacacaaaca

SEQ ID NO: 3068253 - DNA, 22 bp, Homo sapiens
agatcattgaagaccagctttc

SEQ ID NO: 3068254 - DNA, 16 bp, Homo sapiens
agatcatttggagctc

SEQ ID NO: 3068255 - DNA, 21 bp, Homo sapiens
agatccaaaagaagcccccag

SEQ ID NO: 3068256 - DNA, 20 bp, Homo sapiens
agatccaaatgctgtgcaaa

SEQ ID NO: 3068257 - DNA, 18 bp, Homo sapiens
agatccaaggccgcggcc

SEQ ID NO: 3068258 - DNA, 10 bp, Homo sapiens
agatccaggc

SEQ ID NO: 3068259 - DNA, 13 bp, Homo sapiens
agatccaggcttc

SEQ ID NO: 3068260 - DNA, 22 bp, Homo sapiens
agatccagggacagaggcccca

SEQ ID NO: 3068261 - DNA, 14 bp, Homo sapiens
agatcccatattta

SEQ ID NO: 3068262 - DNA, 18 bp, Homo sapiens
agcagctctaaaacatag

SEQ ID NO: 3068263 - DNA, 12 bp, Homo sapiens
agcagctctccc

SEQ ID NO: 3068264 - DNA, 22 bp, Homo sapiens
agcagctgaaatatgctggctg

SEQ ID NO: 3068265 - DNA, 14 bp, Homo sapiens
agcaggaaatgtag

SEQ ID NO: 3068266 - DNA, 13 bp, Homo sapiens
agcaggacctctg

SEQ ID NO: 3068267 - DNA, 14 bp, Homo sapiens
agcaggactccagg

SEQ ID NO: 3068268 - DNA, 15 bp, Homo sapiens
agcaggactccaggc

SEQ ID NO: 3068269 - DNA, 18 bp, Homo sapiens
agcaggactccaggccca

SEQ ID NO: 3068270 - DNA, 23 bp, Homo sapiens
agcaggactgaattgtccccagt

SEQ ID NO: 3068271 - DNA, 16 bp, Homo sapiens
agcaggagaggagagc

SEQ ID NO: 3068272 - DNA, 17 bp, Homo sapiens
agcaggagaggagagcc

SEQ ID NO: 3068273 - DNA, 20 bp, Homo sapiens
agcaggagaggagagccaga

SEQ ID NO: 3068274 - DNA, 15 bp, Homo sapiens
agcaggaggccaggc

SEQ ID NO: 3068275 - DNA, 14 bp, Homo sapiens
agcaggagtggaag

SEQ ID NO: 3068276 - DNA, 21 bp, Homo sapiens
agcaggatgaccacgcacctc

SEQ ID NO: 3068277 - DNA, 21 bp, Homo sapiens
agcaggatttttttgtagaga

SEQ ID NO: 3068278 - DNA, 20 bp, Homo sapiens
agcaggcatggcttcccctt

SEQ ID NO: 3068279 - DNA, 19 bp, Homo sapiens
agcaggccagcccggacct

SEQ ID NO: 3068280 - DNA, 22 bp, Homo sapiens
agcaggccattggctactgact

SEQ ID NO: 3068281 - DNA, 14 bp, Homo sapiens
agcaggcctccctg

SEQ ID NO: 3068282 - DNA, 17 bp, Homo sapiens
agcagggatgccctgga

SEQ ID NO: 3068283 - DNA, 22 bp, Homo sapiens
agcagggatgccctggaggtgg

SEQ ID NO: 3068284 - DNA, 18 bp, Homo sapiens
agcagggtcttttcatct

SEQ ID NO: 3068285 - DNA, 15 bp, Homo sapiens
agcagggtttgagca

SEQ ID NO: 3068286 - DNA, 18 bp, Homo sapiens
agcaggttcccaagctca

SEQ ID NO: 3068287 - DNA, 23 bp, Homo sapiens
agcaggttcccaagctcagaggc

SEQ ID NO: 3068288 - DNA, 18 bp, Homo sapiens
agcagtagacattttaac

SEQ ID NO: 3068289 - DNA, 20 bp, Homo sapiens
agcagtagacattttaacaa

SEQ ID NO: 3068290 - DNA, 22 bp, Homo sapiens
agcagtagacattttaacaaga

SEQ ID NO: 3068291 - DNA, 23 bp, Homo sapiens
agcagtagacattttaacaagaa

SEQ ID NO: 3068292 - DNA, 20 bp, Homo sapiens
agcagtatttaaatcttgca

SEQ ID NO: 3068293 - DNA, 14 bp, Homo sapiens
agcagtccctgctt

SEQ ID NO: 3068294 - DNA, 16 bp, Homo sapiens
agcagtctacttctgt

SEQ ID NO: 3068295 - DNA, 17 bp, Homo sapiens
agcagtctacttctgtg

SEQ ID NO: 3068296 - DNA, 13 bp, Homo sapiens
agcagtcttgctc

SEQ ID NO: 3068297 - DNA, 22 bp, Homo sapiens
agcagtgagccgcatcttctcc

SEQ ID NO: 3068298 - DNA, 14 bp, Homo sapiens
agcagtgggcaggt

SEQ ID NO: 3068299 - DNA, 15 bp, Homo sapiens
agcagtgggcaggtg

SEQ ID NO: 3068300 - DNA, 16 bp, Homo sapiens
agcagtgggcaggtgg

SEQ ID NO: 3068301 - DNA, 21 bp, Homo sapiens
agcagtgggcaggtggccgcc

SEQ ID NO: 3068302 - DNA, 18 bp, Homo sapiens
agcagtgggcctggccag

SEQ ID NO: 3068303 - DNA, 21 bp, Homo sapiens
agcagtgtgaggccagggcag

SEQ ID NO: 3068304 - DNA, 22 bp, Homo sapiens
agcagttactccctacactgat

SEQ ID NO: 3068305 - DNA, 16 bp, Homo sapiens
agcagttgactcagag

SEQ ID NO: 3068306 - DNA, 24 bp, Homo sapiens
agcagttttgtaaatgtactggta

SEQ ID NO: 3068307 - DNA, 16 bp, Homo sapiens
agcataaatgggaact

SEQ ID NO: 3068308 - DNA, 16 bp, Homo sapiens
agcataaatttaatgt

SEQ ID NO: 3068309 - DNA, 22 bp, Homo sapiens
agcataattccgaaacaaaact

SEQ ID NO: 3068310 - DNA, 16 bp, Homo sapiens
agcataatttgtttaa

SEQ ID NO: 3068311 - DNA, 17 bp, Homo sapiens
agcataatttgtttaaa

SEQ ID NO: 3068312 - DNA, 22 bp, Homo sapiens
agcatactttgtaaataggatt

SEQ ID NO: 3068313 - DNA, 16 bp, Homo sapiens
agcatatgctatcatt

SEQ ID NO: 3068314 - DNA, 15 bp, Homo sapiens
agcatcaaacatgaa

SEQ ID NO: 3068315 - DNA, 15 bp, Homo sapiens
agcatcacctgcctg

SEQ ID NO: 3068316 - DNA, 14 bp, Homo sapiens
agcatcattgtccc

SEQ ID NO: 3068317 - DNA, 15 bp, Homo sapiens
agcatccaggctggc

SEQ ID NO: 3068318 - DNA, 17 bp, Homo sapiens
agcatccaggctggcca

SEQ ID NO: 3068319 - DNA, 20 bp, Homo sapiens
agcatccccttgaactcttc

SEQ ID NO: 3068320 - DNA, 18 bp, Homo sapiens
agcatccctaattcttca

SEQ ID NO: 3068321 - DNA, 21 bp, Homo sapiens
agcatccctaattcttcatag

SEQ ID NO: 3068322 - DNA, 12 bp, Homo sapiens
agcatcctcccc

SEQ ID NO: 3068323 - DNA, 14 bp, Homo sapiens
agcatcctccccac

SEQ ID NO: 3068324 - DNA, 18 bp, Homo sapiens
agcatcctccccaccaga

SEQ ID NO: 3068325 - DNA, 19 bp, Homo sapiens
agcatcctccccaccagag

SEQ ID NO: 3068326 - DNA, 20 bp, Homo sapiens
agcatcctccccaccagagc

SEQ ID NO: 3068327 - DNA, 23 bp, Homo sapiens
agcatcctccccaccagagctgc

SEQ ID NO: 3068328 - DNA, 23 bp, Homo sapiens
agcatcggacaagacccccagca

SEQ ID NO: 3068329 - DNA, 17 bp, Homo sapiens
agcatcggtcatgtgtg

SEQ ID NO: 3068330 - DNA, 15 bp, Homo sapiens
agcatctacttcagg

SEQ ID NO: 3068331 - DNA, 16 bp, Homo sapiens
agcatctcaaatgttt

SEQ ID NO: 3068332 - DNA, 21 bp, Homo sapiens
agcatctcttcttccctgtca

SEQ ID NO: 3068333 - DNA, 15 bp, Homo sapiens
agcatctgaccatct

SEQ ID NO: 3068334 - DNA, 16 bp, Homo sapiens
agcatctgaccatctg

SEQ ID NO: 3068335 - DNA, 18 bp, Homo sapiens
agcatctgaccatctgtg

SEQ ID NO: 3068336 - DNA, 24 bp, Homo sapiens
agcatctgccacaaaaatgttcac

SEQ ID NO: 3068337 - DNA, 17 bp, Homo sapiens
agcatctgtacaaaggg

SEQ ID NO: 3068338 - DNA, 23 bp, Homo sapiens
agcatgaagtcttaaggacaaag

SEQ ID NO: 3068339 - DNA, 19 bp, Homo sapiens
agcatgacaaaagtgacag

SEQ ID NO: 3068340 - DNA, 14 bp, Homo sapiens
agcatgacatttct

SEQ ID NO: 3068341 - DNA, 17 bp, Homo sapiens
agcatgatattgttctc

SEQ ID NO: 3068342 - DNA, 19 bp, Homo sapiens
agcatgattttaagaggct

SEQ ID NO: 3068343 - DNA, 15 bp, Homo sapiens
agcatgcatctgttt

SEQ ID NO: 3068344 - DNA, 18 bp, Homo sapiens
agcatgccaacaagaatg

SEQ ID NO: 3068345 - DNA, 16 bp, Homo sapiens
agcatgcggagccagc

SEQ ID NO: 3068346 - DNA, 17 bp, Homo sapiens
agcatgcggagccagca

SEQ ID NO: 3068347 - DNA, 18 bp, Homo sapiens
agcatgcggagccagcag

SEQ ID NO: 3068348 - DNA, 14 bp, Homo sapiens
agcatggaatctga

SEQ ID NO: 3068349 - DNA, 23 bp, Homo sapiens
agcatggcatatagtgcccttgg

SEQ ID NO: 3068350 - DNA, 15 bp, Homo sapiens
agcatgtaggagaat

SEQ ID NO: 3068351 - DNA, 14 bp, Homo sapiens
agcatgtctctgct

SEQ ID NO: 3068352 - DNA, 16 bp, Homo sapiens
agcatgtctctgcttc

SEQ ID NO: 3068353 - DNA, 20 bp, Homo sapiens
agcatgtctctgcttccatg

SEQ ID NO: 3068354 - DNA, 23 bp, Homo sapiens
agcatgtctctgcttccatggct

SEQ ID NO: 3068355 - DNA, 17 bp, Homo sapiens
agcatgttgttttttca

SEQ ID NO: 3068356 - DNA, 19 bp, Homo sapiens
agcatgttgttttttcata

SEQ ID NO: 3068357 - DNA, 19 bp, Homo sapiens
agcatgtttattctgttcc

SEQ ID NO: 3068358 - DNA, 21 bp, Homo sapiens
agcatgttttctgctttaaat

SEQ ID NO: 3068359 - DNA, 18 bp, Homo sapiens
agcattaaaataactatc

SEQ ID NO: 3068360 - DNA, 14 bp, Homo sapiens
agcattaagcccaa

SEQ ID NO: 3068361 - DNA, 16 bp, Homo sapiens
agcattaagcccaatc

SEQ ID NO: 3068362 - DNA, 20 bp, Homo sapiens
agcattaagctgttcctgtt

SEQ ID NO: 3068363 - DNA, 18 bp, Homo sapiens
agcattcacaacttgttt

SEQ ID NO: 3068364 - DNA, 15 bp, Homo sapiens
agcattcaggcagca

SEQ ID NO: 3068365 - DNA, 14 bp, Homo sapiens
agcattccaacaaa

SEQ ID NO: 3068366 - DNA, 19 bp, Homo sapiens
agcattcgagacagaacct

SEQ ID NO: 3068367 - DNA, 14 bp, Homo sapiens
agcattctcagcca

SEQ ID NO: 3068368 - DNA, 19 bp, Homo sapiens
agcattctcaggcaccagt

SEQ ID NO: 3068369 - DNA, 15 bp, Homo sapiens
agcattgctttctga

SEQ ID NO: 3068370 - DNA, 16 bp, Homo sapiens
agcattgctttctgaa

SEQ ID NO: 3068371 - DNA, 17 bp, Homo sapiens
agcattgctttctgaaa

SEQ ID NO: 3068372 - DNA, 23 bp, Homo sapiens
agcattggatacagcagtagaca

SEQ ID NO: 3068373 - DNA, 21 bp, Homo sapiens
agcattgggtgaggtaataaa

SEQ ID NO: 3068374 - DNA, 13 bp, Homo sapiens
agcattgtgagta

SEQ ID NO: 3068375 - DNA, 20 bp, Homo sapiens
agcatttaccaacatgtatc

SEQ ID NO: 3068376 - DNA, 23 bp, Homo sapiens
agcatttagaacgagcctggaag

SEQ ID NO: 3068377 - DNA, 16 bp, Homo sapiens
agcatttagctggcca

SEQ ID NO: 3068378 - DNA, 19 bp, Homo sapiens
agcatttatgtagacattg

SEQ ID NO: 3068379 - DNA, 23 bp, Homo sapiens
agcatttatgtagacattgtaaa

SEQ ID NO: 3068380 - DNA, 17 bp, Homo sapiens
agcatttcaaagccctg

SEQ ID NO: 3068381 - DNA, 21 bp, Homo sapiens
agcatttcaaagccctgcctc

SEQ ID NO: 3068382 - DNA, 24 bp, Homo sapiens
agcatttcaaagccctgcctctgt

SEQ ID NO: 3068383 - DNA, 19 bp, Homo sapiens
agcatttcccgaaggccga

SEQ ID NO: 3068384 - DNA, 20 bp, Homo sapiens
agcatttcgcgatggacaga

SEQ ID NO: 3068385 - DNA, 17 bp, Homo sapiens
agcatttgattaacatt

SEQ ID NO: 3068386 - DNA, 17 bp, Homo sapiens
agcatttgtttctactt

SEQ ID NO: 3068387 - DNA, 19 bp, Homo sapiens
agcatttgtttctactttg

SEQ ID NO: 3068388 - DNA, 12 bp, Homo sapiens
agcattttcctc

SEQ ID NO: 3068389 - DNA, 11 bp, Homo sapiens
agccaaagagt

SEQ ID NO: 3068390 - DNA, 15 bp, Homo sapiens
agccaaagccagagt

SEQ ID NO: 3068391 - DNA, 18 bp, Homo sapiens
agccaacacgcacctgcc

SEQ ID NO: 3068392 - DNA, 19 bp, Homo sapiens
agccaacagctacaacagc

SEQ ID NO: 3068393 - DNA, 17 bp, Homo sapiens
agcctcgcacaggccct

SEQ ID NO: 3068394 - DNA, 13 bp, Homo sapiens
agcctcgctctgt

SEQ ID NO: 3068395 - DNA, 16 bp, Homo sapiens
agcctctccactcatg

SEQ ID NO: 3068396 - DNA, 13 bp, Homo sapiens
agcctctcctcct

SEQ ID NO: 3068397 - DNA, 23 bp, Homo sapiens
agcctctgggtcagtggtccaca

SEQ ID NO: 3068398 - DNA, 18 bp, Homo sapiens
agcctctttctgtccctt

SEQ ID NO: 3068399 - DNA, 22 bp, Homo sapiens
agcctgaaggggcgtctgttcc

SEQ ID NO: 3068400 - DNA, 15 bp, Homo sapiens
agcctgaataaacca

SEQ ID NO: 3068401 - DNA, 12 bp, Homo sapiens
agcctgaggcag

SEQ ID NO: 3068402 - DNA, 23 bp, Homo sapiens
agcctgagtccacgacctaggca

SEQ ID NO: 3068403 - DNA, 18 bp, Homo sapiens
agcctgatcaggcttcct

SEQ ID NO: 3068404 - DNA, 21 bp, Homo sapiens
agcctgatcaggcttcctggt

SEQ ID NO: 3068405 - DNA, 13 bp, Homo sapiens
agcctgcaccctc

SEQ ID NO: 3068406 - DNA, 13 bp, Homo sapiens
agcctgcagagct

SEQ ID NO: 3068407 - DNA, 23 bp, Homo sapiens
agcctgcagggaagccccacatg

SEQ ID NO: 3068408 - DNA, 21 bp, Homo sapiens
agcctgcgctcggcaggaagg

SEQ ID NO: 3068409 - DNA, 17 bp, Homo sapiens
agcctgctcccccaccc

SEQ ID NO: 3068410 - DNA, 19 bp, Homo sapiens
agcctgctcccccaccccc

SEQ ID NO: 3068411 - DNA, 21 bp, Homo sapiens
agcctgctcccccaccccctc

SEQ ID NO: 3068412 - DNA, 11 bp, Homo sapiens
agcctggaagc

SEQ ID NO: 3068413 - DNA, 20 bp, Homo sapiens
agcctggatagccttgaaaa

SEQ ID NO: 3068414 - DNA, 16 bp, Homo sapiens
agcctggcatctgtgc

SEQ ID NO: 3068415 - DNA, 13 bp, Homo sapiens
agcctggccagac

SEQ ID NO: 3068416 - DNA, 15 bp, Homo sapiens
agcctggccagacac

SEQ ID NO: 3068417 - DNA, 13 bp, Homo sapiens
agcctggctccaa

SEQ ID NO: 3068418 - DNA, 20 bp, Homo sapiens
agcctggctccaaaccctcg

SEQ ID NO: 3068419 - DNA, 15 bp, Homo sapiens
agcctgggaggcaca

SEQ ID NO: 3068420 - DNA, 15 bp, Homo sapiens
agcctggggcttgaa

SEQ ID NO: 3068421 - DNA, 18 bp, Homo sapiens
agcctggggcttgaattt

SEQ ID NO: 3068422 - DNA, 15 bp, Homo sapiens
agcctggggtctgga

SEQ ID NO: 3068423 - DNA, 19 bp, Homo sapiens
agcctggggtggggtcatg

SEQ ID NO: 3068424 - DNA, 12 bp, Homo sapiens
agcctgggtcac

SEQ ID NO: 3068425 - DNA, 18 bp, Homo sapiens
agcctgggtcacagagtg

SEQ ID NO: 3068426 - DNA, 19 bp, Homo sapiens
agcctgggtgacaaagcga

SEQ ID NO: 3068427 - DNA, 12 bp, Homo sapiens
agcctgtcccag

SEQ ID NO: 3068428 - DNA, 16 bp, Homo sapiens
agcctgtcccaggact

SEQ ID NO: 3068429 - DNA, 22 bp, Homo sapiens
agcctgtccccgccttccctca

SEQ ID NO: 3068430 - DNA, 17 bp, Homo sapiens
agcctgtctctttccac

SEQ ID NO: 3068431 - DNA, 15 bp, Homo sapiens
agcctgtgaccttgg

SEQ ID NO: 3068432 - DNA, 21 bp, Homo sapiens
agcctgtgagggagtgcagaa

SEQ ID NO: 3068433 - DNA, 20 bp, Homo sapiens
agcctgtgcaaaaaaattaa

SEQ ID NO: 3068434 - DNA, 21 bp, Homo sapiens
agcctgtgcatgtatgtcttg

SEQ ID NO: 3068435 - DNA, 14 bp, Homo sapiens
agcctgtggccctg

SEQ ID NO: 3068436 - DNA, 15 bp, Homo sapiens
agcctgtggccctgt

SEQ ID NO: 3068437 - DNA, 17 bp, Homo sapiens
agcctgtggcggtgcct

SEQ ID NO: 3068438 - DNA, 16 bp, Homo sapiens
agcctgtttattgcca

SEQ ID NO: 3068439 - DNA, 22 bp, Homo sapiens
agccttaactaagactcccgcc

SEQ ID NO: 3068440 - DNA, 20 bp, Homo sapiens
agccttacagttatcctgca

SEQ ID NO: 3068441 - DNA, 21 bp, Homo sapiens
agccttacagttatcctgcaa

SEQ ID NO: 3068442 - DNA, 16 bp, Homo sapiens
agccttagaggtcttt

SEQ ID NO: 3068443 - DNA, 17 bp, Homo sapiens
agccttcacttttctga

SEQ ID NO: 3068444 - DNA, 22 bp, Homo sapiens
agccttcttatatctgaagatt

SEQ ID NO: 3068445 - DNA, 14 bp, Homo sapiens
agccttgaaaacaa

SEQ ID NO: 3068446 - DNA, 16 bp, Homo sapiens
agccttgctgtagaga

SEQ ID NO: 3068447 - DNA, 22 bp, Homo sapiens
agccttgctgtagagacttccg

SEQ ID NO: 3068448 - DNA, 19 bp, Homo sapiens
agccttggataatgctgtt

SEQ ID NO: 3068449 - DNA, 18 bp, Homo sapiens
agccttgggggggctgcc

SEQ ID NO: 3068450 - DNA, 18 bp, Homo sapiens
agccttggtgtccacctg

SEQ ID NO: 3068451 - DNA, 22 bp, Homo sapiens
agcctttaccctcctctatttc

SEQ ID NO: 3068452 - DNA, 13 bp, Homo sapiens
agcctttcttcct

SEQ ID NO: 3068453 - DNA, 18 bp, Homo sapiens
agcctttggttctggcca

SEQ ID NO: 3068454 - DNA, 19 bp, Homo sapiens
agcctttggttctggccag

SEQ ID NO: 3068455 - DNA, 16 bp, Homo sapiens
agcctttttaaaacac

SEQ ID NO: 3068456 - DNA, 21 bp, Homo sapiens
agcctttttaaaacacatgtt

SEQ ID NO: 3068457 - DNA, 22 bp, Homo sapiens
agcctttttaaaacacatgttt

SEQ ID NO: 3068458 - DNA, 12 bp, Homo sapiens
agcgaacatctt

SEQ ID NO: 3068459 - DNA, 15 bp, Homo sapiens
agcgaacatcttcat

SEQ ID NO: 3068460 - DNA, 15 bp, Homo sapiens
agcgacaaagatgat

SEQ ID NO: 3068461 - DNA, 13 bp, Homo sapiens
agcgagactccat

SEQ ID NO: 3068462 - DNA, 21 bp, Homo sapiens
agcgagattccgtctcaaaaa

SEQ ID NO: 3068463 - DNA, 19 bp, Homo sapiens
agcgagccacaggaacggc

SEQ ID NO: 3068464 - DNA, 22 bp, Homo sapiens
agcgagccacaggaacggccct

SEQ ID NO: 3068465 - DNA, 16 bp, Homo sapiens
agcgaggaaaaacaac

SEQ ID NO: 3068466 - DNA, 20 bp, Homo sapiens
agcgaggagatgctccttgg

SEQ ID NO: 3068467 - DNA, 19 bp, Homo sapiens
agcgaggaggcgcggcctc

SEQ ID NO: 3068468 - DNA, 19 bp, Homo sapiens
agcgatgggcccctggccc

SEQ ID NO: 3068469 - DNA, 15 bp, Homo sapiens
agcgattctcctgcc

SEQ ID NO: 3068470 - DNA, 18 bp, Homo sapiens
agcgattctcctgcctca

SEQ ID NO: 3068471 - DNA, 14 bp, Homo sapiens
agcgcaagccacag

SEQ ID NO: 3068472 - DNA, 15 bp, Homo sapiens
agcgcaagccacagc

SEQ ID NO: 3068473 - DNA, 12 bp, Homo sapiens
agcgccagggcc

SEQ ID NO: 3068474 - DNA, 13 bp, Homo sapiens
agcgccagggccc

SEQ ID NO: 3068475 - DNA, 17 bp, Homo sapiens
agcgccagggcccaggc

SEQ ID NO: 3068476 - DNA, 21 bp, Homo sapiens
agcgccagggcccaggccatg

SEQ ID NO: 3068477 - DNA, 12 bp, Homo sapiens
agcgcccccagg

SEQ ID NO: 3068478 - DNA, 19 bp, Homo sapiens
agcgcccccaggcctgccc

SEQ ID NO: 3068479 - DNA, 18 bp, Homo sapiens
agcgccccggccggcggc

SEQ ID NO: 3068480 - DNA, 12 bp, Homo sapiens
agcgcctgcccc

SEQ ID NO: 3068481 - DNA, 15 bp, Homo sapiens
agcgcctgcccctcc

SEQ ID NO: 3068482 - DNA, 19 bp, Homo sapiens
agcgcctgcccctcccaga

SEQ ID NO: 3068483 - DNA, 15 bp, Homo sapiens
agcgcctggctgctg

SEQ ID NO: 3068484 - DNA, 14 bp, Homo sapiens
agcgcctgtataag

SEQ ID NO: 3068485 - DNA, 12 bp, Homo sapiens
agcgcctgtccc

SEQ ID NO: 3068486 - DNA, 14 bp, Homo sapiens
agcgcctgtcccct

SEQ ID NO: 3068487 - DNA, 16 bp, Homo sapiens
agcgcctgtcccctca

SEQ ID NO: 3068488 - DNA, 17 bp, Homo sapiens
agcgcctttcccaactc

SEQ ID NO: 3068489 - DNA, 20 bp, Homo sapiens
agcgcctttcccaactctag

SEQ ID NO: 3068490 - DNA, 14 bp, Homo sapiens
agcgcgcaggcctg

SEQ ID NO: 3068491 - DNA, 15 bp, Homo sapiens
agcgcgttgcctgtc

SEQ ID NO: 3068492 - DNA, 23 bp, Homo sapiens
agcgctagtgccttgcccacagg

SEQ ID NO: 3068493 - DNA, 12 bp, Homo sapiens
agcgctctcctg

SEQ ID NO: 3068494 - DNA, 17 bp, Homo sapiens
agcgctctcctggacgc

SEQ ID NO: 3068495 - DNA, 14 bp, Homo sapiens
agcgctctggacag

SEQ ID NO: 3068496 - DNA, 19 bp, Homo sapiens
agcgctgccgcaccccaga

SEQ ID NO: 3068497 - DNA, 20 bp, Homo sapiens
agcgctgccgcaccccagag

SEQ ID NO: 3068498 - DNA, 17 bp, Homo sapiens
agcggaaagcagctcaa

SEQ ID NO: 3068499 - DNA, 23 bp, Homo sapiens
agcggaaagcagctcaaaggcac

SEQ ID NO: 3068500 - DNA, 14 bp, Homo sapiens
agcggaataaacta

SEQ ID NO: 3068501 - DNA, 14 bp, Homo sapiens
agcggaccactctt

SEQ ID NO: 3068502 - DNA, 16 bp, Homo sapiens
agcggccgcagagact

SEQ ID NO: 3068503 - DNA, 20 bp, Homo sapiens
agcggccttgaagacagagc

SEQ ID NO: 3068504 - DNA, 21 bp, Homo sapiens
agcggccttgaagacagagca

SEQ ID NO: 3068505 - DNA, 14 bp, Homo sapiens
agcggcgccctgga

SEQ ID NO: 3068506 - DNA, 20 bp, Homo sapiens
agcggctctaaacctcaggc

SEQ ID NO: 3068507 - DNA, 20 bp, Homo sapiens
agcggctctggtcctcggag

SEQ ID NO: 3068508 - DNA, 21 bp, Homo sapiens
agcggctgagtcatgatctcc

SEQ ID NO: 3068509 - DNA, 11 bp, Homo sapiens
agcggctgctc

SEQ ID NO: 3068510 - DNA, 21 bp, Homo sapiens
agcggctgctcgcccaggaag

SEQ ID NO: 3068511 - DNA, 20 bp, Homo sapiens
agcggctggaattgggtggg

SEQ ID NO: 3068512 - DNA, 13 bp, Homo sapiens
agcgggagggagt

SEQ ID NO: 3068513 - DNA, 22 bp, Homo sapiens
agcgggagggagtctcaggagg

SEQ ID NO: 3068514 - DNA, 11 bp, Homo sapiens
agcgggcaggg

SEQ ID NO: 3068515 - DNA, 19 bp, Homo sapiens
agcgggggccttgaagact

SEQ ID NO: 3068516 - DNA, 15 bp, Homo sapiens
agcggtatgtgcgtg

SEQ ID NO: 3068517 - DNA, 18 bp, Homo sapiens
agcggtcagactggaggt

SEQ ID NO: 3068518 - DNA, 19 bp, Homo sapiens
agcggtccaacgccgcctt

SEQ ID NO: 3068519 - DNA, 22 bp, Homo sapiens
agcggtccaacgccgccttggc

SEQ ID NO: 3068520 - DNA, 21 bp, Homo sapiens
agcggtccatgggtctggcct

SEQ ID NO: 3068521 - DNA, 22 bp, Homo sapiens
agcggtgctgtcctcaggtggc

SEQ ID NO: 3068522 - DNA, 21 bp, Homo sapiens
agcggtgggaaggaaaggcag

SEQ ID NO: 3068523 - DNA, 12 bp, Homo sapiens
agcgtcctgccc

SEQ ID NO: 3068524 - DNA, 21 bp, Homo sapiens
agcgtcctgccctgccccctc

SEQ ID NO: 3068525 - DNA, 13 bp, Homo sapiens
agcgtctttaaga

SEQ ID NO: 3068526 - DNA, 19 bp, Homo sapiens
aggaaggtctgatttgcag

SEQ ID NO: 3068527 - DNA, 14 bp, Homo sapiens
aggaagtaggaagt

SEQ ID NO: 3068528 - DNA, 17 bp, Homo sapiens
aggaagtatcagcacta

SEQ ID NO: 3068529 - DNA, 18 bp, Homo sapiens
aggaagtcaaagcaagga

SEQ ID NO: 3068530 - DNA, 18 bp, Homo sapiens
aggaagtctaggagctgg

SEQ ID NO: 3068531 - DNA, 18 bp, Homo sapiens
aggaagtgagccagcagt

SEQ ID NO: 3068532 - DNA, 20 bp, Homo sapiens
aggaagttcttttttgtaca

SEQ ID NO: 3068533 - DNA, 21 bp, Homo sapiens
aggaagttcttttttgtacag

SEQ ID NO: 3068534 - DNA, 21 bp, Homo sapiens
aggaataaataaaaatggata

SEQ ID NO: 3068535 - DNA, 13 bp, Homo sapiens
aggaatactgttt

SEQ ID NO: 3068536 - DNA, 18 bp, Homo sapiens
aggaatactgttttatct

SEQ ID NO: 3068537 - DNA, 22 bp, Homo sapiens
aggaatatttcctccattcctg

SEQ ID NO: 3068538 - DNA, 18 bp, Homo sapiens
aggaatcactcttgtgga

SEQ ID NO: 3068539 - DNA, 15 bp, Homo sapiens
aggaatcagacttca

SEQ ID NO: 3068540 - DNA, 16 bp, Homo sapiens
aggaatctgccttcca

SEQ ID NO: 3068541 - DNA, 23 bp, Homo sapiens
aggaatgactcatgcctctgagc

SEQ ID NO: 3068542 - DNA, 13 bp, Homo sapiens
aggaatgagaagt

SEQ ID NO: 3068543 - DNA, 14 bp, Homo sapiens
aggaatgttaaagt

SEQ ID NO: 3068544 - DNA, 22 bp, Homo sapiens
aggaatgttttgtagctctagg

SEQ ID NO: 3068545 - DNA, 14 bp, Homo sapiens
aggaattgaagatg

SEQ ID NO: 3068546 - DNA, 21 bp, Homo sapiens
aggaattgaagatgtaaggaa

SEQ ID NO: 3068547 - DNA, 22 bp, Homo sapiens
aggaattgattgtcagccacct

SEQ ID NO: 3068548 - DNA, 17 bp, Homo sapiens
aggaatttcccaggacc

SEQ ID NO: 3068549 - DNA, 19 bp, Homo sapiens
aggaatttcccaggaccct

SEQ ID NO: 3068550 - DNA, 21 bp, Homo sapiens
aggaatttcccaggaccctga

SEQ ID NO: 3068551 - DNA, 17 bp, Homo sapiens
aggaatttggctgcttc

SEQ ID NO: 3068552 - DNA, 20 bp, Homo sapiens
aggaatttgggaccctgctt

SEQ ID NO: 3068553 - DNA, 18 bp, Homo sapiens
aggacaaagtgccaaaga

SEQ ID NO: 3068554 - DNA, 22 bp, Homo sapiens
aggacaaagtgccaaagaaagt

SEQ ID NO: 3068555 - DNA, 16 bp, Homo sapiens
aggacaaatgataagt

SEQ ID NO: 3068556 - DNA, 18 bp, Homo sapiens
aggacaacgaggaagccc

SEQ ID NO: 3068557 - DNA, 22 bp, Homo sapiens
aggacaactttatgtagagaaa

SEQ ID NO: 3068558 - DNA, 15 bp, Homo sapiens
aggacaatcccagga

SEQ ID NO: 3068559 - DNA, 13 bp, Homo sapiens
aggacagacagca

SEQ ID NO: 3068560 - DNA, 17 bp, Homo sapiens
aggacagaccaaaaatc

SEQ ID NO: 3068561 - DNA, 18 bp, Homo sapiens
aggacagactggccgggc

SEQ ID NO: 3068562 - DNA, 19 bp, Homo sapiens
aggacagactggccgggca

SEQ ID NO: 3068563 - DNA, 17 bp, Homo sapiens
aggacagagaagatgac

SEQ ID NO: 3068564 - DNA, 15 bp, Homo sapiens
aggacagctcttgat

SEQ ID NO: 3068565 - DNA, 18 bp, Homo sapiens
aggacaggaccagatttt

SEQ ID NO: 3068566 - DNA, 17 bp, Homo sapiens
aggacaggtctctgaga

SEQ ID NO: 3068567 - DNA, 13 bp, Homo sapiens
aggacataatggg

SEQ ID NO: 3068568 - DNA, 20 bp, Homo sapiens
aggacataatggggtcctgg

SEQ ID NO: 3068569 - DNA, 24 bp, Homo sapiens
aggacataatggggtcctggccat

SEQ ID NO: 3068570 - DNA, 21 bp, Homo sapiens
aggacatgcatgacacttcca

SEQ ID NO: 3068571 - DNA, 14 bp, Homo sapiens
aggacattcttgta

SEQ ID NO: 3068572 - DNA, 13 bp, Homo sapiens
aggaccaaggggg

SEQ ID NO: 3068573 - DNA, 19 bp, Homo sapiens
aggaccaagggggcgggga

SEQ ID NO: 3068574 - DNA, 19 bp, Homo sapiens
aggaccacaggtgtgagcc

SEQ ID NO: 3068575 - DNA, 12 bp, Homo sapiens
aggaccagctca

SEQ ID NO: 3068576 - DNA, 14 bp, Homo sapiens
aggaccagctcagg

SEQ ID NO: 3068577 - DNA, 18 bp, Homo sapiens
aggaccagctcaggacag

SEQ ID NO: 3068578 - DNA, 23 bp, Homo sapiens
aggaccagctcaggacagatgcc

SEQ ID NO: 3068579 - DNA, 19 bp, Homo sapiens
aggaccaggacccagggag

SEQ ID NO: 3068580 - DNA, 13 bp, Homo sapiens
aggacccaagcag

SEQ ID NO: 3068581 - DNA, 15 bp, Homo sapiens
aggacccagaggaag

SEQ ID NO: 3068582 - DNA, 15 bp, Homo sapiens
aggacccctcaccac

SEQ ID NO: 3068583 - DNA, 16 bp, Homo sapiens
aggacccctcaccacc

SEQ ID NO: 3068584 - DNA, 17 bp, Homo sapiens
aggacccctcaccaccc

SEQ ID NO: 3068585 - DNA, 14 bp, Homo sapiens
aggacccgccagcc

SEQ ID NO: 3068586 - DNA, 21 bp, Homo sapiens
aggacccgccagccccgctcc

SEQ ID NO: 3068587 - DNA, 20 bp, Homo sapiens
aggaccgccccaccctggaa

SEQ ID NO: 3068588 - DNA, 15 bp, Homo sapiens
aggacctccaagcca

SEQ ID NO: 3068589 - DNA, 18 bp, Homo sapiens
aggacctctgaaaccctg

SEQ ID NO: 3068590 - DNA, 20 bp, Homo sapiens
aggacctctgaaaccctgga

SEQ ID NO: 3068591 - DNA, 17 bp, Homo sapiens
aggacctgaaattccaa

SEQ ID NO: 3068592 - DNA, 14 bp, Homo sapiens
aggacctgcctgta

SEQ ID NO: 3068593 - DNA, 17 bp, Homo sapiens
aggacctggctgccata

SEQ ID NO: 3068594 - DNA, 20 bp, Homo sapiens
aggacctggcttggctttaa

SEQ ID NO: 3068595 - DNA, 18 bp, Homo sapiens
aggaccttcgggctgtgc

SEQ ID NO: 3068596 - DNA, 19 bp, Homo sapiens
aggaccttcgggctgtgcc

SEQ ID NO: 3068597 - DNA, 22 bp, Homo sapiens
aggacgcgaggggaaaggcctg

SEQ ID NO: 3068598 - DNA, 21 bp, Homo sapiens
aggacggcaaggctgaggtgg

SEQ ID NO: 3068599 - DNA, 19 bp, Homo sapiens
aggacgtgggctgggccca

SEQ ID NO: 3068600 - DNA, 14 bp, Homo sapiens
aggacgttggcctc

SEQ ID NO: 3068601 - DNA, 18 bp, Homo sapiens
aggactaatccaatacct

SEQ ID NO: 3068602 - DNA, 21 bp, Homo sapiens
aggactaatccaatacctctt

SEQ ID NO: 3068603 - DNA, 21 bp, Homo sapiens
aggactacattttgctctgtg

SEQ ID NO: 3068604 - DNA, 18 bp, Homo sapiens
aggactcagaagcctctg

SEQ ID NO: 3068605 - DNA, 22 bp, Homo sapiens
aggactcctccccaccctcctg

SEQ ID NO: 3068606 - DNA, 23 bp, Homo sapiens
aggactcctccccaccctcctgg

SEQ ID NO: 3068607 - DNA, 12 bp, Homo sapiens
aggactctcagg

SEQ ID NO: 3068608 - DNA, 14 bp, Homo sapiens
aggactctggacaa

SEQ ID NO: 3068609 - DNA, 17 bp, Homo sapiens
aggactgaattgtcccc

SEQ ID NO: 3068610 - DNA, 21 bp, Homo sapiens
aggactgcacagcgtcctgtc

SEQ ID NO: 3068611 - DNA, 21 bp, Homo sapiens
aggactgcaccattgctgctc

SEQ ID NO: 3068612 - DNA, 16 bp, Homo sapiens
aggactggaaaaatga

SEQ ID NO: 3068613 - DNA, 21 bp, Homo sapiens
aggactggccgtggctccaga

SEQ ID NO: 3068614 - DNA, 18 bp, Homo sapiens
aggactgtatttgtgact

SEQ ID NO: 3068615 - DNA, 20 bp, Homo sapiens
aggactgtgatgccctgccc

SEQ ID NO: 3068616 - DNA, 15 bp, Homo sapiens
aggacttacccagta

SEQ ID NO: 3068617 - DNA, 20 bp, Homo sapiens
aggacttagccgactgcgct

SEQ ID NO: 3068618 - DNA, 18 bp, Homo sapiens
aggacttggttgatgttt

SEQ ID NO: 3068619 - DNA, 17 bp, Homo sapiens
aggactttctgaagcct

SEQ ID NO: 3068620 - DNA, 19 bp, Homo sapiens
aggactttggtcacccaga

SEQ ID NO: 3068621 - DNA, 20 bp, Homo sapiens
aggactttggtcacccagac

SEQ ID NO: 3068622 - DNA, 17 bp, Homo sapiens
aggagaaacacttgaac

SEQ ID NO: 3068623 - DNA, 12 bp, Homo sapiens
aggagaaatgca

SEQ ID NO: 3068624 - DNA, 12 bp, Homo sapiens
aggagaagccag

SEQ ID NO: 3068625 - DNA, 14 bp, Homo sapiens
aggagaagctgcat

SEQ ID NO: 3068626 - DNA, 17 bp, Homo sapiens
aggagaagctgcatcca

SEQ ID NO: 3068627 - DNA, 15 bp, Homo sapiens
aggagaaggaaaaag

SEQ ID NO: 3068628 - DNA, 21 bp, Homo sapiens
aggagaaggtcagcgagaagg

SEQ ID NO: 3068629 - DNA, 23 bp, Homo sapiens
aggagaagtggggaccccacccc

SEQ ID NO: 3068630 - DNA, 11 bp, Homo sapiens
aggagaagttg

SEQ ID NO: 3068631 - DNA, 13 bp, Homo sapiens
aggagaagttggt

SEQ ID NO: 3068632 - DNA, 20 bp, Homo sapiens
aggagaatcacttgaacccg

SEQ ID NO: 3068633 - DNA, 20 bp, Homo sapiens
aggagaatcacttgaacctg

SEQ ID NO: 3068634 - DNA, 23 bp, Homo sapiens
aggagaatcgcttgaacctggga

SEQ ID NO: 3068635 - DNA, 20 bp, Homo sapiens
aggagaatggtgtgaacccg

SEQ ID NO: 3068636 - DNA, 15 bp, Homo sapiens
aggagaattgaattc

SEQ ID NO: 3068637 - DNA, 18 bp, Homo sapiens
aggagacaaagcaggagt

SEQ ID NO: 3068638 - DNA, 21 bp, Homo sapiens
aggagacaaagcaggagtgga

SEQ ID NO: 3068639 - DNA, 12 bp, Homo sapiens
aggagacacaga

SEQ ID NO: 3068640 - DNA, 16 bp, Homo sapiens
aggagacacagatgtt

SEQ ID NO: 3068641 - DNA, 12 bp, Homo sapiens
aggagacaggaa

SEQ ID NO: 3068642 - DNA, 13 bp, Homo sapiens
aggagacaggaag

SEQ ID NO: 3068643 - DNA, 18 bp, Homo sapiens
aggagacaggcagagctg

SEQ ID NO: 3068644 - DNA, 14 bp, Homo sapiens
aggagactcacctc

SEQ ID NO: 3068645 - DNA, 20 bp, Homo sapiens
aggagactggtaggaggagg

SEQ ID NO: 3068646 - DNA, 23 bp, Homo sapiens
aggagactggtaggaggaggcat

SEQ ID NO: 3068647 - DNA, 15 bp, Homo sapiens
aggagacttaatttc

SEQ ID NO: 3068648 - DNA, 19 bp, Homo sapiens
aggagagatagcctgtggc

SEQ ID NO: 3068649 - DNA, 20 bp, Homo sapiens
aggagagatagcctgtggcc

SEQ ID NO: 3068650 - DNA, 20 bp, Homo sapiens
aggagagattattaaatcgt

SEQ ID NO: 3068651 - DNA, 12 bp, Homo sapiens
aggagagccaga

SEQ ID NO: 3068652 - DNA, 14 bp, Homo sapiens
aggagagccagccc

SEQ ID NO: 3068653 - DNA, 16 bp, Homo sapiens
aggagagccagccctc

SEQ ID NO: 3068654 - DNA, 16 bp, Homo sapiens
aggagagcggaggagg

SEQ ID NO: 3068655 - DNA, 16 bp, Homo sapiens
aggagaggaaaactat

SEQ ID NO: 3068656 - DNA, 15 bp, Homo sapiens
aggagatcagaaaaa

SEQ ID NO: 3068657 - DNA, 18 bp, Homo sapiens
aggagatgctccttgggc

SEQ ID NO: 3068658 - DNA, 20 bp, Homo sapiens
aggctgtgtttggctttcag

SEQ ID NO: 3068659 - DNA, 19 bp, Homo sapiens
aggcttaataaaaatgaca

SEQ ID NO: 3068660 - DNA, 17 bp, Homo sapiens
aggcttaccaaagtatt

SEQ ID NO: 3068661 - DNA, 16 bp, Homo sapiens
aggcttcacgccggga

SEQ ID NO: 3068662 - DNA, 17 bp, Homo sapiens
aggcttcacgccgggag

SEQ ID NO: 3068663 - DNA, 14 bp, Homo sapiens
aggcttctcccgga

SEQ ID NO: 3068664 - DNA, 17 bp, Homo sapiens
aggcttctcccggacct

SEQ ID NO: 3068665 - DNA, 18 bp, Homo sapiens
aggcttctcccggacctg

SEQ ID NO: 3068666 - DNA, 21 bp, Homo sapiens
aggcttgccgcacatgaaaca

SEQ ID NO: 3068667 - DNA, 15 bp, Homo sapiens
aggcttgcctgggct

SEQ ID NO: 3068668 - DNA, 14 bp, Homo sapiens
aggcttgttgtgct

SEQ ID NO: 3068669 - DNA, 16 bp, Homo sapiens
aggcttgttgtgcttt

SEQ ID NO: 3068670 - DNA, 15 bp, Homo sapiens
aggctttaaaaagaa

SEQ ID NO: 3068671 - DNA, 18 bp, Homo sapiens
aggctttaagctccagct

SEQ ID NO: 3068672 - DNA, 18 bp, Homo sapiens
aggctttcccacttccca

SEQ ID NO: 3068673 - DNA, 22 bp, Homo sapiens
aggctttctgttgccatggtga

SEQ ID NO: 3068674 - DNA, 17 bp, Homo sapiens
aggctttgagcaactaa

SEQ ID NO: 3068675 - DNA, 19 bp, Homo sapiens
aggctttgagcaactaact

SEQ ID NO: 3068676 - DNA, 18 bp, Homo sapiens
aggctttggcaacagaaa

SEQ ID NO: 3068677 - DNA, 15 bp, Homo sapiens
agggaaaagcagatg

SEQ ID NO: 3068678 - DNA, 18 bp, Homo sapiens
agggaaaataggcaggaa

SEQ ID NO: 3068679 - DNA, 18 bp, Homo sapiens
agggaaaattatttgcat

SEQ ID NO: 3068680 - DNA, 14 bp, Homo sapiens
agggaacagacagg

SEQ ID NO: 3068681 - DNA, 20 bp, Homo sapiens
agggaacagacaggagaaat

SEQ ID NO: 3068682 - DNA, 18 bp, Homo sapiens
agggaacatatttaagga

SEQ ID NO: 3068683 - DNA, 19 bp, Homo sapiens
agggaactgcttgcccagg

SEQ ID NO: 3068684 - DNA, 14 bp, Homo sapiens
agggaaggacagaa

SEQ ID NO: 3068685 - DNA, 15 bp, Homo sapiens
agggaaggacagaaa

SEQ ID NO: 3068686 - DNA, 22 bp, Homo sapiens
agggaaggatcccatgagctcc

SEQ ID NO: 3068687 - DNA, 14 bp, Homo sapiens
agggaagggcctgc

SEQ ID NO: 3068688 - DNA, 16 bp, Homo sapiens
agggaaggggcctccc

SEQ ID NO: 3068689 - DNA, 20 bp, Homo sapiens
agggaaggtgaccgcccagc

SEQ ID NO: 3068690 - DNA, 15 bp, Homo sapiens
agggaagtccccagg

SEQ ID NO: 3068691 - DNA, 15 bp, Homo sapiens
agggaatcacatctt

SEQ ID NO: 3068692 - DNA, 15 bp, Homo sapiens
agggaatcctcctcc

SEQ ID NO: 3068693 - DNA, 12 bp, Homo sapiens
agggaattgctc

SEQ ID NO: 3068694 - DNA, 13 bp, Homo sapiens
agggaattgctca

SEQ ID NO: 3068695 - DNA, 21 bp, Homo sapiens
agggacacctgggagaaatct

SEQ ID NO: 3068696 - DNA, 20 bp, Homo sapiens
agggacagagacacctgcac

SEQ ID NO: 3068697 - DNA, 16 bp, Homo sapiens
agggacagaggcccca

SEQ ID NO: 3068698 - DNA, 17 bp, Homo sapiens
agggacagaggccccag

SEQ ID NO: 3068699 - DNA, 21 bp, Homo sapiens
agggacaggaaggtctgattt

SEQ ID NO: 3068700 - DNA, 16 bp, Homo sapiens
agggacatgccctgtg

SEQ ID NO: 3068701 - DNA, 18 bp, Homo sapiens
agggacatgccctgtgtg

SEQ ID NO: 3068702 - DNA, 17 bp, Homo sapiens
agggacattgcagagtg

SEQ ID NO: 3068703 - DNA, 18 bp, Homo sapiens
agggaccaaattgcttct

SEQ ID NO: 3068704 - DNA, 15 bp, Homo sapiens
agggacccctgccct

SEQ ID NO: 3068705 - DNA, 23 bp, Homo sapiens
agggacccctgcccttgtcccac

SEQ ID NO: 3068706 - DNA, 22 bp, Homo sapiens
agggacccggggtctcctggac

SEQ ID NO: 3068707 - DNA, 18 bp, Homo sapiens
agggaccgagcccagcag

SEQ ID NO: 3068708 - DNA, 13 bp, Homo sapiens
agggacgcctggg

SEQ ID NO: 3068709 - DNA, 22 bp, Homo sapiens
agggacttctgcggggcctgag

SEQ ID NO: 3068710 - DNA, 18 bp, Homo sapiens
agggactttgggctgtga

SEQ ID NO: 3068711 - DNA, 15 bp, Homo sapiens
agggagaaaggagaa

SEQ ID NO: 3068712 - DNA, 22 bp, Homo sapiens
agggagacattgtttggatttc

SEQ ID NO: 3068713 - DNA, 21 bp, Homo sapiens
agggagacgccgggctagagc

SEQ ID NO: 3068714 - DNA, 17 bp, Homo sapiens
agggagagaaaactctt

SEQ ID NO: 3068715 - DNA, 20 bp, Homo sapiens
agggagagaactgagcatct

SEQ ID NO: 3068716 - DNA, 12 bp, Homo sapiens
agggagaggaag

SEQ ID NO: 3068717 - DNA, 14 bp, Homo sapiens
agggagaggctgtg

SEQ ID NO: 3068718 - DNA, 17 bp, Homo sapiens
agggagaggctgtgtcc

SEQ ID NO: 3068719 - DNA, 21 bp, Homo sapiens
agggagagggcctctgcctgg

SEQ ID NO: 3068720 - DNA, 20 bp, Homo sapiens
agggagagttggggaaggca

SEQ ID NO: 3068721 - DNA, 20 bp, Homo sapiens
agggagatgatccagagaca

SEQ ID NO: 3068722 - DNA, 19 bp, Homo sapiens
agggagatgttggactgtg

SEQ ID NO: 3068723 - DNA, 18 bp, Homo sapiens
agggagcggaaagcagct

SEQ ID NO: 3068724 - DNA, 15 bp, Homo sapiens
agggagctagccaga

SEQ ID NO: 3068725 - DNA, 14 bp, Homo sapiens
agggagctgggccc

SEQ ID NO: 3068726 - DNA, 16 bp, Homo sapiens
agggagctgggcccga

SEQ ID NO: 3068727 - DNA, 20 bp, Homo sapiens
agggaggaatgtgtgccttg

SEQ ID NO: 3068728 - DNA, 22 bp, Homo sapiens
agggaggaccaaagggatggta

SEQ ID NO: 3068729 - DNA, 22 bp, Homo sapiens
agggaggaccagggcagggcca

SEQ ID NO: 3068730 - DNA, 22 bp, Homo sapiens
agggaggacccacactgctaca

SEQ ID NO: 3068731 - DNA, 23 bp, Homo sapiens
agggaggacccacactgctacac

SEQ ID NO: 3068732 - DNA, 15 bp, Homo sapiens
agggaggcagagcgg

SEQ ID NO: 3068733 - DNA, 15 bp, Homo sapiens
agggaggccccaggg

SEQ ID NO: 3068734 - DNA, 20 bp, Homo sapiens
agggaggcgtcttcatctcc

SEQ ID NO: 3068735 - DNA, 22 bp, Homo sapiens
agggagggagccatggaaggtg

SEQ ID NO: 3068736 - DNA, 13 bp, Homo sapiens
agggagggagctg

SEQ ID NO: 3068737 - DNA, 15 bp, Homo sapiens
agggagggccaggga

SEQ ID NO: 3068738 - DNA, 17 bp, Homo sapiens
agggagggccagggagg

SEQ ID NO: 3068739 - DNA, 20 bp, Homo sapiens
agggagggccagggaggcag

SEQ ID NO: 3068740 - DNA, 16 bp, Homo sapiens
agggaggggaaggggc

SEQ ID NO: 3068741 - DNA, 15 bp, Homo sapiens
agggaggggcctagg

SEQ ID NO: 3068742 - DNA, 20 bp, Homo sapiens
agggaggggcctaggcctca

SEQ ID NO: 3068743 - DNA, 12 bp, Homo sapiens
agggagggtgag

SEQ ID NO: 3068744 - DNA, 17 bp, Homo sapiens
agggagggtttctctcc

SEQ ID NO: 3068745 - DNA, 20 bp, Homo sapiens
agggagttactgaagtctta

SEQ ID NO: 3068746 - DNA, 15 bp, Homo sapiens
agggatccctcatct

SEQ ID NO: 3068747 - DNA, 18 bp, Homo sapiens
agggatgaagggcgagtg

SEQ ID NO: 3068748 - DNA, 15 bp, Homo sapiens
agggatgcatggaga

SEQ ID NO: 3068749 - DNA, 15 bp, Homo sapiens
agggatggcgaggcc

SEQ ID NO: 3068750 - DNA, 14 bp, Homo sapiens
agggatgggcagcc

SEQ ID NO: 3068751 - DNA, 16 bp, Homo sapiens
agggatggtgttcaaa

SEQ ID NO: 3068752 - DNA, 18 bp, Homo sapiens
agggattcggccgcggct

SEQ ID NO: 3068753 - DNA, 16 bp, Homo sapiens
agggattgctgccact

SEQ ID NO: 3068754 - DNA, 20 bp, Homo sapiens
agggattggaccgagctgga

SEQ ID NO: 3068755 - DNA, 22 bp, Homo sapiens
agggcaagtggatgggaatttg

SEQ ID NO: 3068756 - DNA, 13 bp, Homo sapiens
agggcacagatga

SEQ ID NO: 3068757 - DNA, 14 bp, Homo sapiens
agggcacagatgac

SEQ ID NO: 3068758 - DNA, 15 bp, Homo sapiens
agggcacatgatctg

SEQ ID NO: 3068759 - DNA, 18 bp, Homo sapiens
agggcagaggaagagaca

SEQ ID NO: 3068760 - DNA, 20 bp, Homo sapiens
agggcagaggctggaggcag

SEQ ID NO: 3068761 - DNA, 18 bp, Homo sapiens
agggcagcactgggaagc

SEQ ID NO: 3068762 - DNA, 15 bp, Homo sapiens
agggcagcccctgca

SEQ ID NO: 3068763 - DNA, 18 bp, Homo sapiens
agggcagccctccatggt

SEQ ID NO: 3068764 - DNA, 17 bp, Homo sapiens
agggcagcgccaggctg

SEQ ID NO: 3068765 - DNA, 12 bp, Homo sapiens
agggcagctgcc

SEQ ID NO: 3068766 - DNA, 13 bp, Homo sapiens
agggcagctgcct

SEQ ID NO: 3068767 - DNA, 16 bp, Homo sapiens
agggcagctgcctggc

SEQ ID NO: 3068768 - DNA, 19 bp, Homo sapiens
agggcagctgcctggccat

SEQ ID NO: 3068769 - DNA, 12 bp, Homo sapiens
agggcagggcca

SEQ ID NO: 3068770 - DNA, 13 bp, Homo sapiens
agggcagggtggg

SEQ ID NO: 3068771 - DNA, 17 bp, Homo sapiens
agggcatcatgcatctt

SEQ ID NO: 3068772 - DNA, 15 bp, Homo sapiens
agggcatctctgagt

SEQ ID NO: 3068773 - DNA, 16 bp, Homo sapiens
agggccacgctccagc

SEQ ID NO: 3068774 - DNA, 17 bp, Homo sapiens
agggccacgctccagct

SEQ ID NO: 3068775 - DNA, 23 bp, Homo sapiens
agggccactcaacagagaggacc

SEQ ID NO: 3068776 - DNA, 18 bp, Homo sapiens
agggccagcaggcagcgc

SEQ ID NO: 3068777 - DNA, 19 bp, Homo sapiens
agggccagcaggcagcgcc

SEQ ID NO: 3068778 - DNA, 22 bp, Homo sapiens
agggccagcaggcagcgcctgt

SEQ ID NO: 3068779 - DNA, 18 bp, Homo sapiens
agggccaggtgcggcctg

SEQ ID NO: 3068780 - DNA, 14 bp, Homo sapiens
agggccatggctca

SEQ ID NO: 3068781 - DNA, 21 bp, Homo sapiens
agggccatggctcagggtggt

SEQ ID NO: 3068782 - DNA, 20 bp, Homo sapiens
agggcccagagcccagctcc

SEQ ID NO: 3068783 - DNA, 12 bp, Homo sapiens
agggcccaggcc

SEQ ID NO: 3068784 - DNA, 14 bp, Homo sapiens
agggccctgtggag

SEQ ID NO: 3068785 - DNA, 20 bp, Homo sapiens
agggccctgtggagtccagc

SEQ ID NO: 3068786 - DNA, 21 bp, Homo sapiens
agggccctgtggagtccagct

SEQ ID NO: 3068787 - DNA, 23 bp, Homo sapiens
agggccctgtggagtccagctct

SEQ ID NO: 3068788 - DNA, 18 bp, Homo sapiens
agggcccttcccctcccc

SEQ ID NO: 3068789 - DNA, 13 bp, Homo sapiens
agggccgcctgcc

SEQ ID NO: 3068790 - DNA, 14 bp, Homo sapiens
agtcatctcaacca

SEQ ID NO: 3068791 - DNA, 21 bp, Homo sapiens
agtcatcttgaccaagcagga

SEQ ID NO: 3068792 - DNA, 16 bp, Homo sapiens
agtcatgatctccctg

SEQ ID NO: 3068793 - DNA, 17 bp, Homo sapiens
agtcatgatctccctgc

SEQ ID NO: 3068794 - DNA, 18 bp, Homo sapiens
agtcatgatctccctgcc

SEQ ID NO: 3068795 - DNA, 20 bp, Homo sapiens
agtcatgatctccctgccgc

SEQ ID NO: 3068796 - DNA, 17 bp, Homo sapiens
agtcatgggaacgcagc

SEQ ID NO: 3068797 - DNA, 22 bp, Homo sapiens
agtcatgtagccccagtcagaa

SEQ ID NO: 3068798 - DNA, 22 bp, Homo sapiens
agtcatgttttaaatgtacagt

SEQ ID NO: 3068799 - DNA, 14 bp, Homo sapiens
agtcattaaactgg

SEQ ID NO: 3068800 - DNA, 23 bp, Homo sapiens
agtcattattattactttttaaa

SEQ ID NO: 3068801 - DNA, 17 bp, Homo sapiens
agtcattcgttctgtgg

SEQ ID NO: 3068802 - DNA, 22 bp, Homo sapiens
agtcatttaactgaagatgttg

SEQ ID NO: 3068803 - DNA, 19 bp, Homo sapiens
agtcatttccgtccccccc

SEQ ID NO: 3068804 - DNA, 16 bp, Homo sapiens
agtcatttgagtctct

SEQ ID NO: 3068805 - DNA, 12 bp, Homo sapiens
agtcattttggg

SEQ ID NO: 3068806 - DNA, 22 bp, Homo sapiens
agtccaagcagaagggcagatg

SEQ ID NO: 3068807 - DNA, 11 bp, Homo sapiens
agtccaagctg

SEQ ID NO: 3068808 - DNA, 14 bp, Homo sapiens
agtccaatgtggca

SEQ ID NO: 3068809 - DNA, 14 bp, Homo sapiens
agtccacaaaataa

SEQ ID NO: 3068810 - DNA, 14 bp, Homo sapiens
agtccagctctact

SEQ ID NO: 3068811 - DNA, 17 bp, Homo sapiens
agtccagctttctgcag

SEQ ID NO: 3068812 - DNA, 19 bp, Homo sapiens
agtccaggaggccctggtc

SEQ ID NO: 3068813 - DNA, 15 bp, Homo sapiens
agtccatgctccagg

SEQ ID NO: 3068814 - DNA, 18 bp, Homo sapiens
agtccatgctccagggtc

SEQ ID NO: 3068815 - DNA, 17 bp, Homo sapiens
agtccattatttgagtt

SEQ ID NO: 3068816 - DNA, 14 bp, Homo sapiens
agtccatttcctaa

SEQ ID NO: 3068817 - DNA, 16 bp, Homo sapiens
agtcccagagctgcac

SEQ ID NO: 3068818 - DNA, 21 bp, Homo sapiens
agtcccagctacttgggagcc

SEQ ID NO: 3068819 - DNA, 20 bp, Homo sapiens
agtcccaggggcagccacac

SEQ ID NO: 3068820 - DNA, 13 bp, Homo sapiens
agtccccagactc

SEQ ID NO: 3068821 - DNA, 16 bp, Homo sapiens
agtccccaggccccag

SEQ ID NO: 3068822 - DNA, 19 bp, Homo sapiens
agtcccccaaagggcctcc

SEQ ID NO: 3068823 - DNA, 23 bp, Homo sapiens
agtcccccaaagggcctcctcac

SEQ ID NO: 3068824 - DNA, 19 bp, Homo sapiens
agtccccgggcatctttgg

SEQ ID NO: 3068825 - DNA, 22 bp, Homo sapiens
agtccccgggcatctttgggga

SEQ ID NO: 3068826 - DNA, 15 bp, Homo sapiens
agtccctatgtattt

SEQ ID NO: 3068827 - DNA, 21 bp, Homo sapiens
agtccctcacgtttcttcccc

SEQ ID NO: 3068828 - DNA, 18 bp, Homo sapiens
agtccctctggaaagaaa

SEQ ID NO: 3068829 - DNA, 15 bp, Homo sapiens
agtccctgcctggac

SEQ ID NO: 3068830 - DNA, 22 bp, Homo sapiens
agtccctgcctggaccagcctc

SEQ ID NO: 3068831 - DNA, 15 bp, Homo sapiens
agtccctgcttatga

SEQ ID NO: 3068832 - DNA, 21 bp, Homo sapiens
agtccctgggagcaagttgca

SEQ ID NO: 3068833 - DNA, 14 bp, Homo sapiens
agtccctgggggaa

SEQ ID NO: 3068834 - DNA, 18 bp, Homo sapiens
agtcccttcctgcttcct

SEQ ID NO: 3068835 - DNA, 20 bp, Homo sapiens
agtcccttcctgcttcctgt

SEQ ID NO: 3068836 - DNA, 14 bp, Homo sapiens
agtcccttttcatt

SEQ ID NO: 3068837 - DNA, 15 bp, Homo sapiens
agtccgtcaaaacag

SEQ ID NO: 3068838 - DNA, 21 bp, Homo sapiens
agtccgtgctgacagctgctc

SEQ ID NO: 3068839 - DNA, 22 bp, Homo sapiens
agtcctaaaagttctcaatgta

SEQ ID NO: 3068840 - DNA, 24 bp, Homo sapiens
agtcctaaaagttctcaatgtaga

SEQ ID NO: 3068841 - DNA, 13 bp, Homo sapiens
agtcctaacaaat

SEQ ID NO: 3068842 - DNA, 15 bp, Homo sapiens
agtcctagctgacgc

SEQ ID NO: 3068843 - DNA, 17 bp, Homo sapiens
agtcctagctgacgcca

SEQ ID NO: 3068844 - DNA, 19 bp, Homo sapiens
agtcctattcaaattccta

SEQ ID NO: 3068845 - DNA, 13 bp, Homo sapiens
agtcctctgcctc

SEQ ID NO: 3068846 - DNA, 17 bp, Homo sapiens
agtcctgactgggctgg

SEQ ID NO: 3068847 - DNA, 20 bp, Homo sapiens
agtcctgactgggctgggtt

SEQ ID NO: 3068848 - DNA, 21 bp, Homo sapiens
agtcctgactgggctgggttt

SEQ ID NO: 3068849 - DNA, 22 bp, Homo sapiens
agtcctgactgggctgggtttg

SEQ ID NO: 3068850 - DNA, 16 bp, Homo sapiens
agtcctgctggcctgc

SEQ ID NO: 3068851 - DNA, 17 bp, Homo sapiens
agtcctgctggcctgct

SEQ ID NO: 3068852 - DNA, 23 bp, Homo sapiens
agtcctggactcctgccaccagc

SEQ ID NO: 3068853 - DNA, 14 bp, Homo sapiens
agtcctgggaggat

SEQ ID NO: 3068854 - DNA, 13 bp, Homo sapiens
agtcctggtcctg

SEQ ID NO: 3068855 - DNA, 16 bp, Homo sapiens
agtcctggtcctggct

SEQ ID NO: 3068856 - DNA, 21 bp, Homo sapiens
agtcctggtcctggctgcact

SEQ ID NO: 3068857 - DNA, 16 bp, Homo sapiens
agtcctggtctgctca

SEQ ID NO: 3068858 - DNA, 18 bp, Homo sapiens
agtcctggtctgctcagg

SEQ ID NO: 3068859 - DNA, 12 bp, Homo sapiens
agtcctgtaatg

SEQ ID NO: 3068860 - DNA, 19 bp, Homo sapiens
agtcctgtatgtctgtcat

SEQ ID NO: 3068861 - DNA, 14 bp, Homo sapiens
agtccttgaaaata

SEQ ID NO: 3068862 - DNA, 17 bp, Homo sapiens
agtcctttatgtggaaa

SEQ ID NO: 3068863 - DNA, 12 bp, Homo sapiens
agtccttttgta

SEQ ID NO: 3068864 - DNA, 16 bp, Homo sapiens
agtccttttgtaaagt

SEQ ID NO: 3068865 - DNA, 21 bp, Homo sapiens
agtcctttttttccatcttta

SEQ ID NO: 3068866 - DNA, 15 bp, Homo sapiens
agtcgctcagtctgt

SEQ ID NO: 3068867 - DNA, 14 bp, Homo sapiens
agtcgcttgccaaa

SEQ ID NO: 3068868 - DNA, 17 bp, Homo sapiens
agtcgcttgccaaagca

SEQ ID NO: 3068869 - DNA, 18 bp, Homo sapiens
agtcgcttgccaaagcag

SEQ ID NO: 3068870 - DNA, 19 bp, Homo sapiens
agtcgcttgccaaagcaga

SEQ ID NO: 3068871 - DNA, 20 bp, Homo sapiens
agtcggaacggagaaaggtg

SEQ ID NO: 3068872 - DNA, 17 bp, Homo sapiens
agtctacccgacataag

SEQ ID NO: 3068873 - DNA, 20 bp, Homo sapiens
agtctacgctctcctttctt

SEQ ID NO: 3068874 - DNA, 20 bp, Homo sapiens
agtctactcttaagccatct

SEQ ID NO: 3068875 - DNA, 15 bp, Homo sapiens
agtctacttctgtgt

SEQ ID NO: 3068876 - DNA, 18 bp, Homo sapiens
agtctagaagaattaagc

SEQ ID NO: 3068877 - DNA, 21 bp, Homo sapiens
agtctagattcaaaggttcta

SEQ ID NO: 3068878 - DNA, 20 bp, Homo sapiens
agtctagattctctggctgt

SEQ ID NO: 3068879 - DNA, 11 bp, Homo sapiens
agtctatggcc

SEQ ID NO: 3068880 - DNA, 19 bp, Homo sapiens
agtctatgttttaaaataa

SEQ ID NO: 3068881 - DNA, 15 bp, Homo sapiens
agtctcaggaggagg

SEQ ID NO: 3068882 - DNA, 21 bp, Homo sapiens
agtctccagaagaaaatttgc

SEQ ID NO: 3068883 - DNA, 15 bp, Homo sapiens
agtctccccttgcag

SEQ ID NO: 3068884 - DNA, 18 bp, Homo sapiens
agtctccccttgcagcct

SEQ ID NO: 3068885 - DNA, 20 bp, Homo sapiens
agtctccctcacagcacaga

SEQ ID NO: 3068886 - DNA, 20 bp, Homo sapiens
agtctccctccgactccaga

SEQ ID NO: 3068887 - DNA, 19 bp, Homo sapiens
agtctcctaggggcttggt

SEQ ID NO: 3068888 - DNA, 22 bp, Homo sapiens
agtctcctaggggcttggtcct

SEQ ID NO: 3068889 - DNA, 11 bp, Homo sapiens
agtctccttct

SEQ ID NO: 3068890 - DNA, 12 bp, Homo sapiens
agtctccttctc

SEQ ID NO: 3068891 - DNA, 19 bp, Homo sapiens
agtctccttctcttctctt

SEQ ID NO: 3068892 - DNA, 23 bp, Homo sapiens
agtctccttctcttctcttcttt

SEQ ID NO: 3068893 - DNA, 19 bp, Homo sapiens
agtctcgctctgttgccca

SEQ ID NO: 3068894 - DNA, 17 bp, Homo sapiens
agtctctatcattaaag

SEQ ID NO: 3068895 - DNA, 20 bp, Homo sapiens
agtctctccagcctcacaga

SEQ ID NO: 3068896 - DNA, 16 bp, Homo sapiens
agtctctgagcagtga

SEQ ID NO: 3068897 - DNA, 15 bp, Homo sapiens
agtctctgctccacc

SEQ ID NO: 3068898 - DNA, 19 bp, Homo sapiens
agtctctggctcagctgtg

SEQ ID NO: 3068899 - DNA, 20 bp, Homo sapiens
agtctctggctcagctgtgg

SEQ ID NO: 3068900 - DNA, 22 bp, Homo sapiens
agtctctgggtttacaacaaac

SEQ ID NO: 3068901 - DNA, 16 bp, Homo sapiens
agtctctgtgtaacca

SEQ ID NO: 3068902 - DNA, 20 bp, Homo sapiens
agtctctgttcttcatctgc

SEQ ID NO: 3068903 - DNA, 18 bp, Homo sapiens
agtctctttattcctagt

SEQ ID NO: 3068904 - DNA, 21 bp, Homo sapiens
agtctgaagcagatgcaaaga

SEQ ID NO: 3068905 - DNA, 21 bp, Homo sapiens
agtctgatcgtgacgctgaat

SEQ ID NO: 3068906 - DNA, 22 bp, Homo sapiens
agtctgatcgtgacgctgaata

SEQ ID NO: 3068907 - DNA, 15 bp, Homo sapiens
agtctgctttctcta

SEQ ID NO: 3068908 - DNA, 16 bp, Homo sapiens
agtctgctttctctac

SEQ ID NO: 3068909 - DNA, 17 bp, Homo sapiens
agtctggatctgggacc

SEQ ID NO: 3068910 - DNA, 14 bp, Homo sapiens
agtctggccatttt

SEQ ID NO: 3068911 - DNA, 19 bp, Homo sapiens
agtctgggtcagacccatc

SEQ ID NO: 3068912 - DNA, 21 bp, Homo sapiens
agtctgggtctgggtttggat

SEQ ID NO: 3068913 - DNA, 17 bp, Homo sapiens
agtctggtgaacttcaa

SEQ ID NO: 3068914 - DNA, 14 bp, Homo sapiens
agtctggtggagga

SEQ ID NO: 3068915 - DNA, 16 bp, Homo sapiens
agtctgtatttttcta

SEQ ID NO: 3068916 - DNA, 14 bp, Homo sapiens
agtctgtcttctgt

SEQ ID NO: 3068917 - DNA, 20 bp, Homo sapiens
agtctgtcttctgtatataa

SEQ ID NO: 3068918 - DNA, 22 bp, Homo sapiens
agtctgtcttctgtatataaat

SEQ ID NO: 3068919 - DNA, 12 bp, Homo sapiens
agtcttaacaaa

SEQ ID NO: 3068920 - DNA, 15 bp, Homo sapiens
agtcttaacaaacca

SEQ ID NO: 3068921 - DNA, 20 bp, Homo sapiens
agtcttaacaaaccaacatc

SEQ ID NO: 3068922 - DNA, 20 bp, Homo sapiens
agtgttaatactagttgtga

SEQ ID NO: 3068923 - DNA, 12 bp, Homo sapiens
agtgttaatcaa

SEQ ID NO: 3068924 - DNA, 23 bp, Homo sapiens
agtgttcacaacctggaagtgct

SEQ ID NO: 3068925 - DNA, 21 bp, Homo sapiens
agtgttccgtggttaaactcg

SEQ ID NO: 3068926 - DNA, 15 bp, Homo sapiens
agtgttcctgagaca

SEQ ID NO: 3068927 - DNA, 15 bp, Homo sapiens
agtgttcctgtctca

SEQ ID NO: 3068928 - DNA, 17 bp, Homo sapiens
agtgttcctgtctcaat

SEQ ID NO: 3068929 - DNA, 22 bp, Homo sapiens
agtgttcctttttaaatgtgaa

SEQ ID NO: 3068930 - DNA, 16 bp, Homo sapiens
agtgttcttcagtgta

SEQ ID NO: 3068931 - DNA, 23 bp, Homo sapiens
agtgttgaaaaatatctttgcat

SEQ ID NO: 3068932 - DNA, 17 bp, Homo sapiens
agtgttgaaaatgtatt

SEQ ID NO: 3068933 - DNA, 13 bp, Homo sapiens
agtgtttctatga

SEQ ID NO: 3068934 - DNA, 20 bp, Homo sapiens
agtgtttctatgagtggaaa

SEQ ID NO: 3068935 - DNA, 23 bp, Homo sapiens
agtgtttctgaatgtttgtgtct

SEQ ID NO: 3068936 - DNA, 17 bp, Homo sapiens
agtgtttctgtgcatgg

SEQ ID NO: 3068937 - DNA, 22 bp, Homo sapiens
agtgtttgggggacgtttctca

SEQ ID NO: 3068938 - DNA, 16 bp, Homo sapiens
agtgttttgcatacat

SEQ ID NO: 3068939 - DNA, 19 bp, Homo sapiens
agtgttttggactccatct

SEQ ID NO: 3068940 - DNA, 23 bp, Homo sapiens
agtgttttggactccatctctca

SEQ ID NO: 3068941 - DNA, 23 bp, Homo sapiens
agtgttttgtaccagtgaatttt

SEQ ID NO: 3068942 - DNA, 14 bp, Homo sapiens
agtgtttttgtaaa

SEQ ID NO: 3068943 - DNA, 20 bp, Homo sapiens
agtgtttttgtaaagtgtgg

SEQ ID NO: 3068944 - DNA, 13 bp, Homo sapiens
agttaaaaaaaaa

SEQ ID NO: 3068945 - DNA, 19 bp, Homo sapiens
agttaaaatgtttactgta

SEQ ID NO: 3068946 - DNA, 16 bp, Homo sapiens
agttaaagcatatgct

SEQ ID NO: 3068947 - DNA, 12 bp, Homo sapiens
agttaaaggcag

SEQ ID NO: 3068948 - DNA, 18 bp, Homo sapiens
agttaaaggcagtccaga

SEQ ID NO: 3068949 - DNA, 23 bp, Homo sapiens
agttaacgtcacccaaaagcaca

SEQ ID NO: 3068950 - DNA, 13 bp, Homo sapiens
agttaagacctgg

SEQ ID NO: 3068951 - DNA, 17 bp, Homo sapiens
agttaagacctggcagc

SEQ ID NO: 3068952 - DNA, 16 bp, Homo sapiens
agttaaggtatctggt

SEQ ID NO: 3068953 - DNA, 16 bp, Homo sapiens
agttaataagcaaaat

SEQ ID NO: 3068954 - DNA, 20 bp, Homo sapiens
agttaataagcaaaatcctg

SEQ ID NO: 3068955 - DNA, 17 bp, Homo sapiens
agttaataagttgatgt

SEQ ID NO: 3068956 - DNA, 21 bp, Homo sapiens
agttaatgaaggtgtgctaca

SEQ ID NO: 3068957 - DNA, 22 bp, Homo sapiens
agttaattgtatttatgtatgt

SEQ ID NO: 3068958 - DNA, 15 bp, Homo sapiens
agttaattgttttat

SEQ ID NO: 3068959 - DNA, 21 bp, Homo sapiens
agttaattttttttgtattct

SEQ ID NO: 3068960 - DNA, 16 bp, Homo sapiens
agttacagctgtgatt

SEQ ID NO: 3068961 - DNA, 24 bp, Homo sapiens
agttacaggggattttattaatta

SEQ ID NO: 3068962 - DNA, 20 bp, Homo sapiens
agttacattaatgcccagcc

SEQ ID NO: 3068963 - DNA, 12 bp, Homo sapiens
agttactcagcc

SEQ ID NO: 3068964 - DNA, 13 bp, Homo sapiens
agttactcagccc

SEQ ID NO: 3068965 - DNA, 14 bp, Homo sapiens
agttactcagccct

SEQ ID NO: 3068966 - DNA, 17 bp, Homo sapiens
agttactcagccctggg

SEQ ID NO: 3068967 - DNA, 19 bp, Homo sapiens
agttactcagccctgggcc

SEQ ID NO: 3068968 - DNA, 17 bp, Homo sapiens
agttactccagtgccaa

SEQ ID NO: 3068969 - DNA, 19 bp, Homo sapiens
agttactccctacactgat

SEQ ID NO: 3068970 - DNA, 13 bp, Homo sapiens
agttactgttgtg

SEQ ID NO: 3068971 - DNA, 16 bp, Homo sapiens
agttacttaagattca

SEQ ID NO: 3068972 - DNA, 23 bp, Homo sapiens
agttagaacaagcccaaatttaa

SEQ ID NO: 3068973 - DNA, 21 bp, Homo sapiens
agttagaattccttcagggtg

SEQ ID NO: 3068974 - DNA, 16 bp, Homo sapiens
agttagcaaactttgt

SEQ ID NO: 3068975 - DNA, 18 bp, Homo sapiens
agttagcatccaggctgg

SEQ ID NO: 3068976 - DNA, 22 bp, Homo sapiens
agttagcatccaggctggccag

SEQ ID NO: 3068977 - DNA, 21 bp, Homo sapiens
agttagcatttaccaacatgt

SEQ ID NO: 3068978 - DNA, 20 bp, Homo sapiens
agttagcctggatagccttg

SEQ ID NO: 3068979 - DNA, 18 bp, Homo sapiens
agttaggctattcacaac

SEQ ID NO: 3068980 - DNA, 16 bp, Homo sapiens
agttaggttataagaa

SEQ ID NO: 3068981 - DNA, 17 bp, Homo sapiens
agttatagatgtctagg

SEQ ID NO: 3068982 - DNA, 21 bp, Homo sapiens
agttatataggttttgtttgc

SEQ ID NO: 3068983 - DNA, 19 bp, Homo sapiens
agttatatttcagatgtaa

SEQ ID NO: 3068984 - DNA, 22 bp, Homo sapiens
agttatatttcagatgtaatgt

SEQ ID NO: 3068985 - DNA, 14 bp, Homo sapiens
agttatctaagaat

SEQ ID NO: 3068986 - DNA, 21 bp, Homo sapiens
agttatctgttcttttgactt

SEQ ID NO: 3068987 - DNA, 20 bp, Homo sapiens
agttattatatttacaaatg

SEQ ID NO: 3068988 - DNA, 18 bp, Homo sapiens
agttattgcagtttatca

SEQ ID NO: 3068989 - DNA, 19 bp, Homo sapiens
agttattggtggaatcttt

SEQ ID NO: 3068990 - DNA, 12 bp, Homo sapiens
agttatttaaat

SEQ ID NO: 3068991 - DNA, 20 bp, Homo sapiens
agttatttaagaagaatgag

SEQ ID NO: 3068992 - DNA, 17 bp, Homo sapiens
agttatttacttgaaag

SEQ ID NO: 3068993 - DNA, 18 bp, Homo sapiens
agttcaataaatgtctgt

SEQ ID NO: 3068994 - DNA, 21 bp, Homo sapiens
agttcaataaatgtctgttga

SEQ ID NO: 3068995 - DNA, 17 bp, Homo sapiens
agttcagcctttaagat

SEQ ID NO: 3068996 - DNA, 13 bp, Homo sapiens
agttcagcttggg

SEQ ID NO: 3068997 - DNA, 21 bp, Homo sapiens
agttcaggtagctgcccctgg

SEQ ID NO: 3068998 - DNA, 18 bp, Homo sapiens
agttcagtttgtctcttt

SEQ ID NO: 3068999 - DNA, 21 bp, Homo sapiens
agttcataaatttgttgtcat

SEQ ID NO: 3069000 - DNA, 16 bp, Homo sapiens
agttcatgtctgctat

SEQ ID NO: 3069001 - DNA, 17 bp, Homo sapiens
agttcatgtctgctatc

SEQ ID NO: 3069002 - DNA, 13 bp, Homo sapiens
agttccaagagtc

SEQ ID NO: 3069003 - DNA, 14 bp, Homo sapiens
agttccaagagtct

SEQ ID NO: 3069004 - DNA, 19 bp, Homo sapiens
agttccaagagtctaaaga

SEQ ID NO: 3069005 - DNA, 21 bp, Homo sapiens
agttccacagattgtttctat

SEQ ID NO: 3069006 - DNA, 15 bp, Homo sapiens
agttccagtgctgca

SEQ ID NO: 3069007 - DNA, 14 bp, Homo sapiens
agttccctgaaaac

SEQ ID NO: 3069008 - DNA, 13 bp, Homo sapiens
agttcctcgccct

SEQ ID NO: 3069009 - DNA, 17 bp, Homo sapiens
agttcctcgccctgggt

SEQ ID NO: 3069010 - DNA, 11 bp, Homo sapiens
agttcctgctc

SEQ ID NO: 3069011 - DNA, 20 bp, Homo sapiens
agttcctgctccgtggactg

SEQ ID NO: 3069012 - DNA, 17 bp, Homo sapiens
agttcctgctgcctggg

SEQ ID NO: 3069013 - DNA, 18 bp, Homo sapiens
agttcgagaccaacctga

SEQ ID NO: 3069014 - DNA, 19 bp, Homo sapiens
agttcgagaccagcctggc

SEQ ID NO: 3069015 - DNA, 19 bp, Homo sapiens
agttcgcctggagccctcc

SEQ ID NO: 3069016 - DNA, 19 bp, Homo sapiens
agttcggtgagctacaaat

SEQ ID NO: 3069017 - DNA, 18 bp, Homo sapiens
agttctaagactcaaatg

SEQ ID NO: 3069018 - DNA, 14 bp, Homo sapiens
agttctaagattct

SEQ ID NO: 3069019 - DNA, 23 bp, Homo sapiens
agttctagacatggaggttctaa

SEQ ID NO: 3069020 - DNA, 10 bp, Homo sapiens
agttctaggc

SEQ ID NO: 3069021 - DNA, 14 bp, Homo sapiens
agttctaggcactg

SEQ ID NO: 3069022 - DNA, 22 bp, Homo sapiens
agttctaggcactgtagttcta

SEQ ID NO: 3069023 - DNA, 16 bp, Homo sapiens
agttctagtttgcatt

SEQ ID NO: 3069024 - DNA, 17 bp, Homo sapiens
agttctagtttgcattc

SEQ ID NO: 3069025 - DNA, 19 bp, Homo sapiens
agttctcactatgtttctc

SEQ ID NO: 3069026 - DNA, 12 bp, Homo sapiens
agttctcagctt

SEQ ID NO: 3069027 - DNA, 16 bp, Homo sapiens
agttctcttatctttg

SEQ ID NO: 3069028 - DNA, 18 bp, Homo sapiens
agttctgagctgccagtg

SEQ ID NO: 3069029 - DNA, 15 bp, Homo sapiens
agttctgcactccag

SEQ ID NO: 3069030 - DNA, 17 bp, Homo sapiens
agttctgggtgctccct

SEQ ID NO: 3069031 - DNA, 20 bp, Homo sapiens
agttctgtatataaatatat

SEQ ID NO: 3069032 - DNA, 23 bp, Homo sapiens
agttctgtccttggcaactttct

SEQ ID NO: 3069033 - DNA, 13 bp, Homo sapiens
agttctgtgaaga

SEQ ID NO: 3069034 - DNA, 14 bp, Homo sapiens
agttctgtgaagag

SEQ ID NO: 3069035 - DNA, 14 bp, Homo sapiens
agttcttgtgccat

SEQ ID NO: 3069036 - DNA, 17 bp, Homo sapiens
agttctttgggccagac

SEQ ID NO: 3069037 - DNA, 21 bp, Homo sapiens
agttctttgggccagacatgc

SEQ ID NO: 3069038 - DNA, 20 bp, Homo sapiens
agttctttgttcctgctttc

SEQ ID NO: 3069039 - DNA, 20 bp, Homo sapiens
agttgaaaaaagaagtttgg

SEQ ID NO: 3069040 - DNA, 22 bp, Homo sapiens
agttgaaaatcttataatttaa

SEQ ID NO: 3069041 - DNA, 14 bp, Homo sapiens
agttgaagagcctg

SEQ ID NO: 3069042 - DNA, 18 bp, Homo sapiens
agttgaaggttaaaggaa

SEQ ID NO: 3069043 - DNA, 19 bp, Homo sapiens
agttgaattccaagtgtat

SEQ ID NO: 3069044 - DNA, 17 bp, Homo sapiens
agttgagtgatagagct

SEQ ID NO: 3069045 - DNA, 21 bp, Homo sapiens
agttgatcgcctttcccaggt

SEQ ID NO: 3069046 - DNA, 18 bp, Homo sapiens
agttgatctggaacccag

SEQ ID NO: 3069047 - DNA, 19 bp, Homo sapiens
agttgatctggaacccaga

SEQ ID NO: 3069048 - DNA, 21 bp, Homo sapiens
agttgatctggaacccagact

SEQ ID NO: 3069049 - DNA, 20 bp, Homo sapiens
agttgcaaagtggaattaaa

SEQ ID NO: 3069050 - DNA, 18 bp, Homo sapiens
agttgcaattgaattaaa

SEQ ID NO: 3069051 - DNA, 19 bp, Homo sapiens
agttgcaattgaattaaat

SEQ ID NO: 3069052 - DNA, 19 bp, Homo sapiens
agttgcaccattctttctt

SEQ ID NO: 3069053 - DNA, 18 bp, Homo sapiens
atacagtataaaaataga

SEQ ID NO: 3069054 - DNA, 21 bp, Homo sapiens
atacagtcattatttaaagca

SEQ ID NO: 3069055 - DNA, 17 bp, Homo sapiens
atacagtgaagagtaag

SEQ ID NO: 3069056 - DNA, 16 bp, Homo sapiens
atacagtgtacatgta

SEQ ID NO: 3069057 - DNA, 13 bp, Homo sapiens
atacagtgttttt

SEQ ID NO: 3069058 - DNA, 15 bp, Homo sapiens
atacagtgtttttta

SEQ ID NO: 3069059 - DNA, 17 bp, Homo sapiens
atacagtgttttttagg

SEQ ID NO: 3069060 - DNA, 22 bp, Homo sapiens
atacagttaacacaatgtgaat

SEQ ID NO: 3069061 - DNA, 20 bp, Homo sapiens
atacagtttataaagccaag

SEQ ID NO: 3069062 - DNA, 22 bp, Homo sapiens
atacagtttataaagccaagaa

SEQ ID NO: 3069063 - DNA, 15 bp, Homo sapiens
atacataaatagtag

SEQ ID NO: 3069064 - DNA, 21 bp, Homo sapiens
atacataagcggcgtaagttt

SEQ ID NO: 3069065 - DNA, 22 bp, Homo sapiens
atacataatgggccactgaaat

SEQ ID NO: 3069066 - DNA, 13 bp, Homo sapiens
atacatacctact

SEQ ID NO: 3069067 - DNA, 17 bp, Homo sapiens
atacatagacatttcaa

SEQ ID NO: 3069068 - DNA, 12 bp, Homo sapiens
atacatatttca

SEQ ID NO: 3069069 - DNA, 14 bp, Homo sapiens
atacatcaatatgt

SEQ ID NO: 3069070 - DNA, 15 bp, Homo sapiens
atacatcacttcctg

SEQ ID NO: 3069071 - DNA, 17 bp, Homo sapiens
atacatcacttcctgtt

SEQ ID NO: 3069072 - DNA, 19 bp, Homo sapiens
atacatcacttcctgtttt

SEQ ID NO: 3069073 - DNA, 18 bp, Homo sapiens
atacatcctttttctgct

SEQ ID NO: 3069074 - DNA, 19 bp, Homo sapiens
atacatgttattgttttca

SEQ ID NO: 3069075 - DNA, 15 bp, Homo sapiens
atacattaaggagca

SEQ ID NO: 3069076 - DNA, 19 bp, Homo sapiens
atacatttgaggggaaaac

SEQ ID NO: 3069077 - DNA, 12 bp, Homo sapiens
ataccagcctac

SEQ ID NO: 3069078 - DNA, 14 bp, Homo sapiens
ataccagctcaggg

SEQ ID NO: 3069079 - DNA, 15 bp, Homo sapiens
ataccagctcagggg

SEQ ID NO: 3069080 - DNA, 20 bp, Homo sapiens
ataccattttttaaggaaac

SEQ ID NO: 3069081 - DNA, 15 bp, Homo sapiens
ataccccatttgatt

SEQ ID NO: 3069082 - DNA, 18 bp, Homo sapiens
ataccgcctcgtgccagc

SEQ ID NO: 3069083 - DNA, 21 bp, Homo sapiens
ataccgcctcgtgccagcagc

SEQ ID NO: 3069084 - DNA, 15 bp, Homo sapiens
ataccggaattactt

SEQ ID NO: 3069085 - DNA, 17 bp, Homo sapiens
atacctacaataaactg

SEQ ID NO: 3069086 - DNA, 19 bp, Homo sapiens
atacctacaataaactggt

SEQ ID NO: 3069087 - DNA, 17 bp, Homo sapiens
atacctctgtgtgctcc

SEQ ID NO: 3069088 - DNA, 19 bp, Homo sapiens
atacgagagcagaggtctc

SEQ ID NO: 3069089 - DNA, 18 bp, Homo sapiens
atacgggagtgacccagc

SEQ ID NO: 3069090 - DNA, 14 bp, Homo sapiens
atacgtacattcct

SEQ ID NO: 3069091 - DNA, 21 bp, Homo sapiens
atacgtatgcatttttttagt

SEQ ID NO: 3069092 - DNA, 21 bp, Homo sapiens
atacgtgaaaattatttgaaa

SEQ ID NO: 3069093 - DNA, 21 bp, Homo sapiens
atacgtgttttgaattgcaaa

SEQ ID NO: 3069094 - DNA, 21 bp, Homo sapiens
atacgtttgtgcagaatctct

SEQ ID NO: 3069095 - DNA, 17 bp, Homo sapiens
atactaactgctgattt

SEQ ID NO: 3069096 - DNA, 19 bp, Homo sapiens
atactacctataggaaagt

SEQ ID NO: 3069097 - DNA, 14 bp, Homo sapiens
atactaccttgaaa

SEQ ID NO: 3069098 - DNA, 15 bp, Homo sapiens
atactactactgtta

SEQ ID NO: 3069099 - DNA, 21 bp, Homo sapiens
atactagggagccatttgaga

SEQ ID NO: 3069100 - DNA, 14 bp, Homo sapiens
atactaggtgcctt

SEQ ID NO: 3069101 - DNA, 16 bp, Homo sapiens
atactaggtgcctttt

SEQ ID NO: 3069102 - DNA, 17 bp, Homo sapiens
atactcataatgtgaag

SEQ ID NO: 3069103 - DNA, 13 bp, Homo sapiens
atactcatgtgta

SEQ ID NO: 3069104 - DNA, 15 bp, Homo sapiens
atactcatgtgtatg

SEQ ID NO: 3069105 - DNA, 17 bp, Homo sapiens
atactctagatgaagtt

SEQ ID NO: 3069106 - DNA, 23 bp, Homo sapiens
atactctagatgaagttttacat

SEQ ID NO: 3069107 - DNA, 16 bp, Homo sapiens
atactctctgagtaca

SEQ ID NO: 3069108 - DNA, 12 bp, Homo sapiens
atactctcttcc

SEQ ID NO: 3069109 - DNA, 13 bp, Homo sapiens
atactctgttgcc

SEQ ID NO: 3069110 - DNA, 14 bp, Homo sapiens
atactctgttgcct

SEQ ID NO: 3069111 - DNA, 18 bp, Homo sapiens
atactctgttgcctcctc

SEQ ID NO: 3069112 - DNA, 20 bp, Homo sapiens
atactctgttgcctcctctc

SEQ ID NO: 3069113 - DNA, 23 bp, Homo sapiens
atactctgttgcctcctctctcc

SEQ ID NO: 3069114 - DNA, 16 bp, Homo sapiens
atactctttctgtata

SEQ ID NO: 3069115 - DNA, 22 bp, Homo sapiens
atactctttctgtatatacttt

SEQ ID NO: 3069116 - DNA, 18 bp, Homo sapiens
atactgactcaacatgga

SEQ ID NO: 3069117 - DNA, 14 bp, Homo sapiens
atactgatttaatt

SEQ ID NO: 3069118 - DNA, 13 bp, Homo sapiens
atactgcacttac

SEQ ID NO: 3069119 - DNA, 16 bp, Homo sapiens
atactgcacttacaat

SEQ ID NO: 3069120 - DNA, 15 bp, Homo sapiens
atactgccagatgct

SEQ ID NO: 3069121 - DNA, 17 bp, Homo sapiens
atactgccagatgctga

SEQ ID NO: 3069122 - DNA, 21 bp, Homo sapiens
atactgccagatgctgatgtt

SEQ ID NO: 3069123 - DNA, 18 bp, Homo sapiens
atactgcttaattgctga

SEQ ID NO: 3069124 - DNA, 22 bp, Homo sapiens
atactgcttgcttacaatcttt

SEQ ID NO: 3069125 - DNA, 23 bp, Homo sapiens
atactgcttgcttacaatcttta

SEQ ID NO: 3069126 - DNA, 15 bp, Homo sapiens
atactgcttggagct

SEQ ID NO: 3069127 - DNA, 20 bp, Homo sapiens
atactggttatcctgtgcta

SEQ ID NO: 3069128 - DNA, 23 bp, Homo sapiens
atactggttatcctgtgctacag

SEQ ID NO: 3069129 - DNA, 13 bp, Homo sapiens
atactgtaaagaa

SEQ ID NO: 3069130 - DNA, 19 bp, Homo sapiens
atactgtgaagttacatgc

SEQ ID NO: 3069131 - DNA, 18 bp, Homo sapiens
atactgtgagcttacatt

SEQ ID NO: 3069132 - DNA, 13 bp, Homo sapiens
atactgttatcca

SEQ ID NO: 3069133 - DNA, 15 bp, Homo sapiens
atactgttttatctc

SEQ ID NO: 3069134 - DNA, 17 bp, Homo sapiens
atactgttttatctcca

SEQ ID NO: 3069135 - DNA, 15 bp, Homo sapiens
atacttaaacagctt

SEQ ID NO: 3069136 - DNA, 13 bp, Homo sapiens
atacttacattct

SEQ ID NO: 3069137 - DNA, 22 bp, Homo sapiens
atacttacattctctaataaga

SEQ ID NO: 3069138 - DNA, 23 bp, Homo sapiens
atacttacattctctaataagaa

SEQ ID NO: 3069139 - DNA, 19 bp, Homo sapiens
atacttatatggaaattct

SEQ ID NO: 3069140 - DNA, 12 bp, Homo sapiens
atacttcaaaag

SEQ ID NO: 3069141 - DNA, 20 bp, Homo sapiens
atacttcagctttgtgtatc

SEQ ID NO: 3069142 - DNA, 18 bp, Homo sapiens
atacttcgatgatgatga

SEQ ID NO: 3069143 - DNA, 13 bp, Homo sapiens
atacttgaacttg

SEQ ID NO: 3069144 - DNA, 18 bp, Homo sapiens
atacttgaagggccagag

SEQ ID NO: 3069145 - DNA, 19 bp, Homo sapiens
atacttgaagggccagagc

SEQ ID NO: 3069146 - DNA, 23 bp, Homo sapiens
atactttagaagtagaattgaca

SEQ ID NO: 3069147 - DNA, 14 bp, Homo sapiens
atactttatttctg

SEQ ID NO: 3069148 - DNA, 22 bp, Homo sapiens
atactttcggagaaattctctt

SEQ ID NO: 3069149 - DNA, 14 bp, Homo sapiens
atactttgtaaata

SEQ ID NO: 3069150 - DNA, 14 bp, Homo sapiens
atactttgtatttt

SEQ ID NO: 3069151 - DNA, 20 bp, Homo sapiens
atacttttacattaaagaaa

SEQ ID NO: 3069152 - DNA, 13 bp, Homo sapiens
atagaaaagttat

SEQ ID NO: 3069153 - DNA, 22 bp, Homo sapiens
atagaaataaaggatgtgattg

SEQ ID NO: 3069154 - DNA, 17 bp, Homo sapiens
atagaaatgccaagcac

SEQ ID NO: 3069155 - DNA, 12 bp, Homo sapiens
atagaaatggaa

SEQ ID NO: 3069156 - DNA, 20 bp, Homo sapiens
atagaaatggaaattttgct

SEQ ID NO: 3069157 - DNA, 22 bp, Homo sapiens
atagaaatggtttcctctggat

SEQ ID NO: 3069158 - DNA, 15 bp, Homo sapiens
atagaaatgtatttt

SEQ ID NO: 3069159 - DNA, 22 bp, Homo sapiens
atagaaatgtattttgaaaaca

SEQ ID NO: 3069160 - DNA, 18 bp, Homo sapiens
atagaactctgaaatgaa

SEQ ID NO: 3069161 - DNA, 12 bp, Homo sapiens
atagaataaaag

SEQ ID NO: 3069162 - DNA, 13 bp, Homo sapiens
atagaatgacagt

SEQ ID NO: 3069163 - DNA, 16 bp, Homo sapiens
atagaattctagcttt

SEQ ID NO: 3069164 - DNA, 18 bp, Homo sapiens
atagaattctagcttttt

SEQ ID NO: 3069165 - DNA, 21 bp, Homo sapiens
atagacagaatagatagcact

SEQ ID NO: 3069166 - DNA, 18 bp, Homo sapiens
atagacatttcaaaatta

SEQ ID NO: 3069167 - DNA, 22 bp, Homo sapiens
atagaccctctttcttgtttgt

SEQ ID NO: 3069168 - DNA, 14 bp, Homo sapiens
atagagaggcctgc

SEQ ID NO: 3069169 - DNA, 15 bp, Homo sapiens
atagagaggcctgct

SEQ ID NO: 3069170 - DNA, 19 bp, Homo sapiens
atagagaggcctgctttgt

SEQ ID NO: 3069171 - DNA, 21 bp, Homo sapiens
atagagagggagaagaagtca

SEQ ID NO: 3069172 - DNA, 24 bp, Homo sapiens
atagagattttttaaccatggcag

SEQ ID NO: 3069173 - DNA, 15 bp, Homo sapiens
atagagcctgaggga

SEQ ID NO: 3069174 - DNA, 14 bp, Homo sapiens
atagagctgccact

SEQ ID NO: 3069175 - DNA, 13 bp, Homo sapiens
atagagctgtatt

SEQ ID NO: 3069176 - DNA, 21 bp, Homo sapiens
atagaggacagagaagatgac

SEQ ID NO: 3069177 - DNA, 23 bp, Homo sapiens
atagataactgctcttttactaa

SEQ ID NO: 3069178 - DNA, 13 bp, Homo sapiens
atagatattggaa

SEQ ID NO: 3069179 - DNA, 17 bp, Homo sapiens
atagatgactttgcaga

SEQ ID NO: 3069180 - DNA, 15 bp, Homo sapiens
atagatgctggccca

SEQ ID NO: 3069181 - DNA, 23 bp, Homo sapiens
atagatgctggcccagggcccag

SEQ ID NO: 3069182 - DNA, 15 bp, Homo sapiens
atagatgggaatgaa

SEQ ID NO: 3069183 - DNA, 21 bp, Homo sapiens
atagatgtttgactttaaaga

SEQ ID NO: 3069184 - DNA, 16 bp, Homo sapiens
atagattctaaagatt

SEQ ID NO: 3069185 - DNA, 17 bp, Homo sapiens
atcaatgggattttcta

SEQ ID NO: 3069186 - DNA, 21 bp, Homo sapiens
atcaatgggattttctagttt

SEQ ID NO: 3069187 - DNA, 15 bp, Homo sapiens
atcaatgtgacattt

SEQ ID NO: 3069188 - DNA, 17 bp, Homo sapiens
atcaatgtgacatttac

SEQ ID NO: 3069189 - DNA, 20 bp, Homo sapiens
atcaattaactgagtagctc

SEQ ID NO: 3069190 - DNA, 16 bp, Homo sapiens
atcaattatagtttct

SEQ ID NO: 3069191 - DNA, 17 bp, Homo sapiens
atcaattatagtttctg

SEQ ID NO: 3069192 - DNA, 18 bp, Homo sapiens
atcaattatagtttctga

SEQ ID NO: 3069193 - DNA, 16 bp, Homo sapiens
atcaattcatatctat

SEQ ID NO: 3069194 - DNA, 15 bp, Homo sapiens
atcaatttaaaccca

SEQ ID NO: 3069195 - DNA, 18 bp, Homo sapiens
atcaatttaaatgtttac

SEQ ID NO: 3069196 - DNA, 17 bp, Homo sapiens
atcaatttatcactgtt

SEQ ID NO: 3069197 - DNA, 12 bp, Homo sapiens
atcaattttcat

SEQ ID NO: 3069198 - DNA, 23 bp, Homo sapiens
atcaattttcattaaacttgaag

SEQ ID NO: 3069199 - DNA, 12 bp, Homo sapiens
atcacaatcagt

SEQ ID NO: 3069200 - DNA, 20 bp, Homo sapiens
atcacaccatcgctggcccc

SEQ ID NO: 3069201 - DNA, 14 bp, Homo sapiens
atcacagaggcttc

SEQ ID NO: 3069202 - DNA, 15 bp, Homo sapiens
atcacagaggcttct

SEQ ID NO: 3069203 - DNA, 15 bp, Homo sapiens
atcacatgtgctgca

SEQ ID NO: 3069204 - DNA, 23 bp, Homo sapiens
atcacccacaaccctctggaagt

SEQ ID NO: 3069205 - DNA, 20 bp, Homo sapiens
atcaccgagagtagccgaga

SEQ ID NO: 3069206 - DNA, 20 bp, Homo sapiens
atcaccgtgggctccctgac

SEQ ID NO: 3069207 - DNA, 14 bp, Homo sapiens
atcacctatttcca

SEQ ID NO: 3069208 - DNA, 16 bp, Homo sapiens
atcacctcattctgaa

SEQ ID NO: 3069209 - DNA, 18 bp, Homo sapiens
atcacctcattctgaacc

SEQ ID NO: 3069210 - DNA, 22 bp, Homo sapiens
atcacctctctgtagtttatgg

SEQ ID NO: 3069211 - DNA, 18 bp, Homo sapiens
atcacctgaaccccagag

SEQ ID NO: 3069212 - DNA, 21 bp, Homo sapiens
atcacctgaaccccagaggca

SEQ ID NO: 3069213 - DNA, 13 bp, Homo sapiens
atcacctgaggtc

SEQ ID NO: 3069214 - DNA, 17 bp, Homo sapiens
atcaccttaggcaggga

SEQ ID NO: 3069215 - DNA, 22 bp, Homo sapiens
atcacgccattgtactccagcc

SEQ ID NO: 3069216 - DNA, 19 bp, Homo sapiens
atcacgggcggtcctgcac

SEQ ID NO: 3069217 - DNA, 19 bp, Homo sapiens
atcacgtgtactggctcct

SEQ ID NO: 3069218 - DNA, 20 bp, Homo sapiens
atcactaaaagaaaatctat

SEQ ID NO: 3069219 - DNA, 18 bp, Homo sapiens
atcactagagtgctctga

SEQ ID NO: 3069220 - DNA, 13 bp, Homo sapiens
atcactcagcccc

SEQ ID NO: 3069221 - DNA, 15 bp, Homo sapiens
atcactcagccccta

SEQ ID NO: 3069222 - DNA, 11 bp, Homo sapiens
atcactcctgg

SEQ ID NO: 3069223 - DNA, 12 bp, Homo sapiens
atcactcctgga

SEQ ID NO: 3069224 - DNA, 18 bp, Homo sapiens
atcactctgcaatggaaa

SEQ ID NO: 3069225 - DNA, 14 bp, Homo sapiens
atcactcttgtgga

SEQ ID NO: 3069226 - DNA, 17 bp, Homo sapiens
atcactcttgtggatgt

SEQ ID NO: 3069227 - DNA, 13 bp, Homo sapiens
atcactgaaacaa

SEQ ID NO: 3069228 - DNA, 15 bp, Homo sapiens
atcactgagttttcc

SEQ ID NO: 3069229 - DNA, 17 bp, Homo sapiens
atcactgagttttccat

SEQ ID NO: 3069230 - DNA, 23 bp, Homo sapiens
atcactgccagagataaactaat

SEQ ID NO: 3069231 - DNA, 15 bp, Homo sapiens
atcactgtcctccac

SEQ ID NO: 3069232 - DNA, 14 bp, Homo sapiens
atcactgtggctgt

SEQ ID NO: 3069233 - DNA, 16 bp, Homo sapiens
atcactgttcatgctg

SEQ ID NO: 3069234 - DNA, 17 bp, Homo sapiens
atcactgtttaaagctt

SEQ ID NO: 3069235 - DNA, 12 bp, Homo sapiens
atcactgtttgt

SEQ ID NO: 3069236 - DNA, 23 bp, Homo sapiens
atcactgtttgtttttaaaaagc

SEQ ID NO: 3069237 - DNA, 15 bp, Homo sapiens
atcactgtttttaga

SEQ ID NO: 3069238 - DNA, 23 bp, Homo sapiens
atcacttgaacccgggaggcaga

SEQ ID NO: 3069239 - DNA, 18 bp, Homo sapiens
atcacttgattcataaag

SEQ ID NO: 3069240 - DNA, 22 bp, Homo sapiens
atcactttgagcctgggaaata

SEQ ID NO: 3069241 - DNA, 23 bp, Homo sapiens
atcagaactcaaatggggccaga

SEQ ID NO: 3069242 - DNA, 22 bp, Homo sapiens
atcagaagaaaggccaaggtgc

SEQ ID NO: 3069243 - DNA, 20 bp, Homo sapiens
atcagaagtaactcccactc

SEQ ID NO: 3069244 - DNA, 15 bp, Homo sapiens
atcagacaagcttga

SEQ ID NO: 3069245 - DNA, 16 bp, Homo sapiens
atcagaccctacccca

SEQ ID NO: 3069246 - DNA, 20 bp, Homo sapiens
atcagaccctaccccaccac

SEQ ID NO: 3069247 - DNA, 16 bp, Homo sapiens
atcagactagtatcaa

SEQ ID NO: 3069248 - DNA, 13 bp, Homo sapiens
atcagagaccagg

SEQ ID NO: 3069249 - DNA, 20 bp, Homo sapiens
atcagatgctccaagattct

SEQ ID NO: 3069250 - DNA, 23 bp, Homo sapiens
atcagatgctccaagattctaga

SEQ ID NO: 3069251 - DNA, 17 bp, Homo sapiens
atcagatgttcccgtgt

SEQ ID NO: 3069252 - DNA, 19 bp, Homo sapiens
atcagatgttgaattcttt

SEQ ID NO: 3069253 - DNA, 21 bp, Homo sapiens
atcagatttggtgatggaaaa

SEQ ID NO: 3069254 - DNA, 16 bp, Homo sapiens
atcagcaatgaagaac

SEQ ID NO: 3069255 - DNA, 14 bp, Homo sapiens
atcagcaatgcttc

SEQ ID NO: 3069256 - DNA, 14 bp, Homo sapiens
atcagcatgttttc

SEQ ID NO: 3069257 - DNA, 17 bp, Homo sapiens
atcagcatgttttctgc

SEQ ID NO: 3069258 - DNA, 19 bp, Homo sapiens
atcagcatgttttctgctt

SEQ ID NO: 3069259 - DNA, 22 bp, Homo sapiens
atcagcatgttttctgctttaa

SEQ ID NO: 3069260 - DNA, 13 bp, Homo sapiens
atcagctccttcc

SEQ ID NO: 3069261 - DNA, 15 bp, Homo sapiens
atcagctgtctgtca

SEQ ID NO: 3069262 - DNA, 19 bp, Homo sapiens
atcagctgtctgtcatctg

SEQ ID NO: 3069263 - DNA, 21 bp, Homo sapiens
atcagcttctatccttgactt

SEQ ID NO: 3069264 - DNA, 18 bp, Homo sapiens
atcaggacccagaggaag

SEQ ID NO: 3069265 - DNA, 20 bp, Homo sapiens
atcaggacccagaggaaggg

SEQ ID NO: 3069266 - DNA, 17 bp, Homo sapiens
atcaggagttccagtgc

SEQ ID NO: 3069267 - DNA, 14 bp, Homo sapiens
atcaggcacaggtc

SEQ ID NO: 3069268 - DNA, 21 bp, Homo sapiens
atcaggcagataactgctgta

SEQ ID NO: 3069269 - DNA, 19 bp, Homo sapiens
atcaggctctgttcctcaa

SEQ ID NO: 3069270 - DNA, 21 bp, Homo sapiens
atcagggtaaaaggtgcaggt

SEQ ID NO: 3069271 - DNA, 19 bp, Homo sapiens
atcagtaatgctaaatgtg

SEQ ID NO: 3069272 - DNA, 20 bp, Homo sapiens
atcagtaatgctaaatgtgt

SEQ ID NO: 3069273 - DNA, 21 bp, Homo sapiens
atcagtcctctttcaaaggta

SEQ ID NO: 3069274 - DNA, 21 bp, Homo sapiens
atcagtggacagtctgctcta

SEQ ID NO: 3069275 - DNA, 12 bp, Homo sapiens
atcagtgttgat

SEQ ID NO: 3069276 - DNA, 24 bp, Homo sapiens
atcagtgttgattctagatgatca

SEQ ID NO: 3069277 - DNA, 13 bp, Homo sapiens
atcagtgtttaaa

SEQ ID NO: 3069278 - DNA, 21 bp, Homo sapiens
atcagtgtttaaataaagacc

SEQ ID NO: 3069279 - DNA, 16 bp, Homo sapiens
atcagttactcagccc

SEQ ID NO: 3069280 - DNA, 17 bp, Homo sapiens
atcagttactcagccct

SEQ ID NO: 3069281 - DNA, 18 bp, Homo sapiens
atcagttactcagccctg

SEQ ID NO: 3069282 - DNA, 16 bp, Homo sapiens
atcagttgattaagtt

SEQ ID NO: 3069283 - DNA, 18 bp, Homo sapiens
atcagtttattaaatctg

SEQ ID NO: 3069284 - DNA, 17 bp, Homo sapiens
atcataacatagttgaa

SEQ ID NO: 3069285 - DNA, 18 bp, Homo sapiens
atcataacatagttgaaa

SEQ ID NO: 3069286 - DNA, 20 bp, Homo sapiens
atcataacatagttgaaaaa

SEQ ID NO: 3069287 - DNA, 16 bp, Homo sapiens
atcatagcttgtttta

SEQ ID NO: 3069288 - DNA, 11 bp, Homo sapiens
atcatatgaat

SEQ ID NO: 3069289 - DNA, 14 bp, Homo sapiens
atcatatttgaaaa

SEQ ID NO: 3069290 - DNA, 15 bp, Homo sapiens
atcatatttgaaaac

SEQ ID NO: 3069291 - DNA, 20 bp, Homo sapiens
atcatcaatgtgacatttac

SEQ ID NO: 3069292 - DNA, 16 bp, Homo sapiens
atcatccacattgttt

SEQ ID NO: 3069293 - DNA, 16 bp, Homo sapiens
atcatccctccctgcc

SEQ ID NO: 3069294 - DNA, 17 bp, Homo sapiens
atcatcctttgttctga

SEQ ID NO: 3069295 - DNA, 19 bp, Homo sapiens
atcatcctttgttctgagc

SEQ ID NO: 3069296 - DNA, 15 bp, Homo sapiens
atcatcgccagaggt

SEQ ID NO: 3069297 - DNA, 23 bp, Homo sapiens
atcatctcctgccttcctcctgg

SEQ ID NO: 3069298 - DNA, 15 bp, Homo sapiens
atcatctctgccttt

SEQ ID NO: 3069299 - DNA, 16 bp, Homo sapiens
atcatctctgcctttg

SEQ ID NO: 3069300 - DNA, 17 bp, Homo sapiens
atcatctctgcctttga

SEQ ID NO: 3069301 - DNA, 20 bp, Homo sapiens
atcatctcttgataaaggag

SEQ ID NO: 3069302 - DNA, 22 bp, Homo sapiens
atcatctcttgataaaggagag

SEQ ID NO: 3069303 - DNA, 14 bp, Homo sapiens
atcatgaactggct

SEQ ID NO: 3069304 - DNA, 24 bp, Homo sapiens
atcatgaactggcttgtacatttt

SEQ ID NO: 3069305 - DNA, 19 bp, Homo sapiens
atcatgaattcccttttaa

SEQ ID NO: 3069306 - DNA, 21 bp, Homo sapiens
atcatgaattcccttttaatc

SEQ ID NO: 3069307 - DNA, 19 bp, Homo sapiens
atcatgaatttattgcaca

SEQ ID NO: 3069308 - DNA, 14 bp, Homo sapiens
atcatgagcctgtt

SEQ ID NO: 3069309 - DNA, 19 bp, Homo sapiens
atcatgcaaatgctgtatt

SEQ ID NO: 3069310 - DNA, 12 bp, Homo sapiens
atcatgccctgt

SEQ ID NO: 3069311 - DNA, 22 bp, Homo sapiens
atcatgctggaacctgcaaaaa

SEQ ID NO: 3069312 - DNA, 17 bp, Homo sapiens
atcatggcactgcattc

SEQ ID NO: 3069313 - DNA, 15 bp, Homo sapiens
atcatggcttaggat

SEQ ID NO: 3069314 - DNA, 16 bp, Homo sapiens
atcatgtaaatgtatt

SEQ ID NO: 3069315 - DNA, 23 bp, Homo sapiens
atcatgtaaatgtattggcacag

SEQ ID NO: 3069316 - DNA, 15 bp, Homo sapiens
atcatgtatctctct

SEQ ID NO: 3069317 - DNA, 17 bp, Homo sapiens
atctggttaggatggca

SEQ ID NO: 3069318 - DNA, 15 bp, Homo sapiens
atctgtaaaaaagaa

SEQ ID NO: 3069319 - DNA, 19 bp, Homo sapiens
atctgtaaggaactggaac

SEQ ID NO: 3069320 - DNA, 13 bp, Homo sapiens
atctgtacaatga

SEQ ID NO: 3069321 - DNA, 12 bp, Homo sapiens
atctgtataaat

SEQ ID NO: 3069322 - DNA, 17 bp, Homo sapiens
atctgtataaatgtcta

SEQ ID NO: 3069323 - DNA, 21 bp, Homo sapiens
atctgtcattatcaaaagtga

SEQ ID NO: 3069324 - DNA, 20 bp, Homo sapiens
atctgtccacatccccagag

SEQ ID NO: 3069325 - DNA, 15 bp, Homo sapiens
atctgtccatcctcc

SEQ ID NO: 3069326 - DNA, 16 bp, Homo sapiens
atctgtccatcctcct

SEQ ID NO: 3069327 - DNA, 17 bp, Homo sapiens
atctgtccatcctcctc

SEQ ID NO: 3069328 - DNA, 16 bp, Homo sapiens
atctgtcctcagcctt

SEQ ID NO: 3069329 - DNA, 14 bp, Homo sapiens
atctgtcctctgta

SEQ ID NO: 3069330 - DNA, 16 bp, Homo sapiens
atctgtcctctgtagt

SEQ ID NO: 3069331 - DNA, 17 bp, Homo sapiens
atctgtcctctgtagta

SEQ ID NO: 3069332 - DNA, 18 bp, Homo sapiens
atctgtcctctgtagtat

SEQ ID NO: 3069333 - DNA, 23 bp, Homo sapiens
atctgtcctgtggcatgcaaaag

SEQ ID NO: 3069334 - DNA, 13 bp, Homo sapiens
atctgtctaaaga

SEQ ID NO: 3069335 - DNA, 17 bp, Homo sapiens
atctgtctactttctct

SEQ ID NO: 3069336 - DNA, 18 bp, Homo sapiens
atctgtctactttctctt

SEQ ID NO: 3069337 - DNA, 19 bp, Homo sapiens
atctgtctactttctcttg

SEQ ID NO: 3069338 - DNA, 20 bp, Homo sapiens
atctgtctactttctcttgt

SEQ ID NO: 3069339 - DNA, 18 bp, Homo sapiens
atctgtgactataaagct

SEQ ID NO: 3069340 - DNA, 12 bp, Homo sapiens
atctgtgcaggg

SEQ ID NO: 3069341 - DNA, 15 bp, Homo sapiens
atctgtgcagggctg

SEQ ID NO: 3069342 - DNA, 16 bp, Homo sapiens
atctgtgcattctcct

SEQ ID NO: 3069343 - DNA, 20 bp, Homo sapiens
atctgtgcctgtctgtccaa

SEQ ID NO: 3069344 - DNA, 23 bp, Homo sapiens
atctgtgcgtgtggcgtggcccg

SEQ ID NO: 3069345 - DNA, 19 bp, Homo sapiens
atctgtggattcagcttct

SEQ ID NO: 3069346 - DNA, 22 bp, Homo sapiens
atctgtgggcatggtcaaaggc

SEQ ID NO: 3069347 - DNA, 18 bp, Homo sapiens
atctgtggttttcctcta

SEQ ID NO: 3069348 - DNA, 15 bp, Homo sapiens
atctgtgtacaaaga

SEQ ID NO: 3069349 - DNA, 21 bp, Homo sapiens
atctgtgtgcgtggtgtggcc

SEQ ID NO: 3069350 - DNA, 23 bp, Homo sapiens
atctgtgtgtgtggcgtggcccg

SEQ ID NO: 3069351 - DNA, 19 bp, Homo sapiens
atctgtgtgtgtgtgcgtg

SEQ ID NO: 3069352 - DNA, 10 bp, Homo sapiens
atctgtgttc

SEQ ID NO: 3069353 - DNA, 16 bp, Homo sapiens
atctgtgtttttgaaa

SEQ ID NO: 3069354 - DNA, 16 bp, Homo sapiens
atctgttctaacatgt

SEQ ID NO: 3069355 - DNA, 17 bp, Homo sapiens
atctgttctactcttaa

SEQ ID NO: 3069356 - DNA, 15 bp, Homo sapiens
atctgtttacagtgt

SEQ ID NO: 3069357 - DNA, 14 bp, Homo sapiens
atctgtttttctaa

SEQ ID NO: 3069358 - DNA, 15 bp, Homo sapiens
atcttaaatcagaat

SEQ ID NO: 3069359 - DNA, 17 bp, Homo sapiens
atcttaaatcagaataa

SEQ ID NO: 3069360 - DNA, 13 bp, Homo sapiens
atcttaacactga

SEQ ID NO: 3069361 - DNA, 17 bp, Homo sapiens
atcttaagcagagataa

SEQ ID NO: 3069362 - DNA, 18 bp, Homo sapiens
atcttaattttggttgta

SEQ ID NO: 3069363 - DNA, 23 bp, Homo sapiens
atcttaattttggttgtattctt

SEQ ID NO: 3069364 - DNA, 13 bp, Homo sapiens
atcttacaaaatc

SEQ ID NO: 3069365 - DNA, 16 bp, Homo sapiens
atcttacaaaatcctg

SEQ ID NO: 3069366 - DNA, 19 bp, Homo sapiens
atcttaccaggttcactta

SEQ ID NO: 3069367 - DNA, 15 bp, Homo sapiens
atcttacctttatga

SEQ ID NO: 3069368 - DNA, 14 bp, Homo sapiens
atcttactgaaggt

SEQ ID NO: 3069369 - DNA, 13 bp, Homo sapiens
atcttagattctc

SEQ ID NO: 3069370 - DNA, 23 bp, Homo sapiens
atcttagattctctgtgtctaag

SEQ ID NO: 3069371 - DNA, 21 bp, Homo sapiens
atcttagttctgtatataaat

SEQ ID NO: 3069372 - DNA, 13 bp, Homo sapiens
atcttatactgta

SEQ ID NO: 3069373 - DNA, 16 bp, Homo sapiens
atcttatactgtacaa

SEQ ID NO: 3069374 - DNA, 17 bp, Homo sapiens
atcttatactgtacaat

SEQ ID NO: 3069375 - DNA, 19 bp, Homo sapiens
atcttatactgtacaataa

SEQ ID NO: 3069376 - DNA, 17 bp, Homo sapiens
atcttatagttctaggc

SEQ ID NO: 3069377 - DNA, 18 bp, Homo sapiens
atcttatgcaaaactttt

SEQ ID NO: 3069378 - DNA, 17 bp, Homo sapiens
atcttatttttctaaac

SEQ ID NO: 3069379 - DNA, 24 bp, Homo sapiens
atcttcaaaagtaatgcctctgtc

SEQ ID NO: 3069380 - DNA, 14 bp, Homo sapiens
atcttcaatttgga

SEQ ID NO: 3069381 - DNA, 21 bp, Homo sapiens
atcttcaccagaggaatcact

SEQ ID NO: 3069382 - DNA, 20 bp, Homo sapiens
atcttcagctggtggatggt

SEQ ID NO: 3069383 - DNA, 12 bp, Homo sapiens
atcttcagcttc

SEQ ID NO: 3069384 - DNA, 15 bp, Homo sapiens
atcttcagcttcttc

SEQ ID NO: 3069385 - DNA, 14 bp, Homo sapiens
atcttcatataaac

SEQ ID NO: 3069386 - DNA, 18 bp, Homo sapiens
atcttccagaagtgtgat

SEQ ID NO: 3069387 - DNA, 18 bp, Homo sapiens
atcttcccgcctcagcct

SEQ ID NO: 3069388 - DNA, 20 bp, Homo sapiens
atcttcccgcctcagcctct

SEQ ID NO: 3069389 - DNA, 13 bp, Homo sapiens
atcttccctgccc

SEQ ID NO: 3069390 - DNA, 15 bp, Homo sapiens
atcttccctgcccct

SEQ ID NO: 3069391 - DNA, 19 bp, Homo sapiens
atcttccctgcccctgtgc

SEQ ID NO: 3069392 - DNA, 20 bp, Homo sapiens
atcttccctgcccctgtgcc

SEQ ID NO: 3069393 - DNA, 16 bp, Homo sapiens
atcttcgtaacttcat

SEQ ID NO: 3069394 - DNA, 15 bp, Homo sapiens
atcttctatttttat

SEQ ID NO: 3069395 - DNA, 18 bp, Homo sapiens
atcttctcaagttctaag

SEQ ID NO: 3069396 - DNA, 20 bp, Homo sapiens
atcttctcaagttctaagat

SEQ ID NO: 3069397 - DNA, 22 bp, Homo sapiens
atcttctccatctggcagggtg

SEQ ID NO: 3069398 - DNA, 21 bp, Homo sapiens
atcttcttaaaccaggaaaaa

SEQ ID NO: 3069399 - DNA, 19 bp, Homo sapiens
atcttcttaacagtttagt

SEQ ID NO: 3069400 - DNA, 21 bp, Homo sapiens
atcttctttggacttctgaag

SEQ ID NO: 3069401 - DNA, 21 bp, Homo sapiens
atcttgaaattaagaaggcaa

SEQ ID NO: 3069402 - DNA, 21 bp, Homo sapiens
atcttgaatatgggcggaagt

SEQ ID NO: 3069403 - DNA, 19 bp, Homo sapiens
atcttgaccaagcaggaag

SEQ ID NO: 3069404 - DNA, 23 bp, Homo sapiens
atcttgaccaagcaggaagctca

SEQ ID NO: 3069405 - DNA, 18 bp, Homo sapiens
atcttgagagagaaatgc

SEQ ID NO: 3069406 - DNA, 14 bp, Homo sapiens
atcttgatggtgtt

SEQ ID NO: 3069407 - DNA, 15 bp, Homo sapiens
atcttgatggtgttt

SEQ ID NO: 3069408 - DNA, 17 bp, Homo sapiens
atcttgcagttttgtaa

SEQ ID NO: 3069409 - DNA, 14 bp, Homo sapiens
atcttgctctgtaa

SEQ ID NO: 3069410 - DNA, 16 bp, Homo sapiens
atcttgctctgtaatc

SEQ ID NO: 3069411 - DNA, 17 bp, Homo sapiens
atcttgctctgtaatct

SEQ ID NO: 3069412 - DNA, 21 bp, Homo sapiens
atcttggcctaaacctcagtt

SEQ ID NO: 3069413 - DNA, 12 bp, Homo sapiens
atcttggtaaat

SEQ ID NO: 3069414 - DNA, 14 bp, Homo sapiens
atcttgtcttttcc

SEQ ID NO: 3069415 - DNA, 17 bp, Homo sapiens
atcttgttattattgtt

SEQ ID NO: 3069416 - DNA, 22 bp, Homo sapiens
atcttgttattattgttaataa

SEQ ID NO: 3069417 - DNA, 19 bp, Homo sapiens
atcttgttttaagcaaatg

SEQ ID NO: 3069418 - DNA, 19 bp, Homo sapiens
atctttaatcaatgtgaca

SEQ ID NO: 3069419 - DNA, 20 bp, Homo sapiens
atctttatatttcaataaat

SEQ ID NO: 3069420 - DNA, 22 bp, Homo sapiens
atctttatcctaaaaatctgga

SEQ ID NO: 3069421 - DNA, 23 bp, Homo sapiens
atctttccaggcttccctgactt

SEQ ID NO: 3069422 - DNA, 21 bp, Homo sapiens
atctttcgttggttgtttctc

SEQ ID NO: 3069423 - DNA, 24 bp, Homo sapiens
atctttcgttggttgtttctctga

SEQ ID NO: 3069424 - DNA, 21 bp, Homo sapiens
atctttctatgctgcttttat

SEQ ID NO: 3069425 - DNA, 21 bp, Homo sapiens
atctttctttggggaaaaatt

SEQ ID NO: 3069426 - DNA, 22 bp, Homo sapiens
atctttgcatcatagaacagaa

SEQ ID NO: 3069427 - DNA, 23 bp, Homo sapiens
atctttgcatcatagaacagaaa

SEQ ID NO: 3069428 - DNA, 17 bp, Homo sapiens
atctttgcgaaaagata

SEQ ID NO: 3069429 - DNA, 19 bp, Homo sapiens
atcttttatagacgctctt

SEQ ID NO: 3069430 - DNA, 11 bp, Homo sapiens
atcttttgaac

SEQ ID NO: 3069431 - DNA, 14 bp, Homo sapiens
atcttttgggggaa

SEQ ID NO: 3069432 - DNA, 17 bp, Homo sapiens
atcttttgtaagacatt

SEQ ID NO: 3069433 - DNA, 16 bp, Homo sapiens
atctttttctccaccc

SEQ ID NO: 3069434 - DNA, 13 bp, Homo sapiens
atgaaaaaccatt

SEQ ID NO: 3069435 - DNA, 20 bp, Homo sapiens
atgaaaaatagtgtctttgt

SEQ ID NO: 3069436 - DNA, 15 bp, Homo sapiens
atgaaaaatgaaaga

SEQ ID NO: 3069437 - DNA, 19 bp, Homo sapiens
atgaaaaatgaaagatgat

SEQ ID NO: 3069438 - DNA, 19 bp, Homo sapiens
atgaaaagattcttctgtg

SEQ ID NO: 3069439 - DNA, 22 bp, Homo sapiens
atgaaaagttatttatgctata

SEQ ID NO: 3069440 - DNA, 18 bp, Homo sapiens
atgaaaataactgaacca

SEQ ID NO: 3069441 - DNA, 14 bp, Homo sapiens
atgaaaatatttaa

SEQ ID NO: 3069442 - DNA, 17 bp, Homo sapiens
atgaaaatgaatagctt

SEQ ID NO: 3069443 - DNA, 15 bp, Homo sapiens
atgaaaatgtcttgt

SEQ ID NO: 3069444 - DNA, 18 bp, Homo sapiens
atgaaaatttgtttgaca

SEQ ID NO: 3069445 - DNA, 16 bp, Homo sapiens
atgaaacccccacaca

SEQ ID NO: 3069446 - DNA, 17 bp, Homo sapiens
atgaaacccccacacac

SEQ ID NO: 3069447 - DNA, 18 bp, Homo sapiens
atgaaacccccacacaca

SEQ ID NO: 3069448 - DNA, 22 bp, Homo sapiens
atgaaactaaagcaatagaaac

SEQ ID NO: 3069449 - DNA, 13 bp, Homo sapiens
atgcttttgtcta

SEQ ID NO: 3069450 - DNA, 19 bp, Homo sapiens
atgctttttatttctgcat

SEQ ID NO: 3069451 - DNA, 21 bp, Homo sapiens
atggaaaaaaacataaaaagc

SEQ ID NO: 3069452 - DNA, 15 bp, Homo sapiens
atggaaaaagcgctg

SEQ ID NO: 3069453 - DNA, 20 bp, Homo sapiens
atggaaaaagcgctgtttcc

SEQ ID NO: 3069454 - DNA, 12 bp, Homo sapiens
atggaaaaataa

SEQ ID NO: 3069455 - DNA, 17 bp, Homo sapiens
atggaaaagccttctta

SEQ ID NO: 3069456 - DNA, 21 bp, Homo sapiens
atggaaacccgagggttgatt

SEQ ID NO: 3069457 - DNA, 12 bp, Homo sapiens
atggaaagaggt

SEQ ID NO: 3069458 - DNA, 19 bp, Homo sapiens
atggaaagaggtgaaaatg

SEQ ID NO: 3069459 - DNA, 12 bp, Homo sapiens
atggaaagccag

SEQ ID NO: 3069460 - DNA, 18 bp, Homo sapiens
atggaaattctgctcaga

SEQ ID NO: 3069461 - DNA, 16 bp, Homo sapiens
atggaaattttgctat

SEQ ID NO: 3069462 - DNA, 18 bp, Homo sapiens
atggaacacaaacacatt

SEQ ID NO: 3069463 - DNA, 15 bp, Homo sapiens
atggaacatgcccac

SEQ ID NO: 3069464 - DNA, 19 bp, Homo sapiens
atggaaccgcaggaagctg

SEQ ID NO: 3069465 - DNA, 14 bp, Homo sapiens
atggaagccaacac

SEQ ID NO: 3069466 - DNA, 14 bp, Homo sapiens
atggaaggggcttc

SEQ ID NO: 3069467 - DNA, 18 bp, Homo sapiens
atggaaggggcttctgga

SEQ ID NO: 3069468 - DNA, 14 bp, Homo sapiens
atggaagtaaaggc

SEQ ID NO: 3069469 - DNA, 21 bp, Homo sapiens
atggaatcccactgtatgatt

SEQ ID NO: 3069470 - DNA, 15 bp, Homo sapiens
atggaatctacatgt

SEQ ID NO: 3069471 - DNA, 16 bp, Homo sapiens
atggaatggttataaa

SEQ ID NO: 3069472 - DNA, 14 bp, Homo sapiens
atggaattgatttg

SEQ ID NO: 3069473 - DNA, 15 bp, Homo sapiens
atggaattgatttgc

SEQ ID NO: 3069474 - DNA, 16 bp, Homo sapiens
atggaattgatttgca

SEQ ID NO: 3069475 - DNA, 12 bp, Homo sapiens
atggaatttata

SEQ ID NO: 3069476 - DNA, 15 bp, Homo sapiens
atggacaacttattt

SEQ ID NO: 3069477 - DNA, 21 bp, Homo sapiens
atggacaacttatttaaaaat

SEQ ID NO: 3069478 - DNA, 18 bp, Homo sapiens
atggacaatttccaagaa

SEQ ID NO: 3069479 - DNA, 15 bp, Homo sapiens
atggacactgtgaca

SEQ ID NO: 3069480 - DNA, 17 bp, Homo sapiens
atggacactgtgacaat

SEQ ID NO: 3069481 - DNA, 14 bp, Homo sapiens
atggacacttttca

SEQ ID NO: 3069482 - DNA, 16 bp, Homo sapiens
atggacacttttcacc

SEQ ID NO: 3069483 - DNA, 14 bp, Homo sapiens
atggacaggctggc

SEQ ID NO: 3069484 - DNA, 13 bp, Homo sapiens
atggacagtttgt

SEQ ID NO: 3069485 - DNA, 19 bp, Homo sapiens
atggacatcgatatgaaaa

SEQ ID NO: 3069486 - DNA, 15 bp, Homo sapiens
atggacccctcgccc

SEQ ID NO: 3069487 - DNA, 20 bp, Homo sapiens
atggacgcaggccctgtcca

SEQ ID NO: 3069488 - DNA, 21 bp, Homo sapiens
atggactcagctctgtctgct

SEQ ID NO: 3069489 - DNA, 21 bp, Homo sapiens
atggactccagcctgcctggc

SEQ ID NO: 3069490 - DNA, 12 bp, Homo sapiens
atggagaaaatg

SEQ ID NO: 3069491 - DNA, 14 bp, Homo sapiens
atggagaaaccctg

SEQ ID NO: 3069492 - DNA, 19 bp, Homo sapiens
atggagattcagttttcat

SEQ ID NO: 3069493 - DNA, 15 bp, Homo sapiens
atggagccagctccc

SEQ ID NO: 3069494 - DNA, 12 bp, Homo sapiens
atggaggttcta

SEQ ID NO: 3069495 - DNA, 18 bp, Homo sapiens
atggagtattttaagtct

SEQ ID NO: 3069496 - DNA, 23 bp, Homo sapiens
atggagtgtttgacgaagaaaca

SEQ ID NO: 3069497 - DNA, 19 bp, Homo sapiens
atggagttaacatcatgaa

SEQ ID NO: 3069498 - DNA, 19 bp, Homo sapiens
atggatacatatttcagtt

SEQ ID NO: 3069499 - DNA, 21 bp, Homo sapiens
atggatatttgtactgtttaa

SEQ ID NO: 3069500 - DNA, 23 bp, Homo sapiens
atggatcttttctaaatgttatt

SEQ ID NO: 3069501 - DNA, 22 bp, Homo sapiens
atggatgccaatattaaatctg

SEQ ID NO: 3069502 - DNA, 23 bp, Homo sapiens
atggatgccaatattaaatctgc

SEQ ID NO: 3069503 - DNA, 14 bp, Homo sapiens
atggatggcttcta

SEQ ID NO: 3069504 - DNA, 14 bp, Homo sapiens
atggattttagtca

SEQ ID NO: 3069505 - DNA, 15 bp, Homo sapiens
atggcaacagatctg

SEQ ID NO: 3069506 - DNA, 17 bp, Homo sapiens
atggcaacagatctgga

SEQ ID NO: 3069507 - DNA, 18 bp, Homo sapiens
atggcactccctccagca

SEQ ID NO: 3069508 - DNA, 16 bp, Homo sapiens
atggcactttagtgat

SEQ ID NO: 3069509 - DNA, 20 bp, Homo sapiens
atggcagaaagggggcatct

SEQ ID NO: 3069510 - DNA, 20 bp, Homo sapiens
atggcagaaggcaaacccat

SEQ ID NO: 3069511 - DNA, 12 bp, Homo sapiens
atggcagaaggg

SEQ ID NO: 3069512 - DNA, 14 bp, Homo sapiens
atggcagaagggaa

SEQ ID NO: 3069513 - DNA, 16 bp, Homo sapiens
atggcagaagggaatt

SEQ ID NO: 3069514 - DNA, 23 bp, Homo sapiens
atggcagagtttgtgtgttgtct

SEQ ID NO: 3069515 - DNA, 15 bp, Homo sapiens
atggcagctgggccc

SEQ ID NO: 3069516 - DNA, 21 bp, Homo sapiens
atggcagctgggcccacagcc

SEQ ID NO: 3069517 - DNA, 13 bp, Homo sapiens
atggcagggctga

SEQ ID NO: 3069518 - DNA, 16 bp, Homo sapiens
atggcagggctgagga

SEQ ID NO: 3069519 - DNA, 17 bp, Homo sapiens
atggcatcctgtgaagt

SEQ ID NO: 3069520 - DNA, 20 bp, Homo sapiens
atggcatctcattgaggaca

SEQ ID NO: 3069521 - DNA, 19 bp, Homo sapiens
atggcatgagaaatacaaa

SEQ ID NO: 3069522 - DNA, 18 bp, Homo sapiens
atggcatgcaaaagcaat

SEQ ID NO: 3069523 - DNA, 17 bp, Homo sapiens
atggcatgcgccaccat

SEQ ID NO: 3069524 - DNA, 21 bp, Homo sapiens
atggccacactgtgacacact

SEQ ID NO: 3069525 - DNA, 16 bp, Homo sapiens
atggccaccttttcag

SEQ ID NO: 3069526 - DNA, 14 bp, Homo sapiens
atggccactgctct

SEQ ID NO: 3069527 - DNA, 13 bp, Homo sapiens
atggccagaggaa

SEQ ID NO: 3069528 - DNA, 13 bp, Homo sapiens
atggccctgctgc

SEQ ID NO: 3069529 - DNA, 19 bp, Homo sapiens
atggccctgctgcccctcc

SEQ ID NO: 3069530 - DNA, 18 bp, Homo sapiens
atggccggagaggaccgg

SEQ ID NO: 3069531 - DNA, 17 bp, Homo sapiens
atggccgtatcaaatgg

SEQ ID NO: 3069532 - DNA, 17 bp, Homo sapiens
atggccttaatatacta

SEQ ID NO: 3069533 - DNA, 22 bp, Homo sapiens
atggccttttgctacgtgcctc

SEQ ID NO: 3069534 - DNA, 24 bp, Homo sapiens
atggcgaggcctctctcaggagca

SEQ ID NO: 3069535 - DNA, 21 bp, Homo sapiens
atggcgtagagggtgctgccc

SEQ ID NO: 3069536 - DNA, 22 bp, Homo sapiens
atggcgtccgtgggttgctaac

SEQ ID NO: 3069537 - DNA, 20 bp, Homo sapiens
atggctaagatactgctgat

SEQ ID NO: 3069538 - DNA, 21 bp, Homo sapiens
atggctataaacaattacatg

SEQ ID NO: 3069539 - DNA, 13 bp, Homo sapiens
atggctcagggtg

SEQ ID NO: 3069540 - DNA, 17 bp, Homo sapiens
atggctcccacaggagt

SEQ ID NO: 3069541 - DNA, 12 bp, Homo sapiens
atggctcctctc

SEQ ID NO: 3069542 - DNA, 13 bp, Homo sapiens
atggctcctctca

SEQ ID NO: 3069543 - DNA, 17 bp, Homo sapiens
atggctgggggagggac

SEQ ID NO: 3069544 - DNA, 21 bp, Homo sapiens
atggctgggggagggactgct

SEQ ID NO: 3069545 - DNA, 23 bp, Homo sapiens
atggctgggtccttgggcctggc

SEQ ID NO: 3069546 - DNA, 14 bp, Homo sapiens
atggcttattgtgt

SEQ ID NO: 3069547 - DNA, 15 bp, Homo sapiens
atggcttattgtgtg

SEQ ID NO: 3069548 - DNA, 23 bp, Homo sapiens
atggcttcccatctgtggttttc

SEQ ID NO: 3069549 - DNA, 15 bp, Homo sapiens
atggcttctcctttg

SEQ ID NO: 3069550 - DNA, 18 bp, Homo sapiens
atgggaaaactgccaata

SEQ ID NO: 3069551 - DNA, 13 bp, Homo sapiens
atgggaaaatatt

SEQ ID NO: 3069552 - DNA, 17 bp, Homo sapiens
atgggaaaatatttcct

SEQ ID NO: 3069553 - DNA, 18 bp, Homo sapiens
atgggaaaatatttcctg

SEQ ID NO: 3069554 - DNA, 13 bp, Homo sapiens
atgggaacattta

SEQ ID NO: 3069555 - DNA, 14 bp, Homo sapiens
atgggaacatttat

SEQ ID NO: 3069556 - DNA, 23 bp, Homo sapiens
atgggaacatttattttatgaga

SEQ ID NO: 3069557 - DNA, 21 bp, Homo sapiens
atgggaacgcagcctccagtt

SEQ ID NO: 3069558 - DNA, 18 bp, Homo sapiens
atgggaaggggaggaccc

SEQ ID NO: 3069559 - DNA, 18 bp, Homo sapiens
atgggaatcaagatttaa

SEQ ID NO: 3069560 - DNA, 16 bp, Homo sapiens
atgggaatcaggcatg

SEQ ID NO: 3069561 - DNA, 14 bp, Homo sapiens
atgggaatgaagct

SEQ ID NO: 3069562 - DNA, 15 bp, Homo sapiens
atgggaatgaagctt

SEQ ID NO: 3069563 - DNA, 16 bp, Homo sapiens
atgggaatgaagcttg

SEQ ID NO: 3069564 - DNA, 14 bp, Homo sapiens
atgggacagcaaca

SEQ ID NO: 3069565 - DNA, 15 bp, Homo sapiens
atgggacagcaacaa

SEQ ID NO: 3069566 - DNA, 12 bp, Homo sapiens
atgggaccacaa

SEQ ID NO: 3069567 - DNA, 13 bp, Homo sapiens
atgggagaatcag

SEQ ID NO: 3069568 - DNA, 17 bp, Homo sapiens
atgggagccgggtctgc

SEQ ID NO: 3069569 - DNA, 15 bp, Homo sapiens
atgggaggccgggag

SEQ ID NO: 3069570 - DNA, 18 bp, Homo sapiens
atgggagggaggctcagg

SEQ ID NO: 3069571 - DNA, 21 bp, Homo sapiens
atgggagggatggcccttcct

SEQ ID NO: 3069572 - DNA, 17 bp, Homo sapiens
atgggatctgtaaggaa

SEQ ID NO: 3069573 - DNA, 18 bp, Homo sapiens
atgggatggtggagggcc

SEQ ID NO: 3069574 - DNA, 18 bp, Homo sapiens
atgggcacaaagggccca

SEQ ID NO: 3069575 - DNA, 15 bp, Homo sapiens
atgggcaggtggcct

SEQ ID NO: 3069576 - DNA, 22 bp, Homo sapiens
atgggcaggtggcctctgctgg

SEQ ID NO: 3069577 - DNA, 12 bp, Homo sapiens
atgggccagccc

SEQ ID NO: 3069578 - DNA, 15 bp, Homo sapiens
atgggccagcccctc

SEQ ID NO: 3069579 - DNA, 14 bp, Homo sapiens
atgggcccctggca

SEQ ID NO: 3069580 - DNA, 14 bp, Homo sapiens
atgggcccctggcc

SEQ ID NO: 3069581 - DNA, 14 bp, Homo sapiens
atgggcgggcagtc

SEQ ID NO: 3069582 - DNA, 19 bp, Homo sapiens
atgttttaattccatgaat

SEQ ID NO: 3069583 - DNA, 14 bp, Homo sapiens
atgttttacactgt

SEQ ID NO: 3069584 - DNA, 20 bp, Homo sapiens
atgttttacgcaaggaagga

SEQ ID NO: 3069585 - DNA, 22 bp, Homo sapiens
atgttttagacaaatactcatg

SEQ ID NO: 3069586 - DNA, 15 bp, Homo sapiens
atgttttatttcatt

SEQ ID NO: 3069587 - DNA, 23 bp, Homo sapiens
atgttttatttcattggttaatt

SEQ ID NO: 3069588 - DNA, 20 bp, Homo sapiens
atgttttccattgtttgaaa

SEQ ID NO: 3069589 - DNA, 17 bp, Homo sapiens
atgttttctgctttaaa

SEQ ID NO: 3069590 - DNA, 18 bp, Homo sapiens
atgttttctttgctttaa

SEQ ID NO: 3069591 - DNA, 12 bp, Homo sapiens
atgttttgataa

SEQ ID NO: 3069592 - DNA, 11 bp, Homo sapiens
atgttttggtg

SEQ ID NO: 3069593 - DNA, 22 bp, Homo sapiens
atgttttttaaaatatttatct

SEQ ID NO: 3069594 - DNA, 13 bp, Homo sapiens
attaaaaaacaat

SEQ ID NO: 3069595 - DNA, 18 bp, Homo sapiens
attaaaaaacaattaact

SEQ ID NO: 3069596 - DNA, 19 bp, Homo sapiens
attaaaaactagtagttct

SEQ ID NO: 3069597 - DNA, 21 bp, Homo sapiens
attaaaaagatggttgccaag

SEQ ID NO: 3069598 - DNA, 13 bp, Homo sapiens
attaaaaagcctt

SEQ ID NO: 3069599 - DNA, 14 bp, Homo sapiens
attaaaaagcctta

SEQ ID NO: 3069600 - DNA, 23 bp, Homo sapiens
attaaaaagggagaaagaaaact

SEQ ID NO: 3069601 - DNA, 11 bp, Homo sapiens
attaaaaataa

SEQ ID NO: 3069602 - DNA, 13 bp, Homo sapiens
attaaaaattata

SEQ ID NO: 3069603 - DNA, 21 bp, Homo sapiens
attaaaacaatattgtttcta

SEQ ID NO: 3069604 - DNA, 13 bp, Homo sapiens
attaaaataacta

SEQ ID NO: 3069605 - DNA, 15 bp, Homo sapiens
attaaaataactatc

SEQ ID NO: 3069606 - DNA, 22 bp, Homo sapiens
attaaaataactatcaggcaga

SEQ ID NO: 3069607 - DNA, 16 bp, Homo sapiens
attaaaatatgaaggt

SEQ ID NO: 3069608 - DNA, 13 bp, Homo sapiens
attaaaatctctt

SEQ ID NO: 3069609 - DNA, 13 bp, Homo sapiens
attaaaatgaatt

SEQ ID NO: 3069610 - DNA, 13 bp, Homo sapiens
attaaaattagtg

SEQ ID NO: 3069611 - DNA, 21 bp, Homo sapiens
attaaacccacaagctgcctc

SEQ ID NO: 3069612 - DNA, 17 bp, Homo sapiens
attaaacctttccattt

SEQ ID NO: 3069613 - DNA, 20 bp, Homo sapiens
attaaacgtatgcatgtgaa

SEQ ID NO: 3069614 - DNA, 14 bp, Homo sapiens
attaaacttatgaa

SEQ ID NO: 3069615 - DNA, 14 bp, Homo sapiens
attaaacttgaagc

SEQ ID NO: 3069616 - DNA, 17 bp, Homo sapiens
attaaagctaaagtatc

SEQ ID NO: 3069617 - DNA, 19 bp, Homo sapiens
attaaaggtgaaaattgta

SEQ ID NO: 3069618 - DNA, 18 bp, Homo sapiens
attaaagtgctaaggttc

SEQ ID NO: 3069619 - DNA, 20 bp, Homo sapiens
attaaagtgctaaggttcta

SEQ ID NO: 3069620 - DNA, 20 bp, Homo sapiens
attaaagtgctgtttagatt

SEQ ID NO: 3069621 - DNA, 23 bp, Homo sapiens
attaaagtgctgtttagatttat

SEQ ID NO: 3069622 - DNA, 12 bp, Homo sapiens
attaaagttcta

SEQ ID NO: 3069623 - DNA, 16 bp, Homo sapiens
attaaagtttgcttgt

SEQ ID NO: 3069624 - DNA, 23 bp, Homo sapiens
attaaagtttgcttgtttcttgg

SEQ ID NO: 3069625 - DNA, 14 bp, Homo sapiens
attaaataacatgt

SEQ ID NO: 3069626 - DNA, 15 bp, Homo sapiens
attaaataagattct

SEQ ID NO: 3069627 - DNA, 17 bp, Homo sapiens
attaaataagattctaa

SEQ ID NO: 3069628 - DNA, 22 bp, Homo sapiens
attaaatataaatatccccagg

SEQ ID NO: 3069629 - DNA, 13 bp, Homo sapiens
attaaatatttct

SEQ ID NO: 3069630 - DNA, 16 bp, Homo sapiens
attaaatcgtttaatg

SEQ ID NO: 3069631 - DNA, 19 bp, Homo sapiens
attaaatcgtttaatgttt

SEQ ID NO: 3069632 - DNA, 13 bp, Homo sapiens
attaaatgttgct

SEQ ID NO: 3069633 - DNA, 15 bp, Homo sapiens
attaaattaattgaa

SEQ ID NO: 3069634 - DNA, 18 bp, Homo sapiens
attaaattaattgaatct

SEQ ID NO: 3069635 - DNA, 19 bp, Homo sapiens
attaaattaattgaatcta

SEQ ID NO: 3069636 - DNA, 16 bp, Homo sapiens
attaaattcacaaact

SEQ ID NO: 3069637 - DNA, 24 bp, Homo sapiens
attaaattctctctaacataacaa

SEQ ID NO: 3069638 - DNA, 17 bp, Homo sapiens
attaaatttgcaacaat

SEQ ID NO: 3069639 - DNA, 12 bp, Homo sapiens
attaacaatgta

SEQ ID NO: 3069640 - DNA, 18 bp, Homo sapiens
attaacataggtgaaagt

SEQ ID NO: 3069641 - DNA, 15 bp, Homo sapiens
attaaccgatgcttt

SEQ ID NO: 3069642 - DNA, 22 bp, Homo sapiens
attaactactgtagaactgatt

SEQ ID NO: 3069643 - DNA, 17 bp, Homo sapiens
attaactagtttatcat

SEQ ID NO: 3069644 - DNA, 17 bp, Homo sapiens
attaactcattagactg

SEQ ID NO: 3069645 - DNA, 21 bp, Homo sapiens
attaactctgtaaaagtgtct

SEQ ID NO: 3069646 - DNA, 22 bp, Homo sapiens
attaactgagtagctctcctga

SEQ ID NO: 3069647 - DNA, 13 bp, Homo sapiens
attaagaaacaat

SEQ ID NO: 3069648 - DNA, 15 bp, Homo sapiens
attaagaaggcaaaa

SEQ ID NO: 3069649 - DNA, 22 bp, Homo sapiens
attaagaaggcaaaaatgtaaa

SEQ ID NO: 3069650 - DNA, 23 bp, Homo sapiens
attaagagaacaaagagtgaaat

SEQ ID NO: 3069651 - DNA, 17 bp, Homo sapiens
attaagaggcagaaaat

SEQ ID NO: 3069652 - DNA, 14 bp, Homo sapiens
attaagatgtatat

SEQ ID NO: 3069653 - DNA, 21 bp, Homo sapiens
attaagattctctgcccagcc

SEQ ID NO: 3069654 - DNA, 14 bp, Homo sapiens
attaaggatgtagc

SEQ ID NO: 3069655 - DNA, 18 bp, Homo sapiens
attaaggatgtagctttt

SEQ ID NO: 3069656 - DNA, 23 bp, Homo sapiens
attaaggatgtagcttttcacct

SEQ ID NO: 3069657 - DNA, 16 bp, Homo sapiens
attaagtcaagaatat

SEQ ID NO: 3069658 - DNA, 12 bp, Homo sapiens
attaagtgttga

SEQ ID NO: 3069659 - DNA, 13 bp, Homo sapiens
attaagttcttta

SEQ ID NO: 3069660 - DNA, 17 bp, Homo sapiens
attaatataagtttctt

SEQ ID NO: 3069661 - DNA, 14 bp, Homo sapiens
attaatatctccat

SEQ ID NO: 3069662 - DNA, 15 bp, Homo sapiens
attaatattgtattg

SEQ ID NO: 3069663 - DNA, 17 bp, Homo sapiens
attaatattgtattgct

SEQ ID NO: 3069664 - DNA, 23 bp, Homo sapiens
attaatatttgtgctttgaaaaa

SEQ ID NO: 3069665 - DNA, 18 bp, Homo sapiens
attaatcagctgttgcag

SEQ ID NO: 3069666 - DNA, 13 bp, Homo sapiens
attaatcctttaa

SEQ ID NO: 3069667 - DNA, 14 bp, Homo sapiens
attaatctaaaaaa

SEQ ID NO: 3069668 - DNA, 17 bp, Homo sapiens
attaatgaaaataagaa

SEQ ID NO: 3069669 - DNA, 12 bp, Homo sapiens
attaatgcactt

SEQ ID NO: 3069670 - DNA, 13 bp, Homo sapiens
attaatgcacttt

SEQ ID NO: 3069671 - DNA, 15 bp, Homo sapiens
attaatgcactttct

SEQ ID NO: 3069672 - DNA, 14 bp, Homo sapiens
attaattctataag

SEQ ID NO: 3069673 - DNA, 14 bp, Homo sapiens
attaattgaatcta

SEQ ID NO: 3069674 - DNA, 14 bp, Homo sapiens
attaattgtgcctg

SEQ ID NO: 3069675 - DNA, 19 bp, Homo sapiens
attaattgttccttgcttt

SEQ ID NO: 3069676 - DNA, 17 bp, Homo sapiens
attaatttgttaattaa

SEQ ID NO: 3069677 - DNA, 22 bp, Homo sapiens
attaatttgttaattaaatatt

SEQ ID NO: 3069678 - DNA, 15 bp, Homo sapiens
attaattttctatgt

SEQ ID NO: 3069679 - DNA, 19 bp, Homo sapiens
attacaaattttcactgct

SEQ ID NO: 3069680 - DNA, 21 bp, Homo sapiens
attacagaaactgatgccaag

SEQ ID NO: 3069681 - DNA, 21 bp, Homo sapiens
attacagcttatttttttcta

SEQ ID NO: 3069682 - DNA, 20 bp, Homo sapiens
attacaggcacctgccacca

SEQ ID NO: 3069683 - DNA, 21 bp, Homo sapiens
attacaggcgtgagccactgc

SEQ ID NO: 3069684 - DNA, 19 bp, Homo sapiens
attacagttgcatttttat

SEQ ID NO: 3069685 - DNA, 19 bp, Homo sapiens
attacataactgatctatt

SEQ ID NO: 3069686 - DNA, 15 bp, Homo sapiens
attacatctttcaca

SEQ ID NO: 3069687 - DNA, 16 bp, Homo sapiens
attacatctttcacat

SEQ ID NO: 3069688 - DNA, 15 bp, Homo sapiens
attacatttaaatcc

SEQ ID NO: 3069689 - DNA, 15 bp, Homo sapiens
attaccaagagaagg

SEQ ID NO: 3069690 - DNA, 18 bp, Homo sapiens
attaccccctccttcaga

SEQ ID NO: 3069691 - DNA, 20 bp, Homo sapiens
attaccccctccttcagaca

SEQ ID NO: 3069692 - DNA, 21 bp, Homo sapiens
attaccccctccttcagacac

SEQ ID NO: 3069693 - DNA, 13 bp, Homo sapiens
attacccttcctc

SEQ ID NO: 3069694 - DNA, 14 bp, Homo sapiens
attacccttcctca

SEQ ID NO: 3069695 - DNA, 13 bp, Homo sapiens
attacgataaaca

SEQ ID NO: 3069696 - DNA, 17 bp, Homo sapiens
attacgataaggaagaa

SEQ ID NO: 3069697 - DNA, 20 bp, Homo sapiens
attacgataaggaagaaaca

SEQ ID NO: 3069698 - DNA, 19 bp, Homo sapiens
attacggtgtacagtttaa

SEQ ID NO: 3069699 - DNA, 16 bp, Homo sapiens
attactctttgctttg

SEQ ID NO: 3069700 - DNA, 18 bp, Homo sapiens
attactctttgctttgta

SEQ ID NO: 3069701 - DNA, 21 bp, Homo sapiens
attactggcgtggattaaact

SEQ ID NO: 3069702 - DNA, 22 bp, Homo sapiens
attactggcgtggattaaactt

SEQ ID NO: 3069703 - DNA, 20 bp, Homo sapiens
attactgttgataattctta

SEQ ID NO: 3069704 - DNA, 15 bp, Homo sapiens
attacttatcatcca

SEQ ID NO: 3069705 - DNA, 19 bp, Homo sapiens
attacttatcatccacatt

SEQ ID NO: 3069706 - DNA, 14 bp, Homo sapiens
attactttaatgat

SEQ ID NO: 3069707 - DNA, 22 bp, Homo sapiens
attactttcgtaatagctcaga

SEQ ID NO: 3069708 - DNA, 14 bp, Homo sapiens
attacttttcatct

SEQ ID NO: 3069709 - DNA, 18 bp, Homo sapiens
attagaaacaaacaaaac

SEQ ID NO: 3069710 - DNA, 19 bp, Homo sapiens
attagaaacaaacaaaact

SEQ ID NO: 3069711 - DNA, 10 bp, Homo sapiens
attagaactt

SEQ ID NO: 3069712 - DNA, 21 bp, Homo sapiens
attagaagacaattgacaaca

SEQ ID NO: 3069713 - DNA, 14 bp, Homo sapiens
attagaatgtgatt

SEQ ID NO: 3069714 - DNA, 15 bp, Homo sapiens
attagactggacagc

SEQ ID NO: 3069715 - DNA, 15 bp, Homo sapiens
atttaaaagacaaac

SEQ ID NO: 3069716 - DNA, 17 bp, Homo sapiens
atttaaaagacaaacac

SEQ ID NO: 3069717 - DNA, 19 bp, Homo sapiens
atttaaaagacaaacacct

SEQ ID NO: 3069718 - DNA, 18 bp, Homo sapiens
atttaaaagattcatttt

SEQ ID NO: 3069719 - DNA, 14 bp, Homo sapiens
atttaaaataaatt

SEQ ID NO: 3069720 - DNA, 23 bp, Homo sapiens
atttaaaatgctcaatttcagca

SEQ ID NO: 3069721 - DNA, 15 bp, Homo sapiens
atttaaaattaagta

SEQ ID NO: 3069722 - DNA, 13 bp, Homo sapiens
atttaaacccatt

SEQ ID NO: 3069723 - DNA, 14 bp, Homo sapiens
atttaaacccattt

SEQ ID NO: 3069724 - DNA, 13 bp, Homo sapiens
atttaaagaaagt

SEQ ID NO: 3069725 - DNA, 21 bp, Homo sapiens
atttaaaggccctatctgttt

SEQ ID NO: 3069726 - DNA, 21 bp, Homo sapiens
atttaaaggcttaggcatgtt

SEQ ID NO: 3069727 - DNA, 18 bp, Homo sapiens
atttaaatccttgtgtaa

SEQ ID NO: 3069728 - DNA, 13 bp, Homo sapiens
atttaaatgcttt

SEQ ID NO: 3069729 - DNA, 18 bp, Homo sapiens
atttaaatgtacttatat

SEQ ID NO: 3069730 - DNA, 13 bp, Homo sapiens
atttaaatgttta

SEQ ID NO: 3069731 - DNA, 16 bp, Homo sapiens
atttaaatgtttacta

SEQ ID NO: 3069732 - DNA, 17 bp, Homo sapiens
atttaaatgtttactat

SEQ ID NO: 3069733 - DNA, 21 bp, Homo sapiens
atttaaattacaattttatct

SEQ ID NO: 3069734 - DNA, 20 bp, Homo sapiens
atttaaattctttttcaaaa

SEQ ID NO: 3069735 - DNA, 14 bp, Homo sapiens
atttaaattgttat

SEQ ID NO: 3069736 - DNA, 19 bp, Homo sapiens
atttaaattttacccttta

SEQ ID NO: 3069737 - DNA, 17 bp, Homo sapiens
atttaacagggagggga

SEQ ID NO: 3069738 - DNA, 19 bp, Homo sapiens
atttaactcttaactgaag

SEQ ID NO: 3069739 - DNA, 18 bp, Homo sapiens
atttaactggtgcacttt

SEQ ID NO: 3069740 - DNA, 23 bp, Homo sapiens
atttaactggtgcactttgtaaa

SEQ ID NO: 3069741 - DNA, 23 bp, Homo sapiens
atttaacttttcttttggacttt

SEQ ID NO: 3069742 - DNA, 16 bp, Homo sapiens
atttaagcaacatctt

SEQ ID NO: 3069743 - DNA, 15 bp, Homo sapiens
atttaagctgtaaat

SEQ ID NO: 3069744 - DNA, 17 bp, Homo sapiens
atttaagctgtaaatta

SEQ ID NO: 3069745 - DNA, 19 bp, Homo sapiens
atttaagctgtaaattaca

SEQ ID NO: 3069746 - DNA, 22 bp, Homo sapiens
atttaagctgtaaattacataa

SEQ ID NO: 3069747 - DNA, 20 bp, Homo sapiens
atttaagttcctgctgcctg

SEQ ID NO: 3069748 - DNA, 22 bp, Homo sapiens
atttaagttcctgctgcctggg

SEQ ID NO: 3069749 - DNA, 13 bp, Homo sapiens
atttaataacttt

SEQ ID NO: 3069750 - DNA, 15 bp, Homo sapiens
atttaatacagataa

SEQ ID NO: 3069751 - DNA, 14 bp, Homo sapiens
atttaatagtgtta

SEQ ID NO: 3069752 - DNA, 15 bp, Homo sapiens
atttaatagtgttaa

SEQ ID NO: 3069753 - DNA, 20 bp, Homo sapiens
atttaatagtgttaatcaat

SEQ ID NO: 3069754 - DNA, 14 bp, Homo sapiens
atttaatgtagaca

SEQ ID NO: 3069755 - DNA, 23 bp, Homo sapiens
atttaatgttttaaatgtacaga

SEQ ID NO: 3069756 - DNA, 17 bp, Homo sapiens
atttaattcatgtttct

SEQ ID NO: 3069757 - DNA, 18 bp, Homo sapiens
atttaattcctcttttta

SEQ ID NO: 3069758 - DNA, 23 bp, Homo sapiens
atttaattcctctttttagggct

SEQ ID NO: 3069759 - DNA, 16 bp, Homo sapiens
atttaattctcttgaa

SEQ ID NO: 3069760 - DNA, 17 bp, Homo sapiens
atttaatttttattaaa

SEQ ID NO: 3069761 - DNA, 17 bp, Homo sapiens
atttacaatgtgtatca

SEQ ID NO: 3069762 - DNA, 14 bp, Homo sapiens
atttacagaacaaa

SEQ ID NO: 3069763 - DNA, 19 bp, Homo sapiens
atttacagatgaatgtatt

SEQ ID NO: 3069764 - DNA, 19 bp, Homo sapiens
atttacatgtattatttca

SEQ ID NO: 3069765 - DNA, 22 bp, Homo sapiens
atttacatgtattatttcatta

SEQ ID NO: 3069766 - DNA, 20 bp, Homo sapiens
atttacatttaatacagata

SEQ ID NO: 3069767 - DNA, 19 bp, Homo sapiens
atttaccaacatgtatctg

SEQ ID NO: 3069768 - DNA, 21 bp, Homo sapiens
atttaccaacatgtatctgtc

SEQ ID NO: 3069769 - DNA, 23 bp, Homo sapiens
atttaccaacatgtatctgtcta

SEQ ID NO: 3069770 - DNA, 15 bp, Homo sapiens
atttacctctaaatt

SEQ ID NO: 3069771 - DNA, 21 bp, Homo sapiens
atttacgaaaccaaaaagttg

SEQ ID NO: 3069772 - DNA, 13 bp, Homo sapiens
atttacgactgaa

SEQ ID NO: 3069773 - DNA, 15 bp, Homo sapiens
atttacgactgaaga

SEQ ID NO: 3069774 - DNA, 15 bp, Homo sapiens
atttacgctttgatt

SEQ ID NO: 3069775 - DNA, 22 bp, Homo sapiens
atttactcaccatatttgaatt

SEQ ID NO: 3069776 - DNA, 17 bp, Homo sapiens
atttactgtgagactgt

SEQ ID NO: 3069777 - DNA, 18 bp, Homo sapiens
atttacttctaatcttaa

SEQ ID NO: 3069778 - DNA, 17 bp, Homo sapiens
atttactttttaaacag

SEQ ID NO: 3069779 - DNA, 18 bp, Homo sapiens
atttactttttaaacagt

SEQ ID NO: 3069780 - DNA, 13 bp, Homo sapiens
atttagaaacaat

SEQ ID NO: 3069781 - DNA, 17 bp, Homo sapiens
atttagaacgagcctgg

SEQ ID NO: 3069782 - DNA, 18 bp, Homo sapiens
atttagaagtgtcatgtt

SEQ ID NO: 3069783 - DNA, 20 bp, Homo sapiens
atttagagaactgtggccgt

SEQ ID NO: 3069784 - DNA, 14 bp, Homo sapiens
atttagattgtaaa

SEQ ID NO: 3069785 - DNA, 16 bp, Homo sapiens
atttagcaatgctgtg

SEQ ID NO: 3069786 - DNA, 15 bp, Homo sapiens
atttagcataaattt

SEQ ID NO: 3069787 - DNA, 21 bp, Homo sapiens
atttagctaaacggattccaa

SEQ ID NO: 3069788 - DNA, 18 bp, Homo sapiens
atttagctgaagggcttg

SEQ ID NO: 3069789 - DNA, 17 bp, Homo sapiens
atttaggagaagccagg

SEQ ID NO: 3069790 - DNA, 17 bp, Homo sapiens
atttaggagaagttggt

SEQ ID NO: 3069791 - DNA, 16 bp, Homo sapiens
atttagggaactgctt

SEQ ID NO: 3069792 - DNA, 21 bp, Homo sapiens
atttagtattgaatacttaca

SEQ ID NO: 3069793 - DNA, 21 bp, Homo sapiens
atttagtctctttattcctag

SEQ ID NO: 3069794 - DNA, 15 bp, Homo sapiens
atttagttaataaaa

SEQ ID NO: 3069795 - DNA, 22 bp, Homo sapiens
atttagtttgattattcagtgt

SEQ ID NO: 3069796 - DNA, 17 bp, Homo sapiens
atttataaacagacaat

SEQ ID NO: 3069797 - DNA, 21 bp, Homo sapiens
atttataaagctaaaataacc

SEQ ID NO: 3069798 - DNA, 19 bp, Homo sapiens
atttataattcagtatgtt

SEQ ID NO: 3069799 - DNA, 13 bp, Homo sapiens
atttatacataca

SEQ ID NO: 3069800 - DNA, 18 bp, Homo sapiens
atttatacatacagagat

SEQ ID NO: 3069801 - DNA, 16 bp, Homo sapiens
atttatagaagaaatg

SEQ ID NO: 3069802 - DNA, 13 bp, Homo sapiens
atttatagtaatg

SEQ ID NO: 3069803 - DNA, 21 bp, Homo sapiens
atttatatagcaagtgctatt

SEQ ID NO: 3069804 - DNA, 11 bp, Homo sapiens
atttatatgaa

SEQ ID NO: 3069805 - DNA, 14 bp, Homo sapiens
atttatatgaagca

SEQ ID NO: 3069806 - DNA, 15 bp, Homo sapiens
atttatatgtacatg

SEQ ID NO: 3069807 - DNA, 17 bp, Homo sapiens
atttatatgtactgttt

SEQ ID NO: 3069808 - DNA, 13 bp, Homo sapiens
atttatattaaat

SEQ ID NO: 3069809 - DNA, 15 bp, Homo sapiens
atttatattgtaaat

SEQ ID NO: 3069810 - DNA, 12 bp, Homo sapiens
atttatcaaatc

SEQ ID NO: 3069811 - DNA, 14 bp, Homo sapiens
atttatcaaatcag

SEQ ID NO: 3069812 - DNA, 20 bp, Homo sapiens
atttatcctcacataaaaaa

SEQ ID NO: 3069813 - DNA, 20 bp, Homo sapiens
atttatctgtgtttttgaaa

SEQ ID NO: 3069814 - DNA, 13 bp, Homo sapiens
atttatgaatata

SEQ ID NO: 3069815 - DNA, 23 bp, Homo sapiens
atttatgctataaattttttgaa

SEQ ID NO: 3069816 - DNA, 19 bp, Homo sapiens
atttatgggcccctggcac

SEQ ID NO: 3069817 - DNA, 16 bp, Homo sapiens
atttatgtaacttgaa

SEQ ID NO: 3069818 - DNA, 22 bp, Homo sapiens
atttatgtagacattgtaaata

SEQ ID NO: 3069819 - DNA, 17 bp, Homo sapiens
atttattaattgctttg

SEQ ID NO: 3069820 - DNA, 21 bp, Homo sapiens
atttattatcgcatacagata

SEQ ID NO: 3069821 - DNA, 11 bp, Homo sapiens
atttattattt

SEQ ID NO: 3069822 - DNA, 19 bp, Homo sapiens
atttattatttatttatta

SEQ ID NO: 3069823 - DNA, 17 bp, Homo sapiens
atttattctacttttaa

SEQ ID NO: 3069824 - DNA, 14 bp, Homo sapiens
atttattgaaattt

SEQ ID NO: 3069825 - DNA, 20 bp, Homo sapiens
atttattgaaatttttctct

SEQ ID NO: 3069826 - DNA, 21 bp, Homo sapiens
atttattgcaggatggtgtct

SEQ ID NO: 3069827 - DNA, 21 bp, Homo sapiens
atttattggatgatacagtgt

SEQ ID NO: 3069828 - DNA, 18 bp, Homo sapiens
atttattgtgtgttctca

SEQ ID NO: 3069829 - DNA, 17 bp, Homo sapiens
atttattgtttatgtaa

SEQ ID NO: 3069830 - DNA, 18 bp, Homo sapiens
atttatttatgtactttt

SEQ ID NO: 3069831 - DNA, 14 bp, Homo sapiens
atttatttattatt

SEQ ID NO: 3069832 - DNA, 17 bp, Homo sapiens
atttattttatgagaaa

SEQ ID NO: 3069833 - DNA, 18 bp, Homo sapiens
atttattttatgagaaat

SEQ ID NO: 3069834 - DNA, 21 bp, Homo sapiens
atttattttatttatttaatt

SEQ ID NO: 3069835 - DNA, 14 bp, Homo sapiens
atttcaaaactcat

SEQ ID NO: 3069836 - DNA, 11 bp, Homo sapiens
atttcaaaatt

SEQ ID NO: 3069837 - DNA, 13 bp, Homo sapiens
atttcaaaattaa

SEQ ID NO: 3069838 - DNA, 15 bp, Homo sapiens
atttcaaagccctgc

SEQ ID NO: 3069839 - DNA, 20 bp, Homo sapiens
atttcaaagccctgcctctg

SEQ ID NO: 3069840 - DNA, 21 bp, Homo sapiens
atttcaaagccctgcctctgt

SEQ ID NO: 3069841 - DNA, 22 bp, Homo sapiens
atttcaaatatttacagtactt

SEQ ID NO: 3069842 - DNA, 14 bp, Homo sapiens
atttcaaggttcta

SEQ ID NO: 3069843 - DNA, 17 bp, Homo sapiens
atttcaattcctggccc

SEQ ID NO: 3069844 - DNA, 16 bp, Homo sapiens
atttcacggagacagc

SEQ ID NO: 3069845 - DNA, 19 bp, Homo sapiens
atttcacggagacagcaac

SEQ ID NO: 3069846 - DNA, 22 bp, Homo sapiens
atttcactgaatttcaaacatt

SEQ ID NO: 3069847 - DNA, 22 bp, Homo sapiens
caaaactttttgaccagtttct

SEQ ID NO: 3069848 - DNA, 14 bp, Homo sapiens
caaaagaaagcaaa

SEQ ID NO: 3069849 - DNA, 22 bp, Homo sapiens
caaaagaaagcaaattattttt

SEQ ID NO: 3069850 - DNA, 12 bp, Homo sapiens
caaaagaactta

SEQ ID NO: 3069851 - DNA, 19 bp, Homo sapiens
caaaagaagcccccagcta

SEQ ID NO: 3069852 - DNA, 13 bp, Homo sapiens
caaaagacaattc

SEQ ID NO: 3069853 - DNA, 20 bp, Homo sapiens
caaaagatttggaaagatat

SEQ ID NO: 3069854 - DNA, 12 bp, Homo sapiens
caaaagctgctc

SEQ ID NO: 3069855 - DNA, 14 bp, Homo sapiens
caaaagctgctcag

SEQ ID NO: 3069856 - DNA, 15 bp, Homo sapiens
caaaagctgtgtctc

SEQ ID NO: 3069857 - DNA, 15 bp, Homo sapiens
caaaaggaaagaaac

SEQ ID NO: 3069858 - DNA, 17 bp, Homo sapiens
caaaaggaagactggag

SEQ ID NO: 3069859 - DNA, 22 bp, Homo sapiens
caaaaggatctttgtggccaag

SEQ ID NO: 3069860 - DNA, 17 bp, Homo sapiens
caaaaggccgtgtgttt

SEQ ID NO: 3069861 - DNA, 18 bp, Homo sapiens
caaaaggcggtgagagag

SEQ ID NO: 3069862 - DNA, 19 bp, Homo sapiens
caaaagggaaaaaataaaa

SEQ ID NO: 3069863 - DNA, 13 bp, Homo sapiens
caaaaggtgcctg

SEQ ID NO: 3069864 - DNA, 16 bp, Homo sapiens
caaaagtattttcctg

SEQ ID NO: 3069865 - DNA, 19 bp, Homo sapiens
caaaagtcaaaaggtgcct

SEQ ID NO: 3069866 - DNA, 14 bp, Homo sapiens
caaaagtgacagat

SEQ ID NO: 3069867 - DNA, 14 bp, Homo sapiens
caaaagtggcctct

SEQ ID NO: 3069868 - DNA, 21 bp, Homo sapiens
caaaagtggggctaaatgaag

SEQ ID NO: 3069869 - DNA, 14 bp, Homo sapiens
caaaagttccaaga

SEQ ID NO: 3069870 - DNA, 18 bp, Homo sapiens
caaaagttccaagagtct

SEQ ID NO: 3069871 - DNA, 23 bp, Homo sapiens
caaaagttccatatagacaccaa

SEQ ID NO: 3069872 - DNA, 15 bp, Homo sapiens
caaaataaaaaccaa

SEQ ID NO: 3069873 - DNA, 14 bp, Homo sapiens
caaaataaaacaaa

SEQ ID NO: 3069874 - DNA, 18 bp, Homo sapiens
caaaataaagctgttctc

SEQ ID NO: 3069875 - DNA, 14 bp, Homo sapiens
caaaataaatcagt

SEQ ID NO: 3069876 - DNA, 12 bp, Homo sapiens
caaaatagaaaa

SEQ ID NO: 3069877 - DNA, 21 bp, Homo sapiens
caaaataggatttcttaaatt

SEQ ID NO: 3069878 - DNA, 13 bp, Homo sapiens
caaaatatttaaa

SEQ ID NO: 3069879 - DNA, 18 bp, Homo sapiens
caaaatatttaaaaatgt

SEQ ID NO: 3069880 - DNA, 20 bp, Homo sapiens
caaaatatttaaaaatgtct

SEQ ID NO: 3069881 - DNA, 23 bp, Homo sapiens
caaaatcatggaatggttataaa

SEQ ID NO: 3069882 - DNA, 13 bp, Homo sapiens
caaaatccaaact

SEQ ID NO: 3069883 - DNA, 16 bp, Homo sapiens
caaaatccaaactgct

SEQ ID NO: 3069884 - DNA, 17 bp, Homo sapiens
caaaatccaaactgctg

SEQ ID NO: 3069885 - DNA, 20 bp, Homo sapiens
caaaatccttacttccagca

SEQ ID NO: 3069886 - DNA, 17 bp, Homo sapiens
caaaatctgttctaaca

SEQ ID NO: 3069887 - DNA, 17 bp, Homo sapiens
caaaatgatgcaaccaa

SEQ ID NO: 3069888 - DNA, 18 bp, Homo sapiens
caaaatgatgcaaccaaa

SEQ ID NO: 3069889 - DNA, 18 bp, Homo sapiens
caaaatgctctagtgcct

SEQ ID NO: 3069890 - DNA, 16 bp, Homo sapiens
caaaatggattttagt

SEQ ID NO: 3069891 - DNA, 12 bp, Homo sapiens
caaaatgtcttg

SEQ ID NO: 3069892 - DNA, 13 bp, Homo sapiens
caaaatgtcttgt

SEQ ID NO: 3069893 - DNA, 14 bp, Homo sapiens
caaaatgtcttgtg

SEQ ID NO: 3069894 - DNA, 19 bp, Homo sapiens
caaaatgtcttgtgtattt

SEQ ID NO: 3069895 - DNA, 19 bp, Homo sapiens
caaaatgttatcttctcaa

SEQ ID NO: 3069896 - DNA, 21 bp, Homo sapiens
caaaatgttatcttctcaagt

SEQ ID NO: 3069897 - DNA, 22 bp, Homo sapiens
caaaatgttatcttctcaagtt

SEQ ID NO: 3069898 - DNA, 11 bp, Homo sapiens
caaaattaata

SEQ ID NO: 3069899 - DNA, 19 bp, Homo sapiens
caaaattcatttctaatta

SEQ ID NO: 3069900 - DNA, 16 bp, Homo sapiens
caaaattctaaatgta

SEQ ID NO: 3069901 - DNA, 18 bp, Homo sapiens
caaaattgcctttttctc

SEQ ID NO: 3069902 - DNA, 20 bp, Homo sapiens
caaaattgcctttttctcta

SEQ ID NO: 3069903 - DNA, 23 bp, Homo sapiens
caaaattgggaaaggagtagaaa

SEQ ID NO: 3069904 - DNA, 15 bp, Homo sapiens
caaaatttatatttt

SEQ ID NO: 3069905 - DNA, 13 bp, Homo sapiens
caaaatttgacta

SEQ ID NO: 3069906 - DNA, 18 bp, Homo sapiens
caaaatttttcaacccca

SEQ ID NO: 3069907 - DNA, 23 bp, Homo sapiens
caaaatttttcaaccccaccctg

SEQ ID NO: 3069908 - DNA, 16 bp, Homo sapiens
caaacaaaagcagccc

SEQ ID NO: 3069909 - DNA, 20 bp, Homo sapiens
caaacaaagccagaagctga

SEQ ID NO: 3069910 - DNA, 14 bp, Homo sapiens
caaacacaacacaa

SEQ ID NO: 3069911 - DNA, 15 bp, Homo sapiens
caaacacaacacaag

SEQ ID NO: 3069912 - DNA, 17 bp, Homo sapiens
caaacacaacacaagaa

SEQ ID NO: 3069913 - DNA, 14 bp, Homo sapiens
caaacagcaaacca

SEQ ID NO: 3069914 - DNA, 16 bp, Homo sapiens
caaacagcaaaccaag

SEQ ID NO: 3069915 - DNA, 19 bp, Homo sapiens
caaacagcaaaccaagaga

SEQ ID NO: 3069916 - DNA, 20 bp, Homo sapiens
caaacagcaaaccaagagat

SEQ ID NO: 3069917 - DNA, 17 bp, Homo sapiens
caaacagggtggcccag

SEQ ID NO: 3069918 - DNA, 18 bp, Homo sapiens
caaacagggtggcccagg

SEQ ID NO: 3069919 - DNA, 20 bp, Homo sapiens
caaacagggtggcccaggtg

SEQ ID NO: 3069920 - DNA, 20 bp, Homo sapiens
caaacaggtgctggcccagc

SEQ ID NO: 3069921 - DNA, 12 bp, Homo sapiens
caaacagtgaat

SEQ ID NO: 3069922 - DNA, 14 bp, Homo sapiens
caaacatgaaaaca

SEQ ID NO: 3069923 - DNA, 21 bp, Homo sapiens
caaacatgaagtgtgtttcct

SEQ ID NO: 3069924 - DNA, 14 bp, Homo sapiens
caaacatgtgcaac

SEQ ID NO: 3069925 - DNA, 19 bp, Homo sapiens
caaacatgtgcaactcttg

SEQ ID NO: 3069926 - DNA, 13 bp, Homo sapiens
caaaccaacatct

SEQ ID NO: 3069927 - DNA, 12 bp, Homo sapiens
caaaccagcctc

SEQ ID NO: 3069928 - DNA, 13 bp, Homo sapiens
caaaccccttccc

SEQ ID NO: 3069929 - DNA, 16 bp, Homo sapiens
caaacccttagcagcc

SEQ ID NO: 3069930 - DNA, 17 bp, Homo sapiens
caaacccttagcagccc

SEQ ID NO: 3069931 - DNA, 21 bp, Homo sapiens
caaacccttagcagcccagca

SEQ ID NO: 3069932 - DNA, 12 bp, Homo sapiens
caaacctctgtt

SEQ ID NO: 3069933 - DNA, 15 bp, Homo sapiens
caaacctctgttcag

SEQ ID NO: 3069934 - DNA, 23 bp, Homo sapiens
caaacctctgttcagtgtaaata

SEQ ID NO: 3069935 - DNA, 19 bp, Homo sapiens
caaacctgtagatgcagaa

SEQ ID NO: 3069936 - DNA, 23 bp, Homo sapiens
caaacctttttatattttatact

SEQ ID NO: 3069937 - DNA, 17 bp, Homo sapiens
caaacgctgcctgccca

SEQ ID NO: 3069938 - DNA, 14 bp, Homo sapiens
caaacggcaacatt

SEQ ID NO: 3069939 - DNA, 18 bp, Homo sapiens
caaactaaggtgctaaat

SEQ ID NO: 3069940 - DNA, 21 bp, Homo sapiens
caaactacctatattccttgt

SEQ ID NO: 3069941 - DNA, 23 bp, Homo sapiens
caaactacgcgatagtctctgtt

SEQ ID NO: 3069942 - DNA, 16 bp, Homo sapiens
caaactacttgatttt

SEQ ID NO: 3069943 - DNA, 13 bp, Homo sapiens
caaactagggcca

SEQ ID NO: 3069944 - DNA, 12 bp, Homo sapiens
caaactctgctg

SEQ ID NO: 3069945 - DNA, 16 bp, Homo sapiens
caaactgctgtctctt

SEQ ID NO: 3069946 - DNA, 15 bp, Homo sapiens
caaactggggcctcc

SEQ ID NO: 3069947 - DNA, 19 bp, Homo sapiens
caaactggggcctccagaa

SEQ ID NO: 3069948 - DNA, 17 bp, Homo sapiens
caaactggttcacctga

SEQ ID NO: 3069949 - DNA, 20 bp, Homo sapiens
caaactgtaaataaaaagaa

SEQ ID NO: 3069950 - DNA, 14 bp, Homo sapiens
caaactgtaataca

SEQ ID NO: 3069951 - DNA, 19 bp, Homo sapiens
caaacttgtatctgaagac

SEQ ID NO: 3069952 - DNA, 16 bp, Homo sapiens
caaacttttattagcc

SEQ ID NO: 3069953 - DNA, 17 bp, Homo sapiens
caaagaaaactgcacaa

SEQ ID NO: 3069954 - DNA, 15 bp, Homo sapiens
caaagaaccatgcag

SEQ ID NO: 3069955 - DNA, 13 bp, Homo sapiens
caaagaagacatg

SEQ ID NO: 3069956 - DNA, 22 bp, Homo sapiens
caaagaaggcatttgcagggtc

SEQ ID NO: 3069957 - DNA, 13 bp, Homo sapiens
caaagaagtggtt

SEQ ID NO: 3069958 - DNA, 15 bp, Homo sapiens
caaagaataagaaaa

SEQ ID NO: 3069959 - DNA, 17 bp, Homo sapiens
caaagagaatgtatttc

SEQ ID NO: 3069960 - DNA, 13 bp, Homo sapiens
caaagaggcaaga

SEQ ID NO: 3069961 - DNA, 14 bp, Homo sapiens
caaagaggcaagag

SEQ ID NO: 3069962 - DNA, 15 bp, Homo sapiens
caaagaggcaagagg

SEQ ID NO: 3069963 - DNA, 20 bp, Homo sapiens
caaagaggcaagaggctgga

SEQ ID NO: 3069964 - DNA, 20 bp, Homo sapiens
caaagaggctgaggctggca

SEQ ID NO: 3069965 - DNA, 16 bp, Homo sapiens
caaagagtctctggct

SEQ ID NO: 3069966 - DNA, 19 bp, Homo sapiens
caaagagtctctggctcag

SEQ ID NO: 3069967 - DNA, 16 bp, Homo sapiens
caaagagtgtggaatt

SEQ ID NO: 3069968 - DNA, 16 bp, Homo sapiens
caaagataccattctt

SEQ ID NO: 3069969 - DNA, 15 bp, Homo sapiens
caaagatatatattc

SEQ ID NO: 3069970 - DNA, 14 bp, Homo sapiens
caaagatatctttt

SEQ ID NO: 3069971 - DNA, 21 bp, Homo sapiens
caaagatctgtcctcagcctt

SEQ ID NO: 3069972 - DNA, 14 bp, Homo sapiens
caaagatgataatt

SEQ ID NO: 3069973 - DNA, 11 bp, Homo sapiens
caaagatgctg

SEQ ID NO: 3069974 - DNA, 21 bp, Homo sapiens
caaagatgggtgaaggctggc

SEQ ID NO: 3069975 - DNA, 20 bp, Homo sapiens
caaagatgtgggttcttttt

SEQ ID NO: 3069976 - DNA, 16 bp, Homo sapiens
caaagattcatgattt

SEQ ID NO: 3069977 - DNA, 19 bp, Homo sapiens
caaagattcatgatttata

SEQ ID NO: 3069978 - DNA, 21 bp, Homo sapiens
caaagattttcaaacaaaata

SEQ ID NO: 3069979 - DNA, 13 bp, Homo sapiens
caaagcaaaggca

SEQ ID NO: 3069980 - DNA, 17 bp, Homo sapiens
caactgacactcccacc

SEQ ID NO: 3069981 - DNA, 22 bp, Homo sapiens
caactgacactcccacccagtc

SEQ ID NO: 3069982 - DNA, 13 bp, Homo sapiens
caactgacctgcc

SEQ ID NO: 3069983 - DNA, 21 bp, Homo sapiens
caactgcctaaggccctttgt

SEQ ID NO: 3069984 - DNA, 18 bp, Homo sapiens
caactgctcttttatact

SEQ ID NO: 3069985 - DNA, 15 bp, Homo sapiens
caactggctggccag

SEQ ID NO: 3069986 - DNA, 16 bp, Homo sapiens
caactggctggccagt

SEQ ID NO: 3069987 - DNA, 21 bp, Homo sapiens
caactggggggaccaaatagc

SEQ ID NO: 3069988 - DNA, 16 bp, Homo sapiens
caactgtaaagcaaat

SEQ ID NO: 3069989 - DNA, 12 bp, Homo sapiens
caactgtatata

SEQ ID NO: 3069990 - DNA, 21 bp, Homo sapiens
caactgtctcgatgcaatgaa

SEQ ID NO: 3069991 - DNA, 23 bp, Homo sapiens
caactgtctcgatgcaatgaaca

SEQ ID NO: 3069992 - DNA, 20 bp, Homo sapiens
caactgtggtagctccagcg

SEQ ID NO: 3069993 - DNA, 23 bp, Homo sapiens
caactgtggtagctccagcgatg

SEQ ID NO: 3069994 - DNA, 22 bp, Homo sapiens
caactgttttaaaactttaaga

SEQ ID NO: 3069995 - DNA, 14 bp, Homo sapiens
caacttaatggaaa

SEQ ID NO: 3069996 - DNA, 15 bp, Homo sapiens
caacttatttaaaaa

SEQ ID NO: 3069997 - DNA, 19 bp, Homo sapiens
caacttatttaaaaatatt

SEQ ID NO: 3069998 - DNA, 16 bp, Homo sapiens
caacttcaagtgcatg

SEQ ID NO: 3069999 - DNA, 17 bp, Homo sapiens
caacttcaagtgcatgc

SEQ ID NO: 3070000 - DNA, 13 bp, Homo sapiens
caacttgaagaaa

SEQ ID NO: 3070001 - DNA, 19 bp, Homo sapiens
caacttgaagaaacgcttc

SEQ ID NO: 3070002 - DNA, 22 bp, Homo sapiens
caacttgcatccaactccagga

SEQ ID NO: 3070003 - DNA, 15 bp, Homo sapiens
caacttgcttctaaa

SEQ ID NO: 3070004 - DNA, 23 bp, Homo sapiens
caacttgcttctaaatgcccagt

SEQ ID NO: 3070005 - DNA, 21 bp, Homo sapiens
caacttggaaaaagaaagaaa

SEQ ID NO: 3070006 - DNA, 16 bp, Homo sapiens
caacttggctgcagga

SEQ ID NO: 3070007 - DNA, 17 bp, Homo sapiens
caacttgtcacccaaag

SEQ ID NO: 3070008 - DNA, 18 bp, Homo sapiens
caacttgtcacccaaagc

SEQ ID NO: 3070009 - DNA, 23 bp, Homo sapiens
caactttatgtagagaaaaggag

SEQ ID NO: 3070010 - DNA, 23 bp, Homo sapiens
caactttcatttgaaagtgggtt

SEQ ID NO: 3070011 - DNA, 14 bp, Homo sapiens
caactttgaataaa

SEQ ID NO: 3070012 - DNA, 16 bp, Homo sapiens
caactttgaataaaga

SEQ ID NO: 3070013 - DNA, 22 bp, Homo sapiens
caactttgaataaagaatactt

SEQ ID NO: 3070014 - DNA, 17 bp, Homo sapiens
caactttttattgcctt

SEQ ID NO: 3070015 - DNA, 16 bp, Homo sapiens
caagaaaaaaaaatgc

SEQ ID NO: 3070016 - DNA, 13 bp, Homo sapiens
caagaaaaagata

SEQ ID NO: 3070017 - DNA, 15 bp, Homo sapiens
caagaaaactggaaa

SEQ ID NO: 3070018 - DNA, 20 bp, Homo sapiens
caagaaaccaagtgggctgg

SEQ ID NO: 3070019 - DNA, 17 bp, Homo sapiens
caagaaactttggaagc

SEQ ID NO: 3070020 - DNA, 21 bp, Homo sapiens
caagaaactttggaagcactt

SEQ ID NO: 3070021 - DNA, 13 bp, Homo sapiens
caagaaataaaag

SEQ ID NO: 3070022 - DNA, 15 bp, Homo sapiens
caagaaattctgctg

SEQ ID NO: 3070023 - DNA, 20 bp, Homo sapiens
caagaacacagccctgcttc

SEQ ID NO: 3070024 - DNA, 16 bp, Homo sapiens
caagaactcatcactg

SEQ ID NO: 3070025 - DNA, 19 bp, Homo sapiens
caagaactcatcactgtgg

SEQ ID NO: 3070026 - DNA, 21 bp, Homo sapiens
caagaactcatcactgtggct

SEQ ID NO: 3070027 - DNA, 12 bp, Homo sapiens
caagaagatgaa

SEQ ID NO: 3070028 - DNA, 13 bp, Homo sapiens
caagaagatgaat

SEQ ID NO: 3070029 - DNA, 19 bp, Homo sapiens
caagaagcaattatttaaa

SEQ ID NO: 3070030 - DNA, 23 bp, Homo sapiens
caagaagcaattatttaaagaaa

SEQ ID NO: 3070031 - DNA, 15 bp, Homo sapiens
caagaagcctttcct

SEQ ID NO: 3070032 - DNA, 19 bp, Homo sapiens
caagaaggcaacttgaaga

SEQ ID NO: 3070033 - DNA, 20 bp, Homo sapiens
caagaaggcaacttgaagaa

SEQ ID NO: 3070034 - DNA, 19 bp, Homo sapiens
caagaagtcagagaaaaca

SEQ ID NO: 3070035 - DNA, 16 bp, Homo sapiens
caagaagttaaaaaac

SEQ ID NO: 3070036 - DNA, 20 bp, Homo sapiens
caagaagttaaaaaacagct

SEQ ID NO: 3070037 - DNA, 18 bp, Homo sapiens
caagaatagcatctgtac

SEQ ID NO: 3070038 - DNA, 19 bp, Homo sapiens
caagaatagcatctgtaca

SEQ ID NO: 3070039 - DNA, 22 bp, Homo sapiens
caagaatagcatctgtacaaag

SEQ ID NO: 3070040 - DNA, 21 bp, Homo sapiens
caagaatcggcatgtatactt

SEQ ID NO: 3070041 - DNA, 22 bp, Homo sapiens
caagaatcggcatgtatactta

SEQ ID NO: 3070042 - DNA, 15 bp, Homo sapiens
caagaatgcattgat

SEQ ID NO: 3070043 - DNA, 15 bp, Homo sapiens
caagaatggaagcct

SEQ ID NO: 3070044 - DNA, 11 bp, Homo sapiens
caagaatgtac

SEQ ID NO: 3070045 - DNA, 22 bp, Homo sapiens
caagaatttgatcgttccagtt

SEQ ID NO: 3070046 - DNA, 12 bp, Homo sapiens
caagacagcctt

SEQ ID NO: 3070047 - DNA, 14 bp, Homo sapiens
caagacagccttca

SEQ ID NO: 3070048 - DNA, 12 bp, Homo sapiens
caagaccagact

SEQ ID NO: 3070049 - DNA, 14 bp, Homo sapiens
caagaccatttgta

SEQ ID NO: 3070050 - DNA, 15 bp, Homo sapiens
caagaccatttgtag

SEQ ID NO: 3070051 - DNA, 14 bp, Homo sapiens
caagacccccagca

SEQ ID NO: 3070052 - DNA, 15 bp, Homo sapiens
caagacccccagcac

SEQ ID NO: 3070053 - DNA, 16 bp, Homo sapiens
caagacccccagcact

SEQ ID NO: 3070054 - DNA, 12 bp, Homo sapiens
caagaccctctc

SEQ ID NO: 3070055 - DNA, 22 bp, Homo sapiens
caagaccctctcaggctgtccc

SEQ ID NO: 3070056 - DNA, 24 bp, Homo sapiens
caagacctcagggcacaaagatgg

SEQ ID NO: 3070057 - DNA, 23 bp, Homo sapiens
caagacgggatgattgcttgagc

SEQ ID NO: 3070058 - DNA, 17 bp, Homo sapiens
caagactctagagtcca

SEQ ID NO: 3070059 - DNA, 14 bp, Homo sapiens
caagactgcctccc

SEQ ID NO: 3070060 - DNA, 23 bp, Homo sapiens
caagactgtcttacctggcagca

SEQ ID NO: 3070061 - DNA, 22 bp, Homo sapiens
caagagaaggtggacctggcag

SEQ ID NO: 3070062 - DNA, 12 bp, Homo sapiens
caagagactgag

SEQ ID NO: 3070063 - DNA, 15 bp, Homo sapiens
caagagactgagtca

SEQ ID NO: 3070064 - DNA, 19 bp, Homo sapiens
caagagagaacctaactgt

SEQ ID NO: 3070065 - DNA, 14 bp, Homo sapiens
caagagaggaagga

SEQ ID NO: 3070066 - DNA, 23 bp, Homo sapiens
caagagaggaaggacccctcacc

SEQ ID NO: 3070067 - DNA, 15 bp, Homo sapiens
caagagattgctaat

SEQ ID NO: 3070068 - DNA, 11 bp, Homo sapiens
caagagcctga

SEQ ID NO: 3070069 - DNA, 13 bp, Homo sapiens
caagagcctgaga

SEQ ID NO: 3070070 - DNA, 22 bp, Homo sapiens
caagagccttggtgtccacctg

SEQ ID NO: 3070071 - DNA, 18 bp, Homo sapiens
caagagcgaaactccgtc

SEQ ID NO: 3070072 - DNA, 12 bp, Homo sapiens
caagaggaatga

SEQ ID NO: 3070073 - DNA, 22 bp, Homo sapiens
caagaggccacttagggaaaga

SEQ ID NO: 3070074 - DNA, 14 bp, Homo sapiens
caagaggctgcagc

SEQ ID NO: 3070075 - DNA, 19 bp, Homo sapiens
caagagggacgcctggggg

SEQ ID NO: 3070076 - DNA, 12 bp, Homo sapiens
caagagggctgc

SEQ ID NO: 3070077 - DNA, 18 bp, Homo sapiens
caagagggttcacacagc

SEQ ID NO: 3070078 - DNA, 19 bp, Homo sapiens
caagagtagttatataatt

SEQ ID NO: 3070079 - DNA, 17 bp, Homo sapiens
caagagtccccagactc

SEQ ID NO: 3070080 - DNA, 22 bp, Homo sapiens
caagagtccccagactctgcct

SEQ ID NO: 3070081 - DNA, 17 bp, Homo sapiens
caagagtctctccagcc

SEQ ID NO: 3070082 - DNA, 23 bp, Homo sapiens
caagagtctctccagcctcacag

SEQ ID NO: 3070083 - DNA, 23 bp, Homo sapiens
caagatattttaaaatctgtcac

SEQ ID NO: 3070084 - DNA, 22 bp, Homo sapiens
caagatccaaatgctgtgcaaa

SEQ ID NO: 3070085 - DNA, 18 bp, Homo sapiens
caagatcgcaccactgca

SEQ ID NO: 3070086 - DNA, 18 bp, Homo sapiens
caagatgaaggagaggca

SEQ ID NO: 3070087 - DNA, 23 bp, Homo sapiens
caagatggcgccaccgcactcca

SEQ ID NO: 3070088 - DNA, 19 bp, Homo sapiens
caagatgttgatttttact

SEQ ID NO: 3070089 - DNA, 20 bp, Homo sapiens
caagattagaagctgaaaac

SEQ ID NO: 3070090 - DNA, 15 bp, Homo sapiens
caagattcccagaga

SEQ ID NO: 3070091 - DNA, 23 bp, Homo sapiens
caagattcccagagacaggaaaa

SEQ ID NO: 3070092 - DNA, 18 bp, Homo sapiens
caagattctagatgatta

SEQ ID NO: 3070093 - DNA, 19 bp, Homo sapiens
caagattggaaagacagga

SEQ ID NO: 3070094 - DNA, 22 bp, Homo sapiens
caagattggaaagacaggaaga

SEQ ID NO: 3070095 - DNA, 12 bp, Homo sapiens
caagattttagg

SEQ ID NO: 3070096 - DNA, 14 bp, Homo sapiens
caagattttagggc

SEQ ID NO: 3070097 - DNA, 18 bp, Homo sapiens
caagattttccacaagat

SEQ ID NO: 3070098 - DNA, 17 bp, Homo sapiens
caagattttgaaggaaa

SEQ ID NO: 3070099 - DNA, 23 bp, Homo sapiens
caagattttgggagagtaaagct

SEQ ID NO: 3070100 - DNA, 23 bp, Homo sapiens
caagcaaaatcatggaatggtta

SEQ ID NO: 3070101 - DNA, 17 bp, Homo sapiens
caagcaaacccagacgg

SEQ ID NO: 3070102 - DNA, 14 bp, Homo sapiens
caagcaagactgag

SEQ ID NO: 3070103 - DNA, 19 bp, Homo sapiens
caagcaaggatatcagagc

SEQ ID NO: 3070104 - DNA, 17 bp, Homo sapiens
caagcacagcagcctgg

SEQ ID NO: 3070105 - DNA, 15 bp, Homo sapiens
caagcacagtggtgg

SEQ ID NO: 3070106 - DNA, 16 bp, Homo sapiens
caagcacagtggtggc

SEQ ID NO: 3070107 - DNA, 22 bp, Homo sapiens
caagcagaggaccagggccttt

SEQ ID NO: 3070108 - DNA, 17 bp, Homo sapiens
caagcagatactgctgt

SEQ ID NO: 3070109 - DNA, 23 bp, Homo sapiens
caagcagatactgctgtgtaatg

SEQ ID NO: 3070110 - DNA, 13 bp, Homo sapiens
caagcagcaaaat

SEQ ID NO: 3070111 - DNA, 14 bp, Homo sapiens
cacaaggtataata

SEQ ID NO: 3070112 - DNA, 15 bp, Homo sapiens
cacaaggtcaggagt

SEQ ID NO: 3070113 - DNA, 23 bp, Homo sapiens
cacaaggtcatggccacactgtg

SEQ ID NO: 3070114 - DNA, 12 bp, Homo sapiens
cacaagtgaaaa

SEQ ID NO: 3070115 - DNA, 19 bp, Homo sapiens
cacaagtgccgcaaattgt

SEQ ID NO: 3070116 - DNA, 16 bp, Homo sapiens
cacaagtggcagacat

SEQ ID NO: 3070117 - DNA, 14 bp, Homo sapiens
cacaagtggtggta

SEQ ID NO: 3070118 - DNA, 21 bp, Homo sapiens
cacaataaaaccaagcctctg

SEQ ID NO: 3070119 - DNA, 11 bp, Homo sapiens
cacaataccta

SEQ ID NO: 3070120 - DNA, 15 bp, Homo sapiens
cacaatattgaactt

SEQ ID NO: 3070121 - DNA, 22 bp, Homo sapiens
cacaatctcattgaggagcatt

SEQ ID NO: 3070122 - DNA, 19 bp, Homo sapiens
cacaatctgacattctcag

SEQ ID NO: 3070123 - DNA, 18 bp, Homo sapiens
cacaatgttctttatata

SEQ ID NO: 3070124 - DNA, 19 bp, Homo sapiens
cacaatttctttaaaaaag

SEQ ID NO: 3070125 - DNA, 20 bp, Homo sapiens
cacaatttctttaaaaaaga

SEQ ID NO: 3070126 - DNA, 23 bp, Homo sapiens
cacacaaaagggaacccagctct

SEQ ID NO: 3070127 - DNA, 19 bp, Homo sapiens
cacacaaggatagatgctg

SEQ ID NO: 3070128 - DNA, 19 bp, Homo sapiens
cacacaagggaaggacaga

SEQ ID NO: 3070129 - DNA, 20 bp, Homo sapiens
cacacaagtaagagactcag

SEQ ID NO: 3070130 - DNA, 19 bp, Homo sapiens
cacacacaaaagggaaccc

SEQ ID NO: 3070131 - DNA, 13 bp, Homo sapiens
cacacacaacagc

SEQ ID NO: 3070132 - DNA, 11 bp, Homo sapiens
cacacacacac

SEQ ID NO: 3070133 - DNA, 14 bp, Homo sapiens
cacacacacacaca

SEQ ID NO: 3070134 - DNA, 15 bp, Homo sapiens
cacacacacacacag

SEQ ID NO: 3070135 - DNA, 16 bp, Homo sapiens
cacacacacacacagc

SEQ ID NO: 3070136 - DNA, 16 bp, Homo sapiens
cacacacacacacatg

SEQ ID NO: 3070137 - DNA, 15 bp, Homo sapiens
cacacacacacagcc

SEQ ID NO: 3070138 - DNA, 16 bp, Homo sapiens
cacacacacacatgca

SEQ ID NO: 3070139 - DNA, 12 bp, Homo sapiens
cacacacacaga

SEQ ID NO: 3070140 - DNA, 13 bp, Homo sapiens
cacacacacagaa

SEQ ID NO: 3070141 - DNA, 15 bp, Homo sapiens
cacacacacagaaaa

SEQ ID NO: 3070142 - DNA, 12 bp, Homo sapiens
cacacacacagc

SEQ ID NO: 3070143 - DNA, 13 bp, Homo sapiens
cacacacacagcc

SEQ ID NO: 3070144 - DNA, 15 bp, Homo sapiens
cacacacacagccac

SEQ ID NO: 3070145 - DNA, 15 bp, Homo sapiens
cacacacacatgcat

SEQ ID NO: 3070146 - DNA, 14 bp, Homo sapiens
cacacacagaaaat

SEQ ID NO: 3070147 - DNA, 15 bp, Homo sapiens
cacacacagccacac

SEQ ID NO: 3070148 - DNA, 16 bp, Homo sapiens
cacacacagccacaca

SEQ ID NO: 3070149 - DNA, 16 bp, Homo sapiens
cacacacatgcataca

SEQ ID NO: 3070150 - DNA, 15 bp, Homo sapiens
cacacaccagtttac

SEQ ID NO: 3070151 - DNA, 16 bp, Homo sapiens
cacacactttctcttc

SEQ ID NO: 3070152 - DNA, 12 bp, Homo sapiens
cacacagaaaat

SEQ ID NO: 3070153 - DNA, 19 bp, Homo sapiens
cacacagaaaatatactgt

SEQ ID NO: 3070154 - DNA, 12 bp, Homo sapiens
cacacagccaca

SEQ ID NO: 3070155 - DNA, 15 bp, Homo sapiens
cacacagccacacac

SEQ ID NO: 3070156 - DNA, 16 bp, Homo sapiens
cacacagccacacaca

SEQ ID NO: 3070157 - DNA, 17 bp, Homo sapiens
cacacagccacacacac

SEQ ID NO: 3070158 - DNA, 13 bp, Homo sapiens
cacacagcccagt

SEQ ID NO: 3070159 - DNA, 15 bp, Homo sapiens
cacacagcccagttc

SEQ ID NO: 3070160 - DNA, 19 bp, Homo sapiens
cacacaggggccacccggg

SEQ ID NO: 3070161 - DNA, 14 bp, Homo sapiens
cacacaggtgttga

SEQ ID NO: 3070162 - DNA, 20 bp, Homo sapiens
cacacatatatattacaagg

SEQ ID NO: 3070163 - DNA, 13 bp, Homo sapiens
cacacatcaggag

SEQ ID NO: 3070164 - DNA, 14 bp, Homo sapiens
cacacatcccagcc

SEQ ID NO: 3070165 - DNA, 22 bp, Homo sapiens
cacacatctgggtgccctgaaa

SEQ ID NO: 3070166 - DNA, 14 bp, Homo sapiens
cacacatgcataca

SEQ ID NO: 3070167 - DNA, 16 bp, Homo sapiens
cacacatgcatacaca

SEQ ID NO: 3070168 - DNA, 22 bp, Homo sapiens
cacacatggaaacccataggcc

SEQ ID NO: 3070169 - DNA, 18 bp, Homo sapiens
cacaccaagcagcaacag

SEQ ID NO: 3070170 - DNA, 23 bp, Homo sapiens
cacacccgacaccagccctgctg

SEQ ID NO: 3070171 - DNA, 13 bp, Homo sapiens
cacaccctacctt

SEQ ID NO: 3070172 - DNA, 15 bp, Homo sapiens
cacaccctaccttcc

SEQ ID NO: 3070173 - DNA, 14 bp, Homo sapiens
cacaccctgcctgc

SEQ ID NO: 3070174 - DNA, 15 bp, Homo sapiens
cacaccctgcctgct

SEQ ID NO: 3070175 - DNA, 16 bp, Homo sapiens
cacaccctgcctgctg

SEQ ID NO: 3070176 - DNA, 22 bp, Homo sapiens
cacaccgccagcagcgcgcagg

SEQ ID NO: 3070177 - DNA, 23 bp, Homo sapiens
cacacctaagggacatgttttga

SEQ ID NO: 3070178 - DNA, 12 bp, Homo sapiens
cacacctctggc

SEQ ID NO: 3070179 - DNA, 13 bp, Homo sapiens
cacacctctggct

SEQ ID NO: 3070180 - DNA, 13 bp, Homo sapiens
cacacctgcctgc

SEQ ID NO: 3070181 - DNA, 18 bp, Homo sapiens
cacacctggtctgttttc

SEQ ID NO: 3070182 - DNA, 20 bp, Homo sapiens
cacacctgtaatcccagcac

SEQ ID NO: 3070183 - DNA, 22 bp, Homo sapiens
cacacctgtaatcccagcactt

SEQ ID NO: 3070184 - DNA, 22 bp, Homo sapiens
cacaccttttattgacacagaa

SEQ ID NO: 3070185 - DNA, 23 bp, Homo sapiens
cacacgcaggcctccctgcctca

SEQ ID NO: 3070186 - DNA, 14 bp, Homo sapiens
cacacgcaggcggc

SEQ ID NO: 3070187 - DNA, 19 bp, Homo sapiens
cacacgtaatgaaacttgg

SEQ ID NO: 3070188 - DNA, 18 bp, Homo sapiens
cacacgtttaatcccagc

SEQ ID NO: 3070189 - DNA, 21 bp, Homo sapiens
cacacgtttaatcccagcact

SEQ ID NO: 3070190 - DNA, 23 bp, Homo sapiens
cacacgtttaatcccagcacttt

SEQ ID NO: 3070191 - DNA, 21 bp, Homo sapiens
cacactaaacatatgaatgca

SEQ ID NO: 3070192 - DNA, 18 bp, Homo sapiens
cacactacaccacacaca

SEQ ID NO: 3070193 - DNA, 14 bp, Homo sapiens
cacactcatcccct

SEQ ID NO: 3070194 - DNA, 16 bp, Homo sapiens
cacactccaagatatg

SEQ ID NO: 3070195 - DNA, 17 bp, Homo sapiens
cacactccatcagctta

SEQ ID NO: 3070196 - DNA, 13 bp, Homo sapiens
cacactcctcctg

SEQ ID NO: 3070197 - DNA, 15 bp, Homo sapiens
cacactcctcctgcc

SEQ ID NO: 3070198 - DNA, 19 bp, Homo sapiens
cacactcctcctgccagct

SEQ ID NO: 3070199 - DNA, 13 bp, Homo sapiens
cacactccttccc

SEQ ID NO: 3070200 - DNA, 14 bp, Homo sapiens
cacactccttcccc

SEQ ID NO: 3070201 - DNA, 23 bp, Homo sapiens
cacactgaccaagtgctggccca

SEQ ID NO: 3070202 - DNA, 16 bp, Homo sapiens
cacactgaggcaggga

SEQ ID NO: 3070203 - DNA, 21 bp, Homo sapiens
cacactgcaagagccttggtg

SEQ ID NO: 3070204 - DNA, 22 bp, Homo sapiens
cacactgggtggtggcctggtc

SEQ ID NO: 3070205 - DNA, 19 bp, Homo sapiens
cacactggttctcaatgaa

SEQ ID NO: 3070206 - DNA, 15 bp, Homo sapiens
cacacttgtgccagc

SEQ ID NO: 3070207 - DNA, 13 bp, Homo sapiens
cacagaaaaagca

SEQ ID NO: 3070208 - DNA, 18 bp, Homo sapiens
cacagaaaatatactgta

SEQ ID NO: 3070209 - DNA, 15 bp, Homo sapiens
cacagaaacactgcc

SEQ ID NO: 3070210 - DNA, 16 bp, Homo sapiens
cacagaagcacatgca

SEQ ID NO: 3070211 - DNA, 23 bp, Homo sapiens
cacagaagcctaggaggactggg

SEQ ID NO: 3070212 - DNA, 20 bp, Homo sapiens
cacagaaggtgaactttgtg

SEQ ID NO: 3070213 - DNA, 12 bp, Homo sapiens
cacagaagtcct

SEQ ID NO: 3070214 - DNA, 14 bp, Homo sapiens
cacagaagtcctgt

SEQ ID NO: 3070215 - DNA, 21 bp, Homo sapiens
cacagacaggttttcacataa

SEQ ID NO: 3070216 - DNA, 22 bp, Homo sapiens
cacagacaggttttcacataaa

SEQ ID NO: 3070217 - DNA, 18 bp, Homo sapiens
cacagacattctgccagg

SEQ ID NO: 3070218 - DNA, 20 bp, Homo sapiens
cacagacattctgccaggcc

SEQ ID NO: 3070219 - DNA, 20 bp, Homo sapiens
cacagactcttccaccagag

SEQ ID NO: 3070220 - DNA, 15 bp, Homo sapiens
cacagagaagacaaa

SEQ ID NO: 3070221 - DNA, 14 bp, Homo sapiens
cacagagacccccg

SEQ ID NO: 3070222 - DNA, 22 bp, Homo sapiens
cacagagacccccggaacaagc

SEQ ID NO: 3070223 - DNA, 23 bp, Homo sapiens
cacagagacccccggaacaagcc

SEQ ID NO: 3070224 - DNA, 14 bp, Homo sapiens
cacagagcacgcct

SEQ ID NO: 3070225 - DNA, 22 bp, Homo sapiens
cacagagctttggtctgtgtgt

SEQ ID NO: 3070226 - DNA, 18 bp, Homo sapiens
cacagagggcgctcctgt

SEQ ID NO: 3070227 - DNA, 15 bp, Homo sapiens
cacagagtaagacat

SEQ ID NO: 3070228 - DNA, 16 bp, Homo sapiens
cacagagtaagacatt

SEQ ID NO: 3070229 - DNA, 12 bp, Homo sapiens
cacagagtgaga

SEQ ID NO: 3070230 - DNA, 15 bp, Homo sapiens
cacagagtgtagcca

SEQ ID NO: 3070231 - DNA, 23 bp, Homo sapiens
cacagagtgtgtttttgcactgt

SEQ ID NO: 3070232 - DNA, 20 bp, Homo sapiens
cacagagttttttaaacaaa

SEQ ID NO: 3070233 - DNA, 14 bp, Homo sapiens
cacagatgctggcc

SEQ ID NO: 3070234 - DNA, 19 bp, Homo sapiens
cacagatgttcccccatct

SEQ ID NO: 3070235 - DNA, 14 bp, Homo sapiens
cacagattcccagg

SEQ ID NO: 3070236 - DNA, 16 bp, Homo sapiens
cacagattcccaggcc

SEQ ID NO: 3070237 - DNA, 18 bp, Homo sapiens
cacagattcccaggccag

SEQ ID NO: 3070238 - DNA, 20 bp, Homo sapiens
cacagattgtttctatacaa

SEQ ID NO: 3070239 - DNA, 17 bp, Homo sapiens
cacagcaaactgtcccc

SEQ ID NO: 3070240 - DNA, 17 bp, Homo sapiens
cacagcaaccccaggct

SEQ ID NO: 3070241 - DNA, 18 bp, Homo sapiens
cacagcaaccccaggctg

SEQ ID NO: 3070242 - DNA, 10 bp, Homo sapiens
cacagccaca

SEQ ID NO: 3070243 - DNA, 15 bp, Homo sapiens
cacagccacacacac

SEQ ID NO: 3070244 - DNA, 13 bp, Homo sapiens
cactgaaaggaaa

SEQ ID NO: 3070245 - DNA, 16 bp, Homo sapiens
cactgaaatgtttgga

SEQ ID NO: 3070246 - DNA, 17 bp, Homo sapiens
cactgaaattgcctgaa

SEQ ID NO: 3070247 - DNA, 18 bp, Homo sapiens
cactgaaattgcctgaaa

SEQ ID NO: 3070248 - DNA, 17 bp, Homo sapiens
cactgaactccttcccc

SEQ ID NO: 3070249 - DNA, 11 bp, Homo sapiens
cactgaagacg

SEQ ID NO: 3070250 - DNA, 11 bp, Homo sapiens
cactgaagccc

SEQ ID NO: 3070251 - DNA, 15 bp, Homo sapiens
cactgaagcccagac

SEQ ID NO: 3070252 - DNA, 13 bp, Homo sapiens
cactgaagtgctt

SEQ ID NO: 3070253 - DNA, 19 bp, Homo sapiens
cactgaagtttttgaaata

SEQ ID NO: 3070254 - DNA, 22 bp, Homo sapiens
cactgaagtttttgaaatacct

SEQ ID NO: 3070255 - DNA, 23 bp, Homo sapiens
cactgaatttcaaacatttgtca

SEQ ID NO: 3070256 - DNA, 14 bp, Homo sapiens
cactgaattttgga

SEQ ID NO: 3070257 - DNA, 14 bp, Homo sapiens
cactgaccagaact

SEQ ID NO: 3070258 - DNA, 17 bp, Homo sapiens
cactgaccccccccatt

SEQ ID NO: 3070259 - DNA, 21 bp, Homo sapiens
cactgagcatcactagtgaca

SEQ ID NO: 3070260 - DNA, 22 bp, Homo sapiens
cactgagcatcactagtgacaa

SEQ ID NO: 3070261 - DNA, 15 bp, Homo sapiens
cactgagctctgcct

SEQ ID NO: 3070262 - DNA, 13 bp, Homo sapiens
cactgaggcaggg

SEQ ID NO: 3070263 - DNA, 16 bp, Homo sapiens
cactgaggcagggaag

SEQ ID NO: 3070264 - DNA, 19 bp, Homo sapiens
cactgaggcagggaagtcc

SEQ ID NO: 3070265 - DNA, 15 bp, Homo sapiens
cactgagtgaaggaa

SEQ ID NO: 3070266 - DNA, 13 bp, Homo sapiens
cactgagtttcta

SEQ ID NO: 3070267 - DNA, 21 bp, Homo sapiens
cactgagttttccatggcagg

SEQ ID NO: 3070268 - DNA, 17 bp, Homo sapiens
cactgatgctgcccctc

SEQ ID NO: 3070269 - DNA, 20 bp, Homo sapiens
cactgcaaaccgccacctcc

SEQ ID NO: 3070270 - DNA, 14 bp, Homo sapiens
cactgcaacctccg

SEQ ID NO: 3070271 - DNA, 13 bp, Homo sapiens
cactgcaagagcc

SEQ ID NO: 3070272 - DNA, 18 bp, Homo sapiens
cactgcaagagccttggt

SEQ ID NO: 3070273 - DNA, 12 bp, Homo sapiens
cactgcaagtcc

SEQ ID NO: 3070274 - DNA, 19 bp, Homo sapiens
cactgcaagtccttttgta

SEQ ID NO: 3070275 - DNA, 22 bp, Homo sapiens
cactgcaagtccttttgtaaag

SEQ ID NO: 3070276 - DNA, 12 bp, Homo sapiens
cactgcactcca

SEQ ID NO: 3070277 - DNA, 15 bp, Homo sapiens
cactgcactccagcc

SEQ ID NO: 3070278 - DNA, 19 bp, Homo sapiens
cactgcactccagcctggg

SEQ ID NO: 3070279 - DNA, 15 bp, Homo sapiens
cactgcactccaggc

SEQ ID NO: 3070280 - DNA, 20 bp, Homo sapiens
cactgcaggtgagaaccccg

SEQ ID NO: 3070281 - DNA, 19 bp, Homo sapiens
cactgccagagataaacta

SEQ ID NO: 3070282 - DNA, 21 bp, Homo sapiens
cactgccaggggttcttgagc

SEQ ID NO: 3070283 - DNA, 16 bp, Homo sapiens
cactgccatcttagtt

SEQ ID NO: 3070284 - DNA, 22 bp, Homo sapiens
cactgccatgcaccaggactgg

SEQ ID NO: 3070285 - DNA, 19 bp, Homo sapiens
cactgccattacccagtgc

SEQ ID NO: 3070286 - DNA, 18 bp, Homo sapiens
cactgcccatggacaggc

SEQ ID NO: 3070287 - DNA, 11 bp, Homo sapiens
cactgcctcct

SEQ ID NO: 3070288 - DNA, 19 bp, Homo sapiens
cactgcctcctacaaccag

SEQ ID NO: 3070289 - DNA, 21 bp, Homo sapiens
cactgcctcctccctggctgc

SEQ ID NO: 3070290 - DNA, 22 bp, Homo sapiens
cactgcctcctccctggctgca

SEQ ID NO: 3070291 - DNA, 12 bp, Homo sapiens
cactgcctgggc

SEQ ID NO: 3070292 - DNA, 15 bp, Homo sapiens
cactgctacacttct

SEQ ID NO: 3070293 - DNA, 13 bp, Homo sapiens
cactgctgcagta

SEQ ID NO: 3070294 - DNA, 18 bp, Homo sapiens
cactgctgctactgcccc

SEQ ID NO: 3070295 - DNA, 15 bp, Homo sapiens
cactgctgctcctct

SEQ ID NO: 3070296 - DNA, 22 bp, Homo sapiens
cactgctgctcctctttcccct

SEQ ID NO: 3070297 - DNA, 22 bp, Homo sapiens
cactgctggctgcagcggcagg

SEQ ID NO: 3070298 - DNA, 16 bp, Homo sapiens
cactgcttctcggcca

SEQ ID NO: 3070299 - DNA, 18 bp, Homo sapiens
cactgcttctcggccagc

SEQ ID NO: 3070300 - DNA, 13 bp, Homo sapiens
cactgcttgagga

SEQ ID NO: 3070301 - DNA, 17 bp, Homo sapiens
cactgcttttggcctgg

SEQ ID NO: 3070302 - DNA, 12 bp, Homo sapiens
cactggaaggag

SEQ ID NO: 3070303 - DNA, 23 bp, Homo sapiens
cactggaaggagcacatactacc

SEQ ID NO: 3070304 - DNA, 17 bp, Homo sapiens
cactggaccaggtcctg

SEQ ID NO: 3070305 - DNA, 17 bp, Homo sapiens
cactggactgacctggt

SEQ ID NO: 3070306 - DNA, 17 bp, Homo sapiens
cactggagcaccaggca

SEQ ID NO: 3070307 - DNA, 15 bp, Homo sapiens
cactggagccacagg

SEQ ID NO: 3070308 - DNA, 16 bp, Homo sapiens
cactggaggagagaag

SEQ ID NO: 3070309 - DNA, 19 bp, Homo sapiens
cactggaggagagaagaat

SEQ ID NO: 3070310 - DNA, 22 bp, Homo sapiens
cactggagtcttgcaagaccca

SEQ ID NO: 3070311 - DNA, 20 bp, Homo sapiens
cactggagtggctcgccagg

SEQ ID NO: 3070312 - DNA, 20 bp, Homo sapiens
cactggatcccatcaaagaa

SEQ ID NO: 3070313 - DNA, 19 bp, Homo sapiens
cactggattggtcatttag

SEQ ID NO: 3070314 - DNA, 19 bp, Homo sapiens
cactggcagcctgcacctg

SEQ ID NO: 3070315 - DNA, 15 bp, Homo sapiens
cactggcgccttctc

SEQ ID NO: 3070316 - DNA, 15 bp, Homo sapiens
cactggctcatgccc

SEQ ID NO: 3070317 - DNA, 16 bp, Homo sapiens
cactggctcatgcccc

SEQ ID NO: 3070318 - DNA, 18 bp, Homo sapiens
cactgggaaacagaggct

SEQ ID NO: 3070319 - DNA, 21 bp, Homo sapiens
cactgggaggccagtgagcca

SEQ ID NO: 3070320 - DNA, 14 bp, Homo sapiens
cactgggcacctgc

SEQ ID NO: 3070321 - DNA, 15 bp, Homo sapiens
cactgggcacctgcg

SEQ ID NO: 3070322 - DNA, 15 bp, Homo sapiens
cactgggcccctcag

SEQ ID NO: 3070323 - DNA, 21 bp, Homo sapiens
cactggggaaataacagctgt

SEQ ID NO: 3070324 - DNA, 14 bp, Homo sapiens
cactggggcctaca

SEQ ID NO: 3070325 - DNA, 16 bp, Homo sapiens
cactggggcctacagc

SEQ ID NO: 3070326 - DNA, 15 bp, Homo sapiens
cactgggtggtggcc

SEQ ID NO: 3070327 - DNA, 20 bp, Homo sapiens
cactgggtggtggcctggtc

SEQ ID NO: 3070328 - DNA, 17 bp, Homo sapiens
cactggtaacatgtgac

SEQ ID NO: 3070329 - DNA, 18 bp, Homo sapiens
cactggtgtatctcagaa

SEQ ID NO: 3070330 - DNA, 12 bp, Homo sapiens
cactggttctca

SEQ ID NO: 3070331 - DNA, 14 bp, Homo sapiens
cactggtttgaaga

SEQ ID NO: 3070332 - DNA, 15 bp, Homo sapiens
cactggttttactta

SEQ ID NO: 3070333 - DNA, 22 bp, Homo sapiens
cactggttttacttacaaaaat

SEQ ID NO: 3070334 - DNA, 20 bp, Homo sapiens
cactgtacaaggtacccctt

SEQ ID NO: 3070335 - DNA, 16 bp, Homo sapiens
cactgtacagttttgt

SEQ ID NO: 3070336 - DNA, 19 bp, Homo sapiens
cactgtagccttagtgtca

SEQ ID NO: 3070337 - DNA, 15 bp, Homo sapiens
cactgtagttctaag

SEQ ID NO: 3070338 - DNA, 15 bp, Homo sapiens
cactgtatgatttat

SEQ ID NO: 3070339 - DNA, 22 bp, Homo sapiens
cactgtatgatttataaacaga

SEQ ID NO: 3070340 - DNA, 17 bp, Homo sapiens
cactgtcctccaagcca

SEQ ID NO: 3070341 - DNA, 22 bp, Homo sapiens
cactgtcctccacacaagggaa

SEQ ID NO: 3070342 - DNA, 18 bp, Homo sapiens
cactgtcctgggcctgca

SEQ ID NO: 3070343 - DNA, 10 bp, Homo sapiens
cactgtctga

SEQ ID NO: 3070344 - DNA, 23 bp, Homo sapiens
cactgtctgagagtttagttgta

SEQ ID NO: 3070345 - DNA, 11 bp, Homo sapiens
cactgtctgta

SEQ ID NO: 3070346 - DNA, 16 bp, Homo sapiens
cactgtcttttaaaaa

SEQ ID NO: 3070347 - DNA, 17 bp, Homo sapiens
cactgtcttttaaaaaa

SEQ ID NO: 3070348 - DNA, 14 bp, Homo sapiens
cactgtctttttct

SEQ ID NO: 3070349 - DNA, 19 bp, Homo sapiens
cactgtgaatcctggcaag

SEQ ID NO: 3070350 - DNA, 12 bp, Homo sapiens
cactgtgacaca

SEQ ID NO: 3070351 - DNA, 13 bp, Homo sapiens
cactgtgacacac

SEQ ID NO: 3070352 - DNA, 16 bp, Homo sapiens
cactgtgacacactac

SEQ ID NO: 3070353 - DNA, 16 bp, Homo sapiens
cactgtgagctcccag

SEQ ID NO: 3070354 - DNA, 17 bp, Homo sapiens
cactgtgagctcccagg

SEQ ID NO: 3070355 - DNA, 15 bp, Homo sapiens
cactgtgatgttggg

SEQ ID NO: 3070356 - DNA, 16 bp, Homo sapiens
cactgtgatgttggga

SEQ ID NO: 3070357 - DNA, 22 bp, Homo sapiens
cactgtgcacatctgtgtcttg

SEQ ID NO: 3070358 - DNA, 12 bp, Homo sapiens
cactgtgctcca

SEQ ID NO: 3070359 - DNA, 19 bp, Homo sapiens
cactgtggaagtccctcag

SEQ ID NO: 3070360 - DNA, 20 bp, Homo sapiens
cactgtggaagtccctcaga

SEQ ID NO: 3070361 - DNA, 20 bp, Homo sapiens
cactgtgggaaggccagctg

SEQ ID NO: 3070362 - DNA, 12 bp, Homo sapiens
cactgtgggtgt

SEQ ID NO: 3070363 - DNA, 16 bp, Homo sapiens
cactgtgggtgtgtga

SEQ ID NO: 3070364 - DNA, 18 bp, Homo sapiens
cactgtggtaaatgccac

SEQ ID NO: 3070365 - DNA, 17 bp, Homo sapiens
cactgtgtttctgtgct

SEQ ID NO: 3070366 - DNA, 19 bp, Homo sapiens
cactgttcatgctggcgag

SEQ ID NO: 3070367 - DNA, 21 bp, Homo sapiens
cactgttgcagtggcctggcc

SEQ ID NO: 3070368 - DNA, 23 bp, Homo sapiens
cactgttgcagtggcctggccgt

SEQ ID NO: 3070369 - DNA, 16 bp, Homo sapiens
cactgtttttccatag

SEQ ID NO: 3070370 - DNA, 16 bp, Homo sapiens
cacttaaacagaagca

SEQ ID NO: 3070371 - DNA, 16 bp, Homo sapiens
cacttaaattatgata

SEQ ID NO: 3070372 - DNA, 13 bp, Homo sapiens
cacttaacagatg

SEQ ID NO: 3070373 - DNA, 17 bp, Homo sapiens
cacttaaggcactctgt

SEQ ID NO: 3070374 - DNA, 21 bp, Homo sapiens
cacttaccgccctgcgggcca

SEQ ID NO: 3070375 - DNA, 15 bp, Homo sapiens
cacttaggctttgta

SEQ ID NO: 3070376 - DNA, 15 bp, Homo sapiens
cacttatctgatact

SEQ ID NO: 3070377 - DNA, 11 bp, Homo sapiens
cagccaaagtc

SEQ ID NO: 3070378 - DNA, 20 bp, Homo sapiens
cagccaacacgcacctgcct

SEQ ID NO: 3070379 - DNA, 22 bp, Homo sapiens
cagccaacacgcacctgcctca

SEQ ID NO: 3070380 - DNA, 19 bp, Homo sapiens
cagccaacagctacaacag

SEQ ID NO: 3070381 - DNA, 23 bp, Homo sapiens
cagccaacagctacaacagcctc

SEQ ID NO: 3070382 - DNA, 22 bp, Homo sapiens
cagccaacattgccttgcattt

SEQ ID NO: 3070383 - DNA, 18 bp, Homo sapiens
cagccaactagcccctgg

SEQ ID NO: 3070384 - DNA, 13 bp, Homo sapiens
cagccaagcacag

SEQ ID NO: 3070385 - DNA, 14 bp, Homo sapiens
cagccaatctggac

SEQ ID NO: 3070386 - DNA, 18 bp, Homo sapiens
cagccaatttgtctccta

SEQ ID NO: 3070387 - DNA, 9 bp, Homo sapiens
cagccacac

SEQ ID NO: 3070388 - DNA, 12 bp, Homo sapiens
cagccacacaca

SEQ ID NO: 3070389 - DNA, 13 bp, Homo sapiens
cagccacacacac

SEQ ID NO: 3070390 - DNA, 17 bp, Homo sapiens
cagccacacacacagaa

SEQ ID NO: 3070391 - DNA, 19 bp, Homo sapiens
cagccacacacacagaaaa

SEQ ID NO: 3070392 - DNA, 16 bp, Homo sapiens
cagccacacgcaggcg

SEQ ID NO: 3070393 - DNA, 17 bp, Homo sapiens
cagccacacgcaggcgg

SEQ ID NO: 3070394 - DNA, 15 bp, Homo sapiens
cagccacatgcccca

SEQ ID NO: 3070395 - DNA, 18 bp, Homo sapiens
cagccacatgccccaggc

SEQ ID NO: 3070396 - DNA, 13 bp, Homo sapiens
cagccacccctca

SEQ ID NO: 3070397 - DNA, 13 bp, Homo sapiens
cagccacccctgc

SEQ ID NO: 3070398 - DNA, 14 bp, Homo sapiens
cagccacccctgcc

SEQ ID NO: 3070399 - DNA, 16 bp, Homo sapiens
cagccacccctgccac

SEQ ID NO: 3070400 - DNA, 12 bp, Homo sapiens
cagccacctccc

SEQ ID NO: 3070401 - DNA, 21 bp, Homo sapiens
cagccactccaagccccctgg

SEQ ID NO: 3070402 - DNA, 21 bp, Homo sapiens
cagccactcccctccactctc

SEQ ID NO: 3070403 - DNA, 22 bp, Homo sapiens
cagccagaacgtggctctgctg

SEQ ID NO: 3070404 - DNA, 23 bp, Homo sapiens
cagccagaacgtggctctgctgg

SEQ ID NO: 3070405 - DNA, 14 bp, Homo sapiens
cagccagccacccc

SEQ ID NO: 3070406 - DNA, 19 bp, Homo sapiens
cagccagccacccctgcca

SEQ ID NO: 3070407 - DNA, 16 bp, Homo sapiens
cagccagccactctac

SEQ ID NO: 3070408 - DNA, 11 bp, Homo sapiens
cagccagccca

SEQ ID NO: 3070409 - DNA, 13 bp, Homo sapiens
cagccagcccagc

SEQ ID NO: 3070410 - DNA, 20 bp, Homo sapiens
cagccagcccagcccagctg

SEQ ID NO: 3070411 - DNA, 15 bp, Homo sapiens
cagccagctgcccta

SEQ ID NO: 3070412 - DNA, 18 bp, Homo sapiens
cagccaggagctgtcacc

SEQ ID NO: 3070413 - DNA, 12 bp, Homo sapiens
cagccaggaggg

SEQ ID NO: 3070414 - DNA, 15 bp, Homo sapiens
cagccaggccctgcc

SEQ ID NO: 3070415 - DNA, 12 bp, Homo sapiens
cagccaggcctc

SEQ ID NO: 3070416 - DNA, 18 bp, Homo sapiens
cagccaggcctcgcctgc

SEQ ID NO: 3070417 - DNA, 19 bp, Homo sapiens
cagccagtgacctgaggaa

SEQ ID NO: 3070418 - DNA, 20 bp, Homo sapiens
cagccagtgacctgaggaag

SEQ ID NO: 3070419 - DNA, 22 bp, Homo sapiens
cagccagtgacctgaggaagcg

SEQ ID NO: 3070420 - DNA, 16 bp, Homo sapiens
cagccataggtgcagt

SEQ ID NO: 3070421 - DNA, 15 bp, Homo sapiens
cagccatccgcagac

SEQ ID NO: 3070422 - DNA, 23 bp, Homo sapiens
cagccatgcgcgcgctctctctc

SEQ ID NO: 3070423 - DNA, 14 bp, Homo sapiens
cagccatgtacaga

SEQ ID NO: 3070424 - DNA, 20 bp, Homo sapiens
cagccattacccagctaaat

SEQ ID NO: 3070425 - DNA, 17 bp, Homo sapiens
cagccattctaactcat

SEQ ID NO: 3070426 - DNA, 22 bp, Homo sapiens
cagccattggctatttaaaact

SEQ ID NO: 3070427 - DNA, 15 bp, Homo sapiens
cagcccaaaccttgg

SEQ ID NO: 3070428 - DNA, 14 bp, Homo sapiens
cagcccacagagcc

SEQ ID NO: 3070429 - DNA, 16 bp, Homo sapiens
cagcccacagagcctg

SEQ ID NO: 3070430 - DNA, 13 bp, Homo sapiens
cagcccaccagga

SEQ ID NO: 3070431 - DNA, 14 bp, Homo sapiens
cagcccaccaggag

SEQ ID NO: 3070432 - DNA, 16 bp, Homo sapiens
cagcccaccaggagca

SEQ ID NO: 3070433 - DNA, 13 bp, Homo sapiens
cagcccaccctgc

SEQ ID NO: 3070434 - DNA, 11 bp, Homo sapiens
cagcccagaga

SEQ ID NO: 3070435 - DNA, 13 bp, Homo sapiens
cagcccagagaca

SEQ ID NO: 3070436 - DNA, 22 bp, Homo sapiens
cagcccagagacatacttgaag

SEQ ID NO: 3070437 - DNA, 15 bp, Homo sapiens
cagcccagcccagct

SEQ ID NO: 3070438 - DNA, 13 bp, Homo sapiens
cagcccaggcctc

SEQ ID NO: 3070439 - DNA, 20 bp, Homo sapiens
cagcccaggcctccagctca

SEQ ID NO: 3070440 - DNA, 19 bp, Homo sapiens
cagcccatccatagtaact

SEQ ID NO: 3070441 - DNA, 20 bp, Homo sapiens
cagcccatttctccagaacc

SEQ ID NO: 3070442 - DNA, 22 bp, Homo sapiens
cagccccatcgccccaactcca

SEQ ID NO: 3070443 - DNA, 13 bp, Homo sapiens
cagccccatctgt

SEQ ID NO: 3070444 - DNA, 17 bp, Homo sapiens
cagccccatctgtgcat

SEQ ID NO: 3070445 - DNA, 19 bp, Homo sapiens
cagcccccgcgccctccct

SEQ ID NO: 3070446 - DNA, 21 bp, Homo sapiens
cagcccccgcgccctccctcc

SEQ ID NO: 3070447 - DNA, 20 bp, Homo sapiens
cagcccccgggacaccgtgg

SEQ ID NO: 3070448 - DNA, 17 bp, Homo sapiens
cagcccctacccctgcc

SEQ ID NO: 3070449 - DNA, 19 bp, Homo sapiens
cagcccctacccctgccct

SEQ ID NO: 3070450 - DNA, 20 bp, Homo sapiens
cagcccctacccctgccctg

SEQ ID NO: 3070451 - DNA, 21 bp, Homo sapiens
cagcccctacccctgccctgc

SEQ ID NO: 3070452 - DNA, 12 bp, Homo sapiens
cagcccctcctc

SEQ ID NO: 3070453 - DNA, 19 bp, Homo sapiens
cagcccctcctctgccacc

SEQ ID NO: 3070454 - DNA, 22 bp, Homo sapiens
cagcccctcctctgccacctcc

SEQ ID NO: 3070455 - DNA, 13 bp, Homo sapiens
cagcccctgcaga

SEQ ID NO: 3070456 - DNA, 13 bp, Homo sapiens
cagcccctgctgg

SEQ ID NO: 3070457 - DNA, 23 bp, Homo sapiens
cagcccctgctggctggtgcctg

SEQ ID NO: 3070458 - DNA, 18 bp, Homo sapiens
cagcccctgctgtgtggg

SEQ ID NO: 3070459 - DNA, 13 bp, Homo sapiens
cagcccctggccc

SEQ ID NO: 3070460 - DNA, 14 bp, Homo sapiens
cagcccgcacacct

SEQ ID NO: 3070461 - DNA, 13 bp, Homo sapiens
cagcccgcggcct

SEQ ID NO: 3070462 - DNA, 14 bp, Homo sapiens
cagcccgcggcctg

SEQ ID NO: 3070463 - DNA, 16 bp, Homo sapiens
cagcccgcggcctgga

SEQ ID NO: 3070464 - DNA, 17 bp, Homo sapiens
cagcccgcggcctggac

SEQ ID NO: 3070465 - DNA, 22 bp, Homo sapiens
cagcccggacctctggagtgcc

SEQ ID NO: 3070466 - DNA, 17 bp, Homo sapiens
cagcccggccgctccac

SEQ ID NO: 3070467 - DNA, 19 bp, Homo sapiens
cagcccggctcggcccagc

SEQ ID NO: 3070468 - DNA, 22 bp, Homo sapiens
cagccctagtatgaaagctggg

SEQ ID NO: 3070469 - DNA, 23 bp, Homo sapiens
cagccctagtatgaaagctgggg

SEQ ID NO: 3070470 - DNA, 21 bp, Homo sapiens
cagccctccccatggagccag

SEQ ID NO: 3070471 - DNA, 13 bp, Homo sapiens
cagccctccctgt

SEQ ID NO: 3070472 - DNA, 14 bp, Homo sapiens
cagccctccctgtc

SEQ ID NO: 3070473 - DNA, 16 bp, Homo sapiens
cagccctccctgtcct

SEQ ID NO: 3070474 - DNA, 18 bp, Homo sapiens
cagccctccctgtcctcc

SEQ ID NO: 3070475 - DNA, 13 bp, Homo sapiens
cagccctgaccct

SEQ ID NO: 3070476 - DNA, 19 bp, Homo sapiens
cagccctgagttcctagcc

SEQ ID NO: 3070477 - DNA, 21 bp, Homo sapiens
cagccctgagttcctagccac

SEQ ID NO: 3070478 - DNA, 21 bp, Homo sapiens
cagccctgattgtgccagtgc

SEQ ID NO: 3070479 - DNA, 22 bp, Homo sapiens
cagccctgattgtgccagtgca

SEQ ID NO: 3070480 - DNA, 20 bp, Homo sapiens
cagccctgggccccaccacc

SEQ ID NO: 3070481 - DNA, 21 bp, Homo sapiens
cagccctgggccccaccacct

SEQ ID NO: 3070482 - DNA, 16 bp, Homo sapiens
cagccctgtcttccta

SEQ ID NO: 3070483 - DNA, 19 bp, Homo sapiens
cagccgattcacctgagca

SEQ ID NO: 3070484 - DNA, 17 bp, Homo sapiens
cagccgcaggaaggcag

SEQ ID NO: 3070485 - DNA, 16 bp, Homo sapiens
cagccgccggaagtgg

SEQ ID NO: 3070486 - DNA, 19 bp, Homo sapiens
cagccgctgagcgaggaga

SEQ ID NO: 3070487 - DNA, 20 bp, Homo sapiens
cagccgctgagcgaggagat

SEQ ID NO: 3070488 - DNA, 20 bp, Homo sapiens
cagcctactccgctcactga

SEQ ID NO: 3070489 - DNA, 15 bp, Homo sapiens
cagcctactgagtag

SEQ ID NO: 3070490 - DNA, 19 bp, Homo sapiens
cagcctcaacctcctgggt

SEQ ID NO: 3070491 - DNA, 12 bp, Homo sapiens
cagcctcacaga

SEQ ID NO: 3070492 - DNA, 14 bp, Homo sapiens
cagcctcacagaag

SEQ ID NO: 3070493 - DNA, 15 bp, Homo sapiens
cagcctcacagatgc

SEQ ID NO: 3070494 - DNA, 19 bp, Homo sapiens
cagcctcacagatgctggc

SEQ ID NO: 3070495 - DNA, 21 bp, Homo sapiens
cagcctcacagatgctggcct

SEQ ID NO: 3070496 - DNA, 22 bp, Homo sapiens
cagcctcacttggtctgccagg

SEQ ID NO: 3070497 - DNA, 18 bp, Homo sapiens
cagcctccatcctacccc

SEQ ID NO: 3070498 - DNA, 21 bp, Homo sapiens
cagcctccatcctaccccctg

SEQ ID NO: 3070499 - DNA, 15 bp, Homo sapiens
cagcctcccaaagtg

SEQ ID NO: 3070500 - DNA, 19 bp, Homo sapiens
cagcctcccatccagggcc

SEQ ID NO: 3070501 - DNA, 17 bp, Homo sapiens
cagcctcccctgccagg

SEQ ID NO: 3070502 - DNA, 20 bp, Homo sapiens
cagcctcccctgccagggca

SEQ ID NO: 3070503 - DNA, 18 bp, Homo sapiens
cagcctcccgagtagctg

SEQ ID NO: 3070504 - DNA, 14 bp, Homo sapiens
cagcctccctgaag

SEQ ID NO: 3070505 - DNA, 18 bp, Homo sapiens
cagcctccctgaagcctt

SEQ ID NO: 3070506 - DNA, 20 bp, Homo sapiens
cagcctcctgtctcgccaga

SEQ ID NO: 3070507 - DNA, 17 bp, Homo sapiens
cagcctcgcacaggccc

SEQ ID NO: 3070508 - DNA, 21 bp, Homo sapiens
cagcctcgcacaggccctagc

SEQ ID NO: 3070509 - DNA, 19 bp, Homo sapiens
cagcctctcaaatagctgg

SEQ ID NO: 3070510 - DNA, 20 bp, Homo sapiens
caggaagggatgcaggctcc

SEQ ID NO: 3070511 - DNA, 14 bp, Homo sapiens
caggaatataaata

SEQ ID NO: 3070512 - DNA, 14 bp, Homo sapiens
caggaatcttaagg

SEQ ID NO: 3070513 - DNA, 15 bp, Homo sapiens
caggaatcttaaggt

SEQ ID NO: 3070514 - DNA, 16 bp, Homo sapiens
caggaatgtgtggcct

SEQ ID NO: 3070515 - DNA, 17 bp, Homo sapiens
caggaatgtgtggcctg

SEQ ID NO: 3070516 - DNA, 17 bp, Homo sapiens
caggaatttcccaggac

SEQ ID NO: 3070517 - DNA, 18 bp, Homo sapiens
caggaatttcccaggacc

SEQ ID NO: 3070518 - DNA, 21 bp, Homo sapiens
caggaatttgggaccctgctt

SEQ ID NO: 3070519 - DNA, 22 bp, Homo sapiens
caggaatttgggaccctgcttt

SEQ ID NO: 3070520 - DNA, 23 bp, Homo sapiens
caggaatttgggaccctgcttta

SEQ ID NO: 3070521 - DNA, 15 bp, Homo sapiens
caggacaacgaggaa

SEQ ID NO: 3070522 - DNA, 13 bp, Homo sapiens
caggacagctctt

SEQ ID NO: 3070523 - DNA, 14 bp, Homo sapiens
caggaccaaggggg

SEQ ID NO: 3070524 - DNA, 19 bp, Homo sapiens
caggaccaagggggcgggg

SEQ ID NO: 3070525 - DNA, 13 bp, Homo sapiens
caggaccagctca

SEQ ID NO: 3070526 - DNA, 19 bp, Homo sapiens
caggaccagctcaggacag

SEQ ID NO: 3070527 - DNA, 16 bp, Homo sapiens
caggaccaggacccag

SEQ ID NO: 3070528 - DNA, 15 bp, Homo sapiens
caggacccagaggaa

SEQ ID NO: 3070529 - DNA, 16 bp, Homo sapiens
caggacccagggagag

SEQ ID NO: 3070530 - DNA, 15 bp, Homo sapiens
caggacccgccagcc

SEQ ID NO: 3070531 - DNA, 16 bp, Homo sapiens
caggacccgccagccc

SEQ ID NO: 3070532 - DNA, 21 bp, Homo sapiens
caggacccgccagccccgctc

SEQ ID NO: 3070533 - DNA, 17 bp, Homo sapiens
caggacctccaagccac

SEQ ID NO: 3070534 - DNA, 20 bp, Homo sapiens
caggacctccaagccactga

SEQ ID NO: 3070535 - DNA, 21 bp, Homo sapiens
caggacctctgaaaccctgga

SEQ ID NO: 3070536 - DNA, 13 bp, Homo sapiens
caggacctgcctg

SEQ ID NO: 3070537 - DNA, 14 bp, Homo sapiens
caggacctgcctgt

SEQ ID NO: 3070538 - DNA, 18 bp, Homo sapiens
caggacctggctgccata

SEQ ID NO: 3070539 - DNA, 16 bp, Homo sapiens
caggactccaggccca

SEQ ID NO: 3070540 - DNA, 17 bp, Homo sapiens
caggactccaggcccaa

SEQ ID NO: 3070541 - DNA, 12 bp, Homo sapiens
caggactctgac

SEQ ID NO: 3070542 - DNA, 18 bp, Homo sapiens
caggactgaattgtcccc

SEQ ID NO: 3070543 - DNA, 19 bp, Homo sapiens
caggactgaattgtcccca

SEQ ID NO: 3070544 - DNA, 13 bp, Homo sapiens
caggactgcacag

SEQ ID NO: 3070545 - DNA, 13 bp, Homo sapiens
caggactgggtct

SEQ ID NO: 3070546 - DNA, 20 bp, Homo sapiens
caggactgggtctgacctgg

SEQ ID NO: 3070547 - DNA, 23 bp, Homo sapiens
caggactgggtctgacctggtgg

SEQ ID NO: 3070548 - DNA, 23 bp, Homo sapiens
caggagaaatgcatccattcctc

SEQ ID NO: 3070549 - DNA, 19 bp, Homo sapiens
caggagaaggccaattcct

SEQ ID NO: 3070550 - DNA, 13 bp, Homo sapiens
caggagacatttt

SEQ ID NO: 3070551 - DNA, 14 bp, Homo sapiens
caggagacattttc

SEQ ID NO: 3070552 - DNA, 18 bp, Homo sapiens
caggagacattttcatat

SEQ ID NO: 3070553 - DNA, 22 bp, Homo sapiens
caggagactgggctctggctct

SEQ ID NO: 3070554 - DNA, 16 bp, Homo sapiens
caggagagccagccct

SEQ ID NO: 3070555 - DNA, 18 bp, Homo sapiens
caggagagccagccctcc

SEQ ID NO: 3070556 - DNA, 23 bp, Homo sapiens
caggagagccagccctccctgtc

SEQ ID NO: 3070557 - DNA, 16 bp, Homo sapiens
caggagcacacccagc

SEQ ID NO: 3070558 - DNA, 11 bp, Homo sapiens
caggagcaggg

SEQ ID NO: 3070559 - DNA, 18 bp, Homo sapiens
caggagcagggcggctgc

SEQ ID NO: 3070560 - DNA, 12 bp, Homo sapiens
caggagccctgc

SEQ ID NO: 3070561 - DNA, 13 bp, Homo sapiens
caggagccctgct

SEQ ID NO: 3070562 - DNA, 17 bp, Homo sapiens
caggagccctgctatga

SEQ ID NO: 3070563 - DNA, 14 bp, Homo sapiens
caggagcgtgaagg

SEQ ID NO: 3070564 - DNA, 16 bp, Homo sapiens
caggagcgtgaaggac

SEQ ID NO: 3070565 - DNA, 23 bp, Homo sapiens
caggagctagttctcagcttgca

SEQ ID NO: 3070566 - DNA, 19 bp, Homo sapiens
caggagctgtcaccaagga

SEQ ID NO: 3070567 - DNA, 22 bp, Homo sapiens
caggagctgtcaccaaggaaac

SEQ ID NO: 3070568 - DNA, 13 bp, Homo sapiens
caggaggacaatt

SEQ ID NO: 3070569 - DNA, 14 bp, Homo sapiens
caggaggagctgcc

SEQ ID NO: 3070570 - DNA, 19 bp, Homo sapiens
caggaggaggattgtgctg

SEQ ID NO: 3070571 - DNA, 15 bp, Homo sapiens
caggaggcaggacct

SEQ ID NO: 3070572 - DNA, 18 bp, Homo sapiens
caggaggcaggcatggcc

SEQ ID NO: 3070573 - DNA, 13 bp, Homo sapiens
caggaggccctgg

SEQ ID NO: 3070574 - DNA, 19 bp, Homo sapiens
caggaggcggcagctcttc

SEQ ID NO: 3070575 - DNA, 13 bp, Homo sapiens
caggaggctgaga

SEQ ID NO: 3070576 - DNA, 19 bp, Homo sapiens
caggaggctgagacaggag

SEQ ID NO: 3070577 - DNA, 20 bp, Homo sapiens
caggaggctgaggcagaaga

SEQ ID NO: 3070578 - DNA, 19 bp, Homo sapiens
caggaggctttaagctcca

SEQ ID NO: 3070579 - DNA, 21 bp, Homo sapiens
caggagggagggtttctctcc

SEQ ID NO: 3070580 - DNA, 13 bp, Homo sapiens
caggagggcactg

SEQ ID NO: 3070581 - DNA, 21 bp, Homo sapiens
caggaggtgtgatagagcctt

SEQ ID NO: 3070582 - DNA, 16 bp, Homo sapiens
caggagtcaccatgca

SEQ ID NO: 3070583 - DNA, 17 bp, Homo sapiens
caggagtcaccatgcaa

SEQ ID NO: 3070584 - DNA, 19 bp, Homo sapiens
caggagtcaccatgcaagg

SEQ ID NO: 3070585 - DNA, 21 bp, Homo sapiens
caggagtcaccatgcaagggt

SEQ ID NO: 3070586 - DNA, 20 bp, Homo sapiens
caggagtccaagaccagact

SEQ ID NO: 3070587 - DNA, 22 bp, Homo sapiens
caggagtgggaaaacactgcca

SEQ ID NO: 3070588 - DNA, 19 bp, Homo sapiens
caggagtgtcctcttccct

SEQ ID NO: 3070589 - DNA, 19 bp, Homo sapiens
caggagtgtcctggctgtg

SEQ ID NO: 3070590 - DNA, 21 bp, Homo sapiens
caggagttcaagaccagcctg

SEQ ID NO: 3070591 - DNA, 22 bp, Homo sapiens
caggagttcaagaccagcctgt

SEQ ID NO: 3070592 - DNA, 23 bp, Homo sapiens
caggagttcaataaatgtctgtt

SEQ ID NO: 3070593 - DNA, 17 bp, Homo sapiens
caggagttccagtgctg

SEQ ID NO: 3070594 - DNA, 21 bp, Homo sapiens
caggagttcgagaccaaccta

SEQ ID NO: 3070595 - DNA, 21 bp, Homo sapiens
caggagttcgagaccagcctg

SEQ ID NO: 3070596 - DNA, 23 bp, Homo sapiens
caggagttcgagaccagcctggc

SEQ ID NO: 3070597 - DNA, 18 bp, Homo sapiens
caggagttgggggcaggt

SEQ ID NO: 3070598 - DNA, 19 bp, Homo sapiens
caggagttgggggcaggtc

SEQ ID NO: 3070599 - DNA, 21 bp, Homo sapiens
caggagttgggggcaggtcag

SEQ ID NO: 3070600 - DNA, 16 bp, Homo sapiens
caggagttgtgagccc

SEQ ID NO: 3070601 - DNA, 21 bp, Homo sapiens
caggagtttgagaccaggctg

SEQ ID NO: 3070602 - DNA, 22 bp, Homo sapiens
caggagtttgagaccaggctgg

SEQ ID NO: 3070603 - DNA, 23 bp, Homo sapiens
caggagtttgagaccaggctggg

SEQ ID NO: 3070604 - DNA, 19 bp, Homo sapiens
caggatactcaaagtggaa

SEQ ID NO: 3070605 - DNA, 20 bp, Homo sapiens
caggatcatcatttaaaaaa

SEQ ID NO: 3070606 - DNA, 14 bp, Homo sapiens
caggatccagcctc

SEQ ID NO: 3070607 - DNA, 15 bp, Homo sapiens
caggatccagcctca

SEQ ID NO: 3070608 - DNA, 19 bp, Homo sapiens
caggatctcagatcactgc

SEQ ID NO: 3070609 - DNA, 14 bp, Homo sapiens
caggatctgctcca

SEQ ID NO: 3070610 - DNA, 21 bp, Homo sapiens
caggatgaccacgcacctcca

SEQ ID NO: 3070611 - DNA, 15 bp, Homo sapiens
caggatgaggacaga

SEQ ID NO: 3070612 - DNA, 16 bp, Homo sapiens
caggatgaggacagag

SEQ ID NO: 3070613 - DNA, 18 bp, Homo sapiens
caggatgcacggtttctg

SEQ ID NO: 3070614 - DNA, 19 bp, Homo sapiens
caggatgcacggtttctgt

SEQ ID NO: 3070615 - DNA, 15 bp, Homo sapiens
caggatggtgttact

SEQ ID NO: 3070616 - DNA, 21 bp, Homo sapiens
caggatggtgttactgcagtt

SEQ ID NO: 3070617 - DNA, 23 bp, Homo sapiens
caggattgtgcaatagtcagagt

SEQ ID NO: 3070618 - DNA, 16 bp, Homo sapiens
caggatttgcacagaa

SEQ ID NO: 3070619 - DNA, 22 bp, Homo sapiens
caggatttgcacagaagcacat

SEQ ID NO: 3070620 - DNA, 19 bp, Homo sapiens
caggatttgttctctgtcc

SEQ ID NO: 3070621 - DNA, 21 bp, Homo sapiens
caggattttgtattgccatcg

SEQ ID NO: 3070622 - DNA, 19 bp, Homo sapiens
caggatttttagagcatta

SEQ ID NO: 3070623 - DNA, 21 bp, Homo sapiens
caggatttttagagcattaaa

SEQ ID NO: 3070624 - DNA, 23 bp, Homo sapiens
caggatttttagagcattaaaat

SEQ ID NO: 3070625 - DNA, 12 bp, Homo sapiens
caggcaaattca

SEQ ID NO: 3070626 - DNA, 23 bp, Homo sapiens
caggcaataatattttctgtgta

SEQ ID NO: 3070627 - DNA, 20 bp, Homo sapiens
caggcacacagctactctcc

SEQ ID NO: 3070628 - DNA, 15 bp, Homo sapiens
caggcacaggtcagg

SEQ ID NO: 3070629 - DNA, 13 bp, Homo sapiens
caggcacatggct

SEQ ID NO: 3070630 - DNA, 16 bp, Homo sapiens
caggcacattaactgt

SEQ ID NO: 3070631 - DNA, 13 bp, Homo sapiens
caggcaccgggct

SEQ ID NO: 3070632 - DNA, 16 bp, Homo sapiens
caggcaccgggctggc

SEQ ID NO: 3070633 - DNA, 23 bp, Homo sapiens
caggcaccgggctggctgcttgc

SEQ ID NO: 3070634 - DNA, 17 bp, Homo sapiens
caggcacgaacccacct

SEQ ID NO: 3070635 - DNA, 21 bp, Homo sapiens
caggcacgaacccacctgctg

SEQ ID NO: 3070636 - DNA, 16 bp, Homo sapiens
caggcactgagaatga

SEQ ID NO: 3070637 - DNA, 22 bp, Homo sapiens
caggcactgagataccagcgag

SEQ ID NO: 3070638 - DNA, 23 bp, Homo sapiens
caggcactgagataccagcgagg

SEQ ID NO: 3070639 - DNA, 16 bp, Homo sapiens
caggcagaaatataaa

SEQ ID NO: 3070640 - DNA, 17 bp, Homo sapiens
caggcagagctgagggc

SEQ ID NO: 3070641 - DNA, 21 bp, Homo sapiens
cagtatctatatatgtgtatg

SEQ ID NO: 3070642 - DNA, 15 bp, Homo sapiens
cagtatgatttatcc

SEQ ID NO: 3070643 - DNA, 20 bp, Homo sapiens
cagtatggtacatttttcaa

SEQ ID NO: 3070644 - DNA, 23 bp, Homo sapiens
cagtatggtacatttttcaactt

SEQ ID NO: 3070645 - DNA, 16 bp, Homo sapiens
cagtatgttttacact

SEQ ID NO: 3070646 - DNA, 18 bp, Homo sapiens
cagtatgttttacactgt

SEQ ID NO: 3070647 - DNA, 20 bp, Homo sapiens
cagtatgttttacactgtac

SEQ ID NO: 3070648 - DNA, 20 bp, Homo sapiens
cagtattaaactctcctttg

SEQ ID NO: 3070649 - DNA, 23 bp, Homo sapiens
cagtattaaattagatatcttca

SEQ ID NO: 3070650 - DNA, 17 bp, Homo sapiens
cagtattacagaggtcg

SEQ ID NO: 3070651 - DNA, 18 bp, Homo sapiens
cagtattttctgttttta

SEQ ID NO: 3070652 - DNA, 10 bp, Homo sapiens
cagtattttt

SEQ ID NO: 3070653 - DNA, 19 bp, Homo sapiens
cagtatttttcagatataa

SEQ ID NO: 3070654 - DNA, 15 bp, Homo sapiens
cagtcaaatctgggc

SEQ ID NO: 3070655 - DNA, 15 bp, Homo sapiens
cagtcaacaagcctg

SEQ ID NO: 3070656 - DNA, 15 bp, Homo sapiens
cagtcaacctgggca

SEQ ID NO: 3070657 - DNA, 22 bp, Homo sapiens
cagtcaacctgggcaaagccta

SEQ ID NO: 3070658 - DNA, 21 bp, Homo sapiens
cagtcacttcggccagagctg

SEQ ID NO: 3070659 - DNA, 22 bp, Homo sapiens
cagtcagccctgattgtgccag

SEQ ID NO: 3070660 - DNA, 21 bp, Homo sapiens
cagtcaggaaaggaatcattt

SEQ ID NO: 3070661 - DNA, 22 bp, Homo sapiens
cagtcaggggtcaggtgtcagg

SEQ ID NO: 3070662 - DNA, 23 bp, Homo sapiens
cagtcatacctgctcctcatctg

SEQ ID NO: 3070663 - DNA, 21 bp, Homo sapiens
cagtcatcaacaatgattaat

SEQ ID NO: 3070664 - DNA, 13 bp, Homo sapiens
cagtcatcatctc

SEQ ID NO: 3070665 - DNA, 16 bp, Homo sapiens
cagtcatcatctcttg

SEQ ID NO: 3070666 - DNA, 21 bp, Homo sapiens
cagtcatcatctcttgataaa

SEQ ID NO: 3070667 - DNA, 18 bp, Homo sapiens
cagtcatcttgaccaagc

SEQ ID NO: 3070668 - DNA, 22 bp, Homo sapiens
cagtcatcttgaccaagcagga

SEQ ID NO: 3070669 - DNA, 24 bp, Homo sapiens
cagtcatcttgaccaagcaggaag

SEQ ID NO: 3070670 - DNA, 23 bp, Homo sapiens
cagtcatgttttaaatgtacagt

SEQ ID NO: 3070671 - DNA, 18 bp, Homo sapiens
cagtcattatttaaagca

SEQ ID NO: 3070672 - DNA, 13 bp, Homo sapiens
cagtcattggctg

SEQ ID NO: 3070673 - DNA, 11 bp, Homo sapiens
cagtccacagc

SEQ ID NO: 3070674 - DNA, 16 bp, Homo sapiens
cagtccagagcttttc

SEQ ID NO: 3070675 - DNA, 13 bp, Homo sapiens
cagtccatgctcc

SEQ ID NO: 3070676 - DNA, 23 bp, Homo sapiens
cagtccatgctccagggtcaggc

SEQ ID NO: 3070677 - DNA, 15 bp, Homo sapiens
cagtccatttcctaa

SEQ ID NO: 3070678 - DNA, 14 bp, Homo sapiens
cagtccccccaccc

SEQ ID NO: 3070679 - DNA, 20 bp, Homo sapiens
cagtccccccaccctcattc

SEQ ID NO: 3070680 - DNA, 18 bp, Homo sapiens
cagtcccgaaatttggat

SEQ ID NO: 3070681 - DNA, 23 bp, Homo sapiens
cagtccctgggagcaagttgcag

SEQ ID NO: 3070682 - DNA, 20 bp, Homo sapiens
cagtccctgggggaagccct

SEQ ID NO: 3070683 - DNA, 22 bp, Homo sapiens
cagtccctgggggaagccctgg

SEQ ID NO: 3070684 - DNA, 13 bp, Homo sapiens
cagtcctctttca

SEQ ID NO: 3070685 - DNA, 22 bp, Homo sapiens
cagtcctgatcagagccgtggt

SEQ ID NO: 3070686 - DNA, 14 bp, Homo sapiens
cagtcctgctggcc

SEQ ID NO: 3070687 - DNA, 20 bp, Homo sapiens
cagtcctgctggcctgctct

SEQ ID NO: 3070688 - DNA, 14 bp, Homo sapiens
cagtcctggtcctg

SEQ ID NO: 3070689 - DNA, 18 bp, Homo sapiens
cagtcctggtcctggctg

SEQ ID NO: 3070690 - DNA, 23 bp, Homo sapiens
cagtcctggtcctggctgcactc

SEQ ID NO: 3070691 - DNA, 15 bp, Homo sapiens
cagtcctgttcagaa

SEQ ID NO: 3070692 - DNA, 15 bp, Homo sapiens
cagtcgatagagctg

SEQ ID NO: 3070693 - DNA, 20 bp, Homo sapiens
cagtcgctcagtctgttcac

SEQ ID NO: 3070694 - DNA, 15 bp, Homo sapiens
cagtcgctgcaggga

SEQ ID NO: 3070695 - DNA, 13 bp, Homo sapiens
cagtcgcttgcca

SEQ ID NO: 3070696 - DNA, 21 bp, Homo sapiens
cagtcgcttgccaaagcagat

SEQ ID NO: 3070697 - DNA, 17 bp, Homo sapiens
cagtcggaaaagcgtct

SEQ ID NO: 3070698 - DNA, 14 bp, Homo sapiens
cagtcggcatgcca

SEQ ID NO: 3070699 - DNA, 18 bp, Homo sapiens
cagtcggcatgccaggac

SEQ ID NO: 3070700 - DNA, 19 bp, Homo sapiens
cagtctacttctgtgtctg

SEQ ID NO: 3070701 - DNA, 14 bp, Homo sapiens
cagtctagaagaat

SEQ ID NO: 3070702 - DNA, 19 bp, Homo sapiens
cagtctcactgtgggaagg

SEQ ID NO: 3070703 - DNA, 22 bp, Homo sapiens
cagtctcgggtggctagtcaga

SEQ ID NO: 3070704 - DNA, 14 bp, Homo sapiens
cagtctctgagcag

SEQ ID NO: 3070705 - DNA, 17 bp, Homo sapiens
cagtctgagagaggcca

SEQ ID NO: 3070706 - DNA, 22 bp, Homo sapiens
cagtctgatcgtgacgctgaat

SEQ ID NO: 3070707 - DNA, 17 bp, Homo sapiens
cagtctgtcttctgtat

SEQ ID NO: 3070708 - DNA, 21 bp, Homo sapiens
cagtctgtcttctgtatataa

SEQ ID NO: 3070709 - DNA, 20 bp, Homo sapiens
cagtctgttcactgcattca

SEQ ID NO: 3070710 - DNA, 21 bp, Homo sapiens
cagtctgttcactgcattcac

SEQ ID NO: 3070711 - DNA, 18 bp, Homo sapiens
cagtcttccatttgcaag

SEQ ID NO: 3070712 - DNA, 23 bp, Homo sapiens
cagtcttttctctgaaaagcaaa

SEQ ID NO: 3070713 - DNA, 20 bp, Homo sapiens
cagtgaaagaaaataacaat

SEQ ID NO: 3070714 - DNA, 21 bp, Homo sapiens
cagtgaactaatttggttttt

SEQ ID NO: 3070715 - DNA, 15 bp, Homo sapiens
cagtgaagacagaag

SEQ ID NO: 3070716 - DNA, 14 bp, Homo sapiens
cagtgaagagtaag

SEQ ID NO: 3070717 - DNA, 20 bp, Homo sapiens
cagtgaagatattttatttc

SEQ ID NO: 3070718 - DNA, 21 bp, Homo sapiens
cagtgaagtgttctgctgaga

SEQ ID NO: 3070719 - DNA, 17 bp, Homo sapiens
cagtgacactggaccag

SEQ ID NO: 3070720 - DNA, 16 bp, Homo sapiens
cagtgacctgaggaag

SEQ ID NO: 3070721 - DNA, 18 bp, Homo sapiens
cagtgacctgaggaagcg

SEQ ID NO: 3070722 - DNA, 19 bp, Homo sapiens
cagtgacgtgactcagagc

SEQ ID NO: 3070723 - DNA, 14 bp, Homo sapiens
cagtgactgaaacc

SEQ ID NO: 3070724 - DNA, 20 bp, Homo sapiens
cagtgactgtggccatggtc

SEQ ID NO: 3070725 - DNA, 18 bp, Homo sapiens
cagtgagagtactcactt

SEQ ID NO: 3070726 - DNA, 20 bp, Homo sapiens
cagtgagagtactcactttt

SEQ ID NO: 3070727 - DNA, 13 bp, Homo sapiens
cagtgagccactc

SEQ ID NO: 3070728 - DNA, 18 bp, Homo sapiens
cagtgagccagaaattga

SEQ ID NO: 3070729 - DNA, 14 bp, Homo sapiens
cagtgagtggcccc

SEQ ID NO: 3070730 - DNA, 15 bp, Homo sapiens
cagtgagtggcccca

SEQ ID NO: 3070731 - DNA, 15 bp, Homo sapiens
cagtgatgcctgccc

SEQ ID NO: 3070732 - DNA, 14 bp, Homo sapiens
cagtgatttgaaga

SEQ ID NO: 3070733 - DNA, 14 bp, Homo sapiens
cagtgatttttagt

SEQ ID NO: 3070734 - DNA, 14 bp, Homo sapiens
cagtgcaacctctg

SEQ ID NO: 3070735 - DNA, 14 bp, Homo sapiens
cagtgcacatgaac

SEQ ID NO: 3070736 - DNA, 16 bp, Homo sapiens
cagtgcacctgcctca

SEQ ID NO: 3070737 - DNA, 17 bp, Homo sapiens
cagtgcacctgcctcag

SEQ ID NO: 3070738 - DNA, 18 bp, Homo sapiens
cagtgcacctgcctcagc

SEQ ID NO: 3070739 - DNA, 12 bp, Homo sapiens
cagtgcagaatg

SEQ ID NO: 3070740 - DNA, 14 bp, Homo sapiens
cagtgcagaatgta

SEQ ID NO: 3070741 - DNA, 22 bp, Homo sapiens
cagtgcagaatgtaagtgggcc

SEQ ID NO: 3070742 - DNA, 14 bp, Homo sapiens
cagtgcagatggag

SEQ ID NO: 3070743 - DNA, 17 bp, Homo sapiens
cagtgcaggctggccag

SEQ ID NO: 3070744 - DNA, 18 bp, Homo sapiens
cagtgcagtccatttcct

SEQ ID NO: 3070745 - DNA, 20 bp, Homo sapiens
cagtgcagtccatttcctaa

SEQ ID NO: 3070746 - DNA, 15 bp, Homo sapiens
cagtgcagtttctaa

SEQ ID NO: 3070747 - DNA, 20 bp, Homo sapiens
cagtgcagtttctaagcatg

SEQ ID NO: 3070748 - DNA, 23 bp, Homo sapiens
cagtgcatccccacgacccctgc

SEQ ID NO: 3070749 - DNA, 14 bp, Homo sapiens
cagtgcatggtggc

SEQ ID NO: 3070750 - DNA, 15 bp, Homo sapiens
cagtgcatggtggcc

SEQ ID NO: 3070751 - DNA, 17 bp, Homo sapiens
cagtgcatggtggccag

SEQ ID NO: 3070752 - DNA, 18 bp, Homo sapiens
cagtgcattttgtttctg

SEQ ID NO: 3070753 - DNA, 19 bp, Homo sapiens
cagtgcattttgtttctgt

SEQ ID NO: 3070754 - DNA, 16 bp, Homo sapiens
cagtgccaactgtggc

SEQ ID NO: 3070755 - DNA, 18 bp, Homo sapiens
cagtgccaactgtggctg

SEQ ID NO: 3070756 - DNA, 13 bp, Homo sapiens
cagtgccagctcc

SEQ ID NO: 3070757 - DNA, 15 bp, Homo sapiens
cagtgccatacatgt

SEQ ID NO: 3070758 - DNA, 16 bp, Homo sapiens
cagtgcccaccaacat

SEQ ID NO: 3070759 - DNA, 17 bp, Homo sapiens
cagtgcccccactgacc

SEQ ID NO: 3070760 - DNA, 23 bp, Homo sapiens
cagtgcccccactgaccagaact

SEQ ID NO: 3070761 - DNA, 15 bp, Homo sapiens
cagtgccgaggacat

SEQ ID NO: 3070762 - DNA, 17 bp, Homo sapiens
cagtgccgaggacatgc

SEQ ID NO: 3070763 - DNA, 10 bp, Homo sapiens
cagtgcctgc

SEQ ID NO: 3070764 - DNA, 20 bp, Homo sapiens
cagtgccttacctcctgccc

SEQ ID NO: 3070765 - DNA, 21 bp, Homo sapiens
cagtgccttacctcctgccca

SEQ ID NO: 3070766 - DNA, 22 bp, Homo sapiens
cagtgccttctctcagctccca

SEQ ID NO: 3070767 - DNA, 20 bp, Homo sapiens
cagtgcgctcgttccggtcc

SEQ ID NO: 3070768 - DNA, 15 bp, Homo sapiens
cagtgctaaaaatgg

SEQ ID NO: 3070769 - DNA, 17 bp, Homo sapiens
cagtgctaaaaatggga

SEQ ID NO: 3070770 - DNA, 12 bp, Homo sapiens
cagtgctctgcc

SEQ ID NO: 3070771 - DNA, 23 bp, Homo sapiens
cagtgctctgcctctaactccct

SEQ ID NO: 3070772 - DNA, 21 bp, Homo sapiens
catatggacactgtgacaatg

SEQ ID NO: 3070773 - DNA, 15 bp, Homo sapiens
catatggactctgca

SEQ ID NO: 3070774 - DNA, 17 bp, Homo sapiens
catatggactctgcaca

SEQ ID NO: 3070775 - DNA, 17 bp, Homo sapiens
catatgtagaaacattt

SEQ ID NO: 3070776 - DNA, 18 bp, Homo sapiens
catatgtagaaacattta

SEQ ID NO: 3070777 - DNA, 23 bp, Homo sapiens
catatgtagaaacatttagattt

SEQ ID NO: 3070778 - DNA, 17 bp, Homo sapiens
catatgtgaatatggac

SEQ ID NO: 3070779 - DNA, 13 bp, Homo sapiens
catatgttaagca

SEQ ID NO: 3070780 - DNA, 18 bp, Homo sapiens
catatgttgaatactttt

SEQ ID NO: 3070781 - DNA, 19 bp, Homo sapiens
catatgttgaatacttttt

SEQ ID NO: 3070782 - DNA, 21 bp, Homo sapiens
catattacgttgtttcttata

SEQ ID NO: 3070783 - DNA, 21 bp, Homo sapiens
catattgcaggagacattttc

SEQ ID NO: 3070784 - DNA, 22 bp, Homo sapiens
catattgcaggagacattttca

SEQ ID NO: 3070785 - DNA, 20 bp, Homo sapiens
catattggatctgcttgctg

SEQ ID NO: 3070786 - DNA, 20 bp, Homo sapiens
catattgtaatctatgttta

SEQ ID NO: 3070787 - DNA, 13 bp, Homo sapiens
catatttaactgg

SEQ ID NO: 3070788 - DNA, 14 bp, Homo sapiens
catatttaatgttt

SEQ ID NO: 3070789 - DNA, 20 bp, Homo sapiens
catatttaatgttttaaatg

SEQ ID NO: 3070790 - DNA, 13 bp, Homo sapiens
catatttgaaaac

SEQ ID NO: 3070791 - DNA, 15 bp, Homo sapiens
catatttgtgttcag

SEQ ID NO: 3070792 - DNA, 18 bp, Homo sapiens
catatttgtgttcagttc

SEQ ID NO: 3070793 - DNA, 13 bp, Homo sapiens
catattttacatc

SEQ ID NO: 3070794 - DNA, 21 bp, Homo sapiens
catattttattgtattttgat

SEQ ID NO: 3070795 - DNA, 12 bp, Homo sapiens
catcaaaagaca

SEQ ID NO: 3070796 - DNA, 19 bp, Homo sapiens
catcaaaatgagtcaggca

SEQ ID NO: 3070797 - DNA, 13 bp, Homo sapiens
catcaaacatgaa

SEQ ID NO: 3070798 - DNA, 18 bp, Homo sapiens
catcaaacatgaaaacat

SEQ ID NO: 3070799 - DNA, 15 bp, Homo sapiens
catcaacaaaaattg

SEQ ID NO: 3070800 - DNA, 16 bp, Homo sapiens
catcaacttaaagtga

SEQ ID NO: 3070801 - DNA, 19 bp, Homo sapiens
catcaagaactattgtgtt

SEQ ID NO: 3070802 - DNA, 17 bp, Homo sapiens
catcaagagactgagtc

SEQ ID NO: 3070803 - DNA, 13 bp, Homo sapiens
catcaatatgtat

SEQ ID NO: 3070804 - DNA, 18 bp, Homo sapiens
catcaatgtgacatttac

SEQ ID NO: 3070805 - DNA, 20 bp, Homo sapiens
catcacacacatggaaaccc

SEQ ID NO: 3070806 - DNA, 19 bp, Homo sapiens
catcacacccttttaacat

SEQ ID NO: 3070807 - DNA, 12 bp, Homo sapiens
catcacagaatg

SEQ ID NO: 3070808 - DNA, 13 bp, Homo sapiens
catcacagggtgg

SEQ ID NO: 3070809 - DNA, 15 bp, Homo sapiens
catcaccaggtgcat

SEQ ID NO: 3070810 - DNA, 21 bp, Homo sapiens
catcaccaggtgcatctgcag

SEQ ID NO: 3070811 - DNA, 17 bp, Homo sapiens
catcaccttaggcaggg

SEQ ID NO: 3070812 - DNA, 23 bp, Homo sapiens
catcaccttaggcagggaagtgt

SEQ ID NO: 3070813 - DNA, 15 bp, Homo sapiens
catcaccttcctcct

SEQ ID NO: 3070814 - DNA, 15 bp, Homo sapiens
catcactagtgacaa

SEQ ID NO: 3070815 - DNA, 19 bp, Homo sapiens
catcactattcaaggatga

SEQ ID NO: 3070816 - DNA, 15 bp, Homo sapiens
catcactcagcccct

SEQ ID NO: 3070817 - DNA, 20 bp, Homo sapiens
catcactgtcaaactttgtc

SEQ ID NO: 3070818 - DNA, 12 bp, Homo sapiens
catcactgtggc

SEQ ID NO: 3070819 - DNA, 13 bp, Homo sapiens
catcagaactgaa

SEQ ID NO: 3070820 - DNA, 17 bp, Homo sapiens
catcagaactgaaataa

SEQ ID NO: 3070821 - DNA, 14 bp, Homo sapiens
catcagaaggagaa

SEQ ID NO: 3070822 - DNA, 21 bp, Homo sapiens
catcagaagtaactcccactc

SEQ ID NO: 3070823 - DNA, 21 bp, Homo sapiens
catcagcactttaccagaggc

SEQ ID NO: 3070824 - DNA, 11 bp, Homo sapiens
catcagccttc

SEQ ID NO: 3070825 - DNA, 16 bp, Homo sapiens
catcaggaagcctgtg

SEQ ID NO: 3070826 - DNA, 21 bp, Homo sapiens
catcaggagactgggctctgg

SEQ ID NO: 3070827 - DNA, 22 bp, Homo sapiens
catcaggcagataactgctgta

SEQ ID NO: 3070828 - DNA, 16 bp, Homo sapiens
catcaggctctgttcc

SEQ ID NO: 3070829 - DNA, 15 bp, Homo sapiens
catcagtaacagtat

SEQ ID NO: 3070830 - DNA, 18 bp, Homo sapiens
catcagtgccagcccctg

SEQ ID NO: 3070831 - DNA, 22 bp, Homo sapiens
catcagttactctgaagggcat

SEQ ID NO: 3070832 - DNA, 17 bp, Homo sapiens
catcatattaaaaatat

SEQ ID NO: 3070833 - DNA, 21 bp, Homo sapiens
catcatattaaaaatatacaa

SEQ ID NO: 3070834 - DNA, 14 bp, Homo sapiens
catcatcctttgtt

SEQ ID NO: 3070835 - DNA, 21 bp, Homo sapiens
catcatctcctgccttcctcc

SEQ ID NO: 3070836 - DNA, 11 bp, Homo sapiens
catcatctctg

SEQ ID NO: 3070837 - DNA, 12 bp, Homo sapiens
catcatctctgc

SEQ ID NO: 3070838 - DNA, 15 bp, Homo sapiens
catcatctctgcctt

SEQ ID NO: 3070839 - DNA, 14 bp, Homo sapiens
catcatctgctgca

SEQ ID NO: 3070840 - DNA, 14 bp, Homo sapiens
catcatgaactggc

SEQ ID NO: 3070841 - DNA, 22 bp, Homo sapiens
catcatgaactggcttgtacat

SEQ ID NO: 3070842 - DNA, 21 bp, Homo sapiens
catcatgctggaacctgcaaa

SEQ ID NO: 3070843 - DNA, 18 bp, Homo sapiens
catcatgtaccaagtgct

SEQ ID NO: 3070844 - DNA, 13 bp, Homo sapiens
catcattagaaca

SEQ ID NO: 3070845 - DNA, 20 bp, Homo sapiens
catcattccctctcatctca

SEQ ID NO: 3070846 - DNA, 12 bp, Homo sapiens
catcattctctg

SEQ ID NO: 3070847 - DNA, 13 bp, Homo sapiens
catcattgcagat

SEQ ID NO: 3070848 - DNA, 22 bp, Homo sapiens
catcattgtccccatgcaacaa

SEQ ID NO: 3070849 - DNA, 12 bp, Homo sapiens
catcatttaaaa

SEQ ID NO: 3070850 - DNA, 12 bp, Homo sapiens
catcatttcagc

SEQ ID NO: 3070851 - DNA, 17 bp, Homo sapiens
catcatttttgtatcta

SEQ ID NO: 3070852 - DNA, 23 bp, Homo sapiens
catccaaaatagttaagacatga

SEQ ID NO: 3070853 - DNA, 15 bp, Homo sapiens
catccaaagcagaca

SEQ ID NO: 3070854 - DNA, 21 bp, Homo sapiens
catccaaagcagacagctcca

SEQ ID NO: 3070855 - DNA, 22 bp, Homo sapiens
catccaacagacctggtgctct

SEQ ID NO: 3070856 - DNA, 23 bp, Homo sapiens
catccaaggccttctcaggctgg

SEQ ID NO: 3070857 - DNA, 23 bp, Homo sapiens
catccaatgctcaagaaacaact

SEQ ID NO: 3070858 - DNA, 17 bp, Homo sapiens
catccacattgttttaa

SEQ ID NO: 3070859 - DNA, 21 bp, Homo sapiens
catccacattgttttaaaaag

SEQ ID NO: 3070860 - DNA, 17 bp, Homo sapiens
catccacattttaacag

SEQ ID NO: 3070861 - DNA, 13 bp, Homo sapiens
catccacgccaag

SEQ ID NO: 3070862 - DNA, 20 bp, Homo sapiens
catccagagtccctgcctgg

SEQ ID NO: 3070863 - DNA, 21 bp, Homo sapiens
catccagcagtctctgccttg

SEQ ID NO: 3070864 - DNA, 20 bp, Homo sapiens
catccagctacttagctggc

SEQ ID NO: 3070865 - DNA, 22 bp, Homo sapiens
catccagctacttagctggcca

SEQ ID NO: 3070866 - DNA, 15 bp, Homo sapiens
catccagcttgccag

SEQ ID NO: 3070867 - DNA, 16 bp, Homo sapiens
catccaggccagggct

SEQ ID NO: 3070868 - DNA, 12 bp, Homo sapiens
catccaggctgg

SEQ ID NO: 3070869 - DNA, 11 bp, Homo sapiens
catccagggcc

SEQ ID NO: 3070870 - DNA, 14 bp, Homo sapiens
catccatcatcatg

SEQ ID NO: 3070871 - DNA, 17 bp, Homo sapiens
catccatcatctgctgc

SEQ ID NO: 3070872 - DNA, 23 bp, Homo sapiens
catccatctgtccgtccagagcc

SEQ ID NO: 3070873 - DNA, 15 bp, Homo sapiens
catccattcctcagg

SEQ ID NO: 3070874 - DNA, 16 bp, Homo sapiens
catccattcctcaggg

SEQ ID NO: 3070875 - DNA, 17 bp, Homo sapiens
catccattcctcaggga

SEQ ID NO: 3070876 - DNA, 23 bp, Homo sapiens
catcccagacaggtccctcccct

SEQ ID NO: 3070877 - DNA, 13 bp, Homo sapiens
catcccagcccaa

SEQ ID NO: 3070878 - DNA, 21 bp, Homo sapiens
catcccagcccaatccaggta

SEQ ID NO: 3070879 - DNA, 14 bp, Homo sapiens
catcccagccttga

SEQ ID NO: 3070880 - DNA, 15 bp, Homo sapiens
catcccagccttgag

SEQ ID NO: 3070881 - DNA, 19 bp, Homo sapiens
catcccatgtaacagaaag

SEQ ID NO: 3070882 - DNA, 21 bp, Homo sapiens
catcccattcacttctgcatt

SEQ ID NO: 3070883 - DNA, 12 bp, Homo sapiens
catccccagagc

SEQ ID NO: 3070884 - DNA, 20 bp, Homo sapiens
catccccagagcccagctct

SEQ ID NO: 3070885 - DNA, 23 bp, Homo sapiens
catccccagagcccagctcttgc

SEQ ID NO: 3070886 - DNA, 16 bp, Homo sapiens
catccccatcggccct

SEQ ID NO: 3070887 - DNA, 19 bp, Homo sapiens
catccccatcggccctgtc

SEQ ID NO: 3070888 - DNA, 20 bp, Homo sapiens
catccccctctcacgccacc

SEQ ID NO: 3070889 - DNA, 20 bp, Homo sapiens
catccccttacccttagaat

SEQ ID NO: 3070890 - DNA, 17 bp, Homo sapiens
catcccggcccatgttg

SEQ ID NO: 3070891 - DNA, 15 bp, Homo sapiens
catcccggctgaccc

SEQ ID NO: 3070892 - DNA, 16 bp, Homo sapiens
catcccggctgaccct

SEQ ID NO: 3070893 - DNA, 17 bp, Homo sapiens
catcccggctgaccctg

SEQ ID NO: 3070894 - DNA, 20 bp, Homo sapiens
catccctaattcttcatagg

SEQ ID NO: 3070895 - DNA, 16 bp, Homo sapiens
catccctcccccagca

SEQ ID NO: 3070896 - DNA, 13 bp, Homo sapiens
catccctccctgc

SEQ ID NO: 3070897 - DNA, 14 bp, Homo sapiens
catccctccctgcc

SEQ ID NO: 3070898 - DNA, 15 bp, Homo sapiens
catccctccctgcct

SEQ ID NO: 3070899 - DNA, 18 bp, Homo sapiens
catccctccctgcctaag

SEQ ID NO: 3070900 - DNA, 14 bp, Homo sapiens
catccctgcttctg

SEQ ID NO: 3070901 - DNA, 19 bp, Homo sapiens
catccgcagactgcttggc

SEQ ID NO: 3070902 - DNA, 22 bp, Homo sapiens
catccgcagactgcttggccag

SEQ ID NO: 3070903 - DNA, 15 bp, Homo sapiens
catccgccagggccc

SEQ ID NO: 3070904 - DNA, 21 bp, Homo sapiens
catccgtagttccctgaaaac

SEQ ID NO: 3070905 - DNA, 20 bp, Homo sapiens
catgtggccatggcctctgc

SEQ ID NO: 3070906 - DNA, 14 bp, Homo sapiens
catgtggcctgccc

SEQ ID NO: 3070907 - DNA, 17 bp, Homo sapiens
catgtggcctgcccagc

SEQ ID NO: 3070908 - DNA, 19 bp, Homo sapiens
catgtggcctgcccagcct

SEQ ID NO: 3070909 - DNA, 21 bp, Homo sapiens
catgtggcctgcccagcctca

SEQ ID NO: 3070910 - DNA, 18 bp, Homo sapiens
catgtgtaatcaataaac

SEQ ID NO: 3070911 - DNA, 23 bp, Homo sapiens
catgtgtaatcaataaacgattt

SEQ ID NO: 3070912 - DNA, 16 bp, Homo sapiens
catgtgtagcctgtgc

SEQ ID NO: 3070913 - DNA, 18 bp, Homo sapiens
catgtgtagcctgtgcat

SEQ ID NO: 3070914 - DNA, 13 bp, Homo sapiens
catgtgtatgaga

SEQ ID NO: 3070915 - DNA, 23 bp, Homo sapiens
catgtgtatgcgtgtccgtctgt

SEQ ID NO: 3070916 - DNA, 21 bp, Homo sapiens
catgtgtccctggcgctgtgc

SEQ ID NO: 3070917 - DNA, 21 bp, Homo sapiens
catgtgttttcatcatttcag

SEQ ID NO: 3070918 - DNA, 21 bp, Homo sapiens
catgtgttttgcttttatcca

SEQ ID NO: 3070919 - DNA, 16 bp, Homo sapiens
catgttattgttttca

SEQ ID NO: 3070920 - DNA, 16 bp, Homo sapiens
catgttcatgtgatta

SEQ ID NO: 3070921 - DNA, 22 bp, Homo sapiens
catgttcatgtgattaactctt

SEQ ID NO: 3070922 - DNA, 23 bp, Homo sapiens
catgttcgagcttacctactctt

SEQ ID NO: 3070923 - DNA, 14 bp, Homo sapiens
catgttctgctttc

SEQ ID NO: 3070924 - DNA, 20 bp, Homo sapiens
catgttgaccatgtctatga

SEQ ID NO: 3070925 - DNA, 20 bp, Homo sapiens
catgttggccaggctggtct

SEQ ID NO: 3070926 - DNA, 15 bp, Homo sapiens
catgttgttttttca

SEQ ID NO: 3070927 - DNA, 14 bp, Homo sapiens
catgtttaattgtg

SEQ ID NO: 3070928 - DNA, 13 bp, Homo sapiens
catgtttataaat

SEQ ID NO: 3070929 - DNA, 13 bp, Homo sapiens
catgtttattcta

SEQ ID NO: 3070930 - DNA, 17 bp, Homo sapiens
catgtttattctgttcc

SEQ ID NO: 3070931 - DNA, 14 bp, Homo sapiens
catgtttgctgttc

SEQ ID NO: 3070932 - DNA, 22 bp, Homo sapiens
catgtttggaaggggtctgtag

SEQ ID NO: 3070933 - DNA, 19 bp, Homo sapiens
catgttttaaaattatata

SEQ ID NO: 3070934 - DNA, 12 bp, Homo sapiens
catgttttaaca

SEQ ID NO: 3070935 - DNA, 20 bp, Homo sapiens
catgttttaacaaaaaccaa

SEQ ID NO: 3070936 - DNA, 17 bp, Homo sapiens
catgttttcaactgcca

SEQ ID NO: 3070937 - DNA, 21 bp, Homo sapiens
catgttttccattgtttgaaa

SEQ ID NO: 3070938 - DNA, 14 bp, Homo sapiens
catgttttctgctt

SEQ ID NO: 3070939 - DNA, 13 bp, Homo sapiens
catgttttgataa

SEQ ID NO: 3070940 - DNA, 14 bp, Homo sapiens
catgttttgataaa

SEQ ID NO: 3070941 - DNA, 11 bp, Homo sapiens
catgttttggt

SEQ ID NO: 3070942 - DNA, 17 bp, Homo sapiens
cattaaaaacatagaaa

SEQ ID NO: 3070943 - DNA, 15 bp, Homo sapiens
cattaaaaagcctta

SEQ ID NO: 3070944 - DNA, 14 bp, Homo sapiens
cattaaaataacta

SEQ ID NO: 3070945 - DNA, 15 bp, Homo sapiens
cattaaaataactat

SEQ ID NO: 3070946 - DNA, 10 bp, Homo sapiens
cattaaactg

SEQ ID NO: 3070947 - DNA, 17 bp, Homo sapiens
cattaaatcacttgaat

SEQ ID NO: 3070948 - DNA, 12 bp, Homo sapiens
cattaaatgttt

SEQ ID NO: 3070949 - DNA, 13 bp, Homo sapiens
cattaaatgtttg

SEQ ID NO: 3070950 - DNA, 14 bp, Homo sapiens
cattaaattcacaa

SEQ ID NO: 3070951 - DNA, 13 bp, Homo sapiens
cattaactgttgc

SEQ ID NO: 3070952 - DNA, 17 bp, Homo sapiens
cattaagagaacaaaga

SEQ ID NO: 3070953 - DNA, 15 bp, Homo sapiens
cattaatgcccagcc

SEQ ID NO: 3070954 - DNA, 22 bp, Homo sapiens
cattaatgcccagccagccacc

SEQ ID NO: 3070955 - DNA, 19 bp, Homo sapiens
cattaattattattgctgt

SEQ ID NO: 3070956 - DNA, 12 bp, Homo sapiens
cattaattctat

SEQ ID NO: 3070957 - DNA, 17 bp, Homo sapiens
cattactataagaactt

SEQ ID NO: 3070958 - DNA, 23 bp, Homo sapiens
cattactataagaactttgagct

SEQ ID NO: 3070959 - DNA, 12 bp, Homo sapiens
cattagaacttc

SEQ ID NO: 3070960 - DNA, 13 bp, Homo sapiens
cattagaatgtga

SEQ ID NO: 3070961 - DNA, 15 bp, Homo sapiens
cattagaatgtgatt

SEQ ID NO: 3070962 - DNA, 20 bp, Homo sapiens
cattagactggaacttgaac

SEQ ID NO: 3070963 - DNA, 20 bp, Homo sapiens
cattagagagatttttcatt

SEQ ID NO: 3070964 - DNA, 23 bp, Homo sapiens
cattagattcctttcctgtgtga

SEQ ID NO: 3070965 - DNA, 21 bp, Homo sapiens
cattagtaacataataaatta

SEQ ID NO: 3070966 - DNA, 19 bp, Homo sapiens
cattagttaagatgtctga

SEQ ID NO: 3070967 - DNA, 16 bp, Homo sapiens
cattagttttagaggc

SEQ ID NO: 3070968 - DNA, 18 bp, Homo sapiens
cattataactgaaggaga

SEQ ID NO: 3070969 - DNA, 15 bp, Homo sapiens
cattatagcgcctgt

SEQ ID NO: 3070970 - DNA, 17 bp, Homo sapiens
cattatagcgcctgtat

SEQ ID NO: 3070971 - DNA, 18 bp, Homo sapiens
cattatagcgcctgtata

SEQ ID NO: 3070972 - DNA, 22 bp, Homo sapiens
cattatagcgcctgtataagta

SEQ ID NO: 3070973 - DNA, 15 bp, Homo sapiens
cattatcaaaagtga

SEQ ID NO: 3070974 - DNA, 13 bp, Homo sapiens
cattatcatgtgt

SEQ ID NO: 3070975 - DNA, 16 bp, Homo sapiens
cattatcatgtgtaat

SEQ ID NO: 3070976 - DNA, 22 bp, Homo sapiens
cattatcatgtgtaatcaataa

SEQ ID NO: 3070977 - DNA, 12 bp, Homo sapiens
cattatgaggtc

SEQ ID NO: 3070978 - DNA, 19 bp, Homo sapiens
cattatgtccactgtgtat

SEQ ID NO: 3070979 - DNA, 19 bp, Homo sapiens
cattattagtactgctctt

SEQ ID NO: 3070980 - DNA, 19 bp, Homo sapiens
cattattgacgaactggct

SEQ ID NO: 3070981 - DNA, 16 bp, Homo sapiens
cattattgtcccacaa

SEQ ID NO: 3070982 - DNA, 12 bp, Homo sapiens
cattatttaata

SEQ ID NO: 3070983 - DNA, 17 bp, Homo sapiens
cattattttttgttgaa

SEQ ID NO: 3070984 - DNA, 21 bp, Homo sapiens
cattcaaaaaactctctccca

SEQ ID NO: 3070985 - DNA, 22 bp, Homo sapiens
cattcaaaaaactctctcccag

SEQ ID NO: 3070986 - DNA, 22 bp, Homo sapiens
cattcaaaaagacagcagacaa

SEQ ID NO: 3070987 - DNA, 24 bp, Homo sapiens
cattcaaaaagacagcagacaaaa

SEQ ID NO: 3070988 - DNA, 12 bp, Homo sapiens
cattcaacaaga

SEQ ID NO: 3070989 - DNA, 20 bp, Homo sapiens
cattcaaccacgcaggaagc

SEQ ID NO: 3070990 - DNA, 22 bp, Homo sapiens
cattcaagtgtaaaatattttg

SEQ ID NO: 3070991 - DNA, 20 bp, Homo sapiens
cattcaatcaacctgcactt

SEQ ID NO: 3070992 - DNA, 15 bp, Homo sapiens
cattcaatctccaga

SEQ ID NO: 3070993 - DNA, 21 bp, Homo sapiens
cattcaatttcaggctcccca

SEQ ID NO: 3070994 - DNA, 19 bp, Homo sapiens
cattcacctgccccaactc

SEQ ID NO: 3070995 - DNA, 22 bp, Homo sapiens
cattcacttctgcattcctgta

SEQ ID NO: 3070996 - DNA, 13 bp, Homo sapiens
cattcagaaaaaa

SEQ ID NO: 3070997 - DNA, 16 bp, Homo sapiens
cattcaggagcttcct

SEQ ID NO: 3070998 - DNA, 14 bp, Homo sapiens
cattcaggcagcac

SEQ ID NO: 3070999 - DNA, 17 bp, Homo sapiens
cattcaggcagcactga

SEQ ID NO: 3071000 - DNA, 23 bp, Homo sapiens
cattcagtgcacctgcctcagct

SEQ ID NO: 3071001 - DNA, 19 bp, Homo sapiens
cattcataaaagtttgcat

SEQ ID NO: 3071002 - DNA, 16 bp, Homo sapiens
cattcatggttatgaa

SEQ ID NO: 3071003 - DNA, 15 bp, Homo sapiens
cattcattttatatt

SEQ ID NO: 3071004 - DNA, 23 bp, Homo sapiens
cattcattttatattgaaaaaaa

SEQ ID NO: 3071005 - DNA, 18 bp, Homo sapiens
cattccaacaaagggttt

SEQ ID NO: 3071006 - DNA, 21 bp, Homo sapiens
cattccaactcgtatagcatg

SEQ ID NO: 3071007 - DNA, 13 bp, Homo sapiens
cattccaagacag

SEQ ID NO: 3071008 - DNA, 14 bp, Homo sapiens
cattccaagacagt

SEQ ID NO: 3071009 - DNA, 15 bp, Homo sapiens
cattccacactgttg

SEQ ID NO: 3071010 - DNA, 11 bp, Homo sapiens
cattccacagg

SEQ ID NO: 3071011 - DNA, 20 bp, Homo sapiens
cattccacaggatcatcatt

SEQ ID NO: 3071012 - DNA, 18 bp, Homo sapiens
cattccactgttggtatt

SEQ ID NO: 3071013 - DNA, 23 bp, Homo sapiens
cattccagtcaaatctgggctca

SEQ ID NO: 3071014 - DNA, 13 bp, Homo sapiens
cattccccaggtg

SEQ ID NO: 3071015 - DNA, 17 bp, Homo sapiens
cattccccaggtggctg

SEQ ID NO: 3071016 - DNA, 21 bp, Homo sapiens
cattccctgagtcaccaggaa

SEQ ID NO: 3071017 - DNA, 22 bp, Homo sapiens
cattccgtcctgatgattttta

SEQ ID NO: 3071018 - DNA, 23 bp, Homo sapiens
cattcctcagggacagagacacc

SEQ ID NO: 3071019 - DNA, 16 bp, Homo sapiens
cattcctgaagaacca

SEQ ID NO: 3071020 - DNA, 17 bp, Homo sapiens
cattcctgaagaaccag

SEQ ID NO: 3071021 - DNA, 21 bp, Homo sapiens
cattcctgatatgatttaaaa

SEQ ID NO: 3071022 - DNA, 16 bp, Homo sapiens
cattcctgttctttct

SEQ ID NO: 3071023 - DNA, 14 bp, Homo sapiens
cattcgttctgtgg

SEQ ID NO: 3071024 - DNA, 16 bp, Homo sapiens
cattctacacagagca

SEQ ID NO: 3071025 - DNA, 19 bp, Homo sapiens
cattctacacagagcagga

SEQ ID NO: 3071026 - DNA, 14 bp, Homo sapiens
cattctacacctgg

SEQ ID NO: 3071027 - DNA, 15 bp, Homo sapiens
cattctacacctgga

SEQ ID NO: 3071028 - DNA, 15 bp, Homo sapiens
cattctactgaaaag

SEQ ID NO: 3071029 - DNA, 21 bp, Homo sapiens
cattctagatgcaagtctctt

SEQ ID NO: 3071030 - DNA, 22 bp, Homo sapiens
cattctatcgttattataaatg

SEQ ID NO: 3071031 - DNA, 14 bp, Homo sapiens
cattctccacagca

SEQ ID NO: 3071032 - DNA, 15 bp, Homo sapiens
cattctccacagcaa

SEQ ID NO: 3071033 - DNA, 22 bp, Homo sapiens
cattctcctcctcctccctcct

SEQ ID NO: 3071034 - DNA, 18 bp, Homo sapiens
cattctcctgcctcagcc

SEQ ID NO: 3071035 - DNA, 17 bp, Homo sapiens
cattctcgttgcctctg

SEQ ID NO: 3071036 - DNA, 15 bp, Homo sapiens
cattctctctcctgt

SEQ ID NO: 3071037 - DNA, 17 bp, Homo sapiens
ccaaggaaacgctacct

SEQ ID NO: 3071038 - DNA, 12 bp, Homo sapiens
ccaaggaaggag

SEQ ID NO: 3071039 - DNA, 15 bp, Homo sapiens
ccaaggagctgctat

SEQ ID NO: 3071040 - DNA, 22 bp, Homo sapiens
ccaaggagctgctatagcctgg

SEQ ID NO: 3071041 - DNA, 21 bp, Homo sapiens
ccaaggaggaaaaacagacaa

SEQ ID NO: 3071042 - DNA, 20 bp, Homo sapiens
ccaaggagggtgagtgcaag

SEQ ID NO: 3071043 - DNA, 20 bp, Homo sapiens
ccaaggccttctcaggctgg

SEQ ID NO: 3071044 - DNA, 20 bp, Homo sapiens
ccaaggcgggcggatcactt

SEQ ID NO: 3071045 - DNA, 24 bp, Homo sapiens
ccaagggagttaggctattcacaa

SEQ ID NO: 3071046 - DNA, 13 bp, Homo sapiens
ccaagggcccaaa

SEQ ID NO: 3071047 - DNA, 16 bp, Homo sapiens
ccaaggggcttcaggt

SEQ ID NO: 3071048 - DNA, 15 bp, Homo sapiens
ccaagggggcagagg

SEQ ID NO: 3071049 - DNA, 23 bp, Homo sapiens
ccaagggggcggggactgctggc

SEQ ID NO: 3071050 - DNA, 15 bp, Homo sapiens
ccaaggtctcacact

SEQ ID NO: 3071051 - DNA, 23 bp, Homo sapiens
ccaaggtctcacactcctcctgc

SEQ ID NO: 3071052 - DNA, 18 bp, Homo sapiens
ccaaggtgaaatgaagca

SEQ ID NO: 3071053 - DNA, 19 bp, Homo sapiens
ccaaggtgcatatagaaaa

SEQ ID NO: 3071054 - DNA, 22 bp, Homo sapiens
ccaaggtgcatatagaaaacaa

SEQ ID NO: 3071055 - DNA, 21 bp, Homo sapiens
ccaaggtgtcatttatgtgtc

SEQ ID NO: 3071056 - DNA, 17 bp, Homo sapiens
ccaaggttactcagcag

SEQ ID NO: 3071057 - DNA, 22 bp, Homo sapiens
ccaaggttactcagcagcagag

SEQ ID NO: 3071058 - DNA, 20 bp, Homo sapiens
ccaaggtttaaagagtctag

SEQ ID NO: 3071059 - DNA, 22 bp, Homo sapiens
ccaaggtttaaagagtctagat

SEQ ID NO: 3071060 - DNA, 15 bp, Homo sapiens
ccaagtaagaggctg

SEQ ID NO: 3071061 - DNA, 21 bp, Homo sapiens
ccaagtatagcctatggcaga

SEQ ID NO: 3071062 - DNA, 13 bp, Homo sapiens
ccaagtcaggcca

SEQ ID NO: 3071063 - DNA, 14 bp, Homo sapiens
ccaagtcaggccag

SEQ ID NO: 3071064 - DNA, 16 bp, Homo sapiens
ccaagtcaggccaggt

SEQ ID NO: 3071065 - DNA, 16 bp, Homo sapiens
ccaagtcctgcctttg

SEQ ID NO: 3071066 - DNA, 23 bp, Homo sapiens
ccaagtgaccagggaagtgtgtg

SEQ ID NO: 3071067 - DNA, 18 bp, Homo sapiens
ccaagtgccaagacacag

SEQ ID NO: 3071068 - DNA, 13 bp, Homo sapiens
ccaagtgctggcc

SEQ ID NO: 3071069 - DNA, 14 bp, Homo sapiens
ccaagtgctggccc

SEQ ID NO: 3071070 - DNA, 15 bp, Homo sapiens
ccaagtgctggccca

SEQ ID NO: 3071071 - DNA, 20 bp, Homo sapiens
ccaagtggaagccactggac

SEQ ID NO: 3071072 - DNA, 20 bp, Homo sapiens
ccaagtggcagtttttaaaa

SEQ ID NO: 3071073 - DNA, 13 bp, Homo sapiens
ccaagtgggctgg

SEQ ID NO: 3071074 - DNA, 23 bp, Homo sapiens
ccaagtgggctggtattctctct

SEQ ID NO: 3071075 - DNA, 18 bp, Homo sapiens
ccaagtgggggcagaggg

SEQ ID NO: 3071076 - DNA, 20 bp, Homo sapiens
ccaagtgtattttaaaatag

SEQ ID NO: 3071077 - DNA, 21 bp, Homo sapiens
ccaagtgtattttaaaataga

SEQ ID NO: 3071078 - DNA, 19 bp, Homo sapiens
ccaagtgtgcatattgtac

SEQ ID NO: 3071079 - DNA, 18 bp, Homo sapiens
ccaagttcacagtagagt

SEQ ID NO: 3071080 - DNA, 22 bp, Homo sapiens
ccaagttgagactcggccgcag

SEQ ID NO: 3071081 - DNA, 22 bp, Homo sapiens
ccaagttgatttagtgttttta

SEQ ID NO: 3071082 - DNA, 14 bp, Homo sapiens
ccaagtttatatac

SEQ ID NO: 3071083 - DNA, 14 bp, Homo sapiens
ccaatacatttgta

SEQ ID NO: 3071084 - DNA, 17 bp, Homo sapiens
ccaatacatttgtattt

SEQ ID NO: 3071085 - DNA, 22 bp, Homo sapiens
ccaatacatttgtattttgtga

SEQ ID NO: 3071086 - DNA, 17 bp, Homo sapiens
ccaatatatgtattttt

SEQ ID NO: 3071087 - DNA, 18 bp, Homo sapiens
ccaatattaaatctgctg

SEQ ID NO: 3071088 - DNA, 22 bp, Homo sapiens
ccaatcaatttaaatgtttact

SEQ ID NO: 3071089 - DNA, 20 bp, Homo sapiens
ccaatccaggtacgcacaga

SEQ ID NO: 3071090 - DNA, 20 bp, Homo sapiens
ccaatccatcgtattaaaaa

SEQ ID NO: 3071091 - DNA, 20 bp, Homo sapiens
ccaatccatttggcagaact

SEQ ID NO: 3071092 - DNA, 18 bp, Homo sapiens
ccaatcccagctacctca

SEQ ID NO: 3071093 - DNA, 14 bp, Homo sapiens
ccaatccctggcca

SEQ ID NO: 3071094 - DNA, 17 bp, Homo sapiens
ccaatcctccccgctct

SEQ ID NO: 3071095 - DNA, 18 bp, Homo sapiens
ccaatcctccccgctctg

SEQ ID NO: 3071096 - DNA, 16 bp, Homo sapiens
ccaatcggtgtgtagt

SEQ ID NO: 3071097 - DNA, 20 bp, Homo sapiens
ccaatcttgttttaagcaaa

SEQ ID NO: 3071098 - DNA, 17 bp, Homo sapiens
ccaatctttcctacttt

SEQ ID NO: 3071099 - DNA, 20 bp, Homo sapiens
ccaatctttcctactttcta

SEQ ID NO: 3071100 - DNA, 18 bp, Homo sapiens
ccaatgaaaaaattaaaa

SEQ ID NO: 3071101 - DNA, 21 bp, Homo sapiens
ccaatgagacttgccttccta

SEQ ID NO: 3071102 - DNA, 13 bp, Homo sapiens
ccaatgccaaaaa

SEQ ID NO: 3071103 - DNA, 17 bp, Homo sapiens
ccaatgtaggagctgcc

SEQ ID NO: 3071104 - DNA, 21 bp, Homo sapiens
ccaattaaaaacgaaaacctg

SEQ ID NO: 3071105 - DNA, 18 bp, Homo sapiens
ccaattacggtgtacagt

SEQ ID NO: 3071106 - DNA, 22 bp, Homo sapiens
ccaattacggtgtacagtttaa

SEQ ID NO: 3071107 - DNA, 21 bp, Homo sapiens
ccaattagggggtaaggcccc

SEQ ID NO: 3071108 - DNA, 18 bp, Homo sapiens
ccaattagtcactgctgc

SEQ ID NO: 3071109 - DNA, 14 bp, Homo sapiens
ccaattcagacagg

SEQ ID NO: 3071110 - DNA, 16 bp, Homo sapiens
ccaattcagacaggca

SEQ ID NO: 3071111 - DNA, 17 bp, Homo sapiens
ccaattctcgagcttgg

SEQ ID NO: 3071112 - DNA, 20 bp, Homo sapiens
ccaatttgtaaaaacagcat

SEQ ID NO: 3071113 - DNA, 23 bp, Homo sapiens
ccaattttaatttagtaaatgtt

SEQ ID NO: 3071114 - DNA, 16 bp, Homo sapiens
ccacaaacggagcccc

SEQ ID NO: 3071115 - DNA, 17 bp, Homo sapiens
ccacaaacggagcccct

SEQ ID NO: 3071116 - DNA, 18 bp, Homo sapiens
ccacaaacggagcccctg

SEQ ID NO: 3071117 - DNA, 20 bp, Homo sapiens
ccacaaacggagcccctgaa

SEQ ID NO: 3071118 - DNA, 15 bp, Homo sapiens
ccacaaagcaaaggc

SEQ ID NO: 3071119 - DNA, 22 bp, Homo sapiens
ccacaaagcaaaggcagtcccg

SEQ ID NO: 3071120 - DNA, 16 bp, Homo sapiens
ccacaaaggcaaaggg

SEQ ID NO: 3071121 - DNA, 16 bp, Homo sapiens
ccacaacactgtgtca

SEQ ID NO: 3071122 - DNA, 23 bp, Homo sapiens
ccacaaccaaaaaaaaataaaaa

SEQ ID NO: 3071123 - DNA, 17 bp, Homo sapiens
ccacaaccctctggaag

SEQ ID NO: 3071124 - DNA, 18 bp, Homo sapiens
ccacaaccctctggaagt

SEQ ID NO: 3071125 - DNA, 22 bp, Homo sapiens
ccacaaccctctggaagtggcc

SEQ ID NO: 3071126 - DNA, 15 bp, Homo sapiens
ccacaaccttgcagt

SEQ ID NO: 3071127 - DNA, 17 bp, Homo sapiens
ccacaactattttcaga

SEQ ID NO: 3071128 - DNA, 18 bp, Homo sapiens
ccacaagattcccagaga

SEQ ID NO: 3071129 - DNA, 21 bp, Homo sapiens
ccacaagattcccagagacag

SEQ ID NO: 3071130 - DNA, 15 bp, Homo sapiens
ccacaagcctgcctc

SEQ ID NO: 3071131 - DNA, 15 bp, Homo sapiens
ccacaagctgcctct

SEQ ID NO: 3071132 - DNA, 17 bp, Homo sapiens
ccacaaggacttcctgt

SEQ ID NO: 3071133 - DNA, 21 bp, Homo sapiens
ccacaagtggtggtaaccctg

SEQ ID NO: 3071134 - DNA, 13 bp, Homo sapiens
ccacacacacaga

SEQ ID NO: 3071135 - DNA, 15 bp, Homo sapiens
ccacacacacagaaa

SEQ ID NO: 3071136 - DNA, 20 bp, Homo sapiens
ccacacacacagaaaatata

SEQ ID NO: 3071137 - DNA, 21 bp, Homo sapiens
ccacacacacagaaaatatac

SEQ ID NO: 3071138 - DNA, 11 bp, Homo sapiens
ccacacacagg

SEQ ID NO: 3071139 - DNA, 12 bp, Homo sapiens
ccacacatccca

SEQ ID NO: 3071140 - DNA, 17 bp, Homo sapiens
ccacacatcccagccca

SEQ ID NO: 3071141 - DNA, 14 bp, Homo sapiens
ccacaccactgcca

SEQ ID NO: 3071142 - DNA, 23 bp, Homo sapiens
ccacaccctgcctgctgtggagc

SEQ ID NO: 3071143 - DNA, 17 bp, Homo sapiens
ccacacctgcagtgcca

SEQ ID NO: 3071144 - DNA, 23 bp, Homo sapiens
ccacacgcaaaccaacctttctg

SEQ ID NO: 3071145 - DNA, 16 bp, Homo sapiens
ccacacgcaggcggcc

SEQ ID NO: 3071146 - DNA, 18 bp, Homo sapiens
ccacacgcaggcggccag

SEQ ID NO: 3071147 - DNA, 19 bp, Homo sapiens
ccacactcgccatctcctg

SEQ ID NO: 3071148 - DNA, 14 bp, Homo sapiens
ccacactgaccaag

SEQ ID NO: 3071149 - DNA, 22 bp, Homo sapiens
ccacactgatccagccctgagt

SEQ ID NO: 3071150 - DNA, 21 bp, Homo sapiens
ccacactgctacacttctgat

SEQ ID NO: 3071151 - DNA, 22 bp, Homo sapiens
ccacactggactccggccctcc

SEQ ID NO: 3071152 - DNA, 17 bp, Homo sapiens
ccacactgtgacacact

SEQ ID NO: 3071153 - DNA, 18 bp, Homo sapiens
ccacactgtgacacacta

SEQ ID NO: 3071154 - DNA, 17 bp, Homo sapiens
ccacacttgtgccagcc

SEQ ID NO: 3071155 - DNA, 18 bp, Homo sapiens
ccacagaaggtgaacttt

SEQ ID NO: 3071156 - DNA, 15 bp, Homo sapiens
ccacagactgcccca

SEQ ID NO: 3071157 - DNA, 16 bp, Homo sapiens
ccacagactgccccag

SEQ ID NO: 3071158 - DNA, 18 bp, Homo sapiens
ccacagactgccccagcc

SEQ ID NO: 3071159 - DNA, 19 bp, Homo sapiens
ccacagactgccccagcca

SEQ ID NO: 3071160 - DNA, 15 bp, Homo sapiens
ccacagcccaggcct

SEQ ID NO: 3071161 - DNA, 16 bp, Homo sapiens
ccacagcctcccctgc

SEQ ID NO: 3071162 - DNA, 13 bp, Homo sapiens
ccacagctcccac

SEQ ID NO: 3071163 - DNA, 19 bp, Homo sapiens
ccacagctcccaccccacc

SEQ ID NO: 3071164 - DNA, 19 bp, Homo sapiens
ccacagctgaagagcaagg

SEQ ID NO: 3071165 - DNA, 19 bp, Homo sapiens
ccacagcttatggcatctc

SEQ ID NO: 3071166 - DNA, 16 bp, Homo sapiens
ccacaggaacggccct

SEQ ID NO: 3071167 - DNA, 17 bp, Homo sapiens
ccacaggaacggccctg

SEQ ID NO: 3071168 - DNA, 16 bp, Homo sapiens
ccagccctgcccaccc

SEQ ID NO: 3071169 - DNA, 19 bp, Homo sapiens
ccagccctgctgcttccta

SEQ ID NO: 3071170 - DNA, 18 bp, Homo sapiens
ccagccgcaggaaggcag

SEQ ID NO: 3071171 - DNA, 20 bp, Homo sapiens
ccagccgctctcctgccaca

SEQ ID NO: 3071172 - DNA, 15 bp, Homo sapiens
ccagccgggcacagt

SEQ ID NO: 3071173 - DNA, 17 bp, Homo sapiens
ccagcctcacagatgct

SEQ ID NO: 3071174 - DNA, 18 bp, Homo sapiens
ccagcctcacagatgctg

SEQ ID NO: 3071175 - DNA, 21 bp, Homo sapiens
ccagcctcacagatgctggcc

SEQ ID NO: 3071176 - DNA, 22 bp, Homo sapiens
ccagcctcagcggaccactctt

SEQ ID NO: 3071177 - DNA, 15 bp, Homo sapiens
ccagcctccctgaag

SEQ ID NO: 3071178 - DNA, 14 bp, Homo sapiens
ccagcctcctgggg

SEQ ID NO: 3071179 - DNA, 18 bp, Homo sapiens
ccagcctctcctccttgg

SEQ ID NO: 3071180 - DNA, 10 bp, Homo sapiens
ccagcctgcc

SEQ ID NO: 3071181 - DNA, 18 bp, Homo sapiens
ccagcctgcctggcaggc

SEQ ID NO: 3071182 - DNA, 17 bp, Homo sapiens
ccagcctgggaggcaca

SEQ ID NO: 3071183 - DNA, 18 bp, Homo sapiens
ccagcctgggcaacaaag

SEQ ID NO: 3071184 - DNA, 18 bp, Homo sapiens
ccagcctttgggtcctgg

SEQ ID NO: 3071185 - DNA, 15 bp, Homo sapiens
ccagcgagccacagg

SEQ ID NO: 3071186 - DNA, 20 bp, Homo sapiens
ccagcgagccacaggaacgg

SEQ ID NO: 3071187 - DNA, 20 bp, Homo sapiens
ccagcgatggtgctgcccag

SEQ ID NO: 3071188 - DNA, 21 bp, Homo sapiens
ccagcgatggtgctgcccagg

SEQ ID NO: 3071189 - DNA, 23 bp, Homo sapiens
ccagcgatggtgctgcccaggcc

SEQ ID NO: 3071190 - DNA, 20 bp, Homo sapiens
ccagcggcccaagagcccgt

SEQ ID NO: 3071191 - DNA, 13 bp, Homo sapiens
ccagcggctccaa

SEQ ID NO: 3071192 - DNA, 15 bp, Homo sapiens
ccagcggctccaact

SEQ ID NO: 3071193 - DNA, 17 bp, Homo sapiens
ccagcgggaatggcagc

SEQ ID NO: 3071194 - DNA, 19 bp, Homo sapiens
ccagcggtccatgggtctg

SEQ ID NO: 3071195 - DNA, 19 bp, Homo sapiens
ccagcgtatatataagaaa

SEQ ID NO: 3071196 - DNA, 13 bp, Homo sapiens
ccagctaagaacc

SEQ ID NO: 3071197 - DNA, 18 bp, Homo sapiens
ccagctaagaacctggaa

SEQ ID NO: 3071198 - DNA, 19 bp, Homo sapiens
ccagctacacctttctcct

SEQ ID NO: 3071199 - DNA, 14 bp, Homo sapiens
ccagctactcagga

SEQ ID NO: 3071200 - DNA, 17 bp, Homo sapiens
ccagctactcaggaggc

SEQ ID NO: 3071201 - DNA, 20 bp, Homo sapiens
ccagctactcaggaggctga

SEQ ID NO: 3071202 - DNA, 21 bp, Homo sapiens
ccagctactcaggaggctgag

SEQ ID NO: 3071203 - DNA, 22 bp, Homo sapiens
ccagctactcaggaggctgaga

SEQ ID NO: 3071204 - DNA, 19 bp, Homo sapiens
ccagctactgaaccagcca

SEQ ID NO: 3071205 - DNA, 21 bp, Homo sapiens
ccagctactggggaggctgag

SEQ ID NO: 3071206 - DNA, 23 bp, Homo sapiens
ccagctactggggaggctgaggc

SEQ ID NO: 3071207 - DNA, 18 bp, Homo sapiens
ccagctacttagctggcc

SEQ ID NO: 3071208 - DNA, 19 bp, Homo sapiens
ccagctacttagctggcca

SEQ ID NO: 3071209 - DNA, 22 bp, Homo sapiens
ccagctacttgggagcctgagg

SEQ ID NO: 3071210 - DNA, 16 bp, Homo sapiens
ccagctatacctgtgc

SEQ ID NO: 3071211 - DNA, 15 bp, Homo sapiens
ccagctcagcagtga

SEQ ID NO: 3071212 - DNA, 20 bp, Homo sapiens
ccagctcaggggacactggc

SEQ ID NO: 3071213 - DNA, 17 bp, Homo sapiens
ccagctcattcatttta

SEQ ID NO: 3071214 - DNA, 22 bp, Homo sapiens
ccagctccaaggggaatcagaa

SEQ ID NO: 3071215 - DNA, 13 bp, Homo sapiens
ccagctccaggcc

SEQ ID NO: 3071216 - DNA, 18 bp, Homo sapiens
ccagctcccgctgtggcc

SEQ ID NO: 3071217 - DNA, 19 bp, Homo sapiens
ccagctccgacctctctca

SEQ ID NO: 3071218 - DNA, 16 bp, Homo sapiens
ccagctccttttctgt

SEQ ID NO: 3071219 - DNA, 17 bp, Homo sapiens
ccagctctaagcagcca

SEQ ID NO: 3071220 - DNA, 22 bp, Homo sapiens
ccagctctccctctggccctgc

SEQ ID NO: 3071221 - DNA, 23 bp, Homo sapiens
ccagctctccctctggccctgcc

SEQ ID NO: 3071222 - DNA, 21 bp, Homo sapiens
ccagctctgaggactgcacca

SEQ ID NO: 3071223 - DNA, 21 bp, Homo sapiens
ccagctctgtatcaggaccca

SEQ ID NO: 3071224 - DNA, 22 bp, Homo sapiens
ccagctctgtcaccctggccac

SEQ ID NO: 3071225 - DNA, 15 bp, Homo sapiens
ccagctcttgctctc

SEQ ID NO: 3071226 - DNA, 18 bp, Homo sapiens
ccagctcttgctctcttg

SEQ ID NO: 3071227 - DNA, 20 bp, Homo sapiens
ccagctgagcgccaggatgg

SEQ ID NO: 3071228 - DNA, 14 bp, Homo sapiens
ccagctgcaaagtg

SEQ ID NO: 3071229 - DNA, 15 bp, Homo sapiens
ccagctgcaaagtgt

SEQ ID NO: 3071230 - DNA, 12 bp, Homo sapiens
ccagctgcctcc

SEQ ID NO: 3071231 - DNA, 14 bp, Homo sapiens
ccagctgctcccca

SEQ ID NO: 3071232 - DNA, 24 bp, Homo sapiens
ccagctggagaaatatggtactca

SEQ ID NO: 3071233 - DNA, 14 bp, Homo sapiens
ccagctggcagcag

SEQ ID NO: 3071234 - DNA, 17 bp, Homo sapiens
ccagctgggtcaggcag

SEQ ID NO: 3071235 - DNA, 16 bp, Homo sapiens
ccagctgtcagcctgg

SEQ ID NO: 3071236 - DNA, 16 bp, Homo sapiens
ccagctgtgcccctcc

SEQ ID NO: 3071237 - DNA, 15 bp, Homo sapiens
ccagctgtgcttatg

SEQ ID NO: 3071238 - DNA, 18 bp, Homo sapiens
ccagcttgccagatgctg

SEQ ID NO: 3071239 - DNA, 16 bp, Homo sapiens
ccagcttgctcttcag

SEQ ID NO: 3071240 - DNA, 23 bp, Homo sapiens
ccagcttgctcttcagtgggaga

SEQ ID NO: 3071241 - DNA, 14 bp, Homo sapiens
ccagctttctgcag

SEQ ID NO: 3071242 - DNA, 21 bp, Homo sapiens
ccaggaaaaaaaaaaaaagaa

SEQ ID NO: 3071243 - DNA, 17 bp, Homo sapiens
ccaggaaactcttgcta

SEQ ID NO: 3071244 - DNA, 14 bp, Homo sapiens
ccaggaagcaggga

SEQ ID NO: 3071245 - DNA, 17 bp, Homo sapiens
ccaggaagcagggagag

SEQ ID NO: 3071246 - DNA, 17 bp, Homo sapiens
ccaggaagcccactgcc

SEQ ID NO: 3071247 - DNA, 15 bp, Homo sapiens
ccaggaagctttggt

SEQ ID NO: 3071248 - DNA, 19 bp, Homo sapiens
ccaggaaggacagactggc

SEQ ID NO: 3071249 - DNA, 16 bp, Homo sapiens
ccaggaagggagggag

SEQ ID NO: 3071250 - DNA, 22 bp, Homo sapiens
ccaggaagggagggagctgagg

SEQ ID NO: 3071251 - DNA, 20 bp, Homo sapiens
ccaggaatattgtcatcctt

SEQ ID NO: 3071252 - DNA, 14 bp, Homo sapiens
ccaggaatgtttca

SEQ ID NO: 3071253 - DNA, 17 bp, Homo sapiens
ccaggaatgtttcagct

SEQ ID NO: 3071254 - DNA, 16 bp, Homo sapiens
ccaggaatttcccagg

SEQ ID NO: 3071255 - DNA, 22 bp, Homo sapiens
ccaggaatttcccaggaccctg

SEQ ID NO: 3071256 - DNA, 22 bp, Homo sapiens
ccaggaatttgggaccctgctt

SEQ ID NO: 3071257 - DNA, 14 bp, Homo sapiens
ccaggacaggcccg

SEQ ID NO: 3071258 - DNA, 16 bp, Homo sapiens
ccaggaccagctcagg

SEQ ID NO: 3071259 - DNA, 15 bp, Homo sapiens
ccaggaccatcatcc

SEQ ID NO: 3071260 - DNA, 15 bp, Homo sapiens
ccaggacccagggag

SEQ ID NO: 3071261 - DNA, 16 bp, Homo sapiens
ccaggacccagggaga

SEQ ID NO: 3071262 - DNA, 19 bp, Homo sapiens
ccaggacccgccagccccg

SEQ ID NO: 3071263 - DNA, 15 bp, Homo sapiens
ccaggacctggctgc

SEQ ID NO: 3071264 - DNA, 21 bp, Homo sapiens
ccaggactatatttgggcctg

SEQ ID NO: 3071265 - DNA, 17 bp, Homo sapiens
ccaggactctctgcttg

SEQ ID NO: 3071266 - DNA, 13 bp, Homo sapiens
ccaggactctgac

SEQ ID NO: 3071267 - DNA, 14 bp, Homo sapiens
ccaggactggctgt

SEQ ID NO: 3071268 - DNA, 23 bp, Homo sapiens
ccaggactgtcattttggcatct

SEQ ID NO: 3071269 - DNA, 21 bp, Homo sapiens
ccaggacttatttaaactctg

SEQ ID NO: 3071270 - DNA, 18 bp, Homo sapiens
ccaggagacctgctctcc

SEQ ID NO: 3071271 - DNA, 19 bp, Homo sapiens
ccaggagacctgctctccg

SEQ ID NO: 3071272 - DNA, 18 bp, Homo sapiens
ccaggagagccagccctc

SEQ ID NO: 3071273 - DNA, 17 bp, Homo sapiens
ccaggagcacctggacc

SEQ ID NO: 3071274 - DNA, 14 bp, Homo sapiens
ccaggagctctgcg

SEQ ID NO: 3071275 - DNA, 20 bp, Homo sapiens
ccaggagctctgcgccaggc

SEQ ID NO: 3071276 - DNA, 21 bp, Homo sapiens
ccaggagctctgcgccaggca

SEQ ID NO: 3071277 - DNA, 22 bp, Homo sapiens
ccaggaggcggcagctcttctg

SEQ ID NO: 3071278 - DNA, 21 bp, Homo sapiens
ccaggaggctttaagctccag

SEQ ID NO: 3071279 - DNA, 22 bp, Homo sapiens
ccaggaggctttaagctccagc

SEQ ID NO: 3071280 - DNA, 20 bp, Homo sapiens
ccaggaggggaacactgccc

SEQ ID NO: 3071281 - DNA, 19 bp, Homo sapiens
ccaggagtttgaggctgca

SEQ ID NO: 3071282 - DNA, 18 bp, Homo sapiens
ccaggatctgctccaaca

SEQ ID NO: 3071283 - DNA, 20 bp, Homo sapiens
ccaggattggggacctgatg

SEQ ID NO: 3071284 - DNA, 18 bp, Homo sapiens
ccaggatttgctgggaga

SEQ ID NO: 3071285 - DNA, 14 bp, Homo sapiens
ccaggatttggttg

SEQ ID NO: 3071286 - DNA, 19 bp, Homo sapiens
ccaggcacatggctggggg

SEQ ID NO: 3071287 - DNA, 22 bp, Homo sapiens
ccaggcacgaacccacctgctg

SEQ ID NO: 3071288 - DNA, 23 bp, Homo sapiens
ccaggcacgaacccacctgctga

SEQ ID NO: 3071289 - DNA, 12 bp, Homo sapiens
ccaggcagagct

SEQ ID NO: 3071290 - DNA, 16 bp, Homo sapiens
ccaggcagagctgagg

SEQ ID NO: 3071291 - DNA, 13 bp, Homo sapiens
ccaggcagatcca

SEQ ID NO: 3071292 - DNA, 19 bp, Homo sapiens
ccaggcagggccaaccctt

SEQ ID NO: 3071293 - DNA, 15 bp, Homo sapiens
ccaggcaggtctgca

SEQ ID NO: 3071294 - DNA, 21 bp, Homo sapiens
ccaggcatccatcttggaaga

SEQ ID NO: 3071295 - DNA, 16 bp, Homo sapiens
ccaggccactggcccc

SEQ ID NO: 3071296 - DNA, 23 bp, Homo sapiens
ccaggccactggcccctgagatc

SEQ ID NO: 3071297 - DNA, 15 bp, Homo sapiens
ccaggccagctcctt

SEQ ID NO: 3071298 - DNA, 12 bp, Homo sapiens
ccaggccagggc

SEQ ID NO: 3071299 - DNA, 20 bp, Homo sapiens
ccatctgtccatcctcctct

SEQ ID NO: 3071300 - DNA, 19 bp, Homo sapiens
ccatctgtccgtccagagc

SEQ ID NO: 3071301 - DNA, 20 bp, Homo sapiens
ccatctgtggttttcctcta

SEQ ID NO: 3071302 - DNA, 11 bp, Homo sapiens
ccatcttgctt

SEQ ID NO: 3071303 - DNA, 17 bp, Homo sapiens
ccatcttggcagggtta

SEQ ID NO: 3071304 - DNA, 14 bp, Homo sapiens
ccatcttggtaaat

SEQ ID NO: 3071305 - DNA, 21 bp, Homo sapiens
ccatgaaaaaaatgatcccca

SEQ ID NO: 3071306 - DNA, 19 bp, Homo sapiens
ccatgaagccacagcccag

SEQ ID NO: 3071307 - DNA, 20 bp, Homo sapiens
ccatgaaggaaattgggact

SEQ ID NO: 3071308 - DNA, 17 bp, Homo sapiens
ccatgaatcgcttctct

SEQ ID NO: 3071309 - DNA, 20 bp, Homo sapiens
ccatgacaatgttgtagtgt

SEQ ID NO: 3071310 - DNA, 23 bp, Homo sapiens
ccatgaggagaaaaaaagcatgt

SEQ ID NO: 3071311 - DNA, 23 bp, Homo sapiens
ccatgaggtactggtcccttcct

SEQ ID NO: 3071312 - DNA, 17 bp, Homo sapiens
ccatgatgcatggagtg

SEQ ID NO: 3071313 - DNA, 14 bp, Homo sapiens
ccatgatggcaaca

SEQ ID NO: 3071314 - DNA, 19 bp, Homo sapiens
ccatgatggcaacagatct

SEQ ID NO: 3071315 - DNA, 21 bp, Homo sapiens
ccatgatggcaacagatctgg

SEQ ID NO: 3071316 - DNA, 17 bp, Homo sapiens
ccatgatttcccactgc

SEQ ID NO: 3071317 - DNA, 23 bp, Homo sapiens
ccatgatttcccactgcactcca

SEQ ID NO: 3071318 - DNA, 14 bp, Homo sapiens
ccatgcaagtgctg

SEQ ID NO: 3071319 - DNA, 18 bp, Homo sapiens
ccatgcaagtgctgtttg

SEQ ID NO: 3071320 - DNA, 19 bp, Homo sapiens
ccatgcaccaacccactgc

SEQ ID NO: 3071321 - DNA, 20 bp, Homo sapiens
ccatgcaccaggactggctg

SEQ ID NO: 3071322 - DNA, 19 bp, Homo sapiens
ccatgcacccctgatgttc

SEQ ID NO: 3071323 - DNA, 21 bp, Homo sapiens
ccatgcaccctcatacacaga

SEQ ID NO: 3071324 - DNA, 19 bp, Homo sapiens
ccatgcactgtgaaggacc

SEQ ID NO: 3071325 - DNA, 15 bp, Homo sapiens
ccatgcctcagccct

SEQ ID NO: 3071326 - DNA, 19 bp, Homo sapiens
ccatgcctgcaaccttgca

SEQ ID NO: 3071327 - DNA, 14 bp, Homo sapiens
ccatgcctgtggct

SEQ ID NO: 3071328 - DNA, 15 bp, Homo sapiens
ccatgcctgtggctg

SEQ ID NO: 3071329 - DNA, 16 bp, Homo sapiens
ccatgcctgtggctgc

SEQ ID NO: 3071330 - DNA, 20 bp, Homo sapiens
ccatgcgcgcgctctctctc

SEQ ID NO: 3071331 - DNA, 21 bp, Homo sapiens
ccatgctcccaactcccttct

SEQ ID NO: 3071332 - DNA, 20 bp, Homo sapiens
ccatgctggtggaaagatag

SEQ ID NO: 3071333 - DNA, 20 bp, Homo sapiens
ccatgctgttgattgctaaa

SEQ ID NO: 3071334 - DNA, 24 bp, Homo sapiens
ccatgctgttgattgctaaatgta

SEQ ID NO: 3071335 - DNA, 14 bp, Homo sapiens
ccatggacaggctg

SEQ ID NO: 3071336 - DNA, 19 bp, Homo sapiens
ccatggacaggctggctcc

SEQ ID NO: 3071337 - DNA, 17 bp, Homo sapiens
ccatggagccagctccc

SEQ ID NO: 3071338 - DNA, 14 bp, Homo sapiens
ccatggcttcctga

SEQ ID NO: 3071339 - DNA, 19 bp, Homo sapiens
ccatggctttcatcctgtg

SEQ ID NO: 3071340 - DNA, 16 bp, Homo sapiens
ccatgggaataataga

SEQ ID NO: 3071341 - DNA, 11 bp, Homo sapiens
ccatgggacca

SEQ ID NO: 3071342 - DNA, 14 bp, Homo sapiens
ccatgggcagagcc

SEQ ID NO: 3071343 - DNA, 23 bp, Homo sapiens
ccatggtagaaaatgcaccaaat

SEQ ID NO: 3071344 - DNA, 15 bp, Homo sapiens
ccatggtccctagca

SEQ ID NO: 3071345 - DNA, 15 bp, Homo sapiens
ccatgtaatgatctt

SEQ ID NO: 3071346 - DNA, 19 bp, Homo sapiens
ccatgtagaataaatgaag

SEQ ID NO: 3071347 - DNA, 14 bp, Homo sapiens
ccatgtagccccct

SEQ ID NO: 3071348 - DNA, 23 bp, Homo sapiens
ccatgtagccccctggcctctgt

SEQ ID NO: 3071349 - DNA, 23 bp, Homo sapiens
ccatgtatagctagctatttcta

SEQ ID NO: 3071350 - DNA, 18 bp, Homo sapiens
ccatgtgaaactctaccc

SEQ ID NO: 3071351 - DNA, 17 bp, Homo sapiens
ccatgtgcggagcagcc

SEQ ID NO: 3071352 - DNA, 15 bp, Homo sapiens
ccatgtggcctgccc

SEQ ID NO: 3071353 - DNA, 18 bp, Homo sapiens
ccatgtgtatgcgtgtcc

SEQ ID NO: 3071354 - DNA, 22 bp, Homo sapiens
ccatgttaatttcatgtgtcaa

SEQ ID NO: 3071355 - DNA, 19 bp, Homo sapiens
ccatgttggtcaggctggt

SEQ ID NO: 3071356 - DNA, 17 bp, Homo sapiens
ccatgtttgagctcaga

SEQ ID NO: 3071357 - DNA, 15 bp, Homo sapiens
ccatgttttaaaatt

SEQ ID NO: 3071358 - DNA, 16 bp, Homo sapiens
ccatgtttttgccaaa

SEQ ID NO: 3071359 - DNA, 15 bp, Homo sapiens
ccattaattaatgag

SEQ ID NO: 3071360 - DNA, 19 bp, Homo sapiens
ccattacccagtgccgagg

SEQ ID NO: 3071361 - DNA, 19 bp, Homo sapiens
ccattacttgtataaatac

SEQ ID NO: 3071362 - DNA, 14 bp, Homo sapiens
ccattagaatgtga

SEQ ID NO: 3071363 - DNA, 21 bp, Homo sapiens
ccattcacttctgcattcctg

SEQ ID NO: 3071364 - DNA, 16 bp, Homo sapiens
ccattcctcagggaca

SEQ ID NO: 3071365 - DNA, 15 bp, Homo sapiens
ccattctccacagca

SEQ ID NO: 3071366 - DNA, 22 bp, Homo sapiens
ccattctcctgcctcagccttc

SEQ ID NO: 3071367 - DNA, 14 bp, Homo sapiens
ccattctctctcct

SEQ ID NO: 3071368 - DNA, 20 bp, Homo sapiens
ccattcttgagtcatggatt

SEQ ID NO: 3071369 - DNA, 16 bp, Homo sapiens
ccattcttggcatcta

SEQ ID NO: 3071370 - DNA, 15 bp, Homo sapiens
ccattctttcttcct

SEQ ID NO: 3071371 - DNA, 20 bp, Homo sapiens
ccattcttttcacttcctct

SEQ ID NO: 3071372 - DNA, 16 bp, Homo sapiens
ccattcttttgtaatt

SEQ ID NO: 3071373 - DNA, 22 bp, Homo sapiens
ccattgatgagcactcctgatt

SEQ ID NO: 3071374 - DNA, 14 bp, Homo sapiens
ccattgccctggtt

SEQ ID NO: 3071375 - DNA, 20 bp, Homo sapiens
ccattgctgttctacttttt

SEQ ID NO: 3071376 - DNA, 15 bp, Homo sapiens
ccattgtactccagc

SEQ ID NO: 3071377 - DNA, 19 bp, Homo sapiens
ccattgtccaatcctatgt

SEQ ID NO: 3071378 - DNA, 23 bp, Homo sapiens
ccattgtcgtttcattcattttg

SEQ ID NO: 3071379 - DNA, 20 bp, Homo sapiens
ccatttcaggaatttaaaat

SEQ ID NO: 3071380 - DNA, 18 bp, Homo sapiens
ccatttcccacatctttc

SEQ ID NO: 3071381 - DNA, 16 bp, Homo sapiens
ccatttcctcacgtgc

SEQ ID NO: 3071382 - DNA, 19 bp, Homo sapiens
ccatttcctcacgtgcagg

SEQ ID NO: 3071383 - DNA, 19 bp, Homo sapiens
ccatttcctcagcttatct

SEQ ID NO: 3071384 - DNA, 13 bp, Homo sapiens
ccatttctccaga

SEQ ID NO: 3071385 - DNA, 21 bp, Homo sapiens
ccatttgatttcgatgtacag

SEQ ID NO: 3071386 - DNA, 22 bp, Homo sapiens
ccatttgccaattttcctactc

SEQ ID NO: 3071387 - DNA, 20 bp, Homo sapiens
ccatttggcagaactgctgg

SEQ ID NO: 3071388 - DNA, 19 bp, Homo sapiens
ccatttggcagagcttctt

SEQ ID NO: 3071389 - DNA, 12 bp, Homo sapiens
ccatttgtagtg

SEQ ID NO: 3071390 - DNA, 16 bp, Homo sapiens
ccatttgtattaccat

SEQ ID NO: 3071391 - DNA, 18 bp, Homo sapiens
ccatttgtctctactttt

SEQ ID NO: 3071392 - DNA, 15 bp, Homo sapiens
ccatttgttaactgt

SEQ ID NO: 3071393 - DNA, 15 bp, Homo sapiens
ccatttgttgctgct

SEQ ID NO: 3071394 - DNA, 16 bp, Homo sapiens
ccatttgttgctgctg

SEQ ID NO: 3071395 - DNA, 17 bp, Homo sapiens
ccatttgttgctgctgc

SEQ ID NO: 3071396 - DNA, 18 bp, Homo sapiens
ccatttgttgctgctgct

SEQ ID NO: 3071397 - DNA, 19 bp, Homo sapiens
ccattttagtcactttttt

SEQ ID NO: 3071398 - DNA, 22 bp, Homo sapiens
ccattttataaagtgcttgtgt

SEQ ID NO: 3071399 - DNA, 23 bp, Homo sapiens
ccattttatcttatcttgctttg

SEQ ID NO: 3071400 - DNA, 13 bp, Homo sapiens
ccattttgtgaag

SEQ ID NO: 3071401 - DNA, 16 bp, Homo sapiens
ccattttgtgaagccc

SEQ ID NO: 3071402 - DNA, 22 bp, Homo sapiens
cccaaaaatgttcccttgacca

SEQ ID NO: 3071403 - DNA, 21 bp, Homo sapiens
cccaaaacaccgggttccagc

SEQ ID NO: 3071404 - DNA, 22 bp, Homo sapiens
cccaaaagtcaaaaggtgcctg

SEQ ID NO: 3071405 - DNA, 14 bp, Homo sapiens
cccaaacatctggc

SEQ ID NO: 3071406 - DNA, 14 bp, Homo sapiens
cccaaaccttgggc

SEQ ID NO: 3071407 - DNA, 22 bp, Homo sapiens
cccaaacgccctttcctcctca

SEQ ID NO: 3071408 - DNA, 14 bp, Homo sapiens
cccaaagagaaaga

SEQ ID NO: 3071409 - DNA, 19 bp, Homo sapiens
cccaaagcagcccttcccc

SEQ ID NO: 3071410 - DNA, 14 bp, Homo sapiens
cccaaagctgagcc

SEQ ID NO: 3071411 - DNA, 16 bp, Homo sapiens
cccaaagctgagcctg

SEQ ID NO: 3071412 - DNA, 17 bp, Homo sapiens
cccaaagcttgtaaata

SEQ ID NO: 3071413 - DNA, 15 bp, Homo sapiens
cccaaagggcctcct

SEQ ID NO: 3071414 - DNA, 18 bp, Homo sapiens
cccaaatccgaacctcct

SEQ ID NO: 3071415 - DNA, 23 bp, Homo sapiens
cccaaatccgccagtgtttctga

SEQ ID NO: 3071416 - DNA, 16 bp, Homo sapiens
cccaaatttgattgat

SEQ ID NO: 3071417 - DNA, 10 bp, Homo sapiens
cccaacaatg

SEQ ID NO: 3071418 - DNA, 17 bp, Homo sapiens
cccaacaccccgcctgc

SEQ ID NO: 3071419 - DNA, 13 bp, Homo sapiens
cccaacacctctt

SEQ ID NO: 3071420 - DNA, 14 bp, Homo sapiens
cccaacactgccag

SEQ ID NO: 3071421 - DNA, 14 bp, Homo sapiens
cccaacagcacttt

SEQ ID NO: 3071422 - DNA, 20 bp, Homo sapiens
cccaacaggaggacaattca

SEQ ID NO: 3071423 - DNA, 12 bp, Homo sapiens
cccaacagtgtg

SEQ ID NO: 3071424 - DNA, 13 bp, Homo sapiens
cccaacagtgtga

SEQ ID NO: 3071425 - DNA, 15 bp, Homo sapiens
cccaacagtgtgaag

SEQ ID NO: 3071426 - DNA, 16 bp, Homo sapiens
cccaaccaaggaagga

SEQ ID NO: 3071427 - DNA, 20 bp, Homo sapiens
cccaacccccagcccccacc

SEQ ID NO: 3071428 - DNA, 23 bp, Homo sapiens
cccaactacccccagctgtgctt

SEQ ID NO: 3071429 - DNA, 20 bp, Homo sapiens
cccaactactatctcagaga

SEQ ID NO: 3071430 - DNA, 22 bp, Homo sapiens
cccaactcccttctgcttgtcc

SEQ ID NO: 3071431 - DNA, 18 bp, Homo sapiens
ccccagagcccagctctt

SEQ ID NO: 3071432 - DNA, 20 bp, Homo sapiens
ccccagagcccagctcttgc

SEQ ID NO: 3071433 - DNA, 22 bp, Homo sapiens
ccccagagcccagctcttgctc

SEQ ID NO: 3071434 - DNA, 22 bp, Homo sapiens
ccccagagtgtgggaagggaga

SEQ ID NO: 3071435 - DNA, 22 bp, Homo sapiens
ccccagatgtgagggcaccacc

SEQ ID NO: 3071436 - DNA, 18 bp, Homo sapiens
ccccagcacagctcctcc

SEQ ID NO: 3071437 - DNA, 19 bp, Homo sapiens
ccccagcacagctcctccc

SEQ ID NO: 3071438 - DNA, 21 bp, Homo sapiens
ccccagcacagctcctcccct

SEQ ID NO: 3071439 - DNA, 22 bp, Homo sapiens
ccccagcagaatggaggcaggg

SEQ ID NO: 3071440 - DNA, 19 bp, Homo sapiens
ccccagcattctcaggcac

SEQ ID NO: 3071441 - DNA, 16 bp, Homo sapiens
ccccagccacaggcca

SEQ ID NO: 3071442 - DNA, 20 bp, Homo sapiens
ccccagcccacagagcctga

SEQ ID NO: 3071443 - DNA, 12 bp, Homo sapiens
ccccagcccaga

SEQ ID NO: 3071444 - DNA, 21 bp, Homo sapiens
ccccagccctggcccctccaa

SEQ ID NO: 3071445 - DNA, 13 bp, Homo sapiens
ccccagcctccct

SEQ ID NO: 3071446 - DNA, 13 bp, Homo sapiens
ccccagctccggc

SEQ ID NO: 3071447 - DNA, 21 bp, Homo sapiens
ccccagctctaagcagccagg

SEQ ID NO: 3071448 - DNA, 24 bp, Homo sapiens
ccccagctctaagcagccaggagg

SEQ ID NO: 3071449 - DNA, 15 bp, Homo sapiens
ccccagctgccaaag

SEQ ID NO: 3071450 - DNA, 11 bp, Homo sapiens
ccccagctggc

SEQ ID NO: 3071451 - DNA, 12 bp, Homo sapiens
ccccaggaagcc

SEQ ID NO: 3071452 - DNA, 17 bp, Homo sapiens
ccccaggaagcccactg

SEQ ID NO: 3071453 - DNA, 20 bp, Homo sapiens
ccccaggaatttgggaccct

SEQ ID NO: 3071454 - DNA, 11 bp, Homo sapiens
ccccaggacca

SEQ ID NO: 3071455 - DNA, 16 bp, Homo sapiens
ccccaggaccagctca

SEQ ID NO: 3071456 - DNA, 19 bp, Homo sapiens
ccccaggaccagctcagga

SEQ ID NO: 3071457 - DNA, 21 bp, Homo sapiens
ccccaggaccagctcaggaca

SEQ ID NO: 3071458 - DNA, 17 bp, Homo sapiens
ccccaggacctggctgc

SEQ ID NO: 3071459 - DNA, 21 bp, Homo sapiens
ccccaggacctggctgccata

SEQ ID NO: 3071460 - DNA, 17 bp, Homo sapiens
ccccaggcccactcagg

SEQ ID NO: 3071461 - DNA, 22 bp, Homo sapiens
ccccaggcccactcaggggtca

SEQ ID NO: 3071462 - DNA, 19 bp, Homo sapiens
ccccaggccccaggaagcc

SEQ ID NO: 3071463 - DNA, 15 bp, Homo sapiens
ccccaggccctccca

SEQ ID NO: 3071464 - DNA, 16 bp, Homo sapiens
ccccaggccctcccac

SEQ ID NO: 3071465 - DNA, 17 bp, Homo sapiens
ccccaggccctcccacc

SEQ ID NO: 3071466 - DNA, 15 bp, Homo sapiens
ccccaggccggagcc

SEQ ID NO: 3071467 - DNA, 16 bp, Homo sapiens
ccccaggccggagccc

SEQ ID NO: 3071468 - DNA, 14 bp, Homo sapiens
ccccaggcctgccc

SEQ ID NO: 3071469 - DNA, 16 bp, Homo sapiens
ccccagggcctgagcc

SEQ ID NO: 3071470 - DNA, 21 bp, Homo sapiens
ccccagggcctgagcctggcc

SEQ ID NO: 3071471 - DNA, 14 bp, Homo sapiens
ccccagggctagtg

SEQ ID NO: 3071472 - DNA, 21 bp, Homo sapiens
ccccaggggacgtgggccctg

SEQ ID NO: 3071473 - DNA, 22 bp, Homo sapiens
ccccagggggtctcacccatgc

SEQ ID NO: 3071474 - DNA, 13 bp, Homo sapiens
ccccaggtggctg

SEQ ID NO: 3071475 - DNA, 20 bp, Homo sapiens
ccccaggtggctgacccagt

SEQ ID NO: 3071476 - DNA, 21 bp, Homo sapiens
ccccaggtggctgacccagtc

SEQ ID NO: 3071477 - DNA, 23 bp, Homo sapiens
ccccaggtggctgacccagtccc

SEQ ID NO: 3071478 - DNA, 23 bp, Homo sapiens
ccccaggtttttgcccatcctcc

SEQ ID NO: 3071479 - DNA, 22 bp, Homo sapiens
ccccagtcagaagttctgggtg

SEQ ID NO: 3071480 - DNA, 15 bp, Homo sapiens
ccccagtgacagcta

SEQ ID NO: 3071481 - DNA, 13 bp, Homo sapiens
ccccagtgcgctc

SEQ ID NO: 3071482 - DNA, 16 bp, Homo sapiens
ccccagtgtattttgt

SEQ ID NO: 3071483 - DNA, 15 bp, Homo sapiens
ccccagttcgcctgg

SEQ ID NO: 3071484 - DNA, 21 bp, Homo sapiens
ccccagttcgcctggagccct

SEQ ID NO: 3071485 - DNA, 23 bp, Homo sapiens
ccccagtttgcagaaaagcacct

SEQ ID NO: 3071486 - DNA, 14 bp, Homo sapiens
ccccatcagtgctc

SEQ ID NO: 3071487 - DNA, 12 bp, Homo sapiens
ccccatcctcca

SEQ ID NO: 3071488 - DNA, 19 bp, Homo sapiens
ccccatcgccccaactcca

SEQ ID NO: 3071489 - DNA, 17 bp, Homo sapiens
ccccatcggccctgtcc

SEQ ID NO: 3071490 - DNA, 18 bp, Homo sapiens
ccccatcggccctgtccc

SEQ ID NO: 3071491 - DNA, 16 bp, Homo sapiens
ccccatctcggggctg

SEQ ID NO: 3071492 - DNA, 20 bp, Homo sapiens
ccccatctcggggctgctgt

SEQ ID NO: 3071493 - DNA, 12 bp, Homo sapiens
ccccatctgtgt

SEQ ID NO: 3071494 - DNA, 13 bp, Homo sapiens
ccccatctgtgtt

SEQ ID NO: 3071495 - DNA, 18 bp, Homo sapiens
ccccatcttcgggaccag

SEQ ID NO: 3071496 - DNA, 19 bp, Homo sapiens
ccccatcttcgggaccagg

SEQ ID NO: 3071497 - DNA, 23 bp, Homo sapiens
ccccatgcactgtgaaggaccct

SEQ ID NO: 3071498 - DNA, 23 bp, Homo sapiens
ccccattcctgggaaatattccc

SEQ ID NO: 3071499 - DNA, 15 bp, Homo sapiens
ccccattttctgtgg

SEQ ID NO: 3071500 - DNA, 21 bp, Homo sapiens
cccccaaacatctggcatggc

SEQ ID NO: 3071501 - DNA, 19 bp, Homo sapiens
cccccaacaccccgcctgc

SEQ ID NO: 3071502 - DNA, 16 bp, Homo sapiens
cccccaaccaaggaag

SEQ ID NO: 3071503 - DNA, 14 bp, Homo sapiens
cccccaatccctca

SEQ ID NO: 3071504 - DNA, 11 bp, Homo sapiens
cccccacacac

SEQ ID NO: 3071505 - DNA, 12 bp, Homo sapiens
cccccacacaca

SEQ ID NO: 3071506 - DNA, 17 bp, Homo sapiens
cccccaccgccggggtc

SEQ ID NO: 3071507 - DNA, 21 bp, Homo sapiens
cccccacgtctctctgcctgc

SEQ ID NO: 3071508 - DNA, 23 bp, Homo sapiens
cccccacgtctctctgcctgctg

SEQ ID NO: 3071509 - DNA, 14 bp, Homo sapiens
cccccactccagct

SEQ ID NO: 3071510 - DNA, 16 bp, Homo sapiens
cccccagacagctgct

SEQ ID NO: 3071511 - DNA, 15 bp, Homo sapiens
cccccagagaccttt

SEQ ID NO: 3071512 - DNA, 22 bp, Homo sapiens
cccccagagacctttgcccaca

SEQ ID NO: 3071513 - DNA, 12 bp, Homo sapiens
cccccagccccc

SEQ ID NO: 3071514 - DNA, 15 bp, Homo sapiens
cccccagccctggcc

SEQ ID NO: 3071515 - DNA, 21 bp, Homo sapiens
cccccagctaagaacctggaa

SEQ ID NO: 3071516 - DNA, 18 bp, Homo sapiens
cccccaggattgtgcaat

SEQ ID NO: 3071517 - DNA, 15 bp, Homo sapiens
cccccaggcctgccc

SEQ ID NO: 3071518 - DNA, 22 bp, Homo sapiens
cccccagtgtattttgtccaag

SEQ ID NO: 3071519 - DNA, 15 bp, Homo sapiens
cccccatagcaccct

SEQ ID NO: 3071520 - DNA, 17 bp, Homo sapiens
cccccatcctgctcagc

SEQ ID NO: 3071521 - DNA, 11 bp, Homo sapiens
cccccatctcc

SEQ ID NO: 3071522 - DNA, 11 bp, Homo sapiens
cccccatctct

SEQ ID NO: 3071523 - DNA, 14 bp, Homo sapiens
cccccatgcactgt

SEQ ID NO: 3071524 - DNA, 12 bp, Homo sapiens
ccccccaggccc

SEQ ID NO: 3071525 - DNA, 14 bp, Homo sapiens
ccccccatgcactg

SEQ ID NO: 3071526 - DNA, 12 bp, Homo sapiens
cccccccaggcc

SEQ ID NO: 3071527 - DNA, 13 bp, Homo sapiens
cccccccaggccc

SEQ ID NO: 3071528 - DNA, 13 bp, Homo sapiens
cccccccttccac

SEQ ID NO: 3071529 - DNA, 14 bp, Homo sapiens
cccccgactgcctg

SEQ ID NO: 3071530 - DNA, 18 bp, Homo sapiens
cccccgactgcctgtctc

SEQ ID NO: 3071531 - DNA, 20 bp, Homo sapiens
cccccgggatcctgccccca

SEQ ID NO: 3071532 - DNA, 20 bp, Homo sapiens
ccccctaccgcatggcagct

SEQ ID NO: 3071533 - DNA, 23 bp, Homo sapiens
ccccctaccgcatggcagctggg

SEQ ID NO: 3071534 - DNA, 14 bp, Homo sapiens
ccccctcccagagg

SEQ ID NO: 3071535 - DNA, 19 bp, Homo sapiens
ccccctctcacgccacccc

SEQ ID NO: 3071536 - DNA, 16 bp, Homo sapiens
ccccctctcctggagg

SEQ ID NO: 3071537 - DNA, 13 bp, Homo sapiens
ccccctctgcttc

SEQ ID NO: 3071538 - DNA, 13 bp, Homo sapiens
ccccctgccctcc

SEQ ID NO: 3071539 - DNA, 18 bp, Homo sapiens
ccccctggcagctgcccc

SEQ ID NO: 3071540 - DNA, 19 bp, Homo sapiens
ccccctggcctctgtgcct

SEQ ID NO: 3071541 - DNA, 16 bp, Homo sapiens
cccccttcaagcctgt

SEQ ID NO: 3071542 - DNA, 14 bp, Homo sapiens
cccccttcagtgcc

SEQ ID NO: 3071543 - DNA, 23 bp, Homo sapiens
cccccttcagtgcccaccaacat

SEQ ID NO: 3071544 - DNA, 13 bp, Homo sapiens
ccccgacggctgt

SEQ ID NO: 3071545 - DNA, 17 bp, Homo sapiens
ccccgaggccctgcatg

SEQ ID NO: 3071546 - DNA, 15 bp, Homo sapiens
ccccgaggctgcccc

SEQ ID NO: 3071547 - DNA, 19 bp, Homo sapiens
ccccgagggctcagaagag

SEQ ID NO: 3071548 - DNA, 19 bp, Homo sapiens
ccccgcacaaagcggctct

SEQ ID NO: 3071549 - DNA, 14 bp, Homo sapiens
ccccgcaggcctgc

SEQ ID NO: 3071550 - DNA, 19 bp, Homo sapiens
ccccgcaggcctgccttct

SEQ ID NO: 3071551 - DNA, 17 bp, Homo sapiens
ccccgcattccaggctc

SEQ ID NO: 3071552 - DNA, 17 bp, Homo sapiens
ccccgccccctgccctc

SEQ ID NO: 3071553 - DNA, 12 bp, Homo sapiens
ccccgcctgcct

SEQ ID NO: 3071554 - DNA, 15 bp, Homo sapiens
ccccgccttccctca

SEQ ID NO: 3071555 - DNA, 16 bp, Homo sapiens
ccccgctccgtctctg

SEQ ID NO: 3071556 - DNA, 21 bp, Homo sapiens
ccccgctccgtctctgtcctc

SEQ ID NO: 3071557 - DNA, 23 bp, Homo sapiens
ccccgggatcctgcccccaagtc

SEQ ID NO: 3071558 - DNA, 21 bp, Homo sapiens
ccccgggctggccctgtgcag

SEQ ID NO: 3071559 - DNA, 13 bp, Homo sapiens
ccccgtctctgtt

SEQ ID NO: 3071560 - DNA, 15 bp, Homo sapiens
cccctacccctgccc

SEQ ID NO: 3071561 - DNA, 15 bp, Homo sapiens
cccctaccgcatggc

SEQ ID NO: 3071562 - DNA, 17 bp, Homo sapiens
cccctaccgcatggcag

SEQ ID NO: 3071563 - DNA, 22 bp, Homo sapiens
cccctagagacagtgatgcctg

SEQ ID NO: 3071564 - DNA, 12 bp, Homo sapiens
ccctggctgcag

SEQ ID NO: 3071565 - DNA, 19 bp, Homo sapiens
ccctggcttgtaactccac

SEQ ID NO: 3071566 - DNA, 23 bp, Homo sapiens
ccctggcttgtaactccaccaac

SEQ ID NO: 3071567 - DNA, 14 bp, Homo sapiens
ccctgggccccacc

SEQ ID NO: 3071568 - DNA, 13 bp, Homo sapiens
ccctgggctgaga

SEQ ID NO: 3071569 - DNA, 13 bp, Homo sapiens
ccctggggcactc

SEQ ID NO: 3071570 - DNA, 18 bp, Homo sapiens
ccctggggcactccccca

SEQ ID NO: 3071571 - DNA, 19 bp, Homo sapiens
ccctggggcactcccccag

SEQ ID NO: 3071572 - DNA, 21 bp, Homo sapiens
ccctggggctaggctggagcc

SEQ ID NO: 3071573 - DNA, 14 bp, Homo sapiens
ccctggggctggct

SEQ ID NO: 3071574 - DNA, 15 bp, Homo sapiens
ccctggggctggtgg

SEQ ID NO: 3071575 - DNA, 17 bp, Homo sapiens
ccctggggtggccacca

SEQ ID NO: 3071576 - DNA, 16 bp, Homo sapiens
ccctggggtgtgtctc

SEQ ID NO: 3071577 - DNA, 16 bp, Homo sapiens
ccctgggtcctgcctg

SEQ ID NO: 3071578 - DNA, 17 bp, Homo sapiens
ccctgggtcctgcctgc

SEQ ID NO: 3071579 - DNA, 20 bp, Homo sapiens
ccctgggtttggcccctgga

SEQ ID NO: 3071580 - DNA, 23 bp, Homo sapiens
ccctgggtttggcccctggaacc

SEQ ID NO: 3071581 - DNA, 15 bp, Homo sapiens
ccctggtaagcagag

SEQ ID NO: 3071582 - DNA, 17 bp, Homo sapiens
ccctggtcctggcctcc

SEQ ID NO: 3071583 - DNA, 23 bp, Homo sapiens
ccctggtcctggcctccttcccc

SEQ ID NO: 3071584 - DNA, 17 bp, Homo sapiens
ccctggtgctcctgccc

SEQ ID NO: 3071585 - DNA, 19 bp, Homo sapiens
ccctggtgctcctgcccag

SEQ ID NO: 3071586 - DNA, 13 bp, Homo sapiens
ccctggtggttca

SEQ ID NO: 3071587 - DNA, 20 bp, Homo sapiens
ccctggttcctgctgtcctg

SEQ ID NO: 3071588 - DNA, 19 bp, Homo sapiens
ccctgtcaccaagctcaca

SEQ ID NO: 3071589 - DNA, 12 bp, Homo sapiens
ccctgtccagcc

SEQ ID NO: 3071590 - DNA, 14 bp, Homo sapiens
ccctgtcctcctcg

SEQ ID NO: 3071591 - DNA, 15 bp, Homo sapiens
ccctgtcctcctcgg

SEQ ID NO: 3071592 - DNA, 21 bp, Homo sapiens
ccctgtcgggctttgtgtgaa

SEQ ID NO: 3071593 - DNA, 14 bp, Homo sapiens
ccctgtgccgcact

SEQ ID NO: 3071594 - DNA, 13 bp, Homo sapiens
ccctgtggacagg

SEQ ID NO: 3071595 - DNA, 16 bp, Homo sapiens
ccctgtggagtccagc

SEQ ID NO: 3071596 - DNA, 17 bp, Homo sapiens
ccctgtggagtccagct

SEQ ID NO: 3071597 - DNA, 21 bp, Homo sapiens
ccctgtggagtccagctctac

SEQ ID NO: 3071598 - DNA, 21 bp, Homo sapiens
ccctgtggatgagccctcaga

SEQ ID NO: 3071599 - DNA, 16 bp, Homo sapiens
ccctgttgtgccacag

SEQ ID NO: 3071600 - DNA, 19 bp, Homo sapiens
ccctgtttcaatcactgtc

SEQ ID NO: 3071601 - DNA, 15 bp, Homo sapiens
cccttaagccctggc

SEQ ID NO: 3071602 - DNA, 20 bp, Homo sapiens
cccttaagtcaccctagccc

SEQ ID NO: 3071603 - DNA, 14 bp, Homo sapiens
cccttactgagcgc

SEQ ID NO: 3071604 - DNA, 16 bp, Homo sapiens
cccttacttcttgccc

SEQ ID NO: 3071605 - DNA, 13 bp, Homo sapiens
cccttcagtgccc

SEQ ID NO: 3071606 - DNA, 16 bp, Homo sapiens
cccttccactgagggc

SEQ ID NO: 3071607 - DNA, 14 bp, Homo sapiens
cccttcccacagga

SEQ ID NO: 3071608 - DNA, 14 bp, Homo sapiens
cccttcccagtggg

SEQ ID NO: 3071609 - DNA, 21 bp, Homo sapiens
cccttcccagtgggctgtgtt

SEQ ID NO: 3071610 - DNA, 22 bp, Homo sapiens
cccttcccctcccccactcctc

SEQ ID NO: 3071611 - DNA, 13 bp, Homo sapiens
cccttccctcacc

SEQ ID NO: 3071612 - DNA, 17 bp, Homo sapiens
cccttccctcacccctg

SEQ ID NO: 3071613 - DNA, 12 bp, Homo sapiens
cccttcctcatc

SEQ ID NO: 3071614 - DNA, 20 bp, Homo sapiens
cccttcctcatctgtgcctg

SEQ ID NO: 3071615 - DNA, 21 bp, Homo sapiens
cccttcctcatctgtgcctgt

SEQ ID NO: 3071616 - DNA, 23 bp, Homo sapiens
cccttcctcatctgtgcctgtct

SEQ ID NO: 3071617 - DNA, 15 bp, Homo sapiens
cccttcctctttggt

SEQ ID NO: 3071618 - DNA, 12 bp, Homo sapiens
cccttcctgacc

SEQ ID NO: 3071619 - DNA, 18 bp, Homo sapiens
cccttcctgacccggatt

SEQ ID NO: 3071620 - DNA, 19 bp, Homo sapiens
cccttcctggcccaggcct

SEQ ID NO: 3071621 - DNA, 13 bp, Homo sapiens
cccttcctgtctg

SEQ ID NO: 3071622 - DNA, 14 bp, Homo sapiens
cccttccttgggca

SEQ ID NO: 3071623 - DNA, 15 bp, Homo sapiens
cccttccttgggcag

SEQ ID NO: 3071624 - DNA, 20 bp, Homo sapiens
cccttcgacatgctgccagg

SEQ ID NO: 3071625 - DNA, 15 bp, Homo sapiens
cccttctccaaaggc

SEQ ID NO: 3071626 - DNA, 17 bp, Homo sapiens
cccttctcctcttgtaa

SEQ ID NO: 3071627 - DNA, 18 bp, Homo sapiens
cccttctcctcttgtaaa

SEQ ID NO: 3071628 - DNA, 12 bp, Homo sapiens
cccttctctgtg

SEQ ID NO: 3071629 - DNA, 23 bp, Homo sapiens
cccttctgctcagctctgggcca

SEQ ID NO: 3071630 - DNA, 12 bp, Homo sapiens
cccttctgcttt

SEQ ID NO: 3071631 - DNA, 14 bp, Homo sapiens
cccttctgctttct

SEQ ID NO: 3071632 - DNA, 22 bp, Homo sapiens
cccttctggtgccagatcctct

SEQ ID NO: 3071633 - DNA, 13 bp, Homo sapiens
cccttgaacctca

SEQ ID NO: 3071634 - DNA, 17 bp, Homo sapiens
cccttgacaactggcag

SEQ ID NO: 3071635 - DNA, 19 bp, Homo sapiens
cccttgacaactggcaggc

SEQ ID NO: 3071636 - DNA, 15 bp, Homo sapiens
cccttgagacctcag

SEQ ID NO: 3071637 - DNA, 16 bp, Homo sapiens
cccttgagacctcagc

SEQ ID NO: 3071638 - DNA, 12 bp, Homo sapiens
cccttgagccct

SEQ ID NO: 3071639 - DNA, 15 bp, Homo sapiens
cccttgagccctccc

SEQ ID NO: 3071640 - DNA, 18 bp, Homo sapiens
cccttgagccctccccag

SEQ ID NO: 3071641 - DNA, 13 bp, Homo sapiens
cccttgagggaga

SEQ ID NO: 3071642 - DNA, 17 bp, Homo sapiens
cccttgagtaggccctg

SEQ ID NO: 3071643 - DNA, 18 bp, Homo sapiens
cccttgagtaggccctgc

SEQ ID NO: 3071644 - DNA, 19 bp, Homo sapiens
cccttgccatccattctgg

SEQ ID NO: 3071645 - DNA, 17 bp, Homo sapiens
cccttgccatcccaagc

SEQ ID NO: 3071646 - DNA, 14 bp, Homo sapiens
cccttgctgtatgc

SEQ ID NO: 3071647 - DNA, 17 bp, Homo sapiens
cccttggaggccagcca

SEQ ID NO: 3071648 - DNA, 18 bp, Homo sapiens
cccttggaggccagccag

SEQ ID NO: 3071649 - DNA, 16 bp, Homo sapiens
cccttggtttctgggg

SEQ ID NO: 3071650 - DNA, 22 bp, Homo sapiens
cccttggtttctgggggctggt

SEQ ID NO: 3071651 - DNA, 16 bp, Homo sapiens
cccttgtccctggggc

SEQ ID NO: 3071652 - DNA, 23 bp, Homo sapiens
cccttgtccctggggcactcccc

SEQ ID NO: 3071653 - DNA, 14 bp, Homo sapiens
cccttgtgttcctt

SEQ ID NO: 3071654 - DNA, 16 bp, Homo sapiens
cccttgtgttccttct

SEQ ID NO: 3071655 - DNA, 20 bp, Homo sapiens
cccttgtgttccttctgtga

SEQ ID NO: 3071656 - DNA, 20 bp, Homo sapiens
ccctttcatagagaggcctg

SEQ ID NO: 3071657 - DNA, 13 bp, Homo sapiens
ccctttccacgaa

SEQ ID NO: 3071658 - DNA, 13 bp, Homo sapiens
ccctttccccagc

SEQ ID NO: 3071659 - DNA, 23 bp, Homo sapiens
ccctttccccgacgcccacccaa

SEQ ID NO: 3071660 - DNA, 13 bp, Homo sapiens
ccctttcctgcgg

SEQ ID NO: 3071661 - DNA, 21 bp, Homo sapiens
ccctttgcatcgtcccctccc

SEQ ID NO: 3071662 - DNA, 23 bp, Homo sapiens
ccctttggagatgctgagggtgt

SEQ ID NO: 3071663 - DNA, 23 bp, Homo sapiens
cccttttagtttgatcagacagc

SEQ ID NO: 3071664 - DNA, 13 bp, Homo sapiens
cccttttatacta

SEQ ID NO: 3071665 - DNA, 15 bp, Homo sapiens
cccttttccagcctc

SEQ ID NO: 3071666 - DNA, 16 bp, Homo sapiens
cccttttccagcctca

SEQ ID NO: 3071667 - DNA, 13 bp, Homo sapiens
cccttttctatgt

SEQ ID NO: 3071668 - DNA, 21 bp, Homo sapiens
cccttttctttaagttttatt

SEQ ID NO: 3071669 - DNA, 15 bp, Homo sapiens
ccctttttgcagggg

SEQ ID NO: 3071670 - DNA, 18 bp, Homo sapiens
cccttttttttctgggta

SEQ ID NO: 3071671 - DNA, 23 bp, Homo sapiens
ccgaaagggttaatcatatttga

SEQ ID NO: 3071672 - DNA, 13 bp, Homo sapiens
ccgaacctcctct

SEQ ID NO: 3071673 - DNA, 16 bp, Homo sapiens
ccgaactccaggctgg

SEQ ID NO: 3071674 - DNA, 19 bp, Homo sapiens
ccgaactccaggctgggct

SEQ ID NO: 3071675 - DNA, 18 bp, Homo sapiens
ccgaagccgcctgtggac

SEQ ID NO: 3071676 - DNA, 20 bp, Homo sapiens
ccgaatgttgaggtggactc

SEQ ID NO: 3071677 - DNA, 15 bp, Homo sapiens
ccgaattgagcacaa

SEQ ID NO: 3071678 - DNA, 19 bp, Homo sapiens
ccgacaccactcctgccag

SEQ ID NO: 3071679 - DNA, 20 bp, Homo sapiens
ccgacaccagccctgctgct

SEQ ID NO: 3071680 - DNA, 19 bp, Homo sapiens
ccgacagtcggtgacccca

SEQ ID NO: 3071681 - DNA, 12 bp, Homo sapiens
ccgaccctgcgg

SEQ ID NO: 3071682 - DNA, 13 bp, Homo sapiens
ccgacctcgtcct

SEQ ID NO: 3071683 - DNA, 19 bp, Homo sapiens
ccgacctcgtcctccccct

SEQ ID NO: 3071684 - DNA, 23 bp, Homo sapiens
ccgacctcgtcctccccctgcca

SEQ ID NO: 3071685 - DNA, 12 bp, Homo sapiens
ccgacctctctc

SEQ ID NO: 3071686 - DNA, 16 bp, Homo sapiens
ccgaccttagatttag

SEQ ID NO: 3071687 - DNA, 13 bp, Homo sapiens
ccgacgcccaccc

SEQ ID NO: 3071688 - DNA, 14 bp, Homo sapiens
ccgacggagccggg

SEQ ID NO: 3071689 - DNA, 12 bp, Homo sapiens
ccgactccagat

SEQ ID NO: 3071690 - DNA, 13 bp, Homo sapiens
ccgactcccccaa

SEQ ID NO: 3071691 - DNA, 19 bp, Homo sapiens
ccgactcccccaaccaagg

SEQ ID NO: 3071692 - DNA, 23 bp, Homo sapiens
ccgactgcgctgctttttcaaaa

SEQ ID NO: 3071693 - DNA, 13 bp, Homo sapiens
ccgagaagcaaga

SEQ ID NO: 3071694 - DNA, 22 bp, Homo sapiens
ccgagaccccatcttccagcca

SEQ ID NO: 3071695 - DNA, 20 bp, Homo sapiens
ccgagagcagtgggcaggtg

SEQ ID NO: 3071696 - DNA, 13 bp, Homo sapiens
ccgagagcctgct

SEQ ID NO: 3071697 - DNA, 12 bp, Homo sapiens
cctcagaagaaa

SEQ ID NO: 3071698 - DNA, 16 bp, Homo sapiens
cctcagaagcctcgac

SEQ ID NO: 3071699 - DNA, 23 bp, Homo sapiens
cctcagaagcctcgactgagctt

SEQ ID NO: 3071700 - DNA, 15 bp, Homo sapiens
cctcagagtatcttt

SEQ ID NO: 3071701 - DNA, 21 bp, Homo sapiens
cctcagccatgaggagttgct

SEQ ID NO: 3071702 - DNA, 15 bp, Homo sapiens
cctcagccctgaccc

SEQ ID NO: 3071703 - DNA, 16 bp, Homo sapiens
cctcagccctgaccct

SEQ ID NO: 3071704 - DNA, 17 bp, Homo sapiens
cctcagccgtcagccat

SEQ ID NO: 3071705 - DNA, 21 bp, Homo sapiens
cctcagcctcccaaagtgctg

SEQ ID NO: 3071706 - DNA, 13 bp, Homo sapiens
cctcagcctcctg

SEQ ID NO: 3071707 - DNA, 14 bp, Homo sapiens
cctcagcctcctga

SEQ ID NO: 3071708 - DNA, 15 bp, Homo sapiens
cctcagcctcctgag

SEQ ID NO: 3071709 - DNA, 19 bp, Homo sapiens
cctcagcctcctgggtagc

SEQ ID NO: 3071710 - DNA, 22 bp, Homo sapiens
cctcagcctgatcaggcttcct

SEQ ID NO: 3071711 - DNA, 11 bp, Homo sapiens
cctcagcctgg

SEQ ID NO: 3071712 - DNA, 14 bp, Homo sapiens
cctcagcctggcca

SEQ ID NO: 3071713 - DNA, 15 bp, Homo sapiens
cctcagcctggccag

SEQ ID NO: 3071714 - DNA, 18 bp, Homo sapiens
cctcagcctggccagaca

SEQ ID NO: 3071715 - DNA, 22 bp, Homo sapiens
cctcagcctggccagacacagg

SEQ ID NO: 3071716 - DNA, 21 bp, Homo sapiens
cctcagcgggggccttgaaga

SEQ ID NO: 3071717 - DNA, 14 bp, Homo sapiens
cctcagctgctccc

SEQ ID NO: 3071718 - DNA, 19 bp, Homo sapiens
cctcaggaggcaggacctt

SEQ ID NO: 3071719 - DNA, 20 bp, Homo sapiens
cctcaggcacacagctactc

SEQ ID NO: 3071720 - DNA, 21 bp, Homo sapiens
cctcagggacagagacacctg

SEQ ID NO: 3071721 - DNA, 17 bp, Homo sapiens
cctcagggccaggaagg

SEQ ID NO: 3071722 - DNA, 15 bp, Homo sapiens
cctcaggggaagctg

SEQ ID NO: 3071723 - DNA, 16 bp, Homo sapiens
cctcaggggaagctgc

SEQ ID NO: 3071724 - DNA, 20 bp, Homo sapiens
cctcagggtctaaggagcgc

SEQ ID NO: 3071725 - DNA, 15 bp, Homo sapiens
cctcaggtggccatg

SEQ ID NO: 3071726 - DNA, 22 bp, Homo sapiens
cctcaggttcctaagacttcag

SEQ ID NO: 3071727 - DNA, 22 bp, Homo sapiens
cctcagtgcaaaatgtcttgtg

SEQ ID NO: 3071728 - DNA, 24 bp, Homo sapiens
cctcagtgcaaaatgtcttgtgta

SEQ ID NO: 3071729 - DNA, 12 bp, Homo sapiens
cctcatccccca

SEQ ID NO: 3071730 - DNA, 15 bp, Homo sapiens
cctcatcccccagtt

SEQ ID NO: 3071731 - DNA, 13 bp, Homo sapiens
cctcatcctcctc

SEQ ID NO: 3071732 - DNA, 17 bp, Homo sapiens
cctcatcctcctcctca

SEQ ID NO: 3071733 - DNA, 16 bp, Homo sapiens
cctcatctctactaaa

SEQ ID NO: 3071734 - DNA, 17 bp, Homo sapiens
cctcatctctctgccca

SEQ ID NO: 3071735 - DNA, 19 bp, Homo sapiens
cctcatctctctgcccaac

SEQ ID NO: 3071736 - DNA, 20 bp, Homo sapiens
cctcatctctctgcccaacc

SEQ ID NO: 3071737 - DNA, 17 bp, Homo sapiens
cctcatctgtccctccg

SEQ ID NO: 3071738 - DNA, 18 bp, Homo sapiens
cctcatctgtgcctgtct

SEQ ID NO: 3071739 - DNA, 16 bp, Homo sapiens
cctcatgtcatttctc

SEQ ID NO: 3071740 - DNA, 16 bp, Homo sapiens
cctcatgttctgtggg

SEQ ID NO: 3071741 - DNA, 15 bp, Homo sapiens
cctcattcagaccaa

SEQ ID NO: 3071742 - DNA, 15 bp, Homo sapiens
cctcattgcatttat

SEQ ID NO: 3071743 - DNA, 20 bp, Homo sapiens
cctcatttggggtagctaga

SEQ ID NO: 3071744 - DNA, 20 bp, Homo sapiens
cctccacactgaccaagtgc

SEQ ID NO: 3071745 - DNA, 11 bp, Homo sapiens
cctccacagct

SEQ ID NO: 3071746 - DNA, 20 bp, Homo sapiens
cctccacatcctccacgttc

SEQ ID NO: 3071747 - DNA, 22 bp, Homo sapiens
cctccaccaaccccgcggccca

SEQ ID NO: 3071748 - DNA, 14 bp, Homo sapiens
cctccacccacagt

SEQ ID NO: 3071749 - DNA, 23 bp, Homo sapiens
cctccacggtccgcggcctgcac

SEQ ID NO: 3071750 - DNA, 17 bp, Homo sapiens
cctccacgttctgctca

SEQ ID NO: 3071751 - DNA, 18 bp, Homo sapiens
cctccacgttctgctcat

SEQ ID NO: 3071752 - DNA, 13 bp, Homo sapiens
cctccagagaaag

SEQ ID NO: 3071753 - DNA, 14 bp, Homo sapiens
cctccagagaaagc

SEQ ID NO: 3071754 - DNA, 12 bp, Homo sapiens
cctccagcacaa

SEQ ID NO: 3071755 - DNA, 18 bp, Homo sapiens
cctccagccctgcccacc

SEQ ID NO: 3071756 - DNA, 19 bp, Homo sapiens
cctccagccctgcccaccc

SEQ ID NO: 3071757 - DNA, 11 bp, Homo sapiens
cctccagctca

SEQ ID NO: 3071758 - DNA, 13 bp, Homo sapiens
cctccagctcagc

SEQ ID NO: 3071759 - DNA, 15 bp, Homo sapiens
cctccagctcagcag

SEQ ID NO: 3071760 - DNA, 18 bp, Homo sapiens
cctccagctcagcagtga

SEQ ID NO: 3071761 - DNA, 16 bp, Homo sapiens
cctccaggcccgtctg

SEQ ID NO: 3071762 - DNA, 20 bp, Homo sapiens
cctccaggcccgtctgtcca

SEQ ID NO: 3071763 - DNA, 12 bp, Homo sapiens
cctccagggcca

SEQ ID NO: 3071764 - DNA, 17 bp, Homo sapiens
cctccagggccacgtgc

SEQ ID NO: 3071765 - DNA, 17 bp, Homo sapiens
cctccagggtgtgtgct

SEQ ID NO: 3071766 - DNA, 15 bp, Homo sapiens
cctccaggtgcagag

SEQ ID NO: 3071767 - DNA, 17 bp, Homo sapiens
cctccagtcctgctggc

SEQ ID NO: 3071768 - DNA, 20 bp, Homo sapiens
cctccagtctgttctcacat

SEQ ID NO: 3071769 - DNA, 15 bp, Homo sapiens
cctccatagcgacac

SEQ ID NO: 3071770 - DNA, 20 bp, Homo sapiens
cctccatccatctgtccgtc

SEQ ID NO: 3071771 - DNA, 17 bp, Homo sapiens
cctccatcctaccccct

SEQ ID NO: 3071772 - DNA, 13 bp, Homo sapiens
cctccattcctgc

SEQ ID NO: 3071773 - DNA, 15 bp, Homo sapiens
cctccattcctgctc

SEQ ID NO: 3071774 - DNA, 16 bp, Homo sapiens
cctcccaaagtgctgg

SEQ ID NO: 3071775 - DNA, 20 bp, Homo sapiens
cctcccaagctggctggggt

SEQ ID NO: 3071776 - DNA, 22 bp, Homo sapiens
cctcccaatctcaatacagcct

SEQ ID NO: 3071777 - DNA, 18 bp, Homo sapiens
cctcccacacccaaagct

SEQ ID NO: 3071778 - DNA, 22 bp, Homo sapiens
cctcccacacccaaagctgagc

SEQ ID NO: 3071779 - DNA, 15 bp, Homo sapiens
cctcccactggggtc

SEQ ID NO: 3071780 - DNA, 19 bp, Homo sapiens
cctcccactttgctgttcc

SEQ ID NO: 3071781 - DNA, 15 bp, Homo sapiens
cctcccagactacct

SEQ ID NO: 3071782 - DNA, 14 bp, Homo sapiens
cctcccagctctga

SEQ ID NO: 3071783 - DNA, 15 bp, Homo sapiens
cctcccaggctctca

SEQ ID NO: 3071784 - DNA, 18 bp, Homo sapiens
cctcccagtgccttctgg

SEQ ID NO: 3071785 - DNA, 16 bp, Homo sapiens
cctccccacccaagag

SEQ ID NO: 3071786 - DNA, 12 bp, Homo sapiens
cctccccagggg

SEQ ID NO: 3071787 - DNA, 14 bp, Homo sapiens
cctccccaggggag

SEQ ID NO: 3071788 - DNA, 16 bp, Homo sapiens
cctccccatctgtgtt

SEQ ID NO: 3071789 - DNA, 22 bp, Homo sapiens
cctcccccacgtctctctgcct

SEQ ID NO: 3071790 - DNA, 13 bp, Homo sapiens
cctcccccagcag

SEQ ID NO: 3071791 - DNA, 14 bp, Homo sapiens
cctccccccactgc

SEQ ID NO: 3071792 - DNA, 16 bp, Homo sapiens
cctcccccccatgcac

SEQ ID NO: 3071793 - DNA, 17 bp, Homo sapiens
cctcccccccatgcact

SEQ ID NO: 3071794 - DNA, 14 bp, Homo sapiens
cctccccctgccag

SEQ ID NO: 3071795 - DNA, 15 bp, Homo sapiens
cctccccctgccagt

SEQ ID NO: 3071796 - DNA, 18 bp, Homo sapiens
cctccccctgccagtgcc

SEQ ID NO: 3071797 - DNA, 17 bp, Homo sapiens
cctcccctatccaccca

SEQ ID NO: 3071798 - DNA, 16 bp, Homo sapiens
cctcccctcagagccc

SEQ ID NO: 3071799 - DNA, 20 bp, Homo sapiens
cctcccctcagagcccatgg

SEQ ID NO: 3071800 - DNA, 9 bp, Homo sapiens
cctcccctg

SEQ ID NO: 3071801 - DNA, 12 bp, Homo sapiens
cctcccctgagg

SEQ ID NO: 3071802 - DNA, 12 bp, Homo sapiens
cctcccctgcca

SEQ ID NO: 3071803 - DNA, 13 bp, Homo sapiens
cctcccctgccag

SEQ ID NO: 3071804 - DNA, 16 bp, Homo sapiens
cctcccctgccagggc

SEQ ID NO: 3071805 - DNA, 16 bp, Homo sapiens
cctccctagatccagg

SEQ ID NO: 3071806 - DNA, 17 bp, Homo sapiens
cctccctagatccaggc

SEQ ID NO: 3071807 - DNA, 15 bp, Homo sapiens
cctccctagccagca

SEQ ID NO: 3071808 - DNA, 21 bp, Homo sapiens
cctccctagccagcacttgta

SEQ ID NO: 3071809 - DNA, 22 bp, Homo sapiens
cctccctagttagcatccaggc

SEQ ID NO: 3071810 - DNA, 20 bp, Homo sapiens
cctccctatatgcacccctg

SEQ ID NO: 3071811 - DNA, 16 bp, Homo sapiens
cctccctcccttcctt

SEQ ID NO: 3071812 - DNA, 16 bp, Homo sapiens
cctccctccgcctccc

SEQ ID NO: 3071813 - DNA, 14 bp, Homo sapiens
cctccctccgtccc

SEQ ID NO: 3071814 - DNA, 18 bp, Homo sapiens
cctccctccgtccctctg

SEQ ID NO: 3071815 - DNA, 13 bp, Homo sapiens
cctccctctcttc

SEQ ID NO: 3071816 - DNA, 14 bp, Homo sapiens
cctccctctgccag

SEQ ID NO: 3071817 - DNA, 14 bp, Homo sapiens
cctccctctgcctc

SEQ ID NO: 3071818 - DNA, 20 bp, Homo sapiens
cctccctctgcctcatcctc

SEQ ID NO: 3071819 - DNA, 12 bp, Homo sapiens
cctccctgcctc

SEQ ID NO: 3071820 - DNA, 16 bp, Homo sapiens
cctccctgcctcagtg

SEQ ID NO: 3071821 - DNA, 14 bp, Homo sapiens
cctccctgcctcca

SEQ ID NO: 3071822 - DNA, 13 bp, Homo sapiens
cctccctggctgc

SEQ ID NO: 3071823 - DNA, 18 bp, Homo sapiens
cctccctgttccccagag

SEQ ID NO: 3071824 - DNA, 19 bp, Homo sapiens
cctccctgttccccagaga

SEQ ID NO: 3071825 - DNA, 15 bp, Homo sapiens
cctcccttcccagtg

SEQ ID NO: 3071826 - DNA, 17 bp, Homo sapiens
cctcccttcccagtggg

SEQ ID NO: 3071827 - DNA, 20 bp, Homo sapiens
cctcccttccttgggcagaa

SEQ ID NO: 3071828 - DNA, 16 bp, Homo sapiens
cctcccttctgctact

SEQ ID NO: 3071829 - DNA, 20 bp, Homo sapiens
cctccgacctctctcggccc

SEQ ID NO: 3071830 - DNA, 14 bp, Homo sapiens
cctccgaggccagt

SEQ ID NO: 3071831 - DNA, 16 bp, Homo sapiens
cctgcgggccacaggg

SEQ ID NO: 3071832 - DNA, 17 bp, Homo sapiens
cctgcgggccacagggc

SEQ ID NO: 3071833 - DNA, 18 bp, Homo sapiens
cctgcgggccacagggca

SEQ ID NO: 3071834 - DNA, 21 bp, Homo sapiens
cctgcgggcttttccccggtc

SEQ ID NO: 3071835 - DNA, 14 bp, Homo sapiens
cctgcgggtcctca

SEQ ID NO: 3071836 - DNA, 18 bp, Homo sapiens
cctgcgggtcctcagctg

SEQ ID NO: 3071837 - DNA, 23 bp, Homo sapiens
cctgcggtagatgggagggaggc

SEQ ID NO: 3071838 - DNA, 17 bp, Homo sapiens
cctgcgttctccccatg

SEQ ID NO: 3071839 - DNA, 16 bp, Homo sapiens
cctgctactctgttcc

SEQ ID NO: 3071840 - DNA, 22 bp, Homo sapiens
cctgctagcaggccccctagga

SEQ ID NO: 3071841 - DNA, 18 bp, Homo sapiens
cctgctatttcaggccct

SEQ ID NO: 3071842 - DNA, 23 bp, Homo sapiens
cctgctatttcaggccctcagct

SEQ ID NO: 3071843 - DNA, 16 bp, Homo sapiens
cctgctcccccacccc

SEQ ID NO: 3071844 - DNA, 17 bp, Homo sapiens
cctgctccgctgcctgg

SEQ ID NO: 3071845 - DNA, 18 bp, Homo sapiens
cctgctccgctgcctgga

SEQ ID NO: 3071846 - DNA, 21 bp, Homo sapiens
cctgctccgctgcctggaaca

SEQ ID NO: 3071847 - DNA, 12 bp, Homo sapiens
cctgctctgcac

SEQ ID NO: 3071848 - DNA, 17 bp, Homo sapiens
cctgctcttacttcccc

SEQ ID NO: 3071849 - DNA, 19 bp, Homo sapiens
cctgctcttacttccccca

SEQ ID NO: 3071850 - DNA, 13 bp, Homo sapiens
cctgctgaagctg

SEQ ID NO: 3071851 - DNA, 18 bp, Homo sapiens
cctgctgaagctgctgca

SEQ ID NO: 3071852 - DNA, 17 bp, Homo sapiens
cctgctgagagacccaa

SEQ ID NO: 3071853 - DNA, 20 bp, Homo sapiens
cctgctgagagacccaagga

SEQ ID NO: 3071854 - DNA, 21 bp, Homo sapiens
cctgctgagagacccaaggag

SEQ ID NO: 3071855 - DNA, 23 bp, Homo sapiens
cctgctgcccctccctgcctcca

SEQ ID NO: 3071856 - DNA, 18 bp, Homo sapiens
cctgctgctggtgcacag

SEQ ID NO: 3071857 - DNA, 22 bp, Homo sapiens
cctgctgctgtcacctctccca

SEQ ID NO: 3071858 - DNA, 19 bp, Homo sapiens
cctgctgcttcctaactta

SEQ ID NO: 3071859 - DNA, 12 bp, Homo sapiens
cctgctgctttg

SEQ ID NO: 3071860 - DNA, 23 bp, Homo sapiens
cctgctgctttgttgttctgcct

SEQ ID NO: 3071861 - DNA, 15 bp, Homo sapiens
cctgctggcctgctc

SEQ ID NO: 3071862 - DNA, 18 bp, Homo sapiens
cctgctgggctctccacc

SEQ ID NO: 3071863 - DNA, 17 bp, Homo sapiens
cctgctggggtctcagg

SEQ ID NO: 3071864 - DNA, 18 bp, Homo sapiens
cctgctggggtctcaggt

SEQ ID NO: 3071865 - DNA, 17 bp, Homo sapiens
cctgctggttcactcta

SEQ ID NO: 3071866 - DNA, 19 bp, Homo sapiens
cctgctgtctctctgggct

SEQ ID NO: 3071867 - DNA, 14 bp, Homo sapiens
cctgctgtggagcc

SEQ ID NO: 3071868 - DNA, 22 bp, Homo sapiens
cctgcttagaacccttctgctt

SEQ ID NO: 3071869 - DNA, 19 bp, Homo sapiens
cctgcttcagatgtggagc

SEQ ID NO: 3071870 - DNA, 14 bp, Homo sapiens
cctgcttcatatct

SEQ ID NO: 3071871 - DNA, 17 bp, Homo sapiens
cctgcttcatatctctc

SEQ ID NO: 3071872 - DNA, 16 bp, Homo sapiens
cctgcttctcttttcc

SEQ ID NO: 3071873 - DNA, 15 bp, Homo sapiens
cctgcttctggcgcc

SEQ ID NO: 3071874 - DNA, 20 bp, Homo sapiens
cctgcttgggtggagaagcc

SEQ ID NO: 3071875 - DNA, 14 bp, Homo sapiens
cctgctttctcttt

SEQ ID NO: 3071876 - DNA, 15 bp, Homo sapiens
cctgctttctctttc

SEQ ID NO: 3071877 - DNA, 22 bp, Homo sapiens
cctgctttgacgggccaggccc

SEQ ID NO: 3071878 - DNA, 22 bp, Homo sapiens
cctggaaccagcaagtcccaga

SEQ ID NO: 3071879 - DNA, 14 bp, Homo sapiens
cctggaacctttcc

SEQ ID NO: 3071880 - DNA, 11 bp, Homo sapiens
cctggaagcac

SEQ ID NO: 3071881 - DNA, 16 bp, Homo sapiens
cctggaagcactacag

SEQ ID NO: 3071882 - DNA, 18 bp, Homo sapiens
cctggaagctgtgtcctt

SEQ ID NO: 3071883 - DNA, 21 bp, Homo sapiens
cctggaagctgtgtccttgca

SEQ ID NO: 3071884 - DNA, 20 bp, Homo sapiens
cctggaaggacatccatgtt

SEQ ID NO: 3071885 - DNA, 23 bp, Homo sapiens
cctggaattagcttggggccagg

SEQ ID NO: 3071886 - DNA, 23 bp, Homo sapiens
cctggacatgaagattctttccc

SEQ ID NO: 3071887 - DNA, 15 bp, Homo sapiens
cctggaccagcctct

SEQ ID NO: 3071888 - DNA, 15 bp, Homo sapiens
cctggaccccctgcc

SEQ ID NO: 3071889 - DNA, 19 bp, Homo sapiens
cctggaccttgacagagca

SEQ ID NO: 3071890 - DNA, 21 bp, Homo sapiens
cctggaccttgacagagcagc

SEQ ID NO: 3071891 - DNA, 19 bp, Homo sapiens
cctggaccttttgttttct

SEQ ID NO: 3071892 - DNA, 20 bp, Homo sapiens
cctggaccttttgttttctg

SEQ ID NO: 3071893 - DNA, 19 bp, Homo sapiens
cctggacgaagagcaggcc

SEQ ID NO: 3071894 - DNA, 21 bp, Homo sapiens
cctggacgcccccgcccgcac

SEQ ID NO: 3071895 - DNA, 22 bp, Homo sapiens
cctggactagggcctcggaggc

SEQ ID NO: 3071896 - DNA, 23 bp, Homo sapiens
cctggactagggcctcggaggct

SEQ ID NO: 3071897 - DNA, 14 bp, Homo sapiens
cctggactgctacc

SEQ ID NO: 3071898 - DNA, 14 bp, Homo sapiens
cctggagcagaaag

SEQ ID NO: 3071899 - DNA, 22 bp, Homo sapiens
cctggagcgtttgctgtgccag

SEQ ID NO: 3071900 - DNA, 12 bp, Homo sapiens
cctggaggccca

SEQ ID NO: 3071901 - DNA, 16 bp, Homo sapiens
cctggaggcccagttc

SEQ ID NO: 3071902 - DNA, 14 bp, Homo sapiens
cctggaggctcagc

SEQ ID NO: 3071903 - DNA, 13 bp, Homo sapiens
cctggagggcaga

SEQ ID NO: 3071904 - DNA, 14 bp, Homo sapiens
cctggagggcagag

SEQ ID NO: 3071905 - DNA, 16 bp, Homo sapiens
cctggagggcagagac

SEQ ID NO: 3071906 - DNA, 12 bp, Homo sapiens
cctggagggcgc

SEQ ID NO: 3071907 - DNA, 22 bp, Homo sapiens
cctggagggcgcccagcagcct

SEQ ID NO: 3071908 - DNA, 23 bp, Homo sapiens
cctggagggcgcccagcagcctg

SEQ ID NO: 3071909 - DNA, 12 bp, Homo sapiens
cctggaggtctg

SEQ ID NO: 3071910 - DNA, 13 bp, Homo sapiens
cctggaggtctga

SEQ ID NO: 3071911 - DNA, 22 bp, Homo sapiens
cctggaggtctgaaaagaggag

SEQ ID NO: 3071912 - DNA, 16 bp, Homo sapiens
cctggagtatttggaa

SEQ ID NO: 3071913 - DNA, 19 bp, Homo sapiens
cctggagtatttggaagca

SEQ ID NO: 3071914 - DNA, 18 bp, Homo sapiens
cctggagtgctgtgctgt

SEQ ID NO: 3071915 - DNA, 21 bp, Homo sapiens
cctggagtgctgtgctgtgtt

SEQ ID NO: 3071916 - DNA, 20 bp, Homo sapiens
cctggagtgtgtcagagccc

SEQ ID NO: 3071917 - DNA, 15 bp, Homo sapiens
cctggagtttgggat

SEQ ID NO: 3071918 - DNA, 17 bp, Homo sapiens
cctggataaaaaagaaa

SEQ ID NO: 3071919 - DNA, 13 bp, Homo sapiens
cctggatagcctt

SEQ ID NO: 3071920 - DNA, 14 bp, Homo sapiens
cctggatagccttg

SEQ ID NO: 3071921 - DNA, 21 bp, Homo sapiens
cctggatagccttgaaaacaa

SEQ ID NO: 3071922 - DNA, 23 bp, Homo sapiens
cctggatagccttgaaaacaaac

SEQ ID NO: 3071923 - DNA, 21 bp, Homo sapiens
cctggatataaattaattgtg

SEQ ID NO: 3071924 - DNA, 17 bp, Homo sapiens
cctggatgtctgaactt

SEQ ID NO: 3071925 - DNA, 18 bp, Homo sapiens
cctggatgtctgaacttt

SEQ ID NO: 3071926 - DNA, 12 bp, Homo sapiens
cctggcacacat

SEQ ID NO: 3071927 - DNA, 21 bp, Homo sapiens
cctggcacacatcaggagttc

SEQ ID NO: 3071928 - DNA, 14 bp, Homo sapiens
cctggcagacacaa

SEQ ID NO: 3071929 - DNA, 19 bp, Homo sapiens
cctggcagacacaacccaa

SEQ ID NO: 3071930 - DNA, 13 bp, Homo sapiens
cctggcagctctg

SEQ ID NO: 3071931 - DNA, 14 bp, Homo sapiens
cctggcagctgccc

SEQ ID NO: 3071932 - DNA, 21 bp, Homo sapiens
cctggcagctgcccctcctgg

SEQ ID NO: 3071933 - DNA, 23 bp, Homo sapiens
cctggcagggggtgaaggcagga

SEQ ID NO: 3071934 - DNA, 16 bp, Homo sapiens
cctggcatctgtgtgc

SEQ ID NO: 3071935 - DNA, 20 bp, Homo sapiens
cctggccaccacccaacctg

SEQ ID NO: 3071936 - DNA, 22 bp, Homo sapiens
cctggccaccacccaacctgtc

SEQ ID NO: 3071937 - DNA, 19 bp, Homo sapiens
cctggccactgaaaagctt

SEQ ID NO: 3071938 - DNA, 13 bp, Homo sapiens
cctggccagacac

SEQ ID NO: 3071939 - DNA, 23 bp, Homo sapiens
cctggccagacacaggccctccc

SEQ ID NO: 3071940 - DNA, 12 bp, Homo sapiens
cctggccagtct

SEQ ID NO: 3071941 - DNA, 15 bp, Homo sapiens
cctggccagtcttcc

SEQ ID NO: 3071942 - DNA, 17 bp, Homo sapiens
cctggccatcccacaag

SEQ ID NO: 3071943 - DNA, 20 bp, Homo sapiens
cctggccatgctgtccctgc

SEQ ID NO: 3071944 - DNA, 20 bp, Homo sapiens
cctggccatttggccccagg

SEQ ID NO: 3071945 - DNA, 20 bp, Homo sapiens
cctggccccatgtctctcag

SEQ ID NO: 3071946 - DNA, 21 bp, Homo sapiens
cctggccccatgtctctcaga

SEQ ID NO: 3071947 - DNA, 18 bp, Homo sapiens
cctggccccctcagctct

SEQ ID NO: 3071948 - DNA, 22 bp, Homo sapiens
cctggccccctcagctctgtcc

SEQ ID NO: 3071949 - DNA, 15 bp, Homo sapiens
cctggccccgcctgc

SEQ ID NO: 3071950 - DNA, 14 bp, Homo sapiens
cctggcccctccaa

SEQ ID NO: 3071951 - DNA, 18 bp, Homo sapiens
cctggcccctccaatcct

SEQ ID NO: 3071952 - DNA, 16 bp, Homo sapiens
cctggccggccagcca

SEQ ID NO: 3071953 - DNA, 18 bp, Homo sapiens
cctggccggccagccagc

SEQ ID NO: 3071954 - DNA, 20 bp, Homo sapiens
cctggccgggtcaccctgtg

SEQ ID NO: 3071955 - DNA, 17 bp, Homo sapiens
cctggccgttcagcctg

SEQ ID NO: 3071956 - DNA, 13 bp, Homo sapiens
cctggcctcagac

SEQ ID NO: 3071957 - DNA, 16 bp, Homo sapiens
cctggcctcagactgc

SEQ ID NO: 3071958 - DNA, 13 bp, Homo sapiens
cctggcctccagg

SEQ ID NO: 3071959 - DNA, 19 bp, Homo sapiens
cctggcctccaggcccgtc

SEQ ID NO: 3071960 - DNA, 11 bp, Homo sapiens
cctggcctcct

SEQ ID NO: 3071961 - DNA, 13 bp, Homo sapiens
cctggcctgccag

SEQ ID NO: 3071962 - DNA, 15 bp, Homo sapiens
cctggcctgccagac

SEQ ID NO: 3071963 - DNA, 18 bp, Homo sapiens
ccttcataccgcctcgtg

SEQ ID NO: 3071964 - DNA, 20 bp, Homo sapiens
ccttcataccgcctcgtgcc

SEQ ID NO: 3071965 - DNA, 19 bp, Homo sapiens
ccttcattctgagaccaaa

SEQ ID NO: 3071966 - DNA, 16 bp, Homo sapiens
ccttcatttcatcctg

SEQ ID NO: 3071967 - DNA, 18 bp, Homo sapiens
ccttccaagtttgacttg

SEQ ID NO: 3071968 - DNA, 20 bp, Homo sapiens
ccttcccaaggttactcagc

SEQ ID NO: 3071969 - DNA, 21 bp, Homo sapiens
ccttcccaaggttactcagca

SEQ ID NO: 3071970 - DNA, 12 bp, Homo sapiens
ccttcccagctc

SEQ ID NO: 3071971 - DNA, 22 bp, Homo sapiens
ccttcccagtgggctgtgttga

SEQ ID NO: 3071972 - DNA, 15 bp, Homo sapiens
ccttccccttgtccc

SEQ ID NO: 3071973 - DNA, 17 bp, Homo sapiens
ccttccccttgtccctg

SEQ ID NO: 3071974 - DNA, 20 bp, Homo sapiens
ccttccccttgtccctgggg

SEQ ID NO: 3071975 - DNA, 19 bp, Homo sapiens
ccttccctcactcttcctc

SEQ ID NO: 3071976 - DNA, 17 bp, Homo sapiens
ccttccctgcctccagc

SEQ ID NO: 3071977 - DNA, 16 bp, Homo sapiens
ccttcctaagcctgtg

SEQ ID NO: 3071978 - DNA, 17 bp, Homo sapiens
ccttcctactcctcata

SEQ ID NO: 3071979 - DNA, 16 bp, Homo sapiens
ccttcctcatctgtgc

SEQ ID NO: 3071980 - DNA, 20 bp, Homo sapiens
ccttcctcatctgtgcctgt

SEQ ID NO: 3071981 - DNA, 23 bp, Homo sapiens
ccttcctcatctgtgcctgtctg

SEQ ID NO: 3071982 - DNA, 16 bp, Homo sapiens
ccttcctcctccacca

SEQ ID NO: 3071983 - DNA, 15 bp, Homo sapiens
ccttcctctctccag

SEQ ID NO: 3071984 - DNA, 13 bp, Homo sapiens
ccttcctgacctc

SEQ ID NO: 3071985 - DNA, 20 bp, Homo sapiens
ccttcctgcttcctgttacc

SEQ ID NO: 3071986 - DNA, 13 bp, Homo sapiens
ccttcctggccca

SEQ ID NO: 3071987 - DNA, 15 bp, Homo sapiens
ccttcctggcccagg

SEQ ID NO: 3071988 - DNA, 16 bp, Homo sapiens
ccttccttccattggc

SEQ ID NO: 3071989 - DNA, 16 bp, Homo sapiens
ccttccttccctggct

SEQ ID NO: 3071990 - DNA, 15 bp, Homo sapiens
ccttcgctctgctgg

SEQ ID NO: 3071991 - DNA, 20 bp, Homo sapiens
ccttcggtggaagagctcaa

SEQ ID NO: 3071992 - DNA, 19 bp, Homo sapiens
ccttcgtttactatgcctg

SEQ ID NO: 3071993 - DNA, 22 bp, Homo sapiens
ccttcgtttactatgcctgtgt

SEQ ID NO: 3071994 - DNA, 20 bp, Homo sapiens
ccttctaacatgttatcaaa

SEQ ID NO: 3071995 - DNA, 21 bp, Homo sapiens
ccttctcaccagctgcaaagt

SEQ ID NO: 3071996 - DNA, 22 bp, Homo sapiens
ccttctcaccagctgcaaagtg

SEQ ID NO: 3071997 - DNA, 17 bp, Homo sapiens
ccttctcagctctccac

SEQ ID NO: 3071998 - DNA, 20 bp, Homo sapiens
ccttctcaggctggcttgag

SEQ ID NO: 3071999 - DNA, 14 bp, Homo sapiens
ccttctccaaaggc

SEQ ID NO: 3072000 - DNA, 18 bp, Homo sapiens
ccttctccaaaggctctg

SEQ ID NO: 3072001 - DNA, 13 bp, Homo sapiens
ccttctccatcca

SEQ ID NO: 3072002 - DNA, 15 bp, Homo sapiens
ccttctctcagctcc

SEQ ID NO: 3072003 - DNA, 18 bp, Homo sapiens
ccttctctcagctcccag

SEQ ID NO: 3072004 - DNA, 19 bp, Homo sapiens
ccttctctcagctcccagg

SEQ ID NO: 3072005 - DNA, 12 bp, Homo sapiens
ccttctcttctc

SEQ ID NO: 3072006 - DNA, 20 bp, Homo sapiens
ccttctcttctcttctttgg

SEQ ID NO: 3072007 - DNA, 12 bp, Homo sapiens
ccttctgctcag

SEQ ID NO: 3072008 - DNA, 17 bp, Homo sapiens
ccttctgctcagctctg

SEQ ID NO: 3072009 - DNA, 12 bp, Homo sapiens
ccttctgctttc

SEQ ID NO: 3072010 - DNA, 14 bp, Homo sapiens
ccttctgctttcta

SEQ ID NO: 3072011 - DNA, 18 bp, Homo sapiens
ccttctggcctcccacag

SEQ ID NO: 3072012 - DNA, 11 bp, Homo sapiens
ccttctggctg

SEQ ID NO: 3072013 - DNA, 15 bp, Homo sapiens
ccttctgtgaagaag

SEQ ID NO: 3072014 - DNA, 16 bp, Homo sapiens
ccttctgtgaagaagc

SEQ ID NO: 3072015 - DNA, 20 bp, Homo sapiens
ccttctgtgaagaagccctg

SEQ ID NO: 3072016 - DNA, 21 bp, Homo sapiens
ccttctgtgaagaagccctgt

SEQ ID NO: 3072017 - DNA, 22 bp, Homo sapiens
ccttctgtgaagaagccctgtt

SEQ ID NO: 3072018 - DNA, 20 bp, Homo sapiens
ccttcttatatctgaagatt

SEQ ID NO: 3072019 - DNA, 17 bp, Homo sapiens
ccttcttattctcactc

SEQ ID NO: 3072020 - DNA, 20 bp, Homo sapiens
ccttcttattctcactccac

SEQ ID NO: 3072021 - DNA, 18 bp, Homo sapiens
ccttcttccacttctcca

SEQ ID NO: 3072022 - DNA, 22 bp, Homo sapiens
ccttcttcggggaactcctgga

SEQ ID NO: 3072023 - DNA, 16 bp, Homo sapiens
ccttcttgtgtcctgg

SEQ ID NO: 3072024 - DNA, 16 bp, Homo sapiens
ccttgaacctcattaa

SEQ ID NO: 3072025 - DNA, 17 bp, Homo sapiens
ccttgaacctcattaaa

SEQ ID NO: 3072026 - DNA, 16 bp, Homo sapiens
ccttgaactctgggct

SEQ ID NO: 3072027 - DNA, 12 bp, Homo sapiens
ccttgaagacag

SEQ ID NO: 3072028 - DNA, 16 bp, Homo sapiens
ccttgaagacagagca

SEQ ID NO: 3072029 - DNA, 17 bp, Homo sapiens
ccttgaagacagagcaa

SEQ ID NO: 3072030 - DNA, 13 bp, Homo sapiens
ccttgaataataa

SEQ ID NO: 3072031 - DNA, 21 bp, Homo sapiens
ccttgacaactggcaggcagg

SEQ ID NO: 3072032 - DNA, 12 bp, Homo sapiens
ccttgacagagc

SEQ ID NO: 3072033 - DNA, 14 bp, Homo sapiens
ccttgacctttgta

SEQ ID NO: 3072034 - DNA, 16 bp, Homo sapiens
ccttgacctttgtaca

SEQ ID NO: 3072035 - DNA, 16 bp, Homo sapiens
ccttgactgttgatgt

SEQ ID NO: 3072036 - DNA, 18 bp, Homo sapiens
ccttgagccctccccagg

SEQ ID NO: 3072037 - DNA, 20 bp, Homo sapiens
ccttgagccctccccaggaa

SEQ ID NO: 3072038 - DNA, 13 bp, Homo sapiens
ccttgaggagaag

SEQ ID NO: 3072039 - DNA, 11 bp, Homo sapiens
ccttgagggag

SEQ ID NO: 3072040 - DNA, 17 bp, Homo sapiens
ccttgagtaggccctgc

SEQ ID NO: 3072041 - DNA, 18 bp, Homo sapiens
ccttgagtaggccctgct

SEQ ID NO: 3072042 - DNA, 16 bp, Homo sapiens
ccttgcagcctggtca

SEQ ID NO: 3072043 - DNA, 12 bp, Homo sapiens
ccttgcagctgg

SEQ ID NO: 3072044 - DNA, 15 bp, Homo sapiens
ccttgcagctggccc

SEQ ID NO: 3072045 - DNA, 16 bp, Homo sapiens
ccttgcagctggccca

SEQ ID NO: 3072046 - DNA, 22 bp, Homo sapiens
ccttgccacccattcttcccgt

SEQ ID NO: 3072047 - DNA, 21 bp, Homo sapiens
ccttgccatcccaagcccagt

SEQ ID NO: 3072048 - DNA, 13 bp, Homo sapiens
ccttgcccagaga

SEQ ID NO: 3072049 - DNA, 19 bp, Homo sapiens
ccttgcccgtcgtgtgctg

SEQ ID NO: 3072050 - DNA, 17 bp, Homo sapiens
ccttgcctgtctaaagc

SEQ ID NO: 3072051 - DNA, 17 bp, Homo sapiens
ccttgctagctagccag

SEQ ID NO: 3072052 - DNA, 21 bp, Homo sapiens
ccttgctcctggccttgctga

SEQ ID NO: 3072053 - DNA, 11 bp, Homo sapiens
ccttgctgcca

SEQ ID NO: 3072054 - DNA, 23 bp, Homo sapiens
ccttgctgccaagtcctgccttt

SEQ ID NO: 3072055 - DNA, 14 bp, Homo sapiens
ccttgctgtagaga

SEQ ID NO: 3072056 - DNA, 19 bp, Homo sapiens
ccttgctgtagagacttcc

SEQ ID NO: 3072057 - DNA, 20 bp, Homo sapiens
ccttgcttcttactgataat

SEQ ID NO: 3072058 - DNA, 14 bp, Homo sapiens
ccttgcttgttaca

SEQ ID NO: 3072059 - DNA, 16 bp, Homo sapiens
ccttgcttttatagtt

SEQ ID NO: 3072060 - DNA, 12 bp, Homo sapiens
ccttggagcatt

SEQ ID NO: 3072061 - DNA, 12 bp, Homo sapiens
ccttggaggaca

SEQ ID NO: 3072062 - DNA, 22 bp, Homo sapiens
ccttggataatgctgttgcctc

SEQ ID NO: 3072063 - DNA, 20 bp, Homo sapiens
ccttggcctcccaaagtgct

SEQ ID NO: 3072064 - DNA, 24 bp, Homo sapiens
ccttggcctcccaaagtgctggga

SEQ ID NO: 3072065 - DNA, 17 bp, Homo sapiens
ccttggccttgcagctg

SEQ ID NO: 3072066 - DNA, 21 bp, Homo sapiens
ccttggccttgcagctggccc

SEQ ID NO: 3072067 - DNA, 15 bp, Homo sapiens
ccttggctcagacat

SEQ ID NO: 3072068 - DNA, 22 bp, Homo sapiens
ccttggctttgaggccgaagct

SEQ ID NO: 3072069 - DNA, 18 bp, Homo sapiens
ccttgggaccaaaggggg

SEQ ID NO: 3072070 - DNA, 12 bp, Homo sapiens
ccttgggccctt

SEQ ID NO: 3072071 - DNA, 11 bp, Homo sapiens
ccttgggcctg

SEQ ID NO: 3072072 - DNA, 14 bp, Homo sapiens
ccttgggcctggcc

SEQ ID NO: 3072073 - DNA, 15 bp, Homo sapiens
ccttgggcctggcca

SEQ ID NO: 3072074 - DNA, 16 bp, Homo sapiens
ccttggggcaggcagt

SEQ ID NO: 3072075 - DNA, 20 bp, Homo sapiens
ccttgggggggctgcctttg

SEQ ID NO: 3072076 - DNA, 13 bp, Homo sapiens
ccttggggtggcg

SEQ ID NO: 3072077 - DNA, 22 bp, Homo sapiens
ccttggggtgggggccaggcct

SEQ ID NO: 3072078 - DNA, 15 bp, Homo sapiens
ccttgggtggcccct

SEQ ID NO: 3072079 - DNA, 22 bp, Homo sapiens
ccttggtctctccttcctcttg

SEQ ID NO: 3072080 - DNA, 17 bp, Homo sapiens
ccttggtgcctcttgta

SEQ ID NO: 3072081 - DNA, 16 bp, Homo sapiens
ccttggtgctcttgct

SEQ ID NO: 3072082 - DNA, 18 bp, Homo sapiens
ccttggtgtagttgaact

SEQ ID NO: 3072083 - DNA, 17 bp, Homo sapiens
ccttggtgtccacctgg

SEQ ID NO: 3072084 - DNA, 20 bp, Homo sapiens
ccttggtgtccacctggccc

SEQ ID NO: 3072085 - DNA, 21 bp, Homo sapiens
ccttggttggacctattgcca

SEQ ID NO: 3072086 - DNA, 17 bp, Homo sapiens
ccttggtttctgggggc

SEQ ID NO: 3072087 - DNA, 20 bp, Homo sapiens
ccttggtttctgggggctgg

SEQ ID NO: 3072088 - DNA, 16 bp, Homo sapiens
ccttgtccctggggca

SEQ ID NO: 3072089 - DNA, 17 bp, Homo sapiens
ccttgtccctggggcac

SEQ ID NO: 3072090 - DNA, 17 bp, Homo sapiens
ccttgtcctcagccagt

SEQ ID NO: 3072091 - DNA, 15 bp, Homo sapiens
ccttgtgagggagag

SEQ ID NO: 3072092 - DNA, 14 bp, Homo sapiens
ccttgtgtgtcagg

SEQ ID NO: 3072093 - DNA, 17 bp, Homo sapiens
ccttgtgtgtcaggccc

SEQ ID NO: 3072094 - DNA, 21 bp, Homo sapiens
ccttgtgtgtcaggccctctg

SEQ ID NO: 3072095 - DNA, 21 bp, Homo sapiens
ccttgtgttccttctgtgaag

SEQ ID NO: 3072096 - DNA, 16 bp, Homo sapiens
cgggaagggaggggaa

SEQ ID NO: 3072097 - DNA, 15 bp, Homo sapiens
cgggaatattgtttc

SEQ ID NO: 3072098 - DNA, 16 bp, Homo sapiens
cgggaatattgtttct

SEQ ID NO: 3072099 - DNA, 18 bp, Homo sapiens
cgggacccggcggccctg

SEQ ID NO: 3072100 - DNA, 13 bp, Homo sapiens
cgggaccctcagg

SEQ ID NO: 3072101 - DNA, 15 bp, Homo sapiens
cgggagagccaggct

SEQ ID NO: 3072102 - DNA, 19 bp, Homo sapiens
cgggagaggggacgcaggc

SEQ ID NO: 3072103 - DNA, 23 bp, Homo sapiens
cgggagaggggacgcaggcccct

SEQ ID NO: 3072104 - DNA, 11 bp, Homo sapiens
cgggagctggt

SEQ ID NO: 3072105 - DNA, 20 bp, Homo sapiens
cgggaggcagaggttgtagt

SEQ ID NO: 3072106 - DNA, 15 bp, Homo sapiens
cgggagtgacccagc

SEQ ID NO: 3072107 - DNA, 16 bp, Homo sapiens
cgggagtgacccagct

SEQ ID NO: 3072108 - DNA, 16 bp, Homo sapiens
cgggagttggagaccc

SEQ ID NO: 3072109 - DNA, 15 bp, Homo sapiens
cgggatcctgccccc

SEQ ID NO: 3072110 - DNA, 20 bp, Homo sapiens
cgggatcctgcccccaagtc

SEQ ID NO: 3072111 - DNA, 18 bp, Homo sapiens
cgggcaagtgagagggga

SEQ ID NO: 3072112 - DNA, 15 bp, Homo sapiens
cgggcacagccagcc

SEQ ID NO: 3072113 - DNA, 15 bp, Homo sapiens
cgggcagagggctgg

SEQ ID NO: 3072114 - DNA, 18 bp, Homo sapiens
cgggcagagggctggagg

SEQ ID NO: 3072115 - DNA, 22 bp, Homo sapiens
cgggcagagggctggaggccca

SEQ ID NO: 3072116 - DNA, 23 bp, Homo sapiens
cgggcagagggctggaggcccag

SEQ ID NO: 3072117 - DNA, 15 bp, Homo sapiens
cgggcagccaggctg

SEQ ID NO: 3072118 - DNA, 20 bp, Homo sapiens
cgggcagccaggctgggccg

SEQ ID NO: 3072119 - DNA, 16 bp, Homo sapiens
cgggcaggggagccag

SEQ ID NO: 3072120 - DNA, 17 bp, Homo sapiens
cgggcaggggagccagg

SEQ ID NO: 3072121 - DNA, 16 bp, Homo sapiens
cgggcatgtctgcctg

SEQ ID NO: 3072122 - DNA, 12 bp, Homo sapiens
cgggcattttga

SEQ ID NO: 3072123 - DNA, 15 bp, Homo sapiens
cgggccaggccctgg

SEQ ID NO: 3072124 - DNA, 22 bp, Homo sapiens
cgggccaggccctggagggcag

SEQ ID NO: 3072125 - DNA, 19 bp, Homo sapiens
cgggcccagaccggcttct

SEQ ID NO: 3072126 - DNA, 13 bp, Homo sapiens
cgggcccttcagt

SEQ ID NO: 3072127 - DNA, 13 bp, Homo sapiens
cgggcctgtacag

SEQ ID NO: 3072128 - DNA, 15 bp, Homo sapiens
cgggcggtcctgcac

SEQ ID NO: 3072129 - DNA, 18 bp, Homo sapiens
cgggcgtcaggggtgcac

SEQ ID NO: 3072130 - DNA, 20 bp, Homo sapiens
cgggcgtcaggggtgcacag

SEQ ID NO: 3072131 - DNA, 11 bp, Homo sapiens
cgggctggccc

SEQ ID NO: 3072132 - DNA, 12 bp, Homo sapiens
cgggctgtgccc

SEQ ID NO: 3072133 - DNA, 16 bp, Homo sapiens
cggggaactcctggaa

SEQ ID NO: 3072134 - DNA, 12 bp, Homo sapiens
cggggaagagat

SEQ ID NO: 3072135 - DNA, 19 bp, Homo sapiens
cggggaagagatccaaaga

SEQ ID NO: 3072136 - DNA, 17 bp, Homo sapiens
cggggaccactgggccc

SEQ ID NO: 3072137 - DNA, 22 bp, Homo sapiens
cggggaccttggtctgatcgac

SEQ ID NO: 3072138 - DNA, 17 bp, Homo sapiens
cggggactgctggctca

SEQ ID NO: 3072139 - DNA, 24 bp, Homo sapiens
cggggagcgtgtggctgtgcccct

SEQ ID NO: 3072140 - DNA, 15 bp, Homo sapiens
cggggagggggcacg

SEQ ID NO: 3072141 - DNA, 14 bp, Homo sapiens
cggggatggatctt

SEQ ID NO: 3072142 - DNA, 20 bp, Homo sapiens
cggggcccagcgctctcctg

SEQ ID NO: 3072143 - DNA, 14 bp, Homo sapiens
cggggcctgtctca

SEQ ID NO: 3072144 - DNA, 15 bp, Homo sapiens
cggggcctgtctcag

SEQ ID NO: 3072145 - DNA, 21 bp, Homo sapiens
cgggggagcaaaaggcggtga

SEQ ID NO: 3072146 - DNA, 21 bp, Homo sapiens
cgggggcagtctgagagaggc

SEQ ID NO: 3072147 - DNA, 19 bp, Homo sapiens
cgggggtccggaagggtga

SEQ ID NO: 3072148 - DNA, 15 bp, Homo sapiens
cggggtatcctgggg

SEQ ID NO: 3072149 - DNA, 12 bp, Homo sapiens
cggggtcctggg

SEQ ID NO: 3072150 - DNA, 18 bp, Homo sapiens
cggggtcggacggggcag

SEQ ID NO: 3072151 - DNA, 16 bp, Homo sapiens
cggggtctcctggacc

SEQ ID NO: 3072152 - DNA, 16 bp, Homo sapiens
cggggtgcccacaggc

SEQ ID NO: 3072153 - DNA, 17 bp, Homo sapiens
cggggtggggtgcactc

SEQ ID NO: 3072154 - DNA, 13 bp, Homo sapiens
cggggtgtggtgg

SEQ ID NO: 3072155 - DNA, 15 bp, Homo sapiens
cggggtttcatcatg

SEQ ID NO: 3072156 - DNA, 13 bp, Homo sapiens
cgggtctccctcc

SEQ ID NO: 3072157 - DNA, 19 bp, Homo sapiens
cgggtctctcactgttgca

SEQ ID NO: 3072158 - DNA, 12 bp, Homo sapiens
cgggtggctgca

SEQ ID NO: 3072159 - DNA, 21 bp, Homo sapiens
cggtagccagcacacagggca

SEQ ID NO: 3072160 - DNA, 12 bp, Homo sapiens
cggtcagactgg

SEQ ID NO: 3072161 - DNA, 14 bp, Homo sapiens
cggtccccacagac

SEQ ID NO: 3072162 - DNA, 19 bp, Homo sapiens
cggtcccttgagacctcag

SEQ ID NO: 3072163 - DNA, 21 bp, Homo sapiens
cggtcccttgagacctcagcc

SEQ ID NO: 3072164 - DNA, 14 bp, Homo sapiens
cggtcctgcacaga

SEQ ID NO: 3072165 - DNA, 16 bp, Homo sapiens
cggtgcagtctgggtg

SEQ ID NO: 3072166 - DNA, 14 bp, Homo sapiens
cggtgcgcacaccg

SEQ ID NO: 3072167 - DNA, 16 bp, Homo sapiens
cggtgctgtcctcagg

SEQ ID NO: 3072168 - DNA, 17 bp, Homo sapiens
cggtgctgtcctcaggt

SEQ ID NO: 3072169 - DNA, 22 bp, Homo sapiens
cggtggacttgaactttcctgg

SEQ ID NO: 3072170 - DNA, 13 bp, Homo sapiens
cggtggcggcagg

SEQ ID NO: 3072171 - DNA, 16 bp, Homo sapiens
cggtggcggcagggcc

SEQ ID NO: 3072172 - DNA, 18 bp, Homo sapiens
cggtgtcttgttctgtca

SEQ ID NO: 3072173 - DNA, 16 bp, Homo sapiens
cggtgtgcaccagggt

SEQ ID NO: 3072174 - DNA, 13 bp, Homo sapiens
cggtgttctaaga

SEQ ID NO: 3072175 - DNA, 22 bp, Homo sapiens
cggttgccttttttatcatttc

SEQ ID NO: 3072176 - DNA, 15 bp, Homo sapiens
cggttttttcacttc

SEQ ID NO: 3072177 - DNA, 12 bp, Homo sapiens
cgtaaatgtttt

SEQ ID NO: 3072178 - DNA, 15 bp, Homo sapiens
cgtaagcactgtttt

SEQ ID NO: 3072179 - DNA, 15 bp, Homo sapiens
cgtaagctctatctg

SEQ ID NO: 3072180 - DNA, 14 bp, Homo sapiens
cgtaatagctcaga

SEQ ID NO: 3072181 - DNA, 14 bp, Homo sapiens
cgtacatctgcaat

SEQ ID NO: 3072182 - DNA, 20 bp, Homo sapiens
cgtacatctgcaatatgaat

SEQ ID NO: 3072183 - DNA, 23 bp, Homo sapiens
cgtaccaagccaccgcagctgct

SEQ ID NO: 3072184 - DNA, 13 bp, Homo sapiens
cgtacttgtgatt

SEQ ID NO: 3072185 - DNA, 16 bp, Homo sapiens
cgtagagggtgctgcc

SEQ ID NO: 3072186 - DNA, 17 bp, Homo sapiens
cgtagagggtgctgccc

SEQ ID NO: 3072187 - DNA, 18 bp, Homo sapiens
cgtagagttggccttttt

SEQ ID NO: 3072188 - DNA, 17 bp, Homo sapiens
cgtagcgtatacatttg

SEQ ID NO: 3072189 - DNA, 22 bp, Homo sapiens
cgtagttccctgaaaacccaga

SEQ ID NO: 3072190 - DNA, 22 bp, Homo sapiens
cgtataatttagtcccttaaaa

SEQ ID NO: 3072191 - DNA, 12 bp, Homo sapiens
cgtatagctgta

SEQ ID NO: 3072192 - DNA, 18 bp, Homo sapiens
cgtatatataagaaagac

SEQ ID NO: 3072193 - DNA, 15 bp, Homo sapiens
cgtatatctatatat

SEQ ID NO: 3072194 - DNA, 15 bp, Homo sapiens
cgtatgcatgctaaa

SEQ ID NO: 3072195 - DNA, 16 bp, Homo sapiens
cgtatgcatgctaaat

SEQ ID NO: 3072196 - DNA, 15 bp, Homo sapiens
cgtattaaaaaacaa

SEQ ID NO: 3072197 - DNA, 15 bp, Homo sapiens
cgtattacatttttg

SEQ ID NO: 3072198 - DNA, 17 bp, Homo sapiens
cgtattgcaaataagac

SEQ ID NO: 3072199 - DNA, 15 bp, Homo sapiens
cgtattggtccagct

SEQ ID NO: 3072200 - DNA, 15 bp, Homo sapiens
cgtcaacgttgtact

SEQ ID NO: 3072201 - DNA, 21 bp, Homo sapiens
cgtcaacgttgtactgtatgt

SEQ ID NO: 3072202 - DNA, 16 bp, Homo sapiens
cgtcaatccatcagca

SEQ ID NO: 3072203 - DNA, 18 bp, Homo sapiens
cgtcaccacgactggcca

SEQ ID NO: 3072204 - DNA, 14 bp, Homo sapiens
cgtcacccttggta

SEQ ID NO: 3072205 - DNA, 20 bp, Homo sapiens
cgtcacgtgcgctgggcact

SEQ ID NO: 3072206 - DNA, 14 bp, Homo sapiens
cgtcagtgctgtgc

SEQ ID NO: 3072207 - DNA, 14 bp, Homo sapiens
cgtcatcttccctg

SEQ ID NO: 3072208 - DNA, 16 bp, Homo sapiens
cgtccacagcttcctg

SEQ ID NO: 3072209 - DNA, 16 bp, Homo sapiens
cgtccaccaggcctca

SEQ ID NO: 3072210 - DNA, 17 bp, Homo sapiens
cgtccatctctctccct

SEQ ID NO: 3072211 - DNA, 18 bp, Homo sapiens
cgtccatctctctccctt

SEQ ID NO: 3072212 - DNA, 20 bp, Homo sapiens
cgtccatctctctcccttac

SEQ ID NO: 3072213 - DNA, 21 bp, Homo sapiens
cgtccccccccaggccctccc

SEQ ID NO: 3072214 - DNA, 20 bp, Homo sapiens
cgtccctctgtccacttgtg

SEQ ID NO: 3072215 - DNA, 12 bp, Homo sapiens
cgtccgagaagg

SEQ ID NO: 3072216 - DNA, 15 bp, Homo sapiens
cgtccgccgcgtgtg

SEQ ID NO: 3072217 - DNA, 16 bp, Homo sapiens
cgtcctccccctgcca

SEQ ID NO: 3072218 - DNA, 13 bp, Homo sapiens
cgtcctcctctgt

SEQ ID NO: 3072219 - DNA, 12 bp, Homo sapiens
cgtcctgccctg

SEQ ID NO: 3072220 - DNA, 13 bp, Homo sapiens
cgtcctgccctgc

SEQ ID NO: 3072221 - DNA, 19 bp, Homo sapiens
cgtcgaaaggtgcagctgc

SEQ ID NO: 3072222 - DNA, 22 bp, Homo sapiens
cgtcgaaaggtgcagctgcgtt

SEQ ID NO: 3072223 - DNA, 14 bp, Homo sapiens
cgtcggagctgcct

SEQ ID NO: 3072224 - DNA, 16 bp, Homo sapiens
cgtcggagctgcctgc

SEQ ID NO: 3072225 - DNA, 12 bp, Homo sapiens
cgtctcccagat

SEQ ID NO: 3072226 - DNA, 18 bp, Homo sapiens
cgtctcccttggcccaga

SEQ ID NO: 3072227 - DNA, 21 bp, Homo sapiens
cgtctcccttggcccagagac

SEQ ID NO: 3072228 - DNA, 13 bp, Homo sapiens
cgtctctgtcctc

SEQ ID NO: 3072229 - DNA, 22 bp, Homo sapiens
cgtctcttgtgactcagcagag

SEQ ID NO: 3072230 - DNA, 18 bp, Homo sapiens
ctaagtttctaagattct

SEQ ID NO: 3072231 - DNA, 22 bp, Homo sapiens
ctaagtttctaagattctaaag

SEQ ID NO: 3072232 - DNA, 23 bp, Homo sapiens
ctaagtttctaagattctaaagg

SEQ ID NO: 3072233 - DNA, 20 bp, Homo sapiens
ctaagttttgtgtgtatata

SEQ ID NO: 3072234 - DNA, 22 bp, Homo sapiens
ctaataaacagactgttttcta

SEQ ID NO: 3072235 - DNA, 12 bp, Homo sapiens
ctaataaatcaa

SEQ ID NO: 3072236 - DNA, 16 bp, Homo sapiens
ctaataaatcaatgtg

SEQ ID NO: 3072237 - DNA, 18 bp, Homo sapiens
ctaataatttctaatgtt

SEQ ID NO: 3072238 - DNA, 17 bp, Homo sapiens
ctaatacctctgtgtgc

SEQ ID NO: 3072239 - DNA, 19 bp, Homo sapiens
ctaatactggttatcctgt

SEQ ID NO: 3072240 - DNA, 12 bp, Homo sapiens
ctaatatgattt

SEQ ID NO: 3072241 - DNA, 21 bp, Homo sapiens
ctaatatttccagaaggattt

SEQ ID NO: 3072242 - DNA, 12 bp, Homo sapiens
ctaatattttat

SEQ ID NO: 3072243 - DNA, 18 bp, Homo sapiens
ctaatattttatttgaaa

SEQ ID NO: 3072244 - DNA, 16 bp, Homo sapiens
ctaatcatccaatgct

SEQ ID NO: 3072245 - DNA, 15 bp, Homo sapiens
ctaatccaatacctc

SEQ ID NO: 3072246 - DNA, 18 bp, Homo sapiens
ctaatccaatacctcttg

SEQ ID NO: 3072247 - DNA, 19 bp, Homo sapiens
ctaatccaggcagatccag

SEQ ID NO: 3072248 - DNA, 20 bp, Homo sapiens
ctaatccaggcagatccagg

SEQ ID NO: 3072249 - DNA, 20 bp, Homo sapiens
ctaatccctgggcattgctt

SEQ ID NO: 3072250 - DNA, 22 bp, Homo sapiens
ctaatccctgggcattgctttc

SEQ ID NO: 3072251 - DNA, 22 bp, Homo sapiens
ctaatctatatgatatgcagcc

SEQ ID NO: 3072252 - DNA, 22 bp, Homo sapiens
ctaatcttaaatcagaataaat

SEQ ID NO: 3072253 - DNA, 19 bp, Homo sapiens
ctaatctttcacttgaaag

SEQ ID NO: 3072254 - DNA, 22 bp, Homo sapiens
ctaatctttcacttgaaagatt

SEQ ID NO: 3072255 - DNA, 21 bp, Homo sapiens
ctaatgaaggttttcatttgc

SEQ ID NO: 3072256 - DNA, 14 bp, Homo sapiens
ctaatgaattgaaa

SEQ ID NO: 3072257 - DNA, 16 bp, Homo sapiens
ctaatgaattgaaatt

SEQ ID NO: 3072258 - DNA, 18 bp, Homo sapiens
ctaatgaattgaaatttt

SEQ ID NO: 3072259 - DNA, 20 bp, Homo sapiens
ctaatgatgacttgagccct

SEQ ID NO: 3072260 - DNA, 22 bp, Homo sapiens
ctaatgcataagctttttaatg

SEQ ID NO: 3072261 - DNA, 14 bp, Homo sapiens
ctaatgccaagtta

SEQ ID NO: 3072262 - DNA, 13 bp, Homo sapiens
ctaatgctttctg

SEQ ID NO: 3072263 - DNA, 18 bp, Homo sapiens
ctaatggcatgagaaata

SEQ ID NO: 3072264 - DNA, 17 bp, Homo sapiens
ctaatgttagaattgat

SEQ ID NO: 3072265 - DNA, 18 bp, Homo sapiens
ctaattaaccttactaat

SEQ ID NO: 3072266 - DNA, 16 bp, Homo sapiens
ctaattatactacttt

SEQ ID NO: 3072267 - DNA, 18 bp, Homo sapiens
ctaattatactactttgt

SEQ ID NO: 3072268 - DNA, 21 bp, Homo sapiens
ctaattatactactttgttag

SEQ ID NO: 3072269 - DNA, 13 bp, Homo sapiens
ctaattcatcttt

SEQ ID NO: 3072270 - DNA, 20 bp, Homo sapiens
ctaattcatcttttaatcat

SEQ ID NO: 3072271 - DNA, 15 bp, Homo sapiens
ctaattcatttactc

SEQ ID NO: 3072272 - DNA, 18 bp, Homo sapiens
ctaattcttctgtcctga

SEQ ID NO: 3072273 - DNA, 17 bp, Homo sapiens
ctaattgactttagaaa

SEQ ID NO: 3072274 - DNA, 22 bp, Homo sapiens
ctaattgctgtgtgtcccaggc

SEQ ID NO: 3072275 - DNA, 22 bp, Homo sapiens
ctaattgtataacaggttattt

SEQ ID NO: 3072276 - DNA, 17 bp, Homo sapiens
ctaattgtcacatcaag

SEQ ID NO: 3072277 - DNA, 18 bp, Homo sapiens
ctaattgtcacatcaagc

SEQ ID NO: 3072278 - DNA, 19 bp, Homo sapiens
ctaattgtcacatcaagca

SEQ ID NO: 3072279 - DNA, 22 bp, Homo sapiens
ctaatttgcattaaattcacaa

SEQ ID NO: 3072280 - DNA, 12 bp, Homo sapiens
ctaatttttcca

SEQ ID NO: 3072281 - DNA, 18 bp, Homo sapiens
ctaatttttgtattattt

SEQ ID NO: 3072282 - DNA, 14 bp, Homo sapiens
ctaatttttttgta

SEQ ID NO: 3072283 - DNA, 15 bp, Homo sapiens
ctaatttttttgtat

SEQ ID NO: 3072284 - DNA, 16 bp, Homo sapiens
ctacaaaaaataaaat

SEQ ID NO: 3072285 - DNA, 18 bp, Homo sapiens
ctacaaaaaataaaataa

SEQ ID NO: 3072286 - DNA, 17 bp, Homo sapiens
ctacaaaaaggtataaa

SEQ ID NO: 3072287 - DNA, 20 bp, Homo sapiens
ctacaaaaaggtataaataa

SEQ ID NO: 3072288 - DNA, 18 bp, Homo sapiens
ctacaaacaaaagcagcc

SEQ ID NO: 3072289 - DNA, 20 bp, Homo sapiens
ctacaaagaagacatgtttt

SEQ ID NO: 3072290 - DNA, 21 bp, Homo sapiens
ctacaactgttttaaaacttt

SEQ ID NO: 3072291 - DNA, 18 bp, Homo sapiens
ctacaatattttattcta

SEQ ID NO: 3072292 - DNA, 17 bp, Homo sapiens
ctacaatttaaacacca

SEQ ID NO: 3072293 - DNA, 13 bp, Homo sapiens
ctacacaacatgt

SEQ ID NO: 3072294 - DNA, 22 bp, Homo sapiens
ctacacactgtcatgcttcatc

SEQ ID NO: 3072295 - DNA, 14 bp, Homo sapiens
ctacaccacacaca

SEQ ID NO: 3072296 - DNA, 15 bp, Homo sapiens
ctacaccacacacaa

SEQ ID NO: 3072297 - DNA, 16 bp, Homo sapiens
ctacacccttttccag

SEQ ID NO: 3072298 - DNA, 18 bp, Homo sapiens
ctacacccttttccagct

SEQ ID NO: 3072299 - DNA, 21 bp, Homo sapiens
ctacactcattgaaatgtaat

SEQ ID NO: 3072300 - DNA, 22 bp, Homo sapiens
ctacagaaatgaggaggatgct

SEQ ID NO: 3072301 - DNA, 19 bp, Homo sapiens
ctacagacagacatacata

SEQ ID NO: 3072302 - DNA, 14 bp, Homo sapiens
ctacagctatgaag

SEQ ID NO: 3072303 - DNA, 22 bp, Homo sapiens
ctacagctttgggtcattttta

SEQ ID NO: 3072304 - DNA, 11 bp, Homo sapiens
ctacaggttac

SEQ ID NO: 3072305 - DNA, 17 bp, Homo sapiens
ctacaggttacaacaga

SEQ ID NO: 3072306 - DNA, 18 bp, Homo sapiens
ctacaggttacaacagat

SEQ ID NO: 3072307 - DNA, 18 bp, Homo sapiens
ctacagtcaggaaaggaa

SEQ ID NO: 3072308 - DNA, 17 bp, Homo sapiens
ctacataattgtgacca

SEQ ID NO: 3072309 - DNA, 20 bp, Homo sapiens
ctacatacgtctttcacagt

SEQ ID NO: 3072310 - DNA, 13 bp, Homo sapiens
ctacatgagaaca

SEQ ID NO: 3072311 - DNA, 12 bp, Homo sapiens
ctacatgtgttt

SEQ ID NO: 3072312 - DNA, 16 bp, Homo sapiens
ctacatttgtttgtat

SEQ ID NO: 3072313 - DNA, 19 bp, Homo sapiens
ctacatttgtttgtattca

SEQ ID NO: 3072314 - DNA, 22 bp, Homo sapiens
ctacatttgtttgtattcatgt

SEQ ID NO: 3072315 - DNA, 23 bp, Homo sapiens
ctacatttgtttgtattcatgtt

SEQ ID NO: 3072316 - DNA, 15 bp, Homo sapiens
ctacattttgctctg

SEQ ID NO: 3072317 - DNA, 22 bp, Homo sapiens
ctaccaaatgttaataaagccc

SEQ ID NO: 3072318 - DNA, 13 bp, Homo sapiens
ctaccaatattag

SEQ ID NO: 3072319 - DNA, 11 bp, Homo sapiens
ctaccacctcc

SEQ ID NO: 3072320 - DNA, 12 bp, Homo sapiens
ctaccactcctg

SEQ ID NO: 3072321 - DNA, 17 bp, Homo sapiens
ctaccactcctgccaag

SEQ ID NO: 3072322 - DNA, 18 bp, Homo sapiens
ctaccagtgcaggctggc

SEQ ID NO: 3072323 - DNA, 19 bp, Homo sapiens
ctaccagtgcaggctggcc

SEQ ID NO: 3072324 - DNA, 20 bp, Homo sapiens
ctaccagtgcaggctggcca

SEQ ID NO: 3072325 - DNA, 21 bp, Homo sapiens
ctaccagtgcaggctggccag

SEQ ID NO: 3072326 - DNA, 11 bp, Homo sapiens
ctacccagggc

SEQ ID NO: 3072327 - DNA, 14 bp, Homo sapiens
ctacccagggcctg

SEQ ID NO: 3072328 - DNA, 15 bp, Homo sapiens
ctacccagggcctgc

SEQ ID NO: 3072329 - DNA, 13 bp, Homo sapiens
ctacccatccccg

SEQ ID NO: 3072330 - DNA, 13 bp, Homo sapiens
ctaccccaccacg

SEQ ID NO: 3072331 - DNA, 18 bp, Homo sapiens
ctacccccagctgtgctt

SEQ ID NO: 3072332 - DNA, 19 bp, Homo sapiens
ctacccccagctgtgctta

SEQ ID NO: 3072333 - DNA, 12 bp, Homo sapiens
ctaccccctcat

SEQ ID NO: 3072334 - DNA, 14 bp, Homo sapiens
ctaccccctcatcc

SEQ ID NO: 3072335 - DNA, 15 bp, Homo sapiens
ctacccctgccctgc

SEQ ID NO: 3072336 - DNA, 14 bp, Homo sapiens
ctacccgtgcctgg

SEQ ID NO: 3072337 - DNA, 22 bp, Homo sapiens
ctacccgtgcctgggcccctcc

SEQ ID NO: 3072338 - DNA, 19 bp, Homo sapiens
ctaccctaaagcgacatcc

SEQ ID NO: 3072339 - DNA, 22 bp, Homo sapiens
ctaccctgagatctgcacagtc

SEQ ID NO: 3072340 - DNA, 12 bp, Homo sapiens
ctaccctgagct

SEQ ID NO: 3072341 - DNA, 17 bp, Homo sapiens
ctaccctgagctgaggc

SEQ ID NO: 3072342 - DNA, 19 bp, Homo sapiens
ctaccctgtgctaagcacg

SEQ ID NO: 3072343 - DNA, 13 bp, Homo sapiens
ctaccgagttcaa

SEQ ID NO: 3072344 - DNA, 12 bp, Homo sapiens
ctaccgcatggc

SEQ ID NO: 3072345 - DNA, 23 bp, Homo sapiens
ctaccgccccaaagtaaaagaaa

SEQ ID NO: 3072346 - DNA, 17 bp, Homo sapiens
ctacctaagaatttcac

SEQ ID NO: 3072347 - DNA, 22 bp, Homo sapiens
ctacctaagaatttcactgtct

SEQ ID NO: 3072348 - DNA, 22 bp, Homo sapiens
ctacctacgtttgcaccgcctg

SEQ ID NO: 3072349 - DNA, 14 bp, Homo sapiens
ctacctagaagtaa

SEQ ID NO: 3072350 - DNA, 16 bp, Homo sapiens
ctacctagaagtaaga

SEQ ID NO: 3072351 - DNA, 16 bp, Homo sapiens
ctacctataggaaagt

SEQ ID NO: 3072352 - DNA, 23 bp, Homo sapiens
ctacctccctccccgtctcattc

SEQ ID NO: 3072353 - DNA, 18 bp, Homo sapiens
ctacctcgcatcattgca

SEQ ID NO: 3072354 - DNA, 14 bp, Homo sapiens
ctacctctctgtcc

SEQ ID NO: 3072355 - DNA, 23 bp, Homo sapiens
ctacctgggacctgatttattga

SEQ ID NO: 3072356 - DNA, 23 bp, Homo sapiens
ctacctgtatttaaaaatagaaa

SEQ ID NO: 3072357 - DNA, 13 bp, Homo sapiens
ctacctgttctgt

SEQ ID NO: 3072358 - DNA, 14 bp, Homo sapiens
ctacctgttctgta

SEQ ID NO: 3072359 - DNA, 22 bp, Homo sapiens
ctacctgttgagcatcacagaa

SEQ ID NO: 3072360 - DNA, 13 bp, Homo sapiens
ctaccttccccag

SEQ ID NO: 3072361 - DNA, 19 bp, Homo sapiens
ctaccttccccagacttgc

SEQ ID NO: 3072362 - DNA, 14 bp, Homo sapiens
ctcagagcccatgg

SEQ ID NO: 3072363 - DNA, 18 bp, Homo sapiens
ctcagagctgcgggctga

SEQ ID NO: 3072364 - DNA, 22 bp, Homo sapiens
ctcagagcttttcgaactgtgc

SEQ ID NO: 3072365 - DNA, 23 bp, Homo sapiens
ctcagagcttttcgaactgtgct

SEQ ID NO: 3072366 - DNA, 13 bp, Homo sapiens
ctcagaggaatat

SEQ ID NO: 3072367 - DNA, 14 bp, Homo sapiens
ctcagaggccttgg

SEQ ID NO: 3072368 - DNA, 16 bp, Homo sapiens
ctcagagggtgtcctg

SEQ ID NO: 3072369 - DNA, 20 bp, Homo sapiens
ctcagagtgcaagaagtctg

SEQ ID NO: 3072370 - DNA, 22 bp, Homo sapiens
ctcagataaggtaaaatgccat

SEQ ID NO: 3072371 - DNA, 23 bp, Homo sapiens
ctcagataaggtaaaatgccatg

SEQ ID NO: 3072372 - DNA, 18 bp, Homo sapiens
ctcagatagaatgacagt

SEQ ID NO: 3072373 - DNA, 13 bp, Homo sapiens
ctcagatcactgc

SEQ ID NO: 3072374 - DNA, 17 bp, Homo sapiens
ctcagatcagtgtacca

SEQ ID NO: 3072375 - DNA, 15 bp, Homo sapiens
ctcagatccagggac

SEQ ID NO: 3072376 - DNA, 20 bp, Homo sapiens
ctcagatccagggacagagg

SEQ ID NO: 3072377 - DNA, 18 bp, Homo sapiens
ctcagatgcgttcgcctc

SEQ ID NO: 3072378 - DNA, 22 bp, Homo sapiens
ctcagatgcgttcgcctctggc

SEQ ID NO: 3072379 - DNA, 13 bp, Homo sapiens
ctcagatgctcaa

SEQ ID NO: 3072380 - DNA, 15 bp, Homo sapiens
ctcagatgctcaaag

SEQ ID NO: 3072381 - DNA, 19 bp, Homo sapiens
ctcagatgctcaaagttgt

SEQ ID NO: 3072382 - DNA, 16 bp, Homo sapiens
ctcagatggaaccgca

SEQ ID NO: 3072383 - DNA, 22 bp, Homo sapiens
ctcagatggaaccgcaggaagc

SEQ ID NO: 3072384 - DNA, 13 bp, Homo sapiens
ctcagattttata

SEQ ID NO: 3072385 - DNA, 21 bp, Homo sapiens
ctcagattttatattttctat

SEQ ID NO: 3072386 - DNA, 20 bp, Homo sapiens
ctcagcacaaggccatctgg

SEQ ID NO: 3072387 - DNA, 14 bp, Homo sapiens
ctcagcagaggcag

SEQ ID NO: 3072388 - DNA, 21 bp, Homo sapiens
ctcagcagaggcagtggccac

SEQ ID NO: 3072389 - DNA, 14 bp, Homo sapiens
ctcagcagccctcc

SEQ ID NO: 3072390 - DNA, 17 bp, Homo sapiens
ctcagcagccctcctca

SEQ ID NO: 3072391 - DNA, 21 bp, Homo sapiens
ctcagcagccctcctcacccc

SEQ ID NO: 3072392 - DNA, 14 bp, Homo sapiens
ctcagccaagcaca

SEQ ID NO: 3072393 - DNA, 15 bp, Homo sapiens
ctcagccaagcacag

SEQ ID NO: 3072394 - DNA, 18 bp, Homo sapiens
ctcagccaagcacagtgg

SEQ ID NO: 3072395 - DNA, 20 bp, Homo sapiens
ctcagccaagcacagtggtg

SEQ ID NO: 3072396 - DNA, 13 bp, Homo sapiens
ctcagccagcact

SEQ ID NO: 3072397 - DNA, 20 bp, Homo sapiens
ctcagccatccgcagactgc

SEQ ID NO: 3072398 - DNA, 15 bp, Homo sapiens
ctcagccatgaggag

SEQ ID NO: 3072399 - DNA, 14 bp, Homo sapiens
ctcagcccaccctc

SEQ ID NO: 3072400 - DNA, 17 bp, Homo sapiens
ctcagcccctacccctg

SEQ ID NO: 3072401 - DNA, 20 bp, Homo sapiens
ctcagcccctacccctgccc

SEQ ID NO: 3072402 - DNA, 13 bp, Homo sapiens
ctcagccctgacc

SEQ ID NO: 3072403 - DNA, 17 bp, Homo sapiens
ctcagccctgaccctgt

SEQ ID NO: 3072404 - DNA, 13 bp, Homo sapiens
ctcagccctgggc

SEQ ID NO: 3072405 - DNA, 15 bp, Homo sapiens
ctcagccctgggccc

SEQ ID NO: 3072406 - DNA, 19 bp, Homo sapiens
ctcagccctgggccccacc

SEQ ID NO: 3072407 - DNA, 19 bp, Homo sapiens
ctcagccgcagacaagtaa

SEQ ID NO: 3072408 - DNA, 18 bp, Homo sapiens
ctcagccgtcagccatca

SEQ ID NO: 3072409 - DNA, 16 bp, Homo sapiens
ctcagcctcctgggta

SEQ ID NO: 3072410 - DNA, 13 bp, Homo sapiens
ctcagcctgcaca

SEQ ID NO: 3072411 - DNA, 19 bp, Homo sapiens
ctcagccttgccagagatc

SEQ ID NO: 3072412 - DNA, 20 bp, Homo sapiens
ctcagccttgccagagatcc

SEQ ID NO: 3072413 - DNA, 18 bp, Homo sapiens
ctcagcgggggccttgaa

SEQ ID NO: 3072414 - DNA, 20 bp, Homo sapiens
ctcagcgggggccttgaaga

SEQ ID NO: 3072415 - DNA, 19 bp, Homo sapiens
ctcagctcactgcaagctc

SEQ ID NO: 3072416 - DNA, 16 bp, Homo sapiens
ctcagctcccaggcca

SEQ ID NO: 3072417 - DNA, 15 bp, Homo sapiens
ctcagctcggggagc

SEQ ID NO: 3072418 - DNA, 19 bp, Homo sapiens
ctcagctctggtccaggcc

SEQ ID NO: 3072419 - DNA, 16 bp, Homo sapiens
ctcagctctgtctgct

SEQ ID NO: 3072420 - DNA, 18 bp, Homo sapiens
ctcagctgctcccacact

SEQ ID NO: 3072421 - DNA, 17 bp, Homo sapiens
ctcagctgtcgggggcc

SEQ ID NO: 3072422 - DNA, 16 bp, Homo sapiens
ctcagctgtggtccca

SEQ ID NO: 3072423 - DNA, 17 bp, Homo sapiens
ctcagcttccccaacac

SEQ ID NO: 3072424 - DNA, 20 bp, Homo sapiens
ctcagcttctaattttgtgc

SEQ ID NO: 3072425 - DNA, 16 bp, Homo sapiens
ctcagcttctcctgtg

SEQ ID NO: 3072426 - DNA, 17 bp, Homo sapiens
ctcagcttggataacca

SEQ ID NO: 3072427 - DNA, 13 bp, Homo sapiens
ctcagctttgctt

SEQ ID NO: 3072428 - DNA, 21 bp, Homo sapiens
ctcagctttttgtcttttctg

SEQ ID NO: 3072429 - DNA, 18 bp, Homo sapiens
ctcaggaaatggcttttc

SEQ ID NO: 3072430 - DNA, 12 bp, Homo sapiens
ctcaggaagaac

SEQ ID NO: 3072431 - DNA, 24 bp, Homo sapiens
ctcaggaattgaagatgtaaggaa

SEQ ID NO: 3072432 - DNA, 13 bp, Homo sapiens
ctcaggagcaggg

SEQ ID NO: 3072433 - DNA, 23 bp, Homo sapiens
ctcaggaggaggctgccctgagg

SEQ ID NO: 3072434 - DNA, 16 bp, Homo sapiens
ctcaggaggcaggacc

SEQ ID NO: 3072435 - DNA, 17 bp, Homo sapiens
ctcaggaggcaggacct

SEQ ID NO: 3072436 - DNA, 13 bp, Homo sapiens
ctcaggaggctga

SEQ ID NO: 3072437 - DNA, 14 bp, Homo sapiens
ctcaggaggctgag

SEQ ID NO: 3072438 - DNA, 15 bp, Homo sapiens
ctcaggaggctgaga

SEQ ID NO: 3072439 - DNA, 18 bp, Homo sapiens
ctcaggaggctgaggcag

SEQ ID NO: 3072440 - DNA, 23 bp, Homo sapiens
ctcaggaggctgaggcagaagaa

SEQ ID NO: 3072441 - DNA, 20 bp, Homo sapiens
ctcaggagtttgagaccagg

SEQ ID NO: 3072442 - DNA, 18 bp, Homo sapiens
ctcaggatccaagctaag

SEQ ID NO: 3072443 - DNA, 20 bp, Homo sapiens
ctcaggatccaagctaagca

SEQ ID NO: 3072444 - DNA, 15 bp, Homo sapiens
ctcaggcacacagct

SEQ ID NO: 3072445 - DNA, 14 bp, Homo sapiens
ctcaggcaccagtc

SEQ ID NO: 3072446 - DNA, 13 bp, Homo sapiens
ctcaggcactctc

SEQ ID NO: 3072447 - DNA, 16 bp, Homo sapiens
ctcaggccagagccaa

SEQ ID NO: 3072448 - DNA, 16 bp, Homo sapiens
ctcaggcccaaagcct

SEQ ID NO: 3072449 - DNA, 20 bp, Homo sapiens
ctcaggcgggcaccaaggca

SEQ ID NO: 3072450 - DNA, 22 bp, Homo sapiens
ctcaggctgtcccaagctccca

SEQ ID NO: 3072451 - DNA, 20 bp, Homo sapiens
ctcagggaaaagcagctctc

SEQ ID NO: 3072452 - DNA, 23 bp, Homo sapiens
ctcagggaaaagcagctctcccc

SEQ ID NO: 3072453 - DNA, 16 bp, Homo sapiens
ctcagggatgtgggaa

SEQ ID NO: 3072454 - DNA, 11 bp, Homo sapiens
ctcagggcagc

SEQ ID NO: 3072455 - DNA, 21 bp, Homo sapiens
ctcagggcagctgcctggcca

SEQ ID NO: 3072456 - DNA, 22 bp, Homo sapiens
ctcagggcagtggcttctttcc

SEQ ID NO: 3072457 - DNA, 15 bp, Homo sapiens
ctcagggccaggaag

SEQ ID NO: 3072458 - DNA, 17 bp, Homo sapiens
ctcagggccaggaagga

SEQ ID NO: 3072459 - DNA, 22 bp, Homo sapiens
ctcaggggaagctgctagggga

SEQ ID NO: 3072460 - DNA, 20 bp, Homo sapiens
ctcaggggacactggcccca

SEQ ID NO: 3072461 - DNA, 17 bp, Homo sapiens
ctcagggtattgcttgc

SEQ ID NO: 3072462 - DNA, 16 bp, Homo sapiens
ctcagggtggtctctt

SEQ ID NO: 3072463 - DNA, 17 bp, Homo sapiens
ctcagggtgtcctgagg

SEQ ID NO: 3072464 - DNA, 17 bp, Homo sapiens
ctcaggtagaaggttga

SEQ ID NO: 3072465 - DNA, 23 bp, Homo sapiens
ctcaggtgcacacatcaccaggt

SEQ ID NO: 3072466 - DNA, 12 bp, Homo sapiens
ctcaggtggcca

SEQ ID NO: 3072467 - DNA, 15 bp, Homo sapiens
ctcaggtggccatgc

SEQ ID NO: 3072468 - DNA, 18 bp, Homo sapiens
ctcaggtggccatgcctc

SEQ ID NO: 3072469 - DNA, 22 bp, Homo sapiens
ctcaggtggtgtccttcttcct

SEQ ID NO: 3072470 - DNA, 19 bp, Homo sapiens
ctcaggttcacagcagctt

SEQ ID NO: 3072471 - DNA, 21 bp, Homo sapiens
ctcaggttggcggcagacaca

SEQ ID NO: 3072472 - DNA, 13 bp, Homo sapiens
ctcagtaataaaa

SEQ ID NO: 3072473 - DNA, 17 bp, Homo sapiens
ctcagtacccagaacag

SEQ ID NO: 3072474 - DNA, 12 bp, Homo sapiens
ctcagtactttg

SEQ ID NO: 3072475 - DNA, 23 bp, Homo sapiens
ctcagtactttggaggcccctat

SEQ ID NO: 3072476 - DNA, 21 bp, Homo sapiens
ctcagtcccaaatccttccca

SEQ ID NO: 3072477 - DNA, 17 bp, Homo sapiens
ctcagtcgccctgttct

SEQ ID NO: 3072478 - DNA, 16 bp, Homo sapiens
ctcagtgattcgcttt

SEQ ID NO: 3072479 - DNA, 21 bp, Homo sapiens
ctcagtgattcgcttttggta

SEQ ID NO: 3072480 - DNA, 24 bp, Homo sapiens
ctcagtgcaaaatgtcttgtgtat

SEQ ID NO: 3072481 - DNA, 17 bp, Homo sapiens
ctcagtgcaacctctgc

SEQ ID NO: 3072482 - DNA, 11 bp, Homo sapiens
ctcagtgcaga

SEQ ID NO: 3072483 - DNA, 14 bp, Homo sapiens
ctcagtgcatttgt

SEQ ID NO: 3072484 - DNA, 22 bp, Homo sapiens
ctcagtgcatttgtgctagaaa

SEQ ID NO: 3072485 - DNA, 19 bp, Homo sapiens
ctcagtgccaactgtggct

SEQ ID NO: 3072486 - DNA, 23 bp, Homo sapiens
ctcagtgccaactgtggctggtc

SEQ ID NO: 3072487 - DNA, 17 bp, Homo sapiens
ctcagtgccttctctca

SEQ ID NO: 3072488 - DNA, 18 bp, Homo sapiens
ctcagttgctaaacactg

SEQ ID NO: 3072489 - DNA, 11 bp, Homo sapiens
ctcagttgtag

SEQ ID NO: 3072490 - DNA, 16 bp, Homo sapiens
ctcagttgtagaatgt

SEQ ID NO: 3072491 - DNA, 21 bp, Homo sapiens
ctcagttgtagaatgtattgt

SEQ ID NO: 3072492 - DNA, 21 bp, Homo sapiens
ctcagttgtgcagcttttggt

SEQ ID NO: 3072493 - DNA, 15 bp, Homo sapiens
ctcagtttcatatat

SEQ ID NO: 3072494 - DNA, 13 bp, Homo sapiens
ctcccctctgaaa

SEQ ID NO: 3072495 - DNA, 22 bp, Homo sapiens
ctcccctctgaaagttgtacat

SEQ ID NO: 3072496 - DNA, 19 bp, Homo sapiens
ctcccctgaggatcccctg

SEQ ID NO: 3072497 - DNA, 20 bp, Homo sapiens
ctcccctgaggatcccctgt

SEQ ID NO: 3072498 - DNA, 21 bp, Homo sapiens
ctcccctgccagggcagggcc

SEQ ID NO: 3072499 - DNA, 16 bp, Homo sapiens
ctccccttttctatgt

SEQ ID NO: 3072500 - DNA, 17 bp, Homo sapiens
ctccccttttctatgtt

SEQ ID NO: 3072501 - DNA, 16 bp, Homo sapiens
ctcccgacctcaggtg

SEQ ID NO: 3072502 - DNA, 13 bp, Homo sapiens
ctcccgagaaatt

SEQ ID NO: 3072503 - DNA, 22 bp, Homo sapiens
ctcccgagtagctgggattaca

SEQ ID NO: 3072504 - DNA, 20 bp, Homo sapiens
ctcccgagtagggaggacca

SEQ ID NO: 3072505 - DNA, 18 bp, Homo sapiens
ctcccgcaccttcctcct

SEQ ID NO: 3072506 - DNA, 16 bp, Homo sapiens
ctcccgccccgggctg

SEQ ID NO: 3072507 - DNA, 22 bp, Homo sapiens
ctcccggaattccgtcaccacg

SEQ ID NO: 3072508 - DNA, 19 bp, Homo sapiens
ctcccggacctggactagg

SEQ ID NO: 3072509 - DNA, 18 bp, Homo sapiens
ctcccgggaagcatcctc

SEQ ID NO: 3072510 - DNA, 22 bp, Homo sapiens
ctcccgggaagcatcctcccca

SEQ ID NO: 3072511 - DNA, 16 bp, Homo sapiens
ctcccgggactcactg

SEQ ID NO: 3072512 - DNA, 21 bp, Homo sapiens
ctcccgggactcactggcagc

SEQ ID NO: 3072513 - DNA, 22 bp, Homo sapiens
ctcccgggactcactggcagcc

SEQ ID NO: 3072514 - DNA, 17 bp, Homo sapiens
ctcccgggatgggtgga

SEQ ID NO: 3072515 - DNA, 15 bp, Homo sapiens
ctccctaccacctcc

SEQ ID NO: 3072516 - DNA, 13 bp, Homo sapiens
ctccctaccttgc

SEQ ID NO: 3072517 - DNA, 15 bp, Homo sapiens
ctccctaccttgcct

SEQ ID NO: 3072518 - DNA, 20 bp, Homo sapiens
ctccctagatccaggcttct

SEQ ID NO: 3072519 - DNA, 21 bp, Homo sapiens
ctccctagccagcacttgtat

SEQ ID NO: 3072520 - DNA, 13 bp, Homo sapiens
ctccctaggccca

SEQ ID NO: 3072521 - DNA, 14 bp, Homo sapiens
ctccctaggcccaa

SEQ ID NO: 3072522 - DNA, 15 bp, Homo sapiens
ctccctaggcccaag

SEQ ID NO: 3072523 - DNA, 16 bp, Homo sapiens
ctccctaggcccaagt

SEQ ID NO: 3072524 - DNA, 21 bp, Homo sapiens
ctccctagttagcatccaggc

SEQ ID NO: 3072525 - DNA, 13 bp, Homo sapiens
ctccctccagcac

SEQ ID NO: 3072526 - DNA, 19 bp, Homo sapiens
ctccctcccatcctccagc

SEQ ID NO: 3072527 - DNA, 13 bp, Homo sapiens
ctccctccccacc

SEQ ID NO: 3072528 - DNA, 20 bp, Homo sapiens
ctccctccccacccaagaga

SEQ ID NO: 3072529 - DNA, 17 bp, Homo sapiens
ctccctccgactccaga

SEQ ID NO: 3072530 - DNA, 20 bp, Homo sapiens
ctccctccgcctcccatccc

SEQ ID NO: 3072531 - DNA, 19 bp, Homo sapiens
ctccctcctcactccctag

SEQ ID NO: 3072532 - DNA, 14 bp, Homo sapiens
ctccctcctctgcc

SEQ ID NO: 3072533 - DNA, 20 bp, Homo sapiens
ctccctcctggagctctgtg

SEQ ID NO: 3072534 - DNA, 19 bp, Homo sapiens
ctccctctactgggagcct

SEQ ID NO: 3072535 - DNA, 22 bp, Homo sapiens
ctccctctaggctctgccttcg

SEQ ID NO: 3072536 - DNA, 14 bp, Homo sapiens
ctccctctatttat

SEQ ID NO: 3072537 - DNA, 10 bp, Homo sapiens
ctccctctca

SEQ ID NO: 3072538 - DNA, 15 bp, Homo sapiens
ctccctctcactgtc

SEQ ID NO: 3072539 - DNA, 14 bp, Homo sapiens
ctccctctcctgcc

SEQ ID NO: 3072540 - DNA, 22 bp, Homo sapiens
ctccctctctcctggactggtt

SEQ ID NO: 3072541 - DNA, 21 bp, Homo sapiens
ctccctctcttccgggagctg

SEQ ID NO: 3072542 - DNA, 22 bp, Homo sapiens
ctccctctcttccgggagctgg

SEQ ID NO: 3072543 - DNA, 14 bp, Homo sapiens
ctccctctgcctca

SEQ ID NO: 3072544 - DNA, 15 bp, Homo sapiens
ctccctctgcctcat

SEQ ID NO: 3072545 - DNA, 17 bp, Homo sapiens
ctccctctgcctcatcc

SEQ ID NO: 3072546 - DNA, 17 bp, Homo sapiens
ctccctctggccctgcc

SEQ ID NO: 3072547 - DNA, 19 bp, Homo sapiens
ctccctctggccctgcctt

SEQ ID NO: 3072548 - DNA, 20 bp, Homo sapiens
ctccctctggccctgccttc

SEQ ID NO: 3072549 - DNA, 15 bp, Homo sapiens
ctccctcttctgccc

SEQ ID NO: 3072550 - DNA, 15 bp, Homo sapiens
ctccctctttctagc

SEQ ID NO: 3072551 - DNA, 17 bp, Homo sapiens
ctccctgaaacactgct

SEQ ID NO: 3072552 - DNA, 18 bp, Homo sapiens
ctccctgaaacactgctt

SEQ ID NO: 3072553 - DNA, 18 bp, Homo sapiens
ctccctgaagcctttgca

SEQ ID NO: 3072554 - DNA, 12 bp, Homo sapiens
ctccctgaccct

SEQ ID NO: 3072555 - DNA, 14 bp, Homo sapiens
ctccctgaccctgt

SEQ ID NO: 3072556 - DNA, 16 bp, Homo sapiens
ctccctgaccctgtat

SEQ ID NO: 3072557 - DNA, 21 bp, Homo sapiens
ctccctgccatccccctctca

SEQ ID NO: 3072558 - DNA, 15 bp, Homo sapiens
ctccctgccgcctca

SEQ ID NO: 3072559 - DNA, 18 bp, Homo sapiens
ctccctgccgcctcaatg

SEQ ID NO: 3072560 - DNA, 12 bp, Homo sapiens
ctccctgcctca

SEQ ID NO: 3072561 - DNA, 17 bp, Homo sapiens
ctccctgcctcacatct

SEQ ID NO: 3072562 - DNA, 13 bp, Homo sapiens
ctccctgcctcca

SEQ ID NO: 3072563 - DNA, 18 bp, Homo sapiens
ctccctgcctccacccac

SEQ ID NO: 3072564 - DNA, 19 bp, Homo sapiens
ctccctgcctccacccaca

SEQ ID NO: 3072565 - DNA, 21 bp, Homo sapiens
ctccctgcctccacccacagt

SEQ ID NO: 3072566 - DNA, 16 bp, Homo sapiens
ctccctgcctccagga

SEQ ID NO: 3072567 - DNA, 20 bp, Homo sapiens
ctccctgcgcttcctgagca

SEQ ID NO: 3072568 - DNA, 14 bp, Homo sapiens
ctccctgcttcata

SEQ ID NO: 3072569 - DNA, 16 bp, Homo sapiens
ctccctggcagacaca

SEQ ID NO: 3072570 - DNA, 14 bp, Homo sapiens
ctccctggctgcag

SEQ ID NO: 3072571 - DNA, 10 bp, Homo sapiens
ctccctgggc

SEQ ID NO: 3072572 - DNA, 13 bp, Homo sapiens
ctccctgttattt

SEQ ID NO: 3072573 - DNA, 17 bp, Homo sapiens
ctcccttacccatcttg

SEQ ID NO: 3072574 - DNA, 19 bp, Homo sapiens
ctcccttacccatcttgct

SEQ ID NO: 3072575 - DNA, 22 bp, Homo sapiens
ctcccttacccatcttgcttcc

SEQ ID NO: 3072576 - DNA, 15 bp, Homo sapiens
ctcccttccacctca

SEQ ID NO: 3072577 - DNA, 15 bp, Homo sapiens
ctcccttcccagtgg

SEQ ID NO: 3072578 - DNA, 17 bp, Homo sapiens
ctcccttccttgggcag

SEQ ID NO: 3072579 - DNA, 17 bp, Homo sapiens
ctcccttcggtggaaga

SEQ ID NO: 3072580 - DNA, 21 bp, Homo sapiens
ctcccttcggtggaagagctc

SEQ ID NO: 3072581 - DNA, 16 bp, Homo sapiens
ctcccttctctcaccc

SEQ ID NO: 3072582 - DNA, 13 bp, Homo sapiens
ctcccttctgctt

SEQ ID NO: 3072583 - DNA, 14 bp, Homo sapiens
ctcccttctgcttg

SEQ ID NO: 3072584 - DNA, 15 bp, Homo sapiens
ctcccttctttacct

SEQ ID NO: 3072585 - DNA, 18 bp, Homo sapiens
ctcccttgagtaggccct

SEQ ID NO: 3072586 - DNA, 21 bp, Homo sapiens
ctcccttgagtaggccctgct

SEQ ID NO: 3072587 - DNA, 18 bp, Homo sapiens
ctcccttggcccagagac

SEQ ID NO: 3072588 - DNA, 23 bp, Homo sapiens
ctcccttggctttgaggccgaag

SEQ ID NO: 3072589 - DNA, 19 bp, Homo sapiens
ctcccttttacattctgtg

SEQ ID NO: 3072590 - DNA, 21 bp, Homo sapiens
ctcccttttacattctgtgtg

SEQ ID NO: 3072591 - DNA, 17 bp, Homo sapiens
ctcccttttgtccttcc

SEQ ID NO: 3072592 - DNA, 21 bp, Homo sapiens
ctccctttttttctctcttcc

SEQ ID NO: 3072593 - DNA, 14 bp, Homo sapiens
ctccgacctctctc

SEQ ID NO: 3072594 - DNA, 18 bp, Homo sapiens
ctccgacctctctcagcc

SEQ ID NO: 3072595 - DNA, 19 bp, Homo sapiens
ctccgacctctctcagccc

SEQ ID NO: 3072596 - DNA, 21 bp, Homo sapiens
ctccgacctctctcagcccca

SEQ ID NO: 3072597 - DNA, 20 bp, Homo sapiens
ctccgagagcagtgggcagg

SEQ ID NO: 3072598 - DNA, 16 bp, Homo sapiens
ctccgaggactggact

SEQ ID NO: 3072599 - DNA, 13 bp, Homo sapiens
ctccgaggccagt

SEQ ID NO: 3072600 - DNA, 16 bp, Homo sapiens
ctccgcacttggaaag

SEQ ID NO: 3072601 - DNA, 13 bp, Homo sapiens
ctccgcatgccaa

SEQ ID NO: 3072602 - DNA, 23 bp, Homo sapiens
ctccgccaggcgagatggggtgg

SEQ ID NO: 3072603 - DNA, 15 bp, Homo sapiens
ctccgcctccacact

SEQ ID NO: 3072604 - DNA, 14 bp, Homo sapiens
ctccgccttcacat

SEQ ID NO: 3072605 - DNA, 19 bp, Homo sapiens
ctccgccttcacattcccc

SEQ ID NO: 3072606 - DNA, 13 bp, Homo sapiens
ctccgccttccgg

SEQ ID NO: 3072607 - DNA, 14 bp, Homo sapiens
ctccgccttccggg

SEQ ID NO: 3072608 - DNA, 19 bp, Homo sapiens
ctccgcgccctccgacctc

SEQ ID NO: 3072609 - DNA, 21 bp, Homo sapiens
ctccgcgccctccgacctctc

SEQ ID NO: 3072610 - DNA, 12 bp, Homo sapiens
ctccgctgcctg

SEQ ID NO: 3072611 - DNA, 15 bp, Homo sapiens
ctccgggacctggtg

SEQ ID NO: 3072612 - DNA, 12 bp, Homo sapiens
ctccgggcaggg

SEQ ID NO: 3072613 - DNA, 19 bp, Homo sapiens
ctccgggcaggggagccag

SEQ ID NO: 3072614 - DNA, 20 bp, Homo sapiens
ctccggggttcagcctcctg

SEQ ID NO: 3072615 - DNA, 17 bp, Homo sapiens
ctccgtcccccaaacat

SEQ ID NO: 3072616 - DNA, 16 bp, Homo sapiens
ctccgtccctctgtcc

SEQ ID NO: 3072617 - DNA, 17 bp, Homo sapiens
ctccgtccctctgtcca

SEQ ID NO: 3072618 - DNA, 15 bp, Homo sapiens
ctccgtctctgtcct

SEQ ID NO: 3072619 - DNA, 16 bp, Homo sapiens
ctccgtctctgtcctc

SEQ ID NO: 3072620 - DNA, 17 bp, Homo sapiens
ctccgtctctgtcctcg

SEQ ID NO: 3072621 - DNA, 15 bp, Homo sapiens
ctccgtgaggctgct

SEQ ID NO: 3072622 - DNA, 15 bp, Homo sapiens
ctcctaatgatgact

SEQ ID NO: 3072623 - DNA, 19 bp, Homo sapiens
ctcctacaaccaggtcttg

SEQ ID NO: 3072624 - DNA, 11 bp, Homo sapiens
ctcctacctca

SEQ ID NO: 3072625 - DNA, 15 bp, Homo sapiens
ctcctactctgtgta

SEQ ID NO: 3072626 - DNA, 20 bp, Homo sapiens
ctcctactgcttcctctgaa

SEQ ID NO: 3072627 - DNA, 17 bp, Homo sapiens
ctctgcccacctctctt

SEQ ID NO: 3072628 - DNA, 20 bp, Homo sapiens
ctctgcccaggaactcgcac

SEQ ID NO: 3072629 - DNA, 15 bp, Homo sapiens
ctctgccccatcctc

SEQ ID NO: 3072630 - DNA, 24 bp, Homo sapiens
ctctgccccatcctccagcaggga

SEQ ID NO: 3072631 - DNA, 15 bp, Homo sapiens
ctctgcccctaagct

SEQ ID NO: 3072632 - DNA, 15 bp, Homo sapiens
ctctgccctctgctg

SEQ ID NO: 3072633 - DNA, 21 bp, Homo sapiens
ctctgccgctacctccctccc

SEQ ID NO: 3072634 - DNA, 16 bp, Homo sapiens
ctctgcctagaaacag

SEQ ID NO: 3072635 - DNA, 20 bp, Homo sapiens
ctctgcctcatcctcctcct

SEQ ID NO: 3072636 - DNA, 15 bp, Homo sapiens
ctctgcctcccaggt

SEQ ID NO: 3072637 - DNA, 21 bp, Homo sapiens
ctctgcctctaactccctcct

SEQ ID NO: 3072638 - DNA, 22 bp, Homo sapiens
ctctgcctgcactccctggcct

SEQ ID NO: 3072639 - DNA, 12 bp, Homo sapiens
ctctgcctgctg

SEQ ID NO: 3072640 - DNA, 15 bp, Homo sapiens
ctctgcctgctgggc

SEQ ID NO: 3072641 - DNA, 16 bp, Homo sapiens
ctctgcctgctgggct

SEQ ID NO: 3072642 - DNA, 19 bp, Homo sapiens
ctctgcctgctgggctctt

SEQ ID NO: 3072643 - DNA, 13 bp, Homo sapiens
ctctgcctggagc

SEQ ID NO: 3072644 - DNA, 14 bp, Homo sapiens
ctctgcctggagca

SEQ ID NO: 3072645 - DNA, 14 bp, Homo sapiens
ctctgccttgcctt

SEQ ID NO: 3072646 - DNA, 12 bp, Homo sapiens
ctctgcctttga

SEQ ID NO: 3072647 - DNA, 13 bp, Homo sapiens
ctctgcctttgag

SEQ ID NO: 3072648 - DNA, 21 bp, Homo sapiens
ctctgcgccaggcagagctga

SEQ ID NO: 3072649 - DNA, 13 bp, Homo sapiens
ctctgctccccag

SEQ ID NO: 3072650 - DNA, 16 bp, Homo sapiens
ctctgctcgccttagc

SEQ ID NO: 3072651 - DNA, 17 bp, Homo sapiens
ctctgctcgccttagca

SEQ ID NO: 3072652 - DNA, 14 bp, Homo sapiens
ctctgctctaccat

SEQ ID NO: 3072653 - DNA, 13 bp, Homo sapiens
ctctgctgaagac

SEQ ID NO: 3072654 - DNA, 16 bp, Homo sapiens
ctctgctgaagacttg

SEQ ID NO: 3072655 - DNA, 12 bp, Homo sapiens
ctctgctgcctg

SEQ ID NO: 3072656 - DNA, 13 bp, Homo sapiens
ctctgctgcctgt

SEQ ID NO: 3072657 - DNA, 16 bp, Homo sapiens
ctctgctgcctgtaca

SEQ ID NO: 3072658 - DNA, 17 bp, Homo sapiens
ctctgctgcctgtacag

SEQ ID NO: 3072659 - DNA, 22 bp, Homo sapiens
ctctgcttaccgttcaagaggc

SEQ ID NO: 3072660 - DNA, 19 bp, Homo sapiens
ctctgcttctcggggtcca

SEQ ID NO: 3072661 - DNA, 23 bp, Homo sapiens
ctctgcttctcggggtccagtgc

SEQ ID NO: 3072662 - DNA, 10 bp, Homo sapiens
ctctggaagt

SEQ ID NO: 3072663 - DNA, 21 bp, Homo sapiens
ctctggacaatctcacacctt

SEQ ID NO: 3072664 - DNA, 15 bp, Homo sapiens
ctctggacagatgga

SEQ ID NO: 3072665 - DNA, 18 bp, Homo sapiens
ctctggacagccccaccc

SEQ ID NO: 3072666 - DNA, 23 bp, Homo sapiens
ctctggacctcaggttcctaaga

SEQ ID NO: 3072667 - DNA, 10 bp, Homo sapiens
ctctggagcc

SEQ ID NO: 3072668 - DNA, 14 bp, Homo sapiens
ctctggagtggcca

SEQ ID NO: 3072669 - DNA, 15 bp, Homo sapiens
ctctggagtggccac

SEQ ID NO: 3072670 - DNA, 20 bp, Homo sapiens
ctctggagtggccactaagc

SEQ ID NO: 3072671 - DNA, 21 bp, Homo sapiens
ctctggatctagaagggacca

SEQ ID NO: 3072672 - DNA, 14 bp, Homo sapiens
ctctggccctgcct

SEQ ID NO: 3072673 - DNA, 13 bp, Homo sapiens
ctctggctcagct

SEQ ID NO: 3072674 - DNA, 16 bp, Homo sapiens
ctctggctcagctgtg

SEQ ID NO: 3072675 - DNA, 18 bp, Homo sapiens
ctctggctcagctgtggt

SEQ ID NO: 3072676 - DNA, 18 bp, Homo sapiens
ctctggctccaggcagaa

SEQ ID NO: 3072677 - DNA, 13 bp, Homo sapiens
ctctggctggcta

SEQ ID NO: 3072678 - DNA, 23 bp, Homo sapiens
ctctggctggctaactggaagca

SEQ ID NO: 3072679 - DNA, 20 bp, Homo sapiens
ctctggctgtaaggctctag

SEQ ID NO: 3072680 - DNA, 22 bp, Homo sapiens
ctctggctgtaaggctctagat

SEQ ID NO: 3072681 - DNA, 13 bp, Homo sapiens
ctctggcttccct

SEQ ID NO: 3072682 - DNA, 18 bp, Homo sapiens
ctctgggatttatgctca

SEQ ID NO: 3072683 - DNA, 20 bp, Homo sapiens
ctctgggccattctccacag

SEQ ID NO: 3072684 - DNA, 21 bp, Homo sapiens
ctctgggccgggcctggggct

SEQ ID NO: 3072685 - DNA, 22 bp, Homo sapiens
ctctgggtcccggggtgcattt

SEQ ID NO: 3072686 - DNA, 16 bp, Homo sapiens
ctctggtcttggaatt

SEQ ID NO: 3072687 - DNA, 16 bp, Homo sapiens
ctctggtgcctccaga

SEQ ID NO: 3072688 - DNA, 21 bp, Homo sapiens
ctctgtaaatgaaaaaaccca

SEQ ID NO: 3072689 - DNA, 24 bp, Homo sapiens
ctctgtaaccacctctctgtcttt

SEQ ID NO: 3072690 - DNA, 14 bp, Homo sapiens
ctctgtacactgcc

SEQ ID NO: 3072691 - DNA, 11 bp, Homo sapiens
ctctgtacttt

SEQ ID NO: 3072692 - DNA, 22 bp, Homo sapiens
ctctgtacttttcattctcttt

SEQ ID NO: 3072693 - DNA, 15 bp, Homo sapiens
ctctgtattttttct

SEQ ID NO: 3072694 - DNA, 23 bp, Homo sapiens
ctctgtattttttcttgcattga

SEQ ID NO: 3072695 - DNA, 18 bp, Homo sapiens
ctctgtcaccctggccac

SEQ ID NO: 3072696 - DNA, 16 bp, Homo sapiens
ctctgtcagtcacagc

SEQ ID NO: 3072697 - DNA, 17 bp, Homo sapiens
ctctgtcagtcacagcc

SEQ ID NO: 3072698 - DNA, 20 bp, Homo sapiens
ctctgtcagtcacagccacc

SEQ ID NO: 3072699 - DNA, 13 bp, Homo sapiens
ctctgtcagtgtg

SEQ ID NO: 3072700 - DNA, 13 bp, Homo sapiens
ctctgtccacttg

SEQ ID NO: 3072701 - DNA, 23 bp, Homo sapiens
ctctgtccacttgtgggtcctgg

SEQ ID NO: 3072702 - DNA, 16 bp, Homo sapiens
ctctgtccccaggcct

SEQ ID NO: 3072703 - DNA, 20 bp, Homo sapiens
ctctgtccccaggcctggct

SEQ ID NO: 3072704 - DNA, 22 bp, Homo sapiens
ctctgtccccaggcctggctcc

SEQ ID NO: 3072705 - DNA, 16 bp, Homo sapiens
ctctgtcccttgctgt

SEQ ID NO: 3072706 - DNA, 15 bp, Homo sapiens
ctctgtctctgtgga

SEQ ID NO: 3072707 - DNA, 17 bp, Homo sapiens
ctctgtctgctcaatgc

SEQ ID NO: 3072708 - DNA, 18 bp, Homo sapiens
ctctgtctgtctctcccc

SEQ ID NO: 3072709 - DNA, 17 bp, Homo sapiens
ctctgtcttcacctgat

SEQ ID NO: 3072710 - DNA, 23 bp, Homo sapiens
ctctgtcttcaggctctgcccag

SEQ ID NO: 3072711 - DNA, 13 bp, Homo sapiens
ctctgtcttctct

SEQ ID NO: 3072712 - DNA, 21 bp, Homo sapiens
ctctgtcttctctatcctctc

SEQ ID NO: 3072713 - DNA, 22 bp, Homo sapiens
ctctgtctttttccttcctgag

SEQ ID NO: 3072714 - DNA, 16 bp, Homo sapiens
ctctgtgaactatccc

SEQ ID NO: 3072715 - DNA, 12 bp, Homo sapiens
ctctgtgaatcc

SEQ ID NO: 3072716 - DNA, 22 bp, Homo sapiens
ctctgtgaatccatgggtctgg

SEQ ID NO: 3072717 - DNA, 15 bp, Homo sapiens
ctctgtgaccaatgt

SEQ ID NO: 3072718 - DNA, 15 bp, Homo sapiens
ctctgtgccttcttt

SEQ ID NO: 3072719 - DNA, 19 bp, Homo sapiens
ctctgtggaaaagccatct

SEQ ID NO: 3072720 - DNA, 18 bp, Homo sapiens
ctctgtggaggggccctc

SEQ ID NO: 3072721 - DNA, 11 bp, Homo sapiens
ctctgtggatg

SEQ ID NO: 3072722 - DNA, 17 bp, Homo sapiens
ctctgtgggaaaaaaga

SEQ ID NO: 3072723 - DNA, 20 bp, Homo sapiens
ctctgtgggaaaaaagaaaa

SEQ ID NO: 3072724 - DNA, 17 bp, Homo sapiens
ctctgtgggtctctgga

SEQ ID NO: 3072725 - DNA, 18 bp, Homo sapiens
ctctgtgggtctctggaa

SEQ ID NO: 3072726 - DNA, 14 bp, Homo sapiens
ctctgtggtgtctg

SEQ ID NO: 3072727 - DNA, 15 bp, Homo sapiens
ctctgtgtatttata

SEQ ID NO: 3072728 - DNA, 14 bp, Homo sapiens
ctctgtgtctgaga

SEQ ID NO: 3072729 - DNA, 19 bp, Homo sapiens
ctctgttatcagctgggca

SEQ ID NO: 3072730 - DNA, 16 bp, Homo sapiens
ctctgttccatgtctc

SEQ ID NO: 3072731 - DNA, 16 bp, Homo sapiens
ctctgttccttcacat

SEQ ID NO: 3072732 - DNA, 18 bp, Homo sapiens
ctctgttcggcctttggg

SEQ ID NO: 3072733 - DNA, 20 bp, Homo sapiens
ctctgttgatctacccgtgc

SEQ ID NO: 3072734 - DNA, 15 bp, Homo sapiens
ctctgttgcctcctc

SEQ ID NO: 3072735 - DNA, 13 bp, Homo sapiens
ctcttaaactctc

SEQ ID NO: 3072736 - DNA, 13 bp, Homo sapiens
ctcttaaatctct

SEQ ID NO: 3072737 - DNA, 22 bp, Homo sapiens
ctcttaaatctcttaaactctc

SEQ ID NO: 3072738 - DNA, 12 bp, Homo sapiens
ctcttaagccat

SEQ ID NO: 3072739 - DNA, 14 bp, Homo sapiens
ctcttacttgccaa

SEQ ID NO: 3072740 - DNA, 14 bp, Homo sapiens
ctcttagatggatt

SEQ ID NO: 3072741 - DNA, 18 bp, Homo sapiens
ctcttagcaaaaacatgt

SEQ ID NO: 3072742 - DNA, 15 bp, Homo sapiens
ctcttagcctctgga

SEQ ID NO: 3072743 - DNA, 15 bp, Homo sapiens
ctcttcaaatgcctg

SEQ ID NO: 3072744 - DNA, 17 bp, Homo sapiens
ctcttcaagcatcctca

SEQ ID NO: 3072745 - DNA, 24 bp, Homo sapiens
ctcttcaccttggtttatgagaac

SEQ ID NO: 3072746 - DNA, 18 bp, Homo sapiens
ctcttcactcttcaaatg

SEQ ID NO: 3072747 - DNA, 14 bp, Homo sapiens
ctcttcacttcctc

SEQ ID NO: 3072748 - DNA, 21 bp, Homo sapiens
ctcttcacttcctccagaagc

SEQ ID NO: 3072749 - DNA, 13 bp, Homo sapiens
ctcttcagaggcc

SEQ ID NO: 3072750 - DNA, 16 bp, Homo sapiens
ctcttccaccagagca

SEQ ID NO: 3072751 - DNA, 21 bp, Homo sapiens
ctcttccaccagagcaggggc

SEQ ID NO: 3072752 - DNA, 24 bp, Homo sapiens
ctcttccaggagccaccttgccac

SEQ ID NO: 3072753 - DNA, 15 bp, Homo sapiens
ctcttccctgacctc

SEQ ID NO: 3072754 - DNA, 18 bp, Homo sapiens
ctcttccgggagctggtg

SEQ ID NO: 3072755 - DNA, 18 bp, Homo sapiens
ctcttccgggcagaaaca

SEQ ID NO: 3072756 - DNA, 13 bp, Homo sapiens
ctcttctcttctt

SEQ ID NO: 3072757 - DNA, 10 bp, Homo sapiens
ctcttctggg

SEQ ID NO: 3072758 - DNA, 19 bp, Homo sapiens
ctcttctgggcagagcctg

SEQ ID NO: 3072759 - DNA, 22 bp, Homo sapiens
ctcttctgggcagagcctgtcc

SEQ ID NO: 3072760 - DNA, 21 bp, Homo sapiens
ctgatcctggaggcccagttc

SEQ ID NO: 3072761 - DNA, 20 bp, Homo sapiens
ctgatcgccaacctttcccc

SEQ ID NO: 3072762 - DNA, 21 bp, Homo sapiens
ctgatcgtgacgctgaataaa

SEQ ID NO: 3072763 - DNA, 14 bp, Homo sapiens
ctgatctttgcaaa

SEQ ID NO: 3072764 - DNA, 14 bp, Homo sapiens
ctgatgaatcactg

SEQ ID NO: 3072765 - DNA, 18 bp, Homo sapiens
ctgatgaatcactgtttt

SEQ ID NO: 3072766 - DNA, 24 bp, Homo sapiens
ctgatgacaaacccaggagtttgt

SEQ ID NO: 3072767 - DNA, 18 bp, Homo sapiens
ctgatgagactccactca

SEQ ID NO: 3072768 - DNA, 12 bp, Homo sapiens
ctgatgcaagga

SEQ ID NO: 3072769 - DNA, 15 bp, Homo sapiens
ctgatgcaaggatta

SEQ ID NO: 3072770 - DNA, 20 bp, Homo sapiens
ctgatgcaaggattacagaa

SEQ ID NO: 3072771 - DNA, 21 bp, Homo sapiens
ctgatgcaaggattacagaaa

SEQ ID NO: 3072772 - DNA, 15 bp, Homo sapiens
ctgatgctgaaataa

SEQ ID NO: 3072773 - DNA, 12 bp, Homo sapiens
ctgatgctgaca

SEQ ID NO: 3072774 - DNA, 13 bp, Homo sapiens
ctgatggattcca

SEQ ID NO: 3072775 - DNA, 23 bp, Homo sapiens
ctgatggattccaaaccaggaca

SEQ ID NO: 3072776 - DNA, 21 bp, Homo sapiens
ctgatgggcgtacgctggtgc

SEQ ID NO: 3072777 - DNA, 23 bp, Homo sapiens
ctgatgggcgtacgctggtgctg

SEQ ID NO: 3072778 - DNA, 22 bp, Homo sapiens
ctgatggtgagcagtaactgtc

SEQ ID NO: 3072779 - DNA, 15 bp, Homo sapiens
ctgatgtggactgtc

SEQ ID NO: 3072780 - DNA, 13 bp, Homo sapiens
ctgatgtgtacat

SEQ ID NO: 3072781 - DNA, 15 bp, Homo sapiens
ctgatgttcagtgta

SEQ ID NO: 3072782 - DNA, 19 bp, Homo sapiens
ctgatgttcagtgtaattt

SEQ ID NO: 3072783 - DNA, 22 bp, Homo sapiens
ctgattaaaaagggagaaagaa

SEQ ID NO: 3072784 - DNA, 18 bp, Homo sapiens
ctgattcactgcatggct

SEQ ID NO: 3072785 - DNA, 17 bp, Homo sapiens
ctgattgtttcattgcg

SEQ ID NO: 3072786 - DNA, 16 bp, Homo sapiens
ctgatttaaaaagtga

SEQ ID NO: 3072787 - DNA, 20 bp, Homo sapiens
ctgatttacctcttacctgt

SEQ ID NO: 3072788 - DNA, 21 bp, Homo sapiens
ctgatttaggagaagccagga

SEQ ID NO: 3072789 - DNA, 22 bp, Homo sapiens
ctgatttaggagaagccaggaa

SEQ ID NO: 3072790 - DNA, 16 bp, Homo sapiens
ctgatttattgaaatt

SEQ ID NO: 3072791 - DNA, 15 bp, Homo sapiens
ctgatttgagtttcc

SEQ ID NO: 3072792 - DNA, 16 bp, Homo sapiens
ctgatttgcaggattt

SEQ ID NO: 3072793 - DNA, 19 bp, Homo sapiens
ctgatttgcaggattttta

SEQ ID NO: 3072794 - DNA, 17 bp, Homo sapiens
ctgattttacaaattaa

SEQ ID NO: 3072795 - DNA, 18 bp, Homo sapiens
ctgattttacaaattaat

SEQ ID NO: 3072796 - DNA, 21 bp, Homo sapiens
ctgattttaggagctaaggct

SEQ ID NO: 3072797 - DNA, 22 bp, Homo sapiens
ctgattttaggagctaaggctc

SEQ ID NO: 3072798 - DNA, 20 bp, Homo sapiens
ctgattttctccacaacact

SEQ ID NO: 3072799 - DNA, 16 bp, Homo sapiens
ctgatttttatctaga

SEQ ID NO: 3072800 - DNA, 13 bp, Homo sapiens
ctgcaaaaaatac

SEQ ID NO: 3072801 - DNA, 13 bp, Homo sapiens
ctgcaaaatctgt

SEQ ID NO: 3072802 - DNA, 13 bp, Homo sapiens
ctgcaaacgctgc

SEQ ID NO: 3072803 - DNA, 15 bp, Homo sapiens
ctgcaaacgctgcct

SEQ ID NO: 3072804 - DNA, 16 bp, Homo sapiens
ctgcaaacgctgcctg

SEQ ID NO: 3072805 - DNA, 19 bp, Homo sapiens
ctgcaaacgctgcctgccg

SEQ ID NO: 3072806 - DNA, 16 bp, Homo sapiens
ctgcaacacaacattt

SEQ ID NO: 3072807 - DNA, 18 bp, Homo sapiens
ctgcaacacaacatttgt

SEQ ID NO: 3072808 - DNA, 12 bp, Homo sapiens
ctgcaacatgga

SEQ ID NO: 3072809 - DNA, 21 bp, Homo sapiens
ctgcaactgctcagctctggt

SEQ ID NO: 3072810 - DNA, 14 bp, Homo sapiens
ctgcaacttctgcc

SEQ ID NO: 3072811 - DNA, 13 bp, Homo sapiens
ctgcaagagcctt

SEQ ID NO: 3072812 - DNA, 14 bp, Homo sapiens
ctgcaagagccttg

SEQ ID NO: 3072813 - DNA, 18 bp, Homo sapiens
ctgcaagagccttggtgt

SEQ ID NO: 3072814 - DNA, 19 bp, Homo sapiens
ctgcaagagccttggtgtc

SEQ ID NO: 3072815 - DNA, 21 bp, Homo sapiens
ctgcaagagccttggtgtcca

SEQ ID NO: 3072816 - DNA, 18 bp, Homo sapiens
ctgcaagggacaggaagg

SEQ ID NO: 3072817 - DNA, 19 bp, Homo sapiens
ctgcaagggacaggaaggt

SEQ ID NO: 3072818 - DNA, 16 bp, Homo sapiens
ctgcaagggcccagag

SEQ ID NO: 3072819 - DNA, 18 bp, Homo sapiens
ctgcaaggtttaggctgg

SEQ ID NO: 3072820 - DNA, 19 bp, Homo sapiens
ctgcaagtccttttgtaaa

SEQ ID NO: 3072821 - DNA, 20 bp, Homo sapiens
ctgcaagtccttttgtaaag

SEQ ID NO: 3072822 - DNA, 14 bp, Homo sapiens
ctgcaagtgtctgg

SEQ ID NO: 3072823 - DNA, 14 bp, Homo sapiens
ctgcaatcactgtg

SEQ ID NO: 3072824 - DNA, 15 bp, Homo sapiens
ctgcaatcctgtctt

SEQ ID NO: 3072825 - DNA, 15 bp, Homo sapiens
ctgcaatgagccatg

SEQ ID NO: 3072826 - DNA, 18 bp, Homo sapiens
ctgcaatgtttttgtgta

SEQ ID NO: 3072827 - DNA, 14 bp, Homo sapiens
ctgcaattcaaaag

SEQ ID NO: 3072828 - DNA, 12 bp, Homo sapiens
ctgcaatttcta

SEQ ID NO: 3072829 - DNA, 16 bp, Homo sapiens
ctgcacactatttccc

SEQ ID NO: 3072830 - DNA, 20 bp, Homo sapiens
ctgcacagattcccaggcca

SEQ ID NO: 3072831 - DNA, 14 bp, Homo sapiens
ctgcacaggtctct

SEQ ID NO: 3072832 - DNA, 17 bp, Homo sapiens
ctgcacagtcagaagga

SEQ ID NO: 3072833 - DNA, 23 bp, Homo sapiens
ctgcacatgaatcccacccacat

SEQ ID NO: 3072834 - DNA, 16 bp, Homo sapiens
ctgcacatgtcttgta

SEQ ID NO: 3072835 - DNA, 16 bp, Homo sapiens
ctgcaccaccatgccc

SEQ ID NO: 3072836 - DNA, 22 bp, Homo sapiens
ctgcacccacctacttagatat

SEQ ID NO: 3072837 - DNA, 14 bp, Homo sapiens
ctgcacccaggagg

SEQ ID NO: 3072838 - DNA, 18 bp, Homo sapiens
ctgcaccgaccccgggcc

SEQ ID NO: 3072839 - DNA, 19 bp, Homo sapiens
ctgcaccgaccccgggccg

SEQ ID NO: 3072840 - DNA, 18 bp, Homo sapiens
ctgcaccgacccgaggcc

SEQ ID NO: 3072841 - DNA, 20 bp, Homo sapiens
ctgcaccgacccgaggccca

SEQ ID NO: 3072842 - DNA, 21 bp, Homo sapiens
ctgcaccgacccgaggcccag

SEQ ID NO: 3072843 - DNA, 14 bp, Homo sapiens
ctgcaccggggcct

SEQ ID NO: 3072844 - DNA, 19 bp, Homo sapiens
ctgcacctccccccactgc

SEQ ID NO: 3072845 - DNA, 13 bp, Homo sapiens
ctgcacgctcccc

SEQ ID NO: 3072846 - DNA, 16 bp, Homo sapiens
ctgcacgctcccctcc

SEQ ID NO: 3072847 - DNA, 16 bp, Homo sapiens
ctgcactccagatatg

SEQ ID NO: 3072848 - DNA, 13 bp, Homo sapiens
ctgcactccagcc

SEQ ID NO: 3072849 - DNA, 15 bp, Homo sapiens
ctgcactccagcctg

SEQ ID NO: 3072850 - DNA, 23 bp, Homo sapiens
ctgcactccagcctgagtgacag

SEQ ID NO: 3072851 - DNA, 24 bp, Homo sapiens
ctgcactccagcctgagtgacaga

SEQ ID NO: 3072852 - DNA, 20 bp, Homo sapiens
ctgcactccaggctgggtga

SEQ ID NO: 3072853 - DNA, 20 bp, Homo sapiens
ctgcactccagtctgggtga

SEQ ID NO: 3072854 - DNA, 18 bp, Homo sapiens
ctgcactccctcctggag

SEQ ID NO: 3072855 - DNA, 22 bp, Homo sapiens
ctgcactcctcagggcagcctc

SEQ ID NO: 3072856 - DNA, 19 bp, Homo sapiens
ctgcactgatgctgcccct

SEQ ID NO: 3072857 - DNA, 16 bp, Homo sapiens
ctgcactggagccaca

SEQ ID NO: 3072858 - DNA, 18 bp, Homo sapiens
ctgcactggagccacagg

SEQ ID NO: 3072859 - DNA, 19 bp, Homo sapiens
ctgcactggagccacaggc

SEQ ID NO: 3072860 - DNA, 20 bp, Homo sapiens
ctgcactggagccacaggca

SEQ ID NO: 3072861 - DNA, 15 bp, Homo sapiens
ctgcacttcatatct

SEQ ID NO: 3072862 - DNA, 23 bp, Homo sapiens
ctgcactttagtgtattttctgt

SEQ ID NO: 3072863 - DNA, 21 bp, Homo sapiens
ctgcagaacgtattggtccag

SEQ ID NO: 3072864 - DNA, 15 bp, Homo sapiens
ctgcagacttcccag

SEQ ID NO: 3072865 - DNA, 16 bp, Homo sapiens
ctgcagacttcccagc

SEQ ID NO: 3072866 - DNA, 17 bp, Homo sapiens
ctgcagacttcccagct

SEQ ID NO: 3072867 - DNA, 14 bp, Homo sapiens
ctgcagagtttgga

SEQ ID NO: 3072868 - DNA, 13 bp, Homo sapiens
ctgcagcacatgc

SEQ ID NO: 3072869 - DNA, 16 bp, Homo sapiens
ctgcagcaccgagggg

SEQ ID NO: 3072870 - DNA, 19 bp, Homo sapiens
ctgcagcaccgaggggcct

SEQ ID NO: 3072871 - DNA, 12 bp, Homo sapiens
ctgcagccagcc

SEQ ID NO: 3072872 - DNA, 14 bp, Homo sapiens
ctgcagccagccca

SEQ ID NO: 3072873 - DNA, 15 bp, Homo sapiens
ctgcagccagcccag

SEQ ID NO: 3072874 - DNA, 11 bp, Homo sapiens
ctgcagccagg

SEQ ID NO: 3072875 - DNA, 14 bp, Homo sapiens
ctgcagccaggcct

SEQ ID NO: 3072876 - DNA, 15 bp, Homo sapiens
ctgcagccaggcctc

SEQ ID NO: 3072877 - DNA, 22 bp, Homo sapiens
ctgcagccaggcctcgcctgcc

SEQ ID NO: 3072878 - DNA, 23 bp, Homo sapiens
ctgcagccaggcctcgcctgccc

SEQ ID NO: 3072879 - DNA, 14 bp, Homo sapiens
ctgcagccctgcca

SEQ ID NO: 3072880 - DNA, 15 bp, Homo sapiens
ctgcagccctgccag

SEQ ID NO: 3072881 - DNA, 22 bp, Homo sapiens
ctgcagccttgaactctgggct

SEQ ID NO: 3072882 - DNA, 21 bp, Homo sapiens
ctgcagctagtcctagtgaac

SEQ ID NO: 3072883 - DNA, 14 bp, Homo sapiens
ctgcaggaatcttt

SEQ ID NO: 3072884 - DNA, 14 bp, Homo sapiens
ctgcaggacctgcc

SEQ ID NO: 3072885 - DNA, 23 bp, Homo sapiens
ctgcaggacttgagaagacctca

SEQ ID NO: 3072886 - DNA, 17 bp, Homo sapiens
ctgcaggagggcactgg

SEQ ID NO: 3072887 - DNA, 21 bp, Homo sapiens
ctgcaggcaccgggctggctg

SEQ ID NO: 3072888 - DNA, 22 bp, Homo sapiens
ctgcaggcaccgggctggctgc

SEQ ID NO: 3072889 - DNA, 12 bp, Homo sapiens
ctgcaggcaggg

SEQ ID NO: 3072890 - DNA, 17 bp, Homo sapiens
ctgcaggccaggccagc

SEQ ID NO: 3072891 - DNA, 11 bp, Homo sapiens
ctgcaggcccc

SEQ ID NO: 3072892 - DNA, 19 bp, Homo sapiens
ctggatgtcatattggcag

SEQ ID NO: 3072893 - DNA, 12 bp, Homo sapiens
ctggatgtctga

SEQ ID NO: 3072894 - DNA, 17 bp, Homo sapiens
ctggatgtctgaacttt

SEQ ID NO: 3072895 - DNA, 18 bp, Homo sapiens
ctggcaagaaagcttgag

SEQ ID NO: 3072896 - DNA, 23 bp, Homo sapiens
ctggcacagcctggctgtggcct

SEQ ID NO: 3072897 - DNA, 19 bp, Homo sapiens
ctggcactcttgttcccac

SEQ ID NO: 3072898 - DNA, 20 bp, Homo sapiens
ctggcagacacaacccaata

SEQ ID NO: 3072899 - DNA, 23 bp, Homo sapiens
ctggcagactgtgtaaaatgtaa

SEQ ID NO: 3072900 - DNA, 15 bp, Homo sapiens
ctggcagccccagca

SEQ ID NO: 3072901 - DNA, 14 bp, Homo sapiens
ctggcagcctccca

SEQ ID NO: 3072902 - DNA, 15 bp, Homo sapiens
ctggcagcctcccat

SEQ ID NO: 3072903 - DNA, 22 bp, Homo sapiens
ctggcagcctcccatccagggc

SEQ ID NO: 3072904 - DNA, 17 bp, Homo sapiens
ctggcagcctgcacctg

SEQ ID NO: 3072905 - DNA, 13 bp, Homo sapiens
ctggcagctcagc

SEQ ID NO: 3072906 - DNA, 17 bp, Homo sapiens
ctggcagctctggacag

SEQ ID NO: 3072907 - DNA, 13 bp, Homo sapiens
ctggcagctgccc

SEQ ID NO: 3072908 - DNA, 14 bp, Homo sapiens
ctggcagctgcccc

SEQ ID NO: 3072909 - DNA, 17 bp, Homo sapiens
ctggcagctgcccctcc

SEQ ID NO: 3072910 - DNA, 20 bp, Homo sapiens
ctggcagctgcccctcctgg

SEQ ID NO: 3072911 - DNA, 23 bp, Homo sapiens
ctggcagctgcccctcctggagc

SEQ ID NO: 3072912 - DNA, 11 bp, Homo sapiens
ctggcaggcgg

SEQ ID NO: 3072913 - DNA, 21 bp, Homo sapiens
ctggcaggcggggggggcgcc

SEQ ID NO: 3072914 - DNA, 16 bp, Homo sapiens
ctggcagggggtgaag

SEQ ID NO: 3072915 - DNA, 14 bp, Homo sapiens
ctggcatctctgca

SEQ ID NO: 3072916 - DNA, 17 bp, Homo sapiens
ctggcatgatccaagca

SEQ ID NO: 3072917 - DNA, 21 bp, Homo sapiens
ctggcattctacacctggacc

SEQ ID NO: 3072918 - DNA, 16 bp, Homo sapiens
ctggcatttgtttcct

SEQ ID NO: 3072919 - DNA, 20 bp, Homo sapiens
ctggccaaagagcctttcca

SEQ ID NO: 3072920 - DNA, 18 bp, Homo sapiens
ctggccaccacccaacct

SEQ ID NO: 3072921 - DNA, 15 bp, Homo sapiens
ctggccagacacagg

SEQ ID NO: 3072922 - DNA, 19 bp, Homo sapiens
ctggccagacacaggccct

SEQ ID NO: 3072923 - DNA, 21 bp, Homo sapiens
ctggccagacacaggccctcc

SEQ ID NO: 3072924 - DNA, 13 bp, Homo sapiens
ctggccagactcg

SEQ ID NO: 3072925 - DNA, 14 bp, Homo sapiens
ctggccaggccctg

SEQ ID NO: 3072926 - DNA, 15 bp, Homo sapiens
ctggccaggccctgg

SEQ ID NO: 3072927 - DNA, 13 bp, Homo sapiens
ctggccagggcca

SEQ ID NO: 3072928 - DNA, 13 bp, Homo sapiens
ctggccagtcttc

SEQ ID NO: 3072929 - DNA, 23 bp, Homo sapiens
ctggccagtcttcctcttagcct

SEQ ID NO: 3072930 - DNA, 23 bp, Homo sapiens
ctggccatgctgtccctgcactg

SEQ ID NO: 3072931 - DNA, 22 bp, Homo sapiens
ctggccatttgccaattttcct

SEQ ID NO: 3072932 - DNA, 20 bp, Homo sapiens
ctggccatttggccccaggg

SEQ ID NO: 3072933 - DNA, 16 bp, Homo sapiens
ctggcccactgctggc

SEQ ID NO: 3072934 - DNA, 17 bp, Homo sapiens
ctggcccactgctggct

SEQ ID NO: 3072935 - DNA, 15 bp, Homo sapiens
ctggcccagcatgga

SEQ ID NO: 3072936 - DNA, 17 bp, Homo sapiens
ctggcccagcatggaat

SEQ ID NO: 3072937 - DNA, 18 bp, Homo sapiens
ctggcccagcatggaatc

SEQ ID NO: 3072938 - DNA, 13 bp, Homo sapiens
ctggcccaggagg

SEQ ID NO: 3072939 - DNA, 16 bp, Homo sapiens
ctggcccaggccttgc

SEQ ID NO: 3072940 - DNA, 11 bp, Homo sapiens
ctggcccaggg

SEQ ID NO: 3072941 - DNA, 16 bp, Homo sapiens
ctggcccagggcccag

SEQ ID NO: 3072942 - DNA, 19 bp, Homo sapiens
ctggcccagggcccagagc

SEQ ID NO: 3072943 - DNA, 21 bp, Homo sapiens
ctggcccagggcccagagccc

SEQ ID NO: 3072944 - DNA, 13 bp, Homo sapiens
ctggccccacagg

SEQ ID NO: 3072945 - DNA, 16 bp, Homo sapiens
ctggccccagagatga

SEQ ID NO: 3072946 - DNA, 16 bp, Homo sapiens
ctggccccaggacctg

SEQ ID NO: 3072947 - DNA, 16 bp, Homo sapiens
ctggccccatgtctct

SEQ ID NO: 3072948 - DNA, 17 bp, Homo sapiens
ctggccccctcagctct

SEQ ID NO: 3072949 - DNA, 16 bp, Homo sapiens
ctggccccgccgcctg

SEQ ID NO: 3072950 - DNA, 18 bp, Homo sapiens
ctggccccgcctgcctgc

SEQ ID NO: 3072951 - DNA, 20 bp, Homo sapiens
ctggccccgcctgcctgcca

SEQ ID NO: 3072952 - DNA, 13 bp, Homo sapiens
ctggcccctccaa

SEQ ID NO: 3072953 - DNA, 19 bp, Homo sapiens
ctggcccctggcctgccgg

SEQ ID NO: 3072954 - DNA, 20 bp, Homo sapiens
ctggcccctttgggccctgc

SEQ ID NO: 3072955 - DNA, 23 bp, Homo sapiens
ctggcccgtgacagactcctgag

SEQ ID NO: 3072956 - DNA, 15 bp, Homo sapiens
ctggccctgtgcaga

SEQ ID NO: 3072957 - DNA, 22 bp, Homo sapiens
ctggccggccagccagccactc

SEQ ID NO: 3072958 - DNA, 16 bp, Homo sapiens
ctggccgggcaggcgt

SEQ ID NO: 3072959 - DNA, 21 bp, Homo sapiens
ctggccgggtcaccctgtgac

SEQ ID NO: 3072960 - DNA, 14 bp, Homo sapiens
ctggccgtggctcc

SEQ ID NO: 3072961 - DNA, 19 bp, Homo sapiens
ctggccgtggctccagaat

SEQ ID NO: 3072962 - DNA, 19 bp, Homo sapiens
ctggccgttcagcctgtct

SEQ ID NO: 3072963 - DNA, 14 bp, Homo sapiens
ctggcctaggggcc

SEQ ID NO: 3072964 - DNA, 17 bp, Homo sapiens
ctggcctcaagccatct

SEQ ID NO: 3072965 - DNA, 18 bp, Homo sapiens
ctggcctcaagccatctt

SEQ ID NO: 3072966 - DNA, 12 bp, Homo sapiens
ctggcctcagac

SEQ ID NO: 3072967 - DNA, 23 bp, Homo sapiens
ctggcctcagactgcacccagga

SEQ ID NO: 3072968 - DNA, 11 bp, Homo sapiens
ctggcctccag

SEQ ID NO: 3072969 - DNA, 12 bp, Homo sapiens
ctggcctccagg

SEQ ID NO: 3072970 - DNA, 20 bp, Homo sapiens
ctggcctccaggcccgtctg

SEQ ID NO: 3072971 - DNA, 23 bp, Homo sapiens
ctggcctccaggcccgtctgtcc

SEQ ID NO: 3072972 - DNA, 14 bp, Homo sapiens
ctggcctcccaaat

SEQ ID NO: 3072973 - DNA, 17 bp, Homo sapiens
ctggcctcccacagact

SEQ ID NO: 3072974 - DNA, 14 bp, Homo sapiens
ctggcctccctccg

SEQ ID NO: 3072975 - DNA, 18 bp, Homo sapiens
ctggcctccctccgtccc

SEQ ID NO: 3072976 - DNA, 20 bp, Homo sapiens
ctggcctccgatgcctggcc

SEQ ID NO: 3072977 - DNA, 20 bp, Homo sapiens
ctggcctctgtgccttcttt

SEQ ID NO: 3072978 - DNA, 13 bp, Homo sapiens
ctggcctcttggc

SEQ ID NO: 3072979 - DNA, 15 bp, Homo sapiens
ctggcctcttggcac

SEQ ID NO: 3072980 - DNA, 17 bp, Homo sapiens
ctggcctcttggcacct

SEQ ID NO: 3072981 - DNA, 18 bp, Homo sapiens
ctggcctcttggcacctg

SEQ ID NO: 3072982 - DNA, 21 bp, Homo sapiens
ctggcctcttggcacctgcct

SEQ ID NO: 3072983 - DNA, 11 bp, Homo sapiens
ctggcctgagg

SEQ ID NO: 3072984 - DNA, 12 bp, Homo sapiens
ctggcctgctct

SEQ ID NO: 3072985 - DNA, 13 bp, Homo sapiens
ctggcctgctctt

SEQ ID NO: 3072986 - DNA, 15 bp, Homo sapiens
ctggcctgctcttac

SEQ ID NO: 3072987 - DNA, 14 bp, Homo sapiens
ctggcctggaggct

SEQ ID NO: 3072988 - DNA, 16 bp, Homo sapiens
ctggcctggcacacat

SEQ ID NO: 3072989 - DNA, 18 bp, Homo sapiens
ctggccttggtatgtgcc

SEQ ID NO: 3072990 - DNA, 19 bp, Homo sapiens
ctggccttggtatgtgcca

SEQ ID NO: 3072991 - DNA, 21 bp, Homo sapiens
ctggccttggtatgtgccagg

SEQ ID NO: 3072992 - DNA, 14 bp, Homo sapiens
ctggcgacactcag

SEQ ID NO: 3072993 - DNA, 19 bp, Homo sapiens
ctggcgacagttttccttc

SEQ ID NO: 3072994 - DNA, 22 bp, Homo sapiens
ctggcgagtgaatgccagtgtg

SEQ ID NO: 3072995 - DNA, 23 bp, Homo sapiens
ctggcgagtgaatgccagtgtgc

SEQ ID NO: 3072996 - DNA, 13 bp, Homo sapiens
ctggcgccttctc

SEQ ID NO: 3072997 - DNA, 14 bp, Homo sapiens
ctggcgccttctcg

SEQ ID NO: 3072998 - DNA, 16 bp, Homo sapiens
ctggcgccttctcgga

SEQ ID NO: 3072999 - DNA, 17 bp, Homo sapiens
ctggcgccttctcggag

SEQ ID NO: 3073000 - DNA, 23 bp, Homo sapiens
ctggcggctactcagcagccctc

SEQ ID NO: 3073001 - DNA, 13 bp, Homo sapiens
ctggcgggtggct

SEQ ID NO: 3073002 - DNA, 19 bp, Homo sapiens
ctggcgggtggctgcaagc

SEQ ID NO: 3073003 - DNA, 15 bp, Homo sapiens
ctggcgtagcaccca

SEQ ID NO: 3073004 - DNA, 18 bp, Homo sapiens
ctggcgtggattaaactt

SEQ ID NO: 3073005 - DNA, 19 bp, Homo sapiens
ctggcgtggattaaactta

SEQ ID NO: 3073006 - DNA, 16 bp, Homo sapiens
ctggctaacagtctag

SEQ ID NO: 3073007 - DNA, 21 bp, Homo sapiens
ctggctagagggcccaaagct

SEQ ID NO: 3073008 - DNA, 23 bp, Homo sapiens
ctggctatcaaagaataagaaaa

SEQ ID NO: 3073009 - DNA, 14 bp, Homo sapiens
ctggctcagctgtg

SEQ ID NO: 3073010 - DNA, 17 bp, Homo sapiens
ctggctcagctgtggtc

SEQ ID NO: 3073011 - DNA, 19 bp, Homo sapiens
ctggctcagctgtggtccc

SEQ ID NO: 3073012 - DNA, 20 bp, Homo sapiens
ctggctcagctgtggtccca

SEQ ID NO: 3073013 - DNA, 13 bp, Homo sapiens
ctggctcatctct

SEQ ID NO: 3073014 - DNA, 20 bp, Homo sapiens
ctggctccaaaccctcgagg

SEQ ID NO: 3073015 - DNA, 18 bp, Homo sapiens
ctggctccaggcagaagg

SEQ ID NO: 3073016 - DNA, 24 bp, Homo sapiens
ctggctcctctgtggtgtctgcct

SEQ ID NO: 3073017 - DNA, 14 bp, Homo sapiens
ctggctctgtggag

SEQ ID NO: 3073018 - DNA, 18 bp, Homo sapiens
ctggctctgttcggcctt

SEQ ID NO: 3073019 - DNA, 21 bp, Homo sapiens
ctggctctgttcggcctttgg

SEQ ID NO: 3073020 - DNA, 18 bp, Homo sapiens
ctggctgaacagtgctct

SEQ ID NO: 3073021 - DNA, 22 bp, Homo sapiens
ctggctgaacagtgctctgcct

SEQ ID NO: 3073022 - DNA, 23 bp, Homo sapiens
ctggctgaacagtgctctgcctc

SEQ ID NO: 3073023 - DNA, 13 bp, Homo sapiens
ctggctgagggga

SEQ ID NO: 3073024 - DNA, 15 bp, Homo sapiens
ctgtaaaaaagaaaa

SEQ ID NO: 3073025 - DNA, 13 bp, Homo sapiens
ctgtaaaaaatgt

SEQ ID NO: 3073026 - DNA, 18 bp, Homo sapiens
ctgtaaaagattaaactg

SEQ ID NO: 3073027 - DNA, 23 bp, Homo sapiens
ctgtaaaatatacttaaatggaa

SEQ ID NO: 3073028 - DNA, 14 bp, Homo sapiens
ctgtaaaatatagt

SEQ ID NO: 3073029 - DNA, 13 bp, Homo sapiens
ctgtaaagaaaga

SEQ ID NO: 3073030 - DNA, 15 bp, Homo sapiens
ctgtaaagaaagaga

SEQ ID NO: 3073031 - DNA, 20 bp, Homo sapiens
ctgtaaagaaagagagaaaa

SEQ ID NO: 3073032 - DNA, 23 bp, Homo sapiens
ctgtaaagaaagagagaaaataa

SEQ ID NO: 3073033 - DNA, 12 bp, Homo sapiens
ctgtaaagcaaa

SEQ ID NO: 3073034 - DNA, 13 bp, Homo sapiens
ctgtaaagcaaat

SEQ ID NO: 3073035 - DNA, 22 bp, Homo sapiens
ctgtaaatacatcctttttctg

SEQ ID NO: 3073036 - DNA, 22 bp, Homo sapiens
ctgtaaatgaagggtcatttct

SEQ ID NO: 3073037 - DNA, 21 bp, Homo sapiens
ctgtaaatttttgttctttta

SEQ ID NO: 3073038 - DNA, 16 bp, Homo sapiens
ctgtaaccacctctct

SEQ ID NO: 3073039 - DNA, 19 bp, Homo sapiens
ctgtaaccacctctctgtc

SEQ ID NO: 3073040 - DNA, 22 bp, Homo sapiens
ctgtaaccacctctctgtcttt

SEQ ID NO: 3073041 - DNA, 13 bp, Homo sapiens
ctgtaagaaacct

SEQ ID NO: 3073042 - DNA, 21 bp, Homo sapiens
ctgtaagaaacctactgccca

SEQ ID NO: 3073043 - DNA, 22 bp, Homo sapiens
ctgtaagaaacctactgcccag

SEQ ID NO: 3073044 - DNA, 20 bp, Homo sapiens
ctgtaagaataatttatagt

SEQ ID NO: 3073045 - DNA, 21 bp, Homo sapiens
ctgtaagaataatttatagta

SEQ ID NO: 3073046 - DNA, 16 bp, Homo sapiens
ctgtaagatgtctgtt

SEQ ID NO: 3073047 - DNA, 22 bp, Homo sapiens
ctgtaagatgtctgtttgctga

SEQ ID NO: 3073048 - DNA, 17 bp, Homo sapiens
ctgtaatcagcaataaa

SEQ ID NO: 3073049 - DNA, 16 bp, Homo sapiens
ctgtaatcccagaact

SEQ ID NO: 3073050 - DNA, 13 bp, Homo sapiens
ctgtaatcccagc

SEQ ID NO: 3073051 - DNA, 14 bp, Homo sapiens
ctgtaatcccagca

SEQ ID NO: 3073052 - DNA, 16 bp, Homo sapiens
ctgtaatcccagcact

SEQ ID NO: 3073053 - DNA, 17 bp, Homo sapiens
ctgtaatcccagcactt

SEQ ID NO: 3073054 - DNA, 15 bp, Homo sapiens
ctgtaatcccagcag

SEQ ID NO: 3073055 - DNA, 20 bp, Homo sapiens
ctgtaatcgccctactattc

SEQ ID NO: 3073056 - DNA, 20 bp, Homo sapiens
ctgtaatctttttctccacc

SEQ ID NO: 3073057 - DNA, 21 bp, Homo sapiens
ctgtaatgttaaactctttgg

SEQ ID NO: 3073058 - DNA, 23 bp, Homo sapiens
ctgtaattcagtgtatttcagtt

SEQ ID NO: 3073059 - DNA, 16 bp, Homo sapiens
ctgtaattgtgtgtga

SEQ ID NO: 3073060 - DNA, 12 bp, Homo sapiens
ctgtacaaaggg

SEQ ID NO: 3073061 - DNA, 19 bp, Homo sapiens
ctgtacaaatgacactgca

SEQ ID NO: 3073062 - DNA, 17 bp, Homo sapiens
ctgtacacgtgtcctgt

SEQ ID NO: 3073063 - DNA, 18 bp, Homo sapiens
ctgtacacgtgtcctgta

SEQ ID NO: 3073064 - DNA, 16 bp, Homo sapiens
ctgtacagtctgtctt

SEQ ID NO: 3073065 - DNA, 20 bp, Homo sapiens
ctgtacagtctgtcttctgt

SEQ ID NO: 3073066 - DNA, 19 bp, Homo sapiens
ctgtaccagcccagatgtt

SEQ ID NO: 3073067 - DNA, 23 bp, Homo sapiens
ctgtaccatatagcaaaactttt

SEQ ID NO: 3073068 - DNA, 15 bp, Homo sapiens
ctgtaccctttaaga

SEQ ID NO: 3073069 - DNA, 14 bp, Homo sapiens
ctgtacctaaagca

SEQ ID NO: 3073070 - DNA, 20 bp, Homo sapiens
ctgtactgttttctgggcca

SEQ ID NO: 3073071 - DNA, 17 bp, Homo sapiens
ctgtacttgatgacaga

SEQ ID NO: 3073072 - DNA, 20 bp, Homo sapiens
ctgtacttggtccaactgca

SEQ ID NO: 3073073 - DNA, 21 bp, Homo sapiens
ctgtacttggtccaactgcaa

SEQ ID NO: 3073074 - DNA, 18 bp, Homo sapiens
ctgtacttttcattctct

SEQ ID NO: 3073075 - DNA, 12 bp, Homo sapiens
ctgtagagactt

SEQ ID NO: 3073076 - DNA, 17 bp, Homo sapiens
ctgtagagccaattaga

SEQ ID NO: 3073077 - DNA, 16 bp, Homo sapiens
ctgtagataaataatg

SEQ ID NO: 3073078 - DNA, 16 bp, Homo sapiens
ctgtagatgatgtatt

SEQ ID NO: 3073079 - DNA, 15 bp, Homo sapiens
ctgtagatgcagaaa

SEQ ID NO: 3073080 - DNA, 16 bp, Homo sapiens
ctgtagatgcagaaaa

SEQ ID NO: 3073081 - DNA, 18 bp, Homo sapiens
ctgtagatgcagaaaaag

SEQ ID NO: 3073082 - DNA, 18 bp, Homo sapiens
ctgtagatggaaaaactt

SEQ ID NO: 3073083 - DNA, 20 bp, Homo sapiens
ctgtagattctgtggaacaa

SEQ ID NO: 3073084 - DNA, 16 bp, Homo sapiens
ctgtagcccactctgc

SEQ ID NO: 3073085 - DNA, 20 bp, Homo sapiens
ctgtagcccactctgctcgc

SEQ ID NO: 3073086 - DNA, 18 bp, Homo sapiens
ctgtagccttagtgtcac

SEQ ID NO: 3073087 - DNA, 22 bp, Homo sapiens
ctgtaggatattggaatgcaca

SEQ ID NO: 3073088 - DNA, 17 bp, Homo sapiens
ctgtaggcagaggctgc

SEQ ID NO: 3073089 - DNA, 16 bp, Homo sapiens
ctgtaggtatagaaga

SEQ ID NO: 3073090 - DNA, 15 bp, Homo sapiens
ctgtagtcccagcta

SEQ ID NO: 3073091 - DNA, 15 bp, Homo sapiens
ctgtagtctcagcta

SEQ ID NO: 3073092 - DNA, 20 bp, Homo sapiens
ctgtagtgtcactcaaggcg

SEQ ID NO: 3073093 - DNA, 13 bp, Homo sapiens
ctgtagttctaag

SEQ ID NO: 3073094 - DNA, 23 bp, Homo sapiens
ctgtagtttatggcagaagggaa

SEQ ID NO: 3073095 - DNA, 12 bp, Homo sapiens
ctgtataaatgt

SEQ ID NO: 3073096 - DNA, 14 bp, Homo sapiens
ctgtataaatgtct

SEQ ID NO: 3073097 - DNA, 21 bp, Homo sapiens
ctgtataaatgtctattatta

SEQ ID NO: 3073098 - DNA, 20 bp, Homo sapiens
ctgtatataaacgtgtcccg

SEQ ID NO: 3073099 - DNA, 13 bp, Homo sapiens
ctgtatataaatg

SEQ ID NO: 3073100 - DNA, 14 bp, Homo sapiens
ctgtatataaatgg

SEQ ID NO: 3073101 - DNA, 13 bp, Homo sapiens
ctgtatatacttt

SEQ ID NO: 3073102 - DNA, 18 bp, Homo sapiens
ctgtatatgattctctgt

SEQ ID NO: 3073103 - DNA, 19 bp, Homo sapiens
ctgtatatgattctctgtg

SEQ ID NO: 3073104 - DNA, 21 bp, Homo sapiens
ctgtatatttatgaccagagc

SEQ ID NO: 3073105 - DNA, 16 bp, Homo sapiens
ctgtatatttgtaaag

SEQ ID NO: 3073106 - DNA, 19 bp, Homo sapiens
ctgtatatttgtaaagcta

SEQ ID NO: 3073107 - DNA, 20 bp, Homo sapiens
ctgtatatttgtaaagctat

SEQ ID NO: 3073108 - DNA, 17 bp, Homo sapiens
ctgtatattttaagaag

SEQ ID NO: 3073109 - DNA, 22 bp, Homo sapiens
ctgtatcaggacccagaggaag

SEQ ID NO: 3073110 - DNA, 23 bp, Homo sapiens
ctgtatcaggacccagaggaagg

SEQ ID NO: 3073111 - DNA, 14 bp, Homo sapiens
ctgtatccatgtaa

SEQ ID NO: 3073112 - DNA, 21 bp, Homo sapiens
ctgtatccatgtaatgatctt

SEQ ID NO: 3073113 - DNA, 23 bp, Homo sapiens
ctgtatctgtagtgagatagcat

SEQ ID NO: 3073114 - DNA, 18 bp, Homo sapiens
ctgtatcttgtttttcca

SEQ ID NO: 3073115 - DNA, 12 bp, Homo sapiens
ctgtatgattta

SEQ ID NO: 3073116 - DNA, 13 bp, Homo sapiens
ctgtatgatttgt

SEQ ID NO: 3073117 - DNA, 23 bp, Homo sapiens
ctgtatgatttgttttgaatttt

SEQ ID NO: 3073118 - DNA, 15 bp, Homo sapiens
ctgtatgcggtgacg

SEQ ID NO: 3073119 - DNA, 16 bp, Homo sapiens
ctgtatgctgatcatc

SEQ ID NO: 3073120 - DNA, 20 bp, Homo sapiens
ctgtatgtattagtgatatt

SEQ ID NO: 3073121 - DNA, 15 bp, Homo sapiens
ctgtatgttgtccaa

SEQ ID NO: 3073122 - DNA, 18 bp, Homo sapiens
ctgtatgttgtccaattg

SEQ ID NO: 3073123 - DNA, 14 bp, Homo sapiens
ctgtattattgcaa

SEQ ID NO: 3073124 - DNA, 13 bp, Homo sapiens
ctgtattcccaca

SEQ ID NO: 3073125 - DNA, 16 bp, Homo sapiens
ctgtattcgtgcattt

SEQ ID NO: 3073126 - DNA, 13 bp, Homo sapiens
ctgtattgccctt

SEQ ID NO: 3073127 - DNA, 20 bp, Homo sapiens
ctgtatttaaggaatcaaat

SEQ ID NO: 3073128 - DNA, 13 bp, Homo sapiens
ctgtatttgtgac

SEQ ID NO: 3073129 - DNA, 15 bp, Homo sapiens
ctgtatttgtgacta

SEQ ID NO: 3073130 - DNA, 17 bp, Homo sapiens
ctgtatttgtgactaat

SEQ ID NO: 3073131 - DNA, 23 bp, Homo sapiens
ctgtatttgtgactaattgtata

SEQ ID NO: 3073132 - DNA, 14 bp, Homo sapiens
ctgtattttcaaag

SEQ ID NO: 3073133 - DNA, 21 bp, Homo sapiens
ctgtattttccaccttttgtt

SEQ ID NO: 3073134 - DNA, 13 bp, Homo sapiens
ctgtattttgagt

SEQ ID NO: 3073135 - DNA, 18 bp, Homo sapiens
ctgtattttgttttcctt

SEQ ID NO: 3073136 - DNA, 18 bp, Homo sapiens
ctgtatttttaaagcatg

SEQ ID NO: 3073137 - DNA, 21 bp, Homo sapiens
ctgtatttttacctttttcct

SEQ ID NO: 3073138 - DNA, 18 bp, Homo sapiens
ctgtattttttttttcca

SEQ ID NO: 3073139 - DNA, 14 bp, Homo sapiens
ctgtcaaacaaagc

SEQ ID NO: 3073140 - DNA, 19 bp, Homo sapiens
ctgtcaaacaaagccagaa

SEQ ID NO: 3073141 - DNA, 19 bp, Homo sapiens
ctgtcaagagtagttatat

SEQ ID NO: 3073142 - DNA, 22 bp, Homo sapiens
ctgtcacaattcttagatctgg

SEQ ID NO: 3073143 - DNA, 22 bp, Homo sapiens
ctgtcacatagtttttcctggg

SEQ ID NO: 3073144 - DNA, 20 bp, Homo sapiens
ctgtcaccacatcttgtctt

SEQ ID NO: 3073145 - DNA, 14 bp, Homo sapiens
ctgtcaccctggcc

SEQ ID NO: 3073146 - DNA, 16 bp, Homo sapiens
ctgtcacctctcccac

SEQ ID NO: 3073147 - DNA, 21 bp, Homo sapiens
ctgtcactcattgctgagcct

SEQ ID NO: 3073148 - DNA, 20 bp, Homo sapiens
ctgtcagccaacattgcctt

SEQ ID NO: 3073149 - DNA, 15 bp, Homo sapiens
ctgtcagcctgactc

SEQ ID NO: 3073150 - DNA, 13 bp, Homo sapiens
ctgtcagggaggg

SEQ ID NO: 3073151 - DNA, 14 bp, Homo sapiens
ctgtcagggagggc

SEQ ID NO: 3073152 - DNA, 15 bp, Homo sapiens
ctgtcagggagggcc

SEQ ID NO: 3073153 - DNA, 15 bp, Homo sapiens
ctgtcagtgtgaaaa

SEQ ID NO: 3073154 - DNA, 14 bp, Homo sapiens
ctgtcatctgaatt

SEQ ID NO: 3073155 - DNA, 14 bp, Homo sapiens
ctgtcatctgctgc

SEQ ID NO: 3073156 - DNA, 20 bp, Homo sapiens
cttaaagatttatcaaatca

SEQ ID NO: 3073157 - DNA, 17 bp, Homo sapiens
cttaaagtttcatgtga

SEQ ID NO: 3073158 - DNA, 17 bp, Homo sapiens
cttaaatcagaataaat

SEQ ID NO: 3073159 - DNA, 17 bp, Homo sapiens
cttaaatctcttaaact

SEQ ID NO: 3073160 - DNA, 20 bp, Homo sapiens
cttaacaaaccaacatcttt

SEQ ID NO: 3073161 - DNA, 14 bp, Homo sapiens
cttaactaagactc

SEQ ID NO: 3073162 - DNA, 13 bp, Homo sapiens
cttaactttttaa

SEQ ID NO: 3073163 - DNA, 22 bp, Homo sapiens
cttaagacctactgttctaaag

SEQ ID NO: 3073164 - DNA, 21 bp, Homo sapiens
cttaagaggcctgtgattatt

SEQ ID NO: 3073165 - DNA, 15 bp, Homo sapiens
cttaagattcagttt

SEQ ID NO: 3073166 - DNA, 20 bp, Homo sapiens
cttaagattcagttttccca

SEQ ID NO: 3073167 - DNA, 14 bp, Homo sapiens
cttaagatttttct

SEQ ID NO: 3073168 - DNA, 15 bp, Homo sapiens
cttaagcagcaacag

SEQ ID NO: 3073169 - DNA, 17 bp, Homo sapiens
cttaagccatcttggta

SEQ ID NO: 3073170 - DNA, 13 bp, Homo sapiens
cttaagccctggc

SEQ ID NO: 3073171 - DNA, 14 bp, Homo sapiens
cttaagccctggcc

SEQ ID NO: 3073172 - DNA, 23 bp, Homo sapiens
cttaagctttggacccaaggaaa

SEQ ID NO: 3073173 - DNA, 21 bp, Homo sapiens
cttaaggaagagagaattctg

SEQ ID NO: 3073174 - DNA, 15 bp, Homo sapiens
cttaaggagactggt

SEQ ID NO: 3073175 - DNA, 17 bp, Homo sapiens
cttaaggagactggtag

SEQ ID NO: 3073176 - DNA, 17 bp, Homo sapiens
cttaaggcatactttta

SEQ ID NO: 3073177 - DNA, 21 bp, Homo sapiens
cttaaggcatacttttaatca

SEQ ID NO: 3073178 - DNA, 15 bp, Homo sapiens
cttaaggtgaagtga

SEQ ID NO: 3073179 - DNA, 20 bp, Homo sapiens
cttaaggtgaggcctgtctg

SEQ ID NO: 3073180 - DNA, 15 bp, Homo sapiens
cttaagtataaacct

SEQ ID NO: 3073181 - DNA, 16 bp, Homo sapiens
cttaagtataaacctt

SEQ ID NO: 3073182 - DNA, 16 bp, Homo sapiens
cttaataaaaatgaca

SEQ ID NO: 3073183 - DNA, 20 bp, Homo sapiens
cttaataaaaatgacagact

SEQ ID NO: 3073184 - DNA, 21 bp, Homo sapiens
cttaataaaaatgacagactg

SEQ ID NO: 3073185 - DNA, 16 bp, Homo sapiens
cttaatacaggagacc

SEQ ID NO: 3073186 - DNA, 21 bp, Homo sapiens
cttaatacctgggtgattaca

SEQ ID NO: 3073187 - DNA, 14 bp, Homo sapiens
cttaatagaggagc

SEQ ID NO: 3073188 - DNA, 20 bp, Homo sapiens
cttaatattagcttgcttaa

SEQ ID NO: 3073189 - DNA, 20 bp, Homo sapiens
cttaatcctttaactctgcg

SEQ ID NO: 3073190 - DNA, 19 bp, Homo sapiens
cttaatgatgttatcttaa

SEQ ID NO: 3073191 - DNA, 18 bp, Homo sapiens
cttaatttggataataaa

SEQ ID NO: 3073192 - DNA, 22 bp, Homo sapiens
cttaatttggataataaaaatt

SEQ ID NO: 3073193 - DNA, 23 bp, Homo sapiens
cttaatttggataataaaaattg

SEQ ID NO: 3073194 - DNA, 21 bp, Homo sapiens
cttaatttggatctatttatt

SEQ ID NO: 3073195 - DNA, 20 bp, Homo sapiens
cttaattttggttgtattct

SEQ ID NO: 3073196 - DNA, 22 bp, Homo sapiens
cttaattttgtctttcaaattt

SEQ ID NO: 3073197 - DNA, 19 bp, Homo sapiens
cttacaaggcaggcctttc

SEQ ID NO: 3073198 - DNA, 20 bp, Homo sapiens
cttacaatttttttaatttt

SEQ ID NO: 3073199 - DNA, 16 bp, Homo sapiens
cttacagtaggagccc

SEQ ID NO: 3073200 - DNA, 23 bp, Homo sapiens
cttacagtaggagcccagctctg

SEQ ID NO: 3073201 - DNA, 17 bp, Homo sapiens
cttacagttatcctgca

SEQ ID NO: 3073202 - DNA, 18 bp, Homo sapiens
cttacatactaggtgcct

SEQ ID NO: 3073203 - DNA, 21 bp, Homo sapiens
cttacatgttcccaaaacaat

SEQ ID NO: 3073204 - DNA, 13 bp, Homo sapiens
cttacattaaaaa

SEQ ID NO: 3073205 - DNA, 12 bp, Homo sapiens
cttacattctct

SEQ ID NO: 3073206 - DNA, 21 bp, Homo sapiens
cttacattctctaataagaaa

SEQ ID NO: 3073207 - DNA, 13 bp, Homo sapiens
cttaccagaagct

SEQ ID NO: 3073208 - DNA, 17 bp, Homo sapiens
cttaccagtctcctccc

SEQ ID NO: 3073209 - DNA, 22 bp, Homo sapiens
cttaccattcctatagtacttt

SEQ ID NO: 3073210 - DNA, 16 bp, Homo sapiens
cttacccatcttgctt

SEQ ID NO: 3073211 - DNA, 19 bp, Homo sapiens
cttaccccaaagagaaaga

SEQ ID NO: 3073212 - DNA, 19 bp, Homo sapiens
cttaccgccctgcgggcca

SEQ ID NO: 3073213 - DNA, 17 bp, Homo sapiens
cttaccgttcaagaggc

SEQ ID NO: 3073214 - DNA, 15 bp, Homo sapiens
cttacctcctgccca

SEQ ID NO: 3073215 - DNA, 14 bp, Homo sapiens
cttacctggcagca

SEQ ID NO: 3073216 - DNA, 13 bp, Homo sapiens
cttaccttgtttt

SEQ ID NO: 3073217 - DNA, 16 bp, Homo sapiens
cttacctttaccccat

SEQ ID NO: 3073218 - DNA, 15 bp, Homo sapiens
cttacgatcaggcac

SEQ ID NO: 3073219 - DNA, 22 bp, Homo sapiens
cttactatgaccttccaagttt

SEQ ID NO: 3073220 - DNA, 19 bp, Homo sapiens
cttactattcccactttca

SEQ ID NO: 3073221 - DNA, 20 bp, Homo sapiens
cttactattcccactttcat

SEQ ID NO: 3073222 - DNA, 21 bp, Homo sapiens
cttactgagcgcaagccacag

SEQ ID NO: 3073223 - DNA, 22 bp, Homo sapiens
cttactgagcgcaagccacagc

SEQ ID NO: 3073224 - DNA, 11 bp, Homo sapiens
cttacttccag

SEQ ID NO: 3073225 - DNA, 13 bp, Homo sapiens
cttacttccagca

SEQ ID NO: 3073226 - DNA, 22 bp, Homo sapiens
cttacttccagcaaaatccaaa

SEQ ID NO: 3073227 - DNA, 14 bp, Homo sapiens
cttacttcttgccc

SEQ ID NO: 3073228 - DNA, 19 bp, Homo sapiens
cttactttgtgcaaaagca

SEQ ID NO: 3073229 - DNA, 17 bp, Homo sapiens
cttagaacccttctgct

SEQ ID NO: 3073230 - DNA, 18 bp, Homo sapiens
cttagaacccttctgctt

SEQ ID NO: 3073231 - DNA, 20 bp, Homo sapiens
cttagaacccttctgctttc

SEQ ID NO: 3073232 - DNA, 18 bp, Homo sapiens
cttagaacctttctgtgt

SEQ ID NO: 3073233 - DNA, 23 bp, Homo sapiens
cttagaagtggaccaggacagga

SEQ ID NO: 3073234 - DNA, 18 bp, Homo sapiens
cttagactttagtagttt

SEQ ID NO: 3073235 - DNA, 13 bp, Homo sapiens
cttagaggaaaat

SEQ ID NO: 3073236 - DNA, 18 bp, Homo sapiens
cttagatattaaaatttg

SEQ ID NO: 3073237 - DNA, 18 bp, Homo sapiens
cttagatctctcctgcaa

SEQ ID NO: 3073238 - DNA, 16 bp, Homo sapiens
cttagatctggcatgt

SEQ ID NO: 3073239 - DNA, 15 bp, Homo sapiens
cttagattcagggga

SEQ ID NO: 3073240 - DNA, 19 bp, Homo sapiens
cttagattcaggggaaggg

SEQ ID NO: 3073241 - DNA, 11 bp, Homo sapiens
cttagcagccc

SEQ ID NO: 3073242 - DNA, 13 bp, Homo sapiens
cttagcagcccag

SEQ ID NO: 3073243 - DNA, 13 bp, Homo sapiens
cttagcaggagag

SEQ ID NO: 3073244 - DNA, 14 bp, Homo sapiens
cttagcaggagagg

SEQ ID NO: 3073245 - DNA, 17 bp, Homo sapiens
cttagcatgtgactcct

SEQ ID NO: 3073246 - DNA, 18 bp, Homo sapiens
cttagccgactgcgctgc

SEQ ID NO: 3073247 - DNA, 14 bp, Homo sapiens
cttagcctctggat

SEQ ID NO: 3073248 - DNA, 17 bp, Homo sapiens
cttagccttgctgtaga

SEQ ID NO: 3073249 - DNA, 22 bp, Homo sapiens
cttagctactgtatgcaaagtc

SEQ ID NO: 3073250 - DNA, 19 bp, Homo sapiens
cttagctagttttattctt

SEQ ID NO: 3073251 - DNA, 13 bp, Homo sapiens
cttagctctggac

SEQ ID NO: 3073252 - DNA, 15 bp, Homo sapiens
cttagctctggacgt

SEQ ID NO: 3073253 - DNA, 22 bp, Homo sapiens
cttagctctggacgtgaaatac

SEQ ID NO: 3073254 - DNA, 15 bp, Homo sapiens
cttagctgaggctga

SEQ ID NO: 3073255 - DNA, 19 bp, Homo sapiens
cttagctgaggctgagaaa

SEQ ID NO: 3073256 - DNA, 21 bp, Homo sapiens
cttagctgaggctgagaaagc

SEQ ID NO: 3073257 - DNA, 15 bp, Homo sapiens
cttagctgccaagcc

SEQ ID NO: 3073258 - DNA, 13 bp, Homo sapiens
cttagctggccaa

SEQ ID NO: 3073259 - DNA, 13 bp, Homo sapiens
cttagcttcagga

SEQ ID NO: 3073260 - DNA, 21 bp, Homo sapiens
cttaggagacagatcactcct

SEQ ID NO: 3073261 - DNA, 23 bp, Homo sapiens
cttaggagacagatcactcctgg

SEQ ID NO: 3073262 - DNA, 13 bp, Homo sapiens
cttaggctttgta

SEQ ID NO: 3073263 - DNA, 13 bp, Homo sapiens
cttaggtcttcct

SEQ ID NO: 3073264 - DNA, 19 bp, Homo sapiens
cttaggtcttcctgtggct

SEQ ID NO: 3073265 - DNA, 21 bp, Homo sapiens
cttaggtcttcctgtggctcc

SEQ ID NO: 3073266 - DNA, 23 bp, Homo sapiens
cttagtaatgctacgtgtgattt

SEQ ID NO: 3073267 - DNA, 16 bp, Homo sapiens
cttagtagattaaaaa

SEQ ID NO: 3073268 - DNA, 16 bp, Homo sapiens
cttagtgtttctgtgc

SEQ ID NO: 3073269 - DNA, 19 bp, Homo sapiens
cttagtgtttctgtgcatg

SEQ ID NO: 3073270 - DNA, 19 bp, Homo sapiens
cttataaagtggacttctg

SEQ ID NO: 3073271 - DNA, 13 bp, Homo sapiens
cttataaatatga

SEQ ID NO: 3073272 - DNA, 20 bp, Homo sapiens
cttataagagggcatataca

SEQ ID NO: 3073273 - DNA, 22 bp, Homo sapiens
cttataaggtgttttctgtgta

SEQ ID NO: 3073274 - DNA, 14 bp, Homo sapiens
cttataatttaaaa

SEQ ID NO: 3073275 - DNA, 13 bp, Homo sapiens
cttatacatcact

SEQ ID NO: 3073276 - DNA, 14 bp, Homo sapiens
cttatacccatgaa

SEQ ID NO: 3073277 - DNA, 19 bp, Homo sapiens
cttatagattttttaaaaa

SEQ ID NO: 3073278 - DNA, 17 bp, Homo sapiens
cttatagggaaaaatgc

SEQ ID NO: 3073279 - DNA, 15 bp, Homo sapiens
cttatatctgaagat

SEQ ID NO: 3073280 - DNA, 16 bp, Homo sapiens
cttatatctgaagatt

SEQ ID NO: 3073281 - DNA, 19 bp, Homo sapiens
cttatatctgaagattgaa

SEQ ID NO: 3073282 - DNA, 20 bp, Homo sapiens
cttatattttcagcaaagaa

SEQ ID NO: 3073283 - DNA, 18 bp, Homo sapiens
cttatcactgacacaaaa

SEQ ID NO: 3073284 - DNA, 13 bp, Homo sapiens
cttatccaacttt

SEQ ID NO: 3073285 - DNA, 14 bp, Homo sapiens
cttatccaactttt

SEQ ID NO: 3073286 - DNA, 19 bp, Homo sapiens
cttatccctgcccatttca

SEQ ID NO: 3073287 - DNA, 22 bp, Homo sapiens
cttatccctgcccatttcatat

SEQ ID NO: 3073288 - DNA, 12 bp, Homo sapiens
cttgagcagaat

SEQ ID NO: 3073289 - DNA, 17 bp, Homo sapiens
cttgagccctccccagg

SEQ ID NO: 3073290 - DNA, 12 bp, Homo sapiens
cttgagctctgc

SEQ ID NO: 3073291 - DNA, 18 bp, Homo sapiens
cttgagctgttgtggttt

SEQ ID NO: 3073292 - DNA, 13 bp, Homo sapiens
cttgaggaaacaa

SEQ ID NO: 3073293 - DNA, 18 bp, Homo sapiens
cttgaggaaacaacagct

SEQ ID NO: 3073294 - DNA, 21 bp, Homo sapiens
cttgaggaaacaacagcttta

SEQ ID NO: 3073295 - DNA, 15 bp, Homo sapiens
cttgaggtctctttt

SEQ ID NO: 3073296 - DNA, 18 bp, Homo sapiens
cttgaggtctcttttctc

SEQ ID NO: 3073297 - DNA, 15 bp, Homo sapiens
cttgagtaggccctg

SEQ ID NO: 3073298 - DNA, 21 bp, Homo sapiens
cttgagtctcaagggtggcag

SEQ ID NO: 3073299 - DNA, 19 bp, Homo sapiens
cttgagtgttatgtgaatt

SEQ ID NO: 3073300 - DNA, 21 bp, Homo sapiens
cttgagtgttcctttttaaat

SEQ ID NO: 3073301 - DNA, 15 bp, Homo sapiens
cttgagttctgcact

SEQ ID NO: 3073302 - DNA, 12 bp, Homo sapiens
cttgatagaaat

SEQ ID NO: 3073303 - DNA, 14 bp, Homo sapiens
cttgatagaaatgc

SEQ ID NO: 3073304 - DNA, 17 bp, Homo sapiens
cttgatagaaatgccaa

SEQ ID NO: 3073305 - DNA, 14 bp, Homo sapiens
cttgatattttcta

SEQ ID NO: 3073306 - DNA, 17 bp, Homo sapiens
cttgatctcctgacctc

SEQ ID NO: 3073307 - DNA, 16 bp, Homo sapiens
cttgatcttaaagatc

SEQ ID NO: 3073308 - DNA, 21 bp, Homo sapiens
cttgatgcatgcactgttccc

SEQ ID NO: 3073309 - DNA, 18 bp, Homo sapiens
cttgatgggattctggac

SEQ ID NO: 3073310 - DNA, 19 bp, Homo sapiens
cttgatgtttcctggaagc

SEQ ID NO: 3073311 - DNA, 13 bp, Homo sapiens
cttgattctgcag

SEQ ID NO: 3073312 - DNA, 22 bp, Homo sapiens
cttgattctgcagtaaatcttt

SEQ ID NO: 3073313 - DNA, 16 bp, Homo sapiens
cttgcaagcatgcttg

SEQ ID NO: 3073314 - DNA, 17 bp, Homo sapiens
cttgcaagcatgcttgt

SEQ ID NO: 3073315 - DNA, 17 bp, Homo sapiens
cttgcaatcttctactt

SEQ ID NO: 3073316 - DNA, 19 bp, Homo sapiens
cttgcagaggagcccagtg

SEQ ID NO: 3073317 - DNA, 20 bp, Homo sapiens
cttgcagaggagcccagtgg

SEQ ID NO: 3073318 - DNA, 17 bp, Homo sapiens
cttgcagccaggagaag

SEQ ID NO: 3073319 - DNA, 16 bp, Homo sapiens
cttgcagctggcccac

SEQ ID NO: 3073320 - DNA, 14 bp, Homo sapiens
cttgcagtagattt

SEQ ID NO: 3073321 - DNA, 14 bp, Homo sapiens
cttgcagttcttga

SEQ ID NO: 3073322 - DNA, 15 bp, Homo sapiens
cttgcagttttgtaa

SEQ ID NO: 3073323 - DNA, 21 bp, Homo sapiens
cttgcagttttgtaagccctc

SEQ ID NO: 3073324 - DNA, 19 bp, Homo sapiens
cttgcatggcattaattgt

SEQ ID NO: 3073325 - DNA, 16 bp, Homo sapiens
cttgcattccagagtt

SEQ ID NO: 3073326 - DNA, 14 bp, Homo sapiens
cttgcattgcagag

SEQ ID NO: 3073327 - DNA, 13 bp, Homo sapiens
cttgccaaagcag

SEQ ID NO: 3073328 - DNA, 19 bp, Homo sapiens
cttgccaagggtccctgtg

SEQ ID NO: 3073329 - DNA, 19 bp, Homo sapiens
cttgccacccattcttccc

SEQ ID NO: 3073330 - DNA, 20 bp, Homo sapiens
cttgccagaagttgtggatt

SEQ ID NO: 3073331 - DNA, 16 bp, Homo sapiens
cttgccagagatccaa

SEQ ID NO: 3073332 - DNA, 23 bp, Homo sapiens
cttgccagagatccaaaagaagc

SEQ ID NO: 3073333 - DNA, 13 bp, Homo sapiens
cttgccagagccg

SEQ ID NO: 3073334 - DNA, 14 bp, Homo sapiens
cttgccagatgctg

SEQ ID NO: 3073335 - DNA, 17 bp, Homo sapiens
cttgccagatgctgcag

SEQ ID NO: 3073336 - DNA, 17 bp, Homo sapiens
cttgccagggctctggg

SEQ ID NO: 3073337 - DNA, 18 bp, Homo sapiens
cttgccagggctctgggg

SEQ ID NO: 3073338 - DNA, 18 bp, Homo sapiens
cttgccatccattctgga

SEQ ID NO: 3073339 - DNA, 16 bp, Homo sapiens
cttgccatcccaagcc

SEQ ID NO: 3073340 - DNA, 21 bp, Homo sapiens
cttgccatgtgactctggctt

SEQ ID NO: 3073341 - DNA, 15 bp, Homo sapiens
cttgcccacaggtgc

SEQ ID NO: 3073342 - DNA, 22 bp, Homo sapiens
cttgcccagagatgcctccacc

SEQ ID NO: 3073343 - DNA, 21 bp, Homo sapiens
cttgcccctccagagacagga

SEQ ID NO: 3073344 - DNA, 17 bp, Homo sapiens
cttgcccgtcgtgtgct

SEQ ID NO: 3073345 - DNA, 12 bp, Homo sapiens
cttgccctgctc

SEQ ID NO: 3073346 - DNA, 13 bp, Homo sapiens
cttgcccttcctg

SEQ ID NO: 3073347 - DNA, 23 bp, Homo sapiens
cttgccgcgtcgccctcccaggc

SEQ ID NO: 3073348 - DNA, 15 bp, Homo sapiens
cttgcctccaggtgc

SEQ ID NO: 3073349 - DNA, 16 bp, Homo sapiens
cttgcctccttttttc

SEQ ID NO: 3073350 - DNA, 20 bp, Homo sapiens
cttgcctgcagggccatggc

SEQ ID NO: 3073351 - DNA, 15 bp, Homo sapiens
cttgcctgggctggg

SEQ ID NO: 3073352 - DNA, 17 bp, Homo sapiens
cttgcctgggctgggca

SEQ ID NO: 3073353 - DNA, 19 bp, Homo sapiens
cttgcctgggctgggcagc

SEQ ID NO: 3073354 - DNA, 22 bp, Homo sapiens
cttgcctgggctgggcagcctt

SEQ ID NO: 3073355 - DNA, 16 bp, Homo sapiens
cttgcctgggtcacac

SEQ ID NO: 3073356 - DNA, 19 bp, Homo sapiens
cttgcctgtctaaagcctt

SEQ ID NO: 3073357 - DNA, 22 bp, Homo sapiens
cttgccttagaaacacataaat

SEQ ID NO: 3073358 - DNA, 18 bp, Homo sapiens
cttgccttattagagtgt

SEQ ID NO: 3073359 - DNA, 21 bp, Homo sapiens
cttgccttattagagtgtctt

SEQ ID NO: 3073360 - DNA, 21 bp, Homo sapiens
cttgccttcctaagcctgtgg

SEQ ID NO: 3073361 - DNA, 23 bp, Homo sapiens
cttgcgaactagagatgtgcaat

SEQ ID NO: 3073362 - DNA, 15 bp, Homo sapiens
cttgctaagctccag

SEQ ID NO: 3073363 - DNA, 14 bp, Homo sapiens
cttgctagctagcc

SEQ ID NO: 3073364 - DNA, 20 bp, Homo sapiens
cttgctcctggccttgctga

SEQ ID NO: 3073365 - DNA, 14 bp, Homo sapiens
cttgctcctgggga

SEQ ID NO: 3073366 - DNA, 16 bp, Homo sapiens
cttgctcctggggaga

SEQ ID NO: 3073367 - DNA, 22 bp, Homo sapiens
cttgctctgctctaccatgttt

SEQ ID NO: 3073368 - DNA, 19 bp, Homo sapiens
cttgctctgttacccaggc

SEQ ID NO: 3073369 - DNA, 19 bp, Homo sapiens
cttgctcttcagtgggaga

SEQ ID NO: 3073370 - DNA, 21 bp, Homo sapiens
cttgctgccaagtcctgcctt

SEQ ID NO: 3073371 - DNA, 16 bp, Homo sapiens
cttgctggacctgaat

SEQ ID NO: 3073372 - DNA, 23 bp, Homo sapiens
cttgctggagtcatgtgcctctg

SEQ ID NO: 3073373 - DNA, 13 bp, Homo sapiens
cttgctgtatgct

SEQ ID NO: 3073374 - DNA, 23 bp, Homo sapiens
cttgctgttgacatatttaatgt

SEQ ID NO: 3073375 - DNA, 14 bp, Homo sapiens
cttgcttattacat

SEQ ID NO: 3073376 - DNA, 16 bp, Homo sapiens
cttgcttattacattt

SEQ ID NO: 3073377 - DNA, 16 bp, Homo sapiens
cttgcttccaagacca

SEQ ID NO: 3073378 - DNA, 19 bp, Homo sapiens
cttgcttctaaatgcccag

SEQ ID NO: 3073379 - DNA, 14 bp, Homo sapiens
cttgcttgccaact

SEQ ID NO: 3073380 - DNA, 14 bp, Homo sapiens
cttgcttgttacat

SEQ ID NO: 3073381 - DNA, 14 bp, Homo sapiens
cttgcttttatagt

SEQ ID NO: 3073382 - DNA, 15 bp, Homo sapiens
cttgcttttctttgg

SEQ ID NO: 3073383 - DNA, 21 bp, Homo sapiens
cttgcttttctttggacaaca

SEQ ID NO: 3073384 - DNA, 21 bp, Homo sapiens
cttggaaaaagaaagaaacac

SEQ ID NO: 3073385 - DNA, 21 bp, Homo sapiens
cttggaaagaaacaaccgttg

SEQ ID NO: 3073386 - DNA, 23 bp, Homo sapiens
cttggaaatggcatgcaaaagca

SEQ ID NO: 3073387 - DNA, 20 bp, Homo sapiens
cttggaagcattcacaaagt

SEQ ID NO: 3073388 - DNA, 21 bp, Homo sapiens
cttggaatatttgctgtgaag

SEQ ID NO: 3073389 - DNA, 19 bp, Homo sapiens
cttggaattagatgtttat

SEQ ID NO: 3073390 - DNA, 11 bp, Homo sapiens
cttggactcat

SEQ ID NO: 3073391 - DNA, 17 bp, Homo sapiens
cttggagaatactgcca

SEQ ID NO: 3073392 - DNA, 14 bp, Homo sapiens
cttggagcaatcag

SEQ ID NO: 3073393 - DNA, 12 bp, Homo sapiens
cttggagcattt

SEQ ID NO: 3073394 - DNA, 17 bp, Homo sapiens
cttggagcatttatgta

SEQ ID NO: 3073395 - DNA, 13 bp, Homo sapiens
cttggagcctgca

SEQ ID NO: 3073396 - DNA, 16 bp, Homo sapiens
cttggagcctgcagag

SEQ ID NO: 3073397 - DNA, 17 bp, Homo sapiens
cttggagcctgcagagc

SEQ ID NO: 3073398 - DNA, 18 bp, Homo sapiens
cttggagcctgcagagct

SEQ ID NO: 3073399 - DNA, 17 bp, Homo sapiens
cttggagctgagcaaat

SEQ ID NO: 3073400 - DNA, 14 bp, Homo sapiens
cttggagggaagcc

SEQ ID NO: 3073401 - DNA, 17 bp, Homo sapiens
cttggaggtagctttga

SEQ ID NO: 3073402 - DNA, 19 bp, Homo sapiens
cttggagtcccaggggcag

SEQ ID NO: 3073403 - DNA, 23 bp, Homo sapiens
cttggatacctagaccgttataa

SEQ ID NO: 3073404 - DNA, 16 bp, Homo sapiens
cttggatcccaaagca

SEQ ID NO: 3073405 - DNA, 20 bp, Homo sapiens
cttggatcccaaagcaagga

SEQ ID NO: 3073406 - DNA, 16 bp, Homo sapiens
cttggatcctgggctg

SEQ ID NO: 3073407 - DNA, 17 bp, Homo sapiens
cttggatcctgggctgg

SEQ ID NO: 3073408 - DNA, 14 bp, Homo sapiens
cttggattcactaa

SEQ ID NO: 3073409 - DNA, 21 bp, Homo sapiens
cttggcacatagtgggccttc

SEQ ID NO: 3073410 - DNA, 19 bp, Homo sapiens
cttggcaccagacacccag

SEQ ID NO: 3073411 - DNA, 16 bp, Homo sapiens
cttggcacctgcctag

SEQ ID NO: 3073412 - DNA, 20 bp, Homo sapiens
cttggcagcacctgtctcct

SEQ ID NO: 3073413 - DNA, 23 bp, Homo sapiens
cttggcatcgaccacaccagcct

SEQ ID NO: 3073414 - DNA, 16 bp, Homo sapiens
cttggcatctactctg

SEQ ID NO: 3073415 - DNA, 16 bp, Homo sapiens
cttggcatctgtgtgc

SEQ ID NO: 3073416 - DNA, 17 bp, Homo sapiens
cttggcatctgtgtgcg

SEQ ID NO: 3073417 - DNA, 14 bp, Homo sapiens
cttggccaagagaa

SEQ ID NO: 3073418 - DNA, 15 bp, Homo sapiens
cttggccagttttct

SEQ ID NO: 3073419 - DNA, 15 bp, Homo sapiens
cttggcccaggagct

SEQ ID NO: 3073420 - DNA, 14 bp, Homo sapiens
ctttgtatttttct

SEQ ID NO: 3073421 - DNA, 23 bp, Homo sapiens
ctttgtcagtgttgcctcttgca

SEQ ID NO: 3073422 - DNA, 15 bp, Homo sapiens
ctttgtcccctgctt

SEQ ID NO: 3073423 - DNA, 13 bp, Homo sapiens
ctttgtcttgaaa

SEQ ID NO: 3073424 - DNA, 19 bp, Homo sapiens
ctttgtcttgaaaaaaaat

SEQ ID NO: 3073425 - DNA, 17 bp, Homo sapiens
ctttgtcttttttttca

SEQ ID NO: 3073426 - DNA, 22 bp, Homo sapiens
ctttgtgaatagaactctgaaa

SEQ ID NO: 3073427 - DNA, 14 bp, Homo sapiens
ctttgtggccaagg

SEQ ID NO: 3073428 - DNA, 15 bp, Homo sapiens
ctttgtggccaagga

SEQ ID NO: 3073429 - DNA, 13 bp, Homo sapiens
ctttgtggcttct

SEQ ID NO: 3073430 - DNA, 14 bp, Homo sapiens
ctttgtggcttctc

SEQ ID NO: 3073431 - DNA, 22 bp, Homo sapiens
ctttgtggtgggcgctggggaa

SEQ ID NO: 3073432 - DNA, 17 bp, Homo sapiens
ctttgttaagttctatt

SEQ ID NO: 3073433 - DNA, 16 bp, Homo sapiens
ctttgttcctgctttc

SEQ ID NO: 3073434 - DNA, 18 bp, Homo sapiens
ctttgttctaaagatgga

SEQ ID NO: 3073435 - DNA, 15 bp, Homo sapiens
ctttgttgcactgaa

SEQ ID NO: 3073436 - DNA, 19 bp, Homo sapiens
ctttgttggcccttccagt

SEQ ID NO: 3073437 - DNA, 16 bp, Homo sapiens
ctttgttgtctacatt

SEQ ID NO: 3073438 - DNA, 19 bp, Homo sapiens
ctttgttttaaaaagcatc

SEQ ID NO: 3073439 - DNA, 23 bp, Homo sapiens
ctttgttttgcacactttgccat

SEQ ID NO: 3073440 - DNA, 12 bp, Homo sapiens
ctttgtttttcc

SEQ ID NO: 3073441 - DNA, 17 bp, Homo sapiens
cttttaaaaatacaatt

SEQ ID NO: 3073442 - DNA, 18 bp, Homo sapiens
cttttaaacaaaagtgta

SEQ ID NO: 3073443 - DNA, 13 bp, Homo sapiens
cttttaaacacat

SEQ ID NO: 3073444 - DNA, 21 bp, Homo sapiens
cttttaaactactatttttct

SEQ ID NO: 3073445 - DNA, 13 bp, Homo sapiens
cttttaaattatg

SEQ ID NO: 3073446 - DNA, 20 bp, Homo sapiens
cttttaacacctgatgtgta

SEQ ID NO: 3073447 - DNA, 23 bp, Homo sapiens
cttttaacacctgatgtgtacat

SEQ ID NO: 3073448 - DNA, 22 bp, Homo sapiens
cttttaacatttatctaaaaga

SEQ ID NO: 3073449 - DNA, 19 bp, Homo sapiens
cttttaacgtatgtatttc

SEQ ID NO: 3073450 - DNA, 20 bp, Homo sapiens
cttttaatcatgagcctgtt

SEQ ID NO: 3073451 - DNA, 13 bp, Homo sapiens
cttttacatactg

SEQ ID NO: 3073452 - DNA, 14 bp, Homo sapiens
cttttacatactgc

SEQ ID NO: 3073453 - DNA, 16 bp, Homo sapiens
cttttacattctgtgt

SEQ ID NO: 3073454 - DNA, 16 bp, Homo sapiens
cttttaccagtttctt

SEQ ID NO: 3073455 - DNA, 20 bp, Homo sapiens
cttttacctggatataaatt

SEQ ID NO: 3073456 - DNA, 15 bp, Homo sapiens
cttttacgagtgcta

SEQ ID NO: 3073457 - DNA, 14 bp, Homo sapiens
cttttactaagaca

SEQ ID NO: 3073458 - DNA, 20 bp, Homo sapiens
cttttactgaagcctttctt

SEQ ID NO: 3073459 - DNA, 18 bp, Homo sapiens
cttttacttgttcatttc

SEQ ID NO: 3073460 - DNA, 13 bp, Homo sapiens
cttttactttatt

SEQ ID NO: 3073461 - DNA, 22 bp, Homo sapiens
cttttagtaaaaacatttaaat

SEQ ID NO: 3073462 - DNA, 21 bp, Homo sapiens
cttttagtttgatcagacagc

SEQ ID NO: 3073463 - DNA, 12 bp, Homo sapiens
cttttatacatg

SEQ ID NO: 3073464 - DNA, 17 bp, Homo sapiens
cttttatactctttctg

SEQ ID NO: 3073465 - DNA, 19 bp, Homo sapiens
cttttatactctttctgta

SEQ ID NO: 3073466 - DNA, 16 bp, Homo sapiens
cttttatagatggtca

SEQ ID NO: 3073467 - DNA, 14 bp, Homo sapiens
cttttatagttgta

SEQ ID NO: 3073468 - DNA, 19 bp, Homo sapiens
cttttatatttgaaaaaat

SEQ ID NO: 3073469 - DNA, 20 bp, Homo sapiens
cttttatatttgaaaaaatt

SEQ ID NO: 3073470 - DNA, 23 bp, Homo sapiens
cttttatatttgaaaaaattaaa

SEQ ID NO: 3073471 - DNA, 14 bp, Homo sapiens
cttttatatttgta

SEQ ID NO: 3073472 - DNA, 14 bp, Homo sapiens
cttttatcaataaa

SEQ ID NO: 3073473 - DNA, 24 bp, Homo sapiens
cttttatctattctgagaaaacaa

SEQ ID NO: 3073474 - DNA, 18 bp, Homo sapiens
cttttatgccaaattgat

SEQ ID NO: 3073475 - DNA, 15 bp, Homo sapiens
cttttatgtagtaat

SEQ ID NO: 3073476 - DNA, 23 bp, Homo sapiens
cttttatgtagtaattgacatgt

SEQ ID NO: 3073477 - DNA, 16 bp, Homo sapiens
cttttattacattagt

SEQ ID NO: 3073478 - DNA, 20 bp, Homo sapiens
cttttattacattagttaag

SEQ ID NO: 3073479 - DNA, 17 bp, Homo sapiens
cttttattgacacagaa

SEQ ID NO: 3073480 - DNA, 12 bp, Homo sapiens
cttttatttcat

SEQ ID NO: 3073481 - DNA, 20 bp, Homo sapiens
cttttattttacacagaaac

SEQ ID NO: 3073482 - DNA, 19 bp, Homo sapiens
cttttattttttcttttgt

SEQ ID NO: 3073483 - DNA, 21 bp, Homo sapiens
cttttattttttcttttgtaa

SEQ ID NO: 3073484 - DNA, 14 bp, Homo sapiens
cttttcaattatat

SEQ ID NO: 3073485 - DNA, 19 bp, Homo sapiens
cttttcaattatattgtta

SEQ ID NO: 3073486 - DNA, 20 bp, Homo sapiens
cttttcacatagctgtctag

SEQ ID NO: 3073487 - DNA, 19 bp, Homo sapiens
cttttcacattcttataaa

SEQ ID NO: 3073488 - DNA, 19 bp, Homo sapiens
cttttcacctccttcaatt

SEQ ID NO: 3073489 - DNA, 22 bp, Homo sapiens
cttttcacttcctctccacagg

SEQ ID NO: 3073490 - DNA, 15 bp, Homo sapiens
cttttcacttgtctt

SEQ ID NO: 3073491 - DNA, 21 bp, Homo sapiens
cttttcagccaatttgtctcc

SEQ ID NO: 3073492 - DNA, 22 bp, Homo sapiens
cttttcagccaatttgtctcct

SEQ ID NO: 3073493 - DNA, 23 bp, Homo sapiens
cttttcatatctcttgcccttcc

SEQ ID NO: 3073494 - DNA, 13 bp, Homo sapiens
cttttcatctggg

SEQ ID NO: 3073495 - DNA, 16 bp, Homo sapiens
cttttcatctgggaaa

SEQ ID NO: 3073496 - DNA, 17 bp, Homo sapiens
cttttcattctctttta

SEQ ID NO: 3073497 - DNA, 13 bp, Homo sapiens
cttttcattgcaa

SEQ ID NO: 3073498 - DNA, 17 bp, Homo sapiens
cttttcccctcattgca

SEQ ID NO: 3073499 - DNA, 18 bp, Homo sapiens
cttttcccctcattgcat

SEQ ID NO: 3073500 - DNA, 18 bp, Homo sapiens
cttttccctgtacttttc

SEQ ID NO: 3073501 - DNA, 15 bp, Homo sapiens
cttttcctctctctc

SEQ ID NO: 3073502 - DNA, 21 bp, Homo sapiens
cttttcctgggccttctcagc

SEQ ID NO: 3073503 - DNA, 22 bp, Homo sapiens
cttttcctgggccttctcagct

SEQ ID NO: 3073504 - DNA, 19 bp, Homo sapiens
cttttcgaactgtgctccc

SEQ ID NO: 3073505 - DNA, 19 bp, Homo sapiens
cttttctaaatccttgtta

SEQ ID NO: 3073506 - DNA, 14 bp, Homo sapiens
cttttctaaatgtt

SEQ ID NO: 3073507 - DNA, 20 bp, Homo sapiens
cttttctataatgtgcctgg

SEQ ID NO: 3073508 - DNA, 22 bp, Homo sapiens
cttttctatgttgctattgtaa

SEQ ID NO: 3073509 - DNA, 16 bp, Homo sapiens
cttttctgctgttgcc

SEQ ID NO: 3073510 - DNA, 20 bp, Homo sapiens
cttttctgctgttgcctctc

SEQ ID NO: 3073511 - DNA, 14 bp, Homo sapiens
cttttctggcaccg

SEQ ID NO: 3073512 - DNA, 23 bp, Homo sapiens
cttttctggggaaagacactgcc

SEQ ID NO: 3073513 - DNA, 17 bp, Homo sapiens
cttttctttagagaact

SEQ ID NO: 3073514 - DNA, 20 bp, Homo sapiens
cttttctttagagaactgaa

SEQ ID NO: 3073515 - DNA, 22 bp, Homo sapiens
cttttctttagagaactgaaaa

SEQ ID NO: 3073516 - DNA, 16 bp, Homo sapiens
cttttctttctaccaa

SEQ ID NO: 3073517 - DNA, 14 bp, Homo sapiens
cttttgaaatctgt

SEQ ID NO: 3073518 - DNA, 20 bp, Homo sapiens
cttttgaacccaggagttca

SEQ ID NO: 3073519 - DNA, 19 bp, Homo sapiens
cttttgaacgtatgtgctc

SEQ ID NO: 3073520 - DNA, 21 bp, Homo sapiens
cttttgaagaacaaaaggctt

SEQ ID NO: 3073521 - DNA, 20 bp, Homo sapiens
cttttgaagtgttttagtct

SEQ ID NO: 3073522 - DNA, 19 bp, Homo sapiens
cttttgaatgtccaaaatt

SEQ ID NO: 3073523 - DNA, 14 bp, Homo sapiens
cttttgaattgtta

SEQ ID NO: 3073524 - DNA, 17 bp, Homo sapiens
cttttgacaaaggcaag

SEQ ID NO: 3073525 - DNA, 11 bp, Homo sapiens
cttttgacatt

SEQ ID NO: 3073526 - DNA, 14 bp, Homo sapiens
cttttgatctctgc

SEQ ID NO: 3073527 - DNA, 14 bp, Homo sapiens
cttttgcagaagag

SEQ ID NO: 3073528 - DNA, 16 bp, Homo sapiens
cttttgcccatataaa

SEQ ID NO: 3073529 - DNA, 16 bp, Homo sapiens
cttttgctacgtgcct

SEQ ID NO: 3073530 - DNA, 21 bp, Homo sapiens
cttttggtaaagactggcttt

SEQ ID NO: 3073531 - DNA, 17 bp, Homo sapiens
cttttggtgtgttggac

SEQ ID NO: 3073532 - DNA, 20 bp, Homo sapiens
cttttggtgtgttggacaga

SEQ ID NO: 3073533 - DNA, 12 bp, Homo sapiens
cttttgtaattt

SEQ ID NO: 3073534 - DNA, 21 bp, Homo sapiens
cttttgtgaagaactatttta

SEQ ID NO: 3073535 - DNA, 13 bp, Homo sapiens
cttttgttctgag

SEQ ID NO: 3073536 - DNA, 22 bp, Homo sapiens
cttttgttttggtttggttttg

SEQ ID NO: 3073537 - DNA, 16 bp, Homo sapiens
cttttgtttttccagt

SEQ ID NO: 3073538 - DNA, 15 bp, Homo sapiens
ctttttaaacagtgt

SEQ ID NO: 3073539 - DNA, 15 bp, Homo sapiens
ctttttaaatgtgaa

SEQ ID NO: 3073540 - DNA, 22 bp, Homo sapiens
ctttttaaccaagttgtttatt

SEQ ID NO: 3073541 - DNA, 16 bp, Homo sapiens
ctttttaacctgcaaa

SEQ ID NO: 3073542 - DNA, 15 bp, Homo sapiens
ctttttaataaaaag

SEQ ID NO: 3073543 - DNA, 19 bp, Homo sapiens
ctttttaatgctgtaaaat

SEQ ID NO: 3073544 - DNA, 14 bp, Homo sapiens
ctttttaattattt

SEQ ID NO: 3073545 - DNA, 22 bp, Homo sapiens
ctttttaattattttaaaatat

SEQ ID NO: 3073546 - DNA, 16 bp, Homo sapiens
ctttttagtaatttct

SEQ ID NO: 3073547 - DNA, 14 bp, Homo sapiens
ctttttatcttgag

SEQ ID NO: 3073548 - DNA, 20 bp, Homo sapiens
ctttttatcttgagtgttat

SEQ ID NO: 3073549 - DNA, 13 bp, Homo sapiens
ctttttattgaat

SEQ ID NO: 3073550 - DNA, 14 bp, Homo sapiens
ctttttattgaatc

SEQ ID NO: 3073551 - DNA, 17 bp, Homo sapiens
ctttttattgaatctat

SEQ ID NO: 3073552 - DNA, 12 bp, Homo sapiens
gacttttgtaaa

SEQ ID NO: 3073553 - DNA, 17 bp, Homo sapiens
gacttttgttctcttct

SEQ ID NO: 3073554 - DNA, 19 bp, Homo sapiens
gagaaaaagaaagaactgt

SEQ ID NO: 3073555 - DNA, 13 bp, Homo sapiens
gagaaaaatgctt

SEQ ID NO: 3073556 - DNA, 14 bp, Homo sapiens
gagaaaacactttc

SEQ ID NO: 3073557 - DNA, 21 bp, Homo sapiens
gagaaaactcttctgaggatc

SEQ ID NO: 3073558 - DNA, 14 bp, Homo sapiens
gagaaaataaaaag

SEQ ID NO: 3073559 - DNA, 17 bp, Homo sapiens
gagaaaatatatgtatt

SEQ ID NO: 3073560 - DNA, 18 bp, Homo sapiens
gagaaaatatatgtattt

SEQ ID NO: 3073561 - DNA, 19 bp, Homo sapiens
gagaaaatatatgtatttt

SEQ ID NO: 3073562 - DNA, 14 bp, Homo sapiens
gagaaacacttgaa

SEQ ID NO: 3073563 - DNA, 12 bp, Homo sapiens
gagaaaccctgt

SEQ ID NO: 3073564 - DNA, 16 bp, Homo sapiens
gagaaacctgtatctt

SEQ ID NO: 3073565 - DNA, 18 bp, Homo sapiens
gagaaacctgtatctttc

SEQ ID NO: 3073566 - DNA, 21 bp, Homo sapiens
gagaaacctgtatctttctat

SEQ ID NO: 3073567 - DNA, 16 bp, Homo sapiens
gagaaagagacagaga

SEQ ID NO: 3073568 - DNA, 16 bp, Homo sapiens
gagaaagcccacctgg

SEQ ID NO: 3073569 - DNA, 21 bp, Homo sapiens
gagaaagcccacctgggctgg

SEQ ID NO: 3073570 - DNA, 21 bp, Homo sapiens
gagaaaggacagagccagcgg

SEQ ID NO: 3073571 - DNA, 16 bp, Homo sapiens
gagaaagggagagaaa

SEQ ID NO: 3073572 - DNA, 22 bp, Homo sapiens
gagaaagggagagaaaactctt

SEQ ID NO: 3073573 - DNA, 14 bp, Homo sapiens
gagaaatacaaaaa

SEQ ID NO: 3073574 - DNA, 16 bp, Homo sapiens
gagaacaaaacctctt

SEQ ID NO: 3073575 - DNA, 22 bp, Homo sapiens
gagaacacagccgattcacctg

SEQ ID NO: 3073576 - DNA, 19 bp, Homo sapiens
gagaacatggtgtgtgtct

SEQ ID NO: 3073577 - DNA, 21 bp, Homo sapiens
gagaacggtgaccgcctcctg

SEQ ID NO: 3073578 - DNA, 15 bp, Homo sapiens
gagaacgtatcaata

SEQ ID NO: 3073579 - DNA, 19 bp, Homo sapiens
gagaactggttcttgcctt

SEQ ID NO: 3073580 - DNA, 21 bp, Homo sapiens
gagaacttaagtggctaaaga

SEQ ID NO: 3073581 - DNA, 19 bp, Homo sapiens
gagaagagagaaatagcct

SEQ ID NO: 3073582 - DNA, 16 bp, Homo sapiens
gagaagaggaggaggt

SEQ ID NO: 3073583 - DNA, 21 bp, Homo sapiens
gagaagcacactctggtcttg

SEQ ID NO: 3073584 - DNA, 23 bp, Homo sapiens
gagaagccaggaatttcccagga

SEQ ID NO: 3073585 - DNA, 15 bp, Homo sapiens
gagaagccattgtct

SEQ ID NO: 3073586 - DNA, 22 bp, Homo sapiens
gagaagctcctctccccagccc

SEQ ID NO: 3073587 - DNA, 14 bp, Homo sapiens
gagaagctgcatcc

SEQ ID NO: 3073588 - DNA, 18 bp, Homo sapiens
gagaaggaaaattttagc

SEQ ID NO: 3073589 - DNA, 14 bp, Homo sapiens
gagaaggaaggaga

SEQ ID NO: 3073590 - DNA, 13 bp, Homo sapiens
gagaaggcaggaa

SEQ ID NO: 3073591 - DNA, 17 bp, Homo sapiens
gagaaggtggacctggc

SEQ ID NO: 3073592 - DNA, 20 bp, Homo sapiens
gagaagtggggaccccaccc

SEQ ID NO: 3073593 - DNA, 14 bp, Homo sapiens
gagaatagagctgc

SEQ ID NO: 3073594 - DNA, 19 bp, Homo sapiens
gagaatcgcttgaacctgg

SEQ ID NO: 3073595 - DNA, 14 bp, Homo sapiens
gagaatgcagccca

SEQ ID NO: 3073596 - DNA, 22 bp, Homo sapiens
gagaatgcagcccaccaggagc

SEQ ID NO: 3073597 - DNA, 22 bp, Homo sapiens
gagaatggaaaccacaactttt

SEQ ID NO: 3073598 - DNA, 22 bp, Homo sapiens
gagaattcttacatgttttctt

SEQ ID NO: 3073599 - DNA, 14 bp, Homo sapiens
gagacaaaagaaaa

SEQ ID NO: 3073600 - DNA, 15 bp, Homo sapiens
gagacaaaagaaaaa

SEQ ID NO: 3073601 - DNA, 16 bp, Homo sapiens
gagacaaagcaggagt

SEQ ID NO: 3073602 - DNA, 22 bp, Homo sapiens
gagacaatgtctgcagccctga

SEQ ID NO: 3073603 - DNA, 15 bp, Homo sapiens
gagacacctgcacct

SEQ ID NO: 3073604 - DNA, 17 bp, Homo sapiens
gagacacctgcacctcc

SEQ ID NO: 3073605 - DNA, 17 bp, Homo sapiens
gagacagagtctcgctc

SEQ ID NO: 3073606 - DNA, 16 bp, Homo sapiens
gagacaggaagcctca

SEQ ID NO: 3073607 - DNA, 20 bp, Homo sapiens
gagacaggagaatcacctga

SEQ ID NO: 3073608 - DNA, 15 bp, Homo sapiens
gagacataaatagag

SEQ ID NO: 3073609 - DNA, 15 bp, Homo sapiens
gagacatacttgaag

SEQ ID NO: 3073610 - DNA, 18 bp, Homo sapiens
gagacatacttgaagggc

SEQ ID NO: 3073611 - DNA, 20 bp, Homo sapiens
gagacatacttgaagggcca

SEQ ID NO: 3073612 - DNA, 16 bp, Homo sapiens
gagacattaactcatt

SEQ ID NO: 3073613 - DNA, 14 bp, Homo sapiens
gagacattttcata

SEQ ID NO: 3073614 - DNA, 15 bp, Homo sapiens
gagaccaacctgacc

SEQ ID NO: 3073615 - DNA, 14 bp, Homo sapiens
gagaccagcctggc

SEQ ID NO: 3073616 - DNA, 16 bp, Homo sapiens
gagaccagcctttctt

SEQ ID NO: 3073617 - DNA, 18 bp, Homo sapiens
gagaccagcctttcttcc

SEQ ID NO: 3073618 - DNA, 17 bp, Homo sapiens
gagaccaggggaccaga

SEQ ID NO: 3073619 - DNA, 22 bp, Homo sapiens
gagaccatttgtattaccatta

SEQ ID NO: 3073620 - DNA, 15 bp, Homo sapiens
gagacccaagggcag

SEQ ID NO: 3073621 - DNA, 18 bp, Homo sapiens
gagacccagccctcatcc

SEQ ID NO: 3073622 - DNA, 20 bp, Homo sapiens
gagacccagggggctgaaac

SEQ ID NO: 3073623 - DNA, 14 bp, Homo sapiens
gagacccgggaagg

SEQ ID NO: 3073624 - DNA, 20 bp, Homo sapiens
gagaccggggtatcctgggg

SEQ ID NO: 3073625 - DNA, 18 bp, Homo sapiens
gagacctcagatgtgttg

SEQ ID NO: 3073626 - DNA, 11 bp, Homo sapiens
gagacctcagc

SEQ ID NO: 3073627 - DNA, 15 bp, Homo sapiens
gagacctcagccatg

SEQ ID NO: 3073628 - DNA, 14 bp, Homo sapiens
gagacctgctctcc

SEQ ID NO: 3073629 - DNA, 19 bp, Homo sapiens
gagacctggacacaggcct

SEQ ID NO: 3073630 - DNA, 23 bp, Homo sapiens
gagacctgttttaaaaaggaact

SEQ ID NO: 3073631 - DNA, 16 bp, Homo sapiens
gagacgggccctggtg

SEQ ID NO: 3073632 - DNA, 19 bp, Homo sapiens
gagacggtttccagggagg

SEQ ID NO: 3073633 - DNA, 19 bp, Homo sapiens
gagactcacctctgcctca

SEQ ID NO: 3073634 - DNA, 15 bp, Homo sapiens
gagactcagcctgca

SEQ ID NO: 3073635 - DNA, 13 bp, Homo sapiens
gagactcagtgca

SEQ ID NO: 3073636 - DNA, 23 bp, Homo sapiens
gagactcagtgcagatggagaga

SEQ ID NO: 3073637 - DNA, 21 bp, Homo sapiens
gagactgatccctggccactg

SEQ ID NO: 3073638 - DNA, 22 bp, Homo sapiens
gagactgatccctggccactga

SEQ ID NO: 3073639 - DNA, 14 bp, Homo sapiens
gagactggcaggcg

SEQ ID NO: 3073640 - DNA, 16 bp, Homo sapiens
gagactgggctctggc

SEQ ID NO: 3073641 - DNA, 14 bp, Homo sapiens
gagactgggctgag

SEQ ID NO: 3073642 - DNA, 15 bp, Homo sapiens
gagactgggctgagg

SEQ ID NO: 3073643 - DNA, 15 bp, Homo sapiens
gagacttccgtcacc

SEQ ID NO: 3073644 - DNA, 15 bp, Homo sapiens
gagacttggatgagg

SEQ ID NO: 3073645 - DNA, 12 bp, Homo sapiens
gagagaaaaaga

SEQ ID NO: 3073646 - DNA, 18 bp, Homo sapiens
gagagaaaaagaaagaac

SEQ ID NO: 3073647 - DNA, 11 bp, Homo sapiens
gagagaaaata

SEQ ID NO: 3073648 - DNA, 16 bp, Homo sapiens
gagagaaaataaaaag

SEQ ID NO: 3073649 - DNA, 11 bp, Homo sapiens
gagagaaagaa

SEQ ID NO: 3073650 - DNA, 22 bp, Homo sapiens
gagagaaagtgtgagcaaacta

SEQ ID NO: 3073651 - DNA, 16 bp, Homo sapiens
gagagaacctaactgt

SEQ ID NO: 3073652 - DNA, 18 bp, Homo sapiens
gagagaacctaactgtat

SEQ ID NO: 3073653 - DNA, 12 bp, Homo sapiens
gagagaaggggc

SEQ ID NO: 3073654 - DNA, 16 bp, Homo sapiens
gagagaatagagctgc

SEQ ID NO: 3073655 - DNA, 22 bp, Homo sapiens
gagagaatagagctgccactgg

SEQ ID NO: 3073656 - DNA, 12 bp, Homo sapiens
gagagagaggct

SEQ ID NO: 3073657 - DNA, 13 bp, Homo sapiens
gagagagctggag

SEQ ID NO: 3073658 - DNA, 13 bp, Homo sapiens
gagagattattaa

SEQ ID NO: 3073659 - DNA, 17 bp, Homo sapiens
gagagcactagaagtgg

SEQ ID NO: 3073660 - DNA, 22 bp, Homo sapiens
gagagcactagaagtggtttcc

SEQ ID NO: 3073661 - DNA, 12 bp, Homo sapiens
gagagccagccc

SEQ ID NO: 3073662 - DNA, 14 bp, Homo sapiens
gagagccagccctc

SEQ ID NO: 3073663 - DNA, 20 bp, Homo sapiens
gagagccagccctccctgtc

SEQ ID NO: 3073664 - DNA, 12 bp, Homo sapiens
gagagccaggct

SEQ ID NO: 3073665 - DNA, 16 bp, Homo sapiens
gagagcgcctgcccct

SEQ ID NO: 3073666 - DNA, 22 bp, Homo sapiens
gagagcgcctgcccctcccaga

SEQ ID NO: 3073667 - DNA, 15 bp, Homo sapiens
gagagctttctgcct

SEQ ID NO: 3073668 - DNA, 20 bp, Homo sapiens
gagagctttctgccttagcc

SEQ ID NO: 3073669 - DNA, 12 bp, Homo sapiens
gagaggaaggac

SEQ ID NO: 3073670 - DNA, 18 bp, Homo sapiens
gagaggaaggacccctca

SEQ ID NO: 3073671 - DNA, 12 bp, Homo sapiens
gagaggaagggt

SEQ ID NO: 3073672 - DNA, 19 bp, Homo sapiens
gagaggagagccagagaag

SEQ ID NO: 3073673 - DNA, 18 bp, Homo sapiens
gagaggagggatgcaact

SEQ ID NO: 3073674 - DNA, 20 bp, Homo sapiens
gagaggctgcctccgcacct

SEQ ID NO: 3073675 - DNA, 22 bp, Homo sapiens
gagaggctgcctccgcacctga

SEQ ID NO: 3073676 - DNA, 22 bp, Homo sapiens
gagaggctggtgtatgcactgc

SEQ ID NO: 3073677 - DNA, 18 bp, Homo sapiens
gagagggaggcaagccct

SEQ ID NO: 3073678 - DNA, 18 bp, Homo sapiens
gagagggcctctgcctgg

SEQ ID NO: 3073679 - DNA, 19 bp, Homo sapiens
gagagggcctctgcctggg

SEQ ID NO: 3073680 - DNA, 20 bp, Homo sapiens
gagagggcctctgcctggga

SEQ ID NO: 3073681 - DNA, 19 bp, Homo sapiens
gagaggggacgcaggcccc

SEQ ID NO: 3073682 - DNA, 20 bp, Homo sapiens
gagaggggacgcaggcccct

SEQ ID NO: 3073683 - DNA, 13 bp, Homo sapiens
gagaggggaggga

SEQ ID NO: 3073684 - DNA, 16 bp, Homo sapiens
gagaggggagggaggg

SEQ ID NO: 3073685 - DNA, 21 bp, Homo sapiens
gaggacttggttgatgtttaa

SEQ ID NO: 3073686 - DNA, 12 bp, Homo sapiens
gaggagaagaat

SEQ ID NO: 3073687 - DNA, 21 bp, Homo sapiens
gaggagagaagaatgagccta

SEQ ID NO: 3073688 - DNA, 24 bp, Homo sapiens
gaggagagatagcctgtggccctg

SEQ ID NO: 3073689 - DNA, 19 bp, Homo sapiens
gaggagcccagtgggctgc

SEQ ID NO: 3073690 - DNA, 17 bp, Homo sapiens
gaggagccccatctgtc

SEQ ID NO: 3073691 - DNA, 17 bp, Homo sapiens
gaggagcctcagaagaa

SEQ ID NO: 3073692 - DNA, 22 bp, Homo sapiens
gaggagctgcctcttctcttga

SEQ ID NO: 3073693 - DNA, 12 bp, Homo sapiens
gaggaggcatgg

SEQ ID NO: 3073694 - DNA, 15 bp, Homo sapiens
gaggaggcatggaaa

SEQ ID NO: 3073695 - DNA, 18 bp, Homo sapiens
gaggaggcgcggcctccc

SEQ ID NO: 3073696 - DNA, 18 bp, Homo sapiens
gaggaggctccagagggc

SEQ ID NO: 3073697 - DNA, 22 bp, Homo sapiens
gaggaggctgccctgaggggct

SEQ ID NO: 3073698 - DNA, 14 bp, Homo sapiens
gaggagggcaggca

SEQ ID NO: 3073699 - DNA, 19 bp, Homo sapiens
gaggaggggcccccctgcc

SEQ ID NO: 3073700 - DNA, 22 bp, Homo sapiens
gaggaggggcccccctgccctg

SEQ ID NO: 3073701 - DNA, 22 bp, Homo sapiens
gaggaggggcccggtggcggca

SEQ ID NO: 3073702 - DNA, 20 bp, Homo sapiens
gaggaggtgggggctggagg

SEQ ID NO: 3073703 - DNA, 20 bp, Homo sapiens
gaggagtaaccgctccaggt

SEQ ID NO: 3073704 - DNA, 23 bp, Homo sapiens
gaggagtggttgggctgtgcctg

SEQ ID NO: 3073705 - DNA, 19 bp, Homo sapiens
gaggagttctttggctcta

SEQ ID NO: 3073706 - DNA, 19 bp, Homo sapiens
gaggatcccctgtcccctg

SEQ ID NO: 3073707 - DNA, 21 bp, Homo sapiens
gaggatcccctgtcccctggg

SEQ ID NO: 3073708 - DNA, 16 bp, Homo sapiens
gaggatcctgagctgc

SEQ ID NO: 3073709 - DNA, 14 bp, Homo sapiens
gaggatgagacagg

SEQ ID NO: 3073710 - DNA, 15 bp, Homo sapiens
gaggatgctctttcc

SEQ ID NO: 3073711 - DNA, 20 bp, Homo sapiens
gaggcaaagctggctcacct

SEQ ID NO: 3073712 - DNA, 20 bp, Homo sapiens
gaggcaagccatggagtgag

SEQ ID NO: 3073713 - DNA, 14 bp, Homo sapiens
gaggcacagcaaac

SEQ ID NO: 3073714 - DNA, 12 bp, Homo sapiens
gaggcactgaag

SEQ ID NO: 3073715 - DNA, 16 bp, Homo sapiens
gaggcagaaaattgca

SEQ ID NO: 3073716 - DNA, 20 bp, Homo sapiens
gaggcagaggttgcagtgag

SEQ ID NO: 3073717 - DNA, 12 bp, Homo sapiens
gaggcagcccgc

SEQ ID NO: 3073718 - DNA, 18 bp, Homo sapiens
gaggcaggcatggccctg

SEQ ID NO: 3073719 - DNA, 20 bp, Homo sapiens
gaggcaggcatggccctggg

SEQ ID NO: 3073720 - DNA, 15 bp, Homo sapiens
gaggcagggccttgc

SEQ ID NO: 3073721 - DNA, 17 bp, Homo sapiens
gaggcagggccttgccc

SEQ ID NO: 3073722 - DNA, 18 bp, Homo sapiens
gaggcagggccttgccca

SEQ ID NO: 3073723 - DNA, 20 bp, Homo sapiens
gaggcagggccttgcccaga

SEQ ID NO: 3073724 - DNA, 14 bp, Homo sapiens
gaggcaggggcgga

SEQ ID NO: 3073725 - DNA, 15 bp, Homo sapiens
gaggcaggggcggag

SEQ ID NO: 3073726 - DNA, 21 bp, Homo sapiens
gaggcatcatggaaagactgg

SEQ ID NO: 3073727 - DNA, 21 bp, Homo sapiens
gaggcatccagcagtctctgc

SEQ ID NO: 3073728 - DNA, 19 bp, Homo sapiens
gaggcatcctacccttttc

SEQ ID NO: 3073729 - DNA, 18 bp, Homo sapiens
gaggcatggggcatgtcc

SEQ ID NO: 3073730 - DNA, 20 bp, Homo sapiens
gaggccaagcagtgcctgcc

SEQ ID NO: 3073731 - DNA, 13 bp, Homo sapiens
gaggccaaggtgg

SEQ ID NO: 3073732 - DNA, 18 bp, Homo sapiens
gaggccaaggtgggcgga

SEQ ID NO: 3073733 - DNA, 16 bp, Homo sapiens
gaggccacttagggaa

SEQ ID NO: 3073734 - DNA, 13 bp, Homo sapiens
gaggccagggcag

SEQ ID NO: 3073735 - DNA, 16 bp, Homo sapiens
gaggcccagccgcagg

SEQ ID NO: 3073736 - DNA, 13 bp, Homo sapiens
gaggcccaggctg

SEQ ID NO: 3073737 - DNA, 20 bp, Homo sapiens
gaggcccagttcaccctgat

SEQ ID NO: 3073738 - DNA, 12 bp, Homo sapiens
gaggcccttcct

SEQ ID NO: 3073739 - DNA, 18 bp, Homo sapiens
gaggccgaagctgctgtg

SEQ ID NO: 3073740 - DNA, 20 bp, Homo sapiens
gaggccgagcggtggccccg

SEQ ID NO: 3073741 - DNA, 14 bp, Homo sapiens
gaggccgaggcagg

SEQ ID NO: 3073742 - DNA, 18 bp, Homo sapiens
gaggccgcggcctccccg

SEQ ID NO: 3073743 - DNA, 20 bp, Homo sapiens
gaggccggccctgcccctcc

SEQ ID NO: 3073744 - DNA, 21 bp, Homo sapiens
gaggcctctctcaggagcagg

SEQ ID NO: 3073745 - DNA, 19 bp, Homo sapiens
gaggcctgcgaccctgggg

SEQ ID NO: 3073746 - DNA, 15 bp, Homo sapiens
gaggccttgagaggc

SEQ ID NO: 3073747 - DNA, 18 bp, Homo sapiens
gaggccttggggtggggg

SEQ ID NO: 3073748 - DNA, 23 bp, Homo sapiens
gaggccttggggtgggggccagg

SEQ ID NO: 3073749 - DNA, 22 bp, Homo sapiens
gaggccttgtgtgtcaggccct

SEQ ID NO: 3073750 - DNA, 19 bp, Homo sapiens
gaggcggatctttggacag

SEQ ID NO: 3073751 - DNA, 12 bp, Homo sapiens
gaggcggtgggg

SEQ ID NO: 3073752 - DNA, 17 bp, Homo sapiens
gaggcgttctcctgctt

SEQ ID NO: 3073753 - DNA, 18 bp, Homo sapiens
gaggcgttctcctgcttg

SEQ ID NO: 3073754 - DNA, 23 bp, Homo sapiens
gaggctaaattactcaggaagaa

SEQ ID NO: 3073755 - DNA, 18 bp, Homo sapiens
gaggctcagcccaccctc

SEQ ID NO: 3073756 - DNA, 10 bp, Homo sapiens
gaggctcagg

SEQ ID NO: 3073757 - DNA, 12 bp, Homo sapiens
gaggctcaggtc

SEQ ID NO: 3073758 - DNA, 17 bp, Homo sapiens
gaggctccagagggcac

SEQ ID NO: 3073759 - DNA, 14 bp, Homo sapiens
gaggctcctccctc

SEQ ID NO: 3073760 - DNA, 15 bp, Homo sapiens
gaggctcctccctct

SEQ ID NO: 3073761 - DNA, 19 bp, Homo sapiens
gaggctcctccctctgcct

SEQ ID NO: 3073762 - DNA, 21 bp, Homo sapiens
gaggctcctccctctgcctca

SEQ ID NO: 3073763 - DNA, 14 bp, Homo sapiens
gaggctgagaaagc

SEQ ID NO: 3073764 - DNA, 16 bp, Homo sapiens
gaggctgaggcagaag

SEQ ID NO: 3073765 - DNA, 18 bp, Homo sapiens
gaggctgaggcagaagaa

SEQ ID NO: 3073766 - DNA, 14 bp, Homo sapiens
gaggctgaggcagg

SEQ ID NO: 3073767 - DNA, 18 bp, Homo sapiens
gaggctgaggcaggagaa

SEQ ID NO: 3073768 - DNA, 17 bp, Homo sapiens
gaggctgcactggagcc

SEQ ID NO: 3073769 - DNA, 19 bp, Homo sapiens
gaggctgcagccaggcctc

SEQ ID NO: 3073770 - DNA, 21 bp, Homo sapiens
gaggctgcagccaggcctcgc

SEQ ID NO: 3073771 - DNA, 15 bp, Homo sapiens
gaggctgcagtcagc

SEQ ID NO: 3073772 - DNA, 11 bp, Homo sapiens
gaggctgcccc

SEQ ID NO: 3073773 - DNA, 19 bp, Homo sapiens
gaggctgccccaggccgga

SEQ ID NO: 3073774 - DNA, 22 bp, Homo sapiens
gaggctgcctccgcacctgacc

SEQ ID NO: 3073775 - DNA, 15 bp, Homo sapiens
gaggctggaggcagg

SEQ ID NO: 3073776 - DNA, 20 bp, Homo sapiens
gaggctggtgtatgcactgc

SEQ ID NO: 3073777 - DNA, 12 bp, Homo sapiens
gaggctgtgtcc

SEQ ID NO: 3073778 - DNA, 14 bp, Homo sapiens
gaggctgtgtccct

SEQ ID NO: 3073779 - DNA, 22 bp, Homo sapiens
gaggctgtgtccctgctggggt

SEQ ID NO: 3073780 - DNA, 16 bp, Homo sapiens
gaggcttcttcagatc

SEQ ID NO: 3073781 - DNA, 23 bp, Homo sapiens
gaggctttatgataatagattct

SEQ ID NO: 3073782 - DNA, 18 bp, Homo sapiens
gaggctttgagcaactaa

SEQ ID NO: 3073783 - DNA, 14 bp, Homo sapiens
gaggctttggccca

SEQ ID NO: 3073784 - DNA, 16 bp, Homo sapiens
gagggaaactgtgaat

SEQ ID NO: 3073785 - DNA, 23 bp, Homo sapiens
gagggaaactgtgaatgcttctg

SEQ ID NO: 3073786 - DNA, 13 bp, Homo sapiens
gagggaagccagg

SEQ ID NO: 3073787 - DNA, 16 bp, Homo sapiens
gagggaagtcctggga

SEQ ID NO: 3073788 - DNA, 19 bp, Homo sapiens
gagggacccttcgagatca

SEQ ID NO: 3073789 - DNA, 15 bp, Homo sapiens
gagggacgcctgggg

SEQ ID NO: 3073790 - DNA, 15 bp, Homo sapiens
gagggacggccaaga

SEQ ID NO: 3073791 - DNA, 16 bp, Homo sapiens
gagggactgagccaga

SEQ ID NO: 3073792 - DNA, 14 bp, Homo sapiens
gagggactgctgac

SEQ ID NO: 3073793 - DNA, 13 bp, Homo sapiens
gagggagaagaag

SEQ ID NO: 3073794 - DNA, 12 bp, Homo sapiens
gagggagatgga

SEQ ID NO: 3073795 - DNA, 22 bp, Homo sapiens
gagggagcaagtccttcccttt

SEQ ID NO: 3073796 - DNA, 16 bp, Homo sapiens
gagggagccatggaag

SEQ ID NO: 3073797 - DNA, 15 bp, Homo sapiens
gagggagctgaggcc

SEQ ID NO: 3073798 - DNA, 19 bp, Homo sapiens
gagggagctgaggcctccc

SEQ ID NO: 3073799 - DNA, 20 bp, Homo sapiens
gagggaggcactagtcaccg

SEQ ID NO: 3073800 - DNA, 12 bp, Homo sapiens
gagggaggcccc

SEQ ID NO: 3073801 - DNA, 17 bp, Homo sapiens
gagggagggtttctctc

SEQ ID NO: 3073802 - DNA, 17 bp, Homo sapiens
gagggagtctcaggagg

SEQ ID NO: 3073803 - DNA, 23 bp, Homo sapiens
gagggatgaagggcgagtgaatc

SEQ ID NO: 3073804 - DNA, 16 bp, Homo sapiens
gagggcacatgaacag

SEQ ID NO: 3073805 - DNA, 20 bp, Homo sapiens
gagggcactggagctgggag

SEQ ID NO: 3073806 - DNA, 22 bp, Homo sapiens
gagggcagaaaccttgtttgtt

SEQ ID NO: 3073807 - DNA, 13 bp, Homo sapiens
gagggcagagaca

SEQ ID NO: 3073808 - DNA, 12 bp, Homo sapiens
gagggcagcagg

SEQ ID NO: 3073809 - DNA, 15 bp, Homo sapiens
gagggcatataaatt

SEQ ID NO: 3073810 - DNA, 16 bp, Homo sapiens
gagggccacatgggag

SEQ ID NO: 3073811 - DNA, 17 bp, Homo sapiens
gagggccagggaggcag

SEQ ID NO: 3073812 - DNA, 17 bp, Homo sapiens
gagggccgcctgcctta

SEQ ID NO: 3073813 - DNA, 15 bp, Homo sapiens
gagggcctctgcctg

SEQ ID NO: 3073814 - DNA, 18 bp, Homo sapiens
gagggcctctgcctggga

SEQ ID NO: 3073815 - DNA, 15 bp, Homo sapiens
gagggcgcccagcag

SEQ ID NO: 3073816 - DNA, 21 bp, Homo sapiens
gagggcgcccagcagcctgcc

SEQ ID NO: 3073817 - DNA, 22 bp, Homo sapiens
gatgccaggttctatttggaat

SEQ ID NO: 3073818 - DNA, 15 bp, Homo sapiens
gatgccataaataca

SEQ ID NO: 3073819 - DNA, 15 bp, Homo sapiens
gatgccctggaggtg

SEQ ID NO: 3073820 - DNA, 15 bp, Homo sapiens
gatgcctgcccgcac

SEQ ID NO: 3073821 - DNA, 18 bp, Homo sapiens
gatgcctggcctgccaga

SEQ ID NO: 3073822 - DNA, 12 bp, Homo sapiens
gatgccttcccc

SEQ ID NO: 3073823 - DNA, 15 bp, Homo sapiens
gatgcctttgctgtt

SEQ ID NO: 3073824 - DNA, 23 bp, Homo sapiens
gatgcgggcattttgaatgtgat

SEQ ID NO: 3073825 - DNA, 13 bp, Homo sapiens
gatgcggggacag

SEQ ID NO: 3073826 - DNA, 20 bp, Homo sapiens
gatgctagaaaaatgttctt

SEQ ID NO: 3073827 - DNA, 21 bp, Homo sapiens
gatgctagcgcgttgcctgtc

SEQ ID NO: 3073828 - DNA, 20 bp, Homo sapiens
gatgctcagttttaaacgtt

SEQ ID NO: 3073829 - DNA, 19 bp, Homo sapiens
gatgctcatctgagccagc

SEQ ID NO: 3073830 - DNA, 20 bp, Homo sapiens
gatgctccaagattctagat

SEQ ID NO: 3073831 - DNA, 22 bp, Homo sapiens
gatgctccgaggactggactgt

SEQ ID NO: 3073832 - DNA, 16 bp, Homo sapiens
gatgctccttgggccc

SEQ ID NO: 3073833 - DNA, 15 bp, Homo sapiens
gatgctcttctgtgg

SEQ ID NO: 3073834 - DNA, 14 bp, Homo sapiens
gatgctctttccca

SEQ ID NO: 3073835 - DNA, 18 bp, Homo sapiens
gatgctctttcccaggac

SEQ ID NO: 3073836 - DNA, 24 bp, Homo sapiens
gatgctgacctcacctggtcctcc

SEQ ID NO: 3073837 - DNA, 15 bp, Homo sapiens
gatgctgatgttcag

SEQ ID NO: 3073838 - DNA, 13 bp, Homo sapiens
gatgctgctggcc

SEQ ID NO: 3073839 - DNA, 20 bp, Homo sapiens
gatgctggatgtctgccaat

SEQ ID NO: 3073840 - DNA, 13 bp, Homo sapiens
gatgctggcccag

SEQ ID NO: 3073841 - DNA, 17 bp, Homo sapiens
gatgctggcccagggcc

SEQ ID NO: 3073842 - DNA, 22 bp, Homo sapiens
gatgctggcccagggcccagag

SEQ ID NO: 3073843 - DNA, 13 bp, Homo sapiens
gatgctggcctct

SEQ ID NO: 3073844 - DNA, 16 bp, Homo sapiens
gatgctggcctcttgg

SEQ ID NO: 3073845 - DNA, 12 bp, Homo sapiens
gatgctgtgcta

SEQ ID NO: 3073846 - DNA, 16 bp, Homo sapiens
gatgctgtgctatgaa

SEQ ID NO: 3073847 - DNA, 20 bp, Homo sapiens
gatgcttggagcaatcagaa

SEQ ID NO: 3073848 - DNA, 14 bp, Homo sapiens
gatgctttaccaaa

SEQ ID NO: 3073849 - DNA, 14 bp, Homo sapiens
gatgctttggaaga

SEQ ID NO: 3073850 - DNA, 13 bp, Homo sapiens
gatggaaaaataa

SEQ ID NO: 3073851 - DNA, 13 bp, Homo sapiens
gatggaacagtga

SEQ ID NO: 3073852 - DNA, 17 bp, Homo sapiens
gatggaaccgcaggaag

SEQ ID NO: 3073853 - DNA, 13 bp, Homo sapiens
gatggaagcacac

SEQ ID NO: 3073854 - DNA, 16 bp, Homo sapiens
gatggaatgtaaaata

SEQ ID NO: 3073855 - DNA, 12 bp, Homo sapiens
gatggacagact

SEQ ID NO: 3073856 - DNA, 13 bp, Homo sapiens
gatggaccccagc

SEQ ID NO: 3073857 - DNA, 14 bp, Homo sapiens
gatggaccccagca

SEQ ID NO: 3073858 - DNA, 14 bp, Homo sapiens
gatggacgcaggcc

SEQ ID NO: 3073859 - DNA, 16 bp, Homo sapiens
gatggagtttctctct

SEQ ID NO: 3073860 - DNA, 18 bp, Homo sapiens
gatggataaactgagcct

SEQ ID NO: 3073861 - DNA, 23 bp, Homo sapiens
gatggatgccaatattaaatctg

SEQ ID NO: 3073862 - DNA, 15 bp, Homo sapiens
gatggcaacagatct

SEQ ID NO: 3073863 - DNA, 22 bp, Homo sapiens
gatggcaacagatctggaacct

SEQ ID NO: 3073864 - DNA, 17 bp, Homo sapiens
gatggcaggatccaagg

SEQ ID NO: 3073865 - DNA, 17 bp, Homo sapiens
gatggccactgctcttg

SEQ ID NO: 3073866 - DNA, 13 bp, Homo sapiens
gatggccagagga

SEQ ID NO: 3073867 - DNA, 18 bp, Homo sapiens
gatggccggagaggaccg

SEQ ID NO: 3073868 - DNA, 13 bp, Homo sapiens
gatggctcctctc

SEQ ID NO: 3073869 - DNA, 20 bp, Homo sapiens
gatgggaaaaactgcagtca

SEQ ID NO: 3073870 - DNA, 12 bp, Homo sapiens
gatgggaaaata

SEQ ID NO: 3073871 - DNA, 22 bp, Homo sapiens
gatgggaatgaagcttgtgtat

SEQ ID NO: 3073872 - DNA, 16 bp, Homo sapiens
gatgggagtctccctc

SEQ ID NO: 3073873 - DNA, 23 bp, Homo sapiens
gatgggcatatgtgtcagtgggg

SEQ ID NO: 3073874 - DNA, 21 bp, Homo sapiens
gatgggccctatgtctcagga

SEQ ID NO: 3073875 - DNA, 21 bp, Homo sapiens
gatgggcttttgttctgaggg

SEQ ID NO: 3073876 - DNA, 19 bp, Homo sapiens
gatgggggaactcagatcc

SEQ ID NO: 3073877 - DNA, 22 bp, Homo sapiens
gatggggtggggtggagaactc

SEQ ID NO: 3073878 - DNA, 18 bp, Homo sapiens
gatgggttttatgagatg

SEQ ID NO: 3073879 - DNA, 14 bp, Homo sapiens
gatggtaataatct

SEQ ID NO: 3073880 - DNA, 16 bp, Homo sapiens
gatggtacgtgaccct

SEQ ID NO: 3073881 - DNA, 19 bp, Homo sapiens
gatggtacgtgaccctctg

SEQ ID NO: 3073882 - DNA, 20 bp, Homo sapiens
gatggtacgtgaccctctgc

SEQ ID NO: 3073883 - DNA, 15 bp, Homo sapiens
gatggtcacttaaaa

SEQ ID NO: 3073884 - DNA, 17 bp, Homo sapiens
gatggtcttgatctcct

SEQ ID NO: 3073885 - DNA, 20 bp, Homo sapiens
gatggtgacttttgaagaac

SEQ ID NO: 3073886 - DNA, 21 bp, Homo sapiens
gatggtgcatgcctgtagtct

SEQ ID NO: 3073887 - DNA, 18 bp, Homo sapiens
gatggtgctgggtaataa

SEQ ID NO: 3073888 - DNA, 19 bp, Homo sapiens
gatggtgggcttcagggca

SEQ ID NO: 3073889 - DNA, 21 bp, Homo sapiens
gatggtgtctcttctttagaa

SEQ ID NO: 3073890 - DNA, 13 bp, Homo sapiens
gatggtgttgtca

SEQ ID NO: 3073891 - DNA, 14 bp, Homo sapiens
gatggtttcttgca

SEQ ID NO: 3073892 - DNA, 17 bp, Homo sapiens
gatgtaaatcgggaagg

SEQ ID NO: 3073893 - DNA, 18 bp, Homo sapiens
gatgtaaatcgggaagga

SEQ ID NO: 3073894 - DNA, 23 bp, Homo sapiens
gatgtaacaagggttttaatgta

SEQ ID NO: 3073895 - DNA, 21 bp, Homo sapiens
gatgtaaggaattgaagatag

SEQ ID NO: 3073896 - DNA, 19 bp, Homo sapiens
gatgtagggtaaggtgcct

SEQ ID NO: 3073897 - DNA, 20 bp, Homo sapiens
gatgtagggtaaggtgcctt

SEQ ID NO: 3073898 - DNA, 22 bp, Homo sapiens
gatgtatcgggaagatttctaa

SEQ ID NO: 3073899 - DNA, 20 bp, Homo sapiens
gatgtatgaatacagcagca

SEQ ID NO: 3073900 - DNA, 13 bp, Homo sapiens
gatgtctgagaga

SEQ ID NO: 3073901 - DNA, 22 bp, Homo sapiens
gatgtctgagagaccatctcct

SEQ ID NO: 3073902 - DNA, 14 bp, Homo sapiens
gatgtctgccaatt

SEQ ID NO: 3073903 - DNA, 20 bp, Homo sapiens
gatgtctgtttgctgatggt

SEQ ID NO: 3073904 - DNA, 12 bp, Homo sapiens
gatgtgaagcca

SEQ ID NO: 3073905 - DNA, 17 bp, Homo sapiens
gatgtgagtgtgtgtga

SEQ ID NO: 3073906 - DNA, 15 bp, Homo sapiens
gatgtgatattctaa

SEQ ID NO: 3073907 - DNA, 18 bp, Homo sapiens
gatgtgatttaatagtgt

SEQ ID NO: 3073908 - DNA, 16 bp, Homo sapiens
gatgtgcaattgattt

SEQ ID NO: 3073909 - DNA, 15 bp, Homo sapiens
gatgtgcagcagatt

SEQ ID NO: 3073910 - DNA, 21 bp, Homo sapiens
gatgtgcagcagattggaagg

SEQ ID NO: 3073911 - DNA, 23 bp, Homo sapiens
gatgtgcagcagattggaaggag

SEQ ID NO: 3073912 - DNA, 16 bp, Homo sapiens
gatgtggagccaggcg

SEQ ID NO: 3073913 - DNA, 18 bp, Homo sapiens
gatgtggagccaggcgtg

SEQ ID NO: 3073914 - DNA, 13 bp, Homo sapiens
gatgtggccctgg

SEQ ID NO: 3073915 - DNA, 18 bp, Homo sapiens
gatgtggggctgagctgg

SEQ ID NO: 3073916 - DNA, 16 bp, Homo sapiens
gatgtggttttcttaa

SEQ ID NO: 3073917 - DNA, 12 bp, Homo sapiens
gatgtgtacatc

SEQ ID NO: 3073918 - DNA, 22 bp, Homo sapiens
gatgtgtacatcccatgtaaca

SEQ ID NO: 3073919 - DNA, 21 bp, Homo sapiens
gatgtgttcggttttgttgtt

SEQ ID NO: 3073920 - DNA, 21 bp, Homo sapiens
gatgtgttgaccggctgccgt

SEQ ID NO: 3073921 - DNA, 20 bp, Homo sapiens
gatgttaaagcatttccctg

SEQ ID NO: 3073922 - DNA, 21 bp, Homo sapiens
gatgttaacacattttgtata

SEQ ID NO: 3073923 - DNA, 21 bp, Homo sapiens
gatgttacaagtttatatata

SEQ ID NO: 3073924 - DNA, 20 bp, Homo sapiens
gatgttatcttaacactgaa

SEQ ID NO: 3073925 - DNA, 17 bp, Homo sapiens
gatgttatttttgtatt

SEQ ID NO: 3073926 - DNA, 19 bp, Homo sapiens
gatgttgataatttcaggg

SEQ ID NO: 3073927 - DNA, 13 bp, Homo sapiens
gatgttgccatgt

SEQ ID NO: 3073928 - DNA, 17 bp, Homo sapiens
gatgttgccatgtgttt

SEQ ID NO: 3073929 - DNA, 16 bp, Homo sapiens
gatgtttacctggtgc

SEQ ID NO: 3073930 - DNA, 14 bp, Homo sapiens
gatgtttatgttct

SEQ ID NO: 3073931 - DNA, 13 bp, Homo sapiens
gatgtttcatttt

SEQ ID NO: 3073932 - DNA, 16 bp, Homo sapiens
gatgtttcctggaagc

SEQ ID NO: 3073933 - DNA, 20 bp, Homo sapiens
gatgtttcctggaagcagag

SEQ ID NO: 3073934 - DNA, 16 bp, Homo sapiens
gatgtttgctcagagg

SEQ ID NO: 3073935 - DNA, 14 bp, Homo sapiens
gatgttttaactta

SEQ ID NO: 3073936 - DNA, 23 bp, Homo sapiens
gatgttttacgcaaggaaggact

SEQ ID NO: 3073937 - DNA, 19 bp, Homo sapiens
gattaacaatgtattttaa

SEQ ID NO: 3073938 - DNA, 14 bp, Homo sapiens
gattaattgctgca

SEQ ID NO: 3073939 - DNA, 18 bp, Homo sapiens
gattacagaaactgatgc

SEQ ID NO: 3073940 - DNA, 20 bp, Homo sapiens
gattacaggcatgagccact

SEQ ID NO: 3073941 - DNA, 18 bp, Homo sapiens
gattacagggatgagcca

SEQ ID NO: 3073942 - DNA, 14 bp, Homo sapiens
gattacataatctg

SEQ ID NO: 3073943 - DNA, 21 bp, Homo sapiens
gattacccaagcaaaatcatg

SEQ ID NO: 3073944 - DNA, 19 bp, Homo sapiens
gattactctttgctttgta

SEQ ID NO: 3073945 - DNA, 14 bp, Homo sapiens
gattactgcaatca

SEQ ID NO: 3073946 - DNA, 20 bp, Homo sapiens
gattagaaacaaacaaaact

SEQ ID NO: 3073947 - DNA, 23 bp, Homo sapiens
gattagcctttgacattgatgtg

SEQ ID NO: 3073948 - DNA, 18 bp, Homo sapiens
gattaggggatggggagg

SEQ ID NO: 3073949 - DNA, 14 bp, Homo sapiens
gcactccctcctgg

SEQ ID NO: 3073950 - DNA, 14 bp, Homo sapiens
gcactccctggcct

SEQ ID NO: 3073951 - DNA, 17 bp, Homo sapiens
gcactccctggccttgc

SEQ ID NO: 3073952 - DNA, 12 bp, Homo sapiens
gcactctagatt

SEQ ID NO: 3073953 - DNA, 22 bp, Homo sapiens
gcactctcaccccaagcggcct

SEQ ID NO: 3073954 - DNA, 20 bp, Homo sapiens
gcactctcctgtctgaacct

SEQ ID NO: 3073955 - DNA, 19 bp, Homo sapiens
gcactctgttatttagact

SEQ ID NO: 3073956 - DNA, 18 bp, Homo sapiens
gcactcttgttcccacac

SEQ ID NO: 3073957 - DNA, 17 bp, Homo sapiens
gcactgaaaaaaaatct

SEQ ID NO: 3073958 - DNA, 12 bp, Homo sapiens
gcactgaaaacc

SEQ ID NO: 3073959 - DNA, 11 bp, Homo sapiens
gcactgaagcc

SEQ ID NO: 3073960 - DNA, 17 bp, Homo sapiens
gcactgaagtttttgaa

SEQ ID NO: 3073961 - DNA, 17 bp, Homo sapiens
gcactgatctttgcaaa

SEQ ID NO: 3073962 - DNA, 13 bp, Homo sapiens
gcactgctgcctc

SEQ ID NO: 3073963 - DNA, 17 bp, Homo sapiens
gcactgctgcctcagct

SEQ ID NO: 3073964 - DNA, 17 bp, Homo sapiens
gcactgcttgaggaaaa

SEQ ID NO: 3073965 - DNA, 14 bp, Homo sapiens
gcactggagccaca

SEQ ID NO: 3073966 - DNA, 18 bp, Homo sapiens
gcactggagccacaggca

SEQ ID NO: 3073967 - DNA, 21 bp, Homo sapiens
gcactggagccacaggcaggg

SEQ ID NO: 3073968 - DNA, 16 bp, Homo sapiens
gcactggagctgggag

SEQ ID NO: 3073969 - DNA, 16 bp, Homo sapiens
gcactgggaagctgga

SEQ ID NO: 3073970 - DNA, 23 bp, Homo sapiens
gcactgggaagctggagtgctgc

SEQ ID NO: 3073971 - DNA, 15 bp, Homo sapiens
gcactgggatcacag

SEQ ID NO: 3073972 - DNA, 20 bp, Homo sapiens
gcactggtcggaccaggcag

SEQ ID NO: 3073973 - DNA, 11 bp, Homo sapiens
gcactgtctgt

SEQ ID NO: 3073974 - DNA, 17 bp, Homo sapiens
gcactgtgaatcctggc

SEQ ID NO: 3073975 - DNA, 19 bp, Homo sapiens
gcactgttccccctgtgca

SEQ ID NO: 3073976 - DNA, 21 bp, Homo sapiens
gcactgttggtgttcggagct

SEQ ID NO: 3073977 - DNA, 19 bp, Homo sapiens
gcacttaaggcactctgtt

SEQ ID NO: 3073978 - DNA, 15 bp, Homo sapiens
gcacttacaatccca

SEQ ID NO: 3073979 - DNA, 22 bp, Homo sapiens
gcacttcatatctagatttcta

SEQ ID NO: 3073980 - DNA, 17 bp, Homo sapiens
gcacttcatctggctgc

SEQ ID NO: 3073981 - DNA, 14 bp, Homo sapiens
gcacttcccaggat

SEQ ID NO: 3073982 - DNA, 17 bp, Homo sapiens
gcacttgcagaggagcc

SEQ ID NO: 3073983 - DNA, 16 bp, Homo sapiens
gcacttgtccagctga

SEQ ID NO: 3073984 - DNA, 20 bp, Homo sapiens
gcacttgtgattatttatta

SEQ ID NO: 3073985 - DNA, 21 bp, Homo sapiens
gcacttgtgattatttattat

SEQ ID NO: 3073986 - DNA, 20 bp, Homo sapiens
gcactttatattttcctctt

SEQ ID NO: 3073987 - DNA, 13 bp, Homo sapiens
gcactttgcagga

SEQ ID NO: 3073988 - DNA, 17 bp, Homo sapiens
gcactttgggaggcagg

SEQ ID NO: 3073989 - DNA, 19 bp, Homo sapiens
gcactttgggaggccaagg

SEQ ID NO: 3073990 - DNA, 11 bp, Homo sapiens
gcactttgggg

SEQ ID NO: 3073991 - DNA, 13 bp, Homo sapiens
gcactttgggttt

SEQ ID NO: 3073992 - DNA, 19 bp, Homo sapiens
gcactttgggtttttaact

SEQ ID NO: 3073993 - DNA, 21 bp, Homo sapiens
gcactttgggtttttaactca

SEQ ID NO: 3073994 - DNA, 13 bp, Homo sapiens
gcactttgtaaat

SEQ ID NO: 3073995 - DNA, 20 bp, Homo sapiens
gcagaaaaaacaaaaaaact

SEQ ID NO: 3073996 - DNA, 13 bp, Homo sapiens
gcagaaaaagaaa

SEQ ID NO: 3073997 - DNA, 17 bp, Homo sapiens
gcagaaaagcacctgcc

SEQ ID NO: 3073998 - DNA, 20 bp, Homo sapiens
gcagaaaagcacctgccgac

SEQ ID NO: 3073999 - DNA, 21 bp, Homo sapiens
gcagaaaagcacctgccgacc

SEQ ID NO: 3074000 - DNA, 14 bp, Homo sapiens
gcagaaaattgcac

SEQ ID NO: 3074001 - DNA, 18 bp, Homo sapiens
gcagaaagtaagcatttc

SEQ ID NO: 3074002 - DNA, 20 bp, Homo sapiens
gcagaaagtaagcatttcca

SEQ ID NO: 3074003 - DNA, 13 bp, Homo sapiens
gcagaacacctgg

SEQ ID NO: 3074004 - DNA, 14 bp, Homo sapiens
gcagaactctctgt

SEQ ID NO: 3074005 - DNA, 14 bp, Homo sapiens
gcagaactgctggg

SEQ ID NO: 3074006 - DNA, 16 bp, Homo sapiens
gcagaactgctggggc

SEQ ID NO: 3074007 - DNA, 17 bp, Homo sapiens
gcagaactgctggggct

SEQ ID NO: 3074008 - DNA, 18 bp, Homo sapiens
gcagaactgctggggctg

SEQ ID NO: 3074009 - DNA, 19 bp, Homo sapiens
gcagaactgctggggctgg

SEQ ID NO: 3074010 - DNA, 14 bp, Homo sapiens
gcagaagaaaggaa

SEQ ID NO: 3074011 - DNA, 13 bp, Homo sapiens
gcagaagaatctt

SEQ ID NO: 3074012 - DNA, 16 bp, Homo sapiens
gcagaagaatctttct

SEQ ID NO: 3074013 - DNA, 17 bp, Homo sapiens
gcagaagagggggaggg

SEQ ID NO: 3074014 - DNA, 17 bp, Homo sapiens
gcagaagcaataataaa

SEQ ID NO: 3074015 - DNA, 19 bp, Homo sapiens
gcagaagccagagggtggg

SEQ ID NO: 3074016 - DNA, 12 bp, Homo sapiens
gcagaaggagag

SEQ ID NO: 3074017 - DNA, 13 bp, Homo sapiens
gcagaagggaatt

SEQ ID NO: 3074018 - DNA, 15 bp, Homo sapiens
gcagaatcctgggcc

SEQ ID NO: 3074019 - DNA, 16 bp, Homo sapiens
gcagaatcctgggccc

SEQ ID NO: 3074020 - DNA, 23 bp, Homo sapiens
gcagaatgaacccatagggagct

SEQ ID NO: 3074021 - DNA, 14 bp, Homo sapiens
gcagaatggaggca

SEQ ID NO: 3074022 - DNA, 16 bp, Homo sapiens
gcagaatggaggcagg

SEQ ID NO: 3074023 - DNA, 18 bp, Homo sapiens
gcagaatgtaagtgggcc

SEQ ID NO: 3074024 - DNA, 22 bp, Homo sapiens
gcagaatgtaagtgggcccacc

SEQ ID NO: 3074025 - DNA, 11 bp, Homo sapiens
gcagaatttta

SEQ ID NO: 3074026 - DNA, 13 bp, Homo sapiens
gcagaattttaat

SEQ ID NO: 3074027 - DNA, 18 bp, Homo sapiens
gcagaattttaatgtgaa

SEQ ID NO: 3074028 - DNA, 19 bp, Homo sapiens
gcagaattttaatgtgaag

SEQ ID NO: 3074029 - DNA, 22 bp, Homo sapiens
gcagacacattgtcatcagagg

SEQ ID NO: 3074030 - DNA, 19 bp, Homo sapiens
gcagacaggcggggcccag

SEQ ID NO: 3074031 - DNA, 23 bp, Homo sapiens
gcagacaggcggggcccagcgct

SEQ ID NO: 3074032 - DNA, 20 bp, Homo sapiens
gcagacatagaagagccaag

SEQ ID NO: 3074033 - DNA, 13 bp, Homo sapiens
gcagaccttactc

SEQ ID NO: 3074034 - DNA, 16 bp, Homo sapiens
gcagacgtctgccttg

SEQ ID NO: 3074035 - DNA, 22 bp, Homo sapiens
gcagacgtctgccttggcatcc

SEQ ID NO: 3074036 - DNA, 16 bp, Homo sapiens
gcagacgtctggccct

SEQ ID NO: 3074037 - DNA, 20 bp, Homo sapiens
gcagactctttatgcttgca

SEQ ID NO: 3074038 - DNA, 17 bp, Homo sapiens
gcagactgcttggccag

SEQ ID NO: 3074039 - DNA, 19 bp, Homo sapiens
gcagactgcttggccagat

SEQ ID NO: 3074040 - DNA, 16 bp, Homo sapiens
gcagacttcccagcta

SEQ ID NO: 3074041 - DNA, 23 bp, Homo sapiens
gcagagaaagaaagggaaactgg

SEQ ID NO: 3074042 - DNA, 20 bp, Homo sapiens
gcagagaaagggacaatgat

SEQ ID NO: 3074043 - DNA, 17 bp, Homo sapiens
gcagagaagctctcggg

SEQ ID NO: 3074044 - DNA, 15 bp, Homo sapiens
gcagagagcacagcc

SEQ ID NO: 3074045 - DNA, 18 bp, Homo sapiens
gcagagagccctgggtga

SEQ ID NO: 3074046 - DNA, 18 bp, Homo sapiens
gcagagatatttcttcag

SEQ ID NO: 3074047 - DNA, 11 bp, Homo sapiens
gcagagcctgt

SEQ ID NO: 3074048 - DNA, 16 bp, Homo sapiens
gcagagcgggagggag

SEQ ID NO: 3074049 - DNA, 17 bp, Homo sapiens
gcagagcgggagggagt

SEQ ID NO: 3074050 - DNA, 15 bp, Homo sapiens
gcagagctgagggcc

SEQ ID NO: 3074051 - DNA, 18 bp, Homo sapiens
gcagagctgagggccctg

SEQ ID NO: 3074052 - DNA, 16 bp, Homo sapiens
gcagaggaccagggcc

SEQ ID NO: 3074053 - DNA, 18 bp, Homo sapiens
gcagaggagcccagtggg

SEQ ID NO: 3074054 - DNA, 12 bp, Homo sapiens
gcagaggagggg

SEQ ID NO: 3074055 - DNA, 15 bp, Homo sapiens
gcagaggaggggccg

SEQ ID NO: 3074056 - DNA, 13 bp, Homo sapiens
gcagaggcagaat

SEQ ID NO: 3074057 - DNA, 14 bp, Homo sapiens
gcagaggcagtggc

SEQ ID NO: 3074058 - DNA, 19 bp, Homo sapiens
gcagaggctggaggcaggg

SEQ ID NO: 3074059 - DNA, 18 bp, Homo sapiens
gcagagggcagaggctgg

SEQ ID NO: 3074060 - DNA, 13 bp, Homo sapiens
gcagagggctgga

SEQ ID NO: 3074061 - DNA, 14 bp, Homo sapiens
gcagagggctggag

SEQ ID NO: 3074062 - DNA, 17 bp, Homo sapiens
gcagagggctggaggcc

SEQ ID NO: 3074063 - DNA, 23 bp, Homo sapiens
gcagagggctggaggcccaggct

SEQ ID NO: 3074064 - DNA, 19 bp, Homo sapiens
gcagaggtaccctgggtgt

SEQ ID NO: 3074065 - DNA, 15 bp, Homo sapiens
gcagagttctttgca

SEQ ID NO: 3074066 - DNA, 24 bp, Homo sapiens
gcagagtttgtgtgttgtcttgaa

SEQ ID NO: 3074067 - DNA, 16 bp, Homo sapiens
gcagatactgctgtgt

SEQ ID NO: 3074068 - DNA, 18 bp, Homo sapiens
gcagatactgctgtgtaa

SEQ ID NO: 3074069 - DNA, 14 bp, Homo sapiens
gcagatcatctggg

SEQ ID NO: 3074070 - DNA, 16 bp, Homo sapiens
gcagatcttggactca

SEQ ID NO: 3074071 - DNA, 14 bp, Homo sapiens
gcagatgacaagat

SEQ ID NO: 3074072 - DNA, 17 bp, Homo sapiens
gcagatgataaaaggaa

SEQ ID NO: 3074073 - DNA, 18 bp, Homo sapiens
gcagatgatgctttggaa

SEQ ID NO: 3074074 - DNA, 22 bp, Homo sapiens
gcagatgcaaagaggcaagagg

SEQ ID NO: 3074075 - DNA, 15 bp, Homo sapiens
gcagatggaaagagg

SEQ ID NO: 3074076 - DNA, 16 bp, Homo sapiens
gcagatgtgcagcaga

SEQ ID NO: 3074077 - DNA, 17 bp, Homo sapiens
gcagatgtgcagcagat

SEQ ID NO: 3074078 - DNA, 20 bp, Homo sapiens
gcagatttagtgaaagctag

SEQ ID NO: 3074079 - DNA, 23 bp, Homo sapiens
gcagatttgtggggacctcagcc

SEQ ID NO: 3074080 - DNA, 20 bp, Homo sapiens
gcagcaaatagcaaatgaaa

SEQ ID NO: 3074081 - DNA, 19 bp, Homo sapiens
gcagcaagaaaaaaaaatg

SEQ ID NO: 3074082 - DNA, 21 bp, Homo sapiens
gcattccctgagtcaccagga

SEQ ID NO: 3074083 - DNA, 15 bp, Homo sapiens
gcattctacacctgg

SEQ ID NO: 3074084 - DNA, 18 bp, Homo sapiens
gcattctatcgttattat

SEQ ID NO: 3074085 - DNA, 21 bp, Homo sapiens
gcattctatcgttattataaa

SEQ ID NO: 3074086 - DNA, 22 bp, Homo sapiens
gcattctatcgttattataaat

SEQ ID NO: 3074087 - DNA, 24 bp, Homo sapiens
gcattctatcgttattataaatgt

SEQ ID NO: 3074088 - DNA, 16 bp, Homo sapiens
gcattctcctggatgc

SEQ ID NO: 3074089 - DNA, 20 bp, Homo sapiens
gcattctgataggagggggc

SEQ ID NO: 3074090 - DNA, 15 bp, Homo sapiens
gcattctggcagttt

SEQ ID NO: 3074091 - DNA, 13 bp, Homo sapiens
gcattctgtttat

SEQ ID NO: 3074092 - DNA, 16 bp, Homo sapiens
gcattctttgcaatac

SEQ ID NO: 3074093 - DNA, 12 bp, Homo sapiens
gcattgaacaca

SEQ ID NO: 3074094 - DNA, 23 bp, Homo sapiens
gcattgaacacaaactgtaaata

SEQ ID NO: 3074095 - DNA, 12 bp, Homo sapiens
gcattgagaact

SEQ ID NO: 3074096 - DNA, 15 bp, Homo sapiens
gcattgagctgagat

SEQ ID NO: 3074097 - DNA, 18 bp, Homo sapiens
gcattgatattgtgaaca

SEQ ID NO: 3074098 - DNA, 16 bp, Homo sapiens
gcattgatggggaagg

SEQ ID NO: 3074099 - DNA, 17 bp, Homo sapiens
gcattgatggggaagga

SEQ ID NO: 3074100 - DNA, 20 bp, Homo sapiens
gcattggatacagcagtaga

SEQ ID NO: 3074101 - DNA, 19 bp, Homo sapiens
gcattgtatcgatgttatg

SEQ ID NO: 3074102 - DNA, 18 bp, Homo sapiens
gcattgtgaactgacagg

SEQ ID NO: 3074103 - DNA, 21 bp, Homo sapiens
gcattgttagtttagtgtgtg

SEQ ID NO: 3074104 - DNA, 15 bp, Homo sapiens
gcatttaccaacatg

SEQ ID NO: 3074105 - DNA, 18 bp, Homo sapiens
gcatttaccaacatgtat

SEQ ID NO: 3074106 - DNA, 20 bp, Homo sapiens
gcatttaccaacatgtatct

SEQ ID NO: 3074107 - DNA, 19 bp, Homo sapiens
gcatttatgtagacattgt

SEQ ID NO: 3074108 - DNA, 23 bp, Homo sapiens
gcatttatgtagacattgtaaat

SEQ ID NO: 3074109 - DNA, 21 bp, Homo sapiens
gcatttcaaagccctgcctct

SEQ ID NO: 3074110 - DNA, 20 bp, Homo sapiens
gcatttcacaaaacagcctt

SEQ ID NO: 3074111 - DNA, 19 bp, Homo sapiens
gcatttcacatgccttgca

SEQ ID NO: 3074112 - DNA, 21 bp, Homo sapiens
gcatttcctatcacctatttc

SEQ ID NO: 3074113 - DNA, 21 bp, Homo sapiens
gcatttcgggaagggcatgca

SEQ ID NO: 3074114 - DNA, 22 bp, Homo sapiens
gcatttcggttgagaatggaaa

SEQ ID NO: 3074115 - DNA, 16 bp, Homo sapiens
gcatttggaaccaaag

SEQ ID NO: 3074116 - DNA, 23 bp, Homo sapiens
gcatttggattggggtccctcta

SEQ ID NO: 3074117 - DNA, 13 bp, Homo sapiens
gcatttgtcaatg

SEQ ID NO: 3074118 - DNA, 18 bp, Homo sapiens
gcatttgtcaatgacagt

SEQ ID NO: 3074119 - DNA, 21 bp, Homo sapiens
gcatttgtgctagaaattttc

SEQ ID NO: 3074120 - DNA, 13 bp, Homo sapiens
gcattttatagac

SEQ ID NO: 3074121 - DNA, 15 bp, Homo sapiens
gcattttcagcatca

SEQ ID NO: 3074122 - DNA, 18 bp, Homo sapiens
gcattttccagcactttg

SEQ ID NO: 3074123 - DNA, 23 bp, Homo sapiens
gcattttgaatgtgatcatcttt

SEQ ID NO: 3074124 - DNA, 12 bp, Homo sapiens
gcattttgctaa

SEQ ID NO: 3074125 - DNA, 22 bp, Homo sapiens
gcattttggagagtttcctgaa

SEQ ID NO: 3074126 - DNA, 18 bp, Homo sapiens
gcattttgtgtacagtaa

SEQ ID NO: 3074127 - DNA, 18 bp, Homo sapiens
gcattttgtttctgtata

SEQ ID NO: 3074128 - DNA, 14 bp, Homo sapiens
gccaaaaaaagaca

SEQ ID NO: 3074129 - DNA, 16 bp, Homo sapiens
gccaaaaaaagacagg

SEQ ID NO: 3074130 - DNA, 13 bp, Homo sapiens
gccaaacccctag

SEQ ID NO: 3074131 - DNA, 15 bp, Homo sapiens
gccaaacctctgttc

SEQ ID NO: 3074132 - DNA, 19 bp, Homo sapiens
gccaaacctctgttcagtg

SEQ ID NO: 3074133 - DNA, 22 bp, Homo sapiens
gccaaacctctgttcagtgtaa

SEQ ID NO: 3074134 - DNA, 22 bp, Homo sapiens
gccaaataaaaaacagaaaccg

SEQ ID NO: 3074135 - DNA, 19 bp, Homo sapiens
gccaaatagccccagactg

SEQ ID NO: 3074136 - DNA, 22 bp, Homo sapiens
gccaacaagaatgcattgatat

SEQ ID NO: 3074137 - DNA, 22 bp, Homo sapiens
gccaacagctacaacagcctca

SEQ ID NO: 3074138 - DNA, 12 bp, Homo sapiens
gccaaccagcct

SEQ ID NO: 3074139 - DNA, 13 bp, Homo sapiens
gccaaccagcctt

SEQ ID NO: 3074140 - DNA, 15 bp, Homo sapiens
gccaaccccacccag

SEQ ID NO: 3074141 - DNA, 17 bp, Homo sapiens
gccaaccccacccagct

SEQ ID NO: 3074142 - DNA, 13 bp, Homo sapiens
gccaacccttctc

SEQ ID NO: 3074143 - DNA, 22 bp, Homo sapiens
gccaacccttctcctcttgtaa

SEQ ID NO: 3074144 - DNA, 23 bp, Homo sapiens
gccaacccttctcctcttgtaaa

SEQ ID NO: 3074145 - DNA, 16 bp, Homo sapiens
gccaactagcccctgg

SEQ ID NO: 3074146 - DNA, 20 bp, Homo sapiens
gccaactagcccctggggtg

SEQ ID NO: 3074147 - DNA, 22 bp, Homo sapiens
gccaactgcctccttgccagcc

SEQ ID NO: 3074148 - DNA, 15 bp, Homo sapiens
gccaagaaacgtctt

SEQ ID NO: 3074149 - DNA, 12 bp, Homo sapiens
gccaagaaatcg

SEQ ID NO: 3074150 - DNA, 19 bp, Homo sapiens
gccaagacgggatgattgc

SEQ ID NO: 3074151 - DNA, 13 bp, Homo sapiens
gccaagagaaggg

SEQ ID NO: 3074152 - DNA, 14 bp, Homo sapiens
gccaagagaagggc

SEQ ID NO: 3074153 - DNA, 14 bp, Homo sapiens
gccaagaggctgca

SEQ ID NO: 3074154 - DNA, 17 bp, Homo sapiens
gccaagaggctgcagcc

SEQ ID NO: 3074155 - DNA, 19 bp, Homo sapiens
gccaagatcgcaccactgc

SEQ ID NO: 3074156 - DNA, 12 bp, Homo sapiens
gccaagcacagt

SEQ ID NO: 3074157 - DNA, 12 bp, Homo sapiens
gccaagcagcca

SEQ ID NO: 3074158 - DNA, 14 bp, Homo sapiens
gccaagcagccaag

SEQ ID NO: 3074159 - DNA, 15 bp, Homo sapiens
gccaagctgtgttca

SEQ ID NO: 3074160 - DNA, 20 bp, Homo sapiens
gccaaggagaggagttcttt

SEQ ID NO: 3074161 - DNA, 12 bp, Homo sapiens
gccaaggagctg

SEQ ID NO: 3074162 - DNA, 15 bp, Homo sapiens
gccaaggagctgcta

SEQ ID NO: 3074163 - DNA, 20 bp, Homo sapiens
gccaaggagctgctatagcc

SEQ ID NO: 3074164 - DNA, 20 bp, Homo sapiens
gccaaggagggtgagtgcaa

SEQ ID NO: 3074165 - DNA, 20 bp, Homo sapiens
gccaagggcccaaagaaaga

SEQ ID NO: 3074166 - DNA, 23 bp, Homo sapiens
gccaagggggcagagggctttca

SEQ ID NO: 3074167 - DNA, 20 bp, Homo sapiens
gccaaggtgcatatagaaaa

SEQ ID NO: 3074168 - DNA, 16 bp, Homo sapiens
gccaagtgcctgctta

SEQ ID NO: 3074169 - DNA, 15 bp, Homo sapiens
gccaagtttatatac

SEQ ID NO: 3074170 - DNA, 20 bp, Homo sapiens
gccaagtttatatacaatta

SEQ ID NO: 3074171 - DNA, 22 bp, Homo sapiens
gccaatccctcaccttctgagt

SEQ ID NO: 3074172 - DNA, 13 bp, Homo sapiens
gccaatccctggc

SEQ ID NO: 3074173 - DNA, 22 bp, Homo sapiens
gccaatctttcctactttctat

SEQ ID NO: 3074174 - DNA, 15 bp, Homo sapiens
gccaatgattccaga

SEQ ID NO: 3074175 - DNA, 16 bp, Homo sapiens
gccaatgttgtgtgtt

SEQ ID NO: 3074176 - DNA, 19 bp, Homo sapiens
gccaattaaaaacgaaaac

SEQ ID NO: 3074177 - DNA, 18 bp, Homo sapiens
gccaattagacttgaaat

SEQ ID NO: 3074178 - DNA, 17 bp, Homo sapiens
gccaattcagacaggca

SEQ ID NO: 3074179 - DNA, 11 bp, Homo sapiens
gccaattttgt

SEQ ID NO: 3074180 - DNA, 22 bp, Homo sapiens
gccaattttgtcacagctcttg

SEQ ID NO: 3074181 - DNA, 15 bp, Homo sapiens
gccacaaaaatgttc

SEQ ID NO: 3074182 - DNA, 14 bp, Homo sapiens
gccacaaggacttc

SEQ ID NO: 3074183 - DNA, 17 bp, Homo sapiens
gccacaaggacttcctg

SEQ ID NO: 3074184 - DNA, 18 bp, Homo sapiens
gccacaaggacttcctgt

SEQ ID NO: 3074185 - DNA, 13 bp, Homo sapiens
gccacacacacag

SEQ ID NO: 3074186 - DNA, 14 bp, Homo sapiens
gccacacacacaga

SEQ ID NO: 3074187 - DNA, 18 bp, Homo sapiens
gccacacacacagaaaat

SEQ ID NO: 3074188 - DNA, 17 bp, Homo sapiens
gccacacattgtgcttg

SEQ ID NO: 3074189 - DNA, 20 bp, Homo sapiens
gccacacattgtgcttggcc

SEQ ID NO: 3074190 - DNA, 13 bp, Homo sapiens
gccacaccaggat

SEQ ID NO: 3074191 - DNA, 16 bp, Homo sapiens
gccacaccaggataga

SEQ ID NO: 3074192 - DNA, 16 bp, Homo sapiens
gccacacgcaggcggc

SEQ ID NO: 3074193 - DNA, 21 bp, Homo sapiens
gccacacgcaggcggccaggg

SEQ ID NO: 3074194 - DNA, 18 bp, Homo sapiens
gccacagaaggtgaactt

SEQ ID NO: 3074195 - DNA, 22 bp, Homo sapiens
gccacagcccaggcctccagct

SEQ ID NO: 3074196 - DNA, 16 bp, Homo sapiens
gccacagcctcccctg

SEQ ID NO: 3074197 - DNA, 13 bp, Homo sapiens
gccacagcctgtc

SEQ ID NO: 3074198 - DNA, 15 bp, Homo sapiens
gccacagcgtgctgg

SEQ ID NO: 3074199 - DNA, 16 bp, Homo sapiens
gccacagcgtgctggc

SEQ ID NO: 3074200 - DNA, 22 bp, Homo sapiens
gccacagcgtgctggcgacact

SEQ ID NO: 3074201 - DNA, 15 bp, Homo sapiens
gccacaggagccctg

SEQ ID NO: 3074202 - DNA, 16 bp, Homo sapiens
gccacaggcaggggtg

SEQ ID NO: 3074203 - DNA, 18 bp, Homo sapiens
gccacagtatggatgggt

SEQ ID NO: 3074204 - DNA, 15 bp, Homo sapiens
gccacatctgtgtct

SEQ ID NO: 3074205 - DNA, 23 bp, Homo sapiens
gccacatctgtgtctctggaacc

SEQ ID NO: 3074206 - DNA, 17 bp, Homo sapiens
gccacatggtgtggcca

SEQ ID NO: 3074207 - DNA, 15 bp, Homo sapiens
gccacattagaactt

SEQ ID NO: 3074208 - DNA, 16 bp, Homo sapiens
gccacattagaacttc

SEQ ID NO: 3074209 - DNA, 23 bp, Homo sapiens
gccacattagaacttctccgtcc

SEQ ID NO: 3074210 - DNA, 19 bp, Homo sapiens
gccacatttggaatacttt

SEQ ID NO: 3074211 - DNA, 22 bp, Homo sapiens
gccacatttggaatactttttg

SEQ ID NO: 3074212 - DNA, 17 bp, Homo sapiens
gccacattttcagccaa

SEQ ID NO: 3074213 - DNA, 14 bp, Homo sapiens
gccaccaagaggga

SEQ ID NO: 3074214 - DNA, 19 bp, Homo sapiens
gcccaagggatctggtcct

SEQ ID NO: 3074215 - DNA, 22 bp, Homo sapiens
gcccaagtgaagcatggcatat

SEQ ID NO: 3074216 - DNA, 19 bp, Homo sapiens
gcccaagtgaccagggaag

SEQ ID NO: 3074217 - DNA, 22 bp, Homo sapiens
gcccaagtgaccagggaagtgt

SEQ ID NO: 3074218 - DNA, 23 bp, Homo sapiens
gcccacaaaggcaaagggtccag

SEQ ID NO: 3074219 - DNA, 19 bp, Homo sapiens
gcccacacacactccttcc

SEQ ID NO: 3074220 - DNA, 21 bp, Homo sapiens
gcccacacacactccttcccc

SEQ ID NO: 3074221 - DNA, 13 bp, Homo sapiens
gcccacacacagg

SEQ ID NO: 3074222 - DNA, 14 bp, Homo sapiens
gcccacacacaggt

SEQ ID NO: 3074223 - DNA, 21 bp, Homo sapiens
gcccacacccgacaccagccc

SEQ ID NO: 3074224 - DNA, 14 bp, Homo sapiens
gcccacagagcctg

SEQ ID NO: 3074225 - DNA, 11 bp, Homo sapiens
gcccacagccc

SEQ ID NO: 3074226 - DNA, 19 bp, Homo sapiens
gcccacagcccccacccca

SEQ ID NO: 3074227 - DNA, 17 bp, Homo sapiens
gcccacagctcccaccc

SEQ ID NO: 3074228 - DNA, 13 bp, Homo sapiens
gcccacaggtgcg

SEQ ID NO: 3074229 - DNA, 17 bp, Homo sapiens
gcccacatttagtctct

SEQ ID NO: 3074230 - DNA, 18 bp, Homo sapiens
gcccaccatgcacccctg

SEQ ID NO: 3074231 - DNA, 22 bp, Homo sapiens
gcccacccccgggatcctgccc

SEQ ID NO: 3074232 - DNA, 23 bp, Homo sapiens
gcccacccccgggatcctgcccc

SEQ ID NO: 3074233 - DNA, 17 bp, Homo sapiens
gcccaccctccctccac

SEQ ID NO: 3074234 - DNA, 21 bp, Homo sapiens
gcccaccctgctgctggtgca

SEQ ID NO: 3074235 - DNA, 9 bp, Homo sapiens
gcccacctg

SEQ ID NO: 3074236 - DNA, 21 bp, Homo sapiens
gcccacctgaaagcctgtctc

SEQ ID NO: 3074237 - DNA, 11 bp, Homo sapiens
gcccacctgcc

SEQ ID NO: 3074238 - DNA, 17 bp, Homo sapiens
gcccacctgcctggccg

SEQ ID NO: 3074239 - DNA, 17 bp, Homo sapiens
gcccactctgctcgcct

SEQ ID NO: 3074240 - DNA, 21 bp, Homo sapiens
gcccactgctgcagtagggga

SEQ ID NO: 3074241 - DNA, 14 bp, Homo sapiens
gcccactgctggct

SEQ ID NO: 3074242 - DNA, 23 bp, Homo sapiens
gcccactgctggctgcagcggca

SEQ ID NO: 3074243 - DNA, 16 bp, Homo sapiens
gcccagaataagttat

SEQ ID NO: 3074244 - DNA, 23 bp, Homo sapiens
gcccagaataagttattgcagtt

SEQ ID NO: 3074245 - DNA, 15 bp, Homo sapiens
gcccagagcccagct

SEQ ID NO: 3074246 - DNA, 17 bp, Homo sapiens
gcccagagcccagctcc

SEQ ID NO: 3074247 - DNA, 21 bp, Homo sapiens
gcccagaggagcccagcggcc

SEQ ID NO: 3074248 - DNA, 23 bp, Homo sapiens
gcccagaggccaacactgtgggt

SEQ ID NO: 3074249 - DNA, 17 bp, Homo sapiens
gcccagatacgggggct

SEQ ID NO: 3074250 - DNA, 20 bp, Homo sapiens
gcccagatacgggggctgtg

SEQ ID NO: 3074251 - DNA, 21 bp, Homo sapiens
gcccagatacgggggctgtga

SEQ ID NO: 3074252 - DNA, 20 bp, Homo sapiens
gcccagcactgcttgaggaa

SEQ ID NO: 3074253 - DNA, 12 bp, Homo sapiens
gcccagcagcct

SEQ ID NO: 3074254 - DNA, 18 bp, Homo sapiens
gcccagcagcctgccagc

SEQ ID NO: 3074255 - DNA, 14 bp, Homo sapiens
gcccagcaggggcc

SEQ ID NO: 3074256 - DNA, 17 bp, Homo sapiens
gcccagccacccctcag

SEQ ID NO: 3074257 - DNA, 14 bp, Homo sapiens
gcccagccactcca

SEQ ID NO: 3074258 - DNA, 19 bp, Homo sapiens
gcccagccactccaagccc

SEQ ID NO: 3074259 - DNA, 15 bp, Homo sapiens
gcccagccagccacc

SEQ ID NO: 3074260 - DNA, 16 bp, Homo sapiens
gcccagccagccaccc

SEQ ID NO: 3074261 - DNA, 14 bp, Homo sapiens
gcccagccaggccc

SEQ ID NO: 3074262 - DNA, 16 bp, Homo sapiens
gcccagcccagctggt

SEQ ID NO: 3074263 - DNA, 16 bp, Homo sapiens
gcccagccctccccat

SEQ ID NO: 3074264 - DNA, 13 bp, Homo sapiens
gcccagccgggca

SEQ ID NO: 3074265 - DNA, 23 bp, Homo sapiens
gcccagccgggcacagtggcgca

SEQ ID NO: 3074266 - DNA, 15 bp, Homo sapiens
gcccagcgctctcct

SEQ ID NO: 3074267 - DNA, 16 bp, Homo sapiens
gcccagcgctctcctg

SEQ ID NO: 3074268 - DNA, 20 bp, Homo sapiens
gcccagctatacctgtgcct

SEQ ID NO: 3074269 - DNA, 15 bp, Homo sapiens
gcccagctccaaggg

SEQ ID NO: 3074270 - DNA, 11 bp, Homo sapiens
gcccagctctc

SEQ ID NO: 3074271 - DNA, 13 bp, Homo sapiens
gcccagctctgaa

SEQ ID NO: 3074272 - DNA, 15 bp, Homo sapiens
gcccagctctgggaa

SEQ ID NO: 3074273 - DNA, 11 bp, Homo sapiens
gcccagctctt

SEQ ID NO: 3074274 - DNA, 18 bp, Homo sapiens
gcccagctcttgctctct

SEQ ID NO: 3074275 - DNA, 14 bp, Homo sapiens
gcccagctgggtca

SEQ ID NO: 3074276 - DNA, 19 bp, Homo sapiens
gcccagctgggtcaggcag

SEQ ID NO: 3074277 - DNA, 23 bp, Homo sapiens
gcccaggaaggcctaggctagga

SEQ ID NO: 3074278 - DNA, 18 bp, Homo sapiens
gcccaggaccatcatcct

SEQ ID NO: 3074279 - DNA, 19 bp, Homo sapiens
gcccaggagagccagccct

SEQ ID NO: 3074280 - DNA, 15 bp, Homo sapiens
gcccaggagctctgc

SEQ ID NO: 3074281 - DNA, 16 bp, Homo sapiens
gcccaggagctctgcg

SEQ ID NO: 3074282 - DNA, 17 bp, Homo sapiens
gcccaggagctctgcgc

SEQ ID NO: 3074283 - DNA, 21 bp, Homo sapiens
gcccaggagctctgcgccagg

SEQ ID NO: 3074284 - DNA, 22 bp, Homo sapiens
gcccaggagctctgcgccaggc

SEQ ID NO: 3074285 - DNA, 16 bp, Homo sapiens
gcccaggcactgcaaa

SEQ ID NO: 3074286 - DNA, 13 bp, Homo sapiens
gcccaggcaggtc

SEQ ID NO: 3074287 - DNA, 19 bp, Homo sapiens
gcccaggccatgtggcctg

SEQ ID NO: 3074288 - DNA, 23 bp, Homo sapiens
gcccaggccatgtggcctgccca

SEQ ID NO: 3074289 - DNA, 18 bp, Homo sapiens
gcccaggcctccagctca

SEQ ID NO: 3074290 - DNA, 19 bp, Homo sapiens
gcccaggcctctcggtgct

SEQ ID NO: 3074291 - DNA, 20 bp, Homo sapiens
gcccaggccttgctgactct

SEQ ID NO: 3074292 - DNA, 13 bp, Homo sapiens
gcccaggctggga

SEQ ID NO: 3074293 - DNA, 19 bp, Homo sapiens
gcccagggacattgcagag

SEQ ID NO: 3074294 - DNA, 23 bp, Homo sapiens
gcccagggagcggaaagcagctc

SEQ ID NO: 3074295 - DNA, 13 bp, Homo sapiens
gcccagggagggt

SEQ ID NO: 3074296 - DNA, 23 bp, Homo sapiens
gcccagggcccagagcccagctc

SEQ ID NO: 3074297 - DNA, 20 bp, Homo sapiens
gcccaggggagaatgcagcc

SEQ ID NO: 3074298 - DNA, 23 bp, Homo sapiens
gcccaggggagaatgcagcccac

SEQ ID NO: 3074299 - DNA, 17 bp, Homo sapiens
gcccagggggcctggag

SEQ ID NO: 3074300 - DNA, 20 bp, Homo sapiens
gcccagggtgcagtgtgagt

SEQ ID NO: 3074301 - DNA, 13 bp, Homo sapiens
gcccaggtggcta

SEQ ID NO: 3074302 - DNA, 12 bp, Homo sapiens
gcccagtgcatg

SEQ ID NO: 3074303 - DNA, 21 bp, Homo sapiens
gcccagtgcatggtggccaga

SEQ ID NO: 3074304 - DNA, 16 bp, Homo sapiens
gcccatcatctctgcc

SEQ ID NO: 3074305 - DNA, 13 bp, Homo sapiens
gcccatcctccca

SEQ ID NO: 3074306 - DNA, 12 bp, Homo sapiens
gcccatccttcc

SEQ ID NO: 3074307 - DNA, 18 bp, Homo sapiens
gcccatcgccacaaactc

SEQ ID NO: 3074308 - DNA, 21 bp, Homo sapiens
gcccatctgtccatcctcctc

SEQ ID NO: 3074309 - DNA, 23 bp, Homo sapiens
gcccatctgtccatcctcctctc

SEQ ID NO: 3074310 - DNA, 19 bp, Homo sapiens
gcccatgagcaagcctagg

SEQ ID NO: 3074311 - DNA, 17 bp, Homo sapiens
gcccatgcactggggac

SEQ ID NO: 3074312 - DNA, 18 bp, Homo sapiens
gcccatggaggagacagg

SEQ ID NO: 3074313 - DNA, 22 bp, Homo sapiens
gcccatggaggagacaggaagc

SEQ ID NO: 3074314 - DNA, 17 bp, Homo sapiens
gcccatgttgagccatg

SEQ ID NO: 3074315 - DNA, 14 bp, Homo sapiens
gcccattctctctc

SEQ ID NO: 3074316 - DNA, 15 bp, Homo sapiens
gcccattctctctcc

SEQ ID NO: 3074317 - DNA, 20 bp, Homo sapiens
gcccattctctctcctgtcc

SEQ ID NO: 3074318 - DNA, 13 bp, Homo sapiens
gcccattcttttc

SEQ ID NO: 3074319 - DNA, 11 bp, Homo sapiens
gcccatttcat

SEQ ID NO: 3074320 - DNA, 19 bp, Homo sapiens
gcccatttcgaagatatac

SEQ ID NO: 3074321 - DNA, 18 bp, Homo sapiens
gcccatttctccagaacc

SEQ ID NO: 3074322 - DNA, 14 bp, Homo sapiens
gccccaactcctgg

SEQ ID NO: 3074323 - DNA, 22 bp, Homo sapiens
gccccaactcctggaagctgtg

SEQ ID NO: 3074324 - DNA, 14 bp, Homo sapiens
gccccacaaggcct

SEQ ID NO: 3074325 - DNA, 19 bp, Homo sapiens
gccccacaaggcctggtct

SEQ ID NO: 3074326 - DNA, 22 bp, Homo sapiens
gccccacaaggcctggtctggg

SEQ ID NO: 3074327 - DNA, 13 bp, Homo sapiens
gccccacaggagt

SEQ ID NO: 3074328 - DNA, 21 bp, Homo sapiens
gccccacatgtggccatggcc

SEQ ID NO: 3074329 - DNA, 18 bp, Homo sapiens
gccccaccacctaggcca

SEQ ID NO: 3074330 - DNA, 20 bp, Homo sapiens
gccccaccacctaggccact

SEQ ID NO: 3074331 - DNA, 23 bp, Homo sapiens
gccccacccaccccacacctgca

SEQ ID NO: 3074332 - DNA, 14 bp, Homo sapiens
gccccacctgtgtc

SEQ ID NO: 3074333 - DNA, 17 bp, Homo sapiens
gccccactctgcctgcc

SEQ ID NO: 3074334 - DNA, 15 bp, Homo sapiens
gccccagactgagct

SEQ ID NO: 3074335 - DNA, 17 bp, Homo sapiens
gccccagactgagctct

SEQ ID NO: 3074336 - DNA, 21 bp, Homo sapiens
gccccagactgagctctccag

SEQ ID NO: 3074337 - DNA, 14 bp, Homo sapiens
gccccaggaccagc

SEQ ID NO: 3074338 - DNA, 17 bp, Homo sapiens
gccccaggaccagctca

SEQ ID NO: 3074339 - DNA, 19 bp, Homo sapiens
gccccaggaccagctcagg

SEQ ID NO: 3074340 - DNA, 20 bp, Homo sapiens
gccccaggacctggctgcca

SEQ ID NO: 3074341 - DNA, 20 bp, Homo sapiens
gccccaggcccgcgggcaca

SEQ ID NO: 3074342 - DNA, 17 bp, Homo sapiens
gccccaggccggagccc

SEQ ID NO: 3074343 - DNA, 19 bp, Homo sapiens
gccccaggccggagcccag

SEQ ID NO: 3074344 - DNA, 11 bp, Homo sapiens
gccccaggctc

SEQ ID NO: 3074345 - DNA, 16 bp, Homo sapiens
gccccaggtagaaact

SEQ ID NO: 3074346 - DNA, 21 bp, Homo sapiens
gcctgggatttctatgcagtg

SEQ ID NO: 3074347 - DNA, 23 bp, Homo sapiens
gcctgggcaacaaagtgagactc

SEQ ID NO: 3074348 - DNA, 14 bp, Homo sapiens
gcctgggcagtgcc

SEQ ID NO: 3074349 - DNA, 13 bp, Homo sapiens
gcctgggcccctc

SEQ ID NO: 3074350 - DNA, 14 bp, Homo sapiens
gcctgggcccctcc

SEQ ID NO: 3074351 - DNA, 17 bp, Homo sapiens
gcctgggcccctcccct

SEQ ID NO: 3074352 - DNA, 23 bp, Homo sapiens
gcctgggcccctcccctcagagc

SEQ ID NO: 3074353 - DNA, 19 bp, Homo sapiens
gcctgggctgggcagcctt

SEQ ID NO: 3074354 - DNA, 23 bp, Homo sapiens
gcctgggggacccctggctctgg

SEQ ID NO: 3074355 - DNA, 22 bp, Homo sapiens
gcctggggtggggtcatgccct

SEQ ID NO: 3074356 - DNA, 21 bp, Homo sapiens
gcctggggtgttagtggcacc

SEQ ID NO: 3074357 - DNA, 22 bp, Homo sapiens
gcctggggtgttagtggcaccg

SEQ ID NO: 3074358 - DNA, 17 bp, Homo sapiens
gcctgggtaggccccac

SEQ ID NO: 3074359 - DNA, 22 bp, Homo sapiens
gcctgggtaggccccacaaggc

SEQ ID NO: 3074360 - DNA, 23 bp, Homo sapiens
gcctgggtgacagagtgagaccc

SEQ ID NO: 3074361 - DNA, 15 bp, Homo sapiens
gcctgggtggggctg

SEQ ID NO: 3074362 - DNA, 22 bp, Homo sapiens
gcctgggtggggctgctcctcc

SEQ ID NO: 3074363 - DNA, 23 bp, Homo sapiens
gcctgggtggggctgctcctcca

SEQ ID NO: 3074364 - DNA, 24 bp, Homo sapiens
gcctgggtggggctgctcctccag

SEQ ID NO: 3074365 - DNA, 23 bp, Homo sapiens
gcctggtaggaaagggcaagtct

SEQ ID NO: 3074366 - DNA, 14 bp, Homo sapiens
gcctggtccctggt

SEQ ID NO: 3074367 - DNA, 14 bp, Homo sapiens
gcctggtctgggag

SEQ ID NO: 3074368 - DNA, 15 bp, Homo sapiens
gcctgtaatcccagc

SEQ ID NO: 3074369 - DNA, 17 bp, Homo sapiens
gcctgtaatcccagcac

SEQ ID NO: 3074370 - DNA, 21 bp, Homo sapiens
gcctgtaatcccagcactttg

SEQ ID NO: 3074371 - DNA, 18 bp, Homo sapiens
gcctgtaatcccagcagt

SEQ ID NO: 3074372 - DNA, 17 bp, Homo sapiens
gcctgtaatcccagcta

SEQ ID NO: 3074373 - DNA, 12 bp, Homo sapiens
gcctgtaatctt

SEQ ID NO: 3074374 - DNA, 17 bp, Homo sapiens
gcctgtaatctttttct

SEQ ID NO: 3074375 - DNA, 19 bp, Homo sapiens
gcctgtacagaagaaactg

SEQ ID NO: 3074376 - DNA, 15 bp, Homo sapiens
gcctgtacagtctgt

SEQ ID NO: 3074377 - DNA, 20 bp, Homo sapiens
gcctgtacagtctgtcttct

SEQ ID NO: 3074378 - DNA, 17 bp, Homo sapiens
gcctgtactaaggagca

SEQ ID NO: 3074379 - DNA, 21 bp, Homo sapiens
gcctgtactaaggagcatgat

SEQ ID NO: 3074380 - DNA, 19 bp, Homo sapiens
gcctgtagaatagcctgtg

SEQ ID NO: 3074381 - DNA, 22 bp, Homo sapiens
gcctgtagaatagcctgtggcc

SEQ ID NO: 3074382 - DNA, 14 bp, Homo sapiens
gcctgtagagccag

SEQ ID NO: 3074383 - DNA, 19 bp, Homo sapiens
gcctgtagcccactctgct

SEQ ID NO: 3074384 - DNA, 21 bp, Homo sapiens
gcctgtatcctccctggcaga

SEQ ID NO: 3074385 - DNA, 12 bp, Homo sapiens
gcctgtcccagg

SEQ ID NO: 3074386 - DNA, 13 bp, Homo sapiens
gcctgtcccagga

SEQ ID NO: 3074387 - DNA, 13 bp, Homo sapiens
gcctgtccccgcc

SEQ ID NO: 3074388 - DNA, 21 bp, Homo sapiens
gcctgtccccgccttccctca

SEQ ID NO: 3074389 - DNA, 22 bp, Homo sapiens
gcctgtccccgccttccctcac

SEQ ID NO: 3074390 - DNA, 16 bp, Homo sapiens
gcctgtcccctcacag

SEQ ID NO: 3074391 - DNA, 22 bp, Homo sapiens
gcctgtcctccaacaccaagca

SEQ ID NO: 3074392 - DNA, 13 bp, Homo sapiens
gcctgtctaaagc

SEQ ID NO: 3074393 - DNA, 21 bp, Homo sapiens
gcctgtctaaagccttaacta

SEQ ID NO: 3074394 - DNA, 15 bp, Homo sapiens
gcctgtctccatgag

SEQ ID NO: 3074395 - DNA, 17 bp, Homo sapiens
gcctgtctgtccaaccc

SEQ ID NO: 3074396 - DNA, 16 bp, Homo sapiens
gcctgtctgtgacctg

SEQ ID NO: 3074397 - DNA, 18 bp, Homo sapiens
gcctgtgaggcaggggcg

SEQ ID NO: 3074398 - DNA, 24 bp, Homo sapiens
gcctgtgaggggcccctggcccag

SEQ ID NO: 3074399 - DNA, 10 bp, Homo sapiens
gcctgtggcc

SEQ ID NO: 3074400 - DNA, 16 bp, Homo sapiens
gcctgtggcggtgcct

SEQ ID NO: 3074401 - DNA, 17 bp, Homo sapiens
gcctgtggctgtggaga

SEQ ID NO: 3074402 - DNA, 20 bp, Homo sapiens
gcctgtggtggcctggtgca

SEQ ID NO: 3074403 - DNA, 15 bp, Homo sapiens
gcctgtggtggctcc

SEQ ID NO: 3074404 - DNA, 16 bp, Homo sapiens
gcctgtttattgccat

SEQ ID NO: 3074405 - DNA, 23 bp, Homo sapiens
gccttaactaagactcccgcccc

SEQ ID NO: 3074406 - DNA, 14 bp, Homo sapiens
gccttacccctgcc

SEQ ID NO: 3074407 - DNA, 14 bp, Homo sapiens
gccttacctcctgc

SEQ ID NO: 3074408 - DNA, 17 bp, Homo sapiens
gccttacctcctgccca

SEQ ID NO: 3074409 - DNA, 18 bp, Homo sapiens
gccttacctcctgcccag

SEQ ID NO: 3074410 - DNA, 19 bp, Homo sapiens
gccttacctcctgcccagg

SEQ ID NO: 3074411 - DNA, 13 bp, Homo sapiens
gccttagagtatg

SEQ ID NO: 3074412 - DNA, 18 bp, Homo sapiens
gccttagcttcaggaacc

SEQ ID NO: 3074413 - DNA, 23 bp, Homo sapiens
gccttaggaatactgttttatct

SEQ ID NO: 3074414 - DNA, 16 bp, Homo sapiens
gccttatgagaacatg

SEQ ID NO: 3074415 - DNA, 21 bp, Homo sapiens
gccttatgagaacatggtgtg

SEQ ID NO: 3074416 - DNA, 12 bp, Homo sapiens
gccttattaaag

SEQ ID NO: 3074417 - DNA, 21 bp, Homo sapiens
gccttattacataactgatct

SEQ ID NO: 3074418 - DNA, 13 bp, Homo sapiens
gccttcaaatcaa

SEQ ID NO: 3074419 - DNA, 18 bp, Homo sapiens
gccttcacattcccctgg

SEQ ID NO: 3074420 - DNA, 23 bp, Homo sapiens
gccttcactgtgctccaacctga

SEQ ID NO: 3074421 - DNA, 14 bp, Homo sapiens
gccttcagcctccc

SEQ ID NO: 3074422 - DNA, 16 bp, Homo sapiens
gccttcattaaatgtt

SEQ ID NO: 3074423 - DNA, 19 bp, Homo sapiens
gccttcattaaatgtttgt

SEQ ID NO: 3074424 - DNA, 22 bp, Homo sapiens
gccttcattaaatgtttgttga

SEQ ID NO: 3074425 - DNA, 18 bp, Homo sapiens
gccttccatttcccctct

SEQ ID NO: 3074426 - DNA, 22 bp, Homo sapiens
gccttccccttgaacctcatta

SEQ ID NO: 3074427 - DNA, 15 bp, Homo sapiens
gccttccctcactct

SEQ ID NO: 3074428 - DNA, 16 bp, Homo sapiens
gccttccctcactctt

SEQ ID NO: 3074429 - DNA, 20 bp, Homo sapiens
gccttccctcactcttcctc

SEQ ID NO: 3074430 - DNA, 17 bp, Homo sapiens
gccttcctaagcctgtg

SEQ ID NO: 3074431 - DNA, 13 bp, Homo sapiens
gccttcctcctgg

SEQ ID NO: 3074432 - DNA, 22 bp, Homo sapiens
gccttcctcctgggccctctct

SEQ ID NO: 3074433 - DNA, 17 bp, Homo sapiens
gccttcctctctccaga

SEQ ID NO: 3074434 - DNA, 16 bp, Homo sapiens
gccttcgaggtcagag

SEQ ID NO: 3074435 - DNA, 14 bp, Homo sapiens
gccttcgattttaa

SEQ ID NO: 3074436 - DNA, 17 bp, Homo sapiens
gccttcgtttatatttt

SEQ ID NO: 3074437 - DNA, 13 bp, Homo sapiens
gccttctcaccag

SEQ ID NO: 3074438 - DNA, 16 bp, Homo sapiens
gccttctcaccagctg

SEQ ID NO: 3074439 - DNA, 14 bp, Homo sapiens
gccttctcagctct

SEQ ID NO: 3074440 - DNA, 18 bp, Homo sapiens
gccttctcggagctggcc

SEQ ID NO: 3074441 - DNA, 21 bp, Homo sapiens
gccttctcggagctggcccag

SEQ ID NO: 3074442 - DNA, 12 bp, Homo sapiens
gccttctctcag

SEQ ID NO: 3074443 - DNA, 19 bp, Homo sapiens
gccttcttattctcactcc

SEQ ID NO: 3074444 - DNA, 23 bp, Homo sapiens
gccttcttattctcactccacca

SEQ ID NO: 3074445 - DNA, 17 bp, Homo sapiens
gccttcttcagggcctg

SEQ ID NO: 3074446 - DNA, 22 bp, Homo sapiens
gccttcttcggggaactcctgg

SEQ ID NO: 3074447 - DNA, 17 bp, Homo sapiens
gccttgaagactccctg

SEQ ID NO: 3074448 - DNA, 14 bp, Homo sapiens
gccttgcccacagg

SEQ ID NO: 3074449 - DNA, 22 bp, Homo sapiens
gccttgcccagagatgcctcca

SEQ ID NO: 3074450 - DNA, 15 bp, Homo sapiens
gccttgctgccaagt

SEQ ID NO: 3074451 - DNA, 15 bp, Homo sapiens
gccttggcctcccaa

SEQ ID NO: 3074452 - DNA, 18 bp, Homo sapiens
gccttggccttgcagctg

SEQ ID NO: 3074453 - DNA, 20 bp, Homo sapiens
gccttgggggggctgccttt

SEQ ID NO: 3074454 - DNA, 15 bp, Homo sapiens
gccttggggtggggg

SEQ ID NO: 3074455 - DNA, 20 bp, Homo sapiens
gccttggggtgggggccagg

SEQ ID NO: 3074456 - DNA, 23 bp, Homo sapiens
gccttggggtgggggccaggcct

SEQ ID NO: 3074457 - DNA, 16 bp, Homo sapiens
gccttggtatgtgcca

SEQ ID NO: 3074458 - DNA, 19 bp, Homo sapiens
gccttggtatgtgccaggc

SEQ ID NO: 3074459 - DNA, 15 bp, Homo sapiens
gccttgtcacgccag

SEQ ID NO: 3074460 - DNA, 16 bp, Homo sapiens
gccttgtcacgccaga

SEQ ID NO: 3074461 - DNA, 18 bp, Homo sapiens
gccttgtcctcagccagt

SEQ ID NO: 3074462 - DNA, 16 bp, Homo sapiens
gccttgtgtgtcaggc

SEQ ID NO: 3074463 - DNA, 18 bp, Homo sapiens
gccttgtgtgtcaggccc

SEQ ID NO: 3074464 - DNA, 19 bp, Homo sapiens
gccttgtgtgtcaggccct

SEQ ID NO: 3074465 - DNA, 15 bp, Homo sapiens
gcctttacaagggag

SEQ ID NO: 3074466 - DNA, 19 bp, Homo sapiens
gcctttatctcagccatcc

SEQ ID NO: 3074467 - DNA, 19 bp, Homo sapiens
gcctttcccaactctagct

SEQ ID NO: 3074468 - DNA, 21 bp, Homo sapiens
gcctttccctcctaaagctga

SEQ ID NO: 3074469 - DNA, 17 bp, Homo sapiens
gcctttcctgtagcctt

SEQ ID NO: 3074470 - DNA, 12 bp, Homo sapiens
gcctttcttcct

SEQ ID NO: 3074471 - DNA, 11 bp, Homo sapiens
gcctttgagtg

SEQ ID NO: 3074472 - DNA, 22 bp, Homo sapiens
gcctttgagtgtgggactccag

SEQ ID NO: 3074473 - DNA, 16 bp, Homo sapiens
gcctttgctgcccttg

SEQ ID NO: 3074474 - DNA, 21 bp, Homo sapiens
gcctttgctgtttagcttcct

SEQ ID NO: 3074475 - DNA, 17 bp, Homo sapiens
gcctttgggtcctgggc

SEQ ID NO: 3074476 - DNA, 19 bp, Homo sapiens
gcctttgggtcgacatagt

SEQ ID NO: 3074477 - DNA, 21 bp, Homo sapiens
gcggctgctcgcccaggaagg

SEQ ID NO: 3074478 - DNA, 22 bp, Homo sapiens
gcggctgctcgcccaggaaggc

SEQ ID NO: 3074479 - DNA, 22 bp, Homo sapiens
gcggctggctctgtggaggggc

SEQ ID NO: 3074480 - DNA, 14 bp, Homo sapiens
gcggctgggaggag

SEQ ID NO: 3074481 - DNA, 18 bp, Homo sapiens
gcggctgggaggagggca

SEQ ID NO: 3074482 - DNA, 22 bp, Homo sapiens
gcggctttatcattcctttcca

SEQ ID NO: 3074483 - DNA, 18 bp, Homo sapiens
gcgggagggagtctcagg

SEQ ID NO: 3074484 - DNA, 22 bp, Homo sapiens
gcgggagggagtctcaggagga

SEQ ID NO: 3074485 - DNA, 10 bp, Homo sapiens
gcgggcaggg

SEQ ID NO: 3074486 - DNA, 18 bp, Homo sapiens
gcgggcagtcgctgcagg

SEQ ID NO: 3074487 - DNA, 20 bp, Homo sapiens
gcgggcagtcgctgcaggga

SEQ ID NO: 3074488 - DNA, 20 bp, Homo sapiens
gcgggcccctcacctggtac

SEQ ID NO: 3074489 - DNA, 13 bp, Homo sapiens
gcgggctgagggc

SEQ ID NO: 3074490 - DNA, 16 bp, Homo sapiens
gcgggctgagggcatc

SEQ ID NO: 3074491 - DNA, 15 bp, Homo sapiens
gcggggactgctggc

SEQ ID NO: 3074492 - DNA, 20 bp, Homo sapiens
gcggggactgctggctcacg

SEQ ID NO: 3074493 - DNA, 16 bp, Homo sapiens
gcggggagtacaaggc

SEQ ID NO: 3074494 - DNA, 19 bp, Homo sapiens
gcggggcctgaggcaagcc

SEQ ID NO: 3074495 - DNA, 22 bp, Homo sapiens
gcggggggggcgcctggagagc

SEQ ID NO: 3074496 - DNA, 16 bp, Homo sapiens
gcggggtttcaccatg

SEQ ID NO: 3074497 - DNA, 20 bp, Homo sapiens
gcgggtccacttgccagggc

SEQ ID NO: 3074498 - DNA, 22 bp, Homo sapiens
gcgggtccacttgccagggctc

SEQ ID NO: 3074499 - DNA, 21 bp, Homo sapiens
gcgggtgaacaaagcagccac

SEQ ID NO: 3074500 - DNA, 20 bp, Homo sapiens
gcgggtggatcacctgaggt

SEQ ID NO: 3074501 - DNA, 14 bp, Homo sapiens
gcgggtggctgcaa

SEQ ID NO: 3074502 - DNA, 18 bp, Homo sapiens
gcgggtggctgcaagccc

SEQ ID NO: 3074503 - DNA, 15 bp, Homo sapiens
gcggtagccagcaca

SEQ ID NO: 3074504 - DNA, 15 bp, Homo sapiens
gcggtcagactggag

SEQ ID NO: 3074505 - DNA, 16 bp, Homo sapiens
gcggtcagactggagg

SEQ ID NO: 3074506 - DNA, 18 bp, Homo sapiens
gcggtccaacgccgcctt

SEQ ID NO: 3074507 - DNA, 18 bp, Homo sapiens
gcggtgctgtcctcaggt

SEQ ID NO: 3074508 - DNA, 17 bp, Homo sapiens
gcggtgcttgatagaaa

SEQ ID NO: 3074509 - DNA, 22 bp, Homo sapiens
gcggtggccacagcgtgctggc

SEQ ID NO: 3074510 - DNA, 18 bp, Homo sapiens
gcggtgggaaggaaaggc

SEQ ID NO: 3074511 - DNA, 22 bp, Homo sapiens
gcggtgggaaggaaaggcagat

SEQ ID NO: 3074512 - DNA, 18 bp, Homo sapiens
gcgtagagggtgctgccc

SEQ ID NO: 3074513 - DNA, 19 bp, Homo sapiens
gcgtcaggggtgcacagtc

SEQ ID NO: 3074514 - DNA, 23 bp, Homo sapiens
gcgtcaggggtgcacagtccaca

SEQ ID NO: 3074515 - DNA, 16 bp, Homo sapiens
gcgtcctcctctgtga

SEQ ID NO: 3074516 - DNA, 19 bp, Homo sapiens
gcgtcctgtccacacccag

SEQ ID NO: 3074517 - DNA, 16 bp, Homo sapiens
gcgtcgccctcccagg

SEQ ID NO: 3074518 - DNA, 15 bp, Homo sapiens
gcgtctgactccctc

SEQ ID NO: 3074519 - DNA, 21 bp, Homo sapiens
gcgtctggaagtccaatgtgg

SEQ ID NO: 3074520 - DNA, 17 bp, Homo sapiens
gcgtctgttcccccttc

SEQ ID NO: 3074521 - DNA, 16 bp, Homo sapiens
gcgtcttcatctccct

SEQ ID NO: 3074522 - DNA, 19 bp, Homo sapiens
gcgtctttaagagactcac

SEQ ID NO: 3074523 - DNA, 16 bp, Homo sapiens
gcgtgactcacccaag

SEQ ID NO: 3074524 - DNA, 15 bp, Homo sapiens
gcgtgactcagcagc

SEQ ID NO: 3074525 - DNA, 13 bp, Homo sapiens
gcgtgagctgccc

SEQ ID NO: 3074526 - DNA, 15 bp, Homo sapiens
gcgtgatcaaagcca

SEQ ID NO: 3074527 - DNA, 14 bp, Homo sapiens
gcgtgccgggcccc

SEQ ID NO: 3074528 - DNA, 15 bp, Homo sapiens
gcgtgccgggccccc

SEQ ID NO: 3074529 - DNA, 17 bp, Homo sapiens
gcgtgccgggcccccac

SEQ ID NO: 3074530 - DNA, 18 bp, Homo sapiens
gcgtggagactggcaggc

SEQ ID NO: 3074531 - DNA, 14 bp, Homo sapiens
gcgtggagggaggc

SEQ ID NO: 3074532 - DNA, 17 bp, Homo sapiens
gcgtggagggaggcccc

SEQ ID NO: 3074533 - DNA, 22 bp, Homo sapiens
gcgtggagggaggccccagggg

SEQ ID NO: 3074534 - DNA, 19 bp, Homo sapiens
gcgtggggaatgggcaggt

SEQ ID NO: 3074535 - DNA, 14 bp, Homo sapiens
gcgtggtgccatcc

SEQ ID NO: 3074536 - DNA, 17 bp, Homo sapiens
gcgtgtcacctgtgctt

SEQ ID NO: 3074537 - DNA, 21 bp, Homo sapiens
gcgtgtgcatagcgtcctgcc

SEQ ID NO: 3074538 - DNA, 17 bp, Homo sapiens
gcgtgtggcagccacac

SEQ ID NO: 3074539 - DNA, 16 bp, Homo sapiens
gcgttctcctgcttgt

SEQ ID NO: 3074540 - DNA, 16 bp, Homo sapiens
gcgttgtgggcaggct

SEQ ID NO: 3074541 - DNA, 20 bp, Homo sapiens
gcgtttcaccatgttggcca

SEQ ID NO: 3074542 - DNA, 21 bp, Homo sapiens
gctaaaaatatgcagaatctc

SEQ ID NO: 3074543 - DNA, 20 bp, Homo sapiens
gctaaacactgcgctttatt

SEQ ID NO: 3074544 - DNA, 22 bp, Homo sapiens
gctaaacactgcgctttatttt

SEQ ID NO: 3074545 - DNA, 15 bp, Homo sapiens
gctaaagcccagaga

SEQ ID NO: 3074546 - DNA, 14 bp, Homo sapiens
gctaaagtgcattt

SEQ ID NO: 3074547 - DNA, 19 bp, Homo sapiens
gctaaataaaatttgttgc

SEQ ID NO: 3074548 - DNA, 20 bp, Homo sapiens
gctaaataaaatttgttgca

SEQ ID NO: 3074549 - DNA, 21 bp, Homo sapiens
gctaaataactatataagaca

SEQ ID NO: 3074550 - DNA, 12 bp, Homo sapiens
gctaaatgaagt

SEQ ID NO: 3074551 - DNA, 14 bp, Homo sapiens
gctaaatgtaacag

SEQ ID NO: 3074552 - DNA, 13 bp, Homo sapiens
gctaacaaacctg

SEQ ID NO: 3074553 - DNA, 20 bp, Homo sapiens
gctaacaaggcgaaatcctg

SEQ ID NO: 3074554 - DNA, 11 bp, Homo sapiens
gctaacattta

SEQ ID NO: 3074555 - DNA, 17 bp, Homo sapiens
gctaacatttaggagaa

SEQ ID NO: 3074556 - DNA, 18 bp, Homo sapiens
gctaacatttaggagaag

SEQ ID NO: 3074557 - DNA, 19 bp, Homo sapiens
gctaacccccagcccacag

SEQ ID NO: 3074558 - DNA, 23 bp, Homo sapiens
gctaacgttttttcttcttttaa

SEQ ID NO: 3074559 - DNA, 11 bp, Homo sapiens
gctaactgaac

SEQ ID NO: 3074560 - DNA, 12 bp, Homo sapiens
gctaactggaag

SEQ ID NO: 3074561 - DNA, 14 bp, Homo sapiens
gctaactgtaaatc

SEQ ID NO: 3074562 - DNA, 21 bp, Homo sapiens
gctaactttgcccttcactgt

SEQ ID NO: 3074563 - DNA, 14 bp, Homo sapiens
gctaagaatatttg

SEQ ID NO: 3074564 - DNA, 17 bp, Homo sapiens
gctaagatactgctgat

SEQ ID NO: 3074565 - DNA, 12 bp, Homo sapiens
gctaagatgctc

SEQ ID NO: 3074566 - DNA, 22 bp, Homo sapiens
gctaagggggaccatggggagg

SEQ ID NO: 3074567 - DNA, 18 bp, Homo sapiens
gctaatattttatttgaa

SEQ ID NO: 3074568 - DNA, 20 bp, Homo sapiens
gctaatattttatttgaaaa

SEQ ID NO: 3074569 - DNA, 21 bp, Homo sapiens
gctaatattttatttgaaaaa

SEQ ID NO: 3074570 - DNA, 21 bp, Homo sapiens
gctaattgctgttgaaagcaa

SEQ ID NO: 3074571 - DNA, 15 bp, Homo sapiens
gctaatttttttgta

SEQ ID NO: 3074572 - DNA, 15 bp, Homo sapiens
gctacaaagaagaca

SEQ ID NO: 3074573 - DNA, 17 bp, Homo sapiens
gctacaaagaagacatg

SEQ ID NO: 3074574 - DNA, 18 bp, Homo sapiens
gctacaaagaagacatgt

SEQ ID NO: 3074575 - DNA, 23 bp, Homo sapiens
gctacaaaggaggacaagaccct

SEQ ID NO: 3074576 - DNA, 15 bp, Homo sapiens
gctacacctttctcc

SEQ ID NO: 3074577 - DNA, 20 bp, Homo sapiens
gctacaggttacaacagatt

SEQ ID NO: 3074578 - DNA, 14 bp, Homo sapiens
gctaccaagtcaga

SEQ ID NO: 3074579 - DNA, 14 bp, Homo sapiens
gctaccctgagctg

SEQ ID NO: 3074580 - DNA, 19 bp, Homo sapiens
gctaccctgagctgaggca

SEQ ID NO: 3074581 - DNA, 20 bp, Homo sapiens
gctaccctgagctgaggcag

SEQ ID NO: 3074582 - DNA, 14 bp, Homo sapiens
gctacctccctccc

SEQ ID NO: 3074583 - DNA, 14 bp, Homo sapiens
gctacctctctgtc

SEQ ID NO: 3074584 - DNA, 16 bp, Homo sapiens
gctacctctctgtccc

SEQ ID NO: 3074585 - DNA, 17 bp, Homo sapiens
gctacctttcaaagctt

SEQ ID NO: 3074586 - DNA, 12 bp, Homo sapiens
gctacgcctgca

SEQ ID NO: 3074587 - DNA, 14 bp, Homo sapiens
gctacgtgcctccc

SEQ ID NO: 3074588 - DNA, 16 bp, Homo sapiens
gctacgtgcctcccga

SEQ ID NO: 3074589 - DNA, 16 bp, Homo sapiens
gctacgtgtgaaatct

SEQ ID NO: 3074590 - DNA, 19 bp, Homo sapiens
gctacgtgtgatttttctg

SEQ ID NO: 3074591 - DNA, 15 bp, Homo sapiens
gctactagaaataaa

SEQ ID NO: 3074592 - DNA, 23 bp, Homo sapiens
gctactcagaaatggacaaagaa

SEQ ID NO: 3074593 - DNA, 18 bp, Homo sapiens
gctactcagcagccctcc

SEQ ID NO: 3074594 - DNA, 19 bp, Homo sapiens
gctactcagcagccctcct

SEQ ID NO: 3074595 - DNA, 14 bp, Homo sapiens
gctactcaggaggc

SEQ ID NO: 3074596 - DNA, 21 bp, Homo sapiens
gctactcgggaggctgaggca

SEQ ID NO: 3074597 - DNA, 12 bp, Homo sapiens
gctactgaaact

SEQ ID NO: 3074598 - DNA, 14 bp, Homo sapiens
gctactgcccctct

SEQ ID NO: 3074599 - DNA, 18 bp, Homo sapiens
gctactgcccctctccga

SEQ ID NO: 3074600 - DNA, 22 bp, Homo sapiens
gctactgccgtcagtgctgtgc

SEQ ID NO: 3074601 - DNA, 23 bp, Homo sapiens
gctactggcaaaaggatctttgt

SEQ ID NO: 3074602 - DNA, 16 bp, Homo sapiens
gctactggggaggctg

SEQ ID NO: 3074603 - DNA, 18 bp, Homo sapiens
gctactggggaggctgag

SEQ ID NO: 3074604 - DNA, 19 bp, Homo sapiens
gctactggggaggctgagg

SEQ ID NO: 3074605 - DNA, 16 bp, Homo sapiens
gctactgtctcactga

SEQ ID NO: 3074606 - DNA, 15 bp, Homo sapiens
gctactgtgtgtgtg

SEQ ID NO: 3074607 - DNA, 15 bp, Homo sapiens
gctacttgggagcct

SEQ ID NO: 3074608 - DNA, 16 bp, Homo sapiens
gctacttgggagcctg

SEQ ID NO: 3074609 - DNA, 17 bp, Homo sapiens
gctgctacaaagaagac

SEQ ID NO: 3074610 - DNA, 20 bp, Homo sapiens
gctgctcagggaaaagcagc

SEQ ID NO: 3074611 - DNA, 20 bp, Homo sapiens
gctgctcccacacttgtgcc

SEQ ID NO: 3074612 - DNA, 15 bp, Homo sapiens
gctgctcctagaggg

SEQ ID NO: 3074613 - DNA, 19 bp, Homo sapiens
gctgctcctagagggaggg

SEQ ID NO: 3074614 - DNA, 23 bp, Homo sapiens
gctgctcctagagggaggggcct

SEQ ID NO: 3074615 - DNA, 11 bp, Homo sapiens
gctgctcctcc

SEQ ID NO: 3074616 - DNA, 14 bp, Homo sapiens
gctgctcctccagg

SEQ ID NO: 3074617 - DNA, 15 bp, Homo sapiens
gctgctcctccaggg

SEQ ID NO: 3074618 - DNA, 18 bp, Homo sapiens
gctgctcctccagggcca

SEQ ID NO: 3074619 - DNA, 15 bp, Homo sapiens
gctgctcctctttcc

SEQ ID NO: 3074620 - DNA, 19 bp, Homo sapiens
gctgctcctctttcccctc

SEQ ID NO: 3074621 - DNA, 15 bp, Homo sapiens
gctgctcgcccagga

SEQ ID NO: 3074622 - DNA, 16 bp, Homo sapiens
gctgctcgcccaggaa

SEQ ID NO: 3074623 - DNA, 18 bp, Homo sapiens
gctgctcgcccaggaagg

SEQ ID NO: 3074624 - DNA, 19 bp, Homo sapiens
gctgctcgcccaggaaggc

SEQ ID NO: 3074625 - DNA, 16 bp, Homo sapiens
gctgctgactgatgtt

SEQ ID NO: 3074626 - DNA, 16 bp, Homo sapiens
gctgctgatgcgctgg

SEQ ID NO: 3074627 - DNA, 16 bp, Homo sapiens
gctgctgccagggctt

SEQ ID NO: 3074628 - DNA, 17 bp, Homo sapiens
gctgctgccagggcttc

SEQ ID NO: 3074629 - DNA, 18 bp, Homo sapiens
gctgctgccagggcttcc

SEQ ID NO: 3074630 - DNA, 14 bp, Homo sapiens
gctgctgccatcca

SEQ ID NO: 3074631 - DNA, 15 bp, Homo sapiens
gctgctgggatggtg

SEQ ID NO: 3074632 - DNA, 20 bp, Homo sapiens
gctgctggggcctcagacga

SEQ ID NO: 3074633 - DNA, 18 bp, Homo sapiens
gctgctgggggctcccct

SEQ ID NO: 3074634 - DNA, 19 bp, Homo sapiens
gctgctgggggctcccctt

SEQ ID NO: 3074635 - DNA, 16 bp, Homo sapiens
gctgctgtcacctctc

SEQ ID NO: 3074636 - DNA, 15 bp, Homo sapiens
gctgcttccaggctg

SEQ ID NO: 3074637 - DNA, 14 bp, Homo sapiens
gctgcttcttgctt

SEQ ID NO: 3074638 - DNA, 19 bp, Homo sapiens
gctgcttgcagccaggaga

SEQ ID NO: 3074639 - DNA, 22 bp, Homo sapiens
gctgcttgtgcctcccttccca

SEQ ID NO: 3074640 - DNA, 15 bp, Homo sapiens
gctgctttgttgttc

SEQ ID NO: 3074641 - DNA, 12 bp, Homo sapiens
gctgcttttcct

SEQ ID NO: 3074642 - DNA, 14 bp, Homo sapiens
gctgctttttcaaa

SEQ ID NO: 3074643 - DNA, 23 bp, Homo sapiens
gctggaaaatctgtaaaaaagaa

SEQ ID NO: 3074644 - DNA, 20 bp, Homo sapiens
gctggaaacagactcgattc

SEQ ID NO: 3074645 - DNA, 23 bp, Homo sapiens
gctggaaaccaagtcaggccagg

SEQ ID NO: 3074646 - DNA, 16 bp, Homo sapiens
gctggaaacttctgta

SEQ ID NO: 3074647 - DNA, 17 bp, Homo sapiens
gctggaaacttctgtaa

SEQ ID NO: 3074648 - DNA, 16 bp, Homo sapiens
gctggaagaaccactg

SEQ ID NO: 3074649 - DNA, 19 bp, Homo sapiens
gctggaagaaccactgtct

SEQ ID NO: 3074650 - DNA, 21 bp, Homo sapiens
gctggaagaggtgggtggtgg

SEQ ID NO: 3074651 - DNA, 14 bp, Homo sapiens
gctggaatgaggga

SEQ ID NO: 3074652 - DNA, 13 bp, Homo sapiens
gctggaggcaggg

SEQ ID NO: 3074653 - DNA, 14 bp, Homo sapiens
gctggaggcccagg

SEQ ID NO: 3074654 - DNA, 15 bp, Homo sapiens
gctggaggcccaggc

SEQ ID NO: 3074655 - DNA, 22 bp, Homo sapiens
gctggagggtgctaggcccctg

SEQ ID NO: 3074656 - DNA, 14 bp, Homo sapiens
gctggaggtgctgg

SEQ ID NO: 3074657 - DNA, 12 bp, Homo sapiens
gctggagtgagg

SEQ ID NO: 3074658 - DNA, 15 bp, Homo sapiens
gctggagtgcagtgg

SEQ ID NO: 3074659 - DNA, 19 bp, Homo sapiens
gctggagtgcagtggtgca

SEQ ID NO: 3074660 - DNA, 21 bp, Homo sapiens
gctggatgctccttccaacag

SEQ ID NO: 3074661 - DNA, 22 bp, Homo sapiens
gctggatgtctgccaatttttg

SEQ ID NO: 3074662 - DNA, 14 bp, Homo sapiens
gctggcaacacaga

SEQ ID NO: 3074663 - DNA, 13 bp, Homo sapiens
gctggcccagggg

SEQ ID NO: 3074664 - DNA, 19 bp, Homo sapiens
gctggcccgtgacagactc

SEQ ID NO: 3074665 - DNA, 13 bp, Homo sapiens
gctggccctgtgc

SEQ ID NO: 3074666 - DNA, 15 bp, Homo sapiens
gctggccctgtgcag

SEQ ID NO: 3074667 - DNA, 22 bp, Homo sapiens
gctggccggagcaaactctgct

SEQ ID NO: 3074668 - DNA, 18 bp, Homo sapiens
gctggcctcttggcacct

SEQ ID NO: 3074669 - DNA, 11 bp, Homo sapiens
gctggcctgct

SEQ ID NO: 3074670 - DNA, 17 bp, Homo sapiens
gctggcctgctcttact

SEQ ID NO: 3074671 - DNA, 14 bp, Homo sapiens
gctggcctggaggc

SEQ ID NO: 3074672 - DNA, 19 bp, Homo sapiens
gctggcctggaggctcagc

SEQ ID NO: 3074673 - DNA, 13 bp, Homo sapiens
gctggcctggcag

SEQ ID NO: 3074674 - DNA, 14 bp, Homo sapiens
gctggcctggcagg

SEQ ID NO: 3074675 - DNA, 15 bp, Homo sapiens
gctggcctggcaggg

SEQ ID NO: 3074676 - DNA, 19 bp, Homo sapiens
gctggccttggtatgtgcc

SEQ ID NO: 3074677 - DNA, 21 bp, Homo sapiens
gctggcgacactcagggcagc

SEQ ID NO: 3074678 - DNA, 17 bp, Homo sapiens
gctggctcacgccccgc

SEQ ID NO: 3074679 - DNA, 23 bp, Homo sapiens
gctggctcacgccccgctgtgtc

SEQ ID NO: 3074680 - DNA, 21 bp, Homo sapiens
gctggctccagatgcagggca

SEQ ID NO: 3074681 - DNA, 23 bp, Homo sapiens
gctggctccagatgcagggcagt

SEQ ID NO: 3074682 - DNA, 19 bp, Homo sapiens
gctggctgcttgcagccag

SEQ ID NO: 3074683 - DNA, 12 bp, Homo sapiens
gctggctggcct

SEQ ID NO: 3074684 - DNA, 11 bp, Homo sapiens
gctgggaaaca

SEQ ID NO: 3074685 - DNA, 20 bp, Homo sapiens
gctgggacgtggctcagcca

SEQ ID NO: 3074686 - DNA, 17 bp, Homo sapiens
gctgggaggagggcagg

SEQ ID NO: 3074687 - DNA, 20 bp, Homo sapiens
gctgggatggtgggcttcag

SEQ ID NO: 3074688 - DNA, 21 bp, Homo sapiens
gctgggattacaggcgtgagc

SEQ ID NO: 3074689 - DNA, 17 bp, Homo sapiens
gctgggattacagggat

SEQ ID NO: 3074690 - DNA, 21 bp, Homo sapiens
gctgggattataggcatgagc

SEQ ID NO: 3074691 - DNA, 22 bp, Homo sapiens
gctgggattataggcatgagcc

SEQ ID NO: 3074692 - DNA, 13 bp, Homo sapiens
gctgggcacttcc

SEQ ID NO: 3074693 - DNA, 15 bp, Homo sapiens
gctgggcacttccct

SEQ ID NO: 3074694 - DNA, 18 bp, Homo sapiens
gctgggcacttccctgct

SEQ ID NO: 3074695 - DNA, 17 bp, Homo sapiens
gctgggcagccttgggg

SEQ ID NO: 3074696 - DNA, 16 bp, Homo sapiens
gctgggcagtgccagc

SEQ ID NO: 3074697 - DNA, 16 bp, Homo sapiens
gctgggcccacagccc

SEQ ID NO: 3074698 - DNA, 12 bp, Homo sapiens
gctgggcccagc

SEQ ID NO: 3074699 - DNA, 21 bp, Homo sapiens
gctgggccgcaagggcctgga

SEQ ID NO: 3074700 - DNA, 22 bp, Homo sapiens
gctgggctctccacctcagcct

SEQ ID NO: 3074701 - DNA, 12 bp, Homo sapiens
gctggggaagga

SEQ ID NO: 3074702 - DNA, 23 bp, Homo sapiens
gctggggaggtgggaggccaggc

SEQ ID NO: 3074703 - DNA, 15 bp, Homo sapiens
gctggggcctcagac

SEQ ID NO: 3074704 - DNA, 18 bp, Homo sapiens
gctgggggagggactgct

SEQ ID NO: 3074705 - DNA, 18 bp, Homo sapiens
gctgggggcaactggcca

SEQ ID NO: 3074706 - DNA, 16 bp, Homo sapiens
gctgggggctcccctt

SEQ ID NO: 3074707 - DNA, 19 bp, Homo sapiens
gctgggggtgggccaggct

SEQ ID NO: 3074708 - DNA, 22 bp, Homo sapiens
gctggggtacacagtgagagta

SEQ ID NO: 3074709 - DNA, 14 bp, Homo sapiens
gctgggtcacagga

SEQ ID NO: 3074710 - DNA, 16 bp, Homo sapiens
gctgggtcacaggaag

SEQ ID NO: 3074711 - DNA, 20 bp, Homo sapiens
gctgggtccttgggcctggc

SEQ ID NO: 3074712 - DNA, 19 bp, Homo sapiens
gctgggtgagctcttccag

SEQ ID NO: 3074713 - DNA, 18 bp, Homo sapiens
gctgggtttgctgtcttg

SEQ ID NO: 3074714 - DNA, 19 bp, Homo sapiens
gctggtattctctctatgc

SEQ ID NO: 3074715 - DNA, 20 bp, Homo sapiens
gctggtcactctgccctctg

SEQ ID NO: 3074716 - DNA, 14 bp, Homo sapiens
gctggtcagagtgg

SEQ ID NO: 3074717 - DNA, 15 bp, Homo sapiens
gctggtcatccttgg

SEQ ID NO: 3074718 - DNA, 18 bp, Homo sapiens
gctggtccgagctgagga

SEQ ID NO: 3074719 - DNA, 15 bp, Homo sapiens
gctggtctctggctc

SEQ ID NO: 3074720 - DNA, 20 bp, Homo sapiens
gctggtgcacagccactccc

SEQ ID NO: 3074721 - DNA, 13 bp, Homo sapiens
gctggtgcctgag

SEQ ID NO: 3074722 - DNA, 17 bp, Homo sapiens
gctggtggatggtgact

SEQ ID NO: 3074723 - DNA, 13 bp, Homo sapiens
gctggttcactct

SEQ ID NO: 3074724 - DNA, 12 bp, Homo sapiens
gctggttctgta

SEQ ID NO: 3074725 - DNA, 22 bp, Homo sapiens
gctggtttcctgcccagcctgg

SEQ ID NO: 3074726 - DNA, 19 bp, Homo sapiens
gctggttttgatggctggg

SEQ ID NO: 3074727 - DNA, 14 bp, Homo sapiens
gctgtaaataaatg

SEQ ID NO: 3074728 - DNA, 15 bp, Homo sapiens
gctgtaaataaatgc

SEQ ID NO: 3074729 - DNA, 16 bp, Homo sapiens
gctgtaagatgtctgt

SEQ ID NO: 3074730 - DNA, 15 bp, Homo sapiens
gctgtaaggctctag

SEQ ID NO: 3074731 - DNA, 22 bp, Homo sapiens
gctgtacatctattttggattg

SEQ ID NO: 3074732 - DNA, 16 bp, Homo sapiens
gctgtagtaggcattt

SEQ ID NO: 3074733 - DNA, 14 bp, Homo sapiens
gctgtatcttgttt

SEQ ID NO: 3074734 - DNA, 22 bp, Homo sapiens
gctgtatgaatattttatatta

SEQ ID NO: 3074735 - DNA, 12 bp, Homo sapiens
gctgtatgattt

SEQ ID NO: 3074736 - DNA, 23 bp, Homo sapiens
gctgtattcatgaatcttgagag

SEQ ID NO: 3074737 - DNA, 13 bp, Homo sapiens
gctgtcacctctc

SEQ ID NO: 3074738 - DNA, 17 bp, Homo sapiens
gctgtcagatgtcacat

SEQ ID NO: 3074739 - DNA, 15 bp, Homo sapiens
gctgtcatctgtgca

SEQ ID NO: 3074740 - DNA, 19 bp, Homo sapiens
gctgtcccaagctcccaag

SEQ ID NO: 3074741 - DNA, 22 bp, Homo sapiens
gctgtcccatctccactgttat

SEQ ID NO: 3074742 - DNA, 17 bp, Homo sapiens
ggaagtgttcctgtctc

SEQ ID NO: 3074743 - DNA, 18 bp, Homo sapiens
ggaagtgttcctgtctca

SEQ ID NO: 3074744 - DNA, 12 bp, Homo sapiens
ggaatacttttt

SEQ ID NO: 3074745 - DNA, 14 bp, Homo sapiens
ggaatatgcattgt

SEQ ID NO: 3074746 - DNA, 21 bp, Homo sapiens
ggaatatgcattgtctgcaat

SEQ ID NO: 3074747 - DNA, 23 bp, Homo sapiens
ggaatatgcattgtctgcaatgg

SEQ ID NO: 3074748 - DNA, 12 bp, Homo sapiens
ggaatcaagatt

SEQ ID NO: 3074749 - DNA, 23 bp, Homo sapiens
ggaatcagacttcacactgcaag

SEQ ID NO: 3074750 - DNA, 13 bp, Homo sapiens
ggaatcagcttct

SEQ ID NO: 3074751 - DNA, 23 bp, Homo sapiens
ggaatctcccagacttgtttcct

SEQ ID NO: 3074752 - DNA, 13 bp, Homo sapiens
ggaatctgccttc

SEQ ID NO: 3074753 - DNA, 18 bp, Homo sapiens
ggaatgaaaaaagcttta

SEQ ID NO: 3074754 - DNA, 18 bp, Homo sapiens
ggaatgaagcttgtgtat

SEQ ID NO: 3074755 - DNA, 20 bp, Homo sapiens
ggaatgagaagtagccacag

SEQ ID NO: 3074756 - DNA, 14 bp, Homo sapiens
ggaatgagggaggc

SEQ ID NO: 3074757 - DNA, 18 bp, Homo sapiens
ggaatgatatgcatttga

SEQ ID NO: 3074758 - DNA, 22 bp, Homo sapiens
ggaatgcacacagcggctgcct

SEQ ID NO: 3074759 - DNA, 23 bp, Homo sapiens
ggaatgcacacagcggctgcctc

SEQ ID NO: 3074760 - DNA, 13 bp, Homo sapiens
ggaatgtcagtgt

SEQ ID NO: 3074761 - DNA, 14 bp, Homo sapiens
ggaatgtgtgcctt

SEQ ID NO: 3074762 - DNA, 19 bp, Homo sapiens
ggaattagcttggggccag

SEQ ID NO: 3074763 - DNA, 20 bp, Homo sapiens
ggaattagcttggggccagg

SEQ ID NO: 3074764 - DNA, 10 bp, Homo sapiens
ggaattgaaa

SEQ ID NO: 3074765 - DNA, 19 bp, Homo sapiens
ggaattgacattctctatt

SEQ ID NO: 3074766 - DNA, 23 bp, Homo sapiens
ggaattgggtggggggcttcata

SEQ ID NO: 3074767 - DNA, 18 bp, Homo sapiens
ggaatttaaaattaagta

SEQ ID NO: 3074768 - DNA, 13 bp, Homo sapiens
ggaatttgtcagc

SEQ ID NO: 3074769 - DNA, 16 bp, Homo sapiens
ggacaaaagggccagg

SEQ ID NO: 3074770 - DNA, 22 bp, Homo sapiens
ggacaagagggttcacacagcc

SEQ ID NO: 3074771 - DNA, 16 bp, Homo sapiens
ggacaagggaggcagt

SEQ ID NO: 3074772 - DNA, 21 bp, Homo sapiens
ggacacacatggtgagcctag

SEQ ID NO: 3074773 - DNA, 18 bp, Homo sapiens
ggacacacctctgctcca

SEQ ID NO: 3074774 - DNA, 18 bp, Homo sapiens
ggacacaggcctgctctc

SEQ ID NO: 3074775 - DNA, 20 bp, Homo sapiens
ggacacagtttctattgtaa

SEQ ID NO: 3074776 - DNA, 18 bp, Homo sapiens
ggacaccactgagctctg

SEQ ID NO: 3074777 - DNA, 15 bp, Homo sapiens
ggacacccagggtct

SEQ ID NO: 3074778 - DNA, 15 bp, Homo sapiens
ggacaccgtggcctg

SEQ ID NO: 3074779 - DNA, 18 bp, Homo sapiens
ggacaccgtggggaaggg

SEQ ID NO: 3074780 - DNA, 19 bp, Homo sapiens
ggacaccgtggggaagggg

SEQ ID NO: 3074781 - DNA, 16 bp, Homo sapiens
ggacacctaggctagg

SEQ ID NO: 3074782 - DNA, 21 bp, Homo sapiens
ggacacctcaaatacatacct

SEQ ID NO: 3074783 - DNA, 13 bp, Homo sapiens
ggacactgtgaca

SEQ ID NO: 3074784 - DNA, 22 bp, Homo sapiens
ggacagaaaggagagtggccat

SEQ ID NO: 3074785 - DNA, 14 bp, Homo sapiens
ggacagaagcagct

SEQ ID NO: 3074786 - DNA, 15 bp, Homo sapiens
ggacagaagcagctc

SEQ ID NO: 3074787 - DNA, 19 bp, Homo sapiens
ggacagactggccgggcag

SEQ ID NO: 3074788 - DNA, 23 bp, Homo sapiens
ggacagaggccccagcctccctg

SEQ ID NO: 3074789 - DNA, 15 bp, Homo sapiens
ggacagagggcacat

SEQ ID NO: 3074790 - DNA, 12 bp, Homo sapiens
ggacagagggtg

SEQ ID NO: 3074791 - DNA, 20 bp, Homo sapiens
ggacagatggacgcaggccc

SEQ ID NO: 3074792 - DNA, 14 bp, Homo sapiens
ggacagatttcagt

SEQ ID NO: 3074793 - DNA, 12 bp, Homo sapiens
ggacagccttca

SEQ ID NO: 3074794 - DNA, 11 bp, Homo sapiens
ggacagctgtc

SEQ ID NO: 3074795 - DNA, 17 bp, Homo sapiens
ggacaggatgtgtttgc

SEQ ID NO: 3074796 - DNA, 18 bp, Homo sapiens
ggacaggatgtgtttgct

SEQ ID NO: 3074797 - DNA, 20 bp, Homo sapiens
ggacaggatgtgtttgcttt

SEQ ID NO: 3074798 - DNA, 11 bp, Homo sapiens
ggacaggcccg

SEQ ID NO: 3074799 - DNA, 22 bp, Homo sapiens
ggacaggctggaatgagggagg

SEQ ID NO: 3074800 - DNA, 16 bp, Homo sapiens
ggacaggtctctgaga

SEQ ID NO: 3074801 - DNA, 19 bp, Homo sapiens
ggacaggtctctgagacag

SEQ ID NO: 3074802 - DNA, 20 bp, Homo sapiens
ggacagtaataagaatggaa

SEQ ID NO: 3074803 - DNA, 16 bp, Homo sapiens
ggacagtgtgggcgct

SEQ ID NO: 3074804 - DNA, 22 bp, Homo sapiens
ggacagttagcatttaccaaca

SEQ ID NO: 3074805 - DNA, 19 bp, Homo sapiens
ggacagttgtttggagaac

SEQ ID NO: 3074806 - DNA, 21 bp, Homo sapiens
ggacagtttgtttcctgtctg

SEQ ID NO: 3074807 - DNA, 21 bp, Homo sapiens
ggacataagataaaatgatgt

SEQ ID NO: 3074808 - DNA, 19 bp, Homo sapiens
ggacataatggggtcctgg

SEQ ID NO: 3074809 - DNA, 23 bp, Homo sapiens
ggacataatggggtcctggccat

SEQ ID NO: 3074810 - DNA, 15 bp, Homo sapiens
ggacatagagaggga

SEQ ID NO: 3074811 - DNA, 14 bp, Homo sapiens
ggacatcagctggt

SEQ ID NO: 3074812 - DNA, 17 bp, Homo sapiens
ggacatgctaaataact

SEQ ID NO: 3074813 - DNA, 16 bp, Homo sapiens
ggacatggtctgtcct

SEQ ID NO: 3074814 - DNA, 19 bp, Homo sapiens
ggacattttctctttaaaa

SEQ ID NO: 3074815 - DNA, 15 bp, Homo sapiens
ggaccaaagggggag

SEQ ID NO: 3074816 - DNA, 20 bp, Homo sapiens
ggaccaaattgcttctagga

SEQ ID NO: 3074817 - DNA, 17 bp, Homo sapiens
ggaccactgggcccctc

SEQ ID NO: 3074818 - DNA, 16 bp, Homo sapiens
ggaccagctcaggaca

SEQ ID NO: 3074819 - DNA, 12 bp, Homo sapiens
ggaccagggcct

SEQ ID NO: 3074820 - DNA, 17 bp, Homo sapiens
ggaccagggtggagctg

SEQ ID NO: 3074821 - DNA, 23 bp, Homo sapiens
ggaccaggtcctgctccgctgcc

SEQ ID NO: 3074822 - DNA, 19 bp, Homo sapiens
ggaccagtcaacctgggca

SEQ ID NO: 3074823 - DNA, 12 bp, Homo sapiens
ggaccagtgaag

SEQ ID NO: 3074824 - DNA, 17 bp, Homo sapiens
ggaccatcatcctactg

SEQ ID NO: 3074825 - DNA, 17 bp, Homo sapiens
ggacccaaagcaggatg

SEQ ID NO: 3074826 - DNA, 19 bp, Homo sapiens
ggacccaaggaaaactgca

SEQ ID NO: 3074827 - DNA, 19 bp, Homo sapiens
ggacccaatgtaggagctg

SEQ ID NO: 3074828 - DNA, 16 bp, Homo sapiens
ggacccagggaacagc

SEQ ID NO: 3074829 - DNA, 13 bp, Homo sapiens
ggacccagtgcag

SEQ ID NO: 3074830 - DNA, 13 bp, Homo sapiens
ggaccccacccct

SEQ ID NO: 3074831 - DNA, 16 bp, Homo sapiens
ggaccccacccctcat

SEQ ID NO: 3074832 - DNA, 14 bp, Homo sapiens
ggacccccgccccc

SEQ ID NO: 3074833 - DNA, 15 bp, Homo sapiens
ggacccccgccccct

SEQ ID NO: 3074834 - DNA, 16 bp, Homo sapiens
ggacccccgccccctg

SEQ ID NO: 3074835 - DNA, 22 bp, Homo sapiens
ggacccccgccccctgccctcc

SEQ ID NO: 3074836 - DNA, 16 bp, Homo sapiens
ggacccccgtggggca

SEQ ID NO: 3074837 - DNA, 13 bp, Homo sapiens
ggaccccctgccc

SEQ ID NO: 3074838 - DNA, 15 bp, Homo sapiens
ggaccccgagcctgg

SEQ ID NO: 3074839 - DNA, 21 bp, Homo sapiens
ggaccccgagcctggctccaa

SEQ ID NO: 3074840 - DNA, 13 bp, Homo sapiens
ggacccctgccct

SEQ ID NO: 3074841 - DNA, 18 bp, Homo sapiens
ggacccctggtggttcac

SEQ ID NO: 3074842 - DNA, 19 bp, Homo sapiens
ggacccggggtctcctgga

SEQ ID NO: 3074843 - DNA, 11 bp, Homo sapiens
ggaccctgctt

SEQ ID NO: 3074844 - DNA, 21 bp, Homo sapiens
ggaccctgctttagagctagg

SEQ ID NO: 3074845 - DNA, 16 bp, Homo sapiens
ggaccctttccttcct

SEQ ID NO: 3074846 - DNA, 22 bp, Homo sapiens
ggaccctttccttccttccctg

SEQ ID NO: 3074847 - DNA, 15 bp, Homo sapiens
ggaccgccatggtgc

SEQ ID NO: 3074848 - DNA, 20 bp, Homo sapiens
ggaccgggtggaagggatgg

SEQ ID NO: 3074849 - DNA, 23 bp, Homo sapiens
ggaccgtgccattgtactccagc

SEQ ID NO: 3074850 - DNA, 16 bp, Homo sapiens
ggacctagggtggcct

SEQ ID NO: 3074851 - DNA, 18 bp, Homo sapiens
ggacctcatccaaacaat

SEQ ID NO: 3074852 - DNA, 12 bp, Homo sapiens
ggacctctccca

SEQ ID NO: 3074853 - DNA, 15 bp, Homo sapiens
ggacctgatggagag

SEQ ID NO: 3074854 - DNA, 22 bp, Homo sapiens
ggacctgccctccctcagccgt

SEQ ID NO: 3074855 - DNA, 15 bp, Homo sapiens
ggacctgcctgtagc

SEQ ID NO: 3074856 - DNA, 19 bp, Homo sapiens
ggacctgcggtacaggagt

SEQ ID NO: 3074857 - DNA, 17 bp, Homo sapiens
ggacctggtgctgcctc

SEQ ID NO: 3074858 - DNA, 17 bp, Homo sapiens
ggaccttgacagagcag

SEQ ID NO: 3074859 - DNA, 13 bp, Homo sapiens
ggaccttggtctg

SEQ ID NO: 3074860 - DNA, 22 bp, Homo sapiens
ggacgaatgcatattcaacaca

SEQ ID NO: 3074861 - DNA, 22 bp, Homo sapiens
ggacgcagcaggaggccaggcc

SEQ ID NO: 3074862 - DNA, 17 bp, Homo sapiens
ggacgcaggcccctctc

SEQ ID NO: 3074863 - DNA, 16 bp, Homo sapiens
ggacgcaggccctgtc

SEQ ID NO: 3074864 - DNA, 16 bp, Homo sapiens
ggacgcaggtgctgcg

SEQ ID NO: 3074865 - DNA, 16 bp, Homo sapiens
ggacgcggaacctggg

SEQ ID NO: 3074866 - DNA, 12 bp, Homo sapiens
ggacggccaaga

SEQ ID NO: 3074867 - DNA, 15 bp, Homo sapiens
ggacggctgggcaca

SEQ ID NO: 3074868 - DNA, 15 bp, Homo sapiens
ggacggtcagtttgg

SEQ ID NO: 3074869 - DNA, 15 bp, Homo sapiens
ggacgtaaaatttac

SEQ ID NO: 3074870 - DNA, 17 bp, Homo sapiens
ggacgtcagacttggct

SEQ ID NO: 3074871 - DNA, 21 bp, Homo sapiens
ggacgtgctggccttggtatg

SEQ ID NO: 3074872 - DNA, 19 bp, Homo sapiens
ggacgtggctcagccagca

SEQ ID NO: 3074873 - DNA, 12 bp, Homo sapiens
ggacgtttctca

SEQ ID NO: 3074874 - DNA, 20 bp, Homo sapiens
ggactaatccaatacctctt

SEQ ID NO: 3074875 - DNA, 22 bp, Homo sapiens
ggccctgcaaaaggactctcag

SEQ ID NO: 3074876 - DNA, 12 bp, Homo sapiens
ggccctgcagga

SEQ ID NO: 3074877 - DNA, 14 bp, Homo sapiens
ggccctgcaggagc

SEQ ID NO: 3074878 - DNA, 20 bp, Homo sapiens
ggccctgcaggagcagggcg

SEQ ID NO: 3074879 - DNA, 24 bp, Homo sapiens
ggccctgcaggctgcaggagggca

SEQ ID NO: 3074880 - DNA, 11 bp, Homo sapiens
ggccctgcccc

SEQ ID NO: 3074881 - DNA, 15 bp, Homo sapiens
ggccctgcccctccc

SEQ ID NO: 3074882 - DNA, 17 bp, Homo sapiens
ggccctgcccctcccta

SEQ ID NO: 3074883 - DNA, 17 bp, Homo sapiens
ggccctgctgcccctcc

SEQ ID NO: 3074884 - DNA, 15 bp, Homo sapiens
ggccctggagggcag

SEQ ID NO: 3074885 - DNA, 20 bp, Homo sapiens
ggccctggagggcagagaca

SEQ ID NO: 3074886 - DNA, 12 bp, Homo sapiens
ggccctggcctg

SEQ ID NO: 3074887 - DNA, 21 bp, Homo sapiens
ggccctggcgggtggctgcaa

SEQ ID NO: 3074888 - DNA, 11 bp, Homo sapiens
ggccctggggc

SEQ ID NO: 3074889 - DNA, 22 bp, Homo sapiens
ggccctggggtgtgtctcggtg

SEQ ID NO: 3074890 - DNA, 17 bp, Homo sapiens
ggccctggttcctgctg

SEQ ID NO: 3074891 - DNA, 22 bp, Homo sapiens
ggccctggttcctgctgtcctg

SEQ ID NO: 3074892 - DNA, 15 bp, Homo sapiens
ggccctgtccagccc

SEQ ID NO: 3074893 - DNA, 12 bp, Homo sapiens
ggccctgtcccc

SEQ ID NO: 3074894 - DNA, 15 bp, Homo sapiens
ggccctgtcccctgg

SEQ ID NO: 3074895 - DNA, 17 bp, Homo sapiens
ggccctgtcccctggag

SEQ ID NO: 3074896 - DNA, 18 bp, Homo sapiens
ggccctgtcccctggagt

SEQ ID NO: 3074897 - DNA, 16 bp, Homo sapiens
ggccctgtgcagacct

SEQ ID NO: 3074898 - DNA, 13 bp, Homo sapiens
ggccctgtggagt

SEQ ID NO: 3074899 - DNA, 15 bp, Homo sapiens
ggccctgtggcagga

SEQ ID NO: 3074900 - DNA, 19 bp, Homo sapiens
ggccctgttctcctcccca

SEQ ID NO: 3074901 - DNA, 14 bp, Homo sapiens
ggcccttcccctcc

SEQ ID NO: 3074902 - DNA, 21 bp, Homo sapiens
ggcccttcctcctccaccacc

SEQ ID NO: 3074903 - DNA, 16 bp, Homo sapiens
ggcccttcctctttgg

SEQ ID NO: 3074904 - DNA, 13 bp, Homo sapiens
ggcccttggggtg

SEQ ID NO: 3074905 - DNA, 14 bp, Homo sapiens
ggcccttggtgggg

SEQ ID NO: 3074906 - DNA, 14 bp, Homo sapiens
ggccctttccacga

SEQ ID NO: 3074907 - DNA, 21 bp, Homo sapiens
ggccgacaccactcctgccag

SEQ ID NO: 3074908 - DNA, 21 bp, Homo sapiens
ggccgacagtcggtgacccca

SEQ ID NO: 3074909 - DNA, 14 bp, Homo sapiens
ggccgacggagccg

SEQ ID NO: 3074910 - DNA, 23 bp, Homo sapiens
ggccgagctggtttcctgcccag

SEQ ID NO: 3074911 - DNA, 16 bp, Homo sapiens
ggccgcaagggcctgg

SEQ ID NO: 3074912 - DNA, 17 bp, Homo sapiens
ggccgcacgcctctccc

SEQ ID NO: 3074913 - DNA, 13 bp, Homo sapiens
ggccgccatctgc

SEQ ID NO: 3074914 - DNA, 21 bp, Homo sapiens
ggccgccatctgcgcagggtg

SEQ ID NO: 3074915 - DNA, 22 bp, Homo sapiens
ggccgccatctgcgcagggtgg

SEQ ID NO: 3074916 - DNA, 21 bp, Homo sapiens
ggccgcccctgaggcttcacg

SEQ ID NO: 3074917 - DNA, 12 bp, Homo sapiens
ggccgcctgcct

SEQ ID NO: 3074918 - DNA, 16 bp, Homo sapiens
ggccgcgccctttccc

SEQ ID NO: 3074919 - DNA, 18 bp, Homo sapiens
ggccgcgcgtccagctgc

SEQ ID NO: 3074920 - DNA, 19 bp, Homo sapiens
ggccgcggcctccccgagg

SEQ ID NO: 3074921 - DNA, 16 bp, Homo sapiens
ggccgcgtgccgggcc

SEQ ID NO: 3074922 - DNA, 16 bp, Homo sapiens
ggccgctccaccagca

SEQ ID NO: 3074923 - DNA, 19 bp, Homo sapiens
ggccgctccaccagcatca

SEQ ID NO: 3074924 - DNA, 18 bp, Homo sapiens
ggccgctcgatgcctttg

SEQ ID NO: 3074925 - DNA, 12 bp, Homo sapiens
ggccgctgccac

SEQ ID NO: 3074926 - DNA, 13 bp, Homo sapiens
ggccgctgccacc

SEQ ID NO: 3074927 - DNA, 15 bp, Homo sapiens
ggccgctgccaccca

SEQ ID NO: 3074928 - DNA, 19 bp, Homo sapiens
ggccgctgccacccacctc

SEQ ID NO: 3074929 - DNA, 16 bp, Homo sapiens
ggccgctgttcaccca

SEQ ID NO: 3074930 - DNA, 12 bp, Homo sapiens
ggccggccagcc

SEQ ID NO: 3074931 - DNA, 15 bp, Homo sapiens
ggccggccagccagc

SEQ ID NO: 3074932 - DNA, 14 bp, Homo sapiens
ggccggccctgccc

SEQ ID NO: 3074933 - DNA, 16 bp, Homo sapiens
ggccggccctgcccct

SEQ ID NO: 3074934 - DNA, 22 bp, Homo sapiens
ggccgggaccccgagcctggct

SEQ ID NO: 3074935 - DNA, 12 bp, Homo sapiens
ggccgggcacag

SEQ ID NO: 3074936 - DNA, 15 bp, Homo sapiens
ggccgggcacagtgg

SEQ ID NO: 3074937 - DNA, 17 bp, Homo sapiens
ggccgggcacagtggct

SEQ ID NO: 3074938 - DNA, 19 bp, Homo sapiens
ggccgggcaggcgtgactc

SEQ ID NO: 3074939 - DNA, 23 bp, Homo sapiens
ggccgtctcccttggcccagaga

SEQ ID NO: 3074940 - DNA, 16 bp, Homo sapiens
ggccgtggcttgggct

SEQ ID NO: 3074941 - DNA, 19 bp, Homo sapiens
ggccgtggcttgggctggt

SEQ ID NO: 3074942 - DNA, 21 bp, Homo sapiens
ggccgtgtgtttagaagccta

SEQ ID NO: 3074943 - DNA, 23 bp, Homo sapiens
ggcctacagctttgatccctgac

SEQ ID NO: 3074944 - DNA, 22 bp, Homo sapiens
ggcctaccttgtgagggagaga

SEQ ID NO: 3074945 - DNA, 16 bp, Homo sapiens
ggcctagagcactctc

SEQ ID NO: 3074946 - DNA, 20 bp, Homo sapiens
ggcctagctgctacaaagaa

SEQ ID NO: 3074947 - DNA, 16 bp, Homo sapiens
ggcctaggctaggacg

SEQ ID NO: 3074948 - DNA, 18 bp, Homo sapiens
ggcctcaagccatcttcc

SEQ ID NO: 3074949 - DNA, 12 bp, Homo sapiens
ggcctcacccac

SEQ ID NO: 3074950 - DNA, 17 bp, Homo sapiens
ggcctcacccacccctg

SEQ ID NO: 3074951 - DNA, 11 bp, Homo sapiens
ggcctcagact

SEQ ID NO: 3074952 - DNA, 20 bp, Homo sapiens
ggcctcagccagagaagcta

SEQ ID NO: 3074953 - DNA, 11 bp, Homo sapiens
ggcctcagggt

SEQ ID NO: 3074954 - DNA, 19 bp, Homo sapiens
ggcctcagggtctaaggag

SEQ ID NO: 3074955 - DNA, 13 bp, Homo sapiens
ggcctccagctca

SEQ ID NO: 3074956 - DNA, 15 bp, Homo sapiens
ggcctccagctcagc

SEQ ID NO: 3074957 - DNA, 16 bp, Homo sapiens
ggcctccagctcagca

SEQ ID NO: 3074958 - DNA, 17 bp, Homo sapiens
ggcctccaggcccgtct

SEQ ID NO: 3074959 - DNA, 19 bp, Homo sapiens
ggcctccaggcccgtctgt

SEQ ID NO: 3074960 - DNA, 22 bp, Homo sapiens
ggcctccaggcccgtctgtcca

SEQ ID NO: 3074961 - DNA, 23 bp, Homo sapiens
ggcctccaggcccgtctgtccat

SEQ ID NO: 3074962 - DNA, 13 bp, Homo sapiens
ggcctcccaaagt

SEQ ID NO: 3074963 - DNA, 16 bp, Homo sapiens
ggcctcccaaagtgct

SEQ ID NO: 3074964 - DNA, 14 bp, Homo sapiens
ggcctcccacagac

SEQ ID NO: 3074965 - DNA, 16 bp, Homo sapiens
ggcctcccacagactc

SEQ ID NO: 3074966 - DNA, 11 bp, Homo sapiens
ggcctccctcc

SEQ ID NO: 3074967 - DNA, 21 bp, Homo sapiens
ggcctccctccgtccctctgt

SEQ ID NO: 3074968 - DNA, 16 bp, Homo sapiens
ggcctccttgcttgtt

SEQ ID NO: 3074969 - DNA, 17 bp, Homo sapiens
ggcctccttgcttgtta

SEQ ID NO: 3074970 - DNA, 20 bp, Homo sapiens
ggcctcgcacttgcagagga

SEQ ID NO: 3074971 - DNA, 19 bp, Homo sapiens
ggcctcgcctgccctcctc

SEQ ID NO: 3074972 - DNA, 20 bp, Homo sapiens
ggcctcgcctgccctcctct

SEQ ID NO: 3074973 - DNA, 17 bp, Homo sapiens
ggcctcggaggctcctc

SEQ ID NO: 3074974 - DNA, 22 bp, Homo sapiens
ggcctcggaggctcctccctct

SEQ ID NO: 3074975 - DNA, 13 bp, Homo sapiens
ggcctcggcagaa

SEQ ID NO: 3074976 - DNA, 23 bp, Homo sapiens
ggcctctcacctctgtgcctctg

SEQ ID NO: 3074977 - DNA, 17 bp, Homo sapiens
ggcctctctcaggagca

SEQ ID NO: 3074978 - DNA, 16 bp, Homo sapiens
ggcctctgcctgggac

SEQ ID NO: 3074979 - DNA, 13 bp, Homo sapiens
ggcctctgctggt

SEQ ID NO: 3074980 - DNA, 19 bp, Homo sapiens
ggcctcttggcacctgcct

SEQ ID NO: 3074981 - DNA, 23 bp, Homo sapiens
ggcctctttgtctaaaacaataa

SEQ ID NO: 3074982 - DNA, 22 bp, Homo sapiens
ggcctgaaaggagcccttatct

SEQ ID NO: 3074983 - DNA, 20 bp, Homo sapiens
ggcctgaacagatgtaaatc

SEQ ID NO: 3074984 - DNA, 20 bp, Homo sapiens
ggcctgaccaaacagccaac

SEQ ID NO: 3074985 - DNA, 14 bp, Homo sapiens
ggcctgacctccag

SEQ ID NO: 3074986 - DNA, 22 bp, Homo sapiens
ggcctgacctccagtcctgctg

SEQ ID NO: 3074987 - DNA, 23 bp, Homo sapiens
ggcctgacctccagtcctgctgg

SEQ ID NO: 3074988 - DNA, 15 bp, Homo sapiens
ggcctgagacccagg

SEQ ID NO: 3074989 - DNA, 18 bp, Homo sapiens
ggcctgagacccaggact

SEQ ID NO: 3074990 - DNA, 16 bp, Homo sapiens
ggcctgagcctggcca

SEQ ID NO: 3074991 - DNA, 18 bp, Homo sapiens
ggcctgatcagaccacgg

SEQ ID NO: 3074992 - DNA, 21 bp, Homo sapiens
ggcctgatgagactccactca

SEQ ID NO: 3074993 - DNA, 22 bp, Homo sapiens
ggcctgatgagactccactcag

SEQ ID NO: 3074994 - DNA, 19 bp, Homo sapiens
ggcctgcaccgaccccggg

SEQ ID NO: 3074995 - DNA, 21 bp, Homo sapiens
ggcctgcaggacctgcctgta

SEQ ID NO: 3074996 - DNA, 13 bp, Homo sapiens
ggcctgcccagcc

SEQ ID NO: 3074997 - DNA, 14 bp, Homo sapiens
ggcctgcccagcct

SEQ ID NO: 3074998 - DNA, 15 bp, Homo sapiens
ggcctgcccagcctc

SEQ ID NO: 3074999 - DNA, 11 bp, Homo sapiens
ggcctgccctg

SEQ ID NO: 3075000 - DNA, 18 bp, Homo sapiens
ggcctgccggacacagca

SEQ ID NO: 3075001 - DNA, 16 bp, Homo sapiens
ggcctgccttctcagg

SEQ ID NO: 3075002 - DNA, 16 bp, Homo sapiens
ggcctgcgaccctggg

SEQ ID NO: 3075003 - DNA, 13 bp, Homo sapiens
ggcctgctccaga

SEQ ID NO: 3075004 - DNA, 15 bp, Homo sapiens
ggcctgctccagacc

SEQ ID NO: 3075005 - DNA, 17 bp, Homo sapiens
ggcctgctccagacctg

SEQ ID NO: 3075006 - DNA, 18 bp, Homo sapiens
ggcctgctccagacctga

SEQ ID NO: 3075007 - DNA, 22 bp, Homo sapiens
ggcctgctgggctctccacctc

SEQ ID NO: 3075008 - DNA, 16 bp, Homo sapiens
gggagtttagggtggg

SEQ ID NO: 3075009 - DNA, 22 bp, Homo sapiens
gggatacaggcccctgggtttc

SEQ ID NO: 3075010 - DNA, 13 bp, Homo sapiens
gggatcatgaaag

SEQ ID NO: 3075011 - DNA, 22 bp, Homo sapiens
gggatccaatatgactcagaga

SEQ ID NO: 3075012 - DNA, 18 bp, Homo sapiens
gggatcccacagccctag

SEQ ID NO: 3075013 - DNA, 19 bp, Homo sapiens
gggatccctgtctttccta

SEQ ID NO: 3075014 - DNA, 19 bp, Homo sapiens
gggatctggtcctacccat

SEQ ID NO: 3075015 - DNA, 19 bp, Homo sapiens
gggatgctatttcagccaa

SEQ ID NO: 3075016 - DNA, 20 bp, Homo sapiens
gggatgctatttcagccaat

SEQ ID NO: 3075017 - DNA, 19 bp, Homo sapiens
gggatggacgatctcccac

SEQ ID NO: 3075018 - DNA, 15 bp, Homo sapiens
gggattacccaagca

SEQ ID NO: 3075019 - DNA, 18 bp, Homo sapiens
gggatttttttgttcttg

SEQ ID NO: 3075020 - DNA, 20 bp, Homo sapiens
gggatttttttgttcttgtt

SEQ ID NO: 3075021 - DNA, 14 bp, Homo sapiens
gggcaaagcctagt

SEQ ID NO: 3075022 - DNA, 20 bp, Homo sapiens
gggcaacaaagtgagactcc

SEQ ID NO: 3075023 - DNA, 13 bp, Homo sapiens
gggcaagaccttt

SEQ ID NO: 3075024 - DNA, 12 bp, Homo sapiens
gggcaagaggga

SEQ ID NO: 3075025 - DNA, 18 bp, Homo sapiens
gggcaagtgagaggggag

SEQ ID NO: 3075026 - DNA, 23 bp, Homo sapiens
gggcaagtgagaggggagggagg

SEQ ID NO: 3075027 - DNA, 14 bp, Homo sapiens
gggcaatttagaaa

SEQ ID NO: 3075028 - DNA, 15 bp, Homo sapiens
gggcacaaagggccc

SEQ ID NO: 3075029 - DNA, 17 bp, Homo sapiens
gggcacaaagggcccag

SEQ ID NO: 3075030 - DNA, 15 bp, Homo sapiens
gggcacacgcctccc

SEQ ID NO: 3075031 - DNA, 17 bp, Homo sapiens
gggcacagccagcccaa

SEQ ID NO: 3075032 - DNA, 19 bp, Homo sapiens
gggcacctgcgcacaggtg

SEQ ID NO: 3075033 - DNA, 23 bp, Homo sapiens
gggcacggcaggcgtgtggcagc

SEQ ID NO: 3075034 - DNA, 21 bp, Homo sapiens
gggcacgtgtgggccgtggct

SEQ ID NO: 3075035 - DNA, 21 bp, Homo sapiens
gggcactcccgggatgggtgg

SEQ ID NO: 3075036 - DNA, 22 bp, Homo sapiens
gggcactgggcgtctgactccc

SEQ ID NO: 3075037 - DNA, 18 bp, Homo sapiens
gggcagaatcctgggccc

SEQ ID NO: 3075038 - DNA, 14 bp, Homo sapiens
gggcagaggctgga

SEQ ID NO: 3075039 - DNA, 23 bp, Homo sapiens
gggcagaggctggaggcagggcc

SEQ ID NO: 3075040 - DNA, 14 bp, Homo sapiens
gggcagagggcaga

SEQ ID NO: 3075041 - DNA, 13 bp, Homo sapiens
gggcagagggctg

SEQ ID NO: 3075042 - DNA, 16 bp, Homo sapiens
gggcagagggctggag

SEQ ID NO: 3075043 - DNA, 20 bp, Homo sapiens
gggcagatcttggactcatg

SEQ ID NO: 3075044 - DNA, 22 bp, Homo sapiens
gggcagatcttggactcatgag

SEQ ID NO: 3075045 - DNA, 19 bp, Homo sapiens
gggcagcactgggaagctg

SEQ ID NO: 3075046 - DNA, 21 bp, Homo sapiens
gggcagcactgggaagctgga

SEQ ID NO: 3075047 - DNA, 18 bp, Homo sapiens
gggcagcagcatcccagc

SEQ ID NO: 3075048 - DNA, 21 bp, Homo sapiens
gggcagcagcatcccagcctt

SEQ ID NO: 3075049 - DNA, 22 bp, Homo sapiens
gggcagcagcatcccagccttg

SEQ ID NO: 3075050 - DNA, 23 bp, Homo sapiens
gggcagcagcatcccagccttga

SEQ ID NO: 3075051 - DNA, 19 bp, Homo sapiens
gggcagcagttgaggtggg

SEQ ID NO: 3075052 - DNA, 14 bp, Homo sapiens
gggcagcccctgca

SEQ ID NO: 3075053 - DNA, 15 bp, Homo sapiens
gggcagcccctgcag

SEQ ID NO: 3075054 - DNA, 18 bp, Homo sapiens
gggcagccctccttacca

SEQ ID NO: 3075055 - DNA, 23 bp, Homo sapiens
gggcagccttgggggggctgcct

SEQ ID NO: 3075056 - DNA, 11 bp, Homo sapiens
gggcagggagc

SEQ ID NO: 3075057 - DNA, 14 bp, Homo sapiens
gggcagggcccctg

SEQ ID NO: 3075058 - DNA, 22 bp, Homo sapiens
gggcaggggagccagggtagag

SEQ ID NO: 3075059 - DNA, 17 bp, Homo sapiens
gggcagggtctctgctc

SEQ ID NO: 3075060 - DNA, 19 bp, Homo sapiens
gggcagggtctctgctcca

SEQ ID NO: 3075061 - DNA, 22 bp, Homo sapiens
gggcaggtcctagtcgggcagg

SEQ ID NO: 3075062 - DNA, 21 bp, Homo sapiens
gggcaggtggccgcccctgag

SEQ ID NO: 3075063 - DNA, 16 bp, Homo sapiens
gggcaggtgggagctg

SEQ ID NO: 3075064 - DNA, 16 bp, Homo sapiens
gggcagtcgctgcagg

SEQ ID NO: 3075065 - DNA, 20 bp, Homo sapiens
gggcagtctgagagaggcca

SEQ ID NO: 3075066 - DNA, 20 bp, Homo sapiens
gggcatgacccagtgaagat

SEQ ID NO: 3075067 - DNA, 21 bp, Homo sapiens
gggcatttcttgcgagcctcg

SEQ ID NO: 3075068 - DNA, 20 bp, Homo sapiens
gggccaccaggatcagccag

SEQ ID NO: 3075069 - DNA, 16 bp, Homo sapiens
gggccacgctccagct

SEQ ID NO: 3075070 - DNA, 18 bp, Homo sapiens
gggccacgtgccaggccc

SEQ ID NO: 3075071 - DNA, 19 bp, Homo sapiens
gggccacgtgccaggcccg

SEQ ID NO: 3075072 - DNA, 11 bp, Homo sapiens
gggccagagcc

SEQ ID NO: 3075073 - DNA, 12 bp, Homo sapiens
gggccagagcca

SEQ ID NO: 3075074 - DNA, 15 bp, Homo sapiens
gggccagagccaggg

SEQ ID NO: 3075075 - DNA, 17 bp, Homo sapiens
gggccagatccagcctg

SEQ ID NO: 3075076 - DNA, 18 bp, Homo sapiens
gggccagcaggcagcgcc

SEQ ID NO: 3075077 - DNA, 13 bp, Homo sapiens
gggccagcccctc

SEQ ID NO: 3075078 - DNA, 16 bp, Homo sapiens
gggccagcccctccat

SEQ ID NO: 3075079 - DNA, 22 bp, Homo sapiens
gggccaggaaggacagactggc

SEQ ID NO: 3075080 - DNA, 17 bp, Homo sapiens
gggccaggacaggcccg

SEQ ID NO: 3075081 - DNA, 22 bp, Homo sapiens
gggccaggccctggagggcaga

SEQ ID NO: 3075082 - DNA, 11 bp, Homo sapiens
gggccaggcct

SEQ ID NO: 3075083 - DNA, 12 bp, Homo sapiens
gggccaggtgcg

SEQ ID NO: 3075084 - DNA, 16 bp, Homo sapiens
gggccaggtgcggcct

SEQ ID NO: 3075085 - DNA, 17 bp, Homo sapiens
gggccaggtgcggcctg

SEQ ID NO: 3075086 - DNA, 21 bp, Homo sapiens
gggccaggtgcggcctggggg

SEQ ID NO: 3075087 - DNA, 22 bp, Homo sapiens
gggccatgatggcaacagatct

SEQ ID NO: 3075088 - DNA, 23 bp, Homo sapiens
gggccatgatggcaacagatctg

SEQ ID NO: 3075089 - DNA, 19 bp, Homo sapiens
gggccatggctcagggtgg

SEQ ID NO: 3075090 - DNA, 22 bp, Homo sapiens
gggccatggctttcatcctgtg

SEQ ID NO: 3075091 - DNA, 15 bp, Homo sapiens
gggccatgggtcctc

SEQ ID NO: 3075092 - DNA, 12 bp, Homo sapiens
gggcccacagcc

SEQ ID NO: 3075093 - DNA, 11 bp, Homo sapiens
gggcccagagc

SEQ ID NO: 3075094 - DNA, 23 bp, Homo sapiens
gggcccagcgctctcctggacgc

SEQ ID NO: 3075095 - DNA, 14 bp, Homo sapiens
gggcccatggagga

SEQ ID NO: 3075096 - DNA, 15 bp, Homo sapiens
gggccccaccaccta

SEQ ID NO: 3075097 - DNA, 13 bp, Homo sapiens
gggcccccagaga

SEQ ID NO: 3075098 - DNA, 23 bp, Homo sapiens
gggcccccagagacctttgccca

SEQ ID NO: 3075099 - DNA, 14 bp, Homo sapiens
gggccccccaactg

SEQ ID NO: 3075100 - DNA, 13 bp, Homo sapiens
gggcccctgccag

SEQ ID NO: 3075101 - DNA, 17 bp, Homo sapiens
gggcccctggcccagga

SEQ ID NO: 3075102 - DNA, 14 bp, Homo sapiens
gggccctgagtctg

SEQ ID NO: 3075103 - DNA, 22 bp, Homo sapiens
gggccctgcaggctgcaggagg

SEQ ID NO: 3075104 - DNA, 22 bp, Homo sapiens
gggccctgtggagtccagctct

SEQ ID NO: 3075105 - DNA, 23 bp, Homo sapiens
gggccctgtggagtccagctcta

SEQ ID NO: 3075106 - DNA, 13 bp, Homo sapiens
gggccgaccagag

SEQ ID NO: 3075107 - DNA, 16 bp, Homo sapiens
gggccgaccctgcggc

SEQ ID NO: 3075108 - DNA, 23 bp, Homo sapiens
gggccgccgctgaccctgggcct

SEQ ID NO: 3075109 - DNA, 14 bp, Homo sapiens
gggccgcctgcctt

SEQ ID NO: 3075110 - DNA, 16 bp, Homo sapiens
gggccgcctgccttag

SEQ ID NO: 3075111 - DNA, 17 bp, Homo sapiens
gggccgcctgccttagc

SEQ ID NO: 3075112 - DNA, 17 bp, Homo sapiens
gggccgcgtgccgggcc

SEQ ID NO: 3075113 - DNA, 21 bp, Homo sapiens
gggccgcgtgccgggccccca

SEQ ID NO: 3075114 - DNA, 23 bp, Homo sapiens
gggccggctggcctggaggctca

SEQ ID NO: 3075115 - DNA, 14 bp, Homo sapiens
gggccgggcctggg

SEQ ID NO: 3075116 - DNA, 21 bp, Homo sapiens
gggcctcagtgtgcccatctg

SEQ ID NO: 3075117 - DNA, 14 bp, Homo sapiens
gggcctccagaact

SEQ ID NO: 3075118 - DNA, 21 bp, Homo sapiens
gggcctcggaggctcctccct

SEQ ID NO: 3075119 - DNA, 22 bp, Homo sapiens
gggcctcggaggctcctccctc

SEQ ID NO: 3075120 - DNA, 16 bp, Homo sapiens
gggcctctgcctggga

SEQ ID NO: 3075121 - DNA, 17 bp, Homo sapiens
gggcctctgcctgggac

SEQ ID NO: 3075122 - DNA, 15 bp, Homo sapiens
gggcctgagcctggc

SEQ ID NO: 3075123 - DNA, 16 bp, Homo sapiens
gggcctgagcctggcc

SEQ ID NO: 3075124 - DNA, 18 bp, Homo sapiens
gggcctgagcctggccag

SEQ ID NO: 3075125 - DNA, 13 bp, Homo sapiens
gggcctgctccag

SEQ ID NO: 3075126 - DNA, 12 bp, Homo sapiens
gggcctggccag

SEQ ID NO: 3075127 - DNA, 15 bp, Homo sapiens
gggcctggccagtcc

SEQ ID NO: 3075128 - DNA, 15 bp, Homo sapiens
gggcctggttgaaga

SEQ ID NO: 3075129 - DNA, 12 bp, Homo sapiens
gggcctgtacag

SEQ ID NO: 3075130 - DNA, 16 bp, Homo sapiens
gggcctgtctcagtga

SEQ ID NO: 3075131 - DNA, 18 bp, Homo sapiens
gggcctgtgtggaggcct

SEQ ID NO: 3075132 - DNA, 17 bp, Homo sapiens
gggccttagggagcccc

SEQ ID NO: 3075133 - DNA, 12 bp, Homo sapiens
gggccttgccca

SEQ ID NO: 3075134 - DNA, 18 bp, Homo sapiens
gggccttttctggcaccg

SEQ ID NO: 3075135 - DNA, 18 bp, Homo sapiens
gggcgatcgcggcggagc

SEQ ID NO: 3075136 - DNA, 22 bp, Homo sapiens
gggcgatcgcggcggagctggc

SEQ ID NO: 3075137 - DNA, 13 bp, Homo sapiens
gggcgcaaagggc

SEQ ID NO: 3075138 - DNA, 21 bp, Homo sapiens
gggcgcccagcagcctgccag

SEQ ID NO: 3075139 - DNA, 22 bp, Homo sapiens
gggcgcccagcagcctgccagc

SEQ ID NO: 3075140 - DNA, 12 bp, Homo sapiens
ggttcaggcctg

SEQ ID NO: 3075141 - DNA, 16 bp, Homo sapiens
ggttcaggcctggcgt

SEQ ID NO: 3075142 - DNA, 18 bp, Homo sapiens
ggttcatcatccctccct

SEQ ID NO: 3075143 - DNA, 16 bp, Homo sapiens
ggttcattccacagga

SEQ ID NO: 3075144 - DNA, 19 bp, Homo sapiens
ggttccacagagtaagaca

SEQ ID NO: 3075145 - DNA, 19 bp, Homo sapiens
ggttcccacaagcctgcct

SEQ ID NO: 3075146 - DNA, 21 bp, Homo sapiens
ggttccgcttggagcagaggg

SEQ ID NO: 3075147 - DNA, 17 bp, Homo sapiens
ggttcctgctgtcctgg

SEQ ID NO: 3075148 - DNA, 20 bp, Homo sapiens
ggttcctgctgtcctggtgg

SEQ ID NO: 3075149 - DNA, 22 bp, Homo sapiens
ggttcgcgcaccaggtgtcttt

SEQ ID NO: 3075150 - DNA, 19 bp, Homo sapiens
ggttcgttctgtactgtta

SEQ ID NO: 3075151 - DNA, 11 bp, Homo sapiens
ggttctaaagt

SEQ ID NO: 3075152 - DNA, 13 bp, Homo sapiens
ggttctaaagttc

SEQ ID NO: 3075153 - DNA, 22 bp, Homo sapiens
ggttctaaagttctaagattct

SEQ ID NO: 3075154 - DNA, 21 bp, Homo sapiens
ggttctgctagagcagacagg

SEQ ID NO: 3075155 - DNA, 17 bp, Homo sapiens
ggttcttgccttcccct

SEQ ID NO: 3075156 - DNA, 22 bp, Homo sapiens
ggttgaactctggtggcacagg

SEQ ID NO: 3075157 - DNA, 23 bp, Homo sapiens
ggttgagaatggaaaccacaact

SEQ ID NO: 3075158 - DNA, 13 bp, Homo sapiens
ggttgattaaggc

SEQ ID NO: 3075159 - DNA, 20 bp, Homo sapiens
ggttgattctcgactgcttt

SEQ ID NO: 3075160 - DNA, 23 bp, Homo sapiens
ggttgcagtctttcccccaggaa

SEQ ID NO: 3075161 - DNA, 21 bp, Homo sapiens
ggttgctgttttcctcccttc

SEQ ID NO: 3075162 - DNA, 18 bp, Homo sapiens
ggttggagaaggaggtaa

SEQ ID NO: 3075163 - DNA, 15 bp, Homo sapiens
ggttgggctgtgcct

SEQ ID NO: 3075164 - DNA, 18 bp, Homo sapiens
ggttgggggacagccttc

SEQ ID NO: 3075165 - DNA, 19 bp, Homo sapiens
ggttgggggacagccttca

SEQ ID NO: 3075166 - DNA, 14 bp, Homo sapiens
ggttgtattctttg

SEQ ID NO: 3075167 - DNA, 13 bp, Homo sapiens
ggttgtggggagg

SEQ ID NO: 3075168 - DNA, 13 bp, Homo sapiens
ggttgtttctctg

SEQ ID NO: 3075169 - DNA, 14 bp, Homo sapiens
ggttgtttctctga

SEQ ID NO: 3075170 - DNA, 16 bp, Homo sapiens
ggtttacaacaaacac

SEQ ID NO: 3075171 - DNA, 17 bp, Homo sapiens
ggtttacaacaaacact

SEQ ID NO: 3075172 - DNA, 14 bp, Homo sapiens
ggtttactttcaaa

SEQ ID NO: 3075173 - DNA, 22 bp, Homo sapiens
ggtttaggctggtggcccagga

SEQ ID NO: 3075174 - DNA, 22 bp, Homo sapiens
ggtttatttgttgttttctggg

SEQ ID NO: 3075175 - DNA, 20 bp, Homo sapiens
ggtttcaaagatgctgtgag

SEQ ID NO: 3075176 - DNA, 12 bp, Homo sapiens
ggtttcaattta

SEQ ID NO: 3075177 - DNA, 19 bp, Homo sapiens
ggtttcaccatgttggcca

SEQ ID NO: 3075178 - DNA, 13 bp, Homo sapiens
ggtttcaggaagt

SEQ ID NO: 3075179 - DNA, 23 bp, Homo sapiens
ggtttcatcatgttgaccaggct

SEQ ID NO: 3075180 - DNA, 15 bp, Homo sapiens
ggtttcccaatggtg

SEQ ID NO: 3075181 - DNA, 18 bp, Homo sapiens
ggtttcccaatggtgttt

SEQ ID NO: 3075182 - DNA, 14 bp, Homo sapiens
ggtttcctctggat

SEQ ID NO: 3075183 - DNA, 16 bp, Homo sapiens
ggtttcgcagcctgag

SEQ ID NO: 3075184 - DNA, 11 bp, Homo sapiens
ggtttctctcc

SEQ ID NO: 3075185 - DNA, 10 bp, Homo sapiens
ggtttcttat

SEQ ID NO: 3075186 - DNA, 18 bp, Homo sapiens
ggtttcttttttctttct

SEQ ID NO: 3075187 - DNA, 16 bp, Homo sapiens
ggtttgaccaggaaag

SEQ ID NO: 3075188 - DNA, 15 bp, Homo sapiens
ggtttgagatgtttg

SEQ ID NO: 3075189 - DNA, 17 bp, Homo sapiens
ggtttgagcacaatctg

SEQ ID NO: 3075190 - DNA, 15 bp, Homo sapiens
ggtttggcccaagac

SEQ ID NO: 3075191 - DNA, 14 bp, Homo sapiens
ggtttggcccctgg

SEQ ID NO: 3075192 - DNA, 17 bp, Homo sapiens
ggtttgggaaagatgga

SEQ ID NO: 3075193 - DNA, 19 bp, Homo sapiens
ggtttgtgagccttgctgc

SEQ ID NO: 3075194 - DNA, 14 bp, Homo sapiens
ggtttgtgttgagc

SEQ ID NO: 3075195 - DNA, 23 bp, Homo sapiens
ggtttgttggtcacatggagctc

SEQ ID NO: 3075196 - DNA, 17 bp, Homo sapiens
ggttttaagttgtttgc

SEQ ID NO: 3075197 - DNA, 12 bp, Homo sapiens
ggttttaatgta

SEQ ID NO: 3075198 - DNA, 20 bp, Homo sapiens
ggttttacttacaaaaatgg

SEQ ID NO: 3075199 - DNA, 20 bp, Homo sapiens
ggttttcgtcatcttccctg

SEQ ID NO: 3075200 - DNA, 16 bp, Homo sapiens
ggtttttaaaacccag

SEQ ID NO: 3075201 - DNA, 18 bp, Homo sapiens
ggtttttaaattttgtaa

SEQ ID NO: 3075202 - DNA, 16 bp, Homo sapiens
gtaaaaaaaaaaaagt

SEQ ID NO: 3075203 - DNA, 12 bp, Homo sapiens
gtaaaaaaaaga

SEQ ID NO: 3075204 - DNA, 14 bp, Homo sapiens
gtaaaaaatggaaa

SEQ ID NO: 3075205 - DNA, 11 bp, Homo sapiens
gtaaaaaatgt

SEQ ID NO: 3075206 - DNA, 14 bp, Homo sapiens
gtaaaaattaaaaa

SEQ ID NO: 3075207 - DNA, 15 bp, Homo sapiens
gtaaaacaaaacaaa

SEQ ID NO: 3075208 - DNA, 14 bp, Homo sapiens
gtaaaacaaaattt

SEQ ID NO: 3075209 - DNA, 20 bp, Homo sapiens
gtaaaaggccaaacctctgt

SEQ ID NO: 3075210 - DNA, 12 bp, Homo sapiens
gtaaaagtgtct

SEQ ID NO: 3075211 - DNA, 18 bp, Homo sapiens
gtaaaatattttgaatca

SEQ ID NO: 3075212 - DNA, 19 bp, Homo sapiens
gtaaaatcttcagctggtg

SEQ ID NO: 3075213 - DNA, 21 bp, Homo sapiens
gtaaaatcttcagctggtgga

SEQ ID NO: 3075214 - DNA, 15 bp, Homo sapiens
gtaaaatggaggtgg

SEQ ID NO: 3075215 - DNA, 16 bp, Homo sapiens
gtaaaattgaaaggca

SEQ ID NO: 3075216 - DNA, 19 bp, Homo sapiens
gtaaacagcctctttttga

SEQ ID NO: 3075217 - DNA, 13 bp, Homo sapiens
gtaaacagtgcct

SEQ ID NO: 3075218 - DNA, 15 bp, Homo sapiens
gtaaacagtgcctgc

SEQ ID NO: 3075219 - DNA, 16 bp, Homo sapiens
gtaaacataccaacat

SEQ ID NO: 3075220 - DNA, 21 bp, Homo sapiens
gtaaactcttcaccttggttt

SEQ ID NO: 3075221 - DNA, 16 bp, Homo sapiens
gtaaactttttgtgct

SEQ ID NO: 3075222 - DNA, 16 bp, Homo sapiens
gtaaagaaagagagaa

SEQ ID NO: 3075223 - DNA, 16 bp, Homo sapiens
gtaaagcattccaaca

SEQ ID NO: 3075224 - DNA, 20 bp, Homo sapiens
gtaaagctatttatgggccc

SEQ ID NO: 3075225 - DNA, 16 bp, Homo sapiens
gtaaaggcattccaca

SEQ ID NO: 3075226 - DNA, 22 bp, Homo sapiens
gtaaagggcgcaaagggcatgg

SEQ ID NO: 3075227 - DNA, 21 bp, Homo sapiens
gtaaagtaatgcatttgagca

SEQ ID NO: 3075228 - DNA, 14 bp, Homo sapiens
gtaaagtgaagaat

SEQ ID NO: 3075229 - DNA, 14 bp, Homo sapiens
gtaaagttagtcta

SEQ ID NO: 3075230 - DNA, 13 bp, Homo sapiens
gtaaataaagccc

SEQ ID NO: 3075231 - DNA, 16 bp, Homo sapiens
gtaaataaaggaacca

SEQ ID NO: 3075232 - DNA, 17 bp, Homo sapiens
gtaaataaagtctattt

SEQ ID NO: 3075233 - DNA, 13 bp, Homo sapiens
gtaaataaatttt

SEQ ID NO: 3075234 - DNA, 14 bp, Homo sapiens
gtaaatacatcact

SEQ ID NO: 3075235 - DNA, 22 bp, Homo sapiens
gtaaatagacagcctttctgct

SEQ ID NO: 3075236 - DNA, 16 bp, Homo sapiens
gtaaatatatgaacat

SEQ ID NO: 3075237 - DNA, 19 bp, Homo sapiens
gtaaatatggggatagtct

SEQ ID NO: 3075238 - DNA, 17 bp, Homo sapiens
gtaaatatttttccctc

SEQ ID NO: 3075239 - DNA, 22 bp, Homo sapiens
gtaaatcgggaaggatgggaaa

SEQ ID NO: 3075240 - DNA, 22 bp, Homo sapiens
gtaaatctagagtttatacagt

SEQ ID NO: 3075241 - DNA, 20 bp, Homo sapiens
gtaaatgaagatctttatat

SEQ ID NO: 3075242 - DNA, 23 bp, Homo sapiens
gtaaatgaagggtcatttctctt

SEQ ID NO: 3075243 - DNA, 15 bp, Homo sapiens
gtaaatgctattata

SEQ ID NO: 3075244 - DNA, 20 bp, Homo sapiens
gtaaatgtgttggacaaatg

SEQ ID NO: 3075245 - DNA, 22 bp, Homo sapiens
gtaaatgttatcttatactgta

SEQ ID NO: 3075246 - DNA, 14 bp, Homo sapiens
gtaaattatatttg

SEQ ID NO: 3075247 - DNA, 20 bp, Homo sapiens
gtaaattatatttgtgctat

SEQ ID NO: 3075248 - DNA, 13 bp, Homo sapiens
gtaaattcagtct

SEQ ID NO: 3075249 - DNA, 18 bp, Homo sapiens
gtaaatttccccaacagt

SEQ ID NO: 3075250 - DNA, 21 bp, Homo sapiens
gtaaatttccccaacagtgtg

SEQ ID NO: 3075251 - DNA, 14 bp, Homo sapiens
gtaaattttatggc

SEQ ID NO: 3075252 - DNA, 11 bp, Homo sapiens
gtaacagaaag

SEQ ID NO: 3075253 - DNA, 14 bp, Homo sapiens
gtaacataataaat

SEQ ID NO: 3075254 - DNA, 23 bp, Homo sapiens
gtaacatgtgttaagtattttca

SEQ ID NO: 3075255 - DNA, 17 bp, Homo sapiens
gtaacatttatagaaga

SEQ ID NO: 3075256 - DNA, 17 bp, Homo sapiens
gtaaccacctctctgtc

SEQ ID NO: 3075257 - DNA, 21 bp, Homo sapiens
gtaaccctggtggttgctgtt

SEQ ID NO: 3075258 - DNA, 23 bp, Homo sapiens
gtaacctaccttatcatgtggct

SEQ ID NO: 3075259 - DNA, 20 bp, Homo sapiens
gtaacctcttcagaggccct

SEQ ID NO: 3075260 - DNA, 19 bp, Homo sapiens
gtaacctttaaaaatgtat

SEQ ID NO: 3075261 - DNA, 16 bp, Homo sapiens
gtaactataacaaaaa

SEQ ID NO: 3075262 - DNA, 18 bp, Homo sapiens
gtaactatttcttcagag

SEQ ID NO: 3075263 - DNA, 17 bp, Homo sapiens
gtaactccaccaaccca

SEQ ID NO: 3075264 - DNA, 18 bp, Homo sapiens
gtaactcccactcctaat

SEQ ID NO: 3075265 - DNA, 22 bp, Homo sapiens
gtaactgcattgagaactgcat

SEQ ID NO: 3075266 - DNA, 20 bp, Homo sapiens
gtaactgtccctgctttctg

SEQ ID NO: 3075267 - DNA, 20 bp, Homo sapiens
gtaacttcttatggaattga

SEQ ID NO: 3075268 - DNA, 16 bp, Homo sapiens
gtaactttatgtgtaa

SEQ ID NO: 3075269 - DNA, 18 bp, Homo sapiens
gtaactttgcaggcggcc

SEQ ID NO: 3075270 - DNA, 12 bp, Homo sapiens
gtaacttttaat

SEQ ID NO: 3075271 - DNA, 18 bp, Homo sapiens
gtaagaagaggagcctca

SEQ ID NO: 3075272 - DNA, 20 bp, Homo sapiens
gtaagaagaggagcctcaga

SEQ ID NO: 3075273 - DNA, 23 bp, Homo sapiens
gtcagagtttcagctttcttcag

SEQ ID NO: 3075274 - DNA, 11 bp, Homo sapiens
gtcagcacctt

SEQ ID NO: 3075275 - DNA, 12 bp, Homo sapiens
gtcagcaccttg

SEQ ID NO: 3075276 - DNA, 22 bp, Homo sapiens
gtcagcaccttggcccaggagc

SEQ ID NO: 3075277 - DNA, 24 bp, Homo sapiens
gtcagcaccttggcccaggagctc

SEQ ID NO: 3075278 - DNA, 15 bp, Homo sapiens
gtcagcatctgacca

SEQ ID NO: 3075279 - DNA, 20 bp, Homo sapiens
gtcagcatctgaccatctgt

SEQ ID NO: 3075280 - DNA, 22 bp, Homo sapiens
gtcagcatctgaccatctgtga

SEQ ID NO: 3075281 - DNA, 23 bp, Homo sapiens
gtcagcatctgaccatctgtgac

SEQ ID NO: 3075282 - DNA, 15 bp, Homo sapiens
gtcagccaggagctg

SEQ ID NO: 3075283 - DNA, 20 bp, Homo sapiens
gtcagccaggagctgtcacc

SEQ ID NO: 3075284 - DNA, 13 bp, Homo sapiens
gtcagccatgtct

SEQ ID NO: 3075285 - DNA, 21 bp, Homo sapiens
gtcagcgttctaccaggcaaa

SEQ ID NO: 3075286 - DNA, 19 bp, Homo sapiens
gtcagctgaccccctcccc

SEQ ID NO: 3075287 - DNA, 18 bp, Homo sapiens
gtcagcttttgttgttta

SEQ ID NO: 3075288 - DNA, 17 bp, Homo sapiens
gtcaggaaacccagtcg

SEQ ID NO: 3075289 - DNA, 14 bp, Homo sapiens
gtcaggaccaggac

SEQ ID NO: 3075290 - DNA, 21 bp, Homo sapiens
gtcaggaccaggacccaggga

SEQ ID NO: 3075291 - DNA, 19 bp, Homo sapiens
gtcaggagttcgagaccaa

SEQ ID NO: 3075292 - DNA, 13 bp, Homo sapiens
gtcaggcagggtg

SEQ ID NO: 3075293 - DNA, 22 bp, Homo sapiens
gtcaggcccgtcggagctgcct

SEQ ID NO: 3075294 - DNA, 17 bp, Homo sapiens
gtcaggccctctgcctg

SEQ ID NO: 3075295 - DNA, 23 bp, Homo sapiens
gtcaggccctctgcctgcactcc

SEQ ID NO: 3075296 - DNA, 18 bp, Homo sapiens
gtcagggacccctgccct

SEQ ID NO: 3075297 - DNA, 16 bp, Homo sapiens
gtcagggagggccagg

SEQ ID NO: 3075298 - DNA, 15 bp, Homo sapiens
gtcaggggtgacaca

SEQ ID NO: 3075299 - DNA, 14 bp, Homo sapiens
gtcaggtcccagcg

SEQ ID NO: 3075300 - DNA, 15 bp, Homo sapiens
gtcaggtcccagcga

SEQ ID NO: 3075301 - DNA, 23 bp, Homo sapiens
gtcaggtcccagcgagccacagg

SEQ ID NO: 3075302 - DNA, 16 bp, Homo sapiens
gtcaggtggaccctgt

SEQ ID NO: 3075303 - DNA, 15 bp, Homo sapiens
gtcaggtgtcaggcc

SEQ ID NO: 3075304 - DNA, 16 bp, Homo sapiens
gtcagtaccttcaaac

SEQ ID NO: 3075305 - DNA, 14 bp, Homo sapiens
gtcagtcacagcca

SEQ ID NO: 3075306 - DNA, 16 bp, Homo sapiens
gtcagtcacagccacc

SEQ ID NO: 3075307 - DNA, 12 bp, Homo sapiens
gtcagtctttag

SEQ ID NO: 3075308 - DNA, 18 bp, Homo sapiens
gtcagtgcaaatgtcaga

SEQ ID NO: 3075309 - DNA, 22 bp, Homo sapiens
gtcagtgggaacgtgactgccc

SEQ ID NO: 3075310 - DNA, 20 bp, Homo sapiens
gtcagtgttgcctcttgcaa

SEQ ID NO: 3075311 - DNA, 22 bp, Homo sapiens
gtcataacggttaagaaagcac

SEQ ID NO: 3075312 - DNA, 16 bp, Homo sapiens
gtcatatgttaagcag

SEQ ID NO: 3075313 - DNA, 20 bp, Homo sapiens
gtcatcaatttgtaatttta

SEQ ID NO: 3075314 - DNA, 23 bp, Homo sapiens
gtcatcagaggggagcagcggct

SEQ ID NO: 3075315 - DNA, 14 bp, Homo sapiens
gtcatcatgaactg

SEQ ID NO: 3075316 - DNA, 17 bp, Homo sapiens
gtcatcgttccccaccc

SEQ ID NO: 3075317 - DNA, 13 bp, Homo sapiens
gtcatctgctgcg

SEQ ID NO: 3075318 - DNA, 13 bp, Homo sapiens
gtcatcttccctg

SEQ ID NO: 3075319 - DNA, 22 bp, Homo sapiens
gtcatcttccctgcccctgtgc

SEQ ID NO: 3075320 - DNA, 20 bp, Homo sapiens
gtcatcttgaccaagcagga

SEQ ID NO: 3075321 - DNA, 20 bp, Homo sapiens
gtcatgaattcatactctgt

SEQ ID NO: 3075322 - DNA, 17 bp, Homo sapiens
gtcatgccctcctctcc

SEQ ID NO: 3075323 - DNA, 12 bp, Homo sapiens
gtcatgcttcat

SEQ ID NO: 3075324 - DNA, 13 bp, Homo sapiens
gtcatggacattc

SEQ ID NO: 3075325 - DNA, 15 bp, Homo sapiens
gtcatgggaacgcag

SEQ ID NO: 3075326 - DNA, 20 bp, Homo sapiens
gtcatgggccccccatgcat

SEQ ID NO: 3075327 - DNA, 16 bp, Homo sapiens
gtcatgtaaatactgt

SEQ ID NO: 3075328 - DNA, 19 bp, Homo sapiens
gtcatgtaaatactgttgg

SEQ ID NO: 3075329 - DNA, 16 bp, Homo sapiens
gtcatgtgcctctgtc

SEQ ID NO: 3075330 - DNA, 18 bp, Homo sapiens
gtcatgtgcctctgtcct

SEQ ID NO: 3075331 - DNA, 17 bp, Homo sapiens
gtcatgtgtatgagaag

SEQ ID NO: 3075332 - DNA, 17 bp, Homo sapiens
gtcatgttttaaatgta

SEQ ID NO: 3075333 - DNA, 20 bp, Homo sapiens
gtcatgttttaaatgtacag

SEQ ID NO: 3075334 - DNA, 13 bp, Homo sapiens
gtcattaaaattg

SEQ ID NO: 3075335 - DNA, 15 bp, Homo sapiens
gtcattaaactggtt

SEQ ID NO: 3075336 - DNA, 21 bp, Homo sapiens
gtcattaaccatctttaatca

SEQ ID NO: 3075337 - DNA, 15 bp, Homo sapiens
gtcattactaaccat

SEQ ID NO: 3075338 - DNA, 14 bp, Homo sapiens
gtcattatttaaag

SEQ ID NO: 3075339 - DNA, 17 bp, Homo sapiens
gtcattcctaatgcatt

SEQ ID NO: 3075340 - DNA, 18 bp, Homo sapiens
gtcattcctaatgcatta

SEQ ID NO: 3075341 - DNA, 23 bp, Homo sapiens
gtcattgcacctatctcagccat

SEQ ID NO: 3075342 - DNA, 18 bp, Homo sapiens
gtcattgcagtttaagag

SEQ ID NO: 3075343 - DNA, 18 bp, Homo sapiens
gtcattgtaacctcgtgt

SEQ ID NO: 3075344 - DNA, 17 bp, Homo sapiens
gtcatttgagtctctta

SEQ ID NO: 3075345 - DNA, 16 bp, Homo sapiens
gtcattttacaagcat

SEQ ID NO: 3075346 - DNA, 16 bp, Homo sapiens
gtcattttcagtgact

SEQ ID NO: 3075347 - DNA, 13 bp, Homo sapiens
gtcattttgggtt

SEQ ID NO: 3075348 - DNA, 14 bp, Homo sapiens
gtcatttttaacta

SEQ ID NO: 3075349 - DNA, 19 bp, Homo sapiens
gtcatttttaactactgta

SEQ ID NO: 3075350 - DNA, 14 bp, Homo sapiens
gtcatttttccttc

SEQ ID NO: 3075351 - DNA, 21 bp, Homo sapiens
gtccaaaaaaaggaaaaataa

SEQ ID NO: 3075352 - DNA, 18 bp, Homo sapiens
gtccaaaatttatatttt

SEQ ID NO: 3075353 - DNA, 13 bp, Homo sapiens
gtccaacatggtg

SEQ ID NO: 3075354 - DNA, 23 bp, Homo sapiens
gtccaacatggtgaaacccccat

SEQ ID NO: 3075355 - DNA, 15 bp, Homo sapiens
gtccaacccctcccc

SEQ ID NO: 3075356 - DNA, 15 bp, Homo sapiens
gtccaacgccgcctt

SEQ ID NO: 3075357 - DNA, 14 bp, Homo sapiens
gtccaactaaaaac

SEQ ID NO: 3075358 - DNA, 20 bp, Homo sapiens
gtccaagattccggatccta

SEQ ID NO: 3075359 - DNA, 22 bp, Homo sapiens
gtccaagattccggatcctaag

SEQ ID NO: 3075360 - DNA, 15 bp, Homo sapiens
gtccaagctgggaga

SEQ ID NO: 3075361 - DNA, 19 bp, Homo sapiens
gtccaatttgtaaaaacag

SEQ ID NO: 3075362 - DNA, 18 bp, Homo sapiens
gtccaattttaatttagt

SEQ ID NO: 3075363 - DNA, 16 bp, Homo sapiens
gtccacagctgaagag

SEQ ID NO: 3075364 - DNA, 14 bp, Homo sapiens
gtccacagcttcct

SEQ ID NO: 3075365 - DNA, 15 bp, Homo sapiens
gtccacatccccaga

SEQ ID NO: 3075366 - DNA, 17 bp, Homo sapiens
gtccacatccccagagc

SEQ ID NO: 3075367 - DNA, 22 bp, Homo sapiens
gtccacatccccagagcccagc

SEQ ID NO: 3075368 - DNA, 13 bp, Homo sapiens
gtccaccaggcct

SEQ ID NO: 3075369 - DNA, 19 bp, Homo sapiens
gtccaccaggcctcactgg

SEQ ID NO: 3075370 - DNA, 18 bp, Homo sapiens
gtccacgactgtctccat

SEQ ID NO: 3075371 - DNA, 18 bp, Homo sapiens
gtccacgcggccacctca

SEQ ID NO: 3075372 - DNA, 14 bp, Homo sapiens
gtccactgtgtata

SEQ ID NO: 3075373 - DNA, 16 bp, Homo sapiens
gtccacttgccagggc

SEQ ID NO: 3075374 - DNA, 15 bp, Homo sapiens
gtccacttgtgggtc

SEQ ID NO: 3075375 - DNA, 16 bp, Homo sapiens
gtccacttgtgggtcc

SEQ ID NO: 3075376 - DNA, 14 bp, Homo sapiens
gtccagaaggagac

SEQ ID NO: 3075377 - DNA, 12 bp, Homo sapiens
gtccagagccgg

SEQ ID NO: 3075378 - DNA, 23 bp, Homo sapiens
gtccagcaccttgtgcctggggt

SEQ ID NO: 3075379 - DNA, 14 bp, Homo sapiens
gtccagcagtcact

SEQ ID NO: 3075380 - DNA, 19 bp, Homo sapiens
gtccagcccccagtgcgct

SEQ ID NO: 3075381 - DNA, 22 bp, Homo sapiens
gtccagcctgccccggagctgg

SEQ ID NO: 3075382 - DNA, 11 bp, Homo sapiens
gtccagctcta

SEQ ID NO: 3075383 - DNA, 21 bp, Homo sapiens
gtccagctgcccttccgcagt

SEQ ID NO: 3075384 - DNA, 20 bp, Homo sapiens
gtccagctttactgtggctg

SEQ ID NO: 3075385 - DNA, 13 bp, Homo sapiens
gtccagggcccca

SEQ ID NO: 3075386 - DNA, 18 bp, Homo sapiens
gtccaggggaggccttcc

SEQ ID NO: 3075387 - DNA, 18 bp, Homo sapiens
gtccatcctcctctccat

SEQ ID NO: 3075388 - DNA, 22 bp, Homo sapiens
gtccatcctcctctccatgcaa

SEQ ID NO: 3075389 - DNA, 23 bp, Homo sapiens
gtccatcctcctctccatgcaag

SEQ ID NO: 3075390 - DNA, 12 bp, Homo sapiens
gtccatcctgac

SEQ ID NO: 3075391 - DNA, 13 bp, Homo sapiens
gtccatcctgacc

SEQ ID NO: 3075392 - DNA, 16 bp, Homo sapiens
gtccatcctgacctgc

SEQ ID NO: 3075393 - DNA, 16 bp, Homo sapiens
gtccatcctgtgccag

SEQ ID NO: 3075394 - DNA, 17 bp, Homo sapiens
gtccatctctctccctt

SEQ ID NO: 3075395 - DNA, 16 bp, Homo sapiens
gtccatctgcccgcct

SEQ ID NO: 3075396 - DNA, 19 bp, Homo sapiens
gtccatctgcccgcctgcc

SEQ ID NO: 3075397 - DNA, 21 bp, Homo sapiens
gtccatctgcccgcctgccca

SEQ ID NO: 3075398 - DNA, 14 bp, Homo sapiens
gtccatgggcagag

SEQ ID NO: 3075399 - DNA, 17 bp, Homo sapiens
gtccattatttgagttt

SEQ ID NO: 3075400 - DNA, 21 bp, Homo sapiens
gtccattgtccaatcctatgt

SEQ ID NO: 3075401 - DNA, 18 bp, Homo sapiens
gtccatttttcttccagg

SEQ ID NO: 3075402 - DNA, 23 bp, Homo sapiens
gtcccaacaggaggacaattcat

SEQ ID NO: 3075403 - DNA, 16 bp, Homo sapiens
gtcccaagctcccaag

SEQ ID NO: 3075404 - DNA, 21 bp, Homo sapiens
gtcccaaggtgaaatgaagca

SEQ ID NO: 3075405 - DNA, 22 bp, Homo sapiens
gtgaatccatgggtctggctag

SEQ ID NO: 3075406 - DNA, 15 bp, Homo sapiens
gtgaatgccagtgtg

SEQ ID NO: 3075407 - DNA, 18 bp, Homo sapiens
gtgaatgccagtgtgctg

SEQ ID NO: 3075408 - DNA, 17 bp, Homo sapiens
gtgaatgtgtgagaaaa

SEQ ID NO: 3075409 - DNA, 21 bp, Homo sapiens
gtgaatgtgtgagaaaaacta

SEQ ID NO: 3075410 - DNA, 16 bp, Homo sapiens
gtgaatttttctctaa

SEQ ID NO: 3075411 - DNA, 16 bp, Homo sapiens
gtgaatttttgcaata

SEQ ID NO: 3075412 - DNA, 21 bp, Homo sapiens
gtgaatttttgcaataatgca

SEQ ID NO: 3075413 - DNA, 16 bp, Homo sapiens
gtgacaattctgtttt

SEQ ID NO: 3075414 - DNA, 13 bp, Homo sapiens
gtgacacaaacac

SEQ ID NO: 3075415 - DNA, 20 bp, Homo sapiens
gtgacacactacaccacaca

SEQ ID NO: 3075416 - DNA, 12 bp, Homo sapiens
gtgacacagact

SEQ ID NO: 3075417 - DNA, 19 bp, Homo sapiens
gtgacacagactcatcctg

SEQ ID NO: 3075418 - DNA, 16 bp, Homo sapiens
gtgacacccaagaggg

SEQ ID NO: 3075419 - DNA, 15 bp, Homo sapiens
gtgacagactcctga

SEQ ID NO: 3075420 - DNA, 16 bp, Homo sapiens
gtgacagactcctgag

SEQ ID NO: 3075421 - DNA, 20 bp, Homo sapiens
gtgacagactcctgaggaca

SEQ ID NO: 3075422 - DNA, 23 bp, Homo sapiens
gtgacagccttgggcctttcagt

SEQ ID NO: 3075423 - DNA, 12 bp, Homo sapiens
gtgacagctttc

SEQ ID NO: 3075424 - DNA, 19 bp, Homo sapiens
gtgacagggaagctacagg

SEQ ID NO: 3075425 - DNA, 16 bp, Homo sapiens
gtgacatagcctcatg

SEQ ID NO: 3075426 - DNA, 17 bp, Homo sapiens
gtgaccaaaagttacat

SEQ ID NO: 3075427 - DNA, 18 bp, Homo sapiens
gtgaccaatacatttgta

SEQ ID NO: 3075428 - DNA, 12 bp, Homo sapiens
gtgaccagggaa

SEQ ID NO: 3075429 - DNA, 14 bp, Homo sapiens
gtgacccaatgatt

SEQ ID NO: 3075430 - DNA, 15 bp, Homo sapiens
gtgacccacttctca

SEQ ID NO: 3075431 - DNA, 23 bp, Homo sapiens
gtgaccccatcactcgcaggacc

SEQ ID NO: 3075432 - DNA, 16 bp, Homo sapiens
gtgacccccagctccg

SEQ ID NO: 3075433 - DNA, 13 bp, Homo sapiens
gtgacccctcctg

SEQ ID NO: 3075434 - DNA, 14 bp, Homo sapiens
gtgacccctcctgg

SEQ ID NO: 3075435 - DNA, 15 bp, Homo sapiens
gtgacccctcctggg

SEQ ID NO: 3075436 - DNA, 20 bp, Homo sapiens
gtgacccctcctggggccag

SEQ ID NO: 3075437 - DNA, 19 bp, Homo sapiens
gtgaccttccaagagcctg

SEQ ID NO: 3075438 - DNA, 21 bp, Homo sapiens
gtgaccttccaagagcctgag

SEQ ID NO: 3075439 - DNA, 22 bp, Homo sapiens
gtgaccttccaagagcctgaga

SEQ ID NO: 3075440 - DNA, 19 bp, Homo sapiens
gtgaccttgggaccaaagg

SEQ ID NO: 3075441 - DNA, 17 bp, Homo sapiens
gtgactaattgtataac

SEQ ID NO: 3075442 - DNA, 22 bp, Homo sapiens
gtgactcacacttgtaatccca

SEQ ID NO: 3075443 - DNA, 14 bp, Homo sapiens
gtgactcagagctt

SEQ ID NO: 3075444 - DNA, 22 bp, Homo sapiens
gtgactctcctgcctcagcctc

SEQ ID NO: 3075445 - DNA, 14 bp, Homo sapiens
gtgactgaaaccat

SEQ ID NO: 3075446 - DNA, 20 bp, Homo sapiens
gtgactggttatcacaccat

SEQ ID NO: 3075447 - DNA, 12 bp, Homo sapiens
gtgactttctga

SEQ ID NO: 3075448 - DNA, 13 bp, Homo sapiens
gtgactttctgaa

SEQ ID NO: 3075449 - DNA, 14 bp, Homo sapiens
gtgacttttgaaga

SEQ ID NO: 3075450 - DNA, 15 bp, Homo sapiens
gtgagaaacctgtat

SEQ ID NO: 3075451 - DNA, 23 bp, Homo sapiens
gtgagaaacctgtatctttctat

SEQ ID NO: 3075452 - DNA, 13 bp, Homo sapiens
gtgagaaagaaag

SEQ ID NO: 3075453 - DNA, 15 bp, Homo sapiens
gtgagaccaggggac

SEQ ID NO: 3075454 - DNA, 18 bp, Homo sapiens
gtgagaccctgtctcaaa

SEQ ID NO: 3075455 - DNA, 23 bp, Homo sapiens
gtgagagacattaactcattaga

SEQ ID NO: 3075456 - DNA, 15 bp, Homo sapiens
gtgagagcacccact

SEQ ID NO: 3075457 - DNA, 16 bp, Homo sapiens
gtgagaggaagggtgg

SEQ ID NO: 3075458 - DNA, 17 bp, Homo sapiens
gtgagagggctgttaac

SEQ ID NO: 3075459 - DNA, 14 bp, Homo sapiens
gtgagaggggaggg

SEQ ID NO: 3075460 - DNA, 18 bp, Homo sapiens
gtgagaggggagggaggg

SEQ ID NO: 3075461 - DNA, 13 bp, Homo sapiens
gtgagagtgagct

SEQ ID NO: 3075462 - DNA, 18 bp, Homo sapiens
gtgagatgatttgtactt

SEQ ID NO: 3075463 - DNA, 21 bp, Homo sapiens
gtgagatttaagttcctgctg

SEQ ID NO: 3075464 - DNA, 19 bp, Homo sapiens
gtgagcatgtttggaaggg

SEQ ID NO: 3075465 - DNA, 23 bp, Homo sapiens
gtgagccaagatcgcaccactgc

SEQ ID NO: 3075466 - DNA, 23 bp, Homo sapiens
gtgagccatagagatatttaaaa

SEQ ID NO: 3075467 - DNA, 15 bp, Homo sapiens
gtgagcccagctggg

SEQ ID NO: 3075468 - DNA, 16 bp, Homo sapiens
gtgagccccatcttca

SEQ ID NO: 3075469 - DNA, 22 bp, Homo sapiens
gtgagccctctagggcagggtg

SEQ ID NO: 3075470 - DNA, 12 bp, Homo sapiens
gtgagccgcatc

SEQ ID NO: 3075471 - DNA, 21 bp, Homo sapiens
gtgagccgcatcttctccatc

SEQ ID NO: 3075472 - DNA, 23 bp, Homo sapiens
gtgagccttgcatgacatcatga

SEQ ID NO: 3075473 - DNA, 23 bp, Homo sapiens
gtgagcgagtggatgctgtgcta

SEQ ID NO: 3075474 - DNA, 14 bp, Homo sapiens
gtgagctgagatca

SEQ ID NO: 3075475 - DNA, 21 bp, Homo sapiens
gtgagctgcccggcgcctgcc

SEQ ID NO: 3075476 - DNA, 23 bp, Homo sapiens
gtgagctgcccggcgcctgccct

SEQ ID NO: 3075477 - DNA, 18 bp, Homo sapiens
gtgaggaaggcaggaaga

SEQ ID NO: 3075478 - DNA, 22 bp, Homo sapiens
gtgaggagaatgaaatgtatgt

SEQ ID NO: 3075479 - DNA, 21 bp, Homo sapiens
gtgaggagccccatctgtcta

SEQ ID NO: 3075480 - DNA, 13 bp, Homo sapiens
gtgaggagctggg

SEQ ID NO: 3075481 - DNA, 22 bp, Homo sapiens
gtgaggatgtcactcagatgga

SEQ ID NO: 3075482 - DNA, 18 bp, Homo sapiens
gtgaggccggccctgccc

SEQ ID NO: 3075483 - DNA, 16 bp, Homo sapiens
gtgaggcctgtctgtg

SEQ ID NO: 3075484 - DNA, 14 bp, Homo sapiens
gtgaggctgctgcc

SEQ ID NO: 3075485 - DNA, 15 bp, Homo sapiens
gtgaggctgctgcca

SEQ ID NO: 3075486 - DNA, 16 bp, Homo sapiens
gtgaggctgctgccat

SEQ ID NO: 3075487 - DNA, 12 bp, Homo sapiens
gtgagggagaga

SEQ ID NO: 3075488 - DNA, 13 bp, Homo sapiens
gtgagggagagaa

SEQ ID NO: 3075489 - DNA, 17 bp, Homo sapiens
gtgagggagggctgtca

SEQ ID NO: 3075490 - DNA, 15 bp, Homo sapiens
gtgagggcaccacca

SEQ ID NO: 3075491 - DNA, 15 bp, Homo sapiens
gtgaggggcccctgg

SEQ ID NO: 3075492 - DNA, 21 bp, Homo sapiens
gtgaggggcccctggcccagg

SEQ ID NO: 3075493 - DNA, 22 bp, Homo sapiens
gtgaggggcccctggcccagga

SEQ ID NO: 3075494 - DNA, 15 bp, Homo sapiens
gtgaggtttcccaat

SEQ ID NO: 3075495 - DNA, 17 bp, Homo sapiens
gtgaggtttcccaatgg

SEQ ID NO: 3075496 - DNA, 22 bp, Homo sapiens
gtgaggtttcccaatggtgttt

SEQ ID NO: 3075497 - DNA, 13 bp, Homo sapiens
gtgagtactgtta

SEQ ID NO: 3075498 - DNA, 22 bp, Homo sapiens
gtgagtctccccttgcagcctg

SEQ ID NO: 3075499 - DNA, 12 bp, Homo sapiens
gtgagtgccttt

SEQ ID NO: 3075500 - DNA, 13 bp, Homo sapiens
gtgagttctcact

SEQ ID NO: 3075501 - DNA, 20 bp, Homo sapiens
gtgataactacttagcactg

SEQ ID NO: 3075502 - DNA, 19 bp, Homo sapiens
gtgatatagaattagcttt

SEQ ID NO: 3075503 - DNA, 13 bp, Homo sapiens
gtgatatggagca

SEQ ID NO: 3075504 - DNA, 17 bp, Homo sapiens
gtgatatggagcaagag

SEQ ID NO: 3075505 - DNA, 22 bp, Homo sapiens
gtgatatggtactaaggagaat

SEQ ID NO: 3075506 - DNA, 15 bp, Homo sapiens
gtgatatttctctag

SEQ ID NO: 3075507 - DNA, 16 bp, Homo sapiens
gtgatatttctctagt

SEQ ID NO: 3075508 - DNA, 15 bp, Homo sapiens
gtgatatttgacaga

SEQ ID NO: 3075509 - DNA, 13 bp, Homo sapiens
gtgatcaaagcca

SEQ ID NO: 3075510 - DNA, 14 bp, Homo sapiens
gtgatcagcaatga

SEQ ID NO: 3075511 - DNA, 18 bp, Homo sapiens
gtgatgaatctacatttg

SEQ ID NO: 3075512 - DNA, 23 bp, Homo sapiens
gtgatgccaggttctatttggaa

SEQ ID NO: 3075513 - DNA, 13 bp, Homo sapiens
gtgatgctcccaa

SEQ ID NO: 3075514 - DNA, 14 bp, Homo sapiens
gtgatggccagagg

SEQ ID NO: 3075515 - DNA, 15 bp, Homo sapiens
gtgatggccagagga

SEQ ID NO: 3075516 - DNA, 12 bp, Homo sapiens
gtgatgtgccac

SEQ ID NO: 3075517 - DNA, 18 bp, Homo sapiens
gtgatgttgggaagctat

SEQ ID NO: 3075518 - DNA, 22 bp, Homo sapiens
gtgattgacagctttgctgctg

SEQ ID NO: 3075519 - DNA, 12 bp, Homo sapiens
gtgattgctttt

SEQ ID NO: 3075520 - DNA, 15 bp, Homo sapiens
gtgatttaatagtgt

SEQ ID NO: 3075521 - DNA, 15 bp, Homo sapiens
gtgatttccacaggt

SEQ ID NO: 3075522 - DNA, 17 bp, Homo sapiens
gtgattttaactctgtc

SEQ ID NO: 3075523 - DNA, 22 bp, Homo sapiens
gtgattttgtaggttattttat

SEQ ID NO: 3075524 - DNA, 13 bp, Homo sapiens
gtgattttttgtt

SEQ ID NO: 3075525 - DNA, 14 bp, Homo sapiens
gtgcaaaaaggact

SEQ ID NO: 3075526 - DNA, 15 bp, Homo sapiens
gtgcaaaatgtcttg

SEQ ID NO: 3075527 - DNA, 17 bp, Homo sapiens
gtgcaaaatgtcttgtg

SEQ ID NO: 3075528 - DNA, 13 bp, Homo sapiens
gtgcaaacagtgt

SEQ ID NO: 3075529 - DNA, 19 bp, Homo sapiens
gtgcaaatgtcagatacaa

SEQ ID NO: 3075530 - DNA, 22 bp, Homo sapiens
gtgcaacaaggtcctctgtcag

SEQ ID NO: 3075531 - DNA, 16 bp, Homo sapiens
gtgcaacgccgtgggc

SEQ ID NO: 3075532 - DNA, 15 bp, Homo sapiens
gtgcaagcccctgct

SEQ ID NO: 3075533 - DNA, 21 bp, Homo sapiens
gtgcaatatgggcgggcagtc

SEQ ID NO: 3075534 - DNA, 18 bp, Homo sapiens
gtgcacaaaacccagacc

SEQ ID NO: 3075535 - DNA, 18 bp, Homo sapiens
gtgcaccaccacacccgg

SEQ ID NO: 3075536 - DNA, 18 bp, Homo sapiens
gtgcacgttgcttcaggc

SEQ ID NO: 3075537 - DNA, 15 bp, Homo sapiens
gtgcactgcccatgg

SEQ ID NO: 3075538 - DNA, 19 bp, Homo sapiens
gttcagagtccttaaaatg

SEQ ID NO: 3075539 - DNA, 19 bp, Homo sapiens
gttcagataattgaataag

SEQ ID NO: 3075540 - DNA, 14 bp, Homo sapiens
gttcagcccctcct

SEQ ID NO: 3075541 - DNA, 17 bp, Homo sapiens
gttcagcccctcctctg

SEQ ID NO: 3075542 - DNA, 18 bp, Homo sapiens
gttcagcccctcctctgc

SEQ ID NO: 3075543 - DNA, 19 bp, Homo sapiens
gttcagcccctcctctgcc

SEQ ID NO: 3075544 - DNA, 23 bp, Homo sapiens
gttcagcccctcctctgccacct

SEQ ID NO: 3075545 - DNA, 17 bp, Homo sapiens
gttcagcctcctgtctc

SEQ ID NO: 3075546 - DNA, 11 bp, Homo sapiens
gttcagcctgt

SEQ ID NO: 3075547 - DNA, 12 bp, Homo sapiens
gttcagcctgtc

SEQ ID NO: 3075548 - DNA, 12 bp, Homo sapiens
gttcagcttggg

SEQ ID NO: 3075549 - DNA, 14 bp, Homo sapiens
gttcaggctggctc

SEQ ID NO: 3075550 - DNA, 13 bp, Homo sapiens
gttcagtctagaa

SEQ ID NO: 3075551 - DNA, 12 bp, Homo sapiens
gttcagtgtaat

SEQ ID NO: 3075552 - DNA, 19 bp, Homo sapiens
gttcagtgtaatttctttg

SEQ ID NO: 3075553 - DNA, 16 bp, Homo sapiens
gttcagttacagaaag

SEQ ID NO: 3075554 - DNA, 17 bp, Homo sapiens
gttcagttgccactaag

SEQ ID NO: 3075555 - DNA, 21 bp, Homo sapiens
gttcagtttgtctctttgcaa

SEQ ID NO: 3075556 - DNA, 22 bp, Homo sapiens
gttcatgaaggtcctagcttta

SEQ ID NO: 3075557 - DNA, 12 bp, Homo sapiens
gttcattccaca

SEQ ID NO: 3075558 - DNA, 15 bp, Homo sapiens
gttcatttctgtctc

SEQ ID NO: 3075559 - DNA, 15 bp, Homo sapiens
gttccaaatgaatgt

SEQ ID NO: 3075560 - DNA, 16 bp, Homo sapiens
gttccaagagtctaaa

SEQ ID NO: 3075561 - DNA, 20 bp, Homo sapiens
gttccaagagtctaaagatg

SEQ ID NO: 3075562 - DNA, 14 bp, Homo sapiens
gttccaaggccagg

SEQ ID NO: 3075563 - DNA, 19 bp, Homo sapiens
gttccagagctgcttctgt

SEQ ID NO: 3075564 - DNA, 13 bp, Homo sapiens
gttccagcctgcc

SEQ ID NO: 3075565 - DNA, 20 bp, Homo sapiens
gttcccaaggacttccacat

SEQ ID NO: 3075566 - DNA, 17 bp, Homo sapiens
gttcccacaagcctgcc

SEQ ID NO: 3075567 - DNA, 19 bp, Homo sapiens
gttcccacaagcctgcctc

SEQ ID NO: 3075568 - DNA, 20 bp, Homo sapiens
gttcccacaagcctgcctcg

SEQ ID NO: 3075569 - DNA, 21 bp, Homo sapiens
gttcccacaagcctgcctcgc

SEQ ID NO: 3075570 - DNA, 14 bp, Homo sapiens
gttcccacttggag

SEQ ID NO: 3075571 - DNA, 19 bp, Homo sapiens
gttcccatgtagccccctg

SEQ ID NO: 3075572 - DNA, 11 bp, Homo sapiens
gttccccaccc

SEQ ID NO: 3075573 - DNA, 23 bp, Homo sapiens
gttcccctcagaaaaaaattcat

SEQ ID NO: 3075574 - DNA, 13 bp, Homo sapiens
gttccccttccac

SEQ ID NO: 3075575 - DNA, 18 bp, Homo sapiens
gttccctgaaaacccaga

SEQ ID NO: 3075576 - DNA, 21 bp, Homo sapiens
gttccctgaaaacccagagag

SEQ ID NO: 3075577 - DNA, 15 bp, Homo sapiens
gttcccttgaccatt

SEQ ID NO: 3075578 - DNA, 23 bp, Homo sapiens
gttcctagaggagacagcctgtc

SEQ ID NO: 3075579 - DNA, 15 bp, Homo sapiens
gttcctcgccctggg

SEQ ID NO: 3075580 - DNA, 14 bp, Homo sapiens
gttcctgagacaga

SEQ ID NO: 3075581 - DNA, 16 bp, Homo sapiens
gttcctgctgcctggg

SEQ ID NO: 3075582 - DNA, 15 bp, Homo sapiens
gttcctgctttctct

SEQ ID NO: 3075583 - DNA, 21 bp, Homo sapiens
gttcctgctttctctttcagt

SEQ ID NO: 3075584 - DNA, 12 bp, Homo sapiens
gttcctgtctca

SEQ ID NO: 3075585 - DNA, 14 bp, Homo sapiens
gttcctgtctcaat

SEQ ID NO: 3075586 - DNA, 17 bp, Homo sapiens
gttcctgtctcaatagc

SEQ ID NO: 3075587 - DNA, 21 bp, Homo sapiens
gttcctgtgcttatattcagt

SEQ ID NO: 3075588 - DNA, 15 bp, Homo sapiens
gttccttactgcaga

SEQ ID NO: 3075589 - DNA, 13 bp, Homo sapiens
gttccttagacct

SEQ ID NO: 3075590 - DNA, 13 bp, Homo sapiens
gttccttctgtga

SEQ ID NO: 3075591 - DNA, 16 bp, Homo sapiens
gttccttctgtgaaga

SEQ ID NO: 3075592 - DNA, 16 bp, Homo sapiens
gttcctttttaaatgt

SEQ ID NO: 3075593 - DNA, 20 bp, Homo sapiens
gttcctttttaaatgtgaat

SEQ ID NO: 3075594 - DNA, 16 bp, Homo sapiens
gttcgagaccagcctg

SEQ ID NO: 3075595 - DNA, 19 bp, Homo sapiens
gttcgccgtctggcgagcc

SEQ ID NO: 3075596 - DNA, 16 bp, Homo sapiens
gttcgcctggagccct

SEQ ID NO: 3075597 - DNA, 14 bp, Homo sapiens
gttctaaaaagatg

SEQ ID NO: 3075598 - DNA, 23 bp, Homo sapiens
gttctaaagatggaaaaaccacc

SEQ ID NO: 3075599 - DNA, 10 bp, Homo sapiens
gttctaaagc

SEQ ID NO: 3075600 - DNA, 14 bp, Homo sapiens
gttctaaagctctg

SEQ ID NO: 3075601 - DNA, 13 bp, Homo sapiens
gttctaaagttct

SEQ ID NO: 3075602 - DNA, 16 bp, Homo sapiens
gttctaaagttctaag

SEQ ID NO: 3075603 - DNA, 18 bp, Homo sapiens
gttctaaagttctaagat

SEQ ID NO: 3075604 - DNA, 17 bp, Homo sapiens
gttctaagactcaaatg

SEQ ID NO: 3075605 - DNA, 21 bp, Homo sapiens
gttctaagactcaaatgttct

SEQ ID NO: 3075606 - DNA, 22 bp, Homo sapiens
gttctaagatgtgatattctaa

SEQ ID NO: 3075607 - DNA, 20 bp, Homo sapiens
gttctaagattctaatgatg

SEQ ID NO: 3075608 - DNA, 13 bp, Homo sapiens
gttctaaggctct

SEQ ID NO: 3075609 - DNA, 19 bp, Homo sapiens
gttctaagtctttccattg

SEQ ID NO: 3075610 - DNA, 17 bp, Homo sapiens
gttctaataatttctaa

SEQ ID NO: 3075611 - DNA, 17 bp, Homo sapiens
gttctaccaggcaaatt

SEQ ID NO: 3075612 - DNA, 15 bp, Homo sapiens
gttctacttgatatt

SEQ ID NO: 3075613 - DNA, 18 bp, Homo sapiens
gttctacttgatatttcc

SEQ ID NO: 3075614 - DNA, 14 bp, Homo sapiens
gttctaggtttcaa

SEQ ID NO: 3075615 - DNA, 14 bp, Homo sapiens
gttctagtttgcat

SEQ ID NO: 3075616 - DNA, 22 bp, Homo sapiens
gttctattaatcacctctctgt

SEQ ID NO: 3075617 - DNA, 13 bp, Homo sapiens
gttctatttggaa

SEQ ID NO: 3075618 - DNA, 14 bp, Homo sapiens
gttctatttggaat

SEQ ID NO: 3075619 - DNA, 15 bp, Homo sapiens
gttctatttggaatt

SEQ ID NO: 3075620 - DNA, 12 bp, Homo sapiens
gttctcaatgaa

SEQ ID NO: 3075621 - DNA, 13 bp, Homo sapiens
gttctcaatgaaa

SEQ ID NO: 3075622 - DNA, 21 bp, Homo sapiens
gttctcattcctgttctttct

SEQ ID NO: 3075623 - DNA, 20 bp, Homo sapiens
gttctcctaatgctctgaaa

SEQ ID NO: 3075624 - DNA, 14 bp, Homo sapiens
gttctcctgcttgt

SEQ ID NO: 3075625 - DNA, 15 bp, Homo sapiens
gttctcctgcttgta

SEQ ID NO: 3075626 - DNA, 17 bp, Homo sapiens
gttctccttttgaactt

SEQ ID NO: 3075627 - DNA, 18 bp, Homo sapiens
gttctgagctgccagtgg

SEQ ID NO: 3075628 - DNA, 14 bp, Homo sapiens
gttctgccaggaga

SEQ ID NO: 3075629 - DNA, 15 bp, Homo sapiens
gttctgcctgccagc

SEQ ID NO: 3075630 - DNA, 22 bp, Homo sapiens
gttctgcctgccagctgcactg

SEQ ID NO: 3075631 - DNA, 20 bp, Homo sapiens
gttctgctagagcagacagg

SEQ ID NO: 3075632 - DNA, 18 bp, Homo sapiens
gttctgctcatcattctc

SEQ ID NO: 3075633 - DNA, 17 bp, Homo sapiens
gttctgcttttaagttt

SEQ ID NO: 3075634 - DNA, 16 bp, Homo sapiens
gttctggccagaatgc

SEQ ID NO: 3075635 - DNA, 19 bp, Homo sapiens
gttctggggggacccagtg

SEQ ID NO: 3075636 - DNA, 21 bp, Homo sapiens
gttctggggggacccagtgca

SEQ ID NO: 3075637 - DNA, 18 bp, Homo sapiens
gttctgggtgttgaccac

SEQ ID NO: 3075638 - DNA, 16 bp, Homo sapiens
gttctgtagagccaat

SEQ ID NO: 3075639 - DNA, 17 bp, Homo sapiens
gttctgtagctttctgg

SEQ ID NO: 3075640 - DNA, 21 bp, Homo sapiens
gttctgtggaaagtgtaaagc

SEQ ID NO: 3075641 - DNA, 22 bp, Homo sapiens
gttctgtggaaagtgtaaagca

SEQ ID NO: 3075642 - DNA, 13 bp, Homo sapiens
gttctgtttcaag

SEQ ID NO: 3075643 - DNA, 14 bp, Homo sapiens
gttctgttttcgta

SEQ ID NO: 3075644 - DNA, 15 bp, Homo sapiens
gttcttatagaataa

SEQ ID NO: 3075645 - DNA, 21 bp, Homo sapiens
gttcttcagtgtaatgtgact

SEQ ID NO: 3075646 - DNA, 23 bp, Homo sapiens
gttcttgaagcatttcaaagccc

SEQ ID NO: 3075647 - DNA, 18 bp, Homo sapiens
gttcttgccttccccttg

SEQ ID NO: 3075648 - DNA, 23 bp, Homo sapiens
gttcttgttgtttatatgaaaac

SEQ ID NO: 3075649 - DNA, 16 bp, Homo sapiens
gttctttatatacaat

SEQ ID NO: 3075650 - DNA, 19 bp, Homo sapiens
gttctttatatacaataat

SEQ ID NO: 3075651 - DNA, 14 bp, Homo sapiens
gttctttgttcctg

SEQ ID NO: 3075652 - DNA, 15 bp, Homo sapiens
gttcttttaaagact

SEQ ID NO: 3075653 - DNA, 17 bp, Homo sapiens
gttcttttttgtacagt

SEQ ID NO: 3075654 - DNA, 17 bp, Homo sapiens
gttgaaaaaagaagttt

SEQ ID NO: 3075655 - DNA, 20 bp, Homo sapiens
gttgaaaatgtatttcctga

SEQ ID NO: 3075656 - DNA, 15 bp, Homo sapiens
gttgaaagagtccta

SEQ ID NO: 3075657 - DNA, 12 bp, Homo sapiens
gttgaaagcaaa

SEQ ID NO: 3075658 - DNA, 21 bp, Homo sapiens
gttgaactgatagttactgtt

SEQ ID NO: 3075659 - DNA, 22 bp, Homo sapiens
gttgaattccaagtgtatttta

SEQ ID NO: 3075660 - DNA, 21 bp, Homo sapiens
gttgacaggtacttggagggc

SEQ ID NO: 3075661 - DNA, 16 bp, Homo sapiens
gttgacagttctgaag

SEQ ID NO: 3075662 - DNA, 17 bp, Homo sapiens
gttgacagttctgaaga

SEQ ID NO: 3075663 - DNA, 17 bp, Homo sapiens
gttgacatatttaatgt

SEQ ID NO: 3075664 - DNA, 23 bp, Homo sapiens
gttgacatatttaatgttttaaa

SEQ ID NO: 3075665 - DNA, 13 bp, Homo sapiens
gttgactgctgct

SEQ ID NO: 3075666 - DNA, 14 bp, Homo sapiens
gttgagatgatatt

SEQ ID NO: 3075667 - DNA, 14 bp, Homo sapiens
gttgagcaagcagt

SEQ ID NO: 3075668 - DNA, 23 bp, Homo sapiens
gttgagggaacagacaggagaaa

SEQ ID NO: 3075669 - DNA, 23 bp, Homo sapiens
gttgaggtggaagccctccttcc

SEQ ID NO: 3075670 - DNA, 15 bp, Homo sapiens
gttgataatttcagg

SEQ ID NO: 3075671 - DNA, 23 bp, Homo sapiens
taaagatacagaactctttcaaa

SEQ ID NO: 3075672 - DNA, 18 bp, Homo sapiens
taaagatatttttattca

SEQ ID NO: 3075673 - DNA, 23 bp, Homo sapiens
taaagatatttttattcaaacta

SEQ ID NO: 3075674 - DNA, 22 bp, Homo sapiens
taaagatggagtttctaaggtc

SEQ ID NO: 3075675 - DNA, 12 bp, Homo sapiens
taaagatgtgaa

SEQ ID NO: 3075676 - DNA, 15 bp, Homo sapiens
taaagatgtgaaaac

SEQ ID NO: 3075677 - DNA, 17 bp, Homo sapiens
taaagatgtgaaaactc

SEQ ID NO: 3075678 - DNA, 15 bp, Homo sapiens
taaagatgttaaaaa

SEQ ID NO: 3075679 - DNA, 14 bp, Homo sapiens
taaagatttcttga

SEQ ID NO: 3075680 - DNA, 16 bp, Homo sapiens
taaagcaaaccagcct

SEQ ID NO: 3075681 - DNA, 13 bp, Homo sapiens
taaagcattccaa

SEQ ID NO: 3075682 - DNA, 16 bp, Homo sapiens
taaagccaaccagcct

SEQ ID NO: 3075683 - DNA, 15 bp, Homo sapiens
taaagccagtcatca

SEQ ID NO: 3075684 - DNA, 16 bp, Homo sapiens
taaagccagtcatcat

SEQ ID NO: 3075685 - DNA, 18 bp, Homo sapiens
taaagccagtcatcatct

SEQ ID NO: 3075686 - DNA, 19 bp, Homo sapiens
taaagctacaggtcagttt

SEQ ID NO: 3075687 - DNA, 20 bp, Homo sapiens
taaagctctcaaatgtgacc

SEQ ID NO: 3075688 - DNA, 14 bp, Homo sapiens
taaagctgttattc

SEQ ID NO: 3075689 - DNA, 17 bp, Homo sapiens
taaagctgttattcttg

SEQ ID NO: 3075690 - DNA, 20 bp, Homo sapiens
taaagctgttattcttgtta

SEQ ID NO: 3075691 - DNA, 23 bp, Homo sapiens
taaagctgttctcattcctgttc

SEQ ID NO: 3075692 - DNA, 19 bp, Homo sapiens
taaagcttatttttctgtg

SEQ ID NO: 3075693 - DNA, 20 bp, Homo sapiens
taaagcttatttttctgtga

SEQ ID NO: 3075694 - DNA, 21 bp, Homo sapiens
taaaggaaaagcacaagaaac

SEQ ID NO: 3075695 - DNA, 19 bp, Homo sapiens
taaaggaaaggccctgcac

SEQ ID NO: 3075696 - DNA, 20 bp, Homo sapiens
taaaggaacatggtttgtca

SEQ ID NO: 3075697 - DNA, 17 bp, Homo sapiens
taaaggacaaacagtga

SEQ ID NO: 3075698 - DNA, 22 bp, Homo sapiens
taaaggacaaacagtgaattta

SEQ ID NO: 3075699 - DNA, 23 bp, Homo sapiens
taaaggatatgaaactctacatt

SEQ ID NO: 3075700 - DNA, 21 bp, Homo sapiens
taaagggaaaggattcatgtg

SEQ ID NO: 3075701 - DNA, 18 bp, Homo sapiens
taaaggggtctgaaattt

SEQ ID NO: 3075702 - DNA, 19 bp, Homo sapiens
taaaggtccacaggtctag

SEQ ID NO: 3075703 - DNA, 20 bp, Homo sapiens
taaaggtggtgaggcaataa

SEQ ID NO: 3075704 - DNA, 15 bp, Homo sapiens
taaagtacttgacta

SEQ ID NO: 3075705 - DNA, 18 bp, Homo sapiens
taaagtattcttctcttc

SEQ ID NO: 3075706 - DNA, 19 bp, Homo sapiens
taaagtcacacatttctat

SEQ ID NO: 3075707 - DNA, 14 bp, Homo sapiens
taaagtctattttt

SEQ ID NO: 3075708 - DNA, 19 bp, Homo sapiens
taaagtgctaaggttctaa

SEQ ID NO: 3075709 - DNA, 20 bp, Homo sapiens
taaagtgctaaggttctaag

SEQ ID NO: 3075710 - DNA, 15 bp, Homo sapiens
taaagtgctgtttag

SEQ ID NO: 3075711 - DNA, 16 bp, Homo sapiens
taaagtgctgtttaga

SEQ ID NO: 3075712 - DNA, 18 bp, Homo sapiens
taaagtgctgtttagatt

SEQ ID NO: 3075713 - DNA, 17 bp, Homo sapiens
taaagtgcttgtgtaat

SEQ ID NO: 3075714 - DNA, 14 bp, Homo sapiens
taaagtgtttgaaa

SEQ ID NO: 3075715 - DNA, 13 bp, Homo sapiens
taaagttaaagtc

SEQ ID NO: 3075716 - DNA, 15 bp, Homo sapiens
taaagttagtctact

SEQ ID NO: 3075717 - DNA, 12 bp, Homo sapiens
taaagttctaag

SEQ ID NO: 3075718 - DNA, 19 bp, Homo sapiens
taaagttctaagattctga

SEQ ID NO: 3075719 - DNA, 20 bp, Homo sapiens
taaagttgtgccaaactata

SEQ ID NO: 3075720 - DNA, 18 bp, Homo sapiens
taaagttgtttgtgcctt

SEQ ID NO: 3075721 - DNA, 21 bp, Homo sapiens
taaagtttaagtgtgcagcca

SEQ ID NO: 3075722 - DNA, 13 bp, Homo sapiens
taaagtttctcag

SEQ ID NO: 3075723 - DNA, 18 bp, Homo sapiens
taaagtttggttttgaca

SEQ ID NO: 3075724 - DNA, 15 bp, Homo sapiens
taaataaaaatgtct

SEQ ID NO: 3075725 - DNA, 14 bp, Homo sapiens
taaataaaagatag

SEQ ID NO: 3075726 - DNA, 14 bp, Homo sapiens
taaataaaatttgt

SEQ ID NO: 3075727 - DNA, 20 bp, Homo sapiens
taaataaactgttgctcgtt

SEQ ID NO: 3075728 - DNA, 14 bp, Homo sapiens
taaataaattttgt

SEQ ID NO: 3075729 - DNA, 18 bp, Homo sapiens
taaataaattttgtgcaa

SEQ ID NO: 3075730 - DNA, 13 bp, Homo sapiens
taaataagattct

SEQ ID NO: 3075731 - DNA, 16 bp, Homo sapiens
taaataatcttactct

SEQ ID NO: 3075732 - DNA, 22 bp, Homo sapiens
taaataatttcctacacaaatg

SEQ ID NO: 3075733 - DNA, 14 bp, Homo sapiens
taaatacaaatctg

SEQ ID NO: 3075734 - DNA, 15 bp, Homo sapiens
taaatacaaatctgt

SEQ ID NO: 3075735 - DNA, 14 bp, Homo sapiens
taaatacataaata

SEQ ID NO: 3075736 - DNA, 18 bp, Homo sapiens
taaatactaactgctgat

SEQ ID NO: 3075737 - DNA, 20 bp, Homo sapiens
taaatactaactgctgattt

SEQ ID NO: 3075738 - DNA, 18 bp, Homo sapiens
taaatagagtttgctatt

SEQ ID NO: 3075739 - DNA, 14 bp, Homo sapiens
taaatagtagaaaa

SEQ ID NO: 3075740 - DNA, 15 bp, Homo sapiens
taaatagttaatata

SEQ ID NO: 3075741 - DNA, 20 bp, Homo sapiens
taaatatagttgtctttctt

SEQ ID NO: 3075742 - DNA, 16 bp, Homo sapiens
taaatatattttcttt

SEQ ID NO: 3075743 - DNA, 19 bp, Homo sapiens
taaatatgcctctcctttg

SEQ ID NO: 3075744 - DNA, 18 bp, Homo sapiens
taaatattctgtacattt

SEQ ID NO: 3075745 - DNA, 21 bp, Homo sapiens
taaatattggtttgttattct

SEQ ID NO: 3075746 - DNA, 12 bp, Homo sapiens
taaatatttctt

SEQ ID NO: 3075747 - DNA, 15 bp, Homo sapiens
taaatcacacatgct

SEQ ID NO: 3075748 - DNA, 13 bp, Homo sapiens
taaatcagaataa

SEQ ID NO: 3075749 - DNA, 17 bp, Homo sapiens
taaatcagaataaatta

SEQ ID NO: 3075750 - DNA, 16 bp, Homo sapiens
taaatcagatgttgaa

SEQ ID NO: 3075751 - DNA, 22 bp, Homo sapiens
taaatcagatgttttggtcaag

SEQ ID NO: 3075752 - DNA, 21 bp, Homo sapiens
taaatcagtttattaaatctg

SEQ ID NO: 3075753 - DNA, 22 bp, Homo sapiens
taaatcatgatgctagccagca

SEQ ID NO: 3075754 - DNA, 23 bp, Homo sapiens
taaatccttgggagtcattacca

SEQ ID NO: 3075755 - DNA, 16 bp, Homo sapiens
taaatcgggaaggatg

SEQ ID NO: 3075756 - DNA, 17 bp, Homo sapiens
taaatcgtttaatgttt

SEQ ID NO: 3075757 - DNA, 19 bp, Homo sapiens
taaatcgtttaatgtttat

SEQ ID NO: 3075758 - DNA, 22 bp, Homo sapiens
taaatcgtttaatgtttataca

SEQ ID NO: 3075759 - DNA, 24 bp, Homo sapiens
taaatctagagtttatacagtgta

SEQ ID NO: 3075760 - DNA, 14 bp, Homo sapiens
taaatctcttaaac

SEQ ID NO: 3075761 - DNA, 19 bp, Homo sapiens
taaatctcttaaactctct

SEQ ID NO: 3075762 - DNA, 14 bp, Homo sapiens
taaatctgacccag

SEQ ID NO: 3075763 - DNA, 15 bp, Homo sapiens
taaatctgacccagt

SEQ ID NO: 3075764 - DNA, 15 bp, Homo sapiens
taaatgaaaggagtt

SEQ ID NO: 3075765 - DNA, 21 bp, Homo sapiens
taaatgaaaggagtttaaaaa

SEQ ID NO: 3075766 - DNA, 15 bp, Homo sapiens
taaatgaagatcttt

SEQ ID NO: 3075767 - DNA, 16 bp, Homo sapiens
taaatgacaaagtgtt

SEQ ID NO: 3075768 - DNA, 17 bp, Homo sapiens
taaatgacaaagtgttg

SEQ ID NO: 3075769 - DNA, 14 bp, Homo sapiens
taaatgagctaaat

SEQ ID NO: 3075770 - DNA, 13 bp, Homo sapiens
taaatgcagccca

SEQ ID NO: 3075771 - DNA, 21 bp, Homo sapiens
taaatgcagcccatttctcca

SEQ ID NO: 3075772 - DNA, 23 bp, Homo sapiens
taaatgcagcccatttctccaga

SEQ ID NO: 3075773 - DNA, 12 bp, Homo sapiens
taaatgccacac

SEQ ID NO: 3075774 - DNA, 13 bp, Homo sapiens
taaatgctattat

SEQ ID NO: 3075775 - DNA, 19 bp, Homo sapiens
taaatgctattatactgtt

SEQ ID NO: 3075776 - DNA, 24 bp, Homo sapiens
taaatgctattatactgttatcca

SEQ ID NO: 3075777 - DNA, 14 bp, Homo sapiens
taaatgcttttaaa

SEQ ID NO: 3075778 - DNA, 15 bp, Homo sapiens
taaatgggaacattt

SEQ ID NO: 3075779 - DNA, 17 bp, Homo sapiens
taaatgggaacatttat

SEQ ID NO: 3075780 - DNA, 20 bp, Homo sapiens
taaatggtgatttcttgcta

SEQ ID NO: 3075781 - DNA, 19 bp, Homo sapiens
taaatgtaacagtctgatc

SEQ ID NO: 3075782 - DNA, 18 bp, Homo sapiens
taaatgtacagacatatt

SEQ ID NO: 3075783 - DNA, 23 bp, Homo sapiens
taaatgtactggtaattgtacaa

SEQ ID NO: 3075784 - DNA, 18 bp, Homo sapiens
taaatgtctattattatg

SEQ ID NO: 3075785 - DNA, 12 bp, Homo sapiens
taaatgtctgtt

SEQ ID NO: 3075786 - DNA, 10 bp, Homo sapiens
taaatgtgaa

SEQ ID NO: 3075787 - DNA, 20 bp, Homo sapiens
taaatgtgtaataatgtaac

SEQ ID NO: 3075788 - DNA, 11 bp, Homo sapiens
taaatgtgttg

SEQ ID NO: 3075789 - DNA, 16 bp, Homo sapiens
taaatgttaagaaaaa

SEQ ID NO: 3075790 - DNA, 17 bp, Homo sapiens
taaatgttagttctagc

SEQ ID NO: 3075791 - DNA, 18 bp, Homo sapiens
taaatgttagttctagct

SEQ ID NO: 3075792 - DNA, 15 bp, Homo sapiens
taaatgttattactt

SEQ ID NO: 3075793 - DNA, 20 bp, Homo sapiens
taaatgttattacttgtaaa

SEQ ID NO: 3075794 - DNA, 13 bp, Homo sapiens
taaatgtttacta

SEQ ID NO: 3075795 - DNA, 19 bp, Homo sapiens
taaatgtttactatagacc

SEQ ID NO: 3075796 - DNA, 15 bp, Homo sapiens
taaatgtttccccca

SEQ ID NO: 3075797 - DNA, 17 bp, Homo sapiens
taaattaattgaatcta

SEQ ID NO: 3075798 - DNA, 13 bp, Homo sapiens
taaattacaattt

SEQ ID NO: 3075799 - DNA, 17 bp, Homo sapiens
taaattacaattttatc

SEQ ID NO: 3075800 - DNA, 19 bp, Homo sapiens
taaattacactttattctt

SEQ ID NO: 3075801 - DNA, 19 bp, Homo sapiens
taaattatgaatattaaag

SEQ ID NO: 3075802 - DNA, 20 bp, Homo sapiens
taaattatgaatattaaagg

SEQ ID NO: 3075803 - DNA, 18 bp, Homo sapiens
taatgatttttgtgtatc

SEQ ID NO: 3075804 - DNA, 14 bp, Homo sapiens
taatgcactttcta

SEQ ID NO: 3075805 - DNA, 16 bp, Homo sapiens
taatgcagtatggtac

SEQ ID NO: 3075806 - DNA, 16 bp, Homo sapiens
taatgcataagctttt

SEQ ID NO: 3075807 - DNA, 21 bp, Homo sapiens
taatgcccagccagccacccc

SEQ ID NO: 3075808 - DNA, 19 bp, Homo sapiens
taatgcctataactttttt

SEQ ID NO: 3075809 - DNA, 15 bp, Homo sapiens
taatgctaaatgtgt

SEQ ID NO: 3075810 - DNA, 22 bp, Homo sapiens
taatgctacgtgtgatttttct

SEQ ID NO: 3075811 - DNA, 15 bp, Homo sapiens
taatgctgtctttgt

SEQ ID NO: 3075812 - DNA, 17 bp, Homo sapiens
taatgctgtctttgtgg

SEQ ID NO: 3075813 - DNA, 18 bp, Homo sapiens
taatgctgtctttgtgga

SEQ ID NO: 3075814 - DNA, 20 bp, Homo sapiens
taatggactcagctctgtct

SEQ ID NO: 3075815 - DNA, 23 bp, Homo sapiens
taatggactcagctctgtctgct

SEQ ID NO: 3075816 - DNA, 12 bp, Homo sapiens
taatggatcctt

SEQ ID NO: 3075817 - DNA, 15 bp, Homo sapiens
taatggcatgagaaa

SEQ ID NO: 3075818 - DNA, 17 bp, Homo sapiens
taatggggtcctggcca

SEQ ID NO: 3075819 - DNA, 19 bp, Homo sapiens
taatggtaccagataaaat

SEQ ID NO: 3075820 - DNA, 14 bp, Homo sapiens
taatgtaacatgat

SEQ ID NO: 3075821 - DNA, 19 bp, Homo sapiens
taatgtaatcggcttgaat

SEQ ID NO: 3075822 - DNA, 22 bp, Homo sapiens
taatgtatggctcatttgcttt

SEQ ID NO: 3075823 - DNA, 21 bp, Homo sapiens
taatgtcaccaccttcccagc

SEQ ID NO: 3075824 - DNA, 20 bp, Homo sapiens
taatgtgaactctcccctcc

SEQ ID NO: 3075825 - DNA, 18 bp, Homo sapiens
taatgtgaagacattttt

SEQ ID NO: 3075826 - DNA, 11 bp, Homo sapiens
taatgtgcagg

SEQ ID NO: 3075827 - DNA, 11 bp, Homo sapiens
taatgtgcctg

SEQ ID NO: 3075828 - DNA, 21 bp, Homo sapiens
taatgtgcctggctctgattc

SEQ ID NO: 3075829 - DNA, 12 bp, Homo sapiens
taatgtgctgtg

SEQ ID NO: 3075830 - DNA, 17 bp, Homo sapiens
taatgtgctgtgtaaag

SEQ ID NO: 3075831 - DNA, 18 bp, Homo sapiens
taatgtgctgtgtaaagt

SEQ ID NO: 3075832 - DNA, 20 bp, Homo sapiens
taatgtgctgtgtaaagtta

SEQ ID NO: 3075833 - DNA, 21 bp, Homo sapiens
taatgtgctgtgtaaagttag

SEQ ID NO: 3075834 - DNA, 17 bp, Homo sapiens
taatgtgttttagagta

SEQ ID NO: 3075835 - DNA, 18 bp, Homo sapiens
taatgttctgacagttgt

SEQ ID NO: 3075836 - DNA, 21 bp, Homo sapiens
taatgttggacacctttaggt

SEQ ID NO: 3075837 - DNA, 16 bp, Homo sapiens
taatgtttatacagag

SEQ ID NO: 3075838 - DNA, 15 bp, Homo sapiens
taatgttttaaatgt

SEQ ID NO: 3075839 - DNA, 17 bp, Homo sapiens
taatgttttaaatgtac

SEQ ID NO: 3075840 - DNA, 20 bp, Homo sapiens
taatgttttaaatgtacaga

SEQ ID NO: 3075841 - DNA, 13 bp, Homo sapiens
taatgttttcttt

SEQ ID NO: 3075842 - DNA, 21 bp, Homo sapiens
taatgttttctttgcaaagta

SEQ ID NO: 3075843 - DNA, 20 bp, Homo sapiens
taattaaaaactagtagttc

SEQ ID NO: 3075844 - DNA, 20 bp, Homo sapiens
taattaataaacgaagataa

SEQ ID NO: 3075845 - DNA, 15 bp, Homo sapiens
taattaatcctttaa

SEQ ID NO: 3075846 - DNA, 14 bp, Homo sapiens
taattataggaagt

SEQ ID NO: 3075847 - DNA, 16 bp, Homo sapiens
taattatctaaagtat

SEQ ID NO: 3075848 - DNA, 14 bp, Homo sapiens
taattattattatt

SEQ ID NO: 3075849 - DNA, 19 bp, Homo sapiens
taattattttaaaatattt

SEQ ID NO: 3075850 - DNA, 18 bp, Homo sapiens
taattatttttaatttaa

SEQ ID NO: 3075851 - DNA, 18 bp, Homo sapiens
taattcagccatgtacag

SEQ ID NO: 3075852 - DNA, 18 bp, Homo sapiens
taattcagtatgttttac

SEQ ID NO: 3075853 - DNA, 13 bp, Homo sapiens
taattcatatttt

SEQ ID NO: 3075854 - DNA, 15 bp, Homo sapiens
taattcatcttttaa

SEQ ID NO: 3075855 - DNA, 17 bp, Homo sapiens
taattcatcttttaatc

SEQ ID NO: 3075856 - DNA, 20 bp, Homo sapiens
taattcatcttttaatcatg

SEQ ID NO: 3075857 - DNA, 18 bp, Homo sapiens
taattcatttactcacca

SEQ ID NO: 3075858 - DNA, 15 bp, Homo sapiens
taattccacaccttt

SEQ ID NO: 3075859 - DNA, 17 bp, Homo sapiens
taattccacacctttta

SEQ ID NO: 3075860 - DNA, 12 bp, Homo sapiens
taattctatact

SEQ ID NO: 3075861 - DNA, 13 bp, Homo sapiens
taattctatactg

SEQ ID NO: 3075862 - DNA, 16 bp, Homo sapiens
taattctgttaactga

SEQ ID NO: 3075863 - DNA, 18 bp, Homo sapiens
taattcttattttgtgga

SEQ ID NO: 3075864 - DNA, 21 bp, Homo sapiens
taattcttcctgtttgtgtaa

SEQ ID NO: 3075865 - DNA, 15 bp, Homo sapiens
taattcttctgtcct

SEQ ID NO: 3075866 - DNA, 12 bp, Homo sapiens
taattgaagaat

SEQ ID NO: 3075867 - DNA, 14 bp, Homo sapiens
taattgcatttaaa

SEQ ID NO: 3075868 - DNA, 14 bp, Homo sapiens
taattgctgttgaa

SEQ ID NO: 3075869 - DNA, 17 bp, Homo sapiens
taattgctgttgaaagc

SEQ ID NO: 3075870 - DNA, 12 bp, Homo sapiens
taattggaggaa

SEQ ID NO: 3075871 - DNA, 16 bp, Homo sapiens
taattgtgaacagcca

SEQ ID NO: 3075872 - DNA, 22 bp, Homo sapiens
taattgtgaccaatacatttgt

SEQ ID NO: 3075873 - DNA, 20 bp, Homo sapiens
taattgtgtaaaaaatggaa

SEQ ID NO: 3075874 - DNA, 22 bp, Homo sapiens
taattgtgtaaaaaatggaaaa

SEQ ID NO: 3075875 - DNA, 19 bp, Homo sapiens
taattgttccttgctttta

SEQ ID NO: 3075876 - DNA, 20 bp, Homo sapiens
taattgttgtggtttaaata

SEQ ID NO: 3075877 - DNA, 13 bp, Homo sapiens
taatttaactttc

SEQ ID NO: 3075878 - DNA, 19 bp, Homo sapiens
taatttacaaaaatataaa

SEQ ID NO: 3075879 - DNA, 16 bp, Homo sapiens
taatttagattgtaaa

SEQ ID NO: 3075880 - DNA, 15 bp, Homo sapiens
taatttagtaaatgt

SEQ ID NO: 3075881 - DNA, 22 bp, Homo sapiens
taatttatgcacttataaggtg

SEQ ID NO: 3075882 - DNA, 14 bp, Homo sapiens
taatttatgtgaaa

SEQ ID NO: 3075883 - DNA, 17 bp, Homo sapiens
taatttattaattgctt

SEQ ID NO: 3075884 - DNA, 20 bp, Homo sapiens
taatttcaaaatgcttttta

SEQ ID NO: 3075885 - DNA, 15 bp, Homo sapiens
taatttcaaatctgt

SEQ ID NO: 3075886 - DNA, 20 bp, Homo sapiens
taatttcaaatctgtaatta

SEQ ID NO: 3075887 - DNA, 13 bp, Homo sapiens
taatttctaatgt

SEQ ID NO: 3075888 - DNA, 21 bp, Homo sapiens
taatttctgcacaggtctctg

SEQ ID NO: 3075889 - DNA, 22 bp, Homo sapiens
taatttctgtgtctaaatttct

SEQ ID NO: 3075890 - DNA, 17 bp, Homo sapiens
taatttctttttttcct

SEQ ID NO: 3075891 - DNA, 17 bp, Homo sapiens
taatttgaactttggaa

SEQ ID NO: 3075892 - DNA, 19 bp, Homo sapiens
taatttgagatcgtccact

SEQ ID NO: 3075893 - DNA, 20 bp, Homo sapiens
taatttgcattaaattcaca

SEQ ID NO: 3075894 - DNA, 17 bp, Homo sapiens
taatttggataataaaa

SEQ ID NO: 3075895 - DNA, 13 bp, Homo sapiens
taattttaacatc

SEQ ID NO: 3075896 - DNA, 18 bp, Homo sapiens
taattttagtattaactc

SEQ ID NO: 3075897 - DNA, 16 bp, Homo sapiens
taattttattcaagaa

SEQ ID NO: 3075898 - DNA, 14 bp, Homo sapiens
taattttggttgta

SEQ ID NO: 3075899 - DNA, 16 bp, Homo sapiens
taattttgtctttcaa

SEQ ID NO: 3075900 - DNA, 19 bp, Homo sapiens
taattttgtgctctttcct

SEQ ID NO: 3075901 - DNA, 16 bp, Homo sapiens
taattttgttcctgtt

SEQ ID NO: 3075902 - DNA, 18 bp, Homo sapiens
taattttgttcctgttta

SEQ ID NO: 3075903 - DNA, 19 bp, Homo sapiens
taattttttaattatttaa

SEQ ID NO: 3075904 - DNA, 18 bp, Homo sapiens
taattttttggtacaaaa

SEQ ID NO: 3075905 - DNA, 20 bp, Homo sapiens
tacaaaaacatacttcaaaa

SEQ ID NO: 3075906 - DNA, 17 bp, Homo sapiens
tacaaaaatataaaata

SEQ ID NO: 3075907 - DNA, 17 bp, Homo sapiens
tacaaaaatcagccaga

SEQ ID NO: 3075908 - DNA, 13 bp, Homo sapiens
tacaaaaatggga

SEQ ID NO: 3075909 - DNA, 16 bp, Homo sapiens
tacaaaaatgggaaaa

SEQ ID NO: 3075910 - DNA, 20 bp, Homo sapiens
tacaaaacgcgcagatgtgc

SEQ ID NO: 3075911 - DNA, 13 bp, Homo sapiens
tacaaaaggctcc

SEQ ID NO: 3075912 - DNA, 12 bp, Homo sapiens
tacaaaaggttt

SEQ ID NO: 3075913 - DNA, 22 bp, Homo sapiens
tacaaacgtatggaatgcttct

SEQ ID NO: 3075914 - DNA, 17 bp, Homo sapiens
tacaaagaaataacaag

SEQ ID NO: 3075915 - DNA, 19 bp, Homo sapiens
tacaaagaaccatgcagga

SEQ ID NO: 3075916 - DNA, 13 bp, Homo sapiens
tacaaagaagaca

SEQ ID NO: 3075917 - DNA, 14 bp, Homo sapiens
tacaaagaagacat

SEQ ID NO: 3075918 - DNA, 15 bp, Homo sapiens
tacaaagaagacatg

SEQ ID NO: 3075919 - DNA, 17 bp, Homo sapiens
tacaaagaagacatgtt

SEQ ID NO: 3075920 - DNA, 18 bp, Homo sapiens
tacaaagagatgcttgga

SEQ ID NO: 3075921 - DNA, 20 bp, Homo sapiens
tacaaagagatgcttggagc

SEQ ID NO: 3075922 - DNA, 12 bp, Homo sapiens
tacaaatctgta

SEQ ID NO: 3075923 - DNA, 18 bp, Homo sapiens
tacaaatctgtataaatg

SEQ ID NO: 3075924 - DNA, 19 bp, Homo sapiens
tacaaatctgtataaatgt

SEQ ID NO: 3075925 - DNA, 22 bp, Homo sapiens
tacaaatctgtataaatgtcta

SEQ ID NO: 3075926 - DNA, 23 bp, Homo sapiens
tacaaatctgtataaatgtctat

SEQ ID NO: 3075927 - DNA, 13 bp, Homo sapiens
tacaaattttcac

SEQ ID NO: 3075928 - DNA, 15 bp, Homo sapiens
tacaacaaacactgt

SEQ ID NO: 3075929 - DNA, 19 bp, Homo sapiens
tacaacaaacactgtgatg

SEQ ID NO: 3075930 - DNA, 15 bp, Homo sapiens
tacaacagatttgtg

SEQ ID NO: 3075931 - DNA, 16 bp, Homo sapiens
tacaacagatttgtga

SEQ ID NO: 3075932 - DNA, 18 bp, Homo sapiens
tacaacagatttgtgaac

SEQ ID NO: 3075933 - DNA, 13 bp, Homo sapiens
tacaacagcctca

SEQ ID NO: 3075934 - DNA, 20 bp, Homo sapiens
tacaacagtgctaaaaatgg

SEQ ID NO: 3075935 - DNA, 16 bp, Homo sapiens
tacaaccaatggaatg

SEQ ID NO: 3075936 - DNA, 12 bp, Homo sapiens
tactgtgggcaa

SEQ ID NO: 3075937 - DNA, 17 bp, Homo sapiens
tactgtgggcaatttag

SEQ ID NO: 3075938 - DNA, 21 bp, Homo sapiens
tactgtgtgtgtgaatgaaca

SEQ ID NO: 3075939 - DNA, 23 bp, Homo sapiens
tactgtgtgtgtgaatgaacact

SEQ ID NO: 3075940 - DNA, 12 bp, Homo sapiens
tactgttctaaa

SEQ ID NO: 3075941 - DNA, 15 bp, Homo sapiens
tactgttctaaagct

SEQ ID NO: 3075942 - DNA, 17 bp, Homo sapiens
tactgttctaaagctct

SEQ ID NO: 3075943 - DNA, 18 bp, Homo sapiens
tactgttctaaagctctg

SEQ ID NO: 3075944 - DNA, 11 bp, Homo sapiens
tactgttggtg

SEQ ID NO: 3075945 - DNA, 12 bp, Homo sapiens
tactgttttatc

SEQ ID NO: 3075946 - DNA, 14 bp, Homo sapiens
tactgttttatctc

SEQ ID NO: 3075947 - DNA, 16 bp, Homo sapiens
tactgttttctgggcc

SEQ ID NO: 3075948 - DNA, 15 bp, Homo sapiens
tacttaaacatcatt

SEQ ID NO: 3075949 - DNA, 16 bp, Homo sapiens
tacttaagattcagtt

SEQ ID NO: 3075950 - DNA, 12 bp, Homo sapiens
tacttaataaaa

SEQ ID NO: 3075951 - DNA, 17 bp, Homo sapiens
tacttaatactgaattt

SEQ ID NO: 3075952 - DNA, 13 bp, Homo sapiens
tacttacaaaaat

SEQ ID NO: 3075953 - DNA, 14 bp, Homo sapiens
tacttacattctct

SEQ ID NO: 3075954 - DNA, 17 bp, Homo sapiens
tacttagatatttcatg

SEQ ID NO: 3075955 - DNA, 16 bp, Homo sapiens
tacttaggactacatt

SEQ ID NO: 3075956 - DNA, 17 bp, Homo sapiens
tacttagtggtgtatat

SEQ ID NO: 3075957 - DNA, 14 bp, Homo sapiens
tacttataaagaag

SEQ ID NO: 3075958 - DNA, 20 bp, Homo sapiens
tacttatcatccacattgtt

SEQ ID NO: 3075959 - DNA, 23 bp, Homo sapiens
tacttatccctgcccatttcata

SEQ ID NO: 3075960 - DNA, 18 bp, Homo sapiens
tacttatttacctataaa

SEQ ID NO: 3075961 - DNA, 14 bp, Homo sapiens
tacttcaaaagtat

SEQ ID NO: 3075962 - DNA, 22 bp, Homo sapiens
tacttcagcaagagagaaccta

SEQ ID NO: 3075963 - DNA, 11 bp, Homo sapiens
tacttccagca

SEQ ID NO: 3075964 - DNA, 14 bp, Homo sapiens
tacttccagcaaaa

SEQ ID NO: 3075965 - DNA, 21 bp, Homo sapiens
tacttccagcaaaatccaaac

SEQ ID NO: 3075966 - DNA, 16 bp, Homo sapiens
tacttcccccaccctg

SEQ ID NO: 3075967 - DNA, 19 bp, Homo sapiens
tacttcccccaccctgggt

SEQ ID NO: 3075968 - DNA, 20 bp, Homo sapiens
tacttcccccaccctgggtt

SEQ ID NO: 3075969 - DNA, 15 bp, Homo sapiens
tacttccctcttgaa

SEQ ID NO: 3075970 - DNA, 16 bp, Homo sapiens
tacttcgatgatgatg

SEQ ID NO: 3075971 - DNA, 16 bp, Homo sapiens
tacttctaatcttaaa

SEQ ID NO: 3075972 - DNA, 23 bp, Homo sapiens
tacttctaatcttaaatcagaat

SEQ ID NO: 3075973 - DNA, 16 bp, Homo sapiens
tacttctagagggaga

SEQ ID NO: 3075974 - DNA, 20 bp, Homo sapiens
tacttctctgagtcagctga

SEQ ID NO: 3075975 - DNA, 14 bp, Homo sapiens
tacttcttgaaggt

SEQ ID NO: 3075976 - DNA, 17 bp, Homo sapiens
tacttgaagggccagag

SEQ ID NO: 3075977 - DNA, 18 bp, Homo sapiens
tacttgaagggccagagc

SEQ ID NO: 3075978 - DNA, 16 bp, Homo sapiens
tacttgatatttcctt

SEQ ID NO: 3075979 - DNA, 15 bp, Homo sapiens
tacttgccaagcagt

SEQ ID NO: 3075980 - DNA, 22 bp, Homo sapiens
tacttgccaagcagtgcacatt

SEQ ID NO: 3075981 - DNA, 14 bp, Homo sapiens
tacttgccagaagt

SEQ ID NO: 3075982 - DNA, 23 bp, Homo sapiens
tacttgccttattagagtgtctt

SEQ ID NO: 3075983 - DNA, 17 bp, Homo sapiens
tacttgcttattacatt

SEQ ID NO: 3075984 - DNA, 18 bp, Homo sapiens
tacttgcttattacattt

SEQ ID NO: 3075985 - DNA, 19 bp, Homo sapiens
tacttgcttattacattta

SEQ ID NO: 3075986 - DNA, 20 bp, Homo sapiens
tacttgggagcctgaggcag

SEQ ID NO: 3075987 - DNA, 15 bp, Homo sapiens
tacttgtcaaagaag

SEQ ID NO: 3075988 - DNA, 18 bp, Homo sapiens
tacttgtgtttttccctt

SEQ ID NO: 3075989 - DNA, 15 bp, Homo sapiens
tacttgttcatttgg

SEQ ID NO: 3075990 - DNA, 15 bp, Homo sapiens
tacttgtttcaaatg

SEQ ID NO: 3075991 - DNA, 18 bp, Homo sapiens
tactttatcaaagattgg

SEQ ID NO: 3075992 - DNA, 20 bp, Homo sapiens
tactttatgcatctctgctt

SEQ ID NO: 3075993 - DNA, 21 bp, Homo sapiens
tactttctatttttatgatga

SEQ ID NO: 3075994 - DNA, 13 bp, Homo sapiens
tactttctcttgt

SEQ ID NO: 3075995 - DNA, 15 bp, Homo sapiens
tactttctcttgttt

SEQ ID NO: 3075996 - DNA, 13 bp, Homo sapiens
tactttgtaaata

SEQ ID NO: 3075997 - DNA, 23 bp, Homo sapiens
tactttgtaaataggatttttag

SEQ ID NO: 3075998 - DNA, 13 bp, Homo sapiens
tactttgtatttt

SEQ ID NO: 3075999 - DNA, 22 bp, Homo sapiens
tactttgtatttttcttttgaa

SEQ ID NO: 3076000 - DNA, 20 bp, Homo sapiens
tactttgtcctttttgttat

SEQ ID NO: 3076001 - DNA, 13 bp, Homo sapiens
tactttgtgcaaa

SEQ ID NO: 3076002 - DNA, 11 bp, Homo sapiens
tactttgtgct

SEQ ID NO: 3076003 - DNA, 14 bp, Homo sapiens
tactttgtttttcc

SEQ ID NO: 3076004 - DNA, 20 bp, Homo sapiens
tactttgtttttccatgtgt

SEQ ID NO: 3076005 - DNA, 12 bp, Homo sapiens
tacttttaaatt

SEQ ID NO: 3076006 - DNA, 15 bp, Homo sapiens
tacttttacattaaa

SEQ ID NO: 3076007 - DNA, 17 bp, Homo sapiens
tacttttacttgttcat

SEQ ID NO: 3076008 - DNA, 16 bp, Homo sapiens
tactttttaaaatgtt

SEQ ID NO: 3076009 - DNA, 19 bp, Homo sapiens
tactttttagtaatttctt

SEQ ID NO: 3076010 - DNA, 14 bp, Homo sapiens
tactttttcatgta

SEQ ID NO: 3076011 - DNA, 13 bp, Homo sapiens
tactttttcctgg

SEQ ID NO: 3076012 - DNA, 15 bp, Homo sapiens
tactttttgtgaaga

SEQ ID NO: 3076013 - DNA, 18 bp, Homo sapiens
tacttttttaaatatttt

SEQ ID NO: 3076014 - DNA, 21 bp, Homo sapiens
tacttttttaaatattttcta

SEQ ID NO: 3076015 - DNA, 23 bp, Homo sapiens
tacttttttaaatattttctatt

SEQ ID NO: 3076016 - DNA, 12 bp, Homo sapiens
tacttttttcca

SEQ ID NO: 3076017 - DNA, 20 bp, Homo sapiens
tagaaaaacccaaactgaga

SEQ ID NO: 3076018 - DNA, 20 bp, Homo sapiens
tagaaaaagaacatgcagtt

SEQ ID NO: 3076019 - DNA, 21 bp, Homo sapiens
tagaaaaagaacatgcagttt

SEQ ID NO: 3076020 - DNA, 13 bp, Homo sapiens
tagaaaaagcagt

SEQ ID NO: 3076021 - DNA, 18 bp, Homo sapiens
tagaaaaatgatgtcttt

SEQ ID NO: 3076022 - DNA, 19 bp, Homo sapiens
tagaaaaatgatgtcttta

SEQ ID NO: 3076023 - DNA, 16 bp, Homo sapiens
tagaaaacaaaggagc

SEQ ID NO: 3076024 - DNA, 19 bp, Homo sapiens
tagaaaacccaagttttta

SEQ ID NO: 3076025 - DNA, 12 bp, Homo sapiens
tagaaaagttat

SEQ ID NO: 3076026 - DNA, 21 bp, Homo sapiens
tagaaaatagagcttttaaaa

SEQ ID NO: 3076027 - DNA, 14 bp, Homo sapiens
tagaaaatgcacca

SEQ ID NO: 3076028 - DNA, 15 bp, Homo sapiens
tagaaaattcataac

SEQ ID NO: 3076029 - DNA, 21 bp, Homo sapiens
tagaaaattttatgtatttta

SEQ ID NO: 3076030 - DNA, 22 bp, Homo sapiens
tagaaacctttatccctgctta

SEQ ID NO: 3076031 - DNA, 18 bp, Homo sapiens
tagaaagagatacagagg

SEQ ID NO: 3076032 - DNA, 19 bp, Homo sapiens
tagaaagcatccattaatt

SEQ ID NO: 3076033 - DNA, 23 bp, Homo sapiens
tagaaagcatccattaattaatg

SEQ ID NO: 3076034 - DNA, 21 bp, Homo sapiens
tagaaagctgacattgccaaa

SEQ ID NO: 3076035 - DNA, 15 bp, Homo sapiens
tagaaagcttgaaaa

SEQ ID NO: 3076036 - DNA, 17 bp, Homo sapiens
tagaaatctgtcctgtg

SEQ ID NO: 3076037 - DNA, 17 bp, Homo sapiens
tagaaatggtttcctct

SEQ ID NO: 3076038 - DNA, 19 bp, Homo sapiens
tagaaatggtttcctctgg

SEQ ID NO: 3076039 - DNA, 16 bp, Homo sapiens
tagaaatgtattttga

SEQ ID NO: 3076040 - DNA, 14 bp, Homo sapiens
tagaaattctttat

SEQ ID NO: 3076041 - DNA, 19 bp, Homo sapiens
tagaaatttttcagatgct

SEQ ID NO: 3076042 - DNA, 13 bp, Homo sapiens
tagaacaaaaact

SEQ ID NO: 3076043 - DNA, 17 bp, Homo sapiens
tagaacaagcccaaatt

SEQ ID NO: 3076044 - DNA, 19 bp, Homo sapiens
tagaacacagagtgtgttt

SEQ ID NO: 3076045 - DNA, 22 bp, Homo sapiens
tagaacagggaaaataggcagg

SEQ ID NO: 3076046 - DNA, 18 bp, Homo sapiens
tagaaccaccaaaattat

SEQ ID NO: 3076047 - DNA, 23 bp, Homo sapiens
tagaaccaccaaaattatagctt

SEQ ID NO: 3076048 - DNA, 16 bp, Homo sapiens
tagaacccttctgctt

SEQ ID NO: 3076049 - DNA, 18 bp, Homo sapiens
tagaacgagcctggaagc

SEQ ID NO: 3076050 - DNA, 13 bp, Homo sapiens
tagaactgtactg

SEQ ID NO: 3076051 - DNA, 13 bp, Homo sapiens
tagaagataatga

SEQ ID NO: 3076052 - DNA, 15 bp, Homo sapiens
tagaagccacccttc

SEQ ID NO: 3076053 - DNA, 18 bp, Homo sapiens
tagaagccacccttccct

SEQ ID NO: 3076054 - DNA, 19 bp, Homo sapiens
tagaagccacccttccctg

SEQ ID NO: 3076055 - DNA, 17 bp, Homo sapiens
tagaaggatgtacattt

SEQ ID NO: 3076056 - DNA, 24 bp, Homo sapiens
tagaagtaagaagaggagcctcag

SEQ ID NO: 3076057 - DNA, 20 bp, Homo sapiens
tagaagtgggccaggacagg

SEQ ID NO: 3076058 - DNA, 17 bp, Homo sapiens
tagaagtgttgtaaaag

SEQ ID NO: 3076059 - DNA, 13 bp, Homo sapiens
tagaataaaagct

SEQ ID NO: 3076060 - DNA, 18 bp, Homo sapiens
tagaataaaagctgtgga

SEQ ID NO: 3076061 - DNA, 22 bp, Homo sapiens
tagaataaaagctgtggaatga

SEQ ID NO: 3076062 - DNA, 15 bp, Homo sapiens
tagaataaatgaaga

SEQ ID NO: 3076063 - DNA, 17 bp, Homo sapiens
tagaatgcatctcatca

SEQ ID NO: 3076064 - DNA, 19 bp, Homo sapiens
tagaatgcatctcatcaac

SEQ ID NO: 3076065 - DNA, 16 bp, Homo sapiens
tagaatgtattgtacc

SEQ ID NO: 3076066 - DNA, 11 bp, Homo sapiens
tagaatgtgat

SEQ ID NO: 3076067 - DNA, 14 bp, Homo sapiens
tagaattaaaattt

SEQ ID NO: 3076068 - DNA, 16 bp, Homo sapiens
tagaattccttcaggg

SEQ ID NO: 3076069 - DNA, 16 bp, Homo sapiens
tagggctgggaaacac

SEQ ID NO: 3076070 - DNA, 14 bp, Homo sapiens
tagggcttagtgtt

SEQ ID NO: 3076071 - DNA, 13 bp, Homo sapiens
tagggcttttatt

SEQ ID NO: 3076072 - DNA, 11 bp, Homo sapiens
taggggcaggt

SEQ ID NO: 3076073 - DNA, 18 bp, Homo sapiens
taggggcttggtcctagg

SEQ ID NO: 3076074 - DNA, 17 bp, Homo sapiens
taggggtcctgggggca

SEQ ID NO: 3076075 - DNA, 14 bp, Homo sapiens
tagggtaaaaaaag

SEQ ID NO: 3076076 - DNA, 15 bp, Homo sapiens
tagggtaaggtgcct

SEQ ID NO: 3076077 - DNA, 13 bp, Homo sapiens
tagggtctaccaa

SEQ ID NO: 3076078 - DNA, 18 bp, Homo sapiens
tagggtctaccaatacaa

SEQ ID NO: 3076079 - DNA, 16 bp, Homo sapiens
tagggtggagagccac

SEQ ID NO: 3076080 - DNA, 21 bp, Homo sapiens
tagggtggcacatctgtcctg

SEQ ID NO: 3076081 - DNA, 19 bp, Homo sapiens
tagggttttgcaataactt

SEQ ID NO: 3076082 - DNA, 15 bp, Homo sapiens
tagggttttggcctg

SEQ ID NO: 3076083 - DNA, 12 bp, Homo sapiens
taggtaaatcta

SEQ ID NO: 3076084 - DNA, 14 bp, Homo sapiens
taggtatctttata

SEQ ID NO: 3076085 - DNA, 20 bp, Homo sapiens
taggtatctttatagttgta

SEQ ID NO: 3076086 - DNA, 15 bp, Homo sapiens
taggtcattactaac

SEQ ID NO: 3076087 - DNA, 15 bp, Homo sapiens
taggtcttcctgtgg

SEQ ID NO: 3076088 - DNA, 14 bp, Homo sapiens
taggtctttgtaag

SEQ ID NO: 3076089 - DNA, 14 bp, Homo sapiens
taggtgcagctcct

SEQ ID NO: 3076090 - DNA, 15 bp, Homo sapiens
taggtgttctaatca

SEQ ID NO: 3076091 - DNA, 13 bp, Homo sapiens
taggttctaaagt

SEQ ID NO: 3076092 - DNA, 17 bp, Homo sapiens
taggttctaaagttcta

SEQ ID NO: 3076093 - DNA, 18 bp, Homo sapiens
taggttctaaagttctaa

SEQ ID NO: 3076094 - DNA, 21 bp, Homo sapiens
taggttctaaagttctaagat

SEQ ID NO: 3076095 - DNA, 14 bp, Homo sapiens
taggttgtagcaga

SEQ ID NO: 3076096 - DNA, 21 bp, Homo sapiens
taggttttgtttgctatctta

SEQ ID NO: 3076097 - DNA, 23 bp, Homo sapiens
taggttttgtttgctatcttaat

SEQ ID NO: 3076098 - DNA, 13 bp, Homo sapiens
tagtaaaaacatt

SEQ ID NO: 3076099 - DNA, 13 bp, Homo sapiens
tagtaaaaattaa

SEQ ID NO: 3076100 - DNA, 16 bp, Homo sapiens
tagtaaaaattaaaaa

SEQ ID NO: 3076101 - DNA, 15 bp, Homo sapiens
tagtaaaacacagag

SEQ ID NO: 3076102 - DNA, 15 bp, Homo sapiens
tagtaaagtattttt

SEQ ID NO: 3076103 - DNA, 21 bp, Homo sapiens
tagtaacctttaaaaatgtat

SEQ ID NO: 3076104 - DNA, 12 bp, Homo sapiens
tagtaactgaca

SEQ ID NO: 3076105 - DNA, 13 bp, Homo sapiens
tagtaactgacat

SEQ ID NO: 3076106 - DNA, 15 bp, Homo sapiens
tagtaactgacatga

SEQ ID NO: 3076107 - DNA, 15 bp, Homo sapiens
tagtaactgctgtcg

SEQ ID NO: 3076108 - DNA, 18 bp, Homo sapiens
tagtaacttcttatggaa

SEQ ID NO: 3076109 - DNA, 16 bp, Homo sapiens
tagtaagaaaacatca

SEQ ID NO: 3076110 - DNA, 17 bp, Homo sapiens
tagtaatgagtttaaaa

SEQ ID NO: 3076111 - DNA, 12 bp, Homo sapiens
tagtacataatt

SEQ ID NO: 3076112 - DNA, 15 bp, Homo sapiens
tagtactgctcttgt

SEQ ID NO: 3076113 - DNA, 12 bp, Homo sapiens
tagtagaaaaat

SEQ ID NO: 3076114 - DNA, 16 bp, Homo sapiens
tagtataatatttctt

SEQ ID NO: 3076115 - DNA, 23 bp, Homo sapiens
tagtatcaaatattagatgtgat

SEQ ID NO: 3076116 - DNA, 20 bp, Homo sapiens
tagtatcaagtgttctaaaa

SEQ ID NO: 3076117 - DNA, 17 bp, Homo sapiens
tagtatgctgtatgaat

SEQ ID NO: 3076118 - DNA, 18 bp, Homo sapiens
tagtatttatttatgtac

SEQ ID NO: 3076119 - DNA, 20 bp, Homo sapiens
tagtatttgattcaaaatat

SEQ ID NO: 3076120 - DNA, 14 bp, Homo sapiens
tagtcaaatattta

SEQ ID NO: 3076121 - DNA, 14 bp, Homo sapiens
tagtcaagctcctc

SEQ ID NO: 3076122 - DNA, 15 bp, Homo sapiens
tagtcaagctcctcc

SEQ ID NO: 3076123 - DNA, 19 bp, Homo sapiens
tagtcaatcaagtctgttt

SEQ ID NO: 3076124 - DNA, 16 bp, Homo sapiens
tagtcaatttctactt

SEQ ID NO: 3076125 - DNA, 18 bp, Homo sapiens
tagtcaccgacagcggcc

SEQ ID NO: 3076126 - DNA, 15 bp, Homo sapiens
tagtcactgctgcta

SEQ ID NO: 3076127 - DNA, 20 bp, Homo sapiens
tagtcactttttttttccaa

SEQ ID NO: 3076128 - DNA, 21 bp, Homo sapiens
tagtcccaccttggagcattt

SEQ ID NO: 3076129 - DNA, 23 bp, Homo sapiens
tagtcccaccttggagcatttat

SEQ ID NO: 3076130 - DNA, 14 bp, Homo sapiens
tagtcccttggata

SEQ ID NO: 3076131 - DNA, 23 bp, Homo sapiens
tagtcctagctgacgccaataat

SEQ ID NO: 3076132 - DNA, 15 bp, Homo sapiens
tagtcctagtgaacc

SEQ ID NO: 3076133 - DNA, 16 bp, Homo sapiens
tagtcctagtgaacct

SEQ ID NO: 3076134 - DNA, 21 bp, Homo sapiens
tagtcctttataagttgcttt

SEQ ID NO: 3076135 - DNA, 20 bp, Homo sapiens
tagtctagatggctcctctc

SEQ ID NO: 3076136 - DNA, 13 bp, Homo sapiens
tagtctcctttga

SEQ ID NO: 3076137 - DNA, 21 bp, Homo sapiens
tagtctctatcattaaagttc

SEQ ID NO: 3076138 - DNA, 18 bp, Homo sapiens
tagtctctttattcctag

SEQ ID NO: 3076139 - DNA, 19 bp, Homo sapiens
tagtctctttattcctagt

SEQ ID NO: 3076140 - DNA, 13 bp, Homo sapiens
tagtcttacctaa

SEQ ID NO: 3076141 - DNA, 21 bp, Homo sapiens
tagtcttgtcttagctctgga

SEQ ID NO: 3076142 - DNA, 23 bp, Homo sapiens
tagtgaaatgaatatttaaataa

SEQ ID NO: 3076143 - DNA, 16 bp, Homo sapiens
tagtgaacacagcaga

SEQ ID NO: 3076144 - DNA, 20 bp, Homo sapiens
tagtgaacacagcagaccta

SEQ ID NO: 3076145 - DNA, 14 bp, Homo sapiens
tagtgaacttgaaa

SEQ ID NO: 3076146 - DNA, 17 bp, Homo sapiens
tagtgacatttaatgcc

SEQ ID NO: 3076147 - DNA, 18 bp, Homo sapiens
tagtgaccaagtgcaata

SEQ ID NO: 3076148 - DNA, 22 bp, Homo sapiens
tagtgagcgagtggatgctgtg

SEQ ID NO: 3076149 - DNA, 17 bp, Homo sapiens
tagtgagtcagcacctt

SEQ ID NO: 3076150 - DNA, 12 bp, Homo sapiens
tagtgatatttc

SEQ ID NO: 3076151 - DNA, 21 bp, Homo sapiens
tagtgatgtccttaaaatgtg

SEQ ID NO: 3076152 - DNA, 22 bp, Homo sapiens
tagtgatgtccttaaaatgtgg

SEQ ID NO: 3076153 - DNA, 14 bp, Homo sapiens
tagtgattgctttt

SEQ ID NO: 3076154 - DNA, 20 bp, Homo sapiens
tagtgatttttatgccacct

SEQ ID NO: 3076155 - DNA, 21 bp, Homo sapiens
tagtgcattgtttctgtgggc

SEQ ID NO: 3076156 - DNA, 14 bp, Homo sapiens
tagtgccaccacag

SEQ ID NO: 3076157 - DNA, 14 bp, Homo sapiens
tagtgccccagact

SEQ ID NO: 3076158 - DNA, 17 bp, Homo sapiens
tagtgccccagactgag

SEQ ID NO: 3076159 - DNA, 21 bp, Homo sapiens
tagtgccccagactgagctct

SEQ ID NO: 3076160 - DNA, 15 bp, Homo sapiens
tagtgccttgcccac

SEQ ID NO: 3076161 - DNA, 16 bp, Homo sapiens
tagtgccttgcccaca

SEQ ID NO: 3076162 - DNA, 16 bp, Homo sapiens
tagtgcctttttcctt

SEQ ID NO: 3076163 - DNA, 14 bp, Homo sapiens
tagtgcttcttgta

SEQ ID NO: 3076164 - DNA, 18 bp, Homo sapiens
tagtgggcaccccactgc

SEQ ID NO: 3076165 - DNA, 21 bp, Homo sapiens
tagtggggtctccctctcctg

SEQ ID NO: 3076166 - DNA, 22 bp, Homo sapiens
tagtggggtctccctctcctgc

SEQ ID NO: 3076167 - DNA, 21 bp, Homo sapiens
tagtgtacatttctataaata

SEQ ID NO: 3076168 - DNA, 23 bp, Homo sapiens
tagtgtacatttctataaataga

SEQ ID NO: 3076169 - DNA, 22 bp, Homo sapiens
tagtgtacctcctctcagtgtt

SEQ ID NO: 3076170 - DNA, 22 bp, Homo sapiens
tagtgtccgcataagaaaaaga

SEQ ID NO: 3076171 - DNA, 23 bp, Homo sapiens
tagtgtctgggtttggcccaaga

SEQ ID NO: 3076172 - DNA, 17 bp, Homo sapiens
tagtgtgggaggctcct

SEQ ID NO: 3076173 - DNA, 20 bp, Homo sapiens
tagtgtgtgtgcagagtcca

SEQ ID NO: 3076174 - DNA, 12 bp, Homo sapiens
tagtgttaatca

SEQ ID NO: 3076175 - DNA, 14 bp, Homo sapiens
tagtgttaatcaat

SEQ ID NO: 3076176 - DNA, 15 bp, Homo sapiens
tagtgtttctgtgca

SEQ ID NO: 3076177 - DNA, 16 bp, Homo sapiens
tagtgtttctgtgcat

SEQ ID NO: 3076178 - DNA, 16 bp, Homo sapiens
tagtgttttaaaacac

SEQ ID NO: 3076179 - DNA, 21 bp, Homo sapiens
tagttaaaaaaaaaaaaagga

SEQ ID NO: 3076180 - DNA, 14 bp, Homo sapiens
tagttaagacatga

SEQ ID NO: 3076181 - DNA, 21 bp, Homo sapiens
tagttaagacatgatttcctt

SEQ ID NO: 3076182 - DNA, 14 bp, Homo sapiens
tagttacagctgtg

SEQ ID NO: 3076183 - DNA, 20 bp, Homo sapiens
tagttacattaatgcccagc

SEQ ID NO: 3076184 - DNA, 18 bp, Homo sapiens
tagttactgttgtgacct

SEQ ID NO: 3076185 - DNA, 12 bp, Homo sapiens
tagttattggat

SEQ ID NO: 3076186 - DNA, 15 bp, Homo sapiens
tagttatttaagaag

SEQ ID NO: 3076187 - DNA, 23 bp, Homo sapiens
tagttatttctgcctataaattt

SEQ ID NO: 3076188 - DNA, 13 bp, Homo sapiens
tagttattttgca

SEQ ID NO: 3076189 - DNA, 13 bp, Homo sapiens
tagttctaagact

SEQ ID NO: 3076190 - DNA, 11 bp, Homo sapiens
tagttctagac

SEQ ID NO: 3076191 - DNA, 14 bp, Homo sapiens
tagttctgccagga

SEQ ID NO: 3076192 - DNA, 14 bp, Homo sapiens
tagttctttgttcc

SEQ ID NO: 3076193 - DNA, 16 bp, Homo sapiens
tagttctttgttcctg

SEQ ID NO: 3076194 - DNA, 17 bp, Homo sapiens
tagttctttgttcctgc

SEQ ID NO: 3076195 - DNA, 19 bp, Homo sapiens
tagttctttgttcctgctt

SEQ ID NO: 3076196 - DNA, 16 bp, Homo sapiens
tagttgaaaaaagaag

SEQ ID NO: 3076197 - DNA, 17 bp, Homo sapiens
tagttgaaaataaagtg

SEQ ID NO: 3076198 - DNA, 22 bp, Homo sapiens
tagttgaactgatagttactgt

SEQ ID NO: 3076199 - DNA, 13 bp, Homo sapiens
tagttgatatgtt

SEQ ID NO: 3076200 - DNA, 16 bp, Homo sapiens
tagttgcaattgaatt

SEQ ID NO: 3076201 - DNA, 11 bp, Homo sapiens
tagttggaatg

SEQ ID NO: 3076202 - DNA, 15 bp, Homo sapiens
tatgctttgaaacag

SEQ ID NO: 3076203 - DNA, 22 bp, Homo sapiens
tatggaagtaaaggcattccac

SEQ ID NO: 3076204 - DNA, 14 bp, Homo sapiens
tatggaatgcttct

SEQ ID NO: 3076205 - DNA, 15 bp, Homo sapiens
tatggaatgcttctt

SEQ ID NO: 3076206 - DNA, 17 bp, Homo sapiens
tatggaatgcttcttaa

SEQ ID NO: 3076207 - DNA, 17 bp, Homo sapiens
tatggaatgtcagtgtt

SEQ ID NO: 3076208 - DNA, 14 bp, Homo sapiens
tatggacactgtga

SEQ ID NO: 3076209 - DNA, 17 bp, Homo sapiens
tatggacactgtgacaa

SEQ ID NO: 3076210 - DNA, 19 bp, Homo sapiens
tatggacactgtgacaatg

SEQ ID NO: 3076211 - DNA, 21 bp, Homo sapiens
tatggacatcgatatgaaaaa

SEQ ID NO: 3076212 - DNA, 15 bp, Homo sapiens
tatggactctgcaca

SEQ ID NO: 3076213 - DNA, 16 bp, Homo sapiens
tatggctcttcacctg

SEQ ID NO: 3076214 - DNA, 15 bp, Homo sapiens
tatgggcccctggca

SEQ ID NO: 3076215 - DNA, 21 bp, Homo sapiens
tatggggatagtctgggtcag

SEQ ID NO: 3076216 - DNA, 21 bp, Homo sapiens
tatggtatcatgtatctctct

SEQ ID NO: 3076217 - DNA, 20 bp, Homo sapiens
tatggtgctaatattttatt

SEQ ID NO: 3076218 - DNA, 19 bp, Homo sapiens
tatggtgtttctccctctc

SEQ ID NO: 3076219 - DNA, 21 bp, Homo sapiens
tatgtaacaaacctgcactta

SEQ ID NO: 3076220 - DNA, 11 bp, Homo sapiens
tatgtaacatg

SEQ ID NO: 3076221 - DNA, 12 bp, Homo sapiens
tatgtacagtta

SEQ ID NO: 3076222 - DNA, 15 bp, Homo sapiens
tatgtacatgagaag

SEQ ID NO: 3076223 - DNA, 16 bp, Homo sapiens
tatgtacgtttgtatg

SEQ ID NO: 3076224 - DNA, 14 bp, Homo sapiens
tatgtagaaacatt

SEQ ID NO: 3076225 - DNA, 13 bp, Homo sapiens
tatgtagaagcat

SEQ ID NO: 3076226 - DNA, 17 bp, Homo sapiens
tatgtagtaattgacat

SEQ ID NO: 3076227 - DNA, 20 bp, Homo sapiens
tatgtatacacaaatatata

SEQ ID NO: 3076228 - DNA, 17 bp, Homo sapiens
tatgtatattctatttt

SEQ ID NO: 3076229 - DNA, 16 bp, Homo sapiens
tatgtatcagaagaga

SEQ ID NO: 3076230 - DNA, 20 bp, Homo sapiens
tatgtatggaaacacatact

SEQ ID NO: 3076231 - DNA, 22 bp, Homo sapiens
tatgtattaataaatagagcaa

SEQ ID NO: 3076232 - DNA, 20 bp, Homo sapiens
tatgtattagtgatatttct

SEQ ID NO: 3076233 - DNA, 21 bp, Homo sapiens
tatgtattagtgatatttctc

SEQ ID NO: 3076234 - DNA, 22 bp, Homo sapiens
tatgtattagtgatatttctct

SEQ ID NO: 3076235 - DNA, 16 bp, Homo sapiens
tatgtattttttgaat

SEQ ID NO: 3076236 - DNA, 21 bp, Homo sapiens
tatgtcgtgttttcaaggaag

SEQ ID NO: 3076237 - DNA, 15 bp, Homo sapiens
tatgtcttgaaacat

SEQ ID NO: 3076238 - DNA, 21 bp, Homo sapiens
tatgtcttggacactgtacaa

SEQ ID NO: 3076239 - DNA, 17 bp, Homo sapiens
tatgtgaaaggaacatt

SEQ ID NO: 3076240 - DNA, 19 bp, Homo sapiens
tatgtgaaaggaacatttt

SEQ ID NO: 3076241 - DNA, 20 bp, Homo sapiens
tatgtgaaaggaacattttt

SEQ ID NO: 3076242 - DNA, 14 bp, Homo sapiens
tatgtgaatttgag

SEQ ID NO: 3076243 - DNA, 19 bp, Homo sapiens
tatgtgacaattttgtaca

SEQ ID NO: 3076244 - DNA, 16 bp, Homo sapiens
tatgtgagtgaaagta

SEQ ID NO: 3076245 - DNA, 16 bp, Homo sapiens
tatgtgagtgcctttt

SEQ ID NO: 3076246 - DNA, 23 bp, Homo sapiens
tatgtgagtgccttttgcagaag

SEQ ID NO: 3076247 - DNA, 21 bp, Homo sapiens
tatgtgattttaactctgtct

SEQ ID NO: 3076248 - DNA, 19 bp, Homo sapiens
tatgtgccaggcttgcctg

SEQ ID NO: 3076249 - DNA, 16 bp, Homo sapiens
tatgtgcgtgtgcgtg

SEQ ID NO: 3076250 - DNA, 14 bp, Homo sapiens
tatgtgcttgtgct

SEQ ID NO: 3076251 - DNA, 17 bp, Homo sapiens
tatgtggatacagtcat

SEQ ID NO: 3076252 - DNA, 13 bp, Homo sapiens
tatgtgtatgtac

SEQ ID NO: 3076253 - DNA, 18 bp, Homo sapiens
tatgtgtgttgtttccat

SEQ ID NO: 3076254 - DNA, 22 bp, Homo sapiens
tatgtgtgttgtttccatagct

SEQ ID NO: 3076255 - DNA, 18 bp, Homo sapiens
tatgtgttgcataaacaa

SEQ ID NO: 3076256 - DNA, 15 bp, Homo sapiens
tatgtgtttttcaca

SEQ ID NO: 3076257 - DNA, 16 bp, Homo sapiens
tatgtgtttttcacat

SEQ ID NO: 3076258 - DNA, 20 bp, Homo sapiens
tatgttaataaactgcaaat

SEQ ID NO: 3076259 - DNA, 16 bp, Homo sapiens
tatgttacttaaacat

SEQ ID NO: 3076260 - DNA, 17 bp, Homo sapiens
tatgttagattttgcat

SEQ ID NO: 3076261 - DNA, 14 bp, Homo sapiens
tatgttcttataga

SEQ ID NO: 3076262 - DNA, 13 bp, Homo sapiens
tatgttgacttta

SEQ ID NO: 3076263 - DNA, 21 bp, Homo sapiens
tatgttgctataataaagaag

SEQ ID NO: 3076264 - DNA, 15 bp, Homo sapiens
tatgttggaaaaaag

SEQ ID NO: 3076265 - DNA, 21 bp, Homo sapiens
tatgttgtccaattgttgaca

SEQ ID NO: 3076266 - DNA, 23 bp, Homo sapiens
tatgtttcttattctctgtttgc

SEQ ID NO: 3076267 - DNA, 13 bp, Homo sapiens
tatgtttgtacac

SEQ ID NO: 3076268 - DNA, 22 bp, Homo sapiens
tatgttttttttctgctggaaa

SEQ ID NO: 3076269 - DNA, 14 bp, Homo sapiens
tattaaaaaacaat

SEQ ID NO: 3076270 - DNA, 22 bp, Homo sapiens
tattaaaacagaaattaatctt

SEQ ID NO: 3076271 - DNA, 21 bp, Homo sapiens
tattaaacgtatgcatgtgaa

SEQ ID NO: 3076272 - DNA, 12 bp, Homo sapiens
tattaaactctc

SEQ ID NO: 3076273 - DNA, 12 bp, Homo sapiens
tattaaacttga

SEQ ID NO: 3076274 - DNA, 22 bp, Homo sapiens
tattaaagcctcatgtgtgaaa

SEQ ID NO: 3076275 - DNA, 18 bp, Homo sapiens
tattaaagtgctaaggtt

SEQ ID NO: 3076276 - DNA, 16 bp, Homo sapiens
tattaaagtggagaag

SEQ ID NO: 3076277 - DNA, 14 bp, Homo sapiens
tattaaataaaatg

SEQ ID NO: 3076278 - DNA, 18 bp, Homo sapiens
tattaaatcgtttaatgt

SEQ ID NO: 3076279 - DNA, 20 bp, Homo sapiens
tattaaatcgtttaatgttt

SEQ ID NO: 3076280 - DNA, 24 bp, Homo sapiens
tattaaatcgtttaatgtttatac

SEQ ID NO: 3076281 - DNA, 13 bp, Homo sapiens
tattaacttgtag

SEQ ID NO: 3076282 - DNA, 20 bp, Homo sapiens
tattaagaaacaatttaaat

SEQ ID NO: 3076283 - DNA, 19 bp, Homo sapiens
tattaagaatagtctctgg

SEQ ID NO: 3076284 - DNA, 16 bp, Homo sapiens
tattaaggatgtagct

SEQ ID NO: 3076285 - DNA, 20 bp, Homo sapiens
tattaaggatgtagcttttc

SEQ ID NO: 3076286 - DNA, 20 bp, Homo sapiens
tattaagttcgaacatgttt

SEQ ID NO: 3076287 - DNA, 22 bp, Homo sapiens
tattaagttcgaacatgtttca

SEQ ID NO: 3076288 - DNA, 21 bp, Homo sapiens
tattaataaatagagcaatta

SEQ ID NO: 3076289 - DNA, 18 bp, Homo sapiens
tattaatataagtttctt

SEQ ID NO: 3076290 - DNA, 16 bp, Homo sapiens
tattaatatctccata

SEQ ID NO: 3076291 - DNA, 14 bp, Homo sapiens
tattaatgcacttt

SEQ ID NO: 3076292 - DNA, 17 bp, Homo sapiens
tattaatgcactttcta

SEQ ID NO: 3076293 - DNA, 20 bp, Homo sapiens
tattaatgcactttctatcc

SEQ ID NO: 3076294 - DNA, 14 bp, Homo sapiens
tattaattgctttg

SEQ ID NO: 3076295 - DNA, 17 bp, Homo sapiens
tattaatttatgcagaa

SEQ ID NO: 3076296 - DNA, 18 bp, Homo sapiens
tattacatgtaatttgat

SEQ ID NO: 3076297 - DNA, 22 bp, Homo sapiens
tattacccaatggaaaatataa

SEQ ID NO: 3076298 - DNA, 22 bp, Homo sapiens
tattaccccctccttcagacac

SEQ ID NO: 3076299 - DNA, 16 bp, Homo sapiens
tattacgttgtttctt

SEQ ID NO: 3076300 - DNA, 17 bp, Homo sapiens
tattactgtcttttcta

SEQ ID NO: 3076301 - DNA, 21 bp, Homo sapiens
tattactgttgataattctta

SEQ ID NO: 3076302 - DNA, 19 bp, Homo sapiens
tattacttgtaaataaagt

SEQ ID NO: 3076303 - DNA, 12 bp, Homo sapiens
tattagatgaat

SEQ ID NO: 3076304 - DNA, 14 bp, Homo sapiens
tattagatgaatta

SEQ ID NO: 3076305 - DNA, 15 bp, Homo sapiens
tattagatgtgattt

SEQ ID NO: 3076306 - DNA, 18 bp, Homo sapiens
tattagccagtcattgta

SEQ ID NO: 3076307 - DNA, 19 bp, Homo sapiens
tattagccagtcattgtaa

SEQ ID NO: 3076308 - DNA, 21 bp, Homo sapiens
tattaggtgcaatttcaaggt

SEQ ID NO: 3076309 - DNA, 15 bp, Homo sapiens
tattagtaaaagatg

SEQ ID NO: 3076310 - DNA, 19 bp, Homo sapiens
tattagtgatatttctcta

SEQ ID NO: 3076311 - DNA, 18 bp, Homo sapiens
tattataaatgttagttc

SEQ ID NO: 3076312 - DNA, 20 bp, Homo sapiens
tattataaattctactaagt

SEQ ID NO: 3076313 - DNA, 21 bp, Homo sapiens
tattataaattctactaagtt

SEQ ID NO: 3076314 - DNA, 21 bp, Homo sapiens
tattataagggagagctgagc

SEQ ID NO: 3076315 - DNA, 23 bp, Homo sapiens
tattataagggagagctgagcca

SEQ ID NO: 3076316 - DNA, 14 bp, Homo sapiens
tattatatatactt

SEQ ID NO: 3076317 - DNA, 14 bp, Homo sapiens
tattatatttgaca

SEQ ID NO: 3076318 - DNA, 21 bp, Homo sapiens
tattatatttgacatgggtat

SEQ ID NO: 3076319 - DNA, 15 bp, Homo sapiens
tattatcaccaggat

SEQ ID NO: 3076320 - DNA, 16 bp, Homo sapiens
tattatcatgcaaatg

SEQ ID NO: 3076321 - DNA, 18 bp, Homo sapiens
tattatcatgcaaatgct

SEQ ID NO: 3076322 - DNA, 21 bp, Homo sapiens
tattatcctagattatatcaa

SEQ ID NO: 3076323 - DNA, 21 bp, Homo sapiens
tattatcttcttaacagttta

SEQ ID NO: 3076324 - DNA, 22 bp, Homo sapiens
tattatgaagaattgccaatct

SEQ ID NO: 3076325 - DNA, 15 bp, Homo sapiens
tattatgagatgctg

SEQ ID NO: 3076326 - DNA, 17 bp, Homo sapiens
tattatgagatgctggc

SEQ ID NO: 3076327 - DNA, 21 bp, Homo sapiens
tattatgccccagttcagaaa

SEQ ID NO: 3076328 - DNA, 13 bp, Homo sapiens
tattatgcggaaa

SEQ ID NO: 3076329 - DNA, 15 bp, Homo sapiens
tattatgtagttgtt

SEQ ID NO: 3076330 - DNA, 22 bp, Homo sapiens
tattatgtggcttttatttcag

SEQ ID NO: 3076331 - DNA, 12 bp, Homo sapiens
tattattatgaa

SEQ ID NO: 3076332 - DNA, 22 bp, Homo sapiens
tattatttctaggaagaatttt

SEQ ID NO: 3076333 - DNA, 15 bp, Homo sapiens
tcaaagatgataatt

SEQ ID NO: 3076334 - DNA, 13 bp, Homo sapiens
tcaaagccctgcc

SEQ ID NO: 3076335 - DNA, 14 bp, Homo sapiens
tcaaagccctgcct

SEQ ID NO: 3076336 - DNA, 20 bp, Homo sapiens
tcaaagccctgcctctgtgt

SEQ ID NO: 3076337 - DNA, 21 bp, Homo sapiens
tcaaagccctgcctctgtgta

SEQ ID NO: 3076338 - DNA, 16 bp, Homo sapiens
tcaaagggacttttgt

SEQ ID NO: 3076339 - DNA, 17 bp, Homo sapiens
tcaaagggacttttgta

SEQ ID NO: 3076340 - DNA, 23 bp, Homo sapiens
tcaaaggttctaggtttcaaaga

SEQ ID NO: 3076341 - DNA, 20 bp, Homo sapiens
tcaaagtgaaagacatttca

SEQ ID NO: 3076342 - DNA, 13 bp, Homo sapiens
tcaaataaacctt

SEQ ID NO: 3076343 - DNA, 23 bp, Homo sapiens
tcaaataaaccttgtttctttct

SEQ ID NO: 3076344 - DNA, 14 bp, Homo sapiens
tcaaatacaaaaat

SEQ ID NO: 3076345 - DNA, 17 bp, Homo sapiens
tcaaatatttattggat

SEQ ID NO: 3076346 - DNA, 18 bp, Homo sapiens
tcaaatcatgttttttct

SEQ ID NO: 3076347 - DNA, 19 bp, Homo sapiens
tcaaatctcccacaagtat

SEQ ID NO: 3076348 - DNA, 20 bp, Homo sapiens
tcaaatctcccacaagtata

SEQ ID NO: 3076349 - DNA, 13 bp, Homo sapiens
tcaaatctgtaat

SEQ ID NO: 3076350 - DNA, 15 bp, Homo sapiens
tcaaatcttacaaaa

SEQ ID NO: 3076351 - DNA, 16 bp, Homo sapiens
tcaaatcttacaaaat

SEQ ID NO: 3076352 - DNA, 23 bp, Homo sapiens
tcaaatgtgatggctagattcta

SEQ ID NO: 3076353 - DNA, 18 bp, Homo sapiens
tcaaatgtgtcaaataca

SEQ ID NO: 3076354 - DNA, 17 bp, Homo sapiens
tcaaatgtgtgtggcag

SEQ ID NO: 3076355 - DNA, 21 bp, Homo sapiens
tcaaatgttctaagtttctaa

SEQ ID NO: 3076356 - DNA, 15 bp, Homo sapiens
tcaaatgttttctgc

SEQ ID NO: 3076357 - DNA, 21 bp, Homo sapiens
tcaaatgttttctgcagaaaa

SEQ ID NO: 3076358 - DNA, 17 bp, Homo sapiens
tcaaattaaaaaagctg

SEQ ID NO: 3076359 - DNA, 20 bp, Homo sapiens
tcaaattaaaaaagctgctg

SEQ ID NO: 3076360 - DNA, 15 bp, Homo sapiens
tcaaattaaagtgct

SEQ ID NO: 3076361 - DNA, 18 bp, Homo sapiens
tcaaatttactgtcttaa

SEQ ID NO: 3076362 - DNA, 18 bp, Homo sapiens
tcaaatttatttttttct

SEQ ID NO: 3076363 - DNA, 14 bp, Homo sapiens
tcaacaataaagac

SEQ ID NO: 3076364 - DNA, 15 bp, Homo sapiens
tcaacacactgcctt

SEQ ID NO: 3076365 - DNA, 20 bp, Homo sapiens
tcaacaccaccgagctctgt

SEQ ID NO: 3076366 - DNA, 18 bp, Homo sapiens
tcaacactgaaaaaatac

SEQ ID NO: 3076367 - DNA, 16 bp, Homo sapiens
tcaacagagaggacca

SEQ ID NO: 3076368 - DNA, 15 bp, Homo sapiens
tcaacatcactgaaa

SEQ ID NO: 3076369 - DNA, 18 bp, Homo sapiens
tcaacattcttgtgtctg

SEQ ID NO: 3076370 - DNA, 19 bp, Homo sapiens
tcaaccacctaggcaatga

SEQ ID NO: 3076371 - DNA, 12 bp, Homo sapiens
tcaaccagacag

SEQ ID NO: 3076372 - DNA, 13 bp, Homo sapiens
tcaaccagacaga

SEQ ID NO: 3076373 - DNA, 22 bp, Homo sapiens
tcaaccagacagagggtcacag

SEQ ID NO: 3076374 - DNA, 20 bp, Homo sapiens
tcaaccccaccacttctttt

SEQ ID NO: 3076375 - DNA, 16 bp, Homo sapiens
tcaacccttctggaaa

SEQ ID NO: 3076376 - DNA, 15 bp, Homo sapiens
tcaacctcctgggtt

SEQ ID NO: 3076377 - DNA, 19 bp, Homo sapiens
tcaacctgcacttcatatc

SEQ ID NO: 3076378 - DNA, 13 bp, Homo sapiens
tcaacctgcctga

SEQ ID NO: 3076379 - DNA, 19 bp, Homo sapiens
tcaactaaaaaaaaaaaag

SEQ ID NO: 3076380 - DNA, 20 bp, Homo sapiens
tcaactaaaaaaaaaaaagt

SEQ ID NO: 3076381 - DNA, 19 bp, Homo sapiens
tcaactcataagactttgg

SEQ ID NO: 3076382 - DNA, 19 bp, Homo sapiens
tcaacttattaacaattag

SEQ ID NO: 3076383 - DNA, 19 bp, Homo sapiens
tcaacttgcatccaactcc

SEQ ID NO: 3076384 - DNA, 14 bp, Homo sapiens
tcaacttgcttatc

SEQ ID NO: 3076385 - DNA, 20 bp, Homo sapiens
tcaacttggaaaaagaaaga

SEQ ID NO: 3076386 - DNA, 15 bp, Homo sapiens
tcaactttcatttga

SEQ ID NO: 3076387 - DNA, 15 bp, Homo sapiens
tcaactttgaataaa

SEQ ID NO: 3076388 - DNA, 17 bp, Homo sapiens
tcaactttttattgcct

SEQ ID NO: 3076389 - DNA, 18 bp, Homo sapiens
tcaactttttattgcctt

SEQ ID NO: 3076390 - DNA, 23 bp, Homo sapiens
tcaactttttattgccttctcac

SEQ ID NO: 3076391 - DNA, 13 bp, Homo sapiens
tcaagaaaggaaa

SEQ ID NO: 3076392 - DNA, 20 bp, Homo sapiens
tcaagaaataaaaggaagcc

SEQ ID NO: 3076393 - DNA, 22 bp, Homo sapiens
tcaagaacacagccctgcttct

SEQ ID NO: 3076394 - DNA, 13 bp, Homo sapiens
tcaagaagaaagt

SEQ ID NO: 3076395 - DNA, 16 bp, Homo sapiens
tcaagaatcagaagaa

SEQ ID NO: 3076396 - DNA, 21 bp, Homo sapiens
tcaagacatagcatccaagtg

SEQ ID NO: 3076397 - DNA, 15 bp, Homo sapiens
tcaagaccagcctgt

SEQ ID NO: 3076398 - DNA, 18 bp, Homo sapiens
tcaagaccagcctgtcca

SEQ ID NO: 3076399 - DNA, 16 bp, Homo sapiens
tcaagaggcgtgtgca

SEQ ID NO: 3076400 - DNA, 21 bp, Homo sapiens
tcaagagtctctccagcctca

SEQ ID NO: 3076401 - DNA, 16 bp, Homo sapiens
tcaagatcaatgaaat

SEQ ID NO: 3076402 - DNA, 22 bp, Homo sapiens
tcaagatccaaatgctgtgcaa

SEQ ID NO: 3076403 - DNA, 21 bp, Homo sapiens
tcaagcagacatagaagagcc

SEQ ID NO: 3076404 - DNA, 16 bp, Homo sapiens
tcaagcaggttagaga

SEQ ID NO: 3076405 - DNA, 23 bp, Homo sapiens
tcaagcaggttagagaaaataga

SEQ ID NO: 3076406 - DNA, 18 bp, Homo sapiens
tcaagcaggtttcttgct

SEQ ID NO: 3076407 - DNA, 12 bp, Homo sapiens
tcaagcatcatt

SEQ ID NO: 3076408 - DNA, 14 bp, Homo sapiens
tcaagcatcattgt

SEQ ID NO: 3076409 - DNA, 16 bp, Homo sapiens
tcaagcatcattgtcc

SEQ ID NO: 3076410 - DNA, 16 bp, Homo sapiens
tcaagcatcctcagaa

SEQ ID NO: 3076411 - DNA, 16 bp, Homo sapiens
tcaagcattctgttta

SEQ ID NO: 3076412 - DNA, 14 bp, Homo sapiens
tcaagccaagcagc

SEQ ID NO: 3076413 - DNA, 19 bp, Homo sapiens
tcaagcctgtgcaaaaaaa

SEQ ID NO: 3076414 - DNA, 17 bp, Homo sapiens
tcaagcgattctcctgc

SEQ ID NO: 3076415 - DNA, 23 bp, Homo sapiens
tcaagcgattctcctgcctcagc

SEQ ID NO: 3076416 - DNA, 14 bp, Homo sapiens
tcaagctcctcctc

SEQ ID NO: 3076417 - DNA, 18 bp, Homo sapiens
tcaagctcctcctccctg

SEQ ID NO: 3076418 - DNA, 12 bp, Homo sapiens
tcaagctgagct

SEQ ID NO: 3076419 - DNA, 14 bp, Homo sapiens
tcaaggaagaaaac

SEQ ID NO: 3076420 - DNA, 16 bp, Homo sapiens
tcaaggagaatatgat

SEQ ID NO: 3076421 - DNA, 13 bp, Homo sapiens
tcaagggtaatct

SEQ ID NO: 3076422 - DNA, 14 bp, Homo sapiens
tcaagggtggcagg

SEQ ID NO: 3076423 - DNA, 18 bp, Homo sapiens
tcaagggtggcaggtcac

SEQ ID NO: 3076424 - DNA, 22 bp, Homo sapiens
tcaagggtggcaggtcactgtc

SEQ ID NO: 3076425 - DNA, 13 bp, Homo sapiens
tcaaggttttagg

SEQ ID NO: 3076426 - DNA, 20 bp, Homo sapiens
tcaaggttttaggttctaaa

SEQ ID NO: 3076427 - DNA, 22 bp, Homo sapiens
tcaaggttttaggttctaaagt

SEQ ID NO: 3076428 - DNA, 15 bp, Homo sapiens
tcaagtaaaagaaaa

SEQ ID NO: 3076429 - DNA, 17 bp, Homo sapiens
tcaagtaaaagaaaagc

SEQ ID NO: 3076430 - DNA, 19 bp, Homo sapiens
tcaagtactacattttctt

SEQ ID NO: 3076431 - DNA, 18 bp, Homo sapiens
tcaagtagaacaaaaact

SEQ ID NO: 3076432 - DNA, 12 bp, Homo sapiens
tcaagtatttgg

SEQ ID NO: 3076433 - DNA, 16 bp, Homo sapiens
tcaagtcctgactggg

SEQ ID NO: 3076434 - DNA, 21 bp, Homo sapiens
tcaagtgactctcctgcctca

SEQ ID NO: 3076435 - DNA, 19 bp, Homo sapiens
tcaagtgcatgctctctgc

SEQ ID NO: 3076436 - DNA, 21 bp, Homo sapiens
tcaagtgcatgctctctgcag

SEQ ID NO: 3076437 - DNA, 22 bp, Homo sapiens
tcaagtgcatgctctctgcagc

SEQ ID NO: 3076438 - DNA, 20 bp, Homo sapiens
tcaagtgttctaaaatgaaa

SEQ ID NO: 3076439 - DNA, 21 bp, Homo sapiens
tcaagttgtttaactgtgcat

SEQ ID NO: 3076440 - DNA, 15 bp, Homo sapiens
tcaagtttttacaaa

SEQ ID NO: 3076441 - DNA, 17 bp, Homo sapiens
tcaataaaaataaatct

SEQ ID NO: 3076442 - DNA, 13 bp, Homo sapiens
tcaataaacgatt

SEQ ID NO: 3076443 - DNA, 17 bp, Homo sapiens
tcaataaacgatttaat

SEQ ID NO: 3076444 - DNA, 18 bp, Homo sapiens
tcaataaacgatttaatt

SEQ ID NO: 3076445 - DNA, 12 bp, Homo sapiens
tcaataaactta

SEQ ID NO: 3076446 - DNA, 16 bp, Homo sapiens
tcaataaatgtctgtt

SEQ ID NO: 3076447 - DNA, 19 bp, Homo sapiens
tcaataatatattttctgt

SEQ ID NO: 3076448 - DNA, 21 bp, Homo sapiens
tcaatacagtttataaagcca

SEQ ID NO: 3076449 - DNA, 14 bp, Homo sapiens
tcaatactctctga

SEQ ID NO: 3076450 - DNA, 18 bp, Homo sapiens
tcaatagttcaaggaact

SEQ ID NO: 3076451 - DNA, 16 bp, Homo sapiens
tcaatatcctttgcct

SEQ ID NO: 3076452 - DNA, 15 bp, Homo sapiens
tcaatccagctatgt

SEQ ID NO: 3076453 - DNA, 15 bp, Homo sapiens
tcaatccatcagcaa

SEQ ID NO: 3076454 - DNA, 17 bp, Homo sapiens
tcaatcccctcattcag

SEQ ID NO: 3076455 - DNA, 19 bp, Homo sapiens
tcaatctcgtttagtgcca

SEQ ID NO: 3076456 - DNA, 22 bp, Homo sapiens
tcaatgaaaaatagtgtctttg

SEQ ID NO: 3076457 - DNA, 15 bp, Homo sapiens
tcaatgacagagcct

SEQ ID NO: 3076458 - DNA, 17 bp, Homo sapiens
tcaatgacagagccttc

SEQ ID NO: 3076459 - DNA, 18 bp, Homo sapiens
tcaatgacagagccttct

SEQ ID NO: 3076460 - DNA, 12 bp, Homo sapiens
tcaatgccattg

SEQ ID NO: 3076461 - DNA, 18 bp, Homo sapiens
tcaatgccattgtgcaga

SEQ ID NO: 3076462 - DNA, 15 bp, Homo sapiens
tcaatggaataataa

SEQ ID NO: 3076463 - DNA, 20 bp, Homo sapiens
tcaatgggagaatcagcaga

SEQ ID NO: 3076464 - DNA, 22 bp, Homo sapiens
tcaatgggagaatcagcagaac

SEQ ID NO: 3076465 - DNA, 12 bp, Homo sapiens
tcagcccctacc

SEQ ID NO: 3076466 - DNA, 12 bp, Homo sapiens
tcagcccctcct

SEQ ID NO: 3076467 - DNA, 16 bp, Homo sapiens
tcagcccctcctctgc

SEQ ID NO: 3076468 - DNA, 17 bp, Homo sapiens
tcagcccctcctctgcc

SEQ ID NO: 3076469 - DNA, 19 bp, Homo sapiens
tcagccctagggtggagag

SEQ ID NO: 3076470 - DNA, 12 bp, Homo sapiens
tcagccctgggc

SEQ ID NO: 3076471 - DNA, 18 bp, Homo sapiens
tcagccctgggccccacc

SEQ ID NO: 3076472 - DNA, 19 bp, Homo sapiens
tcagccctgggccccacca

SEQ ID NO: 3076473 - DNA, 21 bp, Homo sapiens
tcagccctgggccccaccacc

SEQ ID NO: 3076474 - DNA, 22 bp, Homo sapiens
tcagccctgggccccaccacct

SEQ ID NO: 3076475 - DNA, 23 bp, Homo sapiens
tcagccctgggccccaccaccta

SEQ ID NO: 3076476 - DNA, 16 bp, Homo sapiens
tcagccgtcagccatc

SEQ ID NO: 3076477 - DNA, 21 bp, Homo sapiens
tcagcctactccgctcactga

SEQ ID NO: 3076478 - DNA, 23 bp, Homo sapiens
tcagcctccatcctaccccctgt

SEQ ID NO: 3076479 - DNA, 14 bp, Homo sapiens
tcagcctcccaaag

SEQ ID NO: 3076480 - DNA, 19 bp, Homo sapiens
tcagcctcccaaagtgttg

SEQ ID NO: 3076481 - DNA, 20 bp, Homo sapiens
tcagcctccccagtagctgg

SEQ ID NO: 3076482 - DNA, 12 bp, Homo sapiens
tcagcctgcaca

SEQ ID NO: 3076483 - DNA, 16 bp, Homo sapiens
tcagcctggccagaca

SEQ ID NO: 3076484 - DNA, 18 bp, Homo sapiens
tcagcctggccagacaca

SEQ ID NO: 3076485 - DNA, 16 bp, Homo sapiens
tcagccttgccagaga

SEQ ID NO: 3076486 - DNA, 15 bp, Homo sapiens
tcagcctttaagata

SEQ ID NO: 3076487 - DNA, 14 bp, Homo sapiens
tcagcgagaaggag

SEQ ID NO: 3076488 - DNA, 15 bp, Homo sapiens
tcagcgcccccaggc

SEQ ID NO: 3076489 - DNA, 18 bp, Homo sapiens
tcagcggaccactcttct

SEQ ID NO: 3076490 - DNA, 21 bp, Homo sapiens
tcagcggaccactcttctctc

SEQ ID NO: 3076491 - DNA, 22 bp, Homo sapiens
tcagcgggggccttgaagactc

SEQ ID NO: 3076492 - DNA, 13 bp, Homo sapiens
tcagctcacgctt

SEQ ID NO: 3076493 - DNA, 12 bp, Homo sapiens
tcagctccagcc

SEQ ID NO: 3076494 - DNA, 21 bp, Homo sapiens
tcagctccagcccctttccaa

SEQ ID NO: 3076495 - DNA, 17 bp, Homo sapiens
tcagctccttcctggag

SEQ ID NO: 3076496 - DNA, 17 bp, Homo sapiens
tcagctcggggagcctt

SEQ ID NO: 3076497 - DNA, 15 bp, Homo sapiens
tcagctctcatctga

SEQ ID NO: 3076498 - DNA, 16 bp, Homo sapiens
tcagctctgacattct

SEQ ID NO: 3076499 - DNA, 20 bp, Homo sapiens
tcagctcttcatctgcccaa

SEQ ID NO: 3076500 - DNA, 17 bp, Homo sapiens
tcagctgcagttgaaga

SEQ ID NO: 3076501 - DNA, 15 bp, Homo sapiens
tcagctgcatctgat

SEQ ID NO: 3076502 - DNA, 16 bp, Homo sapiens
tcagctgccccacagg

SEQ ID NO: 3076503 - DNA, 14 bp, Homo sapiens
tcagctgctcccac

SEQ ID NO: 3076504 - DNA, 23 bp, Homo sapiens
tcagctgctcccacacttgtgcc

SEQ ID NO: 3076505 - DNA, 15 bp, Homo sapiens
tcagctgctgttgaa

SEQ ID NO: 3076506 - DNA, 16 bp, Homo sapiens
tcagctggaaacttct

SEQ ID NO: 3076507 - DNA, 14 bp, Homo sapiens
tcagctgggcagtg

SEQ ID NO: 3076508 - DNA, 21 bp, Homo sapiens
tcagctggtggatggtgactt

SEQ ID NO: 3076509 - DNA, 23 bp, Homo sapiens
tcagctggtggatggtgactttt

SEQ ID NO: 3076510 - DNA, 18 bp, Homo sapiens
tcagctgtcgggggccac

SEQ ID NO: 3076511 - DNA, 19 bp, Homo sapiens
tcagcttatctcttttata

SEQ ID NO: 3076512 - DNA, 20 bp, Homo sapiens
tcagcttatctcttttatat

SEQ ID NO: 3076513 - DNA, 22 bp, Homo sapiens
tcagcttctaattttgtgctct

SEQ ID NO: 3076514 - DNA, 20 bp, Homo sapiens
tcagcttctatccttgactt

SEQ ID NO: 3076515 - DNA, 13 bp, Homo sapiens
tcagctttcttca

SEQ ID NO: 3076516 - DNA, 20 bp, Homo sapiens
tcaggaaaactgacagagga

SEQ ID NO: 3076517 - DNA, 21 bp, Homo sapiens
tcaggaaaactgacagaggag

SEQ ID NO: 3076518 - DNA, 22 bp, Homo sapiens
tcaggaaaggaatcatttctat

SEQ ID NO: 3076519 - DNA, 15 bp, Homo sapiens
tcaggaatataaata

SEQ ID NO: 3076520 - DNA, 16 bp, Homo sapiens
tcaggaatataaatat
